United States Patent 7,888,497 (BIOINFORMATICALLY DETECTABLE GROUP OF NOVEL REGULATORY OLIGONUCLEOTIDES AND USES THEREOF) - sequence listing, part 146

SEQ ID NO: 6191351 - DNA, 19 bp, Homo sapiens
gaacccctagaaaggagag

SEQ ID NO: 6191352 - DNA, 15 bp, Homo sapiens
gaacccctcccctcc

SEQ ID NO: 6191353 - DNA, 17 bp, Homo sapiens
gaacccctctgtcttca

SEQ ID NO: 6191354 - DNA, 15 bp, Homo sapiens
gaacccctggccagc

SEQ ID NO: 6191355 - DNA, 20 bp, Homo sapiens
gaacccctggccagctctga

SEQ ID NO: 6191356 - DNA, 14 bp, Homo sapiens
gaacccctggctcc

SEQ ID NO: 6191357 - DNA, 22 bp, Homo sapiens
gaacccctggctccaggccagg

SEQ ID NO: 6191358 - DNA, 19 bp, Homo sapiens
gaacccctggctccttcac

SEQ ID NO: 6191359 - DNA, 21 bp, Homo sapiens
gaacccctggctccttcacca

SEQ ID NO: 6191360 - DNA, 10 bp, Homo sapiens
gaacccctgt

SEQ ID NO: 6191361 - DNA, 13 bp, Homo sapiens
gaacccctgtgtc

SEQ ID NO: 6191362 - DNA, 14 bp, Homo sapiens
gaacccctttccca

SEQ ID NO: 6191363 - DNA, 20 bp, Homo sapiens
gaacccgggagcggaggttg

SEQ ID NO: 6191364 - DNA, 16 bp, Homo sapiens
gaacccgggggacaga

SEQ ID NO: 6191365 - DNA, 18 bp, Homo sapiens
gaacccggtcccaggccg

SEQ ID NO: 6191366 - DNA, 17 bp, Homo sapiens
gaaccctaaagcaaatc

SEQ ID NO: 6191367 - DNA, 22 bp, Homo sapiens
gaaccctaaagcagtaaaataa

SEQ ID NO: 6191368 - DNA, 17 bp, Homo sapiens
gaaccctatttaaaact

SEQ ID NO: 6191369 - DNA, 11 bp, Homo sapiens
gaaccctcagg

SEQ ID NO: 6191370 - DNA, 15 bp, Homo sapiens
gaaccctcctccttt

SEQ ID NO: 6191371 - DNA, 12 bp, Homo sapiens
gaaccctctggg

SEQ ID NO: 6191372 - DNA, 22 bp, Homo sapiens
gaaccctcttgccatcctgatg

SEQ ID NO: 6191373 - DNA, 24 bp, Homo sapiens
gaaccctcttgccatcctgatgga

SEQ ID NO: 6191374 - DNA, 14 bp, Homo sapiens
gaaccctgagcagg

SEQ ID NO: 6191375 - DNA, 22 bp, Homo sapiens
gaaccctgccatggaactgttt

SEQ ID NO: 6191376 - DNA, 16 bp, Homo sapiens
gaaccctgcccactcc

SEQ ID NO: 6191377 - DNA, 16 bp, Homo sapiens
gaaccctgcctcttgt

SEQ ID NO: 6191378 - DNA, 20 bp, Homo sapiens
gaaccctggagacagaagtc

SEQ ID NO: 6191379 - DNA, 12 bp, Homo sapiens
gaaccctggagg

SEQ ID NO: 6191380 - DNA, 16 bp, Homo sapiens
gaaccctggaggtaaa

SEQ ID NO: 6191381 - DNA, 22 bp, Homo sapiens
gaaccctggtgaggaagctcca

SEQ ID NO: 6191382 - DNA, 13 bp, Homo sapiens
gaaccctgtgctg

SEQ ID NO: 6191383 - DNA, 17 bp, Homo sapiens
gaaccctgtgctggtgt

SEQ ID NO: 6191384 - DNA, 13 bp, Homo sapiens
gaacccttcctgc

SEQ ID NO: 6191385 - DNA, 20 bp, Homo sapiens
gaacccttggcttgcccacg

SEQ ID NO: 6191386 - DNA, 18 bp, Homo sapiens
gaacccttttaaagttga

SEQ ID NO: 6191387 - DNA, 17 bp, Homo sapiens
gaacccttttggccccc

SEQ ID NO: 6191388 - DNA, 23 bp, Homo sapiens
gaacccttttggcccccgagctg

SEQ ID NO: 6191389 - DNA, 14 bp, Homo sapiens
gaaccgaaaggcca

SEQ ID NO: 6191390 - DNA, 15 bp, Homo sapiens
gaaccgactgaccct

SEQ ID NO: 6191391 - DNA, 12 bp, Homo sapiens
gaaccgaggcag

SEQ ID NO: 6191392 - DNA, 15 bp, Homo sapiens
gaaccgaggcaggga

SEQ ID NO: 6191393 - DNA, 15 bp, Homo sapiens
gaaccgcacagctca

SEQ ID NO: 6191394 - DNA, 13 bp, Homo sapiens
gaaccgcaggaag

SEQ ID NO: 6191395 - DNA, 14 bp, Homo sapiens
gaaccgcaggaagc

SEQ ID NO: 6191396 - DNA, 16 bp, Homo sapiens
gaaccggctcccaccc

SEQ ID NO: 6191397 - DNA, 18 bp, Homo sapiens
gaaccggctcccaccctc

SEQ ID NO: 6191398 - DNA, 21 bp, Homo sapiens
gaaccggtcccagcctgggct

SEQ ID NO: 6191399 - DNA, 15 bp, Homo sapiens
gaaccgtgaggaggg

SEQ ID NO: 6191400 - DNA, 17 bp, Homo sapiens
gaaccgtgtccagcaca

SEQ ID NO: 6191401 - DNA, 18 bp, Homo sapiens
gaaccgtgtccagcacag

SEQ ID NO: 6191402 - DNA, 17 bp, Homo sapiens
gaaccgttttgaagcta

SEQ ID NO: 6191403 - DNA, 22 bp, Homo sapiens
gaacctaataagtgctactttg

SEQ ID NO: 6191404 - DNA, 14 bp, Homo sapiens
gaacctaattgaaa

SEQ ID NO: 6191405 - DNA, 15 bp, Homo sapiens
gaacctaattgaaat

SEQ ID NO: 6191406 - DNA, 21 bp, Homo sapiens
gaacctacaaaagcttgtgta

SEQ ID NO: 6191407 - DNA, 21 bp, Homo sapiens
gaacctacagactccatctct

SEQ ID NO: 6191408 - DNA, 15 bp, Homo sapiens
gaacctaccttcatt

SEQ ID NO: 6191409 - DNA, 22 bp, Homo sapiens
gaacctactgaggagcaaagca

SEQ ID NO: 6191410 - DNA, 13 bp, Homo sapiens
gaacctaggagga

SEQ ID NO: 6191411 - DNA, 19 bp, Homo sapiens
gaacctagtactctctgct

SEQ ID NO: 6191412 - DNA, 19 bp, Homo sapiens
gaacctattttcatttgta

SEQ ID NO: 6191413 - DNA, 19 bp, Homo sapiens
gaacctcaaactaggagga

SEQ ID NO: 6191414 - DNA, 21 bp, Homo sapiens
gaacctcaaactaggaggaaa

SEQ ID NO: 6191415 - DNA, 21 bp, Homo sapiens
gaacctcaccccgaggccctg

SEQ ID NO: 6191416 - DNA, 11 bp, Homo sapiens
gaacctcacct

SEQ ID NO: 6191417 - DNA, 17 bp, Homo sapiens
gaacctcacgcacctcc

SEQ ID NO: 6191418 - DNA, 18 bp, Homo sapiens
gaacctcacgcacctccc

SEQ ID NO: 6191419 - DNA, 19 bp, Homo sapiens
gaacctcacgcacctccca

SEQ ID NO: 6191420 - DNA, 16 bp, Homo sapiens
gaacctcactcttgcc

SEQ ID NO: 6191421 - DNA, 17 bp, Homo sapiens
gaacctcactcttgcca

SEQ ID NO: 6191422 - DNA, 18 bp, Homo sapiens
gaacctcactcttgccaa

SEQ ID NO: 6191423 - DNA, 15 bp, Homo sapiens
gaacctcagattctt

SEQ ID NO: 6191424 - DNA, 15 bp, Homo sapiens
gaacctcagcctggc

SEQ ID NO: 6191425 - DNA, 14 bp, Homo sapiens
gaacctcaggcttc

SEQ ID NO: 6191426 - DNA, 12 bp, Homo sapiens
gaacctcagttt

SEQ ID NO: 6191427 - DNA, 15 bp, Homo sapiens
gaacctcagtttcct

SEQ ID NO: 6191428 - DNA, 16 bp, Homo sapiens
gaacctcattctggtt

SEQ ID NO: 6191429 - DNA, 17 bp, Homo sapiens
gaacctcattgctacca

SEQ ID NO: 6191430 - DNA, 14 bp, Homo sapiens
gaacctcatttgtc

SEQ ID NO: 6191431 - DNA, 18 bp, Homo sapiens
gaacctcccagaggtcca

SEQ ID NO: 6191432 - DNA, 19 bp, Homo sapiens
gaacctcccagaggtccag

SEQ ID NO: 6191433 - DNA, 21 bp, Homo sapiens
gaacctcccagaggtccagcc

SEQ ID NO: 6191434 - DNA, 22 bp, Homo sapiens
gaacctcccagaggtccagccc

SEQ ID NO: 6191435 - DNA, 15 bp, Homo sapiens
gaacctccccagcct

SEQ ID NO: 6191436 - DNA, 15 bp, Homo sapiens
gaacctccctgggcc

SEQ ID NO: 6191437 - DNA, 15 bp, Homo sapiens
gaacctcctatttta

SEQ ID NO: 6191438 - DNA, 15 bp, Homo sapiens
gaacctcctctgtga

SEQ ID NO: 6191439 - DNA, 13 bp, Homo sapiens
gaacctcctttct

SEQ ID NO: 6191440 - DNA, 17 bp, Homo sapiens
gaacctcgaagctgttc

SEQ ID NO: 6191441 - DNA, 22 bp, Homo sapiens
gaacctcgagtactgtgggcaa

SEQ ID NO: 6191442 - DNA, 20 bp, Homo sapiens
gaacctcgttgacatgcaca

SEQ ID NO: 6191443 - DNA, 20 bp, Homo sapiens
gaacctctaagtgctgctgt

SEQ ID NO: 6191444 - DNA, 16 bp, Homo sapiens
gaacctctcgccatga

SEQ ID NO: 6191445 - DNA, 11 bp, Homo sapiens
gaacctgaccc

SEQ ID NO: 6191446 - DNA, 12 bp, Homo sapiens
gaacctgacccc

SEQ ID NO: 6191447 - DNA, 18 bp, Homo sapiens
gaacctgagctattttcc

SEQ ID NO: 6191448 - DNA, 22 bp, Homo sapiens
gaacctgagctattttcctctg

SEQ ID NO: 6191449 - DNA, 22 bp, Homo sapiens
gaacctgagttcccgggagctg

SEQ ID NO: 6191450 - DNA, 22 bp, Homo sapiens
gaacctgatacctgcctgggac

SEQ ID NO: 6191451 - DNA, 13 bp, Homo sapiens
gaacctgcaagcc

SEQ ID NO: 6191452 - DNA, 15 bp, Homo sapiens
gaacctgcacacagg

SEQ ID NO: 6191453 - DNA, 17 bp, Homo sapiens
gaacctgcacacgagca

SEQ ID NO: 6191454 - DNA, 16 bp, Homo sapiens
gaacctgcatttaaga

SEQ ID NO: 6191455 - DNA, 17 bp, Homo sapiens
gaacctgcgcaccccgt

SEQ ID NO: 6191456 - DNA, 16 bp, Homo sapiens
gaacctggaacttggg

SEQ ID NO: 6191457 - DNA, 12 bp, Homo sapiens
gaacctggacca

SEQ ID NO: 6191458 - DNA, 16 bp, Homo sapiens
gaacctggaccccagc

SEQ ID NO: 6191459 - DNA, 21 bp, Homo sapiens
gaacctggagggctggaatct

SEQ ID NO: 6191460 - DNA, 13 bp, Homo sapiens
gaacctggagggg

SEQ ID NO: 6191461 - DNA, 13 bp, Homo sapiens
gaacctggcaggc

SEQ ID NO: 6191462 - DNA, 14 bp, Homo sapiens
gaacctggcaggcc

SEQ ID NO: 6191463 - DNA, 19 bp, Homo sapiens
gaacctggcaggccctgcc

SEQ ID NO: 6191464 - DNA, 22 bp, Homo sapiens
gaacctggcaggccctgcccag

SEQ ID NO: 6191465 - DNA, 11 bp, Homo sapiens
gaacctggcct

SEQ ID NO: 6191466 - DNA, 13 bp, Homo sapiens
gaacctggccttc

SEQ ID NO: 6191467 - DNA, 20 bp, Homo sapiens
gaacctggtggctggaggca

SEQ ID NO: 6191468 - DNA, 15 bp, Homo sapiens
gaacctgtagagcta

SEQ ID NO: 6191469 - DNA, 16 bp, Homo sapiens
gaacctgtccaacatg

SEQ ID NO: 6191470 - DNA, 12 bp, Homo sapiens
gaacctgtctcc

SEQ ID NO: 6191471 - DNA, 21 bp, Homo sapiens
gaacctgtctccattgtgtga

SEQ ID NO: 6191472 - DNA, 17 bp, Homo sapiens
gaacctgtgagctgcac

SEQ ID NO: 6191473 - DNA, 19 bp, Homo sapiens
gaacctgtgagctgcacca

SEQ ID NO: 6191474 - DNA, 14 bp, Homo sapiens
gaacctgtgaggaa

SEQ ID NO: 6191475 - DNA, 17 bp, Homo sapiens
gaacctgtgaggaagag

SEQ ID NO: 6191476 - DNA, 12 bp, Homo sapiens
gaacctgtgagt

SEQ ID NO: 6191477 - DNA, 20 bp, Homo sapiens
gaacctgttagtctccccac

SEQ ID NO: 6191478 - DNA, 15 bp, Homo sapiens
gaaccttaaggaaga

SEQ ID NO: 6191479 - DNA, 20 bp, Homo sapiens
gaaccttaatgacaacactt

SEQ ID NO: 6191480 - DNA, 21 bp, Homo sapiens
gaaccttaatgacaacactta

SEQ ID NO: 6191481 - DNA, 20 bp, Homo sapiens
gaaccttactggcactgtgg

SEQ ID NO: 6191482 - DNA, 15 bp, Homo sapiens
gaaccttccttcctg

SEQ ID NO: 6191483 - DNA, 17 bp, Homo sapiens
gaaccttctagaacctg

SEQ ID NO: 6191484 - DNA, 15 bp, Homo sapiens
gaaccttctcccttc

SEQ ID NO: 6191485 - DNA, 22 bp, Homo sapiens
gaaccttgaagaagtggctgcc

SEQ ID NO: 6191486 - DNA, 16 bp, Homo sapiens
gaaccttgctgtcctg

SEQ ID NO: 6191487 - DNA, 16 bp, Homo sapiens
gaaccttggcctgggc

SEQ ID NO: 6191488 - DNA, 21 bp, Homo sapiens
gaaccttggtaaattgtaaac

SEQ ID NO: 6191489 - DNA, 19 bp, Homo sapiens
gaaccttgtagaggagcag

SEQ ID NO: 6191490 - DNA, 17 bp, Homo sapiens
gaaccttgtcccagcca

SEQ ID NO: 6191491 - DNA, 13 bp, Homo sapiens
gaaccttgttatt

SEQ ID NO: 6191492 - DNA, 18 bp, Homo sapiens
gaaccttgttatttctca

SEQ ID NO: 6191493 - DNA, 12 bp, Homo sapiens
gaacctttgtca

SEQ ID NO: 6191494 - DNA, 20 bp, Homo sapiens
gaacctttgtgccctatcac

SEQ ID NO: 6191495 - DNA, 16 bp, Homo sapiens
gaacgaaaatgaaagc

SEQ ID NO: 6191496 - DNA, 14 bp, Homo sapiens
gaacgagaggggaa

SEQ ID NO: 6191497 - DNA, 16 bp, Homo sapiens
gaacgagcagcccagg

SEQ ID NO: 6191498 - DNA, 16 bp, Homo sapiens
gaacgagcctggaagc

SEQ ID NO: 6191499 - DNA, 19 bp, Homo sapiens
gaacgaggtttatattttc

SEQ ID NO: 6191500 - DNA, 18 bp, Homo sapiens
gaacgcacaacatgcaca

SEQ ID NO: 6191501 - DNA, 13 bp, Homo sapiens
gaacgcaccccac

SEQ ID NO: 6191502 - DNA, 20 bp, Homo sapiens
gaacgcaccccactgggaga

SEQ ID NO: 6191503 - DNA, 15 bp, Homo sapiens
gaacgcagaagaaag

SEQ ID NO: 6191504 - DNA, 21 bp, Homo sapiens
gaacgcagccctagagcctgc

SEQ ID NO: 6191505 - DNA, 22 bp, Homo sapiens
gaacgcagccctagagcctgcc

SEQ ID NO: 6191506 - DNA, 20 bp, Homo sapiens
gaacgcagttgattccttga

SEQ ID NO: 6191507 - DNA, 13 bp, Homo sapiens
gaacgcatgcagg

SEQ ID NO: 6191508 - DNA, 13 bp, Homo sapiens
gaacgccagggac

SEQ ID NO: 6191509 - DNA, 18 bp, Homo sapiens
gaacgcccccccccaccc

SEQ ID NO: 6191510 - DNA, 15 bp, Homo sapiens
ctgttcgttcaaaag

SEQ ID NO: 6191511 - DNA, 12 bp, Homo sapiens
ctgttctaaagc

SEQ ID NO: 6191512 - DNA, 16 bp, Homo sapiens
ctgttctaacatgtaa

SEQ ID NO: 6191513 - DNA, 12 bp, Homo sapiens
ctgttctaaggg

SEQ ID NO: 6191514 - DNA, 23 bp, Homo sapiens
ctgttctactcttaatgatgtta

SEQ ID NO: 6191515 - DNA, 20 bp, Homo sapiens
ctgttctatgcctttagtca

SEQ ID NO: 6191516 - DNA, 18 bp, Homo sapiens
ctgttctatgcttcctcg

SEQ ID NO: 6191517 - DNA, 17 bp, Homo sapiens
ctgttctcaaagcagaa

SEQ ID NO: 6191518 - DNA, 14 bp, Homo sapiens
ctgttctcaaatgc

SEQ ID NO: 6191519 - DNA, 15 bp, Homo sapiens
ctgttctcaatcatt

SEQ ID NO: 6191520 - DNA, 16 bp, Homo sapiens
ctgttctcaatcattg

SEQ ID NO: 6191521 - DNA, 12 bp, Homo sapiens
ctgttctcagag

SEQ ID NO: 6191522 - DNA, 17 bp, Homo sapiens
ctgttctcagagctcca

SEQ ID NO: 6191523 - DNA, 19 bp, Homo sapiens
ctgttctcagagctccaca

SEQ ID NO: 6191524 - DNA, 20 bp, Homo sapiens
ctgttctcagagctccacag

SEQ ID NO: 6191525 - DNA, 21 bp, Homo sapiens
ctgttctcagagctccacaga

SEQ ID NO: 6191526 - DNA, 20 bp, Homo sapiens
ctgttctcattcctgttctt

SEQ ID NO: 6191527 - DNA, 16 bp, Homo sapiens
ctgttctcatttgatc

SEQ ID NO: 6191528 - DNA, 13 bp, Homo sapiens
ctgttctccagat

SEQ ID NO: 6191529 - DNA, 23 bp, Homo sapiens
ctgttctccaggcttcacagtct

SEQ ID NO: 6191530 - DNA, 16 bp, Homo sapiens
ctgttctcccttcggt

SEQ ID NO: 6191531 - DNA, 17 bp, Homo sapiens
ctgttctccctttctct

SEQ ID NO: 6191532 - DNA, 18 bp, Homo sapiens
ctgttctccctttctctc

SEQ ID NO: 6191533 - DNA, 20 bp, Homo sapiens
ctgttctccctttctctctc

SEQ ID NO: 6191534 - DNA, 18 bp, Homo sapiens
ctgttctcgaactcctga

SEQ ID NO: 6191535 - DNA, 14 bp, Homo sapiens
ctgttctctcccct

SEQ ID NO: 6191536 - DNA, 16 bp, Homo sapiens
ctgttctctgccctcc

SEQ ID NO: 6191537 - DNA, 17 bp, Homo sapiens
ctgttctctgccctcca

SEQ ID NO: 6191538 - DNA, 20 bp, Homo sapiens
ctgttctctgccctccaaga

SEQ ID NO: 6191539 - DNA, 12 bp, Homo sapiens
ctgttctctgct

SEQ ID NO: 6191540 - DNA, 13 bp, Homo sapiens
ctgttctctgctg

SEQ ID NO: 6191541 - DNA, 14 bp, Homo sapiens
ctgttctctgctga

SEQ ID NO: 6191542 - DNA, 13 bp, Homo sapiens
ctgttctctgctt

SEQ ID NO: 6191543 - DNA, 23 bp, Homo sapiens
ctgttctcttcacaccaaggaag

SEQ ID NO: 6191544 - DNA, 19 bp, Homo sapiens
ctgttctgaaaggagacat

SEQ ID NO: 6191545 - DNA, 20 bp, Homo sapiens
ctgttctgaaattaggaaag

SEQ ID NO: 6191546 - DNA, 11 bp, Homo sapiens
ctgttctgagc

SEQ ID NO: 6191547 - DNA, 18 bp, Homo sapiens
ctgttctgatattaattt

SEQ ID NO: 6191548 - DNA, 20 bp, Homo sapiens
ctgttctgatattaatttat

SEQ ID NO: 6191549 - DNA, 21 bp, Homo sapiens
ctgttctgcacaataaacata

SEQ ID NO: 6191550 - DNA, 13 bp, Homo sapiens
ctgttctgcactg

SEQ ID NO: 6191551 - DNA, 14 bp, Homo sapiens
ctgttctgcactga

SEQ ID NO: 6191552 - DNA, 15 bp, Homo sapiens
ctgttctgcactgaa

SEQ ID NO: 6191553 - DNA, 16 bp, Homo sapiens
ctgttctgcactgaaa

SEQ ID NO: 6191554 - DNA, 14 bp, Homo sapiens
ctgttctgcagaca

SEQ ID NO: 6191555 - DNA, 16 bp, Homo sapiens
ctgttctgccccctca

SEQ ID NO: 6191556 - DNA, 18 bp, Homo sapiens
ctgttctgccccctcagg

SEQ ID NO: 6191557 - DNA, 14 bp, Homo sapiens
ctgttctgctggga

SEQ ID NO: 6191558 - DNA, 13 bp, Homo sapiens
ctgttctggagct

SEQ ID NO: 6191559 - DNA, 17 bp, Homo sapiens
ctgttctggagctgctg

SEQ ID NO: 6191560 - DNA, 18 bp, Homo sapiens
ctgttctggagctgctgt

SEQ ID NO: 6191561 - DNA, 22 bp, Homo sapiens
ctgttctggaggaaagggagga

SEQ ID NO: 6191562 - DNA, 15 bp, Homo sapiens
ctgttctgggactcc

SEQ ID NO: 6191563 - DNA, 14 bp, Homo sapiens
ctgttctgggggac

SEQ ID NO: 6191564 - DNA, 20 bp, Homo sapiens
ctgttctgggggacagagaa

SEQ ID NO: 6191565 - DNA, 14 bp, Homo sapiens
ctgttctggtagct

SEQ ID NO: 6191566 - DNA, 20 bp, Homo sapiens
ctgttctggtatttcccctg

SEQ ID NO: 6191567 - DNA, 17 bp, Homo sapiens
ctgttctggtggcccca

SEQ ID NO: 6191568 - DNA, 14 bp, Homo sapiens
ctgttctgtagctt

SEQ ID NO: 6191569 - DNA, 17 bp, Homo sapiens
ctgttctgtagctttct

SEQ ID NO: 6191570 - DNA, 18 bp, Homo sapiens
ctgttctgtagctttctg

SEQ ID NO: 6191571 - DNA, 19 bp, Homo sapiens
ctgttctgtagctttctgg

SEQ ID NO: 6191572 - DNA, 13 bp, Homo sapiens
ctgttctgtagga

SEQ ID NO: 6191573 - DNA, 19 bp, Homo sapiens
ctgttctgtaggagagact

SEQ ID NO: 6191574 - DNA, 12 bp, Homo sapiens
ctgttctgtgac

SEQ ID NO: 6191575 - DNA, 21 bp, Homo sapiens
ctgttctgtggaaagtgtaaa

SEQ ID NO: 6191576 - DNA, 23 bp, Homo sapiens
ctgttctgtggaaagtgtaaagc

SEQ ID NO: 6191577 - DNA, 13 bp, Homo sapiens
ctgttctgtgtac

SEQ ID NO: 6191578 - DNA, 16 bp, Homo sapiens
ctgttctgtgtacata

SEQ ID NO: 6191579 - DNA, 20 bp, Homo sapiens
ctgttctgtgtacataaagt

SEQ ID NO: 6191580 - DNA, 22 bp, Homo sapiens
ctgttctgtgtacataaagtca

SEQ ID NO: 6191581 - DNA, 15 bp, Homo sapiens
ctgttctgtgtgggt

SEQ ID NO: 6191582 - DNA, 21 bp, Homo sapiens
ctgttctgtgtgggtctgggg

SEQ ID NO: 6191583 - DNA, 14 bp, Homo sapiens
ctgttctgtttcaa

SEQ ID NO: 6191584 - DNA, 17 bp, Homo sapiens
ctgttctgtttcctgtg

SEQ ID NO: 6191585 - DNA, 21 bp, Homo sapiens
ctgttctgtttcctgtgtctc

SEQ ID NO: 6191586 - DNA, 17 bp, Homo sapiens
ctgttctgttttgcctg

SEQ ID NO: 6191587 - DNA, 15 bp, Homo sapiens
ctgttcttagagtgt

SEQ ID NO: 6191588 - DNA, 16 bp, Homo sapiens
ctgttcttagagtgta

SEQ ID NO: 6191589 - DNA, 19 bp, Homo sapiens
ctgttcttagagtgtagct

SEQ ID NO: 6191590 - DNA, 21 bp, Homo sapiens
ctgttcttagagtgtagctgt

SEQ ID NO: 6191591 - DNA, 16 bp, Homo sapiens
ctgttcttagctcaat

SEQ ID NO: 6191592 - DNA, 19 bp, Homo sapiens
ctgttcttagctcaatgag

SEQ ID NO: 6191593 - DNA, 21 bp, Homo sapiens
ctgttcttagctcaatgagca

SEQ ID NO: 6191594 - DNA, 21 bp, Homo sapiens
ctgttcttagtgacacacact

SEQ ID NO: 6191595 - DNA, 17 bp, Homo sapiens
ctgttcttcacttctgg

SEQ ID NO: 6191596 - DNA, 15 bp, Homo sapiens
ctgttcttcatctgc

SEQ ID NO: 6191597 - DNA, 22 bp, Homo sapiens
ctgttcttcctcagccagcctc

SEQ ID NO: 6191598 - DNA, 15 bp, Homo sapiens
ctgttcttcctccag

SEQ ID NO: 6191599 - DNA, 20 bp, Homo sapiens
ctgttcttcctccagctgca

SEQ ID NO: 6191600 - DNA, 12 bp, Homo sapiens
ctgttcttcctg

SEQ ID NO: 6191601 - DNA, 22 bp, Homo sapiens
ctgttcttgaaagccaagtgtt

SEQ ID NO: 6191602 - DNA, 12 bp, Homo sapiens
ctgttcttgaag

SEQ ID NO: 6191603 - DNA, 20 bp, Homo sapiens
ctgttcttgaggtctctttt

SEQ ID NO: 6191604 - DNA, 11 bp, Homo sapiens
ctgttcttgct

SEQ ID NO: 6191605 - DNA, 14 bp, Homo sapiens
ctgttcttgctgct

SEQ ID NO: 6191606 - DNA, 15 bp, Homo sapiens
ctgttcttgctgcta

SEQ ID NO: 6191607 - DNA, 18 bp, Homo sapiens
ctgttcttgctgctagaa

SEQ ID NO: 6191608 - DNA, 20 bp, Homo sapiens
ctgttcttgctgctagaact

SEQ ID NO: 6191609 - DNA, 18 bp, Homo sapiens
ctgttcttgggcctcagg

SEQ ID NO: 6191610 - DNA, 22 bp, Homo sapiens
ctgttcttggtaactgattacc

SEQ ID NO: 6191611 - DNA, 18 bp, Homo sapiens
ctgttctttaagactttt

SEQ ID NO: 6191612 - DNA, 16 bp, Homo sapiens
ctgttctttaatttat

SEQ ID NO: 6191613 - DNA, 19 bp, Homo sapiens
ctgttctttcatactacat

SEQ ID NO: 6191614 - DNA, 19 bp, Homo sapiens
ctgttctttccaaagtaca

SEQ ID NO: 6191615 - DNA, 13 bp, Homo sapiens
ctgttctttctgg

SEQ ID NO: 6191616 - DNA, 15 bp, Homo sapiens
ctgttctttgcagtg

SEQ ID NO: 6191617 - DNA, 14 bp, Homo sapiens
ctgttcttttgcat

SEQ ID NO: 6191618 - DNA, 12 bp, Homo sapiens
ctgttgaaaatt

SEQ ID NO: 6191619 - DNA, 14 bp, Homo sapiens
ctgttgaaaattat

SEQ ID NO: 6191620 - DNA, 20 bp, Homo sapiens
ctgttgaaacacacgtgctg

SEQ ID NO: 6191621 - DNA, 23 bp, Homo sapiens
ctgttgaaacttacactgtttca

SEQ ID NO: 6191622 - DNA, 18 bp, Homo sapiens
ctgttgaaagcaaaaatg

SEQ ID NO: 6191623 - DNA, 21 bp, Homo sapiens
ctgttgaagatttgaggactt

SEQ ID NO: 6191624 - DNA, 17 bp, Homo sapiens
ctgttgaagtgcatgtt

SEQ ID NO: 6191625 - DNA, 15 bp, Homo sapiens
ctgttgaatatttag

SEQ ID NO: 6191626 - DNA, 18 bp, Homo sapiens
ctgttgaatgcctgtccc

SEQ ID NO: 6191627 - DNA, 19 bp, Homo sapiens
ctgttgaattggtgaataa

SEQ ID NO: 6191628 - DNA, 23 bp, Homo sapiens
ctgttgaattttgttctctggga

SEQ ID NO: 6191629 - DNA, 18 bp, Homo sapiens
ctgttgacatcagcctgc

SEQ ID NO: 6191630 - DNA, 23 bp, Homo sapiens
ctgttgacatccaagcttccttt

SEQ ID NO: 6191631 - DNA, 14 bp, Homo sapiens
ctgttgaccaggca

SEQ ID NO: 6191632 - DNA, 17 bp, Homo sapiens
ctgttgaccaggcacct

SEQ ID NO: 6191633 - DNA, 17 bp, Homo sapiens
ctgttgacgaagtctct

SEQ ID NO: 6191634 - DNA, 19 bp, Homo sapiens
ctgttgactctagtactgt

SEQ ID NO: 6191635 - DNA, 19 bp, Homo sapiens
ctgttgagatggtaacaga

SEQ ID NO: 6191636 - DNA, 19 bp, Homo sapiens
ctgttgagatgtgctttgc

SEQ ID NO: 6191637 - DNA, 20 bp, Homo sapiens
ctgttgagccccagtgctgg

SEQ ID NO: 6191638 - DNA, 16 bp, Homo sapiens
ctgttgaggcatcaaa

SEQ ID NO: 6191639 - DNA, 17 bp, Homo sapiens
ctgttgaggtggctgta

SEQ ID NO: 6191640 - DNA, 22 bp, Homo sapiens
ctgttgaggtgggtgggcctga

SEQ ID NO: 6191641 - DNA, 16 bp, Homo sapiens
ctgttgagtatttgct

SEQ ID NO: 6191642 - DNA, 23 bp, Homo sapiens
ctgttgagtgcaacaagagcaaa

SEQ ID NO: 6191643 - DNA, 16 bp, Homo sapiens
ctgttgagttggacac

SEQ ID NO: 6191644 - DNA, 18 bp, Homo sapiens
ctgttgataaatccatca

SEQ ID NO: 6191645 - DNA, 15 bp, Homo sapiens
ctgttgatacaaacc

SEQ ID NO: 6191646 - DNA, 17 bp, Homo sapiens
ctgttgatcccacttca

SEQ ID NO: 6191647 - DNA, 19 bp, Homo sapiens
ctgttgatcccacttcact

SEQ ID NO: 6191648 - DNA, 14 bp, Homo sapiens
ctgttgatcccctc

SEQ ID NO: 6191649 - DNA, 21 bp, Homo sapiens
ctgttgatcccctctctgtgg

SEQ ID NO: 6191650 - DNA, 21 bp, Homo sapiens
ctgttgatcgtcacgctcgca

SEQ ID NO: 6191651 - DNA, 20 bp, Homo sapiens
ctgttgatctacccgtgcct

SEQ ID NO: 6191652 - DNA, 14 bp, Homo sapiens
ctgttgatctatgg

SEQ ID NO: 6191653 - DNA, 14 bp, Homo sapiens
ctgttgatgtatct

SEQ ID NO: 6191654 - DNA, 22 bp, Homo sapiens
ctgttgatgtatctgagttgcc

SEQ ID NO: 6191655 - DNA, 18 bp, Homo sapiens
ctgttgattatcttcagc

SEQ ID NO: 6191656 - DNA, 23 bp, Homo sapiens
ctgttgattatcttcagcccagg

SEQ ID NO: 6191657 - DNA, 21 bp, Homo sapiens
ctgttgattccactgaaacct

SEQ ID NO: 6191658 - DNA, 15 bp, Homo sapiens
ctgttgattctttca

SEQ ID NO: 6191659 - DNA, 19 bp, Homo sapiens
ctgttgattgctaaatgta

SEQ ID NO: 6191660 - DNA, 16 bp, Homo sapiens
ctgttgcaagcccctc

SEQ ID NO: 6191661 - DNA, 22 bp, Homo sapiens
ctgttgcaattaggattttgat

SEQ ID NO: 6191662 - DNA, 17 bp, Homo sapiens
ctgttgcacccagccct

SEQ ID NO: 6191663 - DNA, 18 bp, Homo sapiens
ctgttgcacccagccctg

SEQ ID NO: 6191664 - DNA, 21 bp, Homo sapiens
ctgttgcacccagccctggtc

SEQ ID NO: 6191665 - DNA, 23 bp, Homo sapiens
ctgttgcacccagccctggtctc

SEQ ID NO: 6191666 - DNA, 20 bp, Homo sapiens
ctgttgcacgtgtgtttttc

SEQ ID NO: 6191667 - DNA, 15 bp, Homo sapiens
ctgttgcacttttga

SEQ ID NO: 6191668 - DNA, 18 bp, Homo sapiens
ctgttgcacttttgaatg

SEQ ID NO: 6191669 - DNA, 22 bp, Homo sapiens
ctgttgcagcttgtgctgagcc

SEQ ID NO: 6191670 - DNA, 19 bp, Homo sapiens
ctgttgcaggcagtgtctt

SEQ ID NO: 6191671 - DNA, 21 bp, Homo sapiens
ctgttgcaggtgtccgggggt

SEQ ID NO: 6191672 - DNA, 12 bp, Homo sapiens
ctgttgcagtgg

SEQ ID NO: 6191673 - DNA, 16 bp, Homo sapiens
ctgttgcatagaattc

SEQ ID NO: 6191674 - DNA, 12 bp, Homo sapiens
ctgttgcatggg

SEQ ID NO: 6191675 - DNA, 16 bp, Homo sapiens
ctgttgcatttacttt

SEQ ID NO: 6191676 - DNA, 13 bp, Homo sapiens
ctgttgccagact

SEQ ID NO: 6191677 - DNA, 17 bp, Homo sapiens
ctgttgccagagatgga

SEQ ID NO: 6191678 - DNA, 15 bp, Homo sapiens
ctgttgccatagccc

SEQ ID NO: 6191679 - DNA, 17 bp, Homo sapiens
ctgttgccatggattca

SEQ ID NO: 6191680 - DNA, 17 bp, Homo sapiens
ctgttgcccaggctggc

SEQ ID NO: 6191681 - DNA, 20 bp, Homo sapiens
ctgttgcccaggctggcctg

SEQ ID NO: 6191682 - DNA, 13 bp, Homo sapiens
ctgttgcccccca

SEQ ID NO: 6191683 - DNA, 19 bp, Homo sapiens
ctgttgcccgccctccacc

SEQ ID NO: 6191684 - DNA, 21 bp, Homo sapiens
ctgttgccctttctgtaccat

SEQ ID NO: 6191685 - DNA, 16 bp, Homo sapiens
ctgttgcccttttcct

SEQ ID NO: 6191686 - DNA, 23 bp, Homo sapiens
ctgttgcccttttccttgactat

SEQ ID NO: 6191687 - DNA, 18 bp, Homo sapiens
ctgttgcctaattggaaa

SEQ ID NO: 6191688 - DNA, 14 bp, Homo sapiens
ctgttgcctcatct

SEQ ID NO: 6191689 - DNA, 19 bp, Homo sapiens
gaacgccctcatgctcagc

SEQ ID NO: 6191690 - DNA, 20 bp, Homo sapiens
gaacgccctggtaaggctgg

SEQ ID NO: 6191691 - DNA, 14 bp, Homo sapiens
gaacgccctgtgtc

SEQ ID NO: 6191692 - DNA, 19 bp, Homo sapiens
gaacgccctgtgtccacag

SEQ ID NO: 6191693 - DNA, 20 bp, Homo sapiens
gaacgcggtgtgtaacactg

SEQ ID NO: 6191694 - DNA, 17 bp, Homo sapiens
gaacgcgtgtgtgcctg

SEQ ID NO: 6191695 - DNA, 18 bp, Homo sapiens
gaacgcgtgtgtgcctga

SEQ ID NO: 6191696 - DNA, 15 bp, Homo sapiens
gaacgcgttgaaatt

SEQ ID NO: 6191697 - DNA, 21 bp, Homo sapiens
gaacgctgtgatgctgtgtgc

SEQ ID NO: 6191698 - DNA, 23 bp, Homo sapiens
gaacgctgtgatgctgtgtgccc

SEQ ID NO: 6191699 - DNA, 20 bp, Homo sapiens
gaacgcttcgggaaaatatt

SEQ ID NO: 6191700 - DNA, 19 bp, Homo sapiens
gaacggaacgttggacttt

SEQ ID NO: 6191701 - DNA, 21 bp, Homo sapiens
gaacgggcagccacaggactg

SEQ ID NO: 6191702 - DNA, 22 bp, Homo sapiens
gaacgggcagcctgggcctggg

SEQ ID NO: 6191703 - DNA, 22 bp, Homo sapiens
gaacgggcatgggcctctctgg

SEQ ID NO: 6191704 - DNA, 23 bp, Homo sapiens
gaacgggcatgggcctctctggg

SEQ ID NO: 6191705 - DNA, 19 bp, Homo sapiens
gaacggggctcttctcatt

SEQ ID NO: 6191706 - DNA, 17 bp, Homo sapiens
gaacggtaaatttctgt

SEQ ID NO: 6191707 - DNA, 18 bp, Homo sapiens
gaacggtgaaggtgacag

SEQ ID NO: 6191708 - DNA, 20 bp, Homo sapiens
gaacggtggaggcagaggtg

SEQ ID NO: 6191709 - DNA, 21 bp, Homo sapiens
gaacgtatgtgctcttataaa

SEQ ID NO: 6191710 - DNA, 21 bp, Homo sapiens
gaacgtatttctccagaccca

SEQ ID NO: 6191711 - DNA, 14 bp, Homo sapiens
gaacgtgactgccc

SEQ ID NO: 6191712 - DNA, 13 bp, Homo sapiens
gaacgtgccagca

SEQ ID NO: 6191713 - DNA, 13 bp, Homo sapiens
gaacgtgcttctt

SEQ ID NO: 6191714 - DNA, 18 bp, Homo sapiens
gaacgtgcttctttgtaa

SEQ ID NO: 6191715 - DNA, 23 bp, Homo sapiens
gaacgtgggagttcagctgcttc

SEQ ID NO: 6191716 - DNA, 19 bp, Homo sapiens
gaacgtggtctgattttga

SEQ ID NO: 6191717 - DNA, 15 bp, Homo sapiens
gaacgtgtgtccagg

SEQ ID NO: 6191718 - DNA, 15 bp, Homo sapiens
gaacgttgccacacc

SEQ ID NO: 6191719 - DNA, 23 bp, Homo sapiens
gaacgtttagctgacaaaatact

SEQ ID NO: 6191720 - DNA, 15 bp, Homo sapiens
gaacgttttcttctt

SEQ ID NO: 6191721 - DNA, 22 bp, Homo sapiens
gaacgttttcttctttccctgg

SEQ ID NO: 6191722 - DNA, 19 bp, Homo sapiens
gaacgttttttcctcagtg

SEQ ID NO: 6191723 - DNA, 16 bp, Homo sapiens
gaactaaaatgttcta

SEQ ID NO: 6191724 - DNA, 17 bp, Homo sapiens
gaactaaactttcacac

SEQ ID NO: 6191725 - DNA, 12 bp, Homo sapiens
gaactaaagaag

SEQ ID NO: 6191726 - DNA, 15 bp, Homo sapiens
gaactaaagctggag

SEQ ID NO: 6191727 - DNA, 16 bp, Homo sapiens
gaactaaatatgcaat

SEQ ID NO: 6191728 - DNA, 15 bp, Homo sapiens
gaactaaatttttca

SEQ ID NO: 6191729 - DNA, 17 bp, Homo sapiens
gaactaaatttttcata

SEQ ID NO: 6191730 - DNA, 16 bp, Homo sapiens
gaactaacagaggaga

SEQ ID NO: 6191731 - DNA, 18 bp, Homo sapiens
gaactaacagaggagaaa

SEQ ID NO: 6191732 - DNA, 18 bp, Homo sapiens
gaactaagttttttactt

SEQ ID NO: 6191733 - DNA, 12 bp, Homo sapiens
gaactaatatat

SEQ ID NO: 6191734 - DNA, 15 bp, Homo sapiens
gaactaatatatgaa

SEQ ID NO: 6191735 - DNA, 19 bp, Homo sapiens
gaactaatgacaagtgact

SEQ ID NO: 6191736 - DNA, 22 bp, Homo sapiens
gaactaatgataatcccaccac

SEQ ID NO: 6191737 - DNA, 14 bp, Homo sapiens
gaactaattcattt

SEQ ID NO: 6191738 - DNA, 15 bp, Homo sapiens
gaactaccaaaatga

SEQ ID NO: 6191739 - DNA, 24 bp, Homo sapiens
gaactacgtgacctctgcaagaca

SEQ ID NO: 6191740 - DNA, 14 bp, Homo sapiens
gaactactgaggat

SEQ ID NO: 6191741 - DNA, 21 bp, Homo sapiens
gaactactgtactttgccatt

SEQ ID NO: 6191742 - DNA, 23 bp, Homo sapiens
gaactactttgaaaacaattcag

SEQ ID NO: 6191743 - DNA, 18 bp, Homo sapiens
gaactagagactctgtga

SEQ ID NO: 6191744 - DNA, 23 bp, Homo sapiens
gaactagagactctgtgatctaa

SEQ ID NO: 6191745 - DNA, 23 bp, Homo sapiens
gaactagaggtgttacagaggac

SEQ ID NO: 6191746 - DNA, 17 bp, Homo sapiens
gaactagattataagcc

SEQ ID NO: 6191747 - DNA, 23 bp, Homo sapiens
gaactagccaccaactcttgcag

SEQ ID NO: 6191748 - DNA, 21 bp, Homo sapiens
gaactaggagtcttcactgct

SEQ ID NO: 6191749 - DNA, 16 bp, Homo sapiens
gaactagggaagctca

SEQ ID NO: 6191750 - DNA, 16 bp, Homo sapiens
gaactagggcacccct

SEQ ID NO: 6191751 - DNA, 20 bp, Homo sapiens
gaactagtctacttcttaaa

SEQ ID NO: 6191752 - DNA, 19 bp, Homo sapiens
gaactagtggtggctctga

SEQ ID NO: 6191753 - DNA, 19 bp, Homo sapiens
gaactataaacttaaagct

SEQ ID NO: 6191754 - DNA, 15 bp, Homo sapiens
gaactatagtaactt

SEQ ID NO: 6191755 - DNA, 23 bp, Homo sapiens
gaactatatttaataccaccaac

SEQ ID NO: 6191756 - DNA, 18 bp, Homo sapiens
gaactatgaggagcctct

SEQ ID NO: 6191757 - DNA, 17 bp, Homo sapiens
gaactatgggagcctca

SEQ ID NO: 6191758 - DNA, 18 bp, Homo sapiens
gaactattccccagcagg

SEQ ID NO: 6191759 - DNA, 16 bp, Homo sapiens
gaactattttaaataa

SEQ ID NO: 6191760 - DNA, 17 bp, Homo sapiens
gaactattttaaataaa

SEQ ID NO: 6191761 - DNA, 22 bp, Homo sapiens
gaactattttcaaagacttaag

SEQ ID NO: 6191762 - DNA, 17 bp, Homo sapiens
gaactcaaaaggagaac

SEQ ID NO: 6191763 - DNA, 23 bp, Homo sapiens
gaactcaaaaggagaactgtgct

SEQ ID NO: 6191764 - DNA, 19 bp, Homo sapiens
gaactcaaatggggccaga

SEQ ID NO: 6191765 - DNA, 20 bp, Homo sapiens
gaactcaaatggggccagat

SEQ ID NO: 6191766 - DNA, 22 bp, Homo sapiens
gaactcaaatggggccagatcc

SEQ ID NO: 6191767 - DNA, 16 bp, Homo sapiens
gaactcaaggtggctg

SEQ ID NO: 6191768 - DNA, 20 bp, Homo sapiens
gaactcaatatatagttagc

SEQ ID NO: 6191769 - DNA, 19 bp, Homo sapiens
gaactcaatctaaattaaa

SEQ ID NO: 6191770 - DNA, 21 bp, Homo sapiens
gaactcaatctccagggctcc

SEQ ID NO: 6191771 - DNA, 17 bp, Homo sapiens
gaactcaatgcatgatg

SEQ ID NO: 6191772 - DNA, 20 bp, Homo sapiens
gaactcaatgcatgatgact

SEQ ID NO: 6191773 - DNA, 18 bp, Homo sapiens
gaactcacattggcaagt

SEQ ID NO: 6191774 - DNA, 16 bp, Homo sapiens
gaactcaccgctcacc

SEQ ID NO: 6191775 - DNA, 16 bp, Homo sapiens
gaactcacctggggct

SEQ ID NO: 6191776 - DNA, 16 bp, Homo sapiens
gaactcactctgggct

SEQ ID NO: 6191777 - DNA, 17 bp, Homo sapiens
gaactcactctgggctg

SEQ ID NO: 6191778 - DNA, 18 bp, Homo sapiens
gaactcactctgggctgt

SEQ ID NO: 6191779 - DNA, 14 bp, Homo sapiens
gaactcagaagaga

SEQ ID NO: 6191780 - DNA, 15 bp, Homo sapiens
gaactcagaagagaa

SEQ ID NO: 6191781 - DNA, 13 bp, Homo sapiens
gaactcagagccc

SEQ ID NO: 6191782 - DNA, 16 bp, Homo sapiens
gaactcagagcccctc

SEQ ID NO: 6191783 - DNA, 13 bp, Homo sapiens
gaactcagatcca

SEQ ID NO: 6191784 - DNA, 15 bp, Homo sapiens
gaactcagatccagg

SEQ ID NO: 6191785 - DNA, 19 bp, Homo sapiens
gaactcagcacattcggga

SEQ ID NO: 6191786 - DNA, 17 bp, Homo sapiens
gaactcagcagttgaca

SEQ ID NO: 6191787 - DNA, 21 bp, Homo sapiens
gaactcagcagttgacatcca

SEQ ID NO: 6191788 - DNA, 21 bp, Homo sapiens
gaactcagctgtctgtggctt

SEQ ID NO: 6191789 - DNA, 23 bp, Homo sapiens
gaactcagtagctgaacctgtct

SEQ ID NO: 6191790 - DNA, 16 bp, Homo sapiens
gaactcatcactgtgg

SEQ ID NO: 6191791 - DNA, 20 bp, Homo sapiens
gaactcatctaggtaaatta

SEQ ID NO: 6191792 - DNA, 22 bp, Homo sapiens
gaactcatctaggtaaattaca

SEQ ID NO: 6191793 - DNA, 14 bp, Homo sapiens
gaactcattcctgc

SEQ ID NO: 6191794 - DNA, 16 bp, Homo sapiens
gaactcattcctgcct

SEQ ID NO: 6191795 - DNA, 22 bp, Homo sapiens
gaactcattcctgcctgtctcc

SEQ ID NO: 6191796 - DNA, 13 bp, Homo sapiens
gaactcattctct

SEQ ID NO: 6191797 - DNA, 12 bp, Homo sapiens
gaactccactct

SEQ ID NO: 6191798 - DNA, 22 bp, Homo sapiens
gaactccagctggtgcccccag

SEQ ID NO: 6191799 - DNA, 16 bp, Homo sapiens
gaactccaggctgggc

SEQ ID NO: 6191800 - DNA, 19 bp, Homo sapiens
gaactccatacagcctcta

SEQ ID NO: 6191801 - DNA, 20 bp, Homo sapiens
gaactcccaagaacagcagg

SEQ ID NO: 6191802 - DNA, 11 bp, Homo sapiens
gaactcccagc

SEQ ID NO: 6191803 - DNA, 19 bp, Homo sapiens
gaactcccagcaacacaag

SEQ ID NO: 6191804 - DNA, 14 bp, Homo sapiens
gaactccccagggc

SEQ ID NO: 6191805 - DNA, 21 bp, Homo sapiens
gaactccccagggcctccagg

SEQ ID NO: 6191806 - DNA, 14 bp, Homo sapiens
gaactcccttctcc

SEQ ID NO: 6191807 - DNA, 15 bp, Homo sapiens
gaactcccttctccc

SEQ ID NO: 6191808 - DNA, 15 bp, Homo sapiens
gaactccctttcaac

SEQ ID NO: 6191809 - DNA, 18 bp, Homo sapiens
gaactccgctggatgggg

SEQ ID NO: 6191810 - DNA, 23 bp, Homo sapiens
gaactcctaaacctttgcccctg

SEQ ID NO: 6191811 - DNA, 18 bp, Homo sapiens
gaactcctaaataaacta

SEQ ID NO: 6191812 - DNA, 20 bp, Homo sapiens
gaactcctcaagggcagaga

SEQ ID NO: 6191813 - DNA, 14 bp, Homo sapiens
gaactcctcccacc

SEQ ID NO: 6191814 - DNA, 13 bp, Homo sapiens
gaactcctgaaat

SEQ ID NO: 6191815 - DNA, 23 bp, Homo sapiens
gaactcctgacctcaagtgattc

SEQ ID NO: 6191816 - DNA, 15 bp, Homo sapiens
gaactcctgacctcg

SEQ ID NO: 6191817 - DNA, 11 bp, Homo sapiens
gaactcctgcc

SEQ ID NO: 6191818 - DNA, 13 bp, Homo sapiens
gaactcctggcct

SEQ ID NO: 6191819 - DNA, 11 bp, Homo sapiens
gaactcctggg

SEQ ID NO: 6191820 - DNA, 20 bp, Homo sapiens
gaactcctgggctcaagcag

SEQ ID NO: 6191821 - DNA, 19 bp, Homo sapiens
gaactcctgtcttctttct

SEQ ID NO: 6191822 - DNA, 21 bp, Homo sapiens
gaactcctgtgtgtggaaggc

SEQ ID NO: 6191823 - DNA, 17 bp, Homo sapiens
gaactccttccccactt

SEQ ID NO: 6191824 - DNA, 20 bp, Homo sapiens
gaactccttggcctagccca

SEQ ID NO: 6191825 - DNA, 22 bp, Homo sapiens
gaactcgaagcccttccagtgg

SEQ ID NO: 6191826 - DNA, 12 bp, Homo sapiens
gaactcgatgca

SEQ ID NO: 6191827 - DNA, 15 bp, Homo sapiens
gaactcgatgcactg

SEQ ID NO: 6191828 - DNA, 17 bp, Homo sapiens
gaactcgcgctcagtaa

SEQ ID NO: 6191829 - DNA, 15 bp, Homo sapiens
gaactcgctcagaag

SEQ ID NO: 6191830 - DNA, 17 bp, Homo sapiens
gaactcgggattacaga

SEQ ID NO: 6191831 - DNA, 16 bp, Homo sapiens
gaactcgttaaagcaa

SEQ ID NO: 6191832 - DNA, 16 bp, Homo sapiens
gaactctaaccagtgt

SEQ ID NO: 6191833 - DNA, 19 bp, Homo sapiens
gaactctagagagccttaa

SEQ ID NO: 6191834 - DNA, 12 bp, Homo sapiens
gaactctatttt

SEQ ID NO: 6191835 - DNA, 17 bp, Homo sapiens
gaactctcaaaagtcta

SEQ ID NO: 6191836 - DNA, 22 bp, Homo sapiens
gaactctcaaaagtctattttt

SEQ ID NO: 6191837 - DNA, 18 bp, Homo sapiens
gaactctcagaaataaat

SEQ ID NO: 6191838 - DNA, 12 bp, Homo sapiens
gaactctcagga

SEQ ID NO: 6191839 - DNA, 14 bp, Homo sapiens
gaactctcccctcc

SEQ ID NO: 6191840 - DNA, 14 bp, Homo sapiens
gaactctcctcttt

SEQ ID NO: 6191841 - DNA, 16 bp, Homo sapiens
gaactctcctcttttt

SEQ ID NO: 6191842 - DNA, 21 bp, Homo sapiens
gaactctctagttccctcagt

SEQ ID NO: 6191843 - DNA, 18 bp, Homo sapiens
gaactctctccctggtct

SEQ ID NO: 6191844 - DNA, 16 bp, Homo sapiens
gaactctctgcctgta

SEQ ID NO: 6191845 - DNA, 11 bp, Homo sapiens
gaactctgaca

SEQ ID NO: 6191846 - DNA, 13 bp, Homo sapiens
gaactctgacaag

SEQ ID NO: 6191847 - DNA, 16 bp, Homo sapiens
gaactctgcaactgaa

SEQ ID NO: 6191848 - DNA, 15 bp, Homo sapiens
gaactctgcaggcag

SEQ ID NO: 6191849 - DNA, 16 bp, Homo sapiens
gaactctgcctgccct

SEQ ID NO: 6191850 - DNA, 17 bp, Homo sapiens
gaactctggcttccagg

SEQ ID NO: 6191851 - DNA, 20 bp, Homo sapiens
gaactctggcttccaggtat

SEQ ID NO: 6191852 - DNA, 13 bp, Homo sapiens
gaactctggcttt

SEQ ID NO: 6191853 - DNA, 22 bp, Homo sapiens
gaactctgggctcaagcaatcc

SEQ ID NO: 6191854 - DNA, 13 bp, Homo sapiens
gaactctgttccc

SEQ ID NO: 6191855 - DNA, 16 bp, Homo sapiens
gaactctgttccccca

SEQ ID NO: 6191856 - DNA, 19 bp, Homo sapiens
gaactctgttcccccaccc

SEQ ID NO: 6191857 - DNA, 22 bp, Homo sapiens
gaactcttaaatactttttcag

SEQ ID NO: 6191858 - DNA, 22 bp, Homo sapiens
gaactcttcctccaaggacaga

SEQ ID NO: 6191859 - DNA, 16 bp, Homo sapiens
gaactcttcctcctcc

SEQ ID NO: 6191860 - DNA, 14 bp, Homo sapiens
gaactcttctcatt

SEQ ID NO: 6191861 - DNA, 19 bp, Homo sapiens
gaactcttctcattacttg

SEQ ID NO: 6191862 - DNA, 15 bp, Homo sapiens
gaactcttgacagct

SEQ ID NO: 6191863 - DNA, 13 bp, Homo sapiens
gaactctttcccc

SEQ ID NO: 6191864 - DNA, 14 bp, Homo sapiens
gaactctttcccca

SEQ ID NO: 6191865 - DNA, 17 bp, Homo sapiens
gaactctttccccagct

SEQ ID NO: 6191866 - DNA, 15 bp, Homo sapiens
gaactgaaaaccagt

SEQ ID NO: 6191867 - DNA, 13 bp, Homo sapiens
ctgttgcctcctc

SEQ ID NO: 6191868 - DNA, 15 bp, Homo sapiens
ctgttgcctcctctc

SEQ ID NO: 6191869 - DNA, 20 bp, Homo sapiens
ctgttgcctcctctctccct

SEQ ID NO: 6191870 - DNA, 23 bp, Homo sapiens
ctgttgcctcctctctccctgcc

SEQ ID NO: 6191871 - DNA, 13 bp, Homo sapiens
ctgttgcctttta

SEQ ID NO: 6191872 - DNA, 21 bp, Homo sapiens
ctgttgcgacgcgggcttctg

SEQ ID NO: 6191873 - DNA, 18 bp, Homo sapiens
ctgttgcgctcccgcatt

SEQ ID NO: 6191874 - DNA, 18 bp, Homo sapiens
ctgttgcgtgacactctc

SEQ ID NO: 6191875 - DNA, 23 bp, Homo sapiens
ctgttgcgtgacactctccttgc

SEQ ID NO: 6191876 - DNA, 23 bp, Homo sapiens
ctgttgctatagagcctacctgt

SEQ ID NO: 6191877 - DNA, 15 bp, Homo sapiens
ctgttgctatttgta

SEQ ID NO: 6191878 - DNA, 11 bp, Homo sapiens
ctgttgctcaa

SEQ ID NO: 6191879 - DNA, 14 bp, Homo sapiens
ctgttgctgatttt

SEQ ID NO: 6191880 - DNA, 18 bp, Homo sapiens
ctgttgctggactgagga

SEQ ID NO: 6191881 - DNA, 19 bp, Homo sapiens
ctgttgctggactgaggac

SEQ ID NO: 6191882 - DNA, 14 bp, Homo sapiens
ctgttgctggaggg

SEQ ID NO: 6191883 - DNA, 15 bp, Homo sapiens
ctgttgctggagggg

SEQ ID NO: 6191884 - DNA, 17 bp, Homo sapiens
ctgttgctggaggggct

SEQ ID NO: 6191885 - DNA, 11 bp, Homo sapiens
ctgttgctggt

SEQ ID NO: 6191886 - DNA, 21 bp, Homo sapiens
ctgttgctggtgtactctagg

SEQ ID NO: 6191887 - DNA, 23 bp, Homo sapiens
ctgttgctggtgtactctaggac

SEQ ID NO: 6191888 - DNA, 20 bp, Homo sapiens
ctgttgctgtgtttaatttg

SEQ ID NO: 6191889 - DNA, 14 bp, Homo sapiens
ctgttgctgttggc

SEQ ID NO: 6191890 - DNA, 15 bp, Homo sapiens
ctgttgctgttggca

SEQ ID NO: 6191891 - DNA, 16 bp, Homo sapiens
ctgttgcttacaattt

SEQ ID NO: 6191892 - DNA, 15 bp, Homo sapiens
ctgttgcttgaatag

SEQ ID NO: 6191893 - DNA, 22 bp, Homo sapiens
ctgttgctttaatatgagcttc

SEQ ID NO: 6191894 - DNA, 19 bp, Homo sapiens
ctgttgctttgaaaaatct

SEQ ID NO: 6191895 - DNA, 12 bp, Homo sapiens
ctgttgcttttt

SEQ ID NO: 6191896 - DNA, 13 bp, Homo sapiens
ctgttggaagaaa

SEQ ID NO: 6191897 - DNA, 16 bp, Homo sapiens
ctgttggaagttcact

SEQ ID NO: 6191898 - DNA, 15 bp, Homo sapiens
ctgttggacagctgc

SEQ ID NO: 6191899 - DNA, 19 bp, Homo sapiens
ctgttggacagctgcttgt

SEQ ID NO: 6191900 - DNA, 20 bp, Homo sapiens
ctgttggacagctgcttgtg

SEQ ID NO: 6191901 - DNA, 20 bp, Homo sapiens
ctgttggacccgctctggac

SEQ ID NO: 6191902 - DNA, 15 bp, Homo sapiens
ctgttggagaaagaa

SEQ ID NO: 6191903 - DNA, 23 bp, Homo sapiens
ctgttggaggaccccgagggctg

SEQ ID NO: 6191904 - DNA, 18 bp, Homo sapiens
ctgttggattccatgcta

SEQ ID NO: 6191905 - DNA, 23 bp, Homo sapiens
ctgttggcactcacagacctgga

SEQ ID NO: 6191906 - DNA, 16 bp, Homo sapiens
ctgttggcagctctag

SEQ ID NO: 6191907 - DNA, 20 bp, Homo sapiens
ctgttggcaggcccactccc

SEQ ID NO: 6191908 - DNA, 21 bp, Homo sapiens
ctgttggcctcgcctgggccc

SEQ ID NO: 6191909 - DNA, 22 bp, Homo sapiens
ctgttggcctcgcctgggccca

SEQ ID NO: 6191910 - DNA, 13 bp, Homo sapiens
ctgttggcctgtg

SEQ ID NO: 6191911 - DNA, 17 bp, Homo sapiens
ctgttggcctgtgggcc

SEQ ID NO: 6191912 - DNA, 13 bp, Homo sapiens
ctgttggctgctg

SEQ ID NO: 6191913 - DNA, 14 bp, Homo sapiens
ctgttggctggggg

SEQ ID NO: 6191914 - DNA, 19 bp, Homo sapiens
ctgttggctgggggcctca

SEQ ID NO: 6191915 - DNA, 22 bp, Homo sapiens
ctgttggctgggggcctcagtg

SEQ ID NO: 6191916 - DNA, 17 bp, Homo sapiens
ctgttgggagaaagcaa

SEQ ID NO: 6191917 - DNA, 20 bp, Homo sapiens
ctgttgggagaaagcaatac

SEQ ID NO: 6191918 - DNA, 12 bp, Homo sapiens
ctgttgggagag

SEQ ID NO: 6191919 - DNA, 20 bp, Homo sapiens
ctgttgggagagggcgcagg

SEQ ID NO: 6191920 - DNA, 22 bp, Homo sapiens
ctgttgggagagggcgcaggcc

SEQ ID NO: 6191921 - DNA, 16 bp, Homo sapiens
ctgttgggccaggagc

SEQ ID NO: 6191922 - DNA, 20 bp, Homo sapiens
ctgttgggccaggagcctcc

SEQ ID NO: 6191923 - DNA, 12 bp, Homo sapiens
ctgttgggctga

SEQ ID NO: 6191924 - DNA, 16 bp, Homo sapiens
ctgttgggctgaaccc

SEQ ID NO: 6191925 - DNA, 16 bp, Homo sapiens
ctgttgggggcttcag

SEQ ID NO: 6191926 - DNA, 21 bp, Homo sapiens
ctgttgggggcttcaggtctc

SEQ ID NO: 6191927 - DNA, 18 bp, Homo sapiens
ctgttgggtttttgctgt

SEQ ID NO: 6191928 - DNA, 14 bp, Homo sapiens
ctgttggtcagagg

SEQ ID NO: 6191929 - DNA, 16 bp, Homo sapiens
ctgttggtctacagaa

SEQ ID NO: 6191930 - DNA, 17 bp, Homo sapiens
ctgttggtctacagaaa

SEQ ID NO: 6191931 - DNA, 14 bp, Homo sapiens
ctgttggtctgcct

SEQ ID NO: 6191932 - DNA, 21 bp, Homo sapiens
ctgttggtcttaactaatgta

SEQ ID NO: 6191933 - DNA, 15 bp, Homo sapiens
ctgttggttcaaact

SEQ ID NO: 6191934 - DNA, 16 bp, Homo sapiens
ctgttggttcatccag

SEQ ID NO: 6191935 - DNA, 14 bp, Homo sapiens
ctgttggttccaag

SEQ ID NO: 6191936 - DNA, 20 bp, Homo sapiens
ctgttggttccaagccctgg

SEQ ID NO: 6191937 - DNA, 18 bp, Homo sapiens
ctgttggttctgattagg

SEQ ID NO: 6191938 - DNA, 17 bp, Homo sapiens
ctgttggtttcatttga

SEQ ID NO: 6191939 - DNA, 14 bp, Homo sapiens
ctgttgtaaatgac

SEQ ID NO: 6191940 - DNA, 11 bp, Homo sapiens
ctgttgtaact

SEQ ID NO: 6191941 - DNA, 22 bp, Homo sapiens
ctgttgtaactaggctcagaga

SEQ ID NO: 6191942 - DNA, 12 bp, Homo sapiens
ctgttgtaactt

SEQ ID NO: 6191943 - DNA, 21 bp, Homo sapiens
ctgttgtaacttatgtagata

SEQ ID NO: 6191944 - DNA, 21 bp, Homo sapiens
ctgttgtaatatcagttacag

SEQ ID NO: 6191945 - DNA, 22 bp, Homo sapiens
ctgttgtaatttaatgactttt

SEQ ID NO: 6191946 - DNA, 11 bp, Homo sapiens
ctgttgtacaa

SEQ ID NO: 6191947 - DNA, 17 bp, Homo sapiens
ctgttgtacaatcatgt

SEQ ID NO: 6191948 - DNA, 20 bp, Homo sapiens
ctgttgtacaatcatgttct

SEQ ID NO: 6191949 - DNA, 16 bp, Homo sapiens
ctgttgtacacagtct

SEQ ID NO: 6191950 - DNA, 13 bp, Homo sapiens
ctgttgtacattt

SEQ ID NO: 6191951 - DNA, 15 bp, Homo sapiens
ctgttgtacatttat

SEQ ID NO: 6191952 - DNA, 22 bp, Homo sapiens
ctgttgtacatttatgatttaa

SEQ ID NO: 6191953 - DNA, 18 bp, Homo sapiens
ctgttgtagaaattctta

SEQ ID NO: 6191954 - DNA, 15 bp, Homo sapiens
ctgttgtagaagaca

SEQ ID NO: 6191955 - DNA, 12 bp, Homo sapiens
ctgttgtcattg

SEQ ID NO: 6191956 - DNA, 16 bp, Homo sapiens
ctgttgtcattgcttt

SEQ ID NO: 6191957 - DNA, 17 bp, Homo sapiens
ctgttgtcattgcttta

SEQ ID NO: 6191958 - DNA, 17 bp, Homo sapiens
ctgttgtccctctgcta

SEQ ID NO: 6191959 - DNA, 16 bp, Homo sapiens
ctgttgtcctatggga

SEQ ID NO: 6191960 - DNA, 12 bp, Homo sapiens
ctgttgtcctga

SEQ ID NO: 6191961 - DNA, 18 bp, Homo sapiens
ctgttgtccttaaaattc

SEQ ID NO: 6191962 - DNA, 17 bp, Homo sapiens
ctgttgtctcttctcct

SEQ ID NO: 6191963 - DNA, 14 bp, Homo sapiens
ctgttgtctgcgcc

SEQ ID NO: 6191964 - DNA, 18 bp, Homo sapiens
ctgttgtgagctttgaag

SEQ ID NO: 6191965 - DNA, 23 bp, Homo sapiens
ctgttgtgcagtgtgcctgtcac

SEQ ID NO: 6191966 - DNA, 15 bp, Homo sapiens
ctgttgtgccacaga

SEQ ID NO: 6191967 - DNA, 22 bp, Homo sapiens
ctgttgtggaaagtagctgcta

SEQ ID NO: 6191968 - DNA, 14 bp, Homo sapiens
ctgttgtgggcgct

SEQ ID NO: 6191969 - DNA, 13 bp, Homo sapiens
ctgttgttactgg

SEQ ID NO: 6191970 - DNA, 15 bp, Homo sapiens
ctgttgttatgatgt

SEQ ID NO: 6191971 - DNA, 17 bp, Homo sapiens
ctgttgttatgatgtgc

SEQ ID NO: 6191972 - DNA, 23 bp, Homo sapiens
ctgttgttatgatgtgcttaaca

SEQ ID NO: 6191973 - DNA, 15 bp, Homo sapiens
ctgttgttcagaagt

SEQ ID NO: 6191974 - DNA, 12 bp, Homo sapiens
ctgttgttccat

SEQ ID NO: 6191975 - DNA, 20 bp, Homo sapiens
ctgttgttccattttatgca

SEQ ID NO: 6191976 - DNA, 23 bp, Homo sapiens
ctgttgttgttaatgaaaatgtc

SEQ ID NO: 6191977 - DNA, 16 bp, Homo sapiens
ctgttgtttctataaa

SEQ ID NO: 6191978 - DNA, 17 bp, Homo sapiens
ctgttgtttctataaat

SEQ ID NO: 6191979 - DNA, 21 bp, Homo sapiens
ctgttgtttctataaatgact

SEQ ID NO: 6191980 - DNA, 23 bp, Homo sapiens
ctgttgtttctataaatgactat

SEQ ID NO: 6191981 - DNA, 19 bp, Homo sapiens
ctgttgtttggttcaggga

SEQ ID NO: 6191982 - DNA, 22 bp, Homo sapiens
ctgtttaaaaaaagtatatatt

SEQ ID NO: 6191983 - DNA, 16 bp, Homo sapiens
ctgtttaaaaaaccac

SEQ ID NO: 6191984 - DNA, 19 bp, Homo sapiens
ctgtttaaatatttcaaga

SEQ ID NO: 6191985 - DNA, 21 bp, Homo sapiens
ctgtttaaattgctcacagtt

SEQ ID NO: 6191986 - DNA, 22 bp, Homo sapiens
ctgtttaacgtgaggtttcagt

SEQ ID NO: 6191987 - DNA, 19 bp, Homo sapiens
ctgtttaactccctagtta

SEQ ID NO: 6191988 - DNA, 13 bp, Homo sapiens
ctgtttaagaaaa

SEQ ID NO: 6191989 - DNA, 20 bp, Homo sapiens
ctgtttaagaaaagtatttt

SEQ ID NO: 6191990 - DNA, 14 bp, Homo sapiens
ctgtttaagagaca

SEQ ID NO: 6191991 - DNA, 16 bp, Homo sapiens
ctgtttaatatttaaa

SEQ ID NO: 6191992 - DNA, 18 bp, Homo sapiens
ctgtttaatatttaaaca

SEQ ID NO: 6191993 - DNA, 17 bp, Homo sapiens
ctgtttacaagaaaaaa

SEQ ID NO: 6191994 - DNA, 18 bp, Homo sapiens
ctgtttacaagaaaaaat

SEQ ID NO: 6191995 - DNA, 14 bp, Homo sapiens
ctgtttacagacaa

SEQ ID NO: 6191996 - DNA, 17 bp, Homo sapiens
ctgtttaccctccctgt

SEQ ID NO: 6191997 - DNA, 19 bp, Homo sapiens
ctgtttaccctccctgtcc

SEQ ID NO: 6191998 - DNA, 16 bp, Homo sapiens
ctgtttaccgcccacc

SEQ ID NO: 6191999 - DNA, 22 bp, Homo sapiens
ctgtttactcccttctgtagtt

SEQ ID NO: 6192000 - DNA, 14 bp, Homo sapiens
ctgtttactgacat

SEQ ID NO: 6192001 - DNA, 15 bp, Homo sapiens
ctgtttactgcaagg

SEQ ID NO: 6192002 - DNA, 13 bp, Homo sapiens
ctgtttactgctt

SEQ ID NO: 6192003 - DNA, 15 bp, Homo sapiens
ctgtttactggttct

SEQ ID NO: 6192004 - DNA, 13 bp, Homo sapiens
ctgtttagaacac

SEQ ID NO: 6192005 - DNA, 20 bp, Homo sapiens
ctgtttagagtaaataaact

SEQ ID NO: 6192006 - DNA, 21 bp, Homo sapiens
ctgtttagagtaaataaactg

SEQ ID NO: 6192007 - DNA, 12 bp, Homo sapiens
ctgtttagataa

SEQ ID NO: 6192008 - DNA, 17 bp, Homo sapiens
ctgtttagataatacac

SEQ ID NO: 6192009 - DNA, 21 bp, Homo sapiens
ctgtttagcagaactcattct

SEQ ID NO: 6192010 - DNA, 23 bp, Homo sapiens
ctgtttagcttcctccagaggag

SEQ ID NO: 6192011 - DNA, 20 bp, Homo sapiens
ctgtttagtagcagtgattg

SEQ ID NO: 6192012 - DNA, 18 bp, Homo sapiens
ctgtttataatctgaaga

SEQ ID NO: 6192013 - DNA, 19 bp, Homo sapiens
ctgtttataatctgaagat

SEQ ID NO: 6192014 - DNA, 13 bp, Homo sapiens
ctgtttataatga

SEQ ID NO: 6192015 - DNA, 16 bp, Homo sapiens
ctgtttataatgaaga

SEQ ID NO: 6192016 - DNA, 17 bp, Homo sapiens
ctgtttataatgaagaa

SEQ ID NO: 6192017 - DNA, 15 bp, Homo sapiens
ctgtttatacttgag

SEQ ID NO: 6192018 - DNA, 10 bp, Homo sapiens
ctgtttatat

SEQ ID NO: 6192019 - DNA, 21 bp, Homo sapiens
ctgtttatataattttgcagc

SEQ ID NO: 6192020 - DNA, 19 bp, Homo sapiens
ctgtttatatattgaaagt

SEQ ID NO: 6192021 - DNA, 14 bp, Homo sapiens
ctgtttatatcttc

SEQ ID NO: 6192022 - DNA, 13 bp, Homo sapiens
ctgtttatggaaa

SEQ ID NO: 6192023 - DNA, 15 bp, Homo sapiens
ctgtttatggcctca

SEQ ID NO: 6192024 - DNA, 19 bp, Homo sapiens
ctgtttatggcctcagctg

SEQ ID NO: 6192025 - DNA, 22 bp, Homo sapiens
ctgtttatggcctcagctgcct

SEQ ID NO: 6192026 - DNA, 20 bp, Homo sapiens
ctgtttatgggtttcttcca

SEQ ID NO: 6192027 - DNA, 22 bp, Homo sapiens
ctgtttattaaagtacaaccat

SEQ ID NO: 6192028 - DNA, 14 bp, Homo sapiens
ctgtttattaatct

SEQ ID NO: 6192029 - DNA, 18 bp, Homo sapiens
ctgtttattaatcttagt

SEQ ID NO: 6192030 - DNA, 13 bp, Homo sapiens
ctgtttattactt

SEQ ID NO: 6192031 - DNA, 18 bp, Homo sapiens
ctgtttattacttccatg

SEQ ID NO: 6192032 - DNA, 19 bp, Homo sapiens
ctgtttattacttccatga

SEQ ID NO: 6192033 - DNA, 21 bp, Homo sapiens
ctgtttattcatatgcatatt

SEQ ID NO: 6192034 - DNA, 20 bp, Homo sapiens
ctgtttattctctgctgcat

SEQ ID NO: 6192035 - DNA, 20 bp, Homo sapiens
ctgtttattctgggaaatgt

SEQ ID NO: 6192036 - DNA, 18 bp, Homo sapiens
ctgtttattcttccagaa

SEQ ID NO: 6192037 - DNA, 19 bp, Homo sapiens
ctgtttattcttccagaat

SEQ ID NO: 6192038 - DNA, 23 bp, Homo sapiens
ctgtttattcttccagaatgctg

SEQ ID NO: 6192039 - DNA, 12 bp, Homo sapiens
ctgtttattgcc

SEQ ID NO: 6192040 - DNA, 15 bp, Homo sapiens
ctgtttattgccatt

SEQ ID NO: 6192041 - DNA, 21 bp, Homo sapiens
ctgtttatttaaggatggatg

SEQ ID NO: 6192042 - DNA, 18 bp, Homo sapiens
ctgtttatttttaaattt

SEQ ID NO: 6192043 - DNA, 12 bp, Homo sapiens
ctgtttcaaaca

SEQ ID NO: 6192044 - DNA, 13 bp, Homo sapiens
ctgtttcaaatgt

SEQ ID NO: 6192045 - DNA, 22 bp, Homo sapiens
ctgtttcaagccctcctcccca

SEQ ID NO: 6192046 - DNA, 13 bp, Homo sapiens
gaactgaaaagag

SEQ ID NO: 6192047 - DNA, 14 bp, Homo sapiens
gaactgaaaagaga

SEQ ID NO: 6192048 - DNA, 17 bp, Homo sapiens
gaactgaaacttttcta

SEQ ID NO: 6192049 - DNA, 13 bp, Homo sapiens
gaactgaaataaa

SEQ ID NO: 6192050 - DNA, 21 bp, Homo sapiens
gaactgaaataaaaaattatg

SEQ ID NO: 6192051 - DNA, 13 bp, Homo sapiens
gaactgaaatcat

SEQ ID NO: 6192052 - DNA, 19 bp, Homo sapiens
gaactgaacgtcctgcagc

SEQ ID NO: 6192053 - DNA, 15 bp, Homo sapiens
gaactgaactgtaac

SEQ ID NO: 6192054 - DNA, 14 bp, Homo sapiens
gaactgaagcagag

SEQ ID NO: 6192055 - DNA, 17 bp, Homo sapiens
gaactgaccctcaggca

SEQ ID NO: 6192056 - DNA, 17 bp, Homo sapiens
gaactgactttctcccc

SEQ ID NO: 6192057 - DNA, 16 bp, Homo sapiens
gaactgagaaggcagg

SEQ ID NO: 6192058 - DNA, 15 bp, Homo sapiens
gaactgagcatctcc

SEQ ID NO: 6192059 - DNA, 22 bp, Homo sapiens
gaactgagccaaacacactgta

SEQ ID NO: 6192060 - DNA, 15 bp, Homo sapiens
gaactgagccccagc

SEQ ID NO: 6192061 - DNA, 23 bp, Homo sapiens
gaactgagccccagcgggctggc

SEQ ID NO: 6192062 - DNA, 17 bp, Homo sapiens
gaactgagctgggcagg

SEQ ID NO: 6192063 - DNA, 14 bp, Homo sapiens
gaactgagcttgga

SEQ ID NO: 6192064 - DNA, 15 bp, Homo sapiens
gaactgagcttggaa

SEQ ID NO: 6192065 - DNA, 16 bp, Homo sapiens
gaactgagcttggaag

SEQ ID NO: 6192066 - DNA, 22 bp, Homo sapiens
gaactgaggagatgaccaggga

SEQ ID NO: 6192067 - DNA, 17 bp, Homo sapiens
gaactgaggccctgtga

SEQ ID NO: 6192068 - DNA, 13 bp, Homo sapiens
gaactgaggcctt

SEQ ID NO: 6192069 - DNA, 16 bp, Homo sapiens
gaactgagggcaaggg

SEQ ID NO: 6192070 - DNA, 13 bp, Homo sapiens
gaactgagtcacg

SEQ ID NO: 6192071 - DNA, 14 bp, Homo sapiens
gaactgatacatct

SEQ ID NO: 6192072 - DNA, 15 bp, Homo sapiens
gaactgatacatctg

SEQ ID NO: 6192073 - DNA, 19 bp, Homo sapiens
gaactgatagttactgttg

SEQ ID NO: 6192074 - DNA, 22 bp, Homo sapiens
gaactgatcatgtttatgagaa

SEQ ID NO: 6192075 - DNA, 19 bp, Homo sapiens
gaactgatgtagaaggcag

SEQ ID NO: 6192076 - DNA, 20 bp, Homo sapiens
gaactgattgctcccaggat

SEQ ID NO: 6192077 - DNA, 21 bp, Homo sapiens
gaactgattttacaaattaat

SEQ ID NO: 6192078 - DNA, 13 bp, Homo sapiens
gaactgcaaagct

SEQ ID NO: 6192079 - DNA, 16 bp, Homo sapiens
gaactgcaactccagc

SEQ ID NO: 6192080 - DNA, 18 bp, Homo sapiens
gaactgcaactccagcgt

SEQ ID NO: 6192081 - DNA, 19 bp, Homo sapiens
gaactgcacaatgaccagc

SEQ ID NO: 6192082 - DNA, 22 bp, Homo sapiens
gaactgcacaatgaccagcagg

SEQ ID NO: 6192083 - DNA, 23 bp, Homo sapiens
gaactgcacaatgaccagcagga

SEQ ID NO: 6192084 - DNA, 18 bp, Homo sapiens
gaactgcacatgaagaaa

SEQ ID NO: 6192085 - DNA, 20 bp, Homo sapiens
gaactgcacatgaagaaata

SEQ ID NO: 6192086 - DNA, 18 bp, Homo sapiens
gaactgcacgttctatat

SEQ ID NO: 6192087 - DNA, 12 bp, Homo sapiens
gaactgcacttt

SEQ ID NO: 6192088 - DNA, 13 bp, Homo sapiens
gaactgcactttt

SEQ ID NO: 6192089 - DNA, 16 bp, Homo sapiens
gaactgcagacctcac

SEQ ID NO: 6192090 - DNA, 19 bp, Homo sapiens
gaactgcagacctcactgt

SEQ ID NO: 6192091 - DNA, 16 bp, Homo sapiens
gaactgcagacctgtc

SEQ ID NO: 6192092 - DNA, 18 bp, Homo sapiens
gaactgcagacctgtcct

SEQ ID NO: 6192093 - DNA, 21 bp, Homo sapiens
gaactgcagatagcccaggag

SEQ ID NO: 6192094 - DNA, 23 bp, Homo sapiens
gaactgcagatagcccaggagca

SEQ ID NO: 6192095 - DNA, 12 bp, Homo sapiens
gaactgcagtga

SEQ ID NO: 6192096 - DNA, 15 bp, Homo sapiens
gaactgcatggggag

SEQ ID NO: 6192097 - DNA, 14 bp, Homo sapiens
gaactgccaagaaa

SEQ ID NO: 6192098 - DNA, 15 bp, Homo sapiens
gaactgccaagaaaa

SEQ ID NO: 6192099 - DNA, 17 bp, Homo sapiens
gaactgccaccttgggt

SEQ ID NO: 6192100 - DNA, 20 bp, Homo sapiens
gaactgccattattttctgt

SEQ ID NO: 6192101 - DNA, 15 bp, Homo sapiens
gaactgcccccactg

SEQ ID NO: 6192102 - DNA, 16 bp, Homo sapiens
gaactgcccttgctgc

SEQ ID NO: 6192103 - DNA, 18 bp, Homo sapiens
gaactgcccttgctgccc

SEQ ID NO: 6192104 - DNA, 17 bp, Homo sapiens
gaactgcctctttcctg

SEQ ID NO: 6192105 - DNA, 14 bp, Homo sapiens
gaactgcctgggcc

SEQ ID NO: 6192106 - DNA, 21 bp, Homo sapiens
gaactgcctttggcagagttc

SEQ ID NO: 6192107 - DNA, 17 bp, Homo sapiens
gaactgctctactttga

SEQ ID NO: 6192108 - DNA, 14 bp, Homo sapiens
gaactgctgccact

SEQ ID NO: 6192109 - DNA, 12 bp, Homo sapiens
gaactgctgctg

SEQ ID NO: 6192110 - DNA, 13 bp, Homo sapiens
gaactgctgctgg

SEQ ID NO: 6192111 - DNA, 14 bp, Homo sapiens
gaactgctgctggt

SEQ ID NO: 6192112 - DNA, 12 bp, Homo sapiens
gaactgctgggg

SEQ ID NO: 6192113 - DNA, 13 bp, Homo sapiens
gaactgctggggc

SEQ ID NO: 6192114 - DNA, 17 bp, Homo sapiens
gaactgcttactagccc

SEQ ID NO: 6192115 - DNA, 16 bp, Homo sapiens
gaactgcttgcatttc

SEQ ID NO: 6192116 - DNA, 21 bp, Homo sapiens
gaactgctttatcccacggaa

SEQ ID NO: 6192117 - DNA, 16 bp, Homo sapiens
gaactgctttctttcg

SEQ ID NO: 6192118 - DNA, 15 bp, Homo sapiens
gaactggaacacaca

SEQ ID NO: 6192119 - DNA, 16 bp, Homo sapiens
gaactggaagaaagca

SEQ ID NO: 6192120 - DNA, 14 bp, Homo sapiens
gaactggaataata

SEQ ID NO: 6192121 - DNA, 15 bp, Homo sapiens
gaactggacacaata

SEQ ID NO: 6192122 - DNA, 23 bp, Homo sapiens
gaactggacacaataggtctttc

SEQ ID NO: 6192123 - DNA, 17 bp, Homo sapiens
gaactggagccatgggc

SEQ ID NO: 6192124 - DNA, 14 bp, Homo sapiens
gaactggagggtga

SEQ ID NO: 6192125 - DNA, 18 bp, Homo sapiens
gaactggcaattgtctat

SEQ ID NO: 6192126 - DNA, 16 bp, Homo sapiens
gaactggcaggagcct

SEQ ID NO: 6192127 - DNA, 16 bp, Homo sapiens
gaactggccccagctc

SEQ ID NO: 6192128 - DNA, 21 bp, Homo sapiens
gaactggctcctttgcctctg

SEQ ID NO: 6192129 - DNA, 11 bp, Homo sapiens
gaactggctgc

SEQ ID NO: 6192130 - DNA, 15 bp, Homo sapiens
gaactggctgggccc

SEQ ID NO: 6192131 - DNA, 19 bp, Homo sapiens
gaactggctgggcccctgg

SEQ ID NO: 6192132 - DNA, 15 bp, Homo sapiens
gaactggctgtgaag

SEQ ID NO: 6192133 - DNA, 19 bp, Homo sapiens
gaactgggaaaacagtgaa

SEQ ID NO: 6192134 - DNA, 16 bp, Homo sapiens
gaactgggaagatgct

SEQ ID NO: 6192135 - DNA, 18 bp, Homo sapiens
gaactgggaagatgctgg

SEQ ID NO: 6192136 - DNA, 20 bp, Homo sapiens
gaactgggaagatgctggcc

SEQ ID NO: 6192137 - DNA, 21 bp, Homo sapiens
gaactgggaagatgctggccc

SEQ ID NO: 6192138 - DNA, 23 bp, Homo sapiens
gaactgggagtccagggagggag

SEQ ID NO: 6192139 - DNA, 22 bp, Homo sapiens
gaactgggcacagattgaagaa

SEQ ID NO: 6192140 - DNA, 19 bp, Homo sapiens
gaactgggcatatttctaa

SEQ ID NO: 6192141 - DNA, 15 bp, Homo sapiens
gaactgggctgggcc

SEQ ID NO: 6192142 - DNA, 21 bp, Homo sapiens
gaactggggctttgccttgca

SEQ ID NO: 6192143 - DNA, 22 bp, Homo sapiens
gaactggggctttgccttgcag

SEQ ID NO: 6192144 - DNA, 17 bp, Homo sapiens
gaactgggggctagcca

SEQ ID NO: 6192145 - DNA, 22 bp, Homo sapiens
gaactgggtatgaggctggggc

SEQ ID NO: 6192146 - DNA, 22 bp, Homo sapiens
gaactgggttctttggaagcag

SEQ ID NO: 6192147 - DNA, 15 bp, Homo sapiens
gaactggtagaaaaa

SEQ ID NO: 6192148 - DNA, 18 bp, Homo sapiens
gaactggtccaggccagg

SEQ ID NO: 6192149 - DNA, 14 bp, Homo sapiens
gaactggtcttcct

SEQ ID NO: 6192150 - DNA, 23 bp, Homo sapiens
gaactggttcaagagacactgct

SEQ ID NO: 6192151 - DNA, 18 bp, Homo sapiens
gaactgtagatgatgtat

SEQ ID NO: 6192152 - DNA, 18 bp, Homo sapiens
gaactgtatattattgct

SEQ ID NO: 6192153 - DNA, 18 bp, Homo sapiens
gaactgtattattgcaat

SEQ ID NO: 6192154 - DNA, 14 bp, Homo sapiens
gaactgtccagaga

SEQ ID NO: 6192155 - DNA, 16 bp, Homo sapiens
gaactgtccagagagc

SEQ ID NO: 6192156 - DNA, 17 bp, Homo sapiens
gaactgtccagagagca

SEQ ID NO: 6192157 - DNA, 17 bp, Homo sapiens
gaactgtcccacaaaat

SEQ ID NO: 6192158 - DNA, 14 bp, Homo sapiens
gaactgtcccagct

SEQ ID NO: 6192159 - DNA, 13 bp, Homo sapiens
gaactgtccgtga

SEQ ID NO: 6192160 - DNA, 20 bp, Homo sapiens
gaactgtcggaggaaagaca

SEQ ID NO: 6192161 - DNA, 17 bp, Homo sapiens
gaactgtctctcatgaa

SEQ ID NO: 6192162 - DNA, 21 bp, Homo sapiens
gaactgtctctcatgaacctc

SEQ ID NO: 6192163 - DNA, 23 bp, Homo sapiens
gaactgtctgaatattctagaac

SEQ ID NO: 6192164 - DNA, 13 bp, Homo sapiens
gaactgtcttggc

SEQ ID NO: 6192165 - DNA, 13 bp, Homo sapiens
gaactgtgacagg

SEQ ID NO: 6192166 - DNA, 15 bp, Homo sapiens
gaactgtgacaggaa

SEQ ID NO: 6192167 - DNA, 22 bp, Homo sapiens
gaactgtgcatagtgctgggat

SEQ ID NO: 6192168 - DNA, 18 bp, Homo sapiens
gaactgtgcatcaaccag

SEQ ID NO: 6192169 - DNA, 23 bp, Homo sapiens
gaactgtgcatcaaccaggaaga

SEQ ID NO: 6192170 - DNA, 17 bp, Homo sapiens
gaactgtgcctttgagt

SEQ ID NO: 6192171 - DNA, 11 bp, Homo sapiens
gaactgtgctc

SEQ ID NO: 6192172 - DNA, 16 bp, Homo sapiens
gaactgtgtatttatt

SEQ ID NO: 6192173 - DNA, 20 bp, Homo sapiens
gaactgtgtatttatttaaa

SEQ ID NO: 6192174 - DNA, 23 bp, Homo sapiens
gaactgtgtatttatttaaaact

SEQ ID NO: 6192175 - DNA, 14 bp, Homo sapiens
gaactgtgtgtaat

SEQ ID NO: 6192176 - DNA, 17 bp, Homo sapiens
gaactgtgtgtgaatct

SEQ ID NO: 6192177 - DNA, 21 bp, Homo sapiens
gaactgttacaacttgtattt

SEQ ID NO: 6192178 - DNA, 15 bp, Homo sapiens
gaactgttagatgct

SEQ ID NO: 6192179 - DNA, 23 bp, Homo sapiens
gaactgttcacactgcagagact

SEQ ID NO: 6192180 - DNA, 19 bp, Homo sapiens
gaactgttgcctaattgga

SEQ ID NO: 6192181 - DNA, 14 bp, Homo sapiens
gaactgttggttat

SEQ ID NO: 6192182 - DNA, 20 bp, Homo sapiens
gaactgttgtataaatttat

SEQ ID NO: 6192183 - DNA, 19 bp, Homo sapiens
gaactgttgtttacttgtt

SEQ ID NO: 6192184 - DNA, 15 bp, Homo sapiens
gaacttaaaacatat

SEQ ID NO: 6192185 - DNA, 16 bp, Homo sapiens
gaacttaaatgccccc

SEQ ID NO: 6192186 - DNA, 19 bp, Homo sapiens
gaacttaaatgcccccctc

SEQ ID NO: 6192187 - DNA, 20 bp, Homo sapiens
gaacttaaattatgttttaa

SEQ ID NO: 6192188 - DNA, 21 bp, Homo sapiens
gaacttacaaagggtctatct

SEQ ID NO: 6192189 - DNA, 22 bp, Homo sapiens
gaacttacatactaggtgcctt

SEQ ID NO: 6192190 - DNA, 22 bp, Homo sapiens
gaacttagccatttttcaaagc

SEQ ID NO: 6192191 - DNA, 20 bp, Homo sapiens
gaacttatcctaaaacaaat

SEQ ID NO: 6192192 - DNA, 14 bp, Homo sapiens
gaacttcaaaatgt

SEQ ID NO: 6192193 - DNA, 17 bp, Homo sapiens
gaacttcacctgcaaag

SEQ ID NO: 6192194 - DNA, 18 bp, Homo sapiens
gaacttcagaaagacttg

SEQ ID NO: 6192195 - DNA, 17 bp, Homo sapiens
gaacttcagcattgtaa

SEQ ID NO: 6192196 - DNA, 19 bp, Homo sapiens
gaacttcagcattgtaatt

SEQ ID NO: 6192197 - DNA, 23 bp, Homo sapiens
gaacttcaggtgtgactctagca

SEQ ID NO: 6192198 - DNA, 15 bp, Homo sapiens
gaacttcatgggcct

SEQ ID NO: 6192199 - DNA, 22 bp, Homo sapiens
gaacttccagatcctggaaatc

SEQ ID NO: 6192200 - DNA, 13 bp, Homo sapiens
gaacttccctccc

SEQ ID NO: 6192201 - DNA, 23 bp, Homo sapiens
gaacttcgcatcaaaagacaatt

SEQ ID NO: 6192202 - DNA, 14 bp, Homo sapiens
gaacttctaatata

SEQ ID NO: 6192203 - DNA, 15 bp, Homo sapiens
gaacttctaatatat

SEQ ID NO: 6192204 - DNA, 23 bp, Homo sapiens
gaacttctcgtagatgctgccta

SEQ ID NO: 6192205 - DNA, 19 bp, Homo sapiens
gaacttgaaaaaaaaaaac

SEQ ID NO: 6192206 - DNA, 17 bp, Homo sapiens
gaacttgaaagttttct

SEQ ID NO: 6192207 - DNA, 22 bp, Homo sapiens
gaacttgaaatatcctgcttga

SEQ ID NO: 6192208 - DNA, 12 bp, Homo sapiens
gaacttgaacaa

SEQ ID NO: 6192209 - DNA, 13 bp, Homo sapiens
gaacttgaacaaa

SEQ ID NO: 6192210 - DNA, 15 bp, Homo sapiens
gaacttgaactgatt

SEQ ID NO: 6192211 - DNA, 15 bp, Homo sapiens
gaacttgaccctgag

SEQ ID NO: 6192212 - DNA, 15 bp, Homo sapiens
gaacttgaggacaca

SEQ ID NO: 6192213 - DNA, 13 bp, Homo sapiens
gaacttgatggct

SEQ ID NO: 6192214 - DNA, 14 bp, Homo sapiens
gaacttgatgttcc

SEQ ID NO: 6192215 - DNA, 21 bp, Homo sapiens
gaacttgatgttcctgggatg

SEQ ID NO: 6192216 - DNA, 17 bp, Homo sapiens
gaacttgatttgcatgg

SEQ ID NO: 6192217 - DNA, 13 bp, Homo sapiens
gaacttgatttta

SEQ ID NO: 6192218 - DNA, 17 bp, Homo sapiens
gaacttgcctgcctttc

SEQ ID NO: 6192219 - DNA, 12 bp, Homo sapiens
gaacttgctgcc

SEQ ID NO: 6192220 - DNA, 13 bp, Homo sapiens
gaacttgctgcct

SEQ ID NO: 6192221 - DNA, 14 bp, Homo sapiens
gaacttgctgctgc

SEQ ID NO: 6192222 - DNA, 17 bp, Homo sapiens
gaacttgctgctgcctt

SEQ ID NO: 6192223 - DNA, 21 bp, Homo sapiens
gaacttgctgctgccttcaca

SEQ ID NO: 6192224 - DNA, 15 bp, Homo sapiens
gaacttgctgctgtc

SEQ ID NO: 6192225 - DNA, 16 bp, Homo sapiens
gaacttgctgctgtgc

SEQ ID NO: 6192226 - DNA, 19 bp, Homo sapiens
ctgtttcaatgacctgtat

SEQ ID NO: 6192227 - DNA, 17 bp, Homo sapiens
ctgtttcactaatactt

SEQ ID NO: 6192228 - DNA, 19 bp, Homo sapiens
ctgtttcactaatacttac

SEQ ID NO: 6192229 - DNA, 16 bp, Homo sapiens
ctgtttcacttgctct

SEQ ID NO: 6192230 - DNA, 14 bp, Homo sapiens
ctgtttcagaccag

SEQ ID NO: 6192231 - DNA, 21 bp, Homo sapiens
ctgtttcagctaaatgcaggg

SEQ ID NO: 6192232 - DNA, 20 bp, Homo sapiens
ctgtttcatagttttctaaa

SEQ ID NO: 6192233 - DNA, 21 bp, Homo sapiens
ctgtttcatagttttctaaat

SEQ ID NO: 6192234 - DNA, 19 bp, Homo sapiens
ctgtttcatctcagctttt

SEQ ID NO: 6192235 - DNA, 17 bp, Homo sapiens
ctgtttcatgagcccaa

SEQ ID NO: 6192236 - DNA, 21 bp, Homo sapiens
ctgtttcatgggccccttcaa

SEQ ID NO: 6192237 - DNA, 12 bp, Homo sapiens
ctgtttcatttg

SEQ ID NO: 6192238 - DNA, 23 bp, Homo sapiens
ctgtttccaatgccaattcatct

SEQ ID NO: 6192239 - DNA, 13 bp, Homo sapiens
ctgtttccagggt

SEQ ID NO: 6192240 - DNA, 18 bp, Homo sapiens
ctgtttccagttgttact

SEQ ID NO: 6192241 - DNA, 12 bp, Homo sapiens
ctgtttcccagc

SEQ ID NO: 6192242 - DNA, 15 bp, Homo sapiens
ctgtttcccctcaga

SEQ ID NO: 6192243 - DNA, 19 bp, Homo sapiens
ctgtttcccttcccttcca

SEQ ID NO: 6192244 - DNA, 21 bp, Homo sapiens
ctgtttcccttcccttccact

SEQ ID NO: 6192245 - DNA, 15 bp, Homo sapiens
ctgtttcctgaaata

SEQ ID NO: 6192246 - DNA, 14 bp, Homo sapiens
ctgtttcctgacag

SEQ ID NO: 6192247 - DNA, 23 bp, Homo sapiens
ctgtttcctgacagatgcctggt

SEQ ID NO: 6192248 - DNA, 19 bp, Homo sapiens
ctgtttcctgacattgtct

SEQ ID NO: 6192249 - DNA, 14 bp, Homo sapiens
ctgtttcctgctgc

SEQ ID NO: 6192250 - DNA, 15 bp, Homo sapiens
ctgtttcctgctgct

SEQ ID NO: 6192251 - DNA, 20 bp, Homo sapiens
ctgtttcctggcctcagagc

SEQ ID NO: 6192252 - DNA, 18 bp, Homo sapiens
ctgtttcctgtgtctcca

SEQ ID NO: 6192253 - DNA, 15 bp, Homo sapiens
ctgtttcctgttctc

SEQ ID NO: 6192254 - DNA, 20 bp, Homo sapiens
ctgtttcctgttctcttgta

SEQ ID NO: 6192255 - DNA, 13 bp, Homo sapiens
ctgtttcctttta

SEQ ID NO: 6192256 - DNA, 15 bp, Homo sapiens
ctgtttccttttatg

SEQ ID NO: 6192257 - DNA, 20 bp, Homo sapiens
ctgtttcgcatccaccgcca

SEQ ID NO: 6192258 - DNA, 11 bp, Homo sapiens
ctgtttctaag

SEQ ID NO: 6192259 - DNA, 16 bp, Homo sapiens
ctgtttctaggctgtt

SEQ ID NO: 6192260 - DNA, 21 bp, Homo sapiens
ctgtttctatgtccaaacctg

SEQ ID NO: 6192261 - DNA, 20 bp, Homo sapiens
ctgtttctattctctcctca

SEQ ID NO: 6192262 - DNA, 18 bp, Homo sapiens
ctgtttctcagtctcaca

SEQ ID NO: 6192263 - DNA, 22 bp, Homo sapiens
ctgtttctcctccattcatgtt

SEQ ID NO: 6192264 - DNA, 22 bp, Homo sapiens
ctgtttctcgttgtcacaccca

SEQ ID NO: 6192265 - DNA, 17 bp, Homo sapiens
ctgtttctctgctgtca

SEQ ID NO: 6192266 - DNA, 20 bp, Homo sapiens
ctgtttctcttgagctggcc

SEQ ID NO: 6192267 - DNA, 20 bp, Homo sapiens
ctgtttctctttccttggct

SEQ ID NO: 6192268 - DNA, 12 bp, Homo sapiens
ctgtttctgaaa

SEQ ID NO: 6192269 - DNA, 16 bp, Homo sapiens
ctgtttctgaaaagaa

SEQ ID NO: 6192270 - DNA, 16 bp, Homo sapiens
ctgtttctgcttattt

SEQ ID NO: 6192271 - DNA, 15 bp, Homo sapiens
ctgtttctgtagaaa

SEQ ID NO: 6192272 - DNA, 14 bp, Homo sapiens
ctgtttctgtttat

SEQ ID NO: 6192273 - DNA, 18 bp, Homo sapiens
ctgtttcttcctttctgt

SEQ ID NO: 6192274 - DNA, 15 bp, Homo sapiens
ctgtttcttgcttgt

SEQ ID NO: 6192275 - DNA, 17 bp, Homo sapiens
ctgtttcttgtctgtta

SEQ ID NO: 6192276 - DNA, 12 bp, Homo sapiens
ctgtttgaaact

SEQ ID NO: 6192277 - DNA, 14 bp, Homo sapiens
ctgtttgaaagtaa

SEQ ID NO: 6192278 - DNA, 18 bp, Homo sapiens
ctgtttgaaagtaaaaac

SEQ ID NO: 6192279 - DNA, 13 bp, Homo sapiens
ctgtttgaatttt

SEQ ID NO: 6192280 - DNA, 12 bp, Homo sapiens
ctgtttgacaaa

SEQ ID NO: 6192281 - DNA, 16 bp, Homo sapiens
ctgtttgacttctcaa

SEQ ID NO: 6192282 - DNA, 21 bp, Homo sapiens
ctgtttgaggaaagcaagaat

SEQ ID NO: 6192283 - DNA, 23 bp, Homo sapiens
ctgtttgaggatatattttcact

SEQ ID NO: 6192284 - DNA, 10 bp, Homo sapiens
ctgtttgatg

SEQ ID NO: 6192285 - DNA, 20 bp, Homo sapiens
ctgtttgatgctatttatgc

SEQ ID NO: 6192286 - DNA, 12 bp, Homo sapiens
ctgtttgatgta

SEQ ID NO: 6192287 - DNA, 18 bp, Homo sapiens
ctgtttgatgtatgtgtg

SEQ ID NO: 6192288 - DNA, 19 bp, Homo sapiens
ctgtttgatgtatgtgtga

SEQ ID NO: 6192289 - DNA, 20 bp, Homo sapiens
ctgtttgatgtatgtgtgaa

SEQ ID NO: 6192290 - DNA, 21 bp, Homo sapiens
ctgtttgcaatcacacgtggt

SEQ ID NO: 6192291 - DNA, 13 bp, Homo sapiens
ctgtttgcatgag

SEQ ID NO: 6192292 - DNA, 17 bp, Homo sapiens
ctgtttgccaagctgaa

SEQ ID NO: 6192293 - DNA, 15 bp, Homo sapiens
ctgtttgccttggct

SEQ ID NO: 6192294 - DNA, 23 bp, Homo sapiens
ctgtttgctcaaaattgcttcta

SEQ ID NO: 6192295 - DNA, 16 bp, Homo sapiens
ctgtttgctcacccag

SEQ ID NO: 6192296 - DNA, 19 bp, Homo sapiens
ctgtttgctcacccaggac

SEQ ID NO: 6192297 - DNA, 21 bp, Homo sapiens
ctgtttgctcacccaggacct

SEQ ID NO: 6192298 - DNA, 22 bp, Homo sapiens
ctgtttgctcacccaggacctc

SEQ ID NO: 6192299 - DNA, 16 bp, Homo sapiens
ctgtttgctgatggtc

SEQ ID NO: 6192300 - DNA, 11 bp, Homo sapiens
ctgtttggaaa

SEQ ID NO: 6192301 - DNA, 23 bp, Homo sapiens
ctgtttggaaataaatcttccta

SEQ ID NO: 6192302 - DNA, 23 bp, Homo sapiens
ctgtttggaaattgattttgaac

SEQ ID NO: 6192303 - DNA, 12 bp, Homo sapiens
ctgtttggcact

SEQ ID NO: 6192304 - DNA, 13 bp, Homo sapiens
ctgtttggcactt

SEQ ID NO: 6192305 - DNA, 15 bp, Homo sapiens
ctgtttggcacttgt

SEQ ID NO: 6192306 - DNA, 14 bp, Homo sapiens
ctgtttggcctctc

SEQ ID NO: 6192307 - DNA, 22 bp, Homo sapiens
ctgtttggcctttcttggggag

SEQ ID NO: 6192308 - DNA, 15 bp, Homo sapiens
ctgtttggcttataa

SEQ ID NO: 6192309 - DNA, 22 bp, Homo sapiens
ctgtttgggagactgtgctctc

SEQ ID NO: 6192310 - DNA, 20 bp, Homo sapiens
ctgtttgggaggctggagtg

SEQ ID NO: 6192311 - DNA, 21 bp, Homo sapiens
ctgtttgggcaggagtcacca

SEQ ID NO: 6192312 - DNA, 21 bp, Homo sapiens
ctgtttgggttgttggtctgt

SEQ ID NO: 6192313 - DNA, 22 bp, Homo sapiens
ctgtttgggttgttggtctgtg

SEQ ID NO: 6192314 - DNA, 18 bp, Homo sapiens
ctgtttggtcgagtcttt

SEQ ID NO: 6192315 - DNA, 22 bp, Homo sapiens
ctgtttggtcgagtctttgtgt

SEQ ID NO: 6192316 - DNA, 18 bp, Homo sapiens
ctgtttggtgaggacctg

SEQ ID NO: 6192317 - DNA, 23 bp, Homo sapiens
ctgtttggtgaggacctgcggcc

SEQ ID NO: 6192318 - DNA, 22 bp, Homo sapiens
ctgtttggtgtaggtaaatcta

SEQ ID NO: 6192319 - DNA, 21 bp, Homo sapiens
ctgtttggtttgtttataatg

SEQ ID NO: 6192320 - DNA, 12 bp, Homo sapiens
ctgtttgtaaat

SEQ ID NO: 6192321 - DNA, 19 bp, Homo sapiens
ctgtttgtaaattatttgc

SEQ ID NO: 6192322 - DNA, 21 bp, Homo sapiens
ctgtttgtaaattatttgcta

SEQ ID NO: 6192323 - DNA, 22 bp, Homo sapiens
ctgtttgtaaattatttgctaa

SEQ ID NO: 6192324 - DNA, 14 bp, Homo sapiens
ctgtttgtacaaac

SEQ ID NO: 6192325 - DNA, 17 bp, Homo sapiens
ctgtttgtacaaactat

SEQ ID NO: 6192326 - DNA, 20 bp, Homo sapiens
ctgtttgtagccacaagcct

SEQ ID NO: 6192327 - DNA, 17 bp, Homo sapiens
ctgtttgtagtgaaata

SEQ ID NO: 6192328 - DNA, 14 bp, Homo sapiens
ctgtttgtatattt

SEQ ID NO: 6192329 - DNA, 15 bp, Homo sapiens
ctgtttgtatatttg

SEQ ID NO: 6192330 - DNA, 14 bp, Homo sapiens
ctgtttgtgggact

SEQ ID NO: 6192331 - DNA, 18 bp, Homo sapiens
ctgtttgtggggtgacgg

SEQ ID NO: 6192332 - DNA, 13 bp, Homo sapiens
ctgtttgttacta

SEQ ID NO: 6192333 - DNA, 14 bp, Homo sapiens
ctgtttgtttcaag

SEQ ID NO: 6192334 - DNA, 15 bp, Homo sapiens
ctgtttgtttcaaga

SEQ ID NO: 6192335 - DNA, 21 bp, Homo sapiens
ctgtttgtttctgaaagggac

SEQ ID NO: 6192336 - DNA, 19 bp, Homo sapiens
ctgtttgtttggctgtcca

SEQ ID NO: 6192337 - DNA, 20 bp, Homo sapiens
ctgtttgtttggctgtccag

SEQ ID NO: 6192338 - DNA, 23 bp, Homo sapiens
ctgtttgtttttaaaaagcaaat

SEQ ID NO: 6192339 - DNA, 24 bp, Homo sapiens
ctgtttgtttttaaaaagcaaatc

SEQ ID NO: 6192340 - DNA, 24 bp, Homo sapiens
ctgttttaaaaacaaagaaataaa

SEQ ID NO: 6192341 - DNA, 21 bp, Homo sapiens
ctgttttaaaactttaagaaa

SEQ ID NO: 6192342 - DNA, 23 bp, Homo sapiens
ctgttttaaaatgtgaggcaata

SEQ ID NO: 6192343 - DNA, 14 bp, Homo sapiens
ctgttttaaattgc

SEQ ID NO: 6192344 - DNA, 22 bp, Homo sapiens
ctgttttaaatttatttcaaaa

SEQ ID NO: 6192345 - DNA, 15 bp, Homo sapiens
ctgttttaagaaatc

SEQ ID NO: 6192346 - DNA, 22 bp, Homo sapiens
ctgttttaagaaatctggccca

SEQ ID NO: 6192347 - DNA, 14 bp, Homo sapiens
ctgttttaagttct

SEQ ID NO: 6192348 - DNA, 22 bp, Homo sapiens
ctgttttacaaaaaagaaaaga

SEQ ID NO: 6192349 - DNA, 14 bp, Homo sapiens
ctgttttacaagtt

SEQ ID NO: 6192350 - DNA, 16 bp, Homo sapiens
ctgttttacagctgcc

SEQ ID NO: 6192351 - DNA, 13 bp, Homo sapiens
ctgttttactgct

SEQ ID NO: 6192352 - DNA, 15 bp, Homo sapiens
ctgttttactgcttt

SEQ ID NO: 6192353 - DNA, 14 bp, Homo sapiens
ctgttttactgttt

SEQ ID NO: 6192354 - DNA, 15 bp, Homo sapiens
ctgttttagctgagg

SEQ ID NO: 6192355 - DNA, 16 bp, Homo sapiens
ctgttttagtgccagg

SEQ ID NO: 6192356 - DNA, 17 bp, Homo sapiens
ctgttttagtgccaggc

SEQ ID NO: 6192357 - DNA, 15 bp, Homo sapiens
ctgttttagtttctg

SEQ ID NO: 6192358 - DNA, 16 bp, Homo sapiens
ctgttttagtttctga

SEQ ID NO: 6192359 - DNA, 14 bp, Homo sapiens
ctgttttatactgt

SEQ ID NO: 6192360 - DNA, 20 bp, Homo sapiens
ctgttttatctccatacttt

SEQ ID NO: 6192361 - DNA, 22 bp, Homo sapiens
ctgttttatctccatactttgg

SEQ ID NO: 6192362 - DNA, 13 bp, Homo sapiens
ctgttttatgact

SEQ ID NO: 6192363 - DNA, 17 bp, Homo sapiens
ctgttttatgttgatct

SEQ ID NO: 6192364 - DNA, 21 bp, Homo sapiens
ctgttttattttaattcagtt

SEQ ID NO: 6192365 - DNA, 13 bp, Homo sapiens
ctgttttcaataa

SEQ ID NO: 6192366 - DNA, 15 bp, Homo sapiens
ctgttttcaataaca

SEQ ID NO: 6192367 - DNA, 21 bp, Homo sapiens
ctgttttcaataacaaagcac

SEQ ID NO: 6192368 - DNA, 16 bp, Homo sapiens
ctgttttcccacgagg

SEQ ID NO: 6192369 - DNA, 13 bp, Homo sapiens
ctgttttccccca

SEQ ID NO: 6192370 - DNA, 17 bp, Homo sapiens
ctgttttcccccagcaa

SEQ ID NO: 6192371 - DNA, 17 bp, Homo sapiens
ctgttttccctctgctg

SEQ ID NO: 6192372 - DNA, 16 bp, Homo sapiens
ctgttttcctcccttc

SEQ ID NO: 6192373 - DNA, 13 bp, Homo sapiens
ctgttttccttct

SEQ ID NO: 6192374 - DNA, 14 bp, Homo sapiens
ctgttttccttctt

SEQ ID NO: 6192375 - DNA, 19 bp, Homo sapiens
ctgttttcgtaccttccca

SEQ ID NO: 6192376 - DNA, 20 bp, Homo sapiens
ctgttttcgtaccttcccac

SEQ ID NO: 6192377 - DNA, 20 bp, Homo sapiens
ctgttttctagtgtatcaaa

SEQ ID NO: 6192378 - DNA, 21 bp, Homo sapiens
ctgttttctctcggctcccca

SEQ ID NO: 6192379 - DNA, 15 bp, Homo sapiens
ctgttttctctctgt

SEQ ID NO: 6192380 - DNA, 13 bp, Homo sapiens
ctgttttctcttg

SEQ ID NO: 6192381 - DNA, 12 bp, Homo sapiens
ctgttttctgaa

SEQ ID NO: 6192382 - DNA, 13 bp, Homo sapiens
ctgttttctgaaa

SEQ ID NO: 6192383 - DNA, 15 bp, Homo sapiens
ctgttttctgaaaca

SEQ ID NO: 6192384 - DNA, 13 bp, Homo sapiens
ctgttttctgagc

SEQ ID NO: 6192385 - DNA, 17 bp, Homo sapiens
ctgttttctgagcccgg

SEQ ID NO: 6192386 - DNA, 13 bp, Homo sapiens
ctgttttctgctg

SEQ ID NO: 6192387 - DNA, 11 bp, Homo sapiens
ctgttttctgg

SEQ ID NO: 6192388 - DNA, 13 bp, Homo sapiens
ctgttttctgtaa

SEQ ID NO: 6192389 - DNA, 19 bp, Homo sapiens
ctgttttctgtaaattcat

SEQ ID NO: 6192390 - DNA, 14 bp, Homo sapiens
ctgttttctgtttc

SEQ ID NO: 6192391 - DNA, 19 bp, Homo sapiens
ctgttttctgtttgtaaat

SEQ ID NO: 6192392 - DNA, 14 bp, Homo sapiens
ctgttttcttaggc

SEQ ID NO: 6192393 - DNA, 12 bp, Homo sapiens
ctgttttcttct

SEQ ID NO: 6192394 - DNA, 14 bp, Homo sapiens
ctgttttgaaaagt

SEQ ID NO: 6192395 - DNA, 18 bp, Homo sapiens
ctgttttgaagctgggct

SEQ ID NO: 6192396 - DNA, 14 bp, Homo sapiens
ctgttttgaggaat

SEQ ID NO: 6192397 - DNA, 19 bp, Homo sapiens
ctgttttgagttttgtagc

SEQ ID NO: 6192398 - DNA, 23 bp, Homo sapiens
ctgttttgagttttgtagcagtg

SEQ ID NO: 6192399 - DNA, 14 bp, Homo sapiens
ctgttttgcttttg

SEQ ID NO: 6192400 - DNA, 13 bp, Homo sapiens
ctgttttggatga

SEQ ID NO: 6192401 - DNA, 16 bp, Homo sapiens
ctgttttggatgaatg

SEQ ID NO: 6192402 - DNA, 18 bp, Homo sapiens
ctgttttggatgaatgca

SEQ ID NO: 6192403 - DNA, 17 bp, Homo sapiens
ctgttttggatgttgct

SEQ ID NO: 6192404 - DNA, 18 bp, Homo sapiens
ctgttttggatgttgcta

SEQ ID NO: 6192405 - DNA, 20 bp, Homo sapiens
ctgttttggatgttgctata

SEQ ID NO: 6192406 - DNA, 23 bp, Homo sapiens
gaacttgctgggtggttctctgg

SEQ ID NO: 6192407 - DNA, 19 bp, Homo sapiens
gaacttggaaagaaatgcc

SEQ ID NO: 6192408 - DNA, 13 bp, Homo sapiens
gaacttggcgctg

SEQ ID NO: 6192409 - DNA, 13 bp, Homo sapiens
gaacttgggaggg

SEQ ID NO: 6192410 - DNA, 17 bp, Homo sapiens
gaacttggggaacaagg

SEQ ID NO: 6192411 - DNA, 22 bp, Homo sapiens
gaacttggggagttaagacctg

SEQ ID NO: 6192412 - DNA, 16 bp, Homo sapiens
gaacttggtagttcat

SEQ ID NO: 6192413 - DNA, 15 bp, Homo sapiens
gaacttgtagccaga

SEQ ID NO: 6192414 - DNA, 17 bp, Homo sapiens
gaacttgtagctgtaaa

SEQ ID NO: 6192415 - DNA, 22 bp, Homo sapiens
gaacttgtctggctttggcact

SEQ ID NO: 6192416 - DNA, 21 bp, Homo sapiens
gaacttgttaacctttctaac

SEQ ID NO: 6192417 - DNA, 22 bp, Homo sapiens
gaacttgttacttgcagcattc

SEQ ID NO: 6192418 - DNA, 16 bp, Homo sapiens
gaacttgttgctgatt

SEQ ID NO: 6192419 - DNA, 20 bp, Homo sapiens
gaactttagtgaaacataat

SEQ ID NO: 6192420 - DNA, 22 bp, Homo sapiens
gaactttagtttgcctgcagtt

SEQ ID NO: 6192421 - DNA, 22 bp, Homo sapiens
gaactttattttggattgtgga

SEQ ID NO: 6192422 - DNA, 12 bp, Homo sapiens
gaactttcattt

SEQ ID NO: 6192423 - DNA, 18 bp, Homo sapiens
gaactttcggagcctgcc

SEQ ID NO: 6192424 - DNA, 20 bp, Homo sapiens
gaactttcggagcctgcctc

SEQ ID NO: 6192425 - DNA, 23 bp, Homo sapiens
gaactttctcttcatactttttt

SEQ ID NO: 6192426 - DNA, 14 bp, Homo sapiens
gaactttctgcttt

SEQ ID NO: 6192427 - DNA, 21 bp, Homo sapiens
gaactttctgttccctatgga

SEQ ID NO: 6192428 - DNA, 14 bp, Homo sapiens
gaactttgaaggac

SEQ ID NO: 6192429 - DNA, 18 bp, Homo sapiens
gaactttgcacacttcaa

SEQ ID NO: 6192430 - DNA, 16 bp, Homo sapiens
gaactttgcagcatac

SEQ ID NO: 6192431 - DNA, 16 bp, Homo sapiens
gaactttgccaaaaaa

SEQ ID NO: 6192432 - DNA, 17 bp, Homo sapiens
gaactttgccttaagtt

SEQ ID NO: 6192433 - DNA, 11 bp, Homo sapiens
gaactttggga

SEQ ID NO: 6192434 - DNA, 16 bp, Homo sapiens
gaactttgtcagtgtt

SEQ ID NO: 6192435 - DNA, 18 bp, Homo sapiens
gaactttgtgccagcgct

SEQ ID NO: 6192436 - DNA, 18 bp, Homo sapiens
gaactttgtttccagaaa

SEQ ID NO: 6192437 - DNA, 17 bp, Homo sapiens
gaacttttaaactgcag

SEQ ID NO: 6192438 - DNA, 20 bp, Homo sapiens
gaacttttaaactgcagttt

SEQ ID NO: 6192439 - DNA, 19 bp, Homo sapiens
gaacttttacagaatgcat

SEQ ID NO: 6192440 - DNA, 20 bp, Homo sapiens
gaacttttacagaatgcatt

SEQ ID NO: 6192441 - DNA, 20 bp, Homo sapiens
gaacttttgtaatttgaatt

SEQ ID NO: 6192442 - DNA, 21 bp, Homo sapiens
gaacttttgtactgaattttt

SEQ ID NO: 6192443 - DNA, 15 bp, Homo sapiens
gaactttttaaagaa

SEQ ID NO: 6192444 - DNA, 16 bp, Homo sapiens
gaactttttattgatt

SEQ ID NO: 6192445 - DNA, 15 bp, Homo sapiens
gaactttttcttttc

SEQ ID NO: 6192446 - DNA, 18 bp, Homo sapiens
gaacttttttaaataaac

SEQ ID NO: 6192447 - DNA, 21 bp, Homo sapiens
gaacttttttaaataaacttt

SEQ ID NO: 6192448 - DNA, 22 bp, Homo sapiens
gaacttttttaaataaactttt

SEQ ID NO: 6192449 - DNA, 11 bp, Homo sapiens
gaagaaaaaaa

SEQ ID NO: 6192450 - DNA, 18 bp, Homo sapiens
gaagaaaaaaaataacac

SEQ ID NO: 6192451 - DNA, 15 bp, Homo sapiens
gaagaaaaaactgaa

SEQ ID NO: 6192452 - DNA, 13 bp, Homo sapiens
gaagaaaaaatac

SEQ ID NO: 6192453 - DNA, 13 bp, Homo sapiens
gaagaaaaaattt

SEQ ID NO: 6192454 - DNA, 13 bp, Homo sapiens
gaagaaaaactca

SEQ ID NO: 6192455 - DNA, 14 bp, Homo sapiens
gaagaaaaagaagc

SEQ ID NO: 6192456 - DNA, 18 bp, Homo sapiens
gaagaaaaaggaaacaag

SEQ ID NO: 6192457 - DNA, 14 bp, Homo sapiens
gaagaaaaatgttt

SEQ ID NO: 6192458 - DNA, 13 bp, Homo sapiens
gaagaaaacacaa

SEQ ID NO: 6192459 - DNA, 18 bp, Homo sapiens
gaagaaaacactgttatc

SEQ ID NO: 6192460 - DNA, 19 bp, Homo sapiens
gaagaaaacactgttatca

SEQ ID NO: 6192461 - DNA, 18 bp, Homo sapiens
gaagaaaacatatatttt

SEQ ID NO: 6192462 - DNA, 15 bp, Homo sapiens
gaagaaaacccgagg

SEQ ID NO: 6192463 - DNA, 13 bp, Homo sapiens
gaagaaaacctgt

SEQ ID NO: 6192464 - DNA, 15 bp, Homo sapiens
gaagaaaacttttgt

SEQ ID NO: 6192465 - DNA, 9 bp, Homo sapiens
gaagaaaag

SEQ ID NO: 6192466 - DNA, 17 bp, Homo sapiens
gaagaaaagcactggga

SEQ ID NO: 6192467 - DNA, 21 bp, Homo sapiens
gaagaaaaggggagcacaagg

SEQ ID NO: 6192468 - DNA, 15 bp, Homo sapiens
gaagaaaaggtacat

SEQ ID NO: 6192469 - DNA, 13 bp, Homo sapiens
gaagaaaatactt

SEQ ID NO: 6192470 - DNA, 19 bp, Homo sapiens
gaagaaaatacttaaatgt

SEQ ID NO: 6192471 - DNA, 15 bp, Homo sapiens
gaagaaaatagaatt

SEQ ID NO: 6192472 - DNA, 15 bp, Homo sapiens
gaagaaaatggaatt

SEQ ID NO: 6192473 - DNA, 22 bp, Homo sapiens
gaagaaaattggactggtgaaa

SEQ ID NO: 6192474 - DNA, 12 bp, Homo sapiens
gaagaaaatttg

SEQ ID NO: 6192475 - DNA, 20 bp, Homo sapiens
gaagaaacaaggttttcagt

SEQ ID NO: 6192476 - DNA, 18 bp, Homo sapiens
gaagaaacacagcatgca

SEQ ID NO: 6192477 - DNA, 19 bp, Homo sapiens
gaagaaacacagcatgcat

SEQ ID NO: 6192478 - DNA, 15 bp, Homo sapiens
gaagaaacagatctc

SEQ ID NO: 6192479 - DNA, 15 bp, Homo sapiens
gaagaaaccccaagc

SEQ ID NO: 6192480 - DNA, 19 bp, Homo sapiens
gaagaaaccccaagcagca

SEQ ID NO: 6192481 - DNA, 17 bp, Homo sapiens
gaagaaactcagattta

SEQ ID NO: 6192482 - DNA, 15 bp, Homo sapiens
gaagaaactcctgga

SEQ ID NO: 6192483 - DNA, 18 bp, Homo sapiens
gaagaaactttctggtgc

SEQ ID NO: 6192484 - DNA, 16 bp, Homo sapiens
gaagaaagaacggaag

SEQ ID NO: 6192485 - DNA, 14 bp, Homo sapiens
gaagaaagaagaca

SEQ ID NO: 6192486 - DNA, 17 bp, Homo sapiens
gaagaaagaagcactct

SEQ ID NO: 6192487 - DNA, 17 bp, Homo sapiens
gaagaaagaggtgaccc

SEQ ID NO: 6192488 - DNA, 22 bp, Homo sapiens
gaagaaagatttaaagtatttt

SEQ ID NO: 6192489 - DNA, 19 bp, Homo sapiens
gaagaaagcaaaaaataaa

SEQ ID NO: 6192490 - DNA, 13 bp, Homo sapiens
gaagaaagccaga

SEQ ID NO: 6192491 - DNA, 12 bp, Homo sapiens
gaagaaagcctg

SEQ ID NO: 6192492 - DNA, 18 bp, Homo sapiens
gaagaaaggccatcagag

SEQ ID NO: 6192493 - DNA, 21 bp, Homo sapiens
gaagaaagggtgtttttctgt

SEQ ID NO: 6192494 - DNA, 16 bp, Homo sapiens
gaagaaagtgttcaaa

SEQ ID NO: 6192495 - DNA, 14 bp, Homo sapiens
gaagaaataaatga

SEQ ID NO: 6192496 - DNA, 17 bp, Homo sapiens
gaagaaatactgcactt

SEQ ID NO: 6192497 - DNA, 16 bp, Homo sapiens
gaagaaatagcagagc

SEQ ID NO: 6192498 - DNA, 20 bp, Homo sapiens
gaagaaatatgaaattccag

SEQ ID NO: 6192499 - DNA, 14 bp, Homo sapiens
gaagaaatatgagc

SEQ ID NO: 6192500 - DNA, 21 bp, Homo sapiens
gaagaaatccataacaccccc

SEQ ID NO: 6192501 - DNA, 13 bp, Homo sapiens
gaagaaatgaaat

SEQ ID NO: 6192502 - DNA, 17 bp, Homo sapiens
gaagaaatgacattttg

SEQ ID NO: 6192503 - DNA, 20 bp, Homo sapiens
gaagaaattcaggtacagaa

SEQ ID NO: 6192504 - DNA, 14 bp, Homo sapiens
gaagaaattcctgt

SEQ ID NO: 6192505 - DNA, 15 bp, Homo sapiens
gaagaacaaaaggct

SEQ ID NO: 6192506 - DNA, 13 bp, Homo sapiens
gaagaacacagca

SEQ ID NO: 6192507 - DNA, 21 bp, Homo sapiens
gaagaacacagcatgtgccaa

SEQ ID NO: 6192508 - DNA, 18 bp, Homo sapiens
gaagaacaccctctaaat

SEQ ID NO: 6192509 - DNA, 13 bp, Homo sapiens
gaagaacagcaga

SEQ ID NO: 6192510 - DNA, 16 bp, Homo sapiens
gaagaacagccccggg

SEQ ID NO: 6192511 - DNA, 20 bp, Homo sapiens
gaagaacagctgttcctgtg

SEQ ID NO: 6192512 - DNA, 19 bp, Homo sapiens
gaagaacaggcctctccat

SEQ ID NO: 6192513 - DNA, 22 bp, Homo sapiens
gaagaacatctttatggtaaag

SEQ ID NO: 6192514 - DNA, 19 bp, Homo sapiens
gaagaacatgattttacaa

SEQ ID NO: 6192515 - DNA, 13 bp, Homo sapiens
gaagaaccagccc

SEQ ID NO: 6192516 - DNA, 15 bp, Homo sapiens
gaagaaccagcccag

SEQ ID NO: 6192517 - DNA, 17 bp, Homo sapiens
gaagaaccagcccagcc

SEQ ID NO: 6192518 - DNA, 18 bp, Homo sapiens
gaagaaccagcccagcct

SEQ ID NO: 6192519 - DNA, 19 bp, Homo sapiens
gaagaaccagcccagcctg

SEQ ID NO: 6192520 - DNA, 13 bp, Homo sapiens
gaagaaccaggca

SEQ ID NO: 6192521 - DNA, 22 bp, Homo sapiens
gaagaaccagtccccccaccct

SEQ ID NO: 6192522 - DNA, 16 bp, Homo sapiens
gaagaaccgcattttg

SEQ ID NO: 6192523 - DNA, 22 bp, Homo sapiens
gaagaacctgtagaagatgacc

SEQ ID NO: 6192524 - DNA, 13 bp, Homo sapiens
gaagaacggggct

SEQ ID NO: 6192525 - DNA, 20 bp, Homo sapiens
gaagaacggggctcttctca

SEQ ID NO: 6192526 - DNA, 22 bp, Homo sapiens
gaagaacggggctcttctcatt

SEQ ID NO: 6192527 - DNA, 23 bp, Homo sapiens
gaagaacggggctcttctcattt

SEQ ID NO: 6192528 - DNA, 13 bp, Homo sapiens
gaagaactaataa

SEQ ID NO: 6192529 - DNA, 18 bp, Homo sapiens
gaagaactagtagaagaa

SEQ ID NO: 6192530 - DNA, 19 bp, Homo sapiens
gaagaactgcaggccctgg

SEQ ID NO: 6192531 - DNA, 18 bp, Homo sapiens
gaagaactgcatggggag

SEQ ID NO: 6192532 - DNA, 21 bp, Homo sapiens
gaagaactttgccttaagttt

SEQ ID NO: 6192533 - DNA, 14 bp, Homo sapiens
gaagaagaaaagag

SEQ ID NO: 6192534 - DNA, 17 bp, Homo sapiens
gaagaagaaatctttct

SEQ ID NO: 6192535 - DNA, 20 bp, Homo sapiens
gaagaagaaccaggcatgga

SEQ ID NO: 6192536 - DNA, 19 bp, Homo sapiens
gaagaagagaagctgctga

SEQ ID NO: 6192537 - DNA, 20 bp, Homo sapiens
gaagaagaggcctagcctga

SEQ ID NO: 6192538 - DNA, 14 bp, Homo sapiens
gaagaagagggaga

SEQ ID NO: 6192539 - DNA, 13 bp, Homo sapiens
gaagaagcagaga

SEQ ID NO: 6192540 - DNA, 15 bp, Homo sapiens
gaagaagcagagaga

SEQ ID NO: 6192541 - DNA, 21 bp, Homo sapiens
gaagaagccatcaattttaac

SEQ ID NO: 6192542 - DNA, 13 bp, Homo sapiens
gaagaagccctgt

SEQ ID NO: 6192543 - DNA, 14 bp, Homo sapiens
gaagaagctggcta

SEQ ID NO: 6192544 - DNA, 11 bp, Homo sapiens
gaagaaggaaa

SEQ ID NO: 6192545 - DNA, 17 bp, Homo sapiens
gaagaaggaaacggaag

SEQ ID NO: 6192546 - DNA, 17 bp, Homo sapiens
gaagaaggactgaagaa

SEQ ID NO: 6192547 - DNA, 23 bp, Homo sapiens
gaagaaggagcagaataaatgtt

SEQ ID NO: 6192548 - DNA, 20 bp, Homo sapiens
gaagaaggagctcaactaaa

SEQ ID NO: 6192549 - DNA, 23 bp, Homo sapiens
gaagaaggaggaatgctggactg

SEQ ID NO: 6192550 - DNA, 12 bp, Homo sapiens
gaagaaggcaag

SEQ ID NO: 6192551 - DNA, 15 bp, Homo sapiens
gaagaaggcaaggct

SEQ ID NO: 6192552 - DNA, 18 bp, Homo sapiens
gaagaaggcccgggagga

SEQ ID NO: 6192553 - DNA, 14 bp, Homo sapiens
gaagaagggaagcc

SEQ ID NO: 6192554 - DNA, 15 bp, Homo sapiens
gaagaagggaagcct

SEQ ID NO: 6192555 - DNA, 22 bp, Homo sapiens
gaagaagggaagccttttgcaa

SEQ ID NO: 6192556 - DNA, 23 bp, Homo sapiens
gaagaagggaagccttttgcaaa

SEQ ID NO: 6192557 - DNA, 17 bp, Homo sapiens
gaagaagggagaagaaa

SEQ ID NO: 6192558 - DNA, 18 bp, Homo sapiens
gaagaagggagaagaaag

SEQ ID NO: 6192559 - DNA, 18 bp, Homo sapiens
gaagaagggccaccctga

SEQ ID NO: 6192560 - DNA, 15 bp, Homo sapiens
gaagaaggggccatc

SEQ ID NO: 6192561 - DNA, 16 bp, Homo sapiens
gaagaaggtgggagga

SEQ ID NO: 6192562 - DNA, 21 bp, Homo sapiens
gaagaagtcactgaacaaaac

SEQ ID NO: 6192563 - DNA, 16 bp, Homo sapiens
gaagaagtgggagcag

SEQ ID NO: 6192564 - DNA, 17 bp, Homo sapiens
gaagaagtgggagcagc

SEQ ID NO: 6192565 - DNA, 18 bp, Homo sapiens
gaagaagtgggagcagct

SEQ ID NO: 6192566 - DNA, 20 bp, Homo sapiens
gaagaagtgggagcagcttc

SEQ ID NO: 6192567 - DNA, 21 bp, Homo sapiens
gaagaagtgggagcagcttct

SEQ ID NO: 6192568 - DNA, 14 bp, Homo sapiens
gaagaagtggtact

SEQ ID NO: 6192569 - DNA, 21 bp, Homo sapiens
gaagaagtggtactagtgtgg

SEQ ID NO: 6192570 - DNA, 12 bp, Homo sapiens
gaagaagttttt

SEQ ID NO: 6192571 - DNA, 17 bp, Homo sapiens
gaagaataaaaaagaag

SEQ ID NO: 6192572 - DNA, 18 bp, Homo sapiens
gaagaatacaaacatatt

SEQ ID NO: 6192573 - DNA, 19 bp, Homo sapiens
gaagaatacaaacatattt

SEQ ID NO: 6192574 - DNA, 14 bp, Homo sapiens
gaagaatacatcag

SEQ ID NO: 6192575 - DNA, 18 bp, Homo sapiens
gaagaatacccaggaaga

SEQ ID NO: 6192576 - DNA, 23 bp, Homo sapiens
gaagaatagcctattgtctttca

SEQ ID NO: 6192577 - DNA, 13 bp, Homo sapiens
gaagaatattcta

SEQ ID NO: 6192578 - DNA, 13 bp, Homo sapiens
gaagaatattgtt

SEQ ID NO: 6192579 - DNA, 20 bp, Homo sapiens
gaagaatattgttcctaagt

SEQ ID NO: 6192580 - DNA, 17 bp, Homo sapiens
gaagaatccacaaggac

SEQ ID NO: 6192581 - DNA, 17 bp, Homo sapiens
gaagaatccagtattat

SEQ ID NO: 6192582 - DNA, 19 bp, Homo sapiens
gaagaatccttttgtagaa

SEQ ID NO: 6192583 - DNA, 15 bp, Homo sapiens
gaagaatctgcccct

SEQ ID NO: 6192584 - DNA, 20 bp, Homo sapiens
gaagaatctgtttcccagca

SEQ ID NO: 6192585 - DNA, 13 bp, Homo sapiens
gaagaatcttcct

SEQ ID NO: 6192586 - DNA, 14 bp, Homo sapiens
ctgttttgggcctc

SEQ ID NO: 6192587 - DNA, 16 bp, Homo sapiens
ctgttttgggcctcca

SEQ ID NO: 6192588 - DNA, 17 bp, Homo sapiens
ctgttttgggcctccat

SEQ ID NO: 6192589 - DNA, 23 bp, Homo sapiens
ctgttttggggctttcccaggag

SEQ ID NO: 6192590 - DNA, 14 bp, Homo sapiens
ctgttttggtcccc

SEQ ID NO: 6192591 - DNA, 22 bp, Homo sapiens
ctgttttggtcccctccctcgt

SEQ ID NO: 6192592 - DNA, 19 bp, Homo sapiens
ctgttttgtatatgatcta

SEQ ID NO: 6192593 - DNA, 23 bp, Homo sapiens
ctgttttgtcctttgagaaagaa

SEQ ID NO: 6192594 - DNA, 15 bp, Homo sapiens
ctgttttgtgagaac

SEQ ID NO: 6192595 - DNA, 20 bp, Homo sapiens
ctgttttgtggtttggaata

SEQ ID NO: 6192596 - DNA, 12 bp, Homo sapiens
ctgttttgtgta

SEQ ID NO: 6192597 - DNA, 17 bp, Homo sapiens
ctgttttgtgtatattg

SEQ ID NO: 6192598 - DNA, 16 bp, Homo sapiens
ctgttttgtgtctggt

SEQ ID NO: 6192599 - DNA, 18 bp, Homo sapiens
ctgttttgtgtctggtgc

SEQ ID NO: 6192600 - DNA, 15 bp, Homo sapiens
ctgttttgttaatat

SEQ ID NO: 6192601 - DNA, 14 bp, Homo sapiens
ctgttttgttgaca

SEQ ID NO: 6192602 - DNA, 16 bp, Homo sapiens
ctgttttgttgacatt

SEQ ID NO: 6192603 - DNA, 21 bp, Homo sapiens
ctgttttgtttggcaaggaaa

SEQ ID NO: 6192604 - DNA, 22 bp, Homo sapiens
ctgttttgttttgttttttaaa

SEQ ID NO: 6192605 - DNA, 16 bp, Homo sapiens
ctgtttttaaaaatta

SEQ ID NO: 6192606 - DNA, 13 bp, Homo sapiens
ctgtttttaacat

SEQ ID NO: 6192607 - DNA, 16 bp, Homo sapiens
ctgtttttaagctgtt

SEQ ID NO: 6192608 - DNA, 17 bp, Homo sapiens
ctgtttttaagctgttt

SEQ ID NO: 6192609 - DNA, 23 bp, Homo sapiens
ctgtttttaagctgtttccatag

SEQ ID NO: 6192610 - DNA, 15 bp, Homo sapiens
ctgtttttacccata

SEQ ID NO: 6192611 - DNA, 22 bp, Homo sapiens
ctgtttttacccatatcccctc

SEQ ID NO: 6192612 - DNA, 21 bp, Homo sapiens
ctgtttttagagcttccaaat

SEQ ID NO: 6192613 - DNA, 14 bp, Homo sapiens
ctgtttttagtgct

SEQ ID NO: 6192614 - DNA, 16 bp, Homo sapiens
ctgtttttagtgctga

SEQ ID NO: 6192615 - DNA, 19 bp, Homo sapiens
ctgtttttattccttccat

SEQ ID NO: 6192616 - DNA, 15 bp, Homo sapiens
ctgtttttcacattt

SEQ ID NO: 6192617 - DNA, 17 bp, Homo sapiens
ctgtttttcagggaggt

SEQ ID NO: 6192618 - DNA, 21 bp, Homo sapiens
ctgtttttcagggaggtggct

SEQ ID NO: 6192619 - DNA, 13 bp, Homo sapiens
ctgtttttccggt

SEQ ID NO: 6192620 - DNA, 18 bp, Homo sapiens
ctgtttttcctatttggt

SEQ ID NO: 6192621 - DNA, 17 bp, Homo sapiens
ctgtttttcggacagtt

SEQ ID NO: 6192622 - DNA, 22 bp, Homo sapiens
ctgtttttcggacagtttattt

SEQ ID NO: 6192623 - DNA, 13 bp, Homo sapiens
ctgtttttctcaa

SEQ ID NO: 6192624 - DNA, 21 bp, Homo sapiens
ctgtttttctctaatgcttga

SEQ ID NO: 6192625 - DNA, 23 bp, Homo sapiens
ctgtttttctctaatgcttgatt

SEQ ID NO: 6192626 - DNA, 15 bp, Homo sapiens
ctgtttttctgggtg

SEQ ID NO: 6192627 - DNA, 17 bp, Homo sapiens
ctgtttttcttctgaaa

SEQ ID NO: 6192628 - DNA, 14 bp, Homo sapiens
ctgtttttcttgtc

SEQ ID NO: 6192629 - DNA, 14 bp, Homo sapiens
ctgtttttgctatt

SEQ ID NO: 6192630 - DNA, 12 bp, Homo sapiens
ctgtttttgtat

SEQ ID NO: 6192631 - DNA, 21 bp, Homo sapiens
ctgttttttaaaacctgcgac

SEQ ID NO: 6192632 - DNA, 19 bp, Homo sapiens
ctgttttttaaactaggaa

SEQ ID NO: 6192633 - DNA, 17 bp, Homo sapiens
ctgttttttcctgagct

SEQ ID NO: 6192634 - DNA, 18 bp, Homo sapiens
ctgttttttggcttgctt

SEQ ID NO: 6192635 - DNA, 14 bp, Homo sapiens
ctgtttttttccca

SEQ ID NO: 6192636 - DNA, 17 bp, Homo sapiens
ctgttttttttgcaggg

SEQ ID NO: 6192637 - DNA, 16 bp, Homo sapiens
ctgtttttttttcatt

SEQ ID NO: 6192638 - DNA, 22 bp, Homo sapiens
ctgtttttttttttttaaataa

SEQ ID NO: 6192639 - DNA, 22 bp, Homo sapiens
cttaaaaaaaaaaaaaagcttt

SEQ ID NO: 6192640 - DNA, 19 bp, Homo sapiens
cttaaaaaaaactctttaa

SEQ ID NO: 6192641 - DNA, 21 bp, Homo sapiens
cttaaaaaaacacggaagcac

SEQ ID NO: 6192642 - DNA, 21 bp, Homo sapiens
cttaaaaaaataaaatatttt

SEQ ID NO: 6192643 - DNA, 14 bp, Homo sapiens
cttaaaaaactgca

SEQ ID NO: 6192644 - DNA, 12 bp, Homo sapiens
cttaaaaaactt

SEQ ID NO: 6192645 - DNA, 16 bp, Homo sapiens
cttaaaaaataataca

SEQ ID NO: 6192646 - DNA, 15 bp, Homo sapiens
cttaaaaaattgaaa

SEQ ID NO: 6192647 - DNA, 12 bp, Homo sapiens
cttaaaaacaac

SEQ ID NO: 6192648 - DNA, 15 bp, Homo sapiens
cttaaaaactgaaaa

SEQ ID NO: 6192649 - DNA, 12 bp, Homo sapiens
cttaaaaactgt

SEQ ID NO: 6192650 - DNA, 15 bp, Homo sapiens
cttaaaaactgtgta

SEQ ID NO: 6192651 - DNA, 20 bp, Homo sapiens
cttaaaaactgtgtatcatt

SEQ ID NO: 6192652 - DNA, 21 bp, Homo sapiens
cttaaaaactgtgtatcatta

SEQ ID NO: 6192653 - DNA, 14 bp, Homo sapiens
cttaaaaagacact

SEQ ID NO: 6192654 - DNA, 19 bp, Homo sapiens
cttaaaaagaccatgcatt

SEQ ID NO: 6192655 - DNA, 19 bp, Homo sapiens
cttaaaaagcatcattaca

SEQ ID NO: 6192656 - DNA, 13 bp, Homo sapiens
cttaaaaaggaac

SEQ ID NO: 6192657 - DNA, 14 bp, Homo sapiens
cttaaaaagtaact

SEQ ID NO: 6192658 - DNA, 16 bp, Homo sapiens
cttaaaaagtaattgt

SEQ ID NO: 6192659 - DNA, 20 bp, Homo sapiens
cttaaaaatacttaataaat

SEQ ID NO: 6192660 - DNA, 17 bp, Homo sapiens
cttaaaaatatatttcc

SEQ ID NO: 6192661 - DNA, 15 bp, Homo sapiens
cttaaaaatatgtga

SEQ ID NO: 6192662 - DNA, 13 bp, Homo sapiens
cttaaaaatcaca

SEQ ID NO: 6192663 - DNA, 21 bp, Homo sapiens
cttaaaaatcacactgtaaat

SEQ ID NO: 6192664 - DNA, 12 bp, Homo sapiens
cttaaaaatgca

SEQ ID NO: 6192665 - DNA, 14 bp, Homo sapiens
cttaaaaatgcatt

SEQ ID NO: 6192666 - DNA, 18 bp, Homo sapiens
cttaaaaatgcatttaag

SEQ ID NO: 6192667 - DNA, 23 bp, Homo sapiens
cttaaaaatgcatttaagttgta

SEQ ID NO: 6192668 - DNA, 20 bp, Homo sapiens
cttaaaaatgccaaaaacaa

SEQ ID NO: 6192669 - DNA, 13 bp, Homo sapiens
cttaaaaatggtt

SEQ ID NO: 6192670 - DNA, 21 bp, Homo sapiens
cttaaaaatggtttaaatggt

SEQ ID NO: 6192671 - DNA, 18 bp, Homo sapiens
cttaaaaatgtaaatatt

SEQ ID NO: 6192672 - DNA, 22 bp, Homo sapiens
cttaaaaatgttttttcatgtg

SEQ ID NO: 6192673 - DNA, 21 bp, Homo sapiens
cttaaaaattaaattggaaag

SEQ ID NO: 6192674 - DNA, 20 bp, Homo sapiens
cttaaaaattaatagtttta

SEQ ID NO: 6192675 - DNA, 12 bp, Homo sapiens
cttaaaaattta

SEQ ID NO: 6192676 - DNA, 15 bp, Homo sapiens
cttaaaaatttatta

SEQ ID NO: 6192677 - DNA, 16 bp, Homo sapiens
cttaaaacaaaaggaa

SEQ ID NO: 6192678 - DNA, 22 bp, Homo sapiens
cttaaaacaaaaggaaagaaac

SEQ ID NO: 6192679 - DNA, 12 bp, Homo sapiens
cttaaaacaagg

SEQ ID NO: 6192680 - DNA, 20 bp, Homo sapiens
cttaaaacaaggcttaaaag

SEQ ID NO: 6192681 - DNA, 15 bp, Homo sapiens
cttaaaacacatgat

SEQ ID NO: 6192682 - DNA, 11 bp, Homo sapiens
cttaaaacact

SEQ ID NO: 6192683 - DNA, 14 bp, Homo sapiens
cttaaaacagctgt

SEQ ID NO: 6192684 - DNA, 16 bp, Homo sapiens
cttaaaaccaatcaat

SEQ ID NO: 6192685 - DNA, 21 bp, Homo sapiens
cttaaaaccaatcaataatag

SEQ ID NO: 6192686 - DNA, 12 bp, Homo sapiens
cttaaaaccaga

SEQ ID NO: 6192687 - DNA, 18 bp, Homo sapiens
cttaaaaccagagaatct

SEQ ID NO: 6192688 - DNA, 20 bp, Homo sapiens
cttaaaaccagagaatctta

SEQ ID NO: 6192689 - DNA, 15 bp, Homo sapiens
cttaaaacctgcttt

SEQ ID NO: 6192690 - DNA, 12 bp, Homo sapiens
cttaaaactagg

SEQ ID NO: 6192691 - DNA, 22 bp, Homo sapiens
cttaaaactaggcatttgtaaa

SEQ ID NO: 6192692 - DNA, 12 bp, Homo sapiens
cttaaaactcct

SEQ ID NO: 6192693 - DNA, 20 bp, Homo sapiens
cttaaaactttattaaaaga

SEQ ID NO: 6192694 - DNA, 12 bp, Homo sapiens
cttaaaactttg

SEQ ID NO: 6192695 - DNA, 13 bp, Homo sapiens
cttaaaagaacat

SEQ ID NO: 6192696 - DNA, 18 bp, Homo sapiens
cttaaaagaggaaaatga

SEQ ID NO: 6192697 - DNA, 14 bp, Homo sapiens
cttaaaagcatttt

SEQ ID NO: 6192698 - DNA, 22 bp, Homo sapiens
cttaaaagcatttttattatat

SEQ ID NO: 6192699 - DNA, 13 bp, Homo sapiens
cttaaaagccatc

SEQ ID NO: 6192700 - DNA, 21 bp, Homo sapiens
cttaaaagccatcatgtaaat

SEQ ID NO: 6192701 - DNA, 21 bp, Homo sapiens
cttaaaagctatcttcatgta

SEQ ID NO: 6192702 - DNA, 24 bp, Homo sapiens
cttaaaagctatcttcatgtaaat

SEQ ID NO: 6192703 - DNA, 14 bp, Homo sapiens
cttaaaaggggccc

SEQ ID NO: 6192704 - DNA, 22 bp, Homo sapiens
cttaaaagtaataaagagaaat

SEQ ID NO: 6192705 - DNA, 13 bp, Homo sapiens
cttaaaagtactt

SEQ ID NO: 6192706 - DNA, 16 bp, Homo sapiens
cttaaaagtactttaa

SEQ ID NO: 6192707 - DNA, 23 bp, Homo sapiens
cttaaaataaaacactgtttccc

SEQ ID NO: 6192708 - DNA, 23 bp, Homo sapiens
cttaaaataaacagttgtgaacc

SEQ ID NO: 6192709 - DNA, 19 bp, Homo sapiens
cttaaaataaagttaaact

SEQ ID NO: 6192710 - DNA, 13 bp, Homo sapiens
cttaaaataagca

SEQ ID NO: 6192711 - DNA, 15 bp, Homo sapiens
cttaaaataagcagg

SEQ ID NO: 6192712 - DNA, 16 bp, Homo sapiens
cttaaaataatgattt

SEQ ID NO: 6192713 - DNA, 20 bp, Homo sapiens
cttaaaataattaaataaat

SEQ ID NO: 6192714 - DNA, 21 bp, Homo sapiens
cttaaaataattaaataaatg

SEQ ID NO: 6192715 - DNA, 23 bp, Homo sapiens
cttaaaataattaaataaatgaa

SEQ ID NO: 6192716 - DNA, 14 bp, Homo sapiens
cttaaaatacaaga

SEQ ID NO: 6192717 - DNA, 13 bp, Homo sapiens
cttaaaatagaaa

SEQ ID NO: 6192718 - DNA, 11 bp, Homo sapiens
cttaaaatatc

SEQ ID NO: 6192719 - DNA, 20 bp, Homo sapiens
cttaaaatattcctgcattt

SEQ ID NO: 6192720 - DNA, 13 bp, Homo sapiens
cttaaaatatttt

SEQ ID NO: 6192721 - DNA, 15 bp, Homo sapiens
cttaaaatctctaat

SEQ ID NO: 6192722 - DNA, 11 bp, Homo sapiens
cttaaaatgat

SEQ ID NO: 6192723 - DNA, 13 bp, Homo sapiens
cttaaaatgcaag

SEQ ID NO: 6192724 - DNA, 22 bp, Homo sapiens
cttaaaatgcaatatttgtaag

SEQ ID NO: 6192725 - DNA, 12 bp, Homo sapiens
cttaaaatgcat

SEQ ID NO: 6192726 - DNA, 19 bp, Homo sapiens
cttaaaatgcattgaaaga

SEQ ID NO: 6192727 - DNA, 14 bp, Homo sapiens
cttaaaatggaatt

SEQ ID NO: 6192728 - DNA, 19 bp, Homo sapiens
cttaaaattaagttgaaaa

SEQ ID NO: 6192729 - DNA, 21 bp, Homo sapiens
cttaaaattagtgagattaaa

SEQ ID NO: 6192730 - DNA, 18 bp, Homo sapiens
cttaaaattcaagaaaat

SEQ ID NO: 6192731 - DNA, 21 bp, Homo sapiens
cttaaaattgatattatatta

SEQ ID NO: 6192732 - DNA, 21 bp, Homo sapiens
cttaaaattggtaattgaatg

SEQ ID NO: 6192733 - DNA, 16 bp, Homo sapiens
cttaaaattggttaat

SEQ ID NO: 6192734 - DNA, 13 bp, Homo sapiens
cttaaaatttgaa

SEQ ID NO: 6192735 - DNA, 14 bp, Homo sapiens
cttaaaatttgaaa

SEQ ID NO: 6192736 - DNA, 16 bp, Homo sapiens
cttaaaatttgaaaca

SEQ ID NO: 6192737 - DNA, 21 bp, Homo sapiens
cttaaaatttttttctttcga

SEQ ID NO: 6192738 - DNA, 12 bp, Homo sapiens
cttaaacaaaaa

SEQ ID NO: 6192739 - DNA, 16 bp, Homo sapiens
cttaaacaaaaaacta

SEQ ID NO: 6192740 - DNA, 20 bp, Homo sapiens
cttaaacaaaaactttccat

SEQ ID NO: 6192741 - DNA, 13 bp, Homo sapiens
cttaaacaaaaat

SEQ ID NO: 6192742 - DNA, 14 bp, Homo sapiens
cttaaacaaatgta

SEQ ID NO: 6192743 - DNA, 18 bp, Homo sapiens
cttaaacaacacctcctc

SEQ ID NO: 6192744 - DNA, 13 bp, Homo sapiens
cttaaacaatgta

SEQ ID NO: 6192745 - DNA, 16 bp, Homo sapiens
cttaaacaatgtataa

SEQ ID NO: 6192746 - DNA, 14 bp, Homo sapiens
cttaaacagggcat

SEQ ID NO: 6192747 - DNA, 20 bp, Homo sapiens
cttaaacataataaatcaca

SEQ ID NO: 6192748 - DNA, 19 bp, Homo sapiens
cttaaacatttccctgctg

SEQ ID NO: 6192749 - DNA, 16 bp, Homo sapiens
cttaaacccacataaa

SEQ ID NO: 6192750 - DNA, 23 bp, Homo sapiens
cttaaacccatacaatgtatgta

SEQ ID NO: 6192751 - DNA, 15 bp, Homo sapiens
cttaaacctgtgctt

SEQ ID NO: 6192752 - DNA, 19 bp, Homo sapiens
cttaaacctgtgctttcat

SEQ ID NO: 6192753 - DNA, 23 bp, Homo sapiens
cttaaaccttcagttatgatttt

SEQ ID NO: 6192754 - DNA, 19 bp, Homo sapiens
cttaaacgaagagttccct

SEQ ID NO: 6192755 - DNA, 17 bp, Homo sapiens
cttaaactaaataatga

SEQ ID NO: 6192756 - DNA, 19 bp, Homo sapiens
cttaaactctcttcttcca

SEQ ID NO: 6192757 - DNA, 21 bp, Homo sapiens
cttaaactctggacactctat

SEQ ID NO: 6192758 - DNA, 15 bp, Homo sapiens
cttaaactgtacaga

SEQ ID NO: 6192759 - DNA, 14 bp, Homo sapiens
cttaaactgtgtgg

SEQ ID NO: 6192760 - DNA, 19 bp, Homo sapiens
cttaaacttccaaagcttc

SEQ ID NO: 6192761 - DNA, 14 bp, Homo sapiens
cttaaacttcctta

SEQ ID NO: 6192762 - DNA, 18 bp, Homo sapiens
cttaaacttgcacatttg

SEQ ID NO: 6192763 - DNA, 14 bp, Homo sapiens
cttaaactttgtca

SEQ ID NO: 6192764 - DNA, 19 bp, Homo sapiens
cttaaactttgtcacttct

SEQ ID NO: 6192765 - DNA, 18 bp, Homo sapiens
cttaaagaaaacccaccc

SEQ ID NO: 6192766 - DNA, 14 bp, Homo sapiens
gaagaatcttcctg

SEQ ID NO: 6192767 - DNA, 15 bp, Homo sapiens
gaagaatcttcctgg

SEQ ID NO: 6192768 - DNA, 16 bp, Homo sapiens
gaagaatgaaagctgt

SEQ ID NO: 6192769 - DNA, 20 bp, Homo sapiens
gaagaatgcacaagaatgga

SEQ ID NO: 6192770 - DNA, 15 bp, Homo sapiens
gaagaatggagagga

SEQ ID NO: 6192771 - DNA, 13 bp, Homo sapiens
gaagaatggccat

SEQ ID NO: 6192772 - DNA, 17 bp, Homo sapiens
gaagaatggctttcaat

SEQ ID NO: 6192773 - DNA, 18 bp, Homo sapiens
gaagaatgggctgcagaa

SEQ ID NO: 6192774 - DNA, 18 bp, Homo sapiens
gaagaatgtgtttcaaac

SEQ ID NO: 6192775 - DNA, 19 bp, Homo sapiens
gaagaatgtgtttcaaact

SEQ ID NO: 6192776 - DNA, 19 bp, Homo sapiens
gaagaatgttagagtaatg

SEQ ID NO: 6192777 - DNA, 14 bp, Homo sapiens
gaagaatgtttctg

SEQ ID NO: 6192778 - DNA, 22 bp, Homo sapiens
gaagaattattcagtgaatttg

SEQ ID NO: 6192779 - DNA, 13 bp, Homo sapiens
gaagaattatttt

SEQ ID NO: 6192780 - DNA, 17 bp, Homo sapiens
gaagaattgaaaagttt

SEQ ID NO: 6192781 - DNA, 18 bp, Homo sapiens
gaagaattgaaaagtttt

SEQ ID NO: 6192782 - DNA, 20 bp, Homo sapiens
gaagaattgaacccaggagg

SEQ ID NO: 6192783 - DNA, 16 bp, Homo sapiens
gaagaattgccaatct

SEQ ID NO: 6192784 - DNA, 19 bp, Homo sapiens
gaagaattgccaatcttgt

SEQ ID NO: 6192785 - DNA, 14 bp, Homo sapiens
gaagaatttaatgg

SEQ ID NO: 6192786 - DNA, 17 bp, Homo sapiens
gaagaatttaatggact

SEQ ID NO: 6192787 - DNA, 23 bp, Homo sapiens
gaagaatttaatggactgtgaat

SEQ ID NO: 6192788 - DNA, 18 bp, Homo sapiens
gaagaatttagatcttat

SEQ ID NO: 6192789 - DNA, 15 bp, Homo sapiens
gaagaatttattaca

SEQ ID NO: 6192790 - DNA, 13 bp, Homo sapiens
gaagaatttgaag

SEQ ID NO: 6192791 - DNA, 13 bp, Homo sapiens
gaagaatttgtta

SEQ ID NO: 6192792 - DNA, 13 bp, Homo sapiens
gaagaattttaaa

SEQ ID NO: 6192793 - DNA, 23 bp, Homo sapiens
gaagaattttaaaaatgaatcct

SEQ ID NO: 6192794 - DNA, 19 bp, Homo sapiens
gaagaattttatttttctg

SEQ ID NO: 6192795 - DNA, 12 bp, Homo sapiens
gaagaattttga

SEQ ID NO: 6192796 - DNA, 21 bp, Homo sapiens
gaagaattttttctcattctg

SEQ ID NO: 6192797 - DNA, 14 bp, Homo sapiens
gaagacaaaaatac

SEQ ID NO: 6192798 - DNA, 17 bp, Homo sapiens
gaagacaaaaatactct

SEQ ID NO: 6192799 - DNA, 20 bp, Homo sapiens
gaagacaaaattgtaagcca

SEQ ID NO: 6192800 - DNA, 22 bp, Homo sapiens
gaagacaaaattgtaagccaga

SEQ ID NO: 6192801 - DNA, 20 bp, Homo sapiens
gaagacaaaccactgtacat

SEQ ID NO: 6192802 - DNA, 12 bp, Homo sapiens
gaagacaaactt

SEQ ID NO: 6192803 - DNA, 16 bp, Homo sapiens
gaagacaaaggcccaa

SEQ ID NO: 6192804 - DNA, 13 bp, Homo sapiens
gaagacaaagtct

SEQ ID NO: 6192805 - DNA, 16 bp, Homo sapiens
gaagacaaatacacat

SEQ ID NO: 6192806 - DNA, 18 bp, Homo sapiens
gaagacaaatacacatac

SEQ ID NO: 6192807 - DNA, 17 bp, Homo sapiens
gaagacaacagaaagag

SEQ ID NO: 6192808 - DNA, 16 bp, Homo sapiens
gaagacaatgacttac

SEQ ID NO: 6192809 - DNA, 14 bp, Homo sapiens
gaagacaattgaca

SEQ ID NO: 6192810 - DNA, 18 bp, Homo sapiens
gaagacaatttgatacat

SEQ ID NO: 6192811 - DNA, 19 bp, Homo sapiens
gaagacaatttgatacata

SEQ ID NO: 6192812 - DNA, 12 bp, Homo sapiens
gaagacacacag

SEQ ID NO: 6192813 - DNA, 14 bp, Homo sapiens
gaagacacacagcc

SEQ ID NO: 6192814 - DNA, 23 bp, Homo sapiens
gaagacacacagccaacgttcat

SEQ ID NO: 6192815 - DNA, 12 bp, Homo sapiens
gaagacacagac

SEQ ID NO: 6192816 - DNA, 14 bp, Homo sapiens
gaagacaccagagc

SEQ ID NO: 6192817 - DNA, 22 bp, Homo sapiens
gaagacaccagagcagatgcag

SEQ ID NO: 6192818 - DNA, 13 bp, Homo sapiens
gaagacacctgca

SEQ ID NO: 6192819 - DNA, 24 bp, Homo sapiens
gaagacacgtgtttttgtatcttt

SEQ ID NO: 6192820 - DNA, 21 bp, Homo sapiens
gaagacactacagaggattct

SEQ ID NO: 6192821 - DNA, 21 bp, Homo sapiens
gaagacactgtgcaggcccag

SEQ ID NO: 6192822 - DNA, 13 bp, Homo sapiens
gaagacagagaaa

SEQ ID NO: 6192823 - DNA, 18 bp, Homo sapiens
gaagacagagacctcctg

SEQ ID NO: 6192824 - DNA, 21 bp, Homo sapiens
gaagacagagacctcctgcct

SEQ ID NO: 6192825 - DNA, 15 bp, Homo sapiens
gaagacagagatggc

SEQ ID NO: 6192826 - DNA, 21 bp, Homo sapiens
gaagacagagatggcagagcc

SEQ ID NO: 6192827 - DNA, 12 bp, Homo sapiens
gaagacagctct

SEQ ID NO: 6192828 - DNA, 14 bp, Homo sapiens
gaagacagctctta

SEQ ID NO: 6192829 - DNA, 18 bp, Homo sapiens
gaagacaggcacaaaatg

SEQ ID NO: 6192830 - DNA, 10 bp, Homo sapiens
gaagacagtg

SEQ ID NO: 6192831 - DNA, 13 bp, Homo sapiens
gaagacataaaac

SEQ ID NO: 6192832 - DNA, 15 bp, Homo sapiens
gaagacataaaactt

SEQ ID NO: 6192833 - DNA, 15 bp, Homo sapiens
gaagacatatattat

SEQ ID NO: 6192834 - DNA, 21 bp, Homo sapiens
gaagacatatattatatatag

SEQ ID NO: 6192835 - DNA, 15 bp, Homo sapiens
gaagacatggagact

SEQ ID NO: 6192836 - DNA, 22 bp, Homo sapiens
gaagacatggggaggaaggaca

SEQ ID NO: 6192837 - DNA, 12 bp, Homo sapiens
gaagacatgttt

SEQ ID NO: 6192838 - DNA, 14 bp, Homo sapiens
gaagacattctggt

SEQ ID NO: 6192839 - DNA, 21 bp, Homo sapiens
gaagacatttctgctctcagc

SEQ ID NO: 6192840 - DNA, 14 bp, Homo sapiens
gaagacatttcttt

SEQ ID NO: 6192841 - DNA, 23 bp, Homo sapiens
gaagacatttcttttctttttac

SEQ ID NO: 6192842 - DNA, 14 bp, Homo sapiens
gaagacattttgtt

SEQ ID NO: 6192843 - DNA, 19 bp, Homo sapiens
gaagacattttttgctata

SEQ ID NO: 6192844 - DNA, 21 bp, Homo sapiens
gaagacattttttgctataat

SEQ ID NO: 6192845 - DNA, 14 bp, Homo sapiens
gaagaccaaaatta

SEQ ID NO: 6192846 - DNA, 21 bp, Homo sapiens
gaagaccaaatgatagaactg

SEQ ID NO: 6192847 - DNA, 14 bp, Homo sapiens
gaagaccaaggcct

SEQ ID NO: 6192848 - DNA, 11 bp, Homo sapiens
gaagaccaatc

SEQ ID NO: 6192849 - DNA, 14 bp, Homo sapiens
gaagaccacatcca

SEQ ID NO: 6192850 - DNA, 22 bp, Homo sapiens
gaagaccacatccacacacgca

SEQ ID NO: 6192851 - DNA, 20 bp, Homo sapiens
gaagaccagctttgcagtga

SEQ ID NO: 6192852 - DNA, 18 bp, Homo sapiens
gaagaccagtcacagcca

SEQ ID NO: 6192853 - DNA, 22 bp, Homo sapiens
gaagaccagtcacagccatttc

SEQ ID NO: 6192854 - DNA, 20 bp, Homo sapiens
gaagacccattccttcccag

SEQ ID NO: 6192855 - DNA, 14 bp, Homo sapiens
gaagaccccaccca

SEQ ID NO: 6192856 - DNA, 15 bp, Homo sapiens
gaagaccccacccaa

SEQ ID NO: 6192857 - DNA, 16 bp, Homo sapiens
gaagaccccacccaag

SEQ ID NO: 6192858 - DNA, 16 bp, Homo sapiens
gaagacccctgcccaa

SEQ ID NO: 6192859 - DNA, 15 bp, Homo sapiens
gaagaccctttcaga

SEQ ID NO: 6192860 - DNA, 21 bp, Homo sapiens
gaagaccctttgttgaaaaat

SEQ ID NO: 6192861 - DNA, 18 bp, Homo sapiens
gaagacctaaccagggcc

SEQ ID NO: 6192862 - DNA, 23 bp, Homo sapiens
gaagacctaaccagggccagaag

SEQ ID NO: 6192863 - DNA, 17 bp, Homo sapiens
gaagacctagctatgtt

SEQ ID NO: 6192864 - DNA, 14 bp, Homo sapiens
gaagacctgagaat

SEQ ID NO: 6192865 - DNA, 23 bp, Homo sapiens
gaagaccttctagtgagcctggg

SEQ ID NO: 6192866 - DNA, 21 bp, Homo sapiens
gaagacctttttctgcactat

SEQ ID NO: 6192867 - DNA, 21 bp, Homo sapiens
gaagacgccgtctccatggca

SEQ ID NO: 6192868 - DNA, 15 bp, Homo sapiens
gaagacggaaaacaa

SEQ ID NO: 6192869 - DNA, 23 bp, Homo sapiens
gaagacgggaggggaggcattga

SEQ ID NO: 6192870 - DNA, 16 bp, Homo sapiens
gaagacgttttcttta

SEQ ID NO: 6192871 - DNA, 16 bp, Homo sapiens
gaagactacttttaga

SEQ ID NO: 6192872 - DNA, 23 bp, Homo sapiens
gaagactatcttactatttcaca

SEQ ID NO: 6192873 - DNA, 15 bp, Homo sapiens
gaagactccagaaat

SEQ ID NO: 6192874 - DNA, 13 bp, Homo sapiens
gaagactccctga

SEQ ID NO: 6192875 - DNA, 19 bp, Homo sapiens
gaagactccctgatcccag

SEQ ID NO: 6192876 - DNA, 23 bp, Homo sapiens
gaagactccctgatcccagacct

SEQ ID NO: 6192877 - DNA, 17 bp, Homo sapiens
gaagactcctaggccct

SEQ ID NO: 6192878 - DNA, 13 bp, Homo sapiens
gaagactctacca

SEQ ID NO: 6192879 - DNA, 23 bp, Homo sapiens
gaagactctaccagactgtgtat

SEQ ID NO: 6192880 - DNA, 22 bp, Homo sapiens
gaagactctccactgacctggt

SEQ ID NO: 6192881 - DNA, 15 bp, Homo sapiens
gaagactgagaactt

SEQ ID NO: 6192882 - DNA, 19 bp, Homo sapiens
gaagactgctaaatgcact

SEQ ID NO: 6192883 - DNA, 13 bp, Homo sapiens
gaagactgctatc

SEQ ID NO: 6192884 - DNA, 23 bp, Homo sapiens
gaagactgctcccggcccgcctg

SEQ ID NO: 6192885 - DNA, 12 bp, Homo sapiens
gaagactggaga

SEQ ID NO: 6192886 - DNA, 15 bp, Homo sapiens
gaagactggagaaat

SEQ ID NO: 6192887 - DNA, 17 bp, Homo sapiens
gaagactgtgcagaaga

SEQ ID NO: 6192888 - DNA, 13 bp, Homo sapiens
gaagactgtggct

SEQ ID NO: 6192889 - DNA, 19 bp, Homo sapiens
gaagactgttgtgctccat

SEQ ID NO: 6192890 - DNA, 18 bp, Homo sapiens
gaagacttaactggccca

SEQ ID NO: 6192891 - DNA, 19 bp, Homo sapiens
gaagacttaactggcccag

SEQ ID NO: 6192892 - DNA, 21 bp, Homo sapiens
gaagacttaactggcccagaa

SEQ ID NO: 6192893 - DNA, 23 bp, Homo sapiens
gaagacttaactggcccagaagc

SEQ ID NO: 6192894 - DNA, 20 bp, Homo sapiens
gaagacttacagcaaatcct

SEQ ID NO: 6192895 - DNA, 19 bp, Homo sapiens
gaagacttagatctgagcc

SEQ ID NO: 6192896 - DNA, 15 bp, Homo sapiens
gaagacttcaatatt

SEQ ID NO: 6192897 - DNA, 20 bp, Homo sapiens
gaagacttcaatattaaatg

SEQ ID NO: 6192898 - DNA, 14 bp, Homo sapiens
gaagacttccagct

SEQ ID NO: 6192899 - DNA, 19 bp, Homo sapiens
gaagacttccagctttctc

SEQ ID NO: 6192900 - DNA, 13 bp, Homo sapiens
gaagacttcctct

SEQ ID NO: 6192901 - DNA, 16 bp, Homo sapiens
gaagacttctagcaga

SEQ ID NO: 6192902 - DNA, 15 bp, Homo sapiens
gaagacttggcccag

SEQ ID NO: 6192903 - DNA, 20 bp, Homo sapiens
gaagactttaaaccacctag

SEQ ID NO: 6192904 - DNA, 13 bp, Homo sapiens
gaagactttggaa

SEQ ID NO: 6192905 - DNA, 17 bp, Homo sapiens
gaagactttggaaagag

SEQ ID NO: 6192906 - DNA, 17 bp, Homo sapiens
gaagactttgtgactgt

SEQ ID NO: 6192907 - DNA, 17 bp, Homo sapiens
gaagagaaaaaggctga

SEQ ID NO: 6192908 - DNA, 12 bp, Homo sapiens
gaagagaaaatg

SEQ ID NO: 6192909 - DNA, 14 bp, Homo sapiens
gaagagaaaggaca

SEQ ID NO: 6192910 - DNA, 15 bp, Homo sapiens
gaagagaaatacagc

SEQ ID NO: 6192911 - DNA, 16 bp, Homo sapiens
gaagagaaatacagct

SEQ ID NO: 6192912 - DNA, 19 bp, Homo sapiens
gaagagaaatacagctggc

SEQ ID NO: 6192913 - DNA, 20 bp, Homo sapiens
gaagagaaatacagctggct

SEQ ID NO: 6192914 - DNA, 21 bp, Homo sapiens
gaagagaacctcaaactagga

SEQ ID NO: 6192915 - DNA, 21 bp, Homo sapiens
gaagagaagaaatagcagagc

SEQ ID NO: 6192916 - DNA, 19 bp, Homo sapiens
gaagagaagagggcccagc

SEQ ID NO: 6192917 - DNA, 12 bp, Homo sapiens
gaagagaagctg

SEQ ID NO: 6192918 - DNA, 21 bp, Homo sapiens
gaagagaagctgagaagaagc

SEQ ID NO: 6192919 - DNA, 14 bp, Homo sapiens
gaagagaagctgct

SEQ ID NO: 6192920 - DNA, 15 bp, Homo sapiens
gaagagaagctgctg

SEQ ID NO: 6192921 - DNA, 12 bp, Homo sapiens
gaagagaaggag

SEQ ID NO: 6192922 - DNA, 19 bp, Homo sapiens
gaagagaatgcacaaacag

SEQ ID NO: 6192923 - DNA, 18 bp, Homo sapiens
gaagagaatgtattctgt

SEQ ID NO: 6192924 - DNA, 20 bp, Homo sapiens
gaagagacaaagtgggtgtg

SEQ ID NO: 6192925 - DNA, 23 bp, Homo sapiens
gaagagacagagacaagtaattt

SEQ ID NO: 6192926 - DNA, 11 bp, Homo sapiens
gaagagaccac

SEQ ID NO: 6192927 - DNA, 15 bp, Homo sapiens
gaagagaccacagca

SEQ ID NO: 6192928 - DNA, 13 bp, Homo sapiens
gaagagagaaaca

SEQ ID NO: 6192929 - DNA, 14 bp, Homo sapiens
gaagagagaacttt

SEQ ID NO: 6192930 - DNA, 14 bp, Homo sapiens
gaagagagagaccc

SEQ ID NO: 6192931 - DNA, 14 bp, Homo sapiens
gaagagagaggcct

SEQ ID NO: 6192932 - DNA, 17 bp, Homo sapiens
gaagagagaggcctggg

SEQ ID NO: 6192933 - DNA, 16 bp, Homo sapiens
gaagagagatcaaatg

SEQ ID NO: 6192934 - DNA, 12 bp, Homo sapiens
gaagagagccag

SEQ ID NO: 6192935 - DNA, 13 bp, Homo sapiens
gaagagaggagag

SEQ ID NO: 6192936 - DNA, 13 bp, Homo sapiens
gaagagaggagtt

SEQ ID NO: 6192937 - DNA, 15 bp, Homo sapiens
gaagagaggagttca

SEQ ID NO: 6192938 - DNA, 23 bp, Homo sapiens
gaagagaggcacctgctggaaac

SEQ ID NO: 6192939 - DNA, 13 bp, Homo sapiens
gaagagagggctg

SEQ ID NO: 6192940 - DNA, 14 bp, Homo sapiens
gaagagagggctga

SEQ ID NO: 6192941 - DNA, 15 bp, Homo sapiens
gaagagaggggaaga

SEQ ID NO: 6192942 - DNA, 16 bp, Homo sapiens
gaagagaggggaagaa

SEQ ID NO: 6192943 - DNA, 18 bp, Homo sapiens
gaagagaggggaagaatt

SEQ ID NO: 6192944 - DNA, 19 bp, Homo sapiens
gaagagaggggaagaattt

SEQ ID NO: 6192945 - DNA, 20 bp, Homo sapiens
gaagagagttccgggaaaca

SEQ ID NO: 6192946 - DNA, 15 bp, Homo sapiens
gaagagatccaaaga

SEQ ID NO: 6192947 - DNA, 17 bp, Homo sapiens
cttaaagaaaattgcat

SEQ ID NO: 6192948 - DNA, 19 bp, Homo sapiens
cttaaagaaaattgcatga

SEQ ID NO: 6192949 - DNA, 22 bp, Homo sapiens
cttaaagaaacagctttcaagt

SEQ ID NO: 6192950 - DNA, 15 bp, Homo sapiens
cttaaagaattcaaa

SEQ ID NO: 6192951 - DNA, 23 bp, Homo sapiens
cttaaagaattcaaattttatct

SEQ ID NO: 6192952 - DNA, 13 bp, Homo sapiens
cttaaagaatttg

SEQ ID NO: 6192953 - DNA, 14 bp, Homo sapiens
cttaaagacaaatt

SEQ ID NO: 6192954 - DNA, 22 bp, Homo sapiens
cttaaagagggacaggctgaag

SEQ ID NO: 6192955 - DNA, 19 bp, Homo sapiens
cttaaagatttatcaaatc

SEQ ID NO: 6192956 - DNA, 16 bp, Homo sapiens
cttaaagcaataagtt

SEQ ID NO: 6192957 - DNA, 16 bp, Homo sapiens
cttaaagctactgtag

SEQ ID NO: 6192958 - DNA, 14 bp, Homo sapiens
cttaaagctgaatt

SEQ ID NO: 6192959 - DNA, 13 bp, Homo sapiens
cttaaaggaaaag

SEQ ID NO: 6192960 - DNA, 17 bp, Homo sapiens
cttaaaggaaaagtcaa

SEQ ID NO: 6192961 - DNA, 19 bp, Homo sapiens
cttaaaggaaaagtcaaca

SEQ ID NO: 6192962 - DNA, 22 bp, Homo sapiens
cttaaaggaaaagtcaacatct

SEQ ID NO: 6192963 - DNA, 17 bp, Homo sapiens
cttaaaggacaggagga

SEQ ID NO: 6192964 - DNA, 18 bp, Homo sapiens
cttaaaggccgtcatttc

SEQ ID NO: 6192965 - DNA, 19 bp, Homo sapiens
cttaaaggccgtcatttca

SEQ ID NO: 6192966 - DNA, 15 bp, Homo sapiens
cttaaaggcctggaa

SEQ ID NO: 6192967 - DNA, 22 bp, Homo sapiens
cttaaagggcccaatgaattat

SEQ ID NO: 6192968 - DNA, 13 bp, Homo sapiens
cttaaaggggaga

SEQ ID NO: 6192969 - DNA, 16 bp, Homo sapiens
cttaaaggtgtcttcc

SEQ ID NO: 6192970 - DNA, 15 bp, Homo sapiens
cttaaagtgaaggaa

SEQ ID NO: 6192971 - DNA, 17 bp, Homo sapiens
cttaaagtgaaggaaat

SEQ ID NO: 6192972 - DNA, 17 bp, Homo sapiens
cttaaagtggctttcaa

SEQ ID NO: 6192973 - DNA, 11 bp, Homo sapiens
cttaaagttga

SEQ ID NO: 6192974 - DNA, 22 bp, Homo sapiens
cttaaagttgaatttattggct

SEQ ID NO: 6192975 - DNA, 15 bp, Homo sapiens
cttaaagtttaaagt

SEQ ID NO: 6192976 - DNA, 18 bp, Homo sapiens
cttaaagtttaaagttgc

SEQ ID NO: 6192977 - DNA, 19 bp, Homo sapiens
cttaaagtttaaagttgca

SEQ ID NO: 6192978 - DNA, 18 bp, Homo sapiens
cttaaagttttttatata

SEQ ID NO: 6192979 - DNA, 23 bp, Homo sapiens
cttaaataaatcaagaatcattg

SEQ ID NO: 6192980 - DNA, 14 bp, Homo sapiens
cttaaataaattca

SEQ ID NO: 6192981 - DNA, 16 bp, Homo sapiens
cttaaataaattcaaa

SEQ ID NO: 6192982 - DNA, 13 bp, Homo sapiens
cttaaataagaaa

SEQ ID NO: 6192983 - DNA, 16 bp, Homo sapiens
cttaaataagaaactt

SEQ ID NO: 6192984 - DNA, 17 bp, Homo sapiens
cttaaataagaaacttt

SEQ ID NO: 6192985 - DNA, 13 bp, Homo sapiens
cttaaataataaa

SEQ ID NO: 6192986 - DNA, 19 bp, Homo sapiens
cttaaataatgcttcagat

SEQ ID NO: 6192987 - DNA, 21 bp, Homo sapiens
cttaaataatgcttcagatat

SEQ ID NO: 6192988 - DNA, 19 bp, Homo sapiens
cttaaataatgtgaaactg

SEQ ID NO: 6192989 - DNA, 15 bp, Homo sapiens
cttaaataatttaag

SEQ ID NO: 6192990 - DNA, 21 bp, Homo sapiens
cttaaatacactgaattgaat

SEQ ID NO: 6192991 - DNA, 22 bp, Homo sapiens
cttaaatacactgaattgaatc

SEQ ID NO: 6192992 - DNA, 12 bp, Homo sapiens
cttaaatacaga

SEQ ID NO: 6192993 - DNA, 16 bp, Homo sapiens
cttaaatacagataat

SEQ ID NO: 6192994 - DNA, 22 bp, Homo sapiens
cttaaatacagataattcattt

SEQ ID NO: 6192995 - DNA, 14 bp, Homo sapiens
cttaaatagcatct

SEQ ID NO: 6192996 - DNA, 22 bp, Homo sapiens
cttaaatagcatctgctcttct

SEQ ID NO: 6192997 - DNA, 19 bp, Homo sapiens
cttaaatagctttgagatt

SEQ ID NO: 6192998 - DNA, 22 bp, Homo sapiens
cttaaataggaaagtttcttca

SEQ ID NO: 6192999 - DNA, 20 bp, Homo sapiens
cttaaatatatgatttatat

SEQ ID NO: 6193000 - DNA, 13 bp, Homo sapiens
cttaaatatcaat

SEQ ID NO: 6193001 - DNA, 18 bp, Homo sapiens
cttaaatatcaatcattt

SEQ ID NO: 6193002 - DNA, 15 bp, Homo sapiens
cttaaatatctttta

SEQ ID NO: 6193003 - DNA, 22 bp, Homo sapiens
cttaaatatcttttatgtttga

SEQ ID NO: 6193004 - DNA, 22 bp, Homo sapiens
cttaaatattgaataagtattc

SEQ ID NO: 6193005 - DNA, 22 bp, Homo sapiens
cttaaatattgtaatatgacag

SEQ ID NO: 6193006 - DNA, 21 bp, Homo sapiens
cttaaatcatagctgtctgac

SEQ ID NO: 6193007 - DNA, 16 bp, Homo sapiens
cttaaatcatttggtt

SEQ ID NO: 6193008 - DNA, 22 bp, Homo sapiens
cttaaatcatttggttaaatca

SEQ ID NO: 6193009 - DNA, 12 bp, Homo sapiens
cttaaatcttaa

SEQ ID NO: 6193010 - DNA, 21 bp, Homo sapiens
cttaaatgaaagcatgtggca

SEQ ID NO: 6193011 - DNA, 23 bp, Homo sapiens
cttaaatgaactactgctatttt

SEQ ID NO: 6193012 - DNA, 17 bp, Homo sapiens
cttaaatgagttactta

SEQ ID NO: 6193013 - DNA, 19 bp, Homo sapiens
cttaaatgagttacttaga

SEQ ID NO: 6193014 - DNA, 22 bp, Homo sapiens
cttaaatgcaaccatttgaaac

SEQ ID NO: 6193015 - DNA, 18 bp, Homo sapiens
cttaaatgcccccctccc

SEQ ID NO: 6193016 - DNA, 18 bp, Homo sapiens
cttaaatgctcattttct

SEQ ID NO: 6193017 - DNA, 19 bp, Homo sapiens
cttaaatggaattattttg

SEQ ID NO: 6193018 - DNA, 17 bp, Homo sapiens
cttaaatgtgaattact

SEQ ID NO: 6193019 - DNA, 19 bp, Homo sapiens
cttaaatgtgaattactaa

SEQ ID NO: 6193020 - DNA, 18 bp, Homo sapiens
cttaaatgttaatgagaa

SEQ ID NO: 6193021 - DNA, 19 bp, Homo sapiens
cttaaatgttaatgagaaa

SEQ ID NO: 6193022 - DNA, 17 bp, Homo sapiens
cttaaatgttatgtata

SEQ ID NO: 6193023 - DNA, 16 bp, Homo sapiens
cttaaatgttattatc

SEQ ID NO: 6193024 - DNA, 22 bp, Homo sapiens
cttaaatgtttatactgtattt

SEQ ID NO: 6193025 - DNA, 15 bp, Homo sapiens
cttaaatgttttcat

SEQ ID NO: 6193026 - DNA, 16 bp, Homo sapiens
cttaaatgttttcatt

SEQ ID NO: 6193027 - DNA, 17 bp, Homo sapiens
cttaaattaaacaattt

SEQ ID NO: 6193028 - DNA, 20 bp, Homo sapiens
cttaaattatatatttattt

SEQ ID NO: 6193029 - DNA, 16 bp, Homo sapiens
cttaaattcatttcta

SEQ ID NO: 6193030 - DNA, 23 bp, Homo sapiens
cttaaattcatttctagactcaa

SEQ ID NO: 6193031 - DNA, 18 bp, Homo sapiens
cttaaattcctactccct

SEQ ID NO: 6193032 - DNA, 20 bp, Homo sapiens
cttaaattcctcaacagtgt

SEQ ID NO: 6193033 - DNA, 21 bp, Homo sapiens
cttaaattgcttttgttgtga

SEQ ID NO: 6193034 - DNA, 23 bp, Homo sapiens
cttaaattgtgggcaaaagagaa

SEQ ID NO: 6193035 - DNA, 12 bp, Homo sapiens
cttaaatttcag

SEQ ID NO: 6193036 - DNA, 14 bp, Homo sapiens
cttaaatttcagaa

SEQ ID NO: 6193037 - DNA, 18 bp, Homo sapiens
cttaaatttcttatgtga

SEQ ID NO: 6193038 - DNA, 23 bp, Homo sapiens
cttaaatttcttggcaaatttta

SEQ ID NO: 6193039 - DNA, 14 bp, Homo sapiens
cttaaatttgaatc

SEQ ID NO: 6193040 - DNA, 21 bp, Homo sapiens
cttaaatttgatttacatata

SEQ ID NO: 6193041 - DNA, 21 bp, Homo sapiens
cttaaatttggtttgttaatt

SEQ ID NO: 6193042 - DNA, 15 bp, Homo sapiens
cttaaatttgtttaa

SEQ ID NO: 6193043 - DNA, 16 bp, Homo sapiens
cttaaattttaattta

SEQ ID NO: 6193044 - DNA, 23 bp, Homo sapiens
cttaacaaaccctcgtttctgat

SEQ ID NO: 6193045 - DNA, 23 bp, Homo sapiens
cttaacaaatacattcaaattct

SEQ ID NO: 6193046 - DNA, 16 bp, Homo sapiens
cttaacaacagcttct

SEQ ID NO: 6193047 - DNA, 14 bp, Homo sapiens
cttaacaatgcaac

SEQ ID NO: 6193048 - DNA, 19 bp, Homo sapiens
cttaacaatgcaactttta

SEQ ID NO: 6193049 - DNA, 23 bp, Homo sapiens
cttaacaatttctgtccttcaga

SEQ ID NO: 6193050 - DNA, 17 bp, Homo sapiens
cttaacacactggccat

SEQ ID NO: 6193051 - DNA, 17 bp, Homo sapiens
cttaacacagccttcct

SEQ ID NO: 6193052 - DNA, 19 bp, Homo sapiens
cttaacacagccttccttc

SEQ ID NO: 6193053 - DNA, 13 bp, Homo sapiens
cttaacacttaca

SEQ ID NO: 6193054 - DNA, 22 bp, Homo sapiens
cttaacagatctttactcttga

SEQ ID NO: 6193055 - DNA, 16 bp, Homo sapiens
cttaacagctgtatta

SEQ ID NO: 6193056 - DNA, 15 bp, Homo sapiens
cttaacaggctgatt

SEQ ID NO: 6193057 - DNA, 15 bp, Homo sapiens
cttaacagttgcttt

SEQ ID NO: 6193058 - DNA, 16 bp, Homo sapiens
cttaacataaacttgt

SEQ ID NO: 6193059 - DNA, 17 bp, Homo sapiens
cttaacataaacttgta

SEQ ID NO: 6193060 - DNA, 19 bp, Homo sapiens
cttaacatagccaaaatgt

SEQ ID NO: 6193061 - DNA, 17 bp, Homo sapiens
cttaacatatttactaa

SEQ ID NO: 6193062 - DNA, 13 bp, Homo sapiens
cttaacatgctgt

SEQ ID NO: 6193063 - DNA, 15 bp, Homo sapiens
cttaacatgctgtgt

SEQ ID NO: 6193064 - DNA, 17 bp, Homo sapiens
cttaacatgctgtgtaa

SEQ ID NO: 6193065 - DNA, 21 bp, Homo sapiens
cttaacatgctgtgtaagctg

SEQ ID NO: 6193066 - DNA, 14 bp, Homo sapiens
cttaacattctgta

SEQ ID NO: 6193067 - DNA, 17 bp, Homo sapiens
cttaacatttctctcca

SEQ ID NO: 6193068 - DNA, 21 bp, Homo sapiens
cttaaccaccgcatatgcatg

SEQ ID NO: 6193069 - DNA, 20 bp, Homo sapiens
cttaaccagcacatttctcc

SEQ ID NO: 6193070 - DNA, 14 bp, Homo sapiens
cttaaccagtctct

SEQ ID NO: 6193071 - DNA, 14 bp, Homo sapiens
cttaaccagttgtg

SEQ ID NO: 6193072 - DNA, 18 bp, Homo sapiens
cttaaccagttgtggtgt

SEQ ID NO: 6193073 - DNA, 17 bp, Homo sapiens
cttaacccacctctcct

SEQ ID NO: 6193074 - DNA, 15 bp, Homo sapiens
cttaacccagtgtcc

SEQ ID NO: 6193075 - DNA, 21 bp, Homo sapiens
cttaaccccgggatgcaaggt

SEQ ID NO: 6193076 - DNA, 20 bp, Homo sapiens
cttaacccctaagactgcct

SEQ ID NO: 6193077 - DNA, 21 bp, Homo sapiens
cttaacccctaagactgcctt

SEQ ID NO: 6193078 - DNA, 13 bp, Homo sapiens
cttaaccctgaac

SEQ ID NO: 6193079 - DNA, 13 bp, Homo sapiens
cttaaccctgtgc

SEQ ID NO: 6193080 - DNA, 19 bp, Homo sapiens
cttaaccctgtgctgtcag

SEQ ID NO: 6193081 - DNA, 14 bp, Homo sapiens
cttaacctcaggga

SEQ ID NO: 6193082 - DNA, 14 bp, Homo sapiens
cttaacctgctttt

SEQ ID NO: 6193083 - DNA, 18 bp, Homo sapiens
cttaaccttaaccttaaa

SEQ ID NO: 6193084 - DNA, 18 bp, Homo sapiens
cttaacctttccgctgtc

SEQ ID NO: 6193085 - DNA, 16 bp, Homo sapiens
cttaacgaataaaggt

SEQ ID NO: 6193086 - DNA, 16 bp, Homo sapiens
cttaacggaccaaagc

SEQ ID NO: 6193087 - DNA, 20 bp, Homo sapiens
cttaacggaccaaagcaaga

SEQ ID NO: 6193088 - DNA, 14 bp, Homo sapiens
cttaacggctccag

SEQ ID NO: 6193089 - DNA, 23 bp, Homo sapiens
cttaacgttctataaatgaatgt

SEQ ID NO: 6193090 - DNA, 16 bp, Homo sapiens
cttaacgttttcttaa

SEQ ID NO: 6193091 - DNA, 17 bp, Homo sapiens
cttaacgttttcttaaa

SEQ ID NO: 6193092 - DNA, 20 bp, Homo sapiens
cttaactaaatgataaatgt

SEQ ID NO: 6193093 - DNA, 17 bp, Homo sapiens
cttaactaagactcccg

SEQ ID NO: 6193094 - DNA, 15 bp, Homo sapiens
cttaactaatgtaaa

SEQ ID NO: 6193095 - DNA, 17 bp, Homo sapiens
cttaactaatgtaaata

SEQ ID NO: 6193096 - DNA, 17 bp, Homo sapiens
cttaactatcaccagtg

SEQ ID NO: 6193097 - DNA, 20 bp, Homo sapiens
cttaactatcaccagtgcat

SEQ ID NO: 6193098 - DNA, 17 bp, Homo sapiens
cttaactatctgttccc

SEQ ID NO: 6193099 - DNA, 12 bp, Homo sapiens
cttaactatgag

SEQ ID NO: 6193100 - DNA, 17 bp, Homo sapiens
cttaactcatctgttat

SEQ ID NO: 6193101 - DNA, 21 bp, Homo sapiens
cttaactcattgcaacctcca

SEQ ID NO: 6193102 - DNA, 13 bp, Homo sapiens
cttaactccaaga

SEQ ID NO: 6193103 - DNA, 18 bp, Homo sapiens
cttaactctaaccctgtg

SEQ ID NO: 6193104 - DNA, 16 bp, Homo sapiens
cttaactctgcaggaa

SEQ ID NO: 6193105 - DNA, 11 bp, Homo sapiens
cttaactgaag

SEQ ID NO: 6193106 - DNA, 14 bp, Homo sapiens
cttaactgaagaaa

SEQ ID NO: 6193107 - DNA, 22 bp, Homo sapiens
cttaactgatgacattccacca

SEQ ID NO: 6193108 - DNA, 19 bp, Homo sapiens
cttaactgcatttttagac

SEQ ID NO: 6193109 - DNA, 12 bp, Homo sapiens
cttaactggccc

SEQ ID NO: 6193110 - DNA, 15 bp, Homo sapiens
cttaactggccctcg

SEQ ID NO: 6193111 - DNA, 16 bp, Homo sapiens
cttaactggccctcgg

SEQ ID NO: 6193112 - DNA, 18 bp, Homo sapiens
cttaactggccctcgggc

SEQ ID NO: 6193113 - DNA, 14 bp, Homo sapiens
cttaactgtatttc

SEQ ID NO: 6193114 - DNA, 17 bp, Homo sapiens
cttaactgtatttcagt

SEQ ID NO: 6193115 - DNA, 20 bp, Homo sapiens
cttaactgtatttcagtatt

SEQ ID NO: 6193116 - DNA, 20 bp, Homo sapiens
cttaactgtccagtccagtg

SEQ ID NO: 6193117 - DNA, 23 bp, Homo sapiens
cttaactgtccagtccagtgatg

SEQ ID NO: 6193118 - DNA, 11 bp, Homo sapiens
cttaactgtgt

SEQ ID NO: 6193119 - DNA, 20 bp, Homo sapiens
cttaactgtgtgaagaaatg

SEQ ID NO: 6193120 - DNA, 12 bp, Homo sapiens
cttaactgttca

SEQ ID NO: 6193121 - DNA, 15 bp, Homo sapiens
cttaactgttgttga

SEQ ID NO: 6193122 - DNA, 14 bp, Homo sapiens
cttaacttaaaaga

SEQ ID NO: 6193123 - DNA, 17 bp, Homo sapiens
cttaacttaaaagaaca

SEQ ID NO: 6193124 - DNA, 18 bp, Homo sapiens
cttaacttattacctcag

SEQ ID NO: 6193125 - DNA, 22 bp, Homo sapiens
gaagagatcccaggaggtgcag

SEQ ID NO: 6193126 - DNA, 18 bp, Homo sapiens
gaagagatgggcttgttt

SEQ ID NO: 6193127 - DNA, 22 bp, Homo sapiens
gaagagatgtggcaaagtgctg

SEQ ID NO: 6193128 - DNA, 18 bp, Homo sapiens
gaagagatttttcatgat

SEQ ID NO: 6193129 - DNA, 13 bp, Homo sapiens
gaagagcaaaaat

SEQ ID NO: 6193130 - DNA, 21 bp, Homo sapiens
gaagagcaaaaatatcccttc

SEQ ID NO: 6193131 - DNA, 15 bp, Homo sapiens
gaagagcacagagcc

SEQ ID NO: 6193132 - DNA, 16 bp, Homo sapiens
gaagagcacagagccc

SEQ ID NO: 6193133 - DNA, 20 bp, Homo sapiens
gaagagcacagccctcccgc

SEQ ID NO: 6193134 - DNA, 14 bp, Homo sapiens
gaagagcagagctg

SEQ ID NO: 6193135 - DNA, 18 bp, Homo sapiens
gaagagcagcacctcctc

SEQ ID NO: 6193136 - DNA, 13 bp, Homo sapiens
gaagagcagcctg

SEQ ID NO: 6193137 - DNA, 14 bp, Homo sapiens
gaagagcagcctga

SEQ ID NO: 6193138 - DNA, 15 bp, Homo sapiens
gaagagcaggcacat

SEQ ID NO: 6193139 - DNA, 18 bp, Homo sapiens
gaagagcaggcacatgga

SEQ ID NO: 6193140 - DNA, 19 bp, Homo sapiens
gaagagcaggccagcccgg

SEQ ID NO: 6193141 - DNA, 10 bp, Homo sapiens
gaagagccac

SEQ ID NO: 6193142 - DNA, 12 bp, Homo sapiens
gaagagccacag

SEQ ID NO: 6193143 - DNA, 14 bp, Homo sapiens
gaagagccacctgc

SEQ ID NO: 6193144 - DNA, 22 bp, Homo sapiens
gaagagccacctgcaagatgga

SEQ ID NO: 6193145 - DNA, 17 bp, Homo sapiens
gaagagcccagtctgtt

SEQ ID NO: 6193146 - DNA, 21 bp, Homo sapiens
gaagagcccgccgtctgcagg

SEQ ID NO: 6193147 - DNA, 20 bp, Homo sapiens
gaagagccctgagctcaggc

SEQ ID NO: 6193148 - DNA, 23 bp, Homo sapiens
gaagagccctgagctcaggctga

SEQ ID NO: 6193149 - DNA, 17 bp, Homo sapiens
gaagagcctgaagctgg

SEQ ID NO: 6193150 - DNA, 16 bp, Homo sapiens
gaagagccttcacatg

SEQ ID NO: 6193151 - DNA, 21 bp, Homo sapiens
gaagagccttcacatgaaatt

SEQ ID NO: 6193152 - DNA, 15 bp, Homo sapiens
gaagagccttccacc

SEQ ID NO: 6193153 - DNA, 19 bp, Homo sapiens
gaagagccttccacccagg

SEQ ID NO: 6193154 - DNA, 19 bp, Homo sapiens
gaagagctatggcccagaa

SEQ ID NO: 6193155 - DNA, 20 bp, Homo sapiens
gaagagctatggcccagaaa

SEQ ID NO: 6193156 - DNA, 20 bp, Homo sapiens
gaagagctcaagggacaagg

SEQ ID NO: 6193157 - DNA, 21 bp, Homo sapiens
gaagagctcaagggacaagga

SEQ ID NO: 6193158 - DNA, 22 bp, Homo sapiens
gaagagctcccctccacagctg

SEQ ID NO: 6193159 - DNA, 12 bp, Homo sapiens
gaagagctcttc

SEQ ID NO: 6193160 - DNA, 21 bp, Homo sapiens
gaagagctcttcggtttctga

SEQ ID NO: 6193161 - DNA, 11 bp, Homo sapiens
gaagagctgag

SEQ ID NO: 6193162 - DNA, 23 bp, Homo sapiens
gaagagctgagtactcaggccac

SEQ ID NO: 6193163 - DNA, 13 bp, Homo sapiens
gaagagctgttca

SEQ ID NO: 6193164 - DNA, 20 bp, Homo sapiens
gaagagctgttcacagccag

SEQ ID NO: 6193165 - DNA, 14 bp, Homo sapiens
gaagagcttgcaca

SEQ ID NO: 6193166 - DNA, 16 bp, Homo sapiens
gaagagcttgctttga

SEQ ID NO: 6193167 - DNA, 22 bp, Homo sapiens
gaagagcttgtgtcctgtcctt

SEQ ID NO: 6193168 - DNA, 14 bp, Homo sapiens
gaagaggaaaatga

SEQ ID NO: 6193169 - DNA, 14 bp, Homo sapiens
gaagaggaacagtg

SEQ ID NO: 6193170 - DNA, 12 bp, Homo sapiens
gaagaggaacca

SEQ ID NO: 6193171 - DNA, 17 bp, Homo sapiens
gaagaggaactgggcct

SEQ ID NO: 6193172 - DNA, 21 bp, Homo sapiens
gaagaggaagaaattcaggta

SEQ ID NO: 6193173 - DNA, 16 bp, Homo sapiens
gaagaggaccagagga

SEQ ID NO: 6193174 - DNA, 16 bp, Homo sapiens
gaagaggactgtgtga

SEQ ID NO: 6193175 - DNA, 17 bp, Homo sapiens
gaagaggactgtgtgag

SEQ ID NO: 6193176 - DNA, 18 bp, Homo sapiens
gaagaggactgtgtgaga

SEQ ID NO: 6193177 - DNA, 12 bp, Homo sapiens
gaagaggagatg

SEQ ID NO: 6193178 - DNA, 13 bp, Homo sapiens
gaagaggagatgt

SEQ ID NO: 6193179 - DNA, 23 bp, Homo sapiens
gaagaggagatgtgatcaggccc

SEQ ID NO: 6193180 - DNA, 15 bp, Homo sapiens
gaagaggagccctca

SEQ ID NO: 6193181 - DNA, 16 bp, Homo sapiens
gaagaggagcctcaga

SEQ ID NO: 6193182 - DNA, 22 bp, Homo sapiens
gaaggaaggctccatctccagt

SEQ ID NO: 6193183 - DNA, 14 bp, Homo sapiens
gaaggaaggctctc

SEQ ID NO: 6193184 - DNA, 14 bp, Homo sapiens
gaaggaagggcaga

SEQ ID NO: 6193185 - DNA, 14 bp, Homo sapiens
gaaggaataagcat

SEQ ID NO: 6193186 - DNA, 17 bp, Homo sapiens
gaaggaatagccagaga

SEQ ID NO: 6193187 - DNA, 18 bp, Homo sapiens
gaaggaatagccagagag

SEQ ID NO: 6193188 - DNA, 19 bp, Homo sapiens
gaaggaatagccagagagg

SEQ ID NO: 6193189 - DNA, 23 bp, Homo sapiens
gaaggaatagccagagaggagca

SEQ ID NO: 6193190 - DNA, 20 bp, Homo sapiens
gaaggaatatatggcagagt

SEQ ID NO: 6193191 - DNA, 23 bp, Homo sapiens
gaaggaatcaaattttgccagag

SEQ ID NO: 6193192 - DNA, 20 bp, Homo sapiens
gaaggaatcattccagtgct

SEQ ID NO: 6193193 - DNA, 17 bp, Homo sapiens
gaaggaatctgtgcaga

SEQ ID NO: 6193194 - DNA, 18 bp, Homo sapiens
gaaggaatttgattgctt

SEQ ID NO: 6193195 - DNA, 16 bp, Homo sapiens
gaaggacaaggctaga

SEQ ID NO: 6193196 - DNA, 14 bp, Homo sapiens
gaaggacacagcag

SEQ ID NO: 6193197 - DNA, 18 bp, Homo sapiens
gaaggacacagcagtatt

SEQ ID NO: 6193198 - DNA, 19 bp, Homo sapiens
gaaggacacagcagtattg

SEQ ID NO: 6193199 - DNA, 15 bp, Homo sapiens
gaaggacagactggc

SEQ ID NO: 6193200 - DNA, 14 bp, Homo sapiens
gaaggacagctgtg

SEQ ID NO: 6193201 - DNA, 20 bp, Homo sapiens
gaaggacaggaccctcagga

SEQ ID NO: 6193202 - DNA, 19 bp, Homo sapiens
gaaggacaggtctctgaga

SEQ ID NO: 6193203 - DNA, 19 bp, Homo sapiens
gaaggacagtccctgctgg

SEQ ID NO: 6193204 - DNA, 22 bp, Homo sapiens
gaaggacagtccctgctgggga

SEQ ID NO: 6193205 - DNA, 20 bp, Homo sapiens
gaaggacattgcggacagcc

SEQ ID NO: 6193206 - DNA, 21 bp, Homo sapiens
gaaggacattgcggacagcca

SEQ ID NO: 6193207 - DNA, 23 bp, Homo sapiens
gaaggaccaacccatgccctgcc

SEQ ID NO: 6193208 - DNA, 20 bp, Homo sapiens
gaaggaccacattttatatt

SEQ ID NO: 6193209 - DNA, 19 bp, Homo sapiens
gaaggaccaggctggggcc

SEQ ID NO: 6193210 - DNA, 21 bp, Homo sapiens
gaaggaccaggctggggccag

SEQ ID NO: 6193211 - DNA, 17 bp, Homo sapiens
gaaggaccccctccccc

SEQ ID NO: 6193212 - DNA, 17 bp, Homo sapiens
gaaggacccctcaccac

SEQ ID NO: 6193213 - DNA, 21 bp, Homo sapiens
gaaggacccctcaccaccccc

SEQ ID NO: 6193214 - DNA, 23 bp, Homo sapiens
gaaggacccggaggggcctggca

SEQ ID NO: 6193215 - DNA, 16 bp, Homo sapiens
gaaggaccctggctct

SEQ ID NO: 6193216 - DNA, 19 bp, Homo sapiens
gaaggacctccccctgtgt

SEQ ID NO: 6193217 - DNA, 23 bp, Homo sapiens
gaaggacctccccctgtgtggcc

SEQ ID NO: 6193218 - DNA, 21 bp, Homo sapiens
gaaggacctgagctggccagg

SEQ ID NO: 6193219 - DNA, 16 bp, Homo sapiens
gaaggaccttcactct

SEQ ID NO: 6193220 - DNA, 20 bp, Homo sapiens
gaaggacggcaaggctgagg

SEQ ID NO: 6193221 - DNA, 14 bp, Homo sapiens
gaaggacggtgcca

SEQ ID NO: 6193222 - DNA, 20 bp, Homo sapiens
gaaggactaatagaaaagta

SEQ ID NO: 6193223 - DNA, 14 bp, Homo sapiens
gaaggactgaagaa

SEQ ID NO: 6193224 - DNA, 20 bp, Homo sapiens
gaaggactggattggccaaa

SEQ ID NO: 6193225 - DNA, 19 bp, Homo sapiens
gaaggactgtgacaggcag

SEQ ID NO: 6193226 - DNA, 13 bp, Homo sapiens
gaaggacttcctg

SEQ ID NO: 6193227 - DNA, 21 bp, Homo sapiens
gaaggagaaaggagccggacc

SEQ ID NO: 6193228 - DNA, 17 bp, Homo sapiens
gaaggagaagtaagagg

SEQ ID NO: 6193229 - DNA, 22 bp, Homo sapiens
gaaggagaatcatcaggaccct

SEQ ID NO: 6193230 - DNA, 14 bp, Homo sapiens
gaaggagacacaga

SEQ ID NO: 6193231 - DNA, 17 bp, Homo sapiens
gaaggagacacagatgt

SEQ ID NO: 6193232 - DNA, 19 bp, Homo sapiens
gaaggagacaccaagctca

SEQ ID NO: 6193233 - DNA, 22 bp, Homo sapiens
gaaggagacagcagcacccacc

SEQ ID NO: 6193234 - DNA, 12 bp, Homo sapiens
gaaggagacagg

SEQ ID NO: 6193235 - DNA, 13 bp, Homo sapiens
gaaggagacagga

SEQ ID NO: 6193236 - DNA, 15 bp, Homo sapiens
gaaggagacaggcag

SEQ ID NO: 6193237 - DNA, 17 bp, Homo sapiens
gaaggagactcacctct

SEQ ID NO: 6193238 - DNA, 20 bp, Homo sapiens
gaaggagagaaggggaggag

SEQ ID NO: 6193239 - DNA, 17 bp, Homo sapiens
gaaggagagagtctttt

SEQ ID NO: 6193240 - DNA, 19 bp, Homo sapiens
gaaggagagagtcttttaa

SEQ ID NO: 6193241 - DNA, 23 bp, Homo sapiens
gaaggagagatgacccctacccc

SEQ ID NO: 6193242 - DNA, 16 bp, Homo sapiens
gaaggagagcccaggc

SEQ ID NO: 6193243 - DNA, 15 bp, Homo sapiens
gaaggagagcctgct

SEQ ID NO: 6193244 - DNA, 14 bp, Homo sapiens
gaaggagaggagtg

SEQ ID NO: 6193245 - DNA, 13 bp, Homo sapiens
gaaggagaggctc

SEQ ID NO: 6193246 - DNA, 13 bp, Homo sapiens
gaaggagagggag

SEQ ID NO: 6193247 - DNA, 16 bp, Homo sapiens
gaaggagatcagggca

SEQ ID NO: 6193248 - DNA, 20 bp, Homo sapiens
gaaggagatgagtgggcttc

SEQ ID NO: 6193249 - DNA, 14 bp, Homo sapiens
gaaggagattccac

SEQ ID NO: 6193250 - DNA, 16 bp, Homo sapiens
gaaggagccagctccc

SEQ ID NO: 6193251 - DNA, 21 bp, Homo sapiens
gaaggagccccattcctggga

SEQ ID NO: 6193252 - DNA, 22 bp, Homo sapiens
gaaggagccccattcctgggaa

SEQ ID NO: 6193253 - DNA, 13 bp, Homo sapiens
gaaggagcccctg

SEQ ID NO: 6193254 - DNA, 22 bp, Homo sapiens
gaaggagcctgcggctgctggc

SEQ ID NO: 6193255 - DNA, 20 bp, Homo sapiens
gaaggagcggcgccctggac

SEQ ID NO: 6193256 - DNA, 22 bp, Homo sapiens
gaaggagcggcgccctggactt

SEQ ID NO: 6193257 - DNA, 23 bp, Homo sapiens
gaaggagcggcgccctggacttg

SEQ ID NO: 6193258 - DNA, 21 bp, Homo sapiens
gaaggagctcccaggaggggc

SEQ ID NO: 6193259 - DNA, 12 bp, Homo sapiens
gaaggagctgag

SEQ ID NO: 6193260 - DNA, 12 bp, Homo sapiens
gaaggagctgcc

SEQ ID NO: 6193261 - DNA, 14 bp, Homo sapiens
gaaggagctgcctg

SEQ ID NO: 6193262 - DNA, 15 bp, Homo sapiens
gaaggagctgcctgg

SEQ ID NO: 6193263 - DNA, 12 bp, Homo sapiens
gaaggaggaagg

SEQ ID NO: 6193264 - DNA, 18 bp, Homo sapiens
gaaggaggaagggactgg

SEQ ID NO: 6193265 - DNA, 21 bp, Homo sapiens
gaaggaggaagggactggtcc

SEQ ID NO: 6193266 - DNA, 13 bp, Homo sapiens
gaaggaggaccca

SEQ ID NO: 6193267 - DNA, 14 bp, Homo sapiens
gaaggaggacccag

SEQ ID NO: 6193268 - DNA, 18 bp, Homo sapiens
gaaggaggacccaggaca

SEQ ID NO: 6193269 - DNA, 14 bp, Homo sapiens
gaaggaggagacag

SEQ ID NO: 6193270 - DNA, 20 bp, Homo sapiens
gaaggaggagagagagggga

SEQ ID NO: 6193271 - DNA, 20 bp, Homo sapiens
gaaggaggccaaccagcccg

SEQ ID NO: 6193272 - DNA, 12 bp, Homo sapiens
gaaggaggccac

SEQ ID NO: 6193273 - DNA, 16 bp, Homo sapiens
gaaggaggccacctcc

SEQ ID NO: 6193274 - DNA, 17 bp, Homo sapiens
gaaggaggccacctcct

SEQ ID NO: 6193275 - DNA, 21 bp, Homo sapiens
gaaggaggctatgctcagggg

SEQ ID NO: 6193276 - DNA, 16 bp, Homo sapiens
gaaggagggacttggc

SEQ ID NO: 6193277 - DNA, 19 bp, Homo sapiens
gaaggagggagctgctcag

SEQ ID NO: 6193278 - DNA, 12 bp, Homo sapiens
gaaggagggatg

SEQ ID NO: 6193279 - DNA, 18 bp, Homo sapiens
gaaggaggggaagctgca

SEQ ID NO: 6193280 - DNA, 22 bp, Homo sapiens
gaaggagtgccataccttctcc

SEQ ID NO: 6193281 - DNA, 18 bp, Homo sapiens
gaaggagttacagggaag

SEQ ID NO: 6193282 - DNA, 13 bp, Homo sapiens
gaaggagtttaaa

SEQ ID NO: 6193283 - DNA, 13 bp, Homo sapiens
gaaggagttttat

SEQ ID NO: 6193284 - DNA, 17 bp, Homo sapiens
gaaggataaagccactt

SEQ ID NO: 6193285 - DNA, 21 bp, Homo sapiens
gaaggatacaaaagcatgtga

SEQ ID NO: 6193286 - DNA, 10 bp, Homo sapiens
gaaggatcct

SEQ ID NO: 6193287 - DNA, 20 bp, Homo sapiens
gaaggatcctggaaccactg

SEQ ID NO: 6193288 - DNA, 15 bp, Homo sapiens
gaaggatctgctgag

SEQ ID NO: 6193289 - DNA, 22 bp, Homo sapiens
gaaggatctgtttttaaaaatc

SEQ ID NO: 6193290 - DNA, 13 bp, Homo sapiens
gaaggatgaacag

SEQ ID NO: 6193291 - DNA, 16 bp, Homo sapiens
gaaggatgagcattta

SEQ ID NO: 6193292 - DNA, 21 bp, Homo sapiens
gaaggatgatgtctttttatt

SEQ ID NO: 6193293 - DNA, 16 bp, Homo sapiens
gaaggatgccaagaag

SEQ ID NO: 6193294 - DNA, 22 bp, Homo sapiens
gaaggatgggaaaaactgcagt

SEQ ID NO: 6193295 - DNA, 23 bp, Homo sapiens
gaaggatgggatgggttccagag

SEQ ID NO: 6193296 - DNA, 22 bp, Homo sapiens
gaaggatgggggctcctggcag

SEQ ID NO: 6193297 - DNA, 16 bp, Homo sapiens
gaaggatgtacatttc

SEQ ID NO: 6193298 - DNA, 22 bp, Homo sapiens
gaaggattcagtcataaagagg

SEQ ID NO: 6193299 - DNA, 21 bp, Homo sapiens
gaaggattcttttttcaatgt

SEQ ID NO: 6193300 - DNA, 20 bp, Homo sapiens
gaaggattgcatcctgctgg

SEQ ID NO: 6193301 - DNA, 21 bp, Homo sapiens
gaaggattgcatcctgctggg

SEQ ID NO: 6193302 - DNA, 12 bp, Homo sapiens
gaaggattttaa

SEQ ID NO: 6193303 - DNA, 20 bp, Homo sapiens
gaaggcaaactgaggcagca

SEQ ID NO: 6193304 - DNA, 15 bp, Homo sapiens
gaaggcaaagcacga

SEQ ID NO: 6193305 - DNA, 18 bp, Homo sapiens
gaaggcaaagcccctgga

SEQ ID NO: 6193306 - DNA, 13 bp, Homo sapiens
gaaggcaaaggca

SEQ ID NO: 6193307 - DNA, 19 bp, Homo sapiens
gaaggcaaaggcagaggaa

SEQ ID NO: 6193308 - DNA, 20 bp, Homo sapiens
gaaggcaaagtttacagatg

SEQ ID NO: 6193309 - DNA, 15 bp, Homo sapiens
cttagcgctctggac

SEQ ID NO: 6193310 - DNA, 16 bp, Homo sapiens
cttagcgctctggaca

SEQ ID NO: 6193311 - DNA, 17 bp, Homo sapiens
cttagcgtcaagacatt

SEQ ID NO: 6193312 - DNA, 19 bp, Homo sapiens
cttagcgtcaagacatttg

SEQ ID NO: 6193313 - DNA, 23 bp, Homo sapiens
cttagcgtcaagacatttgctga

SEQ ID NO: 6193314 - DNA, 14 bp, Homo sapiens
cttagctactgtat

SEQ ID NO: 6193315 - DNA, 22 bp, Homo sapiens
cttagctactgtatgcaaagtc

SEQ ID NO: 6193316 - DNA, 13 bp, Homo sapiens
cttagctatattt

SEQ ID NO: 6193317 - DNA, 14 bp, Homo sapiens
cttagctatcagaa

SEQ ID NO: 6193318 - DNA, 17 bp, Homo sapiens
cttagctatccttggct

SEQ ID NO: 6193319 - DNA, 20 bp, Homo sapiens
cttagctcaatgagcatgtt

SEQ ID NO: 6193320 - DNA, 12 bp, Homo sapiens
cttagctcaggt

SEQ ID NO: 6193321 - DNA, 15 bp, Homo sapiens
cttagctcaggtgcc

SEQ ID NO: 6193322 - DNA, 16 bp, Homo sapiens
cttagctcaggtgcct

SEQ ID NO: 6193323 - DNA, 17 bp, Homo sapiens
cttagctccctcccgca

SEQ ID NO: 6193324 - DNA, 21 bp, Homo sapiens
cttagctccctcccgcacccc

SEQ ID NO: 6193325 - DNA, 19 bp, Homo sapiens
cttagctcggttctcccaa

SEQ ID NO: 6193326 - DNA, 19 bp, Homo sapiens
cttagctctgccctggaac

SEQ ID NO: 6193327 - DNA, 20 bp, Homo sapiens
cttagctctgccctggaacc

SEQ ID NO: 6193328 - DNA, 14 bp, Homo sapiens
cttagctctggacg

SEQ ID NO: 6193329 - DNA, 11 bp, Homo sapiens
cttagctgagt

SEQ ID NO: 6193330 - DNA, 14 bp, Homo sapiens
cttagctgatgtct

SEQ ID NO: 6193331 - DNA, 14 bp, Homo sapiens
cttagctgccaagt

SEQ ID NO: 6193332 - DNA, 12 bp, Homo sapiens
cttagctgccag

SEQ ID NO: 6193333 - DNA, 14 bp, Homo sapiens
cttagctgccagtg

SEQ ID NO: 6193334 - DNA, 12 bp, Homo sapiens
cttagctggcca

SEQ ID NO: 6193335 - DNA, 14 bp, Homo sapiens
cttagctgtctgct

SEQ ID NO: 6193336 - DNA, 17 bp, Homo sapiens
cttagctgtctgctcag

SEQ ID NO: 6193337 - DNA, 16 bp, Homo sapiens
cttagcttagacctca

SEQ ID NO: 6193338 - DNA, 17 bp, Homo sapiens
cttagcttagacctcag

SEQ ID NO: 6193339 - DNA, 21 bp, Homo sapiens
cttagcttagacctcagcctg

SEQ ID NO: 6193340 - DNA, 22 bp, Homo sapiens
cttagcttagacctcagcctgt

SEQ ID NO: 6193341 - DNA, 20 bp, Homo sapiens
cttagcttatctttctttcc

SEQ ID NO: 6193342 - DNA, 21 bp, Homo sapiens
cttagcttatctttctttcca

SEQ ID NO: 6193343 - DNA, 19 bp, Homo sapiens
cttagcttattgatcccac

SEQ ID NO: 6193344 - DNA, 21 bp, Homo sapiens
cttagcttgcacatgaatgca

SEQ ID NO: 6193345 - DNA, 14 bp, Homo sapiens
cttagctttacatt

SEQ ID NO: 6193346 - DNA, 16 bp, Homo sapiens
cttagctttagaaaca

SEQ ID NO: 6193347 - DNA, 13 bp, Homo sapiens
cttagctttattt

SEQ ID NO: 6193348 - DNA, 17 bp, Homo sapiens
cttagctttccacagga

SEQ ID NO: 6193349 - DNA, 18 bp, Homo sapiens
cttagctttccctgtgcc

SEQ ID NO: 6193350 - DNA, 20 bp, Homo sapiens
cttagctttccctgtgccac

SEQ ID NO: 6193351 - DNA, 22 bp, Homo sapiens
cttagctttccctgtgccactt

SEQ ID NO: 6193352 - DNA, 16 bp, Homo sapiens
cttagctttctcaggg

SEQ ID NO: 6193353 - DNA, 13 bp, Homo sapiens
cttagctttctgg

SEQ ID NO: 6193354 - DNA, 13 bp, Homo sapiens
cttagctttgaaa

SEQ ID NO: 6193355 - DNA, 15 bp, Homo sapiens
cttagctttgaaact

SEQ ID NO: 6193356 - DNA, 19 bp, Homo sapiens
cttagcttttagcctggct

SEQ ID NO: 6193357 - DNA, 15 bp, Homo sapiens
cttagcttttctgca

SEQ ID NO: 6193358 - DNA, 20 bp, Homo sapiens
cttagcttttgatgtctcca

SEQ ID NO: 6193359 - DNA, 18 bp, Homo sapiens
cttaggaaaatgcttctg

SEQ ID NO: 6193360 - DNA, 15 bp, Homo sapiens
cttaggaacagctct

SEQ ID NO: 6193361 - DNA, 23 bp, Homo sapiens
cttaggaaccttctcccttcttg

SEQ ID NO: 6193362 - DNA, 15 bp, Homo sapiens
cttaggaagaatttt

SEQ ID NO: 6193363 - DNA, 16 bp, Homo sapiens
cttaggaatactgttt

SEQ ID NO: 6193364 - DNA, 23 bp, Homo sapiens
cttaggactacattttgctctgt

SEQ ID NO: 6193365 - DNA, 22 bp, Homo sapiens
cttaggagatttaccacttttt

SEQ ID NO: 6193366 - DNA, 18 bp, Homo sapiens
cttaggagcaagaagaaa

SEQ ID NO: 6193367 - DNA, 19 bp, Homo sapiens
cttaggagcaagaagaaaa

SEQ ID NO: 6193368 - DNA, 14 bp, Homo sapiens
cttaggatgtctgt

SEQ ID NO: 6193369 - DNA, 23 bp, Homo sapiens
cttaggcaatggtgaactgtcat

SEQ ID NO: 6193370 - DNA, 21 bp, Homo sapiens
cttaggcactgagggatctga

SEQ ID NO: 6193371 - DNA, 19 bp, Homo sapiens
cttaggcatgactgtagaa

SEQ ID NO: 6193372 - DNA, 22 bp, Homo sapiens
cttaggcatgtaggaccctgca

SEQ ID NO: 6193373 - DNA, 17 bp, Homo sapiens
cttaggcattatttaat

SEQ ID NO: 6193374 - DNA, 22 bp, Homo sapiens
cttaggcattatttaatgtttg

SEQ ID NO: 6193375 - DNA, 23 bp, Homo sapiens
cttaggccttcctctctccagat

SEQ ID NO: 6193376 - DNA, 21 bp, Homo sapiens
cttaggctactgtaatgctgc

SEQ ID NO: 6193377 - DNA, 22 bp, Homo sapiens
cttaggctactgtaatgctgcc

SEQ ID NO: 6193378 - DNA, 19 bp, Homo sapiens
cttaggcttggctgccctg

SEQ ID NO: 6193379 - DNA, 16 bp, Homo sapiens
cttaggctttgtatga

SEQ ID NO: 6193380 - DNA, 12 bp, Homo sapiens
cttagggaaaga

SEQ ID NO: 6193381 - DNA, 14 bp, Homo sapiens
cttagggaagaaaa

SEQ ID NO: 6193382 - DNA, 15 bp, Homo sapiens
cttagggaagaaaaa

SEQ ID NO: 6193383 - DNA, 17 bp, Homo sapiens
cttagggaagctggcct

SEQ ID NO: 6193384 - DNA, 21 bp, Homo sapiens
cttagggaaggatacaaaagc

SEQ ID NO: 6193385 - DNA, 18 bp, Homo sapiens
cttagggacaggacccca

SEQ ID NO: 6193386 - DNA, 21 bp, Homo sapiens
cttagggacaggaccccagct

SEQ ID NO: 6193387 - DNA, 22 bp, Homo sapiens
cttagggacaggaccccagctc

SEQ ID NO: 6193388 - DNA, 23 bp, Homo sapiens
cttagggacaggaccccagctct

SEQ ID NO: 6193389 - DNA, 23 bp, Homo sapiens
cttagggactacccatagacatg

SEQ ID NO: 6193390 - DNA, 15 bp, Homo sapiens
cttagggcaccaggg

SEQ ID NO: 6193391 - DNA, 13 bp, Homo sapiens
cttagggcactgg

SEQ ID NO: 6193392 - DNA, 17 bp, Homo sapiens
cttagggcactgggctg

SEQ ID NO: 6193393 - DNA, 18 bp, Homo sapiens
cttagggccctggaggcg

SEQ ID NO: 6193394 - DNA, 20 bp, Homo sapiens
cttaggggaaccctgtccct

SEQ ID NO: 6193395 - DNA, 18 bp, Homo sapiens
cttaggggaatgttttcg

SEQ ID NO: 6193396 - DNA, 19 bp, Homo sapiens
cttagggtacagcccaggc

SEQ ID NO: 6193397 - DNA, 20 bp, Homo sapiens
cttagggtacagcccaggcg

SEQ ID NO: 6193398 - DNA, 13 bp, Homo sapiens
cttagggtctcag

SEQ ID NO: 6193399 - DNA, 20 bp, Homo sapiens
cttagggtggctttaattgt

SEQ ID NO: 6193400 - DNA, 19 bp, Homo sapiens
cttagggtttgcagagtgg

SEQ ID NO: 6193401 - DNA, 23 bp, Homo sapiens
cttaggtaatttggaagaaaact

SEQ ID NO: 6193402 - DNA, 18 bp, Homo sapiens
cttaggtacttattccag

SEQ ID NO: 6193403 - DNA, 23 bp, Homo sapiens
cttaggtcctcacttctgtctcc

SEQ ID NO: 6193404 - DNA, 15 bp, Homo sapiens
cttaggtctcatgga

SEQ ID NO: 6193405 - DNA, 13 bp, Homo sapiens
cttaggtcttcct

SEQ ID NO: 6193406 - DNA, 17 bp, Homo sapiens
cttaggtcttcctgtgg

SEQ ID NO: 6193407 - DNA, 22 bp, Homo sapiens
cttaggtcttcctgtggctccc

SEQ ID NO: 6193408 - DNA, 22 bp, Homo sapiens
cttaggtgagacagttgcccga

SEQ ID NO: 6193409 - DNA, 21 bp, Homo sapiens
cttaggtggcaagctgtgact

SEQ ID NO: 6193410 - DNA, 22 bp, Homo sapiens
cttaggtgtgattataaaatca

SEQ ID NO: 6193411 - DNA, 21 bp, Homo sapiens
cttaggttgtagcagaaagga

SEQ ID NO: 6193412 - DNA, 13 bp, Homo sapiens
cttaggtttactg

SEQ ID NO: 6193413 - DNA, 16 bp, Homo sapiens
cttaggtttactgtga

SEQ ID NO: 6193414 - DNA, 18 bp, Homo sapiens
cttaggtttactgtgaag

SEQ ID NO: 6193415 - DNA, 21 bp, Homo sapiens
cttaggtttactgtgaagaga

SEQ ID NO: 6193416 - DNA, 14 bp, Homo sapiens
cttaggtttccacg

SEQ ID NO: 6193417 - DNA, 20 bp, Homo sapiens
cttagtaaaatttatttcat

SEQ ID NO: 6193418 - DNA, 18 bp, Homo sapiens
cttagtaaattcctaatt

SEQ ID NO: 6193419 - DNA, 23 bp, Homo sapiens
cttagtaagcggctcaagcccag

SEQ ID NO: 6193420 - DNA, 12 bp, Homo sapiens
cttagtaagtat

SEQ ID NO: 6193421 - DNA, 21 bp, Homo sapiens
cttagtaatgctacgtgtgat

SEQ ID NO: 6193422 - DNA, 23 bp, Homo sapiens
cttagtaatgctacgtgtgattt

SEQ ID NO: 6193423 - DNA, 16 bp, Homo sapiens
cttagtacatgctctg

SEQ ID NO: 6193424 - DNA, 20 bp, Homo sapiens
cttagtacatgctctgtcca

SEQ ID NO: 6193425 - DNA, 17 bp, Homo sapiens
cttagtacggctgctgc

SEQ ID NO: 6193426 - DNA, 14 bp, Homo sapiens
cttagtactgagtt

SEQ ID NO: 6193427 - DNA, 13 bp, Homo sapiens
cttagtaggtcct

SEQ ID NO: 6193428 - DNA, 20 bp, Homo sapiens
cttagtaggtcctcaataaa

SEQ ID NO: 6193429 - DNA, 17 bp, Homo sapiens
cttagtagtttttacaa

SEQ ID NO: 6193430 - DNA, 15 bp, Homo sapiens
cttagtatcagtcat

SEQ ID NO: 6193431 - DNA, 13 bp, Homo sapiens
cttagtatctcat

SEQ ID NO: 6193432 - DNA, 17 bp, Homo sapiens
cttagtatctcatcaac

SEQ ID NO: 6193433 - DNA, 19 bp, Homo sapiens
cttagtatctcatcaacaa

SEQ ID NO: 6193434 - DNA, 22 bp, Homo sapiens
cttagtatctcatcaacaaaga

SEQ ID NO: 6193435 - DNA, 16 bp, Homo sapiens
cttagtatttctcagg

SEQ ID NO: 6193436 - DNA, 18 bp, Homo sapiens
cttagtatttctcaggaa

SEQ ID NO: 6193437 - DNA, 21 bp, Homo sapiens
cttagtcactgagacagcccg

SEQ ID NO: 6193438 - DNA, 14 bp, Homo sapiens
cttagtcactgcct

SEQ ID NO: 6193439 - DNA, 16 bp, Homo sapiens
cttagtcactgcctgc

SEQ ID NO: 6193440 - DNA, 13 bp, Homo sapiens
cttagtccacaag

SEQ ID NO: 6193441 - DNA, 13 bp, Homo sapiens
cttagtcccaagc

SEQ ID NO: 6193442 - DNA, 19 bp, Homo sapiens
cttagtcccacagggaaat

SEQ ID NO: 6193443 - DNA, 17 bp, Homo sapiens
cttagtcctccctgctc

SEQ ID NO: 6193444 - DNA, 21 bp, Homo sapiens
cttagtcctccctgctcagct

SEQ ID NO: 6193445 - DNA, 11 bp, Homo sapiens
cttagtcctgg

SEQ ID NO: 6193446 - DNA, 14 bp, Homo sapiens
cttagtcctgggag

SEQ ID NO: 6193447 - DNA, 23 bp, Homo sapiens
cttagtcgaatgttagattcctc

SEQ ID NO: 6193448 - DNA, 13 bp, Homo sapiens
cttagtctcagtt

SEQ ID NO: 6193449 - DNA, 16 bp, Homo sapiens
cttagtcttctcatag

SEQ ID NO: 6193450 - DNA, 20 bp, Homo sapiens
cttagtcttctcatagcatt

SEQ ID NO: 6193451 - DNA, 17 bp, Homo sapiens
cttagtgaaattacttc

SEQ ID NO: 6193452 - DNA, 15 bp, Homo sapiens
cttagtgacttagtt

SEQ ID NO: 6193453 - DNA, 13 bp, Homo sapiens
cttagtgagcagt

SEQ ID NO: 6193454 - DNA, 16 bp, Homo sapiens
cttagtgagcagtgag

SEQ ID NO: 6193455 - DNA, 20 bp, Homo sapiens
cttagtgatcatttaaaaag

SEQ ID NO: 6193456 - DNA, 21 bp, Homo sapiens
cttagtgattgagactcaaaa

SEQ ID NO: 6193457 - DNA, 20 bp, Homo sapiens
cttagtgccaggagggcaca

SEQ ID NO: 6193458 - DNA, 19 bp, Homo sapiens
cttagtgcggacaagtttt

SEQ ID NO: 6193459 - DNA, 22 bp, Homo sapiens
cttagtgcggacaagttttaat

SEQ ID NO: 6193460 - DNA, 15 bp, Homo sapiens
cttagtgctatgtgt

SEQ ID NO: 6193461 - DNA, 13 bp, Homo sapiens
cttagtggctttt

SEQ ID NO: 6193462 - DNA, 16 bp, Homo sapiens
cttagtggtatgtctc

SEQ ID NO: 6193463 - DNA, 14 bp, Homo sapiens
cttagtgtctcgtg

SEQ ID NO: 6193464 - DNA, 14 bp, Homo sapiens
cttagtgttcaaaa

SEQ ID NO: 6193465 - DNA, 16 bp, Homo sapiens
cttagtgtttctgtgc

SEQ ID NO: 6193466 - DNA, 17 bp, Homo sapiens
cttagtgtttctgtgca

SEQ ID NO: 6193467 - DNA, 21 bp, Homo sapiens
cttagttaagtcatccacagc

SEQ ID NO: 6193468 - DNA, 16 bp, Homo sapiens
cttagttacatttcta

SEQ ID NO: 6193469 - DNA, 22 bp, Homo sapiens
cttagttcacctaccctgagtg

SEQ ID NO: 6193470 - DNA, 19 bp, Homo sapiens
cttagttctgtatataaat

SEQ ID NO: 6193471 - DNA, 13 bp, Homo sapiens
cttagttcttgaa

SEQ ID NO: 6193472 - DNA, 15 bp, Homo sapiens
cttagttcttgaatt

SEQ ID NO: 6193473 - DNA, 20 bp, Homo sapiens
cttagttcttgaattgttat

SEQ ID NO: 6193474 - DNA, 15 bp, Homo sapiens
cttagtttattgtgg

SEQ ID NO: 6193475 - DNA, 20 bp, Homo sapiens
cttagtttcaaagtgtctca

SEQ ID NO: 6193476 - DNA, 20 bp, Homo sapiens
cttagtttcagagaccttaa

SEQ ID NO: 6193477 - DNA, 22 bp, Homo sapiens
cttagtttcagctgaccagaag

SEQ ID NO: 6193478 - DNA, 22 bp, Homo sapiens
cttagtttgtgaattgattttg

SEQ ID NO: 6193479 - DNA, 22 bp, Homo sapiens
cttagtttgtgatgtaaggcac

SEQ ID NO: 6193480 - DNA, 16 bp, Homo sapiens
cttagttttgttccaa

SEQ ID NO: 6193481 - DNA, 14 bp, Homo sapiens
cttagtttttaaaa

SEQ ID NO: 6193482 - DNA, 17 bp, Homo sapiens
cttagtttttaaaaagg

SEQ ID NO: 6193483 - DNA, 18 bp, Homo sapiens
cttagtttttaaaaaggc

SEQ ID NO: 6193484 - DNA, 17 bp, Homo sapiens
cttagtttttaccttgt

SEQ ID NO: 6193485 - DNA, 17 bp, Homo sapiens
cttagttttttttaaaa

SEQ ID NO: 6193486 - DNA, 21 bp, Homo sapiens
cttataaaaataaagggaaga

SEQ ID NO: 6193487 - DNA, 23 bp, Homo sapiens
gaaggcaacacctgtggataaaa

SEQ ID NO: 6193488 - DNA, 16 bp, Homo sapiens
gaaggcaaccattttt

SEQ ID NO: 6193489 - DNA, 23 bp, Homo sapiens
gaaggcaagagggggtggagggg

SEQ ID NO: 6193490 - DNA, 11 bp, Homo sapiens
gaaggcaagat

SEQ ID NO: 6193491 - DNA, 14 bp, Homo sapiens
gaaggcaagccagg

SEQ ID NO: 6193492 - DNA, 17 bp, Homo sapiens
gaaggcaagctggcagg

SEQ ID NO: 6193493 - DNA, 15 bp, Homo sapiens
gaaggcaaggccctg

SEQ ID NO: 6193494 - DNA, 19 bp, Homo sapiens
gaaggcaaggccctgccct

SEQ ID NO: 6193495 - DNA, 20 bp, Homo sapiens
gaaggcaataccaacctgaa

SEQ ID NO: 6193496 - DNA, 22 bp, Homo sapiens
gaaggcaataccaacctgaaag

SEQ ID NO: 6193497 - DNA, 22 bp, Homo sapiens
gaaggcacacagagattctgga

SEQ ID NO: 6193498 - DNA, 16 bp, Homo sapiens
gaaggcacactgagca

SEQ ID NO: 6193499 - DNA, 14 bp, Homo sapiens
gaaggcacctgctc

SEQ ID NO: 6193500 - DNA, 15 bp, Homo sapiens
gaaggcagaaagcaa

SEQ ID NO: 6193501 - DNA, 18 bp, Homo sapiens
gaaggcagaaagcaaaat

SEQ ID NO: 6193502 - DNA, 14 bp, Homo sapiens
gaaggcagacagca

SEQ ID NO: 6193503 - DNA, 22 bp, Homo sapiens
gaaggcagagaaagggacaatg

SEQ ID NO: 6193504 - DNA, 18 bp, Homo sapiens
gaaggcagagaaatctaa

SEQ ID NO: 6193505 - DNA, 19 bp, Homo sapiens
gaaggcagaggctggcacc

SEQ ID NO: 6193506 - DNA, 14 bp, Homo sapiens
gaaggcagcattcc

SEQ ID NO: 6193507 - DNA, 13 bp, Homo sapiens
gaaggcagctgct

SEQ ID NO: 6193508 - DNA, 21 bp, Homo sapiens
gaaggcaggagccttcctttc

SEQ ID NO: 6193509 - DNA, 21 bp, Homo sapiens
gaaggcaggagttgggggcag

SEQ ID NO: 6193510 - DNA, 14 bp, Homo sapiens
gaaggcaggcaggg

SEQ ID NO: 6193511 - DNA, 15 bp, Homo sapiens
gaaggcaggcagggc

SEQ ID NO: 6193512 - DNA, 22 bp, Homo sapiens
gaaggcaggcagggctctcctg

SEQ ID NO: 6193513 - DNA, 23 bp, Homo sapiens
gaaggcaggcctccgtcttccca

SEQ ID NO: 6193514 - DNA, 20 bp, Homo sapiens
gaaggcagggaatgcctgga

SEQ ID NO: 6193515 - DNA, 22 bp, Homo sapiens
gaaggcagggaatgcctggagg

SEQ ID NO: 6193516 - DNA, 14 bp, Homo sapiens
gaaggcagggagga

SEQ ID NO: 6193517 - DNA, 16 bp, Homo sapiens
gaaggcagggaggagg

SEQ ID NO: 6193518 - DNA, 17 bp, Homo sapiens
gaaggcagggaggaggc

SEQ ID NO: 6193519 - DNA, 18 bp, Homo sapiens
gaaggcagggagggcctg

SEQ ID NO: 6193520 - DNA, 22 bp, Homo sapiens
gaaggcagggagggcctgggcc

SEQ ID NO: 6193521 - DNA, 23 bp, Homo sapiens
gaaggcagggagggcctgggccc

SEQ ID NO: 6193522 - DNA, 15 bp, Homo sapiens
gaaggcagggcagag

SEQ ID NO: 6193523 - DNA, 14 bp, Homo sapiens
gaaggcagggctcc

SEQ ID NO: 6193524 - DNA, 15 bp, Homo sapiens
gaaggcagggctcct

SEQ ID NO: 6193525 - DNA, 23 bp, Homo sapiens
gaaggcagggctcctccctggag

SEQ ID NO: 6193526 - DNA, 14 bp, Homo sapiens
gaaggcatgagaaa

SEQ ID NO: 6193527 - DNA, 18 bp, Homo sapiens
gaaggcattgtcctgtga

SEQ ID NO: 6193528 - DNA, 23 bp, Homo sapiens
gaaggcatttgcagggtcctctt

SEQ ID NO: 6193529 - DNA, 16 bp, Homo sapiens
gaaggccacctgcagg

SEQ ID NO: 6193530 - DNA, 17 bp, Homo sapiens
gaaggccacctgcaggt

SEQ ID NO: 6193531 - DNA, 15 bp, Homo sapiens
gaaggccacttgtgt

SEQ ID NO: 6193532 - DNA, 16 bp, Homo sapiens
gaaggccagaaaaggc

SEQ ID NO: 6193533 - DNA, 19 bp, Homo sapiens
gaaggccagaaaaggcagc

SEQ ID NO: 6193534 - DNA, 21 bp, Homo sapiens
gaaggccagaaaaggcagcca

SEQ ID NO: 6193535 - DNA, 21 bp, Homo sapiens
gaaggccagagagggaaaagg

SEQ ID NO: 6193536 - DNA, 12 bp, Homo sapiens
gaaggccagccc

SEQ ID NO: 6193537 - DNA, 21 bp, Homo sapiens
gaaggccagccctccctggct

SEQ ID NO: 6193538 - DNA, 22 bp, Homo sapiens
gaaggccagctgccccagccag

SEQ ID NO: 6193539 - DNA, 14 bp, Homo sapiens
gaaggccaggcctc

SEQ ID NO: 6193540 - DNA, 22 bp, Homo sapiens
gaaggccatcatctctgtaaac

SEQ ID NO: 6193541 - DNA, 19 bp, Homo sapiens
gaaggccatggggcagcct

SEQ ID NO: 6193542 - DNA, 23 bp, Homo sapiens
gaaggccatggggcagcctccag

SEQ ID NO: 6193543 - DNA, 23 bp, Homo sapiens
gaaggcccaagagcagagtctgg

SEQ ID NO: 6193544 - DNA, 22 bp, Homo sapiens
gaaggcccagcaccaccctcct

SEQ ID NO: 6193545 - DNA, 12 bp, Homo sapiens
gaaggcccatga

SEQ ID NO: 6193546 - DNA, 16 bp, Homo sapiens
gaaggccccagagaga

SEQ ID NO: 6193547 - DNA, 22 bp, Homo sapiens
gaaggccccagagagaccctgc

SEQ ID NO: 6193548 - DNA, 15 bp, Homo sapiens
gaaggccccgcccag

SEQ ID NO: 6193549 - DNA, 17 bp, Homo sapiens
gaaggccccgcccaggc

SEQ ID NO: 6193550 - DNA, 22 bp, Homo sapiens
gaaggcccctctgtggagcgcc

SEQ ID NO: 6193551 - DNA, 13 bp, Homo sapiens
gaaggccccttcc

SEQ ID NO: 6193552 - DNA, 17 bp, Homo sapiens
gaaggccccttccctgg

SEQ ID NO: 6193553 - DNA, 16 bp, Homo sapiens
gaaggcccgaggaggc

SEQ ID NO: 6193554 - DNA, 17 bp, Homo sapiens
gaaggcccgaggaggcc

SEQ ID NO: 6193555 - DNA, 21 bp, Homo sapiens
gaaggcccgaggaggccgact

SEQ ID NO: 6193556 - DNA, 16 bp, Homo sapiens
gaaggccctgtgccct

SEQ ID NO: 6193557 - DNA, 18 bp, Homo sapiens
gaaggccgagaagcaaga

SEQ ID NO: 6193558 - DNA, 21 bp, Homo sapiens
gaaggccgctgccccagcccc

SEQ ID NO: 6193559 - DNA, 17 bp, Homo sapiens
gaaggcctaggctagga

SEQ ID NO: 6193560 - DNA, 19 bp, Homo sapiens
gaaggcctcactcaagcct

SEQ ID NO: 6193561 - DNA, 14 bp, Homo sapiens
gaaggcctcccctg

SEQ ID NO: 6193562 - DNA, 20 bp, Homo sapiens
gaaggcctccctagccagca

SEQ ID NO: 6193563 - DNA, 18 bp, Homo sapiens
gaaggcctcgcaggaaga

SEQ ID NO: 6193564 - DNA, 18 bp, Homo sapiens
gaaggcctcttgtgctca

SEQ ID NO: 6193565 - DNA, 17 bp, Homo sapiens
gaaggcctgagggaagc

SEQ ID NO: 6193566 - DNA, 16 bp, Homo sapiens
gaaggcctgcccccct

SEQ ID NO: 6193567 - DNA, 18 bp, Homo sapiens
gaaggcctgccccccttc

SEQ ID NO: 6193568 - DNA, 22 bp, Homo sapiens
gaaggcctggctggaagagggt

SEQ ID NO: 6193569 - DNA, 15 bp, Homo sapiens
gaaggcctggtcagc

SEQ ID NO: 6193570 - DNA, 19 bp, Homo sapiens
gaaggccttacagaaaatt

SEQ ID NO: 6193571 - DNA, 18 bp, Homo sapiens
gaaggcgctgggtgcctg

SEQ ID NO: 6193572 - DNA, 14 bp, Homo sapiens
gaaggcggcaggca

SEQ ID NO: 6193573 - DNA, 17 bp, Homo sapiens
gaaggcggcaggcagag

SEQ ID NO: 6193574 - DNA, 18 bp, Homo sapiens
gaaggcggcaggcagaga

SEQ ID NO: 6193575 - DNA, 20 bp, Homo sapiens
gaaggcggcaggcagagaag

SEQ ID NO: 6193576 - DNA, 15 bp, Homo sapiens
gaaggcgggctgagg

SEQ ID NO: 6193577 - DNA, 13 bp, Homo sapiens
gaaggcgtgcaag

SEQ ID NO: 6193578 - DNA, 21 bp, Homo sapiens
gaaggcgtgcaaggggctcag

SEQ ID NO: 6193579 - DNA, 16 bp, Homo sapiens
gaaggcgtgggggaca

SEQ ID NO: 6193580 - DNA, 22 bp, Homo sapiens
gaaggctaaagaagacacacag

SEQ ID NO: 6193581 - DNA, 20 bp, Homo sapiens
gaaggctaagcatggcctgg

SEQ ID NO: 6193582 - DNA, 17 bp, Homo sapiens
gaaggctactggcatta

SEQ ID NO: 6193583 - DNA, 15 bp, Homo sapiens
gaaggctatggggat

SEQ ID NO: 6193584 - DNA, 21 bp, Homo sapiens
gaaggctcatttacttgaaat

SEQ ID NO: 6193585 - DNA, 18 bp, Homo sapiens
gaaggctctatctgctgg

SEQ ID NO: 6193586 - DNA, 20 bp, Homo sapiens
gaaggctctcgggtggggga

SEQ ID NO: 6193587 - DNA, 22 bp, Homo sapiens
gaaggctgaactcttcagaaca

SEQ ID NO: 6193588 - DNA, 13 bp, Homo sapiens
gaaggctgccaac

SEQ ID NO: 6193589 - DNA, 13 bp, Homo sapiens
gaaggctgcccct

SEQ ID NO: 6193590 - DNA, 19 bp, Homo sapiens
gaaggctgcctaaggagga

SEQ ID NO: 6193591 - DNA, 13 bp, Homo sapiens
gaaggctgctgtg

SEQ ID NO: 6193592 - DNA, 15 bp, Homo sapiens
gaaggctggagaagg

SEQ ID NO: 6193593 - DNA, 14 bp, Homo sapiens
gaaggctggcatga

SEQ ID NO: 6193594 - DNA, 18 bp, Homo sapiens
gaaggctggcatgatcca

SEQ ID NO: 6193595 - DNA, 15 bp, Homo sapiens
gaaggctggctgagt

SEQ ID NO: 6193596 - DNA, 13 bp, Homo sapiens
gaaggctggctgg

SEQ ID NO: 6193597 - DNA, 14 bp, Homo sapiens
gaaggctggggcca

SEQ ID NO: 6193598 - DNA, 15 bp, Homo sapiens
gaaggctggggccag

SEQ ID NO: 6193599 - DNA, 16 bp, Homo sapiens
gaaggctggggccagt

SEQ ID NO: 6193600 - DNA, 16 bp, Homo sapiens
gaaggcttaagaactg

SEQ ID NO: 6193601 - DNA, 23 bp, Homo sapiens
gaaggcttaattgactgaaatta

SEQ ID NO: 6193602 - DNA, 13 bp, Homo sapiens
gaaggcttcactc

SEQ ID NO: 6193603 - DNA, 16 bp, Homo sapiens
gaaggcttcctccagc

SEQ ID NO: 6193604 - DNA, 13 bp, Homo sapiens
gaaggcttctctc

SEQ ID NO: 6193605 - DNA, 23 bp, Homo sapiens
gaaggcttctctccacagtgttg

SEQ ID NO: 6193606 - DNA, 15 bp, Homo sapiens
gaaggcttgggattt

SEQ ID NO: 6193607 - DNA, 24 bp, Homo sapiens
gaaggctttcagggcctccagccc

SEQ ID NO: 6193608 - DNA, 18 bp, Homo sapiens
gaagggaaagcgggcagc

SEQ ID NO: 6193609 - DNA, 20 bp, Homo sapiens
gaagggaaagcgggcagccc

SEQ ID NO: 6193610 - DNA, 16 bp, Homo sapiens
gaagggaaatcaattt

SEQ ID NO: 6193611 - DNA, 23 bp, Homo sapiens
gaagggaaattgtttatgtgtta

SEQ ID NO: 6193612 - DNA, 17 bp, Homo sapiens
gaagggaacagcctgag

SEQ ID NO: 6193613 - DNA, 15 bp, Homo sapiens
gaagggaaccagccc

SEQ ID NO: 6193614 - DNA, 16 bp, Homo sapiens
gaagggaaccagccct

SEQ ID NO: 6193615 - DNA, 22 bp, Homo sapiens
gaagggaaccagccctccagag

SEQ ID NO: 6193616 - DNA, 18 bp, Homo sapiens
gaagggaagaaggggcca

SEQ ID NO: 6193617 - DNA, 20 bp, Homo sapiens
gaagggaagaaggggccatc

SEQ ID NO: 6193618 - DNA, 12 bp, Homo sapiens
gaagggaagcct

SEQ ID NO: 6193619 - DNA, 23 bp, Homo sapiens
gaagggaagcgtatatacttaag

SEQ ID NO: 6193620 - DNA, 18 bp, Homo sapiens
gaagggaattgtttttat

SEQ ID NO: 6193621 - DNA, 14 bp, Homo sapiens
gaagggacagctgc

SEQ ID NO: 6193622 - DNA, 15 bp, Homo sapiens
gaagggaccaaggca

SEQ ID NO: 6193623 - DNA, 16 bp, Homo sapiens
gaagggacggctgtgg

SEQ ID NO: 6193624 - DNA, 14 bp, Homo sapiens
gaagggactggtcc

SEQ ID NO: 6193625 - DNA, 15 bp, Homo sapiens
gaagggactggtcca

SEQ ID NO: 6193626 - DNA, 16 bp, Homo sapiens
gaagggactggtccag

SEQ ID NO: 6193627 - DNA, 18 bp, Homo sapiens
gaagggactggtccaggc

SEQ ID NO: 6193628 - DNA, 15 bp, Homo sapiens
gaagggacttttatt

SEQ ID NO: 6193629 - DNA, 23 bp, Homo sapiens
gaagggagaagacactgcagtga

SEQ ID NO: 6193630 - DNA, 21 bp, Homo sapiens
gaagggagaaggatctagaat

SEQ ID NO: 6193631 - DNA, 13 bp, Homo sapiens
gaagggagagggc

SEQ ID NO: 6193632 - DNA, 18 bp, Homo sapiens
gaagggagagggcctctg

SEQ ID NO: 6193633 - DNA, 23 bp, Homo sapiens
gaagggagagggcctctgcctgg

SEQ ID NO: 6193634 - DNA, 23 bp, Homo sapiens
gaagggagagttctttgctgccc

SEQ ID NO: 6193635 - DNA, 16 bp, Homo sapiens
gaagggagcagcacac

SEQ ID NO: 6193636 - DNA, 12 bp, Homo sapiens
gaagggagccaa

SEQ ID NO: 6193637 - DNA, 22 bp, Homo sapiens
gaagggagccaagggatggaca

SEQ ID NO: 6193638 - DNA, 16 bp, Homo sapiens
gaagggaggcctgagg

SEQ ID NO: 6193639 - DNA, 15 bp, Homo sapiens
gaagggagggcagag

SEQ ID NO: 6193640 - DNA, 15 bp, Homo sapiens
gaagggaggggaagg

SEQ ID NO: 6193641 - DNA, 17 bp, Homo sapiens
gaagggaggggaagggg

SEQ ID NO: 6193642 - DNA, 17 bp, Homo sapiens
gaagggagggggctggc

SEQ ID NO: 6193643 - DNA, 13 bp, Homo sapiens
gaagggagggtgg

SEQ ID NO: 6193644 - DNA, 18 bp, Homo sapiens
gaagggagggtggccagc

SEQ ID NO: 6193645 - DNA, 15 bp, Homo sapiens
gaagggataatttat

SEQ ID NO: 6193646 - DNA, 18 bp, Homo sapiens
gaagggatatgtgaaaca

SEQ ID NO: 6193647 - DNA, 15 bp, Homo sapiens
gaagggatccctaac

SEQ ID NO: 6193648 - DNA, 12 bp, Homo sapiens
gaagggatgggg

SEQ ID NO: 6193649 - DNA, 15 bp, Homo sapiens
gaagggatgggggaa

SEQ ID NO: 6193650 - DNA, 14 bp, Homo sapiens
gaagggcaagaaat

SEQ ID NO: 6193651 - DNA, 13 bp, Homo sapiens
gaagggcaagttt

SEQ ID NO: 6193652 - DNA, 11 bp, Homo sapiens
gaagggcaccg

SEQ ID NO: 6193653 - DNA, 15 bp, Homo sapiens
gaagggcaccgagaa

SEQ ID NO: 6193654 - DNA, 17 bp, Homo sapiens
gaagggcactatatttt

SEQ ID NO: 6193655 - DNA, 13 bp, Homo sapiens
gaagggcagcccc

SEQ ID NO: 6193656 - DNA, 12 bp, Homo sapiens
gaagggcaggag

SEQ ID NO: 6193657 - DNA, 11 bp, Homo sapiens
gaagggcaggc

SEQ ID NO: 6193658 - DNA, 21 bp, Homo sapiens
gaagggcataaaacagctttg

SEQ ID NO: 6193659 - DNA, 18 bp, Homo sapiens
gaagggcatcatgcatct

SEQ ID NO: 6193660 - DNA, 17 bp, Homo sapiens
gaagggcatgcacgggc

SEQ ID NO: 6193661 - DNA, 14 bp, Homo sapiens
gaagggccaccctg

SEQ ID NO: 6193662 - DNA, 17 bp, Homo sapiens
gaagggccaccctgctg

SEQ ID NO: 6193663 - DNA, 18 bp, Homo sapiens
gaagggccaccctgctgc

SEQ ID NO: 6193664 - DNA, 10 bp, Homo sapiens
gaagggccag

SEQ ID NO: 6193665 - DNA, 18 bp, Homo sapiens
gaagggccagagccaggg

SEQ ID NO: 6193666 - DNA, 15 bp, Homo sapiens
cttataaaacagagt

SEQ ID NO: 6193667 - DNA, 20 bp, Homo sapiens
cttataaaacagagtaatct

SEQ ID NO: 6193668 - DNA, 18 bp, Homo sapiens
cttataaaatcctgtgca

SEQ ID NO: 6193669 - DNA, 15 bp, Homo sapiens
cttataaacaaatga

SEQ ID NO: 6193670 - DNA, 17 bp, Homo sapiens
cttataaacagataatg

SEQ ID NO: 6193671 - DNA, 23 bp, Homo sapiens
cttataaacatttaaagacaaag

SEQ ID NO: 6193672 - DNA, 17 bp, Homo sapiens
cttataaaccaatctta

SEQ ID NO: 6193673 - DNA, 20 bp, Homo sapiens
cttataaaccttgtcaataa

SEQ ID NO: 6193674 - DNA, 22 bp, Homo sapiens
cttataaactatttttttctta

SEQ ID NO: 6193675 - DNA, 19 bp, Homo sapiens
cttataaagtggacttctg

SEQ ID NO: 6193676 - DNA, 12 bp, Homo sapiens
cttataaatatg

SEQ ID NO: 6193677 - DNA, 21 bp, Homo sapiens
cttataaatcatattgatgaa

SEQ ID NO: 6193678 - DNA, 22 bp, Homo sapiens
cttataaatcatattgatgaaa

SEQ ID NO: 6193679 - DNA, 16 bp, Homo sapiens
cttataaatgtgtatt

SEQ ID NO: 6193680 - DNA, 23 bp, Homo sapiens
cttataaatgtgtattctggctg

SEQ ID NO: 6193681 - DNA, 23 bp, Homo sapiens
cttataaattctgttagctgctc

SEQ ID NO: 6193682 - DNA, 21 bp, Homo sapiens
cttataacctagttaaagaaa

SEQ ID NO: 6193683 - DNA, 22 bp, Homo sapiens
cttataacctagttaaagaaag

SEQ ID NO: 6193684 - DNA, 13 bp, Homo sapiens
cttataactgttt

SEQ ID NO: 6193685 - DNA, 17 bp, Homo sapiens
cttataactgttttaga

SEQ ID NO: 6193686 - DNA, 22 bp, Homo sapiens
cttataacttgtaagtctgatt

SEQ ID NO: 6193687 - DNA, 19 bp, Homo sapiens
cttataagaaaacatgtaa

SEQ ID NO: 6193688 - DNA, 22 bp, Homo sapiens
cttataagaagaagagaggcat

SEQ ID NO: 6193689 - DNA, 12 bp, Homo sapiens
cttataagaatt

SEQ ID NO: 6193690 - DNA, 16 bp, Homo sapiens
cttataagaattaatc

SEQ ID NO: 6193691 - DNA, 15 bp, Homo sapiens
cttataagcaacatg

SEQ ID NO: 6193692 - DNA, 20 bp, Homo sapiens
cttataataaaggactgtaa

SEQ ID NO: 6193693 - DNA, 23 bp, Homo sapiens
cttataatgtgtgttgtgtgagc

SEQ ID NO: 6193694 - DNA, 19 bp, Homo sapiens
cttataattacaatgcaca

SEQ ID NO: 6193695 - DNA, 13 bp, Homo sapiens
cttataatttaaa

SEQ ID NO: 6193696 - DNA, 13 bp, Homo sapiens
cttataatttcca

SEQ ID NO: 6193697 - DNA, 22 bp, Homo sapiens
cttatacaacagcaaaccctga

SEQ ID NO: 6193698 - DNA, 12 bp, Homo sapiens
cttatacacatt

SEQ ID NO: 6193699 - DNA, 17 bp, Homo sapiens
cttatacatcacttcct

SEQ ID NO: 6193700 - DNA, 21 bp, Homo sapiens
cttatacatcacttcctgttt

SEQ ID NO: 6193701 - DNA, 13 bp, Homo sapiens
cttataccaaagg

SEQ ID NO: 6193702 - DNA, 17 bp, Homo sapiens
cttataccaaagggaaa

SEQ ID NO: 6193703 - DNA, 15 bp, Homo sapiens
cttatacctctctca

SEQ ID NO: 6193704 - DNA, 14 bp, Homo sapiens
cttataccttctga

SEQ ID NO: 6193705 - DNA, 16 bp, Homo sapiens
cttatacgagtaatat

SEQ ID NO: 6193706 - DNA, 14 bp, Homo sapiens
cttatactgaaaaa

SEQ ID NO: 6193707 - DNA, 15 bp, Homo sapiens
cttatactgtacaat

SEQ ID NO: 6193708 - DNA, 19 bp, Homo sapiens
cttatagaagcttcagcag

SEQ ID NO: 6193709 - DNA, 13 bp, Homo sapiens
cttatagaataaa

SEQ ID NO: 6193710 - DNA, 16 bp, Homo sapiens
cttatagaataaaagc

SEQ ID NO: 6193711 - DNA, 13 bp, Homo sapiens
cttatagaatatt

SEQ ID NO: 6193712 - DNA, 15 bp, Homo sapiens
cttatagaatattta

SEQ ID NO: 6193713 - DNA, 14 bp, Homo sapiens
cttatagacaacat

SEQ ID NO: 6193714 - DNA, 19 bp, Homo sapiens
cttatagacacttgctccc

SEQ ID NO: 6193715 - DNA, 14 bp, Homo sapiens
cttatagagcacaa

SEQ ID NO: 6193716 - DNA, 15 bp, Homo sapiens
cttatagcactttga

SEQ ID NO: 6193717 - DNA, 17 bp, Homo sapiens
cttataggcctgtccct

SEQ ID NO: 6193718 - DNA, 18 bp, Homo sapiens
cttataggcctgtccctt

SEQ ID NO: 6193719 - DNA, 21 bp, Homo sapiens
cttataggtaacgtgattgat

SEQ ID NO: 6193720 - DNA, 19 bp, Homo sapiens
cttatagttaatattttgt

SEQ ID NO: 6193721 - DNA, 14 bp, Homo sapiens
cttatagttactgt

SEQ ID NO: 6193722 - DNA, 17 bp, Homo sapiens
cttatagtttgggcttc

SEQ ID NO: 6193723 - DNA, 20 bp, Homo sapiens
cttatagtttgggcttcagc

SEQ ID NO: 6193724 - DNA, 23 bp, Homo sapiens
cttatatacaatgcttctttcct

SEQ ID NO: 6193725 - DNA, 21 bp, Homo sapiens
cttatatagcagcaaaaatat

SEQ ID NO: 6193726 - DNA, 18 bp, Homo sapiens
cttatatagtattcattt

SEQ ID NO: 6193727 - DNA, 19 bp, Homo sapiens
cttatatagtttactattt

SEQ ID NO: 6193728 - DNA, 22 bp, Homo sapiens
cttatatatgcacttaatttgt

SEQ ID NO: 6193729 - DNA, 14 bp, Homo sapiens
cttatatatgtgaa

SEQ ID NO: 6193730 - DNA, 15 bp, Homo sapiens
cttatatatttgaaa

SEQ ID NO: 6193731 - DNA, 20 bp, Homo sapiens
cttatatatttgatacatat

SEQ ID NO: 6193732 - DNA, 14 bp, Homo sapiens
cttatatctgaaga

SEQ ID NO: 6193733 - DNA, 14 bp, Homo sapiens
cttatatgcaggct

SEQ ID NO: 6193734 - DNA, 13 bp, Homo sapiens
cttatatgccaag

SEQ ID NO: 6193735 - DNA, 14 bp, Homo sapiens
cttatatgtacttt

SEQ ID NO: 6193736 - DNA, 20 bp, Homo sapiens
cttatattaatagtaatttg

SEQ ID NO: 6193737 - DNA, 16 bp, Homo sapiens
cttatattattttctg

SEQ ID NO: 6193738 - DNA, 18 bp, Homo sapiens
cttatattattttctgta

SEQ ID NO: 6193739 - DNA, 21 bp, Homo sapiens
cttatattcaaccatggactt

SEQ ID NO: 6193740 - DNA, 23 bp, Homo sapiens
cttatattcatctattttctcag

SEQ ID NO: 6193741 - DNA, 14 bp, Homo sapiens
cttatattggtttg

SEQ ID NO: 6193742 - DNA, 18 bp, Homo sapiens
cttatattggtttgcaca

SEQ ID NO: 6193743 - DNA, 20 bp, Homo sapiens
cttatattggtttgcacaag

SEQ ID NO: 6193744 - DNA, 18 bp, Homo sapiens
cttatattggtttttcca

SEQ ID NO: 6193745 - DNA, 17 bp, Homo sapiens
cttatattgtaagaaat

SEQ ID NO: 6193746 - DNA, 20 bp, Homo sapiens
cttatatttacaacacttta

SEQ ID NO: 6193747 - DNA, 14 bp, Homo sapiens
cttatatttacaat

SEQ ID NO: 6193748 - DNA, 20 bp, Homo sapiens
cttatatttgacattcttca

SEQ ID NO: 6193749 - DNA, 20 bp, Homo sapiens
cttatattttataatcagaa

SEQ ID NO: 6193750 - DNA, 20 bp, Homo sapiens
cttatattttcagcaaagaa

SEQ ID NO: 6193751 - DNA, 15 bp, Homo sapiens
cttatattttcgtat

SEQ ID NO: 6193752 - DNA, 20 bp, Homo sapiens
cttatattttcgtatgaaaa

SEQ ID NO: 6193753 - DNA, 15 bp, Homo sapiens
cttatattttgattt

SEQ ID NO: 6193754 - DNA, 19 bp, Homo sapiens
cttatattttgattttaca

SEQ ID NO: 6193755 - DNA, 19 bp, Homo sapiens
cttatatttttaataaaag

SEQ ID NO: 6193756 - DNA, 13 bp, Homo sapiens
cttatcaaatcat

SEQ ID NO: 6193757 - DNA, 14 bp, Homo sapiens
cttatcaaatcatt

SEQ ID NO: 6193758 - DNA, 15 bp, Homo sapiens
cttatcaattgcaaa

SEQ ID NO: 6193759 - DNA, 23 bp, Homo sapiens
cttatcacaaaaaagaaaatgaa

SEQ ID NO: 6193760 - DNA, 15 bp, Homo sapiens
cttatcacacttgca

SEQ ID NO: 6193761 - DNA, 22 bp, Homo sapiens
cttatcaccacagtaagttcct

SEQ ID NO: 6193762 - DNA, 23 bp, Homo sapiens
cttatcaccacagtaagttccta

SEQ ID NO: 6193763 - DNA, 22 bp, Homo sapiens
cttatcaccagctgcctcttct

SEQ ID NO: 6193764 - DNA, 21 bp, Homo sapiens
cttatcacccccttgttgtaa

SEQ ID NO: 6193765 - DNA, 18 bp, Homo sapiens
cttatcactgacacaaaa

SEQ ID NO: 6193766 - DNA, 22 bp, Homo sapiens
cttatcactggcgcagacttca

SEQ ID NO: 6193767 - DNA, 12 bp, Homo sapiens
cttatcagagct

SEQ ID NO: 6193768 - DNA, 12 bp, Homo sapiens
cttatcagaggc

SEQ ID NO: 6193769 - DNA, 21 bp, Homo sapiens
cttatcagcagcaacaactgt

SEQ ID NO: 6193770 - DNA, 12 bp, Homo sapiens
cttatcatcagc

SEQ ID NO: 6193771 - DNA, 15 bp, Homo sapiens
cttatcatggtctca

SEQ ID NO: 6193772 - DNA, 21 bp, Homo sapiens
cttatcatttttgtataaaaa

SEQ ID NO: 6193773 - DNA, 20 bp, Homo sapiens
cttatccacgagagcgcagc

SEQ ID NO: 6193774 - DNA, 20 bp, Homo sapiens
cttatcccccccagcctggc

SEQ ID NO: 6193775 - DNA, 15 bp, Homo sapiens
cttatccctgcccat

SEQ ID NO: 6193776 - DNA, 22 bp, Homo sapiens
cttatccctgcccatttcatat

SEQ ID NO: 6193777 - DNA, 16 bp, Homo sapiens
cttatcccttcttttt

SEQ ID NO: 6193778 - DNA, 17 bp, Homo sapiens
cttatcccttctttttc

SEQ ID NO: 6193779 - DNA, 21 bp, Homo sapiens
cttatcctaaaacaaatagtt

SEQ ID NO: 6193780 - DNA, 20 bp, Homo sapiens
cttatcctacagtacaatca

SEQ ID NO: 6193781 - DNA, 21 bp, Homo sapiens
cttatcctagcacatgcttca

SEQ ID NO: 6193782 - DNA, 14 bp, Homo sapiens
cttatcctagcctt

SEQ ID NO: 6193783 - DNA, 18 bp, Homo sapiens
cttatcctagcctttggg

SEQ ID NO: 6193784 - DNA, 12 bp, Homo sapiens
cttatcctccct

SEQ ID NO: 6193785 - DNA, 14 bp, Homo sapiens
cttatcctccctgt

SEQ ID NO: 6193786 - DNA, 16 bp, Homo sapiens
cttatcctccctgtaa

SEQ ID NO: 6193787 - DNA, 20 bp, Homo sapiens
cttatcctctctctcttcta

SEQ ID NO: 6193788 - DNA, 15 bp, Homo sapiens
cttatccttaatatt

SEQ ID NO: 6193789 - DNA, 22 bp, Homo sapiens
cttatccttgggccataattat

SEQ ID NO: 6193790 - DNA, 20 bp, Homo sapiens
cttatctagctgcatatctt

SEQ ID NO: 6193791 - DNA, 20 bp, Homo sapiens
cttatctcagatatttgcac

SEQ ID NO: 6193792 - DNA, 20 bp, Homo sapiens
cttatctcagtcatgcataa

SEQ ID NO: 6193793 - DNA, 21 bp, Homo sapiens
cttatctcagtcatgcataaa

SEQ ID NO: 6193794 - DNA, 23 bp, Homo sapiens
cttatctcagtcatgcataaata

SEQ ID NO: 6193795 - DNA, 16 bp, Homo sapiens
cttatctcatttctca

SEQ ID NO: 6193796 - DNA, 18 bp, Homo sapiens
cttatctccacaacctct

SEQ ID NO: 6193797 - DNA, 14 bp, Homo sapiens
cttatctccagcca

SEQ ID NO: 6193798 - DNA, 16 bp, Homo sapiens
cttatctccctgcttc

SEQ ID NO: 6193799 - DNA, 22 bp, Homo sapiens
cttatctccctgcttcatatct

SEQ ID NO: 6193800 - DNA, 21 bp, Homo sapiens
cttatctcgaatttgaagaga

SEQ ID NO: 6193801 - DNA, 17 bp, Homo sapiens
cttatctctagctcaga

SEQ ID NO: 6193802 - DNA, 14 bp, Homo sapiens
cttatctcttctca

SEQ ID NO: 6193803 - DNA, 14 bp, Homo sapiens
cttatctctttcca

SEQ ID NO: 6193804 - DNA, 12 bp, Homo sapiens
cttatctctttt

SEQ ID NO: 6193805 - DNA, 16 bp, Homo sapiens
cttatctgaaacttcc

SEQ ID NO: 6193806 - DNA, 18 bp, Homo sapiens
cttatctgatcttcctca

SEQ ID NO: 6193807 - DNA, 15 bp, Homo sapiens
cttatctgcccctcc

SEQ ID NO: 6193808 - DNA, 16 bp, Homo sapiens
cttatctgctaactct

SEQ ID NO: 6193809 - DNA, 17 bp, Homo sapiens
cttatctgtgcgtgaaa

SEQ ID NO: 6193810 - DNA, 16 bp, Homo sapiens
cttatcttacaaagtg

SEQ ID NO: 6193811 - DNA, 20 bp, Homo sapiens
cttatcttacaactccccca

SEQ ID NO: 6193812 - DNA, 17 bp, Homo sapiens
cttatcttacgaaaaaa

SEQ ID NO: 6193813 - DNA, 13 bp, Homo sapiens
cttatcttctgga

SEQ ID NO: 6193814 - DNA, 15 bp, Homo sapiens
cttatcttctggatt

SEQ ID NO: 6193815 - DNA, 14 bp, Homo sapiens
cttatcttgtttca

SEQ ID NO: 6193816 - DNA, 17 bp, Homo sapiens
cttatctttattggctt

SEQ ID NO: 6193817 - DNA, 22 bp, Homo sapiens
cttatctttctaaaactgcctt

SEQ ID NO: 6193818 - DNA, 15 bp, Homo sapiens
cttatctttctttcc

SEQ ID NO: 6193819 - DNA, 22 bp, Homo sapiens
cttatgaaaacaccactgaaca

SEQ ID NO: 6193820 - DNA, 11 bp, Homo sapiens
cttatgaaaag

SEQ ID NO: 6193821 - DNA, 14 bp, Homo sapiens
cttatgaaaagaat

SEQ ID NO: 6193822 - DNA, 13 bp, Homo sapiens
cttatgaaaatta

SEQ ID NO: 6193823 - DNA, 21 bp, Homo sapiens
cttatgaaatctcacagatgt

SEQ ID NO: 6193824 - DNA, 15 bp, Homo sapiens
cttatgaacagatat

SEQ ID NO: 6193825 - DNA, 15 bp, Homo sapiens
cttatgaactacagt

SEQ ID NO: 6193826 - DNA, 18 bp, Homo sapiens
cttatgaatatttataac

SEQ ID NO: 6193827 - DNA, 12 bp, Homo sapiens
cttatgaatgtt

SEQ ID NO: 6193828 - DNA, 15 bp, Homo sapiens
cttatgaatgtttcc

SEQ ID NO: 6193829 - DNA, 18 bp, Homo sapiens
cttatgactaaattttct

SEQ ID NO: 6193830 - DNA, 15 bp, Homo sapiens
cttatgagaacatgg

SEQ ID NO: 6193831 - DNA, 19 bp, Homo sapiens
cttatgagactcttaaata

SEQ ID NO: 6193832 - DNA, 18 bp, Homo sapiens
cttatgagcgtcactgcc

SEQ ID NO: 6193833 - DNA, 16 bp, Homo sapiens
cttatgagctcagcct

SEQ ID NO: 6193834 - DNA, 23 bp, Homo sapiens
cttatgatagcaaatggcctcat

SEQ ID NO: 6193835 - DNA, 20 bp, Homo sapiens
cttatgatgagccatattaa

SEQ ID NO: 6193836 - DNA, 22 bp, Homo sapiens
cttatgatgttttcccttaact

SEQ ID NO: 6193837 - DNA, 21 bp, Homo sapiens
cttatgattaaacttccttct

SEQ ID NO: 6193838 - DNA, 23 bp, Homo sapiens
cttatgattcagattgttatcta

SEQ ID NO: 6193839 - DNA, 15 bp, Homo sapiens
cttatgattgcagat

SEQ ID NO: 6193840 - DNA, 19 bp, Homo sapiens
cttatgattttattacaga

SEQ ID NO: 6193841 - DNA, 14 bp, Homo sapiens
cttatgcaaaatgg

SEQ ID NO: 6193842 - DNA, 23 bp, Homo sapiens
cttatgccacccccgctggagga

SEQ ID NO: 6193843 - DNA, 15 bp, Homo sapiens
cttatgccatttgtt

SEQ ID NO: 6193844 - DNA, 18 bp, Homo sapiens
gaagggccagagcctggt

SEQ ID NO: 6193845 - DNA, 14 bp, Homo sapiens
gaagggccagccct

SEQ ID NO: 6193846 - DNA, 14 bp, Homo sapiens
gaagggccaggaga

SEQ ID NO: 6193847 - DNA, 11 bp, Homo sapiens
gaagggccagt

SEQ ID NO: 6193848 - DNA, 14 bp, Homo sapiens
gaagggccagtcct

SEQ ID NO: 6193849 - DNA, 19 bp, Homo sapiens
gaagggccagtctgggctg

SEQ ID NO: 6193850 - DNA, 20 bp, Homo sapiens
gaagggccagtctgggctgc

SEQ ID NO: 6193851 - DNA, 15 bp, Homo sapiens
gaagggcccccggct

SEQ ID NO: 6193852 - DNA, 16 bp, Homo sapiens
gaagggccggcttctg

SEQ ID NO: 6193853 - DNA, 14 bp, Homo sapiens
gaagggcctgctct

SEQ ID NO: 6193854 - DNA, 17 bp, Homo sapiens
gaagggcctgctctgct

SEQ ID NO: 6193855 - DNA, 18 bp, Homo sapiens
gaagggccttgagcatct

SEQ ID NO: 6193856 - DNA, 20 bp, Homo sapiens
gaagggccttgagcatctgg

SEQ ID NO: 6193857 - DNA, 19 bp, Homo sapiens
gaagggcgctgagggcagg

SEQ ID NO: 6193858 - DNA, 16 bp, Homo sapiens
gaagggcgttctaggt

SEQ ID NO: 6193859 - DNA, 22 bp, Homo sapiens
gaagggctgcttccctgaagct

SEQ ID NO: 6193860 - DNA, 13 bp, Homo sapiens
gaagggctgggcc

SEQ ID NO: 6193861 - DNA, 14 bp, Homo sapiens
gaagggctgggcca

SEQ ID NO: 6193862 - DNA, 21 bp, Homo sapiens
gaagggctttggttccttctc

SEQ ID NO: 6193863 - DNA, 15 bp, Homo sapiens
gaaggggaaaaatgg

SEQ ID NO: 6193864 - DNA, 17 bp, Homo sapiens
gaaggggaacacagacc

SEQ ID NO: 6193865 - DNA, 16 bp, Homo sapiens
gaaggggacccccgcc

SEQ ID NO: 6193866 - DNA, 20 bp, Homo sapiens
gaaggggacccccgccccct

SEQ ID NO: 6193867 - DNA, 15 bp, Homo sapiens
gaaggggactgccac

SEQ ID NO: 6193868 - DNA, 19 bp, Homo sapiens
gaaggggactgccacctcc

SEQ ID NO: 6193869 - DNA, 13 bp, Homo sapiens
gaaggggaggaag

SEQ ID NO: 6193870 - DNA, 17 bp, Homo sapiens
gaaggggaggagggcgg

SEQ ID NO: 6193871 - DNA, 14 bp, Homo sapiens
gaaggggaggcaca

SEQ ID NO: 6193872 - DNA, 23 bp, Homo sapiens
gaaggggagggtgttcagaggca

SEQ ID NO: 6193873 - DNA, 16 bp, Homo sapiens
gaaggggatgggaaat

SEQ ID NO: 6193874 - DNA, 11 bp, Homo sapiens
gaaggggcagc

SEQ ID NO: 6193875 - DNA, 13 bp, Homo sapiens
gaaggggcagccc

SEQ ID NO: 6193876 - DNA, 16 bp, Homo sapiens
gaaggggcagccctga

SEQ ID NO: 6193877 - DNA, 17 bp, Homo sapiens
gaaggggcagccctgag

SEQ ID NO: 6193878 - DNA, 16 bp, Homo sapiens
gaaggggccagaggct

SEQ ID NO: 6193879 - DNA, 13 bp, Homo sapiens
gaaggggccatca

SEQ ID NO: 6193880 - DNA, 22 bp, Homo sapiens
gaaggggccatcacaggatgcc

SEQ ID NO: 6193881 - DNA, 20 bp, Homo sapiens
gaaggggcccaagagagaca

SEQ ID NO: 6193882 - DNA, 23 bp, Homo sapiens
gaaggggccccatggcagctcct

SEQ ID NO: 6193883 - DNA, 14 bp, Homo sapiens
gaaggggccccggg

SEQ ID NO: 6193884 - DNA, 21 bp, Homo sapiens
gaaggggccccggggctggca

SEQ ID NO: 6193885 - DNA, 22 bp, Homo sapiens
gaaggggccccggggctggcaa

SEQ ID NO: 6193886 - DNA, 20 bp, Homo sapiens
gaaggggccggggagggggc

SEQ ID NO: 6193887 - DNA, 15 bp, Homo sapiens
gaaggggcctgggct

SEQ ID NO: 6193888 - DNA, 13 bp, Homo sapiens
gaaggggcggccc

SEQ ID NO: 6193889 - DNA, 23 bp, Homo sapiens
gaaggggcggggttagagccaag

SEQ ID NO: 6193890 - DNA, 21 bp, Homo sapiens
gaaggggcgtctgttccccct

SEQ ID NO: 6193891 - DNA, 15 bp, Homo sapiens
gaaggggctgaggac

SEQ ID NO: 6193892 - DNA, 14 bp, Homo sapiens
gaaggggcttctaa

SEQ ID NO: 6193893 - DNA, 20 bp, Homo sapiens
gaaggggcttctaatgaccc

SEQ ID NO: 6193894 - DNA, 20 bp, Homo sapiens
gaagggggaaaaggtgggat

SEQ ID NO: 6193895 - DNA, 13 bp, Homo sapiens
gaagggggatatg

SEQ ID NO: 6193896 - DNA, 22 bp, Homo sapiens
gaagggggattggagggaagac

SEQ ID NO: 6193897 - DNA, 19 bp, Homo sapiens
gaagggggcatctggcctt

SEQ ID NO: 6193898 - DNA, 22 bp, Homo sapiens
gaagggggccacagcctgggtg

SEQ ID NO: 6193899 - DNA, 14 bp, Homo sapiens
gaagggggccatga

SEQ ID NO: 6193900 - DNA, 14 bp, Homo sapiens
gaagggggccctgc

SEQ ID NO: 6193901 - DNA, 14 bp, Homo sapiens
gaagggggcggcct

SEQ ID NO: 6193902 - DNA, 17 bp, Homo sapiens
gaagggggctctgcccc

SEQ ID NO: 6193903 - DNA, 15 bp, Homo sapiens
gaagggggctgggac

SEQ ID NO: 6193904 - DNA, 16 bp, Homo sapiens
gaagggggctgggaca

SEQ ID NO: 6193905 - DNA, 17 bp, Homo sapiens
gaagggggtcaaagcaa

SEQ ID NO: 6193906 - DNA, 15 bp, Homo sapiens
gaagggggtctctgt

SEQ ID NO: 6193907 - DNA, 13 bp, Homo sapiens
gaagggggtgaca

SEQ ID NO: 6193908 - DNA, 20 bp, Homo sapiens
gaagggggtgacagtcctcc

SEQ ID NO: 6193909 - DNA, 17 bp, Homo sapiens
gaagggggttgtggcaa

SEQ ID NO: 6193910 - DNA, 22 bp, Homo sapiens
gaaggggtaggattactaggtg

SEQ ID NO: 6193911 - DNA, 16 bp, Homo sapiens
gaaggggtcctgcagg

SEQ ID NO: 6193912 - DNA, 16 bp, Homo sapiens
gaaggggtgccctctg

SEQ ID NO: 6193913 - DNA, 14 bp, Homo sapiens
gaaggggtgggagc

SEQ ID NO: 6193914 - DNA, 17 bp, Homo sapiens
gaaggggttggattgca

SEQ ID NO: 6193915 - DNA, 17 bp, Homo sapiens
gaagggtaaacaatata

SEQ ID NO: 6193916 - DNA, 13 bp, Homo sapiens
gaagggtagctgg

SEQ ID NO: 6193917 - DNA, 19 bp, Homo sapiens
gaagggtccaccctagcct

SEQ ID NO: 6193918 - DNA, 19 bp, Homo sapiens
gaagggtctctctccaggt

SEQ ID NO: 6193919 - DNA, 22 bp, Homo sapiens
gaagggtctctctccaggtcag

SEQ ID NO: 6193920 - DNA, 16 bp, Homo sapiens
gaagggtctgtttaaa

SEQ ID NO: 6193921 - DNA, 17 bp, Homo sapiens
gaagggtgacatcccag

SEQ ID NO: 6193922 - DNA, 14 bp, Homo sapiens
gaagggtgcatagc

SEQ ID NO: 6193923 - DNA, 14 bp, Homo sapiens
gaagggtgcctggc

SEQ ID NO: 6193924 - DNA, 15 bp, Homo sapiens
gaagggtgcctggct

SEQ ID NO: 6193925 - DNA, 16 bp, Homo sapiens
gaagggtgcctggctg

SEQ ID NO: 6193926 - DNA, 23 bp, Homo sapiens
gaagggtgctcagtctccttggt

SEQ ID NO: 6193927 - DNA, 14 bp, Homo sapiens
gaagggtggatgtc

SEQ ID NO: 6193928 - DNA, 19 bp, Homo sapiens
gaagggtggatgtgctgga

SEQ ID NO: 6193929 - DNA, 22 bp, Homo sapiens
gaagggtggatgtgctggaggg

SEQ ID NO: 6193930 - DNA, 23 bp, Homo sapiens
gaagggtggatgtgctggagggg

SEQ ID NO: 6193931 - DNA, 17 bp, Homo sapiens
gaagggtggcctgttcc

SEQ ID NO: 6193932 - DNA, 23 bp, Homo sapiens
gaagggtggcctgttccctagag

SEQ ID NO: 6193933 - DNA, 18 bp, Homo sapiens
gaagggtgggagtggggc

SEQ ID NO: 6193934 - DNA, 11 bp, Homo sapiens
gaagggtgggg

SEQ ID NO: 6193935 - DNA, 12 bp, Homo sapiens
gaagggtgggga

SEQ ID NO: 6193936 - DNA, 12 bp, Homo sapiens
gaagggtggggt

SEQ ID NO: 6193937 - DNA, 19 bp, Homo sapiens
gaagggtggtctgagcacc

SEQ ID NO: 6193938 - DNA, 13 bp, Homo sapiens
gaagggtgtgtga

SEQ ID NO: 6193939 - DNA, 16 bp, Homo sapiens
gaagggttagacaagc

SEQ ID NO: 6193940 - DNA, 19 bp, Homo sapiens
gaagggttagacaagcctg

SEQ ID NO: 6193941 - DNA, 22 bp, Homo sapiens
gaagggttagacaagcctggag

SEQ ID NO: 6193942 - DNA, 16 bp, Homo sapiens
gaagggttctgccctg

SEQ ID NO: 6193943 - DNA, 15 bp, Homo sapiens
gaagggtttgtggct

SEQ ID NO: 6193944 - DNA, 21 bp, Homo sapiens
gaagggtttgtggctgggggc

SEQ ID NO: 6193945 - DNA, 18 bp, Homo sapiens
gaagggtttttagagaat

SEQ ID NO: 6193946 - DNA, 13 bp, Homo sapiens
gaaggtaaaaagt

SEQ ID NO: 6193947 - DNA, 21 bp, Homo sapiens
gaaggtaatactataaatata

SEQ ID NO: 6193948 - DNA, 15 bp, Homo sapiens
gaaggtagaatgttt

SEQ ID NO: 6193949 - DNA, 13 bp, Homo sapiens
gaaggtagcccag

SEQ ID NO: 6193950 - DNA, 19 bp, Homo sapiens
gaaggtagcccagcactgt

SEQ ID NO: 6193951 - DNA, 21 bp, Homo sapiens
gaaggtagcccagcactgtga

SEQ ID NO: 6193952 - DNA, 22 bp, Homo sapiens
gaaggtagcccagcactgtgaa

SEQ ID NO: 6193953 - DNA, 18 bp, Homo sapiens
gaaggtatacctgggaag

SEQ ID NO: 6193954 - DNA, 18 bp, Homo sapiens
gaaggtatatcaggaggg

SEQ ID NO: 6193955 - DNA, 14 bp, Homo sapiens
gaaggtattggcct

SEQ ID NO: 6193956 - DNA, 14 bp, Homo sapiens
gaaggtcaaggtca

SEQ ID NO: 6193957 - DNA, 13 bp, Homo sapiens
gaaggtcagcaaa

SEQ ID NO: 6193958 - DNA, 20 bp, Homo sapiens
gaaggtcagcaaagggtggg

SEQ ID NO: 6193959 - DNA, 16 bp, Homo sapiens
gaaggtcccacagccc

SEQ ID NO: 6193960 - DNA, 18 bp, Homo sapiens
gaaggtcccacagccctg

SEQ ID NO: 6193961 - DNA, 20 bp, Homo sapiens
gaaggtcccacagccctgag

SEQ ID NO: 6193962 - DNA, 22 bp, Homo sapiens
gaaggtcccacagccctgagat

SEQ ID NO: 6193963 - DNA, 16 bp, Homo sapiens
gaaggtcctagcttta

SEQ ID NO: 6193964 - DNA, 16 bp, Homo sapiens
gaaggtccttgcctga

SEQ ID NO: 6193965 - DNA, 15 bp, Homo sapiens
gaaggtcgcccttgc

SEQ ID NO: 6193966 - DNA, 19 bp, Homo sapiens
gaaggtctcatgcctgaga

SEQ ID NO: 6193967 - DNA, 13 bp, Homo sapiens
gaaggtctccaag

SEQ ID NO: 6193968 - DNA, 22 bp, Homo sapiens
gaaggtctccaagacaataatt

SEQ ID NO: 6193969 - DNA, 14 bp, Homo sapiens
gaaggtctccaagg

SEQ ID NO: 6193970 - DNA, 16 bp, Homo sapiens
gaaggtctgatttgca

SEQ ID NO: 6193971 - DNA, 19 bp, Homo sapiens
gaaggtctgatttgcagga

SEQ ID NO: 6193972 - DNA, 14 bp, Homo sapiens
gaaggtctgtggtg

SEQ ID NO: 6193973 - DNA, 13 bp, Homo sapiens
gaaggtcttgatt

SEQ ID NO: 6193974 - DNA, 19 bp, Homo sapiens
gaaggtctttgttatgaca

SEQ ID NO: 6193975 - DNA, 21 bp, Homo sapiens
gaaggtctttgttatgacagt

SEQ ID NO: 6193976 - DNA, 20 bp, Homo sapiens
gaaggtgaaacattttctcc

SEQ ID NO: 6193977 - DNA, 22 bp, Homo sapiens
gaaggtgaatagccatatttgt

SEQ ID NO: 6193978 - DNA, 21 bp, Homo sapiens
gaaggtgacactgctccctga

SEQ ID NO: 6193979 - DNA, 19 bp, Homo sapiens
gaaggtgataagggaaaag

SEQ ID NO: 6193980 - DNA, 14 bp, Homo sapiens
gaaggtgcagttga

SEQ ID NO: 6193981 - DNA, 18 bp, Homo sapiens
gaaggtgcatctttccct

SEQ ID NO: 6193982 - DNA, 15 bp, Homo sapiens
gaaggtgccagaagg

SEQ ID NO: 6193983 - DNA, 17 bp, Homo sapiens
gaaggtgccagaaggaa

SEQ ID NO: 6193984 - DNA, 13 bp, Homo sapiens
gaaggtgcccagg

SEQ ID NO: 6193985 - DNA, 16 bp, Homo sapiens
gaaggtgcccaggagc

SEQ ID NO: 6193986 - DNA, 20 bp, Homo sapiens
gaaggtgccgtgagcaggct

SEQ ID NO: 6193987 - DNA, 16 bp, Homo sapiens
gaaggtgcctcagact

SEQ ID NO: 6193988 - DNA, 21 bp, Homo sapiens
gaaggtgcctcagactccgcc

SEQ ID NO: 6193989 - DNA, 23 bp, Homo sapiens
gaaggtgcctctggatgctgtga

SEQ ID NO: 6193990 - DNA, 21 bp, Homo sapiens
gaaggtgcctgccatagccag

SEQ ID NO: 6193991 - DNA, 23 bp, Homo sapiens
gaaggtgcctgccatagccagga

SEQ ID NO: 6193992 - DNA, 18 bp, Homo sapiens
gaaggtgctgacggccag

SEQ ID NO: 6193993 - DNA, 19 bp, Homo sapiens
gaaggtgctgacggccagg

SEQ ID NO: 6193994 - DNA, 15 bp, Homo sapiens
gaaggtgctgccacc

SEQ ID NO: 6193995 - DNA, 16 bp, Homo sapiens
gaaggtgctgccaccc

SEQ ID NO: 6193996 - DNA, 17 bp, Homo sapiens
gaaggtgctggaggtgg

SEQ ID NO: 6193997 - DNA, 19 bp, Homo sapiens
gaaggtgctggaggtggga

SEQ ID NO: 6193998 - DNA, 23 bp, Homo sapiens
gaaggtgctggaggtgggagcag

SEQ ID NO: 6193999 - DNA, 20 bp, Homo sapiens
gaaggtggaagttgcagtga

SEQ ID NO: 6194000 - DNA, 17 bp, Homo sapiens
gaaggtggacctggcag

SEQ ID NO: 6194001 - DNA, 18 bp, Homo sapiens
gaaggtggcctctgtgga

SEQ ID NO: 6194002 - DNA, 22 bp, Homo sapiens
gaaggtggccttcctgctgtta

SEQ ID NO: 6194003 - DNA, 17 bp, Homo sapiens
gaaggtggggccctgcc

SEQ ID NO: 6194004 - DNA, 20 bp, Homo sapiens
gaaggtggggccctgcccct

SEQ ID NO: 6194005 - DNA, 19 bp, Homo sapiens
gaaggtggtctgcacccca

SEQ ID NO: 6194006 - DNA, 22 bp, Homo sapiens
gaaggtggtggcatttttgctt

SEQ ID NO: 6194007 - DNA, 23 bp, Homo sapiens
gaaggtggtgggggtgcagatga

SEQ ID NO: 6194008 - DNA, 15 bp, Homo sapiens
gaaggtgtcatttga

SEQ ID NO: 6194009 - DNA, 15 bp, Homo sapiens
gaaggtgtctctggt

SEQ ID NO: 6194010 - DNA, 23 bp, Homo sapiens
gaaggtgttgggtcagtggccag

SEQ ID NO: 6194011 - DNA, 14 bp, Homo sapiens
gaaggttaaaggaa

SEQ ID NO: 6194012 - DNA, 16 bp, Homo sapiens
gaaggttcccaaggac

SEQ ID NO: 6194013 - DNA, 20 bp, Homo sapiens
gaaggttctggtgtgaacta

SEQ ID NO: 6194014 - DNA, 20 bp, Homo sapiens
gaaggttggaactgctgcca

SEQ ID NO: 6194015 - DNA, 15 bp, Homo sapiens
gaaggttgtgatgaa

SEQ ID NO: 6194016 - DNA, 22 bp, Homo sapiens
gaaggtttattgttaatacaag

SEQ ID NO: 6194017 - DNA, 16 bp, Homo sapiens
gaaggtttgatgccaa

SEQ ID NO: 6194018 - DNA, 19 bp, Homo sapiens
gaaggtttgatgccaaagc

SEQ ID NO: 6194019 - DNA, 20 bp, Homo sapiens
gaaggtttgtgtttttctgc

SEQ ID NO: 6194020 - DNA, 23 bp, Homo sapiens
gaaggtttttaagggccggggat

SEQ ID NO: 6194021 - DNA, 14 bp, Homo sapiens
gaaggtttttgata

SEQ ID NO: 6194022 - DNA, 15 bp, Homo sapiens
cttatgctaaattaa

SEQ ID NO: 6194023 - DNA, 16 bp, Homo sapiens
cttatgctacacagac

SEQ ID NO: 6194024 - DNA, 21 bp, Homo sapiens
cttatgctacacagacattaa

SEQ ID NO: 6194025 - DNA, 16 bp, Homo sapiens
cttatgctcagaagcc

SEQ ID NO: 6194026 - DNA, 19 bp, Homo sapiens
cttatgctcagaagccagt

SEQ ID NO: 6194027 - DNA, 21 bp, Homo sapiens
cttatgctcagaagccagtct

SEQ ID NO: 6194028 - DNA, 22 bp, Homo sapiens
cttatgctcttaattgccacct

SEQ ID NO: 6194029 - DNA, 14 bp, Homo sapiens
cttatgcttaaatt

SEQ ID NO: 6194030 - DNA, 12 bp, Homo sapiens
cttatgcttcca

SEQ ID NO: 6194031 - DNA, 13 bp, Homo sapiens
cttatggaacact

SEQ ID NO: 6194032 - DNA, 20 bp, Homo sapiens
cttatggaacactctgagac

SEQ ID NO: 6194033 - DNA, 14 bp, Homo sapiens
cttatggaattgat

SEQ ID NO: 6194034 - DNA, 16 bp, Homo sapiens
cttatggaattgattt

SEQ ID NO: 6194035 - DNA, 21 bp, Homo sapiens
cttatggaattgatttgcatt

SEQ ID NO: 6194036 - DNA, 14 bp, Homo sapiens
cttatggactgttt

SEQ ID NO: 6194037 - DNA, 19 bp, Homo sapiens
cttatggactgttttgata

SEQ ID NO: 6194038 - DNA, 16 bp, Homo sapiens
cttatggagctcacac

SEQ ID NO: 6194039 - DNA, 22 bp, Homo sapiens
cttatggagtgtgcctctctct

SEQ ID NO: 6194040 - DNA, 15 bp, Homo sapiens
cttatggcatgactc

SEQ ID NO: 6194041 - DNA, 18 bp, Homo sapiens
cttatgggatccttgtct

SEQ ID NO: 6194042 - DNA, 23 bp, Homo sapiens
cttatgggctgggttctacccag

SEQ ID NO: 6194043 - DNA, 19 bp, Homo sapiens
cttatggtaccagatgcag

SEQ ID NO: 6194044 - DNA, 20 bp, Homo sapiens
cttatgtaaagtatgttttt

SEQ ID NO: 6194045 - DNA, 21 bp, Homo sapiens
cttatgtacttgatactgaat

SEQ ID NO: 6194046 - DNA, 15 bp, Homo sapiens
cttatgtagacaaaa

SEQ ID NO: 6194047 - DNA, 14 bp, Homo sapiens
cttatgtagagttt

SEQ ID NO: 6194048 - DNA, 17 bp, Homo sapiens
cttatgtagatatttgg

SEQ ID NO: 6194049 - DNA, 18 bp, Homo sapiens
cttatgtagatatttggc

SEQ ID NO: 6194050 - DNA, 19 bp, Homo sapiens
cttatgtatcagtgtcctt

SEQ ID NO: 6194051 - DNA, 18 bp, Homo sapiens
cttatgtccaccacttca

SEQ ID NO: 6194052 - DNA, 19 bp, Homo sapiens
cttatgtcctccaccacaa

SEQ ID NO: 6194053 - DNA, 14 bp, Homo sapiens
cttatgtcctgtca

SEQ ID NO: 6194054 - DNA, 15 bp, Homo sapiens
cttatgtctctgcct

SEQ ID NO: 6194055 - DNA, 16 bp, Homo sapiens
cttatgtctctgcctt

SEQ ID NO: 6194056 - DNA, 14 bp, Homo sapiens
cttatgtgaaaaat

SEQ ID NO: 6194057 - DNA, 16 bp, Homo sapiens
cttatgtgtgtaggag

SEQ ID NO: 6194058 - DNA, 14 bp, Homo sapiens
cttatgtgttacat

SEQ ID NO: 6194059 - DNA, 17 bp, Homo sapiens
cttatgttgaaaaaatt

SEQ ID NO: 6194060 - DNA, 21 bp, Homo sapiens
cttatgttgatcgatgttaaa

SEQ ID NO: 6194061 - DNA, 15 bp, Homo sapiens
cttattaaagtattc

SEQ ID NO: 6194062 - DNA, 17 bp, Homo sapiens
cttattaaagtttcaaa

SEQ ID NO: 6194063 - DNA, 18 bp, Homo sapiens
cttattaaagtttcaaaa

SEQ ID NO: 6194064 - DNA, 19 bp, Homo sapiens
cttattaaagtttcaaaaa

SEQ ID NO: 6194065 - DNA, 22 bp, Homo sapiens
cttattaaagtttcaaaaatct

SEQ ID NO: 6194066 - DNA, 18 bp, Homo sapiens
cttattaaggaaatactt

SEQ ID NO: 6194067 - DNA, 15 bp, Homo sapiens
cttattaatgctaag

SEQ ID NO: 6194068 - DNA, 13 bp, Homo sapiens
cttattacaattt

SEQ ID NO: 6194069 - DNA, 16 bp, Homo sapiens
cttattacataactga

SEQ ID NO: 6194070 - DNA, 15 bp, Homo sapiens
cttattacatttaaa

SEQ ID NO: 6194071 - DNA, 16 bp, Homo sapiens
cttattacattttatt

SEQ ID NO: 6194072 - DNA, 22 bp, Homo sapiens
cttattaccctgattgaatgtg

SEQ ID NO: 6194073 - DNA, 14 bp, Homo sapiens
cttattactattat

SEQ ID NO: 6194074 - DNA, 21 bp, Homo sapiens
cttattactgagagtgcaaat

SEQ ID NO: 6194075 - DNA, 20 bp, Homo sapiens
cttattactgcttgcagtaa

SEQ ID NO: 6194076 - DNA, 13 bp, Homo sapiens
cttattagcagct

SEQ ID NO: 6194077 - DNA, 20 bp, Homo sapiens
cttattagctaaaaatatat

SEQ ID NO: 6194078 - DNA, 17 bp, Homo sapiens
cttattagggagaaaat

SEQ ID NO: 6194079 - DNA, 14 bp, Homo sapiens
cttattataaaatg

SEQ ID NO: 6194080 - DNA, 22 bp, Homo sapiens
cttattcaaagatgataattta

SEQ ID NO: 6194081 - DNA, 12 bp, Homo sapiens
cttattcacttt

SEQ ID NO: 6194082 - DNA, 22 bp, Homo sapiens
cttattcaggaagataaaaatc

SEQ ID NO: 6194083 - DNA, 22 bp, Homo sapiens
cttattcatgctttctcctttt

SEQ ID NO: 6194084 - DNA, 14 bp, Homo sapiens
cttattcattttct

SEQ ID NO: 6194085 - DNA, 18 bp, Homo sapiens
cttattccaagtgcattt

SEQ ID NO: 6194086 - DNA, 16 bp, Homo sapiens
cttattccaggagaag

SEQ ID NO: 6194087 - DNA, 18 bp, Homo sapiens
cttattccatgactgctt

SEQ ID NO: 6194088 - DNA, 20 bp, Homo sapiens
cttattcccccctaagcttc

SEQ ID NO: 6194089 - DNA, 14 bp, Homo sapiens
cttattcccttcct

SEQ ID NO: 6194090 - DNA, 21 bp, Homo sapiens
cttattccgagaatgccgagg

SEQ ID NO: 6194091 - DNA, 17 bp, Homo sapiens
cttattccgagcattcc

SEQ ID NO: 6194092 - DNA, 19 bp, Homo sapiens
cttattcctaatggctatt

SEQ ID NO: 6194093 - DNA, 13 bp, Homo sapiens
cttattcctaatt

SEQ ID NO: 6194094 - DNA, 15 bp, Homo sapiens
cttattcctaattcc

SEQ ID NO: 6194095 - DNA, 15 bp, Homo sapiens
cttattcctcagtga

SEQ ID NO: 6194096 - DNA, 16 bp, Homo sapiens
cttattcctctaggca

SEQ ID NO: 6194097 - DNA, 21 bp, Homo sapiens
cttattctatactttcttgta

SEQ ID NO: 6194098 - DNA, 18 bp, Homo sapiens
cttattctctgtttgctt

SEQ ID NO: 6194099 - DNA, 15 bp, Homo sapiens
cttattctgacataa

SEQ ID NO: 6194100 - DNA, 17 bp, Homo sapiens
cttattcttttataata

SEQ ID NO: 6194101 - DNA, 20 bp, Homo sapiens
cttattgaaaaaaaaaatgt

SEQ ID NO: 6194102 - DNA, 13 bp, Homo sapiens
cttattgaagtga

SEQ ID NO: 6194103 - DNA, 18 bp, Homo sapiens
cttattgaatttgttaga

SEQ ID NO: 6194104 - DNA, 22 bp, Homo sapiens
cttattgacaaccgagaaggtt

SEQ ID NO: 6194105 - DNA, 14 bp, Homo sapiens
cttattgaccattt

SEQ ID NO: 6194106 - DNA, 18 bp, Homo sapiens
cttattgagcgtgattct

SEQ ID NO: 6194107 - DNA, 19 bp, Homo sapiens
cttattgatattctaagaa

SEQ ID NO: 6194108 - DNA, 23 bp, Homo sapiens
cttattgatattctaagaaatat

SEQ ID NO: 6194109 - DNA, 18 bp, Homo sapiens
cttattgattaagtatat

SEQ ID NO: 6194110 - DNA, 12 bp, Homo sapiens
cttattgcccac

SEQ ID NO: 6194111 - DNA, 16 bp, Homo sapiens
cttattgcccaggctg

SEQ ID NO: 6194112 - DNA, 21 bp, Homo sapiens
cttattgcctgggcagtgccc

SEQ ID NO: 6194113 - DNA, 16 bp, Homo sapiens
cttattgctgatttta

SEQ ID NO: 6194114 - DNA, 11 bp, Homo sapiens
cttattgctgc

SEQ ID NO: 6194115 - DNA, 13 bp, Homo sapiens
cttattgctgcca

SEQ ID NO: 6194116 - DNA, 16 bp, Homo sapiens
cttattgctgccaaaa

SEQ ID NO: 6194117 - DNA, 18 bp, Homo sapiens
cttattgctgccaaaacc

SEQ ID NO: 6194118 - DNA, 19 bp, Homo sapiens
cttattgctgccaaaacca

SEQ ID NO: 6194119 - DNA, 14 bp, Homo sapiens
cttattgcttagta

SEQ ID NO: 6194120 - DNA, 18 bp, Homo sapiens
cttattgcttcatctgta

SEQ ID NO: 6194121 - DNA, 14 bp, Homo sapiens
cttattggaaatgt

SEQ ID NO: 6194122 - DNA, 21 bp, Homo sapiens
cttattggaaatgtacttttg

SEQ ID NO: 6194123 - DNA, 16 bp, Homo sapiens
cttattggatatttga

SEQ ID NO: 6194124 - DNA, 17 bp, Homo sapiens
cttattggatatttgat

SEQ ID NO: 6194125 - DNA, 18 bp, Homo sapiens
cttattgtaacaggcttt

SEQ ID NO: 6194126 - DNA, 13 bp, Homo sapiens
cttattgtacctc

SEQ ID NO: 6194127 - DNA, 19 bp, Homo sapiens
cttattgtgtgcgctgcct

SEQ ID NO: 6194128 - DNA, 20 bp, Homo sapiens
cttattgtgtgcgctgcctg

SEQ ID NO: 6194129 - DNA, 21 bp, Homo sapiens
cttattgtgtgcgctgcctgg

SEQ ID NO: 6194130 - DNA, 16 bp, Homo sapiens
cttattgttctttcat

SEQ ID NO: 6194131 - DNA, 17 bp, Homo sapiens
cttattgtttgtaaaca

SEQ ID NO: 6194132 - DNA, 19 bp, Homo sapiens
cttatttaaaaatatttca

SEQ ID NO: 6194133 - DNA, 21 bp, Homo sapiens
cttatttaaaaatatttcaga

SEQ ID NO: 6194134 - DNA, 14 bp, Homo sapiens
cttatttaaatgac

SEQ ID NO: 6194135 - DNA, 18 bp, Homo sapiens
cttatttaaattttcaga

SEQ ID NO: 6194136 - DNA, 20 bp, Homo sapiens
cttatttaagtatggaatat

SEQ ID NO: 6194137 - DNA, 18 bp, Homo sapiens
cttatttaatgaaagact

SEQ ID NO: 6194138 - DNA, 16 bp, Homo sapiens
cttatttacccttttc

SEQ ID NO: 6194139 - DNA, 18 bp, Homo sapiens
cttatttacccttttccc

SEQ ID NO: 6194140 - DNA, 19 bp, Homo sapiens
cttatttacccttttcccc

SEQ ID NO: 6194141 - DNA, 23 bp, Homo sapiens
cttatttacctataaaatgagat

SEQ ID NO: 6194142 - DNA, 21 bp, Homo sapiens
cttatttacttgtagaaatct

SEQ ID NO: 6194143 - DNA, 14 bp, Homo sapiens
cttatttagaaaaa

SEQ ID NO: 6194144 - DNA, 15 bp, Homo sapiens
cttatttagaaaaaa

SEQ ID NO: 6194145 - DNA, 23 bp, Homo sapiens
cttatttagattcacttaacaaa

SEQ ID NO: 6194146 - DNA, 18 bp, Homo sapiens
cttatttatattcatcaa

SEQ ID NO: 6194147 - DNA, 14 bp, Homo sapiens
cttatttatgaatt

SEQ ID NO: 6194148 - DNA, 13 bp, Homo sapiens
cttatttattatt

SEQ ID NO: 6194149 - DNA, 23 bp, Homo sapiens
cttatttattttagcaaatcagt

SEQ ID NO: 6194150 - DNA, 16 bp, Homo sapiens
cttatttcaaaaggaa

SEQ ID NO: 6194151 - DNA, 17 bp, Homo sapiens
cttatttcaaaaggaag

SEQ ID NO: 6194152 - DNA, 11 bp, Homo sapiens
cttatttcact

SEQ ID NO: 6194153 - DNA, 22 bp, Homo sapiens
cttatttcactatcttcttcaa

SEQ ID NO: 6194154 - DNA, 23 bp, Homo sapiens
cttatttcactttagtttttgaa

SEQ ID NO: 6194155 - DNA, 18 bp, Homo sapiens
cttatttcatcattcact

SEQ ID NO: 6194156 - DNA, 12 bp, Homo sapiens
cttatttccaag

SEQ ID NO: 6194157 - DNA, 20 bp, Homo sapiens
cttatttcccctttccaatt

SEQ ID NO: 6194158 - DNA, 20 bp, Homo sapiens
cttatttcctttccaagtat

SEQ ID NO: 6194159 - DNA, 19 bp, Homo sapiens
cttatttctagaagcacat

SEQ ID NO: 6194160 - DNA, 16 bp, Homo sapiens
cttatttctcagctgt

SEQ ID NO: 6194161 - DNA, 20 bp, Homo sapiens
cttatttctctctcctggtg

SEQ ID NO: 6194162 - DNA, 18 bp, Homo sapiens
cttatttctgctctggaa

SEQ ID NO: 6194163 - DNA, 19 bp, Homo sapiens
cttatttctgctctggaat

SEQ ID NO: 6194164 - DNA, 14 bp, Homo sapiens
cttatttgaaagtg

SEQ ID NO: 6194165 - DNA, 15 bp, Homo sapiens
cttatttgaaagtgt

SEQ ID NO: 6194166 - DNA, 11 bp, Homo sapiens
cttatttgagt

SEQ ID NO: 6194167 - DNA, 12 bp, Homo sapiens
cttatttgagtg

SEQ ID NO: 6194168 - DNA, 12 bp, Homo sapiens
cttatttgcaat

SEQ ID NO: 6194169 - DNA, 14 bp, Homo sapiens
cttatttgccttct

SEQ ID NO: 6194170 - DNA, 18 bp, Homo sapiens
cttatttgctcataagta

SEQ ID NO: 6194171 - DNA, 15 bp, Homo sapiens
cttatttgcttcatt

SEQ ID NO: 6194172 - DNA, 19 bp, Homo sapiens
cttatttggaattgacatt

SEQ ID NO: 6194173 - DNA, 18 bp, Homo sapiens
cttatttggcgtgacccg

SEQ ID NO: 6194174 - DNA, 18 bp, Homo sapiens
cttatttgtatttttcct

SEQ ID NO: 6194175 - DNA, 16 bp, Homo sapiens
cttatttgtcaaaata

SEQ ID NO: 6194176 - DNA, 18 bp, Homo sapiens
cttatttgtttggtcact

SEQ ID NO: 6194177 - DNA, 16 bp, Homo sapiens
cttattttaatgtgat

SEQ ID NO: 6194178 - DNA, 14 bp, Homo sapiens
cttattttagtata

SEQ ID NO: 6194179 - DNA, 15 bp, Homo sapiens
cttattttatttcca

SEQ ID NO: 6194180 - DNA, 14 bp, Homo sapiens
cttattttcaagaa

SEQ ID NO: 6194181 - DNA, 19 bp, Homo sapiens
cttattttcaagaaactga

SEQ ID NO: 6194182 - DNA, 21 bp, Homo sapiens
cttattttcagtgcatcatta

SEQ ID NO: 6194183 - DNA, 16 bp, Homo sapiens
cttattttcatgtata

SEQ ID NO: 6194184 - DNA, 20 bp, Homo sapiens
cttattttccacttatcttg

SEQ ID NO: 6194185 - DNA, 17 bp, Homo sapiens
cttattttctcaatctc

SEQ ID NO: 6194186 - DNA, 15 bp, Homo sapiens
cttattttctctgtg

SEQ ID NO: 6194187 - DNA, 22 bp, Homo sapiens
cttattttgattgtttgatgaa

SEQ ID NO: 6194188 - DNA, 18 bp, Homo sapiens
cttattttggagagatag

SEQ ID NO: 6194189 - DNA, 14 bp, Homo sapiens
cttattttgtaata

SEQ ID NO: 6194190 - DNA, 18 bp, Homo sapiens
cttattttgtaataaact

SEQ ID NO: 6194191 - DNA, 19 bp, Homo sapiens
cttattttgtaataaactc

SEQ ID NO: 6194192 - DNA, 20 bp, Homo sapiens
cttattttgtaataaactct

SEQ ID NO: 6194193 - DNA, 15 bp, Homo sapiens
cttattttgtactag

SEQ ID NO: 6194194 - DNA, 20 bp, Homo sapiens
cttattttgtcttattctta

SEQ ID NO: 6194195 - DNA, 21 bp, Homo sapiens
cttattttgtcttattcttaa

SEQ ID NO: 6194196 - DNA, 17 bp, Homo sapiens
cttatttttaaaataaa

SEQ ID NO: 6194197 - DNA, 16 bp, Homo sapiens
cttatttttagatggt

SEQ ID NO: 6194198 - DNA, 23 bp, Homo sapiens
cttatttttataattaaagatgc

SEQ ID NO: 6194199 - DNA, 13 bp, Homo sapiens
cttatttttccta

SEQ ID NO: 6194200 - DNA, 14 bp, Homo sapiens
cttatttttcctgt

SEQ ID NO: 6194201 - DNA, 17 bp, Homo sapiens
gaaggtttttgtttctt

SEQ ID NO: 6194202 - DNA, 21 bp, Homo sapiens
gaaggttttttttttaagtgc

SEQ ID NO: 6194203 - DNA, 22 bp, Homo sapiens
gaaggttttttttttaagtgca

SEQ ID NO: 6194204 - DNA, 13 bp, Homo sapiens
gaagtaaaataaa

SEQ ID NO: 6194205 - DNA, 17 bp, Homo sapiens
gaagtaaaatgtggcag

SEQ ID NO: 6194206 - DNA, 20 bp, Homo sapiens
gaagtaaacagctgtgcatc

SEQ ID NO: 6194207 - DNA, 13 bp, Homo sapiens
gaagtaaactttt

SEQ ID NO: 6194208 - DNA, 16 bp, Homo sapiens
gaagtaaactttttgt

SEQ ID NO: 6194209 - DNA, 19 bp, Homo sapiens
gaagtaaaggcattccaca

SEQ ID NO: 6194210 - DNA, 15 bp, Homo sapiens
gaagtaaagtgaaga

SEQ ID NO: 6194211 - DNA, 17 bp, Homo sapiens
gaagtaaagtgaagaat

SEQ ID NO: 6194212 - DNA, 17 bp, Homo sapiens
gaagtaaagtttatttc

SEQ ID NO: 6194213 - DNA, 14 bp, Homo sapiens
gaagtaaattattt

SEQ ID NO: 6194214 - DNA, 11 bp, Homo sapiens
gaagtaaattt

SEQ ID NO: 6194215 - DNA, 15 bp, Homo sapiens
gaagtaaatttgtcc

SEQ ID NO: 6194216 - DNA, 14 bp, Homo sapiens
gaagtaacagtaac

SEQ ID NO: 6194217 - DNA, 22 bp, Homo sapiens
gaagtaacatgcatactttatt

SEQ ID NO: 6194218 - DNA, 23 bp, Homo sapiens
gaagtaaccaactgaacgacaaa

SEQ ID NO: 6194219 - DNA, 20 bp, Homo sapiens
gaagtaactcccactcctaa

SEQ ID NO: 6194220 - DNA, 22 bp, Homo sapiens
gaagtaactccccttaaaatgt

SEQ ID NO: 6194221 - DNA, 18 bp, Homo sapiens
gaagtaactggtgatata

SEQ ID NO: 6194222 - DNA, 22 bp, Homo sapiens
gaagtaactgtccgctagaagt

SEQ ID NO: 6194223 - DNA, 18 bp, Homo sapiens
gaagtaacttatttgact

SEQ ID NO: 6194224 - DNA, 17 bp, Homo sapiens
gaagtaacttattttgt

SEQ ID NO: 6194225 - DNA, 15 bp, Homo sapiens
gaagtaagaagagga

SEQ ID NO: 6194226 - DNA, 17 bp, Homo sapiens
gaagtaagaagaggagc

SEQ ID NO: 6194227 - DNA, 17 bp, Homo sapiens
gaagtaagcaaacaaat

SEQ ID NO: 6194228 - DNA, 16 bp, Homo sapiens
gaagtaagggagtcat

SEQ ID NO: 6194229 - DNA, 15 bp, Homo sapiens
gaagtaagttcatca

SEQ ID NO: 6194230 - DNA, 17 bp, Homo sapiens
gaagtaagttctgaaaa

SEQ ID NO: 6194231 - DNA, 14 bp, Homo sapiens
gaagtaattttctt

SEQ ID NO: 6194232 - DNA, 22 bp, Homo sapiens
gaagtacaataagcagaggtgg

SEQ ID NO: 6194233 - DNA, 16 bp, Homo sapiens
gaagtacagtcccagc

SEQ ID NO: 6194234 - DNA, 19 bp, Homo sapiens
gaagtacatgaagagcagc

SEQ ID NO: 6194235 - DNA, 14 bp, Homo sapiens
gaagtaccagacta

SEQ ID NO: 6194236 - DNA, 21 bp, Homo sapiens
gaagtacccgttcacattttt

SEQ ID NO: 6194237 - DNA, 15 bp, Homo sapiens
gaagtacctttgtta

SEQ ID NO: 6194238 - DNA, 21 bp, Homo sapiens
gaagtacgaatcttatttttc

SEQ ID NO: 6194239 - DNA, 21 bp, Homo sapiens
gaagtacgttattgttgactt

SEQ ID NO: 6194240 - DNA, 19 bp, Homo sapiens
gaagtacttgccagaagtt

SEQ ID NO: 6194241 - DNA, 23 bp, Homo sapiens
gaagtacttgccagaagttgtgg

SEQ ID NO: 6194242 - DNA, 21 bp, Homo sapiens
gaagtacttggcccccttcag

SEQ ID NO: 6194243 - DNA, 19 bp, Homo sapiens
gaagtagatgtgaaaaagc

SEQ ID NO: 6194244 - DNA, 13 bp, Homo sapiens
gaagtagcacagg

SEQ ID NO: 6194245 - DNA, 16 bp, Homo sapiens
gaagtagcacaggctg

SEQ ID NO: 6194246 - DNA, 18 bp, Homo sapiens
gaagtagcacaggctgag

SEQ ID NO: 6194247 - DNA, 22 bp, Homo sapiens
gaagtagcctgatctttctaga

SEQ ID NO: 6194248 - DNA, 20 bp, Homo sapiens
gaagtagctgtcagatgtca

SEQ ID NO: 6194249 - DNA, 23 bp, Homo sapiens
gaagtaggaagtgaaaataggta

SEQ ID NO: 6194250 - DNA, 18 bp, Homo sapiens
gaagtaggggtggcccga

SEQ ID NO: 6194251 - DNA, 14 bp, Homo sapiens
gaagtagtccttgg

SEQ ID NO: 6194252 - DNA, 23 bp, Homo sapiens
gaagtagtgtctggatcagtaaa

SEQ ID NO: 6194253 - DNA, 17 bp, Homo sapiens
gaagtagttatcatgtt

SEQ ID NO: 6194254 - DNA, 14 bp, Homo sapiens
gaagtataaagaat

SEQ ID NO: 6194255 - DNA, 21 bp, Homo sapiens
gaagtatagatggtagaaact

SEQ ID NO: 6194256 - DNA, 19 bp, Homo sapiens
gaagtatatttttgcaggt

SEQ ID NO: 6194257 - DNA, 21 bp, Homo sapiens
gaagtatccaattatgtgaca

SEQ ID NO: 6194258 - DNA, 16 bp, Homo sapiens
gaagtatccttcagcc

SEQ ID NO: 6194259 - DNA, 14 bp, Homo sapiens
gaagtatgtgtggg

SEQ ID NO: 6194260 - DNA, 13 bp, Homo sapiens
gaagtattaaaaa

SEQ ID NO: 6194261 - DNA, 22 bp, Homo sapiens
gaagtattaagcctaccgtatt

SEQ ID NO: 6194262 - DNA, 20 bp, Homo sapiens
gaagtattacatgatttaaa

SEQ ID NO: 6194263 - DNA, 19 bp, Homo sapiens
gaagtattagacttctaaa

SEQ ID NO: 6194264 - DNA, 21 bp, Homo sapiens
gaagtattcccttctttccta

SEQ ID NO: 6194265 - DNA, 15 bp, Homo sapiens
gaagtattgctgaaa

SEQ ID NO: 6194266 - DNA, 16 bp, Homo sapiens
gaagtattttcctcca

SEQ ID NO: 6194267 - DNA, 15 bp, Homo sapiens
gaagtatttttagaa

SEQ ID NO: 6194268 - DNA, 19 bp, Homo sapiens
gaagtatttttagaataag

SEQ ID NO: 6194269 - DNA, 18 bp, Homo sapiens
gaagtatttttttaattt

SEQ ID NO: 6194270 - DNA, 23 bp, Homo sapiens
gaagtatttttttaatttctgaa

SEQ ID NO: 6194271 - DNA, 15 bp, Homo sapiens
gaagtcaaacatttc

SEQ ID NO: 6194272 - DNA, 19 bp, Homo sapiens
gaagtcaaaccttaagata

SEQ ID NO: 6194273 - DNA, 20 bp, Homo sapiens
gaagtcaaagacaaagtgtg

SEQ ID NO: 6194274 - DNA, 16 bp, Homo sapiens
gaagtcaagctcaaca

SEQ ID NO: 6194275 - DNA, 22 bp, Homo sapiens
gaagtcaataggcctatttatt

SEQ ID NO: 6194276 - DNA, 20 bp, Homo sapiens
gaagtcacaacaaaaggaag

SEQ ID NO: 6194277 - DNA, 13 bp, Homo sapiens
gaagtcacacagt

SEQ ID NO: 6194278 - DNA, 16 bp, Homo sapiens
gaagtcacagggcagt

SEQ ID NO: 6194279 - DNA, 23 bp, Homo sapiens
gaagtcacattagtgtgttgtct

SEQ ID NO: 6194280 - DNA, 21 bp, Homo sapiens
gaagtcacattccacatctgt

SEQ ID NO: 6194281 - DNA, 16 bp, Homo sapiens
gaagtcacattcctga

SEQ ID NO: 6194282 - DNA, 20 bp, Homo sapiens
gaagtcacattcctgaacag

SEQ ID NO: 6194283 - DNA, 22 bp, Homo sapiens
gaagtcaccttgtgtgttccaa

SEQ ID NO: 6194284 - DNA, 17 bp, Homo sapiens
gaagtcactcacactgg

SEQ ID NO: 6194285 - DNA, 21 bp, Homo sapiens
gaagtcactcacactggccac

SEQ ID NO: 6194286 - DNA, 18 bp, Homo sapiens
gaagtcactgaacaaaac

SEQ ID NO: 6194287 - DNA, 18 bp, Homo sapiens
gaagtcagagaaaacact

SEQ ID NO: 6194288 - DNA, 22 bp, Homo sapiens
gaagtcagatctgcctaaggac

SEQ ID NO: 6194289 - DNA, 18 bp, Homo sapiens
gaagtcagccacactggg

SEQ ID NO: 6194290 - DNA, 23 bp, Homo sapiens
gaagtcagccacactgggcctgg

SEQ ID NO: 6194291 - DNA, 20 bp, Homo sapiens
gaagtcagcccgaatgcctg

SEQ ID NO: 6194292 - DNA, 22 bp, Homo sapiens
gaagtcagcccgaatgcctgtc

SEQ ID NO: 6194293 - DNA, 21 bp, Homo sapiens
gaagtcagctaattggacttt

SEQ ID NO: 6194294 - DNA, 19 bp, Homo sapiens
gaagtcagctactctagtt

SEQ ID NO: 6194295 - DNA, 23 bp, Homo sapiens
gaagtcagctactctagttctgt

SEQ ID NO: 6194296 - DNA, 12 bp, Homo sapiens
gaagtcaggagc

SEQ ID NO: 6194297 - DNA, 16 bp, Homo sapiens
gaagtcaggagccagc

SEQ ID NO: 6194298 - DNA, 18 bp, Homo sapiens
gaagtcaggagccagcag

SEQ ID NO: 6194299 - DNA, 19 bp, Homo sapiens
gaagtcaggagccagcagg

SEQ ID NO: 6194300 - DNA, 13 bp, Homo sapiens
gaagtcaggggag

SEQ ID NO: 6194301 - DNA, 21 bp, Homo sapiens
gaagtcaggggagaagctgaa

SEQ ID NO: 6194302 - DNA, 13 bp, Homo sapiens
gaagtcagtacga

SEQ ID NO: 6194303 - DNA, 23 bp, Homo sapiens
gaagtcagtgtagacctgagctg

SEQ ID NO: 6194304 - DNA, 20 bp, Homo sapiens
gaagtcagttggagaaaatg

SEQ ID NO: 6194305 - DNA, 16 bp, Homo sapiens
gaagtcatcataaaag

SEQ ID NO: 6194306 - DNA, 19 bp, Homo sapiens
gaagtcatgaagcccaagt

SEQ ID NO: 6194307 - DNA, 16 bp, Homo sapiens
gaagtcattgtcgctc

SEQ ID NO: 6194308 - DNA, 22 bp, Homo sapiens
gaagtccaagcatttagatgta

SEQ ID NO: 6194309 - DNA, 14 bp, Homo sapiens
gaagtccaatgtgg

SEQ ID NO: 6194310 - DNA, 13 bp, Homo sapiens
gaagtccagaacg

SEQ ID NO: 6194311 - DNA, 15 bp, Homo sapiens
gaagtccagctcctt

SEQ ID NO: 6194312 - DNA, 19 bp, Homo sapiens
gaagtccaggactgggtct

SEQ ID NO: 6194313 - DNA, 19 bp, Homo sapiens
gaagtccagtgaccctgga

SEQ ID NO: 6194314 - DNA, 20 bp, Homo sapiens
gaagtccagtgaccctggag

SEQ ID NO: 6194315 - DNA, 16 bp, Homo sapiens
gaagtccccaggcccc

SEQ ID NO: 6194316 - DNA, 23 bp, Homo sapiens
gaagtccccaggccccaggaagc

SEQ ID NO: 6194317 - DNA, 16 bp, Homo sapiens
gaagtccctcagaggc

SEQ ID NO: 6194318 - DNA, 20 bp, Homo sapiens
gaagtccctgttctcagctc

SEQ ID NO: 6194319 - DNA, 21 bp, Homo sapiens
gaagtccctgttctcagctcc

SEQ ID NO: 6194320 - DNA, 14 bp, Homo sapiens
gaagtcccttcctg

SEQ ID NO: 6194321 - DNA, 18 bp, Homo sapiens
gaagtcccttcctgtcct

SEQ ID NO: 6194322 - DNA, 18 bp, Homo sapiens
gaagtcccttgccatcct

SEQ ID NO: 6194323 - DNA, 15 bp, Homo sapiens
gaagtccgaggcctg

SEQ ID NO: 6194324 - DNA, 23 bp, Homo sapiens
gaagtccgaggcctggctctgga

SEQ ID NO: 6194325 - DNA, 15 bp, Homo sapiens
gaagtcctagcccct

SEQ ID NO: 6194326 - DNA, 18 bp, Homo sapiens
gaagtcctatggaaaccc

SEQ ID NO: 6194327 - DNA, 22 bp, Homo sapiens
gaagtcctatggaaacccgagg

SEQ ID NO: 6194328 - DNA, 17 bp, Homo sapiens
gaagtcctctgtggcca

SEQ ID NO: 6194329 - DNA, 18 bp, Homo sapiens
gaagtcggccaggtagga

SEQ ID NO: 6194330 - DNA, 15 bp, Homo sapiens
gaagtctaattcaca

SEQ ID NO: 6194331 - DNA, 14 bp, Homo sapiens
gaagtctacctgct

SEQ ID NO: 6194332 - DNA, 15 bp, Homo sapiens
gaagtctacctgctg

SEQ ID NO: 6194333 - DNA, 16 bp, Homo sapiens
gaagtctacctgctgg

SEQ ID NO: 6194334 - DNA, 16 bp, Homo sapiens
gaagtctaggagctgg

SEQ ID NO: 6194335 - DNA, 13 bp, Homo sapiens
gaagtctcagcct

SEQ ID NO: 6194336 - DNA, 18 bp, Homo sapiens
gaagtctcatctggggag

SEQ ID NO: 6194337 - DNA, 19 bp, Homo sapiens
gaagtctcatctggggagc

SEQ ID NO: 6194338 - DNA, 21 bp, Homo sapiens
gaagtctccatgaagagcttg

SEQ ID NO: 6194339 - DNA, 20 bp, Homo sapiens
gaagtctccccgcagccctc

SEQ ID NO: 6194340 - DNA, 11 bp, Homo sapiens
gaagtctctga

SEQ ID NO: 6194341 - DNA, 16 bp, Homo sapiens
gaagtctctgaagtga

SEQ ID NO: 6194342 - DNA, 23 bp, Homo sapiens
gaagtctctgattagttgacagt

SEQ ID NO: 6194343 - DNA, 13 bp, Homo sapiens
gaagtctcttcct

SEQ ID NO: 6194344 - DNA, 18 bp, Homo sapiens
gaagtctcttcctgcctc

SEQ ID NO: 6194345 - DNA, 21 bp, Homo sapiens
gaagtctcttcctgcctccca

SEQ ID NO: 6194346 - DNA, 15 bp, Homo sapiens
gaagtctcttttctt

SEQ ID NO: 6194347 - DNA, 17 bp, Homo sapiens
gaagtctctttttcttc

SEQ ID NO: 6194348 - DNA, 14 bp, Homo sapiens
gaagtctgcgccct

SEQ ID NO: 6194349 - DNA, 20 bp, Homo sapiens
gaagtctgcttaccaaaaca

SEQ ID NO: 6194350 - DNA, 12 bp, Homo sapiens
gaagtctggaaa

SEQ ID NO: 6194351 - DNA, 24 bp, Homo sapiens
gaagtctggctttgctctattaag

SEQ ID NO: 6194352 - DNA, 19 bp, Homo sapiens
gaagtctgtccaaatttaa

SEQ ID NO: 6194353 - DNA, 14 bp, Homo sapiens
gaagtctgttctca

SEQ ID NO: 6194354 - DNA, 17 bp, Homo sapiens
gaagtcttaaggacaaa

SEQ ID NO: 6194355 - DNA, 16 bp, Homo sapiens
gaagtcttaattgtgt

SEQ ID NO: 6194356 - DNA, 17 bp, Homo sapiens
gaagtcttcatgaaatg

SEQ ID NO: 6194357 - DNA, 18 bp, Homo sapiens
gaagtcttcatgaaatgc

SEQ ID NO: 6194358 - DNA, 18 bp, Homo sapiens
gaagtcttccatcagcag

SEQ ID NO: 6194359 - DNA, 20 bp, Homo sapiens
gaagtcttccatcagcagtg

SEQ ID NO: 6194360 - DNA, 21 bp, Homo sapiens
gaagtcttccatcagcagtga

SEQ ID NO: 6194361 - DNA, 17 bp, Homo sapiens
gaagtcttccctcagat

SEQ ID NO: 6194362 - DNA, 16 bp, Homo sapiens
gaagtcttctatttat

SEQ ID NO: 6194363 - DNA, 17 bp, Homo sapiens
gaagtcttctatttatt

SEQ ID NO: 6194364 - DNA, 15 bp, Homo sapiens
gaagtcttgcattga

SEQ ID NO: 6194365 - DNA, 14 bp, Homo sapiens
gaagtcttgtataa

SEQ ID NO: 6194366 - DNA, 18 bp, Homo sapiens
gaagtctttgttgcacca

SEQ ID NO: 6194367 - DNA, 15 bp, Homo sapiens
gaagtctttttcatt

SEQ ID NO: 6194368 - DNA, 16 bp, Homo sapiens
gaagtgaaaaacagaa

SEQ ID NO: 6194369 - DNA, 18 bp, Homo sapiens
gaagtgaacccatatttt

SEQ ID NO: 6194370 - DNA, 14 bp, Homo sapiens
gaagtgaaggagaa

SEQ ID NO: 6194371 - DNA, 18 bp, Homo sapiens
gaagtgaaggagaaagga

SEQ ID NO: 6194372 - DNA, 18 bp, Homo sapiens
gaagtgacaaggccccag

SEQ ID NO: 6194373 - DNA, 21 bp, Homo sapiens
gaagtgacagggaagctacag

SEQ ID NO: 6194374 - DNA, 22 bp, Homo sapiens
gaagtgacagggaagctacagg

SEQ ID NO: 6194375 - DNA, 22 bp, Homo sapiens
gaagtgacattgtaagaggtgg

SEQ ID NO: 6194376 - DNA, 19 bp, Homo sapiens
gaagtgaccccagctccag

SEQ ID NO: 6194377 - DNA, 15 bp, Homo sapiens
cttatttttcctgtc

SEQ ID NO: 6194378 - DNA, 17 bp, Homo sapiens
cttatttttcctgtcct

SEQ ID NO: 6194379 - DNA, 16 bp, Homo sapiens
cttatttttctaaacg

SEQ ID NO: 6194380 - DNA, 16 bp, Homo sapiens
cttatttttgaattct

SEQ ID NO: 6194381 - DNA, 22 bp, Homo sapiens
cttattttttaatgtgagacag

SEQ ID NO: 6194382 - DNA, 14 bp, Homo sapiens
cttattttttccca

SEQ ID NO: 6194383 - DNA, 19 bp, Homo sapiens
cttattttttcccaaagcc

SEQ ID NO: 6194384 - DNA, 19 bp, Homo sapiens
cttatttttttctgattgt

SEQ ID NO: 6194385 - DNA, 20 bp, Homo sapiens
cttatttttttctgattgta

SEQ ID NO: 6194386 - DNA, 16 bp, Homo sapiens
cttcaaaaactaaaat

SEQ ID NO: 6194387 - DNA, 14 bp, Homo sapiens
cttcaaaaagccac

SEQ ID NO: 6194388 - DNA, 20 bp, Homo sapiens
cttcaaaaagccacagcaga

SEQ ID NO: 6194389 - DNA, 21 bp, Homo sapiens
cttcaaaaagccacagcagag

SEQ ID NO: 6194390 - DNA, 22 bp, Homo sapiens
cttcaaaaataaaaaatctgaa

SEQ ID NO: 6194391 - DNA, 12 bp, Homo sapiens
cttcaaaaatac

SEQ ID NO: 6194392 - DNA, 17 bp, Homo sapiens
cttcaaaaatacagaat

SEQ ID NO: 6194393 - DNA, 19 bp, Homo sapiens
cttcaaaaatgtgctgcct

SEQ ID NO: 6194394 - DNA, 20 bp, Homo sapiens
cttcaaaaatgtgctgccta

SEQ ID NO: 6194395 - DNA, 13 bp, Homo sapiens
cttcaaaacattc

SEQ ID NO: 6194396 - DNA, 20 bp, Homo sapiens
cttcaaaaggaatgaacttg

SEQ ID NO: 6194397 - DNA, 22 bp, Homo sapiens
cttcaaaaggaatgaacttgtt

SEQ ID NO: 6194398 - DNA, 20 bp, Homo sapiens
cttcaaaagtaatgcctctg

SEQ ID NO: 6194399 - DNA, 21 bp, Homo sapiens
cttcaaaagtaatgcctctgt

SEQ ID NO: 6194400 - DNA, 21 bp, Homo sapiens
cttcaaaagtttgtttgctta

SEQ ID NO: 6194401 - DNA, 14 bp, Homo sapiens
cttcaaaatcagtg

SEQ ID NO: 6194402 - DNA, 18 bp, Homo sapiens
cttcaaaatgttctattt

SEQ ID NO: 6194403 - DNA, 20 bp, Homo sapiens
cttcaaaatgttctatttaa

SEQ ID NO: 6194404 - DNA, 21 bp, Homo sapiens
cttcaaaccctcaagagggga

SEQ ID NO: 6194405 - DNA, 22 bp, Homo sapiens
cttcaaacctaaaaatcaagtt

SEQ ID NO: 6194406 - DNA, 11 bp, Homo sapiens
cttcaaactac

SEQ ID NO: 6194407 - DNA, 14 bp, Homo sapiens
cttcaaactttcac

SEQ ID NO: 6194408 - DNA, 17 bp, Homo sapiens
cttcaaactttcacttt

SEQ ID NO: 6194409 - DNA, 17 bp, Homo sapiens
cttcaaagaaacttgaa

SEQ ID NO: 6194410 - DNA, 19 bp, Homo sapiens
cttcaaagatagggaggga

SEQ ID NO: 6194411 - DNA, 17 bp, Homo sapiens
cttcaaagattatctga

SEQ ID NO: 6194412 - DNA, 18 bp, Homo sapiens
cttcaaagattatctgat

SEQ ID NO: 6194413 - DNA, 11 bp, Homo sapiens
cttcaaagcag

SEQ ID NO: 6194414 - DNA, 14 bp, Homo sapiens
cttcaaagcagagt

SEQ ID NO: 6194415 - DNA, 19 bp, Homo sapiens
cttcaaagctgaatatttt

SEQ ID NO: 6194416 - DNA, 16 bp, Homo sapiens
cttcaaagcttgaaga

SEQ ID NO: 6194417 - DNA, 22 bp, Homo sapiens
cttcaaagtctcaatgaaatag

SEQ ID NO: 6194418 - DNA, 13 bp, Homo sapiens
cttcaaagtgcct

SEQ ID NO: 6194419 - DNA, 16 bp, Homo sapiens
cttcaaagtgcctggg

SEQ ID NO: 6194420 - DNA, 18 bp, Homo sapiens
cttcaaagtgcctgggct

SEQ ID NO: 6194421 - DNA, 17 bp, Homo sapiens
cttcaaagtgtgtctgg

SEQ ID NO: 6194422 - DNA, 16 bp, Homo sapiens
cttcaaagtttaataa

SEQ ID NO: 6194423 - DNA, 14 bp, Homo sapiens
cttcaaataaagaa

SEQ ID NO: 6194424 - DNA, 21 bp, Homo sapiens
cttcaaataaagaaatttggt

SEQ ID NO: 6194425 - DNA, 16 bp, Homo sapiens
cttcaaataattaaat

SEQ ID NO: 6194426 - DNA, 13 bp, Homo sapiens
cttcaaataattg

SEQ ID NO: 6194427 - DNA, 18 bp, Homo sapiens
cttcaaatacaaagtaaa

SEQ ID NO: 6194428 - DNA, 17 bp, Homo sapiens
cttcaaatacattctaa

SEQ ID NO: 6194429 - DNA, 16 bp, Homo sapiens
cttcaaatatagagat

SEQ ID NO: 6194430 - DNA, 14 bp, Homo sapiens
cttcaaatccatcc

SEQ ID NO: 6194431 - DNA, 16 bp, Homo sapiens
cttcaaatccatccag

SEQ ID NO: 6194432 - DNA, 16 bp, Homo sapiens
cttcaaatctcagcaa

SEQ ID NO: 6194433 - DNA, 18 bp, Homo sapiens
cttcaaatgatccttcct

SEQ ID NO: 6194434 - DNA, 24 bp, Homo sapiens
cttcaaatgggagactctttgaaa

SEQ ID NO: 6194435 - DNA, 23 bp, Homo sapiens
cttcaaatgtcatttcatacaaa

SEQ ID NO: 6194436 - DNA, 22 bp, Homo sapiens
cttcaaattaaagtgctgttta

SEQ ID NO: 6194437 - DNA, 17 bp, Homo sapiens
cttcaaattatagaaac

SEQ ID NO: 6194438 - DNA, 18 bp, Homo sapiens
cttcaaattcaaggcctt

SEQ ID NO: 6194439 - DNA, 20 bp, Homo sapiens
cttcaaatttgattctaaat

SEQ ID NO: 6194440 - DNA, 19 bp, Homo sapiens
cttcaacaactttgtgctt

SEQ ID NO: 6194441 - DNA, 15 bp, Homo sapiens
cttcaacacagcttg

SEQ ID NO: 6194442 - DNA, 22 bp, Homo sapiens
cttcaacacagcttgtctcttg

SEQ ID NO: 6194443 - DNA, 23 bp, Homo sapiens
cttcaacagaccccctctagaaa

SEQ ID NO: 6194444 - DNA, 14 bp, Homo sapiens
cttcaacagccaag

SEQ ID NO: 6194445 - DNA, 21 bp, Homo sapiens
cttcaacagccaagctggcac

SEQ ID NO: 6194446 - DNA, 22 bp, Homo sapiens
cttcaacagccaagctggcaca

SEQ ID NO: 6194447 - DNA, 23 bp, Homo sapiens
cttcaacagccaagctggcacaa

SEQ ID NO: 6194448 - DNA, 17 bp, Homo sapiens
cttcaacagctccccat

SEQ ID NO: 6194449 - DNA, 16 bp, Homo sapiens
cttcaacatcaatgtt

SEQ ID NO: 6194450 - DNA, 20 bp, Homo sapiens
cttcaacatcaatgttcatt

SEQ ID NO: 6194451 - DNA, 19 bp, Homo sapiens
cttcaacatgctccaaata

SEQ ID NO: 6194452 - DNA, 14 bp, Homo sapiens
cttcaacatgtgct

SEQ ID NO: 6194453 - DNA, 14 bp, Homo sapiens
cttcaacatgtgtg

SEQ ID NO: 6194454 - DNA, 22 bp, Homo sapiens
cttcaaccagggattgtttctg

SEQ ID NO: 6194455 - DNA, 23 bp, Homo sapiens
cttcaaccccacttcctactgta

SEQ ID NO: 6194456 - DNA, 15 bp, Homo sapiens
cttcaaccccctcgc

SEQ ID NO: 6194457 - DNA, 21 bp, Homo sapiens
cttcaaccccctcgcctccta

SEQ ID NO: 6194458 - DNA, 19 bp, Homo sapiens
cttcaaccccgaggtccct

SEQ ID NO: 6194459 - DNA, 16 bp, Homo sapiens
cttcaaccctcagcct

SEQ ID NO: 6194460 - DNA, 14 bp, Homo sapiens
cttcaaccctgccc

SEQ ID NO: 6194461 - DNA, 16 bp, Homo sapiens
cttcaacgtttcttca

SEQ ID NO: 6194462 - DNA, 17 bp, Homo sapiens
cttcaacgtttcttcac

SEQ ID NO: 6194463 - DNA, 22 bp, Homo sapiens
cttcaacgtttcttcacttttg

SEQ ID NO: 6194464 - DNA, 13 bp, Homo sapiens
cttcaactcctgg

SEQ ID NO: 6194465 - DNA, 15 bp, Homo sapiens
cttcaactcctggct

SEQ ID NO: 6194466 - DNA, 15 bp, Homo sapiens
cttcaactcctgggc

SEQ ID NO: 6194467 - DNA, 16 bp, Homo sapiens
cttcaactgtctgtct

SEQ ID NO: 6194468 - DNA, 23 bp, Homo sapiens
cttcaagaaagaattcctgcagc

SEQ ID NO: 6194469 - DNA, 18 bp, Homo sapiens
cttcaagaactctgggct

SEQ ID NO: 6194470 - DNA, 17 bp, Homo sapiens
cttcaagaatcagaaga

SEQ ID NO: 6194471 - DNA, 14 bp, Homo sapiens
cttcaagaatgcag

SEQ ID NO: 6194472 - DNA, 18 bp, Homo sapiens
cttcaagacgaggggcag

SEQ ID NO: 6194473 - DNA, 13 bp, Homo sapiens
cttcaagaggaaa

SEQ ID NO: 6194474 - DNA, 22 bp, Homo sapiens
cttcaagaggaaaggcgccccc

SEQ ID NO: 6194475 - DNA, 23 bp, Homo sapiens
cttcaagatcctcttgccacatc

SEQ ID NO: 6194476 - DNA, 20 bp, Homo sapiens
cttcaagatgagcctgggct

SEQ ID NO: 6194477 - DNA, 16 bp, Homo sapiens
cttcaagcaaagacag

SEQ ID NO: 6194478 - DNA, 15 bp, Homo sapiens
cttcaagcacctgca

SEQ ID NO: 6194479 - DNA, 18 bp, Homo sapiens
cttcaagccagctctagg

SEQ ID NO: 6194480 - DNA, 16 bp, Homo sapiens
cttcaagcctggccca

SEQ ID NO: 6194481 - DNA, 17 bp, Homo sapiens
cttcaagcgctccaggg

SEQ ID NO: 6194482 - DNA, 12 bp, Homo sapiens
cttcaagctctc

SEQ ID NO: 6194483 - DNA, 20 bp, Homo sapiens
cttcaagctctgagggaaag

SEQ ID NO: 6194484 - DNA, 18 bp, Homo sapiens
cttcaagctgctttttgt

SEQ ID NO: 6194485 - DNA, 23 bp, Homo sapiens
cttcaagctgttatttcttccct

SEQ ID NO: 6194486 - DNA, 15 bp, Homo sapiens
cttcaaggaaaataa

SEQ ID NO: 6194487 - DNA, 17 bp, Homo sapiens
cttcaaggactgtttca

SEQ ID NO: 6194488 - DNA, 21 bp, Homo sapiens
cttcaaggactgtttcagtgt

SEQ ID NO: 6194489 - DNA, 17 bp, Homo sapiens
cttcaaggatcctgagc

SEQ ID NO: 6194490 - DNA, 18 bp, Homo sapiens
cttcaaggatcctgagcc

SEQ ID NO: 6194491 - DNA, 21 bp, Homo sapiens
cttcaaggatcctgagccaga

SEQ ID NO: 6194492 - DNA, 15 bp, Homo sapiens
cttcaaggcttcagt

SEQ ID NO: 6194493 - DNA, 19 bp, Homo sapiens
cttcaaggcttcagtctca

SEQ ID NO: 6194494 - DNA, 18 bp, Homo sapiens
cttcaagggaagaaacac

SEQ ID NO: 6194495 - DNA, 17 bp, Homo sapiens
cttcaagggctgcttca

SEQ ID NO: 6194496 - DNA, 15 bp, Homo sapiens
cttcaaggtgacaga

SEQ ID NO: 6194497 - DNA, 19 bp, Homo sapiens
cttcaagtaagatcaagaa

SEQ ID NO: 6194498 - DNA, 17 bp, Homo sapiens
cttcaagtaatacgttt

SEQ ID NO: 6194499 - DNA, 16 bp, Homo sapiens
cttcaagtctgtgcct

SEQ ID NO: 6194500 - DNA, 17 bp, Homo sapiens
cttcaagtctgtgcctg

SEQ ID NO: 6194501 - DNA, 18 bp, Homo sapiens
cttcaagtctgtgcctgg

SEQ ID NO: 6194502 - DNA, 21 bp, Homo sapiens
cttcaagtgatatatgtattt

SEQ ID NO: 6194503 - DNA, 12 bp, Homo sapiens
cttcaagtgcca

SEQ ID NO: 6194504 - DNA, 12 bp, Homo sapiens
cttcaagtgcct

SEQ ID NO: 6194505 - DNA, 23 bp, Homo sapiens
cttcaagtgccttttgctgcgca

SEQ ID NO: 6194506 - DNA, 20 bp, Homo sapiens
cttcaagtgttgctcttgga

SEQ ID NO: 6194507 - DNA, 19 bp, Homo sapiens
cttcaataaaatggttcat

SEQ ID NO: 6194508 - DNA, 20 bp, Homo sapiens
cttcaataaaccacaagcat

SEQ ID NO: 6194509 - DNA, 15 bp, Homo sapiens
cttcaataaatcttt

SEQ ID NO: 6194510 - DNA, 18 bp, Homo sapiens
cttcaataaattttttct

SEQ ID NO: 6194511 - DNA, 16 bp, Homo sapiens
cttcaataattgtcca

SEQ ID NO: 6194512 - DNA, 16 bp, Homo sapiens
cttcaatactgaaaat

SEQ ID NO: 6194513 - DNA, 17 bp, Homo sapiens
cttcaatacttaaaaat

SEQ ID NO: 6194514 - DNA, 20 bp, Homo sapiens
cttcaatcaataacagccgc

SEQ ID NO: 6194515 - DNA, 13 bp, Homo sapiens
cttcaatcactgt

SEQ ID NO: 6194516 - DNA, 13 bp, Homo sapiens
cttcaatcccagc

SEQ ID NO: 6194517 - DNA, 17 bp, Homo sapiens
cttcaatccttgaaggt

SEQ ID NO: 6194518 - DNA, 21 bp, Homo sapiens
cttcaatcggcttgtgggtga

SEQ ID NO: 6194519 - DNA, 15 bp, Homo sapiens
cttcaatctcgttta

SEQ ID NO: 6194520 - DNA, 13 bp, Homo sapiens
cttcaatctctgg

SEQ ID NO: 6194521 - DNA, 18 bp, Homo sapiens
cttcaatgaattaattca

SEQ ID NO: 6194522 - DNA, 16 bp, Homo sapiens
cttcaatgctagaaaa

SEQ ID NO: 6194523 - DNA, 18 bp, Homo sapiens
cttcaatgctagaaaatc

SEQ ID NO: 6194524 - DNA, 14 bp, Homo sapiens
cttcaatggaatac

SEQ ID NO: 6194525 - DNA, 19 bp, Homo sapiens
cttcaatggaatacagtca

SEQ ID NO: 6194526 - DNA, 16 bp, Homo sapiens
cttcaatgggagtgaa

SEQ ID NO: 6194527 - DNA, 16 bp, Homo sapiens
cttcaattaaaattac

SEQ ID NO: 6194528 - DNA, 22 bp, Homo sapiens
cttcaattaaaattacaaaaga

SEQ ID NO: 6194529 - DNA, 16 bp, Homo sapiens
cttcaattaatggaaa

SEQ ID NO: 6194530 - DNA, 22 bp, Homo sapiens
cttcaattaatggaaaactgtt

SEQ ID NO: 6194531 - DNA, 16 bp, Homo sapiens
cttcaattggtggaat

SEQ ID NO: 6194532 - DNA, 22 bp, Homo sapiens
cttcaattggtggaattcctct

SEQ ID NO: 6194533 - DNA, 20 bp, Homo sapiens
cttcaatttattactgaaaa

SEQ ID NO: 6194534 - DNA, 17 bp, Homo sapiens
cttcaatttcaaacttt

SEQ ID NO: 6194535 - DNA, 22 bp, Homo sapiens
cttcaatttctagtacctgtga

SEQ ID NO: 6194536 - DNA, 22 bp, Homo sapiens
cttcaatttgtagactcttgct

SEQ ID NO: 6194537 - DNA, 14 bp, Homo sapiens
cttcacaaagccaa

SEQ ID NO: 6194538 - DNA, 17 bp, Homo sapiens
cttcacaaagccaagcc

SEQ ID NO: 6194539 - DNA, 15 bp, Homo sapiens
cttcacaaagcccaa

SEQ ID NO: 6194540 - DNA, 17 bp, Homo sapiens
cttcacaaagcccaagg

SEQ ID NO: 6194541 - DNA, 22 bp, Homo sapiens
cttcacaaatgtcattgtctac

SEQ ID NO: 6194542 - DNA, 17 bp, Homo sapiens
cttcacaaccagccaca

SEQ ID NO: 6194543 - DNA, 21 bp, Homo sapiens
cttcacaaccagccacacaga

SEQ ID NO: 6194544 - DNA, 22 bp, Homo sapiens
cttcacaaccagccacacagag

SEQ ID NO: 6194545 - DNA, 23 bp, Homo sapiens
cttcacaaccagccacacagagc

SEQ ID NO: 6194546 - DNA, 21 bp, Homo sapiens
cttcacaacctccgtgctggg

SEQ ID NO: 6194547 - DNA, 22 bp, Homo sapiens
cttcacaacctccgtgctgggc

SEQ ID NO: 6194548 - DNA, 15 bp, Homo sapiens
cttcacaatttcaat

SEQ ID NO: 6194549 - DNA, 14 bp, Homo sapiens
cttcacacaaagtg

SEQ ID NO: 6194550 - DNA, 17 bp, Homo sapiens
cttcacacaaagtgaaa

SEQ ID NO: 6194551 - DNA, 19 bp, Homo sapiens
cttcacacaaagtgaaatt

SEQ ID NO: 6194552 - DNA, 20 bp, Homo sapiens
cttcacacaaagtgaaatta

SEQ ID NO: 6194553 - DNA, 22 bp, Homo sapiens
cttcacacagcacctcctctct

SEQ ID NO: 6194554 - DNA, 14 bp, Homo sapiens
gaagtgacttgaat

SEQ ID NO: 6194555 - DNA, 17 bp, Homo sapiens
gaagtgacttgaatgta

SEQ ID NO: 6194556 - DNA, 23 bp, Homo sapiens
gaagtgacttgaatgtacaaaga

SEQ ID NO: 6194557 - DNA, 15 bp, Homo sapiens
gaagtgactttggct

SEQ ID NO: 6194558 - DNA, 20 bp, Homo sapiens
gaagtgactttggctgcatg

SEQ ID NO: 6194559 - DNA, 16 bp, Homo sapiens
gaagtgagaaaatgaa

SEQ ID NO: 6194560 - DNA, 21 bp, Homo sapiens
gaagtgagagaaaaaggtcct

SEQ ID NO: 6194561 - DNA, 17 bp, Homo sapiens
gaagtgagagctttgct

SEQ ID NO: 6194562 - DNA, 19 bp, Homo sapiens
gaagtgagagctttgctta

SEQ ID NO: 6194563 - DNA, 16 bp, Homo sapiens
gaagtgagatacaaag

SEQ ID NO: 6194564 - DNA, 21 bp, Homo sapiens
gaagtgagcagtcgcctgcct

SEQ ID NO: 6194565 - DNA, 17 bp, Homo sapiens
gaagtgagcccccccct

SEQ ID NO: 6194566 - DNA, 15 bp, Homo sapiens
gaagtgaggcccaag

SEQ ID NO: 6194567 - DNA, 12 bp, Homo sapiens
gaagtgaggcct

SEQ ID NO: 6194568 - DNA, 22 bp, Homo sapiens
gaagtgagggctcactcagcca

SEQ ID NO: 6194569 - DNA, 18 bp, Homo sapiens
gaagtgagtttgtaaata

SEQ ID NO: 6194570 - DNA, 17 bp, Homo sapiens
gaagtgatatggtgaag

SEQ ID NO: 6194571 - DNA, 18 bp, Homo sapiens
gaagtgattctaagattt

SEQ ID NO: 6194572 - DNA, 18 bp, Homo sapiens
gaagtgcacaggagccaa

SEQ ID NO: 6194573 - DNA, 18 bp, Homo sapiens
gaagtgcagaactgcagt

SEQ ID NO: 6194574 - DNA, 24 bp, Homo sapiens
gaagtgcagtcagcagatgctgtt

SEQ ID NO: 6194575 - DNA, 23 bp, Homo sapiens
gaagtgcatcctgattattttca

SEQ ID NO: 6194576 - DNA, 15 bp, Homo sapiens
gaagtgcatgggtca

SEQ ID NO: 6194577 - DNA, 18 bp, Homo sapiens
gaagtgcatgggtcaggg

SEQ ID NO: 6194578 - DNA, 20 bp, Homo sapiens
gaagtgcatgggtcagggtg

SEQ ID NO: 6194579 - DNA, 22 bp, Homo sapiens
gaagtgcatgggtcagggtgtg

SEQ ID NO: 6194580 - DNA, 12 bp, Homo sapiens
gaagtgcatgtt

SEQ ID NO: 6194581 - DNA, 23 bp, Homo sapiens
gaagtgcatttctgaatagaaat

SEQ ID NO: 6194582 - DNA, 14 bp, Homo sapiens
gaagtgccacatga

SEQ ID NO: 6194583 - DNA, 15 bp, Homo sapiens
gaagtgccatctcaa

SEQ ID NO: 6194584 - DNA, 13 bp, Homo sapiens
gaagtgcccagcc

SEQ ID NO: 6194585 - DNA, 17 bp, Homo sapiens
gaagtgcccagcccctg

SEQ ID NO: 6194586 - DNA, 16 bp, Homo sapiens
gaagtgccccctcccc

SEQ ID NO: 6194587 - DNA, 13 bp, Homo sapiens
gaagtgcccctgc

SEQ ID NO: 6194588 - DNA, 16 bp, Homo sapiens
gaagtgcccttcctgc

SEQ ID NO: 6194589 - DNA, 14 bp, Homo sapiens
gaagtgcctactgg

SEQ ID NO: 6194590 - DNA, 20 bp, Homo sapiens
gaagtgccttctccttcccc

SEQ ID NO: 6194591 - DNA, 16 bp, Homo sapiens
gaagtgcgtgaatgta

SEQ ID NO: 6194592 - DNA, 19 bp, Homo sapiens
gaagtgcgtggtataatct

SEQ ID NO: 6194593 - DNA, 18 bp, Homo sapiens
gaagtgctccccacacgt

SEQ ID NO: 6194594 - DNA, 20 bp, Homo sapiens
gaagtgctcccctctgaaag

SEQ ID NO: 6194595 - DNA, 12 bp, Homo sapiens
gaagtgctccct

SEQ ID NO: 6194596 - DNA, 21 bp, Homo sapiens
gaagtgctctaacttttctta

SEQ ID NO: 6194597 - DNA, 20 bp, Homo sapiens
gaagtgctcttggctgaccc

SEQ ID NO: 6194598 - DNA, 21 bp, Homo sapiens
gaagtgctgccgcgcagtgtg

SEQ ID NO: 6194599 - DNA, 14 bp, Homo sapiens
gaagtgctgctcca

SEQ ID NO: 6194600 - DNA, 22 bp, Homo sapiens
gaagtgcttaacgttttcttaa

SEQ ID NO: 6194601 - DNA, 18 bp, Homo sapiens
gaagtgcttgatatgtaa

SEQ ID NO: 6194602 - DNA, 12 bp, Homo sapiens
gaagtggaatgg

SEQ ID NO: 6194603 - DNA, 20 bp, Homo sapiens
gaagtggactggcccctggg

SEQ ID NO: 6194604 - DNA, 18 bp, Homo sapiens
gaagtggaggttgctgta

SEQ ID NO: 6194605 - DNA, 18 bp, Homo sapiens
gaagtggcaggaggacag

SEQ ID NO: 6194606 - DNA, 12 bp, Homo sapiens
gaagtggcccct

SEQ ID NO: 6194607 - DNA, 21 bp, Homo sapiens
gaagtggctcagacccctcag

SEQ ID NO: 6194608 - DNA, 12 bp, Homo sapiens
gaagtggctggt

SEQ ID NO: 6194609 - DNA, 20 bp, Homo sapiens
gaagtggctggtagaaaaag

SEQ ID NO: 6194610 - DNA, 18 bp, Homo sapiens
gaagtggctggtctggag

SEQ ID NO: 6194611 - DNA, 20 bp, Homo sapiens
gaagtggctggtctggagtc

SEQ ID NO: 6194612 - DNA, 18 bp, Homo sapiens
gaagtgggaaaaaataga

SEQ ID NO: 6194613 - DNA, 12 bp, Homo sapiens
gaagtgggagaa

SEQ ID NO: 6194614 - DNA, 16 bp, Homo sapiens
gaagtgggagaagtgg

SEQ ID NO: 6194615 - DNA, 20 bp, Homo sapiens
gaagtgggagaagtggcccc

SEQ ID NO: 6194616 - DNA, 22 bp, Homo sapiens
gaagtgggagcagcttcttggg

SEQ ID NO: 6194617 - DNA, 21 bp, Homo sapiens
gaagtgggagtgggagaggaa

SEQ ID NO: 6194618 - DNA, 21 bp, Homo sapiens
gaagtgggattcaggaatggg

SEQ ID NO: 6194619 - DNA, 16 bp, Homo sapiens
gaagtgggccaggaca

SEQ ID NO: 6194620 - DNA, 18 bp, Homo sapiens
gaagtgggccagtcctgg

SEQ ID NO: 6194621 - DNA, 20 bp, Homo sapiens
gaagtggggaccccacccct

SEQ ID NO: 6194622 - DNA, 21 bp, Homo sapiens
gaagtggggaccccacccctc

SEQ ID NO: 6194623 - DNA, 22 bp, Homo sapiens
gaagtggggaccccacccctca

SEQ ID NO: 6194624 - DNA, 23 bp, Homo sapiens
gaagtggggaccccacccctcat

SEQ ID NO: 6194625 - DNA, 16 bp, Homo sapiens
gaagtgggggccgctg

SEQ ID NO: 6194626 - DNA, 22 bp, Homo sapiens
gaagtgggggccgctggcccag

SEQ ID NO: 6194627 - DNA, 14 bp, Homo sapiens
gaagtggggtctgg

SEQ ID NO: 6194628 - DNA, 15 bp, Homo sapiens
gaagtggggtgttct

SEQ ID NO: 6194629 - DNA, 19 bp, Homo sapiens
gaagtggggtgttcttctt

SEQ ID NO: 6194630 - DNA, 13 bp, Homo sapiens
gaagtggtccaga

SEQ ID NO: 6194631 - DNA, 13 bp, Homo sapiens
gaagtggtgacat

SEQ ID NO: 6194632 - DNA, 20 bp, Homo sapiens
gaagtggtgtgatcccagct

SEQ ID NO: 6194633 - DNA, 16 bp, Homo sapiens
gaagtggtgttttttt

SEQ ID NO: 6194634 - DNA, 16 bp, Homo sapiens
gaagtggttcagtcta

SEQ ID NO: 6194635 - DNA, 15 bp, Homo sapiens
gaagtgtaacagctg

SEQ ID NO: 6194636 - DNA, 18 bp, Homo sapiens
gaagtgtaggcagacaca

SEQ ID NO: 6194637 - DNA, 14 bp, Homo sapiens
gaagtgtataatat

SEQ ID NO: 6194638 - DNA, 21 bp, Homo sapiens
gaagtgtataatataaaaaat

SEQ ID NO: 6194639 - DNA, 20 bp, Homo sapiens
gaagtgtcaccctgtgggtg

SEQ ID NO: 6194640 - DNA, 22 bp, Homo sapiens
gaagtgtcaccctgtgggtgtc

SEQ ID NO: 6194641 - DNA, 16 bp, Homo sapiens
gaagtgtcgaaagcaa

SEQ ID NO: 6194642 - DNA, 15 bp, Homo sapiens
gaagtgtctgccagc

SEQ ID NO: 6194643 - DNA, 17 bp, Homo sapiens
gaagtgtctgccagctg

SEQ ID NO: 6194644 - DNA, 20 bp, Homo sapiens
gaagtgtcttctgttcccaa

SEQ ID NO: 6194645 - DNA, 20 bp, Homo sapiens
gaagtgtgccttctctctcc

SEQ ID NO: 6194646 - DNA, 14 bp, Homo sapiens
gaagtgtgctgagg

SEQ ID NO: 6194647 - DNA, 18 bp, Homo sapiens
gaagtgtgctgaggtggg

SEQ ID NO: 6194648 - DNA, 17 bp, Homo sapiens
gaagtgtgggtctgtgt

SEQ ID NO: 6194649 - DNA, 19 bp, Homo sapiens
gaagtgtgtgtttcttgct

SEQ ID NO: 6194650 - DNA, 16 bp, Homo sapiens
gaagtgtgttctgatg

SEQ ID NO: 6194651 - DNA, 11 bp, Homo sapiens
gaagtgttaat

SEQ ID NO: 6194652 - DNA, 16 bp, Homo sapiens
gaagtgttaatacatc

SEQ ID NO: 6194653 - DNA, 18 bp, Homo sapiens
gaagtgttaatacatcac

SEQ ID NO: 6194654 - DNA, 22 bp, Homo sapiens
gaagtgttatttcatccaggga

SEQ ID NO: 6194655 - DNA, 15 bp, Homo sapiens
gaagtgttcctgtct

SEQ ID NO: 6194656 - DNA, 17 bp, Homo sapiens
gaagtgttcctgtctca

SEQ ID NO: 6194657 - DNA, 18 bp, Homo sapiens
gaagtgttgaagggaggt

SEQ ID NO: 6194658 - DNA, 15 bp, Homo sapiens
gaagtgttgcatgga

SEQ ID NO: 6194659 - DNA, 22 bp, Homo sapiens
gaagtgtttcacgagagcccgg

SEQ ID NO: 6194660 - DNA, 12 bp, Homo sapiens
gaagtgtttctg

SEQ ID NO: 6194661 - DNA, 22 bp, Homo sapiens
gaagttaaactattttgagcat

SEQ ID NO: 6194662 - DNA, 18 bp, Homo sapiens
gaagttaacagtctcatt

SEQ ID NO: 6194663 - DNA, 23 bp, Homo sapiens
gaagttaagcagcctttctgtgg

SEQ ID NO: 6194664 - DNA, 17 bp, Homo sapiens
gaagttacatgcataaa

SEQ ID NO: 6194665 - DNA, 19 bp, Homo sapiens
gaagttacatgcataaaag

SEQ ID NO: 6194666 - DNA, 20 bp, Homo sapiens
gaagttacctggatgccatt

SEQ ID NO: 6194667 - DNA, 12 bp, Homo sapiens
gaagttaccttt

SEQ ID NO: 6194668 - DNA, 22 bp, Homo sapiens
gaagttaccttttataagacaa

SEQ ID NO: 6194669 - DNA, 18 bp, Homo sapiens
gaagttactgttatagag

SEQ ID NO: 6194670 - DNA, 14 bp, Homo sapiens
gaagttagaattcc

SEQ ID NO: 6194671 - DNA, 20 bp, Homo sapiens
gaagttagaattccttcagg

SEQ ID NO: 6194672 - DNA, 19 bp, Homo sapiens
gaagttagagataattctg

SEQ ID NO: 6194673 - DNA, 20 bp, Homo sapiens
gaagttagagataattctga

SEQ ID NO: 6194674 - DNA, 11 bp, Homo sapiens
gaagttagcct

SEQ ID NO: 6194675 - DNA, 21 bp, Homo sapiens
gaagttagcctttatctacca

SEQ ID NO: 6194676 - DNA, 22 bp, Homo sapiens
gaagttagcctttatctaccaa

SEQ ID NO: 6194677 - DNA, 19 bp, Homo sapiens
gaagttagctttaacttaa

SEQ ID NO: 6194678 - DNA, 22 bp, Homo sapiens
gaagttaggttcttaaaagtgc

SEQ ID NO: 6194679 - DNA, 15 bp, Homo sapiens
gaagttagtggaaat

SEQ ID NO: 6194680 - DNA, 20 bp, Homo sapiens
gaagttatctgctgggaaca

SEQ ID NO: 6194681 - DNA, 13 bp, Homo sapiens
gaagttatctgtg

SEQ ID NO: 6194682 - DNA, 14 bp, Homo sapiens
gaagttattttcca

SEQ ID NO: 6194683 - DNA, 21 bp, Homo sapiens
gaagttattttctacagtggt

SEQ ID NO: 6194684 - DNA, 15 bp, Homo sapiens
gaagttcaagatcaa

SEQ ID NO: 6194685 - DNA, 16 bp, Homo sapiens
gaagttcaccagccct

SEQ ID NO: 6194686 - DNA, 20 bp, Homo sapiens
gaagttcaccagccctgagc

SEQ ID NO: 6194687 - DNA, 19 bp, Homo sapiens
gaagttcaccattaaaagg

SEQ ID NO: 6194688 - DNA, 22 bp, Homo sapiens
gaagttcaccattaaaagggat

SEQ ID NO: 6194689 - DNA, 18 bp, Homo sapiens
gaagttcagaaatttaaa

SEQ ID NO: 6194690 - DNA, 20 bp, Homo sapiens
gaagttcagaaggtgtgtcc

SEQ ID NO: 6194691 - DNA, 15 bp, Homo sapiens
gaagttcatacctaa

SEQ ID NO: 6194692 - DNA, 14 bp, Homo sapiens
gaagttcattttta

SEQ ID NO: 6194693 - DNA, 14 bp, Homo sapiens
gaagttcccattat

SEQ ID NO: 6194694 - DNA, 16 bp, Homo sapiens
gaagttctaggaaatt

SEQ ID NO: 6194695 - DNA, 15 bp, Homo sapiens
gaagttctagtgttt

SEQ ID NO: 6194696 - DNA, 20 bp, Homo sapiens
gaagttctcaaagttaattc

SEQ ID NO: 6194697 - DNA, 18 bp, Homo sapiens
gaagttctcagaataact

SEQ ID NO: 6194698 - DNA, 15 bp, Homo sapiens
gaagttctgaaattt

SEQ ID NO: 6194699 - DNA, 18 bp, Homo sapiens
gaagttctgcctctgatg

SEQ ID NO: 6194700 - DNA, 16 bp, Homo sapiens
gaagttctggcaagat

SEQ ID NO: 6194701 - DNA, 19 bp, Homo sapiens
gaagttcttcaagaggaaa

SEQ ID NO: 6194702 - DNA, 14 bp, Homo sapiens
gaagttctttgatt

SEQ ID NO: 6194703 - DNA, 20 bp, Homo sapiens
gaagttgaataaacataaaa

SEQ ID NO: 6194704 - DNA, 18 bp, Homo sapiens
gaagttgatatagaacag

SEQ ID NO: 6194705 - DNA, 16 bp, Homo sapiens
gaagttgattcatatt

SEQ ID NO: 6194706 - DNA, 22 bp, Homo sapiens
gaagttgattcttatttgatgg

SEQ ID NO: 6194707 - DNA, 16 bp, Homo sapiens
gaagttgccaagagtt

SEQ ID NO: 6194708 - DNA, 14 bp, Homo sapiens
gaagttgctgcttc

SEQ ID NO: 6194709 - DNA, 15 bp, Homo sapiens
gaagttggaaatttt

SEQ ID NO: 6194710 - DNA, 14 bp, Homo sapiens
gaagttggcacatt

SEQ ID NO: 6194711 - DNA, 15 bp, Homo sapiens
gaagttggccacctt

SEQ ID NO: 6194712 - DNA, 19 bp, Homo sapiens
gaagttggggcactgggcg

SEQ ID NO: 6194713 - DNA, 22 bp, Homo sapiens
gaagttggtttagctttggaaa

SEQ ID NO: 6194714 - DNA, 15 bp, Homo sapiens
gaagttgtctccttc

SEQ ID NO: 6194715 - DNA, 17 bp, Homo sapiens
gaagttgtctccttcca

SEQ ID NO: 6194716 - DNA, 19 bp, Homo sapiens
gaagttgtgaaactaaaat

SEQ ID NO: 6194717 - DNA, 19 bp, Homo sapiens
gaagttgtgctaaaccaag

SEQ ID NO: 6194718 - DNA, 18 bp, Homo sapiens
gaagttgtggaggaggtg

SEQ ID NO: 6194719 - DNA, 14 bp, Homo sapiens
gaagttgtttgtca

SEQ ID NO: 6194720 - DNA, 13 bp, Homo sapiens
gaagtttaaaaca

SEQ ID NO: 6194721 - DNA, 14 bp, Homo sapiens
gaagtttaaatctt

SEQ ID NO: 6194722 - DNA, 23 bp, Homo sapiens
gaagtttaacaagtatttattcc

SEQ ID NO: 6194723 - DNA, 17 bp, Homo sapiens
gaagtttaagtaagtaa

SEQ ID NO: 6194724 - DNA, 16 bp, Homo sapiens
gaagtttacattgtaa

SEQ ID NO: 6194725 - DNA, 17 bp, Homo sapiens
gaagtttacattgtaaa

SEQ ID NO: 6194726 - DNA, 21 bp, Homo sapiens
gaagtttacatttttatttat

SEQ ID NO: 6194727 - DNA, 17 bp, Homo sapiens
gaagtttagctctgaga

SEQ ID NO: 6194728 - DNA, 19 bp, Homo sapiens
gaagtttattattttcaaa

SEQ ID NO: 6194729 - DNA, 17 bp, Homo sapiens
gaagtttattctcattt

SEQ ID NO: 6194730 - DNA, 14 bp, Homo sapiens
gaagtttatttcct

SEQ ID NO: 6194731 - DNA, 22 bp, Homo sapiens
gaagtttatttgagaaaatata

SEQ ID NO: 6194732 - DNA, 13 bp, Homo sapiens
cttcacacccctc

SEQ ID NO: 6194733 - DNA, 21 bp, Homo sapiens
cttcacactatcaacactgca

SEQ ID NO: 6194734 - DNA, 20 bp, Homo sapiens
cttcacactgcaagagcctt

SEQ ID NO: 6194735 - DNA, 21 bp, Homo sapiens
cttcacactgcaagagccttg

SEQ ID NO: 6194736 - DNA, 22 bp, Homo sapiens
cttcacactggtttgccaggcc

SEQ ID NO: 6194737 - DNA, 15 bp, Homo sapiens
cttcacagaggaaga

SEQ ID NO: 6194738 - DNA, 20 bp, Homo sapiens
cttcacagagtgtgctggag

SEQ ID NO: 6194739 - DNA, 23 bp, Homo sapiens
cttcacagagtgtgctggaggac

SEQ ID NO: 6194740 - DNA, 13 bp, Homo sapiens
cttcacagatgcc

SEQ ID NO: 6194741 - DNA, 14 bp, Homo sapiens
cttcacagatgcct

SEQ ID NO: 6194742 - DNA, 16 bp, Homo sapiens
cttcacagatgcctac

SEQ ID NO: 6194743 - DNA, 12 bp, Homo sapiens
cttcacagcgtc

SEQ ID NO: 6194744 - DNA, 15 bp, Homo sapiens
cttcacagcgtctgc

SEQ ID NO: 6194745 - DNA, 18 bp, Homo sapiens
cttcacagcgtctgctca

SEQ ID NO: 6194746 - DNA, 16 bp, Homo sapiens
cttcacagctctgtgt

SEQ ID NO: 6194747 - DNA, 15 bp, Homo sapiens
cttcacaggcagtgc

SEQ ID NO: 6194748 - DNA, 18 bp, Homo sapiens
cttcacaggcagtgcatg

SEQ ID NO: 6194749 - DNA, 19 bp, Homo sapiens
cttcacaggcagtgcatgt

SEQ ID NO: 6194750 - DNA, 20 bp, Homo sapiens
cttcacaggcagtgcatgtg

SEQ ID NO: 6194751 - DNA, 19 bp, Homo sapiens
cttcacagggacagatctg

SEQ ID NO: 6194752 - DNA, 16 bp, Homo sapiens
cttcacagtacttccc

SEQ ID NO: 6194753 - DNA, 18 bp, Homo sapiens
cttcacagtacttcccaa

SEQ ID NO: 6194754 - DNA, 18 bp, Homo sapiens
cttcacagtagagccagc

SEQ ID NO: 6194755 - DNA, 22 bp, Homo sapiens
cttcacagtagagccagcttgg

SEQ ID NO: 6194756 - DNA, 15 bp, Homo sapiens
cttcacagtcccagg

SEQ ID NO: 6194757 - DNA, 16 bp, Homo sapiens
cttcacagtcccaggt

SEQ ID NO: 6194758 - DNA, 15 bp, Homo sapiens
cttcacagtctggtg

SEQ ID NO: 6194759 - DNA, 17 bp, Homo sapiens
cttcacagtctggtgct

SEQ ID NO: 6194760 - DNA, 12 bp, Homo sapiens
cttcacagtgtt

SEQ ID NO: 6194761 - DNA, 13 bp, Homo sapiens
cttcacagtgttt

SEQ ID NO: 6194762 - DNA, 14 bp, Homo sapiens
cttcacagtgtttc

SEQ ID NO: 6194763 - DNA, 20 bp, Homo sapiens
cttcacataagctcagaatc

SEQ ID NO: 6194764 - DNA, 14 bp, Homo sapiens
cttcacatattgat

SEQ ID NO: 6194765 - DNA, 12 bp, Homo sapiens
cttcacatttaa

SEQ ID NO: 6194766 - DNA, 23 bp, Homo sapiens
cttcacatttgtatgtgtgtaga

SEQ ID NO: 6194767 - DNA, 13 bp, Homo sapiens
cttcaccaaatat

SEQ ID NO: 6194768 - DNA, 16 bp, Homo sapiens
cttcaccaagaagcaa

SEQ ID NO: 6194769 - DNA, 17 bp, Homo sapiens
cttcaccaccccctgtc

SEQ ID NO: 6194770 - DNA, 18 bp, Homo sapiens
cttcaccagagcccatgc

SEQ ID NO: 6194771 - DNA, 23 bp, Homo sapiens
cttcaccagcaactctgactctt

SEQ ID NO: 6194772 - DNA, 13 bp, Homo sapiens
cttcaccaggaag

SEQ ID NO: 6194773 - DNA, 14 bp, Homo sapiens
cttcaccaggtgca

SEQ ID NO: 6194774 - DNA, 19 bp, Homo sapiens
cttcaccagtctgtctact

SEQ ID NO: 6194775 - DNA, 23 bp, Homo sapiens
cttcaccagtctgtctactgtgg

SEQ ID NO: 6194776 - DNA, 17 bp, Homo sapiens
cttcaccatcaatcctg

SEQ ID NO: 6194777 - DNA, 21 bp, Homo sapiens
cttcaccatcttggccaggct

SEQ ID NO: 6194778 - DNA, 17 bp, Homo sapiens
cttcaccatctttctga

SEQ ID NO: 6194779 - DNA, 22 bp, Homo sapiens
cttcacccaccacccccatcat

SEQ ID NO: 6194780 - DNA, 16 bp, Homo sapiens
cttcacccaccaggcc

SEQ ID NO: 6194781 - DNA, 19 bp, Homo sapiens
cttcacccaccaggccagc

SEQ ID NO: 6194782 - DNA, 18 bp, Homo sapiens
cttcacccaccccatgga

SEQ ID NO: 6194783 - DNA, 14 bp, Homo sapiens
cttcacccagagct

SEQ ID NO: 6194784 - DNA, 16 bp, Homo sapiens
cttcacccagagctgc

SEQ ID NO: 6194785 - DNA, 22 bp, Homo sapiens
cttcacccagctaatctgtagg

SEQ ID NO: 6194786 - DNA, 14 bp, Homo sapiens
cttcacccatgaaa

SEQ ID NO: 6194787 - DNA, 14 bp, Homo sapiens
cttcaccccagtgg

SEQ ID NO: 6194788 - DNA, 19 bp, Homo sapiens
cttcaccccggcaggccct

SEQ ID NO: 6194789 - DNA, 21 bp, Homo sapiens
cttcacccctacactgtgaag

SEQ ID NO: 6194790 - DNA, 18 bp, Homo sapiens
cttcacccggctgggctc

SEQ ID NO: 6194791 - DNA, 21 bp, Homo sapiens
cttcaccctgaatggttccat

SEQ ID NO: 6194792 - DNA, 15 bp, Homo sapiens
cttcaccgcattcca

SEQ ID NO: 6194793 - DNA, 18 bp, Homo sapiens
cttcaccgcattccaggg

SEQ ID NO: 6194794 - DNA, 16 bp, Homo sapiens
cttcaccgtggctacc

SEQ ID NO: 6194795 - DNA, 15 bp, Homo sapiens
cttcacctcactgaa

SEQ ID NO: 6194796 - DNA, 13 bp, Homo sapiens
cttcacctcagag

SEQ ID NO: 6194797 - DNA, 13 bp, Homo sapiens
cttcacctccttc

SEQ ID NO: 6194798 - DNA, 15 bp, Homo sapiens
cttcacctccttctg

SEQ ID NO: 6194799 - DNA, 11 bp, Homo sapiens
cttcacctcta

SEQ ID NO: 6194800 - DNA, 22 bp, Homo sapiens
cttcacctctgggaccccagct

SEQ ID NO: 6194801 - DNA, 13 bp, Homo sapiens
cttcacctgccac

SEQ ID NO: 6194802 - DNA, 14 bp, Homo sapiens
cttcacctgccacc

SEQ ID NO: 6194803 - DNA, 16 bp, Homo sapiens
cttcacctgccaccac

SEQ ID NO: 6194804 - DNA, 19 bp, Homo sapiens
cttcacctgttatgtatga

SEQ ID NO: 6194805 - DNA, 11 bp, Homo sapiens
cttcaccttct

SEQ ID NO: 6194806 - DNA, 16 bp, Homo sapiens
cttcaccttctgtaat

SEQ ID NO: 6194807 - DNA, 16 bp, Homo sapiens
cttcacctttcctctc

SEQ ID NO: 6194808 - DNA, 21 bp, Homo sapiens
cttcacctttcctctccctca

SEQ ID NO: 6194809 - DNA, 16 bp, Homo sapiens
cttcacctttggtgca

SEQ ID NO: 6194810 - DNA, 22 bp, Homo sapiens
cttcacctttggtgcagaggtt

SEQ ID NO: 6194811 - DNA, 17 bp, Homo sapiens
cttcacctttgtcccca

SEQ ID NO: 6194812 - DNA, 22 bp, Homo sapiens
cttcacgacaatgttgagaagt

SEQ ID NO: 6194813 - DNA, 15 bp, Homo sapiens
cttcacgcccttggc

SEQ ID NO: 6194814 - DNA, 13 bp, Homo sapiens
cttcacgcctggg

SEQ ID NO: 6194815 - DNA, 14 bp, Homo sapiens
cttcacgctggctt

SEQ ID NO: 6194816 - DNA, 17 bp, Homo sapiens
cttcacgctggcttcca

SEQ ID NO: 6194817 - DNA, 18 bp, Homo sapiens
cttcacggactctttgct

SEQ ID NO: 6194818 - DNA, 16 bp, Homo sapiens
cttcacggcaggacaa

SEQ ID NO: 6194819 - DNA, 14 bp, Homo sapiens
cttcacgtattctt

SEQ ID NO: 6194820 - DNA, 23 bp, Homo sapiens
cttcactacaacattagaatatt

SEQ ID NO: 6194821 - DNA, 20 bp, Homo sapiens
cttcactacgtgttcacagg

SEQ ID NO: 6194822 - DNA, 18 bp, Homo sapiens
cttcactattcagaactt

SEQ ID NO: 6194823 - DNA, 13 bp, Homo sapiens
cttcactcacttt

SEQ ID NO: 6194824 - DNA, 13 bp, Homo sapiens
cttcactcagcca

SEQ ID NO: 6194825 - DNA, 17 bp, Homo sapiens
cttcactcagctggact

SEQ ID NO: 6194826 - DNA, 17 bp, Homo sapiens
cttcactccaaagagaa

SEQ ID NO: 6194827 - DNA, 19 bp, Homo sapiens
cttcactccaaagagaaac

SEQ ID NO: 6194828 - DNA, 14 bp, Homo sapiens
cttcactccggtgt

SEQ ID NO: 6194829 - DNA, 23 bp, Homo sapiens
cttcactccggtgtgcctgcagc

SEQ ID NO: 6194830 - DNA, 14 bp, Homo sapiens
cttcactcctgctg

SEQ ID NO: 6194831 - DNA, 17 bp, Homo sapiens
cttcactcgcccccggg

SEQ ID NO: 6194832 - DNA, 15 bp, Homo sapiens
cttcactctctgaag

SEQ ID NO: 6194833 - DNA, 22 bp, Homo sapiens
cttcactctgacagtattaaca

SEQ ID NO: 6194834 - DNA, 13 bp, Homo sapiens
cttcactctggct

SEQ ID NO: 6194835 - DNA, 19 bp, Homo sapiens
cttcactcttcaaatgcct

SEQ ID NO: 6194836 - DNA, 13 bp, Homo sapiens
cttcactgaccag

SEQ ID NO: 6194837 - DNA, 18 bp, Homo sapiens
cttcactgaccagcggct

SEQ ID NO: 6194838 - DNA, 19 bp, Homo sapiens
cttcactgcaattttgtgt

SEQ ID NO: 6194839 - DNA, 17 bp, Homo sapiens
cttcactgcagcctttc

SEQ ID NO: 6194840 - DNA, 22 bp, Homo sapiens
cttcactgcagcctttcacagg

SEQ ID NO: 6194841 - DNA, 14 bp, Homo sapiens
cttcactgccatga

SEQ ID NO: 6194842 - DNA, 13 bp, Homo sapiens
cttcactgcccag

SEQ ID NO: 6194843 - DNA, 23 bp, Homo sapiens
cttcactgccccacttctggcat

SEQ ID NO: 6194844 - DNA, 24 bp, Homo sapiens
cttcactgccccacttctggcatg

SEQ ID NO: 6194845 - DNA, 14 bp, Homo sapiens
cttcactgcctttg

SEQ ID NO: 6194846 - DNA, 17 bp, Homo sapiens
cttcactgcctttgctc

SEQ ID NO: 6194847 - DNA, 15 bp, Homo sapiens
cttcactgctacatg

SEQ ID NO: 6194848 - DNA, 15 bp, Homo sapiens
cttcactgctctgcc

SEQ ID NO: 6194849 - DNA, 16 bp, Homo sapiens
cttcactggcgccttc

SEQ ID NO: 6194850 - DNA, 14 bp, Homo sapiens
cttcactgggccag

SEQ ID NO: 6194851 - DNA, 15 bp, Homo sapiens
cttcactgggccagt

SEQ ID NO: 6194852 - DNA, 21 bp, Homo sapiens
cttcactggtgtacatcgttt

SEQ ID NO: 6194853 - DNA, 12 bp, Homo sapiens
cttcactgtata

SEQ ID NO: 6194854 - DNA, 18 bp, Homo sapiens
cttcactgtatataaaca

SEQ ID NO: 6194855 - DNA, 19 bp, Homo sapiens
cttcactgtatataaacat

SEQ ID NO: 6194856 - DNA, 21 bp, Homo sapiens
cttcactgtcctccaagccag

SEQ ID NO: 6194857 - DNA, 16 bp, Homo sapiens
cttcactgtctgttgt

SEQ ID NO: 6194858 - DNA, 19 bp, Homo sapiens
cttcactgtgaccttgaga

SEQ ID NO: 6194859 - DNA, 21 bp, Homo sapiens
cttcactgtggccacagcccc

SEQ ID NO: 6194860 - DNA, 12 bp, Homo sapiens
cttcactgttcc

SEQ ID NO: 6194861 - DNA, 21 bp, Homo sapiens
cttcactgttccctctggctt

SEQ ID NO: 6194862 - DNA, 23 bp, Homo sapiens
cttcactgttccctctggcttcc

SEQ ID NO: 6194863 - DNA, 15 bp, Homo sapiens
cttcacttaaaatca

SEQ ID NO: 6194864 - DNA, 20 bp, Homo sapiens
cttcacttaaaatcaaattt

SEQ ID NO: 6194865 - DNA, 14 bp, Homo sapiens
cttcacttcctcca

SEQ ID NO: 6194866 - DNA, 19 bp, Homo sapiens
cttcacttctgaccacact

SEQ ID NO: 6194867 - DNA, 21 bp, Homo sapiens
cttcacttctgactcttcccc

SEQ ID NO: 6194868 - DNA, 19 bp, Homo sapiens
cttcacttgagttggctgt

SEQ ID NO: 6194869 - DNA, 20 bp, Homo sapiens
cttcacttgagttggctgtg

SEQ ID NO: 6194870 - DNA, 16 bp, Homo sapiens
cttcactttcctcagt

SEQ ID NO: 6194871 - DNA, 18 bp, Homo sapiens
cttcactttcctcagttg

SEQ ID NO: 6194872 - DNA, 13 bp, Homo sapiens
cttcactttctcc

SEQ ID NO: 6194873 - DNA, 13 bp, Homo sapiens
cttcactttctta

SEQ ID NO: 6194874 - DNA, 15 bp, Homo sapiens
cttcagaaaagacac

SEQ ID NO: 6194875 - DNA, 11 bp, Homo sapiens
cttcagaaaga

SEQ ID NO: 6194876 - DNA, 12 bp, Homo sapiens
cttcagaaagac

SEQ ID NO: 6194877 - DNA, 22 bp, Homo sapiens
cttcagaacaatctgagtccag

SEQ ID NO: 6194878 - DNA, 15 bp, Homo sapiens
cttcagaacagaggc

SEQ ID NO: 6194879 - DNA, 23 bp, Homo sapiens
cttcagaacagaggcatttaaaa

SEQ ID NO: 6194880 - DNA, 20 bp, Homo sapiens
cttcagaactgcccttgctg

SEQ ID NO: 6194881 - DNA, 21 bp, Homo sapiens
cttcagaactgcccttgctgc

SEQ ID NO: 6194882 - DNA, 15 bp, Homo sapiens
cttcagaacttgtca

SEQ ID NO: 6194883 - DNA, 23 bp, Homo sapiens
cttcagaagaaaggacagctcag

SEQ ID NO: 6194884 - DNA, 17 bp, Homo sapiens
cttcagaagacactgca

SEQ ID NO: 6194885 - DNA, 15 bp, Homo sapiens
cttcagaagctagtg

SEQ ID NO: 6194886 - DNA, 20 bp, Homo sapiens
cttcagaaggcctcactcaa

SEQ ID NO: 6194887 - DNA, 15 bp, Homo sapiens
cttcagaattagatg

SEQ ID NO: 6194888 - DNA, 20 bp, Homo sapiens
cttcagacacacggggcacc

SEQ ID NO: 6194889 - DNA, 20 bp, Homo sapiens
cttcagacagagaggactgt

SEQ ID NO: 6194890 - DNA, 15 bp, Homo sapiens
cttcagacccagaga

SEQ ID NO: 6194891 - DNA, 16 bp, Homo sapiens
cttcagacccagagaa

SEQ ID NO: 6194892 - DNA, 17 bp, Homo sapiens
cttcagacccagagaag

SEQ ID NO: 6194893 - DNA, 14 bp, Homo sapiens
cttcagactctctc

SEQ ID NO: 6194894 - DNA, 20 bp, Homo sapiens
cttcagactctctcctctct

SEQ ID NO: 6194895 - DNA, 21 bp, Homo sapiens
cttcagactctctcctctctc

SEQ ID NO: 6194896 - DNA, 14 bp, Homo sapiens
cttcagactggccc

SEQ ID NO: 6194897 - DNA, 21 bp, Homo sapiens
cttcagagactcctgcaggca

SEQ ID NO: 6194898 - DNA, 18 bp, Homo sapiens
cttcagagagaatgagca

SEQ ID NO: 6194899 - DNA, 17 bp, Homo sapiens
cttcagagagcagtgct

SEQ ID NO: 6194900 - DNA, 19 bp, Homo sapiens
cttcagagagcagtgcttt

SEQ ID NO: 6194901 - DNA, 15 bp, Homo sapiens
cttcagagagctggt

SEQ ID NO: 6194902 - DNA, 23 bp, Homo sapiens
cttcagagcaaaagacttgagcc

SEQ ID NO: 6194903 - DNA, 21 bp, Homo sapiens
cttcagagcctagccacctcc

SEQ ID NO: 6194904 - DNA, 12 bp, Homo sapiens
cttcagagctga

SEQ ID NO: 6194905 - DNA, 21 bp, Homo sapiens
cttcagaggctcatctaactc

SEQ ID NO: 6194906 - DNA, 13 bp, Homo sapiens
cttcagagggaaa

SEQ ID NO: 6194907 - DNA, 17 bp, Homo sapiens
cttcagagtacgtcctg

SEQ ID NO: 6194908 - DNA, 20 bp, Homo sapiens
cttcagagtacgtcctgcct

SEQ ID NO: 6194909 - DNA, 14 bp, Homo sapiens
cttcagagtgaatc

SEQ ID NO: 6194910 - DNA, 16 bp, Homo sapiens
cttcagagtttgtcat

SEQ ID NO: 6194911 - DNA, 20 bp, Homo sapiens
cttcagatcagtgcttgagt

SEQ ID NO: 6194912 - DNA, 11 bp, Homo sapiens
gaagtttcatc

SEQ ID NO: 6194913 - DNA, 14 bp, Homo sapiens
gaagtttcatttat

SEQ ID NO: 6194914 - DNA, 18 bp, Homo sapiens
gaagtttctacattctct

SEQ ID NO: 6194915 - DNA, 20 bp, Homo sapiens
gaagtttctgccgcagccct

SEQ ID NO: 6194916 - DNA, 16 bp, Homo sapiens
gaagtttgctgtgctt

SEQ ID NO: 6194917 - DNA, 17 bp, Homo sapiens
gaagtttggagatagat

SEQ ID NO: 6194918 - DNA, 14 bp, Homo sapiens
gaagtttggctgct

SEQ ID NO: 6194919 - DNA, 19 bp, Homo sapiens
gaagtttgggctaacattt

SEQ ID NO: 6194920 - DNA, 13 bp, Homo sapiens
gaagtttgtagcc

SEQ ID NO: 6194921 - DNA, 23 bp, Homo sapiens
gaagttttacttgattaaggact

SEQ ID NO: 6194922 - DNA, 23 bp, Homo sapiens
gaagttttcaggacttggtctga

SEQ ID NO: 6194923 - DNA, 13 bp, Homo sapiens
gaagttttctgta

SEQ ID NO: 6194924 - DNA, 17 bp, Homo sapiens
gaagttttgcatttatg

SEQ ID NO: 6194925 - DNA, 18 bp, Homo sapiens
gaagttttggagagggaa

SEQ ID NO: 6194926 - DNA, 11 bp, Homo sapiens
gaagtttttaa

SEQ ID NO: 6194927 - DNA, 17 bp, Homo sapiens
gaagtttttattttaaa

SEQ ID NO: 6194928 - DNA, 18 bp, Homo sapiens
gaagtttttgaaatacct

SEQ ID NO: 6194929 - DNA, 19 bp, Homo sapiens
gaagtttttgaaatacctt

SEQ ID NO: 6194930 - DNA, 14 bp, Homo sapiens
gaagttttttactt

SEQ ID NO: 6194931 - DNA, 18 bp, Homo sapiens
gaataaaaaacatttgta

SEQ ID NO: 6194932 - DNA, 14 bp, Homo sapiens
gaataaaaaagaaa

SEQ ID NO: 6194933 - DNA, 15 bp, Homo sapiens
gaataaaaaagattc

SEQ ID NO: 6194934 - DNA, 17 bp, Homo sapiens
gaataaaaaagattcta

SEQ ID NO: 6194935 - DNA, 19 bp, Homo sapiens
gaataaaaaagattctact

SEQ ID NO: 6194936 - DNA, 21 bp, Homo sapiens
gaataaaaaagattctactaa

SEQ ID NO: 6194937 - DNA, 14 bp, Homo sapiens
gaataaaaaccctg

SEQ ID NO: 6194938 - DNA, 20 bp, Homo sapiens
gaataaaaaggttggcctta

SEQ ID NO: 6194939 - DNA, 19 bp, Homo sapiens
gaataaaaagtgaactttt

SEQ ID NO: 6194940 - DNA, 19 bp, Homo sapiens
gaataaaaataaagttttt

SEQ ID NO: 6194941 - DNA, 19 bp, Homo sapiens
gaataaaaatagaaacctg

SEQ ID NO: 6194942 - DNA, 12 bp, Homo sapiens
gaataaaagtgc

SEQ ID NO: 6194943 - DNA, 15 bp, Homo sapiens
gaataaaatgttgaa

SEQ ID NO: 6194944 - DNA, 16 bp, Homo sapiens
gaataaaatgtttctc

SEQ ID NO: 6194945 - DNA, 18 bp, Homo sapiens
gaataaaattaggttaaa

SEQ ID NO: 6194946 - DNA, 13 bp, Homo sapiens
gaataaaattgta

SEQ ID NO: 6194947 - DNA, 21 bp, Homo sapiens
gaataaaattgttatttcaat

SEQ ID NO: 6194948 - DNA, 12 bp, Homo sapiens
gaataaaatttt

SEQ ID NO: 6194949 - DNA, 14 bp, Homo sapiens
gaataaacaccact

SEQ ID NO: 6194950 - DNA, 19 bp, Homo sapiens
gaataaacactttttctgg

SEQ ID NO: 6194951 - DNA, 12 bp, Homo sapiens
gaataaaccaag

SEQ ID NO: 6194952 - DNA, 15 bp, Homo sapiens
gaataaaccggatcc

SEQ ID NO: 6194953 - DNA, 12 bp, Homo sapiens
gaataaactaga

SEQ ID NO: 6194954 - DNA, 17 bp, Homo sapiens
gaataaactagagaagg

SEQ ID NO: 6194955 - DNA, 12 bp, Homo sapiens
gaataaactgaa

SEQ ID NO: 6194956 - DNA, 14 bp, Homo sapiens
gaataaactgaata

SEQ ID NO: 6194957 - DNA, 16 bp, Homo sapiens
gaataaactgaatatt

SEQ ID NO: 6194958 - DNA, 12 bp, Homo sapiens
gaataaacttca

SEQ ID NO: 6194959 - DNA, 14 bp, Homo sapiens
gaataaacttcagc

SEQ ID NO: 6194960 - DNA, 15 bp, Homo sapiens
gaataaagaatactt

SEQ ID NO: 6194961 - DNA, 19 bp, Homo sapiens
gaataaagaatacttgaac

SEQ ID NO: 6194962 - DNA, 19 bp, Homo sapiens
gaataaagacttcatgttc

SEQ ID NO: 6194963 - DNA, 20 bp, Homo sapiens
gaataaagcaattttccttg

SEQ ID NO: 6194964 - DNA, 20 bp, Homo sapiens
gaataaagcagcctgattga

SEQ ID NO: 6194965 - DNA, 18 bp, Homo sapiens
gaataaagcctttgtatc

SEQ ID NO: 6194966 - DNA, 22 bp, Homo sapiens
gaataaagcttctctctgagct

SEQ ID NO: 6194967 - DNA, 23 bp, Homo sapiens
gaataaagcttctctctgagctg

SEQ ID NO: 6194968 - DNA, 14 bp, Homo sapiens
gaataaaggcagct

SEQ ID NO: 6194969 - DNA, 15 bp, Homo sapiens
gaataaaggcagttt

SEQ ID NO: 6194970 - DNA, 17 bp, Homo sapiens
gaataaaggcagttttc

SEQ ID NO: 6194971 - DNA, 15 bp, Homo sapiens
gaataaagtattgtc

SEQ ID NO: 6194972 - DNA, 16 bp, Homo sapiens
gaataaagtctgagtg

SEQ ID NO: 6194973 - DNA, 14 bp, Homo sapiens
gaataaagtgaata

SEQ ID NO: 6194974 - DNA, 13 bp, Homo sapiens
gaataaagtgcaa

SEQ ID NO: 6194975 - DNA, 21 bp, Homo sapiens
gaataaagttctgttttctgt

SEQ ID NO: 6194976 - DNA, 16 bp, Homo sapiens
gaataaagttgaagct

SEQ ID NO: 6194977 - DNA, 14 bp, Homo sapiens
gaataaagttgcag

SEQ ID NO: 6194978 - DNA, 15 bp, Homo sapiens
gaataaagttgcaga

SEQ ID NO: 6194979 - DNA, 16 bp, Homo sapiens
gaataaataaagaaga

SEQ ID NO: 6194980 - DNA, 17 bp, Homo sapiens
gaataaataaagaagaa

SEQ ID NO: 6194981 - DNA, 18 bp, Homo sapiens
gaataaataaagaagaaa

SEQ ID NO: 6194982 - DNA, 13 bp, Homo sapiens
gaataaatgcctt

SEQ ID NO: 6194983 - DNA, 16 bp, Homo sapiens
gaataaatgtatctga

SEQ ID NO: 6194984 - DNA, 14 bp, Homo sapiens
gaataaatgtcact

SEQ ID NO: 6194985 - DNA, 23 bp, Homo sapiens
gaataaatgtcactttttgaggc

SEQ ID NO: 6194986 - DNA, 12 bp, Homo sapiens
gaataaatgtgt

SEQ ID NO: 6194987 - DNA, 16 bp, Homo sapiens
gaataaatgtgttggg

SEQ ID NO: 6194988 - DNA, 18 bp, Homo sapiens
gaataaatgttcaaactg

SEQ ID NO: 6194989 - DNA, 17 bp, Homo sapiens
gaataaatgttttacaa

SEQ ID NO: 6194990 - DNA, 21 bp, Homo sapiens
gaataaattaatattgtattg

SEQ ID NO: 6194991 - DNA, 17 bp, Homo sapiens
gaataaattatggcatt

SEQ ID NO: 6194992 - DNA, 21 bp, Homo sapiens
gaataaattctacctccttgt

SEQ ID NO: 6194993 - DNA, 21 bp, Homo sapiens
gaataaattttcaaatcctta

SEQ ID NO: 6194994 - DNA, 12 bp, Homo sapiens
gaataacactgc

SEQ ID NO: 6194995 - DNA, 14 bp, Homo sapiens
gaataacatgtaat

SEQ ID NO: 6194996 - DNA, 19 bp, Homo sapiens
gaataacatgtaattaagt

SEQ ID NO: 6194997 - DNA, 14 bp, Homo sapiens
gaataacatttaaa

SEQ ID NO: 6194998 - DNA, 23 bp, Homo sapiens
gaataaccacttaaaaaatgtcc

SEQ ID NO: 6194999 - DNA, 15 bp, Homo sapiens
gaataactagcacca

SEQ ID NO: 6195000 - DNA, 22 bp, Homo sapiens
gaataactatctcacttccaga

SEQ ID NO: 6195001 - DNA, 17 bp, Homo sapiens
gaataactcagaatatt

SEQ ID NO: 6195002 - DNA, 12 bp, Homo sapiens
gaataagaattt

SEQ ID NO: 6195003 - DNA, 15 bp, Homo sapiens
gaataagaatttgca

SEQ ID NO: 6195004 - DNA, 16 bp, Homo sapiens
gaataagaatttgcat

SEQ ID NO: 6195005 - DNA, 17 bp, Homo sapiens
gaataagaatttgcata

SEQ ID NO: 6195006 - DNA, 22 bp, Homo sapiens
gaataagacaagagatctacac

SEQ ID NO: 6195007 - DNA, 23 bp, Homo sapiens
gaataagacaagagatctacaca

SEQ ID NO: 6195008 - DNA, 20 bp, Homo sapiens
gaataagagacctgttttaa

SEQ ID NO: 6195009 - DNA, 17 bp, Homo sapiens
gaataagcactttttaa

SEQ ID NO: 6195010 - DNA, 23 bp, Homo sapiens
gaataagctctagttcttaacaa

SEQ ID NO: 6195011 - DNA, 14 bp, Homo sapiens
gaataaggaggagg

SEQ ID NO: 6195012 - DNA, 18 bp, Homo sapiens
gaataagtgctgtttgag

SEQ ID NO: 6195013 - DNA, 23 bp, Homo sapiens
gaataagtgtacatatgtaaaat

SEQ ID NO: 6195014 - DNA, 13 bp, Homo sapiens
gaataagttattg

SEQ ID NO: 6195015 - DNA, 11 bp, Homo sapiens
gaataataaat

SEQ ID NO: 6195016 - DNA, 21 bp, Homo sapiens
gaataataaatacacaatgaa

SEQ ID NO: 6195017 - DNA, 23 bp, Homo sapiens
gaataataagcaggatgttggcc

SEQ ID NO: 6195018 - DNA, 22 bp, Homo sapiens
gaataataattaggttaacatt

SEQ ID NO: 6195019 - DNA, 18 bp, Homo sapiens
gaataatagcacatgatt

SEQ ID NO: 6195020 - DNA, 19 bp, Homo sapiens
gaataatatcaaataaaat

SEQ ID NO: 6195021 - DNA, 18 bp, Homo sapiens
gaataatcacgctttcct

SEQ ID NO: 6195022 - DNA, 21 bp, Homo sapiens
gaataatcacgctttcctgaa

SEQ ID NO: 6195023 - DNA, 12 bp, Homo sapiens
gaataatcctgt

SEQ ID NO: 6195024 - DNA, 19 bp, Homo sapiens
gaataatctcatcccccca

SEQ ID NO: 6195025 - DNA, 13 bp, Homo sapiens
gaataatgaaaat

SEQ ID NO: 6195026 - DNA, 18 bp, Homo sapiens
gaataatgaaaataaaac

SEQ ID NO: 6195027 - DNA, 15 bp, Homo sapiens
gaataatgaagatct

SEQ ID NO: 6195028 - DNA, 16 bp, Homo sapiens
gaataatgaagatctt

SEQ ID NO: 6195029 - DNA, 14 bp, Homo sapiens
gaataatggaaaca

SEQ ID NO: 6195030 - DNA, 20 bp, Homo sapiens
gaataatggaaacattacag

SEQ ID NO: 6195031 - DNA, 17 bp, Homo sapiens
gaataatggaattatgt

SEQ ID NO: 6195032 - DNA, 13 bp, Homo sapiens
gaataatggactc

SEQ ID NO: 6195033 - DNA, 20 bp, Homo sapiens
gaataatggtaccagataaa

SEQ ID NO: 6195034 - DNA, 13 bp, Homo sapiens
gaataatgtgtta

SEQ ID NO: 6195035 - DNA, 20 bp, Homo sapiens
gaataattatttatttaata

SEQ ID NO: 6195036 - DNA, 15 bp, Homo sapiens
gaataattctttgat

SEQ ID NO: 6195037 - DNA, 16 bp, Homo sapiens
gaataattctttgatt

SEQ ID NO: 6195038 - DNA, 17 bp, Homo sapiens
gaataattgtgtacaaa

SEQ ID NO: 6195039 - DNA, 19 bp, Homo sapiens
gaataatttatagtaatga

SEQ ID NO: 6195040 - DNA, 12 bp, Homo sapiens
gaataatttatt

SEQ ID NO: 6195041 - DNA, 13 bp, Homo sapiens
gaataatttatta

SEQ ID NO: 6195042 - DNA, 23 bp, Homo sapiens
gaataatttattattaaggtaac

SEQ ID NO: 6195043 - DNA, 23 bp, Homo sapiens
gaataatttcccaattaggaagt

SEQ ID NO: 6195044 - DNA, 17 bp, Homo sapiens
gaataatttccttcagg

SEQ ID NO: 6195045 - DNA, 18 bp, Homo sapiens
gaataatttccttcaggc

SEQ ID NO: 6195046 - DNA, 21 bp, Homo sapiens
gaataatttctcctcatttaa

SEQ ID NO: 6195047 - DNA, 17 bp, Homo sapiens
gaataatttctgttgtt

SEQ ID NO: 6195048 - DNA, 14 bp, Homo sapiens
gaataatttcttac

SEQ ID NO: 6195049 - DNA, 23 bp, Homo sapiens
gaataatttgtaaatgattttaa

SEQ ID NO: 6195050 - DNA, 18 bp, Homo sapiens
gaataattttaacagaca

SEQ ID NO: 6195051 - DNA, 17 bp, Homo sapiens
gaatacaaacacctgga

SEQ ID NO: 6195052 - DNA, 14 bp, Homo sapiens
gaatacaattaaag

SEQ ID NO: 6195053 - DNA, 16 bp, Homo sapiens
gaatacaattaaaggt

SEQ ID NO: 6195054 - DNA, 12 bp, Homo sapiens
gaatacacagta

SEQ ID NO: 6195055 - DNA, 22 bp, Homo sapiens
gaatacacatataaaaacaata

SEQ ID NO: 6195056 - DNA, 23 bp, Homo sapiens
gaatacacatctctgtcagtgtg

SEQ ID NO: 6195057 - DNA, 16 bp, Homo sapiens
gaatacagcagcaaga

SEQ ID NO: 6195058 - DNA, 17 bp, Homo sapiens
gaatacatattacaaga

SEQ ID NO: 6195059 - DNA, 18 bp, Homo sapiens
gaatacatcagaaaataa

SEQ ID NO: 6195060 - DNA, 15 bp, Homo sapiens
gaatacatctgtgga

SEQ ID NO: 6195061 - DNA, 17 bp, Homo sapiens
gaatacatcttgtttct

SEQ ID NO: 6195062 - DNA, 20 bp, Homo sapiens
gaatacattaacggtgctaa

SEQ ID NO: 6195063 - DNA, 15 bp, Homo sapiens
gaatacattctttgc

SEQ ID NO: 6195064 - DNA, 21 bp, Homo sapiens
gaatacattctttgctagttg

SEQ ID NO: 6195065 - DNA, 19 bp, Homo sapiens
gaatacattttataatttc

SEQ ID NO: 6195066 - DNA, 19 bp, Homo sapiens
gaataccactctgtaattg

SEQ ID NO: 6195067 - DNA, 23 bp, Homo sapiens
gaataccactctgtaattgcaaa

SEQ ID NO: 6195068 - DNA, 19 bp, Homo sapiens
gaataccattaaaactgct

SEQ ID NO: 6195069 - DNA, 20 bp, Homo sapiens
gaataccattaaaactgctt

SEQ ID NO: 6195070 - DNA, 20 bp, Homo sapiens
gaataccccaccagcagaac

SEQ ID NO: 6195071 - DNA, 17 bp, Homo sapiens
gaatacccccagagacc

SEQ ID NO: 6195072 - DNA, 21 bp, Homo sapiens
gaatacccccagagacctttt

SEQ ID NO: 6195073 - DNA, 17 bp, Homo sapiens
gaataccccttctctgt

SEQ ID NO: 6195074 - DNA, 13 bp, Homo sapiens
gaatacctgtggt

SEQ ID NO: 6195075 - DNA, 18 bp, Homo sapiens
gaatacgcagaactacca

SEQ ID NO: 6195076 - DNA, 20 bp, Homo sapiens
gaatacgctaataagtgaca

SEQ ID NO: 6195077 - DNA, 15 bp, Homo sapiens
gaatacggaagagca

SEQ ID NO: 6195078 - DNA, 23 bp, Homo sapiens
gaatactacagcataaatctgtt

SEQ ID NO: 6195079 - DNA, 13 bp, Homo sapiens
gaatactcacatt

SEQ ID NO: 6195080 - DNA, 15 bp, Homo sapiens
gaatactcacatttt

SEQ ID NO: 6195081 - DNA, 18 bp, Homo sapiens
gaatactgaaaaagaatg

SEQ ID NO: 6195082 - DNA, 15 bp, Homo sapiens
gaatactgatggaat

SEQ ID NO: 6195083 - DNA, 21 bp, Homo sapiens
gaatactgccaaaacatttat

SEQ ID NO: 6195084 - DNA, 22 bp, Homo sapiens
gaatactgccaaaacatttatg

SEQ ID NO: 6195085 - DNA, 13 bp, Homo sapiens
gaatactgcttga

SEQ ID NO: 6195086 - DNA, 22 bp, Homo sapiens
gaatactgcttgcttacaatct

SEQ ID NO: 6195087 - DNA, 23 bp, Homo sapiens
gaatactgcttgcttacaatctt

SEQ ID NO: 6195088 - DNA, 13 bp, Homo sapiens
gaatactggtctc

SEQ ID NO: 6195089 - DNA, 24 bp, Homo sapiens
gaatactgtattgttacagctgaa

SEQ ID NO: 6195090 - DNA, 19 bp, Homo sapiens
gaatacttaatatgtggga

SEQ ID NO: 6195091 - DNA, 21 bp, Homo sapiens
gaatacttattttcagtgcat

SEQ ID NO: 6195092 - DNA, 15 bp, Homo sapiens
cttcagatcctaccc

SEQ ID NO: 6195093 - DNA, 16 bp, Homo sapiens
cttcagatcctacccc

SEQ ID NO: 6195094 - DNA, 13 bp, Homo sapiens
cttcagatctgag

SEQ ID NO: 6195095 - DNA, 16 bp, Homo sapiens
cttcagatgctcttgg

SEQ ID NO: 6195096 - DNA, 17 bp, Homo sapiens
cttcagatgtggagcca

SEQ ID NO: 6195097 - DNA, 18 bp, Homo sapiens
cttcagatgtggagccag

SEQ ID NO: 6195098 - DNA, 23 bp, Homo sapiens
cttcagattaatgactggctaca

SEQ ID NO: 6195099 - DNA, 15 bp, Homo sapiens
cttcagattatttcc

SEQ ID NO: 6195100 - DNA, 11 bp, Homo sapiens
cttcagattcc

SEQ ID NO: 6195101 - DNA, 12 bp, Homo sapiens
cttcagatttca

SEQ ID NO: 6195102 - DNA, 15 bp, Homo sapiens
cttcagatttcaaat

SEQ ID NO: 6195103 - DNA, 17 bp, Homo sapiens
cttcagcaaaaatattt

SEQ ID NO: 6195104 - DNA, 20 bp, Homo sapiens
cttcagcaaccctacagtat

SEQ ID NO: 6195105 - DNA, 20 bp, Homo sapiens
cttcagcaagttagaactag

SEQ ID NO: 6195106 - DNA, 17 bp, Homo sapiens
cttcagcaatccttaaa

SEQ ID NO: 6195107 - DNA, 22 bp, Homo sapiens
cttcagcactttaaagaggctg

SEQ ID NO: 6195108 - DNA, 20 bp, Homo sapiens
cttcagcagcagctcacacc

SEQ ID NO: 6195109 - DNA, 15 bp, Homo sapiens
cttcagcagctagag

SEQ ID NO: 6195110 - DNA, 15 bp, Homo sapiens
cttcagcaggaaggg

SEQ ID NO: 6195111 - DNA, 16 bp, Homo sapiens
cttcagcaggaagggt

SEQ ID NO: 6195112 - DNA, 23 bp, Homo sapiens
cttcagcataattcggaagggaa

SEQ ID NO: 6195113 - DNA, 13 bp, Homo sapiens
cttcagcattccc

SEQ ID NO: 6195114 - DNA, 15 bp, Homo sapiens
cttcagcattccctc

SEQ ID NO: 6195115 - DNA, 15 bp, Homo sapiens
cttcagcattgtaat

SEQ ID NO: 6195116 - DNA, 17 bp, Homo sapiens
cttcagccaccctttct

SEQ ID NO: 6195117 - DNA, 17 bp, Homo sapiens
cttcagccacctctctt

SEQ ID NO: 6195118 - DNA, 17 bp, Homo sapiens
cttcagccaggagctgg

SEQ ID NO: 6195119 - DNA, 18 bp, Homo sapiens
cttcagccaggagctggg

SEQ ID NO: 6195120 - DNA, 13 bp, Homo sapiens
cttcagccaggca

SEQ ID NO: 6195121 - DNA, 16 bp, Homo sapiens
cttcagccaggcaaga

SEQ ID NO: 6195122 - DNA, 21 bp, Homo sapiens
cttcagccaggtctgactcca

SEQ ID NO: 6195123 - DNA, 14 bp, Homo sapiens
cttcagccatcaac

SEQ ID NO: 6195124 - DNA, 17 bp, Homo sapiens
cttcagcccaccaccct

SEQ ID NO: 6195125 - DNA, 16 bp, Homo sapiens
cttcagcccaggcttt

SEQ ID NO: 6195126 - DNA, 16 bp, Homo sapiens
cttcagcccccagccc

SEQ ID NO: 6195127 - DNA, 12 bp, Homo sapiens
cttcagcccctt

SEQ ID NO: 6195128 - DNA, 16 bp, Homo sapiens
cttcagccccttctcc

SEQ ID NO: 6195129 - DNA, 21 bp, Homo sapiens
cttcagccccttctcccctcc

SEQ ID NO: 6195130 - DNA, 17 bp, Homo sapiens
cttcagccctcacccct

SEQ ID NO: 6195131 - DNA, 19 bp, Homo sapiens
cttcagccctcacccctgg

SEQ ID NO: 6195132 - DNA, 22 bp, Homo sapiens
cttcagcctagccgacctcagc

SEQ ID NO: 6195133 - DNA, 17 bp, Homo sapiens
cttcagcctagtggctt

SEQ ID NO: 6195134 - DNA, 23 bp, Homo sapiens
cttcagcctagtggcttgtcctc

SEQ ID NO: 6195135 - DNA, 14 bp, Homo sapiens
cttcagcctcccac

SEQ ID NO: 6195136 - DNA, 15 bp, Homo sapiens
cttcagcctcccaca

SEQ ID NO: 6195137 - DNA, 20 bp, Homo sapiens
cttcagcctccccaccttct

SEQ ID NO: 6195138 - DNA, 14 bp, Homo sapiens
cttcagcctccctc

SEQ ID NO: 6195139 - DNA, 15 bp, Homo sapiens
cttcagcctccctca

SEQ ID NO: 6195140 - DNA, 16 bp, Homo sapiens
cttcagcctccctcag

SEQ ID NO: 6195141 - DNA, 15 bp, Homo sapiens
cttcagcctgaaaga

SEQ ID NO: 6195142 - DNA, 20 bp, Homo sapiens
cttcagcctgaggctgagac

SEQ ID NO: 6195143 - DNA, 22 bp, Homo sapiens
cttcagcctgaggctgagactg

SEQ ID NO: 6195144 - DNA, 16 bp, Homo sapiens
cttcagctccagcccc

SEQ ID NO: 6195145 - DNA, 19 bp, Homo sapiens
cttcagctccagccccttt

SEQ ID NO: 6195146 - DNA, 14 bp, Homo sapiens
cttcagctcccata

SEQ ID NO: 6195147 - DNA, 15 bp, Homo sapiens
cttcagctcccatag

SEQ ID NO: 6195148 - DNA, 14 bp, Homo sapiens
cttcagctcctgag

SEQ ID NO: 6195149 - DNA, 16 bp, Homo sapiens
cttcagctcctgagta

SEQ ID NO: 6195150 - DNA, 21 bp, Homo sapiens
cttcagctcctgagtagctgg

SEQ ID NO: 6195151 - DNA, 13 bp, Homo sapiens
cttcagctctgaa

SEQ ID NO: 6195152 - DNA, 19 bp, Homo sapiens
cttcagctctggggcagag

SEQ ID NO: 6195153 - DNA, 13 bp, Homo sapiens
cttcagctgactc

SEQ ID NO: 6195154 - DNA, 14 bp, Homo sapiens
cttcagctgcctga

SEQ ID NO: 6195155 - DNA, 19 bp, Homo sapiens
cttcagctgcctgaaacag

SEQ ID NO: 6195156 - DNA, 12 bp, Homo sapiens
cttcagctgctg

SEQ ID NO: 6195157 - DNA, 20 bp, Homo sapiens
cttcagctgctgacaatcct

SEQ ID NO: 6195158 - DNA, 11 bp, Homo sapiens
cttcagctggt

SEQ ID NO: 6195159 - DNA, 19 bp, Homo sapiens
cttcagctggtggatggtg

SEQ ID NO: 6195160 - DNA, 20 bp, Homo sapiens
cttcagctgttgcagatgaa

SEQ ID NO: 6195161 - DNA, 13 bp, Homo sapiens
cttcagcttcttc

SEQ ID NO: 6195162 - DNA, 21 bp, Homo sapiens
cttcaggaaagcagcagtttt

SEQ ID NO: 6195163 - DNA, 17 bp, Homo sapiens
cttcaggaacaagtaat

SEQ ID NO: 6195164 - DNA, 22 bp, Homo sapiens
cttcaggaacctcgagtactgt

SEQ ID NO: 6195165 - DNA, 19 bp, Homo sapiens
cttcaggacactcactaca

SEQ ID NO: 6195166 - DNA, 12 bp, Homo sapiens
cttcaggacctg

SEQ ID NO: 6195167 - DNA, 15 bp, Homo sapiens
cttcaggactctgcg

SEQ ID NO: 6195168 - DNA, 18 bp, Homo sapiens
cttcaggactctgcggga

SEQ ID NO: 6195169 - DNA, 11 bp, Homo sapiens
cttcaggagcc

SEQ ID NO: 6195170 - DNA, 14 bp, Homo sapiens
cttcaggagcccta

SEQ ID NO: 6195171 - DNA, 14 bp, Homo sapiens
cttcaggagcctgg

SEQ ID NO: 6195172 - DNA, 16 bp, Homo sapiens
cttcaggagcctggcc

SEQ ID NO: 6195173 - DNA, 17 bp, Homo sapiens
cttcaggagcctggcca

SEQ ID NO: 6195174 - DNA, 19 bp, Homo sapiens
cttcaggagctgacagagc

SEQ ID NO: 6195175 - DNA, 21 bp, Homo sapiens
cttcaggagtttcatgttgga

SEQ ID NO: 6195176 - DNA, 22 bp, Homo sapiens
cttcaggatattggttcttccc

SEQ ID NO: 6195177 - DNA, 22 bp, Homo sapiens
cttcaggcaattctcctgcctt

SEQ ID NO: 6195178 - DNA, 16 bp, Homo sapiens
cttcaggcaccagcat

SEQ ID NO: 6195179 - DNA, 13 bp, Homo sapiens
cttcaggccagct

SEQ ID NO: 6195180 - DNA, 15 bp, Homo sapiens
cttcaggccccagga

SEQ ID NO: 6195181 - DNA, 23 bp, Homo sapiens
cttcaggccccgccccatgggcc

SEQ ID NO: 6195182 - DNA, 16 bp, Homo sapiens
cttcaggctctgccca

SEQ ID NO: 6195183 - DNA, 15 bp, Homo sapiens
cttcaggctcttctc

SEQ ID NO: 6195184 - DNA, 16 bp, Homo sapiens
cttcaggcttctgtca

SEQ ID NO: 6195185 - DNA, 19 bp, Homo sapiens
cttcagggaaggtgaaaca

SEQ ID NO: 6195186 - DNA, 12 bp, Homo sapiens
cttcagggaggg

SEQ ID NO: 6195187 - DNA, 23 bp, Homo sapiens
cttcagggagggttagcctgcac

SEQ ID NO: 6195188 - DNA, 21 bp, Homo sapiens
cttcagggaggtagtttcaaa

SEQ ID NO: 6195189 - DNA, 18 bp, Homo sapiens
cttcagggagtcagctgt

SEQ ID NO: 6195190 - DNA, 16 bp, Homo sapiens
cttcagggattccctg

SEQ ID NO: 6195191 - DNA, 22 bp, Homo sapiens
cttcagggcagattttagtttt

SEQ ID NO: 6195192 - DNA, 16 bp, Homo sapiens
cttcagggcagggctc

SEQ ID NO: 6195193 - DNA, 19 bp, Homo sapiens
cttcagggcagggctctga

SEQ ID NO: 6195194 - DNA, 11 bp, Homo sapiens
cttcagggcca

SEQ ID NO: 6195195 - DNA, 14 bp, Homo sapiens
cttcagggccagaa

SEQ ID NO: 6195196 - DNA, 18 bp, Homo sapiens
cttcagggccagaaggag

SEQ ID NO: 6195197 - DNA, 15 bp, Homo sapiens
cttcagggcctggtt

SEQ ID NO: 6195198 - DNA, 15 bp, Homo sapiens
cttcagggctgagtt

SEQ ID NO: 6195199 - DNA, 22 bp, Homo sapiens
cttcaggggaagagaagacaaa

SEQ ID NO: 6195200 - DNA, 21 bp, Homo sapiens
cttcaggggagtcccgtcagg

SEQ ID NO: 6195201 - DNA, 23 bp, Homo sapiens
cttcaggggagtcccgtcaggac

SEQ ID NO: 6195202 - DNA, 19 bp, Homo sapiens
cttcaggggatgggtgtgg

SEQ ID NO: 6195203 - DNA, 19 bp, Homo sapiens
cttcaggggcacttcattg

SEQ ID NO: 6195204 - DNA, 15 bp, Homo sapiens
cttcaggggctgccc

SEQ ID NO: 6195205 - DNA, 19 bp, Homo sapiens
cttcaggggctgcccgctc

SEQ ID NO: 6195206 - DNA, 21 bp, Homo sapiens
cttcaggggtcacctcctcca

SEQ ID NO: 6195207 - DNA, 23 bp, Homo sapiens
cttcaggggtcacctcctccaag

SEQ ID NO: 6195208 - DNA, 16 bp, Homo sapiens
cttcaggtaaaaactt

SEQ ID NO: 6195209 - DNA, 20 bp, Homo sapiens
cttcaggtaaaaacttcatt

SEQ ID NO: 6195210 - DNA, 23 bp, Homo sapiens
cttcaggtaaagggcaaataatg

SEQ ID NO: 6195211 - DNA, 15 bp, Homo sapiens
cttcaggtcaggtgg

SEQ ID NO: 6195212 - DNA, 10 bp, Homo sapiens
cttcaggtcc

SEQ ID NO: 6195213 - DNA, 18 bp, Homo sapiens
cttcaggtccaggctgtg

SEQ ID NO: 6195214 - DNA, 19 bp, Homo sapiens
cttcaggtcccctggccct

SEQ ID NO: 6195215 - DNA, 15 bp, Homo sapiens
cttcaggtgaacact

SEQ ID NO: 6195216 - DNA, 16 bp, Homo sapiens
cttcaggtgaacactt

SEQ ID NO: 6195217 - DNA, 21 bp, Homo sapiens
cttcaggtggagagcactaga

SEQ ID NO: 6195218 - DNA, 20 bp, Homo sapiens
cttcaggtgtgactctagca

SEQ ID NO: 6195219 - DNA, 21 bp, Homo sapiens
cttcaggttatcgaaataaca

SEQ ID NO: 6195220 - DNA, 16 bp, Homo sapiens
cttcaggttgcattgg

SEQ ID NO: 6195221 - DNA, 14 bp, Homo sapiens
cttcagtaagccgt

SEQ ID NO: 6195222 - DNA, 23 bp, Homo sapiens
cttcagtaccctctcagctccag

SEQ ID NO: 6195223 - DNA, 20 bp, Homo sapiens
cttcagtaggaacaagctgg

SEQ ID NO: 6195224 - DNA, 22 bp, Homo sapiens
cttcagtaggaacaagctggct

SEQ ID NO: 6195225 - DNA, 17 bp, Homo sapiens
cttcagtatcaaggctg

SEQ ID NO: 6195226 - DNA, 15 bp, Homo sapiens
cttcagtatgttgtc

SEQ ID NO: 6195227 - DNA, 18 bp, Homo sapiens
cttcagtattttctccac

SEQ ID NO: 6195228 - DNA, 19 bp, Homo sapiens
cttcagtcatggcattcgc

SEQ ID NO: 6195229 - DNA, 16 bp, Homo sapiens
cttcagtcattaaatt

SEQ ID NO: 6195230 - DNA, 18 bp, Homo sapiens
cttcagtcctgctccaga

SEQ ID NO: 6195231 - DNA, 19 bp, Homo sapiens
cttcagtcctgctccagaa

SEQ ID NO: 6195232 - DNA, 23 bp, Homo sapiens
cttcagtcctgctccagaatttg

SEQ ID NO: 6195233 - DNA, 18 bp, Homo sapiens
cttcagtcctgggagacc

SEQ ID NO: 6195234 - DNA, 22 bp, Homo sapiens
cttcagtcctggtctgctcagg

SEQ ID NO: 6195235 - DNA, 23 bp, Homo sapiens
cttcagtctctataccaataaag

SEQ ID NO: 6195236 - DNA, 14 bp, Homo sapiens
cttcagtctctgca

SEQ ID NO: 6195237 - DNA, 17 bp, Homo sapiens
cttcagtcttaatactt

SEQ ID NO: 6195238 - DNA, 14 bp, Homo sapiens
cttcagtcttggag

SEQ ID NO: 6195239 - DNA, 18 bp, Homo sapiens
cttcagtgaagaacccta

SEQ ID NO: 6195240 - DNA, 14 bp, Homo sapiens
cttcagtgactcct

SEQ ID NO: 6195241 - DNA, 18 bp, Homo sapiens
cttcagtgactcctgctg

SEQ ID NO: 6195242 - DNA, 21 bp, Homo sapiens
cttcagtgagcccctccccag

SEQ ID NO: 6195243 - DNA, 17 bp, Homo sapiens
cttcagtgcaagagact

SEQ ID NO: 6195244 - DNA, 19 bp, Homo sapiens
cttcagtgcaagagacttt

SEQ ID NO: 6195245 - DNA, 14 bp, Homo sapiens
cttcagtgccaaaa

SEQ ID NO: 6195246 - DNA, 13 bp, Homo sapiens
cttcagtgcctta

SEQ ID NO: 6195247 - DNA, 23 bp, Homo sapiens
cttcagtggaccgaaatctgtat

SEQ ID NO: 6195248 - DNA, 14 bp, Homo sapiens
cttcagtggcagct

SEQ ID NO: 6195249 - DNA, 18 bp, Homo sapiens
cttcagtgtaatgtgact

SEQ ID NO: 6195250 - DNA, 15 bp, Homo sapiens
cttcagtgtctctgt

SEQ ID NO: 6195251 - DNA, 17 bp, Homo sapiens
cttcagttaagcctttg

SEQ ID NO: 6195252 - DNA, 17 bp, Homo sapiens
cttcagttatgattttt

SEQ ID NO: 6195253 - DNA, 19 bp, Homo sapiens
cttcagttctctactccct

SEQ ID NO: 6195254 - DNA, 15 bp, Homo sapiens
cttcagttctgcttg

SEQ ID NO: 6195255 - DNA, 20 bp, Homo sapiens
cttcagttctgcttgctccc

SEQ ID NO: 6195256 - DNA, 23 bp, Homo sapiens
cttcagttgcttgtcttctggta

SEQ ID NO: 6195257 - DNA, 14 bp, Homo sapiens
cttcagttggttgt

SEQ ID NO: 6195258 - DNA, 15 bp, Homo sapiens
cttcagttgtctctg

SEQ ID NO: 6195259 - DNA, 17 bp, Homo sapiens
cttcagttgtctctgat

SEQ ID NO: 6195260 - DNA, 20 bp, Homo sapiens
cttcagttgtctctgatgca

SEQ ID NO: 6195261 - DNA, 23 bp, Homo sapiens
cttcagttgtctctgatgcagct

SEQ ID NO: 6195262 - DNA, 18 bp, Homo sapiens
cttcagttgttctttaga

SEQ ID NO: 6195263 - DNA, 17 bp, Homo sapiens
cttcagttgttttcccg

SEQ ID NO: 6195264 - DNA, 18 bp, Homo sapiens
cttcagtttaatgtctcc

SEQ ID NO: 6195265 - DNA, 14 bp, Homo sapiens
cttcagtttatttc

SEQ ID NO: 6195266 - DNA, 22 bp, Homo sapiens
cttcagtttatttccactattt

SEQ ID NO: 6195267 - DNA, 17 bp, Homo sapiens
cttcagtttcctggtct

SEQ ID NO: 6195268 - DNA, 16 bp, Homo sapiens
cttcagtttgcagagt

SEQ ID NO: 6195269 - DNA, 17 bp, Homo sapiens
cttcagtttgcagagta

SEQ ID NO: 6195270 - DNA, 18 bp, Homo sapiens
cttcagttttactgcatt

SEQ ID NO: 6195271 - DNA, 19 bp, Homo sapiens
gaatacttcctgaaataaa

SEQ ID NO: 6195272 - DNA, 23 bp, Homo sapiens
gaatacttcctgaaataaaactg

SEQ ID NO: 6195273 - DNA, 16 bp, Homo sapiens
gaatacttgaacttgt

SEQ ID NO: 6195274 - DNA, 14 bp, Homo sapiens
gaatacttgaagaa

SEQ ID NO: 6195275 - DNA, 17 bp, Homo sapiens
gaatactttgcttcata

SEQ ID NO: 6195276 - DNA, 22 bp, Homo sapiens
gaatagaaaagatgagaggcag

SEQ ID NO: 6195277 - DNA, 16 bp, Homo sapiens
gaatagaaagaaagtc

SEQ ID NO: 6195278 - DNA, 23 bp, Homo sapiens
gaatagaaataaaggatgtgatt

SEQ ID NO: 6195279 - DNA, 13 bp, Homo sapiens
gaatagaaatttg

SEQ ID NO: 6195280 - DNA, 16 bp, Homo sapiens
gaatagaaatttgccc

SEQ ID NO: 6195281 - DNA, 12 bp, Homo sapiens
gaatagaagaaa

SEQ ID NO: 6195282 - DNA, 13 bp, Homo sapiens
gaatagaagaaag

SEQ ID NO: 6195283 - DNA, 17 bp, Homo sapiens
gaatagaagaaagaaaa

SEQ ID NO: 6195284 - DNA, 17 bp, Homo sapiens
gaatagaagctaaggtt

SEQ ID NO: 6195285 - DNA, 11 bp, Homo sapiens
gaatagaagga

SEQ ID NO: 6195286 - DNA, 14 bp, Homo sapiens
gaatagaataaata

SEQ ID NO: 6195287 - DNA, 16 bp, Homo sapiens
gaatagaataaataca

SEQ ID NO: 6195288 - DNA, 16 bp, Homo sapiens
gaatagacatcaaact

SEQ ID NO: 6195289 - DNA, 13 bp, Homo sapiens
gaatagaggaaga

SEQ ID NO: 6195290 - DNA, 16 bp, Homo sapiens
gaatagaggtcctcat

SEQ ID NO: 6195291 - DNA, 17 bp, Homo sapiens
gaatagatcagtatttc

SEQ ID NO: 6195292 - DNA, 14 bp, Homo sapiens
gaatagatgtcttc

SEQ ID NO: 6195293 - DNA, 15 bp, Homo sapiens
gaatagatgtcttca

SEQ ID NO: 6195294 - DNA, 15 bp, Homo sapiens
gaatagcagagagcc

SEQ ID NO: 6195295 - DNA, 18 bp, Homo sapiens
gaatagcagagagccaaa

SEQ ID NO: 6195296 - DNA, 19 bp, Homo sapiens
gaatagcagagagccaaat

SEQ ID NO: 6195297 - DNA, 20 bp, Homo sapiens
gaatagcagagagccaaatc

SEQ ID NO: 6195298 - DNA, 13 bp, Homo sapiens
gaatagcatctgt

SEQ ID NO: 6195299 - DNA, 18 bp, Homo sapiens
gaatagcatctgtacaaa

SEQ ID NO: 6195300 - DNA, 15 bp, Homo sapiens
gaatagcatgtcact

SEQ ID NO: 6195301 - DNA, 17 bp, Homo sapiens
gaatagcatttgccact

SEQ ID NO: 6195302 - DNA, 15 bp, Homo sapiens
gaatagccacatttg

SEQ ID NO: 6195303 - DNA, 18 bp, Homo sapiens
gaatagccacatttggaa

SEQ ID NO: 6195304 - DNA, 17 bp, Homo sapiens
gaatagcctagatatga

SEQ ID NO: 6195305 - DNA, 22 bp, Homo sapiens
gaatagcctagatatgaatata

SEQ ID NO: 6195306 - DNA, 15 bp, Homo sapiens
gaatagctgggacta

SEQ ID NO: 6195307 - DNA, 23 bp, Homo sapiens
gaatagctgggactacaggtgtg

SEQ ID NO: 6195308 - DNA, 18 bp, Homo sapiens
gaatagctgttttgtgta

SEQ ID NO: 6195309 - DNA, 20 bp, Homo sapiens
gaatagctgttttgtgtata

SEQ ID NO: 6195310 - DNA, 21 bp, Homo sapiens
gaataggacttgtttttgttt

SEQ ID NO: 6195311 - DNA, 16 bp, Homo sapiens
gaataggcaaaatgtt

SEQ ID NO: 6195312 - DNA, 22 bp, Homo sapiens
gaataggcagggggccctgccc

SEQ ID NO: 6195313 - DNA, 22 bp, Homo sapiens
gaatagggaagtaaaaaaacaa

SEQ ID NO: 6195314 - DNA, 22 bp, Homo sapiens
gaatagggggatataatacata

SEQ ID NO: 6195315 - DNA, 15 bp, Homo sapiens
gaataggtagtatca

SEQ ID NO: 6195316 - DNA, 16 bp, Homo sapiens
gaataggtagtatcat

SEQ ID NO: 6195317 - DNA, 21 bp, Homo sapiens
gaataggttactttggactga

SEQ ID NO: 6195318 - DNA, 17 bp, Homo sapiens
gaatagtacatgcagaa

SEQ ID NO: 6195319 - DNA, 22 bp, Homo sapiens
gaatagtgcctcagcgctgccc

SEQ ID NO: 6195320 - DNA, 20 bp, Homo sapiens
gaatagtggaacattttcat

SEQ ID NO: 6195321 - DNA, 18 bp, Homo sapiens
gaatagtggacatggtca

SEQ ID NO: 6195322 - DNA, 12 bp, Homo sapiens
gaatagtgggat

SEQ ID NO: 6195323 - DNA, 17 bp, Homo sapiens
gaatagtggttaacaga

SEQ ID NO: 6195324 - DNA, 23 bp, Homo sapiens
gaatagtggttaacagagctaag

SEQ ID NO: 6195325 - DNA, 14 bp, Homo sapiens
gaatagtgtcacca

SEQ ID NO: 6195326 - DNA, 19 bp, Homo sapiens
gaatagttaaaaattaaat

SEQ ID NO: 6195327 - DNA, 22 bp, Homo sapiens
gaatagttaaaaattaaatatt

SEQ ID NO: 6195328 - DNA, 23 bp, Homo sapiens
gaatagttgaacctatttctctt

SEQ ID NO: 6195329 - DNA, 21 bp, Homo sapiens
gaatagttggtcatctagcaa

SEQ ID NO: 6195330 - DNA, 20 bp, Homo sapiens
gaatagttgtcagaatatgt

SEQ ID NO: 6195331 - DNA, 15 bp, Homo sapiens
gaatagttttctcct

SEQ ID NO: 6195332 - DNA, 19 bp, Homo sapiens
gaatataaaaaatgttatt

SEQ ID NO: 6195333 - DNA, 18 bp, Homo sapiens
gaatataaaaactcctgg

SEQ ID NO: 6195334 - DNA, 13 bp, Homo sapiens
gaatataaacact

SEQ ID NO: 6195335 - DNA, 21 bp, Homo sapiens
gaatataaatatcacaaagtt

SEQ ID NO: 6195336 - DNA, 13 bp, Homo sapiens
gaatataaatatt

SEQ ID NO: 6195337 - DNA, 11 bp, Homo sapiens
gaatataaatg

SEQ ID NO: 6195338 - DNA, 16 bp, Homo sapiens
gaatataaatgtacta

SEQ ID NO: 6195339 - DNA, 20 bp, Homo sapiens
gaatataaatgtactacatt

SEQ ID NO: 6195340 - DNA, 15 bp, Homo sapiens
gaatataacatgaaa

SEQ ID NO: 6195341 - DNA, 20 bp, Homo sapiens
gaatataacatgaaatgata

SEQ ID NO: 6195342 - DNA, 16 bp, Homo sapiens
gaatataatactgtat

SEQ ID NO: 6195343 - DNA, 19 bp, Homo sapiens
gaatataatatatttgtgt

SEQ ID NO: 6195344 - DNA, 20 bp, Homo sapiens
gaatataatatatttgtgta

SEQ ID NO: 6195345 - DNA, 12 bp, Homo sapiens
gaatataatgga

SEQ ID NO: 6195346 - DNA, 13 bp, Homo sapiens
gaatataattatc

SEQ ID NO: 6195347 - DNA, 20 bp, Homo sapiens
gaatataattgttttatctg

SEQ ID NO: 6195348 - DNA, 21 bp, Homo sapiens
gaatatacacattttgtaaat

SEQ ID NO: 6195349 - DNA, 23 bp, Homo sapiens
gaatatacacattttgtaaatct

SEQ ID NO: 6195350 - DNA, 22 bp, Homo sapiens
gaatatacatgaagaatagaaa

SEQ ID NO: 6195351 - DNA, 18 bp, Homo sapiens
gaatataccacaccgagg

SEQ ID NO: 6195352 - DNA, 17 bp, Homo sapiens
gaatataccttttttgt

SEQ ID NO: 6195353 - DNA, 17 bp, Homo sapiens
gaatatagacagtgccc

SEQ ID NO: 6195354 - DNA, 18 bp, Homo sapiens
gaatatagcatctttcat

SEQ ID NO: 6195355 - DNA, 19 bp, Homo sapiens
gaatatagcctgcctcagt

SEQ ID NO: 6195356 - DNA, 21 bp, Homo sapiens
gaatataggcacattaccatt

SEQ ID NO: 6195357 - DNA, 21 bp, Homo sapiens
gaatatagttattattgctgt

SEQ ID NO: 6195358 - DNA, 23 bp, Homo sapiens
gaatatagttctgtgtagagaat

SEQ ID NO: 6195359 - DNA, 14 bp, Homo sapiens
gaatatataaacac

SEQ ID NO: 6195360 - DNA, 22 bp, Homo sapiens
gaatatatacataaaaattgtt

SEQ ID NO: 6195361 - DNA, 15 bp, Homo sapiens
gaatatatatatata

SEQ ID NO: 6195362 - DNA, 19 bp, Homo sapiens
gaatatatatggaataagt

SEQ ID NO: 6195363 - DNA, 22 bp, Homo sapiens
gaatatatatggaataagtgta

SEQ ID NO: 6195364 - DNA, 17 bp, Homo sapiens
gaatatatctgtaaaga

SEQ ID NO: 6195365 - DNA, 20 bp, Homo sapiens
gaatatatggcagagttgta

SEQ ID NO: 6195366 - DNA, 21 bp, Homo sapiens
gaatatatggcagagttgtaa

SEQ ID NO: 6195367 - DNA, 23 bp, Homo sapiens
gaatatatggcagagttgtaaat

SEQ ID NO: 6195368 - DNA, 13 bp, Homo sapiens
gaatatattactg

SEQ ID NO: 6195369 - DNA, 21 bp, Homo sapiens
gaatatattgccaaatattaa

SEQ ID NO: 6195370 - DNA, 17 bp, Homo sapiens
gaatatcaagaatagtt

SEQ ID NO: 6195371 - DNA, 20 bp, Homo sapiens
gaatatcaatataatgtttt

SEQ ID NO: 6195372 - DNA, 21 bp, Homo sapiens
gaatatcagaagtatatctgt

SEQ ID NO: 6195373 - DNA, 15 bp, Homo sapiens
gaatatcatatgtat

SEQ ID NO: 6195374 - DNA, 20 bp, Homo sapiens
gaatatcatctgtcattata

SEQ ID NO: 6195375 - DNA, 17 bp, Homo sapiens
gaatatcccctcccagt

SEQ ID NO: 6195376 - DNA, 16 bp, Homo sapiens
gaatatcgatataaat

SEQ ID NO: 6195377 - DNA, 22 bp, Homo sapiens
gaatatctccgtcaactcatat

SEQ ID NO: 6195378 - DNA, 17 bp, Homo sapiens
gaatatctgtaatggta

SEQ ID NO: 6195379 - DNA, 18 bp, Homo sapiens
gaatatctgttcccagcc

SEQ ID NO: 6195380 - DNA, 17 bp, Homo sapiens
gaatatgaaacatagat

SEQ ID NO: 6195381 - DNA, 18 bp, Homo sapiens
gaatatgaatgagaatgt

SEQ ID NO: 6195382 - DNA, 19 bp, Homo sapiens
gaatatgagaaatacagaa

SEQ ID NO: 6195383 - DNA, 21 bp, Homo sapiens
gaatatgattcactatttaaa

SEQ ID NO: 6195384 - DNA, 16 bp, Homo sapiens
gaatatgcaacattgt

SEQ ID NO: 6195385 - DNA, 20 bp, Homo sapiens
gaatatgcattgtctgcaat

SEQ ID NO: 6195386 - DNA, 15 bp, Homo sapiens
gaatatggaacatat

SEQ ID NO: 6195387 - DNA, 18 bp, Homo sapiens
gaatatggaacatatgca

SEQ ID NO: 6195388 - DNA, 13 bp, Homo sapiens
gaatatggacaaa

SEQ ID NO: 6195389 - DNA, 16 bp, Homo sapiens
gaatatggacaaagaa

SEQ ID NO: 6195390 - DNA, 13 bp, Homo sapiens
gaatatggacata

SEQ ID NO: 6195391 - DNA, 23 bp, Homo sapiens
gaatatggcaatagcattgttct

SEQ ID NO: 6195392 - DNA, 17 bp, Homo sapiens
gaatatggtggaaaata

SEQ ID NO: 6195393 - DNA, 22 bp, Homo sapiens
gaatatgtaatacttaaataaa

SEQ ID NO: 6195394 - DNA, 19 bp, Homo sapiens
gaatatgtagtatctatat

SEQ ID NO: 6195395 - DNA, 23 bp, Homo sapiens
gaatatgtagtatctatatgact

SEQ ID NO: 6195396 - DNA, 17 bp, Homo sapiens
gaatatgtatgtacctg

SEQ ID NO: 6195397 - DNA, 15 bp, Homo sapiens
gaatatgtatgtata

SEQ ID NO: 6195398 - DNA, 20 bp, Homo sapiens
gaatatgtggtctccctggc

SEQ ID NO: 6195399 - DNA, 17 bp, Homo sapiens
gaatatgttaatgcaaa

SEQ ID NO: 6195400 - DNA, 22 bp, Homo sapiens
gaatatgttagaatcaaatact

SEQ ID NO: 6195401 - DNA, 15 bp, Homo sapiens
gaatatgttcaatgc

SEQ ID NO: 6195402 - DNA, 14 bp, Homo sapiens
gaatatgtttcaaa

SEQ ID NO: 6195403 - DNA, 20 bp, Homo sapiens
gaatatgtttcaaactttgg

SEQ ID NO: 6195404 - DNA, 13 bp, Homo sapiens
gaatattaaaaaa

SEQ ID NO: 6195405 - DNA, 14 bp, Homo sapiens
gaatattaaaaaac

SEQ ID NO: 6195406 - DNA, 16 bp, Homo sapiens
gaatattaaaaattaa

SEQ ID NO: 6195407 - DNA, 23 bp, Homo sapiens
gaatattaaaaattaattcttta

SEQ ID NO: 6195408 - DNA, 21 bp, Homo sapiens
gaatattaaagctcttcattt

SEQ ID NO: 6195409 - DNA, 13 bp, Homo sapiens
gaatattaaatat

SEQ ID NO: 6195410 - DNA, 14 bp, Homo sapiens
gaatattaaatatt

SEQ ID NO: 6195411 - DNA, 23 bp, Homo sapiens
gaatattaagaaacaatttaaat

SEQ ID NO: 6195412 - DNA, 15 bp, Homo sapiens
gaatattaagctaaa

SEQ ID NO: 6195413 - DNA, 19 bp, Homo sapiens
gaatattaagctaaaaggt

SEQ ID NO: 6195414 - DNA, 14 bp, Homo sapiens
gaatattacatgta

SEQ ID NO: 6195415 - DNA, 16 bp, Homo sapiens
gaatattactggataa

SEQ ID NO: 6195416 - DNA, 20 bp, Homo sapiens
gaatattagatgctctgaga

SEQ ID NO: 6195417 - DNA, 24 bp, Homo sapiens
gaatattatatttggatgcagagt

SEQ ID NO: 6195418 - DNA, 17 bp, Homo sapiens
gaatattatcttcataa

SEQ ID NO: 6195419 - DNA, 11 bp, Homo sapiens
gaatattcagg

SEQ ID NO: 6195420 - DNA, 12 bp, Homo sapiens
gaatattcagga

SEQ ID NO: 6195421 - DNA, 16 bp, Homo sapiens
gaatattcctggactt

SEQ ID NO: 6195422 - DNA, 20 bp, Homo sapiens
gaatattcctggacttacaa

SEQ ID NO: 6195423 - DNA, 13 bp, Homo sapiens
gaatattctagaa

SEQ ID NO: 6195424 - DNA, 20 bp, Homo sapiens
gaatattgagcaatatgtca

SEQ ID NO: 6195425 - DNA, 17 bp, Homo sapiens
gaatattgatgttaaca

SEQ ID NO: 6195426 - DNA, 17 bp, Homo sapiens
gaatattgcccaaataa

SEQ ID NO: 6195427 - DNA, 13 bp, Homo sapiens
gaatattgctgat

SEQ ID NO: 6195428 - DNA, 23 bp, Homo sapiens
gaatattgctgatggtgcaatga

SEQ ID NO: 6195429 - DNA, 24 bp, Homo sapiens
gaatattgctgatggtgcaatgac

SEQ ID NO: 6195430 - DNA, 22 bp, Homo sapiens
gaatattgctttggtcatatga

SEQ ID NO: 6195431 - DNA, 13 bp, Homo sapiens
gaatattgtccat

SEQ ID NO: 6195432 - DNA, 15 bp, Homo sapiens
gaatattgtgattct

SEQ ID NO: 6195433 - DNA, 18 bp, Homo sapiens
gaatattgtgattctgtt

SEQ ID NO: 6195434 - DNA, 12 bp, Homo sapiens
gaatattgtgtt

SEQ ID NO: 6195435 - DNA, 15 bp, Homo sapiens
gaatattgtttcttt

SEQ ID NO: 6195436 - DNA, 12 bp, Homo sapiens
gaatatttaaag

SEQ ID NO: 6195437 - DNA, 17 bp, Homo sapiens
gaatatttaagaaaagc

SEQ ID NO: 6195438 - DNA, 19 bp, Homo sapiens
gaatatttaagaaaagcac

SEQ ID NO: 6195439 - DNA, 20 bp, Homo sapiens
gaatatttaagaaaagcact

SEQ ID NO: 6195440 - DNA, 12 bp, Homo sapiens
gaatatttacta

SEQ ID NO: 6195441 - DNA, 10 bp, Homo sapiens
gaatatttat

SEQ ID NO: 6195442 - DNA, 15 bp, Homo sapiens
gaatatttataacag

SEQ ID NO: 6195443 - DNA, 16 bp, Homo sapiens
gaatatttataacagc

SEQ ID NO: 6195444 - DNA, 15 bp, Homo sapiens
gaatatttatactat

SEQ ID NO: 6195445 - DNA, 18 bp, Homo sapiens
gaatatttatatttcact

SEQ ID NO: 6195446 - DNA, 13 bp, Homo sapiens
gaatatttattac

SEQ ID NO: 6195447 - DNA, 15 bp, Homo sapiens
gaatatttattacct

SEQ ID NO: 6195448 - DNA, 22 bp, Homo sapiens
gaatatttattcagtgacttct

SEQ ID NO: 6195449 - DNA, 19 bp, Homo sapiens
cttcagttttactgcattt

SEQ ID NO: 6195450 - DNA, 14 bp, Homo sapiens
cttcataaatgaag

SEQ ID NO: 6195451 - DNA, 18 bp, Homo sapiens
cttcataagatattcttt

SEQ ID NO: 6195452 - DNA, 20 bp, Homo sapiens
cttcataataaactacacaa

SEQ ID NO: 6195453 - DNA, 12 bp, Homo sapiens
cttcataatcca

SEQ ID NO: 6195454 - DNA, 10 bp, Homo sapiens
cttcatacac

SEQ ID NO: 6195455 - DNA, 12 bp, Homo sapiens
cttcatacaggg

SEQ ID NO: 6195456 - DNA, 13 bp, Homo sapiens
cttcatacaggga

SEQ ID NO: 6195457 - DNA, 22 bp, Homo sapiens
cttcatacagggatggtgttca

SEQ ID NO: 6195458 - DNA, 17 bp, Homo sapiens
cttcataccgcctcgtg

SEQ ID NO: 6195459 - DNA, 16 bp, Homo sapiens
cttcatactggcagga

SEQ ID NO: 6195460 - DNA, 23 bp, Homo sapiens
cttcatacttgaacgttttctaa

SEQ ID NO: 6195461 - DNA, 20 bp, Homo sapiens
cttcatagatgagaaaactg

SEQ ID NO: 6195462 - DNA, 18 bp, Homo sapiens
cttcatagcagattttaa

SEQ ID NO: 6195463 - DNA, 13 bp, Homo sapiens
cttcataggcaga

SEQ ID NO: 6195464 - DNA, 20 bp, Homo sapiens
cttcataggcggtcatgtgt

SEQ ID NO: 6195465 - DNA, 23 bp, Homo sapiens
cttcataggcggtcatgtgtgca

SEQ ID NO: 6195466 - DNA, 23 bp, Homo sapiens
cttcatagggacctttaaaaagc

SEQ ID NO: 6195467 - DNA, 16 bp, Homo sapiens
cttcatagtattggag

SEQ ID NO: 6195468 - DNA, 23 bp, Homo sapiens
cttcatatagcattgataatctt

SEQ ID NO: 6195469 - DNA, 15 bp, Homo sapiens
cttcatatatttctc

SEQ ID NO: 6195470 - DNA, 18 bp, Homo sapiens
cttcatatcatccacaca

SEQ ID NO: 6195471 - DNA, 11 bp, Homo sapiens
cttcatatcta

SEQ ID NO: 6195472 - DNA, 14 bp, Homo sapiens
cttcatatctctcc

SEQ ID NO: 6195473 - DNA, 20 bp, Homo sapiens
cttcatatgaaaggtgccat

SEQ ID NO: 6195474 - DNA, 14 bp, Homo sapiens
cttcatattcagct

SEQ ID NO: 6195475 - DNA, 15 bp, Homo sapiens
cttcatattgctgag

SEQ ID NO: 6195476 - DNA, 15 bp, Homo sapiens
cttcatcaagaaata

SEQ ID NO: 6195477 - DNA, 17 bp, Homo sapiens
cttcatcaatcaaatat

SEQ ID NO: 6195478 - DNA, 19 bp, Homo sapiens
cttcatcattccctctcat

SEQ ID NO: 6195479 - DNA, 16 bp, Homo sapiens
cttcatccaatgtgaa

SEQ ID NO: 6195480 - DNA, 24 bp, Homo sapiens
cttcatccagattgggtgccagca

SEQ ID NO: 6195481 - DNA, 13 bp, Homo sapiens
cttcatccataga

SEQ ID NO: 6195482 - DNA, 20 bp, Homo sapiens
cttcatccatagacacagta

SEQ ID NO: 6195483 - DNA, 22 bp, Homo sapiens
cttcatccatagacacagtatt

SEQ ID NO: 6195484 - DNA, 16 bp, Homo sapiens
cttcatccatcctgag

SEQ ID NO: 6195485 - DNA, 19 bp, Homo sapiens
cttcatccatcctgagcca

SEQ ID NO: 6195486 - DNA, 22 bp, Homo sapiens
cttcatccatcctgagccaaat

SEQ ID NO: 6195487 - DNA, 14 bp, Homo sapiens
cttcatccatttgt

SEQ ID NO: 6195488 - DNA, 23 bp, Homo sapiens
cttcatcccaacagcccagcaag

SEQ ID NO: 6195489 - DNA, 19 bp, Homo sapiens
cttcatcccactccaactc

SEQ ID NO: 6195490 - DNA, 19 bp, Homo sapiens
cttcatcccagctgctgag

SEQ ID NO: 6195491 - DNA, 21 bp, Homo sapiens
cttcatcccggagcgcacctg

SEQ ID NO: 6195492 - DNA, 13 bp, Homo sapiens
cttcatccctctg

SEQ ID NO: 6195493 - DNA, 17 bp, Homo sapiens
cttcatccgcctgtggg

SEQ ID NO: 6195494 - DNA, 18 bp, Homo sapiens
cttcatccgttgtgactc

SEQ ID NO: 6195495 - DNA, 15 bp, Homo sapiens
cttcatcctcctcag

SEQ ID NO: 6195496 - DNA, 16 bp, Homo sapiens
cttcatcctcctcaga

SEQ ID NO: 6195497 - DNA, 19 bp, Homo sapiens
cttcatcgaacaaactgat

SEQ ID NO: 6195498 - DNA, 15 bp, Homo sapiens
cttcatcgaatctac

SEQ ID NO: 6195499 - DNA, 17 bp, Homo sapiens
cttcatcgcattttgat

SEQ ID NO: 6195500 - DNA, 19 bp, Homo sapiens
cttcatctcaatagtgatt

SEQ ID NO: 6195501 - DNA, 13 bp, Homo sapiens
cttcatctccttt

SEQ ID NO: 6195502 - DNA, 18 bp, Homo sapiens
cttcatctgactatgaca

SEQ ID NO: 6195503 - DNA, 19 bp, Homo sapiens
cttcatctgactatgacat

SEQ ID NO: 6195504 - DNA, 21 bp, Homo sapiens
cttcatctgactatgacataa

SEQ ID NO: 6195505 - DNA, 13 bp, Homo sapiens
cttcatctgccac

SEQ ID NO: 6195506 - DNA, 17 bp, Homo sapiens
cttcatctgcctgcgct

SEQ ID NO: 6195507 - DNA, 11 bp, Homo sapiens
cttcatctgga

SEQ ID NO: 6195508 - DNA, 13 bp, Homo sapiens
cttcatctggaac

SEQ ID NO: 6195509 - DNA, 15 bp, Homo sapiens
cttcatctggaacca

SEQ ID NO: 6195510 - DNA, 19 bp, Homo sapiens
cttcatctggcaacatctt

SEQ ID NO: 6195511 - DNA, 14 bp, Homo sapiens
cttcatctggctgc

SEQ ID NO: 6195512 - DNA, 22 bp, Homo sapiens
cttcatctggggttggcaacag

SEQ ID NO: 6195513 - DNA, 20 bp, Homo sapiens
cttcatctgtgggatgctga

SEQ ID NO: 6195514 - DNA, 17 bp, Homo sapiens
cttcatcttcccaggta

SEQ ID NO: 6195515 - DNA, 14 bp, Homo sapiens
cttcatcttcctgt

SEQ ID NO: 6195516 - DNA, 22 bp, Homo sapiens
cttcatcttcctgtgtcctgaa

SEQ ID NO: 6195517 - DNA, 12 bp, Homo sapiens
cttcatcttctc

SEQ ID NO: 6195518 - DNA, 16 bp, Homo sapiens
cttcatcttctcagct

SEQ ID NO: 6195519 - DNA, 15 bp, Homo sapiens
cttcatcttgacatg

SEQ ID NO: 6195520 - DNA, 16 bp, Homo sapiens
cttcatcttgacatgt

SEQ ID NO: 6195521 - DNA, 16 bp, Homo sapiens
cttcatgaaaatccta

SEQ ID NO: 6195522 - DNA, 16 bp, Homo sapiens
cttcatgaaactgtcc

SEQ ID NO: 6195523 - DNA, 17 bp, Homo sapiens
cttcatgaaatgctatg

SEQ ID NO: 6195524 - DNA, 16 bp, Homo sapiens
cttcatgaaatgtgtt

SEQ ID NO: 6195525 - DNA, 17 bp, Homo sapiens
cttcatgaaatgtgttt

SEQ ID NO: 6195526 - DNA, 17 bp, Homo sapiens
cttcatgagcattcata

SEQ ID NO: 6195527 - DNA, 23 bp, Homo sapiens
cttcatgaggaggtcagcccatt

SEQ ID NO: 6195528 - DNA, 17 bp, Homo sapiens
cttcatgcaatgacatc

SEQ ID NO: 6195529 - DNA, 18 bp, Homo sapiens
cttcatgcacttaaagaa

SEQ ID NO: 6195530 - DNA, 22 bp, Homo sapiens
cttcatgcaggtgaaacccagt

SEQ ID NO: 6195531 - DNA, 15 bp, Homo sapiens
cttcatgcatggaaa

SEQ ID NO: 6195532 - DNA, 21 bp, Homo sapiens
cttcatgcatggaaattccct

SEQ ID NO: 6195533 - DNA, 13 bp, Homo sapiens
cttcatgccagtg

SEQ ID NO: 6195534 - DNA, 14 bp, Homo sapiens
cttcatgccagtgc

SEQ ID NO: 6195535 - DNA, 23 bp, Homo sapiens
cttcatgccagtgcatgccagga

SEQ ID NO: 6195536 - DNA, 13 bp, Homo sapiens
cttcatgcctcag

SEQ ID NO: 6195537 - DNA, 19 bp, Homo sapiens
cttcatgcctcagtttccc

SEQ ID NO: 6195538 - DNA, 22 bp, Homo sapiens
cttcatgcctcagtttccccat

SEQ ID NO: 6195539 - DNA, 14 bp, Homo sapiens
cttcatgcctgatg

SEQ ID NO: 6195540 - DNA, 16 bp, Homo sapiens
cttcatgcctgatgaa

SEQ ID NO: 6195541 - DNA, 20 bp, Homo sapiens
cttcatgcctgatgaaagct

SEQ ID NO: 6195542 - DNA, 16 bp, Homo sapiens
cttcatgcctttgtaa

SEQ ID NO: 6195543 - DNA, 17 bp, Homo sapiens
cttcatgcgcagtcccc

SEQ ID NO: 6195544 - DNA, 22 bp, Homo sapiens
cttcatgcgcagtccccaggta

SEQ ID NO: 6195545 - DNA, 17 bp, Homo sapiens
cttcatgctcagccctg

SEQ ID NO: 6195546 - DNA, 19 bp, Homo sapiens
cttcatgctcagccctgac

SEQ ID NO: 6195547 - DNA, 13 bp, Homo sapiens
cttcatgctggcc

SEQ ID NO: 6195548 - DNA, 12 bp, Homo sapiens
cttcatgcttga

SEQ ID NO: 6195549 - DNA, 23 bp, Homo sapiens
cttcatgcttgatttgaccactg

SEQ ID NO: 6195550 - DNA, 18 bp, Homo sapiens
cttcatgcttttctcatg

SEQ ID NO: 6195551 - DNA, 20 bp, Homo sapiens
cttcatgcttttctcatggt

SEQ ID NO: 6195552 - DNA, 17 bp, Homo sapiens
cttcatgcttttttccc

SEQ ID NO: 6195553 - DNA, 18 bp, Homo sapiens
cttcatggaatggacatc

SEQ ID NO: 6195554 - DNA, 12 bp, Homo sapiens
cttcatggaggg

SEQ ID NO: 6195555 - DNA, 13 bp, Homo sapiens
cttcatggatcag

SEQ ID NO: 6195556 - DNA, 21 bp, Homo sapiens
cttcatggcagaaggcaaacc

SEQ ID NO: 6195557 - DNA, 12 bp, Homo sapiens
cttcatgtaaat

SEQ ID NO: 6195558 - DNA, 16 bp, Homo sapiens
cttcatgtaattttat

SEQ ID NO: 6195559 - DNA, 16 bp, Homo sapiens
cttcatgtccagtgag

SEQ ID NO: 6195560 - DNA, 18 bp, Homo sapiens
cttcatgtgatgtcatga

SEQ ID NO: 6195561 - DNA, 19 bp, Homo sapiens
cttcatgtgcaaagtgact

SEQ ID NO: 6195562 - DNA, 23 bp, Homo sapiens
cttcatgtggcacttgggcattt

SEQ ID NO: 6195563 - DNA, 16 bp, Homo sapiens
cttcatgtggcttccc

SEQ ID NO: 6195564 - DNA, 20 bp, Homo sapiens
cttcatgtgtcccagaagat

SEQ ID NO: 6195565 - DNA, 14 bp, Homo sapiens
cttcatgttgatgt

SEQ ID NO: 6195566 - DNA, 12 bp, Homo sapiens
cttcatgtttta

SEQ ID NO: 6195567 - DNA, 14 bp, Homo sapiens
cttcattaaaacaa

SEQ ID NO: 6195568 - DNA, 17 bp, Homo sapiens
cttcattaataataaat

SEQ ID NO: 6195569 - DNA, 16 bp, Homo sapiens
cttcattaatactgtg

SEQ ID NO: 6195570 - DNA, 15 bp, Homo sapiens
cttcattaatttcaa

SEQ ID NO: 6195571 - DNA, 20 bp, Homo sapiens
cttcattaccttttttgata

SEQ ID NO: 6195572 - DNA, 16 bp, Homo sapiens
cttcattagagcaggc

SEQ ID NO: 6195573 - DNA, 16 bp, Homo sapiens
cttcattagatgttta

SEQ ID NO: 6195574 - DNA, 17 bp, Homo sapiens
cttcattagcttgtcta

SEQ ID NO: 6195575 - DNA, 20 bp, Homo sapiens
cttcattagcttgtctatta

SEQ ID NO: 6195576 - DNA, 22 bp, Homo sapiens
cttcattagcttgtctattatt

SEQ ID NO: 6195577 - DNA, 16 bp, Homo sapiens
cttcattatctgagtt

SEQ ID NO: 6195578 - DNA, 15 bp, Homo sapiens
cttcattattctctg

SEQ ID NO: 6195579 - DNA, 20 bp, Homo sapiens
cttcattcaatattgacatt

SEQ ID NO: 6195580 - DNA, 22 bp, Homo sapiens
cttcattcaatattgacatttg

SEQ ID NO: 6195581 - DNA, 12 bp, Homo sapiens
cttcattccatt

SEQ ID NO: 6195582 - DNA, 21 bp, Homo sapiens
cttcattccattgacttagag

SEQ ID NO: 6195583 - DNA, 16 bp, Homo sapiens
cttcattcccactgca

SEQ ID NO: 6195584 - DNA, 20 bp, Homo sapiens
cttcattccggactggcaga

SEQ ID NO: 6195585 - DNA, 17 bp, Homo sapiens
cttcattccttccacta

SEQ ID NO: 6195586 - DNA, 15 bp, Homo sapiens
cttcattcgtatgtt

SEQ ID NO: 6195587 - DNA, 17 bp, Homo sapiens
cttcattctaaaccaaa

SEQ ID NO: 6195588 - DNA, 18 bp, Homo sapiens
cttcattctatcaagccc

SEQ ID NO: 6195589 - DNA, 14 bp, Homo sapiens
cttcattctcagac

SEQ ID NO: 6195590 - DNA, 12 bp, Homo sapiens
cttcattctcgt

SEQ ID NO: 6195591 - DNA, 14 bp, Homo sapiens
cttcattctcgtga

SEQ ID NO: 6195592 - DNA, 10 bp, Homo sapiens
cttcattctt

SEQ ID NO: 6195593 - DNA, 21 bp, Homo sapiens
cttcattcttgaaagctgtgg

SEQ ID NO: 6195594 - DNA, 16 bp, Homo sapiens
cttcattctttactgc

SEQ ID NO: 6195595 - DNA, 19 bp, Homo sapiens
cttcattctttactgcact

SEQ ID NO: 6195596 - DNA, 23 bp, Homo sapiens
cttcattgagagttttgtcttga

SEQ ID NO: 6195597 - DNA, 18 bp, Homo sapiens
cttcattgcactgcagtt

SEQ ID NO: 6195598 - DNA, 18 bp, Homo sapiens
cttcattgtaatctgcaa

SEQ ID NO: 6195599 - DNA, 22 bp, Homo sapiens
cttcattgtactacctgtgtat

SEQ ID NO: 6195600 - DNA, 19 bp, Homo sapiens
cttcattgtccctcttcac

SEQ ID NO: 6195601 - DNA, 21 bp, Homo sapiens
cttcattgtccctcttcactc

SEQ ID NO: 6195602 - DNA, 15 bp, Homo sapiens
cttcattgtttggac

SEQ ID NO: 6195603 - DNA, 12 bp, Homo sapiens
cttcatttaaaa

SEQ ID NO: 6195604 - DNA, 19 bp, Homo sapiens
cttcatttaaaaaaatcac

SEQ ID NO: 6195605 - DNA, 16 bp, Homo sapiens
cttcatttaaactaaa

SEQ ID NO: 6195606 - DNA, 23 bp, Homo sapiens
cttcatttaaactaaattactgt

SEQ ID NO: 6195607 - DNA, 14 bp, Homo sapiens
cttcatttaacact

SEQ ID NO: 6195608 - DNA, 12 bp, Homo sapiens
cttcatttcaat

SEQ ID NO: 6195609 - DNA, 17 bp, Homo sapiens
cttcatttcaatcattg

SEQ ID NO: 6195610 - DNA, 19 bp, Homo sapiens
cttcatttcattgtatgat

SEQ ID NO: 6195611 - DNA, 20 bp, Homo sapiens
cttcatttccgtgaagggca

SEQ ID NO: 6195612 - DNA, 23 bp, Homo sapiens
cttcatttcctctgagctgttat

SEQ ID NO: 6195613 - DNA, 18 bp, Homo sapiens
cttcatttcctgtgtctt

SEQ ID NO: 6195614 - DNA, 20 bp, Homo sapiens
cttcatttctgatatagaat

SEQ ID NO: 6195615 - DNA, 21 bp, Homo sapiens
cttcatttctgatatagaatt

SEQ ID NO: 6195616 - DNA, 14 bp, Homo sapiens
cttcatttctgatg

SEQ ID NO: 6195617 - DNA, 20 bp, Homo sapiens
cttcatttgacacaaagctt

SEQ ID NO: 6195618 - DNA, 21 bp, Homo sapiens
cttcatttgcaattcatgtaa

SEQ ID NO: 6195619 - DNA, 14 bp, Homo sapiens
cttcatttggagat

SEQ ID NO: 6195620 - DNA, 16 bp, Homo sapiens
cttcatttggaggaat

SEQ ID NO: 6195621 - DNA, 18 bp, Homo sapiens
cttcatttgggatgctac

SEQ ID NO: 6195622 - DNA, 13 bp, Homo sapiens
cttcatttgtgcc

SEQ ID NO: 6195623 - DNA, 21 bp, Homo sapiens
cttcattttaggaataataaa

SEQ ID NO: 6195624 - DNA, 18 bp, Homo sapiens
cttcattttatatttaaa

SEQ ID NO: 6195625 - DNA, 18 bp, Homo sapiens
cttcattttgaggggagg

SEQ ID NO: 6195626 - DNA, 14 bp, Homo sapiens
cttcattttgttct

SEQ ID NO: 6195627 - DNA, 23 bp, Homo sapiens
cttcatttttaagaaaggaagca

SEQ ID NO: 6195628 - DNA, 19 bp, Homo sapiens
gaatatttcaaatgaacac

SEQ ID NO: 6195629 - DNA, 13 bp, Homo sapiens
gaatatttgcttt

SEQ ID NO: 6195630 - DNA, 22 bp, Homo sapiens
gaatatttgttatgtagataac

SEQ ID NO: 6195631 - DNA, 19 bp, Homo sapiens
gaatattttaattaaaatt

SEQ ID NO: 6195632 - DNA, 16 bp, Homo sapiens
gaatattttattcaag

SEQ ID NO: 6195633 - DNA, 20 bp, Homo sapiens
gaatattttcaagtttttca

SEQ ID NO: 6195634 - DNA, 20 bp, Homo sapiens
gaatattttcattaaaagct

SEQ ID NO: 6195635 - DNA, 15 bp, Homo sapiens
gaatattttggaaac

SEQ ID NO: 6195636 - DNA, 16 bp, Homo sapiens
gaatattttggaaact

SEQ ID NO: 6195637 - DNA, 23 bp, Homo sapiens
gaatattttgttttgtgcagaga

SEQ ID NO: 6195638 - DNA, 21 bp, Homo sapiens
gaatatttttagactatttct

SEQ ID NO: 6195639 - DNA, 22 bp, Homo sapiens
gaatatttttagactatttctt

SEQ ID NO: 6195640 - DNA, 17 bp, Homo sapiens
gaatatttttgtatttt

SEQ ID NO: 6195641 - DNA, 17 bp, Homo sapiens
gaatattttttgaaggt

SEQ ID NO: 6195642 - DNA, 22 bp, Homo sapiens
gaatattttttgaaggtttcag

SEQ ID NO: 6195643 - DNA, 15 bp, Homo sapiens
gaatcaaaagtgcct

SEQ ID NO: 6195644 - DNA, 13 bp, Homo sapiens
gaatcaaagacat

SEQ ID NO: 6195645 - DNA, 14 bp, Homo sapiens
gaatcaaagacatt

SEQ ID NO: 6195646 - DNA, 19 bp, Homo sapiens
gaatcaaagcaatgcattt

SEQ ID NO: 6195647 - DNA, 22 bp, Homo sapiens
gaatcaaagcagttaactttaa

SEQ ID NO: 6195648 - DNA, 15 bp, Homo sapiens
gaatcaacagggcag

SEQ ID NO: 6195649 - DNA, 14 bp, Homo sapiens
gaatcaagagctgc

SEQ ID NO: 6195650 - DNA, 15 bp, Homo sapiens
gaatcaagagctgcc

SEQ ID NO: 6195651 - DNA, 19 bp, Homo sapiens
gaatcaagagctgccctcc

SEQ ID NO: 6195652 - DNA, 16 bp, Homo sapiens
gaatcaagcacactgt

SEQ ID NO: 6195653 - DNA, 22 bp, Homo sapiens
gaatcaagctagaaggccacat

SEQ ID NO: 6195654 - DNA, 14 bp, Homo sapiens
gaatcaaggaatcc

SEQ ID NO: 6195655 - DNA, 14 bp, Homo sapiens
gaatcaaggagcct

SEQ ID NO: 6195656 - DNA, 11 bp, Homo sapiens
gaatcaataat

SEQ ID NO: 6195657 - DNA, 13 bp, Homo sapiens
gaatcacagccaa

SEQ ID NO: 6195658 - DNA, 23 bp, Homo sapiens
gaatcacagctcaagcattctgt

SEQ ID NO: 6195659 - DNA, 11 bp, Homo sapiens
gaatcacaggc

SEQ ID NO: 6195660 - DNA, 12 bp, Homo sapiens
gaatcacaggct

SEQ ID NO: 6195661 - DNA, 17 bp, Homo sapiens
gaatcacaggctgggct

SEQ ID NO: 6195662 - DNA, 18 bp, Homo sapiens
gaatcacccctctgcccc

SEQ ID NO: 6195663 - DNA, 21 bp, Homo sapiens
gaatcacccctctgcccctgc

SEQ ID NO: 6195664 - DNA, 14 bp, Homo sapiens
gaatcaccctccta

SEQ ID NO: 6195665 - DNA, 18 bp, Homo sapiens
gaatcacctaattaattt

SEQ ID NO: 6195666 - DNA, 23 bp, Homo sapiens
gaatcacctaattaatttcagta

SEQ ID NO: 6195667 - DNA, 20 bp, Homo sapiens
gaatcacctggagggcttgg

SEQ ID NO: 6195668 - DNA, 13 bp, Homo sapiens
gaatcacctggct

SEQ ID NO: 6195669 - DNA, 21 bp, Homo sapiens
gaatcacgttagaggaaaaat

SEQ ID NO: 6195670 - DNA, 16 bp, Homo sapiens
gaatcactcatttatt

SEQ ID NO: 6195671 - DNA, 15 bp, Homo sapiens
gaatcactgcagccc

SEQ ID NO: 6195672 - DNA, 16 bp, Homo sapiens
gaatcactgctccagg

SEQ ID NO: 6195673 - DNA, 19 bp, Homo sapiens
gaatcactgctccaggcct

SEQ ID NO: 6195674 - DNA, 21 bp, Homo sapiens
gaatcactggggatggtggca

SEQ ID NO: 6195675 - DNA, 17 bp, Homo sapiens
gaatcactgtgctcagc

SEQ ID NO: 6195676 - DNA, 21 bp, Homo sapiens
gaatcactgttgagttctgat

SEQ ID NO: 6195677 - DNA, 20 bp, Homo sapiens
gaatcactgttgctttgaaa

SEQ ID NO: 6195678 - DNA, 14 bp, Homo sapiens
gaatcactgttttt

SEQ ID NO: 6195679 - DNA, 13 bp, Homo sapiens
gaatcagaaacag

SEQ ID NO: 6195680 - DNA, 23 bp, Homo sapiens
gaatcagaacagatgctgagcca

SEQ ID NO: 6195681 - DNA, 22 bp, Homo sapiens
gaatcagaagatagtcttggaa

SEQ ID NO: 6195682 - DNA, 13 bp, Homo sapiens
gaatcagaataaa

SEQ ID NO: 6195683 - DNA, 15 bp, Homo sapiens
gaatcagacatttta

SEQ ID NO: 6195684 - DNA, 18 bp, Homo sapiens
gaatcagatacaaaacta

SEQ ID NO: 6195685 - DNA, 19 bp, Homo sapiens
gaatcagatcatttcaaaa

SEQ ID NO: 6195686 - DNA, 22 bp, Homo sapiens
gaatcagatggtgtcatttagt

SEQ ID NO: 6195687 - DNA, 13 bp, Homo sapiens
gaatcagcacaga

SEQ ID NO: 6195688 - DNA, 15 bp, Homo sapiens
gaatcagcagaacct

SEQ ID NO: 6195689 - DNA, 22 bp, Homo sapiens
gaatcagctatgcaaatcagtc

SEQ ID NO: 6195690 - DNA, 19 bp, Homo sapiens
gaatcagctgcagctgctt

SEQ ID NO: 6195691 - DNA, 21 bp, Homo sapiens
gaatcagcttttaataaaatt

SEQ ID NO: 6195692 - DNA, 22 bp, Homo sapiens
gaatcaggaggagattaacaca

SEQ ID NO: 6195693 - DNA, 20 bp, Homo sapiens
gaatcagggagcactggagg

SEQ ID NO: 6195694 - DNA, 15 bp, Homo sapiens
gaatcaggttgcaaa

SEQ ID NO: 6195695 - DNA, 21 bp, Homo sapiens
gaatcagtataaacaaagtta

SEQ ID NO: 6195696 - DNA, 17 bp, Homo sapiens
gaatcagtatttccttc

SEQ ID NO: 6195697 - DNA, 20 bp, Homo sapiens
gaatcagtcctagaatgttt

SEQ ID NO: 6195698 - DNA, 20 bp, Homo sapiens
gaatcagtgttaaattcatt

SEQ ID NO: 6195699 - DNA, 16 bp, Homo sapiens
gaatcatactgcctac

SEQ ID NO: 6195700 - DNA, 17 bp, Homo sapiens
gaatcatactgcctact

SEQ ID NO: 6195701 - DNA, 18 bp, Homo sapiens
gaatcatactgcctactg

SEQ ID NO: 6195702 - DNA, 18 bp, Homo sapiens
gaatcatacttaacattt

SEQ ID NO: 6195703 - DNA, 15 bp, Homo sapiens
gaatcatgagcctgc

SEQ ID NO: 6195704 - DNA, 17 bp, Homo sapiens
gaatcatgagcctgctg

SEQ ID NO: 6195705 - DNA, 19 bp, Homo sapiens
gaatcatgagcctgctgga

SEQ ID NO: 6195706 - DNA, 23 bp, Homo sapiens
gaatcatgatctgactttaattg

SEQ ID NO: 6195707 - DNA, 20 bp, Homo sapiens
gaatcatgctgttctctttg

SEQ ID NO: 6195708 - DNA, 14 bp, Homo sapiens
gaatcatggagaaa

SEQ ID NO: 6195709 - DNA, 15 bp, Homo sapiens
gaatcatggcctctt

SEQ ID NO: 6195710 - DNA, 18 bp, Homo sapiens
gaatcatggcctcttgaa

SEQ ID NO: 6195711 - DNA, 19 bp, Homo sapiens
gaatcatgggcagaggatg

SEQ ID NO: 6195712 - DNA, 13 bp, Homo sapiens
gaatcatgtagta

SEQ ID NO: 6195713 - DNA, 14 bp, Homo sapiens
gaatcatgtagtat

SEQ ID NO: 6195714 - DNA, 14 bp, Homo sapiens
gaatcatgtctgta

SEQ ID NO: 6195715 - DNA, 14 bp, Homo sapiens
gaatcatgttggat

SEQ ID NO: 6195716 - DNA, 13 bp, Homo sapiens
gaatcatgtttct

SEQ ID NO: 6195717 - DNA, 16 bp, Homo sapiens
gaatcattgacctaat

SEQ ID NO: 6195718 - DNA, 18 bp, Homo sapiens
gaatcattgagaaataaa

SEQ ID NO: 6195719 - DNA, 13 bp, Homo sapiens
gaatcattggcct

SEQ ID NO: 6195720 - DNA, 22 bp, Homo sapiens
gaatcattgtgcttaataatac

SEQ ID NO: 6195721 - DNA, 24 bp, Homo sapiens
gaatcatttagcatgttgttgaaa

SEQ ID NO: 6195722 - DNA, 16 bp, Homo sapiens
gaatccaaaagaaaaa

SEQ ID NO: 6195723 - DNA, 21 bp, Homo sapiens
gaatccaaatctgtcctctgt

SEQ ID NO: 6195724 - DNA, 22 bp, Homo sapiens
gaatccaaatctgtcctctgta

SEQ ID NO: 6195725 - DNA, 22 bp, Homo sapiens
gaatccaagacaaactaaactt

SEQ ID NO: 6195726 - DNA, 15 bp, Homo sapiens
gaatccaagattggt

SEQ ID NO: 6195727 - DNA, 13 bp, Homo sapiens
gaatccaagctaa

SEQ ID NO: 6195728 - DNA, 16 bp, Homo sapiens
gaatccaagctccctg

SEQ ID NO: 6195729 - DNA, 18 bp, Homo sapiens
gaatccaagctccctgcc

SEQ ID NO: 6195730 - DNA, 22 bp, Homo sapiens
gaatccaagggttgagagccag

SEQ ID NO: 6195731 - DNA, 18 bp, Homo sapiens
gaatccacatttctaaaa

SEQ ID NO: 6195732 - DNA, 24 bp, Homo sapiens
gaatccacccatcctaccaatgca

SEQ ID NO: 6195733 - DNA, 22 bp, Homo sapiens
gaatccacctcggagcatggtg

SEQ ID NO: 6195734 - DNA, 23 bp, Homo sapiens
gaatccacgtattccccttccca

SEQ ID NO: 6195735 - DNA, 14 bp, Homo sapiens
gaatccagtgcttc

SEQ ID NO: 6195736 - DNA, 18 bp, Homo sapiens
gaatccagtgcttccaca

SEQ ID NO: 6195737 - DNA, 18 bp, Homo sapiens
gaatccagtgtggctccc

SEQ ID NO: 6195738 - DNA, 15 bp, Homo sapiens
gaatccataaatgtg

SEQ ID NO: 6195739 - DNA, 19 bp, Homo sapiens
gaatccataaatgtgttcc

SEQ ID NO: 6195740 - DNA, 17 bp, Homo sapiens
gaatccatatcagctct

SEQ ID NO: 6195741 - DNA, 18 bp, Homo sapiens
gaatccatatcagctctg

SEQ ID NO: 6195742 - DNA, 23 bp, Homo sapiens
gaatccatcctgcaaaggccctt

SEQ ID NO: 6195743 - DNA, 13 bp, Homo sapiens
gaatccatgcttg

SEQ ID NO: 6195744 - DNA, 14 bp, Homo sapiens
gaatccatgcttgg

SEQ ID NO: 6195745 - DNA, 18 bp, Homo sapiens
gaatccatgggtctggct

SEQ ID NO: 6195746 - DNA, 19 bp, Homo sapiens
gaatccatgggtctggcta

SEQ ID NO: 6195747 - DNA, 17 bp, Homo sapiens
gaatccattggagaagc

SEQ ID NO: 6195748 - DNA, 17 bp, Homo sapiens
gaatcccaaatttgatt

SEQ ID NO: 6195749 - DNA, 15 bp, Homo sapiens
gaatcccaagaccca

SEQ ID NO: 6195750 - DNA, 14 bp, Homo sapiens
gaatcccacattag

SEQ ID NO: 6195751 - DNA, 22 bp, Homo sapiens
gaatcccacccacatgtgacac

SEQ ID NO: 6195752 - DNA, 16 bp, Homo sapiens
gaatcccactgtatga

SEQ ID NO: 6195753 - DNA, 17 bp, Homo sapiens
gaatcccactgtatgat

SEQ ID NO: 6195754 - DNA, 16 bp, Homo sapiens
gaatcccatcaggctg

SEQ ID NO: 6195755 - DNA, 14 bp, Homo sapiens
gaatcccccaggga

SEQ ID NO: 6195756 - DNA, 15 bp, Homo sapiens
gaatcccccagggaa

SEQ ID NO: 6195757 - DNA, 17 bp, Homo sapiens
gaatcccccttgccacc

SEQ ID NO: 6195758 - DNA, 18 bp, Homo sapiens
gaatcccccttgccaccc

SEQ ID NO: 6195759 - DNA, 16 bp, Homo sapiens
gaatccccgaaggtgc

SEQ ID NO: 6195760 - DNA, 23 bp, Homo sapiens
gaatccccgacccccctacccca

SEQ ID NO: 6195761 - DNA, 19 bp, Homo sapiens
gaatcccggctccagagca

SEQ ID NO: 6195762 - DNA, 21 bp, Homo sapiens
gaatcccgtcggcttctcgac

SEQ ID NO: 6195763 - DNA, 20 bp, Homo sapiens
gaatccctttcagtttgtcc

SEQ ID NO: 6195764 - DNA, 14 bp, Homo sapiens
gaatccgaagggaa

SEQ ID NO: 6195765 - DNA, 15 bp, Homo sapiens
gaatccgaagggaat

SEQ ID NO: 6195766 - DNA, 15 bp, Homo sapiens
gaatccgcctgcaga

SEQ ID NO: 6195767 - DNA, 22 bp, Homo sapiens
gaatccgcctgcagaggacaga

SEQ ID NO: 6195768 - DNA, 14 bp, Homo sapiens
gaatccgtgtgtgt

SEQ ID NO: 6195769 - DNA, 15 bp, Homo sapiens
gaatccgtgtgtgtg

SEQ ID NO: 6195770 - DNA, 18 bp, Homo sapiens
gaatcctacgctatgtag

SEQ ID NO: 6195771 - DNA, 20 bp, Homo sapiens
gaatcctacgctatgtagaa

SEQ ID NO: 6195772 - DNA, 23 bp, Homo sapiens
gaatcctacgctatgtagaatgt

SEQ ID NO: 6195773 - DNA, 20 bp, Homo sapiens
gaatcctaggctccacccca

SEQ ID NO: 6195774 - DNA, 19 bp, Homo sapiens
gaatcctcccttcccagga

SEQ ID NO: 6195775 - DNA, 20 bp, Homo sapiens
gaatcctcccttcccaggag

SEQ ID NO: 6195776 - DNA, 10 bp, Homo sapiens
gaatcctcct

SEQ ID NO: 6195777 - DNA, 12 bp, Homo sapiens
gaatcctgcctc

SEQ ID NO: 6195778 - DNA, 13 bp, Homo sapiens
gaatcctgcctct

SEQ ID NO: 6195779 - DNA, 14 bp, Homo sapiens
gaatcctgcctctc

SEQ ID NO: 6195780 - DNA, 20 bp, Homo sapiens
gaatcctgcggcaggactgc

SEQ ID NO: 6195781 - DNA, 21 bp, Homo sapiens
gaatcctgcggcaggactgca

SEQ ID NO: 6195782 - DNA, 18 bp, Homo sapiens
gaatcctggacagctccg

SEQ ID NO: 6195783 - DNA, 19 bp, Homo sapiens
gaatcctggcaagaaagct

SEQ ID NO: 6195784 - DNA, 19 bp, Homo sapiens
gaatcctgggcccccagag

SEQ ID NO: 6195785 - DNA, 16 bp, Homo sapiens
gaatccttccatttct

SEQ ID NO: 6195786 - DNA, 19 bp, Homo sapiens
gaatcctttggtgccaact

SEQ ID NO: 6195787 - DNA, 16 bp, Homo sapiens
gaatcgattcccaagc

SEQ ID NO: 6195788 - DNA, 16 bp, Homo sapiens
gaatcgcaaggcctgt

SEQ ID NO: 6195789 - DNA, 14 bp, Homo sapiens
gaatcgcaagttaa

SEQ ID NO: 6195790 - DNA, 14 bp, Homo sapiens
gaatcgcttctctt

SEQ ID NO: 6195791 - DNA, 20 bp, Homo sapiens
gaatcgcttgaacccaggag

SEQ ID NO: 6195792 - DNA, 22 bp, Homo sapiens
gaatcggagcgaagcagagagg

SEQ ID NO: 6195793 - DNA, 15 bp, Homo sapiens
gaatcggtgctgtca

SEQ ID NO: 6195794 - DNA, 21 bp, Homo sapiens
gaatcggtgctgtcagccctg

SEQ ID NO: 6195795 - DNA, 17 bp, Homo sapiens
gaatcgttcaactccac

SEQ ID NO: 6195796 - DNA, 15 bp, Homo sapiens
gaatcgtttcaaatg

SEQ ID NO: 6195797 - DNA, 17 bp, Homo sapiens
gaatcgtttcaaatgga

SEQ ID NO: 6195798 - DNA, 22 bp, Homo sapiens
gaatctaaacgtggtcaccttc

SEQ ID NO: 6195799 - DNA, 16 bp, Homo sapiens
gaatctaagctgtttg

SEQ ID NO: 6195800 - DNA, 17 bp, Homo sapiens
gaatctaagtgggagac

SEQ ID NO: 6195801 - DNA, 17 bp, Homo sapiens
gaatctaattcagacag

SEQ ID NO: 6195802 - DNA, 13 bp, Homo sapiens
gaatctacagaac

SEQ ID NO: 6195803 - DNA, 16 bp, Homo sapiens
gaatctacagaacaaa

SEQ ID NO: 6195804 - DNA, 19 bp, Homo sapiens
gaatctacagaacaaagaa

SEQ ID NO: 6195805 - DNA, 13 bp, Homo sapiens
gaatctacatttg

SEQ ID NO: 6195806 - DNA, 21 bp, Homo sapiens
cttcatttttgtaataacatt

SEQ ID NO: 6195807 - DNA, 16 bp, Homo sapiens
cttcattttttaaaaa

SEQ ID NO: 6195808 - DNA, 19 bp, Homo sapiens
cttcattttttaatgtgct

SEQ ID NO: 6195809 - DNA, 24 bp, Homo sapiens
cttcattttttaatgtgctctgta

SEQ ID NO: 6195810 - DNA, 15 bp, Homo sapiens
cttcatttttttccc

SEQ ID NO: 6195811 - DNA, 19 bp, Homo sapiens
cttcattttttttaattga

SEQ ID NO: 6195812 - DNA, 15 bp, Homo sapiens
cttccaaaaaattaa

SEQ ID NO: 6195813 - DNA, 21 bp, Homo sapiens
cttccaaaaagatttattaat

SEQ ID NO: 6195814 - DNA, 17 bp, Homo sapiens
cttccaaaacctgcttc

SEQ ID NO: 6195815 - DNA, 15 bp, Homo sapiens
cttccaaacaaaagc

SEQ ID NO: 6195816 - DNA, 19 bp, Homo sapiens
cttccaaacaggctcagag

SEQ ID NO: 6195817 - DNA, 16 bp, Homo sapiens
cttccaaacagtgtgt

SEQ ID NO: 6195818 - DNA, 23 bp, Homo sapiens
cttccaaaccccactttctccct

SEQ ID NO: 6195819 - DNA, 12 bp, Homo sapiens
cttccaaagaaa

SEQ ID NO: 6195820 - DNA, 17 bp, Homo sapiens
cttccaaagactaagac

SEQ ID NO: 6195821 - DNA, 22 bp, Homo sapiens
cttccaaagagagttaaaagca

SEQ ID NO: 6195822 - DNA, 14 bp, Homo sapiens
cttccaaagagtca

SEQ ID NO: 6195823 - DNA, 21 bp, Homo sapiens
cttccaaagagtcatcatggg

SEQ ID NO: 6195824 - DNA, 21 bp, Homo sapiens
cttccaaagcagagagcatta

SEQ ID NO: 6195825 - DNA, 14 bp, Homo sapiens
cttccaaaggcagc

SEQ ID NO: 6195826 - DNA, 14 bp, Homo sapiens
cttccaaataaata

SEQ ID NO: 6195827 - DNA, 19 bp, Homo sapiens
cttccaaataataaagtct

SEQ ID NO: 6195828 - DNA, 19 bp, Homo sapiens
cttccaaatcccctaagca

SEQ ID NO: 6195829 - DNA, 11 bp, Homo sapiens
cttccaaatgt

SEQ ID NO: 6195830 - DNA, 15 bp, Homo sapiens
cttccaaatgtccct

SEQ ID NO: 6195831 - DNA, 17 bp, Homo sapiens
cttccaaatgtccctcc

SEQ ID NO: 6195832 - DNA, 14 bp, Homo sapiens
cttccaacaagcct

SEQ ID NO: 6195833 - DNA, 16 bp, Homo sapiens
cttccaacaagcctca

SEQ ID NO: 6195834 - DNA, 17 bp, Homo sapiens
cttccaacaaggacagc

SEQ ID NO: 6195835 - DNA, 14 bp, Homo sapiens
cttccaacacattt

SEQ ID NO: 6195836 - DNA, 18 bp, Homo sapiens
cttccaacaggagctggg

SEQ ID NO: 6195837 - DNA, 19 bp, Homo sapiens
cttccaaccatttatcttg

SEQ ID NO: 6195838 - DNA, 15 bp, Homo sapiens
cttccaaccccagct

SEQ ID NO: 6195839 - DNA, 20 bp, Homo sapiens
cttccaaccccagctggcct

SEQ ID NO: 6195840 - DNA, 22 bp, Homo sapiens
cttccaaccccagctggcctct

SEQ ID NO: 6195841 - DNA, 17 bp, Homo sapiens
cttccaactgctgcccc

SEQ ID NO: 6195842 - DNA, 18 bp, Homo sapiens
cttccaactgctgcccca

SEQ ID NO: 6195843 - DNA, 14 bp, Homo sapiens
cttccaacttcctg

SEQ ID NO: 6195844 - DNA, 15 bp, Homo sapiens
cttccaacttcctgt

SEQ ID NO: 6195845 - DNA, 16 bp, Homo sapiens
cttccaagacctgact

SEQ ID NO: 6195846 - DNA, 19 bp, Homo sapiens
cttccaagactccagccct

SEQ ID NO: 6195847 - DNA, 13 bp, Homo sapiens
cttccaagactga

SEQ ID NO: 6195848 - DNA, 16 bp, Homo sapiens
cttccaagctccaaat

SEQ ID NO: 6195849 - DNA, 13 bp, Homo sapiens
cttccaaggagac

SEQ ID NO: 6195850 - DNA, 20 bp, Homo sapiens
cttccaaggagcagagaggt

SEQ ID NO: 6195851 - DNA, 22 bp, Homo sapiens
cttccaatgatgcttactacag

SEQ ID NO: 6195852 - DNA, 16 bp, Homo sapiens
cttccaatgctgtggg

SEQ ID NO: 6195853 - DNA, 17 bp, Homo sapiens
cttccaatgcttctgtt

SEQ ID NO: 6195854 - DNA, 17 bp, Homo sapiens
cttccaatgtctggaga

SEQ ID NO: 6195855 - DNA, 18 bp, Homo sapiens
cttccaatgtctggagac

SEQ ID NO: 6195856 - DNA, 21 bp, Homo sapiens
cttccaattattacagtcctt

SEQ ID NO: 6195857 - DNA, 16 bp, Homo sapiens
cttccacaaaattaga

SEQ ID NO: 6195858 - DNA, 20 bp, Homo sapiens
cttccacaaacaccatcttc

SEQ ID NO: 6195859 - DNA, 17 bp, Homo sapiens
cttccacaaagaaaatt

SEQ ID NO: 6195860 - DNA, 23 bp, Homo sapiens
cttccacaaagaaaattcctata

SEQ ID NO: 6195861 - DNA, 13 bp, Homo sapiens
cttccacaagagc

SEQ ID NO: 6195862 - DNA, 23 bp, Homo sapiens
cttccacaagagcccaggcctcc

SEQ ID NO: 6195863 - DNA, 23 bp, Homo sapiens
cttccacacccccaccccttgct

SEQ ID NO: 6195864 - DNA, 17 bp, Homo sapiens
cttccacacttctgggc

SEQ ID NO: 6195865 - DNA, 22 bp, Homo sapiens
cttccacagcaaatgagatgta

SEQ ID NO: 6195866 - DNA, 17 bp, Homo sapiens
cttccacagcagcagaa

SEQ ID NO: 6195867 - DNA, 17 bp, Homo sapiens
cttccacaggtctcaga

SEQ ID NO: 6195868 - DNA, 21 bp, Homo sapiens
cttccacagtgtgaagacact

SEQ ID NO: 6195869 - DNA, 21 bp, Homo sapiens
cttccacattaattagatttt

SEQ ID NO: 6195870 - DNA, 20 bp, Homo sapiens
cttccacatttttgcacaga

SEQ ID NO: 6195871 - DNA, 23 bp, Homo sapiens
cttccaccagagcaggggctgct

SEQ ID NO: 6195872 - DNA, 14 bp, Homo sapiens
cttccaccagcctg

SEQ ID NO: 6195873 - DNA, 17 bp, Homo sapiens
cttccaccattgtccta

SEQ ID NO: 6195874 - DNA, 13 bp, Homo sapiens
cttccacccacaa

SEQ ID NO: 6195875 - DNA, 17 bp, Homo sapiens
cttccacccacaaactc

SEQ ID NO: 6195876 - DNA, 23 bp, Homo sapiens
cttccacccacaaactccaggct

SEQ ID NO: 6195877 - DNA, 12 bp, Homo sapiens
cttccacccagt

SEQ ID NO: 6195878 - DNA, 21 bp, Homo sapiens
cttccacccctctcctcagag

SEQ ID NO: 6195879 - DNA, 23 bp, Homo sapiens
cttccacccgtctctctgcccac

SEQ ID NO: 6195880 - DNA, 18 bp, Homo sapiens
cttccaccctgccctggc

SEQ ID NO: 6195881 - DNA, 20 bp, Homo sapiens
cttccacccttttttctaag

SEQ ID NO: 6195882 - DNA, 19 bp, Homo sapiens
cttccaccggcactcatga

SEQ ID NO: 6195883 - DNA, 20 bp, Homo sapiens
cttccaccggcactcatgac

SEQ ID NO: 6195884 - DNA, 16 bp, Homo sapiens
cttccacctcacccca

SEQ ID NO: 6195885 - DNA, 14 bp, Homo sapiens
cttccacctcatgg

SEQ ID NO: 6195886 - DNA, 23 bp, Homo sapiens
cttccacctcatggattgccaca

SEQ ID NO: 6195887 - DNA, 14 bp, Homo sapiens
cttccacctccagc

SEQ ID NO: 6195888 - DNA, 18 bp, Homo sapiens
cttccacctccagcctct

SEQ ID NO: 6195889 - DNA, 20 bp, Homo sapiens
cttccacctccagcctctgg

SEQ ID NO: 6195890 - DNA, 15 bp, Homo sapiens
cttccacctccctcc

SEQ ID NO: 6195891 - DNA, 15 bp, Homo sapiens
cttccacctcctaga

SEQ ID NO: 6195892 - DNA, 22 bp, Homo sapiens
cttccacctcctagaggtgggc

SEQ ID NO: 6195893 - DNA, 14 bp, Homo sapiens
cttccacctctggg

SEQ ID NO: 6195894 - DNA, 18 bp, Homo sapiens
cttccacctgctctgctg

SEQ ID NO: 6195895 - DNA, 13 bp, Homo sapiens
cttccacctggaa

SEQ ID NO: 6195896 - DNA, 17 bp, Homo sapiens
cttccacctgtgccctc

SEQ ID NO: 6195897 - DNA, 21 bp, Homo sapiens
cttccacctgtgccctcacca

SEQ ID NO: 6195898 - DNA, 21 bp, Homo sapiens
cttccacgctgtctccagacc

SEQ ID NO: 6195899 - DNA, 19 bp, Homo sapiens
cttccacgtactgcagcct

SEQ ID NO: 6195900 - DNA, 15 bp, Homo sapiens
cttccacgtcttcct

SEQ ID NO: 6195901 - DNA, 19 bp, Homo sapiens
cttccactaccaaaagaca

SEQ ID NO: 6195902 - DNA, 17 bp, Homo sapiens
cttccactaccctccct

SEQ ID NO: 6195903 - DNA, 15 bp, Homo sapiens
cttccactgagggca

SEQ ID NO: 6195904 - DNA, 14 bp, Homo sapiens
cttccactgcctct

SEQ ID NO: 6195905 - DNA, 19 bp, Homo sapiens
cttccactgcctctgcctt

SEQ ID NO: 6195906 - DNA, 20 bp, Homo sapiens
cttccactgtcagccctcac

SEQ ID NO: 6195907 - DNA, 16 bp, Homo sapiens
cttccactgtgcacct

SEQ ID NO: 6195908 - DNA, 15 bp, Homo sapiens
cttccacttctaact

SEQ ID NO: 6195909 - DNA, 14 bp, Homo sapiens
cttccacttctcca

SEQ ID NO: 6195910 - DNA, 13 bp, Homo sapiens
cttccactttgta

SEQ ID NO: 6195911 - DNA, 23 bp, Homo sapiens
cttccagaaagcaggagcagctg

SEQ ID NO: 6195912 - DNA, 15 bp, Homo sapiens
cttccagaaggcagc

SEQ ID NO: 6195913 - DNA, 15 bp, Homo sapiens
cttccagaagtgtga

SEQ ID NO: 6195914 - DNA, 13 bp, Homo sapiens
cttccagaatgct

SEQ ID NO: 6195915 - DNA, 12 bp, Homo sapiens
cttccagacata

SEQ ID NO: 6195916 - DNA, 13 bp, Homo sapiens
cttccagaccacc

SEQ ID NO: 6195917 - DNA, 14 bp, Homo sapiens
cttccagaccacct

SEQ ID NO: 6195918 - DNA, 12 bp, Homo sapiens
cttccagacctg

SEQ ID NO: 6195919 - DNA, 20 bp, Homo sapiens
cttccagagagtcctctgga

SEQ ID NO: 6195920 - DNA, 18 bp, Homo sapiens
cttccagagcctaagaaa

SEQ ID NO: 6195921 - DNA, 17 bp, Homo sapiens
cttccagagctctgacc

SEQ ID NO: 6195922 - DNA, 18 bp, Homo sapiens
cttccagagctctgaccc

SEQ ID NO: 6195923 - DNA, 17 bp, Homo sapiens
cttccagaggacagctc

SEQ ID NO: 6195924 - DNA, 14 bp, Homo sapiens
cttccagaggagag

SEQ ID NO: 6195925 - DNA, 23 bp, Homo sapiens
cttccagaggagagtggcctggg

SEQ ID NO: 6195926 - DNA, 13 bp, Homo sapiens
cttccagatatcc

SEQ ID NO: 6195927 - DNA, 19 bp, Homo sapiens
cttccagatcctctctggg

SEQ ID NO: 6195928 - DNA, 21 bp, Homo sapiens
cttccagatcctctctggggc

SEQ ID NO: 6195929 - DNA, 22 bp, Homo sapiens
cttccagatcctctctggggct

SEQ ID NO: 6195930 - DNA, 10 bp, Homo sapiens
cttccagatg

SEQ ID NO: 6195931 - DNA, 18 bp, Homo sapiens
cttccagatggtcatcca

SEQ ID NO: 6195932 - DNA, 18 bp, Homo sapiens
cttccagattgggggccc

SEQ ID NO: 6195933 - DNA, 14 bp, Homo sapiens
cttccagattttaa

SEQ ID NO: 6195934 - DNA, 15 bp, Homo sapiens
cttccagcaaaatcc

SEQ ID NO: 6195935 - DNA, 15 bp, Homo sapiens
cttccagcaccctgc

SEQ ID NO: 6195936 - DNA, 18 bp, Homo sapiens
cttccagccacctagtcc

SEQ ID NO: 6195937 - DNA, 11 bp, Homo sapiens
cttccagccca

SEQ ID NO: 6195938 - DNA, 13 bp, Homo sapiens
cttccagcccaga

SEQ ID NO: 6195939 - DNA, 15 bp, Homo sapiens
cttccagcccatcca

SEQ ID NO: 6195940 - DNA, 23 bp, Homo sapiens
cttccagcccatccaaacactga

SEQ ID NO: 6195941 - DNA, 12 bp, Homo sapiens
cttccagcctgg

SEQ ID NO: 6195942 - DNA, 13 bp, Homo sapiens
cttccagcctggg

SEQ ID NO: 6195943 - DNA, 18 bp, Homo sapiens
cttccagcctgggacaca

SEQ ID NO: 6195944 - DNA, 18 bp, Homo sapiens
cttccagctagtgaccca

SEQ ID NO: 6195945 - DNA, 12 bp, Homo sapiens
cttccagctcag

SEQ ID NO: 6195946 - DNA, 16 bp, Homo sapiens
cttccagctcagtccc

SEQ ID NO: 6195947 - DNA, 20 bp, Homo sapiens
cttccagctcagtcccacag

SEQ ID NO: 6195948 - DNA, 21 bp, Homo sapiens
cttccagctcagtcccacagc

SEQ ID NO: 6195949 - DNA, 22 bp, Homo sapiens
cttccagctcagtcccacagcc

SEQ ID NO: 6195950 - DNA, 12 bp, Homo sapiens
cttccagctccc

SEQ ID NO: 6195951 - DNA, 14 bp, Homo sapiens
cttccagctccctc

SEQ ID NO: 6195952 - DNA, 14 bp, Homo sapiens
cttccagctcctgt

SEQ ID NO: 6195953 - DNA, 12 bp, Homo sapiens
cttccagctgct

SEQ ID NO: 6195954 - DNA, 21 bp, Homo sapiens
cttccagctgctgtcttctgg

SEQ ID NO: 6195955 - DNA, 14 bp, Homo sapiens
cttccagcttcagg

SEQ ID NO: 6195956 - DNA, 22 bp, Homo sapiens
cttccagcttcaggcaccagca

SEQ ID NO: 6195957 - DNA, 21 bp, Homo sapiens
cttccagcttcctctgagccg

SEQ ID NO: 6195958 - DNA, 16 bp, Homo sapiens
cttccagctttctctt

SEQ ID NO: 6195959 - DNA, 18 bp, Homo sapiens
cttccagctttctctttg

SEQ ID NO: 6195960 - DNA, 19 bp, Homo sapiens
cttccaggaaaaaggacag

SEQ ID NO: 6195961 - DNA, 20 bp, Homo sapiens
cttccaggaaaaaggacagg

SEQ ID NO: 6195962 - DNA, 19 bp, Homo sapiens
cttccaggaaagtgtgaag

SEQ ID NO: 6195963 - DNA, 16 bp, Homo sapiens
cttccaggaagcacag

SEQ ID NO: 6195964 - DNA, 22 bp, Homo sapiens
cttccaggagccaccttgccac

SEQ ID NO: 6195965 - DNA, 17 bp, Homo sapiens
cttccaggagcccagag

SEQ ID NO: 6195966 - DNA, 20 bp, Homo sapiens
cttccaggagcccagagggc

SEQ ID NO: 6195967 - DNA, 22 bp, Homo sapiens
cttccaggataaggagactgag

SEQ ID NO: 6195968 - DNA, 11 bp, Homo sapiens
cttccaggcag

SEQ ID NO: 6195969 - DNA, 13 bp, Homo sapiens
cttccaggcagcc

SEQ ID NO: 6195970 - DNA, 16 bp, Homo sapiens
cttccaggccatcaga

SEQ ID NO: 6195971 - DNA, 20 bp, Homo sapiens
cttccaggccatcagaggcc

SEQ ID NO: 6195972 - DNA, 18 bp, Homo sapiens
cttccaggcgtagggcca

SEQ ID NO: 6195973 - DNA, 10 bp, Homo sapiens
cttccaggct

SEQ ID NO: 6195974 - DNA, 14 bp, Homo sapiens
cttccaggctcttc

SEQ ID NO: 6195975 - DNA, 14 bp, Homo sapiens
cttccaggctggga

SEQ ID NO: 6195976 - DNA, 19 bp, Homo sapiens
cttccaggcttaagcgatt

SEQ ID NO: 6195977 - DNA, 19 bp, Homo sapiens
cttccagggacgaagaaga

SEQ ID NO: 6195978 - DNA, 21 bp, Homo sapiens
cttccagggatttgcctcacc

SEQ ID NO: 6195979 - DNA, 20 bp, Homo sapiens
cttccagggcagcggctcca

SEQ ID NO: 6195980 - DNA, 21 bp, Homo sapiens
cttccagggcagcggctccac

SEQ ID NO: 6195981 - DNA, 22 bp, Homo sapiens
cttccagggcagcggctccact

SEQ ID NO: 6195982 - DNA, 22 bp, Homo sapiens
cttccagggcctgagcagctgg

SEQ ID NO: 6195983 - DNA, 19 bp, Homo sapiens
cttccaggggaacctgcca

SEQ ID NO: 6195984 - DNA, 21 bp, Homo sapiens
cttccaggggaggttcagtga

SEQ ID NO: 6195985 - DNA, 22 bp, Homo sapiens
gaatctacccccagatccaagc

SEQ ID NO: 6195986 - DNA, 14 bp, Homo sapiens
gaatctacttaacc

SEQ ID NO: 6195987 - DNA, 17 bp, Homo sapiens
gaatctagaaaatcaga

SEQ ID NO: 6195988 - DNA, 17 bp, Homo sapiens
gaatctagaaatgttca

SEQ ID NO: 6195989 - DNA, 15 bp, Homo sapiens
gaatctagaagaaat

SEQ ID NO: 6195990 - DNA, 19 bp, Homo sapiens
gaatctagaagaaatgaaa

SEQ ID NO: 6195991 - DNA, 20 bp, Homo sapiens
gaatctagaagaaatgaaat

SEQ ID NO: 6195992 - DNA, 21 bp, Homo sapiens
gaatctagaagaaatgaaatt

SEQ ID NO: 6195993 - DNA, 17 bp, Homo sapiens
gaatctagccagtgaac

SEQ ID NO: 6195994 - DNA, 21 bp, Homo sapiens
gaatctagttggttgatgcct

SEQ ID NO: 6195995 - DNA, 14 bp, Homo sapiens
gaatctataaaaga

SEQ ID NO: 6195996 - DNA, 16 bp, Homo sapiens
gaatctatgaacctga

SEQ ID NO: 6195997 - DNA, 22 bp, Homo sapiens
gaatctatgccaaagatcactt

SEQ ID NO: 6195998 - DNA, 16 bp, Homo sapiens
gaatctatttaagtaa

SEQ ID NO: 6195999 - DNA, 19 bp, Homo sapiens
gaatctatttatcttcatt

SEQ ID NO: 6196000 - DNA, 16 bp, Homo sapiens
gaatctattttctatg

SEQ ID NO: 6196001 - DNA, 17 bp, Homo sapiens
gaatctattttctatgt

SEQ ID NO: 6196002 - DNA, 12 bp, Homo sapiens
gaatctattttt

SEQ ID NO: 6196003 - DNA, 20 bp, Homo sapiens
gaatctatttttaaaatcat

SEQ ID NO: 6196004 - DNA, 23 bp, Homo sapiens
gaatctatttttcttcagactga

SEQ ID NO: 6196005 - DNA, 15 bp, Homo sapiens
gaatctcaaaattag

SEQ ID NO: 6196006 - DNA, 16 bp, Homo sapiens
gaatctcaaataacta

SEQ ID NO: 6196007 - DNA, 17 bp, Homo sapiens
gaatctcaacatgtctc

SEQ ID NO: 6196008 - DNA, 16 bp, Homo sapiens
gaatctcaagattcta

SEQ ID NO: 6196009 - DNA, 22 bp, Homo sapiens
gaatctcaatgacctgttgatt

SEQ ID NO: 6196010 - DNA, 13 bp, Homo sapiens
gaatctcccaagg

SEQ ID NO: 6196011 - DNA, 18 bp, Homo sapiens
gaatctcccactccagcg

SEQ ID NO: 6196012 - DNA, 21 bp, Homo sapiens
gaatctcccagacttgtttcc

SEQ ID NO: 6196013 - DNA, 16 bp, Homo sapiens
gaatctcgttcccaaa

SEQ ID NO: 6196014 - DNA, 19 bp, Homo sapiens
gaatctcgttcccaaagaa

SEQ ID NO: 6196015 - DNA, 17 bp, Homo sapiens
gaatctcgttgaggcca

SEQ ID NO: 6196016 - DNA, 21 bp, Homo sapiens
gaatctctatgtatattctat

SEQ ID NO: 6196017 - DNA, 15 bp, Homo sapiens
gaatctctgcctctc

SEQ ID NO: 6196018 - DNA, 14 bp, Homo sapiens
gaatctctgtgcct

SEQ ID NO: 6196019 - DNA, 15 bp, Homo sapiens
gaatctcttcactac

SEQ ID NO: 6196020 - DNA, 13 bp, Homo sapiens
gaatctctttccc

SEQ ID NO: 6196021 - DNA, 23 bp, Homo sapiens
gaatctgaaaagaacaaccctga

SEQ ID NO: 6196022 - DNA, 15 bp, Homo sapiens
gaatctgaatcagcc

SEQ ID NO: 6196023 - DNA, 16 bp, Homo sapiens
gaatctgaggcatcct

SEQ ID NO: 6196024 - DNA, 20 bp, Homo sapiens
gaatctgaggcatcctctga

SEQ ID NO: 6196025 - DNA, 12 bp, Homo sapiens
gaatctgagggc

SEQ ID NO: 6196026 - DNA, 22 bp, Homo sapiens
gaatctgagggcactctctgcc

SEQ ID NO: 6196027 - DNA, 21 bp, Homo sapiens
gaatctgagtgaattgtacct

SEQ ID NO: 6196028 - DNA, 17 bp, Homo sapiens
gaatctgataccaaaga

SEQ ID NO: 6196029 - DNA, 16 bp, Homo sapiens
gaatctgatacttaga

SEQ ID NO: 6196030 - DNA, 17 bp, Homo sapiens
gaatctgataggaaaag

SEQ ID NO: 6196031 - DNA, 21 bp, Homo sapiens
gaatctgatcccataaagaaa

SEQ ID NO: 6196032 - DNA, 22 bp, Homo sapiens
gaatctgatcccataaagaaag

SEQ ID NO: 6196033 - DNA, 14 bp, Homo sapiens
gaatctgatgcctt

SEQ ID NO: 6196034 - DNA, 21 bp, Homo sapiens
gaatctgccgctttgtctgtc

SEQ ID NO: 6196035 - DNA, 17 bp, Homo sapiens
gaatctgccttccagcc

SEQ ID NO: 6196036 - DNA, 21 bp, Homo sapiens
gaatctgccttccagcccaga

SEQ ID NO: 6196037 - DNA, 18 bp, Homo sapiens
gaatctgctccaactcca

SEQ ID NO: 6196038 - DNA, 13 bp, Homo sapiens
gaatctgctgaga

SEQ ID NO: 6196039 - DNA, 19 bp, Homo sapiens
gaatctgcttttcctctgc

SEQ ID NO: 6196040 - DNA, 21 bp, Homo sapiens
gaatctggaccccatctgtga

SEQ ID NO: 6196041 - DNA, 23 bp, Homo sapiens
gaatctggaccccatctgtgaat

SEQ ID NO: 6196042 - DNA, 16 bp, Homo sapiens
gaatctggagaccagg

SEQ ID NO: 6196043 - DNA, 18 bp, Homo sapiens
gaatctggagaccaggga

SEQ ID NO: 6196044 - DNA, 15 bp, Homo sapiens
gaatctggcattcta

SEQ ID NO: 6196045 - DNA, 21 bp, Homo sapiens
gaatctggcattctacacctg

SEQ ID NO: 6196046 - DNA, 20 bp, Homo sapiens
gaatctgggactgtgcctgg

SEQ ID NO: 6196047 - DNA, 21 bp, Homo sapiens
gaatctgggactgtgcctggc

SEQ ID NO: 6196048 - DNA, 17 bp, Homo sapiens
gaatctgggagggaagt

SEQ ID NO: 6196049 - DNA, 13 bp, Homo sapiens
gaatctgggggtg

SEQ ID NO: 6196050 - DNA, 18 bp, Homo sapiens
gaatctgtatgattctat

SEQ ID NO: 6196051 - DNA, 12 bp, Homo sapiens
gaatctgtctat

SEQ ID NO: 6196052 - DNA, 16 bp, Homo sapiens
gaatctgtgcaaacag

SEQ ID NO: 6196053 - DNA, 13 bp, Homo sapiens
gaatctgtgcagt

SEQ ID NO: 6196054 - DNA, 23 bp, Homo sapiens
gaatctgtgcagtcatcaacaaa

SEQ ID NO: 6196055 - DNA, 11 bp, Homo sapiens
gaatctgtgtg

SEQ ID NO: 6196056 - DNA, 14 bp, Homo sapiens
gaatctgtgtgaaa

SEQ ID NO: 6196057 - DNA, 20 bp, Homo sapiens
gaatctgtgtggtacaaacc

SEQ ID NO: 6196058 - DNA, 18 bp, Homo sapiens
gaatctgttactgaaatg

SEQ ID NO: 6196059 - DNA, 14 bp, Homo sapiens
gaatcttaacattt

SEQ ID NO: 6196060 - DNA, 22 bp, Homo sapiens
gaatcttaatcgatgaatgtaa

SEQ ID NO: 6196061 - DNA, 21 bp, Homo sapiens
gaatcttacagagtgattgta

SEQ ID NO: 6196062 - DNA, 13 bp, Homo sapiens
gaatcttactcct

SEQ ID NO: 6196063 - DNA, 18 bp, Homo sapiens
gaatcttatttttcctgt

SEQ ID NO: 6196064 - DNA, 14 bp, Homo sapiens
gaatcttccccaag

SEQ ID NO: 6196065 - DNA, 11 bp, Homo sapiens
gaatcttctgg

SEQ ID NO: 6196066 - DNA, 19 bp, Homo sapiens
gaatcttgactttctgatt

SEQ ID NO: 6196067 - DNA, 11 bp, Homo sapiens
gaatcttgatt

SEQ ID NO: 6196068 - DNA, 15 bp, Homo sapiens
gaatcttggtttgcc

SEQ ID NO: 6196069 - DNA, 20 bp, Homo sapiens
gaatcttgtctcaatgctca

SEQ ID NO: 6196070 - DNA, 20 bp, Homo sapiens
gaatcttgttttgaaaataa

SEQ ID NO: 6196071 - DNA, 13 bp, Homo sapiens
gaatctttaatta

SEQ ID NO: 6196072 - DNA, 22 bp, Homo sapiens
gaatctttagagaagtatacat

SEQ ID NO: 6196073 - DNA, 23 bp, Homo sapiens
gaatctttagagaagtatacata

SEQ ID NO: 6196074 - DNA, 22 bp, Homo sapiens
gaatctttattcaaacttttat

SEQ ID NO: 6196075 - DNA, 12 bp, Homo sapiens
gaatctttgcaa

SEQ ID NO: 6196076 - DNA, 13 bp, Homo sapiens
gaatctttggtct

SEQ ID NO: 6196077 - DNA, 15 bp, Homo sapiens
gaatcttttactgtg

SEQ ID NO: 6196078 - DNA, 23 bp, Homo sapiens
gaatcttttggattttaagcagt

SEQ ID NO: 6196079 - DNA, 15 bp, Homo sapiens
gaatgaaaaaacagt

SEQ ID NO: 6196080 - DNA, 17 bp, Homo sapiens
gaatgaaaaatgaaaga

SEQ ID NO: 6196081 - DNA, 21 bp, Homo sapiens
gaatgaaaaatgaaagatgat

SEQ ID NO: 6196082 - DNA, 22 bp, Homo sapiens
gaatgaaaaatgaaagatgatt

SEQ ID NO: 6196083 - DNA, 18 bp, Homo sapiens
gaatgaaaagctgctggt

SEQ ID NO: 6196084 - DNA, 16 bp, Homo sapiens
gaatgaaaataactga

SEQ ID NO: 6196085 - DNA, 23 bp, Homo sapiens
gaatgaaaataactgaatttgga

SEQ ID NO: 6196086 - DNA, 24 bp, Homo sapiens
gaatgaaaatcagcaacttctagc

SEQ ID NO: 6196087 - DNA, 14 bp, Homo sapiens
gaatgaaaccccca

SEQ ID NO: 6196088 - DNA, 22 bp, Homo sapiens
gaatgaaaggaagtataaagta

SEQ ID NO: 6196089 - DNA, 21 bp, Homo sapiens
gaatgaaagggcccagagagg

SEQ ID NO: 6196090 - DNA, 20 bp, Homo sapiens
gaatgaaagtcttgtgacta

SEQ ID NO: 6196091 - DNA, 21 bp, Homo sapiens
gaatgaaagtcttgtgactag

SEQ ID NO: 6196092 - DNA, 18 bp, Homo sapiens
gaatgaaatactgtttga

SEQ ID NO: 6196093 - DNA, 19 bp, Homo sapiens
gaatgaaatactgtttgag

SEQ ID NO: 6196094 - DNA, 13 bp, Homo sapiens
gaatgaaatataa

SEQ ID NO: 6196095 - DNA, 18 bp, Homo sapiens
gaatgaaatataaactgt

SEQ ID NO: 6196096 - DNA, 20 bp, Homo sapiens
gaatgaaatataaactgtga

SEQ ID NO: 6196097 - DNA, 15 bp, Homo sapiens
gaatgaaatgaatga

SEQ ID NO: 6196098 - DNA, 14 bp, Homo sapiens
gaatgaaatgtatg

SEQ ID NO: 6196099 - DNA, 21 bp, Homo sapiens
gaatgaaattaaatgttgatt

SEQ ID NO: 6196100 - DNA, 17 bp, Homo sapiens
gaatgaaattcctcctt

SEQ ID NO: 6196101 - DNA, 20 bp, Homo sapiens
gaatgaaattcctccttccc

SEQ ID NO: 6196102 - DNA, 16 bp, Homo sapiens
gaatgaaattgctgaa

SEQ ID NO: 6196103 - DNA, 13 bp, Homo sapiens
gaatgaacaaatt

SEQ ID NO: 6196104 - DNA, 13 bp, Homo sapiens
gaatgaacactat

SEQ ID NO: 6196105 - DNA, 18 bp, Homo sapiens
gaatgaaccacatcttgc

SEQ ID NO: 6196106 - DNA, 23 bp, Homo sapiens
gaatgaaccacatcttgctctgc

SEQ ID NO: 6196107 - DNA, 17 bp, Homo sapiens
gaatgaaccctcctcct

SEQ ID NO: 6196108 - DNA, 18 bp, Homo sapiens
gaatgaaccctcctcctt

SEQ ID NO: 6196109 - DNA, 23 bp, Homo sapiens
gaatgaaccctcctcctttttaa

SEQ ID NO: 6196110 - DNA, 21 bp, Homo sapiens
gaatgaactgtctagatggat

SEQ ID NO: 6196111 - DNA, 16 bp, Homo sapiens
gaatgaactgtggaat

SEQ ID NO: 6196112 - DNA, 17 bp, Homo sapiens
gaatgaactgtggaatt

SEQ ID NO: 6196113 - DNA, 16 bp, Homo sapiens
gaatgaagaattcaga

SEQ ID NO: 6196114 - DNA, 21 bp, Homo sapiens
gaatgaagacatttctgctct

SEQ ID NO: 6196115 - DNA, 11 bp, Homo sapiens
gaatgaagacc

SEQ ID NO: 6196116 - DNA, 17 bp, Homo sapiens
gaatgaagatactgaaa

SEQ ID NO: 6196117 - DNA, 17 bp, Homo sapiens
gaatgaagcagtatttt

SEQ ID NO: 6196118 - DNA, 13 bp, Homo sapiens
gaatgaagcatgt

SEQ ID NO: 6196119 - DNA, 15 bp, Homo sapiens
gaatgaagcatgtag

SEQ ID NO: 6196120 - DNA, 16 bp, Homo sapiens
gaatgaagctgccatc

SEQ ID NO: 6196121 - DNA, 16 bp, Homo sapiens
gaatgaagggccaggc

SEQ ID NO: 6196122 - DNA, 21 bp, Homo sapiens
gaatgaaggtttttgtaaaga

SEQ ID NO: 6196123 - DNA, 15 bp, Homo sapiens
gaatgaagttctgct

SEQ ID NO: 6196124 - DNA, 14 bp, Homo sapiens
gaatgaatacacag

SEQ ID NO: 6196125 - DNA, 15 bp, Homo sapiens
gaatgaatttatctt

SEQ ID NO: 6196126 - DNA, 22 bp, Homo sapiens
gaatgacaggaacccatcactg

SEQ ID NO: 6196127 - DNA, 22 bp, Homo sapiens
gaatgacatcaacattccccca

SEQ ID NO: 6196128 - DNA, 19 bp, Homo sapiens
gaatgaccacgggcctcag

SEQ ID NO: 6196129 - DNA, 18 bp, Homo sapiens
gaatgaccgctctccctt

SEQ ID NO: 6196130 - DNA, 15 bp, Homo sapiens
gaatgacctgcagtc

SEQ ID NO: 6196131 - DNA, 19 bp, Homo sapiens
gaatgaccttgtaatgtaa

SEQ ID NO: 6196132 - DNA, 22 bp, Homo sapiens
gaatgactaagaggaaagtaca

SEQ ID NO: 6196133 - DNA, 17 bp, Homo sapiens
gaatgactataaacatt

SEQ ID NO: 6196134 - DNA, 14 bp, Homo sapiens
gaatgactatgtcc

SEQ ID NO: 6196135 - DNA, 12 bp, Homo sapiens
gaatgactcctt

SEQ ID NO: 6196136 - DNA, 16 bp, Homo sapiens
gaatgactctggaacc

SEQ ID NO: 6196137 - DNA, 15 bp, Homo sapiens
gaatgacttgggttt

SEQ ID NO: 6196138 - DNA, 12 bp, Homo sapiens
gaatgagaaaca

SEQ ID NO: 6196139 - DNA, 17 bp, Homo sapiens
gaatgagaaatcatgtt

SEQ ID NO: 6196140 - DNA, 19 bp, Homo sapiens
gaatgagaagtaaattatt

SEQ ID NO: 6196141 - DNA, 15 bp, Homo sapiens
gaatgagacatccag

SEQ ID NO: 6196142 - DNA, 16 bp, Homo sapiens
gaatgagagagaaaag

SEQ ID NO: 6196143 - DNA, 16 bp, Homo sapiens
gaatgagagagtgtgg

SEQ ID NO: 6196144 - DNA, 20 bp, Homo sapiens
gaatgagagcgacacagacg

SEQ ID NO: 6196145 - DNA, 17 bp, Homo sapiens
gaatgagagttccttct

SEQ ID NO: 6196146 - DNA, 20 bp, Homo sapiens
gaatgagattaattcctttc

SEQ ID NO: 6196147 - DNA, 16 bp, Homo sapiens
gaatgagccaaaatga

SEQ ID NO: 6196148 - DNA, 12 bp, Homo sapiens
gaatgagcccag

SEQ ID NO: 6196149 - DNA, 14 bp, Homo sapiens
gaatgagcccagag

SEQ ID NO: 6196150 - DNA, 22 bp, Homo sapiens
gaatgagcctacgctgaagatg

SEQ ID NO: 6196151 - DNA, 12 bp, Homo sapiens
gaatgagcctgt

SEQ ID NO: 6196152 - DNA, 14 bp, Homo sapiens
gaatgagctgggcc

SEQ ID NO: 6196153 - DNA, 21 bp, Homo sapiens
gaatgagctgggccctgggtg

SEQ ID NO: 6196154 - DNA, 16 bp, Homo sapiens
gaatgaggaaaattct

SEQ ID NO: 6196155 - DNA, 15 bp, Homo sapiens
gaatgaggaacaatc

SEQ ID NO: 6196156 - DNA, 14 bp, Homo sapiens
gaatgaggaggaag

SEQ ID NO: 6196157 - DNA, 14 bp, Homo sapiens
gaatgaggcttgct

SEQ ID NO: 6196158 - DNA, 15 bp, Homo sapiens
gaatgaggcttgctg

SEQ ID NO: 6196159 - DNA, 15 bp, Homo sapiens
gaatgagggaaacaa

SEQ ID NO: 6196160 - DNA, 20 bp, Homo sapiens
gaatgagggcgtgaaacaca

SEQ ID NO: 6196161 - DNA, 15 bp, Homo sapiens
gaatgagggggctca

SEQ ID NO: 6196162 - DNA, 14 bp, Homo sapiens
gaatgaggtcccag

SEQ ID NO: 6196163 - DNA, 15 bp, Homo sapiens
gaatgaggtcccagg

SEQ ID NO: 6196164 - DNA, 20 bp, Homo sapiens
cttccagggggaaggccaag

SEQ ID NO: 6196165 - DNA, 21 bp, Homo sapiens
cttccaggtagggccagctca

SEQ ID NO: 6196166 - DNA, 18 bp, Homo sapiens
cttccaggtatctccagg

SEQ ID NO: 6196167 - DNA, 14 bp, Homo sapiens
cttccaggtcagga

SEQ ID NO: 6196168 - DNA, 23 bp, Homo sapiens
cttccaggtcaggatgcacattt

SEQ ID NO: 6196169 - DNA, 16 bp, Homo sapiens
cttccaggtgcccagc

SEQ ID NO: 6196170 - DNA, 20 bp, Homo sapiens
cttccaggtgcctggccctt

SEQ ID NO: 6196171 - DNA, 20 bp, Homo sapiens
cttccaggtggcccttcccg

SEQ ID NO: 6196172 - DNA, 16 bp, Homo sapiens
cttccaggtgttactg

SEQ ID NO: 6196173 - DNA, 22 bp, Homo sapiens
cttccaggtgttactgtaattc

SEQ ID NO: 6196174 - DNA, 23 bp, Homo sapiens
cttccaggttccatccaccacct

SEQ ID NO: 6196175 - DNA, 16 bp, Homo sapiens
cttccagtataaccag

SEQ ID NO: 6196176 - DNA, 19 bp, Homo sapiens
cttccagtatcctgaaaca

SEQ ID NO: 6196177 - DNA, 21 bp, Homo sapiens
cttccagtatcctgaaacagt

SEQ ID NO: 6196178 - DNA, 17 bp, Homo sapiens
cttccagtccaatctca

SEQ ID NO: 6196179 - DNA, 21 bp, Homo sapiens
cttccagtcttcctgacactt

SEQ ID NO: 6196180 - DNA, 14 bp, Homo sapiens
cttccagtgaacat

SEQ ID NO: 6196181 - DNA, 20 bp, Homo sapiens
cttccagtgaacattcccag

SEQ ID NO: 6196182 - DNA, 17 bp, Homo sapiens
cttccagtgaggcatct

SEQ ID NO: 6196183 - DNA, 14 bp, Homo sapiens
cttccagtgaggct

SEQ ID NO: 6196184 - DNA, 19 bp, Homo sapiens
cttccagtgaggctctgcc

SEQ ID NO: 6196185 - DNA, 16 bp, Homo sapiens
cttccagtgcatgttg

SEQ ID NO: 6196186 - DNA, 22 bp, Homo sapiens
cttccagtgcatgttgccatga

SEQ ID NO: 6196187 - DNA, 12 bp, Homo sapiens
cttccagtggct

SEQ ID NO: 6196188 - DNA, 21 bp, Homo sapiens
cttccagtggcttctcccaac

SEQ ID NO: 6196189 - DNA, 12 bp, Homo sapiens
cttccagtgttg

SEQ ID NO: 6196190 - DNA, 21 bp, Homo sapiens
cttccagtgttggctgtgtga

SEQ ID NO: 6196191 - DNA, 16 bp, Homo sapiens
cttccagttactttcc

SEQ ID NO: 6196192 - DNA, 17 bp, Homo sapiens
cttccagttggactgtg

SEQ ID NO: 6196193 - DNA, 20 bp, Homo sapiens
cttccagtttattccagagc

SEQ ID NO: 6196194 - DNA, 17 bp, Homo sapiens
cttccagtttgctttgc

SEQ ID NO: 6196195 - DNA, 21 bp, Homo sapiens
cttccataatctggactcctc

SEQ ID NO: 6196196 - DNA, 11 bp, Homo sapiens
cttccataatg

SEQ ID NO: 6196197 - DNA, 18 bp, Homo sapiens
cttccataatgctactgt

SEQ ID NO: 6196198 - DNA, 22 bp, Homo sapiens
cttccataatgctactgtctca

SEQ ID NO: 6196199 - DNA, 11 bp, Homo sapiens
cttccataatt

SEQ ID NO: 6196200 - DNA, 14 bp, Homo sapiens
cttccataattatg

SEQ ID NO: 6196201 - DNA, 14 bp, Homo sapiens
cttccatacagctc

SEQ ID NO: 6196202 - DNA, 15 bp, Homo sapiens
cttccataggacaaa

SEQ ID NO: 6196203 - DNA, 18 bp, Homo sapiens
cttccataggacatactg

SEQ ID NO: 6196204 - DNA, 12 bp, Homo sapiens
cttccatagtga

SEQ ID NO: 6196205 - DNA, 23 bp, Homo sapiens
cttccatatccctgcccagcctg

SEQ ID NO: 6196206 - DNA, 16 bp, Homo sapiens
cttccatatccgggtg

SEQ ID NO: 6196207 - DNA, 22 bp, Homo sapiens
cttccatatccgggtgctcaat

SEQ ID NO: 6196208 - DNA, 16 bp, Homo sapiens
cttccatatgacctca

SEQ ID NO: 6196209 - DNA, 19 bp, Homo sapiens
cttccatatttggaagaaa

SEQ ID NO: 6196210 - DNA, 15 bp, Homo sapiens
cttccatcagagatg

SEQ ID NO: 6196211 - DNA, 15 bp, Homo sapiens
cttccatcagcagtg

SEQ ID NO: 6196212 - DNA, 17 bp, Homo sapiens
cttccatcagcagtgat

SEQ ID NO: 6196213 - DNA, 18 bp, Homo sapiens
cttccatcagcagtgatt

SEQ ID NO: 6196214 - DNA, 19 bp, Homo sapiens
cttccatcagctctctgca

SEQ ID NO: 6196215 - DNA, 17 bp, Homo sapiens
cttccatcatcactgta

SEQ ID NO: 6196216 - DNA, 14 bp, Homo sapiens
cttccatcatgtcc

SEQ ID NO: 6196217 - DNA, 17 bp, Homo sapiens
cttccatcatgtcccca

SEQ ID NO: 6196218 - DNA, 22 bp, Homo sapiens
cttccatccatctttccatcca

SEQ ID NO: 6196219 - DNA, 19 bp, Homo sapiens
cttccatcccaaccagtgc

SEQ ID NO: 6196220 - DNA, 14 bp, Homo sapiens
cttccatcccagga

SEQ ID NO: 6196221 - DNA, 14 bp, Homo sapiens
cttccatccctacc

SEQ ID NO: 6196222 - DNA, 15 bp, Homo sapiens
cttccatccctaccc

SEQ ID NO: 6196223 - DNA, 19 bp, Homo sapiens
cttccatccctacccccta

SEQ ID NO: 6196224 - DNA, 15 bp, Homo sapiens
cttccatcctgagga

SEQ ID NO: 6196225 - DNA, 21 bp, Homo sapiens
cttccatctagcagctggcct

SEQ ID NO: 6196226 - DNA, 22 bp, Homo sapiens
cttccatctagcagctggccta

SEQ ID NO: 6196227 - DNA, 10 bp, Homo sapiens
cttccatctc

SEQ ID NO: 6196228 - DNA, 19 bp, Homo sapiens
cttccatctcttcctttcc

SEQ ID NO: 6196229 - DNA, 21 bp, Homo sapiens
cttccatctgattccagcaca

SEQ ID NO: 6196230 - DNA, 19 bp, Homo sapiens
cttccatgaattttaaaat

SEQ ID NO: 6196231 - DNA, 18 bp, Homo sapiens
cttccatgacctcccctc

SEQ ID NO: 6196232 - DNA, 19 bp, Homo sapiens
cttccatgacctcccctcc

SEQ ID NO: 6196233 - DNA, 18 bp, Homo sapiens
cttccatgatactttaat

SEQ ID NO: 6196234 - DNA, 17 bp, Homo sapiens
cttccatgatagatata

SEQ ID NO: 6196235 - DNA, 22 bp, Homo sapiens
cttccatgatgttacattagga

SEQ ID NO: 6196236 - DNA, 15 bp, Homo sapiens
cttccatgccccagg

SEQ ID NO: 6196237 - DNA, 17 bp, Homo sapiens
cttccatgccccaggat

SEQ ID NO: 6196238 - DNA, 22 bp, Homo sapiens
cttccatgccctgggatgcctc

SEQ ID NO: 6196239 - DNA, 21 bp, Homo sapiens
cttccatgcctgtagctttcc

SEQ ID NO: 6196240 - DNA, 23 bp, Homo sapiens
cttccatgctcccaactcccttc

SEQ ID NO: 6196241 - DNA, 16 bp, Homo sapiens
cttccatgctccgcct

SEQ ID NO: 6196242 - DNA, 15 bp, Homo sapiens
cttccatgctgtgcg

SEQ ID NO: 6196243 - DNA, 13 bp, Homo sapiens
cttccatggtggt

SEQ ID NO: 6196244 - DNA, 20 bp, Homo sapiens
cttccatggtggtttcagaa

SEQ ID NO: 6196245 - DNA, 21 bp, Homo sapiens
cttccatggtggtttcagaaa

SEQ ID NO: 6196246 - DNA, 22 bp, Homo sapiens
cttccatggtggtttcagaaag

SEQ ID NO: 6196247 - DNA, 17 bp, Homo sapiens
cttccatgtcaggccag

SEQ ID NO: 6196248 - DNA, 15 bp, Homo sapiens
cttccatgtcgcctc

SEQ ID NO: 6196249 - DNA, 22 bp, Homo sapiens
cttccatgtcggcctctaaccc

SEQ ID NO: 6196250 - DNA, 14 bp, Homo sapiens
cttccatgtgaggg

SEQ ID NO: 6196251 - DNA, 22 bp, Homo sapiens
cttccatgtgcctttctttgcc

SEQ ID NO: 6196252 - DNA, 16 bp, Homo sapiens
cttccatgttctgggt

SEQ ID NO: 6196253 - DNA, 17 bp, Homo sapiens
cttccattaagaacact

SEQ ID NO: 6196254 - DNA, 21 bp, Homo sapiens
cttccattcagttttatttat

SEQ ID NO: 6196255 - DNA, 17 bp, Homo sapiens
cttccattccacacaga

SEQ ID NO: 6196256 - DNA, 21 bp, Homo sapiens
cttccattccatctagttttt

SEQ ID NO: 6196257 - DNA, 15 bp, Homo sapiens
cttccattcccagac

SEQ ID NO: 6196258 - DNA, 12 bp, Homo sapiens
cttccattcttt

SEQ ID NO: 6196259 - DNA, 17 bp, Homo sapiens
cttccattgctcccagt

SEQ ID NO: 6196260 - DNA, 14 bp, Homo sapiens
cttccattggttct

SEQ ID NO: 6196261 - DNA, 14 bp, Homo sapiens
cttccattgtttaa

SEQ ID NO: 6196262 - DNA, 12 bp, Homo sapiens
cttccatttcta

SEQ ID NO: 6196263 - DNA, 17 bp, Homo sapiens
cttccatttctactgta

SEQ ID NO: 6196264 - DNA, 20 bp, Homo sapiens
cttccatttctgccttttgt

SEQ ID NO: 6196265 - DNA, 14 bp, Homo sapiens
cttccatttcttcc

SEQ ID NO: 6196266 - DNA, 14 bp, Homo sapiens
cttccatttcttct

SEQ ID NO: 6196267 - DNA, 17 bp, Homo sapiens
cttccatttcttctgca

SEQ ID NO: 6196268 - DNA, 13 bp, Homo sapiens
cttccatttgcaa

SEQ ID NO: 6196269 - DNA, 14 bp, Homo sapiens
cttccatttggaat

SEQ ID NO: 6196270 - DNA, 14 bp, Homo sapiens
cttccattttcccc

SEQ ID NO: 6196271 - DNA, 23 bp, Homo sapiens
cttccattttcccccactactgc

SEQ ID NO: 6196272 - DNA, 17 bp, Homo sapiens
cttccattttcctacag

SEQ ID NO: 6196273 - DNA, 14 bp, Homo sapiens
cttccatttttgat

SEQ ID NO: 6196274 - DNA, 15 bp, Homo sapiens
cttcccaaaaacagc

SEQ ID NO: 6196275 - DNA, 17 bp, Homo sapiens
cttcccaaaccaagtgc

SEQ ID NO: 6196276 - DNA, 22 bp, Homo sapiens
cttcccaaaccaagtgccttga

SEQ ID NO: 6196277 - DNA, 17 bp, Homo sapiens
cttcccaaacccagtct

SEQ ID NO: 6196278 - DNA, 13 bp, Homo sapiens
cttcccaaactcc

SEQ ID NO: 6196279 - DNA, 21 bp, Homo sapiens
cttcccaaagcaagcacctgg

SEQ ID NO: 6196280 - DNA, 22 bp, Homo sapiens
cttcccaaagcaagcacctggg

SEQ ID NO: 6196281 - DNA, 19 bp, Homo sapiens
cttcccaaatcaaaataaa

SEQ ID NO: 6196282 - DNA, 20 bp, Homo sapiens
cttcccaaatgtgtgcccag

SEQ ID NO: 6196283 - DNA, 21 bp, Homo sapiens
cttcccaacaatactttgtgt

SEQ ID NO: 6196284 - DNA, 15 bp, Homo sapiens
cttcccaacagatca

SEQ ID NO: 6196285 - DNA, 18 bp, Homo sapiens
cttcccaacagccttagc

SEQ ID NO: 6196286 - DNA, 15 bp, Homo sapiens
cttcccaactcactg

SEQ ID NO: 6196287 - DNA, 18 bp, Homo sapiens
cttcccaactcactgtgc

SEQ ID NO: 6196288 - DNA, 15 bp, Homo sapiens
cttcccaactgcaag

SEQ ID NO: 6196289 - DNA, 18 bp, Homo sapiens
cttcccaagaagagagaa

SEQ ID NO: 6196290 - DNA, 23 bp, Homo sapiens
cttcccaaggtacagctgtatat

SEQ ID NO: 6196291 - DNA, 18 bp, Homo sapiens
cttcccaatcagcactga

SEQ ID NO: 6196292 - DNA, 19 bp, Homo sapiens
cttcccaatcagcactgaa

SEQ ID NO: 6196293 - DNA, 20 bp, Homo sapiens
cttcccaatcagcactgaaa

SEQ ID NO: 6196294 - DNA, 21 bp, Homo sapiens
cttcccaatcagcactgaaaa

SEQ ID NO: 6196295 - DNA, 18 bp, Homo sapiens
cttcccaatcttcttttt

SEQ ID NO: 6196296 - DNA, 18 bp, Homo sapiens
cttcccacaaagaatata

SEQ ID NO: 6196297 - DNA, 22 bp, Homo sapiens
cttcccacaactactagtgtga

SEQ ID NO: 6196298 - DNA, 13 bp, Homo sapiens
cttcccacaccag

SEQ ID NO: 6196299 - DNA, 18 bp, Homo sapiens
cttcccacacctgcctgc

SEQ ID NO: 6196300 - DNA, 19 bp, Homo sapiens
cttcccacacctgcctgcg

SEQ ID NO: 6196301 - DNA, 17 bp, Homo sapiens
cttcccacacggcagcc

SEQ ID NO: 6196302 - DNA, 14 bp, Homo sapiens
cttcccacatgcct

SEQ ID NO: 6196303 - DNA, 20 bp, Homo sapiens
cttcccacatgcctgcgcct

SEQ ID NO: 6196304 - DNA, 22 bp, Homo sapiens
cttcccaccaactctctctgcc

SEQ ID NO: 6196305 - DNA, 17 bp, Homo sapiens
cttcccacccatcgctg

SEQ ID NO: 6196306 - DNA, 16 bp, Homo sapiens
cttcccacccccaggc

SEQ ID NO: 6196307 - DNA, 19 bp, Homo sapiens
cttcccacccccaggcaag

SEQ ID NO: 6196308 - DNA, 12 bp, Homo sapiens
cttcccacccct

SEQ ID NO: 6196309 - DNA, 13 bp, Homo sapiens
cttcccaccccta

SEQ ID NO: 6196310 - DNA, 21 bp, Homo sapiens
cttcccacccctacacacaca

SEQ ID NO: 6196311 - DNA, 15 bp, Homo sapiens
cttcccacctactgc

SEQ ID NO: 6196312 - DNA, 16 bp, Homo sapiens
cttcccacctactgca

SEQ ID NO: 6196313 - DNA, 15 bp, Homo sapiens
cttcccacctccctg

SEQ ID NO: 6196314 - DNA, 16 bp, Homo sapiens
cttcccacctccctgc

SEQ ID NO: 6196315 - DNA, 19 bp, Homo sapiens
cttcccacctccctgccca

SEQ ID NO: 6196316 - DNA, 20 bp, Homo sapiens
cttcccacggccactgcagt

SEQ ID NO: 6196317 - DNA, 12 bp, Homo sapiens
cttcccactcca

SEQ ID NO: 6196318 - DNA, 18 bp, Homo sapiens
cttcccactctagggcag

SEQ ID NO: 6196319 - DNA, 19 bp, Homo sapiens
cttcccactctagggcagt

SEQ ID NO: 6196320 - DNA, 20 bp, Homo sapiens
cttcccactctagggcagtg

SEQ ID NO: 6196321 - DNA, 22 bp, Homo sapiens
cttcccactctagggcagtgga

SEQ ID NO: 6196322 - DNA, 13 bp, Homo sapiens
cttcccactctgt

SEQ ID NO: 6196323 - DNA, 15 bp, Homo sapiens
cttcccactggaggt

SEQ ID NO: 6196324 - DNA, 15 bp, Homo sapiens
cttcccactggggcc

SEQ ID NO: 6196325 - DNA, 15 bp, Homo sapiens
cttcccactgtcctt

SEQ ID NO: 6196326 - DNA, 17 bp, Homo sapiens
cttcccactgtcctttc

SEQ ID NO: 6196327 - DNA, 19 bp, Homo sapiens
cttcccactgtcctttctc

SEQ ID NO: 6196328 - DNA, 17 bp, Homo sapiens
cttcccagaaaaccagt

SEQ ID NO: 6196329 - DNA, 19 bp, Homo sapiens
cttcccagaatctctgagc

SEQ ID NO: 6196330 - DNA, 22 bp, Homo sapiens
cttcccagaccaggaaaggctt

SEQ ID NO: 6196331 - DNA, 10 bp, Homo sapiens
cttcccagag

SEQ ID NO: 6196332 - DNA, 19 bp, Homo sapiens
cttcccagagaagctcatt

SEQ ID NO: 6196333 - DNA, 13 bp, Homo sapiens
cttcccagagaga

SEQ ID NO: 6196334 - DNA, 12 bp, Homo sapiens
cttcccagaggc

SEQ ID NO: 6196335 - DNA, 16 bp, Homo sapiens
cttcccagaggcagag

SEQ ID NO: 6196336 - DNA, 13 bp, Homo sapiens
cttcccagaggcc

SEQ ID NO: 6196337 - DNA, 15 bp, Homo sapiens
cttcccagagggagc

SEQ ID NO: 6196338 - DNA, 20 bp, Homo sapiens
cttcccagagggagcaggcc

SEQ ID NO: 6196339 - DNA, 18 bp, Homo sapiens
cttcccagaggggcctgc

SEQ ID NO: 6196340 - DNA, 23 bp, Homo sapiens
cttcccagatttagggtactttt

SEQ ID NO: 6196341 - DNA, 19 bp, Homo sapiens
cttcccagcaacaataatg

SEQ ID NO: 6196342 - DNA, 21 bp, Homo sapiens
gaatgaggtcccaggcagaga

SEQ ID NO: 6196343 - DNA, 22 bp, Homo sapiens
gaatgaggtgggaggtggaaga

SEQ ID NO: 6196344 - DNA, 15 bp, Homo sapiens
gaatgagtaaataaa

SEQ ID NO: 6196345 - DNA, 21 bp, Homo sapiens
gaatgagtcaatcagccttta

SEQ ID NO: 6196346 - DNA, 14 bp, Homo sapiens
gaatgagtctgctt

SEQ ID NO: 6196347 - DNA, 14 bp, Homo sapiens
gaatgagtttctta

SEQ ID NO: 6196348 - DNA, 16 bp, Homo sapiens
gaatgagtttcttaga

SEQ ID NO: 6196349 - DNA, 13 bp, Homo sapiens
gaatgagttttac

SEQ ID NO: 6196350 - DNA, 22 bp, Homo sapiens
gaatgatagcccagaacaaaaa

SEQ ID NO: 6196351 - DNA, 22 bp, Homo sapiens
gaatgatatctttgacctcaat

SEQ ID NO: 6196352 - DNA, 15 bp, Homo sapiens
gaatgatcatctgta

SEQ ID NO: 6196353 - DNA, 15 bp, Homo sapiens
gaatgatccaatact

SEQ ID NO: 6196354 - DNA, 17 bp, Homo sapiens
gaatgatccctcagtct

SEQ ID NO: 6196355 - DNA, 21 bp, Homo sapiens
gaatgatccctcagtctgaga

SEQ ID NO: 6196356 - DNA, 11 bp, Homo sapiens
gaatgatctat

SEQ ID NO: 6196357 - DNA, 16 bp, Homo sapiens
gaatgatctcttcttt

SEQ ID NO: 6196358 - DNA, 17 bp, Homo sapiens
gaatgatctcttctttt

SEQ ID NO: 6196359 - DNA, 14 bp, Homo sapiens
gaatgattaatcaa

SEQ ID NO: 6196360 - DNA, 19 bp, Homo sapiens
gaatgattcatgttatatt

SEQ ID NO: 6196361 - DNA, 20 bp, Homo sapiens
gaatgattcatgttatattt

SEQ ID NO: 6196362 - DNA, 21 bp, Homo sapiens
gaatgattggttaaaatgtga

SEQ ID NO: 6196363 - DNA, 23 bp, Homo sapiens
gaatgattggttaaaatgtgatt

SEQ ID NO: 6196364 - DNA, 16 bp, Homo sapiens
gaatgatttccaaaga

SEQ ID NO: 6196365 - DNA, 20 bp, Homo sapiens
gaatgatttctatgaacttg

SEQ ID NO: 6196366 - DNA, 21 bp, Homo sapiens
gaatgatttttgctatttcta

SEQ ID NO: 6196367 - DNA, 20 bp, Homo sapiens
gaatgcaatttttttttgtt

SEQ ID NO: 6196368 - DNA, 19 bp, Homo sapiens
gaatgcacaaacagaggcc

SEQ ID NO: 6196369 - DNA, 20 bp, Homo sapiens
gaatgcacaaacagaggccg

SEQ ID NO: 6196370 - DNA, 13 bp, Homo sapiens
gaatgcacacagc

SEQ ID NO: 6196371 - DNA, 20 bp, Homo sapiens
gaatgcacactagcctctcc

SEQ ID NO: 6196372 - DNA, 15 bp, Homo sapiens
gaatgcacctcccca

SEQ ID NO: 6196373 - DNA, 13 bp, Homo sapiens
gaatgcactcaga

SEQ ID NO: 6196374 - DNA, 20 bp, Homo sapiens
gaatgcactcagactgtata

SEQ ID NO: 6196375 - DNA, 21 bp, Homo sapiens
gaatgcagaaaacagggtctg

SEQ ID NO: 6196376 - DNA, 16 bp, Homo sapiens
gaatgcagattcctgg

SEQ ID NO: 6196377 - DNA, 22 bp, Homo sapiens
gaatgcagattcctgggcctgt

SEQ ID NO: 6196378 - DNA, 18 bp, Homo sapiens
gaatgcagcactgctgcc

SEQ ID NO: 6196379 - DNA, 13 bp, Homo sapiens
gaatgcagcagga

SEQ ID NO: 6196380 - DNA, 15 bp, Homo sapiens
gaatgcagcccacca

SEQ ID NO: 6196381 - DNA, 21 bp, Homo sapiens
gaatgcagcccaccaggagca

SEQ ID NO: 6196382 - DNA, 22 bp, Homo sapiens
gaatgcagcccaccaggagcac

SEQ ID NO: 6196383 - DNA, 17 bp, Homo sapiens
gaatgcagggaagaggg

SEQ ID NO: 6196384 - DNA, 22 bp, Homo sapiens
gaatgcagtcctcatctccagc

SEQ ID NO: 6196385 - DNA, 20 bp, Homo sapiens
gaatgcagtctgtccaggct

SEQ ID NO: 6196386 - DNA, 14 bp, Homo sapiens
gaatgcataaaatg

SEQ ID NO: 6196387 - DNA, 20 bp, Homo sapiens
gaatgcatattcaacacact

SEQ ID NO: 6196388 - DNA, 18 bp, Homo sapiens
gaatgcatccaaatagga

SEQ ID NO: 6196389 - DNA, 21 bp, Homo sapiens
gaatgcatgctttccatattt

SEQ ID NO: 6196390 - DNA, 14 bp, Homo sapiens
gaatgcatgtaagg

SEQ ID NO: 6196391 - DNA, 15 bp, Homo sapiens
gaatgcatgttctgt

SEQ ID NO: 6196392 - DNA, 14 bp, Homo sapiens
gaatgcattaaaaa

SEQ ID NO: 6196393 - DNA, 19 bp, Homo sapiens
gaatgcattcactcagcat

SEQ ID NO: 6196394 - DNA, 15 bp, Homo sapiens
gaatgcattccctga

SEQ ID NO: 6196395 - DNA, 19 bp, Homo sapiens
gaatgcattttctgggtga

SEQ ID NO: 6196396 - DNA, 24 bp, Homo sapiens
gaatgccactttggctgaactaca

SEQ ID NO: 6196397 - DNA, 13 bp, Homo sapiens
gaatgccagccca

SEQ ID NO: 6196398 - DNA, 14 bp, Homo sapiens
gaatgccagcccaa

SEQ ID NO: 6196399 - DNA, 20 bp, Homo sapiens
gaatgccagtgtgctgatgg

SEQ ID NO: 6196400 - DNA, 23 bp, Homo sapiens
gaatgccatagtcaaagagagtt

SEQ ID NO: 6196401 - DNA, 17 bp, Homo sapiens
gaatgccattggaacct

SEQ ID NO: 6196402 - DNA, 16 bp, Homo sapiens
gaatgccatttagaat

SEQ ID NO: 6196403 - DNA, 21 bp, Homo sapiens
gaatgccatttagaatctaga

SEQ ID NO: 6196404 - DNA, 15 bp, Homo sapiens
gaatgccatttctca

SEQ ID NO: 6196405 - DNA, 17 bp, Homo sapiens
gaatgcccacaggcaaa

SEQ ID NO: 6196406 - DNA, 17 bp, Homo sapiens
gaatgcccccagctggc

SEQ ID NO: 6196407 - DNA, 18 bp, Homo sapiens
gaatgcccccagctggcc

SEQ ID NO: 6196408 - DNA, 14 bp, Homo sapiens
gaatgccctcagct

SEQ ID NO: 6196409 - DNA, 14 bp, Homo sapiens
gaatgccctcaggg

SEQ ID NO: 6196410 - DNA, 20 bp, Homo sapiens
gaatgccgcgaactgggttc

SEQ ID NO: 6196411 - DNA, 19 bp, Homo sapiens
gaatgccgcgatgggtcag

SEQ ID NO: 6196412 - DNA, 16 bp, Homo sapiens
gaatgccgctgtctct

SEQ ID NO: 6196413 - DNA, 18 bp, Homo sapiens
gaatgccgctgtctctga

SEQ ID NO: 6196414 - DNA, 20 bp, Homo sapiens
gaatgccggttaaattccat

SEQ ID NO: 6196415 - DNA, 17 bp, Homo sapiens
gaatgcctaggccagct

SEQ ID NO: 6196416 - DNA, 16 bp, Homo sapiens
gaatgcctcataaatt

SEQ ID NO: 6196417 - DNA, 19 bp, Homo sapiens
gaatgcctcgctcccttca

SEQ ID NO: 6196418 - DNA, 18 bp, Homo sapiens
gaatgcctgagtgcctgg

SEQ ID NO: 6196419 - DNA, 15 bp, Homo sapiens
gaatgcctgtgccaa

SEQ ID NO: 6196420 - DNA, 20 bp, Homo sapiens
gaatgccttatttttgaatt

SEQ ID NO: 6196421 - DNA, 20 bp, Homo sapiens
gaatgccttccgggccgggc

SEQ ID NO: 6196422 - DNA, 21 bp, Homo sapiens
gaatgcgctcttcaccaggaa

SEQ ID NO: 6196423 - DNA, 17 bp, Homo sapiens
gaatgcgggggagcagg

SEQ ID NO: 6196424 - DNA, 21 bp, Homo sapiens
gaatgcgggggagcaggcagt

SEQ ID NO: 6196425 - DNA, 21 bp, Homo sapiens
gaatgctaacagttcacttgc

SEQ ID NO: 6196426 - DNA, 14 bp, Homo sapiens
gaatgctacaagta

SEQ ID NO: 6196427 - DNA, 22 bp, Homo sapiens
gaatgctagcagggcatggcac

SEQ ID NO: 6196428 - DNA, 22 bp, Homo sapiens
gaatgctcaagtttttcagaaa

SEQ ID NO: 6196429 - DNA, 16 bp, Homo sapiens
gaatgctcaatgtgct

SEQ ID NO: 6196430 - DNA, 14 bp, Homo sapiens
gaatgctcccagct

SEQ ID NO: 6196431 - DNA, 16 bp, Homo sapiens
gaatgctcccagctgt

SEQ ID NO: 6196432 - DNA, 17 bp, Homo sapiens
gaatgctctgtgccaga

SEQ ID NO: 6196433 - DNA, 13 bp, Homo sapiens
gaatgctgaaacc

SEQ ID NO: 6196434 - DNA, 21 bp, Homo sapiens
gaatgctgacaatgctgccat

SEQ ID NO: 6196435 - DNA, 21 bp, Homo sapiens
gaatgctgagacccccggagc

SEQ ID NO: 6196436 - DNA, 19 bp, Homo sapiens
gaatgctgagctgaagaaa

SEQ ID NO: 6196437 - DNA, 21 bp, Homo sapiens
gaatgctgagctgaagaaatt

SEQ ID NO: 6196438 - DNA, 13 bp, Homo sapiens
gaatgctgcccgg

SEQ ID NO: 6196439 - DNA, 14 bp, Homo sapiens
gaatgctgccttta

SEQ ID NO: 6196440 - DNA, 22 bp, Homo sapiens
gaatgctgcgcttaccttccca

SEQ ID NO: 6196441 - DNA, 17 bp, Homo sapiens
gaatgctgggactcagc

SEQ ID NO: 6196442 - DNA, 11 bp, Homo sapiens
gaatgctgggc

SEQ ID NO: 6196443 - DNA, 23 bp, Homo sapiens
gaatgctgggcccccagcctggc

SEQ ID NO: 6196444 - DNA, 22 bp, Homo sapiens
gaatgctgggcccctgctcaag

SEQ ID NO: 6196445 - DNA, 20 bp, Homo sapiens
gaatgctgggtatgctctgt

SEQ ID NO: 6196446 - DNA, 22 bp, Homo sapiens
gaatgctggttttcctaaatgc

SEQ ID NO: 6196447 - DNA, 14 bp, Homo sapiens
gaatgctgtacctt

SEQ ID NO: 6196448 - DNA, 13 bp, Homo sapiens
gaatgctgtagaa

SEQ ID NO: 6196449 - DNA, 13 bp, Homo sapiens
gaatgctgtgtta

SEQ ID NO: 6196450 - DNA, 23 bp, Homo sapiens
gaatgcttaaagaattcaaattt

SEQ ID NO: 6196451 - DNA, 18 bp, Homo sapiens
gaatgcttaaagcaaggc

SEQ ID NO: 6196452 - DNA, 18 bp, Homo sapiens
gaatgcttataggtggcc

SEQ ID NO: 6196453 - DNA, 22 bp, Homo sapiens
gaatgcttataggtggcctctc

SEQ ID NO: 6196454 - DNA, 12 bp, Homo sapiens
gaatgcttctca

SEQ ID NO: 6196455 - DNA, 21 bp, Homo sapiens
gaatgcttctgacttcataga

SEQ ID NO: 6196456 - DNA, 13 bp, Homo sapiens
gaatgcttgaaaa

SEQ ID NO: 6196457 - DNA, 14 bp, Homo sapiens
gaatgcttggaata

SEQ ID NO: 6196458 - DNA, 11 bp, Homo sapiens
gaatgctttgc

SEQ ID NO: 6196459 - DNA, 14 bp, Homo sapiens
gaatgctttgccat

SEQ ID NO: 6196460 - DNA, 19 bp, Homo sapiens
gaatggaaaaatccttgaa

SEQ ID NO: 6196461 - DNA, 16 bp, Homo sapiens
gaatggaaacttggaa

SEQ ID NO: 6196462 - DNA, 18 bp, Homo sapiens
gaatggaagcaaagtgct

SEQ ID NO: 6196463 - DNA, 14 bp, Homo sapiens
gaatggaataacta

SEQ ID NO: 6196464 - DNA, 18 bp, Homo sapiens
gaatggaatccatctgtc

SEQ ID NO: 6196465 - DNA, 15 bp, Homo sapiens
gaatggacatcctgt

SEQ ID NO: 6196466 - DNA, 19 bp, Homo sapiens
gaatggactaagatgaaat

SEQ ID NO: 6196467 - DNA, 21 bp, Homo sapiens
gaatggagcagtacatgggaa

SEQ ID NO: 6196468 - DNA, 17 bp, Homo sapiens
gaatggaggaagaacaa

SEQ ID NO: 6196469 - DNA, 19 bp, Homo sapiens
gaatggaggagccaggccc

SEQ ID NO: 6196470 - DNA, 20 bp, Homo sapiens
gaatggaggagccaggcccc

SEQ ID NO: 6196471 - DNA, 19 bp, Homo sapiens
gaatggaggcagagacctc

SEQ ID NO: 6196472 - DNA, 15 bp, Homo sapiens
gaatggagtcttttc

SEQ ID NO: 6196473 - DNA, 22 bp, Homo sapiens
gaatggataaaataatgctgca

SEQ ID NO: 6196474 - DNA, 18 bp, Homo sapiens
gaatggattaaatggcac

SEQ ID NO: 6196475 - DNA, 20 bp, Homo sapiens
gaatggattggattatttaa

SEQ ID NO: 6196476 - DNA, 21 bp, Homo sapiens
gaatggcaaagcggttgcttc

SEQ ID NO: 6196477 - DNA, 21 bp, Homo sapiens
gaatggcaatagggtagaatg

SEQ ID NO: 6196478 - DNA, 21 bp, Homo sapiens
gaatggcacgttgctgccagt

SEQ ID NO: 6196479 - DNA, 13 bp, Homo sapiens
gaatggcagctgc

SEQ ID NO: 6196480 - DNA, 16 bp, Homo sapiens
gaatggcagctgccac

SEQ ID NO: 6196481 - DNA, 23 bp, Homo sapiens
gaatggcaggggaagccttgcac

SEQ ID NO: 6196482 - DNA, 16 bp, Homo sapiens
gaatggcatggcagga

SEQ ID NO: 6196483 - DNA, 17 bp, Homo sapiens
gaatggcatggcaggag

SEQ ID NO: 6196484 - DNA, 20 bp, Homo sapiens
gaatggccacaaacctgccc

SEQ ID NO: 6196485 - DNA, 24 bp, Homo sapiens
gaatggccctagaactgtgcctag

SEQ ID NO: 6196486 - DNA, 15 bp, Homo sapiens
gaatggccctcattc

SEQ ID NO: 6196487 - DNA, 18 bp, Homo sapiens
gaatggcctcctccctta

SEQ ID NO: 6196488 - DNA, 21 bp, Homo sapiens
gaatggcctgccttgaagcca

SEQ ID NO: 6196489 - DNA, 15 bp, Homo sapiens
gaatggcctggagca

SEQ ID NO: 6196490 - DNA, 18 bp, Homo sapiens
gaatggcctggagcaggc

SEQ ID NO: 6196491 - DNA, 17 bp, Homo sapiens
gaatggctgggtcaggg

SEQ ID NO: 6196492 - DNA, 14 bp, Homo sapiens
gaatggctgtgccc

SEQ ID NO: 6196493 - DNA, 21 bp, Homo sapiens
gaatggctttgtatagaacct

SEQ ID NO: 6196494 - DNA, 19 bp, Homo sapiens
gaatggctttgtcttgaaa

SEQ ID NO: 6196495 - DNA, 21 bp, Homo sapiens
gaatggctttgtcttgaaaaa

SEQ ID NO: 6196496 - DNA, 19 bp, Homo sapiens
gaatgggaaagtatttttg

SEQ ID NO: 6196497 - DNA, 19 bp, Homo sapiens
gaatgggaagcagctcaag

SEQ ID NO: 6196498 - DNA, 14 bp, Homo sapiens
gaatgggagccaga

SEQ ID NO: 6196499 - DNA, 16 bp, Homo sapiens
gaatgggataagaagg

SEQ ID NO: 6196500 - DNA, 17 bp, Homo sapiens
gaatgggatcatgaaag

SEQ ID NO: 6196501 - DNA, 21 bp, Homo sapiens
gaatgggcaaaactgaattat

SEQ ID NO: 6196502 - DNA, 16 bp, Homo sapiens
gaatgggcatttctaa

SEQ ID NO: 6196503 - DNA, 20 bp, Homo sapiens
gaatgggccaagccagggtt

SEQ ID NO: 6196504 - DNA, 23 bp, Homo sapiens
gaatgggccaagccagggttcca

SEQ ID NO: 6196505 - DNA, 17 bp, Homo sapiens
gaatgggctgtttttgg

SEQ ID NO: 6196506 - DNA, 24 bp, Homo sapiens
gaatggggaagggagtctctcttc

SEQ ID NO: 6196507 - DNA, 18 bp, Homo sapiens
gaatggggatcacagaga

SEQ ID NO: 6196508 - DNA, 17 bp, Homo sapiens
gaatggggcttccatgg

SEQ ID NO: 6196509 - DNA, 17 bp, Homo sapiens
gaatgggggccaggctg

SEQ ID NO: 6196510 - DNA, 22 bp, Homo sapiens
gaatgggggctttcggggaggg

SEQ ID NO: 6196511 - DNA, 19 bp, Homo sapiens
gaatggggggcgggccagg

SEQ ID NO: 6196512 - DNA, 20 bp, Homo sapiens
gaatggggggcgggccaggg

SEQ ID NO: 6196513 - DNA, 23 bp, Homo sapiens
gaatggggggcgggccagggtgg

SEQ ID NO: 6196514 - DNA, 18 bp, Homo sapiens
gaatggggttcctgctgt

SEQ ID NO: 6196515 - DNA, 19 bp, Homo sapiens
gaatgggtctgcacagatt

SEQ ID NO: 6196516 - DNA, 16 bp, Homo sapiens
gaatgggtgcccacag

SEQ ID NO: 6196517 - DNA, 17 bp, Homo sapiens
gaatgggttttctattt

SEQ ID NO: 6196518 - DNA, 21 bp, Homo sapiens
cttcccagcaacactccggtc

SEQ ID NO: 6196519 - DNA, 20 bp, Homo sapiens
cttcccagccatgcccagga

SEQ ID NO: 6196520 - DNA, 14 bp, Homo sapiens
cttcccagccctca

SEQ ID NO: 6196521 - DNA, 18 bp, Homo sapiens
cttcccagccctcatccc

SEQ ID NO: 6196522 - DNA, 14 bp, Homo sapiens
cttcccagctctcc

SEQ ID NO: 6196523 - DNA, 15 bp, Homo sapiens
cttcccagctctccc

SEQ ID NO: 6196524 - DNA, 20 bp, Homo sapiens
cttcccagctctccctctgg

SEQ ID NO: 6196525 - DNA, 15 bp, Homo sapiens
cttcccagctctgac

SEQ ID NO: 6196526 - DNA, 15 bp, Homo sapiens
cttcccagctgcccc

SEQ ID NO: 6196527 - DNA, 16 bp, Homo sapiens
cttcccagctggcagc

SEQ ID NO: 6196528 - DNA, 21 bp, Homo sapiens
cttcccagctggcagcgcctc

SEQ ID NO: 6196529 - DNA, 14 bp, Homo sapiens
cttcccaggacccc

SEQ ID NO: 6196530 - DNA, 17 bp, Homo sapiens
cttcccaggaccctggg

SEQ ID NO: 6196531 - DNA, 19 bp, Homo sapiens
cttcccaggaccctgggtc

SEQ ID NO: 6196532 - DNA, 12 bp, Homo sapiens
cttcccaggatc

SEQ ID NO: 6196533 - DNA, 12 bp, Homo sapiens
cttcccaggcca

SEQ ID NO: 6196534 - DNA, 18 bp, Homo sapiens
cttcccaggccagcgagg

SEQ ID NO: 6196535 - DNA, 16 bp, Homo sapiens
cttcccaggccctttg

SEQ ID NO: 6196536 - DNA, 19 bp, Homo sapiens
cttcccaggccctttggct

SEQ ID NO: 6196537 - DNA, 13 bp, Homo sapiens
cttcccaggcctt

SEQ ID NO: 6196538 - DNA, 14 bp, Homo sapiens
cttcccaggccttt

SEQ ID NO: 6196539 - DNA, 16 bp, Homo sapiens
cttcccaggcctttgg

SEQ ID NO: 6196540 - DNA, 10 bp, Homo sapiens
cttcccaggg

SEQ ID NO: 6196541 - DNA, 12 bp, Homo sapiens
cttcccagggac

SEQ ID NO: 6196542 - DNA, 21 bp, Homo sapiens
cttcccagggcacccaggcag

SEQ ID NO: 6196543 - DNA, 21 bp, Homo sapiens
cttcccagggtagcccgcctg

SEQ ID NO: 6196544 - DNA, 16 bp, Homo sapiens
cttcccagtgggctgt

SEQ ID NO: 6196545 - DNA, 23 bp, Homo sapiens
cttcccataaaatgtaagaaaag

SEQ ID NO: 6196546 - DNA, 16 bp, Homo sapiens
cttcccatagtggggc

SEQ ID NO: 6196547 - DNA, 17 bp, Homo sapiens
cttcccatagtggggcc

SEQ ID NO: 6196548 - DNA, 18 bp, Homo sapiens
cttcccatcactggagca

SEQ ID NO: 6196549 - DNA, 15 bp, Homo sapiens
cttcccatccccagc

SEQ ID NO: 6196550 - DNA, 16 bp, Homo sapiens
cttcccatcctaccct

SEQ ID NO: 6196551 - DNA, 15 bp, Homo sapiens
cttcccatcgctgtc

SEQ ID NO: 6196552 - DNA, 12 bp, Homo sapiens
cttcccatctcc

SEQ ID NO: 6196553 - DNA, 17 bp, Homo sapiens
cttcccatctccaggga

SEQ ID NO: 6196554 - DNA, 15 bp, Homo sapiens
cttcccatctgaaga

SEQ ID NO: 6196555 - DNA, 19 bp, Homo sapiens
cttcccatctgtggttttc

SEQ ID NO: 6196556 - DNA, 19 bp, Homo sapiens
cttcccatgacccaggctg

SEQ ID NO: 6196557 - DNA, 21 bp, Homo sapiens
cttcccatgacccaggctggg

SEQ ID NO: 6196558 - DNA, 17 bp, Homo sapiens
cttcccatgactgcacc

SEQ ID NO: 6196559 - DNA, 13 bp, Homo sapiens
cttcccatgcatt

SEQ ID NO: 6196560 - DNA, 14 bp, Homo sapiens
cttcccatgccggt

SEQ ID NO: 6196561 - DNA, 22 bp, Homo sapiens
cttcccatgccggtacacagcc

SEQ ID NO: 6196562 - DNA, 24 bp, Homo sapiens
cttcccatgccggtacacagccag

SEQ ID NO: 6196563 - DNA, 14 bp, Homo sapiens
cttcccatgcctgt

SEQ ID NO: 6196564 - DNA, 20 bp, Homo sapiens
cttcccatggccatttctgt

SEQ ID NO: 6196565 - DNA, 14 bp, Homo sapiens
cttcccattaaaaa

SEQ ID NO: 6196566 - DNA, 14 bp, Homo sapiens
cttcccattctcca

SEQ ID NO: 6196567 - DNA, 16 bp, Homo sapiens
cttcccattggctttc

SEQ ID NO: 6196568 - DNA, 18 bp, Homo sapiens
cttcccattgtggctcct

SEQ ID NO: 6196569 - DNA, 15 bp, Homo sapiens
cttcccatttcttcc

SEQ ID NO: 6196570 - DNA, 20 bp, Homo sapiens
cttcccatttcttcccactt

SEQ ID NO: 6196571 - DNA, 13 bp, Homo sapiens
cttcccatttgta

SEQ ID NO: 6196572 - DNA, 20 bp, Homo sapiens
cttccccaacttccctagtc

SEQ ID NO: 6196573 - DNA, 19 bp, Homo sapiens
cttccccaagcctggcagg

SEQ ID NO: 6196574 - DNA, 11 bp, Homo sapiens
cttccccaccc

SEQ ID NO: 6196575 - DNA, 23 bp, Homo sapiens
cttccccacccaccaaccctcag

SEQ ID NO: 6196576 - DNA, 21 bp, Homo sapiens
cttccccaccctggaggctct

SEQ ID NO: 6196577 - DNA, 15 bp, Homo sapiens
cttccccaccttccc

SEQ ID NO: 6196578 - DNA, 11 bp, Homo sapiens
cttccccactc

SEQ ID NO: 6196579 - DNA, 12 bp, Homo sapiens
cttccccactcc

SEQ ID NO: 6196580 - DNA, 18 bp, Homo sapiens
cttccccactgcacacac

SEQ ID NO: 6196581 - DNA, 16 bp, Homo sapiens
cttccccactgcctgc

SEQ ID NO: 6196582 - DNA, 19 bp, Homo sapiens
cttccccagaaaggagact

SEQ ID NO: 6196583 - DNA, 13 bp, Homo sapiens
cttccccagaccc

SEQ ID NO: 6196584 - DNA, 16 bp, Homo sapiens
cttccccagacccaga

SEQ ID NO: 6196585 - DNA, 23 bp, Homo sapiens
cttccccagactcagctccagaa

SEQ ID NO: 6196586 - DNA, 22 bp, Homo sapiens
cttccccagacttctctttctt

SEQ ID NO: 6196587 - DNA, 21 bp, Homo sapiens
cttccccagacttgcactggg

SEQ ID NO: 6196588 - DNA, 12 bp, Homo sapiens
cttccccagaga

SEQ ID NO: 6196589 - DNA, 14 bp, Homo sapiens
cttccccagccctt

SEQ ID NO: 6196590 - DNA, 12 bp, Homo sapiens
cttccccagctc

SEQ ID NO: 6196591 - DNA, 15 bp, Homo sapiens
cttccccagctcccc

SEQ ID NO: 6196592 - DNA, 21 bp, Homo sapiens
cttccccagctcccccaggca

SEQ ID NO: 6196593 - DNA, 22 bp, Homo sapiens
cttccccagctcccccaggcag

SEQ ID NO: 6196594 - DNA, 23 bp, Homo sapiens
cttccccagctcccccaggcaga

SEQ ID NO: 6196595 - DNA, 17 bp, Homo sapiens
cttccccagctctcagt

SEQ ID NO: 6196596 - DNA, 16 bp, Homo sapiens
cttccccaggagctct

SEQ ID NO: 6196597 - DNA, 23 bp, Homo sapiens
cttccccaggatggactcttctc

SEQ ID NO: 6196598 - DNA, 16 bp, Homo sapiens
cttccccaggcccacc

SEQ ID NO: 6196599 - DNA, 18 bp, Homo sapiens
cttccccaggctgcccac

SEQ ID NO: 6196600 - DNA, 21 bp, Homo sapiens
cttccccagggtgtctctatg

SEQ ID NO: 6196601 - DNA, 22 bp, Homo sapiens
cttccccagggttctgtattgc

SEQ ID NO: 6196602 - DNA, 17 bp, Homo sapiens
cttccccatcagctccc

SEQ ID NO: 6196603 - DNA, 19 bp, Homo sapiens
cttccccatcagctcccaa

SEQ ID NO: 6196604 - DNA, 13 bp, Homo sapiens
cttccccatctcc

SEQ ID NO: 6196605 - DNA, 18 bp, Homo sapiens
cttccccatctccatttc

SEQ ID NO: 6196606 - DNA, 20 bp, Homo sapiens
cttccccatctccatttcac

SEQ ID NO: 6196607 - DNA, 18 bp, Homo sapiens
cttccccatgaaccctgc

SEQ ID NO: 6196608 - DNA, 13 bp, Homo sapiens
cttccccatgctc

SEQ ID NO: 6196609 - DNA, 19 bp, Homo sapiens
cttccccatggccctgagc

SEQ ID NO: 6196610 - DNA, 12 bp, Homo sapiens
cttcccccaagg

SEQ ID NO: 6196611 - DNA, 16 bp, Homo sapiens
cttcccccaccaccaa

SEQ ID NO: 6196612 - DNA, 18 bp, Homo sapiens
cttcccccaccccagaag

SEQ ID NO: 6196613 - DNA, 19 bp, Homo sapiens
cttcccccacccctccacg

SEQ ID NO: 6196614 - DNA, 18 bp, Homo sapiens
cttcccccagctttccat

SEQ ID NO: 6196615 - DNA, 15 bp, Homo sapiens
cttcccccatagcca

SEQ ID NO: 6196616 - DNA, 21 bp, Homo sapiens
cttcccccatcccctttcctc

SEQ ID NO: 6196617 - DNA, 16 bp, Homo sapiens
cttcccccatccctac

SEQ ID NO: 6196618 - DNA, 20 bp, Homo sapiens
cttccccccaaaacccggga

SEQ ID NO: 6196619 - DNA, 18 bp, Homo sapiens
cttcccccctctcctccc

SEQ ID NO: 6196620 - DNA, 20 bp, Homo sapiens
cttcccccctctcctcccag

SEQ ID NO: 6196621 - DNA, 22 bp, Homo sapiens
cttcccccctctcctcccagct

SEQ ID NO: 6196622 - DNA, 20 bp, Homo sapiens
cttcccccgcaatgtgcccc

SEQ ID NO: 6196623 - DNA, 17 bp, Homo sapiens
cttcccccgctaattca

SEQ ID NO: 6196624 - DNA, 17 bp, Homo sapiens
cttccccctctcccagt

SEQ ID NO: 6196625 - DNA, 12 bp, Homo sapiens
cttcccccttcc

SEQ ID NO: 6196626 - DNA, 13 bp, Homo sapiens
cttcccccttccc

SEQ ID NO: 6196627 - DNA, 14 bp, Homo sapiens
cttcccccttcccc

SEQ ID NO: 6196628 - DNA, 15 bp, Homo sapiens
cttcccccttcccct

SEQ ID NO: 6196629 - DNA, 18 bp, Homo sapiens
cttcccccttcctttggt

SEQ ID NO: 6196630 - DNA, 19 bp, Homo sapiens
cttccccctttctctgcct

SEQ ID NO: 6196631 - DNA, 21 bp, Homo sapiens
cttccccctttctctgcctgg

SEQ ID NO: 6196632 - DNA, 22 bp, Homo sapiens
cttccccctttctctgcctggc

SEQ ID NO: 6196633 - DNA, 19 bp, Homo sapiens
cttccccgagtgactctgg

SEQ ID NO: 6196634 - DNA, 20 bp, Homo sapiens
cttccccgctcttgccctgc

SEQ ID NO: 6196635 - DNA, 18 bp, Homo sapiens
cttccccgtcccctgcag

SEQ ID NO: 6196636 - DNA, 19 bp, Homo sapiens
cttccccgtcccctgcagc

SEQ ID NO: 6196637 - DNA, 22 bp, Homo sapiens
cttccccgtcccctgcagcctg

SEQ ID NO: 6196638 - DNA, 16 bp, Homo sapiens
cttccccgtgcatgat

SEQ ID NO: 6196639 - DNA, 16 bp, Homo sapiens
cttccccgtgcggccc

SEQ ID NO: 6196640 - DNA, 18 bp, Homo sapiens
cttccccgtgcggcccgt

SEQ ID NO: 6196641 - DNA, 13 bp, Homo sapiens
cttcccctcccag

SEQ ID NO: 6196642 - DNA, 19 bp, Homo sapiens
cttcccctcccccactcct

SEQ ID NO: 6196643 - DNA, 22 bp, Homo sapiens
cttcccctcccccactcctcta

SEQ ID NO: 6196644 - DNA, 21 bp, Homo sapiens
cttcccctccccgctcctaat

SEQ ID NO: 6196645 - DNA, 18 bp, Homo sapiens
cttcccctcccctccttg

SEQ ID NO: 6196646 - DNA, 21 bp, Homo sapiens
cttcccctcccgacagcccat

SEQ ID NO: 6196647 - DNA, 15 bp, Homo sapiens
cttcccctccctacc

SEQ ID NO: 6196648 - DNA, 21 bp, Homo sapiens
cttcccctccctaccctcgga

SEQ ID NO: 6196649 - DNA, 13 bp, Homo sapiens
cttcccctcctac

SEQ ID NO: 6196650 - DNA, 22 bp, Homo sapiens
cttcccctcctacccctcccag

SEQ ID NO: 6196651 - DNA, 17 bp, Homo sapiens
cttcccctcgctgtcct

SEQ ID NO: 6196652 - DNA, 21 bp, Homo sapiens
cttcccctcgctgtcctgctg

SEQ ID NO: 6196653 - DNA, 23 bp, Homo sapiens
cttcccctgagagtttcctcaga

SEQ ID NO: 6196654 - DNA, 20 bp, Homo sapiens
cttcccctgaggacctttct

SEQ ID NO: 6196655 - DNA, 18 bp, Homo sapiens
cttcccctgcacctggcc

SEQ ID NO: 6196656 - DNA, 22 bp, Homo sapiens
cttcccctgcctcctactccag

SEQ ID NO: 6196657 - DNA, 21 bp, Homo sapiens
cttcccctgcgccctccctcc

SEQ ID NO: 6196658 - DNA, 22 bp, Homo sapiens
cttcccctgcgccctccctccc

SEQ ID NO: 6196659 - DNA, 11 bp, Homo sapiens
cttcccctggg

SEQ ID NO: 6196660 - DNA, 23 bp, Homo sapiens
cttcccctgggaactctcctggc

SEQ ID NO: 6196661 - DNA, 20 bp, Homo sapiens
cttcccctgggatgctgacc

SEQ ID NO: 6196662 - DNA, 21 bp, Homo sapiens
cttcccctgggatgctgaccc

SEQ ID NO: 6196663 - DNA, 15 bp, Homo sapiens
cttccccttagaaac

SEQ ID NO: 6196664 - DNA, 20 bp, Homo sapiens
cttccccttatcctccctgt

SEQ ID NO: 6196665 - DNA, 14 bp, Homo sapiens
cttccccttcagac

SEQ ID NO: 6196666 - DNA, 15 bp, Homo sapiens
cttccccttccaact

SEQ ID NO: 6196667 - DNA, 17 bp, Homo sapiens
cttccccttccccgtcc

SEQ ID NO: 6196668 - DNA, 18 bp, Homo sapiens
cttccccttccccgtccc

SEQ ID NO: 6196669 - DNA, 15 bp, Homo sapiens
cttccccttccctta

SEQ ID NO: 6196670 - DNA, 13 bp, Homo sapiens
cttccccttcctg

SEQ ID NO: 6196671 - DNA, 14 bp, Homo sapiens
cttccccttccttc

SEQ ID NO: 6196672 - DNA, 17 bp, Homo sapiens
cttccccttcttgccat

SEQ ID NO: 6196673 - DNA, 17 bp, Homo sapiens
cttccccttgaacctca

SEQ ID NO: 6196674 - DNA, 23 bp, Homo sapiens
cttccccttgcccttgccctgac

SEQ ID NO: 6196675 - DNA, 16 bp, Homo sapiens
cttccccttggcctct

SEQ ID NO: 6196676 - DNA, 22 bp, Homo sapiens
cttccccttgggatgggcacag

SEQ ID NO: 6196677 - DNA, 22 bp, Homo sapiens
cttccccttgtccctggggcac

SEQ ID NO: 6196678 - DNA, 13 bp, Homo sapiens
cttcccctttccc

SEQ ID NO: 6196679 - DNA, 13 bp, Homo sapiens
cttcccctttcct

SEQ ID NO: 6196680 - DNA, 18 bp, Homo sapiens
cttccccttttgcctggc

SEQ ID NO: 6196681 - DNA, 20 bp, Homo sapiens
cttccccttttgcctggctg

SEQ ID NO: 6196682 - DNA, 21 bp, Homo sapiens
cttccccttttgcctggctgt

SEQ ID NO: 6196683 - DNA, 19 bp, Homo sapiens
cttcccgacccagccagct

SEQ ID NO: 6196684 - DNA, 22 bp, Homo sapiens
cttcccgacccagccagctgca

SEQ ID NO: 6196685 - DNA, 19 bp, Homo sapiens
cttcccgagcgctggtccc

SEQ ID NO: 6196686 - DNA, 14 bp, Homo sapiens
cttcccgcagcacc

SEQ ID NO: 6196687 - DNA, 15 bp, Homo sapiens
cttcccgcagcacca

SEQ ID NO: 6196688 - DNA, 20 bp, Homo sapiens
cttcccgcagcaccagcctg

SEQ ID NO: 6196689 - DNA, 19 bp, Homo sapiens
cttcccgccccacctccca

SEQ ID NO: 6196690 - DNA, 14 bp, Homo sapiens
cttcccgccctcgg

SEQ ID NO: 6196691 - DNA, 21 bp, Homo sapiens
cttcccgccggaggccagcta

SEQ ID NO: 6196692 - DNA, 17 bp, Homo sapiens
cttcccgcctcagcctc

SEQ ID NO: 6196693 - DNA, 22 bp, Homo sapiens
cttcccgccttcaggttcctcc

SEQ ID NO: 6196694 - DNA, 23 bp, Homo sapiens
cttcccgccttcaggttcctcct

SEQ ID NO: 6196695 - DNA, 15 bp, Homo sapiens
cttcccgccttccaa

SEQ ID NO: 6196696 - DNA, 17 bp, Homo sapiens
gaatggtaaccgagcca

SEQ ID NO: 6196697 - DNA, 18 bp, Homo sapiens
gaatggtaaccgagccag

SEQ ID NO: 6196698 - DNA, 18 bp, Homo sapiens
gaatggtagtctaaccaa

SEQ ID NO: 6196699 - DNA, 20 bp, Homo sapiens
gaatggtagtctaaccaaat

SEQ ID NO: 6196700 - DNA, 23 bp, Homo sapiens
gaatggtcagcgttgcatgtcgt

SEQ ID NO: 6196701 - DNA, 15 bp, Homo sapiens
gaatggtcagttgta

SEQ ID NO: 6196702 - DNA, 15 bp, Homo sapiens
gaatggtccagggtt

SEQ ID NO: 6196703 - DNA, 14 bp, Homo sapiens
gaatggtgatttta

SEQ ID NO: 6196704 - DNA, 16 bp, Homo sapiens
gaatggtgattttaaa

SEQ ID NO: 6196705 - DNA, 17 bp, Homo sapiens
gaatggtgcaatgaatt

SEQ ID NO: 6196706 - DNA, 14 bp, Homo sapiens
gaatggtgcagaaa

SEQ ID NO: 6196707 - DNA, 18 bp, Homo sapiens
gaatggtgggctccagag

SEQ ID NO: 6196708 - DNA, 21 bp, Homo sapiens
gaatggtgtgggagagggatg

SEQ ID NO: 6196709 - DNA, 22 bp, Homo sapiens
gaatggtgttttgtcagacttc

SEQ ID NO: 6196710 - DNA, 20 bp, Homo sapiens
gaatggttccatgcctgagg

SEQ ID NO: 6196711 - DNA, 21 bp, Homo sapiens
gaatggtttttcttttcttta

SEQ ID NO: 6196712 - DNA, 16 bp, Homo sapiens
gaatgtaaaagaaaat

SEQ ID NO: 6196713 - DNA, 18 bp, Homo sapiens
gaatgtaaagttacactg

SEQ ID NO: 6196714 - DNA, 19 bp, Homo sapiens
gaatgtaaagttatgtatt

SEQ ID NO: 6196715 - DNA, 14 bp, Homo sapiens
gaatgtaaatttgt

SEQ ID NO: 6196716 - DNA, 12 bp, Homo sapiens
gaatgtaaccaa

SEQ ID NO: 6196717 - DNA, 18 bp, Homo sapiens
gaatgtaactgctgaaaa

SEQ ID NO: 6196718 - DNA, 22 bp, Homo sapiens
gaatgtaaggtatatcattcta

SEQ ID NO: 6196719 - DNA, 13 bp, Homo sapiens
gaatgtaatcaat

SEQ ID NO: 6196720 - DNA, 16 bp, Homo sapiens
gaatgtaatcaatgtt

SEQ ID NO: 6196721 - DNA, 18 bp, Homo sapiens
gaatgtaatcaatgtttc

SEQ ID NO: 6196722 - DNA, 19 bp, Homo sapiens
gaatgtaatcaatgtttct

SEQ ID NO: 6196723 - DNA, 15 bp, Homo sapiens
gaatgtaattggaat

SEQ ID NO: 6196724 - DNA, 16 bp, Homo sapiens
gaatgtaattggaatc

SEQ ID NO: 6196725 - DNA, 13 bp, Homo sapiens
gaatgtacaaaga

SEQ ID NO: 6196726 - DNA, 18 bp, Homo sapiens
gaatgtaccttatttaaa

SEQ ID NO: 6196727 - DNA, 18 bp, Homo sapiens
gaatgtagcatctgagaa

SEQ ID NO: 6196728 - DNA, 16 bp, Homo sapiens
gaatgtagccagccca

SEQ ID NO: 6196729 - DNA, 20 bp, Homo sapiens
gaatgtagctggtttcctca

SEQ ID NO: 6196730 - DNA, 17 bp, Homo sapiens
gaatgtatagtatttga

SEQ ID NO: 6196731 - DNA, 19 bp, Homo sapiens
gaatgtatagtatttgaaa

SEQ ID NO: 6196732 - DNA, 22 bp, Homo sapiens
gaatgtatagtatttgaaaaca

SEQ ID NO: 6196733 - DNA, 17 bp, Homo sapiens
gaatgtatatcagggtt

SEQ ID NO: 6196734 - DNA, 21 bp, Homo sapiens
gaatgtatatgttttgtggga

SEQ ID NO: 6196735 - DNA, 19 bp, Homo sapiens
gaatgtatctagtggtctg

SEQ ID NO: 6196736 - DNA, 16 bp, Homo sapiens
gaatgtatctgtgaag

SEQ ID NO: 6196737 - DNA, 16 bp, Homo sapiens
gaatgtatgcttcata

SEQ ID NO: 6196738 - DNA, 11 bp, Homo sapiens
gaatgtatgta

SEQ ID NO: 6196739 - DNA, 17 bp, Homo sapiens
gaatgtatgtaatgtgt

SEQ ID NO: 6196740 - DNA, 16 bp, Homo sapiens
gaatgtattattctgc

SEQ ID NO: 6196741 - DNA, 18 bp, Homo sapiens
gaatgtattattctgcag

SEQ ID NO: 6196742 - DNA, 19 bp, Homo sapiens
gaatgtattattctgcagc

SEQ ID NO: 6196743 - DNA, 13 bp, Homo sapiens
gaatgtattctgt

SEQ ID NO: 6196744 - DNA, 19 bp, Homo sapiens
gaatgtattcttttatata

SEQ ID NO: 6196745 - DNA, 13 bp, Homo sapiens
gaatgtattgtac

SEQ ID NO: 6196746 - DNA, 14 bp, Homo sapiens
gaatgtattgtacc

SEQ ID NO: 6196747 - DNA, 15 bp, Homo sapiens
gaatgtattgtacct

SEQ ID NO: 6196748 - DNA, 21 bp, Homo sapiens
gaatgtattgtaccttttaac

SEQ ID NO: 6196749 - DNA, 17 bp, Homo sapiens
gaatgtattgttctgtt

SEQ ID NO: 6196750 - DNA, 20 bp, Homo sapiens
gaatgtattgttctgtttgt

SEQ ID NO: 6196751 - DNA, 14 bp, Homo sapiens
gaatgtatttatgt

SEQ ID NO: 6196752 - DNA, 23 bp, Homo sapiens
gaatgtatttatttgggagaccg

SEQ ID NO: 6196753 - DNA, 12 bp, Homo sapiens
gaatgtatttcc

SEQ ID NO: 6196754 - DNA, 14 bp, Homo sapiens
gaatgtattttaac

SEQ ID NO: 6196755 - DNA, 22 bp, Homo sapiens
gaatgtattttcatagatgtgt

SEQ ID NO: 6196756 - DNA, 12 bp, Homo sapiens
gaatgtattttg

SEQ ID NO: 6196757 - DNA, 22 bp, Homo sapiens
gaatgtcaaacagtgccaaatg

SEQ ID NO: 6196758 - DNA, 17 bp, Homo sapiens
gaatgtcaagaaaagga

SEQ ID NO: 6196759 - DNA, 15 bp, Homo sapiens
gaatgtcaatatttg

SEQ ID NO: 6196760 - DNA, 20 bp, Homo sapiens
gaatgtcacatttgaattct

SEQ ID NO: 6196761 - DNA, 17 bp, Homo sapiens
gaatgtcaccagtcctg

SEQ ID NO: 6196762 - DNA, 15 bp, Homo sapiens
gaatgtcacttctgg

SEQ ID NO: 6196763 - DNA, 23 bp, Homo sapiens
gaatgtcagggccaggtgcagac

SEQ ID NO: 6196764 - DNA, 13 bp, Homo sapiens
gaatgtcagtgtt

SEQ ID NO: 6196765 - DNA, 17 bp, Homo sapiens
gaatgtcagttgttatt

SEQ ID NO: 6196766 - DNA, 21 bp, Homo sapiens
gaatgtcagttgttatttatt

SEQ ID NO: 6196767 - DNA, 22 bp, Homo sapiens
gaatgtcatagtcttgaaatga

SEQ ID NO: 6196768 - DNA, 16 bp, Homo sapiens
gaatgtcattatttga

SEQ ID NO: 6196769 - DNA, 20 bp, Homo sapiens
gaatgtccaaaatttatatt

SEQ ID NO: 6196770 - DNA, 13 bp, Homo sapiens
gaatgtcccagag

SEQ ID NO: 6196771 - DNA, 14 bp, Homo sapiens
gaatgtcccagagg

SEQ ID NO: 6196772 - DNA, 17 bp, Homo sapiens
gaatgtccccattctat

SEQ ID NO: 6196773 - DNA, 19 bp, Homo sapiens
gaatgtccccattctataa

SEQ ID NO: 6196774 - DNA, 16 bp, Homo sapiens
gaatgtcctgtagaga

SEQ ID NO: 6196775 - DNA, 15 bp, Homo sapiens
gaatgtccttattct

SEQ ID NO: 6196776 - DNA, 12 bp, Homo sapiens
gaatgtctcagc

SEQ ID NO: 6196777 - DNA, 21 bp, Homo sapiens
gaatgtctgaagtacaaacat

SEQ ID NO: 6196778 - DNA, 12 bp, Homo sapiens
gaatgtctggag

SEQ ID NO: 6196779 - DNA, 15 bp, Homo sapiens
gaatgtcttggtgtt

SEQ ID NO: 6196780 - DNA, 19 bp, Homo sapiens
gaatgtcttgttcctgtgc

SEQ ID NO: 6196781 - DNA, 20 bp, Homo sapiens
gaatgtcttgttcctgtgca

SEQ ID NO: 6196782 - DNA, 22 bp, Homo sapiens
gaatgtctttgttggaaaagaa

SEQ ID NO: 6196783 - DNA, 12 bp, Homo sapiens
gaatgtgaaaaa

SEQ ID NO: 6196784 - DNA, 12 bp, Homo sapiens
gaatgtgaaaca

SEQ ID NO: 6196785 - DNA, 15 bp, Homo sapiens
gaatgtgaaatttaa

SEQ ID NO: 6196786 - DNA, 16 bp, Homo sapiens
gaatgtgaaatttaaa

SEQ ID NO: 6196787 - DNA, 19 bp, Homo sapiens
gaatgtgatcatctttgct

SEQ ID NO: 6196788 - DNA, 14 bp, Homo sapiens
gaatgtgattttaa

SEQ ID NO: 6196789 - DNA, 19 bp, Homo sapiens
gaatgtgattttaaagagt

SEQ ID NO: 6196790 - DNA, 23 bp, Homo sapiens
gaatgtgcaaagcagtatgtaca

SEQ ID NO: 6196791 - DNA, 13 bp, Homo sapiens
gaatgtgcatttc

SEQ ID NO: 6196792 - DNA, 18 bp, Homo sapiens
gaatgtgccacagaggcc

SEQ ID NO: 6196793 - DNA, 17 bp, Homo sapiens
gaatgtgccacctgtcc

SEQ ID NO: 6196794 - DNA, 15 bp, Homo sapiens
gaatgtgccatgtat

SEQ ID NO: 6196795 - DNA, 16 bp, Homo sapiens
gaatgtgcccctggcc

SEQ ID NO: 6196796 - DNA, 18 bp, Homo sapiens
gaatgtgctagagttaaa

SEQ ID NO: 6196797 - DNA, 22 bp, Homo sapiens
gaatgtgctagagttaaaagtt

SEQ ID NO: 6196798 - DNA, 12 bp, Homo sapiens
gaatgtgctggt

SEQ ID NO: 6196799 - DNA, 18 bp, Homo sapiens
gaatgtgctggtgaacac

SEQ ID NO: 6196800 - DNA, 18 bp, Homo sapiens
gaatgtggataaaactgt

SEQ ID NO: 6196801 - DNA, 20 bp, Homo sapiens
gaatgtgggcactggcccag

SEQ ID NO: 6196802 - DNA, 21 bp, Homo sapiens
gaatgtgggcactggcccagg

SEQ ID NO: 6196803 - DNA, 20 bp, Homo sapiens
gaatgtggtaagtggaggaa

SEQ ID NO: 6196804 - DNA, 14 bp, Homo sapiens
gaatgtggtctcag

SEQ ID NO: 6196805 - DNA, 17 bp, Homo sapiens
gaatgtggtctcaggat

SEQ ID NO: 6196806 - DNA, 22 bp, Homo sapiens
gaatgtggttacttcctactgt

SEQ ID NO: 6196807 - DNA, 12 bp, Homo sapiens
gaatgtgtagga

SEQ ID NO: 6196808 - DNA, 23 bp, Homo sapiens
gaatgtgtcctcctgctctgctt

SEQ ID NO: 6196809 - DNA, 12 bp, Homo sapiens
gaatgtgtcttt

SEQ ID NO: 6196810 - DNA, 15 bp, Homo sapiens
gaatgtgtctttaga

SEQ ID NO: 6196811 - DNA, 17 bp, Homo sapiens
gaatgtgtgccttgttc

SEQ ID NO: 6196812 - DNA, 14 bp, Homo sapiens
gaatgtgtgtgcag

SEQ ID NO: 6196813 - DNA, 21 bp, Homo sapiens
gaatgtgtgtgtgtggcaggg

SEQ ID NO: 6196814 - DNA, 23 bp, Homo sapiens
gaatgtgtgtgtgtggcaggggg

SEQ ID NO: 6196815 - DNA, 16 bp, Homo sapiens
gaatgtgttcttttct

SEQ ID NO: 6196816 - DNA, 18 bp, Homo sapiens
gaatgtgtttcaaactgt

SEQ ID NO: 6196817 - DNA, 14 bp, Homo sapiens
gaatgtgtttcaca

SEQ ID NO: 6196818 - DNA, 20 bp, Homo sapiens
gaatgtgtttcacagtttga

SEQ ID NO: 6196819 - DNA, 22 bp, Homo sapiens
gaatgtgtttcacagtttgaaa

SEQ ID NO: 6196820 - DNA, 13 bp, Homo sapiens
gaatgttaaataa

SEQ ID NO: 6196821 - DNA, 16 bp, Homo sapiens
gaatgttaaataaatt

SEQ ID NO: 6196822 - DNA, 16 bp, Homo sapiens
gaatgttaagaataac

SEQ ID NO: 6196823 - DNA, 20 bp, Homo sapiens
gaatgttaagacttgacagt

SEQ ID NO: 6196824 - DNA, 15 bp, Homo sapiens
gaatgttaagcagat

SEQ ID NO: 6196825 - DNA, 23 bp, Homo sapiens
gaatgttaattttttggtacaaa

SEQ ID NO: 6196826 - DNA, 16 bp, Homo sapiens
gaatgttactaaattt

SEQ ID NO: 6196827 - DNA, 16 bp, Homo sapiens
gaatgttactgcctta

SEQ ID NO: 6196828 - DNA, 15 bp, Homo sapiens
gaatgttccctgcac

SEQ ID NO: 6196829 - DNA, 20 bp, Homo sapiens
gaatgttccctgcaccctgg

SEQ ID NO: 6196830 - DNA, 19 bp, Homo sapiens
gaatgttcttgaattatat

SEQ ID NO: 6196831 - DNA, 14 bp, Homo sapiens
gaatgttctttctg

SEQ ID NO: 6196832 - DNA, 18 bp, Homo sapiens
gaatgttctttctgctct

SEQ ID NO: 6196833 - DNA, 19 bp, Homo sapiens
gaatgttctttctgctcta

SEQ ID NO: 6196834 - DNA, 16 bp, Homo sapiens
gaatgttgaaaagtaa

SEQ ID NO: 6196835 - DNA, 13 bp, Homo sapiens
gaatgttgcatga

SEQ ID NO: 6196836 - DNA, 20 bp, Homo sapiens
gaatgttggtttactttcaa

SEQ ID NO: 6196837 - DNA, 13 bp, Homo sapiens
gaatgttgttaaa

SEQ ID NO: 6196838 - DNA, 17 bp, Homo sapiens
gaatgttgttaaatgct

SEQ ID NO: 6196839 - DNA, 21 bp, Homo sapiens
gaatgtttacactctttgtaa

SEQ ID NO: 6196840 - DNA, 16 bp, Homo sapiens
gaatgtttatagcaaa

SEQ ID NO: 6196841 - DNA, 15 bp, Homo sapiens
gaatgtttcatttgc

SEQ ID NO: 6196842 - DNA, 22 bp, Homo sapiens
gaatgtttcatttgcacaagta

SEQ ID NO: 6196843 - DNA, 15 bp, Homo sapiens
gaatgtttcctgtgg

SEQ ID NO: 6196844 - DNA, 16 bp, Homo sapiens
gaatgtttcctgtgga

SEQ ID NO: 6196845 - DNA, 13 bp, Homo sapiens
gaatgtttctatt

SEQ ID NO: 6196846 - DNA, 15 bp, Homo sapiens
gaatgtttcttaact

SEQ ID NO: 6196847 - DNA, 16 bp, Homo sapiens
gaatgtttgaactgcc

SEQ ID NO: 6196848 - DNA, 20 bp, Homo sapiens
gaatgtttgaactgccaaga

SEQ ID NO: 6196849 - DNA, 15 bp, Homo sapiens
gaatgtttgcctctg

SEQ ID NO: 6196850 - DNA, 17 bp, Homo sapiens
gaatgtttgcctctgcc

SEQ ID NO: 6196851 - DNA, 21 bp, Homo sapiens
gaatgtttggcaacctttgtg

SEQ ID NO: 6196852 - DNA, 13 bp, Homo sapiens
gaatgtttgtgtc

SEQ ID NO: 6196853 - DNA, 20 bp, Homo sapiens
gaatgtttgtgtctgtggtt

SEQ ID NO: 6196854 - DNA, 17 bp, Homo sapiens
gaatgttttagcacagc

SEQ ID NO: 6196855 - DNA, 17 bp, Homo sapiens
gaatgttttatttatca

SEQ ID NO: 6196856 - DNA, 19 bp, Homo sapiens
gaatgttttatttatcaaa

SEQ ID NO: 6196857 - DNA, 15 bp, Homo sapiens
gaatgttttccttct

SEQ ID NO: 6196858 - DNA, 18 bp, Homo sapiens
gaatgttttcgcaaatgt

SEQ ID NO: 6196859 - DNA, 15 bp, Homo sapiens
gaatgtttttccctc

SEQ ID NO: 6196860 - DNA, 19 bp, Homo sapiens
gaatgtttttccctcccca

SEQ ID NO: 6196861 - DNA, 15 bp, Homo sapiens
gaattaaaacaatgt

SEQ ID NO: 6196862 - DNA, 12 bp, Homo sapiens
gaattaaaactg

SEQ ID NO: 6196863 - DNA, 15 bp, Homo sapiens
gaattaaaactgagt

SEQ ID NO: 6196864 - DNA, 22 bp, Homo sapiens
gaattaaaacttcttaaatatc

SEQ ID NO: 6196865 - DNA, 22 bp, Homo sapiens
gaattaaaactttgtagacatt

SEQ ID NO: 6196866 - DNA, 21 bp, Homo sapiens
gaattaaaaggatagtatttt

SEQ ID NO: 6196867 - DNA, 18 bp, Homo sapiens
gaattaaaagtcatttaa

SEQ ID NO: 6196868 - DNA, 22 bp, Homo sapiens
gaattaaactcctactgcttcc

SEQ ID NO: 6196869 - DNA, 20 bp, Homo sapiens
gaattaaacttttaattcat

SEQ ID NO: 6196870 - DNA, 15 bp, Homo sapiens
gaattaaagcctttg

SEQ ID NO: 6196871 - DNA, 11 bp, Homo sapiens
gaattaaagtc

SEQ ID NO: 6196872 - DNA, 15 bp, Homo sapiens
gaattaaataatgta

SEQ ID NO: 6196873 - DNA, 14 bp, Homo sapiens
gaattaaatagtgt

SEQ ID NO: 6196874 - DNA, 21 bp, Homo sapiens
gaattaaattaggaataaata

SEQ ID NO: 6196875 - DNA, 14 bp, Homo sapiens
gaattaacacatga

SEQ ID NO: 6196876 - DNA, 18 bp, Homo sapiens
cttcccgctcagccctcc

SEQ ID NO: 6196877 - DNA, 14 bp, Homo sapiens
cttcccgctcccca

SEQ ID NO: 6196878 - DNA, 16 bp, Homo sapiens
cttcccgctccccacc

SEQ ID NO: 6196879 - DNA, 19 bp, Homo sapiens
cttcccggcacacattcca

SEQ ID NO: 6196880 - DNA, 22 bp, Homo sapiens
cttcccggcccccggccaagga

SEQ ID NO: 6196881 - DNA, 21 bp, Homo sapiens
cttcccgggataaactgagcc

SEQ ID NO: 6196882 - DNA, 22 bp, Homo sapiens
cttcccgggcgggcgtgggagg

SEQ ID NO: 6196883 - DNA, 23 bp, Homo sapiens
cttcccggtccgcccgcttccct

SEQ ID NO: 6196884 - DNA, 19 bp, Homo sapiens
cttcccgtcccatatcctg

SEQ ID NO: 6196885 - DNA, 17 bp, Homo sapiens
cttcccgtctgattgtt

SEQ ID NO: 6196886 - DNA, 23 bp, Homo sapiens
cttcccgtctgattgttcctccc

SEQ ID NO: 6196887 - DNA, 13 bp, Homo sapiens
cttcccgttctta

SEQ ID NO: 6196888 - DNA, 16 bp, Homo sapiens
cttccctaaactgcag

SEQ ID NO: 6196889 - DNA, 16 bp, Homo sapiens
cttccctaacacttac

SEQ ID NO: 6196890 - DNA, 22 bp, Homo sapiens
cttccctaatagctttttaaaa

SEQ ID NO: 6196891 - DNA, 12 bp, Homo sapiens
cttccctaatct

SEQ ID NO: 6196892 - DNA, 16 bp, Homo sapiens
cttccctacacagggc

SEQ ID NO: 6196893 - DNA, 17 bp, Homo sapiens
cttccctacacagggcc

SEQ ID NO: 6196894 - DNA, 13 bp, Homo sapiens
cttccctacccac

SEQ ID NO: 6196895 - DNA, 16 bp, Homo sapiens
cttccctacccttcct

SEQ ID NO: 6196896 - DNA, 15 bp, Homo sapiens
cttccctagaagtct

SEQ ID NO: 6196897 - DNA, 20 bp, Homo sapiens
cttccctagagggttcctgt

SEQ ID NO: 6196898 - DNA, 21 bp, Homo sapiens
cttccctagctttagaccctg

SEQ ID NO: 6196899 - DNA, 20 bp, Homo sapiens
cttccctaggcacctctgtg

SEQ ID NO: 6196900 - DNA, 16 bp, Homo sapiens
cttccctagggctggg

SEQ ID NO: 6196901 - DNA, 19 bp, Homo sapiens
cttccctagggctgggtgt

SEQ ID NO: 6196902 - DNA, 22 bp, Homo sapiens
cttccctagtttacaagtcaga

SEQ ID NO: 6196903 - DNA, 17 bp, Homo sapiens
cttccctataggaacag

SEQ ID NO: 6196904 - DNA, 24 bp, Homo sapiens
cttccctcaaagcttccattccac

SEQ ID NO: 6196905 - DNA, 11 bp, Homo sapiens
cttccctcacc

SEQ ID NO: 6196906 - DNA, 12 bp, Homo sapiens
cttccctcaccc

SEQ ID NO: 6196907 - DNA, 17 bp, Homo sapiens
cttccctcaccttggca

SEQ ID NO: 6196908 - DNA, 20 bp, Homo sapiens
cttccctcactcttcctcat

SEQ ID NO: 6196909 - DNA, 16 bp, Homo sapiens
cttccctcagatttcc

SEQ ID NO: 6196910 - DNA, 16 bp, Homo sapiens
cttccctcatgttctc

SEQ ID NO: 6196911 - DNA, 11 bp, Homo sapiens
cttccctccaa

SEQ ID NO: 6196912 - DNA, 13 bp, Homo sapiens
cttccctccacct

SEQ ID NO: 6196913 - DNA, 13 bp, Homo sapiens
cttccctccatcc

SEQ ID NO: 6196914 - DNA, 15 bp, Homo sapiens
cttccctccatccac

SEQ ID NO: 6196915 - DNA, 20 bp, Homo sapiens
cttccctcccctctagtttt

SEQ ID NO: 6196916 - DNA, 16 bp, Homo sapiens
cttccctccctgaggc

SEQ ID NO: 6196917 - DNA, 13 bp, Homo sapiens
cttccctccctgc

SEQ ID NO: 6196918 - DNA, 14 bp, Homo sapiens
cttccctccctgct

SEQ ID NO: 6196919 - DNA, 16 bp, Homo sapiens
cttccctccctgctgt

SEQ ID NO: 6196920 - DNA, 18 bp, Homo sapiens
cttccctccctgctgtca

SEQ ID NO: 6196921 - DNA, 17 bp, Homo sapiens
cttccctccgccttctc

SEQ ID NO: 6196922 - DNA, 12 bp, Homo sapiens
cttccctcctcc

SEQ ID NO: 6196923 - DNA, 14 bp, Homo sapiens
cttccctcctccca

SEQ ID NO: 6196924 - DNA, 16 bp, Homo sapiens
cttccctcctcccatg

SEQ ID NO: 6196925 - DNA, 12 bp, Homo sapiens
cttccctccttc

SEQ ID NO: 6196926 - DNA, 15 bp, Homo sapiens
cttccctccttcatg

SEQ ID NO: 6196927 - DNA, 16 bp, Homo sapiens
cttccctccttcatga

SEQ ID NO: 6196928 - DNA, 13 bp, Homo sapiens
cttccctccttcc

SEQ ID NO: 6196929 - DNA, 14 bp, Homo sapiens
cttccctccttccc

SEQ ID NO: 6196930 - DNA, 16 bp, Homo sapiens
cttccctccttccctt

SEQ ID NO: 6196931 - DNA, 15 bp, Homo sapiens
cttccctcggggagc

SEQ ID NO: 6196932 - DNA, 14 bp, Homo sapiens
cttccctctcagct

SEQ ID NO: 6196933 - DNA, 14 bp, Homo sapiens
cttccctctccctc

SEQ ID NO: 6196934 - DNA, 15 bp, Homo sapiens
cttccctctcctgct

SEQ ID NO: 6196935 - DNA, 23 bp, Homo sapiens
cttccctctcgctcccctctgcc

SEQ ID NO: 6196936 - DNA, 13 bp, Homo sapiens
cttccctctctga

SEQ ID NO: 6196937 - DNA, 20 bp, Homo sapiens
cttccctctctgatgtccca

SEQ ID NO: 6196938 - DNA, 21 bp, Homo sapiens
cttccctctctgatgtcccag

SEQ ID NO: 6196939 - DNA, 16 bp, Homo sapiens
cttccctctgcattga

SEQ ID NO: 6196940 - DNA, 13 bp, Homo sapiens
cttccctctgcct

SEQ ID NO: 6196941 - DNA, 15 bp, Homo sapiens
cttccctctgcctga

SEQ ID NO: 6196942 - DNA, 17 bp, Homo sapiens
cttccctctgcctgtcc

SEQ ID NO: 6196943 - DNA, 12 bp, Homo sapiens
cttccctctgct

SEQ ID NO: 6196944 - DNA, 14 bp, Homo sapiens
cttccctctgctcc

SEQ ID NO: 6196945 - DNA, 15 bp, Homo sapiens
cttccctctgctcca

SEQ ID NO: 6196946 - DNA, 20 bp, Homo sapiens
cttccctctgggcctgttct

SEQ ID NO: 6196947 - DNA, 15 bp, Homo sapiens
cttccctcttccctc

SEQ ID NO: 6196948 - DNA, 23 bp, Homo sapiens
cttccctctttccccacctcttc

SEQ ID NO: 6196949 - DNA, 21 bp, Homo sapiens
cttccctgaacgttttcttct

SEQ ID NO: 6196950 - DNA, 24 bp, Homo sapiens
cttccctgacactgtctgctgccc

SEQ ID NO: 6196951 - DNA, 22 bp, Homo sapiens
cttccctgagtgcgggctgagg

SEQ ID NO: 6196952 - DNA, 19 bp, Homo sapiens
cttccctgatggcctttgg

SEQ ID NO: 6196953 - DNA, 20 bp, Homo sapiens
cttccctgatggcctttgga

SEQ ID NO: 6196954 - DNA, 18 bp, Homo sapiens
cttccctgattgacctgc

SEQ ID NO: 6196955 - DNA, 14 bp, Homo sapiens
cttccctgcaaggt

SEQ ID NO: 6196956 - DNA, 13 bp, Homo sapiens
cttccctgcacta

SEQ ID NO: 6196957 - DNA, 18 bp, Homo sapiens
cttccctgcagctgaccg

SEQ ID NO: 6196958 - DNA, 21 bp, Homo sapiens
cttccctgccacttcaacccc

SEQ ID NO: 6196959 - DNA, 17 bp, Homo sapiens
cttccctgcccaatcct

SEQ ID NO: 6196960 - DNA, 13 bp, Homo sapiens
cttccctgcccca

SEQ ID NO: 6196961 - DNA, 13 bp, Homo sapiens
cttccctgcccct

SEQ ID NO: 6196962 - DNA, 17 bp, Homo sapiens
cttccctgcccctgtgc

SEQ ID NO: 6196963 - DNA, 12 bp, Homo sapiens
cttccctgcctc

SEQ ID NO: 6196964 - DNA, 18 bp, Homo sapiens
cttccctgcctccagctg

SEQ ID NO: 6196965 - DNA, 16 bp, Homo sapiens
cttccctgctcttgca

SEQ ID NO: 6196966 - DNA, 15 bp, Homo sapiens
cttccctgctttgca

SEQ ID NO: 6196967 - DNA, 21 bp, Homo sapiens
cttccctgctttgcatctttg

SEQ ID NO: 6196968 - DNA, 12 bp, Homo sapiens
cttccctggagg

SEQ ID NO: 6196969 - DNA, 13 bp, Homo sapiens
cttccctggcctc

SEQ ID NO: 6196970 - DNA, 10 bp, Homo sapiens
cttccctggg

SEQ ID NO: 6196971 - DNA, 21 bp, Homo sapiens
cttccctgggaactcatcctg

SEQ ID NO: 6196972 - DNA, 13 bp, Homo sapiens
cttccctgggaag

SEQ ID NO: 6196973 - DNA, 12 bp, Homo sapiens
cttccctgggag

SEQ ID NO: 6196974 - DNA, 12 bp, Homo sapiens
cttccctgggcc

SEQ ID NO: 6196975 - DNA, 13 bp, Homo sapiens
cttccctgggcct

SEQ ID NO: 6196976 - DNA, 17 bp, Homo sapiens
cttccctgggcctcagc

SEQ ID NO: 6196977 - DNA, 12 bp, Homo sapiens
cttccctgggct

SEQ ID NO: 6196978 - DNA, 16 bp, Homo sapiens
cttccctgggctgcca

SEQ ID NO: 6196979 - DNA, 17 bp, Homo sapiens
cttccctggggagccct

SEQ ID NO: 6196980 - DNA, 20 bp, Homo sapiens
cttccctggggagccctcag

SEQ ID NO: 6196981 - DNA, 12 bp, Homo sapiens
cttccctggggg

SEQ ID NO: 6196982 - DNA, 13 bp, Homo sapiens
cttccctgggggt

SEQ ID NO: 6196983 - DNA, 23 bp, Homo sapiens
cttccctgggtttgggagccagg

SEQ ID NO: 6196984 - DNA, 22 bp, Homo sapiens
cttccctggtcaccaaggcagt

SEQ ID NO: 6196985 - DNA, 14 bp, Homo sapiens
cttccctggtccag

SEQ ID NO: 6196986 - DNA, 13 bp, Homo sapiens
cttccctggttca

SEQ ID NO: 6196987 - DNA, 22 bp, Homo sapiens
cttccctgtattttctttctct

SEQ ID NO: 6196988 - DNA, 13 bp, Homo sapiens
cttccctgtccct

SEQ ID NO: 6196989 - DNA, 15 bp, Homo sapiens
cttccctgtccctct

SEQ ID NO: 6196990 - DNA, 21 bp, Homo sapiens
cttccctgtgcctcctccctc

SEQ ID NO: 6196991 - DNA, 16 bp, Homo sapiens
cttccctgtgtctttt

SEQ ID NO: 6196992 - DNA, 19 bp, Homo sapiens
cttccctgttctccctttc

SEQ ID NO: 6196993 - DNA, 23 bp, Homo sapiens
cttccctgttttccccccaaggg

SEQ ID NO: 6196994 - DNA, 16 bp, Homo sapiens
cttcccttaactccaa

SEQ ID NO: 6196995 - DNA, 17 bp, Homo sapiens
cttcccttaactccaag

SEQ ID NO: 6196996 - DNA, 19 bp, Homo sapiens
cttcccttaactccaagaa

SEQ ID NO: 6196997 - DNA, 13 bp, Homo sapiens
cttcccttatttt

SEQ ID NO: 6196998 - DNA, 15 bp, Homo sapiens
cttcccttccactgc

SEQ ID NO: 6196999 - DNA, 16 bp, Homo sapiens
cttcccttccactgcc

SEQ ID NO: 6197000 - DNA, 22 bp, Homo sapiens
cttcccttccatctcttccttt

SEQ ID NO: 6197001 - DNA, 11 bp, Homo sapiens
cttcccttccc

SEQ ID NO: 6197002 - DNA, 15 bp, Homo sapiens
cttcccttcccagac

SEQ ID NO: 6197003 - DNA, 16 bp, Homo sapiens
cttcccttcccagacc

SEQ ID NO: 6197004 - DNA, 13 bp, Homo sapiens
cttcccttccctc

SEQ ID NO: 6197005 - DNA, 14 bp, Homo sapiens
cttcccttccctca

SEQ ID NO: 6197006 - DNA, 16 bp, Homo sapiens
cttcccttccctcacc

SEQ ID NO: 6197007 - DNA, 14 bp, Homo sapiens
cttcccttctccct

SEQ ID NO: 6197008 - DNA, 17 bp, Homo sapiens
cttcccttctctccttc

SEQ ID NO: 6197009 - DNA, 22 bp, Homo sapiens
cttcccttctctctctctcaaa

SEQ ID NO: 6197010 - DNA, 19 bp, Homo sapiens
cttcccttctctggtctcc

SEQ ID NO: 6197011 - DNA, 23 bp, Homo sapiens
cttcccttctctggtctccttga

SEQ ID NO: 6197012 - DNA, 14 bp, Homo sapiens
cttcccttctcttg

SEQ ID NO: 6197013 - DNA, 15 bp, Homo sapiens
cttcccttgagccct

SEQ ID NO: 6197014 - DNA, 12 bp, Homo sapiens
cttcccttgcca

SEQ ID NO: 6197015 - DNA, 14 bp, Homo sapiens
cttcccttgccact

SEQ ID NO: 6197016 - DNA, 15 bp, Homo sapiens
cttcccttgccactt

SEQ ID NO: 6197017 - DNA, 19 bp, Homo sapiens
cttcccttgctcatgagct

SEQ ID NO: 6197018 - DNA, 14 bp, Homo sapiens
cttcccttggaggg

SEQ ID NO: 6197019 - DNA, 24 bp, Homo sapiens
cttccctttaaccctcacactgct

SEQ ID NO: 6197020 - DNA, 14 bp, Homo sapiens
cttccctttcctga

SEQ ID NO: 6197021 - DNA, 16 bp, Homo sapiens
cttccctttctaagca

SEQ ID NO: 6197022 - DNA, 13 bp, Homo sapiens
cttccctttctgc

SEQ ID NO: 6197023 - DNA, 14 bp, Homo sapiens
cttcccttttacat

SEQ ID NO: 6197024 - DNA, 20 bp, Homo sapiens
cttccgaaaaatcctcttcc

SEQ ID NO: 6197025 - DNA, 21 bp, Homo sapiens
cttccgaaaaatcctcttcct

SEQ ID NO: 6197026 - DNA, 13 bp, Homo sapiens
cttccgacaggag

SEQ ID NO: 6197027 - DNA, 16 bp, Homo sapiens
cttccgacaggagcac

SEQ ID NO: 6197028 - DNA, 15 bp, Homo sapiens
cttccgaccctctgg

SEQ ID NO: 6197029 - DNA, 18 bp, Homo sapiens
cttccgaccctctgggaa

SEQ ID NO: 6197030 - DNA, 22 bp, Homo sapiens
cttccgaccctctgggaacctc

SEQ ID NO: 6197031 - DNA, 22 bp, Homo sapiens
cttccgagatccccagggcagc

SEQ ID NO: 6197032 - DNA, 17 bp, Homo sapiens
cttccgagattcagact

SEQ ID NO: 6197033 - DNA, 19 bp, Homo sapiens
cttccgagtagctgggatt

SEQ ID NO: 6197034 - DNA, 22 bp, Homo sapiens
cttccgatggatgaatctccca

SEQ ID NO: 6197035 - DNA, 17 bp, Homo sapiens
cttccgcaccctcccta

SEQ ID NO: 6197036 - DNA, 21 bp, Homo sapiens
cttccgcagcccctttcccca

SEQ ID NO: 6197037 - DNA, 15 bp, Homo sapiens
cttccgcagtgtggc

SEQ ID NO: 6197038 - DNA, 21 bp, Homo sapiens
cttccgcagtgtggccaggct

SEQ ID NO: 6197039 - DNA, 15 bp, Homo sapiens
cttccgcatcctagt

SEQ ID NO: 6197040 - DNA, 22 bp, Homo sapiens
cttccgccactggggctcagag

SEQ ID NO: 6197041 - DNA, 17 bp, Homo sapiens
cttccgcccctgcctgc

SEQ ID NO: 6197042 - DNA, 19 bp, Homo sapiens
cttccgccccttcccttcc

SEQ ID NO: 6197043 - DNA, 15 bp, Homo sapiens
cttccgcctcctgtg

SEQ ID NO: 6197044 - DNA, 13 bp, Homo sapiens
cttccgctcccac

SEQ ID NO: 6197045 - DNA, 17 bp, Homo sapiens
cttccgctcccaccagc

SEQ ID NO: 6197046 - DNA, 22 bp, Homo sapiens
cttccgctcctttacctaccac

SEQ ID NO: 6197047 - DNA, 15 bp, Homo sapiens
cttccgctctgaggc

SEQ ID NO: 6197048 - DNA, 12 bp, Homo sapiens
cttccgctgagg

SEQ ID NO: 6197049 - DNA, 14 bp, Homo sapiens
cttccgctgagggg

SEQ ID NO: 6197050 - DNA, 16 bp, Homo sapiens
cttccgctgaggggtc

SEQ ID NO: 6197051 - DNA, 23 bp, Homo sapiens
cttccgctgcgggcccagctgag

SEQ ID NO: 6197052 - DNA, 23 bp, Homo sapiens
cttccgcttggagctattttcca

SEQ ID NO: 6197053 - DNA, 20 bp, Homo sapiens
cttccgctttgaaagaagca

SEQ ID NO: 6197054 - DNA, 14 bp, Homo sapiens
cttccggagatgta

SEQ ID NO: 6197055 - DNA, 15 bp, Homo sapiens
cttccggagatgtag

SEQ ID NO: 6197056 - DNA, 19 bp, Homo sapiens
cttccggctgagctgtgcc

SEQ ID NO: 6197057 - DNA, 13 bp, Homo sapiens
cttccgggagctg

SEQ ID NO: 6197058 - DNA, 15 bp, Homo sapiens
gaattaacacatgat

SEQ ID NO: 6197059 - DNA, 21 bp, Homo sapiens
gaattaaccatttaataaaga

SEQ ID NO: 6197060 - DNA, 22 bp, Homo sapiens
gaattaaccatttaataaagaa

SEQ ID NO: 6197061 - DNA, 12 bp, Homo sapiens
gaattaagaact

SEQ ID NO: 6197062 - DNA, 20 bp, Homo sapiens
gaattaaggaaaaataagtg

SEQ ID NO: 6197063 - DNA, 23 bp, Homo sapiens
gaattaagtgaaaggtcacacta

SEQ ID NO: 6197064 - DNA, 18 bp, Homo sapiens
gaattaagttagggaatg

SEQ ID NO: 6197065 - DNA, 21 bp, Homo sapiens
gaattaagttagggaatggca

SEQ ID NO: 6197066 - DNA, 15 bp, Homo sapiens
gaattaatagctttt

SEQ ID NO: 6197067 - DNA, 22 bp, Homo sapiens
gaattaatatccctacatgtat

SEQ ID NO: 6197068 - DNA, 21 bp, Homo sapiens
gaattaatcatctataaagaa

SEQ ID NO: 6197069 - DNA, 16 bp, Homo sapiens
gaattaatctagaaaa

SEQ ID NO: 6197070 - DNA, 13 bp, Homo sapiens
gaattaatcttaa

SEQ ID NO: 6197071 - DNA, 19 bp, Homo sapiens
gaattaatgacagagccag

SEQ ID NO: 6197072 - DNA, 21 bp, Homo sapiens
gaattaatgcattcaaagtaa

SEQ ID NO: 6197073 - DNA, 18 bp, Homo sapiens
gaattaattaatttggag

SEQ ID NO: 6197074 - DNA, 20 bp, Homo sapiens
gaattacaccacaagtatct

SEQ ID NO: 6197075 - DNA, 19 bp, Homo sapiens
gaattacagaaaatttgca

SEQ ID NO: 6197076 - DNA, 22 bp, Homo sapiens
gaattacaggcgtgagccacca

SEQ ID NO: 6197077 - DNA, 19 bp, Homo sapiens
gaattacagggaagaaatc

SEQ ID NO: 6197078 - DNA, 15 bp, Homo sapiens
gaattacataacagg

SEQ ID NO: 6197079 - DNA, 17 bp, Homo sapiens
gaattacataacaggca

SEQ ID NO: 6197080 - DNA, 17 bp, Homo sapiens
gaattacatatgaaaaa

SEQ ID NO: 6197081 - DNA, 22 bp, Homo sapiens
gaattacatgtaaaacattatc

SEQ ID NO: 6197082 - DNA, 19 bp, Homo sapiens
gaattaccatagagtaatg

SEQ ID NO: 6197083 - DNA, 20 bp, Homo sapiens
gaattacccttcctcatctg

SEQ ID NO: 6197084 - DNA, 20 bp, Homo sapiens
gaattaccctttcattcagc

SEQ ID NO: 6197085 - DNA, 16 bp, Homo sapiens
gaattactaacttcta

SEQ ID NO: 6197086 - DNA, 14 bp, Homo sapiens
gaattactccaaaa

SEQ ID NO: 6197087 - DNA, 23 bp, Homo sapiens
gaattactccaaaaagacaagtg

SEQ ID NO: 6197088 - DNA, 15 bp, Homo sapiens
gaattactgtttgaa

SEQ ID NO: 6197089 - DNA, 18 bp, Homo sapiens
gaattactttattataaa

SEQ ID NO: 6197090 - DNA, 21 bp, Homo sapiens
gaattactttattataaaatg

SEQ ID NO: 6197091 - DNA, 22 bp, Homo sapiens
gaattactttattataaaatgc

SEQ ID NO: 6197092 - DNA, 15 bp, Homo sapiens
gaattactttcctcc

SEQ ID NO: 6197093 - DNA, 16 bp, Homo sapiens
gaattactttcctcct

SEQ ID NO: 6197094 - DNA, 12 bp, Homo sapiens
gaattagaaaat

SEQ ID NO: 6197095 - DNA, 18 bp, Homo sapiens
gaattagaaacataaata

SEQ ID NO: 6197096 - DNA, 19 bp, Homo sapiens
gaattagaagtctttcagt

SEQ ID NO: 6197097 - DNA, 19 bp, Homo sapiens
gaattagagaagctgaaag

SEQ ID NO: 6197098 - DNA, 18 bp, Homo sapiens
gaattagagggccttgct

SEQ ID NO: 6197099 - DNA, 16 bp, Homo sapiens
gaattagatgtttata

SEQ ID NO: 6197100 - DNA, 17 bp, Homo sapiens
gaattagatttctatag

SEQ ID NO: 6197101 - DNA, 15 bp, Homo sapiens
gaattagctgcttct

SEQ ID NO: 6197102 - DNA, 18 bp, Homo sapiens
gaattaggaaggccatgg

SEQ ID NO: 6197103 - DNA, 15 bp, Homo sapiens
gaattaggctgtaac

SEQ ID NO: 6197104 - DNA, 19 bp, Homo sapiens
gaattaggctgtaactact

SEQ ID NO: 6197105 - DNA, 21 bp, Homo sapiens
gaattaggtccacttcaatgt

SEQ ID NO: 6197106 - DNA, 15 bp, Homo sapiens
gaattaggtttcttt

SEQ ID NO: 6197107 - DNA, 16 bp, Homo sapiens
gaattaggtttctttg

SEQ ID NO: 6197108 - DNA, 20 bp, Homo sapiens
gaattagtatttcagtgttt

SEQ ID NO: 6197109 - DNA, 22 bp, Homo sapiens
gaattagtatttcagtgttttc

SEQ ID NO: 6197110 - DNA, 16 bp, Homo sapiens
gaattagtccttgctt

SEQ ID NO: 6197111 - DNA, 13 bp, Homo sapiens
gaattagttggca

SEQ ID NO: 6197112 - DNA, 21 bp, Homo sapiens
gaattagttggcagagaaaat

SEQ ID NO: 6197113 - DNA, 16 bp, Homo sapiens
gaattataaaagccag

SEQ ID NO: 6197114 - DNA, 16 bp, Homo sapiens
gaattataaatgtgtt

SEQ ID NO: 6197115 - DNA, 12 bp, Homo sapiens
gaattataacag

SEQ ID NO: 6197116 - DNA, 14 bp, Homo sapiens
gaattataacagtt

SEQ ID NO: 6197117 - DNA, 20 bp, Homo sapiens
gaattataactggaaagaag

SEQ ID NO: 6197118 - DNA, 14 bp, Homo sapiens
gaattataactgta

SEQ ID NO: 6197119 - DNA, 23 bp, Homo sapiens
gaattatacagacctaatatcat

SEQ ID NO: 6197120 - DNA, 16 bp, Homo sapiens
gaattatataattttc

SEQ ID NO: 6197121 - DNA, 14 bp, Homo sapiens
gaattatatatttc

SEQ ID NO: 6197122 - DNA, 22 bp, Homo sapiens
gaattatatatttctaactata

SEQ ID NO: 6197123 - DNA, 16 bp, Homo sapiens
gaattatatctaattt

SEQ ID NO: 6197124 - DNA, 20 bp, Homo sapiens
gaattatatctaatttatac

SEQ ID NO: 6197125 - DNA, 21 bp, Homo sapiens
gaattatatctaatttataca

SEQ ID NO: 6197126 - DNA, 23 bp, Homo sapiens
gaattatatctaatttatacaaa

SEQ ID NO: 6197127 - DNA, 17 bp, Homo sapiens
gaattatcagcaaagaa

SEQ ID NO: 6197128 - DNA, 15 bp, Homo sapiens
gaattatccattacg

SEQ ID NO: 6197129 - DNA, 22 bp, Homo sapiens
gaattatcctatttcagtactt

SEQ ID NO: 6197130 - DNA, 22 bp, Homo sapiens
gaattatctatacatatcttta

SEQ ID NO: 6197131 - DNA, 12 bp, Homo sapiens
gaattatctcaa

SEQ ID NO: 6197132 - DNA, 20 bp, Homo sapiens
gaattatctcaagtaaaaca

SEQ ID NO: 6197133 - DNA, 20 bp, Homo sapiens
gaattatcttggttgaaaat

SEQ ID NO: 6197134 - DNA, 14 bp, Homo sapiens
gaattatgttttga

SEQ ID NO: 6197135 - DNA, 18 bp, Homo sapiens
gaattattaatgaatgcc

SEQ ID NO: 6197136 - DNA, 19 bp, Homo sapiens
gaattattacagtgtttat

SEQ ID NO: 6197137 - DNA, 20 bp, Homo sapiens
gaattattacatctttatta

SEQ ID NO: 6197138 - DNA, 18 bp, Homo sapiens
gaattattcagtgaattt

SEQ ID NO: 6197139 - DNA, 19 bp, Homo sapiens
gaattattcagtgaatttg

SEQ ID NO: 6197140 - DNA, 17 bp, Homo sapiens
gaattattgacactgaa

SEQ ID NO: 6197141 - DNA, 20 bp, Homo sapiens
gaattattgggcttaatata

SEQ ID NO: 6197142 - DNA, 16 bp, Homo sapiens
gaattattttaaaaga

SEQ ID NO: 6197143 - DNA, 14 bp, Homo sapiens
gaattattttgtta

SEQ ID NO: 6197144 - DNA, 13 bp, Homo sapiens
gaattatttttga

SEQ ID NO: 6197145 - DNA, 20 bp, Homo sapiens
gaattcaaaagtgattatct

SEQ ID NO: 6197146 - DNA, 18 bp, Homo sapiens
gaattcaaactggggcct

SEQ ID NO: 6197147 - DNA, 21 bp, Homo sapiens
gaattcaaactggggcctcca

SEQ ID NO: 6197148 - DNA, 11 bp, Homo sapiens
gaattcaaagc

SEQ ID NO: 6197149 - DNA, 14 bp, Homo sapiens
gaattcaaagcttg

SEQ ID NO: 6197150 - DNA, 17 bp, Homo sapiens
gaattcaaatattcttt

SEQ ID NO: 6197151 - DNA, 19 bp, Homo sapiens
gaattcaaatattctttca

SEQ ID NO: 6197152 - DNA, 16 bp, Homo sapiens
gaattcaaattttatc

SEQ ID NO: 6197153 - DNA, 13 bp, Homo sapiens
gaattcaacagtt

SEQ ID NO: 6197154 - DNA, 17 bp, Homo sapiens
gaattcaagaaaggaaa

SEQ ID NO: 6197155 - DNA, 15 bp, Homo sapiens
gaattcacaaacaaa

SEQ ID NO: 6197156 - DNA, 16 bp, Homo sapiens
gaattcacaaacaaat

SEQ ID NO: 6197157 - DNA, 19 bp, Homo sapiens
gaattcacccctcccacct

SEQ ID NO: 6197158 - DNA, 16 bp, Homo sapiens
gaattcactccagtca

SEQ ID NO: 6197159 - DNA, 18 bp, Homo sapiens
gaattcactccagtcaac

SEQ ID NO: 6197160 - DNA, 23 bp, Homo sapiens
gaattcactccagtcaacagatt

SEQ ID NO: 6197161 - DNA, 13 bp, Homo sapiens
gaattcactgagt

SEQ ID NO: 6197162 - DNA, 19 bp, Homo sapiens
gaattcactgagttttgtt

SEQ ID NO: 6197163 - DNA, 13 bp, Homo sapiens
gaattcagaaaga

SEQ ID NO: 6197164 - DNA, 23 bp, Homo sapiens
gaattcagaagacccctgactca

SEQ ID NO: 6197165 - DNA, 16 bp, Homo sapiens
gaattcagattttaaa

SEQ ID NO: 6197166 - DNA, 16 bp, Homo sapiens
gaattcagcagtttta

SEQ ID NO: 6197167 - DNA, 23 bp, Homo sapiens
gaattcagtagcattttaatagt

SEQ ID NO: 6197168 - DNA, 13 bp, Homo sapiens
gaattcagtgcct

SEQ ID NO: 6197169 - DNA, 20 bp, Homo sapiens
gaattcagttgctttgccca

SEQ ID NO: 6197170 - DNA, 15 bp, Homo sapiens
gaattcataataaat

SEQ ID NO: 6197171 - DNA, 19 bp, Homo sapiens
gaattcataataaattttc

SEQ ID NO: 6197172 - DNA, 23 bp, Homo sapiens
gaattcatactctgttgcctcct

SEQ ID NO: 6197173 - DNA, 16 bp, Homo sapiens
gaattcatcccctccc

SEQ ID NO: 6197174 - DNA, 17 bp, Homo sapiens
gaattcatgcctcaagt

SEQ ID NO: 6197175 - DNA, 18 bp, Homo sapiens
gaattcatgtgaaaataa

SEQ ID NO: 6197176 - DNA, 17 bp, Homo sapiens
gaattcattctggaggg

SEQ ID NO: 6197177 - DNA, 21 bp, Homo sapiens
gaattcattctggtctctcta

SEQ ID NO: 6197178 - DNA, 22 bp, Homo sapiens
gaattcattttcatcactggga

SEQ ID NO: 6197179 - DNA, 22 bp, Homo sapiens
gaattccaagtgtattttaaaa

SEQ ID NO: 6197180 - DNA, 13 bp, Homo sapiens
gaattccaatatt

SEQ ID NO: 6197181 - DNA, 14 bp, Homo sapiens
gaattccaatattt

SEQ ID NO: 6197182 - DNA, 20 bp, Homo sapiens
gaattccaatatttataatt

SEQ ID NO: 6197183 - DNA, 21 bp, Homo sapiens
gaattccaatatttataatta

SEQ ID NO: 6197184 - DNA, 21 bp, Homo sapiens
gaattccacctggaaagccag

SEQ ID NO: 6197185 - DNA, 23 bp, Homo sapiens
gaattccacctggaaagccaggt

SEQ ID NO: 6197186 - DNA, 23 bp, Homo sapiens
gaattccacgcccgggagtgggg

SEQ ID NO: 6197187 - DNA, 13 bp, Homo sapiens
gaattccagtccc

SEQ ID NO: 6197188 - DNA, 20 bp, Homo sapiens
gaattcccagatagtcccag

SEQ ID NO: 6197189 - DNA, 11 bp, Homo sapiens
gaattcccagg

SEQ ID NO: 6197190 - DNA, 12 bp, Homo sapiens
gaattccctccc

SEQ ID NO: 6197191 - DNA, 14 bp, Homo sapiens
gaattccctccccc

SEQ ID NO: 6197192 - DNA, 20 bp, Homo sapiens
gaattccctgaagcaacact

SEQ ID NO: 6197193 - DNA, 13 bp, Homo sapiens
gaattccctggaa

SEQ ID NO: 6197194 - DNA, 16 bp, Homo sapiens
gaattcctaaaattat

SEQ ID NO: 6197195 - DNA, 17 bp, Homo sapiens
gaattcctagaattaaa

SEQ ID NO: 6197196 - DNA, 16 bp, Homo sapiens
gaattcctcttttgct

SEQ ID NO: 6197197 - DNA, 13 bp, Homo sapiens
gaattcctggaac

SEQ ID NO: 6197198 - DNA, 18 bp, Homo sapiens
gaattcctggaacctgga

SEQ ID NO: 6197199 - DNA, 20 bp, Homo sapiens
gaattcctggaacctggacc

SEQ ID NO: 6197200 - DNA, 16 bp, Homo sapiens
gaattccttcagggtg

SEQ ID NO: 6197201 - DNA, 17 bp, Homo sapiens
gaattccttcagggtga

SEQ ID NO: 6197202 - DNA, 23 bp, Homo sapiens
gaattcctttacaactaaataac

SEQ ID NO: 6197203 - DNA, 22 bp, Homo sapiens
gaattcgaaggctctctctttc

SEQ ID NO: 6197204 - DNA, 19 bp, Homo sapiens
gaattcggtgtgctgccaa

SEQ ID NO: 6197205 - DNA, 18 bp, Homo sapiens
gaattctaagattgtaca

SEQ ID NO: 6197206 - DNA, 19 bp, Homo sapiens
gaattctaagattgtacat

SEQ ID NO: 6197207 - DNA, 12 bp, Homo sapiens
gaattctactgg

SEQ ID NO: 6197208 - DNA, 16 bp, Homo sapiens
gaattctattttgctg

SEQ ID NO: 6197209 - DNA, 13 bp, Homo sapiens
gaattctattttt

SEQ ID NO: 6197210 - DNA, 19 bp, Homo sapiens
gaattctatttttgtcctt

SEQ ID NO: 6197211 - DNA, 17 bp, Homo sapiens
gaattctcagaatctca

SEQ ID NO: 6197212 - DNA, 12 bp, Homo sapiens
gaattctgactt

SEQ ID NO: 6197213 - DNA, 23 bp, Homo sapiens
gaattctgcaactagccaaggct

SEQ ID NO: 6197214 - DNA, 23 bp, Homo sapiens
gaattctgccttggttctggcca

SEQ ID NO: 6197215 - DNA, 19 bp, Homo sapiens
gaattctgctacctcactg

SEQ ID NO: 6197216 - DNA, 17 bp, Homo sapiens
gaattctggaggaagaa

SEQ ID NO: 6197217 - DNA, 17 bp, Homo sapiens
gaattctggttgtaaat

SEQ ID NO: 6197218 - DNA, 21 bp, Homo sapiens
gaattctgtatagattagaat

SEQ ID NO: 6197219 - DNA, 16 bp, Homo sapiens
gaattctgtgaagaat

SEQ ID NO: 6197220 - DNA, 17 bp, Homo sapiens
gaattctgtgaagaatg

SEQ ID NO: 6197221 - DNA, 18 bp, Homo sapiens
gaattctgtgaagaatga

SEQ ID NO: 6197222 - DNA, 23 bp, Homo sapiens
gaattctgttgtaatttaatgac

SEQ ID NO: 6197223 - DNA, 12 bp, Homo sapiens
gaattcttctgc

SEQ ID NO: 6197224 - DNA, 13 bp, Homo sapiens
gaattcttctgca

SEQ ID NO: 6197225 - DNA, 20 bp, Homo sapiens
gaattcttctgttctctggt

SEQ ID NO: 6197226 - DNA, 18 bp, Homo sapiens
gaattcttgaaggaaaat

SEQ ID NO: 6197227 - DNA, 17 bp, Homo sapiens
gaattcttgataaatga

SEQ ID NO: 6197228 - DNA, 23 bp, Homo sapiens
gaattcttgatctctaatgagct

SEQ ID NO: 6197229 - DNA, 19 bp, Homo sapiens
gaattcttggttgaggaaa

SEQ ID NO: 6197230 - DNA, 19 bp, Homo sapiens
gaattctttacaataaaca

SEQ ID NO: 6197231 - DNA, 15 bp, Homo sapiens
gaattctttagattt

SEQ ID NO: 6197232 - DNA, 16 bp, Homo sapiens
gaattcttttcctctc

SEQ ID NO: 6197233 - DNA, 17 bp, Homo sapiens
gaattcttttcctctct

SEQ ID NO: 6197234 - DNA, 14 bp, Homo sapiens
gaattgaaaagttt

SEQ ID NO: 6197235 - DNA, 14 bp, Homo sapiens
cttccgggagctgg

SEQ ID NO: 6197236 - DNA, 16 bp, Homo sapiens
cttccgggagctggtg

SEQ ID NO: 6197237 - DNA, 17 bp, Homo sapiens
cttccggggccatgggc

SEQ ID NO: 6197238 - DNA, 22 bp, Homo sapiens
cttccgggtctcgcagcctgaa

SEQ ID NO: 6197239 - DNA, 16 bp, Homo sapiens
cttccggtagggaggc

SEQ ID NO: 6197240 - DNA, 20 bp, Homo sapiens
cttccggtagggaggcagcc

SEQ ID NO: 6197241 - DNA, 21 bp, Homo sapiens
cttccggtagggaggcagcct

SEQ ID NO: 6197242 - DNA, 15 bp, Homo sapiens
cttccgtccatcccc

SEQ ID NO: 6197243 - DNA, 13 bp, Homo sapiens
cttccgtctcccc

SEQ ID NO: 6197244 - DNA, 18 bp, Homo sapiens
cttccgtgagacacaaga

SEQ ID NO: 6197245 - DNA, 19 bp, Homo sapiens
cttccgtgggtcatcccag

SEQ ID NO: 6197246 - DNA, 21 bp, Homo sapiens
cttccgtgggtcatcccagca

SEQ ID NO: 6197247 - DNA, 20 bp, Homo sapiens
cttccgtggtcagagtgcca

SEQ ID NO: 6197248 - DNA, 22 bp, Homo sapiens
cttccgtggtcagagtgccact

SEQ ID NO: 6197249 - DNA, 22 bp, Homo sapiens
cttccgttccccgctaggtcaa

SEQ ID NO: 6197250 - DNA, 22 bp, Homo sapiens
cttcctaaacccaatgacttcc

SEQ ID NO: 6197251 - DNA, 22 bp, Homo sapiens
cttcctaaatattatgagatgc

SEQ ID NO: 6197252 - DNA, 15 bp, Homo sapiens
cttcctaaatttcat

SEQ ID NO: 6197253 - DNA, 16 bp, Homo sapiens
cttcctaaattttcct

SEQ ID NO: 6197254 - DNA, 13 bp, Homo sapiens
cttcctaattcca

SEQ ID NO: 6197255 - DNA, 22 bp, Homo sapiens
cttcctaatttcccttcttgca

SEQ ID NO: 6197256 - DNA, 23 bp, Homo sapiens
cttcctaatttcccttcttgcat

SEQ ID NO: 6197257 - DNA, 24 bp, Homo sapiens
cttcctacaagagcagcctgtggc

SEQ ID NO: 6197258 - DNA, 23 bp, Homo sapiens
cttcctacccacacctctgccag

SEQ ID NO: 6197259 - DNA, 16 bp, Homo sapiens
cttcctaccctgcctc

SEQ ID NO: 6197260 - DNA, 17 bp, Homo sapiens
cttcctactcctcatag

SEQ ID NO: 6197261 - DNA, 22 bp, Homo sapiens
cttcctactttgcttctctcca

SEQ ID NO: 6197262 - DNA, 23 bp, Homo sapiens
cttcctagaagcccctgtcgccc

SEQ ID NO: 6197263 - DNA, 22 bp, Homo sapiens
cttcctagaatccccttctcca

SEQ ID NO: 6197264 - DNA, 18 bp, Homo sapiens
cttcctagatctgcaggc

SEQ ID NO: 6197265 - DNA, 21 bp, Homo sapiens
cttcctagatctgcaggctgc

SEQ ID NO: 6197266 - DNA, 23 bp, Homo sapiens
cttcctagatctgcaggctgcac

SEQ ID NO: 6197267 - DNA, 16 bp, Homo sapiens
cttcctagcttatctc

SEQ ID NO: 6197268 - DNA, 20 bp, Homo sapiens
cttcctagcttatctccctg

SEQ ID NO: 6197269 - DNA, 23 bp, Homo sapiens
cttcctagcttatctccctgctt

SEQ ID NO: 6197270 - DNA, 20 bp, Homo sapiens
cttcctaggcattacccaaa

SEQ ID NO: 6197271 - DNA, 18 bp, Homo sapiens
cttcctagtgaaccacag

SEQ ID NO: 6197272 - DNA, 17 bp, Homo sapiens
cttcctagttcatccct

SEQ ID NO: 6197273 - DNA, 20 bp, Homo sapiens
cttcctataacttcttcctg

SEQ ID NO: 6197274 - DNA, 22 bp, Homo sapiens
cttcctataacttcttcctgct

SEQ ID NO: 6197275 - DNA, 24 bp, Homo sapiens
cttcctataacttcttcctgctgg

SEQ ID NO: 6197276 - DNA, 17 bp, Homo sapiens
cttcctataacttgatg

SEQ ID NO: 6197277 - DNA, 12 bp, Homo sapiens
cttcctatccca

SEQ ID NO: 6197278 - DNA, 17 bp, Homo sapiens
cttcctatcccatccca

SEQ ID NO: 6197279 - DNA, 22 bp, Homo sapiens
cttcctattaatttattaaatt

SEQ ID NO: 6197280 - DNA, 14 bp, Homo sapiens
cttcctattctcct

SEQ ID NO: 6197281 - DNA, 16 bp, Homo sapiens
cttcctattctcctgc

SEQ ID NO: 6197282 - DNA, 21 bp, Homo sapiens
cttcctcaaatacatgcacag

SEQ ID NO: 6197283 - DNA, 13 bp, Homo sapiens
cttcctcaagtct

SEQ ID NO: 6197284 - DNA, 16 bp, Homo sapiens
cttcctcaagtcttga

SEQ ID NO: 6197285 - DNA, 14 bp, Homo sapiens
cttcctcacacccc

SEQ ID NO: 6197286 - DNA, 18 bp, Homo sapiens
cttcctcacactgctgtc

SEQ ID NO: 6197287 - DNA, 19 bp, Homo sapiens
cttcctcactatgacactg

SEQ ID NO: 6197288 - DNA, 14 bp, Homo sapiens
cttcctcacttcca

SEQ ID NO: 6197289 - DNA, 14 bp, Homo sapiens
cttcctcagagggc

SEQ ID NO: 6197290 - DNA, 14 bp, Homo sapiens
cttcctcagccagc

SEQ ID NO: 6197291 - DNA, 18 bp, Homo sapiens
cttcctcagcctggggtt

SEQ ID NO: 6197292 - DNA, 15 bp, Homo sapiens
cttcctcagctcagc

SEQ ID NO: 6197293 - DNA, 21 bp, Homo sapiens
cttcctcagctcagctgggcc

SEQ ID NO: 6197294 - DNA, 23 bp, Homo sapiens
cttcctcagctcagctgggccac

SEQ ID NO: 6197295 - DNA, 19 bp, Homo sapiens
cttcctcagctgcctcctg

SEQ ID NO: 6197296 - DNA, 23 bp, Homo sapiens
cttcctcagtaacatttctgttc

SEQ ID NO: 6197297 - DNA, 16 bp, Homo sapiens
cttcctcagtcctgga

SEQ ID NO: 6197298 - DNA, 22 bp, Homo sapiens
cttcctcatcagtagatggtac

SEQ ID NO: 6197299 - DNA, 23 bp, Homo sapiens
cttcctcatccaccccatccctc

SEQ ID NO: 6197300 - DNA, 14 bp, Homo sapiens
cttcctcatcccct

SEQ ID NO: 6197301 - DNA, 14 bp, Homo sapiens
cttcctcatcctgc

SEQ ID NO: 6197302 - DNA, 13 bp, Homo sapiens
cttcctcatcctt

SEQ ID NO: 6197303 - DNA, 14 bp, Homo sapiens
cttcctcatctgtg

SEQ ID NO: 6197304 - DNA, 13 bp, Homo sapiens
cttcctccaaccc

SEQ ID NO: 6197305 - DNA, 14 bp, Homo sapiens
cttcctccaaggac

SEQ ID NO: 6197306 - DNA, 17 bp, Homo sapiens
cttcctccaatccccac

SEQ ID NO: 6197307 - DNA, 12 bp, Homo sapiens
cttcctccactt

SEQ ID NO: 6197308 - DNA, 14 bp, Homo sapiens
cttcctccagaagc

SEQ ID NO: 6197309 - DNA, 17 bp, Homo sapiens
cttcctccagaagcctc

SEQ ID NO: 6197310 - DNA, 18 bp, Homo sapiens
cttcctccagctgcacca

SEQ ID NO: 6197311 - DNA, 17 bp, Homo sapiens
cttcctccaggagaagg

SEQ ID NO: 6197312 - DNA, 14 bp, Homo sapiens
cttcctccagtctg

SEQ ID NO: 6197313 - DNA, 21 bp, Homo sapiens
cttcctccagtctgttctcac

SEQ ID NO: 6197314 - DNA, 20 bp, Homo sapiens
cttcctcccaagtggtgcct

SEQ ID NO: 6197315 - DNA, 16 bp, Homo sapiens
cttcctcccatttccc

SEQ ID NO: 6197316 - DNA, 22 bp, Homo sapiens
cttcctccccacactccactct

SEQ ID NO: 6197317 - DNA, 23 bp, Homo sapiens
cttcctccccacactccactctg

SEQ ID NO: 6197318 - DNA, 22 bp, Homo sapiens
cttcctccccaggacttggtct

SEQ ID NO: 6197319 - DNA, 12 bp, Homo sapiens
cttcctccccgc

SEQ ID NO: 6197320 - DNA, 12 bp, Homo sapiens
cttcctcccctc

SEQ ID NO: 6197321 - DNA, 22 bp, Homo sapiens
cttcctcccctctcatccccct

SEQ ID NO: 6197322 - DNA, 14 bp, Homo sapiens
cttcctccctccct

SEQ ID NO: 6197323 - DNA, 16 bp, Homo sapiens
cttcctccctccctgc

SEQ ID NO: 6197324 - DNA, 18 bp, Homo sapiens
cttcctccctccctgcag

SEQ ID NO: 6197325 - DNA, 13 bp, Homo sapiens
cttcctccctgga

SEQ ID NO: 6197326 - DNA, 13 bp, Homo sapiens
cttcctccctgtc

SEQ ID NO: 6197327 - DNA, 19 bp, Homo sapiens
cttcctccctgtctctgca

SEQ ID NO: 6197328 - DNA, 17 bp, Homo sapiens
cttcctccgctcccctt

SEQ ID NO: 6197329 - DNA, 22 bp, Homo sapiens
cttcctccgctcccctttccca

SEQ ID NO: 6197330 - DNA, 22 bp, Homo sapiens
cttcctccggctggacctgggg

SEQ ID NO: 6197331 - DNA, 20 bp, Homo sapiens
cttcctccgtccacccaggc

SEQ ID NO: 6197332 - DNA, 22 bp, Homo sapiens
cttcctccgtccacccaggctg

SEQ ID NO: 6197333 - DNA, 23 bp, Homo sapiens
cttcctccgtccacccaggctgc

SEQ ID NO: 6197334 - DNA, 24 bp, Homo sapiens
cttcctccgtccacccaggctgca

SEQ ID NO: 6197335 - DNA, 14 bp, Homo sapiens
cttcctcctacctg

SEQ ID NO: 6197336 - DNA, 15 bp, Homo sapiens
cttcctcctacctgg

SEQ ID NO: 6197337 - DNA, 19 bp, Homo sapiens
cttcctcctacctggggac

SEQ ID NO: 6197338 - DNA, 13 bp, Homo sapiens
cttcctcctcagg

SEQ ID NO: 6197339 - DNA, 18 bp, Homo sapiens
cttcctcctccacagtgc

SEQ ID NO: 6197340 - DNA, 15 bp, Homo sapiens
cttcctcctccacca

SEQ ID NO: 6197341 - DNA, 20 bp, Homo sapiens
cttcctcctccatcacctga

SEQ ID NO: 6197342 - DNA, 13 bp, Homo sapiens
cttcctcctccca

SEQ ID NO: 6197343 - DNA, 17 bp, Homo sapiens
cttcctcctccccactt

SEQ ID NO: 6197344 - DNA, 18 bp, Homo sapiens
cttcctcctcccctggca

SEQ ID NO: 6197345 - DNA, 16 bp, Homo sapiens
cttcctcctccctcct

SEQ ID NO: 6197346 - DNA, 14 bp, Homo sapiens
cttcctcctctcaa

SEQ ID NO: 6197347 - DNA, 18 bp, Homo sapiens
cttcctcctgacacccca

SEQ ID NO: 6197348 - DNA, 19 bp, Homo sapiens
cttcctcctgacaccccac

SEQ ID NO: 6197349 - DNA, 15 bp, Homo sapiens
cttcctcctgcagac

SEQ ID NO: 6197350 - DNA, 22 bp, Homo sapiens
cttcctcctgggccctctctgc

SEQ ID NO: 6197351 - DNA, 17 bp, Homo sapiens
cttcctcggtggctctg

SEQ ID NO: 6197352 - DNA, 22 bp, Homo sapiens
cttcctcggtggctctggggta

SEQ ID NO: 6197353 - DNA, 18 bp, Homo sapiens
cttcctcgtgcagagctg

SEQ ID NO: 6197354 - DNA, 23 bp, Homo sapiens
cttcctcgtgggtcccagagacc

SEQ ID NO: 6197355 - DNA, 23 bp, Homo sapiens
cttcctcgttgggccgctctgat

SEQ ID NO: 6197356 - DNA, 16 bp, Homo sapiens
cttcctctcactcctg

SEQ ID NO: 6197357 - DNA, 17 bp, Homo sapiens
cttcctctcactcctgc

SEQ ID NO: 6197358 - DNA, 23 bp, Homo sapiens
cttcctctcactcctgcctccgc

SEQ ID NO: 6197359 - DNA, 19 bp, Homo sapiens
cttcctctccactgccttc

SEQ ID NO: 6197360 - DNA, 14 bp, Homo sapiens
cttcctctccagcc

SEQ ID NO: 6197361 - DNA, 16 bp, Homo sapiens
cttcctctccttccca

SEQ ID NO: 6197362 - DNA, 18 bp, Homo sapiens
cttcctctcggctggaag

SEQ ID NO: 6197363 - DNA, 15 bp, Homo sapiens
cttcctctctccaga

SEQ ID NO: 6197364 - DNA, 14 bp, Homo sapiens
cttcctctctcgga

SEQ ID NO: 6197365 - DNA, 21 bp, Homo sapiens
cttcctctctctaccagtcta

SEQ ID NO: 6197366 - DNA, 14 bp, Homo sapiens
cttcctctgagccg

SEQ ID NO: 6197367 - DNA, 16 bp, Homo sapiens
cttcctctgagccgca

SEQ ID NO: 6197368 - DNA, 15 bp, Homo sapiens
cttcctctgagcctt

SEQ ID NO: 6197369 - DNA, 14 bp, Homo sapiens
cttcctctgaggct

SEQ ID NO: 6197370 - DNA, 19 bp, Homo sapiens
cttcctctgaggctggatc

SEQ ID NO: 6197371 - DNA, 22 bp, Homo sapiens
cttcctctgcaagtgctcaggg

SEQ ID NO: 6197372 - DNA, 19 bp, Homo sapiens
cttcctctgcagctgacct

SEQ ID NO: 6197373 - DNA, 20 bp, Homo sapiens
cttcctctgcaggacacaga

SEQ ID NO: 6197374 - DNA, 11 bp, Homo sapiens
cttcctctgct

SEQ ID NO: 6197375 - DNA, 13 bp, Homo sapiens
cttcctctgctcc

SEQ ID NO: 6197376 - DNA, 12 bp, Homo sapiens
cttcctctgctg

SEQ ID NO: 6197377 - DNA, 17 bp, Homo sapiens
cttcctctgctgcatcc

SEQ ID NO: 6197378 - DNA, 23 bp, Homo sapiens
cttcctctgctgcatccccttcc

SEQ ID NO: 6197379 - DNA, 20 bp, Homo sapiens
cttcctctggagctttgcag

SEQ ID NO: 6197380 - DNA, 14 bp, Homo sapiens
cttcctctggggct

SEQ ID NO: 6197381 - DNA, 11 bp, Homo sapiens
cttcctctggt

SEQ ID NO: 6197382 - DNA, 19 bp, Homo sapiens
cttcctctggtttctgtgt

SEQ ID NO: 6197383 - DNA, 20 bp, Homo sapiens
cttcctctggtttctgtgtg

SEQ ID NO: 6197384 - DNA, 15 bp, Homo sapiens
cttcctctgtaagat

SEQ ID NO: 6197385 - DNA, 22 bp, Homo sapiens
cttcctctgtaagatatcccag

SEQ ID NO: 6197386 - DNA, 17 bp, Homo sapiens
cttcctctgtcctctca

SEQ ID NO: 6197387 - DNA, 15 bp, Homo sapiens
cttcctctgtgccac

SEQ ID NO: 6197388 - DNA, 19 bp, Homo sapiens
cttcctcttagcctctgga

SEQ ID NO: 6197389 - DNA, 23 bp, Homo sapiens
cttcctcttagcctctggatcta

SEQ ID NO: 6197390 - DNA, 16 bp, Homo sapiens
cttcctcttcctgccc

SEQ ID NO: 6197391 - DNA, 17 bp, Homo sapiens
cttcctcttcctgccct

SEQ ID NO: 6197392 - DNA, 18 bp, Homo sapiens
cttcctcttcctgccctt

SEQ ID NO: 6197393 - DNA, 21 bp, Homo sapiens
cttcctcttgaccctgcaccc

SEQ ID NO: 6197394 - DNA, 15 bp, Homo sapiens
cttcctcttggctga

SEQ ID NO: 6197395 - DNA, 22 bp, Homo sapiens
cttcctctttccatctaccctc

SEQ ID NO: 6197396 - DNA, 17 bp, Homo sapiens
cttcctcttttcctgct

SEQ ID NO: 6197397 - DNA, 17 bp, Homo sapiens
cttcctgaaactatatt

SEQ ID NO: 6197398 - DNA, 19 bp, Homo sapiens
cttcctgaaactatatttt

SEQ ID NO: 6197399 - DNA, 13 bp, Homo sapiens
cttcctgaaataa

SEQ ID NO: 6197400 - DNA, 17 bp, Homo sapiens
cttcctgaaataaacac

SEQ ID NO: 6197401 - DNA, 19 bp, Homo sapiens
cttcctgaaataaacactg

SEQ ID NO: 6197402 - DNA, 21 bp, Homo sapiens
cttcctgaaataaacactggt

SEQ ID NO: 6197403 - DNA, 23 bp, Homo sapiens
cttcctgaagggggacactccat

SEQ ID NO: 6197404 - DNA, 15 bp, Homo sapiens
cttcctgacacttta

SEQ ID NO: 6197405 - DNA, 17 bp, Homo sapiens
cttcctgacactttaat

SEQ ID NO: 6197406 - DNA, 19 bp, Homo sapiens
cttcctgacccggattggc

SEQ ID NO: 6197407 - DNA, 12 bp, Homo sapiens
cttcctgactct

SEQ ID NO: 6197408 - DNA, 19 bp, Homo sapiens
cttcctgactctcacctgt

SEQ ID NO: 6197409 - DNA, 20 bp, Homo sapiens
cttcctgactgacacaggcc

SEQ ID NO: 6197410 - DNA, 20 bp, Homo sapiens
cttcctgagaaagcccacct

SEQ ID NO: 6197411 - DNA, 17 bp, Homo sapiens
gaattgaaaagtttttg

SEQ ID NO: 6197412 - DNA, 20 bp, Homo sapiens
gaattgaaacacttttttgg

SEQ ID NO: 6197413 - DNA, 18 bp, Homo sapiens
gaattgaaccgtcaatgt

SEQ ID NO: 6197414 - DNA, 19 bp, Homo sapiens
gaattgaaccgtcaatgtg

SEQ ID NO: 6197415 - DNA, 22 bp, Homo sapiens
gaattgaagataggagagatac

SEQ ID NO: 6197416 - DNA, 11 bp, Homo sapiens
gaattgaaggt

SEQ ID NO: 6197417 - DNA, 14 bp, Homo sapiens
gaattgaagtcatc

SEQ ID NO: 6197418 - DNA, 16 bp, Homo sapiens
gaattgaatctacaaa

SEQ ID NO: 6197419 - DNA, 16 bp, Homo sapiens
gaattgacattctcta

SEQ ID NO: 6197420 - DNA, 21 bp, Homo sapiens
gaattgaccgacagctttcca

SEQ ID NO: 6197421 - DNA, 18 bp, Homo sapiens
gaattgacttcagcaggg

SEQ ID NO: 6197422 - DNA, 17 bp, Homo sapiens
gaattgagagatgtttt

SEQ ID NO: 6197423 - DNA, 18 bp, Homo sapiens
gaattgagcagttctgtt

SEQ ID NO: 6197424 - DNA, 19 bp, Homo sapiens
gaattgaggggaggtggcc

SEQ ID NO: 6197425 - DNA, 15 bp, Homo sapiens
gaattgaggtctgct

SEQ ID NO: 6197426 - DNA, 16 bp, Homo sapiens
gaattgagtaatggtg

SEQ ID NO: 6197427 - DNA, 19 bp, Homo sapiens
gaattgagtgtttaaagtt

SEQ ID NO: 6197428 - DNA, 14 bp, Homo sapiens
gaattgataataaa

SEQ ID NO: 6197429 - DNA, 22 bp, Homo sapiens
gaattgatacgtttattaggaa

SEQ ID NO: 6197430 - DNA, 21 bp, Homo sapiens
gaattgatcattttcccccca

SEQ ID NO: 6197431 - DNA, 12 bp, Homo sapiens
gaattgatttgc

SEQ ID NO: 6197432 - DNA, 13 bp, Homo sapiens
gaattgatttgca

SEQ ID NO: 6197433 - DNA, 12 bp, Homo sapiens
gaattgattttt

SEQ ID NO: 6197434 - DNA, 20 bp, Homo sapiens
gaattgcaatacattgttca

SEQ ID NO: 6197435 - DNA, 14 bp, Homo sapiens
gaattgcagagtac

SEQ ID NO: 6197436 - DNA, 15 bp, Homo sapiens
gaattgcatacaact

SEQ ID NO: 6197437 - DNA, 13 bp, Homo sapiens
gaattgcattgac

SEQ ID NO: 6197438 - DNA, 20 bp, Homo sapiens
gaattgccacataattcatt

SEQ ID NO: 6197439 - DNA, 21 bp, Homo sapiens
gaattgccacataattcatta

SEQ ID NO: 6197440 - DNA, 23 bp, Homo sapiens
gaattgccaggggcgaggccctt

SEQ ID NO: 6197441 - DNA, 15 bp, Homo sapiens
gaattgccagtcttt

SEQ ID NO: 6197442 - DNA, 12 bp, Homo sapiens
gaattgcctgcc

SEQ ID NO: 6197443 - DNA, 23 bp, Homo sapiens
gaattgccttaaggccacactgg

SEQ ID NO: 6197444 - DNA, 20 bp, Homo sapiens
gaattgcttgaacccaggag

SEQ ID NO: 6197445 - DNA, 22 bp, Homo sapiens
gaattgcttgaacccaggaggc

SEQ ID NO: 6197446 - DNA, 11 bp, Homo sapiens
gaattgcttta

SEQ ID NO: 6197447 - DNA, 14 bp, Homo sapiens
gaattgctttatgg

SEQ ID NO: 6197448 - DNA, 20 bp, Homo sapiens
gaattggagaaaagcacaat

SEQ ID NO: 6197449 - DNA, 20 bp, Homo sapiens
gaattggagtcgtgttgtca

SEQ ID NO: 6197450 - DNA, 16 bp, Homo sapiens
gaattggcagaagcag

SEQ ID NO: 6197451 - DNA, 22 bp, Homo sapiens
gaattggcatttcccaatattt

SEQ ID NO: 6197452 - DNA, 20 bp, Homo sapiens
gaattggccagaggaaatct

SEQ ID NO: 6197453 - DNA, 13 bp, Homo sapiens
gaattggcctgaa

SEQ ID NO: 6197454 - DNA, 20 bp, Homo sapiens
gaattggcctgaacagatgt

SEQ ID NO: 6197455 - DNA, 13 bp, Homo sapiens
gaattggggaggg

SEQ ID NO: 6197456 - DNA, 14 bp, Homo sapiens
gaattggtgaataa

SEQ ID NO: 6197457 - DNA, 15 bp, Homo sapiens
gaattggtgattctg

SEQ ID NO: 6197458 - DNA, 13 bp, Homo sapiens
gaattggtgtata

SEQ ID NO: 6197459 - DNA, 15 bp, Homo sapiens
gaattggtgtatatc

SEQ ID NO: 6197460 - DNA, 19 bp, Homo sapiens
gaattgtacctatttctga

SEQ ID NO: 6197461 - DNA, 16 bp, Homo sapiens
gaattgtcacatctat

SEQ ID NO: 6197462 - DNA, 17 bp, Homo sapiens
gaattgtccatgtgctt

SEQ ID NO: 6197463 - DNA, 19 bp, Homo sapiens
gaattgtccatgtgcttcc

SEQ ID NO: 6197464 - DNA, 23 bp, Homo sapiens
gaattgtccccagtttgcagaaa

SEQ ID NO: 6197465 - DNA, 16 bp, Homo sapiens
gaattgtctctgggct

SEQ ID NO: 6197466 - DNA, 11 bp, Homo sapiens
gaattgtcttg

SEQ ID NO: 6197467 - DNA, 16 bp, Homo sapiens
gaattgtgctccaaat

SEQ ID NO: 6197468 - DNA, 18 bp, Homo sapiens
gaattgtggctatcctga

SEQ ID NO: 6197469 - DNA, 20 bp, Homo sapiens
gaattgtggctatcctgatt

SEQ ID NO: 6197470 - DNA, 22 bp, Homo sapiens
gaattgtggtttatatatttaa

SEQ ID NO: 6197471 - DNA, 20 bp, Homo sapiens
gaattgtgtattgatgcaat

SEQ ID NO: 6197472 - DNA, 16 bp, Homo sapiens
gaattgtgtctgcagg

SEQ ID NO: 6197473 - DNA, 19 bp, Homo sapiens
gaattgtgtggagaagtgt

SEQ ID NO: 6197474 - DNA, 18 bp, Homo sapiens
gaattgtgtgttaatgtc

SEQ ID NO: 6197475 - DNA, 15 bp, Homo sapiens
gaattgtgtttataa

SEQ ID NO: 6197476 - DNA, 12 bp, Homo sapiens
gaattgttacat

SEQ ID NO: 6197477 - DNA, 13 bp, Homo sapiens
gaattgttatgaa

SEQ ID NO: 6197478 - DNA, 22 bp, Homo sapiens
gaattgttatgtaaacatcata

SEQ ID NO: 6197479 - DNA, 16 bp, Homo sapiens
gaattgttgaaactaa

SEQ ID NO: 6197480 - DNA, 13 bp, Homo sapiens
gaattgttgaatg

SEQ ID NO: 6197481 - DNA, 17 bp, Homo sapiens
gaattgttgaatgtatt

SEQ ID NO: 6197482 - DNA, 20 bp, Homo sapiens
gaattgtttagattttgtgt

SEQ ID NO: 6197483 - DNA, 15 bp, Homo sapiens
gaattgtttatacac

SEQ ID NO: 6197484 - DNA, 22 bp, Homo sapiens
gaattgtttggcaatgcactga

SEQ ID NO: 6197485 - DNA, 15 bp, Homo sapiens
gaatttaaaaatatc

SEQ ID NO: 6197486 - DNA, 15 bp, Homo sapiens
gaatttaaaactgtt

SEQ ID NO: 6197487 - DNA, 22 bp, Homo sapiens
gaatttaaaaggtgtcaacttt

SEQ ID NO: 6197488 - DNA, 18 bp, Homo sapiens
gaatttaaaattaagtag

SEQ ID NO: 6197489 - DNA, 22 bp, Homo sapiens
gaatttaaatagcttttttctc

SEQ ID NO: 6197490 - DNA, 13 bp, Homo sapiens
gaatttaaatata

SEQ ID NO: 6197491 - DNA, 14 bp, Homo sapiens
gaatttaaatataa

SEQ ID NO: 6197492 - DNA, 15 bp, Homo sapiens
gaatttaaatataat

SEQ ID NO: 6197493 - DNA, 23 bp, Homo sapiens
gaatttaaatataattctgtaaa

SEQ ID NO: 6197494 - DNA, 21 bp, Homo sapiens
gaatttaaattctttttcaaa

SEQ ID NO: 6197495 - DNA, 17 bp, Homo sapiens
gaatttaacaatgcgaa

SEQ ID NO: 6197496 - DNA, 22 bp, Homo sapiens
gaatttaactactaagaataaa

SEQ ID NO: 6197497 - DNA, 21 bp, Homo sapiens
gaatttaaggagggacaagaa

SEQ ID NO: 6197498 - DNA, 19 bp, Homo sapiens
gaatttaaggcaaaaaagg

SEQ ID NO: 6197499 - DNA, 16 bp, Homo sapiens
gaatttaattctttca

SEQ ID NO: 6197500 - DNA, 18 bp, Homo sapiens
gaatttaatttatgtgaa

SEQ ID NO: 6197501 - DNA, 16 bp, Homo sapiens
gaatttaccagaaata

SEQ ID NO: 6197502 - DNA, 15 bp, Homo sapiens
gaatttagatcttat

SEQ ID NO: 6197503 - DNA, 18 bp, Homo sapiens
gaatttagatcttatatt

SEQ ID NO: 6197504 - DNA, 22 bp, Homo sapiens
gaatttagatcttatattggtt

SEQ ID NO: 6197505 - DNA, 23 bp, Homo sapiens
gaatttagccctggtttgaaatt

SEQ ID NO: 6197506 - DNA, 17 bp, Homo sapiens
gaatttagtattatcaa

SEQ ID NO: 6197507 - DNA, 23 bp, Homo sapiens
gaatttagtgatactggctcaga

SEQ ID NO: 6197508 - DNA, 22 bp, Homo sapiens
gaatttagtttgtactcagtgg

SEQ ID NO: 6197509 - DNA, 13 bp, Homo sapiens
gaatttataattc

SEQ ID NO: 6197510 - DNA, 12 bp, Homo sapiens
gaatttatataa

SEQ ID NO: 6197511 - DNA, 18 bp, Homo sapiens
gaatttatataaagtatt

SEQ ID NO: 6197512 - DNA, 21 bp, Homo sapiens
gaatttatccaattttgatct

SEQ ID NO: 6197513 - DNA, 21 bp, Homo sapiens
gaatttatccctttacaatgt

SEQ ID NO: 6197514 - DNA, 13 bp, Homo sapiens
gaatttattcaat

SEQ ID NO: 6197515 - DNA, 14 bp, Homo sapiens
gaatttattggctt

SEQ ID NO: 6197516 - DNA, 21 bp, Homo sapiens
gaatttattggcttttctgat

SEQ ID NO: 6197517 - DNA, 18 bp, Homo sapiens
gaatttcaaaccattgct

SEQ ID NO: 6197518 - DNA, 12 bp, Homo sapiens
gaatttcaatat

SEQ ID NO: 6197519 - DNA, 16 bp, Homo sapiens
gaatttcatgtgaatc

SEQ ID NO: 6197520 - DNA, 16 bp, Homo sapiens
gaatttcccaaagcag

SEQ ID NO: 6197521 - DNA, 22 bp, Homo sapiens
gaatttcccaaagcagtgcatg

SEQ ID NO: 6197522 - DNA, 14 bp, Homo sapiens
gaatttcccaggac

SEQ ID NO: 6197523 - DNA, 15 bp, Homo sapiens
gaatttcccaggacc

SEQ ID NO: 6197524 - DNA, 15 bp, Homo sapiens
gaatttcctatctgt

SEQ ID NO: 6197525 - DNA, 13 bp, Homo sapiens
gaatttcctctat

SEQ ID NO: 6197526 - DNA, 21 bp, Homo sapiens
gaatttcctctattgatgtac

SEQ ID NO: 6197527 - DNA, 12 bp, Homo sapiens
gaatttctaaaa

SEQ ID NO: 6197528 - DNA, 18 bp, Homo sapiens
gaatttctaaaaagatta

SEQ ID NO: 6197529 - DNA, 16 bp, Homo sapiens
gaatttctagacagta

SEQ ID NO: 6197530 - DNA, 20 bp, Homo sapiens
gaatttctagacagtattgc

SEQ ID NO: 6197531 - DNA, 22 bp, Homo sapiens
gaatttctagacagtattgcca

SEQ ID NO: 6197532 - DNA, 21 bp, Homo sapiens
gaatttctcctttcctacagt

SEQ ID NO: 6197533 - DNA, 13 bp, Homo sapiens
gaatttctgattt

SEQ ID NO: 6197534 - DNA, 12 bp, Homo sapiens
gaatttctggcc

SEQ ID NO: 6197535 - DNA, 13 bp, Homo sapiens
gaatttcttaact

SEQ ID NO: 6197536 - DNA, 18 bp, Homo sapiens
gaatttcttaacttcttg

SEQ ID NO: 6197537 - DNA, 14 bp, Homo sapiens
gaatttcttctttt

SEQ ID NO: 6197538 - DNA, 20 bp, Homo sapiens
gaatttctttgtcattcaag

SEQ ID NO: 6197539 - DNA, 14 bp, Homo sapiens
gaatttcttttcct

SEQ ID NO: 6197540 - DNA, 21 bp, Homo sapiens
gaatttgaagacttcaaaata

SEQ ID NO: 6197541 - DNA, 12 bp, Homo sapiens
gaatttgaagag

SEQ ID NO: 6197542 - DNA, 19 bp, Homo sapiens
gaatttgaagctgcagtga

SEQ ID NO: 6197543 - DNA, 14 bp, Homo sapiens
gaatttgaatgaaa

SEQ ID NO: 6197544 - DNA, 9 bp, Homo sapiens
gaatttgag

SEQ ID NO: 6197545 - DNA, 13 bp, Homo sapiens
gaatttgagaacc

SEQ ID NO: 6197546 - DNA, 17 bp, Homo sapiens
gaatttgagtgctctga

SEQ ID NO: 6197547 - DNA, 13 bp, Homo sapiens
gaatttgattgct

SEQ ID NO: 6197548 - DNA, 11 bp, Homo sapiens
gaatttgcaaa

SEQ ID NO: 6197549 - DNA, 14 bp, Homo sapiens
gaatttgcaaagta

SEQ ID NO: 6197550 - DNA, 10 bp, Homo sapiens
gaatttgcat

SEQ ID NO: 6197551 - DNA, 18 bp, Homo sapiens
gaatttgcatacttacct

SEQ ID NO: 6197552 - DNA, 14 bp, Homo sapiens
gaatttgccctggg

SEQ ID NO: 6197553 - DNA, 23 bp, Homo sapiens
gaatttgccctgggaaacccctt

SEQ ID NO: 6197554 - DNA, 13 bp, Homo sapiens
gaatttgctgggg

SEQ ID NO: 6197555 - DNA, 15 bp, Homo sapiens
gaatttgctttatct

SEQ ID NO: 6197556 - DNA, 15 bp, Homo sapiens
gaatttggcccagag

SEQ ID NO: 6197557 - DNA, 23 bp, Homo sapiens
gaatttgggaggaggaaaagaaa

SEQ ID NO: 6197558 - DNA, 13 bp, Homo sapiens
gaatttgggcctc

SEQ ID NO: 6197559 - DNA, 15 bp, Homo sapiens
gaatttggggcagga

SEQ ID NO: 6197560 - DNA, 18 bp, Homo sapiens
gaatttggggcttccaag

SEQ ID NO: 6197561 - DNA, 19 bp, Homo sapiens
gaatttggggcttccaagt

SEQ ID NO: 6197562 - DNA, 15 bp, Homo sapiens
gaatttggtacacat

SEQ ID NO: 6197563 - DNA, 16 bp, Homo sapiens
gaatttggtacacatg

SEQ ID NO: 6197564 - DNA, 20 bp, Homo sapiens
gaatttggtacacatgtgtt

SEQ ID NO: 6197565 - DNA, 23 bp, Homo sapiens
gaatttggtacacatgtgttatc

SEQ ID NO: 6197566 - DNA, 20 bp, Homo sapiens
gaatttggtgtggctgtatt

SEQ ID NO: 6197567 - DNA, 18 bp, Homo sapiens
gaatttgtaacctcagct

SEQ ID NO: 6197568 - DNA, 19 bp, Homo sapiens
gaatttgtaacctcagctc

SEQ ID NO: 6197569 - DNA, 21 bp, Homo sapiens
gaatttgtaacctcagctctg

SEQ ID NO: 6197570 - DNA, 13 bp, Homo sapiens
gaatttgtaagca

SEQ ID NO: 6197571 - DNA, 22 bp, Homo sapiens
gaatttgtatatgactgcattt

SEQ ID NO: 6197572 - DNA, 16 bp, Homo sapiens
gaatttgtattaaaaa

SEQ ID NO: 6197573 - DNA, 13 bp, Homo sapiens
gaatttgtatttt

SEQ ID NO: 6197574 - DNA, 14 bp, Homo sapiens
gaatttgtattttg

SEQ ID NO: 6197575 - DNA, 21 bp, Homo sapiens
gaatttgtcagcgttctacca

SEQ ID NO: 6197576 - DNA, 19 bp, Homo sapiens
gaatttgtccattgtaaat

SEQ ID NO: 6197577 - DNA, 21 bp, Homo sapiens
gaatttgtccattgtaaatct

SEQ ID NO: 6197578 - DNA, 21 bp, Homo sapiens
gaatttgtccatttaaaaatg

SEQ ID NO: 6197579 - DNA, 21 bp, Homo sapiens
gaatttgtgttgaaggaactt

SEQ ID NO: 6197580 - DNA, 12 bp, Homo sapiens
gaatttgtttaa

SEQ ID NO: 6197581 - DNA, 19 bp, Homo sapiens
gaatttgtttcatctattt

SEQ ID NO: 6197582 - DNA, 20 bp, Homo sapiens
gaattttaaaaaagatggat

SEQ ID NO: 6197583 - DNA, 19 bp, Homo sapiens
gaattttaaaatgcaaata

SEQ ID NO: 6197584 - DNA, 21 bp, Homo sapiens
gaattttaaaatgtagaagaa

SEQ ID NO: 6197585 - DNA, 15 bp, Homo sapiens
gaattttaaagtatg

SEQ ID NO: 6197586 - DNA, 16 bp, Homo sapiens
gaattttaaataatgt

SEQ ID NO: 6197587 - DNA, 18 bp, Homo sapiens
gaattttaaataatgtat

SEQ ID NO: 6197588 - DNA, 15 bp, Homo sapiens
gaattttaatgtgaa

SEQ ID NO: 6197589 - DNA, 17 bp, Homo sapiens
gaattttaatgtgaaga

SEQ ID NO: 6197590 - DNA, 15 bp, Homo sapiens
gaattttacatggta

SEQ ID NO: 6197591 - DNA, 15 bp, Homo sapiens
cttcctgagctttat

SEQ ID NO: 6197592 - DNA, 13 bp, Homo sapiens
cttcctgagggga

SEQ ID NO: 6197593 - DNA, 14 bp, Homo sapiens
cttcctgagttcag

SEQ ID NO: 6197594 - DNA, 17 bp, Homo sapiens
cttcctgcaacaccttg

SEQ ID NO: 6197595 - DNA, 18 bp, Homo sapiens
cttcctgcaaccactctg

SEQ ID NO: 6197596 - DNA, 20 bp, Homo sapiens
cttcctgcaaccactctgtg

SEQ ID NO: 6197597 - DNA, 15 bp, Homo sapiens
cttcctgcaattttc

SEQ ID NO: 6197598 - DNA, 11 bp, Homo sapiens
cttcctgcacc

SEQ ID NO: 6197599 - DNA, 14 bp, Homo sapiens
cttcctgcacccgt

SEQ ID NO: 6197600 - DNA, 15 bp, Homo sapiens
cttcctgcacccgta

SEQ ID NO: 6197601 - DNA, 15 bp, Homo sapiens
cttcctgcagacctg

SEQ ID NO: 6197602 - DNA, 16 bp, Homo sapiens
cttcctgcagacctgg

SEQ ID NO: 6197603 - DNA, 18 bp, Homo sapiens
cttcctgcagacctggct

SEQ ID NO: 6197604 - DNA, 20 bp, Homo sapiens
cttcctgcagaggcccagcc

SEQ ID NO: 6197605 - DNA, 21 bp, Homo sapiens
cttcctgcagaggcccagcca

SEQ ID NO: 6197606 - DNA, 20 bp, Homo sapiens
cttcctgcaggcaggaacaa

SEQ ID NO: 6197607 - DNA, 21 bp, Homo sapiens
cttcctgcattcacccagaca

SEQ ID NO: 6197608 - DNA, 14 bp, Homo sapiens
cttcctgcatttct

SEQ ID NO: 6197609 - DNA, 11 bp, Homo sapiens
cttcctgccac

SEQ ID NO: 6197610 - DNA, 21 bp, Homo sapiens
cttcctgccaccagtcactgt

SEQ ID NO: 6197611 - DNA, 14 bp, Homo sapiens
cttcctgccactgc

SEQ ID NO: 6197612 - DNA, 15 bp, Homo sapiens
cttcctgccagcagg

SEQ ID NO: 6197613 - DNA, 15 bp, Homo sapiens
cttcctgccagcccc

SEQ ID NO: 6197614 - DNA, 20 bp, Homo sapiens
cttcctgccagcccctgcca

SEQ ID NO: 6197615 - DNA, 14 bp, Homo sapiens
cttcctgcccaggg

SEQ ID NO: 6197616 - DNA, 13 bp, Homo sapiens
cttcctgcccctc

SEQ ID NO: 6197617 - DNA, 19 bp, Homo sapiens
cttcctgcccctctttctc

SEQ ID NO: 6197618 - DNA, 22 bp, Homo sapiens
cttcctgcccctctttctcttt

SEQ ID NO: 6197619 - DNA, 11 bp, Homo sapiens
cttcctgccct

SEQ ID NO: 6197620 - DNA, 13 bp, Homo sapiens
cttcctgccctgt

SEQ ID NO: 6197621 - DNA, 15 bp, Homo sapiens
cttcctgcccttccc

SEQ ID NO: 6197622 - DNA, 16 bp, Homo sapiens
cttcctgcccttccct

SEQ ID NO: 6197623 - DNA, 19 bp, Homo sapiens
cttcctgccggttccgccc

SEQ ID NO: 6197624 - DNA, 22 bp, Homo sapiens
cttcctgcctcccaagcagctg

SEQ ID NO: 6197625 - DNA, 16 bp, Homo sapiens
cttcctgcctggtctc

SEQ ID NO: 6197626 - DNA, 18 bp, Homo sapiens
cttcctgcgtcctcctca

SEQ ID NO: 6197627 - DNA, 18 bp, Homo sapiens
cttcctgctacaggaggg

SEQ ID NO: 6197628 - DNA, 13 bp, Homo sapiens
cttcctgctgcac

SEQ ID NO: 6197629 - DNA, 15 bp, Homo sapiens
cttcctgctgcaccc

SEQ ID NO: 6197630 - DNA, 23 bp, Homo sapiens
cttcctgctgcaccctgcgcctc

SEQ ID NO: 6197631 - DNA, 12 bp, Homo sapiens
cttcctgctgct

SEQ ID NO: 6197632 - DNA, 14 bp, Homo sapiens
cttcctgctgggac

SEQ ID NO: 6197633 - DNA, 15 bp, Homo sapiens
cttcctgctgggact

SEQ ID NO: 6197634 - DNA, 16 bp, Homo sapiens
cttcctgctgggactg

SEQ ID NO: 6197635 - DNA, 18 bp, Homo sapiens
cttcctgcttcctcagag

SEQ ID NO: 6197636 - DNA, 15 bp, Homo sapiens
cttcctgcttcctgt

SEQ ID NO: 6197637 - DNA, 12 bp, Homo sapiens
cttcctgcttgc

SEQ ID NO: 6197638 - DNA, 13 bp, Homo sapiens
cttcctggaataa

SEQ ID NO: 6197639 - DNA, 15 bp, Homo sapiens
cttcctggacacact

SEQ ID NO: 6197640 - DNA, 17 bp, Homo sapiens
cttcctggacacactct

SEQ ID NO: 6197641 - DNA, 14 bp, Homo sapiens
cttcctggacagct

SEQ ID NO: 6197642 - DNA, 15 bp, Homo sapiens
cttcctggacagctg

SEQ ID NO: 6197643 - DNA, 17 bp, Homo sapiens
cttcctggacagtgaga

SEQ ID NO: 6197644 - DNA, 17 bp, Homo sapiens
cttcctggaccggggcc

SEQ ID NO: 6197645 - DNA, 15 bp, Homo sapiens
cttcctggacctgag

SEQ ID NO: 6197646 - DNA, 23 bp, Homo sapiens
cttcctggactggcccttgccca

SEQ ID NO: 6197647 - DNA, 16 bp, Homo sapiens
cttcctggagcccaga

SEQ ID NO: 6197648 - DNA, 17 bp, Homo sapiens
cttcctggagcccagag

SEQ ID NO: 6197649 - DNA, 22 bp, Homo sapiens
cttcctggagcccagaggaggg

SEQ ID NO: 6197650 - DNA, 16 bp, Homo sapiens
cttcctggatggggca

SEQ ID NO: 6197651 - DNA, 20 bp, Homo sapiens
cttcctggatggggcagagc

SEQ ID NO: 6197652 - DNA, 23 bp, Homo sapiens
cttcctggattttctttctatgt

SEQ ID NO: 6197653 - DNA, 23 bp, Homo sapiens
cttcctggcacaatgttggagca

SEQ ID NO: 6197654 - DNA, 19 bp, Homo sapiens
cttcctggccgcctgggtc

SEQ ID NO: 6197655 - DNA, 12 bp, Homo sapiens
cttcctggcctc

SEQ ID NO: 6197656 - DNA, 20 bp, Homo sapiens
cttcctggcctcactggctg

SEQ ID NO: 6197657 - DNA, 15 bp, Homo sapiens
cttcctggcctccct

SEQ ID NO: 6197658 - DNA, 22 bp, Homo sapiens
cttcctggcctcccttctcctt

SEQ ID NO: 6197659 - DNA, 21 bp, Homo sapiens
cttcctggcctcttctgggct

SEQ ID NO: 6197660 - DNA, 15 bp, Homo sapiens
cttcctggcctgaga

SEQ ID NO: 6197661 - DNA, 20 bp, Homo sapiens
cttcctggcgggggtgggcc

SEQ ID NO: 6197662 - DNA, 14 bp, Homo sapiens
cttcctggctagga

SEQ ID NO: 6197663 - DNA, 19 bp, Homo sapiens
cttcctggctccttcactg

SEQ ID NO: 6197664 - DNA, 16 bp, Homo sapiens
cttcctggctctgggg

SEQ ID NO: 6197665 - DNA, 18 bp, Homo sapiens
cttcctggctctggggga

SEQ ID NO: 6197666 - DNA, 19 bp, Homo sapiens
cttcctgggatgatgtgtg

SEQ ID NO: 6197667 - DNA, 21 bp, Homo sapiens
cttcctgggcacacgctgctc

SEQ ID NO: 6197668 - DNA, 13 bp, Homo sapiens
cttcctgggcagt

SEQ ID NO: 6197669 - DNA, 14 bp, Homo sapiens
cttcctggggacca

SEQ ID NO: 6197670 - DNA, 18 bp, Homo sapiens
cttcctggggatgtcata

SEQ ID NO: 6197671 - DNA, 18 bp, Homo sapiens
cttcctggggcccaaatg

SEQ ID NO: 6197672 - DNA, 23 bp, Homo sapiens
cttcctgggtcaagtgctaacct

SEQ ID NO: 6197673 - DNA, 19 bp, Homo sapiens
cttcctgggtcctgcctgg

SEQ ID NO: 6197674 - DNA, 21 bp, Homo sapiens
cttcctgggtcctgttcccta

SEQ ID NO: 6197675 - DNA, 17 bp, Homo sapiens
cttcctgggtgttagaa

SEQ ID NO: 6197676 - DNA, 21 bp, Homo sapiens
cttcctggtgagaactgagga

SEQ ID NO: 6197677 - DNA, 20 bp, Homo sapiens
cttcctggtgaggcccagcc

SEQ ID NO: 6197678 - DNA, 22 bp, Homo sapiens
cttcctggtgaggcccagcctg

SEQ ID NO: 6197679 - DNA, 23 bp, Homo sapiens
cttcctggtgaggcccagcctgt

SEQ ID NO: 6197680 - DNA, 19 bp, Homo sapiens
cttcctggttttgtacact

SEQ ID NO: 6197681 - DNA, 23 bp, Homo sapiens
cttcctgtccactctcggggccc

SEQ ID NO: 6197682 - DNA, 19 bp, Homo sapiens
cttcctgtccccaaaatgt

SEQ ID NO: 6197683 - DNA, 15 bp, Homo sapiens
cttcctgtccccagg

SEQ ID NO: 6197684 - DNA, 18 bp, Homo sapiens
cttcctgtccccatctgt

SEQ ID NO: 6197685 - DNA, 17 bp, Homo sapiens
cttcctgtccgccctct

SEQ ID NO: 6197686 - DNA, 14 bp, Homo sapiens
cttcctgtcctgcc

SEQ ID NO: 6197687 - DNA, 15 bp, Homo sapiens
cttcctgtcctgcct

SEQ ID NO: 6197688 - DNA, 16 bp, Homo sapiens
cttcctgtcctgcctc

SEQ ID NO: 6197689 - DNA, 19 bp, Homo sapiens
cttcctgtcctgcctcctc

SEQ ID NO: 6197690 - DNA, 20 bp, Homo sapiens
cttcctgtcctgcctcctca

SEQ ID NO: 6197691 - DNA, 16 bp, Homo sapiens
cttcctgtcctgctca

SEQ ID NO: 6197692 - DNA, 23 bp, Homo sapiens
cttcctgtccttgttcatggaga

SEQ ID NO: 6197693 - DNA, 23 bp, Homo sapiens
cttcctgtctagtctctcctgta

SEQ ID NO: 6197694 - DNA, 20 bp, Homo sapiens
cttcctgtctatttttgttt

SEQ ID NO: 6197695 - DNA, 13 bp, Homo sapiens
cttcctgtctccc

SEQ ID NO: 6197696 - DNA, 14 bp, Homo sapiens
cttcctgtctccca

SEQ ID NO: 6197697 - DNA, 17 bp, Homo sapiens
cttcctgtctgaacaaa

SEQ ID NO: 6197698 - DNA, 15 bp, Homo sapiens
cttcctgtctgttta

SEQ ID NO: 6197699 - DNA, 23 bp, Homo sapiens
cttcctgtctttgttgtctccct

SEQ ID NO: 6197700 - DNA, 16 bp, Homo sapiens
cttcctgtgatccacc

SEQ ID NO: 6197701 - DNA, 18 bp, Homo sapiens
cttcctgtgccctcaccc

SEQ ID NO: 6197702 - DNA, 16 bp, Homo sapiens
cttcctgtgccctgca

SEQ ID NO: 6197703 - DNA, 19 bp, Homo sapiens
cttcctgtgcctttcctat

SEQ ID NO: 6197704 - DNA, 20 bp, Homo sapiens
cttcctgtggatgcaaatag

SEQ ID NO: 6197705 - DNA, 15 bp, Homo sapiens
cttcctgtggcctga

SEQ ID NO: 6197706 - DNA, 18 bp, Homo sapiens
cttcctgtggctccctct

SEQ ID NO: 6197707 - DNA, 20 bp, Homo sapiens
cttcctgtggctccctctct

SEQ ID NO: 6197708 - DNA, 16 bp, Homo sapiens
cttcctgtgggagcag

SEQ ID NO: 6197709 - DNA, 18 bp, Homo sapiens
cttcctgtgggtggggct

SEQ ID NO: 6197710 - DNA, 19 bp, Homo sapiens
cttcctgtgggtggggctt

SEQ ID NO: 6197711 - DNA, 23 bp, Homo sapiens
cttcctgtgggtggggcttctct

SEQ ID NO: 6197712 - DNA, 20 bp, Homo sapiens
cttcctgtgtacctctagaa

SEQ ID NO: 6197713 - DNA, 14 bp, Homo sapiens
cttcctgtgtcctg

SEQ ID NO: 6197714 - DNA, 15 bp, Homo sapiens
cttcctgtgtgtcca

SEQ ID NO: 6197715 - DNA, 16 bp, Homo sapiens
cttcctgttccctcct

SEQ ID NO: 6197716 - DNA, 19 bp, Homo sapiens
cttcctgttccctcctggt

SEQ ID NO: 6197717 - DNA, 21 bp, Homo sapiens
cttcctgttccctcctggtcc

SEQ ID NO: 6197718 - DNA, 14 bp, Homo sapiens
cttcctgttctgaa

SEQ ID NO: 6197719 - DNA, 16 bp, Homo sapiens
cttcctgttctgtgac

SEQ ID NO: 6197720 - DNA, 17 bp, Homo sapiens
cttcctgttctgtgtct

SEQ ID NO: 6197721 - DNA, 23 bp, Homo sapiens
cttcctgttctgtgtctgctgta

SEQ ID NO: 6197722 - DNA, 23 bp, Homo sapiens
cttcctgttggaaggtagagccc

SEQ ID NO: 6197723 - DNA, 20 bp, Homo sapiens
cttcctgtttcagacccccc

SEQ ID NO: 6197724 - DNA, 16 bp, Homo sapiens
cttcctgtttctaagt

SEQ ID NO: 6197725 - DNA, 15 bp, Homo sapiens
cttcctgtttctcgt

SEQ ID NO: 6197726 - DNA, 13 bp, Homo sapiens
cttcctgtttgtt

SEQ ID NO: 6197727 - DNA, 22 bp, Homo sapiens
cttcctgtttgttttgttttct

SEQ ID NO: 6197728 - DNA, 16 bp, Homo sapiens
cttcctgttttaagca

SEQ ID NO: 6197729 - DNA, 17 bp, Homo sapiens
cttcctgtttttcacat

SEQ ID NO: 6197730 - DNA, 18 bp, Homo sapiens
cttcctgtttttcacatt

SEQ ID NO: 6197731 - DNA, 23 bp, Homo sapiens
cttcctgtttttcacattttcct

SEQ ID NO: 6197732 - DNA, 20 bp, Homo sapiens
cttccttaacagctgtatta

SEQ ID NO: 6197733 - DNA, 15 bp, Homo sapiens
cttccttatgcttct

SEQ ID NO: 6197734 - DNA, 23 bp, Homo sapiens
cttccttatgtatcagtgtcctt

SEQ ID NO: 6197735 - DNA, 20 bp, Homo sapiens
cttccttcaaatcctgccac

SEQ ID NO: 6197736 - DNA, 14 bp, Homo sapiens
cttccttcaactgc

SEQ ID NO: 6197737 - DNA, 21 bp, Homo sapiens
cttccttcagagagcagtgct

SEQ ID NO: 6197738 - DNA, 18 bp, Homo sapiens
cttccttcaggactctgc

SEQ ID NO: 6197739 - DNA, 13 bp, Homo sapiens
cttccttcagggt

SEQ ID NO: 6197740 - DNA, 12 bp, Homo sapiens
cttccttcagtt

SEQ ID NO: 6197741 - DNA, 14 bp, Homo sapiens
cttccttccatttt

SEQ ID NO: 6197742 - DNA, 13 bp, Homo sapiens
cttccttcccacc

SEQ ID NO: 6197743 - DNA, 12 bp, Homo sapiens
cttccttccccc

SEQ ID NO: 6197744 - DNA, 12 bp, Homo sapiens
cttccttccctg

SEQ ID NO: 6197745 - DNA, 15 bp, Homo sapiens
cttccttccctgctg

SEQ ID NO: 6197746 - DNA, 16 bp, Homo sapiens
cttccttccctgctgt

SEQ ID NO: 6197747 - DNA, 14 bp, Homo sapiens
cttccttccctggc

SEQ ID NO: 6197748 - DNA, 14 bp, Homo sapiens
cttccttcctagaa

SEQ ID NO: 6197749 - DNA, 13 bp, Homo sapiens
cttccttcctgtt

SEQ ID NO: 6197750 - DNA, 12 bp, Homo sapiens
cttccttccttt

SEQ ID NO: 6197751 - DNA, 20 bp, Homo sapiens
cttccttcggtcttttgtat

SEQ ID NO: 6197752 - DNA, 13 bp, Homo sapiens
cttccttctcagc

SEQ ID NO: 6197753 - DNA, 19 bp, Homo sapiens
cttccttctcatcttgcct

SEQ ID NO: 6197754 - DNA, 13 bp, Homo sapiens
cttccttctctac

SEQ ID NO: 6197755 - DNA, 11 bp, Homo sapiens
cttccttctgc

SEQ ID NO: 6197756 - DNA, 13 bp, Homo sapiens
cttccttctgcac

SEQ ID NO: 6197757 - DNA, 14 bp, Homo sapiens
cttccttctgcacc

SEQ ID NO: 6197758 - DNA, 20 bp, Homo sapiens
cttccttctgctcccacccc

SEQ ID NO: 6197759 - DNA, 14 bp, Homo sapiens
cttccttctgggac

SEQ ID NO: 6197760 - DNA, 18 bp, Homo sapiens
cttccttctttctcttcc

SEQ ID NO: 6197761 - DNA, 20 bp, Homo sapiens
cttccttctttctcttccct

SEQ ID NO: 6197762 - DNA, 21 bp, Homo sapiens
cttccttctttctcttccctc

SEQ ID NO: 6197763 - DNA, 14 bp, Homo sapiens
cttccttgaaccct

SEQ ID NO: 6197764 - DNA, 21 bp, Homo sapiens
cttccttgaagaactgcaggc

SEQ ID NO: 6197765 - DNA, 15 bp, Homo sapiens
cttccttgaccagca

SEQ ID NO: 6197766 - DNA, 22 bp, Homo sapiens
cttccttgaccagcagatccca

SEQ ID NO: 6197767 - DNA, 22 bp, Homo sapiens
cttccttgacctgcattgtaaa

SEQ ID NO: 6197768 - DNA, 15 bp, Homo sapiens
cttccttgactgtct

SEQ ID NO: 6197769 - DNA, 18 bp, Homo sapiens
cttccttgagacacggag

SEQ ID NO: 6197770 - DNA, 20 bp, Homo sapiens
cttccttgagacacggagcc

SEQ ID NO: 6197771 - DNA, 23 bp, Homo sapiens
gaattttactgtgtttcttttgg

SEQ ID NO: 6197772 - DNA, 15 bp, Homo sapiens
gaattttagcttttg

SEQ ID NO: 6197773 - DNA, 19 bp, Homo sapiens
gaattttaggaacttcaga

SEQ ID NO: 6197774 - DNA, 13 bp, Homo sapiens
gaattttagtcct

SEQ ID NO: 6197775 - DNA, 19 bp, Homo sapiens
gaattttatactttcccta

SEQ ID NO: 6197776 - DNA, 16 bp, Homo sapiens
gaattttatctgtgga

SEQ ID NO: 6197777 - DNA, 14 bp, Homo sapiens
gaattttatctttt

SEQ ID NO: 6197778 - DNA, 15 bp, Homo sapiens
gaattttatttattt

SEQ ID NO: 6197779 - DNA, 13 bp, Homo sapiens
gaattttattttg

SEQ ID NO: 6197780 - DNA, 18 bp, Homo sapiens
gaattttatttttctgtg

SEQ ID NO: 6197781 - DNA, 21 bp, Homo sapiens
gaattttattttttgggaaaa

SEQ ID NO: 6197782 - DNA, 13 bp, Homo sapiens
gaattttcaaagg

SEQ ID NO: 6197783 - DNA, 20 bp, Homo sapiens
gaattttcaagcatctcctg

SEQ ID NO: 6197784 - DNA, 16 bp, Homo sapiens
gaattttcaaggcctt

SEQ ID NO: 6197785 - DNA, 18 bp, Homo sapiens
gaattttcaaggccttca

SEQ ID NO: 6197786 - DNA, 14 bp, Homo sapiens
gaattttcagaccc

SEQ ID NO: 6197787 - DNA, 23 bp, Homo sapiens
gaattttcagaccccagcggctg

SEQ ID NO: 6197788 - DNA, 20 bp, Homo sapiens
gaattttcattttcattatt

SEQ ID NO: 6197789 - DNA, 23 bp, Homo sapiens
gaattttcattttcattatttca

SEQ ID NO: 6197790 - DNA, 23 bp, Homo sapiens
gaattttccacgcagttctttcc

SEQ ID NO: 6197791 - DNA, 15 bp, Homo sapiens
gaattttccagacct

SEQ ID NO: 6197792 - DNA, 16 bp, Homo sapiens
gaattttctaaaagct

SEQ ID NO: 6197793 - DNA, 13 bp, Homo sapiens
gaattttctctcc

SEQ ID NO: 6197794 - DNA, 14 bp, Homo sapiens
gaattttctggaaa

SEQ ID NO: 6197795 - DNA, 13 bp, Homo sapiens
gaattttctgtgt

SEQ ID NO: 6197796 - DNA, 17 bp, Homo sapiens
gaattttctgtgttttg

SEQ ID NO: 6197797 - DNA, 12 bp, Homo sapiens
gaattttctgtt

SEQ ID NO: 6197798 - DNA, 20 bp, Homo sapiens
gaattttctttcatacatta

SEQ ID NO: 6197799 - DNA, 22 bp, Homo sapiens
gaattttctttcatacattata

SEQ ID NO: 6197800 - DNA, 21 bp, Homo sapiens
gaattttctttgtgtagcttt

SEQ ID NO: 6197801 - DNA, 15 bp, Homo sapiens
gaattttgagtgaat

SEQ ID NO: 6197802 - DNA, 22 bp, Homo sapiens
gaattttgagtgaattagacct

SEQ ID NO: 6197803 - DNA, 21 bp, Homo sapiens
gaattttgcaaagatttaatc

SEQ ID NO: 6197804 - DNA, 22 bp, Homo sapiens
gaattttgcaaagatttaatct

SEQ ID NO: 6197805 - DNA, 19 bp, Homo sapiens
gaattttggaaaaatgtca

SEQ ID NO: 6197806 - DNA, 21 bp, Homo sapiens
gaattttggaaaaatgtcact

SEQ ID NO: 6197807 - DNA, 19 bp, Homo sapiens
gaattttggctgtgtctcc

SEQ ID NO: 6197808 - DNA, 12 bp, Homo sapiens
gaattttgtaaa

SEQ ID NO: 6197809 - DNA, 19 bp, Homo sapiens
gaattttgtaaaaagaaat

SEQ ID NO: 6197810 - DNA, 21 bp, Homo sapiens
gaattttgtaaaaagaaattg

SEQ ID NO: 6197811 - DNA, 17 bp, Homo sapiens
gaattttgtatgctgaa

SEQ ID NO: 6197812 - DNA, 13 bp, Homo sapiens
gaattttgtctca

SEQ ID NO: 6197813 - DNA, 16 bp, Homo sapiens
gaattttgtctcactt

SEQ ID NO: 6197814 - DNA, 15 bp, Homo sapiens
gaattttgttgctgt

SEQ ID NO: 6197815 - DNA, 19 bp, Homo sapiens
gaattttgttttcttgatt

SEQ ID NO: 6197816 - DNA, 19 bp, Homo sapiens
gaatttttaaaataaactg

SEQ ID NO: 6197817 - DNA, 18 bp, Homo sapiens
gaatttttaaacaagtat

SEQ ID NO: 6197818 - DNA, 14 bp, Homo sapiens
gaatttttaactgt

SEQ ID NO: 6197819 - DNA, 15 bp, Homo sapiens
gaatttttaactgta

SEQ ID NO: 6197820 - DNA, 21 bp, Homo sapiens
gaatttttactggggattctt

SEQ ID NO: 6197821 - DNA, 13 bp, Homo sapiens
gaatttttcaagt

SEQ ID NO: 6197822 - DNA, 14 bp, Homo sapiens
gaatttttcttgcg

SEQ ID NO: 6197823 - DNA, 14 bp, Homo sapiens
gaatttttgcaata

SEQ ID NO: 6197824 - DNA, 15 bp, Homo sapiens
gaatttttgcaataa

SEQ ID NO: 6197825 - DNA, 19 bp, Homo sapiens
gaatttttgcaataatgca

SEQ ID NO: 6197826 - DNA, 17 bp, Homo sapiens
gaatttttgtttggact

SEQ ID NO: 6197827 - DNA, 22 bp, Homo sapiens
gaatttttgtttggactgtttt

SEQ ID NO: 6197828 - DNA, 22 bp, Homo sapiens
gaattttttcctgctagtgtag

SEQ ID NO: 6197829 - DNA, 14 bp, Homo sapiens
gaattttttgaaat

SEQ ID NO: 6197830 - DNA, 22 bp, Homo sapiens
gaatttttttcagtattatttg

SEQ ID NO: 6197831 - DNA, 20 bp, Homo sapiens
gaatttttttcatcttctct

SEQ ID NO: 6197832 - DNA, 22 bp, Homo sapiens
gaatttttttcatcttctctgg

SEQ ID NO: 6197833 - DNA, 16 bp, Homo sapiens
gaatttttttctgcac

SEQ ID NO: 6197834 - DNA, 20 bp, Homo sapiens
gaatttttttctgcacagct

SEQ ID NO: 6197835 - DNA, 13 bp, Homo sapiens
gaatttttttgta

SEQ ID NO: 6197836 - DNA, 15 bp, Homo sapiens
gaattttttttaaaa

SEQ ID NO: 6197837 - DNA, 15 bp, Homo sapiens
gaattttttttaaca

SEQ ID NO: 6197838 - DNA, 20 bp, Homo sapiens
gaattttttttaacattcct

SEQ ID NO: 6197839 - DNA, 21 bp, Homo sapiens
gaattttttttaacattcctc

SEQ ID NO: 6197840 - DNA, 20 bp, Homo sapiens
gacaaaaaaaaaagaagcag

SEQ ID NO: 6197841 - DNA, 14 bp, Homo sapiens
gacaaaaaaaaaat

SEQ ID NO: 6197842 - DNA, 22 bp, Homo sapiens
gacaaaaaaaaaatagagagag

SEQ ID NO: 6197843 - DNA, 18 bp, Homo sapiens
gacaaaaaattaaagcat

SEQ ID NO: 6197844 - DNA, 22 bp, Homo sapiens
gacaaaaacaagactgcctccc

SEQ ID NO: 6197845 - DNA, 15 bp, Homo sapiens
gacaaaaaccaagtt

SEQ ID NO: 6197846 - DNA, 18 bp, Homo sapiens
gacaaaaagtatattaaa

SEQ ID NO: 6197847 - DNA, 22 bp, Homo sapiens
gacaaaaagtatattaaacaaa

SEQ ID NO: 6197848 - DNA, 16 bp, Homo sapiens
gacaaaaagtttccat

SEQ ID NO: 6197849 - DNA, 13 bp, Homo sapiens
gacaaaaataaca

SEQ ID NO: 6197850 - DNA, 19 bp, Homo sapiens
gacaaaaataacactgttg

SEQ ID NO: 6197851 - DNA, 19 bp, Homo sapiens
gacaaaaataatagtttta

SEQ ID NO: 6197852 - DNA, 16 bp, Homo sapiens
gacaaaaatgtttgta

SEQ ID NO: 6197853 - DNA, 19 bp, Homo sapiens
gacaaaaattgaataatgt

SEQ ID NO: 6197854 - DNA, 21 bp, Homo sapiens
gacaaaacattttgaaggaaa

SEQ ID NO: 6197855 - DNA, 23 bp, Homo sapiens
gacaaaaccccccagatatcatc

SEQ ID NO: 6197856 - DNA, 18 bp, Homo sapiens
gacaaaacgggttactaa

SEQ ID NO: 6197857 - DNA, 14 bp, Homo sapiens
gacaaaacttcttg

SEQ ID NO: 6197858 - DNA, 19 bp, Homo sapiens
gacaaaacttcttgtcaga

SEQ ID NO: 6197859 - DNA, 21 bp, Homo sapiens
gacaaaacttcttgtcagaca

SEQ ID NO: 6197860 - DNA, 22 bp, Homo sapiens
gacaaaacttcttgtcagacat

SEQ ID NO: 6197861 - DNA, 21 bp, Homo sapiens
gacaaaagaaaaaatattaaa

SEQ ID NO: 6197862 - DNA, 18 bp, Homo sapiens
gacaaaagaaaattttcc

SEQ ID NO: 6197863 - DNA, 20 bp, Homo sapiens
gacaaaaggaaacctctgac

SEQ ID NO: 6197864 - DNA, 14 bp, Homo sapiens
gacaaaaggaatgt

SEQ ID NO: 6197865 - DNA, 15 bp, Homo sapiens
gacaaaagggccagg

SEQ ID NO: 6197866 - DNA, 19 bp, Homo sapiens
gacaaaagggccaggtgcg

SEQ ID NO: 6197867 - DNA, 13 bp, Homo sapiens
gacaaaagtaaat

SEQ ID NO: 6197868 - DNA, 17 bp, Homo sapiens
gacaaaagtctgtcttt

SEQ ID NO: 6197869 - DNA, 22 bp, Homo sapiens
gacaaaataaagtgtgtgtgca

SEQ ID NO: 6197870 - DNA, 16 bp, Homo sapiens
gacaaaatatttccca

SEQ ID NO: 6197871 - DNA, 22 bp, Homo sapiens
gacaaaatctaatgttgtcttt

SEQ ID NO: 6197872 - DNA, 18 bp, Homo sapiens
gacaaaatctcctggctt

SEQ ID NO: 6197873 - DNA, 15 bp, Homo sapiens
gacaaaatggaatac

SEQ ID NO: 6197874 - DNA, 17 bp, Homo sapiens
gacaaaatggatacata

SEQ ID NO: 6197875 - DNA, 23 bp, Homo sapiens
gacaaaatgggaggaggaaagag

SEQ ID NO: 6197876 - DNA, 13 bp, Homo sapiens
gacaaaatgttat

SEQ ID NO: 6197877 - DNA, 13 bp, Homo sapiens
gacaaaatgtttt

SEQ ID NO: 6197878 - DNA, 13 bp, Homo sapiens
gacaaaattccag

SEQ ID NO: 6197879 - DNA, 18 bp, Homo sapiens
gacaaaattggccagaga

SEQ ID NO: 6197880 - DNA, 17 bp, Homo sapiens
gacaaaattgtaagcca

SEQ ID NO: 6197881 - DNA, 11 bp, Homo sapiens
gacaaaattta

SEQ ID NO: 6197882 - DNA, 20 bp, Homo sapiens
gacaaaatttagatttaatt

SEQ ID NO: 6197883 - DNA, 15 bp, Homo sapiens
gacaaaatttgagaa

SEQ ID NO: 6197884 - DNA, 18 bp, Homo sapiens
gacaaaattttataagca

SEQ ID NO: 6197885 - DNA, 15 bp, Homo sapiens
gacaaacacaattct

SEQ ID NO: 6197886 - DNA, 19 bp, Homo sapiens
gacaaacagcccttccttg

SEQ ID NO: 6197887 - DNA, 23 bp, Homo sapiens
gacaaacagtagagaacagcaaa

SEQ ID NO: 6197888 - DNA, 14 bp, Homo sapiens
gacaaacagtgaat

SEQ ID NO: 6197889 - DNA, 18 bp, Homo sapiens
gacaaacctagcttttaa

SEQ ID NO: 6197890 - DNA, 20 bp, Homo sapiens
gacaaacctagcttttaaaa

SEQ ID NO: 6197891 - DNA, 16 bp, Homo sapiens
gacaaaccttaaaaca

SEQ ID NO: 6197892 - DNA, 12 bp, Homo sapiens
gacaaactaaac

SEQ ID NO: 6197893 - DNA, 14 bp, Homo sapiens
gacaaactgtaaaa

SEQ ID NO: 6197894 - DNA, 19 bp, Homo sapiens
gacaaagaattccaaagca

SEQ ID NO: 6197895 - DNA, 21 bp, Homo sapiens
gacaaagactcctctgggcct

SEQ ID NO: 6197896 - DNA, 22 bp, Homo sapiens
gacaaagatgatttaaaaggga

SEQ ID NO: 6197897 - DNA, 16 bp, Homo sapiens
gacaaagatttcttct

SEQ ID NO: 6197898 - DNA, 13 bp, Homo sapiens
gacaaagcaggag

SEQ ID NO: 6197899 - DNA, 23 bp, Homo sapiens
gacaaagcatcattgtaaattat

SEQ ID NO: 6197900 - DNA, 17 bp, Homo sapiens
gacaaagccattctttt

SEQ ID NO: 6197901 - DNA, 13 bp, Homo sapiens
gacaaagccctgt

SEQ ID NO: 6197902 - DNA, 15 bp, Homo sapiens
gacaaagccctgtcc

SEQ ID NO: 6197903 - DNA, 23 bp, Homo sapiens
gacaaagcttggaagagcctgca

SEQ ID NO: 6197904 - DNA, 13 bp, Homo sapiens
gacaaaggagcct

SEQ ID NO: 6197905 - DNA, 17 bp, Homo sapiens
gacaaaggagcctgtga

SEQ ID NO: 6197906 - DNA, 17 bp, Homo sapiens
gacaaaggagccttgat

SEQ ID NO: 6197907 - DNA, 17 bp, Homo sapiens
gacaaaggccttaacaa

SEQ ID NO: 6197908 - DNA, 14 bp, Homo sapiens
gacaaagggaggga

SEQ ID NO: 6197909 - DNA, 17 bp, Homo sapiens
gacaaagggagggagca

SEQ ID NO: 6197910 - DNA, 14 bp, Homo sapiens
gacaaaggtgattt

SEQ ID NO: 6197911 - DNA, 21 bp, Homo sapiens
gacaaaggtggtaaattcaga

SEQ ID NO: 6197912 - DNA, 18 bp, Homo sapiens
gacaaaggttttcctctt

SEQ ID NO: 6197913 - DNA, 20 bp, Homo sapiens
gacaaagtgaactctatttt

SEQ ID NO: 6197914 - DNA, 11 bp, Homo sapiens
gacaaagtgcc

SEQ ID NO: 6197915 - DNA, 18 bp, Homo sapiens
gacaaagtgccaaagaaa

SEQ ID NO: 6197916 - DNA, 14 bp, Homo sapiens
gacaaagtgcctca

SEQ ID NO: 6197917 - DNA, 19 bp, Homo sapiens
gacaaagtggaggagggcc

SEQ ID NO: 6197918 - DNA, 21 bp, Homo sapiens
gacaaagtgtgtaattatgta

SEQ ID NO: 6197919 - DNA, 15 bp, Homo sapiens
gacaaagttatatat

SEQ ID NO: 6197920 - DNA, 20 bp, Homo sapiens
gacaaagttccaaaatgcca

SEQ ID NO: 6197921 - DNA, 23 bp, Homo sapiens
gacaaataaatagttgctcttct

SEQ ID NO: 6197922 - DNA, 22 bp, Homo sapiens
gacaaataaatgattatattca

SEQ ID NO: 6197923 - DNA, 22 bp, Homo sapiens
gacaaataactactgcaaaaag

SEQ ID NO: 6197924 - DNA, 18 bp, Homo sapiens
gacaaataagtttttgct

SEQ ID NO: 6197925 - DNA, 15 bp, Homo sapiens
gacaaatacacatac

SEQ ID NO: 6197926 - DNA, 20 bp, Homo sapiens
gacaaatactcatgtgtatg

SEQ ID NO: 6197927 - DNA, 16 bp, Homo sapiens
gacaaataggagtgag

SEQ ID NO: 6197928 - DNA, 17 bp, Homo sapiens
gacaaatagtaggcaag

SEQ ID NO: 6197929 - DNA, 13 bp, Homo sapiens
gacaaatattctc

SEQ ID NO: 6197930 - DNA, 19 bp, Homo sapiens
gacaaatattttagaagct

SEQ ID NO: 6197931 - DNA, 17 bp, Homo sapiens
gacaaatcaacagaagc

SEQ ID NO: 6197932 - DNA, 21 bp, Homo sapiens
gacaaatcaacagaagcattt

SEQ ID NO: 6197933 - DNA, 12 bp, Homo sapiens
gacaaatcaagt

SEQ ID NO: 6197934 - DNA, 14 bp, Homo sapiens
gacaaatcaagttt

SEQ ID NO: 6197935 - DNA, 18 bp, Homo sapiens
gacaaatcacatatttta

SEQ ID NO: 6197936 - DNA, 21 bp, Homo sapiens
gacaaatcctttctgcccccc

SEQ ID NO: 6197937 - DNA, 18 bp, Homo sapiens
gacaaatctcagaacctt

SEQ ID NO: 6197938 - DNA, 17 bp, Homo sapiens
gacaaatgggactgatg

SEQ ID NO: 6197939 - DNA, 16 bp, Homo sapiens
gacaaatgtaaacatt

SEQ ID NO: 6197940 - DNA, 14 bp, Homo sapiens
gacaaattagcatg

SEQ ID NO: 6197941 - DNA, 15 bp, Homo sapiens
gacaaattatatttg

SEQ ID NO: 6197942 - DNA, 16 bp, Homo sapiens
gacaaattctgtttct

SEQ ID NO: 6197943 - DNA, 20 bp, Homo sapiens
gacaaattctgtttcttgag

SEQ ID NO: 6197944 - DNA, 15 bp, Homo sapiens
gacaaatttaaaaca

SEQ ID NO: 6197945 - DNA, 14 bp, Homo sapiens
gacaacacatgtgg

SEQ ID NO: 6197946 - DNA, 16 bp, Homo sapiens
gacaacacccattttt

SEQ ID NO: 6197947 - DNA, 11 bp, Homo sapiens
gacaacactga

SEQ ID NO: 6197948 - DNA, 19 bp, Homo sapiens
gacaacactgggaaacaga

SEQ ID NO: 6197949 - DNA, 13 bp, Homo sapiens
cttccttgcccct

SEQ ID NO: 6197950 - DNA, 15 bp, Homo sapiens
cttccttgcccctgc

SEQ ID NO: 6197951 - DNA, 17 bp, Homo sapiens
cttccttgcccctgctc

SEQ ID NO: 6197952 - DNA, 15 bp, Homo sapiens
cttccttgctctccc

SEQ ID NO: 6197953 - DNA, 15 bp, Homo sapiens
cttccttgctctgca

SEQ ID NO: 6197954 - DNA, 20 bp, Homo sapiens
cttccttgctgtcctaggcc

SEQ ID NO: 6197955 - DNA, 11 bp, Homo sapiens
cttccttggcc

SEQ ID NO: 6197956 - DNA, 20 bp, Homo sapiens
cttccttgggcgtctccccc

SEQ ID NO: 6197957 - DNA, 21 bp, Homo sapiens
cttccttgggcgtctccccca

SEQ ID NO: 6197958 - DNA, 23 bp, Homo sapiens
cttccttgggcgtctcccccaga

SEQ ID NO: 6197959 - DNA, 13 bp, Homo sapiens
cttccttggggaa

SEQ ID NO: 6197960 - DNA, 21 bp, Homo sapiens
cttccttggggaaacttggga

SEQ ID NO: 6197961 - DNA, 18 bp, Homo sapiens
cttccttggttcatgctt

SEQ ID NO: 6197962 - DNA, 23 bp, Homo sapiens
cttccttggttccctcttccctg

SEQ ID NO: 6197963 - DNA, 20 bp, Homo sapiens
cttccttgtagccttttgac

SEQ ID NO: 6197964 - DNA, 14 bp, Homo sapiens
cttccttgtgattg

SEQ ID NO: 6197965 - DNA, 21 bp, Homo sapiens
cttccttgttacccatgaaaa

SEQ ID NO: 6197966 - DNA, 14 bp, Homo sapiens
cttcctttactgtt

SEQ ID NO: 6197967 - DNA, 17 bp, Homo sapiens
cttcctttactttccct

SEQ ID NO: 6197968 - DNA, 23 bp, Homo sapiens
cttcctttactttcccttgcttt

SEQ ID NO: 6197969 - DNA, 15 bp, Homo sapiens
cttcctttataatat

SEQ ID NO: 6197970 - DNA, 13 bp, Homo sapiens
cttcctttcagaa

SEQ ID NO: 6197971 - DNA, 17 bp, Homo sapiens
cttcctttcctactgtc

SEQ ID NO: 6197972 - DNA, 21 bp, Homo sapiens
cttcctttcctactgtcctgg

SEQ ID NO: 6197973 - DNA, 13 bp, Homo sapiens
cttcctttcctct

SEQ ID NO: 6197974 - DNA, 13 bp, Homo sapiens
cttcctttccttt

SEQ ID NO: 6197975 - DNA, 21 bp, Homo sapiens
cttcctttcctttcctttctt

SEQ ID NO: 6197976 - DNA, 14 bp, Homo sapiens
cttcctttctaaat

SEQ ID NO: 6197977 - DNA, 14 bp, Homo sapiens
cttcctttctcccc

SEQ ID NO: 6197978 - DNA, 15 bp, Homo sapiens
cttcctttctcctgc

SEQ ID NO: 6197979 - DNA, 18 bp, Homo sapiens
cttcctttctcctgcccc

SEQ ID NO: 6197980 - DNA, 19 bp, Homo sapiens
cttcctttctctcctggct

SEQ ID NO: 6197981 - DNA, 21 bp, Homo sapiens
cttcctttctctttctctctt

SEQ ID NO: 6197982 - DNA, 23 bp, Homo sapiens
cttcctttcttgtctttcctcct

SEQ ID NO: 6197983 - DNA, 21 bp, Homo sapiens
cttcctttgaaagactgtgct

SEQ ID NO: 6197984 - DNA, 13 bp, Homo sapiens
cttcctttgccct

SEQ ID NO: 6197985 - DNA, 15 bp, Homo sapiens
cttcctttgcttccc

SEQ ID NO: 6197986 - DNA, 19 bp, Homo sapiens
cttcctttggggaagttta

SEQ ID NO: 6197987 - DNA, 21 bp, Homo sapiens
cttcctttggggaagtttatt

SEQ ID NO: 6197988 - DNA, 21 bp, Homo sapiens
cttcctttggtgcctcactgg

SEQ ID NO: 6197989 - DNA, 14 bp, Homo sapiens
cttcctttgtctta

SEQ ID NO: 6197990 - DNA, 23 bp, Homo sapiens
cttcctttgtcttacattggctt

SEQ ID NO: 6197991 - DNA, 12 bp, Homo sapiens
cttcctttgtgt

SEQ ID NO: 6197992 - DNA, 16 bp, Homo sapiens
cttcctttgtgtttat

SEQ ID NO: 6197993 - DNA, 13 bp, Homo sapiens
cttccttttaact

SEQ ID NO: 6197994 - DNA, 14 bp, Homo sapiens
cttccttttaactg

SEQ ID NO: 6197995 - DNA, 14 bp, Homo sapiens
cttccttttcactg

SEQ ID NO: 6197996 - DNA, 19 bp, Homo sapiens
cttccttttccctgcttcc

SEQ ID NO: 6197997 - DNA, 21 bp, Homo sapiens
cttcctttttttaaattttct

SEQ ID NO: 6197998 - DNA, 23 bp, Homo sapiens
cttcctttttttaaattttctcc

SEQ ID NO: 6197999 - DNA, 14 bp, Homo sapiens
cttcgaaaagaaat

SEQ ID NO: 6198000 - DNA, 15 bp, Homo sapiens
cttcgaaacctggga

SEQ ID NO: 6198001 - DNA, 20 bp, Homo sapiens
cttcgaaagcatcattattt

SEQ ID NO: 6198002 - DNA, 20 bp, Homo sapiens
cttcgaaaggccttcagaca

SEQ ID NO: 6198003 - DNA, 15 bp, Homo sapiens
cttcgaactccaggc

SEQ ID NO: 6198004 - DNA, 13 bp, Homo sapiens
cttcgaagtattc

SEQ ID NO: 6198005 - DNA, 16 bp, Homo sapiens
cttcgacactgttctt

SEQ ID NO: 6198006 - DNA, 16 bp, Homo sapiens
cttcgacatgctgcca

SEQ ID NO: 6198007 - DNA, 22 bp, Homo sapiens
cttcgactactgctcctgtggc

SEQ ID NO: 6198008 - DNA, 15 bp, Homo sapiens
cttcgactcaggatc

SEQ ID NO: 6198009 - DNA, 18 bp, Homo sapiens
cttcgactcaggatccag

SEQ ID NO: 6198010 - DNA, 13 bp, Homo sapiens
cttcgactgtgac

SEQ ID NO: 6198011 - DNA, 17 bp, Homo sapiens
cttcgacttttcttaac

SEQ ID NO: 6198012 - DNA, 22 bp, Homo sapiens
cttcgaggaacccacccggctg

SEQ ID NO: 6198013 - DNA, 14 bp, Homo sapiens
cttcgaggacagga

SEQ ID NO: 6198014 - DNA, 23 bp, Homo sapiens
cttcgaggacaggaaaggcccca

SEQ ID NO: 6198015 - DNA, 20 bp, Homo sapiens
cttcgaggagataaactgaa

SEQ ID NO: 6198016 - DNA, 18 bp, Homo sapiens
cttcgagggttccaggct

SEQ ID NO: 6198017 - DNA, 20 bp, Homo sapiens
cttcgagggttccaggctgt

SEQ ID NO: 6198018 - DNA, 16 bp, Homo sapiens
cttcgatacaccgggc

SEQ ID NO: 6198019 - DNA, 21 bp, Homo sapiens
cttcgatacaccgggcctgga

SEQ ID NO: 6198020 - DNA, 16 bp, Homo sapiens
cttcgcaccttgctgt

SEQ ID NO: 6198021 - DNA, 19 bp, Homo sapiens
cttcgcaccttgctgtgtg

SEQ ID NO: 6198022 - DNA, 20 bp, Homo sapiens
cttcgcaccttgctgtgtga

SEQ ID NO: 6198023 - DNA, 14 bp, Homo sapiens
cttcgcagaggcaa

SEQ ID NO: 6198024 - DNA, 16 bp, Homo sapiens
cttcgcagaggcaagc

SEQ ID NO: 6198025 - DNA, 23 bp, Homo sapiens
cttcgcagccccgggcggagcct

SEQ ID NO: 6198026 - DNA, 20 bp, Homo sapiens
cttcgcatcaaaagacaatt

SEQ ID NO: 6198027 - DNA, 22 bp, Homo sapiens
cttcgccaaggttgtagcatgg

SEQ ID NO: 6198028 - DNA, 15 bp, Homo sapiens
cttcgccacctgggt

SEQ ID NO: 6198029 - DNA, 18 bp, Homo sapiens
cttcgccctctgaaatta

SEQ ID NO: 6198030 - DNA, 23 bp, Homo sapiens
cttcgcctttcccaccctcctgc

SEQ ID NO: 6198031 - DNA, 16 bp, Homo sapiens
cttcgctattcccagg

SEQ ID NO: 6198032 - DNA, 19 bp, Homo sapiens
cttcgctattcccaggcag

SEQ ID NO: 6198033 - DNA, 19 bp, Homo sapiens
cttcgctccatgtttttgg

SEQ ID NO: 6198034 - DNA, 14 bp, Homo sapiens
cttcgctcctgtgt

SEQ ID NO: 6198035 - DNA, 17 bp, Homo sapiens
cttcgctcctgtgtctt

SEQ ID NO: 6198036 - DNA, 15 bp, Homo sapiens
cttcgctctgctgga

SEQ ID NO: 6198037 - DNA, 12 bp, Homo sapiens
cttcgctcttga

SEQ ID NO: 6198038 - DNA, 14 bp, Homo sapiens
cttcgctgccagga

SEQ ID NO: 6198039 - DNA, 15 bp, Homo sapiens
cttcgctgccaggac

SEQ ID NO: 6198040 - DNA, 16 bp, Homo sapiens
cttcgctgccaggaca

SEQ ID NO: 6198041 - DNA, 18 bp, Homo sapiens
cttcgctgccaggacacc

SEQ ID NO: 6198042 - DNA, 20 bp, Homo sapiens
cttcgctgctagagaagggg

SEQ ID NO: 6198043 - DNA, 17 bp, Homo sapiens
cttcgctgctctagctg

SEQ ID NO: 6198044 - DNA, 20 bp, Homo sapiens
cttcgctgctctagctggca

SEQ ID NO: 6198045 - DNA, 21 bp, Homo sapiens
cttcgctgctctagctggcag

SEQ ID NO: 6198046 - DNA, 12 bp, Homo sapiens
cttcgctggact

SEQ ID NO: 6198047 - DNA, 15 bp, Homo sapiens
cttcgctggctccta

SEQ ID NO: 6198048 - DNA, 19 bp, Homo sapiens
cttcgctgtcccccaacac

SEQ ID NO: 6198049 - DNA, 20 bp, Homo sapiens
cttcgctgtcccccaacact

SEQ ID NO: 6198050 - DNA, 19 bp, Homo sapiens
cttcgctgtgatgcatgag

SEQ ID NO: 6198051 - DNA, 16 bp, Homo sapiens
cttcgcttcttgcctc

SEQ ID NO: 6198052 - DNA, 22 bp, Homo sapiens
cttcggaatccagtgcttccac

SEQ ID NO: 6198053 - DNA, 14 bp, Homo sapiens
cttcggacaaaata

SEQ ID NO: 6198054 - DNA, 21 bp, Homo sapiens
cttcggaccgcttgtggggac

SEQ ID NO: 6198055 - DNA, 22 bp, Homo sapiens
cttcggagatgaggagtaaaat

SEQ ID NO: 6198056 - DNA, 22 bp, Homo sapiens
cttcggagggaaattgtaaatc

SEQ ID NO: 6198057 - DNA, 14 bp, Homo sapiens
cttcggagggccgc

SEQ ID NO: 6198058 - DNA, 15 bp, Homo sapiens
cttcggagggccgca

SEQ ID NO: 6198059 - DNA, 18 bp, Homo sapiens
cttcggagggccgcaggg

SEQ ID NO: 6198060 - DNA, 21 bp, Homo sapiens
cttcggataattttcattttt

SEQ ID NO: 6198061 - DNA, 16 bp, Homo sapiens
cttcggcagtggctgg

SEQ ID NO: 6198062 - DNA, 13 bp, Homo sapiens
cttcggcatttga

SEQ ID NO: 6198063 - DNA, 16 bp, Homo sapiens
cttcggccaggtcaca

SEQ ID NO: 6198064 - DNA, 18 bp, Homo sapiens
cttcggccgagctggttt

SEQ ID NO: 6198065 - DNA, 17 bp, Homo sapiens
cttcgggaagagaggag

SEQ ID NO: 6198066 - DNA, 18 bp, Homo sapiens
cttcgggcgtctgtgtgc

SEQ ID NO: 6198067 - DNA, 15 bp, Homo sapiens
cttcgggctgtgccc

SEQ ID NO: 6198068 - DNA, 19 bp, Homo sapiens
cttcggggaactcctggaa

SEQ ID NO: 6198069 - DNA, 15 bp, Homo sapiens
cttcggggaccagcc

SEQ ID NO: 6198070 - DNA, 14 bp, Homo sapiens
cttcggggcctcct

SEQ ID NO: 6198071 - DNA, 16 bp, Homo sapiens
cttcggggcctgtctg

SEQ ID NO: 6198072 - DNA, 22 bp, Homo sapiens
cttcggggcctgtctgaagcca

SEQ ID NO: 6198073 - DNA, 15 bp, Homo sapiens
cttcggggctgggaa

SEQ ID NO: 6198074 - DNA, 17 bp, Homo sapiens
cttcggggtagaggctg

SEQ ID NO: 6198075 - DNA, 22 bp, Homo sapiens
cttcgggtgtgatcatatatca

SEQ ID NO: 6198076 - DNA, 16 bp, Homo sapiens
cttcggtacccaccac

SEQ ID NO: 6198077 - DNA, 19 bp, Homo sapiens
cttcggtacccaccacaca

SEQ ID NO: 6198078 - DNA, 13 bp, Homo sapiens
cttcggtcacctg

SEQ ID NO: 6198079 - DNA, 16 bp, Homo sapiens
cttcggtggaagagct

SEQ ID NO: 6198080 - DNA, 12 bp, Homo sapiens
cttcggtggcct

SEQ ID NO: 6198081 - DNA, 14 bp, Homo sapiens
cttcggtttctgag

SEQ ID NO: 6198082 - DNA, 22 bp, Homo sapiens
cttcgtatcccgagtctgggac

SEQ ID NO: 6198083 - DNA, 20 bp, Homo sapiens
cttcgtcctgatccctccac

SEQ ID NO: 6198084 - DNA, 18 bp, Homo sapiens
cttcgtcttgtgtttgct

SEQ ID NO: 6198085 - DNA, 15 bp, Homo sapiens
cttcgtgcctgagac

SEQ ID NO: 6198086 - DNA, 19 bp, Homo sapiens
cttcgtgcctgagaccagg

SEQ ID NO: 6198087 - DNA, 22 bp, Homo sapiens
cttcgtgcctgagaccagggtg

SEQ ID NO: 6198088 - DNA, 21 bp, Homo sapiens
cttcgtgcggaatcagcttct

SEQ ID NO: 6198089 - DNA, 12 bp, Homo sapiens
cttcgtgctgga

SEQ ID NO: 6198090 - DNA, 17 bp, Homo sapiens
cttcgtgctggaggaac

SEQ ID NO: 6198091 - DNA, 13 bp, Homo sapiens
cttcgtggagctc

SEQ ID NO: 6198092 - DNA, 23 bp, Homo sapiens
cttcgtgggatctgcccctccct

SEQ ID NO: 6198093 - DNA, 17 bp, Homo sapiens
cttcgtgtgctgctgct

SEQ ID NO: 6198094 - DNA, 17 bp, Homo sapiens
cttcgttaactgtgtat

SEQ ID NO: 6198095 - DNA, 20 bp, Homo sapiens
cttcgttaactgtgtatgta

SEQ ID NO: 6198096 - DNA, 19 bp, Homo sapiens
cttcgttaatagattattt

SEQ ID NO: 6198097 - DNA, 21 bp, Homo sapiens
cttcgttagtaatctgtataa

SEQ ID NO: 6198098 - DNA, 21 bp, Homo sapiens
cttcgttggtgaccagtttct

SEQ ID NO: 6198099 - DNA, 14 bp, Homo sapiens
cttcgttttctaaa

SEQ ID NO: 6198100 - DNA, 15 bp, Homo sapiens
cttcgttttctaaag

SEQ ID NO: 6198101 - DNA, 19 bp, Homo sapiens
cttctaaaactactgcctt

SEQ ID NO: 6198102 - DNA, 21 bp, Homo sapiens
cttctaaaactgtactttgat

SEQ ID NO: 6198103 - DNA, 14 bp, Homo sapiens
cttctaaaataaat

SEQ ID NO: 6198104 - DNA, 12 bp, Homo sapiens
cttctaaacact

SEQ ID NO: 6198105 - DNA, 14 bp, Homo sapiens
cttctaaacatttt

SEQ ID NO: 6198106 - DNA, 19 bp, Homo sapiens
cttctaaacttccccatct

SEQ ID NO: 6198107 - DNA, 22 bp, Homo sapiens
cttctaaaggtgttgtcccttc

SEQ ID NO: 6198108 - DNA, 13 bp, Homo sapiens
cttctaaatgagc

SEQ ID NO: 6198109 - DNA, 18 bp, Homo sapiens
cttctaaatgagctaaat

SEQ ID NO: 6198110 - DNA, 24 bp, Homo sapiens
cttctaaatgagtcactgagcatc

SEQ ID NO: 6198111 - DNA, 15 bp, Homo sapiens
cttctaaatgcccag

SEQ ID NO: 6198112 - DNA, 18 bp, Homo sapiens
cttctaaatgcccagttc

SEQ ID NO: 6198113 - DNA, 22 bp, Homo sapiens
cttctaaattcccaaatcctag

SEQ ID NO: 6198114 - DNA, 18 bp, Homo sapiens
cttctaacatgaaatata

SEQ ID NO: 6198115 - DNA, 18 bp, Homo sapiens
cttctaactcatgggtac

SEQ ID NO: 6198116 - DNA, 14 bp, Homo sapiens
cttctaactccact

SEQ ID NO: 6198117 - DNA, 15 bp, Homo sapiens
cttctaactccactg

SEQ ID NO: 6198118 - DNA, 18 bp, Homo sapiens
cttctaagaagacatttt

SEQ ID NO: 6198119 - DNA, 16 bp, Homo sapiens
cttctaagagatataa

SEQ ID NO: 6198120 - DNA, 16 bp, Homo sapiens
cttctaagataaaaat

SEQ ID NO: 6198121 - DNA, 17 bp, Homo sapiens
cttctaagtaaaaccac

SEQ ID NO: 6198122 - DNA, 23 bp, Homo sapiens
cttctaagtaaaaccacagcagt

SEQ ID NO: 6198123 - DNA, 18 bp, Homo sapiens
cttctaagtaaatacaat

SEQ ID NO: 6198124 - DNA, 17 bp, Homo sapiens
cttctaagtcattcata

SEQ ID NO: 6198125 - DNA, 13 bp, Homo sapiens
cttctaataaatt

SEQ ID NO: 6198126 - DNA, 17 bp, Homo sapiens
cttctaataaattatac

SEQ ID NO: 6198127 - DNA, 17 bp, Homo sapiens
gacaacacttaatagca

SEQ ID NO: 6198128 - DNA, 20 bp, Homo sapiens
gacaacacttcattttcagg

SEQ ID NO: 6198129 - DNA, 18 bp, Homo sapiens
gacaacagaaaaacaatc

SEQ ID NO: 6198130 - DNA, 14 bp, Homo sapiens
gacaacagaagtca

SEQ ID NO: 6198131 - DNA, 17 bp, Homo sapiens
gacaacagaagtcatga

SEQ ID NO: 6198132 - DNA, 13 bp, Homo sapiens
gacaacagactga

SEQ ID NO: 6198133 - DNA, 19 bp, Homo sapiens
gacaacagattggatttta

SEQ ID NO: 6198134 - DNA, 16 bp, Homo sapiens
gacaacagcacacagg

SEQ ID NO: 6198135 - DNA, 21 bp, Homo sapiens
gacaacagctctcgttctcct

SEQ ID NO: 6198136 - DNA, 22 bp, Homo sapiens
gacaacagttctgagctgtaat

SEQ ID NO: 6198137 - DNA, 16 bp, Homo sapiens
gacaacatcccacagt

SEQ ID NO: 6198138 - DNA, 18 bp, Homo sapiens
gacaacatcccacagtgg

SEQ ID NO: 6198139 - DNA, 17 bp, Homo sapiens
gacaacattatgatcta

SEQ ID NO: 6198140 - DNA, 15 bp, Homo sapiens
gacaacatttttgta

SEQ ID NO: 6198141 - DNA, 21 bp, Homo sapiens
gacaacatttttgtacattat

SEQ ID NO: 6198142 - DNA, 22 bp, Homo sapiens
gacaaccaccgctccccagccc

SEQ ID NO: 6198143 - DNA, 23 bp, Homo sapiens
gacaaccaccgctccccagccca

SEQ ID NO: 6198144 - DNA, 19 bp, Homo sapiens
gacaaccatatttagcagt

SEQ ID NO: 6198145 - DNA, 19 bp, Homo sapiens
gacaaccatgcaaattgtg

SEQ ID NO: 6198146 - DNA, 18 bp, Homo sapiens
gacaaccattaaagtcag

SEQ ID NO: 6198147 - DNA, 11 bp, Homo sapiens
gacaacccaga

SEQ ID NO: 6198148 - DNA, 13 bp, Homo sapiens
gacaaccccccaa

SEQ ID NO: 6198149 - DNA, 15 bp, Homo sapiens
gacaacctagaatgt

SEQ ID NO: 6198150 - DNA, 13 bp, Homo sapiens
gacaaccttgtcc

SEQ ID NO: 6198151 - DNA, 13 bp, Homo sapiens
gacaacctttctg

SEQ ID NO: 6198152 - DNA, 14 bp, Homo sapiens
gacaacctttctgt

SEQ ID NO: 6198153 - DNA, 17 bp, Homo sapiens
gacaacctttgtgtaat

SEQ ID NO: 6198154 - DNA, 17 bp, Homo sapiens
gacaacgaaagtaaagt

SEQ ID NO: 6198155 - DNA, 14 bp, Homo sapiens
gacaacgatgaatt

SEQ ID NO: 6198156 - DNA, 18 bp, Homo sapiens
gacaacgggcccatggcc

SEQ ID NO: 6198157 - DNA, 15 bp, Homo sapiens
gacaacgtgctcttt

SEQ ID NO: 6198158 - DNA, 14 bp, Homo sapiens
gacaacgtgctgct

SEQ ID NO: 6198159 - DNA, 18 bp, Homo sapiens
gacaactaaacaaggcat

SEQ ID NO: 6198160 - DNA, 16 bp, Homo sapiens
gacaactgaagagaca

SEQ ID NO: 6198161 - DNA, 22 bp, Homo sapiens
gacaactgctcccacctcctga

SEQ ID NO: 6198162 - DNA, 17 bp, Homo sapiens
gacaactggcaggcagg

SEQ ID NO: 6198163 - DNA, 21 bp, Homo sapiens
gacaacttagctcaggtgcct

SEQ ID NO: 6198164 - DNA, 15 bp, Homo sapiens
gacaacttatttaaa

SEQ ID NO: 6198165 - DNA, 12 bp, Homo sapiens
gacaacttctga

SEQ ID NO: 6198166 - DNA, 18 bp, Homo sapiens
gacaactttgccagcttt

SEQ ID NO: 6198167 - DNA, 13 bp, Homo sapiens
gacaagaaaatca

SEQ ID NO: 6198168 - DNA, 19 bp, Homo sapiens
gacaagaaaggcagacaca

SEQ ID NO: 6198169 - DNA, 22 bp, Homo sapiens
gacaagaaaggctgctgtactg

SEQ ID NO: 6198170 - DNA, 22 bp, Homo sapiens
gacaagaacattctctcataga

SEQ ID NO: 6198171 - DNA, 19 bp, Homo sapiens
gacaagaatatgttcacat

SEQ ID NO: 6198172 - DNA, 18 bp, Homo sapiens
gacaagaatggaatagaa

SEQ ID NO: 6198173 - DNA, 16 bp, Homo sapiens
gacaagacccccagca

SEQ ID NO: 6198174 - DNA, 14 bp, Homo sapiens
gacaagaccctctc

SEQ ID NO: 6198175 - DNA, 17 bp, Homo sapiens
gacaagaccctctcagg

SEQ ID NO: 6198176 - DNA, 24 bp, Homo sapiens
gacaagacttcagtatgttgtcaa

SEQ ID NO: 6198177 - DNA, 18 bp, Homo sapiens
gacaagagatctacacat

SEQ ID NO: 6198178 - DNA, 20 bp, Homo sapiens
gacaagagatgggaatgagg

SEQ ID NO: 6198179 - DNA, 15 bp, Homo sapiens
gacaagagctgctgt

SEQ ID NO: 6198180 - DNA, 19 bp, Homo sapiens
gacaagagctgctgtcctt

SEQ ID NO: 6198181 - DNA, 15 bp, Homo sapiens
gacaagagctgttat

SEQ ID NO: 6198182 - DNA, 16 bp, Homo sapiens
gacaagagctgttatg

SEQ ID NO: 6198183 - DNA, 12 bp, Homo sapiens
gacaagagggaa

SEQ ID NO: 6198184 - DNA, 14 bp, Homo sapiens
gacaagagggcaag

SEQ ID NO: 6198185 - DNA, 19 bp, Homo sapiens
gacaagagggcaagcctct

SEQ ID NO: 6198186 - DNA, 14 bp, Homo sapiens
gacaagatattgta

SEQ ID NO: 6198187 - DNA, 18 bp, Homo sapiens
gacaagatattgtacata

SEQ ID NO: 6198188 - DNA, 23 bp, Homo sapiens
gacaagatggtccatttgttcct

SEQ ID NO: 6198189 - DNA, 12 bp, Homo sapiens
gacaagcacagt

SEQ ID NO: 6198190 - DNA, 21 bp, Homo sapiens
gacaagcagatactgctgtgt

SEQ ID NO: 6198191 - DNA, 14 bp, Homo sapiens
gacaagcagccctt

SEQ ID NO: 6198192 - DNA, 15 bp, Homo sapiens
gacaagcagcccttg

SEQ ID NO: 6198193 - DNA, 17 bp, Homo sapiens
gacaagcattgggtcag

SEQ ID NO: 6198194 - DNA, 21 bp, Homo sapiens
gacaagcattgggtcagaccc

SEQ ID NO: 6198195 - DNA, 19 bp, Homo sapiens
gacaagccaacttgtaaat

SEQ ID NO: 6198196 - DNA, 16 bp, Homo sapiens
gacaagccagaacttg

SEQ ID NO: 6198197 - DNA, 13 bp, Homo sapiens
gacaagccaggcc

SEQ ID NO: 6198198 - DNA, 18 bp, Homo sapiens
gacaagccaggccctctc

SEQ ID NO: 6198199 - DNA, 12 bp, Homo sapiens
gacaagcccagg

SEQ ID NO: 6198200 - DNA, 15 bp, Homo sapiens
gacaagccctggcaa

SEQ ID NO: 6198201 - DNA, 18 bp, Homo sapiens
gacaagcctggaggacaa

SEQ ID NO: 6198202 - DNA, 17 bp, Homo sapiens
gacaagcctgtccattg

SEQ ID NO: 6198203 - DNA, 12 bp, Homo sapiens
gacaagctcctc

SEQ ID NO: 6198204 - DNA, 16 bp, Homo sapiens
gacaagctcctccctt

SEQ ID NO: 6198205 - DNA, 11 bp, Homo sapiens
gacaaggaaaa

SEQ ID NO: 6198206 - DNA, 18 bp, Homo sapiens
gacaaggaaaatctatat

SEQ ID NO: 6198207 - DNA, 18 bp, Homo sapiens
gacaaggaaggaaaagaa

SEQ ID NO: 6198208 - DNA, 19 bp, Homo sapiens
gacaaggagaagagcaagg

SEQ ID NO: 6198209 - DNA, 22 bp, Homo sapiens
gacaaggattgctactgtccta

SEQ ID NO: 6198210 - DNA, 21 bp, Homo sapiens
gacaaggcatgtagggggagc

SEQ ID NO: 6198211 - DNA, 10 bp, Homo sapiens
gacaaggcca

SEQ ID NO: 6198212 - DNA, 13 bp, Homo sapiens
gacaaggccccag

SEQ ID NO: 6198213 - DNA, 17 bp, Homo sapiens
gacaaggccccagagac

SEQ ID NO: 6198214 - DNA, 17 bp, Homo sapiens
gacaaggctgtgccagg

SEQ ID NO: 6198215 - DNA, 18 bp, Homo sapiens
gacaaggctgtgccaggc

SEQ ID NO: 6198216 - DNA, 19 bp, Homo sapiens
gacaaggctgtgccaggct

SEQ ID NO: 6198217 - DNA, 22 bp, Homo sapiens
gacaagggaaaataaaaaaaga

SEQ ID NO: 6198218 - DNA, 16 bp, Homo sapiens
gacaagggaggcagtg

SEQ ID NO: 6198219 - DNA, 17 bp, Homo sapiens
gacaagggattctggga

SEQ ID NO: 6198220 - DNA, 18 bp, Homo sapiens
gacaagggattctgggaa

SEQ ID NO: 6198221 - DNA, 19 bp, Homo sapiens
gacaagggattctgggaag

SEQ ID NO: 6198222 - DNA, 19 bp, Homo sapiens
gacaagggctgacctgcct

SEQ ID NO: 6198223 - DNA, 21 bp, Homo sapiens
gacaaggtagccctggccaga

SEQ ID NO: 6198224 - DNA, 18 bp, Homo sapiens
gacaaggtgcaggcaggc

SEQ ID NO: 6198225 - DNA, 14 bp, Homo sapiens
gacaaggttgctgt

SEQ ID NO: 6198226 - DNA, 15 bp, Homo sapiens
gacaaggttgctgtt

SEQ ID NO: 6198227 - DNA, 15 bp, Homo sapiens
gacaagtaatttcag

SEQ ID NO: 6198228 - DNA, 13 bp, Homo sapiens
gacaagtacataa

SEQ ID NO: 6198229 - DNA, 18 bp, Homo sapiens
gacaagtacataaaggtg

SEQ ID NO: 6198230 - DNA, 14 bp, Homo sapiens
gacaagtagggcac

SEQ ID NO: 6198231 - DNA, 20 bp, Homo sapiens
gacaagtctgagtagttatg

SEQ ID NO: 6198232 - DNA, 14 bp, Homo sapiens
gacaagtcttgctg

SEQ ID NO: 6198233 - DNA, 21 bp, Homo sapiens
gacaagtgacttatttgctca

SEQ ID NO: 6198234 - DNA, 19 bp, Homo sapiens
gacaagtgagagagcaagt

SEQ ID NO: 6198235 - DNA, 12 bp, Homo sapiens
gacaagtgctca

SEQ ID NO: 6198236 - DNA, 20 bp, Homo sapiens
gacaagtgctgaacagtgga

SEQ ID NO: 6198237 - DNA, 15 bp, Homo sapiens
gacaagtgggatttg

SEQ ID NO: 6198238 - DNA, 14 bp, Homo sapiens
gacaagttccatgg

SEQ ID NO: 6198239 - DNA, 14 bp, Homo sapiens
gacaataaaacatt

SEQ ID NO: 6198240 - DNA, 15 bp, Homo sapiens
gacaataaaatatta

SEQ ID NO: 6198241 - DNA, 13 bp, Homo sapiens
gacaataaacagc

SEQ ID NO: 6198242 - DNA, 16 bp, Homo sapiens
gacaataaaccctcag

SEQ ID NO: 6198243 - DNA, 13 bp, Homo sapiens
gacaataaagctt

SEQ ID NO: 6198244 - DNA, 22 bp, Homo sapiens
gacaataaatgagaccccttta

SEQ ID NO: 6198245 - DNA, 14 bp, Homo sapiens
gacaataacttctt

SEQ ID NO: 6198246 - DNA, 21 bp, Homo sapiens
gacaataagaaacagtttaac

SEQ ID NO: 6198247 - DNA, 14 bp, Homo sapiens
gacaataagtttga

SEQ ID NO: 6198248 - DNA, 19 bp, Homo sapiens
gacaataagtttgaacctt

SEQ ID NO: 6198249 - DNA, 16 bp, Homo sapiens
gacaatacaccttccc

SEQ ID NO: 6198250 - DNA, 16 bp, Homo sapiens
gacaatacgtttgata

SEQ ID NO: 6198251 - DNA, 20 bp, Homo sapiens
gacaatactccctttaaaga

SEQ ID NO: 6198252 - DNA, 16 bp, Homo sapiens
gacaatactgctgcct

SEQ ID NO: 6198253 - DNA, 20 bp, Homo sapiens
gacaatatgattttaaattt

SEQ ID NO: 6198254 - DNA, 21 bp, Homo sapiens
gacaatatgtgccaatcaata

SEQ ID NO: 6198255 - DNA, 17 bp, Homo sapiens
gacaatcaaagaaaaga

SEQ ID NO: 6198256 - DNA, 14 bp, Homo sapiens
gacaatcactgcca

SEQ ID NO: 6198257 - DNA, 18 bp, Homo sapiens
gacaatcagtcccctccc

SEQ ID NO: 6198258 - DNA, 14 bp, Homo sapiens
gacaatcatgtgtg

SEQ ID NO: 6198259 - DNA, 15 bp, Homo sapiens
gacaatcatgtgtgt

SEQ ID NO: 6198260 - DNA, 14 bp, Homo sapiens
gacaatcattgttt

SEQ ID NO: 6198261 - DNA, 12 bp, Homo sapiens
gacaatcctatt

SEQ ID NO: 6198262 - DNA, 18 bp, Homo sapiens
gacaatcgtgatagttat

SEQ ID NO: 6198263 - DNA, 20 bp, Homo sapiens
gacaatctaaaaaatatctt

SEQ ID NO: 6198264 - DNA, 22 bp, Homo sapiens
gacaatctagctctccatactt

SEQ ID NO: 6198265 - DNA, 18 bp, Homo sapiens
gacaatgaaatactccag

SEQ ID NO: 6198266 - DNA, 20 bp, Homo sapiens
gacaatgaaatactccagca

SEQ ID NO: 6198267 - DNA, 18 bp, Homo sapiens
gacaatgacactggaagg

SEQ ID NO: 6198268 - DNA, 17 bp, Homo sapiens
gacaatgacttactgta

SEQ ID NO: 6198269 - DNA, 21 bp, Homo sapiens
gacaatgacttactgtacatg

SEQ ID NO: 6198270 - DNA, 21 bp, Homo sapiens
gacaatgagtggaatactaaa

SEQ ID NO: 6198271 - DNA, 19 bp, Homo sapiens
gacaatgatttggccaggc

SEQ ID NO: 6198272 - DNA, 19 bp, Homo sapiens
gacaatgccctgctggcct

SEQ ID NO: 6198273 - DNA, 13 bp, Homo sapiens
gacaatgccttgg

SEQ ID NO: 6198274 - DNA, 18 bp, Homo sapiens
gacaatgccttgggagag

SEQ ID NO: 6198275 - DNA, 17 bp, Homo sapiens
gacaatgcgtggcacat

SEQ ID NO: 6198276 - DNA, 14 bp, Homo sapiens
gacaatgctgccat

SEQ ID NO: 6198277 - DNA, 18 bp, Homo sapiens
gacaatgctgccatgccc

SEQ ID NO: 6198278 - DNA, 22 bp, Homo sapiens
gacaatgcttatggaaagccag

SEQ ID NO: 6198279 - DNA, 20 bp, Homo sapiens
gacaatggaccctttttgtt

SEQ ID NO: 6198280 - DNA, 21 bp, Homo sapiens
gacaatggacctctcagcaga

SEQ ID NO: 6198281 - DNA, 15 bp, Homo sapiens
gacaatggcaatagg

SEQ ID NO: 6198282 - DNA, 14 bp, Homo sapiens
gacaatggcagcta

SEQ ID NO: 6198283 - DNA, 21 bp, Homo sapiens
gacaatgtcgagtatattatt

SEQ ID NO: 6198284 - DNA, 19 bp, Homo sapiens
gacaatgtctgcagccctg

SEQ ID NO: 6198285 - DNA, 12 bp, Homo sapiens
gacaatgtgaaa

SEQ ID NO: 6198286 - DNA, 18 bp, Homo sapiens
gacaatgtgaaaagaaaa

SEQ ID NO: 6198287 - DNA, 13 bp, Homo sapiens
gacaatgtggaat

SEQ ID NO: 6198288 - DNA, 16 bp, Homo sapiens
gacaatgttgagaagt

SEQ ID NO: 6198289 - DNA, 14 bp, Homo sapiens
gacaatgttgcatt

SEQ ID NO: 6198290 - DNA, 18 bp, Homo sapiens
gacaatgttgtagtgtcc

SEQ ID NO: 6198291 - DNA, 12 bp, Homo sapiens
gacaatgtttac

SEQ ID NO: 6198292 - DNA, 13 bp, Homo sapiens
gacaattagcaga

SEQ ID NO: 6198293 - DNA, 19 bp, Homo sapiens
gacaattatgaaaaaatgt

SEQ ID NO: 6198294 - DNA, 16 bp, Homo sapiens
gacaattcacttcatt

SEQ ID NO: 6198295 - DNA, 17 bp, Homo sapiens
gacaattccatttcttt

SEQ ID NO: 6198296 - DNA, 20 bp, Homo sapiens
gacaattcctccagagacac

SEQ ID NO: 6198297 - DNA, 21 bp, Homo sapiens
gacaattctaatggtaacttt

SEQ ID NO: 6198298 - DNA, 22 bp, Homo sapiens
gacaattctaatggtaactttt

SEQ ID NO: 6198299 - DNA, 14 bp, Homo sapiens
gacaattctgcatg

SEQ ID NO: 6198300 - DNA, 13 bp, Homo sapiens
gacaattctgttt

SEQ ID NO: 6198301 - DNA, 13 bp, Homo sapiens
gacaattgtcagt

SEQ ID NO: 6198302 - DNA, 17 bp, Homo sapiens
gacaattgtgaacatga

SEQ ID NO: 6198303 - DNA, 12 bp, Homo sapiens
gacaatttatta

SEQ ID NO: 6198304 - DNA, 13 bp, Homo sapiens
gacaatttattat

SEQ ID NO: 6198305 - DNA, 19 bp, Homo sapiens
gacaatttattatggcaca

SEQ ID NO: 6198306 - DNA, 20 bp, Homo sapiens
gacaatttcaaaaaaataaa

SEQ ID NO: 6198307 - DNA, 19 bp, Homo sapiens
gacaatttgatacataata

SEQ ID NO: 6198308 - DNA, 11 bp, Homo sapiens
cttctaatata

SEQ ID NO: 6198309 - DNA, 21 bp, Homo sapiens
cttctaatctgctatgcttga

SEQ ID NO: 6198310 - DNA, 12 bp, Homo sapiens
cttctaatgacc

SEQ ID NO: 6198311 - DNA, 18 bp, Homo sapiens
cttctaatgacccagata

SEQ ID NO: 6198312 - DNA, 17 bp, Homo sapiens
cttctaattttgtgctc

SEQ ID NO: 6198313 - DNA, 18 bp, Homo sapiens
cttctacaaccagagccc

SEQ ID NO: 6198314 - DNA, 23 bp, Homo sapiens
cttctacaatacaacacattgaa

SEQ ID NO: 6198315 - DNA, 14 bp, Homo sapiens
cttctacactctcc

SEQ ID NO: 6198316 - DNA, 19 bp, Homo sapiens
cttctacagaacctgaggg

SEQ ID NO: 6198317 - DNA, 18 bp, Homo sapiens
cttctacatgtaatgaca

SEQ ID NO: 6198318 - DNA, 23 bp, Homo sapiens
cttctacatgtaatgacacttct

SEQ ID NO: 6198319 - DNA, 18 bp, Homo sapiens
cttctaccaaatgtgtaa

SEQ ID NO: 6198320 - DNA, 17 bp, Homo sapiens
cttctaccaactggaag

SEQ ID NO: 6198321 - DNA, 18 bp, Homo sapiens
cttctaccaactggaagc

SEQ ID NO: 6198322 - DNA, 17 bp, Homo sapiens
cttctaccatgaacaga

SEQ ID NO: 6198323 - DNA, 22 bp, Homo sapiens
cttctaccccaaggccagtagt

SEQ ID NO: 6198324 - DNA, 20 bp, Homo sapiens
cttctaccccacctgacctc

SEQ ID NO: 6198325 - DNA, 13 bp, Homo sapiens
cttctaccctctg

SEQ ID NO: 6198326 - DNA, 17 bp, Homo sapiens
cttctaccctttgtccc

SEQ ID NO: 6198327 - DNA, 20 bp, Homo sapiens
cttctacccttttccttttt

SEQ ID NO: 6198328 - DNA, 15 bp, Homo sapiens
cttctacctgccact

SEQ ID NO: 6198329 - DNA, 16 bp, Homo sapiens
cttctacctgccactc

SEQ ID NO: 6198330 - DNA, 14 bp, Homo sapiens
cttctacctgccct

SEQ ID NO: 6198331 - DNA, 19 bp, Homo sapiens
cttctacggccatgagact

SEQ ID NO: 6198332 - DNA, 18 bp, Homo sapiens
cttctactcacttttccc

SEQ ID NO: 6198333 - DNA, 13 bp, Homo sapiens
cttctactcccct

SEQ ID NO: 6198334 - DNA, 17 bp, Homo sapiens
cttctactcctgcctca

SEQ ID NO: 6198335 - DNA, 13 bp, Homo sapiens
cttctactgagca

SEQ ID NO: 6198336 - DNA, 19 bp, Homo sapiens
cttctactgccttgaaaaa

SEQ ID NO: 6198337 - DNA, 15 bp, Homo sapiens
cttctactgcttcta

SEQ ID NO: 6198338 - DNA, 22 bp, Homo sapiens
cttctacttacacatcttccac

SEQ ID NO: 6198339 - DNA, 13 bp, Homo sapiens
cttctacttctgc

SEQ ID NO: 6198340 - DNA, 12 bp, Homo sapiens
cttctactttta

SEQ ID NO: 6198341 - DNA, 18 bp, Homo sapiens
cttctactttttccttcc

SEQ ID NO: 6198342 - DNA, 19 bp, Homo sapiens
cttctactttttccttcct

SEQ ID NO: 6198343 - DNA, 22 bp, Homo sapiens
cttctactttttccttcctgcc

SEQ ID NO: 6198344 - DNA, 19 bp, Homo sapiens
cttctagaaaacatttttg

SEQ ID NO: 6198345 - DNA, 16 bp, Homo sapiens
cttctagaaactctgg

SEQ ID NO: 6198346 - DNA, 17 bp, Homo sapiens
cttctagaaactctggc

SEQ ID NO: 6198347 - DNA, 20 bp, Homo sapiens
cttctagaaactctggctca

SEQ ID NO: 6198348 - DNA, 17 bp, Homo sapiens
cttctagaaccaggcaa

SEQ ID NO: 6198349 - DNA, 20 bp, Homo sapiens
cttctagaagataacatttt

SEQ ID NO: 6198350 - DNA, 21 bp, Homo sapiens
cttctagaagataacattttc

SEQ ID NO: 6198351 - DNA, 13 bp, Homo sapiens
cttctagaataca

SEQ ID NO: 6198352 - DNA, 19 bp, Homo sapiens
cttctagaatgtaaagtta

SEQ ID NO: 6198353 - DNA, 15 bp, Homo sapiens
cttctagaattataa

SEQ ID NO: 6198354 - DNA, 16 bp, Homo sapiens
cttctagaggctcatg

SEQ ID NO: 6198355 - DNA, 19 bp, Homo sapiens
cttctagaggctcatggcc

SEQ ID NO: 6198356 - DNA, 22 bp, Homo sapiens
cttctagaggctcatggccctg

SEQ ID NO: 6198357 - DNA, 16 bp, Homo sapiens
cttctagctgcagatg

SEQ ID NO: 6198358 - DNA, 17 bp, Homo sapiens
cttctagctgtctgtga

SEQ ID NO: 6198359 - DNA, 22 bp, Homo sapiens
cttctagctttgttgtcctccc

SEQ ID NO: 6198360 - DNA, 23 bp, Homo sapiens
cttctagctttgttgtcctccca

SEQ ID NO: 6198361 - DNA, 13 bp, Homo sapiens
cttctaggaagct

SEQ ID NO: 6198362 - DNA, 18 bp, Homo sapiens
cttctaggaatggaggag

SEQ ID NO: 6198363 - DNA, 23 bp, Homo sapiens
cttctaggaatggaggagccagg

SEQ ID NO: 6198364 - DNA, 20 bp, Homo sapiens
cttctaggaggatgctgtgc

SEQ ID NO: 6198365 - DNA, 21 bp, Homo sapiens
cttctaggaggatgctgtgcc

SEQ ID NO: 6198366 - DNA, 21 bp, Homo sapiens
cttctaggatagcgctcccct

SEQ ID NO: 6198367 - DNA, 22 bp, Homo sapiens
cttctaggcccattgtcctcct

SEQ ID NO: 6198368 - DNA, 23 bp, Homo sapiens
cttctaggcccattgtcctcctt

SEQ ID NO: 6198369 - DNA, 17 bp, Homo sapiens
cttctaggggcaggtga

SEQ ID NO: 6198370 - DNA, 18 bp, Homo sapiens
cttctagggtatgggaaa

SEQ ID NO: 6198371 - DNA, 21 bp, Homo sapiens
cttctagggttattgcatttg

SEQ ID NO: 6198372 - DNA, 22 bp, Homo sapiens
cttctaggtattcgaaacctgt

SEQ ID NO: 6198373 - DNA, 18 bp, Homo sapiens
cttctaggtgtggtccca

SEQ ID NO: 6198374 - DNA, 19 bp, Homo sapiens
cttctaggtgtggtcccat

SEQ ID NO: 6198375 - DNA, 16 bp, Homo sapiens
cttctaggttctaaaa

SEQ ID NO: 6198376 - DNA, 14 bp, Homo sapiens
cttctagtctggaa

SEQ ID NO: 6198377 - DNA, 21 bp, Homo sapiens
cttctagtctggaactgctgc

SEQ ID NO: 6198378 - DNA, 18 bp, Homo sapiens
cttctagtgcttttcagt

SEQ ID NO: 6198379 - DNA, 19 bp, Homo sapiens
cttctagttctgccaggag

SEQ ID NO: 6198380 - DNA, 21 bp, Homo sapiens
cttctataatatttccttttt

SEQ ID NO: 6198381 - DNA, 15 bp, Homo sapiens
cttctataattgtat

SEQ ID NO: 6198382 - DNA, 17 bp, Homo sapiens
cttctataattttgcct

SEQ ID NO: 6198383 - DNA, 20 bp, Homo sapiens
cttctataattttgccttta

SEQ ID NO: 6198384 - DNA, 17 bp, Homo sapiens
cttctatacccacccag

SEQ ID NO: 6198385 - DNA, 18 bp, Homo sapiens
cttctatacccacccaga

SEQ ID NO: 6198386 - DNA, 19 bp, Homo sapiens
cttctatactttctcacat

SEQ ID NO: 6198387 - DNA, 16 bp, Homo sapiens
cttctatagcatcact

SEQ ID NO: 6198388 - DNA, 16 bp, Homo sapiens
cttctatatatacaat

SEQ ID NO: 6198389 - DNA, 16 bp, Homo sapiens
cttctatatattgtat

SEQ ID NO: 6198390 - DNA, 20 bp, Homo sapiens
cttctatatccaaaattcag

SEQ ID NO: 6198391 - DNA, 17 bp, Homo sapiens
cttctatatcctcaagg

SEQ ID NO: 6198392 - DNA, 23 bp, Homo sapiens
cttctatcattccaattctaaat

SEQ ID NO: 6198393 - DNA, 15 bp, Homo sapiens
cttctatcccaggag

SEQ ID NO: 6198394 - DNA, 13 bp, Homo sapiens
cttctatcctgca

SEQ ID NO: 6198395 - DNA, 21 bp, Homo sapiens
cttctatcctgcaatttctcc

SEQ ID NO: 6198396 - DNA, 15 bp, Homo sapiens
cttctatctaatcct

SEQ ID NO: 6198397 - DNA, 17 bp, Homo sapiens
cttctatgaaagactca

SEQ ID NO: 6198398 - DNA, 21 bp, Homo sapiens
cttctatgcagtattgccaca

SEQ ID NO: 6198399 - DNA, 23 bp, Homo sapiens
cttctatggactggttgttgcca

SEQ ID NO: 6198400 - DNA, 22 bp, Homo sapiens
cttctatgtaggaaaaaaatag

SEQ ID NO: 6198401 - DNA, 15 bp, Homo sapiens
cttctatgtccaaca

SEQ ID NO: 6198402 - DNA, 17 bp, Homo sapiens
cttctatgtccaacaga

SEQ ID NO: 6198403 - DNA, 14 bp, Homo sapiens
cttctatgttcata

SEQ ID NO: 6198404 - DNA, 19 bp, Homo sapiens
cttctatgttcataaaaaa

SEQ ID NO: 6198405 - DNA, 20 bp, Homo sapiens
cttctatgttcataaaaaat

SEQ ID NO: 6198406 - DNA, 17 bp, Homo sapiens
cttctatgttggtttca

SEQ ID NO: 6198407 - DNA, 20 bp, Homo sapiens
cttctatgttggtttcagtg

SEQ ID NO: 6198408 - DNA, 18 bp, Homo sapiens
cttctattaatcaagaga

SEQ ID NO: 6198409 - DNA, 18 bp, Homo sapiens
cttctattagccagtctt

SEQ ID NO: 6198410 - DNA, 13 bp, Homo sapiens
cttctattctagc

SEQ ID NO: 6198411 - DNA, 19 bp, Homo sapiens
cttctattgccatgaacca

SEQ ID NO: 6198412 - DNA, 14 bp, Homo sapiens
cttctattgcctct

SEQ ID NO: 6198413 - DNA, 16 bp, Homo sapiens
cttctattgcctctga

SEQ ID NO: 6198414 - DNA, 18 bp, Homo sapiens
cttctattgcctctgaga

SEQ ID NO: 6198415 - DNA, 22 bp, Homo sapiens
cttctattgcctctgagagcat

SEQ ID NO: 6198416 - DNA, 24 bp, Homo sapiens
cttctattgcctctgagagcatca

SEQ ID NO: 6198417 - DNA, 15 bp, Homo sapiens
cttctatttaaaaaa

SEQ ID NO: 6198418 - DNA, 16 bp, Homo sapiens
cttctatttaatgctt

SEQ ID NO: 6198419 - DNA, 13 bp, Homo sapiens
cttctatttagcc

SEQ ID NO: 6198420 - DNA, 20 bp, Homo sapiens
cttctatttatggatatcac

SEQ ID NO: 6198421 - DNA, 16 bp, Homo sapiens
cttctatttatttatt

SEQ ID NO: 6198422 - DNA, 15 bp, Homo sapiens
cttctattttgtaaa

SEQ ID NO: 6198423 - DNA, 23 bp, Homo sapiens
cttctcaaagagaattgtatgta

SEQ ID NO: 6198424 - DNA, 21 bp, Homo sapiens
cttctcaaagctgggattaca

SEQ ID NO: 6198425 - DNA, 14 bp, Homo sapiens
cttctcaactaaag

SEQ ID NO: 6198426 - DNA, 12 bp, Homo sapiens
cttctcaagact

SEQ ID NO: 6198427 - DNA, 20 bp, Homo sapiens
cttctcaagactttagcttt

SEQ ID NO: 6198428 - DNA, 17 bp, Homo sapiens
cttctcaagcactgaca

SEQ ID NO: 6198429 - DNA, 15 bp, Homo sapiens
cttctcaagtgcctt

SEQ ID NO: 6198430 - DNA, 14 bp, Homo sapiens
cttctcaagttcta

SEQ ID NO: 6198431 - DNA, 21 bp, Homo sapiens
cttctcaagttctaagattct

SEQ ID NO: 6198432 - DNA, 22 bp, Homo sapiens
cttctcacacacaactgtccat

SEQ ID NO: 6198433 - DNA, 20 bp, Homo sapiens
cttctcacatttatattttt

SEQ ID NO: 6198434 - DNA, 19 bp, Homo sapiens
cttctcaccagctgcaaag

SEQ ID NO: 6198435 - DNA, 18 bp, Homo sapiens
cttctcacgctttgttta

SEQ ID NO: 6198436 - DNA, 22 bp, Homo sapiens
cttctcacgctttgtttactct

SEQ ID NO: 6198437 - DNA, 13 bp, Homo sapiens
cttctcactgcca

SEQ ID NO: 6198438 - DNA, 14 bp, Homo sapiens
cttctcactgccat

SEQ ID NO: 6198439 - DNA, 19 bp, Homo sapiens
cttctcacttcaattaatg

SEQ ID NO: 6198440 - DNA, 19 bp, Homo sapiens
cttctcacttccccttgca

SEQ ID NO: 6198441 - DNA, 20 bp, Homo sapiens
cttctcacttccccttgcac

SEQ ID NO: 6198442 - DNA, 15 bp, Homo sapiens
cttctcactttcctt

SEQ ID NO: 6198443 - DNA, 17 bp, Homo sapiens
cttctcagaagcacaga

SEQ ID NO: 6198444 - DNA, 14 bp, Homo sapiens
cttctcagaatcta

SEQ ID NO: 6198445 - DNA, 18 bp, Homo sapiens
cttctcagaatctaccca

SEQ ID NO: 6198446 - DNA, 13 bp, Homo sapiens
cttctcagagcag

SEQ ID NO: 6198447 - DNA, 19 bp, Homo sapiens
cttctcagatttctgagga

SEQ ID NO: 6198448 - DNA, 22 bp, Homo sapiens
cttctcagatttctgaggaaat

SEQ ID NO: 6198449 - DNA, 19 bp, Homo sapiens
cttctcagatttttctgaa

SEQ ID NO: 6198450 - DNA, 16 bp, Homo sapiens
cttctcagcactttcc

SEQ ID NO: 6198451 - DNA, 23 bp, Homo sapiens
cttctcagccacaaaccctgcct

SEQ ID NO: 6198452 - DNA, 21 bp, Homo sapiens
cttctcagccccgggcctgcc

SEQ ID NO: 6198453 - DNA, 23 bp, Homo sapiens
cttctcagccccgggcctgcctc

SEQ ID NO: 6198454 - DNA, 15 bp, Homo sapiens
cttctcagccccttt

SEQ ID NO: 6198455 - DNA, 13 bp, Homo sapiens
cttctcagctcca

SEQ ID NO: 6198456 - DNA, 20 bp, Homo sapiens
cttctcagctccactctgaa

SEQ ID NO: 6198457 - DNA, 12 bp, Homo sapiens
cttctcagctct

SEQ ID NO: 6198458 - DNA, 16 bp, Homo sapiens
cttctcagctcttcca

SEQ ID NO: 6198459 - DNA, 13 bp, Homo sapiens
cttctcaggaaat

SEQ ID NO: 6198460 - DNA, 17 bp, Homo sapiens
cttctcaggacacaggc

SEQ ID NO: 6198461 - DNA, 20 bp, Homo sapiens
cttctcaggacacaggcctg

SEQ ID NO: 6198462 - DNA, 21 bp, Homo sapiens
cttctcaggacacaggcctgt

SEQ ID NO: 6198463 - DNA, 20 bp, Homo sapiens
cttctcaggccccgggcttc

SEQ ID NO: 6198464 - DNA, 22 bp, Homo sapiens
cttctcaggccccgggcttccc

SEQ ID NO: 6198465 - DNA, 20 bp, Homo sapiens
cttctcaggctctgccctgc

SEQ ID NO: 6198466 - DNA, 11 bp, Homo sapiens
cttctcagtgt

SEQ ID NO: 6198467 - DNA, 12 bp, Homo sapiens
cttctcagtgtc

SEQ ID NO: 6198468 - DNA, 16 bp, Homo sapiens
cttctcagtgtctgaa

SEQ ID NO: 6198469 - DNA, 12 bp, Homo sapiens
cttctcagtgtt

SEQ ID NO: 6198470 - DNA, 23 bp, Homo sapiens
cttctcagttgcagaaaatgaac

SEQ ID NO: 6198471 - DNA, 19 bp, Homo sapiens
cttctcagtttctgcctgg

SEQ ID NO: 6198472 - DNA, 22 bp, Homo sapiens
cttctcagtttctgcctgggca

SEQ ID NO: 6198473 - DNA, 14 bp, Homo sapiens
cttctcatcacaca

SEQ ID NO: 6198474 - DNA, 15 bp, Homo sapiens
cttctcatcacacac

SEQ ID NO: 6198475 - DNA, 19 bp, Homo sapiens
cttctcatcacacacatgg

SEQ ID NO: 6198476 - DNA, 15 bp, Homo sapiens
cttctcatcctgcag

SEQ ID NO: 6198477 - DNA, 18 bp, Homo sapiens
cttctcatcgaagggatt

SEQ ID NO: 6198478 - DNA, 15 bp, Homo sapiens
cttctcatctcccca

SEQ ID NO: 6198479 - DNA, 18 bp, Homo sapiens
cttctcatcttaaaaata

SEQ ID NO: 6198480 - DNA, 17 bp, Homo sapiens
cttctcatcttgacaga

SEQ ID NO: 6198481 - DNA, 16 bp, Homo sapiens
cttctcatcttgcctc

SEQ ID NO: 6198482 - DNA, 17 bp, Homo sapiens
cttctcatcttttatct

SEQ ID NO: 6198483 - DNA, 14 bp, Homo sapiens
cttctcatgctatt

SEQ ID NO: 6198484 - DNA, 15 bp, Homo sapiens
cttctcatgctattt

SEQ ID NO: 6198485 - DNA, 22 bp, Homo sapiens
gacaatttgatacataataaaa

SEQ ID NO: 6198486 - DNA, 20 bp, Homo sapiens
gacaattttacctattctga

SEQ ID NO: 6198487 - DNA, 19 bp, Homo sapiens
gacaattttgcttcacttt

SEQ ID NO: 6198488 - DNA, 14 bp, Homo sapiens
gacaattttgtctt

SEQ ID NO: 6198489 - DNA, 21 bp, Homo sapiens
gacaattttgtcttaagtgtt

SEQ ID NO: 6198490 - DNA, 13 bp, Homo sapiens
gacaatttttgct

SEQ ID NO: 6198491 - DNA, 15 bp, Homo sapiens
gacaattttttttca

SEQ ID NO: 6198492 - DNA, 17 bp, Homo sapiens
gacaattttttttcaaa

SEQ ID NO: 6198493 - DNA, 21 bp, Homo sapiens
gacacaaaactccgcccccag

SEQ ID NO: 6198494 - DNA, 23 bp, Homo sapiens
gacacaaacaaacaagctaggtg

SEQ ID NO: 6198495 - DNA, 14 bp, Homo sapiens
gacacaaacctgcc

SEQ ID NO: 6198496 - DNA, 17 bp, Homo sapiens
gacacaaacctgcctgg

SEQ ID NO: 6198497 - DNA, 14 bp, Homo sapiens
gacacaaaggaagt

SEQ ID NO: 6198498 - DNA, 14 bp, Homo sapiens
gacacaaatgcatg

SEQ ID NO: 6198499 - DNA, 15 bp, Homo sapiens
gacacaaattttcaa

SEQ ID NO: 6198500 - DNA, 13 bp, Homo sapiens
gacacaacacaga

SEQ ID NO: 6198501 - DNA, 22 bp, Homo sapiens
gacacaacagcagtctccttca

SEQ ID NO: 6198502 - DNA, 22 bp, Homo sapiens
gacacaactgtgtgattaaaag

SEQ ID NO: 6198503 - DNA, 14 bp, Homo sapiens
gacacaagcacttt

SEQ ID NO: 6198504 - DNA, 22 bp, Homo sapiens
gacacaagccttcggcgcctta

SEQ ID NO: 6198505 - DNA, 13 bp, Homo sapiens
gacacaaggcacg

SEQ ID NO: 6198506 - DNA, 19 bp, Homo sapiens
gacacaaggtgatttcaga

SEQ ID NO: 6198507 - DNA, 22 bp, Homo sapiens
gacacaaggtgatttcagactg

SEQ ID NO: 6198508 - DNA, 15 bp, Homo sapiens
gacacaataggtctt

SEQ ID NO: 6198509 - DNA, 21 bp, Homo sapiens
gacacaataggtctttctctc

SEQ ID NO: 6198510 - DNA, 16 bp, Homo sapiens
gacacaatatgtatgc

SEQ ID NO: 6198511 - DNA, 19 bp, Homo sapiens
gacacaatggcacctctgc

SEQ ID NO: 6198512 - DNA, 23 bp, Homo sapiens
gacacaatggcacctctgccctt

SEQ ID NO: 6198513 - DNA, 14 bp, Homo sapiens
gacacaattagaga

SEQ ID NO: 6198514 - DNA, 16 bp, Homo sapiens
gacacaattagagaag

SEQ ID NO: 6198515 - DNA, 20 bp, Homo sapiens
gacacaatttcatttccagc

SEQ ID NO: 6198516 - DNA, 22 bp, Homo sapiens
gacacacaattcattggctcct

SEQ ID NO: 6198517 - DNA, 11 bp, Homo sapiens
gacacacacac

SEQ ID NO: 6198518 - DNA, 13 bp, Homo sapiens
gacacacacacac

SEQ ID NO: 6198519 - DNA, 14 bp, Homo sapiens
gacacacacacaca

SEQ ID NO: 6198520 - DNA, 15 bp, Homo sapiens
gacacacacacgcac

SEQ ID NO: 6198521 - DNA, 18 bp, Homo sapiens
gacacacacacgcacgca

SEQ ID NO: 6198522 - DNA, 13 bp, Homo sapiens
gacacacacatat

SEQ ID NO: 6198523 - DNA, 21 bp, Homo sapiens
gacacacacatatatacatac

SEQ ID NO: 6198524 - DNA, 13 bp, Homo sapiens
gacacacactcac

SEQ ID NO: 6198525 - DNA, 14 bp, Homo sapiens
gacacacactggct

SEQ ID NO: 6198526 - DNA, 20 bp, Homo sapiens
gacacacagcctcacgcccc

SEQ ID NO: 6198527 - DNA, 15 bp, Homo sapiens
gacacacagcctttc

SEQ ID NO: 6198528 - DNA, 17 bp, Homo sapiens
gacacacagcctttctg

SEQ ID NO: 6198529 - DNA, 18 bp, Homo sapiens
gacacacagcctttctgt

SEQ ID NO: 6198530 - DNA, 19 bp, Homo sapiens
gacacacagcctttctgta

SEQ ID NO: 6198531 - DNA, 20 bp, Homo sapiens
gacacacagcctttctgtat

SEQ ID NO: 6198532 - DNA, 15 bp, Homo sapiens
gacacacagctctgt

SEQ ID NO: 6198533 - DNA, 21 bp, Homo sapiens
gacacacagctctgtcctggg

SEQ ID NO: 6198534 - DNA, 23 bp, Homo sapiens
gacacacagttgttgaatgactg

SEQ ID NO: 6198535 - DNA, 22 bp, Homo sapiens
gacacacatacataatggtact

SEQ ID NO: 6198536 - DNA, 20 bp, Homo sapiens
gacacacatgggcagcccaa

SEQ ID NO: 6198537 - DNA, 15 bp, Homo sapiens
gacacaccaggcgct

SEQ ID NO: 6198538 - DNA, 14 bp, Homo sapiens
gacacacccaaggg

SEQ ID NO: 6198539 - DNA, 15 bp, Homo sapiens
gacacaccccccagt

SEQ ID NO: 6198540 - DNA, 23 bp, Homo sapiens
gacacaccccccagtcgagccct

SEQ ID NO: 6198541 - DNA, 16 bp, Homo sapiens
gacacaccgcggccag

SEQ ID NO: 6198542 - DNA, 21 bp, Homo sapiens
gacacaccgcggccaggcacc

SEQ ID NO: 6198543 - DNA, 12 bp, Homo sapiens
gacacacctctg

SEQ ID NO: 6198544 - DNA, 13 bp, Homo sapiens
gacacacggggct

SEQ ID NO: 6198545 - DNA, 17 bp, Homo sapiens
gacacacggggctcggg

SEQ ID NO: 6198546 - DNA, 23 bp, Homo sapiens
gacacactaaactctggggcttg

SEQ ID NO: 6198547 - DNA, 18 bp, Homo sapiens
gacacactaaccaagctg

SEQ ID NO: 6198548 - DNA, 19 bp, Homo sapiens
gacacactaaccaagctga

SEQ ID NO: 6198549 - DNA, 21 bp, Homo sapiens
gacacactacaccacacacaa

SEQ ID NO: 6198550 - DNA, 20 bp, Homo sapiens
gacacactgaaaagcagcct

SEQ ID NO: 6198551 - DNA, 16 bp, Homo sapiens
gacacactgaagaagc

SEQ ID NO: 6198552 - DNA, 16 bp, Homo sapiens
gacacagaaaatgttg

SEQ ID NO: 6198553 - DNA, 18 bp, Homo sapiens
gacacagaaaatgttgag

SEQ ID NO: 6198554 - DNA, 16 bp, Homo sapiens
gacacagacccacaca

SEQ ID NO: 6198555 - DNA, 21 bp, Homo sapiens
gacacagactggcaataaact

SEQ ID NO: 6198556 - DNA, 18 bp, Homo sapiens
gacacagatctggaggac

SEQ ID NO: 6198557 - DNA, 22 bp, Homo sapiens
gacacagattatgttcctgctg

SEQ ID NO: 6198558 - DNA, 15 bp, Homo sapiens
gacacagattggcca

SEQ ID NO: 6198559 - DNA, 19 bp, Homo sapiens
gacacagcacaagggcaca

SEQ ID NO: 6198560 - DNA, 22 bp, Homo sapiens
gacacagcaccgtgccaacccc

SEQ ID NO: 6198561 - DNA, 19 bp, Homo sapiens
gacacagcagcttcaccag

SEQ ID NO: 6198562 - DNA, 11 bp, Homo sapiens
gacacagcagt

SEQ ID NO: 6198563 - DNA, 14 bp, Homo sapiens
gacacagcagtgag

SEQ ID NO: 6198564 - DNA, 16 bp, Homo sapiens
gacacagcccaccctc

SEQ ID NO: 6198565 - DNA, 19 bp, Homo sapiens
gacacagcccaccctctgt

SEQ ID NO: 6198566 - DNA, 16 bp, Homo sapiens
gacacagcccagagac

SEQ ID NO: 6198567 - DNA, 19 bp, Homo sapiens
gacacagcccagagactga

SEQ ID NO: 6198568 - DNA, 12 bp, Homo sapiens
gacacagctctt

SEQ ID NO: 6198569 - DNA, 16 bp, Homo sapiens
gacacagctcttcatt

SEQ ID NO: 6198570 - DNA, 20 bp, Homo sapiens
gacacagctcttcattccat

SEQ ID NO: 6198571 - DNA, 19 bp, Homo sapiens
gacacagctcttccagggc

SEQ ID NO: 6198572 - DNA, 14 bp, Homo sapiens
gacacagctcttct

SEQ ID NO: 6198573 - DNA, 19 bp, Homo sapiens
gacacagctcttctccagg

SEQ ID NO: 6198574 - DNA, 20 bp, Homo sapiens
gacacagcttaacaatgcaa

SEQ ID NO: 6198575 - DNA, 16 bp, Homo sapiens
gacacagcttgtgaat

SEQ ID NO: 6198576 - DNA, 14 bp, Homo sapiens
gacacaggaaaaat

SEQ ID NO: 6198577 - DNA, 23 bp, Homo sapiens
gacacaggaaaaataaacgtgga

SEQ ID NO: 6198578 - DNA, 14 bp, Homo sapiens
gacacaggaaacaa

SEQ ID NO: 6198579 - DNA, 16 bp, Homo sapiens
gacacaggagaccacc

SEQ ID NO: 6198580 - DNA, 17 bp, Homo sapiens
gacacaggagaccaccc

SEQ ID NO: 6198581 - DNA, 20 bp, Homo sapiens
gacacaggatcctggcctga

SEQ ID NO: 6198582 - DNA, 12 bp, Homo sapiens
gacacaggccag

SEQ ID NO: 6198583 - DNA, 13 bp, Homo sapiens
gacacaggccagc

SEQ ID NO: 6198584 - DNA, 16 bp, Homo sapiens
gacacaggccagcccc

SEQ ID NO: 6198585 - DNA, 13 bp, Homo sapiens
gacacaggccgtg

SEQ ID NO: 6198586 - DNA, 12 bp, Homo sapiens
gacacaggcctg

SEQ ID NO: 6198587 - DNA, 17 bp, Homo sapiens
gacacaggcctgtgtag

SEQ ID NO: 6198588 - DNA, 18 bp, Homo sapiens
gacacaggctcagcatgc

SEQ ID NO: 6198589 - DNA, 16 bp, Homo sapiens
gacacaggctgccgct

SEQ ID NO: 6198590 - DNA, 16 bp, Homo sapiens
gacacaggggacactg

SEQ ID NO: 6198591 - DNA, 12 bp, Homo sapiens
gacacaggtcag

SEQ ID NO: 6198592 - DNA, 17 bp, Homo sapiens
gacacagtgaccatact

SEQ ID NO: 6198593 - DNA, 14 bp, Homo sapiens
gacacagttcctgg

SEQ ID NO: 6198594 - DNA, 15 bp, Homo sapiens
gacacagttttgtct

SEQ ID NO: 6198595 - DNA, 16 bp, Homo sapiens
gacacagttttgtctt

SEQ ID NO: 6198596 - DNA, 14 bp, Homo sapiens
gacacataaaagta

SEQ ID NO: 6198597 - DNA, 19 bp, Homo sapiens
gacacatacagagtgggcc

SEQ ID NO: 6198598 - DNA, 17 bp, Homo sapiens
gacacatatacatatga

SEQ ID NO: 6198599 - DNA, 18 bp, Homo sapiens
gacacatatgaacacaga

SEQ ID NO: 6198600 - DNA, 15 bp, Homo sapiens
gacacatatgagggg

SEQ ID NO: 6198601 - DNA, 14 bp, Homo sapiens
gacacatcagcatg

SEQ ID NO: 6198602 - DNA, 19 bp, Homo sapiens
gacacatgaaggtaaataa

SEQ ID NO: 6198603 - DNA, 12 bp, Homo sapiens
gacacatgcccc

SEQ ID NO: 6198604 - DNA, 13 bp, Homo sapiens
gacacatgcccct

SEQ ID NO: 6198605 - DNA, 14 bp, Homo sapiens
gacacatgcccctc

SEQ ID NO: 6198606 - DNA, 15 bp, Homo sapiens
gacacatgcccctcc

SEQ ID NO: 6198607 - DNA, 17 bp, Homo sapiens
gacacatgcccctcccc

SEQ ID NO: 6198608 - DNA, 18 bp, Homo sapiens
gacacatgcccctccccc

SEQ ID NO: 6198609 - DNA, 14 bp, Homo sapiens
gacacatgctatgt

SEQ ID NO: 6198610 - DNA, 15 bp, Homo sapiens
gacacatgctatgtt

SEQ ID NO: 6198611 - DNA, 18 bp, Homo sapiens
gacacatgctgaggtttt

SEQ ID NO: 6198612 - DNA, 17 bp, Homo sapiens
gacacatgggcttgtga

SEQ ID NO: 6198613 - DNA, 15 bp, Homo sapiens
gacacatgggtgcta

SEQ ID NO: 6198614 - DNA, 18 bp, Homo sapiens
gacacattaatgataaac

SEQ ID NO: 6198615 - DNA, 19 bp, Homo sapiens
gacacattggaatgccttg

SEQ ID NO: 6198616 - DNA, 23 bp, Homo sapiens
gacacatttaaggtgtagtatta

SEQ ID NO: 6198617 - DNA, 19 bp, Homo sapiens
gacacattttctcctagga

SEQ ID NO: 6198618 - DNA, 19 bp, Homo sapiens
gacacattttttaggaaat

SEQ ID NO: 6198619 - DNA, 15 bp, Homo sapiens
gacaccaaagccacc

SEQ ID NO: 6198620 - DNA, 14 bp, Homo sapiens
gacaccaagaaacc

SEQ ID NO: 6198621 - DNA, 17 bp, Homo sapiens
gacaccacacccagcct

SEQ ID NO: 6198622 - DNA, 15 bp, Homo sapiens
gacaccacagcctcc

SEQ ID NO: 6198623 - DNA, 18 bp, Homo sapiens
gacaccacagcctcccct

SEQ ID NO: 6198624 - DNA, 19 bp, Homo sapiens
gacaccacagcctcccctt

SEQ ID NO: 6198625 - DNA, 16 bp, Homo sapiens
gacaccaccactgtgt

SEQ ID NO: 6198626 - DNA, 17 bp, Homo sapiens
gacaccaccactgtgtc

SEQ ID NO: 6198627 - DNA, 19 bp, Homo sapiens
gacaccaccactgtgtccc

SEQ ID NO: 6198628 - DNA, 21 bp, Homo sapiens
gacaccaccactgtgtcccag

SEQ ID NO: 6198629 - DNA, 13 bp, Homo sapiens
gacaccactaaga

SEQ ID NO: 6198630 - DNA, 17 bp, Homo sapiens
gacaccactcctgccag

SEQ ID NO: 6198631 - DNA, 18 bp, Homo sapiens
gacaccactcctgccagc

SEQ ID NO: 6198632 - DNA, 19 bp, Homo sapiens
gacaccactcctgccagcc

SEQ ID NO: 6198633 - DNA, 20 bp, Homo sapiens
gacaccactcctgccagccc

SEQ ID NO: 6198634 - DNA, 21 bp, Homo sapiens
gacaccactcctgccagcccg

SEQ ID NO: 6198635 - DNA, 22 bp, Homo sapiens
gacaccactgagctctgcctca

SEQ ID NO: 6198636 - DNA, 19 bp, Homo sapiens
gacaccacttagatttaaa

SEQ ID NO: 6198637 - DNA, 16 bp, Homo sapiens
gacaccagaataatga

SEQ ID NO: 6198638 - DNA, 15 bp, Homo sapiens
gacaccagagcagat

SEQ ID NO: 6198639 - DNA, 14 bp, Homo sapiens
gacaccagccaggc

SEQ ID NO: 6198640 - DNA, 15 bp, Homo sapiens
gacaccagccaggct

SEQ ID NO: 6198641 - DNA, 17 bp, Homo sapiens
gacaccagccaggctct

SEQ ID NO: 6198642 - DNA, 14 bp, Homo sapiens
gacaccagccctgc

SEQ ID NO: 6198643 - DNA, 13 bp, Homo sapiens
gacaccatcccct

SEQ ID NO: 6198644 - DNA, 16 bp, Homo sapiens
gacaccatcccctcct

SEQ ID NO: 6198645 - DNA, 13 bp, Homo sapiens
gacaccatcctga

SEQ ID NO: 6198646 - DNA, 18 bp, Homo sapiens
gacaccatcctgagccag

SEQ ID NO: 6198647 - DNA, 18 bp, Homo sapiens
gacaccatgttcccagct

SEQ ID NO: 6198648 - DNA, 17 bp, Homo sapiens
gacaccattctcctgcc

SEQ ID NO: 6198649 - DNA, 14 bp, Homo sapiens
gacacccaaagggt

SEQ ID NO: 6198650 - DNA, 23 bp, Homo sapiens
gacacccaagggtcgcctatttt

SEQ ID NO: 6198651 - DNA, 22 bp, Homo sapiens
gacacccacacaggtggccatc

SEQ ID NO: 6198652 - DNA, 22 bp, Homo sapiens
gacacccaccccctctttgtgt

SEQ ID NO: 6198653 - DNA, 12 bp, Homo sapiens
gacacccagaaa

SEQ ID NO: 6198654 - DNA, 14 bp, Homo sapiens
gacacccagggtct

SEQ ID NO: 6198655 - DNA, 19 bp, Homo sapiens
gacacccatgccagagagg

SEQ ID NO: 6198656 - DNA, 11 bp, Homo sapiens
gacaccccact

SEQ ID NO: 6198657 - DNA, 22 bp, Homo sapiens
gacaccccagaatcccctgggg

SEQ ID NO: 6198658 - DNA, 12 bp, Homo sapiens
gacacccccagc

SEQ ID NO: 6198659 - DNA, 19 bp, Homo sapiens
gacaccccccaccatggtg

SEQ ID NO: 6198660 - DNA, 14 bp, Homo sapiens
gacacccccccaac

SEQ ID NO: 6198661 - DNA, 15 bp, Homo sapiens
gacaccccccttctg

SEQ ID NO: 6198662 - DNA, 17 bp, Homo sapiens
gacaccccccttctgaa

SEQ ID NO: 6198663 - DNA, 13 bp, Homo sapiens
gacaccccctccc

SEQ ID NO: 6198664 - DNA, 14 bp, Homo sapiens
gacacccccttggt

SEQ ID NO: 6198665 - DNA, 18 bp, Homo sapiens
gacacccctcgcccccat

SEQ ID NO: 6198666 - DNA, 14 bp, Homo sapiens
cttctcatgtatat

SEQ ID NO: 6198667 - DNA, 19 bp, Homo sapiens
cttctcattcccatgtgga

SEQ ID NO: 6198668 - DNA, 15 bp, Homo sapiens
cttctcattcttcta

SEQ ID NO: 6198669 - DNA, 16 bp, Homo sapiens
cttctcattgctgccc

SEQ ID NO: 6198670 - DNA, 15 bp, Homo sapiens
cttctcatttcaccc

SEQ ID NO: 6198671 - DNA, 18 bp, Homo sapiens
cttctcatttcacccctc

SEQ ID NO: 6198672 - DNA, 23 bp, Homo sapiens
cttctcattttttcctgagaacc

SEQ ID NO: 6198673 - DNA, 19 bp, Homo sapiens
cttctccaaaaatctgcct

SEQ ID NO: 6198674 - DNA, 18 bp, Homo sapiens
cttctccaaaggctctgt

SEQ ID NO: 6198675 - DNA, 14 bp, Homo sapiens
cttctccaaataca

SEQ ID NO: 6198676 - DNA, 19 bp, Homo sapiens
cttctccaattctgcccaa

SEQ ID NO: 6198677 - DNA, 21 bp, Homo sapiens
cttctccaccagcccctcaca

SEQ ID NO: 6198678 - DNA, 14 bp, Homo sapiens
cttctccaccctgc

SEQ ID NO: 6198679 - DNA, 18 bp, Homo sapiens
cttctccaccctgctctc

SEQ ID NO: 6198680 - DNA, 14 bp, Homo sapiens
cttctccacctccc

SEQ ID NO: 6198681 - DNA, 17 bp, Homo sapiens
cttctccactggatgga

SEQ ID NO: 6198682 - DNA, 23 bp, Homo sapiens
cttctccagacaaaccagaagca

SEQ ID NO: 6198683 - DNA, 12 bp, Homo sapiens
cttctccagcaa

SEQ ID NO: 6198684 - DNA, 19 bp, Homo sapiens
cttctccaggaagcccagg

SEQ ID NO: 6198685 - DNA, 13 bp, Homo sapiens
cttctccaggcag

SEQ ID NO: 6198686 - DNA, 14 bp, Homo sapiens
cttctccaggctgt

SEQ ID NO: 6198687 - DNA, 17 bp, Homo sapiens
cttctccaggctgtatc

SEQ ID NO: 6198688 - DNA, 17 bp, Homo sapiens
cttctccaggcttcccc

SEQ ID NO: 6198689 - DNA, 13 bp, Homo sapiens
cttctccagggac

SEQ ID NO: 6198690 - DNA, 19 bp, Homo sapiens
cttctccagggtccacagg

SEQ ID NO: 6198691 - DNA, 20 bp, Homo sapiens
cttctccaggtctcacgggc

SEQ ID NO: 6198692 - DNA, 14 bp, Homo sapiens
cttctccatccaca

SEQ ID NO: 6198693 - DNA, 16 bp, Homo sapiens
cttctccatccacatg

SEQ ID NO: 6198694 - DNA, 11 bp, Homo sapiens
cttctccatct

SEQ ID NO: 6198695 - DNA, 13 bp, Homo sapiens
cttctccatctct

SEQ ID NO: 6198696 - DNA, 19 bp, Homo sapiens
cttctccatctctctggcc

SEQ ID NO: 6198697 - DNA, 17 bp, Homo sapiens
cttctccatctggcagg

SEQ ID NO: 6198698 - DNA, 12 bp, Homo sapiens
cttctccatgct

SEQ ID NO: 6198699 - DNA, 14 bp, Homo sapiens
cttctccatgctgc

SEQ ID NO: 6198700 - DNA, 13 bp, Homo sapiens
cttctccattcta

SEQ ID NO: 6198701 - DNA, 18 bp, Homo sapiens
cttctcccaactcagcct

SEQ ID NO: 6198702 - DNA, 12 bp, Homo sapiens
cttctcccaagc

SEQ ID NO: 6198703 - DNA, 15 bp, Homo sapiens
cttctcccaattcat

SEQ ID NO: 6198704 - DNA, 13 bp, Homo sapiens
cttctcccacccc

SEQ ID NO: 6198705 - DNA, 18 bp, Homo sapiens
cttctcccaccccttggc

SEQ ID NO: 6198706 - DNA, 12 bp, Homo sapiens
cttctcccactc

SEQ ID NO: 6198707 - DNA, 19 bp, Homo sapiens
cttctcccactctcctagg

SEQ ID NO: 6198708 - DNA, 16 bp, Homo sapiens
cttctcccagaatccc

SEQ ID NO: 6198709 - DNA, 14 bp, Homo sapiens
cttctcccagagca

SEQ ID NO: 6198710 - DNA, 15 bp, Homo sapiens
cttctcccaggcctc

SEQ ID NO: 6198711 - DNA, 21 bp, Homo sapiens
cttctcccaggcctctgcccc

SEQ ID NO: 6198712 - DNA, 13 bp, Homo sapiens
cttctcccagtgt

SEQ ID NO: 6198713 - DNA, 15 bp, Homo sapiens
cttctcccagtgtga

SEQ ID NO: 6198714 - DNA, 14 bp, Homo sapiens
cttctcccatctag

SEQ ID NO: 6198715 - DNA, 18 bp, Homo sapiens
cttctcccatctcttcct

SEQ ID NO: 6198716 - DNA, 14 bp, Homo sapiens
cttctcccatttcc

SEQ ID NO: 6198717 - DNA, 15 bp, Homo sapiens
cttctcccatttcct

SEQ ID NO: 6198718 - DNA, 19 bp, Homo sapiens
cttctcccatttcctgatc

SEQ ID NO: 6198719 - DNA, 13 bp, Homo sapiens
cttctccccaatc

SEQ ID NO: 6198720 - DNA, 18 bp, Homo sapiens
cttctccccacagcctct

SEQ ID NO: 6198721 - DNA, 13 bp, Homo sapiens
cttctccccagaa

SEQ ID NO: 6198722 - DNA, 20 bp, Homo sapiens
cttctccccagagctgcctg

SEQ ID NO: 6198723 - DNA, 16 bp, Homo sapiens
cttctccccagagttc

SEQ ID NO: 6198724 - DNA, 14 bp, Homo sapiens
cttctccccagcca

SEQ ID NO: 6198725 - DNA, 19 bp, Homo sapiens
cttctccccagccagaggt

SEQ ID NO: 6198726 - DNA, 18 bp, Homo sapiens
cttctccccagctcccag

SEQ ID NO: 6198727 - DNA, 21 bp, Homo sapiens
cttctcccccaccccctaggg

SEQ ID NO: 6198728 - DNA, 17 bp, Homo sapiens
cttctcccccatcctac

SEQ ID NO: 6198729 - DNA, 15 bp, Homo sapiens
cttctccccccatcc

SEQ ID NO: 6198730 - DNA, 20 bp, Homo sapiens
cttctcccccgccctgcccc

SEQ ID NO: 6198731 - DNA, 14 bp, Homo sapiens
cttctccccctcag

SEQ ID NO: 6198732 - DNA, 21 bp, Homo sapiens
cttctccccctcagctctccc

SEQ ID NO: 6198733 - DNA, 19 bp, Homo sapiens
cttctcccccttgtcttcc

SEQ ID NO: 6198734 - DNA, 16 bp, Homo sapiens
cttctccccgaggctg

SEQ ID NO: 6198735 - DNA, 22 bp, Homo sapiens
cttctcccctcagccaatgaat

SEQ ID NO: 6198736 - DNA, 12 bp, Homo sapiens
cttctcccctcc

SEQ ID NO: 6198737 - DNA, 14 bp, Homo sapiens
cttctcccctccac

SEQ ID NO: 6198738 - DNA, 15 bp, Homo sapiens
cttctcccctccaga

SEQ ID NO: 6198739 - DNA, 14 bp, Homo sapiens
cttctcccctcccc

SEQ ID NO: 6198740 - DNA, 16 bp, Homo sapiens
cttctcccctctccca

SEQ ID NO: 6198741 - DNA, 19 bp, Homo sapiens
cttctcccctctcccaggg

SEQ ID NO: 6198742 - DNA, 13 bp, Homo sapiens
cttctcccctgca

SEQ ID NO: 6198743 - DNA, 16 bp, Homo sapiens
cttctcccctgcactg

SEQ ID NO: 6198744 - DNA, 17 bp, Homo sapiens
cttctcccctgcactgt

SEQ ID NO: 6198745 - DNA, 18 bp, Homo sapiens
cttctcccctgcactgta

SEQ ID NO: 6198746 - DNA, 16 bp, Homo sapiens
cttctcccctgccctt

SEQ ID NO: 6198747 - DNA, 19 bp, Homo sapiens
cttctcccctgggtcctcc

SEQ ID NO: 6198748 - DNA, 20 bp, Homo sapiens
cttctcccctgggtcctcca

SEQ ID NO: 6198749 - DNA, 23 bp, Homo sapiens
cttctcccctgggtcctccaaag

SEQ ID NO: 6198750 - DNA, 23 bp, Homo sapiens
cttctccccttcctggacacact

SEQ ID NO: 6198751 - DNA, 18 bp, Homo sapiens
cttctcccctttcaaatt

SEQ ID NO: 6198752 - DNA, 23 bp, Homo sapiens
cttctcccctttcaaattgcctt

SEQ ID NO: 6198753 - DNA, 21 bp, Homo sapiens
cttctcccgccattggcctta

SEQ ID NO: 6198754 - DNA, 21 bp, Homo sapiens
cttctcccggacctggactag

SEQ ID NO: 6198755 - DNA, 16 bp, Homo sapiens
cttctcccggccctca

SEQ ID NO: 6198756 - DNA, 14 bp, Homo sapiens
cttctccctagccc

SEQ ID NO: 6198757 - DNA, 23 bp, Homo sapiens
cttctccctcccctcacccgctg

SEQ ID NO: 6198758 - DNA, 13 bp, Homo sapiens
cttctccctggat

SEQ ID NO: 6198759 - DNA, 14 bp, Homo sapiens
cttctccctggctg

SEQ ID NO: 6198760 - DNA, 15 bp, Homo sapiens
cttctccctggctga

SEQ ID NO: 6198761 - DNA, 23 bp, Homo sapiens
cttctccctggggacggggctcc

SEQ ID NO: 6198762 - DNA, 16 bp, Homo sapiens
cttctccctggggagg

SEQ ID NO: 6198763 - DNA, 22 bp, Homo sapiens
cttctccctggggaggacccct

SEQ ID NO: 6198764 - DNA, 15 bp, Homo sapiens
cttctcccttgccct

SEQ ID NO: 6198765 - DNA, 17 bp, Homo sapiens
cttctcccttgccctcc

SEQ ID NO: 6198766 - DNA, 16 bp, Homo sapiens
cttctccgaggggctg

SEQ ID NO: 6198767 - DNA, 13 bp, Homo sapiens
cttctccgccagc

SEQ ID NO: 6198768 - DNA, 14 bp, Homo sapiens
cttctccgccagcc

SEQ ID NO: 6198769 - DNA, 23 bp, Homo sapiens
cttctccgccagcctcctctgga

SEQ ID NO: 6198770 - DNA, 13 bp, Homo sapiens
cttctccgtcctc

SEQ ID NO: 6198771 - DNA, 20 bp, Homo sapiens
cttctcctacttagggaaga

SEQ ID NO: 6198772 - DNA, 14 bp, Homo sapiens
cttctcctcagctt

SEQ ID NO: 6198773 - DNA, 13 bp, Homo sapiens
cttctcctccagg

SEQ ID NO: 6198774 - DNA, 18 bp, Homo sapiens
cttctcctccccacccgc

SEQ ID NO: 6198775 - DNA, 19 bp, Homo sapiens
cttctcctcctctgtcttt

SEQ ID NO: 6198776 - DNA, 14 bp, Homo sapiens
cttctcctctctgg

SEQ ID NO: 6198777 - DNA, 15 bp, Homo sapiens
cttctcctctggctt

SEQ ID NO: 6198778 - DNA, 14 bp, Homo sapiens
cttctcctcttgta

SEQ ID NO: 6198779 - DNA, 17 bp, Homo sapiens
cttctcctcttgtaaat

SEQ ID NO: 6198780 - DNA, 20 bp, Homo sapiens
cttctcctgaagttcagcca

SEQ ID NO: 6198781 - DNA, 23 bp, Homo sapiens
cttctcctgcagcctgagatgga

SEQ ID NO: 6198782 - DNA, 21 bp, Homo sapiens
cttctcctgcgccccgcccac

SEQ ID NO: 6198783 - DNA, 19 bp, Homo sapiens
cttctcctgtgatgtccca

SEQ ID NO: 6198784 - DNA, 18 bp, Homo sapiens
cttctcctgttttatata

SEQ ID NO: 6198785 - DNA, 13 bp, Homo sapiens
cttctccttaacc

SEQ ID NO: 6198786 - DNA, 20 bp, Homo sapiens
cttctccttagaagtggaag

SEQ ID NO: 6198787 - DNA, 19 bp, Homo sapiens
cttctccttcacctttgtc

SEQ ID NO: 6198788 - DNA, 20 bp, Homo sapiens
cttctccttccaactgctgc

SEQ ID NO: 6198789 - DNA, 17 bp, Homo sapiens
cttctccttccccagga

SEQ ID NO: 6198790 - DNA, 16 bp, Homo sapiens
cttctccttgataaca

SEQ ID NO: 6198791 - DNA, 19 bp, Homo sapiens
cttctccttgataacagct

SEQ ID NO: 6198792 - DNA, 22 bp, Homo sapiens
cttctccttgccttgcttctcc

SEQ ID NO: 6198793 - DNA, 18 bp, Homo sapiens
cttctccttggaggacag

SEQ ID NO: 6198794 - DNA, 13 bp, Homo sapiens
cttctccttggct

SEQ ID NO: 6198795 - DNA, 13 bp, Homo sapiens
cttctcctttcct

SEQ ID NO: 6198796 - DNA, 18 bp, Homo sapiens
cttctcctttccttccca

SEQ ID NO: 6198797 - DNA, 13 bp, Homo sapiens
cttctcctttggc

SEQ ID NO: 6198798 - DNA, 15 bp, Homo sapiens
cttctcctttggcat

SEQ ID NO: 6198799 - DNA, 18 bp, Homo sapiens
cttctcctttggcatgtt

SEQ ID NO: 6198800 - DNA, 21 bp, Homo sapiens
cttctcctttggcatgtttaa

SEQ ID NO: 6198801 - DNA, 22 bp, Homo sapiens
cttctcctttgtcaaatggtat

SEQ ID NO: 6198802 - DNA, 20 bp, Homo sapiens
cttctcgacttcaggagctg

SEQ ID NO: 6198803 - DNA, 14 bp, Homo sapiens
cttctcgcattttc

SEQ ID NO: 6198804 - DNA, 15 bp, Homo sapiens
cttctcgcattttct

SEQ ID NO: 6198805 - DNA, 16 bp, Homo sapiens
cttctcgcttttgcca

SEQ ID NO: 6198806 - DNA, 18 bp, Homo sapiens
cttctcggagctggccca

SEQ ID NO: 6198807 - DNA, 20 bp, Homo sapiens
cttctcggagctggcccagg

SEQ ID NO: 6198808 - DNA, 14 bp, Homo sapiens
cttctcggaggcca

SEQ ID NO: 6198809 - DNA, 18 bp, Homo sapiens
cttctcggaggccaggcc

SEQ ID NO: 6198810 - DNA, 20 bp, Homo sapiens
cttctcggaggccaggccct

SEQ ID NO: 6198811 - DNA, 15 bp, Homo sapiens
cttctcggccagccc

SEQ ID NO: 6198812 - DNA, 15 bp, Homo sapiens
cttctcggctcaggc

SEQ ID NO: 6198813 - DNA, 21 bp, Homo sapiens
cttctcggcttggatcctggg

SEQ ID NO: 6198814 - DNA, 17 bp, Homo sapiens
cttctcgtagatgctgc

SEQ ID NO: 6198815 - DNA, 18 bp, Homo sapiens
cttctcgtagatgctgcc

SEQ ID NO: 6198816 - DNA, 14 bp, Homo sapiens
cttctcgtcttcct

SEQ ID NO: 6198817 - DNA, 16 bp, Homo sapiens
cttctcgtttgctcta

SEQ ID NO: 6198818 - DNA, 16 bp, Homo sapiens
cttctctaaaacagca

SEQ ID NO: 6198819 - DNA, 17 bp, Homo sapiens
cttctctagctggtggt

SEQ ID NO: 6198820 - DNA, 15 bp, Homo sapiens
cttctctataaaaaa

SEQ ID NO: 6198821 - DNA, 17 bp, Homo sapiens
cttctctatatttttat

SEQ ID NO: 6198822 - DNA, 16 bp, Homo sapiens
cttctctatgataatt

SEQ ID NO: 6198823 - DNA, 19 bp, Homo sapiens
cttctctatgataattaca

SEQ ID NO: 6198824 - DNA, 22 bp, Homo sapiens
cttctctcaaccttggccttct

SEQ ID NO: 6198825 - DNA, 15 bp, Homo sapiens
cttctctcacctcct

SEQ ID NO: 6198826 - DNA, 16 bp, Homo sapiens
cttctctcacctccta

SEQ ID NO: 6198827 - DNA, 18 bp, Homo sapiens
cttctctcacctcctaaa

SEQ ID NO: 6198828 - DNA, 21 bp, Homo sapiens
cttctctcagaccgtcttcct

SEQ ID NO: 6198829 - DNA, 13 bp, Homo sapiens
cttctctcagcct

SEQ ID NO: 6198830 - DNA, 15 bp, Homo sapiens
cttctctcatagtgt

SEQ ID NO: 6198831 - DNA, 19 bp, Homo sapiens
cttctctccacagtgttgt

SEQ ID NO: 6198832 - DNA, 12 bp, Homo sapiens
cttctctccagc

SEQ ID NO: 6198833 - DNA, 17 bp, Homo sapiens
cttctctccagcccctg

SEQ ID NO: 6198834 - DNA, 14 bp, Homo sapiens
cttctctccagtgc

SEQ ID NO: 6198835 - DNA, 13 bp, Homo sapiens
cttctctcccaca

SEQ ID NO: 6198836 - DNA, 21 bp, Homo sapiens
cttctctcccacacaagcagt

SEQ ID NO: 6198837 - DNA, 17 bp, Homo sapiens
cttctctcccacgtgca

SEQ ID NO: 6198838 - DNA, 17 bp, Homo sapiens
cttctctccccagcccc

SEQ ID NO: 6198839 - DNA, 13 bp, Homo sapiens
cttctctccctgc

SEQ ID NO: 6198840 - DNA, 13 bp, Homo sapiens
cttctctcctcag

SEQ ID NO: 6198841 - DNA, 15 bp, Homo sapiens
cttctctcctcagac

SEQ ID NO: 6198842 - DNA, 14 bp, Homo sapiens
cttctctccttccc

SEQ ID NO: 6198843 - DNA, 21 bp, Homo sapiens
cttctctccttccctctttcc

SEQ ID NO: 6198844 - DNA, 19 bp, Homo sapiens
cttctctcctttctccctg

SEQ ID NO: 6198845 - DNA, 13 bp, Homo sapiens
cttctctctcacc

SEQ ID NO: 6198846 - DNA, 13 bp, Homo sapiens
cttctctctccag

SEQ ID NO: 6198847 - DNA, 18 bp, Homo sapiens
cttctctctctaaaatga

SEQ ID NO: 6198848 - DNA, 20 bp, Homo sapiens
gacaccccttatccaggact

SEQ ID NO: 6198849 - DNA, 10 bp, Homo sapiens
gacacccggc

SEQ ID NO: 6198850 - DNA, 19 bp, Homo sapiens
gacacccgtgagcgcctgt

SEQ ID NO: 6198851 - DNA, 13 bp, Homo sapiens
gacaccctcaacc

SEQ ID NO: 6198852 - DNA, 17 bp, Homo sapiens
gacaccctccactctga

SEQ ID NO: 6198853 - DNA, 16 bp, Homo sapiens
gacaccctcctgcccc

SEQ ID NO: 6198854 - DNA, 17 bp, Homo sapiens
gacaccctcctgccccc

SEQ ID NO: 6198855 - DNA, 14 bp, Homo sapiens
gacaccctctgccg

SEQ ID NO: 6198856 - DNA, 13 bp, Homo sapiens
gacaccctgtgat

SEQ ID NO: 6198857 - DNA, 22 bp, Homo sapiens
gacaccctgtgatggggccctg

SEQ ID NO: 6198858 - DNA, 23 bp, Homo sapiens
gacaccctgtgatggggccctgc

SEQ ID NO: 6198859 - DNA, 15 bp, Homo sapiens
gacacccttctccca

SEQ ID NO: 6198860 - DNA, 19 bp, Homo sapiens
gacacccttctcccactct

SEQ ID NO: 6198861 - DNA, 23 bp, Homo sapiens
gacacccttctcccactctccta

SEQ ID NO: 6198862 - DNA, 13 bp, Homo sapiens
gacaccgctcagt

SEQ ID NO: 6198863 - DNA, 18 bp, Homo sapiens
gacaccgtccctcagtga

SEQ ID NO: 6198864 - DNA, 16 bp, Homo sapiens
gacaccgtcgaccagg

SEQ ID NO: 6198865 - DNA, 21 bp, Homo sapiens
gacaccgtcgaccaggaaagc

SEQ ID NO: 6198866 - DNA, 16 bp, Homo sapiens
gacaccgtggggaagg

SEQ ID NO: 6198867 - DNA, 18 bp, Homo sapiens
gacaccgtggggaagggg

SEQ ID NO: 6198868 - DNA, 21 bp, Homo sapiens
gacaccgtggggaaggggtgc

SEQ ID NO: 6198869 - DNA, 19 bp, Homo sapiens
gacacctaaccccagggca

SEQ ID NO: 6198870 - DNA, 16 bp, Homo sapiens
gacacctaactcttct

SEQ ID NO: 6198871 - DNA, 18 bp, Homo sapiens
gacacctaactcttcttt

SEQ ID NO: 6198872 - DNA, 15 bp, Homo sapiens
gacacctaatgtccc

SEQ ID NO: 6198873 - DNA, 16 bp, Homo sapiens
gacacctacagcagca

SEQ ID NO: 6198874 - DNA, 23 bp, Homo sapiens
gacacctagagtttggacttcca

SEQ ID NO: 6198875 - DNA, 18 bp, Homo sapiens
gacacctatcagagaagc

SEQ ID NO: 6198876 - DNA, 13 bp, Homo sapiens
gacacctcagagc

SEQ ID NO: 6198877 - DNA, 13 bp, Homo sapiens
gacacctcccagg

SEQ ID NO: 6198878 - DNA, 12 bp, Homo sapiens
gacacctccccc

SEQ ID NO: 6198879 - DNA, 18 bp, Homo sapiens
gacacctccccctaccca

SEQ ID NO: 6198880 - DNA, 19 bp, Homo sapiens
gacacctccccctacccat

SEQ ID NO: 6198881 - DNA, 20 bp, Homo sapiens
gacacctccccctacccata

SEQ ID NO: 6198882 - DNA, 22 bp, Homo sapiens
gacacctccccctttcacactg

SEQ ID NO: 6198883 - DNA, 20 bp, Homo sapiens
gacacctccgagaggcagcc

SEQ ID NO: 6198884 - DNA, 20 bp, Homo sapiens
gacacctgcacctcccccca

SEQ ID NO: 6198885 - DNA, 14 bp, Homo sapiens
gacacctgcagcct

SEQ ID NO: 6198886 - DNA, 15 bp, Homo sapiens
gacacctgccccagc

SEQ ID NO: 6198887 - DNA, 18 bp, Homo sapiens
gacacctgccccagcgcg

SEQ ID NO: 6198888 - DNA, 22 bp, Homo sapiens
gacacctgccccagcgcggctt

SEQ ID NO: 6198889 - DNA, 12 bp, Homo sapiens
gacacctgccct

SEQ ID NO: 6198890 - DNA, 14 bp, Homo sapiens
gacacctgccctgc

SEQ ID NO: 6198891 - DNA, 13 bp, Homo sapiens
gacacctggactg

SEQ ID NO: 6198892 - DNA, 19 bp, Homo sapiens
gacacctggagactgtccc

SEQ ID NO: 6198893 - DNA, 19 bp, Homo sapiens
gacacctggtgcgggcctg

SEQ ID NO: 6198894 - DNA, 20 bp, Homo sapiens
gacacctggtgcgggcctgg

SEQ ID NO: 6198895 - DNA, 16 bp, Homo sapiens
gacacctgtacattct

SEQ ID NO: 6198896 - DNA, 22 bp, Homo sapiens
gacaccttagacggaggtgcct

SEQ ID NO: 6198897 - DNA, 12 bp, Homo sapiens
gacaccttccca

SEQ ID NO: 6198898 - DNA, 15 bp, Homo sapiens
gacaccttcccagct

SEQ ID NO: 6198899 - DNA, 16 bp, Homo sapiens
gacaccttcccagctg

SEQ ID NO: 6198900 - DNA, 15 bp, Homo sapiens
gacaccttgacaggg

SEQ ID NO: 6198901 - DNA, 14 bp, Homo sapiens
gacaccttggacat

SEQ ID NO: 6198902 - DNA, 18 bp, Homo sapiens
gacacctttaaaaagcag

SEQ ID NO: 6198903 - DNA, 17 bp, Homo sapiens
gacacgaatattgctga

SEQ ID NO: 6198904 - DNA, 19 bp, Homo sapiens
gacacgaatattgctgatg

SEQ ID NO: 6198905 - DNA, 16 bp, Homo sapiens
gacacgacagcacaca

SEQ ID NO: 6198906 - DNA, 20 bp, Homo sapiens
gacacgagccacaagctgca

SEQ ID NO: 6198907 - DNA, 22 bp, Homo sapiens
gacacgattgagaactgacaaa

SEQ ID NO: 6198908 - DNA, 18 bp, Homo sapiens
gacacgccgtctgtcctc

SEQ ID NO: 6198909 - DNA, 14 bp, Homo sapiens
gacacgcgctctcc

SEQ ID NO: 6198910 - DNA, 17 bp, Homo sapiens
gacacgctcgcgggcag

SEQ ID NO: 6198911 - DNA, 14 bp, Homo sapiens
gacacgcttctgag

SEQ ID NO: 6198912 - DNA, 16 bp, Homo sapiens
gacacgcttctgagca

SEQ ID NO: 6198913 - DNA, 19 bp, Homo sapiens
gacacggcctctggggaga

SEQ ID NO: 6198914 - DNA, 16 bp, Homo sapiens
gacacggcttcactga

SEQ ID NO: 6198915 - DNA, 19 bp, Homo sapiens
gacacgggcctgtccacag

SEQ ID NO: 6198916 - DNA, 20 bp, Homo sapiens
gacacggggatcatctctgt

SEQ ID NO: 6198917 - DNA, 17 bp, Homo sapiens
gacacgtgatggaccaa

SEQ ID NO: 6198918 - DNA, 22 bp, Homo sapiens
gacacgtgatggaccaaagcca

SEQ ID NO: 6198919 - DNA, 23 bp, Homo sapiens
gacacgtggcctcgtgaggggca

SEQ ID NO: 6198920 - DNA, 19 bp, Homo sapiens
gacacgtgggctcccctct

SEQ ID NO: 6198921 - DNA, 23 bp, Homo sapiens
gacacgtgggctcccctcttcct

SEQ ID NO: 6198922 - DNA, 13 bp, Homo sapiens
gacacgtgttttt

SEQ ID NO: 6198923 - DNA, 16 bp, Homo sapiens
gacactaaaacaagag

SEQ ID NO: 6198924 - DNA, 19 bp, Homo sapiens
gacactaagaggaggcagg

SEQ ID NO: 6198925 - DNA, 23 bp, Homo sapiens
gacactaatgcagccacgattgg

SEQ ID NO: 6198926 - DNA, 16 bp, Homo sapiens
gacactacacccagca

SEQ ID NO: 6198927 - DNA, 17 bp, Homo sapiens
gacactacacccagcaa

SEQ ID NO: 6198928 - DNA, 18 bp, Homo sapiens
gacactaccccatataca

SEQ ID NO: 6198929 - DNA, 16 bp, Homo sapiens
gacactagaagatttt

SEQ ID NO: 6198930 - DNA, 18 bp, Homo sapiens
gacactagcccaatgaaa

SEQ ID NO: 6198931 - DNA, 23 bp, Homo sapiens
gacactagtagagcaaagactta

SEQ ID NO: 6198932 - DNA, 17 bp, Homo sapiens
gacactagttcagagga

SEQ ID NO: 6198933 - DNA, 18 bp, Homo sapiens
gacactagttcagaggaa

SEQ ID NO: 6198934 - DNA, 21 bp, Homo sapiens
gacactagttcagaggaagca

SEQ ID NO: 6198935 - DNA, 23 bp, Homo sapiens
gacactatagtttaaaacacatt

SEQ ID NO: 6198936 - DNA, 17 bp, Homo sapiens
gacactcaagagccctt

SEQ ID NO: 6198937 - DNA, 13 bp, Homo sapiens
gacactcagatgc

SEQ ID NO: 6198938 - DNA, 17 bp, Homo sapiens
gacactcagggcagctg

SEQ ID NO: 6198939 - DNA, 16 bp, Homo sapiens
gacactcatataatta

SEQ ID NO: 6198940 - DNA, 18 bp, Homo sapiens
gacactcattaccgtctg

SEQ ID NO: 6198941 - DNA, 14 bp, Homo sapiens
gacactccagtgcc

SEQ ID NO: 6198942 - DNA, 17 bp, Homo sapiens
gacactccatgagtgtc

SEQ ID NO: 6198943 - DNA, 16 bp, Homo sapiens
gacactccccgaagtc

SEQ ID NO: 6198944 - DNA, 14 bp, Homo sapiens
gacactcctagact

SEQ ID NO: 6198945 - DNA, 14 bp, Homo sapiens
gacactcctagaga

SEQ ID NO: 6198946 - DNA, 19 bp, Homo sapiens
gacactcctataaggagag

SEQ ID NO: 6198947 - DNA, 15 bp, Homo sapiens
gacactccttgaaat

SEQ ID NO: 6198948 - DNA, 21 bp, Homo sapiens
gacactcgaggtcgggcagca

SEQ ID NO: 6198949 - DNA, 18 bp, Homo sapiens
gacactcgtcaccccagc

SEQ ID NO: 6198950 - DNA, 20 bp, Homo sapiens
gacactctataagattccaa

SEQ ID NO: 6198951 - DNA, 14 bp, Homo sapiens
gacactctatatgt

SEQ ID NO: 6198952 - DNA, 17 bp, Homo sapiens
gacactctatatgtagt

SEQ ID NO: 6198953 - DNA, 19 bp, Homo sapiens
gacactctatatgtagtgc

SEQ ID NO: 6198954 - DNA, 21 bp, Homo sapiens
gacactctcaccccccgacct

SEQ ID NO: 6198955 - DNA, 14 bp, Homo sapiens
gacactctccttgc

SEQ ID NO: 6198956 - DNA, 15 bp, Homo sapiens
gacactctccttgca

SEQ ID NO: 6198957 - DNA, 17 bp, Homo sapiens
gacactctctggaagcc

SEQ ID NO: 6198958 - DNA, 16 bp, Homo sapiens
gacactctgacaagct

SEQ ID NO: 6198959 - DNA, 15 bp, Homo sapiens
gacactctgctctgc

SEQ ID NO: 6198960 - DNA, 19 bp, Homo sapiens
gacactgaaagttttgtaa

SEQ ID NO: 6198961 - DNA, 23 bp, Homo sapiens
gacactgaaatatacacacagca

SEQ ID NO: 6198962 - DNA, 15 bp, Homo sapiens
gacactgaaggcaaa

SEQ ID NO: 6198963 - DNA, 12 bp, Homo sapiens
gacactgagcca

SEQ ID NO: 6198964 - DNA, 14 bp, Homo sapiens
gacactgagccagt

SEQ ID NO: 6198965 - DNA, 16 bp, Homo sapiens
gacactgagccccacc

SEQ ID NO: 6198966 - DNA, 22 bp, Homo sapiens
gacactgagccccacctctcca

SEQ ID NO: 6198967 - DNA, 19 bp, Homo sapiens
gacactgagcttctgagac

SEQ ID NO: 6198968 - DNA, 15 bp, Homo sapiens
gacactgagggtcac

SEQ ID NO: 6198969 - DNA, 13 bp, Homo sapiens
gacactgatgggc

SEQ ID NO: 6198970 - DNA, 20 bp, Homo sapiens
gacactgatgggtcctgctg

SEQ ID NO: 6198971 - DNA, 18 bp, Homo sapiens
gacactgccttagcctct

SEQ ID NO: 6198972 - DNA, 19 bp, Homo sapiens
gacactgccttagcctctt

SEQ ID NO: 6198973 - DNA, 22 bp, Homo sapiens
gacactgccttgaagcctcctg

SEQ ID NO: 6198974 - DNA, 19 bp, Homo sapiens
gacactgcctttgctgcct

SEQ ID NO: 6198975 - DNA, 24 bp, Homo sapiens
gacactgcctttgctgccttctgt

SEQ ID NO: 6198976 - DNA, 16 bp, Homo sapiens
gacactgcgccccgcc

SEQ ID NO: 6198977 - DNA, 14 bp, Homo sapiens
gacactgctctaac

SEQ ID NO: 6198978 - DNA, 20 bp, Homo sapiens
gacactgctctaacagccct

SEQ ID NO: 6198979 - DNA, 14 bp, Homo sapiens
gacactgctgcacc

SEQ ID NO: 6198980 - DNA, 20 bp, Homo sapiens
gacactgctgcaccagagtg

SEQ ID NO: 6198981 - DNA, 13 bp, Homo sapiens
gacactgctggag

SEQ ID NO: 6198982 - DNA, 19 bp, Homo sapiens
gacactggacatggcccat

SEQ ID NO: 6198983 - DNA, 20 bp, Homo sapiens
gacactggatccagaagcta

SEQ ID NO: 6198984 - DNA, 15 bp, Homo sapiens
gacactggcagagag

SEQ ID NO: 6198985 - DNA, 23 bp, Homo sapiens
gacactggctcatattcctgcag

SEQ ID NO: 6198986 - DNA, 14 bp, Homo sapiens
gacactgggcagca

SEQ ID NO: 6198987 - DNA, 16 bp, Homo sapiens
gacactggtttgaaga

SEQ ID NO: 6198988 - DNA, 18 bp, Homo sapiens
gacactgtgaaatacact

SEQ ID NO: 6198989 - DNA, 19 bp, Homo sapiens
gacactgtgaccctgggtc

SEQ ID NO: 6198990 - DNA, 19 bp, Homo sapiens
gacactgtgagagttgtct

SEQ ID NO: 6198991 - DNA, 20 bp, Homo sapiens
gacactgtgagagttgtctc

SEQ ID NO: 6198992 - DNA, 14 bp, Homo sapiens
gacactgtgcaggc

SEQ ID NO: 6198993 - DNA, 12 bp, Homo sapiens
gacactgtggca

SEQ ID NO: 6198994 - DNA, 18 bp, Homo sapiens
gacactgtgtaagaagct

SEQ ID NO: 6198995 - DNA, 18 bp, Homo sapiens
gacactgttcttagctca

SEQ ID NO: 6198996 - DNA, 17 bp, Homo sapiens
gacactgttgataaaaa

SEQ ID NO: 6198997 - DNA, 22 bp, Homo sapiens
gacactgtttacaagaaaaaat

SEQ ID NO: 6198998 - DNA, 16 bp, Homo sapiens
gacacttaaaaatggt

SEQ ID NO: 6198999 - DNA, 14 bp, Homo sapiens
gacacttcaaactg

SEQ ID NO: 6199000 - DNA, 19 bp, Homo sapiens
gacacttcaaggtgacaga

SEQ ID NO: 6199001 - DNA, 21 bp, Homo sapiens
gacacttcaaggtgacagaag

SEQ ID NO: 6199002 - DNA, 17 bp, Homo sapiens
gacacttcagagagctg

SEQ ID NO: 6199003 - DNA, 23 bp, Homo sapiens
gacacttcagagagctggtagtt

SEQ ID NO: 6199004 - DNA, 12 bp, Homo sapiens
gacacttcagat

SEQ ID NO: 6199005 - DNA, 16 bp, Homo sapiens
gacacttccattgttt

SEQ ID NO: 6199006 - DNA, 17 bp, Homo sapiens
gacacttccattgttta

SEQ ID NO: 6199007 - DNA, 17 bp, Homo sapiens
gacacttccctctgttt

SEQ ID NO: 6199008 - DNA, 19 bp, Homo sapiens
gacacttccctctgtttct

SEQ ID NO: 6199009 - DNA, 20 bp, Homo sapiens
gacacttccctctgtttctc

SEQ ID NO: 6199010 - DNA, 16 bp, Homo sapiens
gacacttccctgggcc

SEQ ID NO: 6199011 - DNA, 17 bp, Homo sapiens
gacacttccctgggcct

SEQ ID NO: 6199012 - DNA, 16 bp, Homo sapiens
gacacttctcaggaaa

SEQ ID NO: 6199013 - DNA, 22 bp, Homo sapiens
gacacttctttatactctcttc

SEQ ID NO: 6199014 - DNA, 15 bp, Homo sapiens
gacacttgccttctt

SEQ ID NO: 6199015 - DNA, 23 bp, Homo sapiens
gacacttttatatttgaaaaaat

SEQ ID NO: 6199016 - DNA, 23 bp, Homo sapiens
gacacttttcaaaagaagacatc

SEQ ID NO: 6199017 - DNA, 21 bp, Homo sapiens
gacacttttcatgtgtgattt

SEQ ID NO: 6199018 - DNA, 20 bp, Homo sapiens
gacagaaaaaaaaatgtttt

SEQ ID NO: 6199019 - DNA, 17 bp, Homo sapiens
gacagaaaagaaagctg

SEQ ID NO: 6199020 - DNA, 19 bp, Homo sapiens
gacagaaacagagagagac

SEQ ID NO: 6199021 - DNA, 14 bp, Homo sapiens
gacagaaactggat

SEQ ID NO: 6199022 - DNA, 15 bp, Homo sapiens
gacagaaagaccctg

SEQ ID NO: 6199023 - DNA, 23 bp, Homo sapiens
gacagaaagaccctgatgcaggt

SEQ ID NO: 6199024 - DNA, 21 bp, Homo sapiens
gacagaaagcagaacagtgat

SEQ ID NO: 6199025 - DNA, 21 bp, Homo sapiens
gacagaaatgacaacaaggcc

SEQ ID NO: 6199026 - DNA, 11 bp, Homo sapiens
cttctctctga

SEQ ID NO: 6199027 - DNA, 14 bp, Homo sapiens
cttctctctggctc

SEQ ID NO: 6199028 - DNA, 20 bp, Homo sapiens
cttctctcttgattgatttt

SEQ ID NO: 6199029 - DNA, 15 bp, Homo sapiens
cttctctctttctaa

SEQ ID NO: 6199030 - DNA, 18 bp, Homo sapiens
cttctctcttttcctcct

SEQ ID NO: 6199031 - DNA, 18 bp, Homo sapiens
cttctctgaacacaggca

SEQ ID NO: 6199032 - DNA, 19 bp, Homo sapiens
cttctctgaacacaggcag

SEQ ID NO: 6199033 - DNA, 20 bp, Homo sapiens
cttctctgaacacaggcagc

SEQ ID NO: 6199034 - DNA, 22 bp, Homo sapiens
cttctctgaacacaggcagctt

SEQ ID NO: 6199035 - DNA, 12 bp, Homo sapiens
cttctctgaagg

SEQ ID NO: 6199036 - DNA, 16 bp, Homo sapiens
cttctctgaagggagg

SEQ ID NO: 6199037 - DNA, 16 bp, Homo sapiens
cttctctgacttctgc

SEQ ID NO: 6199038 - DNA, 17 bp, Homo sapiens
cttctctgacttctgcc

SEQ ID NO: 6199039 - DNA, 21 bp, Homo sapiens
cttctctgacttctgcctgga

SEQ ID NO: 6199040 - DNA, 22 bp, Homo sapiens
cttctctgacttctgcctggag

SEQ ID NO: 6199041 - DNA, 12 bp, Homo sapiens
cttctctgagtc

SEQ ID NO: 6199042 - DNA, 14 bp, Homo sapiens
cttctctgcaatgc

SEQ ID NO: 6199043 - DNA, 21 bp, Homo sapiens
cttctctgcaatgcttctgta

SEQ ID NO: 6199044 - DNA, 22 bp, Homo sapiens
cttctctgcaatgcttctgtag

SEQ ID NO: 6199045 - DNA, 13 bp, Homo sapiens
cttctctgcagta

SEQ ID NO: 6199046 - DNA, 15 bp, Homo sapiens
cttctctgcccattc

SEQ ID NO: 6199047 - DNA, 17 bp, Homo sapiens
cttctctgcccattccc

SEQ ID NO: 6199048 - DNA, 21 bp, Homo sapiens
cttctctgccctgccctggcc

SEQ ID NO: 6199049 - DNA, 14 bp, Homo sapiens
cttctctgcctcac

SEQ ID NO: 6199050 - DNA, 16 bp, Homo sapiens
cttctctgcctcacct

SEQ ID NO: 6199051 - DNA, 14 bp, Homo sapiens
cttctctgcctcct

SEQ ID NO: 6199052 - DNA, 13 bp, Homo sapiens
cttctctgctaga

SEQ ID NO: 6199053 - DNA, 13 bp, Homo sapiens
cttctctgctcca

SEQ ID NO: 6199054 - DNA, 21 bp, Homo sapiens
cttctctgctccaccacatcc

SEQ ID NO: 6199055 - DNA, 22 bp, Homo sapiens
cttctctgctccaccacatcct

SEQ ID NO: 6199056 - DNA, 16 bp, Homo sapiens
cttctctgctgagaag

SEQ ID NO: 6199057 - DNA, 15 bp, Homo sapiens
cttctctgctgcctc

SEQ ID NO: 6199058 - DNA, 16 bp, Homo sapiens
cttctctgctgcctct

SEQ ID NO: 6199059 - DNA, 21 bp, Homo sapiens
cttctctgctgcctctgtgga

SEQ ID NO: 6199060 - DNA, 22 bp, Homo sapiens
cttctctggagccaagtccaga

SEQ ID NO: 6199061 - DNA, 12 bp, Homo sapiens
cttctctgggac

SEQ ID NO: 6199062 - DNA, 14 bp, Homo sapiens
cttctctgggacca

SEQ ID NO: 6199063 - DNA, 18 bp, Homo sapiens
cttctctgggaccaggct

SEQ ID NO: 6199064 - DNA, 20 bp, Homo sapiens
cttctctgggaccaggctcc

SEQ ID NO: 6199065 - DNA, 18 bp, Homo sapiens
cttctctgggcccagaga

SEQ ID NO: 6199066 - DNA, 14 bp, Homo sapiens
cttctctgggctga

SEQ ID NO: 6199067 - DNA, 18 bp, Homo sapiens
cttctctggtctccttga

SEQ ID NO: 6199068 - DNA, 13 bp, Homo sapiens
cttctctgtaagt

SEQ ID NO: 6199069 - DNA, 14 bp, Homo sapiens
cttctctgtctcag

SEQ ID NO: 6199070 - DNA, 13 bp, Homo sapiens
cttctctgtctct

SEQ ID NO: 6199071 - DNA, 14 bp, Homo sapiens
cttctctgtctctg

SEQ ID NO: 6199072 - DNA, 13 bp, Homo sapiens
cttctctgtgacc

SEQ ID NO: 6199073 - DNA, 20 bp, Homo sapiens
cttctctgtgacccacttct

SEQ ID NO: 6199074 - DNA, 13 bp, Homo sapiens
cttctctgttcat

SEQ ID NO: 6199075 - DNA, 14 bp, Homo sapiens
cttctctgttcatt

SEQ ID NO: 6199076 - DNA, 21 bp, Homo sapiens
cttctctgttccattgaatct

SEQ ID NO: 6199077 - DNA, 13 bp, Homo sapiens
cttctctgttggt

SEQ ID NO: 6199078 - DNA, 20 bp, Homo sapiens
cttctcttaaacttgtgaat

SEQ ID NO: 6199079 - DNA, 16 bp, Homo sapiens
cttctcttccaggcag

SEQ ID NO: 6199080 - DNA, 14 bp, Homo sapiens
cttctcttcccata

SEQ ID NO: 6199081 - DNA, 15 bp, Homo sapiens
cttctcttctatcct

SEQ ID NO: 6199082 - DNA, 12 bp, Homo sapiens
cttctcttctct

SEQ ID NO: 6199083 - DNA, 15 bp, Homo sapiens
cttctcttctctgca

SEQ ID NO: 6199084 - DNA, 17 bp, Homo sapiens
cttctcttctcttcttt

SEQ ID NO: 6199085 - DNA, 12 bp, Homo sapiens
cttctcttcttt

SEQ ID NO: 6199086 - DNA, 18 bp, Homo sapiens
cttctcttctttctgaag

SEQ ID NO: 6199087 - DNA, 15 bp, Homo sapiens
cttctcttgctttct

SEQ ID NO: 6199088 - DNA, 18 bp, Homo sapiens
cttctcttggtgaaataa

SEQ ID NO: 6199089 - DNA, 22 bp, Homo sapiens
cttctcttgtgatttggttgca

SEQ ID NO: 6199090 - DNA, 16 bp, Homo sapiens
cttctcttgttaggta

SEQ ID NO: 6199091 - DNA, 22 bp, Homo sapiens
cttctctttaactcaggactcc

SEQ ID NO: 6199092 - DNA, 19 bp, Homo sapiens
cttctctttacttcctttc

SEQ ID NO: 6199093 - DNA, 14 bp, Homo sapiens
cttctctttataga

SEQ ID NO: 6199094 - DNA, 15 bp, Homo sapiens
cttctctttctctct

SEQ ID NO: 6199095 - DNA, 17 bp, Homo sapiens
cttctctttggggctcc

SEQ ID NO: 6199096 - DNA, 19 bp, Homo sapiens
cttctctttgtccccaaat

SEQ ID NO: 6199097 - DNA, 15 bp, Homo sapiens
cttctctttgtgcag

SEQ ID NO: 6199098 - DNA, 18 bp, Homo sapiens
cttctcttttcctcgcag

SEQ ID NO: 6199099 - DNA, 19 bp, Homo sapiens
cttctcttttcctcgcaga

SEQ ID NO: 6199100 - DNA, 22 bp, Homo sapiens
cttctgaaaaatgaatgtaaaa

SEQ ID NO: 6199101 - DNA, 20 bp, Homo sapiens
cttctgaaaacccaaggcca

SEQ ID NO: 6199102 - DNA, 13 bp, Homo sapiens
cttctgaaactta

SEQ ID NO: 6199103 - DNA, 15 bp, Homo sapiens
cttctgaaagcagga

SEQ ID NO: 6199104 - DNA, 16 bp, Homo sapiens
cttctgaaatgtgacc

SEQ ID NO: 6199105 - DNA, 17 bp, Homo sapiens
cttctgaactcaagctg

SEQ ID NO: 6199106 - DNA, 23 bp, Homo sapiens
cttctgaacttggcgctgcccct

SEQ ID NO: 6199107 - DNA, 17 bp, Homo sapiens
cttctgaactttggaag

SEQ ID NO: 6199108 - DNA, 20 bp, Homo sapiens
cttctgaagactgagaactt

SEQ ID NO: 6199109 - DNA, 19 bp, Homo sapiens
cttctgaagatcagaacat

SEQ ID NO: 6199110 - DNA, 14 bp, Homo sapiens
cttctgaagatgga

SEQ ID NO: 6199111 - DNA, 18 bp, Homo sapiens
cttctgaagtctgagccc

SEQ ID NO: 6199112 - DNA, 21 bp, Homo sapiens
cttctgaagtctgagcccatt

SEQ ID NO: 6199113 - DNA, 23 bp, Homo sapiens
cttctgaagtgtgtccatcctga

SEQ ID NO: 6199114 - DNA, 15 bp, Homo sapiens
cttctgaatatttta

SEQ ID NO: 6199115 - DNA, 12 bp, Homo sapiens
cttctgaatcac

SEQ ID NO: 6199116 - DNA, 14 bp, Homo sapiens
cttctgaatcactg

SEQ ID NO: 6199117 - DNA, 20 bp, Homo sapiens
cttctgaatgaagccttctg

SEQ ID NO: 6199118 - DNA, 20 bp, Homo sapiens
cttctgaatgtgctgatcat

SEQ ID NO: 6199119 - DNA, 16 bp, Homo sapiens
cttctgacaaactgtg

SEQ ID NO: 6199120 - DNA, 22 bp, Homo sapiens
cttctgacaaaggtggtaaatt

SEQ ID NO: 6199121 - DNA, 14 bp, Homo sapiens
cttctgacagcctc

SEQ ID NO: 6199122 - DNA, 19 bp, Homo sapiens
cttctgacagcctcagtga

SEQ ID NO: 6199123 - DNA, 23 bp, Homo sapiens
cttctgaccacacttcctgtcca

SEQ ID NO: 6199124 - DNA, 15 bp, Homo sapiens
cttctgacccatgct

SEQ ID NO: 6199125 - DNA, 20 bp, Homo sapiens
cttctgacccatgctgccct

SEQ ID NO: 6199126 - DNA, 22 bp, Homo sapiens
cttctgacccatgctgccctgt

SEQ ID NO: 6199127 - DNA, 22 bp, Homo sapiens
cttctgaccccacttatgctgc

SEQ ID NO: 6199128 - DNA, 17 bp, Homo sapiens
cttctgaccttgctgcc

SEQ ID NO: 6199129 - DNA, 16 bp, Homo sapiens
cttctgacgcagcctg

SEQ ID NO: 6199130 - DNA, 19 bp, Homo sapiens
cttctgacgcagcctgaga

SEQ ID NO: 6199131 - DNA, 22 bp, Homo sapiens
cttctgacgcagcctgagaatg

SEQ ID NO: 6199132 - DNA, 19 bp, Homo sapiens
cttctgactagattattat

SEQ ID NO: 6199133 - DNA, 17 bp, Homo sapiens
cttctgactgtttattt

SEQ ID NO: 6199134 - DNA, 15 bp, Homo sapiens
cttctgactttactt

SEQ ID NO: 6199135 - DNA, 11 bp, Homo sapiens
cttctgagacg

SEQ ID NO: 6199136 - DNA, 15 bp, Homo sapiens
cttctgagcacagat

SEQ ID NO: 6199137 - DNA, 22 bp, Homo sapiens
cttctgagcagcgagcctgcta

SEQ ID NO: 6199138 - DNA, 20 bp, Homo sapiens
cttctgagcagttttccagg

SEQ ID NO: 6199139 - DNA, 18 bp, Homo sapiens
cttctgagccccagcccc

SEQ ID NO: 6199140 - DNA, 18 bp, Homo sapiens
cttctgagctatttcatc

SEQ ID NO: 6199141 - DNA, 17 bp, Homo sapiens
cttctgagctccacctc

SEQ ID NO: 6199142 - DNA, 19 bp, Homo sapiens
cttctgagctccacctctg

SEQ ID NO: 6199143 - DNA, 14 bp, Homo sapiens
cttctgagctgtct

SEQ ID NO: 6199144 - DNA, 15 bp, Homo sapiens
cttctgagtattctc

SEQ ID NO: 6199145 - DNA, 17 bp, Homo sapiens
cttctgagtgaatgtta

SEQ ID NO: 6199146 - DNA, 14 bp, Homo sapiens
cttctgagtggtgt

SEQ ID NO: 6199147 - DNA, 19 bp, Homo sapiens
cttctgatatctgaatgtt

SEQ ID NO: 6199148 - DNA, 16 bp, Homo sapiens
cttctgatcagtctgt

SEQ ID NO: 6199149 - DNA, 20 bp, Homo sapiens
cttctgatgaaatgttaaca

SEQ ID NO: 6199150 - DNA, 15 bp, Homo sapiens
cttctgatgaatctt

SEQ ID NO: 6199151 - DNA, 18 bp, Homo sapiens
cttctgatgaatcttgcg

SEQ ID NO: 6199152 - DNA, 21 bp, Homo sapiens
cttctgattatttgcagctgc

SEQ ID NO: 6199153 - DNA, 15 bp, Homo sapiens
cttctgattcccctc

SEQ ID NO: 6199154 - DNA, 19 bp, Homo sapiens
cttctgatttttctctttt

SEQ ID NO: 6199155 - DNA, 20 bp, Homo sapiens
cttctgcaaagtggcaggga

SEQ ID NO: 6199156 - DNA, 21 bp, Homo sapiens
cttctgcaaagtggcagggac

SEQ ID NO: 6199157 - DNA, 22 bp, Homo sapiens
cttctgcaaagtggcagggacc

SEQ ID NO: 6199158 - DNA, 23 bp, Homo sapiens
cttctgcaaagtggcagggaccg

SEQ ID NO: 6199159 - DNA, 16 bp, Homo sapiens
cttctgcaactgaaat

SEQ ID NO: 6199160 - DNA, 18 bp, Homo sapiens
cttctgcacatctacttg

SEQ ID NO: 6199161 - DNA, 12 bp, Homo sapiens
cttctgcaccca

SEQ ID NO: 6199162 - DNA, 14 bp, Homo sapiens
cttctgcacccaga

SEQ ID NO: 6199163 - DNA, 16 bp, Homo sapiens
cttctgcaccctccac

SEQ ID NO: 6199164 - DNA, 17 bp, Homo sapiens
cttctgcaccctccacc

SEQ ID NO: 6199165 - DNA, 19 bp, Homo sapiens
cttctgcaccctccaccct

SEQ ID NO: 6199166 - DNA, 16 bp, Homo sapiens
cttctgcagcctcggc

SEQ ID NO: 6199167 - DNA, 20 bp, Homo sapiens
cttctgcagcctcggcctag

SEQ ID NO: 6199168 - DNA, 18 bp, Homo sapiens
cttctgcagtcagactga

SEQ ID NO: 6199169 - DNA, 17 bp, Homo sapiens
cttctgcagttctcatg

SEQ ID NO: 6199170 - DNA, 15 bp, Homo sapiens
cttctgcatcactgg

SEQ ID NO: 6199171 - DNA, 19 bp, Homo sapiens
cttctgccaacgcctcctg

SEQ ID NO: 6199172 - DNA, 14 bp, Homo sapiens
cttctgccaccagc

SEQ ID NO: 6199173 - DNA, 12 bp, Homo sapiens
cttctgccactt

SEQ ID NO: 6199174 - DNA, 18 bp, Homo sapiens
cttctgccacttcccagg

SEQ ID NO: 6199175 - DNA, 16 bp, Homo sapiens
cttctgccagaagact

SEQ ID NO: 6199176 - DNA, 14 bp, Homo sapiens
cttctgcccaaatc

SEQ ID NO: 6199177 - DNA, 23 bp, Homo sapiens
cttctgcccaccccgcctctggg

SEQ ID NO: 6199178 - DNA, 15 bp, Homo sapiens
cttctgccccctgca

SEQ ID NO: 6199179 - DNA, 21 bp, Homo sapiens
cttctgccctaacctgacaga

SEQ ID NO: 6199180 - DNA, 14 bp, Homo sapiens
cttctgccctcctg

SEQ ID NO: 6199181 - DNA, 14 bp, Homo sapiens
cttctgcccttcct

SEQ ID NO: 6199182 - DNA, 16 bp, Homo sapiens
cttctgcccttcctcc

SEQ ID NO: 6199183 - DNA, 21 bp, Homo sapiens
cttctgcccttcctccaggag

SEQ ID NO: 6199184 - DNA, 22 bp, Homo sapiens
cttctgcccttcctccaggaga

SEQ ID NO: 6199185 - DNA, 23 bp, Homo sapiens
cttctgcctgaggggcagcctgc

SEQ ID NO: 6199186 - DNA, 15 bp, Homo sapiens
cttctgcctggagac

SEQ ID NO: 6199187 - DNA, 19 bp, Homo sapiens
cttctgccttagtctcagt

SEQ ID NO: 6199188 - DNA, 20 bp, Homo sapiens
cttctgccttagtctcagtt

SEQ ID NO: 6199189 - DNA, 16 bp, Homo sapiens
cttctgccttctcatg

SEQ ID NO: 6199190 - DNA, 14 bp, Homo sapiens
cttctgccttggcc

SEQ ID NO: 6199191 - DNA, 15 bp, Homo sapiens
cttctgcgcctcagg

SEQ ID NO: 6199192 - DNA, 16 bp, Homo sapiens
cttctgcgcctcaggc

SEQ ID NO: 6199193 - DNA, 22 bp, Homo sapiens
cttctgcggagcttctccagcc

SEQ ID NO: 6199194 - DNA, 23 bp, Homo sapiens
cttctgcggagcttctccagcca

SEQ ID NO: 6199195 - DNA, 13 bp, Homo sapiens
cttctgcgggctc

SEQ ID NO: 6199196 - DNA, 16 bp, Homo sapiens
cttctgcgggctccct

SEQ ID NO: 6199197 - DNA, 19 bp, Homo sapiens
cttctgcgggctccctcct

SEQ ID NO: 6199198 - DNA, 20 bp, Homo sapiens
cttctgcgggctccctcctc

SEQ ID NO: 6199199 - DNA, 23 bp, Homo sapiens
cttctgcgggctccctcctctgg

SEQ ID NO: 6199200 - DNA, 18 bp, Homo sapiens
cttctgcggtgaggcagg

SEQ ID NO: 6199201 - DNA, 18 bp, Homo sapiens
cttctgcgtccaccaggc

SEQ ID NO: 6199202 - DNA, 21 bp, Homo sapiens
cttctgctaaatttaataaaa

SEQ ID NO: 6199203 - DNA, 13 bp, Homo sapiens
cttctgctactgg

SEQ ID NO: 6199204 - DNA, 20 bp, Homo sapiens
cttctgctactggcaaaagg

SEQ ID NO: 6199205 - DNA, 17 bp, Homo sapiens
cttctgctaggtagagg

SEQ ID NO: 6199206 - DNA, 18 bp, Homo sapiens
cttctgctcacattccct

SEQ ID NO: 6199207 - DNA, 13 bp, Homo sapiens
cttctgctcatta

SEQ ID NO: 6199208 - DNA, 14 bp, Homo sapiens
cttctgctccaccc

SEQ ID NO: 6199209 - DNA, 15 bp, Homo sapiens
cttctgctccaccct

SEQ ID NO: 6199210 - DNA, 23 bp, Homo sapiens
cttctgctccacccttggcctgt

SEQ ID NO: 6199211 - DNA, 13 bp, Homo sapiens
cttctgctcccac

SEQ ID NO: 6199212 - DNA, 13 bp, Homo sapiens
cttctgctcctta

SEQ ID NO: 6199213 - DNA, 17 bp, Homo sapiens
cttctgctcgtttacac

SEQ ID NO: 6199214 - DNA, 18 bp, Homo sapiens
cttctgctcttttcctgg

SEQ ID NO: 6199215 - DNA, 11 bp, Homo sapiens
cttctgctgaa

SEQ ID NO: 6199216 - DNA, 12 bp, Homo sapiens
cttctgctgcat

SEQ ID NO: 6199217 - DNA, 18 bp, Homo sapiens
cttctgctgcatcgctgt

SEQ ID NO: 6199218 - DNA, 12 bp, Homo sapiens
cttctgctgccc

SEQ ID NO: 6199219 - DNA, 13 bp, Homo sapiens
cttctgctgccca

SEQ ID NO: 6199220 - DNA, 18 bp, Homo sapiens
cttctgctgcccaggcca

SEQ ID NO: 6199221 - DNA, 15 bp, Homo sapiens
cttctgctgccctga

SEQ ID NO: 6199222 - DNA, 18 bp, Homo sapiens
cttctgctgccctgatgc

SEQ ID NO: 6199223 - DNA, 12 bp, Homo sapiens
cttctgctgcct

SEQ ID NO: 6199224 - DNA, 19 bp, Homo sapiens
cttctgctgcctaggttct

SEQ ID NO: 6199225 - DNA, 11 bp, Homo sapiens
cttctgctgct

SEQ ID NO: 6199226 - DNA, 12 bp, Homo sapiens
cttctgctgctg

SEQ ID NO: 6199227 - DNA, 15 bp, Homo sapiens
cttctgctggaggag

SEQ ID NO: 6199228 - DNA, 22 bp, Homo sapiens
cttctgctggaggaggggaagc

SEQ ID NO: 6199229 - DNA, 15 bp, Homo sapiens
cttctgctggataaa

SEQ ID NO: 6199230 - DNA, 17 bp, Homo sapiens
cttctgctggataaaat

SEQ ID NO: 6199231 - DNA, 11 bp, Homo sapiens
cttctgctggg

SEQ ID NO: 6199232 - DNA, 13 bp, Homo sapiens
cttctgctgggct

SEQ ID NO: 6199233 - DNA, 15 bp, Homo sapiens
cttctgctggggcct

SEQ ID NO: 6199234 - DNA, 18 bp, Homo sapiens
cttctgctgttcttcact

SEQ ID NO: 6199235 - DNA, 21 bp, Homo sapiens
cttctgcttcaaaccctcaag

SEQ ID NO: 6199236 - DNA, 13 bp, Homo sapiens
cttctgcttctcc

SEQ ID NO: 6199237 - DNA, 12 bp, Homo sapiens
cttctgctttca

SEQ ID NO: 6199238 - DNA, 12 bp, Homo sapiens
cttctgctttgt

SEQ ID NO: 6199239 - DNA, 14 bp, Homo sapiens
cttctgcttttcaa

SEQ ID NO: 6199240 - DNA, 16 bp, Homo sapiens
cttctgcttttctgcc

SEQ ID NO: 6199241 - DNA, 20 bp, Homo sapiens
cttctgcttttctgccctgg

SEQ ID NO: 6199242 - DNA, 21 bp, Homo sapiens
cttctgcttttctgccctggc

SEQ ID NO: 6199243 - DNA, 18 bp, Homo sapiens
cttctggaaactgtgaag

SEQ ID NO: 6199244 - DNA, 17 bp, Homo sapiens
cttctggaatactgaaa

SEQ ID NO: 6199245 - DNA, 15 bp, Homo sapiens
cttctggaatattgt

SEQ ID NO: 6199246 - DNA, 18 bp, Homo sapiens
cttctggacaggctctgc

SEQ ID NO: 6199247 - DNA, 21 bp, Homo sapiens
cttctggacaggctctgcttc

SEQ ID NO: 6199248 - DNA, 17 bp, Homo sapiens
cttctggagctgggaga

SEQ ID NO: 6199249 - DNA, 16 bp, Homo sapiens
cttctggagtctccag

SEQ ID NO: 6199250 - DNA, 14 bp, Homo sapiens
cttctggagtttct

SEQ ID NO: 6199251 - DNA, 15 bp, Homo sapiens
cttctggagtttctc

SEQ ID NO: 6199252 - DNA, 15 bp, Homo sapiens
cttctggatatagct

SEQ ID NO: 6199253 - DNA, 16 bp, Homo sapiens
cttctggatggatttt

SEQ ID NO: 6199254 - DNA, 11 bp, Homo sapiens
cttctggcacc

SEQ ID NO: 6199255 - DNA, 17 bp, Homo sapiens
cttctggcacttggaga

SEQ ID NO: 6199256 - DNA, 18 bp, Homo sapiens
cttctggcagattcaaat

SEQ ID NO: 6199257 - DNA, 16 bp, Homo sapiens
cttctggccacatcag

SEQ ID NO: 6199258 - DNA, 17 bp, Homo sapiens
cttctggccacatcagc

SEQ ID NO: 6199259 - DNA, 20 bp, Homo sapiens
cttctggccacatcagcccc

SEQ ID NO: 6199260 - DNA, 12 bp, Homo sapiens
cttctggccagg

SEQ ID NO: 6199261 - DNA, 13 bp, Homo sapiens
cttctggccagga

SEQ ID NO: 6199262 - DNA, 17 bp, Homo sapiens
cttctggccaggaagct

SEQ ID NO: 6199263 - DNA, 14 bp, Homo sapiens
cttctggccggtgc

SEQ ID NO: 6199264 - DNA, 17 bp, Homo sapiens
cttctggccggtgctgg

SEQ ID NO: 6199265 - DNA, 18 bp, Homo sapiens
cttctggccggtgctggg

SEQ ID NO: 6199266 - DNA, 16 bp, Homo sapiens
cttctggcctaggacc

SEQ ID NO: 6199267 - DNA, 16 bp, Homo sapiens
cttctggcctccagcc

SEQ ID NO: 6199268 - DNA, 16 bp, Homo sapiens
cttctggcctcccaca

SEQ ID NO: 6199269 - DNA, 19 bp, Homo sapiens
cttctggcctctgctgaat

SEQ ID NO: 6199270 - DNA, 11 bp, Homo sapiens
cttctggcctt

SEQ ID NO: 6199271 - DNA, 15 bp, Homo sapiens
cttctggctacctgt

SEQ ID NO: 6199272 - DNA, 16 bp, Homo sapiens
cttctggctacctgtt

SEQ ID NO: 6199273 - DNA, 19 bp, Homo sapiens
cttctggctacctgtttga

SEQ ID NO: 6199274 - DNA, 18 bp, Homo sapiens
cttctggctgctgcagtc

SEQ ID NO: 6199275 - DNA, 15 bp, Homo sapiens
cttctggctgtagat

SEQ ID NO: 6199276 - DNA, 15 bp, Homo sapiens
cttctggcttatgct

SEQ ID NO: 6199277 - DNA, 23 bp, Homo sapiens
cttctgggaaattgaagtgtctt

SEQ ID NO: 6199278 - DNA, 19 bp, Homo sapiens
cttctgggactggacagct

SEQ ID NO: 6199279 - DNA, 16 bp, Homo sapiens
cttctgggacttgaaa

SEQ ID NO: 6199280 - DNA, 17 bp, Homo sapiens
cttctgggagcaggaac

SEQ ID NO: 6199281 - DNA, 19 bp, Homo sapiens
cttctgggagggcagcagg

SEQ ID NO: 6199282 - DNA, 23 bp, Homo sapiens
cttctgggagggcagcagggcta

SEQ ID NO: 6199283 - DNA, 19 bp, Homo sapiens
cttctgggcaagggctcct

SEQ ID NO: 6199284 - DNA, 16 bp, Homo sapiens
cttctgggcaaggggg

SEQ ID NO: 6199285 - DNA, 18 bp, Homo sapiens
cttctgggcaaggtgagg

SEQ ID NO: 6199286 - DNA, 17 bp, Homo sapiens
cttctgggcagagcctg

SEQ ID NO: 6199287 - DNA, 20 bp, Homo sapiens
cttctgggcatctgttctgg

SEQ ID NO: 6199288 - DNA, 16 bp, Homo sapiens
cttctgggcctgacca

SEQ ID NO: 6199289 - DNA, 23 bp, Homo sapiens
cttctgggcgccggttccacgtg

SEQ ID NO: 6199290 - DNA, 16 bp, Homo sapiens
cttctgggcgtctgag

SEQ ID NO: 6199291 - DNA, 16 bp, Homo sapiens
cttctgggctactgcc

SEQ ID NO: 6199292 - DNA, 21 bp, Homo sapiens
cttctgggctactgccactgt

SEQ ID NO: 6199293 - DNA, 22 bp, Homo sapiens
cttctgggcttcatctggcaac

SEQ ID NO: 6199294 - DNA, 23 bp, Homo sapiens
cttctgggcttcattctggaaac

SEQ ID NO: 6199295 - DNA, 15 bp, Homo sapiens
cttctgggctttttc

SEQ ID NO: 6199296 - DNA, 15 bp, Homo sapiens
cttctggggagggac

SEQ ID NO: 6199297 - DNA, 21 bp, Homo sapiens
cttctggggaggggctccgtg

SEQ ID NO: 6199298 - DNA, 14 bp, Homo sapiens
cttctggggcaggc

SEQ ID NO: 6199299 - DNA, 16 bp, Homo sapiens
cttctggggcaggctg

SEQ ID NO: 6199300 - DNA, 15 bp, Homo sapiens
cttctggggccagcc

SEQ ID NO: 6199301 - DNA, 16 bp, Homo sapiens
cttctggggccagccc

SEQ ID NO: 6199302 - DNA, 17 bp, Homo sapiens
cttctggggccagcccc

SEQ ID NO: 6199303 - DNA, 19 bp, Homo sapiens
cttctggggccagcccctc

SEQ ID NO: 6199304 - DNA, 19 bp, Homo sapiens
cttctgggtggctcctgcc

SEQ ID NO: 6199305 - DNA, 19 bp, Homo sapiens
cttctgggttcaagcgatt

SEQ ID NO: 6199306 - DNA, 16 bp, Homo sapiens
cttctgggttccttcc

SEQ ID NO: 6199307 - DNA, 17 bp, Homo sapiens
cttctgggttccttcct

SEQ ID NO: 6199308 - DNA, 15 bp, Homo sapiens
cttctggtactttct

SEQ ID NO: 6199309 - DNA, 17 bp, Homo sapiens
cttctggtcccctgtgg

SEQ ID NO: 6199310 - DNA, 18 bp, Homo sapiens
cttctggtcccctgtggt

SEQ ID NO: 6199311 - DNA, 20 bp, Homo sapiens
cttctggtcccctgtggtga

SEQ ID NO: 6199312 - DNA, 15 bp, Homo sapiens
cttctggtctgtgtg

SEQ ID NO: 6199313 - DNA, 21 bp, Homo sapiens
cttctggtctgtgtgtgttct

SEQ ID NO: 6199314 - DNA, 22 bp, Homo sapiens
cttctggtgagtgcaagagcct

SEQ ID NO: 6199315 - DNA, 18 bp, Homo sapiens
cttctggtgcatgttctt

SEQ ID NO: 6199316 - DNA, 19 bp, Homo sapiens
cttctggtgcatgttcttt

SEQ ID NO: 6199317 - DNA, 15 bp, Homo sapiens
cttctggtgctactc

SEQ ID NO: 6199318 - DNA, 15 bp, Homo sapiens
cttctggtgttgact

SEQ ID NO: 6199319 - DNA, 17 bp, Homo sapiens
cttctggttatttatgg

SEQ ID NO: 6199320 - DNA, 14 bp, Homo sapiens
cttctggttgatgc

SEQ ID NO: 6199321 - DNA, 17 bp, Homo sapiens
cttctggttgcttcaga

SEQ ID NO: 6199322 - DNA, 18 bp, Homo sapiens
cttctggttgtatttcta

SEQ ID NO: 6199323 - DNA, 19 bp, Homo sapiens
cttctggtttccctttatt

SEQ ID NO: 6199324 - DNA, 15 bp, Homo sapiens
cttctgtaattgtgt

SEQ ID NO: 6199325 - DNA, 18 bp, Homo sapiens
cttctgtacgtctgacag

SEQ ID NO: 6199326 - DNA, 18 bp, Homo sapiens
cttctgtactaaagtatt

SEQ ID NO: 6199327 - DNA, 15 bp, Homo sapiens
cttctgtagcctgaa

SEQ ID NO: 6199328 - DNA, 18 bp, Homo sapiens
cttctgtaggaattcttt

SEQ ID NO: 6199329 - DNA, 11 bp, Homo sapiens
cttctgtagtt

SEQ ID NO: 6199330 - DNA, 17 bp, Homo sapiens
cttctgtagttttatca

SEQ ID NO: 6199331 - DNA, 16 bp, Homo sapiens
cttctgtagtttttaa

SEQ ID NO: 6199332 - DNA, 17 bp, Homo sapiens
cttctgtatataaatgg

SEQ ID NO: 6199333 - DNA, 14 bp, Homo sapiens
cttctgtatgcatc

SEQ ID NO: 6199334 - DNA, 19 bp, Homo sapiens
cttctgtattcacttatat

SEQ ID NO: 6199335 - DNA, 11 bp, Homo sapiens
cttctgtattt

SEQ ID NO: 6199336 - DNA, 14 bp, Homo sapiens
cttctgtatttcct

SEQ ID NO: 6199337 - DNA, 15 bp, Homo sapiens
cttctgtatttcctt

SEQ ID NO: 6199338 - DNA, 20 bp, Homo sapiens
cttctgtatttttttttcta

SEQ ID NO: 6199339 - DNA, 16 bp, Homo sapiens
cttctgtcatctacct

SEQ ID NO: 6199340 - DNA, 13 bp, Homo sapiens
cttctgtccacca

SEQ ID NO: 6199341 - DNA, 14 bp, Homo sapiens
cttctgtccaggac

SEQ ID NO: 6199342 - DNA, 23 bp, Homo sapiens
cttctgtccaggacatgatactg

SEQ ID NO: 6199343 - DNA, 14 bp, Homo sapiens
cttctgtcccaagt

SEQ ID NO: 6199344 - DNA, 22 bp, Homo sapiens
cttctgtcccaagtctccagag

SEQ ID NO: 6199345 - DNA, 17 bp, Homo sapiens
cttctgtcctactctgt

SEQ ID NO: 6199346 - DNA, 18 bp, Homo sapiens
cttctgtcctactctgtg

SEQ ID NO: 6199347 - DNA, 16 bp, Homo sapiens
cttctgtcctgtgagg

SEQ ID NO: 6199348 - DNA, 17 bp, Homo sapiens
cttctgtcgtccccaga

SEQ ID NO: 6199349 - DNA, 23 bp, Homo sapiens
cttctgtcgtccccagaccagta

SEQ ID NO: 6199350 - DNA, 14 bp, Homo sapiens
cttctgtctcctgt

SEQ ID NO: 6199351 - DNA, 12 bp, Homo sapiens
cttctgtctctt

SEQ ID NO: 6199352 - DNA, 18 bp, Homo sapiens
cttctgtcttcacaacag

SEQ ID NO: 6199353 - DNA, 14 bp, Homo sapiens
cttctgtgaaatat

SEQ ID NO: 6199354 - DNA, 17 bp, Homo sapiens
cttctgtgaaatataat

SEQ ID NO: 6199355 - DNA, 19 bp, Homo sapiens
cttctgtgaaatataattg

SEQ ID NO: 6199356 - DNA, 11 bp, Homo sapiens
cttctgtgaag

SEQ ID NO: 6199357 - DNA, 16 bp, Homo sapiens
cttctgtgaagaagcc

SEQ ID NO: 6199358 - DNA, 22 bp, Homo sapiens
cttctgtgaagaagccctgttc

SEQ ID NO: 6199359 - DNA, 19 bp, Homo sapiens
cttctgtgagacccccaca

SEQ ID NO: 6199360 - DNA, 15 bp, Homo sapiens
cttctgtgcaataaa

SEQ ID NO: 6199361 - DNA, 21 bp, Homo sapiens
cttctgtgcacctgggctctc

SEQ ID NO: 6199362 - DNA, 12 bp, Homo sapiens
cttctgtgcatc

SEQ ID NO: 6199363 - DNA, 19 bp, Homo sapiens
cttctgtgcatctggcctg

SEQ ID NO: 6199364 - DNA, 16 bp, Homo sapiens
cttctgtgcccagctc

SEQ ID NO: 6199365 - DNA, 17 bp, Homo sapiens
cttctgtgcccagctca

SEQ ID NO: 6199366 - DNA, 14 bp, Homo sapiens
cttctgtgctcatg

SEQ ID NO: 6199367 - DNA, 14 bp, Homo sapiens
cttctgtggaagta

SEQ ID NO: 6199368 - DNA, 14 bp, Homo sapiens
cttctgtgggcatg

SEQ ID NO: 6199369 - DNA, 15 bp, Homo sapiens
cttctgtgggcatgg

SEQ ID NO: 6199370 - DNA, 20 bp, Homo sapiens
cttctgtgggcatggccgct

SEQ ID NO: 6199371 - DNA, 24 bp, Homo sapiens
cttctgtgggcccctcaacagcca

SEQ ID NO: 6199372 - DNA, 16 bp, Homo sapiens
cttctgtggggcccct

SEQ ID NO: 6199373 - DNA, 14 bp, Homo sapiens
cttctgtggggctg

SEQ ID NO: 6199374 - DNA, 16 bp, Homo sapiens
cttctgtggggctggg

SEQ ID NO: 6199375 - DNA, 14 bp, Homo sapiens
cttctgtgggtttc

SEQ ID NO: 6199376 - DNA, 14 bp, Homo sapiens
cttctgtgtagaca

SEQ ID NO: 6199377 - DNA, 15 bp, Homo sapiens
cttctgtgtagacat

SEQ ID NO: 6199378 - DNA, 21 bp, Homo sapiens
cttctgtgtcgttttgttgcc

SEQ ID NO: 6199379 - DNA, 15 bp, Homo sapiens
cttctgtgtctgtca

SEQ ID NO: 6199380 - DNA, 13 bp, Homo sapiens
cttctgtgtgtga

SEQ ID NO: 6199381 - DNA, 14 bp, Homo sapiens
cttctgtgttcatt

SEQ ID NO: 6199382 - DNA, 11 bp, Homo sapiens
cttctgtgttt

SEQ ID NO: 6199383 - DNA, 17 bp, Homo sapiens
cttctgtgtttctggag

SEQ ID NO: 6199384 - DNA, 18 bp, Homo sapiens
cttctgtgtttctggagt

SEQ ID NO: 6199385 - DNA, 15 bp, Homo sapiens
cttctgttaagaaag

SEQ ID NO: 6199386 - DNA, 12 bp, Homo sapiens
cttctgttccag

SEQ ID NO: 6199387 - DNA, 15 bp, Homo sapiens
cttctgttctcaaat

SEQ ID NO: 6199388 - DNA, 15 bp, Homo sapiens
aaattctttttcaaa

SEQ ID NO: 6199389 - DNA, 16 bp, Homo sapiens
aaattctttttcaaaa

SEQ ID NO: 6199390 - DNA, 12 bp, Homo sapiens
aaattgaaaaaa

SEQ ID NO: 6199391 - DNA, 12 bp, Homo sapiens
aaattgaaaaca

SEQ ID NO: 6199392 - DNA, 16 bp, Homo sapiens
aaattgaaaacactaa

SEQ ID NO: 6199393 - DNA, 21 bp, Homo sapiens
aaattgaaaacactaacaaaa

SEQ ID NO: 6199394 - DNA, 14 bp, Homo sapiens
aaattgaaaagtta

SEQ ID NO: 6199395 - DNA, 21 bp, Homo sapiens
aaattgaaaagttatttccct

SEQ ID NO: 6199396 - DNA, 16 bp, Homo sapiens
aaattgaaaatgacca

SEQ ID NO: 6199397 - DNA, 15 bp, Homo sapiens
aaattgaaagaactt

SEQ ID NO: 6199398 - DNA, 23 bp, Homo sapiens
aaattgaaaggcattctctgaag

SEQ ID NO: 6199399 - DNA, 13 bp, Homo sapiens
aaattgaaagtat

SEQ ID NO: 6199400 - DNA, 17 bp, Homo sapiens
aaattgaaagtattcag

SEQ ID NO: 6199401 - DNA, 19 bp, Homo sapiens
aaattgaaagtattcagaa

SEQ ID NO: 6199402 - DNA, 13 bp, Homo sapiens
aaattgaaattgt

SEQ ID NO: 6199403 - DNA, 16 bp, Homo sapiens
aaattgaacaaaaatg

SEQ ID NO: 6199404 - DNA, 15 bp, Homo sapiens
aaattgaacctttgt

SEQ ID NO: 6199405 - DNA, 14 bp, Homo sapiens
aaattgaagccaga

SEQ ID NO: 6199406 - DNA, 14 bp, Homo sapiens
aaattgaagtgtct

SEQ ID NO: 6199407 - DNA, 19 bp, Homo sapiens
aaattgaagtgtcttctgt

SEQ ID NO: 6199408 - DNA, 13 bp, Homo sapiens
aaattgaataatg

SEQ ID NO: 6199409 - DNA, 23 bp, Homo sapiens
aaattgaataatgttttttgaag

SEQ ID NO: 6199410 - DNA, 17 bp, Homo sapiens
aaattgaatacacaaat

SEQ ID NO: 6199411 - DNA, 17 bp, Homo sapiens
aaattgaatactttgaa

SEQ ID NO: 6199412 - DNA, 19 bp, Homo sapiens
aaattgaatagtttatttc

SEQ ID NO: 6199413 - DNA, 23 bp, Homo sapiens
aaattgaatcagtataaacaaag

SEQ ID NO: 6199414 - DNA, 14 bp, Homo sapiens
aaattgaatgcaaa

SEQ ID NO: 6199415 - DNA, 15 bp, Homo sapiens
aaattgaatgcaaac

SEQ ID NO: 6199416 - DNA, 15 bp, Homo sapiens
aaattgacaaaaaaa

SEQ ID NO: 6199417 - DNA, 22 bp, Homo sapiens
aaattgacacttaaaaatggtt

SEQ ID NO: 6199418 - DNA, 23 bp, Homo sapiens
aaattgacagctttctaactcac

SEQ ID NO: 6199419 - DNA, 19 bp, Homo sapiens
aaattgacatgttgtcaca

SEQ ID NO: 6199420 - DNA, 15 bp, Homo sapiens
aaattgacattgctt

SEQ ID NO: 6199421 - DNA, 22 bp, Homo sapiens
aaattgaccaagtgatgtgttt

SEQ ID NO: 6199422 - DNA, 23 bp, Homo sapiens
aaattgagatgcccccccaggcc

SEQ ID NO: 6199423 - DNA, 21 bp, Homo sapiens
aaattgagctagttaaggcaa

SEQ ID NO: 6199424 - DNA, 23 bp, Homo sapiens
aaattgagctggacctcaccaag

SEQ ID NO: 6199425 - DNA, 19 bp, Homo sapiens
aaattgaggttcagcaagg

SEQ ID NO: 6199426 - DNA, 22 bp, Homo sapiens
aaattgagtgcactaaacaaat

SEQ ID NO: 6199427 - DNA, 21 bp, Homo sapiens
aaattgatattatattaaaca

SEQ ID NO: 6199428 - DNA, 14 bp, Homo sapiens
aaattgatcattca

SEQ ID NO: 6199429 - DNA, 17 bp, Homo sapiens
aaattgattcaaatgtt

SEQ ID NO: 6199430 - DNA, 22 bp, Homo sapiens
aaattgattcaaatgttacaaa

SEQ ID NO: 6199431 - DNA, 18 bp, Homo sapiens
aaattgattgaattaaat

SEQ ID NO: 6199432 - DNA, 12 bp, Homo sapiens
aaattgatttct

SEQ ID NO: 6199433 - DNA, 13 bp, Homo sapiens
aaattgcaaatct

SEQ ID NO: 6199434 - DNA, 14 bp, Homo sapiens
aaattgcaaatctt

SEQ ID NO: 6199435 - DNA, 13 bp, Homo sapiens
aaattgcaatatg

SEQ ID NO: 6199436 - DNA, 11 bp, Homo sapiens
aaattgcacaa

SEQ ID NO: 6199437 - DNA, 14 bp, Homo sapiens
aaattgcacaattt

SEQ ID NO: 6199438 - DNA, 23 bp, Homo sapiens
aaattgcacaatttgagcaattc

SEQ ID NO: 6199439 - DNA, 19 bp, Homo sapiens
aaattgcacagaagtcctg

SEQ ID NO: 6199440 - DNA, 14 bp, Homo sapiens
aaattgcacagagc

SEQ ID NO: 6199441 - DNA, 17 bp, Homo sapiens
aaattgcacgtgcaata

SEQ ID NO: 6199442 - DNA, 13 bp, Homo sapiens
aaattgcactaaa

SEQ ID NO: 6199443 - DNA, 17 bp, Homo sapiens
aaattgcagcagttgct

SEQ ID NO: 6199444 - DNA, 19 bp, Homo sapiens
aaattgcagtttacagtat

SEQ ID NO: 6199445 - DNA, 15 bp, Homo sapiens
aaattgcagtttcat

SEQ ID NO: 6199446 - DNA, 17 bp, Homo sapiens
aaattgcataaagcata

SEQ ID NO: 6199447 - DNA, 14 bp, Homo sapiens
aaattgcatacttt

SEQ ID NO: 6199448 - DNA, 17 bp, Homo sapiens
aaattgcatactttgta

SEQ ID NO: 6199449 - DNA, 17 bp, Homo sapiens
aaattgcatgctgcttt

SEQ ID NO: 6199450 - DNA, 19 bp, Homo sapiens
aaattgcatgctgctttaa

SEQ ID NO: 6199451 - DNA, 21 bp, Homo sapiens
aaattgcatgctgctttaatt

SEQ ID NO: 6199452 - DNA, 14 bp, Homo sapiens
aaattgcatttcta

SEQ ID NO: 6199453 - DNA, 15 bp, Homo sapiens
aaattgcatttctat

SEQ ID NO: 6199454 - DNA, 22 bp, Homo sapiens
aaattgcatttttacctttcat

SEQ ID NO: 6199455 - DNA, 14 bp, Homo sapiens
aaattgccaaaata

SEQ ID NO: 6199456 - DNA, 17 bp, Homo sapiens
aaattgccataatatga

SEQ ID NO: 6199457 - DNA, 15 bp, Homo sapiens
aaattgccatattgc

SEQ ID NO: 6199458 - DNA, 13 bp, Homo sapiens
aaattgccatttt

SEQ ID NO: 6199459 - DNA, 18 bp, Homo sapiens
aaattgcctataatactt

SEQ ID NO: 6199460 - DNA, 14 bp, Homo sapiens
aaattgccttcagc

SEQ ID NO: 6199461 - DNA, 19 bp, Homo sapiens
aaattgccttcagccctaa

SEQ ID NO: 6199462 - DNA, 14 bp, Homo sapiens
aaattgcctttaaa

SEQ ID NO: 6199463 - DNA, 17 bp, Homo sapiens
aaattgctaatgttgct

SEQ ID NO: 6199464 - DNA, 19 bp, Homo sapiens
aaattgctagtgatttcat

SEQ ID NO: 6199465 - DNA, 15 bp, Homo sapiens
aaattgctcaaaaaa

SEQ ID NO: 6199466 - DNA, 15 bp, Homo sapiens
aaattgctcacagtt

SEQ ID NO: 6199467 - DNA, 22 bp, Homo sapiens
aaattgctcctaactccaccgc

SEQ ID NO: 6199468 - DNA, 14 bp, Homo sapiens
aaattgctctgtgt

SEQ ID NO: 6199469 - DNA, 19 bp, Homo sapiens
aaattgctgactgtagctt

SEQ ID NO: 6199470 - DNA, 18 bp, Homo sapiens
aaattgctgagatgttta

SEQ ID NO: 6199471 - DNA, 17 bp, Homo sapiens
aaattgctgcatatttg

SEQ ID NO: 6199472 - DNA, 20 bp, Homo sapiens
aaattgctgcatatttgtgc

SEQ ID NO: 6199473 - DNA, 18 bp, Homo sapiens
aaattgcttactttggaa

SEQ ID NO: 6199474 - DNA, 13 bp, Homo sapiens
aaattgcttgaaa

SEQ ID NO: 6199475 - DNA, 16 bp, Homo sapiens
aaattgcttgaaagaa

SEQ ID NO: 6199476 - DNA, 21 bp, Homo sapiens
aaattgcttgagcctggctgt

SEQ ID NO: 6199477 - DNA, 18 bp, Homo sapiens
aaattgcttttgttgtga

SEQ ID NO: 6199478 - DNA, 23 bp, Homo sapiens
aaattgcttttgttgtgactttt

SEQ ID NO: 6199479 - DNA, 19 bp, Homo sapiens
aaattggaaacattttctt

SEQ ID NO: 6199480 - DNA, 23 bp, Homo sapiens
aaattggacagttttgatacaaa

SEQ ID NO: 6199481 - DNA, 10 bp, Homo sapiens
aaattggaga

SEQ ID NO: 6199482 - DNA, 16 bp, Homo sapiens
aaattggagaaaagca

SEQ ID NO: 6199483 - DNA, 21 bp, Homo sapiens
aaattggagaaaagcacttaa

SEQ ID NO: 6199484 - DNA, 14 bp, Homo sapiens
aaattggagctcat

SEQ ID NO: 6199485 - DNA, 23 bp, Homo sapiens
aaattggagttggagtagaatgt

SEQ ID NO: 6199486 - DNA, 21 bp, Homo sapiens
aaattggattattactacaaa

SEQ ID NO: 6199487 - DNA, 17 bp, Homo sapiens
aaattggattattttct

SEQ ID NO: 6199488 - DNA, 23 bp, Homo sapiens
aaattggcatggaaatttaaagc

SEQ ID NO: 6199489 - DNA, 14 bp, Homo sapiens
aaattggcattaaa

SEQ ID NO: 6199490 - DNA, 17 bp, Homo sapiens
aaattggcattaaaact

SEQ ID NO: 6199491 - DNA, 23 bp, Homo sapiens
aaattggcattttaagtgtttaa

SEQ ID NO: 6199492 - DNA, 16 bp, Homo sapiens
aaattggctagttgaa

SEQ ID NO: 6199493 - DNA, 19 bp, Homo sapiens
aaattggctagttgaatct

SEQ ID NO: 6199494 - DNA, 16 bp, Homo sapiens
aaattggctcctttcc

SEQ ID NO: 6199495 - DNA, 17 bp, Homo sapiens
aaattggctcctttccc

SEQ ID NO: 6199496 - DNA, 20 bp, Homo sapiens
aaattgggaaaggagtagaa

SEQ ID NO: 6199497 - DNA, 12 bp, Homo sapiens
aaattgggacta

SEQ ID NO: 6199498 - DNA, 18 bp, Homo sapiens
aaattgggatctgtcttg

SEQ ID NO: 6199499 - DNA, 23 bp, Homo sapiens
aaattgggcttgtgatttccatt

SEQ ID NO: 6199500 - DNA, 16 bp, Homo sapiens
aaattggggattctta

SEQ ID NO: 6199501 - DNA, 15 bp, Homo sapiens
aaattggggtttatt

SEQ ID NO: 6199502 - DNA, 16 bp, Homo sapiens
aaattgggttcatgat

SEQ ID NO: 6199503 - DNA, 20 bp, Homo sapiens
aaattggtaattgaatggaa

SEQ ID NO: 6199504 - DNA, 18 bp, Homo sapiens
aaattggtaccttgcaca

SEQ ID NO: 6199505 - DNA, 15 bp, Homo sapiens
aaattggtctgaaag

SEQ ID NO: 6199506 - DNA, 18 bp, Homo sapiens
aaattggttaatgaaaaa

SEQ ID NO: 6199507 - DNA, 19 bp, Homo sapiens
aaattggttaatgaaaaat

SEQ ID NO: 6199508 - DNA, 20 bp, Homo sapiens
aaattggttaatgaaaaatc

SEQ ID NO: 6199509 - DNA, 21 bp, Homo sapiens
aaattggttttccagaggcct

SEQ ID NO: 6199510 - DNA, 15 bp, Homo sapiens
aaattgtaagccaga

SEQ ID NO: 6199511 - DNA, 17 bp, Homo sapiens
aaattgtaagccagagt

SEQ ID NO: 6199512 - DNA, 19 bp, Homo sapiens
aaattgtaagccagagtca

SEQ ID NO: 6199513 - DNA, 14 bp, Homo sapiens
aaattgtaattata

SEQ ID NO: 6199514 - DNA, 15 bp, Homo sapiens
aaattgtaattatat

SEQ ID NO: 6199515 - DNA, 14 bp, Homo sapiens
aaattgtaatttgg

SEQ ID NO: 6199516 - DNA, 18 bp, Homo sapiens
aaattgtagaacatagat

SEQ ID NO: 6199517 - DNA, 19 bp, Homo sapiens
aaattgtatacattttgtt

SEQ ID NO: 6199518 - DNA, 20 bp, Homo sapiens
aaattgtataccaatgtgtt

SEQ ID NO: 6199519 - DNA, 16 bp, Homo sapiens
aaattgtatattcact

SEQ ID NO: 6199520 - DNA, 15 bp, Homo sapiens
aaattgtatattgta

SEQ ID NO: 6199521 - DNA, 19 bp, Homo sapiens
aaattgtatattgtaattt

SEQ ID NO: 6199522 - DNA, 13 bp, Homo sapiens
aaattgtatgaaa

SEQ ID NO: 6199523 - DNA, 14 bp, Homo sapiens
aaattgtatgaaaa

SEQ ID NO: 6199524 - DNA, 22 bp, Homo sapiens
aaattgtatttttgtatgtggc

SEQ ID NO: 6199525 - DNA, 18 bp, Homo sapiens
aaattgtcacctctgtta

SEQ ID NO: 6199526 - DNA, 19 bp, Homo sapiens
aaattgtcacctgcttctc

SEQ ID NO: 6199527 - DNA, 18 bp, Homo sapiens
aaattgtccttgaagctt

SEQ ID NO: 6199528 - DNA, 21 bp, Homo sapiens
aaattgtccttgaagcttgta

SEQ ID NO: 6199529 - DNA, 18 bp, Homo sapiens
aaattgtcgggggagaga

SEQ ID NO: 6199530 - DNA, 23 bp, Homo sapiens
aaattgtctgtctgctcttattt

SEQ ID NO: 6199531 - DNA, 16 bp, Homo sapiens
aaattgtcttaatgga

SEQ ID NO: 6199532 - DNA, 12 bp, Homo sapiens
aaattgtcttta

SEQ ID NO: 6199533 - DNA, 14 bp, Homo sapiens
aaattgtctttaaa

SEQ ID NO: 6199534 - DNA, 20 bp, Homo sapiens
aaattgtctttaaaaactgt

SEQ ID NO: 6199535 - DNA, 18 bp, Homo sapiens
aaattgtcttttgtcatg

SEQ ID NO: 6199536 - DNA, 14 bp, Homo sapiens
aaattgtgaaaaaa

SEQ ID NO: 6199537 - DNA, 13 bp, Homo sapiens
aaattgtgaaata

SEQ ID NO: 6199538 - DNA, 17 bp, Homo sapiens
aaattgtgatgttttgt

SEQ ID NO: 6199539 - DNA, 18 bp, Homo sapiens
aaattgtgattgttttat

SEQ ID NO: 6199540 - DNA, 14 bp, Homo sapiens
aaattgtgcataat

SEQ ID NO: 6199541 - DNA, 18 bp, Homo sapiens
aaattgtgcataatgctt

SEQ ID NO: 6199542 - DNA, 11 bp, Homo sapiens
aaattgtgtag

SEQ ID NO: 6199543 - DNA, 17 bp, Homo sapiens
aaattgtgtccacataa

SEQ ID NO: 6199544 - DNA, 18 bp, Homo sapiens
aaattgtgtccacataat

SEQ ID NO: 6199545 - DNA, 21 bp, Homo sapiens
aaattgtgtgtgctctgcttc

SEQ ID NO: 6199546 - DNA, 21 bp, Homo sapiens
aaattgtgttcttaaaatatt

SEQ ID NO: 6199547 - DNA, 19 bp, Homo sapiens
aaattgtgtttagatttta

SEQ ID NO: 6199548 - DNA, 19 bp, Homo sapiens
aaattgttacccatttgaa

SEQ ID NO: 6199549 - DNA, 15 bp, Homo sapiens
aaattgttcctcttt

SEQ ID NO: 6199550 - DNA, 15 bp, Homo sapiens
aaattgtttccaaag

SEQ ID NO: 6199551 - DNA, 12 bp, Homo sapiens
aaattgtttctt

SEQ ID NO: 6199552 - DNA, 23 bp, Homo sapiens
aaattgtttgacggcaaggttta

SEQ ID NO: 6199553 - DNA, 19 bp, Homo sapiens
aaattgtttggcttcctcc

SEQ ID NO: 6199554 - DNA, 15 bp, Homo sapiens
aaattgtttgtacag

SEQ ID NO: 6199555 - DNA, 14 bp, Homo sapiens
aaatttaaaaagat

SEQ ID NO: 6199556 - DNA, 12 bp, Homo sapiens
aaatttaaaaat

SEQ ID NO: 6199557 - DNA, 14 bp, Homo sapiens
aaatttaaaaatct

SEQ ID NO: 6199558 - DNA, 14 bp, Homo sapiens
aaatttaaaacaaa

SEQ ID NO: 6199559 - DNA, 18 bp, Homo sapiens
aaatttaaaagtaaaatg

SEQ ID NO: 6199560 - DNA, 13 bp, Homo sapiens
aaatttaaaatgt

SEQ ID NO: 6199561 - DNA, 21 bp, Homo sapiens
aaatttaaaatgtgtgccata

SEQ ID NO: 6199562 - DNA, 12 bp, Homo sapiens
aaatttaaaatt

SEQ ID NO: 6199563 - DNA, 13 bp, Homo sapiens
aaatttaaagata

SEQ ID NO: 6199564 - DNA, 23 bp, Homo sapiens
aaatttaaagggtgtacttatat

SEQ ID NO: 6199565 - DNA, 16 bp, Homo sapiens
aaatttaactgcatat

SEQ ID NO: 6199566 - DNA, 13 bp, Homo sapiens
aaatttaagaaaa

SEQ ID NO: 6199567 - DNA, 21 bp, Homo sapiens
aaatttaagagattttatgtt

SEQ ID NO: 6199568 - DNA, 16 bp, Homo sapiens
cttctgttctctgctg

SEQ ID NO: 6199569 - DNA, 17 bp, Homo sapiens
cttctgttctctgctga

SEQ ID NO: 6199570 - DNA, 19 bp, Homo sapiens
cttctgttctctgctgagg

SEQ ID NO: 6199571 - DNA, 17 bp, Homo sapiens
cttctgttctctggttt

SEQ ID NO: 6199572 - DNA, 18 bp, Homo sapiens
cttctgttgctgcctcat

SEQ ID NO: 6199573 - DNA, 20 bp, Homo sapiens
cttctgttgctgcctcatgc

SEQ ID NO: 6199574 - DNA, 21 bp, Homo sapiens
cttctgttgctgcctcatgct

SEQ ID NO: 6199575 - DNA, 17 bp, Homo sapiens
cttctgttggcagagct

SEQ ID NO: 6199576 - DNA, 21 bp, Homo sapiens
cttctgttgtcaccttcacct

SEQ ID NO: 6199577 - DNA, 14 bp, Homo sapiens
cttctgtttctagt

SEQ ID NO: 6199578 - DNA, 16 bp, Homo sapiens
cttctgttttcttctt

SEQ ID NO: 6199579 - DNA, 15 bp, Homo sapiens
cttctgtttttctca

SEQ ID NO: 6199580 - DNA, 16 bp, Homo sapiens
cttctgtttttctcaa

SEQ ID NO: 6199581 - DNA, 14 bp, Homo sapiens
cttcttaaaaactg

SEQ ID NO: 6199582 - DNA, 17 bp, Homo sapiens
cttcttaaaaactgtgt

SEQ ID NO: 6199583 - DNA, 20 bp, Homo sapiens
cttcttaaaaactgtgtatc

SEQ ID NO: 6199584 - DNA, 18 bp, Homo sapiens
cttcttaaaagaaatctt

SEQ ID NO: 6199585 - DNA, 16 bp, Homo sapiens
cttcttaaaaggagct

SEQ ID NO: 6199586 - DNA, 15 bp, Homo sapiens
cttcttaaaagtttc

SEQ ID NO: 6199587 - DNA, 15 bp, Homo sapiens
cttcttaaaattcaa

SEQ ID NO: 6199588 - DNA, 13 bp, Homo sapiens
cttcttaaagagt

SEQ ID NO: 6199589 - DNA, 18 bp, Homo sapiens
cttcttaaatatctttta

SEQ ID NO: 6199590 - DNA, 22 bp, Homo sapiens
cttcttaaatatcttttatgtt

SEQ ID NO: 6199591 - DNA, 21 bp, Homo sapiens
cttcttaaatgagaaggaatt

SEQ ID NO: 6199592 - DNA, 21 bp, Homo sapiens
cttcttaaccctgaacaagag

SEQ ID NO: 6199593 - DNA, 14 bp, Homo sapiens
cttcttaacgaaat

SEQ ID NO: 6199594 - DNA, 21 bp, Homo sapiens
cttcttaagatacaaatggtg

SEQ ID NO: 6199595 - DNA, 23 bp, Homo sapiens
cttcttaagatacaaatggtgga

SEQ ID NO: 6199596 - DNA, 18 bp, Homo sapiens
cttcttaatataactgcc

SEQ ID NO: 6199597 - DNA, 20 bp, Homo sapiens
cttcttaatcttttcacaaa

SEQ ID NO: 6199598 - DNA, 22 bp, Homo sapiens
cttcttaatcttttcacaaata

SEQ ID NO: 6199599 - DNA, 23 bp, Homo sapiens
cttcttaatcttttcacaaataa

SEQ ID NO: 6199600 - DNA, 15 bp, Homo sapiens
cttcttacacttctt

SEQ ID NO: 6199601 - DNA, 16 bp, Homo sapiens
cttcttacacttctta

SEQ ID NO: 6199602 - DNA, 17 bp, Homo sapiens
cttcttacagaagtatt

SEQ ID NO: 6199603 - DNA, 13 bp, Homo sapiens
cttcttacatgca

SEQ ID NO: 6199604 - DNA, 14 bp, Homo sapiens
cttcttacatgcat

SEQ ID NO: 6199605 - DNA, 20 bp, Homo sapiens
cttcttacattattaatcat

SEQ ID NO: 6199606 - DNA, 15 bp, Homo sapiens
cttcttacccaaagc

SEQ ID NO: 6199607 - DNA, 21 bp, Homo sapiens
cttcttacgaacgccacggcc

SEQ ID NO: 6199608 - DNA, 16 bp, Homo sapiens
cttcttacgcaatgct

SEQ ID NO: 6199609 - DNA, 21 bp, Homo sapiens
cttcttacttggaactgaagg

SEQ ID NO: 6199610 - DNA, 24 bp, Homo sapiens
cttcttagaaaattaaaataggca

SEQ ID NO: 6199611 - DNA, 14 bp, Homo sapiens
cttcttagagtttt

SEQ ID NO: 6199612 - DNA, 22 bp, Homo sapiens
cttcttagggattaaatataga

SEQ ID NO: 6199613 - DNA, 14 bp, Homo sapiens
cttcttagtaaaaa

SEQ ID NO: 6199614 - DNA, 19 bp, Homo sapiens
cttcttataacttgtaagt

SEQ ID NO: 6199615 - DNA, 20 bp, Homo sapiens
cttcttataacttgtaagtc

SEQ ID NO: 6199616 - DNA, 13 bp, Homo sapiens
cttcttatacatt

SEQ ID NO: 6199617 - DNA, 13 bp, Homo sapiens
cttcttatcctta

SEQ ID NO: 6199618 - DNA, 13 bp, Homo sapiens
cttcttatctaaa

SEQ ID NO: 6199619 - DNA, 13 bp, Homo sapiens
cttcttatggtat

SEQ ID NO: 6199620 - DNA, 15 bp, Homo sapiens
cttcttattacccaa

SEQ ID NO: 6199621 - DNA, 16 bp, Homo sapiens
cttcttattacccaaa

SEQ ID NO: 6199622 - DNA, 18 bp, Homo sapiens
cttcttattacccaaacc

SEQ ID NO: 6199623 - DNA, 20 bp, Homo sapiens
cttcttattacccaaaccca

SEQ ID NO: 6199624 - DNA, 16 bp, Homo sapiens
cttcttattatatata

SEQ ID NO: 6199625 - DNA, 19 bp, Homo sapiens
cttcttattatatatataa

SEQ ID NO: 6199626 - DNA, 20 bp, Homo sapiens
cttcttattctcactccacc

SEQ ID NO: 6199627 - DNA, 14 bp, Homo sapiens
cttcttcaaataca

SEQ ID NO: 6199628 - DNA, 14 bp, Homo sapiens
cttcttcacatcca

SEQ ID NO: 6199629 - DNA, 15 bp, Homo sapiens
cttcttcacccagct

SEQ ID NO: 6199630 - DNA, 14 bp, Homo sapiens
cttcttcacctctt

SEQ ID NO: 6199631 - DNA, 18 bp, Homo sapiens
cttcttcacctcttccac

SEQ ID NO: 6199632 - DNA, 16 bp, Homo sapiens
cttcttcagagctgac

SEQ ID NO: 6199633 - DNA, 22 bp, Homo sapiens
cttcttcagagtgaagaatctt

SEQ ID NO: 6199634 - DNA, 18 bp, Homo sapiens
cttcttcagatcagtgct

SEQ ID NO: 6199635 - DNA, 14 bp, Homo sapiens
cttcttcagctgac

SEQ ID NO: 6199636 - DNA, 14 bp, Homo sapiens
cttcttcagggact

SEQ ID NO: 6199637 - DNA, 14 bp, Homo sapiens
cttcttcagggcct

SEQ ID NO: 6199638 - DNA, 18 bp, Homo sapiens
cttcttcatctttaaaat

SEQ ID NO: 6199639 - DNA, 13 bp, Homo sapiens
cttcttcattcca

SEQ ID NO: 6199640 - DNA, 23 bp, Homo sapiens
cttcttccaaggagcagagaggt

SEQ ID NO: 6199641 - DNA, 22 bp, Homo sapiens
cttcttccaatgatgcttacta

SEQ ID NO: 6199642 - DNA, 17 bp, Homo sapiens
cttcttccactgtctca

SEQ ID NO: 6199643 - DNA, 21 bp, Homo sapiens
cttcttccaggatcaggggtt

SEQ ID NO: 6199644 - DNA, 14 bp, Homo sapiens
cttcttccatccca

SEQ ID NO: 6199645 - DNA, 19 bp, Homo sapiens
cttcttccattcccagaca

SEQ ID NO: 6199646 - DNA, 12 bp, Homo sapiens
cttcttcccagt

SEQ ID NO: 6199647 - DNA, 19 bp, Homo sapiens
cttcttccccaaggcactg

SEQ ID NO: 6199648 - DNA, 23 bp, Homo sapiens
cttcttccccaaggcactgagcg

SEQ ID NO: 6199649 - DNA, 15 bp, Homo sapiens
cttcttcccccaggg

SEQ ID NO: 6199650 - DNA, 19 bp, Homo sapiens
cttcttcccctctgcggct

SEQ ID NO: 6199651 - DNA, 21 bp, Homo sapiens
cttcttccccttccctgactg

SEQ ID NO: 6199652 - DNA, 20 bp, Homo sapiens
cttcttcccctttgtcctgc

SEQ ID NO: 6199653 - DNA, 22 bp, Homo sapiens
cttcttcccctttgtcctgcgt

SEQ ID NO: 6199654 - DNA, 22 bp, Homo sapiens
cttcttcccgccccacctccca

SEQ ID NO: 6199655 - DNA, 21 bp, Homo sapiens
cttcttccctaatcagctccc

SEQ ID NO: 6199656 - DNA, 14 bp, Homo sapiens
cttcttccctccct

SEQ ID NO: 6199657 - DNA, 12 bp, Homo sapiens
cttcttccctgt

SEQ ID NO: 6199658 - DNA, 21 bp, Homo sapiens
cttcttccctgttttaaatta

SEQ ID NO: 6199659 - DNA, 21 bp, Homo sapiens
cttcttcccttaactccaaga

SEQ ID NO: 6199660 - DNA, 22 bp, Homo sapiens
cttcttcccttaactccaagaa

SEQ ID NO: 6199661 - DNA, 24 bp, Homo sapiens
cttcttcctacatcttcttcccag

SEQ ID NO: 6199662 - DNA, 17 bp, Homo sapiens
cttcttcctaggtccaa

SEQ ID NO: 6199663 - DNA, 12 bp, Homo sapiens
cttcttcctccc

SEQ ID NO: 6199664 - DNA, 16 bp, Homo sapiens
cttcttcctcctccat

SEQ ID NO: 6199665 - DNA, 15 bp, Homo sapiens
cttcttcctgaagct

SEQ ID NO: 6199666 - DNA, 14 bp, Homo sapiens
cttcttcctgctgg

SEQ ID NO: 6199667 - DNA, 15 bp, Homo sapiens
cttcttcctgctgga

SEQ ID NO: 6199668 - DNA, 12 bp, Homo sapiens
cttcttcctgga

SEQ ID NO: 6199669 - DNA, 19 bp, Homo sapiens
cttcttcggaggtggcagc

SEQ ID NO: 6199670 - DNA, 20 bp, Homo sapiens
cttcttcggggaactcctgg

SEQ ID NO: 6199671 - DNA, 21 bp, Homo sapiens
cttcttcggggaactcctgga

SEQ ID NO: 6199672 - DNA, 15 bp, Homo sapiens
cttcttctaagaaga

SEQ ID NO: 6199673 - DNA, 19 bp, Homo sapiens
cttcttctaagaagacatt

SEQ ID NO: 6199674 - DNA, 20 bp, Homo sapiens
cttcttctaagaagacattt

SEQ ID NO: 6199675 - DNA, 22 bp, Homo sapiens
cttcttctaagaagacattttg

SEQ ID NO: 6199676 - DNA, 14 bp, Homo sapiens
cttcttctatatcc

SEQ ID NO: 6199677 - DNA, 18 bp, Homo sapiens
cttcttctatatccaaaa

SEQ ID NO: 6199678 - DNA, 15 bp, Homo sapiens
cttcttctcaaagca

SEQ ID NO: 6199679 - DNA, 12 bp, Homo sapiens
cttcttctccta

SEQ ID NO: 6199680 - DNA, 19 bp, Homo sapiens
cttcttctcctatgtgtaa

SEQ ID NO: 6199681 - DNA, 16 bp, Homo sapiens
cttcttctcggggaca

SEQ ID NO: 6199682 - DNA, 17 bp, Homo sapiens
cttcttctctccacatg

SEQ ID NO: 6199683 - DNA, 22 bp, Homo sapiens
cttcttctgaagatcagaacat

SEQ ID NO: 6199684 - DNA, 11 bp, Homo sapiens
cttcttctgcc

SEQ ID NO: 6199685 - DNA, 19 bp, Homo sapiens
cttcttctgccacttctgc

SEQ ID NO: 6199686 - DNA, 12 bp, Homo sapiens
cttcttctgccc

SEQ ID NO: 6199687 - DNA, 17 bp, Homo sapiens
cttcttctgtaatattt

SEQ ID NO: 6199688 - DNA, 19 bp, Homo sapiens
cttcttctgtcatctacct

SEQ ID NO: 6199689 - DNA, 13 bp, Homo sapiens
cttcttctgtcca

SEQ ID NO: 6199690 - DNA, 15 bp, Homo sapiens
cttcttcttccaaat

SEQ ID NO: 6199691 - DNA, 15 bp, Homo sapiens
cttcttcttgtggag

SEQ ID NO: 6199692 - DNA, 12 bp, Homo sapiens
cttcttctttcc

SEQ ID NO: 6199693 - DNA, 17 bp, Homo sapiens
cttcttctttttgctgt

SEQ ID NO: 6199694 - DNA, 17 bp, Homo sapiens
cttcttgaaacagcctg

SEQ ID NO: 6199695 - DNA, 22 bp, Homo sapiens
cttcttgaaaggagacactcag

SEQ ID NO: 6199696 - DNA, 22 bp, Homo sapiens
cttcttgaacactcatgctgaa

SEQ ID NO: 6199697 - DNA, 16 bp, Homo sapiens
cttcttgaatataaaa

SEQ ID NO: 6199698 - DNA, 19 bp, Homo sapiens
cttcttgaatataaaaaat

SEQ ID NO: 6199699 - DNA, 21 bp, Homo sapiens
cttcttgatgtatttctccat

SEQ ID NO: 6199700 - DNA, 13 bp, Homo sapiens
cttcttgcatcct

SEQ ID NO: 6199701 - DNA, 13 bp, Homo sapiens
cttcttgcatcta

SEQ ID NO: 6199702 - DNA, 20 bp, Homo sapiens
cttcttgccatcactggtcc

SEQ ID NO: 6199703 - DNA, 13 bp, Homo sapiens
cttcttgcccctt

SEQ ID NO: 6199704 - DNA, 20 bp, Homo sapiens
cttcttgccccttgggcctc

SEQ ID NO: 6199705 - DNA, 15 bp, Homo sapiens
cttcttgccctgagc

SEQ ID NO: 6199706 - DNA, 14 bp, Homo sapiens
cttcttgccctggg

SEQ ID NO: 6199707 - DNA, 13 bp, Homo sapiens
cttcttgcctctg

SEQ ID NO: 6199708 - DNA, 17 bp, Homo sapiens
cttcttgcctctgtgct

SEQ ID NO: 6199709 - DNA, 21 bp, Homo sapiens
cttcttgcggcaccgcccacc

SEQ ID NO: 6199710 - DNA, 23 bp, Homo sapiens
cttcttgctacaccccttttcca

SEQ ID NO: 6199711 - DNA, 18 bp, Homo sapiens
cttcttgctatatgattt

SEQ ID NO: 6199712 - DNA, 12 bp, Homo sapiens
cttcttgctgcc

SEQ ID NO: 6199713 - DNA, 13 bp, Homo sapiens
cttcttgctgccc

SEQ ID NO: 6199714 - DNA, 20 bp, Homo sapiens
cttcttgctgccctgcccca

SEQ ID NO: 6199715 - DNA, 20 bp, Homo sapiens
cttcttgcttctttctagaa

SEQ ID NO: 6199716 - DNA, 21 bp, Homo sapiens
cttcttgcttctttctagaaa

SEQ ID NO: 6199717 - DNA, 16 bp, Homo sapiens
cttcttggaccttggc

SEQ ID NO: 6199718 - DNA, 17 bp, Homo sapiens
cttcttggaccttggcg

SEQ ID NO: 6199719 - DNA, 18 bp, Homo sapiens
cttcttggagctttggaa

SEQ ID NO: 6199720 - DNA, 13 bp, Homo sapiens
cttcttggatttt

SEQ ID NO: 6199721 - DNA, 18 bp, Homo sapiens
cttcttggccatgggagg

SEQ ID NO: 6199722 - DNA, 13 bp, Homo sapiens
cttcttggcgctg

SEQ ID NO: 6199723 - DNA, 15 bp, Homo sapiens
cttcttggcgctgga

SEQ ID NO: 6199724 - DNA, 14 bp, Homo sapiens
cttcttggctggtt

SEQ ID NO: 6199725 - DNA, 16 bp, Homo sapiens
cttcttggcttctggg

SEQ ID NO: 6199726 - DNA, 14 bp, Homo sapiens
cttcttggctttgt

SEQ ID NO: 6199727 - DNA, 22 bp, Homo sapiens
cttcttgggagtatgttgtcat

SEQ ID NO: 6199728 - DNA, 23 bp, Homo sapiens
cttcttgggcccggtccacaggt

SEQ ID NO: 6199729 - DNA, 16 bp, Homo sapiens
cttcttgggctgagtg

SEQ ID NO: 6199730 - DNA, 18 bp, Homo sapiens
cttcttggggcccagtgc

SEQ ID NO: 6199731 - DNA, 22 bp, Homo sapiens
cttcttggggcccagtgcatgg

SEQ ID NO: 6199732 - DNA, 23 bp, Homo sapiens
cttcttggggcccagtgcatggt

SEQ ID NO: 6199733 - DNA, 13 bp, Homo sapiens
cttcttgggggca

SEQ ID NO: 6199734 - DNA, 16 bp, Homo sapiens
cttcttggtcttattt

SEQ ID NO: 6199735 - DNA, 13 bp, Homo sapiens
cttcttggttcct

SEQ ID NO: 6199736 - DNA, 15 bp, Homo sapiens
cttcttggttcctgg

SEQ ID NO: 6199737 - DNA, 16 bp, Homo sapiens
cttcttggttcctggg

SEQ ID NO: 6199738 - DNA, 17 bp, Homo sapiens
cttcttggtttcagcca

SEQ ID NO: 6199739 - DNA, 21 bp, Homo sapiens
cttcttggtttggggagaaat

SEQ ID NO: 6199740 - DNA, 20 bp, Homo sapiens
cttcttggttttctctctgg

SEQ ID NO: 6199741 - DNA, 21 bp, Homo sapiens
cttcttggttttctctctgga

SEQ ID NO: 6199742 - DNA, 13 bp, Homo sapiens
cttcttgtaatat

SEQ ID NO: 6199743 - DNA, 13 bp, Homo sapiens
cttcttgtcagac

SEQ ID NO: 6199744 - DNA, 18 bp, Homo sapiens
cttcttgtcagacataaa

SEQ ID NO: 6199745 - DNA, 20 bp, Homo sapiens
cttcttgtcagacataaagc

SEQ ID NO: 6199746 - DNA, 18 bp, Homo sapiens
cttcttgtgcccttaaaa

SEQ ID NO: 6199747 - DNA, 15 bp, Homo sapiens
aaatttaagcattgt

SEQ ID NO: 6199748 - DNA, 17 bp, Homo sapiens
aaatttaagcattgttt

SEQ ID NO: 6199749 - DNA, 15 bp, Homo sapiens
aaatttaagtatctt

SEQ ID NO: 6199750 - DNA, 12 bp, Homo sapiens
aaatttaatgta

SEQ ID NO: 6199751 - DNA, 19 bp, Homo sapiens
aaatttaattacaaacaat

SEQ ID NO: 6199752 - DNA, 20 bp, Homo sapiens
aaatttaattacaaacaata

SEQ ID NO: 6199753 - DNA, 14 bp, Homo sapiens
aaatttaattattt

SEQ ID NO: 6199754 - DNA, 20 bp, Homo sapiens
aaatttacagtgatagaaca

SEQ ID NO: 6199755 - DNA, 23 bp, Homo sapiens
aaatttacatttaatacagataa

SEQ ID NO: 6199756 - DNA, 18 bp, Homo sapiens
aaatttacgtatatttca

SEQ ID NO: 6199757 - DNA, 17 bp, Homo sapiens
aaatttactgtcttaaa

SEQ ID NO: 6199758 - DNA, 20 bp, Homo sapiens
aaatttactttaaactacat

SEQ ID NO: 6199759 - DNA, 14 bp, Homo sapiens
aaatttactttaca

SEQ ID NO: 6199760 - DNA, 13 bp, Homo sapiens
aaatttagaaact

SEQ ID NO: 6199761 - DNA, 17 bp, Homo sapiens
aaatttagaaactaatt

SEQ ID NO: 6199762 - DNA, 22 bp, Homo sapiens
aaatttagatttaatttacgtc

SEQ ID NO: 6199763 - DNA, 22 bp, Homo sapiens
aaatttagcattgtagtgcttt

SEQ ID NO: 6199764 - DNA, 16 bp, Homo sapiens
aaatttagccgggcgc

SEQ ID NO: 6199765 - DNA, 19 bp, Homo sapiens
aaatttaggtaaataaagc

SEQ ID NO: 6199766 - DNA, 12 bp, Homo sapiens
aaatttagtgtt

SEQ ID NO: 6199767 - DNA, 13 bp, Homo sapiens
aaatttagtttgt

SEQ ID NO: 6199768 - DNA, 16 bp, Homo sapiens
aaatttagtttgttaa

SEQ ID NO: 6199769 - DNA, 19 bp, Homo sapiens
aaatttagtttgttaaagc

SEQ ID NO: 6199770 - DNA, 15 bp, Homo sapiens
aaatttagtttttgt

SEQ ID NO: 6199771 - DNA, 15 bp, Homo sapiens
aaatttataacagtt

SEQ ID NO: 6199772 - DNA, 23 bp, Homo sapiens
aaatttataacagttataaagaa

SEQ ID NO: 6199773 - DNA, 13 bp, Homo sapiens
aaatttatacaaa

SEQ ID NO: 6199774 - DNA, 13 bp, Homo sapiens
aaatttatataac

SEQ ID NO: 6199775 - DNA, 23 bp, Homo sapiens
aaatttatatgtcagagctgtta

SEQ ID NO: 6199776 - DNA, 16 bp, Homo sapiens
aaatttatattcataa

SEQ ID NO: 6199777 - DNA, 18 bp, Homo sapiens
aaatttatattcataaag

SEQ ID NO: 6199778 - DNA, 12 bp, Homo sapiens
aaatttatcaaa

SEQ ID NO: 6199779 - DNA, 17 bp, Homo sapiens
aaatttatcaaagcata

SEQ ID NO: 6199780 - DNA, 23 bp, Homo sapiens
aaatttatcaaagcatagatgtt

SEQ ID NO: 6199781 - DNA, 21 bp, Homo sapiens
aaatttatcttgttcaatgaa

SEQ ID NO: 6199782 - DNA, 11 bp, Homo sapiens
aaatttatgca

SEQ ID NO: 6199783 - DNA, 13 bp, Homo sapiens
aaatttatgcatt

SEQ ID NO: 6199784 - DNA, 17 bp, Homo sapiens
aaatttatgcatttcat

SEQ ID NO: 6199785 - DNA, 22 bp, Homo sapiens
aaatttatggccgtatcaaatg

SEQ ID NO: 6199786 - DNA, 19 bp, Homo sapiens
aaatttattgaggaaaaat

SEQ ID NO: 6199787 - DNA, 20 bp, Homo sapiens
aaatttattgaggaaaaata

SEQ ID NO: 6199788 - DNA, 23 bp, Homo sapiens
aaatttattgaggaaaaatatgt

SEQ ID NO: 6199789 - DNA, 15 bp, Homo sapiens
aaatttatttccaat

SEQ ID NO: 6199790 - DNA, 19 bp, Homo sapiens
aaatttatttccaatgttt

SEQ ID NO: 6199791 - DNA, 15 bp, Homo sapiens
aaatttatttggatt

SEQ ID NO: 6199792 - DNA, 22 bp, Homo sapiens
aaatttattttaatgtaaagaa

SEQ ID NO: 6199793 - DNA, 19 bp, Homo sapiens
aaatttattttataagaaa

SEQ ID NO: 6199794 - DNA, 23 bp, Homo sapiens
aaatttattttataagaaaaact

SEQ ID NO: 6199795 - DNA, 12 bp, Homo sapiens
aaatttcaaaag

SEQ ID NO: 6199796 - DNA, 19 bp, Homo sapiens
aaatttcaaaagacatgtt

SEQ ID NO: 6199797 - DNA, 16 bp, Homo sapiens
aaatttcaaatgcaga

SEQ ID NO: 6199798 - DNA, 14 bp, Homo sapiens
aaatttcaacagtt

SEQ ID NO: 6199799 - DNA, 17 bp, Homo sapiens
aaatttcaacagttatt

SEQ ID NO: 6199800 - DNA, 15 bp, Homo sapiens
aaatttcacaatata

SEQ ID NO: 6199801 - DNA, 19 bp, Homo sapiens
aaatttcacagttctgtaa

SEQ ID NO: 6199802 - DNA, 21 bp, Homo sapiens
aaatttcacgattcatttttg

SEQ ID NO: 6199803 - DNA, 20 bp, Homo sapiens
aaatttcataattctgaaac

SEQ ID NO: 6199804 - DNA, 14 bp, Homo sapiens
aaatttcatgattg

SEQ ID NO: 6199805 - DNA, 15 bp, Homo sapiens
aaatttcattgcact

SEQ ID NO: 6199806 - DNA, 16 bp, Homo sapiens
aaatttcattgcactt

SEQ ID NO: 6199807 - DNA, 17 bp, Homo sapiens
aaatttcattgcacttt

SEQ ID NO: 6199808 - DNA, 22 bp, Homo sapiens
aaatttcattgtgttgatttct

SEQ ID NO: 6199809 - DNA, 16 bp, Homo sapiens
aaatttcatttcacat

SEQ ID NO: 6199810 - DNA, 16 bp, Homo sapiens
aaatttccagtacctt

SEQ ID NO: 6199811 - DNA, 23 bp, Homo sapiens
aaatttccagtacctttgtcaca

SEQ ID NO: 6199812 - DNA, 22 bp, Homo sapiens
aaatttccattcccaaaataac

SEQ ID NO: 6199813 - DNA, 17 bp, Homo sapiens
aaatttccccaacagtg

SEQ ID NO: 6199814 - DNA, 23 bp, Homo sapiens
aaatttcctctacttaatttgtt

SEQ ID NO: 6199815 - DNA, 17 bp, Homo sapiens
aaatttccttcaggttt

SEQ ID NO: 6199816 - DNA, 23 bp, Homo sapiens
aaatttcgttgtccaatttgtaa

SEQ ID NO: 6199817 - DNA, 22 bp, Homo sapiens
aaatttctagcctgcactttga

SEQ ID NO: 6199818 - DNA, 14 bp, Homo sapiens
aaatttctatcatt

SEQ ID NO: 6199819 - DNA, 12 bp, Homo sapiens
aaatttctctgt

SEQ ID NO: 6199820 - DNA, 20 bp, Homo sapiens
aaatttctgcttttgcatct

SEQ ID NO: 6199821 - DNA, 19 bp, Homo sapiens
aaatttctggcaaatattt

SEQ ID NO: 6199822 - DNA, 23 bp, Homo sapiens
aaatttctggcaaatattttgtc

SEQ ID NO: 6199823 - DNA, 18 bp, Homo sapiens
aaatttctgtctttctgc

SEQ ID NO: 6199824 - DNA, 11 bp, Homo sapiens
aaatttcttat

SEQ ID NO: 6199825 - DNA, 13 bp, Homo sapiens
aaatttcttccac

SEQ ID NO: 6199826 - DNA, 19 bp, Homo sapiens
aaatttcttggcaaatttt

SEQ ID NO: 6199827 - DNA, 23 bp, Homo sapiens
aaatttcttggcaaattttaaaa

SEQ ID NO: 6199828 - DNA, 18 bp, Homo sapiens
aaatttctttgtttaaca

SEQ ID NO: 6199829 - DNA, 12 bp, Homo sapiens
aaatttcttttg

SEQ ID NO: 6199830 - DNA, 14 bp, Homo sapiens
aaatttgaaacatt

SEQ ID NO: 6199831 - DNA, 20 bp, Homo sapiens
aaatttgaaacattgctttt

SEQ ID NO: 6199832 - DNA, 14 bp, Homo sapiens
aaatttgaagtatt

SEQ ID NO: 6199833 - DNA, 22 bp, Homo sapiens
aaatttgaagtattagacttct

SEQ ID NO: 6199834 - DNA, 14 bp, Homo sapiens
aaatttgaataatt

SEQ ID NO: 6199835 - DNA, 19 bp, Homo sapiens
aaatttgaatggattaaat

SEQ ID NO: 6199836 - DNA, 20 bp, Homo sapiens
aaatttgaatgggtccattt

SEQ ID NO: 6199837 - DNA, 22 bp, Homo sapiens
aaatttgaattttgtgttagag

SEQ ID NO: 6199838 - DNA, 22 bp, Homo sapiens
aaatttgacattgtcagaatgt

SEQ ID NO: 6199839 - DNA, 17 bp, Homo sapiens
aaatttgagaatacata

SEQ ID NO: 6199840 - DNA, 17 bp, Homo sapiens
aaatttgataaactgaa

SEQ ID NO: 6199841 - DNA, 20 bp, Homo sapiens
aaatttgataaactgaattt

SEQ ID NO: 6199842 - DNA, 16 bp, Homo sapiens
aaatttgataatgaca

SEQ ID NO: 6199843 - DNA, 15 bp, Homo sapiens
aaatttgatacttat

SEQ ID NO: 6199844 - DNA, 19 bp, Homo sapiens
aaatttgatcccaatagaa

SEQ ID NO: 6199845 - DNA, 22 bp, Homo sapiens
aaatttgatcccaatagaatac

SEQ ID NO: 6199846 - DNA, 18 bp, Homo sapiens
aaatttgatggactaatt

SEQ ID NO: 6199847 - DNA, 20 bp, Homo sapiens
aaatttgatggtgaatatta

SEQ ID NO: 6199848 - DNA, 14 bp, Homo sapiens
aaatttgattgatt

SEQ ID NO: 6199849 - DNA, 15 bp, Homo sapiens
aaatttgattgattt

SEQ ID NO: 6199850 - DNA, 17 bp, Homo sapiens
aaatttgattgatttga

SEQ ID NO: 6199851 - DNA, 15 bp, Homo sapiens
aaatttgatttccat

SEQ ID NO: 6199852 - DNA, 22 bp, Homo sapiens
aaatttgcatgaaagcacaagg

SEQ ID NO: 6199853 - DNA, 17 bp, Homo sapiens
aaatttgcattaaatta

SEQ ID NO: 6199854 - DNA, 12 bp, Homo sapiens
aaatttgccaag

SEQ ID NO: 6199855 - DNA, 17 bp, Homo sapiens
aaatttgccaatctttc

SEQ ID NO: 6199856 - DNA, 21 bp, Homo sapiens
aaatttgccaccactagagct

SEQ ID NO: 6199857 - DNA, 23 bp, Homo sapiens
aaatttgccaccactagagctga

SEQ ID NO: 6199858 - DNA, 15 bp, Homo sapiens
aaatttgcctctgtc

SEQ ID NO: 6199859 - DNA, 13 bp, Homo sapiens
aaatttgctagca

SEQ ID NO: 6199860 - DNA, 14 bp, Homo sapiens
aaatttgctagcag

SEQ ID NO: 6199861 - DNA, 17 bp, Homo sapiens
aaatttggaattctgtt

SEQ ID NO: 6199862 - DNA, 19 bp, Homo sapiens
aaatttggccttaagaact

SEQ ID NO: 6199863 - DNA, 22 bp, Homo sapiens
aaatttgtaaactttgcttctc

SEQ ID NO: 6199864 - DNA, 16 bp, Homo sapiens
aaatttgtaagtttca

SEQ ID NO: 6199865 - DNA, 15 bp, Homo sapiens
aaatttgtaatatat

SEQ ID NO: 6199866 - DNA, 20 bp, Homo sapiens
aaatttgtactatttaactg

SEQ ID NO: 6199867 - DNA, 16 bp, Homo sapiens
aaatttgtctgaaaca

SEQ ID NO: 6199868 - DNA, 18 bp, Homo sapiens
aaatttgtctgaaacatt

SEQ ID NO: 6199869 - DNA, 21 bp, Homo sapiens
aaatttgtctgaaacatttca

SEQ ID NO: 6199870 - DNA, 21 bp, Homo sapiens
aaatttgtctggttaaaaaat

SEQ ID NO: 6199871 - DNA, 16 bp, Homo sapiens
aaatttgtcttaaaaa

SEQ ID NO: 6199872 - DNA, 23 bp, Homo sapiens
aaatttgtcttgccttattaaag

SEQ ID NO: 6199873 - DNA, 18 bp, Homo sapiens
aaatttgtggttgcatgt

SEQ ID NO: 6199874 - DNA, 14 bp, Homo sapiens
aaatttgtggttgt

SEQ ID NO: 6199875 - DNA, 14 bp, Homo sapiens
aaatttgtgtaaat

SEQ ID NO: 6199876 - DNA, 19 bp, Homo sapiens
aaatttgtgtaaatttgta

SEQ ID NO: 6199877 - DNA, 13 bp, Homo sapiens
aaatttgtgtgct

SEQ ID NO: 6199878 - DNA, 19 bp, Homo sapiens
aaatttgttatacttcaaa

SEQ ID NO: 6199879 - DNA, 20 bp, Homo sapiens
aaatttgttatacttcaaaa

SEQ ID NO: 6199880 - DNA, 14 bp, Homo sapiens
aaatttgttgcata

SEQ ID NO: 6199881 - DNA, 21 bp, Homo sapiens
aaatttgttgtcatgtgtatg

SEQ ID NO: 6199882 - DNA, 12 bp, Homo sapiens
aaatttgtttaa

SEQ ID NO: 6199883 - DNA, 17 bp, Homo sapiens
aaatttgtttaattaaa

SEQ ID NO: 6199884 - DNA, 18 bp, Homo sapiens
aaatttgtttgtattttt

SEQ ID NO: 6199885 - DNA, 22 bp, Homo sapiens
aaatttgttttcaacaattggt

SEQ ID NO: 6199886 - DNA, 16 bp, Homo sapiens
aaattttaaaaagcag

SEQ ID NO: 6199887 - DNA, 12 bp, Homo sapiens
aaattttaaagc

SEQ ID NO: 6199888 - DNA, 14 bp, Homo sapiens
aaattttaaatgca

SEQ ID NO: 6199889 - DNA, 14 bp, Homo sapiens
aaattttaacattt

SEQ ID NO: 6199890 - DNA, 15 bp, Homo sapiens
aaattttaactaaat

SEQ ID NO: 6199891 - DNA, 21 bp, Homo sapiens
aaattttaagaagaaagattt

SEQ ID NO: 6199892 - DNA, 18 bp, Homo sapiens
aaattttaagtgccacag

SEQ ID NO: 6199893 - DNA, 14 bp, Homo sapiens
aaattttaagttaa

SEQ ID NO: 6199894 - DNA, 14 bp, Homo sapiens
aaattttaatgtaa

SEQ ID NO: 6199895 - DNA, 14 bp, Homo sapiens
aaattttaattcaa

SEQ ID NO: 6199896 - DNA, 23 bp, Homo sapiens
aaattttaattcaagaaatgaca

SEQ ID NO: 6199897 - DNA, 20 bp, Homo sapiens
aaattttactttctctcacc

SEQ ID NO: 6199898 - DNA, 14 bp, Homo sapiens
aaattttagaaata

SEQ ID NO: 6199899 - DNA, 15 bp, Homo sapiens
aaattttagaaatat

SEQ ID NO: 6199900 - DNA, 14 bp, Homo sapiens
aaattttagattta

SEQ ID NO: 6199901 - DNA, 21 bp, Homo sapiens
aaattttataaaattaagcaa

SEQ ID NO: 6199902 - DNA, 12 bp, Homo sapiens
aaattttatatg

SEQ ID NO: 6199903 - DNA, 13 bp, Homo sapiens
aaattttatatgt

SEQ ID NO: 6199904 - DNA, 15 bp, Homo sapiens
aaattttatctcagt

SEQ ID NO: 6199905 - DNA, 12 bp, Homo sapiens
aaattttatctg

SEQ ID NO: 6199906 - DNA, 20 bp, Homo sapiens
aaattttatgtcatagaaat

SEQ ID NO: 6199907 - DNA, 21 bp, Homo sapiens
aaattttatgtcatagaaata

SEQ ID NO: 6199908 - DNA, 12 bp, Homo sapiens
aaattttattga

SEQ ID NO: 6199909 - DNA, 13 bp, Homo sapiens
aaattttatttat

SEQ ID NO: 6199910 - DNA, 16 bp, Homo sapiens
aaattttattttgtgc

SEQ ID NO: 6199911 - DNA, 11 bp, Homo sapiens
aaattttcaaa

SEQ ID NO: 6199912 - DNA, 15 bp, Homo sapiens
aaattttcaaatcct

SEQ ID NO: 6199913 - DNA, 13 bp, Homo sapiens
aaattttcagcat

SEQ ID NO: 6199914 - DNA, 22 bp, Homo sapiens
aaattttcattctgaatctgaa

SEQ ID NO: 6199915 - DNA, 23 bp, Homo sapiens
aaattttcctgtcctctttcagc

SEQ ID NO: 6199916 - DNA, 12 bp, Homo sapiens
aaattttctaaa

SEQ ID NO: 6199917 - DNA, 13 bp, Homo sapiens
aaattttctacag

SEQ ID NO: 6199918 - DNA, 15 bp, Homo sapiens
aaattttctagaaat

SEQ ID NO: 6199919 - DNA, 15 bp, Homo sapiens
aaattttctagaata

SEQ ID NO: 6199920 - DNA, 18 bp, Homo sapiens
aaattttctagactttct

SEQ ID NO: 6199921 - DNA, 10 bp, Homo sapiens
aaattttctc

SEQ ID NO: 6199922 - DNA, 16 bp, Homo sapiens
aaattttctccagtcc

SEQ ID NO: 6199923 - DNA, 10 bp, Homo sapiens
aaattttctt

SEQ ID NO: 6199924 - DNA, 14 bp, Homo sapiens
aaattttcttcagt

SEQ ID NO: 6199925 - DNA, 17 bp, Homo sapiens
aaattttcttcagttgg

SEQ ID NO: 6199926 - DNA, 18 bp, Homo sapiens
aaattttcttcagttggt

SEQ ID NO: 6199927 - DNA, 19 bp, Homo sapiens
cttcttgtgcccttaaaac

SEQ ID NO: 6199928 - DNA, 13 bp, Homo sapiens
cttcttgtggaga

SEQ ID NO: 6199929 - DNA, 18 bp, Homo sapiens
cttcttgtgtcctgatga

SEQ ID NO: 6199930 - DNA, 18 bp, Homo sapiens
cttcttgtgtcctggctg

SEQ ID NO: 6199931 - DNA, 15 bp, Homo sapiens
cttcttgtgtttgaa

SEQ ID NO: 6199932 - DNA, 16 bp, Homo sapiens
cttcttgtgtttgaaa

SEQ ID NO: 6199933 - DNA, 19 bp, Homo sapiens
cttcttgtgtttgaaacac

SEQ ID NO: 6199934 - DNA, 19 bp, Homo sapiens
cttctttaaatcaaaagct

SEQ ID NO: 6199935 - DNA, 15 bp, Homo sapiens
cttctttaattttgg

SEQ ID NO: 6199936 - DNA, 16 bp, Homo sapiens
cttctttaattttgga

SEQ ID NO: 6199937 - DNA, 17 bp, Homo sapiens
cttctttaattttggaa

SEQ ID NO: 6199938 - DNA, 20 bp, Homo sapiens
cttctttaccttcatttcat

SEQ ID NO: 6199939 - DNA, 17 bp, Homo sapiens
cttctttactaacactg

SEQ ID NO: 6199940 - DNA, 19 bp, Homo sapiens
cttctttactaacactggc

SEQ ID NO: 6199941 - DNA, 19 bp, Homo sapiens
cttctttagaccctcgggc

SEQ ID NO: 6199942 - DNA, 17 bp, Homo sapiens
cttctttagatgccaaa

SEQ ID NO: 6199943 - DNA, 15 bp, Homo sapiens
cttctttagcatttt

SEQ ID NO: 6199944 - DNA, 17 bp, Homo sapiens
cttctttatactctctt

SEQ ID NO: 6199945 - DNA, 18 bp, Homo sapiens
cttctttatactctcttc

SEQ ID NO: 6199946 - DNA, 21 bp, Homo sapiens
cttctttatactctcttccct

SEQ ID NO: 6199947 - DNA, 16 bp, Homo sapiens
cttctttattattcct

SEQ ID NO: 6199948 - DNA, 23 bp, Homo sapiens
cttctttcattctaatccttgct

SEQ ID NO: 6199949 - DNA, 17 bp, Homo sapiens
cttctttcatttcttct

SEQ ID NO: 6199950 - DNA, 14 bp, Homo sapiens
cttctttcattttc

SEQ ID NO: 6199951 - DNA, 15 bp, Homo sapiens
cttctttccattctt

SEQ ID NO: 6199952 - DNA, 18 bp, Homo sapiens
cttctttccattcttctt

SEQ ID NO: 6199953 - DNA, 13 bp, Homo sapiens
cttctttcccaaa

SEQ ID NO: 6199954 - DNA, 15 bp, Homo sapiens
cttctttccctggac

SEQ ID NO: 6199955 - DNA, 13 bp, Homo sapiens
cttctttcccttc

SEQ ID NO: 6199956 - DNA, 18 bp, Homo sapiens
cttctttcccttcctcca

SEQ ID NO: 6199957 - DNA, 14 bp, Homo sapiens
cttctttccttcct

SEQ ID NO: 6199958 - DNA, 18 bp, Homo sapiens
cttctttcctttactcct

SEQ ID NO: 6199959 - DNA, 16 bp, Homo sapiens
cttctttctagagcag

SEQ ID NO: 6199960 - DNA, 15 bp, Homo sapiens
cttctttctccatgg

SEQ ID NO: 6199961 - DNA, 15 bp, Homo sapiens
cttctttctgctggc

SEQ ID NO: 6199962 - DNA, 16 bp, Homo sapiens
cttctttctgtcttta

SEQ ID NO: 6199963 - DNA, 17 bp, Homo sapiens
cttctttctgtctttaa

SEQ ID NO: 6199964 - DNA, 13 bp, Homo sapiens
cttctttcttcca

SEQ ID NO: 6199965 - DNA, 14 bp, Homo sapiens
cttctttgaagaag

SEQ ID NO: 6199966 - DNA, 13 bp, Homo sapiens
cttctttgaagtt

SEQ ID NO: 6199967 - DNA, 17 bp, Homo sapiens
cttctttgataatgtta

SEQ ID NO: 6199968 - DNA, 15 bp, Homo sapiens
cttctttgcagcttc

SEQ ID NO: 6199969 - DNA, 22 bp, Homo sapiens
cttctttgctgctgcttcctgt

SEQ ID NO: 6199970 - DNA, 15 bp, Homo sapiens
cttctttgcttgcct

SEQ ID NO: 6199971 - DNA, 19 bp, Homo sapiens
cttctttgctttgcccagc

SEQ ID NO: 6199972 - DNA, 21 bp, Homo sapiens
cttctttggaaataaaagata

SEQ ID NO: 6199973 - DNA, 23 bp, Homo sapiens
cttctttgtaatcccttcacagt

SEQ ID NO: 6199974 - DNA, 20 bp, Homo sapiens
cttctttgtagaactgccca

SEQ ID NO: 6199975 - DNA, 15 bp, Homo sapiens
cttctttgtgccttt

SEQ ID NO: 6199976 - DNA, 21 bp, Homo sapiens
cttctttgtgcctttggcctg

SEQ ID NO: 6199977 - DNA, 20 bp, Homo sapiens
cttctttgttattataacat

SEQ ID NO: 6199978 - DNA, 15 bp, Homo sapiens
cttcttttaaaaata

SEQ ID NO: 6199979 - DNA, 13 bp, Homo sapiens
cttcttttacttg

SEQ ID NO: 6199980 - DNA, 12 bp, Homo sapiens
cttcttttagca

SEQ ID NO: 6199981 - DNA, 18 bp, Homo sapiens
cttcttttagtcagaaat

SEQ ID NO: 6199982 - DNA, 23 bp, Homo sapiens
cttcttttagtcagaaatgattc

SEQ ID NO: 6199983 - DNA, 16 bp, Homo sapiens
cttcttttcaatgcaa

SEQ ID NO: 6199984 - DNA, 17 bp, Homo sapiens
cttcttttcaatgcaat

SEQ ID NO: 6199985 - DNA, 20 bp, Homo sapiens
cttcttttcaatgcaatgca

SEQ ID NO: 6199986 - DNA, 17 bp, Homo sapiens
cttcttttcacattctt

SEQ ID NO: 6199987 - DNA, 20 bp, Homo sapiens
cttcttttcacattcttata

SEQ ID NO: 6199988 - DNA, 13 bp, Homo sapiens
cttcttttcacct

SEQ ID NO: 6199989 - DNA, 14 bp, Homo sapiens
cttcttttcctaac

SEQ ID NO: 6199990 - DNA, 13 bp, Homo sapiens
cttcttttccttt

SEQ ID NO: 6199991 - DNA, 16 bp, Homo sapiens
cttcttttctcttcta

SEQ ID NO: 6199992 - DNA, 15 bp, Homo sapiens
cttcttttctttgta

SEQ ID NO: 6199993 - DNA, 11 bp, Homo sapiens
cttcttttgaa

SEQ ID NO: 6199994 - DNA, 14 bp, Homo sapiens
cttcttttgaacat

SEQ ID NO: 6199995 - DNA, 21 bp, Homo sapiens
cttcttttgaccccttcctgt

SEQ ID NO: 6199996 - DNA, 13 bp, Homo sapiens
cttcttttgatta

SEQ ID NO: 6199997 - DNA, 14 bp, Homo sapiens
cttcttttgattat

SEQ ID NO: 6199998 - DNA, 16 bp, Homo sapiens
cttcttttgattatgt

SEQ ID NO: 6199999 - DNA, 21 bp, Homo sapiens
cttcttttgggaggatttgat

SEQ ID NO: 6200000 - DNA, 22 bp, Homo sapiens
cttcttttgtggtgtcttccat

SEQ ID NO: 6200001 - DNA, 13 bp, Homo sapiens
cttctttttcatc

SEQ ID NO: 6200002 - DNA, 13 bp, Homo sapiens
cttctttttctgg

SEQ ID NO: 6200003 - DNA, 23 bp, Homo sapiens
cttctttttcttaccctctcttt

SEQ ID NO: 6200004 - DNA, 12 bp, Homo sapiens
cttctttttggt

SEQ ID NO: 6200005 - DNA, 22 bp, Homo sapiens
cttcttttttaagcgaatgatt

SEQ ID NO: 6200006 - DNA, 19 bp, Homo sapiens
cttcttttttcaaaagaaa

SEQ ID NO: 6200007 - DNA, 17 bp, Homo sapiens
cttctttttttgtgatg

SEQ ID NO: 6200008 - DNA, 18 bp, Homo sapiens
cttgaaaaaaaaaaacac

SEQ ID NO: 6200009 - DNA, 20 bp, Homo sapiens
cttgaaaaaaaacagtggat

SEQ ID NO: 6200010 - DNA, 16 bp, Homo sapiens
cttgaaaaaaaataga

SEQ ID NO: 6200011 - DNA, 18 bp, Homo sapiens
cttgaaaaaaaatagatg

SEQ ID NO: 6200012 - DNA, 12 bp, Homo sapiens
cttgaaaaacaa

SEQ ID NO: 6200013 - DNA, 17 bp, Homo sapiens
cttgaaaaatgacaatt

SEQ ID NO: 6200014 - DNA, 12 bp, Homo sapiens
cttgaaaaatgc

SEQ ID NO: 6200015 - DNA, 18 bp, Homo sapiens
cttgaaaaatgcatgttg

SEQ ID NO: 6200016 - DNA, 12 bp, Homo sapiens
cttgaaaaatgt

SEQ ID NO: 6200017 - DNA, 16 bp, Homo sapiens
cttgaaaacaaacaaa

SEQ ID NO: 6200018 - DNA, 22 bp, Homo sapiens
cttgaaaactgtgcaacttttt

SEQ ID NO: 6200019 - DNA, 16 bp, Homo sapiens
cttgaaaacttctcat

SEQ ID NO: 6200020 - DNA, 17 bp, Homo sapiens
cttgaaaacttctcatt

SEQ ID NO: 6200021 - DNA, 21 bp, Homo sapiens
cttgaaaacttctcatttatg

SEQ ID NO: 6200022 - DNA, 15 bp, Homo sapiens
cttgaaaagaaagaa

SEQ ID NO: 6200023 - DNA, 12 bp, Homo sapiens
cttgaaaagatt

SEQ ID NO: 6200024 - DNA, 15 bp, Homo sapiens
cttgaaaagattgca

SEQ ID NO: 6200025 - DNA, 19 bp, Homo sapiens
cttgaaaagattgcaaagg

SEQ ID NO: 6200026 - DNA, 17 bp, Homo sapiens
cttgaaaagttcaggga

SEQ ID NO: 6200027 - DNA, 20 bp, Homo sapiens
cttgaaaataagattccaga

SEQ ID NO: 6200028 - DNA, 23 bp, Homo sapiens
cttgaaaatattttttatatata

SEQ ID NO: 6200029 - DNA, 14 bp, Homo sapiens
cttgaaaatgccac

SEQ ID NO: 6200030 - DNA, 20 bp, Homo sapiens
cttgaaaattttattaaaaa

SEQ ID NO: 6200031 - DNA, 20 bp, Homo sapiens
cttgaaacagattcaggcca

SEQ ID NO: 6200032 - DNA, 21 bp, Homo sapiens
cttgaaacagattcaggccag

SEQ ID NO: 6200033 - DNA, 23 bp, Homo sapiens
cttgaaacagattcaggccagcc

SEQ ID NO: 6200034 - DNA, 16 bp, Homo sapiens
cttgaaaccagtattt

SEQ ID NO: 6200035 - DNA, 20 bp, Homo sapiens
cttgaaacttggttcccaga

SEQ ID NO: 6200036 - DNA, 18 bp, Homo sapiens
cttgaaactttgggaaaa

SEQ ID NO: 6200037 - DNA, 13 bp, Homo sapiens
cttgaaagaaaat

SEQ ID NO: 6200038 - DNA, 17 bp, Homo sapiens
cttgaaagaaaggggca

SEQ ID NO: 6200039 - DNA, 23 bp, Homo sapiens
cttgaaagaaaggggcaggagct

SEQ ID NO: 6200040 - DNA, 14 bp, Homo sapiens
cttgaaagaatttt

SEQ ID NO: 6200041 - DNA, 18 bp, Homo sapiens
cttgaaagcatccatgtg

SEQ ID NO: 6200042 - DNA, 22 bp, Homo sapiens
cttgaaagcgaaatacttgaaa

SEQ ID NO: 6200043 - DNA, 16 bp, Homo sapiens
cttgaaaggcaggaag

SEQ ID NO: 6200044 - DNA, 13 bp, Homo sapiens
cttgaaaggggaa

SEQ ID NO: 6200045 - DNA, 14 bp, Homo sapiens
cttgaaataagttg

SEQ ID NO: 6200046 - DNA, 17 bp, Homo sapiens
cttgaaataccagtgaa

SEQ ID NO: 6200047 - DNA, 19 bp, Homo sapiens
cttgaaatataggaactta

SEQ ID NO: 6200048 - DNA, 17 bp, Homo sapiens
cttgaaatatataatat

SEQ ID NO: 6200049 - DNA, 18 bp, Homo sapiens
cttgaaatattcagaaat

SEQ ID NO: 6200050 - DNA, 19 bp, Homo sapiens
cttgaaatattcagaaatt

SEQ ID NO: 6200051 - DNA, 17 bp, Homo sapiens
cttgaaatcctggaaaa

SEQ ID NO: 6200052 - DNA, 20 bp, Homo sapiens
cttgaaatctaatatttcta

SEQ ID NO: 6200053 - DNA, 15 bp, Homo sapiens
cttgaaatgaaaggg

SEQ ID NO: 6200054 - DNA, 16 bp, Homo sapiens
cttgaaatgaaaggga

SEQ ID NO: 6200055 - DNA, 20 bp, Homo sapiens
cttgaaatgagtaaaaacta

SEQ ID NO: 6200056 - DNA, 16 bp, Homo sapiens
cttgaaatgtagaatt

SEQ ID NO: 6200057 - DNA, 20 bp, Homo sapiens
cttgaaattactgtgtaaat

SEQ ID NO: 6200058 - DNA, 22 bp, Homo sapiens
cttgaaattactgtgtaaatat

SEQ ID NO: 6200059 - DNA, 21 bp, Homo sapiens
cttgaaattatatctgtggtc

SEQ ID NO: 6200060 - DNA, 13 bp, Homo sapiens
cttgaaatttaca

SEQ ID NO: 6200061 - DNA, 16 bp, Homo sapiens
cttgaaatttctcagc

SEQ ID NO: 6200062 - DNA, 10 bp, Homo sapiens
cttgaacaaa

SEQ ID NO: 6200063 - DNA, 14 bp, Homo sapiens
cttgaacaaaaggg

SEQ ID NO: 6200064 - DNA, 15 bp, Homo sapiens
cttgaacaaaagggt

SEQ ID NO: 6200065 - DNA, 17 bp, Homo sapiens
cttgaacaaaagggtca

SEQ ID NO: 6200066 - DNA, 17 bp, Homo sapiens
cttgaacaaaatctgtt

SEQ ID NO: 6200067 - DNA, 20 bp, Homo sapiens
cttgaacaaaatctgttgcc

SEQ ID NO: 6200068 - DNA, 16 bp, Homo sapiens
cttgaacaaagacatt

SEQ ID NO: 6200069 - DNA, 14 bp, Homo sapiens
cttgaacaaagtct

SEQ ID NO: 6200070 - DNA, 15 bp, Homo sapiens
cttgaacacagtatt

SEQ ID NO: 6200071 - DNA, 17 bp, Homo sapiens
cttgaacacagtatttt

SEQ ID NO: 6200072 - DNA, 13 bp, Homo sapiens
cttgaacactggg

SEQ ID NO: 6200073 - DNA, 16 bp, Homo sapiens
cttgaacactggggga

SEQ ID NO: 6200074 - DNA, 16 bp, Homo sapiens
cttgaacatacttggt

SEQ ID NO: 6200075 - DNA, 18 bp, Homo sapiens
cttgaacatgttttgtat

SEQ ID NO: 6200076 - DNA, 23 bp, Homo sapiens
cttgaacattaatccacatgttt

SEQ ID NO: 6200077 - DNA, 15 bp, Homo sapiens
cttgaacccaggagg

SEQ ID NO: 6200078 - DNA, 16 bp, Homo sapiens
cttgaacccaggaggt

SEQ ID NO: 6200079 - DNA, 23 bp, Homo sapiens
cttgaacccaggtctccctggat

SEQ ID NO: 6200080 - DNA, 16 bp, Homo sapiens
cttgaaccccaaatgc

SEQ ID NO: 6200081 - DNA, 18 bp, Homo sapiens
cttgaaccccctccctgt

SEQ ID NO: 6200082 - DNA, 18 bp, Homo sapiens
cttgaacccgggggacag

SEQ ID NO: 6200083 - DNA, 18 bp, Homo sapiens
cttgaaccctaataagac

SEQ ID NO: 6200084 - DNA, 23 bp, Homo sapiens
cttgaaccctaataagaccccac

SEQ ID NO: 6200085 - DNA, 15 bp, Homo sapiens
cttgaacctcattaa

SEQ ID NO: 6200086 - DNA, 14 bp, Homo sapiens
cttgaacctgcttc

SEQ ID NO: 6200087 - DNA, 17 bp, Homo sapiens
cttgaacctgcttcctg

SEQ ID NO: 6200088 - DNA, 16 bp, Homo sapiens
cttgaacctgggaagt

SEQ ID NO: 6200089 - DNA, 18 bp, Homo sapiens
cttgaacctgtgaggaag

SEQ ID NO: 6200090 - DNA, 16 bp, Homo sapiens
cttgaacctgtgagta

SEQ ID NO: 6200091 - DNA, 23 bp, Homo sapiens
cttgaacgagcagcccagggcct

SEQ ID NO: 6200092 - DNA, 17 bp, Homo sapiens
cttgaacgttttctaat

SEQ ID NO: 6200093 - DNA, 14 bp, Homo sapiens
cttgaactcctaga

SEQ ID NO: 6200094 - DNA, 18 bp, Homo sapiens
cttgaactcctgacctca

SEQ ID NO: 6200095 - DNA, 19 bp, Homo sapiens
cttgaactcctggcctcaa

SEQ ID NO: 6200096 - DNA, 17 bp, Homo sapiens
cttgaactgaggccctg

SEQ ID NO: 6200097 - DNA, 14 bp, Homo sapiens
cttgaactgctgcc

SEQ ID NO: 6200098 - DNA, 19 bp, Homo sapiens
cttgaactgtggccaccta

SEQ ID NO: 6200099 - DNA, 15 bp, Homo sapiens
cttgaactgttgccc

SEQ ID NO: 6200100 - DNA, 17 bp, Homo sapiens
cttgaactgttgccctt

SEQ ID NO: 6200101 - DNA, 24 bp, Homo sapiens
cttgaacttcacctgcaaagctct

SEQ ID NO: 6200102 - DNA, 14 bp, Homo sapiens
cttgaacttgcctc

SEQ ID NO: 6200103 - DNA, 14 bp, Homo sapiens
cttgaactttccaa

SEQ ID NO: 6200104 - DNA, 16 bp, Homo sapiens
cttgaactttccaaaa

SEQ ID NO: 6200105 - DNA, 23 bp, Homo sapiens
cttgaactttcctggatgtctga

SEQ ID NO: 6200106 - DNA, 21 bp, Homo sapiens
cttgaagaaaatgactttatt

SEQ ID NO: 6200107 - DNA, 23 bp, Homo sapiens
aaattttcttctttaatttttct

SEQ ID NO: 6200108 - DNA, 17 bp, Homo sapiens
aaattttcttgatttga

SEQ ID NO: 6200109 - DNA, 18 bp, Homo sapiens
aaattttgaaaagtaata

SEQ ID NO: 6200110 - DNA, 21 bp, Homo sapiens
aaattttgaaaagtaatattt

SEQ ID NO: 6200111 - DNA, 13 bp, Homo sapiens
aaattttgcactt

SEQ ID NO: 6200112 - DNA, 14 bp, Homo sapiens
aaattttgcagaag

SEQ ID NO: 6200113 - DNA, 17 bp, Homo sapiens
aaattttgcagaagcta

SEQ ID NO: 6200114 - DNA, 18 bp, Homo sapiens
aaattttgcatattctct

SEQ ID NO: 6200115 - DNA, 19 bp, Homo sapiens
aaattttgcatattctcta

SEQ ID NO: 6200116 - DNA, 23 bp, Homo sapiens
aaattttgcctaatacattaaag

SEQ ID NO: 6200117 - DNA, 14 bp, Homo sapiens
aaattttgctacca

SEQ ID NO: 6200118 - DNA, 22 bp, Homo sapiens
aaattttgcttttaattaaata

SEQ ID NO: 6200119 - DNA, 18 bp, Homo sapiens
aaattttggaagaattca

SEQ ID NO: 6200120 - DNA, 12 bp, Homo sapiens
aaattttgtaat

SEQ ID NO: 6200121 - DNA, 14 bp, Homo sapiens
aaattttgtaatga

SEQ ID NO: 6200122 - DNA, 17 bp, Homo sapiens
aaattttgtaattttct

SEQ ID NO: 6200123 - DNA, 17 bp, Homo sapiens
aaattttgtatgccaat

SEQ ID NO: 6200124 - DNA, 11 bp, Homo sapiens
aaattttgtcc

SEQ ID NO: 6200125 - DNA, 23 bp, Homo sapiens
aaattttgtcccttccatttcta

SEQ ID NO: 6200126 - DNA, 19 bp, Homo sapiens
aaattttgtcctttcatgt

SEQ ID NO: 6200127 - DNA, 14 bp, Homo sapiens
aaattttgtgcaaa

SEQ ID NO: 6200128 - DNA, 20 bp, Homo sapiens
aaattttgtgcaaaaaggac

SEQ ID NO: 6200129 - DNA, 17 bp, Homo sapiens
aaattttgtgttccttt

SEQ ID NO: 6200130 - DNA, 20 bp, Homo sapiens
aaattttgtttataagaaat

SEQ ID NO: 6200131 - DNA, 22 bp, Homo sapiens
aaattttgtttcagaattttgt

SEQ ID NO: 6200132 - DNA, 21 bp, Homo sapiens
aaattttgttttttaagtttt

SEQ ID NO: 6200133 - DNA, 17 bp, Homo sapiens
aaatttttaaaactgca

SEQ ID NO: 6200134 - DNA, 15 bp, Homo sapiens
aaatttttaaaatct

SEQ ID NO: 6200135 - DNA, 17 bp, Homo sapiens
aaatttttaaaatctgc

SEQ ID NO: 6200136 - DNA, 19 bp, Homo sapiens
aaatttttaaatcatttca

SEQ ID NO: 6200137 - DNA, 23 bp, Homo sapiens
aaatttttaagtaatttcatgca

SEQ ID NO: 6200138 - DNA, 17 bp, Homo sapiens
aaatttttaagtttttc

SEQ ID NO: 6200139 - DNA, 21 bp, Homo sapiens
aaatttttaagtttttcactt

SEQ ID NO: 6200140 - DNA, 23 bp, Homo sapiens
aaatttttaatctttaattttac

SEQ ID NO: 6200141 - DNA, 21 bp, Homo sapiens
aaatttttactcaggctttct

SEQ ID NO: 6200142 - DNA, 15 bp, Homo sapiens
aaatttttatgtaaa

SEQ ID NO: 6200143 - DNA, 21 bp, Homo sapiens
aaatttttcagatgcttctgg

SEQ ID NO: 6200144 - DNA, 15 bp, Homo sapiens
aaatttttcatattt

SEQ ID NO: 6200145 - DNA, 16 bp, Homo sapiens
aaatttttcatatttt

SEQ ID NO: 6200146 - DNA, 17 bp, Homo sapiens
aaatttttcatatttta

SEQ ID NO: 6200147 - DNA, 23 bp, Homo sapiens
aaatttttccacactatgtgtgt

SEQ ID NO: 6200148 - DNA, 20 bp, Homo sapiens
aaatttttctagaagatatc

SEQ ID NO: 6200149 - DNA, 10 bp, Homo sapiens
aaatttttga

SEQ ID NO: 6200150 - DNA, 13 bp, Homo sapiens
aaatttttgaaaa

SEQ ID NO: 6200151 - DNA, 14 bp, Homo sapiens
aaatttttgaaaaa

SEQ ID NO: 6200152 - DNA, 21 bp, Homo sapiens
aaatttttgaaaaatattgct

SEQ ID NO: 6200153 - DNA, 22 bp, Homo sapiens
aaatttttgaaaaatattgcta

SEQ ID NO: 6200154 - DNA, 17 bp, Homo sapiens
aaatttttgcatgttta

SEQ ID NO: 6200155 - DNA, 19 bp, Homo sapiens
aaatttttgcatgtttaat

SEQ ID NO: 6200156 - DNA, 17 bp, Homo sapiens
aaatttttggattgaca

SEQ ID NO: 6200157 - DNA, 12 bp, Homo sapiens
aaatttttgtaa

SEQ ID NO: 6200158 - DNA, 17 bp, Homo sapiens
aaatttttgtaagaaaa

SEQ ID NO: 6200159 - DNA, 23 bp, Homo sapiens
aaatttttgtcattttaaaatct

SEQ ID NO: 6200160 - DNA, 18 bp, Homo sapiens
aaatttttgtctttcatg

SEQ ID NO: 6200161 - DNA, 16 bp, Homo sapiens
aaatttttgtctttgt

SEQ ID NO: 6200162 - DNA, 16 bp, Homo sapiens
aaattttttaaaagag

SEQ ID NO: 6200163 - DNA, 18 bp, Homo sapiens
aaattttttaaaagagac

SEQ ID NO: 6200164 - DNA, 15 bp, Homo sapiens
aaattttttaagcaa

SEQ ID NO: 6200165 - DNA, 16 bp, Homo sapiens
aaattttttagatgac

SEQ ID NO: 6200166 - DNA, 20 bp, Homo sapiens
aaattttttctctaggaaat

SEQ ID NO: 6200167 - DNA, 12 bp, Homo sapiens
aaattttttgaa

SEQ ID NO: 6200168 - DNA, 23 bp, Homo sapiens
aaattttttgactttttttgtat

SEQ ID NO: 6200169 - DNA, 13 bp, Homo sapiens
aaattttttgtga

SEQ ID NO: 6200170 - DNA, 18 bp, Homo sapiens
aaattttttgttgacatt

SEQ ID NO: 6200171 - DNA, 15 bp, Homo sapiens
aaatttttttccaga

SEQ ID NO: 6200172 - DNA, 14 bp, Homo sapiens
aaatttttttgtat

SEQ ID NO: 6200173 - DNA, 15 bp, Homo sapiens
aaatttttttgttgt

SEQ ID NO: 6200174 - DNA, 22 bp, Homo sapiens
aaattttttttcaaaaatgctg

SEQ ID NO: 6200175 - DNA, 17 bp, Homo sapiens
aaattttttttcatgtt

SEQ ID NO: 6200176 - DNA, 22 bp, Homo sapiens
aaattttttttcatgttttaac

SEQ ID NO: 6200177 - DNA, 17 bp, Homo sapiens
aaattttttttgtttca

SEQ ID NO: 6200178 - DNA, 15 bp, Homo sapiens
aaatttttttttaac

SEQ ID NO: 6200179 - DNA, 17 bp, Homo sapiens
aaattttttttttaata

SEQ ID NO: 6200180 - DNA, 20 bp, Homo sapiens
aacaaaaaaaaaccatgcat

SEQ ID NO: 6200181 - DNA, 17 bp, Homo sapiens
aacaaaaaaaacaacaa

SEQ ID NO: 6200182 - DNA, 14 bp, Homo sapiens
aacaaaaaaactat

SEQ ID NO: 6200183 - DNA, 17 bp, Homo sapiens
aacaaaaaaagtttgtt

SEQ ID NO: 6200184 - DNA, 15 bp, Homo sapiens
aacaaaaaacaatat

SEQ ID NO: 6200185 - DNA, 13 bp, Homo sapiens
aacaaaaaaccca

SEQ ID NO: 6200186 - DNA, 14 bp, Homo sapiens
aacaaaaaacccac

SEQ ID NO: 6200187 - DNA, 15 bp, Homo sapiens
aacaaaaaagaaaag

SEQ ID NO: 6200188 - DNA, 14 bp, Homo sapiens
aacaaaaaagagaa

SEQ ID NO: 6200189 - DNA, 14 bp, Homo sapiens
aacaaaaaagctaa

SEQ ID NO: 6200190 - DNA, 13 bp, Homo sapiens
aacaaaaaatatt

SEQ ID NO: 6200191 - DNA, 19 bp, Homo sapiens
aacaaaaacagaatttgag

SEQ ID NO: 6200192 - DNA, 19 bp, Homo sapiens
aacaaaaacagcagtttgt

SEQ ID NO: 6200193 - DNA, 20 bp, Homo sapiens
aacaaaaaccaaatgtttat

SEQ ID NO: 6200194 - DNA, 14 bp, Homo sapiens
aacaaaaactatta

SEQ ID NO: 6200195 - DNA, 14 bp, Homo sapiens
aacaaaaactgtat

SEQ ID NO: 6200196 - DNA, 12 bp, Homo sapiens
aacaaaaacttt

SEQ ID NO: 6200197 - DNA, 15 bp, Homo sapiens
aacaaaaactttcca

SEQ ID NO: 6200198 - DNA, 16 bp, Homo sapiens
aacaaaaactttccat

SEQ ID NO: 6200199 - DNA, 21 bp, Homo sapiens
aacaaaaactttccatgacag

SEQ ID NO: 6200200 - DNA, 16 bp, Homo sapiens
aacaaaaagaaatctt

SEQ ID NO: 6200201 - DNA, 13 bp, Homo sapiens
aacaaaaagaaca

SEQ ID NO: 6200202 - DNA, 14 bp, Homo sapiens
aacaaaaagcttcc

SEQ ID NO: 6200203 - DNA, 15 bp, Homo sapiens
aacaaaaagtttttt

SEQ ID NO: 6200204 - DNA, 17 bp, Homo sapiens
aacaaaaatcaaacttt

SEQ ID NO: 6200205 - DNA, 21 bp, Homo sapiens
aacaaaaatgatcctcagtgc

SEQ ID NO: 6200206 - DNA, 14 bp, Homo sapiens
aacaaaaattaggt

SEQ ID NO: 6200207 - DNA, 13 bp, Homo sapiens
aacaaaaattgtc

SEQ ID NO: 6200208 - DNA, 9 bp, Homo sapiens
aacaaaaca

SEQ ID NO: 6200209 - DNA, 11 bp, Homo sapiens
aacaaaacaaa

SEQ ID NO: 6200210 - DNA, 14 bp, Homo sapiens
aacaaaacaaaaca

SEQ ID NO: 6200211 - DNA, 16 bp, Homo sapiens
aacaaaacaaaactat

SEQ ID NO: 6200212 - DNA, 13 bp, Homo sapiens
aacaaaacaacaa

SEQ ID NO: 6200213 - DNA, 16 bp, Homo sapiens
aacaaaacaagaaaga

SEQ ID NO: 6200214 - DNA, 17 bp, Homo sapiens
aacaaaacaagaaagaa

SEQ ID NO: 6200215 - DNA, 18 bp, Homo sapiens
aacaaaacatttgctctg

SEQ ID NO: 6200216 - DNA, 11 bp, Homo sapiens
aacaaaaccag

SEQ ID NO: 6200217 - DNA, 18 bp, Homo sapiens
aacaaaactatggaaata

SEQ ID NO: 6200218 - DNA, 14 bp, Homo sapiens
aacaaaactgttct

SEQ ID NO: 6200219 - DNA, 13 bp, Homo sapiens
aacaaaacttaaa

SEQ ID NO: 6200220 - DNA, 15 bp, Homo sapiens
aacaaaagatatgaa

SEQ ID NO: 6200221 - DNA, 13 bp, Homo sapiens
aacaaaagatgaa

SEQ ID NO: 6200222 - DNA, 21 bp, Homo sapiens
aacaaaagcgacccattcaga

SEQ ID NO: 6200223 - DNA, 13 bp, Homo sapiens
aacaaaagggtca

SEQ ID NO: 6200224 - DNA, 20 bp, Homo sapiens
aacaaaagtacattgcttaa

SEQ ID NO: 6200225 - DNA, 13 bp, Homo sapiens
aacaaaatacatt

SEQ ID NO: 6200226 - DNA, 14 bp, Homo sapiens
aacaaaatacattc

SEQ ID NO: 6200227 - DNA, 15 bp, Homo sapiens
aacaaaatagaaagt

SEQ ID NO: 6200228 - DNA, 20 bp, Homo sapiens
aacaaaatagcttattatag

SEQ ID NO: 6200229 - DNA, 15 bp, Homo sapiens
aacaaaatcacaagc

SEQ ID NO: 6200230 - DNA, 24 bp, Homo sapiens
aacaaaatcacagcacccactacc

SEQ ID NO: 6200231 - DNA, 21 bp, Homo sapiens
aacaaaatccttgccttcaaa

SEQ ID NO: 6200232 - DNA, 23 bp, Homo sapiens
aacaaaatgcctttttgtttacc

SEQ ID NO: 6200233 - DNA, 14 bp, Homo sapiens
aacaaaatgtatgt

SEQ ID NO: 6200234 - DNA, 15 bp, Homo sapiens
aacaaaattacagac

SEQ ID NO: 6200235 - DNA, 11 bp, Homo sapiens
aacaaaatttg

SEQ ID NO: 6200236 - DNA, 13 bp, Homo sapiens
aacaaaatttgaa

SEQ ID NO: 6200237 - DNA, 14 bp, Homo sapiens
aacaaaatttgaat

SEQ ID NO: 6200238 - DNA, 24 bp, Homo sapiens
aacaaaatttgactaattttacat

SEQ ID NO: 6200239 - DNA, 21 bp, Homo sapiens
aacaaacactgaatcatgtta

SEQ ID NO: 6200240 - DNA, 11 bp, Homo sapiens
aacaaacagga

SEQ ID NO: 6200241 - DNA, 21 bp, Homo sapiens
aacaaaccctcgtttctgatt

SEQ ID NO: 6200242 - DNA, 17 bp, Homo sapiens
aacaaacctcactgaga

SEQ ID NO: 6200243 - DNA, 20 bp, Homo sapiens
aacaaaccttgccttgaaat

SEQ ID NO: 6200244 - DNA, 18 bp, Homo sapiens
aacaaacgtaatttgtta

SEQ ID NO: 6200245 - DNA, 21 bp, Homo sapiens
aacaaactatgatcacagtga

SEQ ID NO: 6200246 - DNA, 15 bp, Homo sapiens
aacaaactatttctt

SEQ ID NO: 6200247 - DNA, 16 bp, Homo sapiens
aacaaactctctgaac

SEQ ID NO: 6200248 - DNA, 14 bp, Homo sapiens
aacaaactgcacat

SEQ ID NO: 6200249 - DNA, 21 bp, Homo sapiens
aacaaactgcacatgatttca

SEQ ID NO: 6200250 - DNA, 17 bp, Homo sapiens
aacaaactgtgtaactg

SEQ ID NO: 6200251 - DNA, 22 bp, Homo sapiens
aacaaacttctcgcaactgaag

SEQ ID NO: 6200252 - DNA, 17 bp, Homo sapiens
aacaaagaaaaaaatat

SEQ ID NO: 6200253 - DNA, 18 bp, Homo sapiens
aacaaagaaaaaaatata

SEQ ID NO: 6200254 - DNA, 12 bp, Homo sapiens
aacaaagaaaga

SEQ ID NO: 6200255 - DNA, 12 bp, Homo sapiens
aacaaagaaata

SEQ ID NO: 6200256 - DNA, 14 bp, Homo sapiens
aacaaagaaatatt

SEQ ID NO: 6200257 - DNA, 19 bp, Homo sapiens
aacaaagaagaaccatctt

SEQ ID NO: 6200258 - DNA, 11 bp, Homo sapiens
aacaaagacat

SEQ ID NO: 6200259 - DNA, 20 bp, Homo sapiens
aacaaagacatgctttccat

SEQ ID NO: 6200260 - DNA, 21 bp, Homo sapiens
aacaaagacattgacagcaat

SEQ ID NO: 6200261 - DNA, 21 bp, Homo sapiens
aacaaagaccaattttttgtg

SEQ ID NO: 6200262 - DNA, 19 bp, Homo sapiens
aacaaagagaaaaaataca

SEQ ID NO: 6200263 - DNA, 13 bp, Homo sapiens
aacaaagagtgaa

SEQ ID NO: 6200264 - DNA, 23 bp, Homo sapiens
aacaaagagttcaagaaataagt

SEQ ID NO: 6200265 - DNA, 11 bp, Homo sapiens
aacaaagatat

SEQ ID NO: 6200266 - DNA, 16 bp, Homo sapiens
aacaaagcacagtgtt

SEQ ID NO: 6200267 - DNA, 13 bp, Homo sapiens
aacaaagcacctc

SEQ ID NO: 6200268 - DNA, 14 bp, Homo sapiens
aacaaagcagccac

SEQ ID NO: 6200269 - DNA, 14 bp, Homo sapiens
aacaaagcatgctc

SEQ ID NO: 6200270 - DNA, 22 bp, Homo sapiens
aacaaagcatgctcagtattga

SEQ ID NO: 6200271 - DNA, 22 bp, Homo sapiens
aacaaagcatttgactttctgt

SEQ ID NO: 6200272 - DNA, 15 bp, Homo sapiens
aacaaagctgatttc

SEQ ID NO: 6200273 - DNA, 19 bp, Homo sapiens
aacaaagctgttaaactgt

SEQ ID NO: 6200274 - DNA, 19 bp, Homo sapiens
aacaaagcttagcaggaga

SEQ ID NO: 6200275 - DNA, 12 bp, Homo sapiens
aacaaaggaagt

SEQ ID NO: 6200276 - DNA, 13 bp, Homo sapiens
aacaaaggaagtg

SEQ ID NO: 6200277 - DNA, 15 bp, Homo sapiens
aacaaaggatactta

SEQ ID NO: 6200278 - DNA, 13 bp, Homo sapiens
aacaaaggcaaga

SEQ ID NO: 6200279 - DNA, 20 bp, Homo sapiens
aacaaaggcagctgtgtctg

SEQ ID NO: 6200280 - DNA, 18 bp, Homo sapiens
aacaaagggttttaatgt

SEQ ID NO: 6200281 - DNA, 12 bp, Homo sapiens
aacaaagtaaaa

SEQ ID NO: 6200282 - DNA, 16 bp, Homo sapiens
aacaaagtgcaaagct

SEQ ID NO: 6200283 - DNA, 20 bp, Homo sapiens
aacaaagtgcaaagctgctt

SEQ ID NO: 6200284 - DNA, 12 bp, Homo sapiens
aacaaagtgctt

SEQ ID NO: 6200285 - DNA, 13 bp, Homo sapiens
aacaaagttacta

SEQ ID NO: 6200286 - DNA, 20 bp, Homo sapiens
aacaaagtttacattgtcct

SEQ ID NO: 6200287 - DNA, 14 bp, Homo sapiens
aacaaataaaagtt

SEQ ID NO: 6200288 - DNA, 16 bp, Homo sapiens
aacaaataaaagttga

SEQ ID NO: 6200289 - DNA, 17 bp, Homo sapiens
cttgaagaaacagagtg

SEQ ID NO: 6200290 - DNA, 23 bp, Homo sapiens
cttgaagaaacagagtggcctcc

SEQ ID NO: 6200291 - DNA, 15 bp, Homo sapiens
cttgaagaaacgctt

SEQ ID NO: 6200292 - DNA, 13 bp, Homo sapiens
cttgaagaactga

SEQ ID NO: 6200293 - DNA, 22 bp, Homo sapiens
cttgaagaactgacttcctgaa

SEQ ID NO: 6200294 - DNA, 18 bp, Homo sapiens
cttgaagaactgcaggcc

SEQ ID NO: 6200295 - DNA, 22 bp, Homo sapiens
cttgaagaactgcaggccctgg

SEQ ID NO: 6200296 - DNA, 13 bp, Homo sapiens
cttgaagaatatt

SEQ ID NO: 6200297 - DNA, 14 bp, Homo sapiens
cttgaagaatattc

SEQ ID NO: 6200298 - DNA, 19 bp, Homo sapiens
cttgaagaatctctcctct

SEQ ID NO: 6200299 - DNA, 20 bp, Homo sapiens
cttgaagaatctctcctctc

SEQ ID NO: 6200300 - DNA, 15 bp, Homo sapiens
cttgaagacagagca

SEQ ID NO: 6200301 - DNA, 16 bp, Homo sapiens
cttgaagactccctga

SEQ ID NO: 6200302 - DNA, 16 bp, Homo sapiens
cttgaagagaaaaaag

SEQ ID NO: 6200303 - DNA, 17 bp, Homo sapiens
cttgaagagaaaaaagt

SEQ ID NO: 6200304 - DNA, 17 bp, Homo sapiens
cttgaagaggcaggtct

SEQ ID NO: 6200305 - DNA, 23 bp, Homo sapiens
cttgaagaggcaggtctgggcca

SEQ ID NO: 6200306 - DNA, 23 bp, Homo sapiens
cttgaagaggggaggggcctagg

SEQ ID NO: 6200307 - DNA, 16 bp, Homo sapiens
cttgaagatgtagctt

SEQ ID NO: 6200308 - DNA, 13 bp, Homo sapiens
cttgaagcaataa

SEQ ID NO: 6200309 - DNA, 14 bp, Homo sapiens
cttgaagcaataac

SEQ ID NO: 6200310 - DNA, 21 bp, Homo sapiens
cttgaagcaataactccaagc

SEQ ID NO: 6200311 - DNA, 22 bp, Homo sapiens
cttgaagcaataactccaagca

SEQ ID NO: 6200312 - DNA, 12 bp, Homo sapiens
cttgaagcagta

SEQ ID NO: 6200313 - DNA, 13 bp, Homo sapiens
cttgaagccactg

SEQ ID NO: 6200314 - DNA, 21 bp, Homo sapiens
cttgaagctgggctgtctctc

SEQ ID NO: 6200315 - DNA, 14 bp, Homo sapiens
cttgaagcttgtat

SEQ ID NO: 6200316 - DNA, 13 bp, Homo sapiens
cttgaaggaagag

SEQ ID NO: 6200317 - DNA, 16 bp, Homo sapiens
cttgaaggactaatag

SEQ ID NO: 6200318 - DNA, 16 bp, Homo sapiens
cttgaaggattgcatc

SEQ ID NO: 6200319 - DNA, 20 bp, Homo sapiens
cttgaaggattgcatcctgc

SEQ ID NO: 6200320 - DNA, 14 bp, Homo sapiens
cttgaagggccaga

SEQ ID NO: 6200321 - DNA, 17 bp, Homo sapiens
cttgaagggccagagcc

SEQ ID NO: 6200322 - DNA, 18 bp, Homo sapiens
cttgaagggccagagcca

SEQ ID NO: 6200323 - DNA, 21 bp, Homo sapiens
cttgaagggccagagccaggg

SEQ ID NO: 6200324 - DNA, 14 bp, Homo sapiens
cttgaagggcccag

SEQ ID NO: 6200325 - DNA, 22 bp, Homo sapiens
cttgaaggtgctgacggccagg

SEQ ID NO: 6200326 - DNA, 15 bp, Homo sapiens
cttgaaggtgctgcc

SEQ ID NO: 6200327 - DNA, 16 bp, Homo sapiens
cttgaaggtgctgcca

SEQ ID NO: 6200328 - DNA, 21 bp, Homo sapiens
cttgaaggtttgatgccaaag

SEQ ID NO: 6200329 - DNA, 16 bp, Homo sapiens
cttgaagtaaccttat

SEQ ID NO: 6200330 - DNA, 21 bp, Homo sapiens
cttgaagtaactataacaaaa

SEQ ID NO: 6200331 - DNA, 17 bp, Homo sapiens
cttgaagtacttaacat

SEQ ID NO: 6200332 - DNA, 17 bp, Homo sapiens
cttgaagtcacccggcc

SEQ ID NO: 6200333 - DNA, 20 bp, Homo sapiens
cttgaagtcacccggccccc

SEQ ID NO: 6200334 - DNA, 15 bp, Homo sapiens
cttgaagtcagccac

SEQ ID NO: 6200335 - DNA, 21 bp, Homo sapiens
cttgaagtcagccacactggg

SEQ ID NO: 6200336 - DNA, 15 bp, Homo sapiens
cttgaagtcctggct

SEQ ID NO: 6200337 - DNA, 20 bp, Homo sapiens
cttgaagtctaaaagcagaa

SEQ ID NO: 6200338 - DNA, 16 bp, Homo sapiens
cttgaagtgagaagat

SEQ ID NO: 6200339 - DNA, 17 bp, Homo sapiens
cttgaagttctgaaatt

SEQ ID NO: 6200340 - DNA, 21 bp, Homo sapiens
cttgaagttctgaaatttaac

SEQ ID NO: 6200341 - DNA, 16 bp, Homo sapiens
cttgaagttgggtgtt

SEQ ID NO: 6200342 - DNA, 20 bp, Homo sapiens
cttgaagttgggtgtttcca

SEQ ID NO: 6200343 - DNA, 22 bp, Homo sapiens
cttgaagttgttactaactaaa

SEQ ID NO: 6200344 - DNA, 14 bp, Homo sapiens
cttgaataataagc

SEQ ID NO: 6200345 - DNA, 19 bp, Homo sapiens
cttgaatagattttctctg

SEQ ID NO: 6200346 - DNA, 22 bp, Homo sapiens
cttgaatagattttctctggaa

SEQ ID NO: 6200347 - DNA, 16 bp, Homo sapiens
cttgaatagcttatgt

SEQ ID NO: 6200348 - DNA, 14 bp, Homo sapiens
cttgaataggaaga

SEQ ID NO: 6200349 - DNA, 16 bp, Homo sapiens
cttgaatataaaaaat

SEQ ID NO: 6200350 - DNA, 20 bp, Homo sapiens
cttgaatataaaaaatcatg

SEQ ID NO: 6200351 - DNA, 22 bp, Homo sapiens
cttgaatatcccctcccagtca

SEQ ID NO: 6200352 - DNA, 20 bp, Homo sapiens
cttgaatatgggcggaagta

SEQ ID NO: 6200353 - DNA, 22 bp, Homo sapiens
cttgaatattcctggacttaca

SEQ ID NO: 6200354 - DNA, 12 bp, Homo sapiens
cttgaatatttg

SEQ ID NO: 6200355 - DNA, 17 bp, Homo sapiens
cttgaatcagacatttt

SEQ ID NO: 6200356 - DNA, 17 bp, Homo sapiens
cttgaatccattgaaag

SEQ ID NO: 6200357 - DNA, 16 bp, Homo sapiens
cttgaatcctctatta

SEQ ID NO: 6200358 - DNA, 14 bp, Homo sapiens
cttgaatcctggcc

SEQ ID NO: 6200359 - DNA, 14 bp, Homo sapiens
cttgaatccttcca

SEQ ID NO: 6200360 - DNA, 20 bp, Homo sapiens
cttgaatccttccattccac

SEQ ID NO: 6200361 - DNA, 21 bp, Homo sapiens
cttgaatccttccattccaca

SEQ ID NO: 6200362 - DNA, 20 bp, Homo sapiens
cttgaatctgttactgaaat

SEQ ID NO: 6200363 - DNA, 15 bp, Homo sapiens
cttgaatctttttat

SEQ ID NO: 6200364 - DNA, 23 bp, Homo sapiens
cttgaatgatgccatgaggaaca

SEQ ID NO: 6200365 - DNA, 21 bp, Homo sapiens
cttgaatggttaataaaactg

SEQ ID NO: 6200366 - DNA, 13 bp, Homo sapiens
cttgaatgtacaa

SEQ ID NO: 6200367 - DNA, 10 bp, Homo sapiens
cttgaatgtc

SEQ ID NO: 6200368 - DNA, 18 bp, Homo sapiens
cttgaatgtggtctcagg

SEQ ID NO: 6200369 - DNA, 20 bp, Homo sapiens
cttgaatgtggtctcaggat

SEQ ID NO: 6200370 - DNA, 15 bp, Homo sapiens
cttgaatgtgtcagg

SEQ ID NO: 6200371 - DNA, 15 bp, Homo sapiens
cttgaattaaaaaaa

SEQ ID NO: 6200372 - DNA, 15 bp, Homo sapiens
cttgaattaagaaga

SEQ ID NO: 6200373 - DNA, 14 bp, Homo sapiens
cttgaattcataga

SEQ ID NO: 6200374 - DNA, 19 bp, Homo sapiens
cttgaattgtaaggaatga

SEQ ID NO: 6200375 - DNA, 12 bp, Homo sapiens
cttgaattgtct

SEQ ID NO: 6200376 - DNA, 19 bp, Homo sapiens
cttgaattgttatgaaaat

SEQ ID NO: 6200377 - DNA, 20 bp, Homo sapiens
cttgaatttctaaaaaacag

SEQ ID NO: 6200378 - DNA, 13 bp, Homo sapiens
cttgaatttctgc

SEQ ID NO: 6200379 - DNA, 14 bp, Homo sapiens
cttgaatttgcatg

SEQ ID NO: 6200380 - DNA, 16 bp, Homo sapiens
cttgaatttgcatgtc

SEQ ID NO: 6200381 - DNA, 17 bp, Homo sapiens
cttgaatttgcatgtct

SEQ ID NO: 6200382 - DNA, 21 bp, Homo sapiens
cttgaattttcccactgcacc

SEQ ID NO: 6200383 - DNA, 22 bp, Homo sapiens
cttgaattttcccactgcaccc

SEQ ID NO: 6200384 - DNA, 23 bp, Homo sapiens
cttgaatttttttctgcacagct

SEQ ID NO: 6200385 - DNA, 24 bp, Homo sapiens
cttgaatttttttctgcacagctt

SEQ ID NO: 6200386 - DNA, 19 bp, Homo sapiens
cttgacaaagtcaagccac

SEQ ID NO: 6200387 - DNA, 15 bp, Homo sapiens
cttgacaaatatttt

SEQ ID NO: 6200388 - DNA, 19 bp, Homo sapiens
cttgacaaatattttcatg

SEQ ID NO: 6200389 - DNA, 17 bp, Homo sapiens
cttgacaacagactgaa

SEQ ID NO: 6200390 - DNA, 22 bp, Homo sapiens
cttgacaagctgacttggcact

SEQ ID NO: 6200391 - DNA, 17 bp, Homo sapiens
cttgacaatcatctcca

SEQ ID NO: 6200392 - DNA, 13 bp, Homo sapiens
cttgacacactgt

SEQ ID NO: 6200393 - DNA, 23 bp, Homo sapiens
cttgacacatagtttttcagtct

SEQ ID NO: 6200394 - DNA, 20 bp, Homo sapiens
cttgacaccaaccagacagc

SEQ ID NO: 6200395 - DNA, 19 bp, Homo sapiens
cttgacaccttactttccc

SEQ ID NO: 6200396 - DNA, 14 bp, Homo sapiens
cttgacacctttga

SEQ ID NO: 6200397 - DNA, 19 bp, Homo sapiens
cttgacacggtgaaatcca

SEQ ID NO: 6200398 - DNA, 20 bp, Homo sapiens
cttgacacggtgaaatccag

SEQ ID NO: 6200399 - DNA, 22 bp, Homo sapiens
cttgacacggtgaaatccaggt

SEQ ID NO: 6200400 - DNA, 16 bp, Homo sapiens
cttgacagaaagcagt

SEQ ID NO: 6200401 - DNA, 19 bp, Homo sapiens
cttgacagaaagcagttct

SEQ ID NO: 6200402 - DNA, 14 bp, Homo sapiens
cttgacagaacact

SEQ ID NO: 6200403 - DNA, 21 bp, Homo sapiens
cttgacagactgtagcttctc

SEQ ID NO: 6200404 - DNA, 19 bp, Homo sapiens
cttgacagagcctgcccca

SEQ ID NO: 6200405 - DNA, 23 bp, Homo sapiens
cttgacagatgtctgggaaagca

SEQ ID NO: 6200406 - DNA, 22 bp, Homo sapiens
cttgacagcatgaggtgttgtg

SEQ ID NO: 6200407 - DNA, 17 bp, Homo sapiens
cttgacaggcgccgcct

SEQ ID NO: 6200408 - DNA, 20 bp, Homo sapiens
cttgacaggcgccgcctcgc

SEQ ID NO: 6200409 - DNA, 20 bp, Homo sapiens
cttgacagggcacaccgggc

SEQ ID NO: 6200410 - DNA, 22 bp, Homo sapiens
cttgacagtatatttgaaactg

SEQ ID NO: 6200411 - DNA, 13 bp, Homo sapiens
cttgacagtctga

SEQ ID NO: 6200412 - DNA, 17 bp, Homo sapiens
cttgacagttacttaca

SEQ ID NO: 6200413 - DNA, 22 bp, Homo sapiens
cttgacatacctaccagtatta

SEQ ID NO: 6200414 - DNA, 20 bp, Homo sapiens
cttgacatcaagggaggaag

SEQ ID NO: 6200415 - DNA, 12 bp, Homo sapiens
cttgacattcct

SEQ ID NO: 6200416 - DNA, 18 bp, Homo sapiens
cttgaccaacagaaacct

SEQ ID NO: 6200417 - DNA, 20 bp, Homo sapiens
cttgaccaacagaaaccttt

SEQ ID NO: 6200418 - DNA, 15 bp, Homo sapiens
cttgaccaagcagga

SEQ ID NO: 6200419 - DNA, 18 bp, Homo sapiens
cttgaccaagcaggaagc

SEQ ID NO: 6200420 - DNA, 14 bp, Homo sapiens
cttgaccagaccta

SEQ ID NO: 6200421 - DNA, 21 bp, Homo sapiens
cttgaccagacctagacctgg

SEQ ID NO: 6200422 - DNA, 17 bp, Homo sapiens
cttgaccaggcctgggc

SEQ ID NO: 6200423 - DNA, 22 bp, Homo sapiens
cttgaccatactaataaatata

SEQ ID NO: 6200424 - DNA, 17 bp, Homo sapiens
cttgaccattggctgcg

SEQ ID NO: 6200425 - DNA, 15 bp, Homo sapiens
cttgaccctagaatt

SEQ ID NO: 6200426 - DNA, 14 bp, Homo sapiens
cttgaccctgaaat

SEQ ID NO: 6200427 - DNA, 23 bp, Homo sapiens
cttgaccctgaaatattttctac

SEQ ID NO: 6200428 - DNA, 13 bp, Homo sapiens
cttgaccctgagc

SEQ ID NO: 6200429 - DNA, 15 bp, Homo sapiens
cttgaccctgcaccc

SEQ ID NO: 6200430 - DNA, 16 bp, Homo sapiens
cttgaccctgcaccct

SEQ ID NO: 6200431 - DNA, 18 bp, Homo sapiens
cttgaccctgcaccctcc

SEQ ID NO: 6200432 - DNA, 13 bp, Homo sapiens
cttgaccctttcc

SEQ ID NO: 6200433 - DNA, 15 bp, Homo sapiens
cttgaccctttcctc

SEQ ID NO: 6200434 - DNA, 15 bp, Homo sapiens
cttgaccgtactctc

SEQ ID NO: 6200435 - DNA, 18 bp, Homo sapiens
cttgaccgtactctcaca

SEQ ID NO: 6200436 - DNA, 21 bp, Homo sapiens
cttgaccgtgaggccagagac

SEQ ID NO: 6200437 - DNA, 22 bp, Homo sapiens
cttgaccgtttttatattactt

SEQ ID NO: 6200438 - DNA, 13 bp, Homo sapiens
cttgacctcaggt

SEQ ID NO: 6200439 - DNA, 12 bp, Homo sapiens
cttgacctccta

SEQ ID NO: 6200440 - DNA, 14 bp, Homo sapiens
cttgacctgagatg

SEQ ID NO: 6200441 - DNA, 17 bp, Homo sapiens
cttgacctgagatgctg

SEQ ID NO: 6200442 - DNA, 20 bp, Homo sapiens
cttgacctgaggctgtggtc

SEQ ID NO: 6200443 - DNA, 23 bp, Homo sapiens
cttgacctgaggctgtggtcaca

SEQ ID NO: 6200444 - DNA, 20 bp, Homo sapiens
cttgacctgcattgtaaata

SEQ ID NO: 6200445 - DNA, 12 bp, Homo sapiens
cttgaccttcct

SEQ ID NO: 6200446 - DNA, 14 bp, Homo sapiens
cttgaccttcctct

SEQ ID NO: 6200447 - DNA, 17 bp, Homo sapiens
cttgaccttcctctggg

SEQ ID NO: 6200448 - DNA, 21 bp, Homo sapiens
cttgaccttcctctggggctc

SEQ ID NO: 6200449 - DNA, 15 bp, Homo sapiens
cttgaccttgtagag

SEQ ID NO: 6200450 - DNA, 17 bp, Homo sapiens
cttgacgaatattgctt

SEQ ID NO: 6200451 - DNA, 20 bp, Homo sapiens
cttgacgcgtggtcacagga

SEQ ID NO: 6200452 - DNA, 15 bp, Homo sapiens
cttgacgtgtgtggt

SEQ ID NO: 6200453 - DNA, 19 bp, Homo sapiens
cttgactataaaaactgcc

SEQ ID NO: 6200454 - DNA, 17 bp, Homo sapiens
cttgactatcacataca

SEQ ID NO: 6200455 - DNA, 20 bp, Homo sapiens
cttgactatcacatacaatt

SEQ ID NO: 6200456 - DNA, 22 bp, Homo sapiens
cttgactatcacatacaatttg

SEQ ID NO: 6200457 - DNA, 23 bp, Homo sapiens
cttgactatcacatacaatttgc

SEQ ID NO: 6200458 - DNA, 17 bp, Homo sapiens
cttgactcatggcagct

SEQ ID NO: 6200459 - DNA, 23 bp, Homo sapiens
cttgactccactactttactgtt

SEQ ID NO: 6200460 - DNA, 18 bp, Homo sapiens
cttgactctaaatgcagt

SEQ ID NO: 6200461 - DNA, 14 bp, Homo sapiens
cttgactctaatat

SEQ ID NO: 6200462 - DNA, 19 bp, Homo sapiens
cttgactctaatatgatta

SEQ ID NO: 6200463 - DNA, 16 bp, Homo sapiens
cttgactctactccca

SEQ ID NO: 6200464 - DNA, 17 bp, Homo sapiens
cttgactcttctaaatg

SEQ ID NO: 6200465 - DNA, 22 bp, Homo sapiens
cttgactgaagcgaacatcttc

SEQ ID NO: 6200466 - DNA, 17 bp, Homo sapiens
aacaaataaatatgaaa

SEQ ID NO: 6200467 - DNA, 17 bp, Homo sapiens
aacaaataatatattaa

SEQ ID NO: 6200468 - DNA, 16 bp, Homo sapiens
aacaaataatcacatt

SEQ ID NO: 6200469 - DNA, 23 bp, Homo sapiens
aacaaatatgattctcctctccc

SEQ ID NO: 6200470 - DNA, 13 bp, Homo sapiens
aacaaatatgcaa

SEQ ID NO: 6200471 - DNA, 15 bp, Homo sapiens
aacaaatcaaacaca

SEQ ID NO: 6200472 - DNA, 19 bp, Homo sapiens
aacaaatcaaattgcttaa

SEQ ID NO: 6200473 - DNA, 12 bp, Homo sapiens
aacaaatcattt

SEQ ID NO: 6200474 - DNA, 16 bp, Homo sapiens
aacaaatctaatctct

SEQ ID NO: 6200475 - DNA, 23 bp, Homo sapiens
aacaaatctaatctcttattcta

SEQ ID NO: 6200476 - DNA, 23 bp, Homo sapiens
aacaaatctaggaaaatattttg

SEQ ID NO: 6200477 - DNA, 13 bp, Homo sapiens
aacaaatcttcct

SEQ ID NO: 6200478 - DNA, 16 bp, Homo sapiens
aacaaatgaaatttaa

SEQ ID NO: 6200479 - DNA, 17 bp, Homo sapiens
aacaaatgccaaattaa

SEQ ID NO: 6200480 - DNA, 23 bp, Homo sapiens
aacaaatgccaaattaaaaaaga

SEQ ID NO: 6200481 - DNA, 14 bp, Homo sapiens
aacaaatgtgaagg

SEQ ID NO: 6200482 - DNA, 13 bp, Homo sapiens
aacaaatgtgtaa

SEQ ID NO: 6200483 - DNA, 13 bp, Homo sapiens
aacaaattaaata

SEQ ID NO: 6200484 - DNA, 20 bp, Homo sapiens
aacaaattaggttttgtaca

SEQ ID NO: 6200485 - DNA, 21 bp, Homo sapiens
aacaaattaggttttgtacaa

SEQ ID NO: 6200486 - DNA, 23 bp, Homo sapiens
aacaaattctgaatattttttga

SEQ ID NO: 6200487 - DNA, 15 bp, Homo sapiens
aacaaattctttagt

SEQ ID NO: 6200488 - DNA, 22 bp, Homo sapiens
aacaaattctttagtactcaat

SEQ ID NO: 6200489 - DNA, 19 bp, Homo sapiens
aacaaattgggatctgtct

SEQ ID NO: 6200490 - DNA, 18 bp, Homo sapiens
aacaaattgtttacataa

SEQ ID NO: 6200491 - DNA, 12 bp, Homo sapiens
aacaaatttaca

SEQ ID NO: 6200492 - DNA, 18 bp, Homo sapiens
aacaaatttacagagaca

SEQ ID NO: 6200493 - DNA, 18 bp, Homo sapiens
aacaaatttacatcagaa

SEQ ID NO: 6200494 - DNA, 13 bp, Homo sapiens
aacaaatttcatt

SEQ ID NO: 6200495 - DNA, 21 bp, Homo sapiens
aacaaatttcattgcactttc

SEQ ID NO: 6200496 - DNA, 19 bp, Homo sapiens
aacaaatttttcaaatcat

SEQ ID NO: 6200497 - DNA, 13 bp, Homo sapiens
aacaacaaaaaaa

SEQ ID NO: 6200498 - DNA, 18 bp, Homo sapiens
aacaacaaagcatgctca

SEQ ID NO: 6200499 - DNA, 14 bp, Homo sapiens
aacaacaacaaagc

SEQ ID NO: 6200500 - DNA, 15 bp, Homo sapiens
aacaacaacaacaat

SEQ ID NO: 6200501 - DNA, 16 bp, Homo sapiens
aacaacaacaataaca

SEQ ID NO: 6200502 - DNA, 17 bp, Homo sapiens
aacaacaacaataataa

SEQ ID NO: 6200503 - DNA, 10 bp, Homo sapiens
aacaacaata

SEQ ID NO: 6200504 - DNA, 13 bp, Homo sapiens
aacaacaataata

SEQ ID NO: 6200505 - DNA, 23 bp, Homo sapiens
aacaacaatggtttacatgaaca

SEQ ID NO: 6200506 - DNA, 12 bp, Homo sapiens
aacaacacaatc

SEQ ID NO: 6200507 - DNA, 16 bp, Homo sapiens
aacaacacccaagatg

SEQ ID NO: 6200508 - DNA, 12 bp, Homo sapiens
aacaacacctcc

SEQ ID NO: 6200509 - DNA, 15 bp, Homo sapiens
aacaacagaaacttc

SEQ ID NO: 6200510 - DNA, 15 bp, Homo sapiens
aacaacagcaacaac

SEQ ID NO: 6200511 - DNA, 18 bp, Homo sapiens
aacaacagtcagccagct

SEQ ID NO: 6200512 - DNA, 14 bp, Homo sapiens
aacaacataaaact

SEQ ID NO: 6200513 - DNA, 19 bp, Homo sapiens
aacaacataaaattaaaat

SEQ ID NO: 6200514 - DNA, 13 bp, Homo sapiens
aacaacatgtcaa

SEQ ID NO: 6200515 - DNA, 17 bp, Homo sapiens
aacaacattattttaaa

SEQ ID NO: 6200516 - DNA, 14 bp, Homo sapiens
aacaacattttgag

SEQ ID NO: 6200517 - DNA, 17 bp, Homo sapiens
aacaaccaaatgtgcat

SEQ ID NO: 6200518 - DNA, 19 bp, Homo sapiens
aacaaccagttaaagccac

SEQ ID NO: 6200519 - DNA, 21 bp, Homo sapiens
aacaacccacaccgtcttcct

SEQ ID NO: 6200520 - DNA, 15 bp, Homo sapiens
aacaaccctgaagca

SEQ ID NO: 6200521 - DNA, 19 bp, Homo sapiens
aacaaccctgttgagtatt

SEQ ID NO: 6200522 - DNA, 20 bp, Homo sapiens
aacaaccctgttgagtattt

SEQ ID NO: 6200523 - DNA, 22 bp, Homo sapiens
aacaaccctgttgagtatttgc

SEQ ID NO: 6200524 - DNA, 22 bp, Homo sapiens
aacaaccgtcctgctgtccctg

SEQ ID NO: 6200525 - DNA, 18 bp, Homo sapiens
aacaacctcaactgccta

SEQ ID NO: 6200526 - DNA, 20 bp, Homo sapiens
aacaacctgccacaatgtga

SEQ ID NO: 6200527 - DNA, 23 bp, Homo sapiens
aacaacctggtgcatcgaaatgt

SEQ ID NO: 6200528 - DNA, 13 bp, Homo sapiens
aacaaccttttac

SEQ ID NO: 6200529 - DNA, 18 bp, Homo sapiens
aacaaccttttacattgt

SEQ ID NO: 6200530 - DNA, 18 bp, Homo sapiens
aacaacgtctttttgttt

SEQ ID NO: 6200531 - DNA, 15 bp, Homo sapiens
aacaacgtgagagaa

SEQ ID NO: 6200532 - DNA, 19 bp, Homo sapiens
aacaacgtgtatagtgcct

SEQ ID NO: 6200533 - DNA, 22 bp, Homo sapiens
aacaactaaaaaaatttttgac

SEQ ID NO: 6200534 - DNA, 18 bp, Homo sapiens
aacaactatttataaact

SEQ ID NO: 6200535 - DNA, 19 bp, Homo sapiens
aacaactcatgtctttatt

SEQ ID NO: 6200536 - DNA, 21 bp, Homo sapiens
aacaactccaggaaaactgtt

SEQ ID NO: 6200537 - DNA, 13 bp, Homo sapiens
aacaactctattt

SEQ ID NO: 6200538 - DNA, 13 bp, Homo sapiens
aacaactgactaa

SEQ ID NO: 6200539 - DNA, 23 bp, Homo sapiens
aacaactgccaaataaaatgttt

SEQ ID NO: 6200540 - DNA, 14 bp, Homo sapiens
aacaactgctctta

SEQ ID NO: 6200541 - DNA, 17 bp, Homo sapiens
aacaactgtgaatatga

SEQ ID NO: 6200542 - DNA, 14 bp, Homo sapiens
aacaacttactaaa

SEQ ID NO: 6200543 - DNA, 13 bp, Homo sapiens
aacaacttcagaa

SEQ ID NO: 6200544 - DNA, 22 bp, Homo sapiens
aacaacttccgttgctgccatc

SEQ ID NO: 6200545 - DNA, 15 bp, Homo sapiens
aacaacttgctactt

SEQ ID NO: 6200546 - DNA, 21 bp, Homo sapiens
aacaacttgctacttatcatt

SEQ ID NO: 6200547 - DNA, 15 bp, Homo sapiens
aacaacttggcattt

SEQ ID NO: 6200548 - DNA, 18 bp, Homo sapiens
aacaacttggcatttcta

SEQ ID NO: 6200549 - DNA, 20 bp, Homo sapiens
aacaactttcacttcttcct

SEQ ID NO: 6200550 - DNA, 14 bp, Homo sapiens
aacaactttcagtg

SEQ ID NO: 6200551 - DNA, 16 bp, Homo sapiens
aacaactttctggaaa

SEQ ID NO: 6200552 - DNA, 11 bp, Homo sapiens
aacaagaaaaa

SEQ ID NO: 6200553 - DNA, 18 bp, Homo sapiens
aacaagaaaaataaagaa

SEQ ID NO: 6200554 - DNA, 23 bp, Homo sapiens
aacaagaaaccaagtgggctggt

SEQ ID NO: 6200555 - DNA, 14 bp, Homo sapiens
aacaagaaagaaac

SEQ ID NO: 6200556 - DNA, 21 bp, Homo sapiens
aacaagaaagaaatggctttt

SEQ ID NO: 6200557 - DNA, 14 bp, Homo sapiens
aacaagaaatctga

SEQ ID NO: 6200558 - DNA, 17 bp, Homo sapiens
aacaagaaatctttctg

SEQ ID NO: 6200559 - DNA, 12 bp, Homo sapiens
aacaagaaatgg

SEQ ID NO: 6200560 - DNA, 19 bp, Homo sapiens
aacaagaaattgtttcttt

SEQ ID NO: 6200561 - DNA, 16 bp, Homo sapiens
aacaagaaccactcct

SEQ ID NO: 6200562 - DNA, 14 bp, Homo sapiens
aacaagaagaaata

SEQ ID NO: 6200563 - DNA, 18 bp, Homo sapiens
aacaagaagaaatatgaa

SEQ ID NO: 6200564 - DNA, 17 bp, Homo sapiens
aacaagaagaatttgaa

SEQ ID NO: 6200565 - DNA, 21 bp, Homo sapiens
aacaagaagccacagacctag

SEQ ID NO: 6200566 - DNA, 19 bp, Homo sapiens
aacaagaagggactgagag

SEQ ID NO: 6200567 - DNA, 14 bp, Homo sapiens
aacaagaatacaac

SEQ ID NO: 6200568 - DNA, 18 bp, Homo sapiens
aacaagaatattgtatgt

SEQ ID NO: 6200569 - DNA, 11 bp, Homo sapiens
aacaagaatgc

SEQ ID NO: 6200570 - DNA, 12 bp, Homo sapiens
aacaagaattgg

SEQ ID NO: 6200571 - DNA, 13 bp, Homo sapiens
aacaagacaaggt

SEQ ID NO: 6200572 - DNA, 17 bp, Homo sapiens
aacaagaccgccccagg

SEQ ID NO: 6200573 - DNA, 18 bp, Homo sapiens
aacaagaccgccccaggg

SEQ ID NO: 6200574 - DNA, 22 bp, Homo sapiens
aacaagaccgccccagggctat

SEQ ID NO: 6200575 - DNA, 19 bp, Homo sapiens
aacaagactgccaggtggt

SEQ ID NO: 6200576 - DNA, 16 bp, Homo sapiens
aacaagactgcctccc

SEQ ID NO: 6200577 - DNA, 15 bp, Homo sapiens
aacaagagaagcatt

SEQ ID NO: 6200578 - DNA, 21 bp, Homo sapiens
aacaagagaccacttccttaa

SEQ ID NO: 6200579 - DNA, 21 bp, Homo sapiens
aacaagagcctgattttttga

SEQ ID NO: 6200580 - DNA, 19 bp, Homo sapiens
aacaagagcgaaactccgt

SEQ ID NO: 6200581 - DNA, 15 bp, Homo sapiens
aacaagaggagcagg

SEQ ID NO: 6200582 - DNA, 23 bp, Homo sapiens
aacaagaggagcaggaagcaagg

SEQ ID NO: 6200583 - DNA, 20 bp, Homo sapiens
aacaagaggttagaaatact

SEQ ID NO: 6200584 - DNA, 22 bp, Homo sapiens
aacaagagtatgtggcaaaaca

SEQ ID NO: 6200585 - DNA, 13 bp, Homo sapiens
aacaagagtgatt

SEQ ID NO: 6200586 - DNA, 17 bp, Homo sapiens
aacaagagttccatccc

SEQ ID NO: 6200587 - DNA, 17 bp, Homo sapiens
aacaagatacgtatatt

SEQ ID NO: 6200588 - DNA, 22 bp, Homo sapiens
aacaagatatttatatgttatt

SEQ ID NO: 6200589 - DNA, 19 bp, Homo sapiens
aacaagatctttcaggaaa

SEQ ID NO: 6200590 - DNA, 17 bp, Homo sapiens
aacaagatgaaattcca

SEQ ID NO: 6200591 - DNA, 18 bp, Homo sapiens
aacaagatgtttcatttt

SEQ ID NO: 6200592 - DNA, 20 bp, Homo sapiens
aacaagatttccttgtgcaa

SEQ ID NO: 6200593 - DNA, 15 bp, Homo sapiens
aacaagatttgtaat

SEQ ID NO: 6200594 - DNA, 19 bp, Homo sapiens
aacaagatttgtaattaca

SEQ ID NO: 6200595 - DNA, 22 bp, Homo sapiens
aacaagcaaggatatcagagct

SEQ ID NO: 6200596 - DNA, 23 bp, Homo sapiens
aacaagcaatgatgacccactaa

SEQ ID NO: 6200597 - DNA, 17 bp, Homo sapiens
aacaagcatataaaatg

SEQ ID NO: 6200598 - DNA, 23 bp, Homo sapiens
aacaagcatgatcttgttactgt

SEQ ID NO: 6200599 - DNA, 22 bp, Homo sapiens
aacaagcctgagggaggaggca

SEQ ID NO: 6200600 - DNA, 11 bp, Homo sapiens
aacaagcctta

SEQ ID NO: 6200601 - DNA, 14 bp, Homo sapiens
aacaagcgtttatt

SEQ ID NO: 6200602 - DNA, 14 bp, Homo sapiens
aacaagctgtgcag

SEQ ID NO: 6200603 - DNA, 18 bp, Homo sapiens
aacaagcttcaaagccat

SEQ ID NO: 6200604 - DNA, 14 bp, Homo sapiens
aacaaggaaacttt

SEQ ID NO: 6200605 - DNA, 14 bp, Homo sapiens
aacaaggaagccaa

SEQ ID NO: 6200606 - DNA, 15 bp, Homo sapiens
aacaaggaagccaaa

SEQ ID NO: 6200607 - DNA, 20 bp, Homo sapiens
aacaaggatcaggctgctgg

SEQ ID NO: 6200608 - DNA, 15 bp, Homo sapiens
aacaaggcaaggctg

SEQ ID NO: 6200609 - DNA, 18 bp, Homo sapiens
aacaaggcaaggctgtca

SEQ ID NO: 6200610 - DNA, 23 bp, Homo sapiens
aacaaggcaaggctgtcaattac

SEQ ID NO: 6200611 - DNA, 16 bp, Homo sapiens
aacaaggcgaaatcct

SEQ ID NO: 6200612 - DNA, 22 bp, Homo sapiens
aacaagggaaggggcctccctc

SEQ ID NO: 6200613 - DNA, 18 bp, Homo sapiens
aacaagggcagtggaggt

SEQ ID NO: 6200614 - DNA, 17 bp, Homo sapiens
aacaaggggttacttta

SEQ ID NO: 6200615 - DNA, 16 bp, Homo sapiens
aacaaggtagttttta

SEQ ID NO: 6200616 - DNA, 12 bp, Homo sapiens
aacaaggtgtct

SEQ ID NO: 6200617 - DNA, 14 bp, Homo sapiens
aacaagtaatgtat

SEQ ID NO: 6200618 - DNA, 18 bp, Homo sapiens
aacaagtcaattctgtgt

SEQ ID NO: 6200619 - DNA, 16 bp, Homo sapiens
aacaagtcacagctgc

SEQ ID NO: 6200620 - DNA, 20 bp, Homo sapiens
aacaagtcacagctgcagct

SEQ ID NO: 6200621 - DNA, 19 bp, Homo sapiens
aacaagtctagtcttctgg

SEQ ID NO: 6200622 - DNA, 14 bp, Homo sapiens
aacaagtgaacaca

SEQ ID NO: 6200623 - DNA, 20 bp, Homo sapiens
aacaagtgaccccagggcct

SEQ ID NO: 6200624 - DNA, 17 bp, Homo sapiens
aacaagtgcctcctgga

SEQ ID NO: 6200625 - DNA, 20 bp, Homo sapiens
aacaagtgctcctgaaagaa

SEQ ID NO: 6200626 - DNA, 15 bp, Homo sapiens
aacaagtgctggcac

SEQ ID NO: 6200627 - DNA, 13 bp, Homo sapiens
aacaagtgtacag

SEQ ID NO: 6200628 - DNA, 17 bp, Homo sapiens
aacaagtgtacagaaga

SEQ ID NO: 6200629 - DNA, 23 bp, Homo sapiens
aacaagttagaaaattcagctcc

SEQ ID NO: 6200630 - DNA, 18 bp, Homo sapiens
aacaagttagtttctcat

SEQ ID NO: 6200631 - DNA, 22 bp, Homo sapiens
aacaagttgagctatgacttaa

SEQ ID NO: 6200632 - DNA, 19 bp, Homo sapiens
aacaagttggctagaagaa

SEQ ID NO: 6200633 - DNA, 21 bp, Homo sapiens
aacaagtttgctagtgactaa

SEQ ID NO: 6200634 - DNA, 17 bp, Homo sapiens
aacaagttttaatgtat

SEQ ID NO: 6200635 - DNA, 20 bp, Homo sapiens
aacaagttttaatgtatagt

SEQ ID NO: 6200636 - DNA, 14 bp, Homo sapiens
aacaagttttagaa

SEQ ID NO: 6200637 - DNA, 12 bp, Homo sapiens
aacaataaaaga

SEQ ID NO: 6200638 - DNA, 14 bp, Homo sapiens
aacaataaaatttt

SEQ ID NO: 6200639 - DNA, 23 bp, Homo sapiens
aacaataaaattttttttcatgt

SEQ ID NO: 6200640 - DNA, 12 bp, Homo sapiens
aacaataaacag

SEQ ID NO: 6200641 - DNA, 14 bp, Homo sapiens
aacaataaacatcc

SEQ ID NO: 6200642 - DNA, 14 bp, Homo sapiens
aacaataaagagat

SEQ ID NO: 6200643 - DNA, 15 bp, Homo sapiens
aacaataaagcaata

SEQ ID NO: 6200644 - DNA, 14 bp, Homo sapiens
aacaataaagcatt

SEQ ID NO: 6200645 - DNA, 11 bp, Homo sapiens
aacaataaagt

SEQ ID NO: 6200646 - DNA, 12 bp, Homo sapiens
cttgactgcatt

SEQ ID NO: 6200647 - DNA, 19 bp, Homo sapiens
cttgactgtcacggaacag

SEQ ID NO: 6200648 - DNA, 12 bp, Homo sapiens
cttgactgtcta

SEQ ID NO: 6200649 - DNA, 23 bp, Homo sapiens
cttgacttagacctatactgaaa

SEQ ID NO: 6200650 - DNA, 17 bp, Homo sapiens
cttgacttctgcccaaa

SEQ ID NO: 6200651 - DNA, 20 bp, Homo sapiens
cttgactttagtctgcaaaa

SEQ ID NO: 6200652 - DNA, 13 bp, Homo sapiens
cttgactttctga

SEQ ID NO: 6200653 - DNA, 17 bp, Homo sapiens
cttgactttggctgatt

SEQ ID NO: 6200654 - DNA, 16 bp, Homo sapiens
cttgactttttaaaaa

SEQ ID NO: 6200655 - DNA, 20 bp, Homo sapiens
cttgagaaaatgcaggagag

SEQ ID NO: 6200656 - DNA, 10 bp, Homo sapiens
cttgagaaat

SEQ ID NO: 6200657 - DNA, 17 bp, Homo sapiens
cttgagaaatttgaaag

SEQ ID NO: 6200658 - DNA, 12 bp, Homo sapiens
cttgagaagaca

SEQ ID NO: 6200659 - DNA, 16 bp, Homo sapiens
cttgagaagtaactgt

SEQ ID NO: 6200660 - DNA, 18 bp, Homo sapiens
cttgagaatctttgcatg

SEQ ID NO: 6200661 - DNA, 22 bp, Homo sapiens
cttgagaatggtgatccaccca

SEQ ID NO: 6200662 - DNA, 18 bp, Homo sapiens
cttgagaattccctgtgg

SEQ ID NO: 6200663 - DNA, 18 bp, Homo sapiens
cttgagacaaatcctttc

SEQ ID NO: 6200664 - DNA, 12 bp, Homo sapiens
cttgagacaatg

SEQ ID NO: 6200665 - DNA, 15 bp, Homo sapiens
cttgagaccagcctg

SEQ ID NO: 6200666 - DNA, 16 bp, Homo sapiens
cttgagaccagcctgc

SEQ ID NO: 6200667 - DNA, 19 bp, Homo sapiens
cttgagaccagcctgccag

SEQ ID NO: 6200668 - DNA, 23 bp, Homo sapiens
cttgagaccagcctgccaggccc

SEQ ID NO: 6200669 - DNA, 22 bp, Homo sapiens
cttgagacccccaagcttccac

SEQ ID NO: 6200670 - DNA, 23 bp, Homo sapiens
cttgagaccctcttctctgggcc

SEQ ID NO: 6200671 - DNA, 15 bp, Homo sapiens
cttgagacctcagcc

SEQ ID NO: 6200672 - DNA, 16 bp, Homo sapiens
cttgagacctcagcca

SEQ ID NO: 6200673 - DNA, 17 bp, Homo sapiens
cttgagactgttttgaa

SEQ ID NO: 6200674 - DNA, 22 bp, Homo sapiens
cttgagactgttttgaatttgg

SEQ ID NO: 6200675 - DNA, 20 bp, Homo sapiens
cttgagagaaaaagtgcccc

SEQ ID NO: 6200676 - DNA, 21 bp, Homo sapiens
cttgagagaaaaagtgcccct

SEQ ID NO: 6200677 - DNA, 22 bp, Homo sapiens
cttgagagaaaaagtgcccctt

SEQ ID NO: 6200678 - DNA, 20 bp, Homo sapiens
cttgagagaaaagaaaaata

SEQ ID NO: 6200679 - DNA, 18 bp, Homo sapiens
cttgagagacccagctgc

SEQ ID NO: 6200680 - DNA, 12 bp, Homo sapiens
cttgagagagaa

SEQ ID NO: 6200681 - DNA, 17 bp, Homo sapiens
cttgagagccccacccc

SEQ ID NO: 6200682 - DNA, 17 bp, Homo sapiens
cttgagagcgctggcct

SEQ ID NO: 6200683 - DNA, 17 bp, Homo sapiens
cttgagagctcaggcag

SEQ ID NO: 6200684 - DNA, 18 bp, Homo sapiens
cttgagagctcaggcagc

SEQ ID NO: 6200685 - DNA, 20 bp, Homo sapiens
cttgagaggcatgacagctg

SEQ ID NO: 6200686 - DNA, 22 bp, Homo sapiens
cttgagagttccggggagaaac

SEQ ID NO: 6200687 - DNA, 18 bp, Homo sapiens
cttgagataaggttttaa

SEQ ID NO: 6200688 - DNA, 21 bp, Homo sapiens
cttgagataatctaaatataa

SEQ ID NO: 6200689 - DNA, 22 bp, Homo sapiens
cttgagatctgtataaataaga

SEQ ID NO: 6200690 - DNA, 21 bp, Homo sapiens
cttgagatgtatgaaggcttt

SEQ ID NO: 6200691 - DNA, 22 bp, Homo sapiens
cttgagatgtattatgcaaagt

SEQ ID NO: 6200692 - DNA, 18 bp, Homo sapiens
cttgagattcaagacaag

SEQ ID NO: 6200693 - DNA, 21 bp, Homo sapiens
cttgagcaccaggtgttaaaa

SEQ ID NO: 6200694 - DNA, 20 bp, Homo sapiens
cttgagcactcagtctagtg

SEQ ID NO: 6200695 - DNA, 12 bp, Homo sapiens
cttgagcagaat

SEQ ID NO: 6200696 - DNA, 19 bp, Homo sapiens
cttgagcatcaatcttgtt

SEQ ID NO: 6200697 - DNA, 16 bp, Homo sapiens
cttgagcatgcccaaa

SEQ ID NO: 6200698 - DNA, 21 bp, Homo sapiens
cttgagccagttacctttgct

SEQ ID NO: 6200699 - DNA, 22 bp, Homo sapiens
cttgagccagttacctttgctg

SEQ ID NO: 6200700 - DNA, 22 bp, Homo sapiens
cttgagccatccaaagaaacac

SEQ ID NO: 6200701 - DNA, 10 bp, Homo sapiens
cttgagccca

SEQ ID NO: 6200702 - DNA, 11 bp, Homo sapiens
cttgagcccag

SEQ ID NO: 6200703 - DNA, 13 bp, Homo sapiens
cttgagcccagga

SEQ ID NO: 6200704 - DNA, 16 bp, Homo sapiens
cttgagcccaggaagt

SEQ ID NO: 6200705 - DNA, 16 bp, Homo sapiens
cttgagcccaggagtt

SEQ ID NO: 6200706 - DNA, 21 bp, Homo sapiens
cttgagccctccccaggaatt

SEQ ID NO: 6200707 - DNA, 12 bp, Homo sapiens
cttgagccctgg

SEQ ID NO: 6200708 - DNA, 14 bp, Homo sapiens
cttgagcctccatt

SEQ ID NO: 6200709 - DNA, 19 bp, Homo sapiens
cttgagcctccatttctgg

SEQ ID NO: 6200710 - DNA, 13 bp, Homo sapiens
cttgagcctcccc

SEQ ID NO: 6200711 - DNA, 15 bp, Homo sapiens
cttgagcctccccca

SEQ ID NO: 6200712 - DNA, 16 bp, Homo sapiens
cttgagcctgggaggt

SEQ ID NO: 6200713 - DNA, 17 bp, Homo sapiens
cttgagccttgaacttt

SEQ ID NO: 6200714 - DNA, 21 bp, Homo sapiens
cttgagcggagcccgatattc

SEQ ID NO: 6200715 - DNA, 16 bp, Homo sapiens
cttgagctcaggagtt

SEQ ID NO: 6200716 - DNA, 14 bp, Homo sapiens
cttgagctccccaa

SEQ ID NO: 6200717 - DNA, 22 bp, Homo sapiens
cttgagctcccctggagccagc

SEQ ID NO: 6200718 - DNA, 14 bp, Homo sapiens
cttgagctctatta

SEQ ID NO: 6200719 - DNA, 18 bp, Homo sapiens
cttgagctctattatgaa

SEQ ID NO: 6200720 - DNA, 12 bp, Homo sapiens
cttgagctctgc

SEQ ID NO: 6200721 - DNA, 13 bp, Homo sapiens
cttgagctctgta

SEQ ID NO: 6200722 - DNA, 16 bp, Homo sapiens
cttgagctctgtaact

SEQ ID NO: 6200723 - DNA, 16 bp, Homo sapiens
cttgagctgagatgga

SEQ ID NO: 6200724 - DNA, 15 bp, Homo sapiens
cttgagctgcctgct

SEQ ID NO: 6200725 - DNA, 20 bp, Homo sapiens
cttgagctgcctgctctgca

SEQ ID NO: 6200726 - DNA, 17 bp, Homo sapiens
cttgagctggcctctct

SEQ ID NO: 6200727 - DNA, 17 bp, Homo sapiens
cttgagctggttttctc

SEQ ID NO: 6200728 - DNA, 14 bp, Homo sapiens
cttgagctgtatat

SEQ ID NO: 6200729 - DNA, 13 bp, Homo sapiens
cttgagctgtctg

SEQ ID NO: 6200730 - DNA, 21 bp, Homo sapiens
cttgagcttggcagctgaact

SEQ ID NO: 6200731 - DNA, 14 bp, Homo sapiens
cttgaggaaaatat

SEQ ID NO: 6200732 - DNA, 13 bp, Homo sapiens
cttgaggaaacaa

SEQ ID NO: 6200733 - DNA, 20 bp, Homo sapiens
cttgaggaaacaacagcttt

SEQ ID NO: 6200734 - DNA, 20 bp, Homo sapiens
cttgaggaataaatgccttt

SEQ ID NO: 6200735 - DNA, 22 bp, Homo sapiens
cttgaggaataaatgcctttat

SEQ ID NO: 6200736 - DNA, 13 bp, Homo sapiens
cttgaggacacat

SEQ ID NO: 6200737 - DNA, 17 bp, Homo sapiens
cttgaggacacatgtcc

SEQ ID NO: 6200738 - DNA, 18 bp, Homo sapiens
cttgaggacacatgtcca

SEQ ID NO: 6200739 - DNA, 13 bp, Homo sapiens
cttgaggacagac

SEQ ID NO: 6200740 - DNA, 22 bp, Homo sapiens
cttgaggacctccacctgggag

SEQ ID NO: 6200741 - DNA, 17 bp, Homo sapiens
cttgaggaggggcacct

SEQ ID NO: 6200742 - DNA, 14 bp, Homo sapiens
cttgaggagtgtga

SEQ ID NO: 6200743 - DNA, 23 bp, Homo sapiens
cttgaggatggagagcagccagc

SEQ ID NO: 6200744 - DNA, 17 bp, Homo sapiens
cttgaggattttgagta

SEQ ID NO: 6200745 - DNA, 15 bp, Homo sapiens
cttgaggcagggtct

SEQ ID NO: 6200746 - DNA, 15 bp, Homo sapiens
cttgaggcctgatct

SEQ ID NO: 6200747 - DNA, 16 bp, Homo sapiens
cttgagggagcttagc

SEQ ID NO: 6200748 - DNA, 12 bp, Homo sapiens
cttgagggcctg

SEQ ID NO: 6200749 - DNA, 14 bp, Homo sapiens
cttgagggctgcag

SEQ ID NO: 6200750 - DNA, 19 bp, Homo sapiens
cttgaggggaagctagtct

SEQ ID NO: 6200751 - DNA, 23 bp, Homo sapiens
cttgaggggaagctagtcttttg

SEQ ID NO: 6200752 - DNA, 15 bp, Homo sapiens
cttgaggggaccagg

SEQ ID NO: 6200753 - DNA, 21 bp, Homo sapiens
cttgaggggaccaggagtggg

SEQ ID NO: 6200754 - DNA, 15 bp, Homo sapiens
cttgaggggcagttt

SEQ ID NO: 6200755 - DNA, 16 bp, Homo sapiens
cttgaggggccccagc

SEQ ID NO: 6200756 - DNA, 23 bp, Homo sapiens
cttgagggtaataatgatgatga

SEQ ID NO: 6200757 - DNA, 20 bp, Homo sapiens
cttgagggtcattttccttt

SEQ ID NO: 6200758 - DNA, 19 bp, Homo sapiens
cttgagggtgggccagcat

SEQ ID NO: 6200759 - DNA, 15 bp, Homo sapiens
cttgagggttgggct

SEQ ID NO: 6200760 - DNA, 17 bp, Homo sapiens
cttgagggttgggctgg

SEQ ID NO: 6200761 - DNA, 19 bp, Homo sapiens
cttgagggttgggctggtg

SEQ ID NO: 6200762 - DNA, 20 bp, Homo sapiens
cttgagggttgggctggtgt

SEQ ID NO: 6200763 - DNA, 21 bp, Homo sapiens
cttgagggttgggctggtgtc

SEQ ID NO: 6200764 - DNA, 23 bp, Homo sapiens
cttgaggtaccagttgtatttaa

SEQ ID NO: 6200765 - DNA, 15 bp, Homo sapiens
cttgaggtcaggagt

SEQ ID NO: 6200766 - DNA, 14 bp, Homo sapiens
cttgaggtcttttg

SEQ ID NO: 6200767 - DNA, 13 bp, Homo sapiens
cttgagtaaaata

SEQ ID NO: 6200768 - DNA, 14 bp, Homo sapiens
cttgagtaaaataa

SEQ ID NO: 6200769 - DNA, 22 bp, Homo sapiens
cttgagtaaaatactcttttta

SEQ ID NO: 6200770 - DNA, 17 bp, Homo sapiens
cttgagtagatctgctt

SEQ ID NO: 6200771 - DNA, 17 bp, Homo sapiens
cttgagtaggccctgct

SEQ ID NO: 6200772 - DNA, 19 bp, Homo sapiens
cttgagtaggccctgcttt

SEQ ID NO: 6200773 - DNA, 21 bp, Homo sapiens
cttgagtataagataaaataa

SEQ ID NO: 6200774 - DNA, 15 bp, Homo sapiens
cttgagtatcataat

SEQ ID NO: 6200775 - DNA, 17 bp, Homo sapiens
cttgagtatcataatat

SEQ ID NO: 6200776 - DNA, 19 bp, Homo sapiens
cttgagtcagaaaacagag

SEQ ID NO: 6200777 - DNA, 23 bp, Homo sapiens
cttgagtcagaaaacagagaaag

SEQ ID NO: 6200778 - DNA, 17 bp, Homo sapiens
cttgagtcatggatttc

SEQ ID NO: 6200779 - DNA, 21 bp, Homo sapiens
cttgagtctcaagggtggcag

SEQ ID NO: 6200780 - DNA, 23 bp, Homo sapiens
cttgagtctttaatcccagtttg

SEQ ID NO: 6200781 - DNA, 14 bp, Homo sapiens
cttgagtggacagc

SEQ ID NO: 6200782 - DNA, 18 bp, Homo sapiens
cttgagtgggccccctct

SEQ ID NO: 6200783 - DNA, 13 bp, Homo sapiens
cttgagtgtgcaa

SEQ ID NO: 6200784 - DNA, 22 bp, Homo sapiens
cttgagtgtgcaagcaaagaac

SEQ ID NO: 6200785 - DNA, 18 bp, Homo sapiens
cttgagtgttatgtgaat

SEQ ID NO: 6200786 - DNA, 19 bp, Homo sapiens
cttgagttaacaggacagt

SEQ ID NO: 6200787 - DNA, 15 bp, Homo sapiens
cttgagttaactttt

SEQ ID NO: 6200788 - DNA, 21 bp, Homo sapiens
cttgagttaactttttgtagg

SEQ ID NO: 6200789 - DNA, 17 bp, Homo sapiens
cttgagttcctctgcag

SEQ ID NO: 6200790 - DNA, 15 bp, Homo sapiens
cttgagttctgcact

SEQ ID NO: 6200791 - DNA, 23 bp, Homo sapiens
cttgagttgaagatctttgacat

SEQ ID NO: 6200792 - DNA, 18 bp, Homo sapiens
cttgagttggagtactat

SEQ ID NO: 6200793 - DNA, 21 bp, Homo sapiens
cttgagttggagtactatatt

SEQ ID NO: 6200794 - DNA, 19 bp, Homo sapiens
cttgagtttaaattgtaat

SEQ ID NO: 6200795 - DNA, 13 bp, Homo sapiens
cttgagtttgtcg

SEQ ID NO: 6200796 - DNA, 16 bp, Homo sapiens
cttgagtttgtttctt

SEQ ID NO: 6200797 - DNA, 22 bp, Homo sapiens
cttgagtttgtttcttgtgtgt

SEQ ID NO: 6200798 - DNA, 16 bp, Homo sapiens
cttgataaagggccaa

SEQ ID NO: 6200799 - DNA, 13 bp, Homo sapiens
cttgataaatata

SEQ ID NO: 6200800 - DNA, 12 bp, Homo sapiens
cttgataatata

SEQ ID NO: 6200801 - DNA, 21 bp, Homo sapiens
cttgataatattagtgattct

SEQ ID NO: 6200802 - DNA, 17 bp, Homo sapiens
cttgataatgttgtggt

SEQ ID NO: 6200803 - DNA, 21 bp, Homo sapiens
cttgataatgttgtggtttgt

SEQ ID NO: 6200804 - DNA, 15 bp, Homo sapiens
cttgatacattcaaa

SEQ ID NO: 6200805 - DNA, 18 bp, Homo sapiens
cttgatacccccctctgt

SEQ ID NO: 6200806 - DNA, 19 bp, Homo sapiens
cttgatacccccctctgtc

SEQ ID NO: 6200807 - DNA, 22 bp, Homo sapiens
cttgatacgatagttacataat

SEQ ID NO: 6200808 - DNA, 22 bp, Homo sapiens
cttgatactaaaagttcttctc

SEQ ID NO: 6200809 - DNA, 21 bp, Homo sapiens
cttgatactgaatgcataaat

SEQ ID NO: 6200810 - DNA, 22 bp, Homo sapiens
cttgatactgaatgcataaata

SEQ ID NO: 6200811 - DNA, 23 bp, Homo sapiens
cttgatagcctcattaaagcatt

SEQ ID NO: 6200812 - DNA, 15 bp, Homo sapiens
cttgataggcctagt

SEQ ID NO: 6200813 - DNA, 20 bp, Homo sapiens
cttgatataataattactta

SEQ ID NO: 6200814 - DNA, 20 bp, Homo sapiens
cttgatataattacttaatg

SEQ ID NO: 6200815 - DNA, 23 bp, Homo sapiens
cttgatataattacttaatgtga

SEQ ID NO: 6200816 - DNA, 19 bp, Homo sapiens
cttgatatatttataaata

SEQ ID NO: 6200817 - DNA, 21 bp, Homo sapiens
cttgatatatttataaatatg

SEQ ID NO: 6200818 - DNA, 15 bp, Homo sapiens
cttgatatcccaagt

SEQ ID NO: 6200819 - DNA, 20 bp, Homo sapiens
cttgatattcctacaaagaa

SEQ ID NO: 6200820 - DNA, 22 bp, Homo sapiens
cttgatattcctacaaagaaaa

SEQ ID NO: 6200821 - DNA, 14 bp, Homo sapiens
cttgatatttcctt

SEQ ID NO: 6200822 - DNA, 20 bp, Homo sapiens
cttgatcagtagtttgcatt

SEQ ID NO: 6200823 - DNA, 23 bp, Homo sapiens
aacaataaatgaatgaataacta

SEQ ID NO: 6200824 - DNA, 15 bp, Homo sapiens
aacaataactactgt

SEQ ID NO: 6200825 - DNA, 19 bp, Homo sapiens
aacaataactactgtgttc

SEQ ID NO: 6200826 - DNA, 16 bp, Homo sapiens
aacaataacttttata

SEQ ID NO: 6200827 - DNA, 17 bp, Homo sapiens
aacaataagaacaagtt

SEQ ID NO: 6200828 - DNA, 19 bp, Homo sapiens
aacaataatatttcaagtg

SEQ ID NO: 6200829 - DNA, 18 bp, Homo sapiens
aacaataatgagagcaaa

SEQ ID NO: 6200830 - DNA, 15 bp, Homo sapiens
aacaatacaacaaga

SEQ ID NO: 6200831 - DNA, 12 bp, Homo sapiens
aacaatacctga

SEQ ID NO: 6200832 - DNA, 20 bp, Homo sapiens
aacaatactcataatgtgaa

SEQ ID NO: 6200833 - DNA, 21 bp, Homo sapiens
aacaatactcataatgtgaag

SEQ ID NO: 6200834 - DNA, 20 bp, Homo sapiens
aacaatacttttcaggcact

SEQ ID NO: 6200835 - DNA, 19 bp, Homo sapiens
aacaatagctattgcatgt

SEQ ID NO: 6200836 - DNA, 23 bp, Homo sapiens
aacaataggatgggcttctgtgc

SEQ ID NO: 6200837 - DNA, 15 bp, Homo sapiens
aacaatagtaactct

SEQ ID NO: 6200838 - DNA, 16 bp, Homo sapiens
aacaatataaaccgtg

SEQ ID NO: 6200839 - DNA, 13 bp, Homo sapiens
aacaatatataga

SEQ ID NO: 6200840 - DNA, 15 bp, Homo sapiens
aacaatatatagaat

SEQ ID NO: 6200841 - DNA, 19 bp, Homo sapiens
aacaatatatgatatataa

SEQ ID NO: 6200842 - DNA, 20 bp, Homo sapiens
aacaatatatgatatataaa

SEQ ID NO: 6200843 - DNA, 23 bp, Homo sapiens
aacaatatatgatatataaacct

SEQ ID NO: 6200844 - DNA, 13 bp, Homo sapiens
aacaatatatgta

SEQ ID NO: 6200845 - DNA, 16 bp, Homo sapiens
aacaatatctgcagcg

SEQ ID NO: 6200846 - DNA, 20 bp, Homo sapiens
aacaatatgattgcactaaa

SEQ ID NO: 6200847 - DNA, 16 bp, Homo sapiens
aacaatattgtttcta

SEQ ID NO: 6200848 - DNA, 11 bp, Homo sapiens
aacaatcacaa

SEQ ID NO: 6200849 - DNA, 21 bp, Homo sapiens
aacaatcagacatgagtccac

SEQ ID NO: 6200850 - DNA, 18 bp, Homo sapiens
aacaatccaaatgcattc

SEQ ID NO: 6200851 - DNA, 19 bp, Homo sapiens
aacaatcccaatctttcta

SEQ ID NO: 6200852 - DNA, 22 bp, Homo sapiens
aacaatcctagtgctttccttt

SEQ ID NO: 6200853 - DNA, 13 bp, Homo sapiens
aacaatcctgtta

SEQ ID NO: 6200854 - DNA, 21 bp, Homo sapiens
aacaatcctgttactctgtcc

SEQ ID NO: 6200855 - DNA, 14 bp, Homo sapiens
aacaatcctttctg

SEQ ID NO: 6200856 - DNA, 16 bp, Homo sapiens
aacaatctatttaaaa

SEQ ID NO: 6200857 - DNA, 20 bp, Homo sapiens
aacaatctggaagaaaaaaa

SEQ ID NO: 6200858 - DNA, 13 bp, Homo sapiens
aacaatctttgct

SEQ ID NO: 6200859 - DNA, 18 bp, Homo sapiens
aacaatgaaaacaaataa

SEQ ID NO: 6200860 - DNA, 14 bp, Homo sapiens
aacaatgaattctt

SEQ ID NO: 6200861 - DNA, 19 bp, Homo sapiens
aacaatgacactagaaaac

SEQ ID NO: 6200862 - DNA, 15 bp, Homo sapiens
aacaatgacatttat

SEQ ID NO: 6200863 - DNA, 22 bp, Homo sapiens
aacaatgagtggacaagtcatg

SEQ ID NO: 6200864 - DNA, 14 bp, Homo sapiens
aacaatgatatatg

SEQ ID NO: 6200865 - DNA, 17 bp, Homo sapiens
aacaatgattaatcagc

SEQ ID NO: 6200866 - DNA, 17 bp, Homo sapiens
aacaatgcaacttttaa

SEQ ID NO: 6200867 - DNA, 19 bp, Homo sapiens
aacaatgcatgctttggaa

SEQ ID NO: 6200868 - DNA, 21 bp, Homo sapiens
aacaatgccgcctgtcaataa

SEQ ID NO: 6200869 - DNA, 22 bp, Homo sapiens
aacaatgccgcctgtcaataaa

SEQ ID NO: 6200870 - DNA, 16 bp, Homo sapiens
aacaatgccttgttgt

SEQ ID NO: 6200871 - DNA, 22 bp, Homo sapiens
aacaatgctttgataaaatatt

SEQ ID NO: 6200872 - DNA, 12 bp, Homo sapiens
aacaatggagat

SEQ ID NO: 6200873 - DNA, 17 bp, Homo sapiens
aacaatggagtattctc

SEQ ID NO: 6200874 - DNA, 16 bp, Homo sapiens
aacaatggtgtctctt

SEQ ID NO: 6200875 - DNA, 16 bp, Homo sapiens
aacaatggtgtggtga

SEQ ID NO: 6200876 - DNA, 21 bp, Homo sapiens
aacaatggtgtggtgaatgtg

SEQ ID NO: 6200877 - DNA, 21 bp, Homo sapiens
aacaatggttgaatgaataaa

SEQ ID NO: 6200878 - DNA, 14 bp, Homo sapiens
aacaatgtaaagta

SEQ ID NO: 6200879 - DNA, 19 bp, Homo sapiens
aacaatgtataaagattgt

SEQ ID NO: 6200880 - DNA, 20 bp, Homo sapiens
aacaatgtataaagattgta

SEQ ID NO: 6200881 - DNA, 12 bp, Homo sapiens
aacaatgtatac

SEQ ID NO: 6200882 - DNA, 15 bp, Homo sapiens
aacaatgtatacaat

SEQ ID NO: 6200883 - DNA, 21 bp, Homo sapiens
aacaatgtggagtctccctct

SEQ ID NO: 6200884 - DNA, 21 bp, Homo sapiens
aacaatgtgtctatttctgaa

SEQ ID NO: 6200885 - DNA, 21 bp, Homo sapiens
aacaatgttcaggagagtaaa

SEQ ID NO: 6200886 - DNA, 21 bp, Homo sapiens
aacaattaactgccctctgaa

SEQ ID NO: 6200887 - DNA, 15 bp, Homo sapiens
aacaattaattgtct

SEQ ID NO: 6200888 - DNA, 22 bp, Homo sapiens
aacaattaattttctatgaatt

SEQ ID NO: 6200889 - DNA, 22 bp, Homo sapiens
aacaattacatgtaaacaaata

SEQ ID NO: 6200890 - DNA, 12 bp, Homo sapiens
aacaattagagg

SEQ ID NO: 6200891 - DNA, 19 bp, Homo sapiens
aacaattaggtctgcattt

SEQ ID NO: 6200892 - DNA, 19 bp, Homo sapiens
aacaattcaagctgagaaa

SEQ ID NO: 6200893 - DNA, 21 bp, Homo sapiens
aacaattcaatcaaagctacc

SEQ ID NO: 6200894 - DNA, 22 bp, Homo sapiens
aacaattcaatcaaagctacct

SEQ ID NO: 6200895 - DNA, 17 bp, Homo sapiens
aacaattcctgtaacct

SEQ ID NO: 6200896 - DNA, 14 bp, Homo sapiens
aacaattctaaaat

SEQ ID NO: 6200897 - DNA, 23 bp, Homo sapiens
aacaattgaagtaaactttttgt

SEQ ID NO: 6200898 - DNA, 14 bp, Homo sapiens
aacaattgtcttaa

SEQ ID NO: 6200899 - DNA, 13 bp, Homo sapiens
aacaatttaaaaa

SEQ ID NO: 6200900 - DNA, 14 bp, Homo sapiens
aacaatttaaaaat

SEQ ID NO: 6200901 - DNA, 19 bp, Homo sapiens
aacaatttaaaaatgagtg

SEQ ID NO: 6200902 - DNA, 14 bp, Homo sapiens
aacaatttagccag

SEQ ID NO: 6200903 - DNA, 16 bp, Homo sapiens
aacaatttattctgat

SEQ ID NO: 6200904 - DNA, 22 bp, Homo sapiens
aacaatttattttattttagca

SEQ ID NO: 6200905 - DNA, 21 bp, Homo sapiens
aacaatttcctttatatttag

SEQ ID NO: 6200906 - DNA, 22 bp, Homo sapiens
aacaatttcctttatatttagt

SEQ ID NO: 6200907 - DNA, 19 bp, Homo sapiens
aacaatttgcataatacta

SEQ ID NO: 6200908 - DNA, 21 bp, Homo sapiens
aacaatttgcataatactaat

SEQ ID NO: 6200909 - DNA, 19 bp, Homo sapiens
aacaatttggtcttagctt

SEQ ID NO: 6200910 - DNA, 22 bp, Homo sapiens
aacaattttcagatttgcacaa

SEQ ID NO: 6200911 - DNA, 23 bp, Homo sapiens
aacaattttcagatttgcacaaa

SEQ ID NO: 6200912 - DNA, 15 bp, Homo sapiens
aacaattttctagat

SEQ ID NO: 6200913 - DNA, 20 bp, Homo sapiens
aacaattttctagatattat

SEQ ID NO: 6200914 - DNA, 12 bp, Homo sapiens
aacaatttttga

SEQ ID NO: 6200915 - DNA, 19 bp, Homo sapiens
aacaattttttgtgatgaa

SEQ ID NO: 6200916 - DNA, 21 bp, Homo sapiens
aacaattttttgtgatgaaaa

SEQ ID NO: 6200917 - DNA, 17 bp, Homo sapiens
aacaattttttttttcc

SEQ ID NO: 6200918 - DNA, 10 bp, Homo sapiens
aacacaaaaa

SEQ ID NO: 6200919 - DNA, 15 bp, Homo sapiens
aacacaaaaaaaatt

SEQ ID NO: 6200920 - DNA, 15 bp, Homo sapiens
aacacaaaaaaagac

SEQ ID NO: 6200921 - DNA, 22 bp, Homo sapiens
aacacaaaaattatctgggcat

SEQ ID NO: 6200922 - DNA, 15 bp, Homo sapiens
aacacaaaacaacaa

SEQ ID NO: 6200923 - DNA, 16 bp, Homo sapiens
aacacaaaacaacaaa

SEQ ID NO: 6200924 - DNA, 18 bp, Homo sapiens
aacacaaaacaacaaaaa

SEQ ID NO: 6200925 - DNA, 20 bp, Homo sapiens
aacacaaaatccatgggcag

SEQ ID NO: 6200926 - DNA, 15 bp, Homo sapiens
aacacaaaccacaac

SEQ ID NO: 6200927 - DNA, 13 bp, Homo sapiens
aacacaaactgta

SEQ ID NO: 6200928 - DNA, 16 bp, Homo sapiens
aacacaaactgtaaat

SEQ ID NO: 6200929 - DNA, 16 bp, Homo sapiens
aacacaaagacacagg

SEQ ID NO: 6200930 - DNA, 19 bp, Homo sapiens
aacacaaagacacaggaag

SEQ ID NO: 6200931 - DNA, 16 bp, Homo sapiens
aacacaaagacatgga

SEQ ID NO: 6200932 - DNA, 17 bp, Homo sapiens
aacacaaagacatggaa

SEQ ID NO: 6200933 - DNA, 20 bp, Homo sapiens
aacacaaagagaaaaagaaa

SEQ ID NO: 6200934 - DNA, 19 bp, Homo sapiens
aacacaaagcggggggagg

SEQ ID NO: 6200935 - DNA, 14 bp, Homo sapiens
aacacaaaggaagt

SEQ ID NO: 6200936 - DNA, 13 bp, Homo sapiens
aacacaaatgcag

SEQ ID NO: 6200937 - DNA, 20 bp, Homo sapiens
aacacaaatgcagggattgc

SEQ ID NO: 6200938 - DNA, 15 bp, Homo sapiens
aacacaaatgtgtac

SEQ ID NO: 6200939 - DNA, 17 bp, Homo sapiens
aacacaaatgtgtactt

SEQ ID NO: 6200940 - DNA, 21 bp, Homo sapiens
aacacaaattatgctaagaat

SEQ ID NO: 6200941 - DNA, 16 bp, Homo sapiens
aacacaacacaagaaa

SEQ ID NO: 6200942 - DNA, 15 bp, Homo sapiens
aacacaacattttaa

SEQ ID NO: 6200943 - DNA, 13 bp, Homo sapiens
aacacaagaaaac

SEQ ID NO: 6200944 - DNA, 19 bp, Homo sapiens
aacacaagaattacactaa

SEQ ID NO: 6200945 - DNA, 23 bp, Homo sapiens
aacacaagacaccttttgtattt

SEQ ID NO: 6200946 - DNA, 23 bp, Homo sapiens
aacacaagattggtgtttttttc

SEQ ID NO: 6200947 - DNA, 19 bp, Homo sapiens
aacacaagcaaaccttctc

SEQ ID NO: 6200948 - DNA, 16 bp, Homo sapiens
aacacaagccacagaa

SEQ ID NO: 6200949 - DNA, 20 bp, Homo sapiens
aacacaagccacgcctgcga

SEQ ID NO: 6200950 - DNA, 17 bp, Homo sapiens
aacacaaggtcatggcc

SEQ ID NO: 6200951 - DNA, 16 bp, Homo sapiens
aacacaagtcctgtga

SEQ ID NO: 6200952 - DNA, 21 bp, Homo sapiens
aacacaagtttacttgtcttt

SEQ ID NO: 6200953 - DNA, 19 bp, Homo sapiens
aacacaatggagtgtgtaa

SEQ ID NO: 6200954 - DNA, 21 bp, Homo sapiens
aacacaatgtgaaaatgtatc

SEQ ID NO: 6200955 - DNA, 14 bp, Homo sapiens
aacacacaaaggta

SEQ ID NO: 6200956 - DNA, 12 bp, Homo sapiens
aacacacaacag

SEQ ID NO: 6200957 - DNA, 14 bp, Homo sapiens
aacacacacaaaag

SEQ ID NO: 6200958 - DNA, 22 bp, Homo sapiens
aacacacacgctccctggaagc

SEQ ID NO: 6200959 - DNA, 17 bp, Homo sapiens
aacacacagactctgtg

SEQ ID NO: 6200960 - DNA, 12 bp, Homo sapiens
aacacacagtat

SEQ ID NO: 6200961 - DNA, 18 bp, Homo sapiens
aacacacagtgaccaagg

SEQ ID NO: 6200962 - DNA, 20 bp, Homo sapiens
aacacacgagcaaacccaga

SEQ ID NO: 6200963 - DNA, 19 bp, Homo sapiens
aacacacgcgcgcacacac

SEQ ID NO: 6200964 - DNA, 19 bp, Homo sapiens
aacacactaccgaatgtgt

SEQ ID NO: 6200965 - DNA, 17 bp, Homo sapiens
aacacactactacctct

SEQ ID NO: 6200966 - DNA, 18 bp, Homo sapiens
aacacactgaggcaggga

SEQ ID NO: 6200967 - DNA, 21 bp, Homo sapiens
aacacactgaggcagggaagt

SEQ ID NO: 6200968 - DNA, 12 bp, Homo sapiens
aacacactggcc

SEQ ID NO: 6200969 - DNA, 15 bp, Homo sapiens
aacacactgtaaata

SEQ ID NO: 6200970 - DNA, 16 bp, Homo sapiens
aacacacttttgcaca

SEQ ID NO: 6200971 - DNA, 20 bp, Homo sapiens
aacacagacattctgccagg

SEQ ID NO: 6200972 - DNA, 20 bp, Homo sapiens
aacacagcaagggtgatggg

SEQ ID NO: 6200973 - DNA, 16 bp, Homo sapiens
aacacagcatgtgtat

SEQ ID NO: 6200974 - DNA, 14 bp, Homo sapiens
aacacagccctgga

SEQ ID NO: 6200975 - DNA, 22 bp, Homo sapiens
aacacagccctggaaacataca

SEQ ID NO: 6200976 - DNA, 16 bp, Homo sapiens
aacacagcctccctga

SEQ ID NO: 6200977 - DNA, 13 bp, Homo sapiens
aacacagcctggg

SEQ ID NO: 6200978 - DNA, 22 bp, Homo sapiens
aacacagcctgggaccagggca

SEQ ID NO: 6200979 - DNA, 16 bp, Homo sapiens
aacacagcctgggccc

SEQ ID NO: 6200980 - DNA, 17 bp, Homo sapiens
aacacagccttccttct

SEQ ID NO: 6200981 - DNA, 22 bp, Homo sapiens
aacacagctgctgaagaggcaa

SEQ ID NO: 6200982 - DNA, 18 bp, Homo sapiens
aacacagctgttcttctg

SEQ ID NO: 6200983 - DNA, 15 bp, Homo sapiens
aacacaggcagcttt

SEQ ID NO: 6200984 - DNA, 17 bp, Homo sapiens
aacacaggcagctttct

SEQ ID NO: 6200985 - DNA, 13 bp, Homo sapiens
aacacagggaaag

SEQ ID NO: 6200986 - DNA, 19 bp, Homo sapiens
aacacaggggacacagctt

SEQ ID NO: 6200987 - DNA, 18 bp, Homo sapiens
aacacagtacctaagact

SEQ ID NO: 6200988 - DNA, 19 bp, Homo sapiens
aacacagtagtgttctgtt

SEQ ID NO: 6200989 - DNA, 17 bp, Homo sapiens
aacacagtattgtagaa

SEQ ID NO: 6200990 - DNA, 22 bp, Homo sapiens
aacacagtcattctaggatgtg

SEQ ID NO: 6200991 - DNA, 17 bp, Homo sapiens
aacacagttctgggcaa

SEQ ID NO: 6200992 - DNA, 21 bp, Homo sapiens
aacacagttgaccctattttt

SEQ ID NO: 6200993 - DNA, 13 bp, Homo sapiens
aacacagtttagt

SEQ ID NO: 6200994 - DNA, 22 bp, Homo sapiens
aacacataaacaattcatgcct

SEQ ID NO: 6200995 - DNA, 17 bp, Homo sapiens
aacacataaagtaaatg

SEQ ID NO: 6200996 - DNA, 23 bp, Homo sapiens
aacacataaagtaaatgctacct

SEQ ID NO: 6200997 - DNA, 15 bp, Homo sapiens
aacacataaatgaaa

SEQ ID NO: 6200998 - DNA, 19 bp, Homo sapiens
aacacataaatgaaagaaa

SEQ ID NO: 6200999 - DNA, 13 bp, Homo sapiens
aacacataacaaa

SEQ ID NO: 6201000 - DNA, 17 bp, Homo sapiens
aacacataattaacact

SEQ ID NO: 6201001 - DNA, 19 bp, Homo sapiens
cttgatcatgaatcactgc

SEQ ID NO: 6201002 - DNA, 14 bp, Homo sapiens
cttgatccagaaga

SEQ ID NO: 6201003 - DNA, 16 bp, Homo sapiens
cttgatccatttctaa

SEQ ID NO: 6201004 - DNA, 20 bp, Homo sapiens
cttgatccatttctaattat

SEQ ID NO: 6201005 - DNA, 17 bp, Homo sapiens
cttgatcctccaatgtc

SEQ ID NO: 6201006 - DNA, 16 bp, Homo sapiens
cttgatctatctacaa

SEQ ID NO: 6201007 - DNA, 19 bp, Homo sapiens
cttgatctatctacaaaga

SEQ ID NO: 6201008 - DNA, 17 bp, Homo sapiens
cttgatctcctgacctc

SEQ ID NO: 6201009 - DNA, 14 bp, Homo sapiens
cttgatctctaatg

SEQ ID NO: 6201010 - DNA, 15 bp, Homo sapiens
cttgatctctcttgt

SEQ ID NO: 6201011 - DNA, 16 bp, Homo sapiens
cttgatctctcttgtc

SEQ ID NO: 6201012 - DNA, 17 bp, Homo sapiens
cttgatctgctcagccc

SEQ ID NO: 6201013 - DNA, 18 bp, Homo sapiens
cttgatctgctcagccct

SEQ ID NO: 6201014 - DNA, 20 bp, Homo sapiens
cttgatctgctcagccctgg

SEQ ID NO: 6201015 - DNA, 22 bp, Homo sapiens
cttgatctgtatatacaataac

SEQ ID NO: 6201016 - DNA, 14 bp, Homo sapiens
cttgatctgtgatt

SEQ ID NO: 6201017 - DNA, 15 bp, Homo sapiens
cttgatctgtgattt

SEQ ID NO: 6201018 - DNA, 13 bp, Homo sapiens
cttgatcttaaag

SEQ ID NO: 6201019 - DNA, 14 bp, Homo sapiens
cttgatctttgagc

SEQ ID NO: 6201020 - DNA, 12 bp, Homo sapiens
cttgatgaagaa

SEQ ID NO: 6201021 - DNA, 13 bp, Homo sapiens
cttgatgaagcaa

SEQ ID NO: 6201022 - DNA, 13 bp, Homo sapiens
cttgatgaagccc

SEQ ID NO: 6201023 - DNA, 15 bp, Homo sapiens
cttgatgaagcctgt

SEQ ID NO: 6201024 - DNA, 18 bp, Homo sapiens
cttgatgaagcctgtgcc

SEQ ID NO: 6201025 - DNA, 22 bp, Homo sapiens
cttgatgaaggtcatctttttc

SEQ ID NO: 6201026 - DNA, 21 bp, Homo sapiens
cttgatgaccaaagtcctttt

SEQ ID NO: 6201027 - DNA, 13 bp, Homo sapiens
cttgatgactgcc

SEQ ID NO: 6201028 - DNA, 14 bp, Homo sapiens
cttgatgactgcct

SEQ ID NO: 6201029 - DNA, 15 bp, Homo sapiens
cttgatgactgctga

SEQ ID NO: 6201030 - DNA, 16 bp, Homo sapiens
cttgatgactgctgat

SEQ ID NO: 6201031 - DNA, 18 bp, Homo sapiens
cttgatgactgctgattt

SEQ ID NO: 6201032 - DNA, 17 bp, Homo sapiens
cttgatgactggaattt

SEQ ID NO: 6201033 - DNA, 20 bp, Homo sapiens
cttgatgactggaattttta

SEQ ID NO: 6201034 - DNA, 19 bp, Homo sapiens
cttgatgagtgtaacaaga

SEQ ID NO: 6201035 - DNA, 13 bp, Homo sapiens
cttgatgatgtgg

SEQ ID NO: 6201036 - DNA, 15 bp, Homo sapiens
cttgatgcacagaga

SEQ ID NO: 6201037 - DNA, 18 bp, Homo sapiens
cttgatgcacagagaagc

SEQ ID NO: 6201038 - DNA, 13 bp, Homo sapiens
cttgatgcactta

SEQ ID NO: 6201039 - DNA, 13 bp, Homo sapiens
cttgatgcatgtg

SEQ ID NO: 6201040 - DNA, 20 bp, Homo sapiens
cttgatgccaaaatgacttt

SEQ ID NO: 6201041 - DNA, 13 bp, Homo sapiens
cttgatgccagag

SEQ ID NO: 6201042 - DNA, 15 bp, Homo sapiens
cttgatgccagaggg

SEQ ID NO: 6201043 - DNA, 20 bp, Homo sapiens
cttgatgccagagggccagc

SEQ ID NO: 6201044 - DNA, 23 bp, Homo sapiens
cttgatgccagagggccagcagg

SEQ ID NO: 6201045 - DNA, 19 bp, Homo sapiens
cttgatgccagtaggctca

SEQ ID NO: 6201046 - DNA, 21 bp, Homo sapiens
cttgatggaagtgggccagtc

SEQ ID NO: 6201047 - DNA, 23 bp, Homo sapiens
cttgatggaagtgggccagtcct

SEQ ID NO: 6201048 - DNA, 16 bp, Homo sapiens
cttgatggagaaggaa

SEQ ID NO: 6201049 - DNA, 15 bp, Homo sapiens
cttgatggattttca

SEQ ID NO: 6201050 - DNA, 21 bp, Homo sapiens
cttgatggctccgaacaccct

SEQ ID NO: 6201051 - DNA, 17 bp, Homo sapiens
cttgatgggattctgga

SEQ ID NO: 6201052 - DNA, 19 bp, Homo sapiens
cttgatgggattctggaca

SEQ ID NO: 6201053 - DNA, 16 bp, Homo sapiens
cttgatgggtgctgcc

SEQ ID NO: 6201054 - DNA, 16 bp, Homo sapiens
cttgatggtcagacac

SEQ ID NO: 6201055 - DNA, 22 bp, Homo sapiens
cttgatggtcagacacaaacaa

SEQ ID NO: 6201056 - DNA, 19 bp, Homo sapiens
cttgatggtgacagctgca

SEQ ID NO: 6201057 - DNA, 20 bp, Homo sapiens
cttgatggtgacagctgcaa

SEQ ID NO: 6201058 - DNA, 20 bp, Homo sapiens
cttgatgtaaaatcttgtca

SEQ ID NO: 6201059 - DNA, 22 bp, Homo sapiens
cttgatgtacataactcctgtc

SEQ ID NO: 6201060 - DNA, 13 bp, Homo sapiens
cttgatgtatttc

SEQ ID NO: 6201061 - DNA, 20 bp, Homo sapiens
cttgatgtgatgtggcagga

SEQ ID NO: 6201062 - DNA, 12 bp, Homo sapiens
cttgatgtgcct

SEQ ID NO: 6201063 - DNA, 20 bp, Homo sapiens
cttgatgttcagacatttat

SEQ ID NO: 6201064 - DNA, 18 bp, Homo sapiens
cttgatgttccacctgcc

SEQ ID NO: 6201065 - DNA, 21 bp, Homo sapiens
cttgatgttccacctgccaca

SEQ ID NO: 6201066 - DNA, 13 bp, Homo sapiens
cttgatgtttaga

SEQ ID NO: 6201067 - DNA, 15 bp, Homo sapiens
cttgatgtttagaaa

SEQ ID NO: 6201068 - DNA, 17 bp, Homo sapiens
cttgatgtttcctggaa

SEQ ID NO: 6201069 - DNA, 18 bp, Homo sapiens
cttgatgtttcctggaag

SEQ ID NO: 6201070 - DNA, 20 bp, Homo sapiens
cttgatgtttcctggaagca

SEQ ID NO: 6201071 - DNA, 21 bp, Homo sapiens
cttgatgtttcctggaagcag

SEQ ID NO: 6201072 - DNA, 16 bp, Homo sapiens
cttgatgtttctatat

SEQ ID NO: 6201073 - DNA, 19 bp, Homo sapiens
cttgatgtttctatatgta

SEQ ID NO: 6201074 - DNA, 16 bp, Homo sapiens
cttgatgtttgttaga

SEQ ID NO: 6201075 - DNA, 17 bp, Homo sapiens
cttgatgtttgttagac

SEQ ID NO: 6201076 - DNA, 19 bp, Homo sapiens
cttgatgttttttctgtaa

SEQ ID NO: 6201077 - DNA, 14 bp, Homo sapiens
cttgattaaacagc

SEQ ID NO: 6201078 - DNA, 22 bp, Homo sapiens
cttgattaaacagcaaagccat

SEQ ID NO: 6201079 - DNA, 13 bp, Homo sapiens
cttgattaaatca

SEQ ID NO: 6201080 - DNA, 20 bp, Homo sapiens
cttgattaagattttacaaa

SEQ ID NO: 6201081 - DNA, 19 bp, Homo sapiens
cttgattaatgtacttttt

SEQ ID NO: 6201082 - DNA, 22 bp, Homo sapiens
cttgattataaatgtttggaaa

SEQ ID NO: 6201083 - DNA, 23 bp, Homo sapiens
cttgattataccactgcactcca

SEQ ID NO: 6201084 - DNA, 16 bp, Homo sapiens
cttgattatccatatt

SEQ ID NO: 6201085 - DNA, 22 bp, Homo sapiens
cttgattcaggaggtcatctga

SEQ ID NO: 6201086 - DNA, 15 bp, Homo sapiens
cttgattcagtcaca

SEQ ID NO: 6201087 - DNA, 19 bp, Homo sapiens
cttgattcataatgactta

SEQ ID NO: 6201088 - DNA, 14 bp, Homo sapiens
cttgattcattctg

SEQ ID NO: 6201089 - DNA, 19 bp, Homo sapiens
cttgattccaacaggcgtg

SEQ ID NO: 6201090 - DNA, 23 bp, Homo sapiens
cttgattcctggctctaccctgt

SEQ ID NO: 6201091 - DNA, 21 bp, Homo sapiens
cttgattcctggtttgactca

SEQ ID NO: 6201092 - DNA, 22 bp, Homo sapiens
cttgattcgtagatttaataac

SEQ ID NO: 6201093 - DNA, 13 bp, Homo sapiens
cttgattctaaag

SEQ ID NO: 6201094 - DNA, 20 bp, Homo sapiens
cttgattctaaaggggacag

SEQ ID NO: 6201095 - DNA, 21 bp, Homo sapiens
cttgattctgcagtaaatctt

SEQ ID NO: 6201096 - DNA, 22 bp, Homo sapiens
cttgattctgcagtaaatcttt

SEQ ID NO: 6201097 - DNA, 17 bp, Homo sapiens
cttgattgagaaagatg

SEQ ID NO: 6201098 - DNA, 20 bp, Homo sapiens
cttgattgatttttaaagtt

SEQ ID NO: 6201099 - DNA, 21 bp, Homo sapiens
cttgattgatttttaaagttt

SEQ ID NO: 6201100 - DNA, 13 bp, Homo sapiens
cttgattggaagg

SEQ ID NO: 6201101 - DNA, 14 bp, Homo sapiens
cttgatttacaagc

SEQ ID NO: 6201102 - DNA, 21 bp, Homo sapiens
cttgatttatcacacaaagca

SEQ ID NO: 6201103 - DNA, 22 bp, Homo sapiens
cttgatttatcacacaaagcag

SEQ ID NO: 6201104 - DNA, 21 bp, Homo sapiens
cttgatttgaccactgacagc

SEQ ID NO: 6201105 - DNA, 19 bp, Homo sapiens
cttgatttgatgtgacttt

SEQ ID NO: 6201106 - DNA, 13 bp, Homo sapiens
cttgatttgcatg

SEQ ID NO: 6201107 - DNA, 18 bp, Homo sapiens
cttgatttgcatggattt

SEQ ID NO: 6201108 - DNA, 17 bp, Homo sapiens
cttgatttgttcttaca

SEQ ID NO: 6201109 - DNA, 18 bp, Homo sapiens
cttgattttaatacattg

SEQ ID NO: 6201110 - DNA, 19 bp, Homo sapiens
cttgattttaattcaggtg

SEQ ID NO: 6201111 - DNA, 14 bp, Homo sapiens
cttgattttcaagc

SEQ ID NO: 6201112 - DNA, 22 bp, Homo sapiens
cttgattttccatctaaaaata

SEQ ID NO: 6201113 - DNA, 23 bp, Homo sapiens
cttgattttccatctaaaaatat

SEQ ID NO: 6201114 - DNA, 22 bp, Homo sapiens
cttgattttcctaatggtctca

SEQ ID NO: 6201115 - DNA, 16 bp, Homo sapiens
cttgatttttcaaaga

SEQ ID NO: 6201116 - DNA, 14 bp, Homo sapiens
cttgattttttcaa

SEQ ID NO: 6201117 - DNA, 19 bp, Homo sapiens
cttgatttttttaaacata

SEQ ID NO: 6201118 - DNA, 15 bp, Homo sapiens
cttgcaaaaagggtc

SEQ ID NO: 6201119 - DNA, 16 bp, Homo sapiens
cttgcaaaatcagttt

SEQ ID NO: 6201120 - DNA, 22 bp, Homo sapiens
cttgcaaaatcagttttcctct

SEQ ID NO: 6201121 - DNA, 16 bp, Homo sapiens
cttgcaaaattcctga

SEQ ID NO: 6201122 - DNA, 21 bp, Homo sapiens
cttgcaaagacctacctccag

SEQ ID NO: 6201123 - DNA, 14 bp, Homo sapiens
cttgcaaatgaatg

SEQ ID NO: 6201124 - DNA, 22 bp, Homo sapiens
cttgcaaatgaatgcctttcaa

SEQ ID NO: 6201125 - DNA, 21 bp, Homo sapiens
cttgcaaatgttgtatttcaa

SEQ ID NO: 6201126 - DNA, 16 bp, Homo sapiens
cttgcaaccaggcagc

SEQ ID NO: 6201127 - DNA, 19 bp, Homo sapiens
cttgcaacctcaccttcct

SEQ ID NO: 6201128 - DNA, 21 bp, Homo sapiens
cttgcaacctcaccttcctgt

SEQ ID NO: 6201129 - DNA, 22 bp, Homo sapiens
cttgcaagaatcagtgcaaaga

SEQ ID NO: 6201130 - DNA, 15 bp, Homo sapiens
cttgcaagaggaggt

SEQ ID NO: 6201131 - DNA, 16 bp, Homo sapiens
cttgcaagcatgcttg

SEQ ID NO: 6201132 - DNA, 18 bp, Homo sapiens
cttgcaagcatgcttgtg

SEQ ID NO: 6201133 - DNA, 11 bp, Homo sapiens
cttgcaagcca

SEQ ID NO: 6201134 - DNA, 13 bp, Homo sapiens
cttgcaagccata

SEQ ID NO: 6201135 - DNA, 21 bp, Homo sapiens
cttgcaagggaagagccttta

SEQ ID NO: 6201136 - DNA, 18 bp, Homo sapiens
cttgcaatccaggctgtt

SEQ ID NO: 6201137 - DNA, 22 bp, Homo sapiens
cttgcaatccaggctgttctca

SEQ ID NO: 6201138 - DNA, 13 bp, Homo sapiens
cttgcaatctaat

SEQ ID NO: 6201139 - DNA, 16 bp, Homo sapiens
cttgcaatgagccaag

SEQ ID NO: 6201140 - DNA, 15 bp, Homo sapiens
cttgcaatggcagcc

SEQ ID NO: 6201141 - DNA, 16 bp, Homo sapiens
cttgcaatggcagcct

SEQ ID NO: 6201142 - DNA, 17 bp, Homo sapiens
cttgcaatggcagcctt

SEQ ID NO: 6201143 - DNA, 18 bp, Homo sapiens
cttgcaattagcattctg

SEQ ID NO: 6201144 - DNA, 22 bp, Homo sapiens
cttgcaattgttaatcaaagat

SEQ ID NO: 6201145 - DNA, 19 bp, Homo sapiens
cttgcacaagcttgtatat

SEQ ID NO: 6201146 - DNA, 16 bp, Homo sapiens
cttgcacacactttca

SEQ ID NO: 6201147 - DNA, 19 bp, Homo sapiens
cttgcacacagggaggctg

SEQ ID NO: 6201148 - DNA, 20 bp, Homo sapiens
cttgcacacatcatctgtaa

SEQ ID NO: 6201149 - DNA, 19 bp, Homo sapiens
cttgcacacccactgcccc

SEQ ID NO: 6201150 - DNA, 17 bp, Homo sapiens
cttgcacacttccccat

SEQ ID NO: 6201151 - DNA, 17 bp, Homo sapiens
cttgcacagctggagaa

SEQ ID NO: 6201152 - DNA, 15 bp, Homo sapiens
cttgcacatctctgc

SEQ ID NO: 6201153 - DNA, 16 bp, Homo sapiens
cttgcacccctcactc

SEQ ID NO: 6201154 - DNA, 13 bp, Homo sapiens
cttgcacccgcaa

SEQ ID NO: 6201155 - DNA, 18 bp, Homo sapiens
cttgcacccgcaagtcaa

SEQ ID NO: 6201156 - DNA, 18 bp, Homo sapiens
cttgcacccgcctctccc

SEQ ID NO: 6201157 - DNA, 15 bp, Homo sapiens
cttgcacctgagcct

SEQ ID NO: 6201158 - DNA, 14 bp, Homo sapiens
cttgcacctgcatc

SEQ ID NO: 6201159 - DNA, 23 bp, Homo sapiens
cttgcaccttatagttcatagca

SEQ ID NO: 6201160 - DNA, 21 bp, Homo sapiens
cttgcaccttttcatgtacag

SEQ ID NO: 6201161 - DNA, 19 bp, Homo sapiens
cttgcacgtattttaatag

SEQ ID NO: 6201162 - DNA, 21 bp, Homo sapiens
cttgcactaaagtatgtaaag

SEQ ID NO: 6201163 - DNA, 14 bp, Homo sapiens
cttgcactattcca

SEQ ID NO: 6201164 - DNA, 17 bp, Homo sapiens
cttgcactattggactt

SEQ ID NO: 6201165 - DNA, 18 bp, Homo sapiens
cttgcactattggacttt

SEQ ID NO: 6201166 - DNA, 17 bp, Homo sapiens
cttgcactcttctacca

SEQ ID NO: 6201167 - DNA, 14 bp, Homo sapiens
cttgcactgaagcc

SEQ ID NO: 6201168 - DNA, 22 bp, Homo sapiens
cttgcactgaagccggacagct

SEQ ID NO: 6201169 - DNA, 23 bp, Homo sapiens
cttgcactgaagccggacagctg

SEQ ID NO: 6201170 - DNA, 16 bp, Homo sapiens
cttgcactgaatatat

SEQ ID NO: 6201171 - DNA, 16 bp, Homo sapiens
cttgcactgatgtccc

SEQ ID NO: 6201172 - DNA, 22 bp, Homo sapiens
cttgcactgatgtccctccttt

SEQ ID NO: 6201173 - DNA, 23 bp, Homo sapiens
cttgcactgatgtccctcctttt

SEQ ID NO: 6201174 - DNA, 18 bp, Homo sapiens
cttgcactggccttctga

SEQ ID NO: 6201175 - DNA, 19 bp, Homo sapiens
cttgcactggccttctgat

SEQ ID NO: 6201176 - DNA, 22 bp, Homo sapiens
cttgcactgtatcatttcatgc

SEQ ID NO: 6201177 - DNA, 13 bp, Homo sapiens
cttgcactgtcca

SEQ ID NO: 6201178 - DNA, 19 bp, Homo sapiens
gacagaacattgccttcct

SEQ ID NO: 6201179 - DNA, 20 bp, Homo sapiens
gacagaacattgccttcctc

SEQ ID NO: 6201180 - DNA, 22 bp, Homo sapiens
gacagaacattgccttcctcgt

SEQ ID NO: 6201181 - DNA, 18 bp, Homo sapiens
gacagaaccaacgggtct

SEQ ID NO: 6201182 - DNA, 14 bp, Homo sapiens
gacagaaccagcag

SEQ ID NO: 6201183 - DNA, 13 bp, Homo sapiens
gacagaagcagga

SEQ ID NO: 6201184 - DNA, 15 bp, Homo sapiens
gacagaagcaggctg

SEQ ID NO: 6201185 - DNA, 17 bp, Homo sapiens
gacagaagctatttcat

SEQ ID NO: 6201186 - DNA, 16 bp, Homo sapiens
gacagaaggactggtg

SEQ ID NO: 6201187 - DNA, 20 bp, Homo sapiens
gacagaaggccttgaagaat

SEQ ID NO: 6201188 - DNA, 14 bp, Homo sapiens
gacagaaggctcct

SEQ ID NO: 6201189 - DNA, 14 bp, Homo sapiens
gacagaaggtgcca

SEQ ID NO: 6201190 - DNA, 15 bp, Homo sapiens
gacagaagtctcctc

SEQ ID NO: 6201191 - DNA, 17 bp, Homo sapiens
gacagaagtctcctcaa

SEQ ID NO: 6201192 - DNA, 22 bp, Homo sapiens
gacagaagtttgcactatcttt

SEQ ID NO: 6201193 - DNA, 18 bp, Homo sapiens
gacagaatatacacattt

SEQ ID NO: 6201194 - DNA, 23 bp, Homo sapiens
gacagaatgatatccagtaagca

SEQ ID NO: 6201195 - DNA, 16 bp, Homo sapiens
gacagaatgtgttctt

SEQ ID NO: 6201196 - DNA, 13 bp, Homo sapiens
gacagaattctcc

SEQ ID NO: 6201197 - DNA, 13 bp, Homo sapiens
gacagacacacac

SEQ ID NO: 6201198 - DNA, 15 bp, Homo sapiens
gacagacacacacac

SEQ ID NO: 6201199 - DNA, 16 bp, Homo sapiens
gacagacacaggcccg

SEQ ID NO: 6201200 - DNA, 18 bp, Homo sapiens
gacagacaccacagcctc

SEQ ID NO: 6201201 - DNA, 21 bp, Homo sapiens
gacagacaccacagcctcccc

SEQ ID NO: 6201202 - DNA, 15 bp, Homo sapiens
gacagacacctcccc

SEQ ID NO: 6201203 - DNA, 23 bp, Homo sapiens
gacagacacttctaaatgaagtg

SEQ ID NO: 6201204 - DNA, 12 bp, Homo sapiens
gacagacagcag

SEQ ID NO: 6201205 - DNA, 14 bp, Homo sapiens
gacagacagcagct

SEQ ID NO: 6201206 - DNA, 15 bp, Homo sapiens
gacagacagcagctg

SEQ ID NO: 6201207 - DNA, 13 bp, Homo sapiens
gacagacagccag

SEQ ID NO: 6201208 - DNA, 17 bp, Homo sapiens
gacagacagccaggtag

SEQ ID NO: 6201209 - DNA, 19 bp, Homo sapiens
gacagacatcaagtgccag

SEQ ID NO: 6201210 - DNA, 18 bp, Homo sapiens
gacagacatctctgcacc

SEQ ID NO: 6201211 - DNA, 15 bp, Homo sapiens
gacagaccacttgcc

SEQ ID NO: 6201212 - DNA, 15 bp, Homo sapiens
gacagaccagcagca

SEQ ID NO: 6201213 - DNA, 15 bp, Homo sapiens
gacagaccagccctt

SEQ ID NO: 6201214 - DNA, 15 bp, Homo sapiens
gacagacccaggtct

SEQ ID NO: 6201215 - DNA, 14 bp, Homo sapiens
gacagacccagtga

SEQ ID NO: 6201216 - DNA, 16 bp, Homo sapiens
gacagacccagtgagt

SEQ ID NO: 6201217 - DNA, 19 bp, Homo sapiens
gacagaccccttggctttt

SEQ ID NO: 6201218 - DNA, 17 bp, Homo sapiens
gacagaccctctgccgc

SEQ ID NO: 6201219 - DNA, 22 bp, Homo sapiens
gacagaccggggttcaagccat

SEQ ID NO: 6201220 - DNA, 14 bp, Homo sapiens
gacagacgagacaa

SEQ ID NO: 6201221 - DNA, 16 bp, Homo sapiens
gacagacgcatgtggc

SEQ ID NO: 6201222 - DNA, 21 bp, Homo sapiens
gacagacggaaatgaaattgt

SEQ ID NO: 6201223 - DNA, 18 bp, Homo sapiens
gacagacggacgggacag

SEQ ID NO: 6201224 - DNA, 17 bp, Homo sapiens
gacagactcactgggaa

SEQ ID NO: 6201225 - DNA, 22 bp, Homo sapiens
gacagactgcaagaggctcctg

SEQ ID NO: 6201226 - DNA, 17 bp, Homo sapiens
gacagactggattaaaa

SEQ ID NO: 6201227 - DNA, 13 bp, Homo sapiens
gacagactggccg

SEQ ID NO: 6201228 - DNA, 18 bp, Homo sapiens
gacagactttggacagtg

SEQ ID NO: 6201229 - DNA, 21 bp, Homo sapiens
gacagactttggacagtggcc

SEQ ID NO: 6201230 - DNA, 22 bp, Homo sapiens
gacagactttggacagtggcct

SEQ ID NO: 6201231 - DNA, 14 bp, Homo sapiens
gacagagaaatgtg

SEQ ID NO: 6201232 - DNA, 17 bp, Homo sapiens
gacagagaaggcagcag

SEQ ID NO: 6201233 - DNA, 21 bp, Homo sapiens
gacagagaaggttcttcttat

SEQ ID NO: 6201234 - DNA, 13 bp, Homo sapiens
gacagagaatctt

SEQ ID NO: 6201235 - DNA, 21 bp, Homo sapiens
gacagagacacctgcacctcc

SEQ ID NO: 6201236 - DNA, 18 bp, Homo sapiens
gacagagacccagatctc

SEQ ID NO: 6201237 - DNA, 20 bp, Homo sapiens
gacagagaccctctgccacc

SEQ ID NO: 6201238 - DNA, 19 bp, Homo sapiens
gacagagactcagcgctcc

SEQ ID NO: 6201239 - DNA, 22 bp, Homo sapiens
gacagagactcagcgctcctcc

SEQ ID NO: 6201240 - DNA, 23 bp, Homo sapiens
gacagagactcagcgctcctcct

SEQ ID NO: 6201241 - DNA, 24 bp, Homo sapiens
gacagagactcagcgctcctcctg

SEQ ID NO: 6201242 - DNA, 13 bp, Homo sapiens
gacagagagagac

SEQ ID NO: 6201243 - DNA, 14 bp, Homo sapiens
gacagagagagaga

SEQ ID NO: 6201244 - DNA, 21 bp, Homo sapiens
gacagagagagatactctggg

SEQ ID NO: 6201245 - DNA, 13 bp, Homo sapiens
gacagagagatga

SEQ ID NO: 6201246 - DNA, 15 bp, Homo sapiens
gacagagaggactgt

SEQ ID NO: 6201247 - DNA, 16 bp, Homo sapiens
gacagagaggactgta

SEQ ID NO: 6201248 - DNA, 17 bp, Homo sapiens
gacagagcaaagcgccc

SEQ ID NO: 6201249 - DNA, 20 bp, Homo sapiens
gacagagcaagaccctgcct

SEQ ID NO: 6201250 - DNA, 13 bp, Homo sapiens
gacagagcaggct

SEQ ID NO: 6201251 - DNA, 15 bp, Homo sapiens
gacagagcaggcttt

SEQ ID NO: 6201252 - DNA, 22 bp, Homo sapiens
gacagagcaggctttgtgagag

SEQ ID NO: 6201253 - DNA, 18 bp, Homo sapiens
gacagagcaggggctcca

SEQ ID NO: 6201254 - DNA, 21 bp, Homo sapiens
gacagagcaggggctccagca

SEQ ID NO: 6201255 - DNA, 16 bp, Homo sapiens
gacagagccaagcact

SEQ ID NO: 6201256 - DNA, 20 bp, Homo sapiens
gacagagccaccccatgagc

SEQ ID NO: 6201257 - DNA, 19 bp, Homo sapiens
gacagagccatgctgggaa

SEQ ID NO: 6201258 - DNA, 21 bp, Homo sapiens
gacagagccccaccctcagat

SEQ ID NO: 6201259 - DNA, 14 bp, Homo sapiens
gacagagcccccct

SEQ ID NO: 6201260 - DNA, 21 bp, Homo sapiens
gacagagccctatctatgtcc

SEQ ID NO: 6201261 - DNA, 19 bp, Homo sapiens
gacagagccgcaaatcaac

SEQ ID NO: 6201262 - DNA, 21 bp, Homo sapiens
gacagagcctgccccagcgct

SEQ ID NO: 6201263 - DNA, 23 bp, Homo sapiens
gacagagcgtgagctgagcaggc

SEQ ID NO: 6201264 - DNA, 18 bp, Homo sapiens
gacagaggaaagggctgg

SEQ ID NO: 6201265 - DNA, 14 bp, Homo sapiens
gacagaggaggatg

SEQ ID NO: 6201266 - DNA, 12 bp, Homo sapiens
gacagaggaggg

SEQ ID NO: 6201267 - DNA, 12 bp, Homo sapiens
gacagaggcagc

SEQ ID NO: 6201268 - DNA, 17 bp, Homo sapiens
gacagaggcagccccat

SEQ ID NO: 6201269 - DNA, 16 bp, Homo sapiens
gacagaggcagggcag

SEQ ID NO: 6201270 - DNA, 12 bp, Homo sapiens
gacagaggccct

SEQ ID NO: 6201271 - DNA, 18 bp, Homo sapiens
gacagaggccctgccacg

SEQ ID NO: 6201272 - DNA, 21 bp, Homo sapiens
gacagaggccctgccacgtcc

SEQ ID NO: 6201273 - DNA, 15 bp, Homo sapiens
gacagaggccggggt

SEQ ID NO: 6201274 - DNA, 19 bp, Homo sapiens
gacagagggaagaaaagag

SEQ ID NO: 6201275 - DNA, 19 bp, Homo sapiens
gacagagggaagccagtca

SEQ ID NO: 6201276 - DNA, 16 bp, Homo sapiens
gacagagggagaaggg

SEQ ID NO: 6201277 - DNA, 18 bp, Homo sapiens
gacagagggagacagggc

SEQ ID NO: 6201278 - DNA, 12 bp, Homo sapiens
gacagagggcac

SEQ ID NO: 6201279 - DNA, 19 bp, Homo sapiens
gacagagggcacatgaaca

SEQ ID NO: 6201280 - DNA, 19 bp, Homo sapiens
gacagaggggactctgggc

SEQ ID NO: 6201281 - DNA, 16 bp, Homo sapiens
gacagaggggagcagt

SEQ ID NO: 6201282 - DNA, 24 bp, Homo sapiens
gacagaggggagcagtggccatca

SEQ ID NO: 6201283 - DNA, 13 bp, Homo sapiens
gacagagggggtg

SEQ ID NO: 6201284 - DNA, 21 bp, Homo sapiens
gacagaggtttgaaggagaat

SEQ ID NO: 6201285 - DNA, 16 bp, Homo sapiens
gacagagtatgaacac

SEQ ID NO: 6201286 - DNA, 14 bp, Homo sapiens
gacagagtctcact

SEQ ID NO: 6201287 - DNA, 15 bp, Homo sapiens
gacagagtctcgctc

SEQ ID NO: 6201288 - DNA, 13 bp, Homo sapiens
gacagagtctggg

SEQ ID NO: 6201289 - DNA, 15 bp, Homo sapiens
gacagagtctgggtg

SEQ ID NO: 6201290 - DNA, 22 bp, Homo sapiens
gacagagtgagaccctgtctca

SEQ ID NO: 6201291 - DNA, 20 bp, Homo sapiens
gacagagtgagactctgtct

SEQ ID NO: 6201292 - DNA, 19 bp, Homo sapiens
gacagagtgccctggggca

SEQ ID NO: 6201293 - DNA, 13 bp, Homo sapiens
gacagagtggatc

SEQ ID NO: 6201294 - DNA, 18 bp, Homo sapiens
gacagagtggatctggag

SEQ ID NO: 6201295 - DNA, 13 bp, Homo sapiens
gacagagttcaca

SEQ ID NO: 6201296 - DNA, 17 bp, Homo sapiens
gacagagttcacaggag

SEQ ID NO: 6201297 - DNA, 19 bp, Homo sapiens
gacagagttcacaggaggc

SEQ ID NO: 6201298 - DNA, 22 bp, Homo sapiens
gacagagttcacaggaggccag

SEQ ID NO: 6201299 - DNA, 23 bp, Homo sapiens
gacagagttcagggaggggctga

SEQ ID NO: 6201300 - DNA, 21 bp, Homo sapiens
gacagataaatccttaacatt

SEQ ID NO: 6201301 - DNA, 13 bp, Homo sapiens
gacagataactct

SEQ ID NO: 6201302 - DNA, 17 bp, Homo sapiens
gacagatacctccaacc

SEQ ID NO: 6201303 - DNA, 23 bp, Homo sapiens
gacagatagacagtgctgccctg

SEQ ID NO: 6201304 - DNA, 16 bp, Homo sapiens
gacagatatttcaaac

SEQ ID NO: 6201305 - DNA, 22 bp, Homo sapiens
gacagatattttatctattggc

SEQ ID NO: 6201306 - DNA, 16 bp, Homo sapiens
gacagatcaagctgtg

SEQ ID NO: 6201307 - DNA, 14 bp, Homo sapiens
gacagatcactcct

SEQ ID NO: 6201308 - DNA, 23 bp, Homo sapiens
gacagatcataggaagtggctgg

SEQ ID NO: 6201309 - DNA, 16 bp, Homo sapiens
gacagatcctccattt

SEQ ID NO: 6201310 - DNA, 19 bp, Homo sapiens
gacagatcctccatttttg

SEQ ID NO: 6201311 - DNA, 17 bp, Homo sapiens
gacagatctagttctct

SEQ ID NO: 6201312 - DNA, 18 bp, Homo sapiens
gacagatcttgagcaagg

SEQ ID NO: 6201313 - DNA, 16 bp, Homo sapiens
gacagatgaaaggaga

SEQ ID NO: 6201314 - DNA, 21 bp, Homo sapiens
gacagatgaagaaggagcaga

SEQ ID NO: 6201315 - DNA, 19 bp, Homo sapiens
gacagatgaatgccgtgga

SEQ ID NO: 6201316 - DNA, 20 bp, Homo sapiens
gacagatgaatgccgtggat

SEQ ID NO: 6201317 - DNA, 15 bp, Homo sapiens
gacagatgagcagga

SEQ ID NO: 6201318 - DNA, 18 bp, Homo sapiens
gacagatgagcaggagct

SEQ ID NO: 6201319 - DNA, 15 bp, Homo sapiens
gacagatgcaagtta

SEQ ID NO: 6201320 - DNA, 16 bp, Homo sapiens
gacagatgcaagttat

SEQ ID NO: 6201321 - DNA, 21 bp, Homo sapiens
gacagatgccaacttcccaca

SEQ ID NO: 6201322 - DNA, 14 bp, Homo sapiens
gacagatgccccag

SEQ ID NO: 6201323 - DNA, 20 bp, Homo sapiens
gacagatgccccagagctgt

SEQ ID NO: 6201324 - DNA, 16 bp, Homo sapiens
gacagatgcctggtga

SEQ ID NO: 6201325 - DNA, 16 bp, Homo sapiens
gacagatgctggtgga

SEQ ID NO: 6201326 - DNA, 23 bp, Homo sapiens
gacagatgctggtggaggaaggg

SEQ ID NO: 6201327 - DNA, 16 bp, Homo sapiens
gacagatggacgcagg

SEQ ID NO: 6201328 - DNA, 22 bp, Homo sapiens
gacagatggcccaagggatggc

SEQ ID NO: 6201329 - DNA, 23 bp, Homo sapiens
gacagatggcccaagggatggca

SEQ ID NO: 6201330 - DNA, 17 bp, Homo sapiens
gacagatgtcagccgag

SEQ ID NO: 6201331 - DNA, 18 bp, Homo sapiens
gacagatgtcagccgagc

SEQ ID NO: 6201332 - DNA, 17 bp, Homo sapiens
gacagatgtcagcttcc

SEQ ID NO: 6201333 - DNA, 23 bp, Homo sapiens
gacagatgtcagcttcccagcca

SEQ ID NO: 6201334 - DNA, 23 bp, Homo sapiens
gacagatgttatttttgtatttt

SEQ ID NO: 6201335 - DNA, 17 bp, Homo sapiens
gacagattcagtcttgc

SEQ ID NO: 6201336 - DNA, 14 bp, Homo sapiens
gacagatttcagta

SEQ ID NO: 6201337 - DNA, 18 bp, Homo sapiens
gacagatttcagtaatgt

SEQ ID NO: 6201338 - DNA, 23 bp, Homo sapiens
gacagcaaaaaaagcaacttttc

SEQ ID NO: 6201339 - DNA, 16 bp, Homo sapiens
gacagcaaaaccattg

SEQ ID NO: 6201340 - DNA, 19 bp, Homo sapiens
gacagcaaaaccattgctt

SEQ ID NO: 6201341 - DNA, 22 bp, Homo sapiens
gacagcaaaaccattgcttcac

SEQ ID NO: 6201342 - DNA, 15 bp, Homo sapiens
gacagcaaagcagca

SEQ ID NO: 6201343 - DNA, 18 bp, Homo sapiens
gacagcaaagcagcagtg

SEQ ID NO: 6201344 - DNA, 21 bp, Homo sapiens
gacagcaaagcagcagtgtcc

SEQ ID NO: 6201345 - DNA, 18 bp, Homo sapiens
gacagcaacctgtagagt

SEQ ID NO: 6201346 - DNA, 13 bp, Homo sapiens
gacagcaagggct

SEQ ID NO: 6201347 - DNA, 11 bp, Homo sapiens
gacagcaaggt

SEQ ID NO: 6201348 - DNA, 21 bp, Homo sapiens
gacagcaaggtgtggaggctc

SEQ ID NO: 6201349 - DNA, 16 bp, Homo sapiens
gacagcaagtgagcag

SEQ ID NO: 6201350 - DNA, 17 bp, Homo sapiens
gacagcaagtgagcaga

SEQ ID NO: 6201351 - DNA, 12 bp, Homo sapiens
gacagcaagttt

SEQ ID NO: 6201352 - DNA, 17 bp, Homo sapiens
gacagcaattgtagaca

SEQ ID NO: 6201353 - DNA, 23 bp, Homo sapiens
gacagcacaaggtggcagcaagc

SEQ ID NO: 6201354 - DNA, 16 bp, Homo sapiens
gacagcacacacagtg

SEQ ID NO: 6201355 - DNA, 15 bp, Homo sapiens
gacagcacagatgtg

SEQ ID NO: 6201356 - DNA, 14 bp, Homo sapiens
cttgcactgtgctt

SEQ ID NO: 6201357 - DNA, 19 bp, Homo sapiens
cttgcactgtgcttgctcc

SEQ ID NO: 6201358 - DNA, 22 bp, Homo sapiens
cttgcacttgttatattataat

SEQ ID NO: 6201359 - DNA, 14 bp, Homo sapiens
cttgcagaaaatga

SEQ ID NO: 6201360 - DNA, 13 bp, Homo sapiens
cttgcagaactgc

SEQ ID NO: 6201361 - DNA, 15 bp, Homo sapiens
cttgcagaactgcca

SEQ ID NO: 6201362 - DNA, 14 bp, Homo sapiens
cttgcagaactgta

SEQ ID NO: 6201363 - DNA, 12 bp, Homo sapiens
cttgcagaactt

SEQ ID NO: 6201364 - DNA, 13 bp, Homo sapiens
cttgcagaagctg

SEQ ID NO: 6201365 - DNA, 13 bp, Homo sapiens
cttgcagagaagc

SEQ ID NO: 6201366 - DNA, 21 bp, Homo sapiens
cttgcagaggagcccagtggg

SEQ ID NO: 6201367 - DNA, 23 bp, Homo sapiens
cttgcagaggagcccagtgggct

SEQ ID NO: 6201368 - DNA, 19 bp, Homo sapiens
cttgcagatatctgcatgt

SEQ ID NO: 6201369 - DNA, 22 bp, Homo sapiens
cttgcagatcatctggggacct

SEQ ID NO: 6201370 - DNA, 19 bp, Homo sapiens
cttgcagatgaaaaaaact

SEQ ID NO: 6201371 - DNA, 16 bp, Homo sapiens
cttgcagattctattt

SEQ ID NO: 6201372 - DNA, 23 bp, Homo sapiens
cttgcagcactcacacaggaccc

SEQ ID NO: 6201373 - DNA, 12 bp, Homo sapiens
cttgcagcagga

SEQ ID NO: 6201374 - DNA, 20 bp, Homo sapiens
cttgcagcagggctgggcct

SEQ ID NO: 6201375 - DNA, 21 bp, Homo sapiens
cttgcagcatttactatgcac

SEQ ID NO: 6201376 - DNA, 15 bp, Homo sapiens
cttgcagccaggaga

SEQ ID NO: 6201377 - DNA, 16 bp, Homo sapiens
cttgcagcggctcctg

SEQ ID NO: 6201378 - DNA, 18 bp, Homo sapiens
cttgcagctaaggagggg

SEQ ID NO: 6201379 - DNA, 22 bp, Homo sapiens
cttgcagctctccccttctctg

SEQ ID NO: 6201380 - DNA, 15 bp, Homo sapiens
cttgcagctggccca

SEQ ID NO: 6201381 - DNA, 23 bp, Homo sapiens
cttgcaggggtcccccctcaaga

SEQ ID NO: 6201382 - DNA, 16 bp, Homo sapiens
cttgcagggtcttgct

SEQ ID NO: 6201383 - DNA, 12 bp, Homo sapiens
cttgcagtacat

SEQ ID NO: 6201384 - DNA, 14 bp, Homo sapiens
cttgcagtagattt

SEQ ID NO: 6201385 - DNA, 20 bp, Homo sapiens
cttgcagtatcggcactgta

SEQ ID NO: 6201386 - DNA, 15 bp, Homo sapiens
cttgcagtgaagtgt

SEQ ID NO: 6201387 - DNA, 20 bp, Homo sapiens
cttgcagtggaagatacttg

SEQ ID NO: 6201388 - DNA, 22 bp, Homo sapiens
cttgcagtggacggagagcctt

SEQ ID NO: 6201389 - DNA, 22 bp, Homo sapiens
cttgcagttagactcaaagaag

SEQ ID NO: 6201390 - DNA, 16 bp, Homo sapiens
cttgcagttcttgagt

SEQ ID NO: 6201391 - DNA, 16 bp, Homo sapiens
cttgcataagcctcag

SEQ ID NO: 6201392 - DNA, 15 bp, Homo sapiens
cttgcatacatatat

SEQ ID NO: 6201393 - DNA, 20 bp, Homo sapiens
cttgcataggctcttaagca

SEQ ID NO: 6201394 - DNA, 23 bp, Homo sapiens
cttgcatcaatttttcttatttc

SEQ ID NO: 6201395 - DNA, 15 bp, Homo sapiens
cttgcatccaactcc

SEQ ID NO: 6201396 - DNA, 19 bp, Homo sapiens
cttgcatccaactccagga

SEQ ID NO: 6201397 - DNA, 14 bp, Homo sapiens
cttgcatccaaggt

SEQ ID NO: 6201398 - DNA, 16 bp, Homo sapiens
cttgcatccattgttg

SEQ ID NO: 6201399 - DNA, 17 bp, Homo sapiens
cttgcatccattgttgt

SEQ ID NO: 6201400 - DNA, 20 bp, Homo sapiens
cttgcatcctcctcccaact

SEQ ID NO: 6201401 - DNA, 14 bp, Homo sapiens
cttgcatccttcct

SEQ ID NO: 6201402 - DNA, 15 bp, Homo sapiens
cttgcatccttccta

SEQ ID NO: 6201403 - DNA, 17 bp, Homo sapiens
cttgcatctacctgctc

SEQ ID NO: 6201404 - DNA, 16 bp, Homo sapiens
cttgcatctgggccag

SEQ ID NO: 6201405 - DNA, 17 bp, Homo sapiens
cttgcatgaggctagtg

SEQ ID NO: 6201406 - DNA, 14 bp, Homo sapiens
cttgcatgcacgga

SEQ ID NO: 6201407 - DNA, 21 bp, Homo sapiens
cttgcatgcctgggcccaggc

SEQ ID NO: 6201408 - DNA, 16 bp, Homo sapiens
cttgcatggagaatgg

SEQ ID NO: 6201409 - DNA, 20 bp, Homo sapiens
cttgcatggtttggagctga

SEQ ID NO: 6201410 - DNA, 12 bp, Homo sapiens
cttgcatgtggt

SEQ ID NO: 6201411 - DNA, 20 bp, Homo sapiens
cttgcattcatggttatgaa

SEQ ID NO: 6201412 - DNA, 13 bp, Homo sapiens
cttgcattcattt

SEQ ID NO: 6201413 - DNA, 16 bp, Homo sapiens
cttgcattcattttct

SEQ ID NO: 6201414 - DNA, 22 bp, Homo sapiens
cttgcattccagagttaaaatg

SEQ ID NO: 6201415 - DNA, 14 bp, Homo sapiens
cttgcattgtgaca

SEQ ID NO: 6201416 - DNA, 15 bp, Homo sapiens
cttgcatttctttat

SEQ ID NO: 6201417 - DNA, 16 bp, Homo sapiens
cttgcatttctttatt

SEQ ID NO: 6201418 - DNA, 20 bp, Homo sapiens
cttgcattttagctaattta

SEQ ID NO: 6201419 - DNA, 16 bp, Homo sapiens
cttgcatttttttcct

SEQ ID NO: 6201420 - DNA, 16 bp, Homo sapiens
cttgccaaaaagcaca

SEQ ID NO: 6201421 - DNA, 22 bp, Homo sapiens
cttgccaaaatgttggctgcgt

SEQ ID NO: 6201422 - DNA, 14 bp, Homo sapiens
cttgccaaagcaga

SEQ ID NO: 6201423 - DNA, 13 bp, Homo sapiens
cttgccaaattta

SEQ ID NO: 6201424 - DNA, 20 bp, Homo sapiens
cttgccaacctgtaataaat

SEQ ID NO: 6201425 - DNA, 21 bp, Homo sapiens
cttgccaacctgtaataaata

SEQ ID NO: 6201426 - DNA, 23 bp, Homo sapiens
cttgccaacctgtaataaatatg

SEQ ID NO: 6201427 - DNA, 23 bp, Homo sapiens
cttgccaagtaatcctgcacaga

SEQ ID NO: 6201428 - DNA, 23 bp, Homo sapiens
cttgccaatgaggtctgaaatgg

SEQ ID NO: 6201429 - DNA, 14 bp, Homo sapiens
cttgccacaatcac

SEQ ID NO: 6201430 - DNA, 12 bp, Homo sapiens
cttgccacacag

SEQ ID NO: 6201431 - DNA, 13 bp, Homo sapiens
cttgccacacagt

SEQ ID NO: 6201432 - DNA, 13 bp, Homo sapiens
cttgccacactct

SEQ ID NO: 6201433 - DNA, 16 bp, Homo sapiens
cttgccacactcttct

SEQ ID NO: 6201434 - DNA, 20 bp, Homo sapiens
cttgccacagctcttgagga

SEQ ID NO: 6201435 - DNA, 12 bp, Homo sapiens
cttgccacatct

SEQ ID NO: 6201436 - DNA, 14 bp, Homo sapiens
cttgccacatcttg

SEQ ID NO: 6201437 - DNA, 16 bp, Homo sapiens
cttgccacatcttgaa

SEQ ID NO: 6201438 - DNA, 18 bp, Homo sapiens
cttgccacatcttgaaaa

SEQ ID NO: 6201439 - DNA, 19 bp, Homo sapiens
cttgccacattaaattgat

SEQ ID NO: 6201440 - DNA, 20 bp, Homo sapiens
cttgccacatttctgatcag

SEQ ID NO: 6201441 - DNA, 23 bp, Homo sapiens
cttgccacatttctgatcagagg

SEQ ID NO: 6201442 - DNA, 23 bp, Homo sapiens
cttgccaccaccagatgagaagt

SEQ ID NO: 6201443 - DNA, 13 bp, Homo sapiens
cttgccaccccac

SEQ ID NO: 6201444 - DNA, 20 bp, Homo sapiens
cttgccaccccaccctccct

SEQ ID NO: 6201445 - DNA, 21 bp, Homo sapiens
cttgccaccccaccctccctg

SEQ ID NO: 6201446 - DNA, 15 bp, Homo sapiens
cttgccaccctctgg

SEQ ID NO: 6201447 - DNA, 16 bp, Homo sapiens
cttgccaccctctggg

SEQ ID NO: 6201448 - DNA, 18 bp, Homo sapiens
cttgccaccctctgggag

SEQ ID NO: 6201449 - DNA, 21 bp, Homo sapiens
cttgccaccggggaacccagc

SEQ ID NO: 6201450 - DNA, 14 bp, Homo sapiens
cttgccactgcctc

SEQ ID NO: 6201451 - DNA, 15 bp, Homo sapiens
cttgccactttgcac

SEQ ID NO: 6201452 - DNA, 19 bp, Homo sapiens
cttgccagaaccaaattaa

SEQ ID NO: 6201453 - DNA, 21 bp, Homo sapiens
cttgccagaaccaaattaact

SEQ ID NO: 6201454 - DNA, 17 bp, Homo sapiens
cttgccagatgctgcag

SEQ ID NO: 6201455 - DNA, 14 bp, Homo sapiens
cttgccagcaacac

SEQ ID NO: 6201456 - DNA, 19 bp, Homo sapiens
cttgccagcaacacctgcc

SEQ ID NO: 6201457 - DNA, 15 bp, Homo sapiens
cttgccagcctcctt

SEQ ID NO: 6201458 - DNA, 16 bp, Homo sapiens
cttgccagcctccttg

SEQ ID NO: 6201459 - DNA, 16 bp, Homo sapiens
cttgccaggctccctt

SEQ ID NO: 6201460 - DNA, 23 bp, Homo sapiens
cttgccagggatgggcagcccaa

SEQ ID NO: 6201461 - DNA, 14 bp, Homo sapiens
cttgccagggcagg

SEQ ID NO: 6201462 - DNA, 17 bp, Homo sapiens
cttgccagggcagggtc

SEQ ID NO: 6201463 - DNA, 18 bp, Homo sapiens
cttgccagggcagggtct

SEQ ID NO: 6201464 - DNA, 18 bp, Homo sapiens
cttgccagggctctgggg

SEQ ID NO: 6201465 - DNA, 12 bp, Homo sapiens
cttgccagtttt

SEQ ID NO: 6201466 - DNA, 19 bp, Homo sapiens
cttgccatcccaagcccag

SEQ ID NO: 6201467 - DNA, 14 bp, Homo sapiens
cttgccatccctcc

SEQ ID NO: 6201468 - DNA, 16 bp, Homo sapiens
cttgccatccctccct

SEQ ID NO: 6201469 - DNA, 19 bp, Homo sapiens
cttgccatccctccctcca

SEQ ID NO: 6201470 - DNA, 22 bp, Homo sapiens
cttgccatccctccctccacct

SEQ ID NO: 6201471 - DNA, 18 bp, Homo sapiens
cttgccatcctgatggac

SEQ ID NO: 6201472 - DNA, 22 bp, Homo sapiens
cttgccatgaaggcacctgccc

SEQ ID NO: 6201473 - DNA, 21 bp, Homo sapiens
cttgccattgccaggagatgg

SEQ ID NO: 6201474 - DNA, 17 bp, Homo sapiens
cttgcccaactcccagc

SEQ ID NO: 6201475 - DNA, 19 bp, Homo sapiens
cttgcccaactcccagcca

SEQ ID NO: 6201476 - DNA, 15 bp, Homo sapiens
cttgcccaagtcaca

SEQ ID NO: 6201477 - DNA, 16 bp, Homo sapiens
cttgcccaattttaat

SEQ ID NO: 6201478 - DNA, 16 bp, Homo sapiens
cttgcccacaggtgcg

SEQ ID NO: 6201479 - DNA, 21 bp, Homo sapiens
cttgcccacaggtgcgggacc

SEQ ID NO: 6201480 - DNA, 16 bp, Homo sapiens
cttgcccactcctgct

SEQ ID NO: 6201481 - DNA, 23 bp, Homo sapiens
cttgcccactcctgctctgctcg

SEQ ID NO: 6201482 - DNA, 17 bp, Homo sapiens
cttgcccactgcctgcc

SEQ ID NO: 6201483 - DNA, 18 bp, Homo sapiens
cttgcccactggccgctg

SEQ ID NO: 6201484 - DNA, 20 bp, Homo sapiens
cttgcccactggccgctgag

SEQ ID NO: 6201485 - DNA, 17 bp, Homo sapiens
cttgcccagactacagg

SEQ ID NO: 6201486 - DNA, 17 bp, Homo sapiens
cttgcccagcaaggacc

SEQ ID NO: 6201487 - DNA, 13 bp, Homo sapiens
cttgcccagcagc

SEQ ID NO: 6201488 - DNA, 11 bp, Homo sapiens
cttgcccagga

SEQ ID NO: 6201489 - DNA, 14 bp, Homo sapiens
cttgcccaggagca

SEQ ID NO: 6201490 - DNA, 19 bp, Homo sapiens
cttgcccagggtgcagtgt

SEQ ID NO: 6201491 - DNA, 17 bp, Homo sapiens
cttgcccaggtgaggga

SEQ ID NO: 6201492 - DNA, 13 bp, Homo sapiens
cttgcccatcagc

SEQ ID NO: 6201493 - DNA, 16 bp, Homo sapiens
cttgcccatcctgact

SEQ ID NO: 6201494 - DNA, 21 bp, Homo sapiens
cttgcccatgctgggctcccg

SEQ ID NO: 6201495 - DNA, 17 bp, Homo sapiens
cttgccccaacccccag

SEQ ID NO: 6201496 - DNA, 20 bp, Homo sapiens
cttgccccaacccccagcac

SEQ ID NO: 6201497 - DNA, 16 bp, Homo sapiens
cttgccccaacccttc

SEQ ID NO: 6201498 - DNA, 18 bp, Homo sapiens
cttgccccacagttgtgt

SEQ ID NO: 6201499 - DNA, 17 bp, Homo sapiens
cttgccccactcctctc

SEQ ID NO: 6201500 - DNA, 17 bp, Homo sapiens
cttgccccactctgcct

SEQ ID NO: 6201501 - DNA, 13 bp, Homo sapiens
cttgccccaggac

SEQ ID NO: 6201502 - DNA, 20 bp, Homo sapiens
cttgccccaggactctggca

SEQ ID NO: 6201503 - DNA, 17 bp, Homo sapiens
cttgccccaggccaggt

SEQ ID NO: 6201504 - DNA, 13 bp, Homo sapiens
cttgccccagtcc

SEQ ID NO: 6201505 - DNA, 14 bp, Homo sapiens
cttgccccagtcct

SEQ ID NO: 6201506 - DNA, 12 bp, Homo sapiens
cttgccccagtt

SEQ ID NO: 6201507 - DNA, 15 bp, Homo sapiens
cttgcccccagtgcc

SEQ ID NO: 6201508 - DNA, 14 bp, Homo sapiens
cttgccccccaccc

SEQ ID NO: 6201509 - DNA, 15 bp, Homo sapiens
cttgccccccacccc

SEQ ID NO: 6201510 - DNA, 16 bp, Homo sapiens
cttgccccccacccca

SEQ ID NO: 6201511 - DNA, 18 bp, Homo sapiens
cttgccccccgccctcat

SEQ ID NO: 6201512 - DNA, 16 bp, Homo sapiens
cttgcccccctggcct

SEQ ID NO: 6201513 - DNA, 21 bp, Homo sapiens
cttgcccccgcttagccccgc

SEQ ID NO: 6201514 - DNA, 19 bp, Homo sapiens
cttgccccctcatctcact

SEQ ID NO: 6201515 - DNA, 19 bp, Homo sapiens
cttgcccctccagagacag

SEQ ID NO: 6201516 - DNA, 14 bp, Homo sapiens
cttgcccctgctct

SEQ ID NO: 6201517 - DNA, 16 bp, Homo sapiens
cttgcccctgctctgt

SEQ ID NO: 6201518 - DNA, 17 bp, Homo sapiens
cttgcccctgctctgta

SEQ ID NO: 6201519 - DNA, 19 bp, Homo sapiens
cttgcccctgctctgtagc

SEQ ID NO: 6201520 - DNA, 21 bp, Homo sapiens
cttgcccctgctctgtagcca

SEQ ID NO: 6201521 - DNA, 22 bp, Homo sapiens
cttgcccctgtggccctggcat

SEQ ID NO: 6201522 - DNA, 15 bp, Homo sapiens
cttgccccttgggcc

SEQ ID NO: 6201523 - DNA, 16 bp, Homo sapiens
cttgccccttgggcct

SEQ ID NO: 6201524 - DNA, 17 bp, Homo sapiens
cttgccccttgggcctc

SEQ ID NO: 6201525 - DNA, 12 bp, Homo sapiens
cttgccccttgt

SEQ ID NO: 6201526 - DNA, 16 bp, Homo sapiens
cttgccccttgtcctg

SEQ ID NO: 6201527 - DNA, 21 bp, Homo sapiens
cttgccccttgtcctgaagcc

SEQ ID NO: 6201528 - DNA, 22 bp, Homo sapiens
cttgcccgcacccctccctgct

SEQ ID NO: 6201529 - DNA, 14 bp, Homo sapiens
cttgcccgccagcc

SEQ ID NO: 6201530 - DNA, 19 bp, Homo sapiens
cttgcccgctcccacagct

SEQ ID NO: 6201531 - DNA, 17 bp, Homo sapiens
cttgcccggattctggg

SEQ ID NO: 6201532 - DNA, 21 bp, Homo sapiens
cttgcccgtcggccctgcgtc

SEQ ID NO: 6201533 - DNA, 17 bp, Homo sapiens
cttgcccgtcgtgtgct

SEQ ID NO: 6201534 - DNA, 22 bp, Homo sapiens
cttgcccgtcgtgtgctgaaga

SEQ ID NO: 6201535 - DNA, 14 bp, Homo sapiens
gacagcacagggca

SEQ ID NO: 6201536 - DNA, 17 bp, Homo sapiens
gacagcacagggcaggg

SEQ ID NO: 6201537 - DNA, 13 bp, Homo sapiens
gacagcaccactg

SEQ ID NO: 6201538 - DNA, 17 bp, Homo sapiens
gacagcacttggctcct

SEQ ID NO: 6201539 - DNA, 20 bp, Homo sapiens
gacagcagaactgctatttt

SEQ ID NO: 6201540 - DNA, 14 bp, Homo sapiens
gacagcagaagcct

SEQ ID NO: 6201541 - DNA, 24 bp, Homo sapiens
gacagcagcactcccgctgcacac

SEQ ID NO: 6201542 - DNA, 22 bp, Homo sapiens
gacagcagcagcctgcacctgc

SEQ ID NO: 6201543 - DNA, 16 bp, Homo sapiens
gacagcagcatctcta

SEQ ID NO: 6201544 - DNA, 19 bp, Homo sapiens
gacagcagcatctctacct

SEQ ID NO: 6201545 - DNA, 19 bp, Homo sapiens
gacagcagcctccctgtca

SEQ ID NO: 6201546 - DNA, 20 bp, Homo sapiens
gacagcagcctccctgtcac

SEQ ID NO: 6201547 - DNA, 16 bp, Homo sapiens
gacagcagcctgtgag

SEQ ID NO: 6201548 - DNA, 17 bp, Homo sapiens
gacagcagcctgtgagg

SEQ ID NO: 6201549 - DNA, 14 bp, Homo sapiens
gacagcagctcagg

SEQ ID NO: 6201550 - DNA, 18 bp, Homo sapiens
gacagcagctcaggcaca

SEQ ID NO: 6201551 - DNA, 12 bp, Homo sapiens
gacagcagctgg

SEQ ID NO: 6201552 - DNA, 14 bp, Homo sapiens
gacagcagctggtg

SEQ ID NO: 6201553 - DNA, 12 bp, Homo sapiens
gacagcaggcag

SEQ ID NO: 6201554 - DNA, 17 bp, Homo sapiens
gacagcaggcagcgcca

SEQ ID NO: 6201555 - DNA, 19 bp, Homo sapiens
gacagcagtcttatgcttc

SEQ ID NO: 6201556 - DNA, 23 bp, Homo sapiens
gacagcagtcttatgcttccaga

SEQ ID NO: 6201557 - DNA, 20 bp, Homo sapiens
gacagcagtgtgagggtgca

SEQ ID NO: 6201558 - DNA, 21 bp, Homo sapiens
gacagcagtgtgagggtgcag

SEQ ID NO: 6201559 - DNA, 21 bp, Homo sapiens
gacagcataccttggactgac

SEQ ID NO: 6201560 - DNA, 22 bp, Homo sapiens
gacagcataccttggactgact

SEQ ID NO: 6201561 - DNA, 22 bp, Homo sapiens
gacagcatatagaatatattat

SEQ ID NO: 6201562 - DNA, 19 bp, Homo sapiens
gacagcatgactggacagc

SEQ ID NO: 6201563 - DNA, 17 bp, Homo sapiens
gacagcatgactgtgca

SEQ ID NO: 6201564 - DNA, 13 bp, Homo sapiens
gacagcatgtgcc

SEQ ID NO: 6201565 - DNA, 20 bp, Homo sapiens
gacagcatgtgccctcctga

SEQ ID NO: 6201566 - DNA, 20 bp, Homo sapiens
gacagcattgatctcctgga

SEQ ID NO: 6201567 - DNA, 14 bp, Homo sapiens
gacagcattttaag

SEQ ID NO: 6201568 - DNA, 16 bp, Homo sapiens
gacagcattttcctct

SEQ ID NO: 6201569 - DNA, 20 bp, Homo sapiens
gacagcattttcctctgctt

SEQ ID NO: 6201570 - DNA, 20 bp, Homo sapiens
gacagccacggccaggccag

SEQ ID NO: 6201571 - DNA, 22 bp, Homo sapiens
gacagccacttttagctactgc

SEQ ID NO: 6201572 - DNA, 16 bp, Homo sapiens
gacagccagagcctgt

SEQ ID NO: 6201573 - DNA, 14 bp, Homo sapiens
gacagccagagctg

SEQ ID NO: 6201574 - DNA, 11 bp, Homo sapiens
gacagccaggt

SEQ ID NO: 6201575 - DNA, 19 bp, Homo sapiens
gacagccaggtggcacctg

SEQ ID NO: 6201576 - DNA, 16 bp, Homo sapiens
gacagccattttccaa

SEQ ID NO: 6201577 - DNA, 17 bp, Homo sapiens
gacagccattttccaac

SEQ ID NO: 6201578 - DNA, 21 bp, Homo sapiens
gacagcccacggtctggaggc

SEQ ID NO: 6201579 - DNA, 17 bp, Homo sapiens
gacagcccactgagaag

SEQ ID NO: 6201580 - DNA, 10 bp, Homo sapiens
gacagcccag

SEQ ID NO: 6201581 - DNA, 21 bp, Homo sapiens
gacagcccaggatactggcac

SEQ ID NO: 6201582 - DNA, 11 bp, Homo sapiens
gacagccccag

SEQ ID NO: 6201583 - DNA, 14 bp, Homo sapiens
gacagccccagagc

SEQ ID NO: 6201584 - DNA, 17 bp, Homo sapiens
gacagccccagagcagg

SEQ ID NO: 6201585 - DNA, 12 bp, Homo sapiens
gacagccccagg

SEQ ID NO: 6201586 - DNA, 15 bp, Homo sapiens
gacagccccagggcc

SEQ ID NO: 6201587 - DNA, 22 bp, Homo sapiens
gacagccccctgccccgcaggc

SEQ ID NO: 6201588 - DNA, 19 bp, Homo sapiens
gacagcccgatcctcccct

SEQ ID NO: 6201589 - DNA, 24 bp, Homo sapiens
gacagcccgatcctcccctggact

SEQ ID NO: 6201590 - DNA, 16 bp, Homo sapiens
gacagcccgggctctg

SEQ ID NO: 6201591 - DNA, 18 bp, Homo sapiens
gacagcccgggctctgcc

SEQ ID NO: 6201592 - DNA, 13 bp, Homo sapiens
gacagccctgcct

SEQ ID NO: 6201593 - DNA, 18 bp, Homo sapiens
gacagccctgcggagacc

SEQ ID NO: 6201594 - DNA, 21 bp, Homo sapiens
gacagcccttctttccacaga

SEQ ID NO: 6201595 - DNA, 20 bp, Homo sapiens
gacagccgggaggagcctgg

SEQ ID NO: 6201596 - DNA, 11 bp, Homo sapiens
gacagcctccc

SEQ ID NO: 6201597 - DNA, 20 bp, Homo sapiens
gacagcctccgccaagatct

SEQ ID NO: 6201598 - DNA, 20 bp, Homo sapiens
gacagcctcctaggctccct

SEQ ID NO: 6201599 - DNA, 16 bp, Homo sapiens
gacagcctctgactca

SEQ ID NO: 6201600 - DNA, 11 bp, Homo sapiens
gacagcctctt

SEQ ID NO: 6201601 - DNA, 20 bp, Homo sapiens
gacagcctcttcagcccctt

SEQ ID NO: 6201602 - DNA, 14 bp, Homo sapiens
gacagcctgcacag

SEQ ID NO: 6201603 - DNA, 18 bp, Homo sapiens
gacagcctgcagcaggaa

SEQ ID NO: 6201604 - DNA, 15 bp, Homo sapiens
gacagcctgcctctg

SEQ ID NO: 6201605 - DNA, 16 bp, Homo sapiens
gacagcctgcctctgc

SEQ ID NO: 6201606 - DNA, 17 bp, Homo sapiens
gacagcctgcctctgcc

SEQ ID NO: 6201607 - DNA, 18 bp, Homo sapiens
gacagcctgcctctgcca

SEQ ID NO: 6201608 - DNA, 19 bp, Homo sapiens
gacagcctgcctctgccac

SEQ ID NO: 6201609 - DNA, 11 bp, Homo sapiens
gacagcctggc

SEQ ID NO: 6201610 - DNA, 12 bp, Homo sapiens
gacagcctggca

SEQ ID NO: 6201611 - DNA, 14 bp, Homo sapiens
gacagcctgggggg

SEQ ID NO: 6201612 - DNA, 11 bp, Homo sapiens
gacagcctgta

SEQ ID NO: 6201613 - DNA, 20 bp, Homo sapiens
gacagcctgtggcggtgcct

SEQ ID NO: 6201614 - DNA, 10 bp, Homo sapiens
gacagccttc

SEQ ID NO: 6201615 - DNA, 14 bp, Homo sapiens
gacagccttcagca

SEQ ID NO: 6201616 - DNA, 16 bp, Homo sapiens
gacagccttccagtgg

SEQ ID NO: 6201617 - DNA, 20 bp, Homo sapiens
gacagccttccccagctcca

SEQ ID NO: 6201618 - DNA, 14 bp, Homo sapiens
gacagccttgccca

SEQ ID NO: 6201619 - DNA, 21 bp, Homo sapiens
gacagccttgggcctttcagt

SEQ ID NO: 6201620 - DNA, 19 bp, Homo sapiens
gacagcgaactagaagaaa

SEQ ID NO: 6201621 - DNA, 19 bp, Homo sapiens
gacagcgatggcaggcctg

SEQ ID NO: 6201622 - DNA, 15 bp, Homo sapiens
gacagcgcacagctg

SEQ ID NO: 6201623 - DNA, 18 bp, Homo sapiens
gacagcgcacagctgctc

SEQ ID NO: 6201624 - DNA, 16 bp, Homo sapiens
gacagcgccatgtgtg

SEQ ID NO: 6201625 - DNA, 17 bp, Homo sapiens
gacagcgccatgtgtgt

SEQ ID NO: 6201626 - DNA, 13 bp, Homo sapiens
gacagcgcccctg

SEQ ID NO: 6201627 - DNA, 16 bp, Homo sapiens
gacagcgcccctgctg

SEQ ID NO: 6201628 - DNA, 22 bp, Homo sapiens
gacagcgctgtatttacagaca

SEQ ID NO: 6201629 - DNA, 12 bp, Homo sapiens
gacagcggcccc

SEQ ID NO: 6201630 - DNA, 16 bp, Homo sapiens
gacagcggcccggccc

SEQ ID NO: 6201631 - DNA, 13 bp, Homo sapiens
gacagcggccttg

SEQ ID NO: 6201632 - DNA, 23 bp, Homo sapiens
gacagcgggtaaaaagagaaggc

SEQ ID NO: 6201633 - DNA, 16 bp, Homo sapiens
gacagcggtcccaggg

SEQ ID NO: 6201634 - DNA, 16 bp, Homo sapiens
gacagcggttgtaaat

SEQ ID NO: 6201635 - DNA, 20 bp, Homo sapiens
gacagcggttgtaaatacaa

SEQ ID NO: 6201636 - DNA, 22 bp, Homo sapiens
gacagctaccggaaggagggga

SEQ ID NO: 6201637 - DNA, 15 bp, Homo sapiens
gacagctaggctgag

SEQ ID NO: 6201638 - DNA, 18 bp, Homo sapiens
gacagctccctctgcctg

SEQ ID NO: 6201639 - DNA, 15 bp, Homo sapiens
gacagctccgggatc

SEQ ID NO: 6201640 - DNA, 21 bp, Homo sapiens
gacagctcctggaccaggccc

SEQ ID NO: 6201641 - DNA, 15 bp, Homo sapiens
gacagctccttctgt

SEQ ID NO: 6201642 - DNA, 16 bp, Homo sapiens
gacagctccttctgtc

SEQ ID NO: 6201643 - DNA, 12 bp, Homo sapiens
gacagctctgca

SEQ ID NO: 6201644 - DNA, 11 bp, Homo sapiens
gacagctctta

SEQ ID NO: 6201645 - DNA, 15 bp, Homo sapiens
gacagctgacagata

SEQ ID NO: 6201646 - DNA, 14 bp, Homo sapiens
gacagctgcaggtg

SEQ ID NO: 6201647 - DNA, 16 bp, Homo sapiens
gacagctgcaggtgcc

SEQ ID NO: 6201648 - DNA, 13 bp, Homo sapiens
gacagctgcccag

SEQ ID NO: 6201649 - DNA, 21 bp, Homo sapiens
gacagctgcctgggatccctc

SEQ ID NO: 6201650 - DNA, 11 bp, Homo sapiens
gacagctgctc

SEQ ID NO: 6201651 - DNA, 17 bp, Homo sapiens
gacagctgctcctagag

SEQ ID NO: 6201652 - DNA, 21 bp, Homo sapiens
gacagctgctcctagagggag

SEQ ID NO: 6201653 - DNA, 14 bp, Homo sapiens
gacagctgctggga

SEQ ID NO: 6201654 - DNA, 15 bp, Homo sapiens
gacagctgctgggac

SEQ ID NO: 6201655 - DNA, 11 bp, Homo sapiens
gacagctggct

SEQ ID NO: 6201656 - DNA, 15 bp, Homo sapiens
gacagctggctgctg

SEQ ID NO: 6201657 - DNA, 16 bp, Homo sapiens
gacagctggctgctga

SEQ ID NO: 6201658 - DNA, 13 bp, Homo sapiens
gacagctggctgg

SEQ ID NO: 6201659 - DNA, 17 bp, Homo sapiens
gacagctggctgggcct

SEQ ID NO: 6201660 - DNA, 12 bp, Homo sapiens
gacagctggtca

SEQ ID NO: 6201661 - DNA, 20 bp, Homo sapiens
gacagctggtcacacaagga

SEQ ID NO: 6201662 - DNA, 16 bp, Homo sapiens
gacagctgtccctgtc

SEQ ID NO: 6201663 - DNA, 22 bp, Homo sapiens
gacagctgtgccgggaggcagc

SEQ ID NO: 6201664 - DNA, 17 bp, Homo sapiens
gacagctgtgcctcgct

SEQ ID NO: 6201665 - DNA, 16 bp, Homo sapiens
gacagcttacaggagc

SEQ ID NO: 6201666 - DNA, 17 bp, Homo sapiens
gacagcttacaggagcc

SEQ ID NO: 6201667 - DNA, 23 bp, Homo sapiens
gacagcttagaattatttgcact

SEQ ID NO: 6201668 - DNA, 12 bp, Homo sapiens
gacagcttcccc

SEQ ID NO: 6201669 - DNA, 16 bp, Homo sapiens
gacagcttcctcacac

SEQ ID NO: 6201670 - DNA, 20 bp, Homo sapiens
gacagcttcctcacacccct

SEQ ID NO: 6201671 - DNA, 21 bp, Homo sapiens
gacagcttctcatcctgcagg

SEQ ID NO: 6201672 - DNA, 22 bp, Homo sapiens
gacagcttctcatcctgcaggc

SEQ ID NO: 6201673 - DNA, 13 bp, Homo sapiens
gacagcttctctg

SEQ ID NO: 6201674 - DNA, 14 bp, Homo sapiens
gacagcttctctgc

SEQ ID NO: 6201675 - DNA, 16 bp, Homo sapiens
gacagcttggaaaggg

SEQ ID NO: 6201676 - DNA, 18 bp, Homo sapiens
gacagcttgggaggaaac

SEQ ID NO: 6201677 - DNA, 21 bp, Homo sapiens
gacagcttgtggcaagtgaat

SEQ ID NO: 6201678 - DNA, 14 bp, Homo sapiens
gacagctttcctgg

SEQ ID NO: 6201679 - DNA, 16 bp, Homo sapiens
gacagctttcctgggt

SEQ ID NO: 6201680 - DNA, 23 bp, Homo sapiens
gacagctttctaactcacaggca

SEQ ID NO: 6201681 - DNA, 15 bp, Homo sapiens
gacagctttctggga

SEQ ID NO: 6201682 - DNA, 18 bp, Homo sapiens
gacagctttctgggatgt

SEQ ID NO: 6201683 - DNA, 20 bp, Homo sapiens
gacagctttctgggatgtca

SEQ ID NO: 6201684 - DNA, 14 bp, Homo sapiens
gacagctttgctcc

SEQ ID NO: 6201685 - DNA, 23 bp, Homo sapiens
gacagctttgctccgctcccacc

SEQ ID NO: 6201686 - DNA, 19 bp, Homo sapiens
gacaggaaagccctccccc

SEQ ID NO: 6201687 - DNA, 12 bp, Homo sapiens
gacaggaaaggg

SEQ ID NO: 6201688 - DNA, 15 bp, Homo sapiens
gacaggaacacccag

SEQ ID NO: 6201689 - DNA, 17 bp, Homo sapiens
gacaggaacccatcact

SEQ ID NO: 6201690 - DNA, 22 bp, Homo sapiens
gacaggaaccttaagtaatcat

SEQ ID NO: 6201691 - DNA, 17 bp, Homo sapiens
gacaggaagaccaaggc

SEQ ID NO: 6201692 - DNA, 12 bp, Homo sapiens
gacaggaagcct

SEQ ID NO: 6201693 - DNA, 12 bp, Homo sapiens
gacaggaaggaa

SEQ ID NO: 6201694 - DNA, 13 bp, Homo sapiens
gacaggaaggaag

SEQ ID NO: 6201695 - DNA, 18 bp, Homo sapiens
gacaggaaggaagcacaa

SEQ ID NO: 6201696 - DNA, 15 bp, Homo sapiens
gacaggacagaatgt

SEQ ID NO: 6201697 - DNA, 14 bp, Homo sapiens
gacaggacagtgct

SEQ ID NO: 6201698 - DNA, 22 bp, Homo sapiens
gacaggaccctcaggaattcag

SEQ ID NO: 6201699 - DNA, 22 bp, Homo sapiens
gacaggacgctgaccgtggagc

SEQ ID NO: 6201700 - DNA, 19 bp, Homo sapiens
gacaggactaacactcaga

SEQ ID NO: 6201701 - DNA, 21 bp, Homo sapiens
gacaggactaacactcagaag

SEQ ID NO: 6201702 - DNA, 18 bp, Homo sapiens
gacaggagaatcacctga

SEQ ID NO: 6201703 - DNA, 12 bp, Homo sapiens
gacaggagcact

SEQ ID NO: 6201704 - DNA, 16 bp, Homo sapiens
gacaggagcagcccac

SEQ ID NO: 6201705 - DNA, 23 bp, Homo sapiens
gacaggagcctagcggagcccag

SEQ ID NO: 6201706 - DNA, 18 bp, Homo sapiens
gacaggaggagtgggaca

SEQ ID NO: 6201707 - DNA, 20 bp, Homo sapiens
gacaggaggagtgggacaga

SEQ ID NO: 6201708 - DNA, 23 bp, Homo sapiens
gacaggaggagtgggacagacag

SEQ ID NO: 6201709 - DNA, 17 bp, Homo sapiens
gacaggaggccatgccc

SEQ ID NO: 6201710 - DNA, 15 bp, Homo sapiens
gacaggatccaggcc

SEQ ID NO: 6201711 - DNA, 20 bp, Homo sapiens
gacaggatggggttctggaa

SEQ ID NO: 6201712 - DNA, 23 bp, Homo sapiens
gacaggatggttcccttgatgaa

SEQ ID NO: 6201713 - DNA, 17 bp, Homo sapiens
gacaggatgtggcactg

SEQ ID NO: 6201714 - DNA, 20 bp, Homo sapiens
gacaggatgtggcactgctt

SEQ ID NO: 6201715 - DNA, 18 bp, Homo sapiens
gacaggattgtctgctgc

SEQ ID NO: 6201716 - DNA, 19 bp, Homo sapiens
gacaggattgtctgctgcc

SEQ ID NO: 6201717 - DNA, 20 bp, Homo sapiens
gacaggattgtctgctgcct

SEQ ID NO: 6201718 - DNA, 16 bp, Homo sapiens
gacaggatttggccac

SEQ ID NO: 6201719 - DNA, 17 bp, Homo sapiens
gacaggcaagcacctcc

SEQ ID NO: 6201720 - DNA, 14 bp, Homo sapiens
gacaggcaatgctg

SEQ ID NO: 6201721 - DNA, 16 bp, Homo sapiens
gacaggcaatgctggc

SEQ ID NO: 6201722 - DNA, 19 bp, Homo sapiens
gacaggcacaaaatgtgac

SEQ ID NO: 6201723 - DNA, 18 bp, Homo sapiens
gacaggcaccagatggga

SEQ ID NO: 6201724 - DNA, 14 bp, Homo sapiens
gacaggcagaatca

SEQ ID NO: 6201725 - DNA, 13 bp, Homo sapiens
gacaggcagacac

SEQ ID NO: 6201726 - DNA, 14 bp, Homo sapiens
gacaggcagcctcc

SEQ ID NO: 6201727 - DNA, 14 bp, Homo sapiens
gacaggcaggccag

SEQ ID NO: 6201728 - DNA, 15 bp, Homo sapiens
gacaggcagggaggg

SEQ ID NO: 6201729 - DNA, 18 bp, Homo sapiens
gacaggcagtttcagaga

SEQ ID NO: 6201730 - DNA, 18 bp, Homo sapiens
gacaggcatgttctctga

SEQ ID NO: 6201731 - DNA, 16 bp, Homo sapiens
gacaggccagtagggg

SEQ ID NO: 6201732 - DNA, 15 bp, Homo sapiens
gacaggcccaagaga

SEQ ID NO: 6201733 - DNA, 16 bp, Homo sapiens
gacaggcccaagagat

SEQ ID NO: 6201734 - DNA, 21 bp, Homo sapiens
gacaggcccaagagatgaaga

SEQ ID NO: 6201735 - DNA, 13 bp, Homo sapiens
gacaggccctggc

SEQ ID NO: 6201736 - DNA, 11 bp, Homo sapiens
gacaggcctca

SEQ ID NO: 6201737 - DNA, 19 bp, Homo sapiens
gacaggcctcacctctacc

SEQ ID NO: 6201738 - DNA, 20 bp, Homo sapiens
gacaggcctcacctctaccc

SEQ ID NO: 6201739 - DNA, 15 bp, Homo sapiens
gacaggcgagagagg

SEQ ID NO: 6201740 - DNA, 19 bp, Homo sapiens
gacaggcgagagaggagcc

SEQ ID NO: 6201741 - DNA, 19 bp, Homo sapiens
gacaggcgccgcctcgccc

SEQ ID NO: 6201742 - DNA, 20 bp, Homo sapiens
gacaggcgccgcctcgcccc

SEQ ID NO: 6201743 - DNA, 16 bp, Homo sapiens
gacaggcggggcccag

SEQ ID NO: 6201744 - DNA, 18 bp, Homo sapiens
gacaggctcgtcagccac

SEQ ID NO: 6201745 - DNA, 17 bp, Homo sapiens
gacaggctctagagaga

SEQ ID NO: 6201746 - DNA, 22 bp, Homo sapiens
gacaggctctcctggctgtcct

SEQ ID NO: 6201747 - DNA, 13 bp, Homo sapiens
gacaggctcttag

SEQ ID NO: 6201748 - DNA, 13 bp, Homo sapiens
gacaggctcttct

SEQ ID NO: 6201749 - DNA, 14 bp, Homo sapiens
gacaggctgaaagc

SEQ ID NO: 6201750 - DNA, 19 bp, Homo sapiens
gacaggctgaagagaggga

SEQ ID NO: 6201751 - DNA, 22 bp, Homo sapiens
gacaggctggaagatagctgtg

SEQ ID NO: 6201752 - DNA, 14 bp, Homo sapiens
gacaggctgtgact

SEQ ID NO: 6201753 - DNA, 20 bp, Homo sapiens
gacagggaacagtatttcca

SEQ ID NO: 6201754 - DNA, 15 bp, Homo sapiens
gacagggaagagcag

SEQ ID NO: 6201755 - DNA, 16 bp, Homo sapiens
gacagggaagagcaga

SEQ ID NO: 6201756 - DNA, 23 bp, Homo sapiens
gacagggaatgctgaggcctcga

SEQ ID NO: 6201757 - DNA, 20 bp, Homo sapiens
gacagggaattaggccccca

SEQ ID NO: 6201758 - DNA, 21 bp, Homo sapiens
gacagggacatgccctgtgtg

SEQ ID NO: 6201759 - DNA, 19 bp, Homo sapiens
gacagggacccacttcaca

SEQ ID NO: 6201760 - DNA, 18 bp, Homo sapiens
gacagggacttcgcagag

SEQ ID NO: 6201761 - DNA, 15 bp, Homo sapiens
gacagggactttgct

SEQ ID NO: 6201762 - DNA, 14 bp, Homo sapiens
gacagggagctggg

SEQ ID NO: 6201763 - DNA, 18 bp, Homo sapiens
gacagggaggacgctctc

SEQ ID NO: 6201764 - DNA, 13 bp, Homo sapiens
gacagggagggaa

SEQ ID NO: 6201765 - DNA, 20 bp, Homo sapiens
gacagggagggccggcggct

SEQ ID NO: 6201766 - DNA, 18 bp, Homo sapiens
gacagggagggggacctg

SEQ ID NO: 6201767 - DNA, 14 bp, Homo sapiens
gacagggatgagca

SEQ ID NO: 6201768 - DNA, 19 bp, Homo sapiens
gacagggcaatcttgtcca

SEQ ID NO: 6201769 - DNA, 18 bp, Homo sapiens
gacagggcaggcgggccc

SEQ ID NO: 6201770 - DNA, 14 bp, Homo sapiens
gacagggccagggt

SEQ ID NO: 6201771 - DNA, 13 bp, Homo sapiens
gacagggccagtg

SEQ ID NO: 6201772 - DNA, 16 bp, Homo sapiens
gacagggccagtgggg

SEQ ID NO: 6201773 - DNA, 22 bp, Homo sapiens
gacagggccagtggggcctgtg

SEQ ID NO: 6201774 - DNA, 12 bp, Homo sapiens
gacagggctcca

SEQ ID NO: 6201775 - DNA, 18 bp, Homo sapiens
gacagggctggcccagcc

SEQ ID NO: 6201776 - DNA, 14 bp, Homo sapiens
gacagggcttctcc

SEQ ID NO: 6201777 - DNA, 18 bp, Homo sapiens
gacaggggagttgtcaac

SEQ ID NO: 6201778 - DNA, 14 bp, Homo sapiens
gacaggggattggc

SEQ ID NO: 6201779 - DNA, 18 bp, Homo sapiens
gacaggggcatctctggg

SEQ ID NO: 6201780 - DNA, 14 bp, Homo sapiens
gacaggggctcagg

SEQ ID NO: 6201781 - DNA, 16 bp, Homo sapiens
gacaggggctcaggat

SEQ ID NO: 6201782 - DNA, 12 bp, Homo sapiens
gacagggggtgg

SEQ ID NO: 6201783 - DNA, 13 bp, Homo sapiens
gacagggggtggg

SEQ ID NO: 6201784 - DNA, 23 bp, Homo sapiens
gacagggggtgggaaggggatgg

SEQ ID NO: 6201785 - DNA, 15 bp, Homo sapiens
gacagggtaggaaag

SEQ ID NO: 6201786 - DNA, 17 bp, Homo sapiens
gacagggtaggaaaggg

SEQ ID NO: 6201787 - DNA, 15 bp, Homo sapiens
gacagggtcctgcta

SEQ ID NO: 6201788 - DNA, 17 bp, Homo sapiens
gacagggtctcactctg

SEQ ID NO: 6201789 - DNA, 24 bp, Homo sapiens
gacagggtctccctatgttgccca

SEQ ID NO: 6201790 - DNA, 15 bp, Homo sapiens
gacagggtgggcttc

SEQ ID NO: 6201791 - DNA, 17 bp, Homo sapiens
gacagggtttcaccgtg

SEQ ID NO: 6201792 - DNA, 17 bp, Homo sapiens
gacagggtttcgccatg

SEQ ID NO: 6201793 - DNA, 21 bp, Homo sapiens
gacagggtttggctgtgtcta

SEQ ID NO: 6201794 - DNA, 19 bp, Homo sapiens
gacagggttttttcatttt

SEQ ID NO: 6201795 - DNA, 16 bp, Homo sapiens
gacaggtaaatgggca

SEQ ID NO: 6201796 - DNA, 17 bp, Homo sapiens
gacaggtccctcaccca

SEQ ID NO: 6201797 - DNA, 23 bp, Homo sapiens
gacaggtgacagtggctgctctg

SEQ ID NO: 6201798 - DNA, 14 bp, Homo sapiens
gacaggtgcctggg

SEQ ID NO: 6201799 - DNA, 15 bp, Homo sapiens
gacaggtgcctgggg

SEQ ID NO: 6201800 - DNA, 23 bp, Homo sapiens
gacaggtggaaaaactgagacag

SEQ ID NO: 6201801 - DNA, 14 bp, Homo sapiens
gacaggtgggcctg

SEQ ID NO: 6201802 - DNA, 17 bp, Homo sapiens
gacaggtgggcctggcg

SEQ ID NO: 6201803 - DNA, 16 bp, Homo sapiens
gacaggtgggcctggg

SEQ ID NO: 6201804 - DNA, 18 bp, Homo sapiens
gacaggtgggcctgggag

SEQ ID NO: 6201805 - DNA, 12 bp, Homo sapiens
gacaggtggggc

SEQ ID NO: 6201806 - DNA, 16 bp, Homo sapiens
gacaggtggggcctca

SEQ ID NO: 6201807 - DNA, 16 bp, Homo sapiens
gacaggtgtgagccac

SEQ ID NO: 6201808 - DNA, 18 bp, Homo sapiens
gacaggtgtgagccactg

SEQ ID NO: 6201809 - DNA, 20 bp, Homo sapiens
gacaggttcccagcagctgg

SEQ ID NO: 6201810 - DNA, 21 bp, Homo sapiens
gacaggttcccagcagctggg

SEQ ID NO: 6201811 - DNA, 15 bp, Homo sapiens
gacagtaattgtgtt

SEQ ID NO: 6201812 - DNA, 14 bp, Homo sapiens
gacagtagctctta

SEQ ID NO: 6201813 - DNA, 15 bp, Homo sapiens
gacagtatacagtcc

SEQ ID NO: 6201814 - DNA, 14 bp, Homo sapiens
gacagtatataact

SEQ ID NO: 6201815 - DNA, 14 bp, Homo sapiens
gacagtatatgtca

SEQ ID NO: 6201816 - DNA, 22 bp, Homo sapiens
gacagtatgagtcaatgtgcag

SEQ ID NO: 6201817 - DNA, 20 bp, Homo sapiens
gacagtatggcagctttcct

SEQ ID NO: 6201818 - DNA, 14 bp, Homo sapiens
gacagtattctcag

SEQ ID NO: 6201819 - DNA, 19 bp, Homo sapiens
gacagtattgccacctctg

SEQ ID NO: 6201820 - DNA, 15 bp, Homo sapiens
gacagtatttattgg

SEQ ID NO: 6201821 - DNA, 19 bp, Homo sapiens
gacagtatttattggtggg

SEQ ID NO: 6201822 - DNA, 15 bp, Homo sapiens
gacagtatttgtggg

SEQ ID NO: 6201823 - DNA, 13 bp, Homo sapiens
gacagtcaaaaga

SEQ ID NO: 6201824 - DNA, 19 bp, Homo sapiens
gacagtcaaggagtggctt

SEQ ID NO: 6201825 - DNA, 17 bp, Homo sapiens
gacagtcacctcatgga

SEQ ID NO: 6201826 - DNA, 19 bp, Homo sapiens
gacagtcactgcatttgcc

SEQ ID NO: 6201827 - DNA, 23 bp, Homo sapiens
gacagtcactgccactttgcaca

SEQ ID NO: 6201828 - DNA, 16 bp, Homo sapiens
gacagtcagcaacatg

SEQ ID NO: 6201829 - DNA, 19 bp, Homo sapiens
gacagtcaggaagcctcct

SEQ ID NO: 6201830 - DNA, 18 bp, Homo sapiens
gacagtcataaatactgt

SEQ ID NO: 6201831 - DNA, 21 bp, Homo sapiens
gacagtcataaatactgtcaa

SEQ ID NO: 6201832 - DNA, 18 bp, Homo sapiens
gacagtcatcatcagggc

SEQ ID NO: 6201833 - DNA, 19 bp, Homo sapiens
gacagtcatcatcagggcc

SEQ ID NO: 6201834 - DNA, 21 bp, Homo sapiens
gacagtcatcatcagggcctg

SEQ ID NO: 6201835 - DNA, 22 bp, Homo sapiens
gacagtcatcatcagggcctgg

SEQ ID NO: 6201836 - DNA, 23 bp, Homo sapiens
gacagtcattgtggatagagcag

SEQ ID NO: 6201837 - DNA, 15 bp, Homo sapiens
gacagtccagcctgg

SEQ ID NO: 6201838 - DNA, 16 bp, Homo sapiens
gacagtccagcctgga

SEQ ID NO: 6201839 - DNA, 17 bp, Homo sapiens
gacagtccagtgtcacc

SEQ ID NO: 6201840 - DNA, 17 bp, Homo sapiens
gacagtccattcatctt

SEQ ID NO: 6201841 - DNA, 13 bp, Homo sapiens
gacagtccctgct

SEQ ID NO: 6201842 - DNA, 16 bp, Homo sapiens
gacagtccctgctggg

SEQ ID NO: 6201843 - DNA, 13 bp, Homo sapiens
gacagtcctggga

SEQ ID NO: 6201844 - DNA, 18 bp, Homo sapiens
gacagtcctttcccacca

SEQ ID NO: 6201845 - DNA, 20 bp, Homo sapiens
gacagtcctttcccaccatt

SEQ ID NO: 6201846 - DNA, 18 bp, Homo sapiens
gacagtcggaaaagcgtc

SEQ ID NO: 6201847 - DNA, 17 bp, Homo sapiens
gacagtcggtgacccca

SEQ ID NO: 6201848 - DNA, 17 bp, Homo sapiens
gacagtcgttcccagtg

SEQ ID NO: 6201849 - DNA, 13 bp, Homo sapiens
gacagtctccctg

SEQ ID NO: 6201850 - DNA, 13 bp, Homo sapiens
gacagtctggaga

SEQ ID NO: 6201851 - DNA, 15 bp, Homo sapiens
gacagtctggagaag

SEQ ID NO: 6201852 - DNA, 14 bp, Homo sapiens
gacagtctggccac

SEQ ID NO: 6201853 - DNA, 15 bp, Homo sapiens
gacagtctgttatgc

SEQ ID NO: 6201854 - DNA, 15 bp, Homo sapiens
gacagtcttttatca

SEQ ID NO: 6201855 - DNA, 14 bp, Homo sapiens
gacagtgaaagaaa

SEQ ID NO: 6201856 - DNA, 20 bp, Homo sapiens
gacagtgaattgacccatgt

SEQ ID NO: 6201857 - DNA, 22 bp, Homo sapiens
gacagtgaattgacccatgttc

SEQ ID NO: 6201858 - DNA, 18 bp, Homo sapiens
gacagtgagacagtctgg

SEQ ID NO: 6201859 - DNA, 20 bp, Homo sapiens
gacagtgaggtcctgggggc

SEQ ID NO: 6201860 - DNA, 20 bp, Homo sapiens
gacagtgccatccccacctt

SEQ ID NO: 6201861 - DNA, 21 bp, Homo sapiens
gacagtgccatccccaccttc

SEQ ID NO: 6201862 - DNA, 17 bp, Homo sapiens
gacagtgcctcttccag

SEQ ID NO: 6201863 - DNA, 15 bp, Homo sapiens
gacagtgccttctct

SEQ ID NO: 6201864 - DNA, 16 bp, Homo sapiens
gacagtgctgacccca

SEQ ID NO: 6201865 - DNA, 22 bp, Homo sapiens
gacagtgctgcagctccctggc

SEQ ID NO: 6201866 - DNA, 14 bp, Homo sapiens
gacagtgctgccct

SEQ ID NO: 6201867 - DNA, 18 bp, Homo sapiens
gacagtgcttcagcctga

SEQ ID NO: 6201868 - DNA, 19 bp, Homo sapiens
gacagtgcttcagcctgag

SEQ ID NO: 6201869 - DNA, 20 bp, Homo sapiens
gacagtgcttcagcctgagg

SEQ ID NO: 6201870 - DNA, 20 bp, Homo sapiens
gacagtggattgcatttctt

SEQ ID NO: 6201871 - DNA, 16 bp, Homo sapiens
gacagtggcactaaaa

SEQ ID NO: 6201872 - DNA, 12 bp, Homo sapiens
gacagtggcagc

SEQ ID NO: 6201873 - DNA, 18 bp, Homo sapiens
gacagtggcagcaaagga

SEQ ID NO: 6201874 - DNA, 20 bp, Homo sapiens
gacagtggcagcaaaggaag

SEQ ID NO: 6201875 - DNA, 15 bp, Homo sapiens
gacagtggctctcca

SEQ ID NO: 6201876 - DNA, 16 bp, Homo sapiens
gacagtggctctccaa

SEQ ID NO: 6201877 - DNA, 17 bp, Homo sapiens
gacagtggctgctctgg

SEQ ID NO: 6201878 - DNA, 17 bp, Homo sapiens
gacagtgggcaggaggc

SEQ ID NO: 6201879 - DNA, 19 bp, Homo sapiens
gacagtggtgggcggggag

SEQ ID NO: 6201880 - DNA, 17 bp, Homo sapiens
gacagtggttatatttc

SEQ ID NO: 6201881 - DNA, 20 bp, Homo sapiens
gacagtgtatgtagaagcat

SEQ ID NO: 6201882 - DNA, 20 bp, Homo sapiens
gacagtgtgggcgctctccc

SEQ ID NO: 6201883 - DNA, 20 bp, Homo sapiens
gacagtgttttgcacatcat

SEQ ID NO: 6201884 - DNA, 22 bp, Homo sapiens
gacagttaagagaaatgagctt

SEQ ID NO: 6201885 - DNA, 21 bp, Homo sapiens
gacagttacaaaccaggtcac

SEQ ID NO: 6201886 - DNA, 17 bp, Homo sapiens
gacagttactcttcagt

SEQ ID NO: 6201887 - DNA, 21 bp, Homo sapiens
gacagttactcttcagtttta

SEQ ID NO: 6201888 - DNA, 20 bp, Homo sapiens
gacagttagcatttaccaac

SEQ ID NO: 6201889 - DNA, 14 bp, Homo sapiens
gacagttcaagaaa

SEQ ID NO: 6201890 - DNA, 18 bp, Homo sapiens
gacagttcattcagggcc

SEQ ID NO: 6201891 - DNA, 18 bp, Homo sapiens
gacagttgatggagcccc

SEQ ID NO: 6201892 - DNA, 20 bp, Homo sapiens
gacagttgattcaacaaagt

SEQ ID NO: 6201893 - DNA, 23 bp, Homo sapiens
gacagttggagggaaagccagcc

SEQ ID NO: 6201894 - DNA, 18 bp, Homo sapiens
gacagttggcagagaagg

SEQ ID NO: 6201895 - DNA, 16 bp, Homo sapiens
cttgccctaagcagaa

SEQ ID NO: 6201896 - DNA, 15 bp, Homo sapiens
cttgccctagatgag

SEQ ID NO: 6201897 - DNA, 15 bp, Homo sapiens
cttgccctattataa

SEQ ID NO: 6201898 - DNA, 16 bp, Homo sapiens
cttgccctattataat

SEQ ID NO: 6201899 - DNA, 18 bp, Homo sapiens
cttgccctattataattg

SEQ ID NO: 6201900 - DNA, 19 bp, Homo sapiens
cttgccctccctttctctc

SEQ ID NO: 6201901 - DNA, 16 bp, Homo sapiens
cttgccctccgcctgg

SEQ ID NO: 6201902 - DNA, 23 bp, Homo sapiens
cttgccctcctgggccctgggct

SEQ ID NO: 6201903 - DNA, 12 bp, Homo sapiens
cttgccctgacc

SEQ ID NO: 6201904 - DNA, 14 bp, Homo sapiens
cttgccctgagctt

SEQ ID NO: 6201905 - DNA, 11 bp, Homo sapiens
cttgccctgct

SEQ ID NO: 6201906 - DNA, 15 bp, Homo sapiens
cttgccctgctccct

SEQ ID NO: 6201907 - DNA, 10 bp, Homo sapiens
cttgccctgg

SEQ ID NO: 6201908 - DNA, 22 bp, Homo sapiens
cttgccctgggccagcccagga

SEQ ID NO: 6201909 - DNA, 17 bp, Homo sapiens
cttgccctgggctgcct

SEQ ID NO: 6201910 - DNA, 19 bp, Homo sapiens
cttgccctgggtcacctag

SEQ ID NO: 6201911 - DNA, 14 bp, Homo sapiens
cttgccctgtgttc

SEQ ID NO: 6201912 - DNA, 21 bp, Homo sapiens
cttgccctgtgttctttcccc

SEQ ID NO: 6201913 - DNA, 19 bp, Homo sapiens
cttgcccttccctgtccct

SEQ ID NO: 6201914 - DNA, 16 bp, Homo sapiens
cttgcccttgggtgct

SEQ ID NO: 6201915 - DNA, 20 bp, Homo sapiens
cttgccgaaactggaagtta

SEQ ID NO: 6201916 - DNA, 15 bp, Homo sapiens
cttgccgagagaggc

SEQ ID NO: 6201917 - DNA, 16 bp, Homo sapiens
cttgccgagagaggcg

SEQ ID NO: 6201918 - DNA, 14 bp, Homo sapiens
cttgccgagcctaa

SEQ ID NO: 6201919 - DNA, 17 bp, Homo sapiens
cttgccgcgcctggctt

SEQ ID NO: 6201920 - DNA, 21 bp, Homo sapiens
cttgccgcgtcgccctcccag

SEQ ID NO: 6201921 - DNA, 23 bp, Homo sapiens
cttgccgcgtcgccctcccaggc

SEQ ID NO: 6201922 - DNA, 13 bp, Homo sapiens
cttgccgctggga

SEQ ID NO: 6201923 - DNA, 14 bp, Homo sapiens
cttgccgctgggag

SEQ ID NO: 6201924 - DNA, 17 bp, Homo sapiens
cttgccgctgggagagc

SEQ ID NO: 6201925 - DNA, 23 bp, Homo sapiens
cttgccggctccccctccagcca

SEQ ID NO: 6201926 - DNA, 14 bp, Homo sapiens
cttgccggggcctg

SEQ ID NO: 6201927 - DNA, 15 bp, Homo sapiens
cttgccggggcctgg

SEQ ID NO: 6201928 - DNA, 18 bp, Homo sapiens
cttgccgtctacctgagg

SEQ ID NO: 6201929 - DNA, 21 bp, Homo sapiens
cttgcctaaatcccaagaaat

SEQ ID NO: 6201930 - DNA, 18 bp, Homo sapiens
cttgcctagccccaggtc

SEQ ID NO: 6201931 - DNA, 14 bp, Homo sapiens
cttgcctaggccaa

SEQ ID NO: 6201932 - DNA, 14 bp, Homo sapiens
cttgcctagggcct

SEQ ID NO: 6201933 - DNA, 16 bp, Homo sapiens
cttgcctagggcctgg

SEQ ID NO: 6201934 - DNA, 18 bp, Homo sapiens
cttgcctcaacctcccaa

SEQ ID NO: 6201935 - DNA, 21 bp, Homo sapiens
cttgcctcaagttccatgctt

SEQ ID NO: 6201936 - DNA, 15 bp, Homo sapiens
cttgcctcaatgcca

SEQ ID NO: 6201937 - DNA, 19 bp, Homo sapiens
cttgcctcagggccaagcc

SEQ ID NO: 6201938 - DNA, 21 bp, Homo sapiens
cttgcctccaggtgcagaggt

SEQ ID NO: 6201939 - DNA, 21 bp, Homo sapiens
cttgcctccatctttttcttg

SEQ ID NO: 6201940 - DNA, 20 bp, Homo sapiens
cttgcctccatggtgcctct

SEQ ID NO: 6201941 - DNA, 22 bp, Homo sapiens
cttgcctccatggtgcctctgg

SEQ ID NO: 6201942 - DNA, 15 bp, Homo sapiens
cttgcctcccctcct

SEQ ID NO: 6201943 - DNA, 14 bp, Homo sapiens
cttgcctccctcct

SEQ ID NO: 6201944 - DNA, 15 bp, Homo sapiens
cttgcctcctcagta

SEQ ID NO: 6201945 - DNA, 14 bp, Homo sapiens
cttgcctcctggaa

SEQ ID NO: 6201946 - DNA, 17 bp, Homo sapiens
cttgcctcctggaagaa

SEQ ID NO: 6201947 - DNA, 16 bp, Homo sapiens
cttgcctcggctcctg

SEQ ID NO: 6201948 - DNA, 17 bp, Homo sapiens
cttgcctcggctcctgc

SEQ ID NO: 6201949 - DNA, 23 bp, Homo sapiens
cttgcctcggctcctgctgcacc

SEQ ID NO: 6201950 - DNA, 13 bp, Homo sapiens
cttgcctctctca

SEQ ID NO: 6201951 - DNA, 14 bp, Homo sapiens
cttgcctctctcag

SEQ ID NO: 6201952 - DNA, 17 bp, Homo sapiens
cttgcctctctcaggag

SEQ ID NO: 6201953 - DNA, 15 bp, Homo sapiens
cttgcctctgcacac

SEQ ID NO: 6201954 - DNA, 19 bp, Homo sapiens
cttgcctctgccctggatt

SEQ ID NO: 6201955 - DNA, 16 bp, Homo sapiens
cttgcctctgtgctgt

SEQ ID NO: 6201956 - DNA, 19 bp, Homo sapiens
cttgcctctgtgctgtgtg

SEQ ID NO: 6201957 - DNA, 13 bp, Homo sapiens
cttgcctcttcct

SEQ ID NO: 6201958 - DNA, 16 bp, Homo sapiens
cttgcctcttccttga

SEQ ID NO: 6201959 - DNA, 18 bp, Homo sapiens
cttgcctctttcctcctc

SEQ ID NO: 6201960 - DNA, 21 bp, Homo sapiens
cttgcctcttttacctgctgc

SEQ ID NO: 6201961 - DNA, 12 bp, Homo sapiens
cttgcctgaggc

SEQ ID NO: 6201962 - DNA, 15 bp, Homo sapiens
cttgcctgaggctca

SEQ ID NO: 6201963 - DNA, 22 bp, Homo sapiens
cttgcctgaggctcaagaggcc

SEQ ID NO: 6201964 - DNA, 23 bp, Homo sapiens
cttgcctgaggctcaagaggccc

SEQ ID NO: 6201965 - DNA, 13 bp, Homo sapiens
cttgcctgagggg

SEQ ID NO: 6201966 - DNA, 23 bp, Homo sapiens
cttgcctgcacccttcctcctcc

SEQ ID NO: 6201967 - DNA, 13 bp, Homo sapiens
cttgcctgcaggc

SEQ ID NO: 6201968 - DNA, 16 bp, Homo sapiens
cttgcctgcagggcca

SEQ ID NO: 6201969 - DNA, 20 bp, Homo sapiens
cttgcctgcagggccatggc

SEQ ID NO: 6201970 - DNA, 21 bp, Homo sapiens
cttgcctgccactgtgtgaat

SEQ ID NO: 6201971 - DNA, 17 bp, Homo sapiens
cttgcctgccagggccc

SEQ ID NO: 6201972 - DNA, 15 bp, Homo sapiens
cttgcctgcctccta

SEQ ID NO: 6201973 - DNA, 16 bp, Homo sapiens
cttgcctgcctcctag

SEQ ID NO: 6201974 - DNA, 12 bp, Homo sapiens
cttgcctgcctg

SEQ ID NO: 6201975 - DNA, 15 bp, Homo sapiens
cttgcctgcctgcct

SEQ ID NO: 6201976 - DNA, 14 bp, Homo sapiens
cttgcctgctgctt

SEQ ID NO: 6201977 - DNA, 17 bp, Homo sapiens
cttgcctgctgggctcc

SEQ ID NO: 6201978 - DNA, 10 bp, Homo sapiens
cttgcctggg

SEQ ID NO: 6201979 - DNA, 17 bp, Homo sapiens
cttgcctgggctgggca

SEQ ID NO: 6201980 - DNA, 19 bp, Homo sapiens
cttgcctgggctgggcagc

SEQ ID NO: 6201981 - DNA, 20 bp, Homo sapiens
cttgcctgggctgggcagcc

SEQ ID NO: 6201982 - DNA, 12 bp, Homo sapiens
cttgcctggggc

SEQ ID NO: 6201983 - DNA, 17 bp, Homo sapiens
cttgcctggggtctgag

SEQ ID NO: 6201984 - DNA, 21 bp, Homo sapiens
cttgcctggggtctgagcatg

SEQ ID NO: 6201985 - DNA, 16 bp, Homo sapiens
cttgcctggtacagta

SEQ ID NO: 6201986 - DNA, 16 bp, Homo sapiens
cttgcctgtctaaagc

SEQ ID NO: 6201987 - DNA, 14 bp, Homo sapiens
cttgcctgtgccag

SEQ ID NO: 6201988 - DNA, 16 bp, Homo sapiens
cttgcctgtgccaggt

SEQ ID NO: 6201989 - DNA, 18 bp, Homo sapiens
cttgcctgttggctgctg

SEQ ID NO: 6201990 - DNA, 19 bp, Homo sapiens
cttgcctgttggctgctgc

SEQ ID NO: 6201991 - DNA, 23 bp, Homo sapiens
cttgccttaaacactcaccttct

SEQ ID NO: 6201992 - DNA, 23 bp, Homo sapiens
cttgccttaaatatatcccatat

SEQ ID NO: 6201993 - DNA, 19 bp, Homo sapiens
cttgccttaaccagtctct

SEQ ID NO: 6201994 - DNA, 16 bp, Homo sapiens
cttgccttaataaata

SEQ ID NO: 6201995 - DNA, 12 bp, Homo sapiens
cttgccttcccc

SEQ ID NO: 6201996 - DNA, 15 bp, Homo sapiens
cttgccttcctaagc

SEQ ID NO: 6201997 - DNA, 23 bp, Homo sapiens
cttgccttcctaagcctgtggct

SEQ ID NO: 6201998 - DNA, 19 bp, Homo sapiens
cttgccttcttcacccagc

SEQ ID NO: 6201999 - DNA, 20 bp, Homo sapiens
cttgccttgaggctctgcag

SEQ ID NO: 6202000 - DNA, 15 bp, Homo sapiens
cttgcctttccacct

SEQ ID NO: 6202001 - DNA, 20 bp, Homo sapiens
cttgcctttccacctgcttt

SEQ ID NO: 6202002 - DNA, 17 bp, Homo sapiens
cttgcctttcgaggcct

SEQ ID NO: 6202003 - DNA, 19 bp, Homo sapiens
cttgcctttcgaggcctga

SEQ ID NO: 6202004 - DNA, 12 bp, Homo sapiens
cttgcctttctc

SEQ ID NO: 6202005 - DNA, 14 bp, Homo sapiens
cttgcctttgaaga

SEQ ID NO: 6202006 - DNA, 12 bp, Homo sapiens
cttgcctttgtg

SEQ ID NO: 6202007 - DNA, 17 bp, Homo sapiens
cttgcctttgtggcctt

SEQ ID NO: 6202008 - DNA, 18 bp, Homo sapiens
cttgccttttaaaagaaa

SEQ ID NO: 6202009 - DNA, 19 bp, Homo sapiens
cttgccttttgttaatgca

SEQ ID NO: 6202010 - DNA, 14 bp, Homo sapiens
cttgcctttttcta

SEQ ID NO: 6202011 - DNA, 19 bp, Homo sapiens
cttgcgaactagagatgtg

SEQ ID NO: 6202012 - DNA, 14 bp, Homo sapiens
cttgcgaataacag

SEQ ID NO: 6202013 - DNA, 13 bp, Homo sapiens
cttgcgaccacca

SEQ ID NO: 6202014 - DNA, 18 bp, Homo sapiens
cttgcgaccaccaacaca

SEQ ID NO: 6202015 - DNA, 22 bp, Homo sapiens
cttgcgaccaccaacacacagg

SEQ ID NO: 6202016 - DNA, 16 bp, Homo sapiens
cttgcgagtccaaggc

SEQ ID NO: 6202017 - DNA, 23 bp, Homo sapiens
cttgcgccgagaccgcagaggga

SEQ ID NO: 6202018 - DNA, 13 bp, Homo sapiens
cttgcgcctcagc

SEQ ID NO: 6202019 - DNA, 21 bp, Homo sapiens
cttgcgcctcagccctcagtt

SEQ ID NO: 6202020 - DNA, 13 bp, Homo sapiens
cttgcgctgtccc

SEQ ID NO: 6202021 - DNA, 15 bp, Homo sapiens
cttgcgctgtcccag

SEQ ID NO: 6202022 - DNA, 16 bp, Homo sapiens
cttgcggaagccatag

SEQ ID NO: 6202023 - DNA, 16 bp, Homo sapiens
cttgcggaggtgaaga

SEQ ID NO: 6202024 - DNA, 17 bp, Homo sapiens
cttgcggcaaaaggaaa

SEQ ID NO: 6202025 - DNA, 15 bp, Homo sapiens
cttgcggcaccgccc

SEQ ID NO: 6202026 - DNA, 19 bp, Homo sapiens
cttgcggcaccgcccaccc

SEQ ID NO: 6202027 - DNA, 22 bp, Homo sapiens
cttgcggcaccgcccacccaca

SEQ ID NO: 6202028 - DNA, 15 bp, Homo sapiens
cttgcggctcctcag

SEQ ID NO: 6202029 - DNA, 16 bp, Homo sapiens
cttgcgtcctgcagag

SEQ ID NO: 6202030 - DNA, 18 bp, Homo sapiens
cttgcgtcctgcagagga

SEQ ID NO: 6202031 - DNA, 13 bp, Homo sapiens
cttgcgtggacag

SEQ ID NO: 6202032 - DNA, 22 bp, Homo sapiens
cttgcgtgtcaatttccctcag

SEQ ID NO: 6202033 - DNA, 13 bp, Homo sapiens
cttgctaaagcac

SEQ ID NO: 6202034 - DNA, 16 bp, Homo sapiens
cttgctaaagcacttt

SEQ ID NO: 6202035 - DNA, 17 bp, Homo sapiens
cttgctaaagcactttg

SEQ ID NO: 6202036 - DNA, 21 bp, Homo sapiens
cttgctaaagcactttgcact

SEQ ID NO: 6202037 - DNA, 15 bp, Homo sapiens
cttgctaagctccag

SEQ ID NO: 6202038 - DNA, 19 bp, Homo sapiens
cttgctaataaacactggc

SEQ ID NO: 6202039 - DNA, 22 bp, Homo sapiens
cttgctacaccccttttccagt

SEQ ID NO: 6202040 - DNA, 19 bp, Homo sapiens
cttgctaccaatctgtgag

SEQ ID NO: 6202041 - DNA, 18 bp, Homo sapiens
cttgctaccagtatttag

SEQ ID NO: 6202042 - DNA, 20 bp, Homo sapiens
cttgctaccagtatttagaa

SEQ ID NO: 6202043 - DNA, 16 bp, Homo sapiens
cttgctacttatcatt

SEQ ID NO: 6202044 - DNA, 21 bp, Homo sapiens
cttgctagacaaggttgctgt

SEQ ID NO: 6202045 - DNA, 15 bp, Homo sapiens
cttgctagccctggg

SEQ ID NO: 6202046 - DNA, 22 bp, Homo sapiens
cttgctagtattcgctgtgttc

SEQ ID NO: 6202047 - DNA, 16 bp, Homo sapiens
cttgctagtgatacac

SEQ ID NO: 6202048 - DNA, 19 bp, Homo sapiens
cttgctagtgatacactgt

SEQ ID NO: 6202049 - DNA, 23 bp, Homo sapiens
cttgctagtgatacactgtatct

SEQ ID NO: 6202050 - DNA, 20 bp, Homo sapiens
cttgctatgttgcccaagct

SEQ ID NO: 6202051 - DNA, 14 bp, Homo sapiens
cttgctattctgtc

SEQ ID NO: 6202052 - DNA, 17 bp, Homo sapiens
cttgctattctgtccct

SEQ ID NO: 6202053 - DNA, 23 bp, Homo sapiens
cttgctattctgtccctaggtgt

SEQ ID NO: 6202054 - DNA, 15 bp, Homo sapiens
cttgctattggaatg

SEQ ID NO: 6202055 - DNA, 16 bp, Homo sapiens
cttgctatttcaataa

SEQ ID NO: 6202056 - DNA, 18 bp, Homo sapiens
cttgctcaaaatctgtga

SEQ ID NO: 6202057 - DNA, 17 bp, Homo sapiens
cttgctcaagttcacca

SEQ ID NO: 6202058 - DNA, 19 bp, Homo sapiens
cttgctcaataaaggtcat

SEQ ID NO: 6202059 - DNA, 20 bp, Homo sapiens
cttgctcaataaaggtcata

SEQ ID NO: 6202060 - DNA, 17 bp, Homo sapiens
cttgctcagtgcctcct

SEQ ID NO: 6202061 - DNA, 22 bp, Homo sapiens
cttgctcagtgcctcctggccg

SEQ ID NO: 6202062 - DNA, 14 bp, Homo sapiens
cttgctcattaatt

SEQ ID NO: 6202063 - DNA, 21 bp, Homo sapiens
cttgctcattcttgaggagca

SEQ ID NO: 6202064 - DNA, 15 bp, Homo sapiens
cttgctccagattct

SEQ ID NO: 6202065 - DNA, 17 bp, Homo sapiens
cttgctccagattctga

SEQ ID NO: 6202066 - DNA, 19 bp, Homo sapiens
cttgctccagattctgatg

SEQ ID NO: 6202067 - DNA, 21 bp, Homo sapiens
cttgctccagattctgatgca

SEQ ID NO: 6202068 - DNA, 16 bp, Homo sapiens
cttgctccagcctgac

SEQ ID NO: 6202069 - DNA, 18 bp, Homo sapiens
cttgctccagcctgacaa

SEQ ID NO: 6202070 - DNA, 13 bp, Homo sapiens
cttgctccagggt

SEQ ID NO: 6202071 - DNA, 15 bp, Homo sapiens
cttgctccagggtct

SEQ ID NO: 6202072 - DNA, 21 bp, Homo sapiens
cttgctccagggtcttgggct

SEQ ID NO: 6202073 - DNA, 16 bp, Homo sapiens
cttgctcccaacccat

SEQ ID NO: 6202074 - DNA, 17 bp, Homo sapiens
cttgctcccaagcccct

SEQ ID NO: 6202075 - DNA, 17 bp, Homo sapiens
gacagttgggatccaaa

SEQ ID NO: 6202076 - DNA, 19 bp, Homo sapiens
gacagttgggtgagaacaa

SEQ ID NO: 6202077 - DNA, 14 bp, Homo sapiens
gacagttgggtgtg

SEQ ID NO: 6202078 - DNA, 17 bp, Homo sapiens
gacagttgggtgtgaga

SEQ ID NO: 6202079 - DNA, 18 bp, Homo sapiens
gacagttgtctagagata

SEQ ID NO: 6202080 - DNA, 14 bp, Homo sapiens
gacagttgtgcagg

SEQ ID NO: 6202081 - DNA, 23 bp, Homo sapiens
gacagtttaccagttgcctttta

SEQ ID NO: 6202082 - DNA, 15 bp, Homo sapiens
gacagtttactttgc

SEQ ID NO: 6202083 - DNA, 19 bp, Homo sapiens
gacagtttactttgccaac

SEQ ID NO: 6202084 - DNA, 15 bp, Homo sapiens
gacagtttataatag

SEQ ID NO: 6202085 - DNA, 19 bp, Homo sapiens
gacagtttatcatgaagcc

SEQ ID NO: 6202086 - DNA, 18 bp, Homo sapiens
gacagtttatcctgtctg

SEQ ID NO: 6202087 - DNA, 19 bp, Homo sapiens
gacagtttatcctgtctga

SEQ ID NO: 6202088 - DNA, 14 bp, Homo sapiens
gacagtttccaaat

SEQ ID NO: 6202089 - DNA, 16 bp, Homo sapiens
gacagtttcttgcaag

SEQ ID NO: 6202090 - DNA, 18 bp, Homo sapiens
gacagtttgtaaatgtta

SEQ ID NO: 6202091 - DNA, 20 bp, Homo sapiens
gacagttttccataaagaag

SEQ ID NO: 6202092 - DNA, 12 bp, Homo sapiens
gacagtttttga

SEQ ID NO: 6202093 - DNA, 14 bp, Homo sapiens
gacagtttttgaca

SEQ ID NO: 6202094 - DNA, 15 bp, Homo sapiens
gacataaaactttaa

SEQ ID NO: 6202095 - DNA, 15 bp, Homo sapiens
gacataaacaaagac

SEQ ID NO: 6202096 - DNA, 22 bp, Homo sapiens
gacataaacaaagacattgaca

SEQ ID NO: 6202097 - DNA, 22 bp, Homo sapiens
gacataaacccatctgtaatat

SEQ ID NO: 6202098 - DNA, 16 bp, Homo sapiens
gacataaagcctctga

SEQ ID NO: 6202099 - DNA, 14 bp, Homo sapiens
gacataaaggaaaa

SEQ ID NO: 6202100 - DNA, 21 bp, Homo sapiens
gacataaaggaaaagacacat

SEQ ID NO: 6202101 - DNA, 20 bp, Homo sapiens
gacataaagttgataaagat

SEQ ID NO: 6202102 - DNA, 16 bp, Homo sapiens
gacataaattgtaatt

SEQ ID NO: 6202103 - DNA, 15 bp, Homo sapiens
gacataacagtgcag

SEQ ID NO: 6202104 - DNA, 23 bp, Homo sapiens
gacataacgtttttcctttaaaa

SEQ ID NO: 6202105 - DNA, 19 bp, Homo sapiens
gacataactgacttagttc

SEQ ID NO: 6202106 - DNA, 19 bp, Homo sapiens
gacataagataaaatgatg

SEQ ID NO: 6202107 - DNA, 14 bp, Homo sapiens
gacataatttcagt

SEQ ID NO: 6202108 - DNA, 13 bp, Homo sapiens
gacataccccact

SEQ ID NO: 6202109 - DNA, 14 bp, Homo sapiens
gacataccccactg

SEQ ID NO: 6202110 - DNA, 17 bp, Homo sapiens
gacataccccactgggc

SEQ ID NO: 6202111 - DNA, 17 bp, Homo sapiens
gacataccccctccccc

SEQ ID NO: 6202112 - DNA, 19 bp, Homo sapiens
gacatacctaccagtatta

SEQ ID NO: 6202113 - DNA, 21 bp, Homo sapiens
gacataccttagactgaaaaa

SEQ ID NO: 6202114 - DNA, 16 bp, Homo sapiens
gacatacgcttttaat

SEQ ID NO: 6202115 - DNA, 21 bp, Homo sapiens
gacatacgcttttaatgaaaa

SEQ ID NO: 6202116 - DNA, 15 bp, Homo sapiens
gacatactaaccagc

SEQ ID NO: 6202117 - DNA, 22 bp, Homo sapiens
gacatactccttccatcaaata

SEQ ID NO: 6202118 - DNA, 14 bp, Homo sapiens
gacatactgctgga

SEQ ID NO: 6202119 - DNA, 14 bp, Homo sapiens
gacatacttgaagg

SEQ ID NO: 6202120 - DNA, 14 bp, Homo sapiens
gacatagagaaaag

SEQ ID NO: 6202121 - DNA, 17 bp, Homo sapiens
gacatagcacgaatctg

SEQ ID NO: 6202122 - DNA, 22 bp, Homo sapiens
gacatagccagcatttttgcat

SEQ ID NO: 6202123 - DNA, 21 bp, Homo sapiens
gacatagcctcatgttctgtg

SEQ ID NO: 6202124 - DNA, 22 bp, Homo sapiens
gacatagcctcatgttctgtgg

SEQ ID NO: 6202125 - DNA, 12 bp, Homo sapiens
gacatagccttt

SEQ ID NO: 6202126 - DNA, 18 bp, Homo sapiens
gacataggtcataaagca

SEQ ID NO: 6202127 - DNA, 21 bp, Homo sapiens
gacatagtggatggacagatg

SEQ ID NO: 6202128 - DNA, 18 bp, Homo sapiens
gacatataccttctcaaa

SEQ ID NO: 6202129 - DNA, 21 bp, Homo sapiens
gacatatattttttaaaataa

SEQ ID NO: 6202130 - DNA, 17 bp, Homo sapiens
gacatatcacatgtcag

SEQ ID NO: 6202131 - DNA, 15 bp, Homo sapiens
gacatatcatgtgtg

SEQ ID NO: 6202132 - DNA, 16 bp, Homo sapiens
gacatattatgcctga

SEQ ID NO: 6202133 - DNA, 13 bp, Homo sapiens
gacatattcaagt

SEQ ID NO: 6202134 - DNA, 13 bp, Homo sapiens
gacatattcattt

SEQ ID NO: 6202135 - DNA, 21 bp, Homo sapiens
gacatattcttggagaacttt

SEQ ID NO: 6202136 - DNA, 14 bp, Homo sapiens
gacatatttaactg

SEQ ID NO: 6202137 - DNA, 22 bp, Homo sapiens
gacatatttaatgttttaaatg

SEQ ID NO: 6202138 - DNA, 15 bp, Homo sapiens
gacatcaaagcctgg

SEQ ID NO: 6202139 - DNA, 20 bp, Homo sapiens
gacatcaaagcctggcctaa

SEQ ID NO: 6202140 - DNA, 21 bp, Homo sapiens
gacatcaaatttgccaccact

SEQ ID NO: 6202141 - DNA, 14 bp, Homo sapiens
gacatcaacagata

SEQ ID NO: 6202142 - DNA, 16 bp, Homo sapiens
gacatcaactgcatca

SEQ ID NO: 6202143 - DNA, 17 bp, Homo sapiens
gacatcaagtgccagat

SEQ ID NO: 6202144 - DNA, 14 bp, Homo sapiens
gacatcaatgaaac

SEQ ID NO: 6202145 - DNA, 18 bp, Homo sapiens
gacatcacagggcctcag

SEQ ID NO: 6202146 - DNA, 19 bp, Homo sapiens
gacatcacagggcctcagt

SEQ ID NO: 6202147 - DNA, 22 bp, Homo sapiens
gacatcagaagtaactcccact

SEQ ID NO: 6202148 - DNA, 13 bp, Homo sapiens
gacatcagatttc

SEQ ID NO: 6202149 - DNA, 15 bp, Homo sapiens
gacatcagatttctt

SEQ ID NO: 6202150 - DNA, 18 bp, Homo sapiens
gacatcagcatcacctag

SEQ ID NO: 6202151 - DNA, 13 bp, Homo sapiens
gacatcagccagc

SEQ ID NO: 6202152 - DNA, 16 bp, Homo sapiens
gacatcagccagctgc

SEQ ID NO: 6202153 - DNA, 13 bp, Homo sapiens
gacatcaggaagg

SEQ ID NO: 6202154 - DNA, 19 bp, Homo sapiens
gacatcagtggcatggctc

SEQ ID NO: 6202155 - DNA, 13 bp, Homo sapiens
gacatcagtgttt

SEQ ID NO: 6202156 - DNA, 21 bp, Homo sapiens
gacatcagttcctttgtgtgt

SEQ ID NO: 6202157 - DNA, 21 bp, Homo sapiens
gacatcatcattcttgtggga

SEQ ID NO: 6202158 - DNA, 22 bp, Homo sapiens
gacatcattcatgacaacatga

SEQ ID NO: 6202159 - DNA, 13 bp, Homo sapiens
gacatcattgtca

SEQ ID NO: 6202160 - DNA, 22 bp, Homo sapiens
gacatcattgtcagccttgcta

SEQ ID NO: 6202161 - DNA, 18 bp, Homo sapiens
gacatcatttgtattatg

SEQ ID NO: 6202162 - DNA, 15 bp, Homo sapiens
gacatccaagcttcc

SEQ ID NO: 6202163 - DNA, 14 bp, Homo sapiens
gacatccacatgca

SEQ ID NO: 6202164 - DNA, 13 bp, Homo sapiens
gacatccagcaga

SEQ ID NO: 6202165 - DNA, 22 bp, Homo sapiens
gacatccagcagatttccagcc

SEQ ID NO: 6202166 - DNA, 13 bp, Homo sapiens
gacatccaggagg

SEQ ID NO: 6202167 - DNA, 18 bp, Homo sapiens
gacatccaggatggctgc

SEQ ID NO: 6202168 - DNA, 23 bp, Homo sapiens
gacatccatgttccgagaagaac

SEQ ID NO: 6202169 - DNA, 17 bp, Homo sapiens
gacatcccctgctggcc

SEQ ID NO: 6202170 - DNA, 12 bp, Homo sapiens
gacatcccttcc

SEQ ID NO: 6202171 - DNA, 13 bp, Homo sapiens
gacatcccttcct

SEQ ID NO: 6202172 - DNA, 17 bp, Homo sapiens
gacatcccttcctggaa

SEQ ID NO: 6202173 - DNA, 22 bp, Homo sapiens
gacatcccttcctggaaacagc

SEQ ID NO: 6202174 - DNA, 16 bp, Homo sapiens
gacatccgttgtgctt

SEQ ID NO: 6202175 - DNA, 20 bp, Homo sapiens
gacatcctagccccacccag

SEQ ID NO: 6202176 - DNA, 20 bp, Homo sapiens
gacatcctcaaaagaaagag

SEQ ID NO: 6202177 - DNA, 13 bp, Homo sapiens
gacatcctcttct

SEQ ID NO: 6202178 - DNA, 16 bp, Homo sapiens
gacatcctcttctgct

SEQ ID NO: 6202179 - DNA, 17 bp, Homo sapiens
gacatcctgacctcctg

SEQ ID NO: 6202180 - DNA, 21 bp, Homo sapiens
gacatcctgtataagcactga

SEQ ID NO: 6202181 - DNA, 20 bp, Homo sapiens
gacatcctgtcatctgagaa

SEQ ID NO: 6202182 - DNA, 14 bp, Homo sapiens
gacatccttgcagt

SEQ ID NO: 6202183 - DNA, 16 bp, Homo sapiens
gacatcgatatgaaaa

SEQ ID NO: 6202184 - DNA, 17 bp, Homo sapiens
gacatcgatatgaaaaa

SEQ ID NO: 6202185 - DNA, 15 bp, Homo sapiens
gacatcggaaaaata

SEQ ID NO: 6202186 - DNA, 15 bp, Homo sapiens
gacatcggttcagga

SEQ ID NO: 6202187 - DNA, 20 bp, Homo sapiens
gacatctacgaagccacagg

SEQ ID NO: 6202188 - DNA, 21 bp, Homo sapiens
gacatctacgaagccacaggc

SEQ ID NO: 6202189 - DNA, 15 bp, Homo sapiens
gacatctcaggattt

SEQ ID NO: 6202190 - DNA, 15 bp, Homo sapiens
gacatctcaggggcc

SEQ ID NO: 6202191 - DNA, 17 bp, Homo sapiens
gacatctcaggggccag

SEQ ID NO: 6202192 - DNA, 22 bp, Homo sapiens
gacatctcaggggccagaggaa

SEQ ID NO: 6202193 - DNA, 14 bp, Homo sapiens
gacatctctctggc

SEQ ID NO: 6202194 - DNA, 17 bp, Homo sapiens
gacatctctgcaccctg

SEQ ID NO: 6202195 - DNA, 21 bp, Homo sapiens
gacatctctggagccagagag

SEQ ID NO: 6202196 - DNA, 22 bp, Homo sapiens
gacatctctggagccagagaga

SEQ ID NO: 6202197 - DNA, 17 bp, Homo sapiens
gacatctgaccccaagg

SEQ ID NO: 6202198 - DNA, 12 bp, Homo sapiens
gacatctgagga

SEQ ID NO: 6202199 - DNA, 23 bp, Homo sapiens
gacatctgattggcagatgagct

SEQ ID NO: 6202200 - DNA, 22 bp, Homo sapiens
gacatctggaatctggagacca

SEQ ID NO: 6202201 - DNA, 23 bp, Homo sapiens
gacatcttgcctacttttcttta

SEQ ID NO: 6202202 - DNA, 14 bp, Homo sapiens
gacatctttaacat

SEQ ID NO: 6202203 - DNA, 18 bp, Homo sapiens
gacatgaaaactatttta

SEQ ID NO: 6202204 - DNA, 17 bp, Homo sapiens
gacatgaaaagttattt

SEQ ID NO: 6202205 - DNA, 23 bp, Homo sapiens
gacatgaaaatagcaatattctt

SEQ ID NO: 6202206 - DNA, 15 bp, Homo sapiens
gacatgaaataaaga

SEQ ID NO: 6202207 - DNA, 22 bp, Homo sapiens
gacatgaagccacgggtgccag

SEQ ID NO: 6202208 - DNA, 16 bp, Homo sapiens
gacatgaagctgttgt

SEQ ID NO: 6202209 - DNA, 22 bp, Homo sapiens
gacatgaatactatccatgtaa

SEQ ID NO: 6202210 - DNA, 12 bp, Homo sapiens
gacatgaatatg

SEQ ID NO: 6202211 - DNA, 16 bp, Homo sapiens
gacatgaatgcacact

SEQ ID NO: 6202212 - DNA, 17 bp, Homo sapiens
gacatgaattttagctt

SEQ ID NO: 6202213 - DNA, 20 bp, Homo sapiens
gacatgaccctctgtcccca

SEQ ID NO: 6202214 - DNA, 23 bp, Homo sapiens
gacatgaccctctgtccccaggc

SEQ ID NO: 6202215 - DNA, 17 bp, Homo sapiens
gacatgagactaagaga

SEQ ID NO: 6202216 - DNA, 14 bp, Homo sapiens
gacatgagatcagg

SEQ ID NO: 6202217 - DNA, 23 bp, Homo sapiens
gacatgagatcagggcctgcccc

SEQ ID NO: 6202218 - DNA, 12 bp, Homo sapiens
gacatgagatgg

SEQ ID NO: 6202219 - DNA, 14 bp, Homo sapiens
gacatgagattcca

SEQ ID NO: 6202220 - DNA, 22 bp, Homo sapiens
gacatgagattttattttttgt

SEQ ID NO: 6202221 - DNA, 23 bp, Homo sapiens
gacatgatactgatgccatgttt

SEQ ID NO: 6202222 - DNA, 17 bp, Homo sapiens
gacatgatgctaagagt

SEQ ID NO: 6202223 - DNA, 21 bp, Homo sapiens
gacatgatggagcgcacctgc

SEQ ID NO: 6202224 - DNA, 16 bp, Homo sapiens
gacatgattccttcct

SEQ ID NO: 6202225 - DNA, 22 bp, Homo sapiens
gacatgattccttcctgttctg

SEQ ID NO: 6202226 - DNA, 23 bp, Homo sapiens
gacatgatttagggaagcaggga

SEQ ID NO: 6202227 - DNA, 14 bp, Homo sapiens
gacatgatttcctt

SEQ ID NO: 6202228 - DNA, 17 bp, Homo sapiens
gacatgatttccttgaa

SEQ ID NO: 6202229 - DNA, 15 bp, Homo sapiens
gacatgcaataaaat

SEQ ID NO: 6202230 - DNA, 20 bp, Homo sapiens
gacatgcacccgcatgtaca

SEQ ID NO: 6202231 - DNA, 14 bp, Homo sapiens
gacatgcactcagc

SEQ ID NO: 6202232 - DNA, 20 bp, Homo sapiens
gacatgcactgacccttcca

SEQ ID NO: 6202233 - DNA, 17 bp, Homo sapiens
gacatgcaggtcaaaag

SEQ ID NO: 6202234 - DNA, 14 bp, Homo sapiens
gacatgcagttata

SEQ ID NO: 6202235 - DNA, 22 bp, Homo sapiens
gacatgcagttatatattttgt

SEQ ID NO: 6202236 - DNA, 19 bp, Homo sapiens
gacatgcataaaaattaaa

SEQ ID NO: 6202237 - DNA, 19 bp, Homo sapiens
gacatgccaactcgggagc

SEQ ID NO: 6202238 - DNA, 14 bp, Homo sapiens
gacatgccaccctc

SEQ ID NO: 6202239 - DNA, 16 bp, Homo sapiens
gacatgccaccctctc

SEQ ID NO: 6202240 - DNA, 18 bp, Homo sapiens
gacatgccaccctctcca

SEQ ID NO: 6202241 - DNA, 24 bp, Homo sapiens
gacatgccaccctctccatgccca

SEQ ID NO: 6202242 - DNA, 12 bp, Homo sapiens
gacatgcctgtc

SEQ ID NO: 6202243 - DNA, 14 bp, Homo sapiens
gacatgcgggctgg

SEQ ID NO: 6202244 - DNA, 17 bp, Homo sapiens
gacatgcgtgtgtcagg

SEQ ID NO: 6202245 - DNA, 12 bp, Homo sapiens
gacatgctcaca

SEQ ID NO: 6202246 - DNA, 16 bp, Homo sapiens
gacatgctcacctcta

SEQ ID NO: 6202247 - DNA, 22 bp, Homo sapiens
gacatgctctccccacaggggg

SEQ ID NO: 6202248 - DNA, 20 bp, Homo sapiens
gacatgctctttttttaagt

SEQ ID NO: 6202249 - DNA, 14 bp, Homo sapiens
gacatgctgaagcc

SEQ ID NO: 6202250 - DNA, 15 bp, Homo sapiens
gacatgctgccagga

SEQ ID NO: 6202251 - DNA, 22 bp, Homo sapiens
gacatgctgcccaccccctgct

SEQ ID NO: 6202252 - DNA, 21 bp, Homo sapiens
gacatgcttttctgccactcc

SEQ ID NO: 6202253 - DNA, 22 bp, Homo sapiens
gacatgcttttctgccactcca

SEQ ID NO: 6202254 - DNA, 19 bp, Homo sapiens
gacatggaatttatgaatg

SEQ ID NO: 6202255 - DNA, 13 bp, Homo sapiens
gacatggaccagc

SEQ ID NO: 6202256 - DNA, 14 bp, Homo sapiens
gacatggaccagca

SEQ ID NO: 6202257 - DNA, 20 bp, Homo sapiens
gacatggaccagcatctggt

SEQ ID NO: 6202258 - DNA, 22 bp, Homo sapiens
gacatggacccactacccttct

SEQ ID NO: 6202259 - DNA, 16 bp, Homo sapiens
gacatggacccggagc

SEQ ID NO: 6202260 - DNA, 23 bp, Homo sapiens
gacatggaccttctctccagagc

SEQ ID NO: 6202261 - DNA, 20 bp, Homo sapiens
gacatggagactcctgccct

SEQ ID NO: 6202262 - DNA, 14 bp, Homo sapiens
gacatggaggttct

SEQ ID NO: 6202263 - DNA, 21 bp, Homo sapiens
gacatggaggttctaaggcct

SEQ ID NO: 6202264 - DNA, 17 bp, Homo sapiens
gacatggagtgttactg

SEQ ID NO: 6202265 - DNA, 19 bp, Homo sapiens
gacatggatgcgaggacca

SEQ ID NO: 6202266 - DNA, 21 bp, Homo sapiens
gacatggcccattggagcacc

SEQ ID NO: 6202267 - DNA, 20 bp, Homo sapiens
gacatggctccggcctctgc

SEQ ID NO: 6202268 - DNA, 14 bp, Homo sapiens
gacatggctgttca

SEQ ID NO: 6202269 - DNA, 12 bp, Homo sapiens
gacatgggcagc

SEQ ID NO: 6202270 - DNA, 21 bp, Homo sapiens
gacatgggcctcccactcctg

SEQ ID NO: 6202271 - DNA, 21 bp, Homo sapiens
gacatgggctatcagggagga

SEQ ID NO: 6202272 - DNA, 18 bp, Homo sapiens
gacatggggaaggcagag

SEQ ID NO: 6202273 - DNA, 22 bp, Homo sapiens
gacatggggaaggcagaggctg

SEQ ID NO: 6202274 - DNA, 16 bp, Homo sapiens
gacatggggaggaagg

SEQ ID NO: 6202275 - DNA, 17 bp, Homo sapiens
gacatggggcaagccag

SEQ ID NO: 6202276 - DNA, 21 bp, Homo sapiens
gacatggggcaagccagggcc

SEQ ID NO: 6202277 - DNA, 24 bp, Homo sapiens
gacatggggcaagccagggcccag

SEQ ID NO: 6202278 - DNA, 14 bp, Homo sapiens
gacatggggcatag

SEQ ID NO: 6202279 - DNA, 17 bp, Homo sapiens
gacatggggcatagaaa

SEQ ID NO: 6202280 - DNA, 22 bp, Homo sapiens
gacatgggtattttataatgtt

SEQ ID NO: 6202281 - DNA, 19 bp, Homo sapiens
gacatggtcacagtcctat

SEQ ID NO: 6202282 - DNA, 17 bp, Homo sapiens
gacatggtgcctgagag

SEQ ID NO: 6202283 - DNA, 21 bp, Homo sapiens
gacatggtgcctgagaggcag

SEQ ID NO: 6202284 - DNA, 22 bp, Homo sapiens
gacatggtgcctgagaggcagg

SEQ ID NO: 6202285 - DNA, 15 bp, Homo sapiens
gacatggtgctgtgt

SEQ ID NO: 6202286 - DNA, 16 bp, Homo sapiens
gacatggtgctgtgtg

SEQ ID NO: 6202287 - DNA, 19 bp, Homo sapiens
gacatggtgtgccacaggc

SEQ ID NO: 6202288 - DNA, 22 bp, Homo sapiens
gacatggttgggggaatgcacc

SEQ ID NO: 6202289 - DNA, 16 bp, Homo sapiens
gacatgtaaaaagaca

SEQ ID NO: 6202290 - DNA, 12 bp, Homo sapiens
gacatgtacaga

SEQ ID NO: 6202291 - DNA, 19 bp, Homo sapiens
gacatgtaccccctttccc

SEQ ID NO: 6202292 - DNA, 22 bp, Homo sapiens
gacatgtaccccctttcccttc

SEQ ID NO: 6202293 - DNA, 16 bp, Homo sapiens
gacatgtactgagaca

SEQ ID NO: 6202294 - DNA, 22 bp, Homo sapiens
gacatgtactgctagtacctgt

SEQ ID NO: 6202295 - DNA, 12 bp, Homo sapiens
gacatgtagctt

SEQ ID NO: 6202296 - DNA, 23 bp, Homo sapiens
gacatgtatactccatagaaact

SEQ ID NO: 6202297 - DNA, 19 bp, Homo sapiens
gacatgtctactttttaat

SEQ ID NO: 6202298 - DNA, 17 bp, Homo sapiens
gacatgtctgttctaca

SEQ ID NO: 6202299 - DNA, 16 bp, Homo sapiens
gacatgtgaggaggaa

SEQ ID NO: 6202300 - DNA, 22 bp, Homo sapiens
gacatgtgcaattgtgagggac

SEQ ID NO: 6202301 - DNA, 14 bp, Homo sapiens
gacatgtgcagtgc

SEQ ID NO: 6202302 - DNA, 15 bp, Homo sapiens
gacatgtgcagtgct

SEQ ID NO: 6202303 - DNA, 22 bp, Homo sapiens
gacatgtgctctggggaattct

SEQ ID NO: 6202304 - DNA, 18 bp, Homo sapiens
gacatgtggaaagtgaat

SEQ ID NO: 6202305 - DNA, 19 bp, Homo sapiens
gacatgtggaaagtgaatt

SEQ ID NO: 6202306 - DNA, 24 bp, Homo sapiens
gacatgtggaggggcagcctgtgc

SEQ ID NO: 6202307 - DNA, 15 bp, Homo sapiens
gacatgtgggtggag

SEQ ID NO: 6202308 - DNA, 23 bp, Homo sapiens
gacatgtgggtggagaagggagg

SEQ ID NO: 6202309 - DNA, 16 bp, Homo sapiens
gacatgtggtgggaca

SEQ ID NO: 6202310 - DNA, 18 bp, Homo sapiens
gacatgttcctttaaggt

SEQ ID NO: 6202311 - DNA, 15 bp, Homo sapiens
gacatgttgtaaatt

SEQ ID NO: 6202312 - DNA, 13 bp, Homo sapiens
gacatgtttcaca

SEQ ID NO: 6202313 - DNA, 16 bp, Homo sapiens
gacatgtttcacaaca

SEQ ID NO: 6202314 - DNA, 21 bp, Homo sapiens
gacatgtttgagaacccccta

SEQ ID NO: 6202315 - DNA, 17 bp, Homo sapiens
gacatgttttccgtgaa

SEQ ID NO: 6202316 - DNA, 14 bp, Homo sapiens
gacattaaacctgg

SEQ ID NO: 6202317 - DNA, 15 bp, Homo sapiens
gacattaaacctgga

SEQ ID NO: 6202318 - DNA, 22 bp, Homo sapiens
gacattaacagttttccatgaa

SEQ ID NO: 6202319 - DNA, 23 bp, Homo sapiens
gacattaacagttttccatgaaa

SEQ ID NO: 6202320 - DNA, 14 bp, Homo sapiens
gacattaactcatt

SEQ ID NO: 6202321 - DNA, 22 bp, Homo sapiens
gacattaagcatcacaaatgat

SEQ ID NO: 6202322 - DNA, 18 bp, Homo sapiens
gacattaataaagttgct

SEQ ID NO: 6202323 - DNA, 21 bp, Homo sapiens
gacattacagaccatggatat

SEQ ID NO: 6202324 - DNA, 13 bp, Homo sapiens
gacattagaaaaa

SEQ ID NO: 6202325 - DNA, 14 bp, Homo sapiens
gacattagaaaaaa

SEQ ID NO: 6202326 - DNA, 14 bp, Homo sapiens
gacattagagaaaa

SEQ ID NO: 6202327 - DNA, 20 bp, Homo sapiens
gacattagtaacataataaa

SEQ ID NO: 6202328 - DNA, 15 bp, Homo sapiens
gacattatagacatt

SEQ ID NO: 6202329 - DNA, 14 bp, Homo sapiens
gacattatgtgagt

SEQ ID NO: 6202330 - DNA, 17 bp, Homo sapiens
gacattatgtggtttta

SEQ ID NO: 6202331 - DNA, 23 bp, Homo sapiens
gacattatgtgtgcatgtgtgta

SEQ ID NO: 6202332 - DNA, 13 bp, Homo sapiens
gacattatgtttt

SEQ ID NO: 6202333 - DNA, 14 bp, Homo sapiens
gacattatgtttta

SEQ ID NO: 6202334 - DNA, 23 bp, Homo sapiens
gacattatgttttatttaaatgc

SEQ ID NO: 6202335 - DNA, 20 bp, Homo sapiens
gacattattaaagttttcaa

SEQ ID NO: 6202336 - DNA, 13 bp, Homo sapiens
gacattatttcgt

SEQ ID NO: 6202337 - DNA, 21 bp, Homo sapiens
gacattcaaaaaactctctcc

SEQ ID NO: 6202338 - DNA, 21 bp, Homo sapiens
gacattcacctgccccaactc

SEQ ID NO: 6202339 - DNA, 18 bp, Homo sapiens
gacattcactgctgattt

SEQ ID NO: 6202340 - DNA, 17 bp, Homo sapiens
gacattccatgacgaca

SEQ ID NO: 6202341 - DNA, 15 bp, Homo sapiens
gacattcccctccca

SEQ ID NO: 6202342 - DNA, 23 bp, Homo sapiens
gacattccgtcctgatgattttt

SEQ ID NO: 6202343 - DNA, 22 bp, Homo sapiens
gacattcctaaactatcttttt

SEQ ID NO: 6202344 - DNA, 23 bp, Homo sapiens
gacattcctgggcacagtttggt

SEQ ID NO: 6202345 - DNA, 19 bp, Homo sapiens
gacattccttctacatgta

SEQ ID NO: 6202346 - DNA, 14 bp, Homo sapiens
gacattcctttgaa

SEQ ID NO: 6202347 - DNA, 13 bp, Homo sapiens
gacattctaatgc

SEQ ID NO: 6202348 - DNA, 16 bp, Homo sapiens
gacattctaatgcata

SEQ ID NO: 6202349 - DNA, 20 bp, Homo sapiens
gacattctaatgcatattta

SEQ ID NO: 6202350 - DNA, 19 bp, Homo sapiens
gacattctctattgtaatt

SEQ ID NO: 6202351 - DNA, 23 bp, Homo sapiens
gacattctctattgtaattttgt

SEQ ID NO: 6202352 - DNA, 16 bp, Homo sapiens
gacattctctttgata

SEQ ID NO: 6202353 - DNA, 20 bp, Homo sapiens
gacattctgaatgcttctaa

SEQ ID NO: 6202354 - DNA, 14 bp, Homo sapiens
gacattctgccagg

SEQ ID NO: 6202355 - DNA, 11 bp, Homo sapiens
gacattctgtc

SEQ ID NO: 6202356 - DNA, 24 bp, Homo sapiens
gacattcttgtaaggctttgatta

SEQ ID NO: 6202357 - DNA, 16 bp, Homo sapiens
gacattcttttaatgc

SEQ ID NO: 6202358 - DNA, 16 bp, Homo sapiens
gacattgaaactacac

SEQ ID NO: 6202359 - DNA, 15 bp, Homo sapiens
gacattgacagcaat

SEQ ID NO: 6202360 - DNA, 18 bp, Homo sapiens
gacattgccaaaaaggat

SEQ ID NO: 6202361 - DNA, 15 bp, Homo sapiens
gacattgccccaaga

SEQ ID NO: 6202362 - DNA, 14 bp, Homo sapiens
gacattgcggacag

SEQ ID NO: 6202363 - DNA, 21 bp, Homo sapiens
gacattgcgtttgacctttta

SEQ ID NO: 6202364 - DNA, 22 bp, Homo sapiens
gacattgctccaagatgttctc

SEQ ID NO: 6202365 - DNA, 16 bp, Homo sapiens
gacattgctctctggg

SEQ ID NO: 6202366 - DNA, 14 bp, Homo sapiens
gacattgctggtca

SEQ ID NO: 6202367 - DNA, 13 bp, Homo sapiens
gacattgtaaacg

SEQ ID NO: 6202368 - DNA, 17 bp, Homo sapiens
gacattgtatgcaggga

SEQ ID NO: 6202369 - DNA, 13 bp, Homo sapiens
gacattgtcagaa

SEQ ID NO: 6202370 - DNA, 15 bp, Homo sapiens
gacattgtcagaatg

SEQ ID NO: 6202371 - DNA, 12 bp, Homo sapiens
gacattgtctcc

SEQ ID NO: 6202372 - DNA, 13 bp, Homo sapiens
gacattgtctccc

SEQ ID NO: 6202373 - DNA, 22 bp, Homo sapiens
gacattgtttggatttccttta

SEQ ID NO: 6202374 - DNA, 21 bp, Homo sapiens
gacatttaaaatagttttcta

SEQ ID NO: 6202375 - DNA, 15 bp, Homo sapiens
gacatttaaatgtaa

SEQ ID NO: 6202376 - DNA, 17 bp, Homo sapiens
gacatttaacttttcta

SEQ ID NO: 6202377 - DNA, 22 bp, Homo sapiens
gacatttaataactttgctgga

SEQ ID NO: 6202378 - DNA, 23 bp, Homo sapiens
gacatttacaccacactttcaaa

SEQ ID NO: 6202379 - DNA, 17 bp, Homo sapiens
gacatttacaggagggc

SEQ ID NO: 6202380 - DNA, 19 bp, Homo sapiens
gacatttacaggagggccc

SEQ ID NO: 6202381 - DNA, 18 bp, Homo sapiens
gacatttacctttttgaa

SEQ ID NO: 6202382 - DNA, 14 bp, Homo sapiens
gacatttagaactt

SEQ ID NO: 6202383 - DNA, 15 bp, Homo sapiens
gacatttagaagaaa

SEQ ID NO: 6202384 - DNA, 15 bp, Homo sapiens
gacatttatattaaa

SEQ ID NO: 6202385 - DNA, 14 bp, Homo sapiens
gacatttatatttg

SEQ ID NO: 6202386 - DNA, 18 bp, Homo sapiens
gacatttatatttgtgta

SEQ ID NO: 6202387 - DNA, 15 bp, Homo sapiens
gacatttatctttgt

SEQ ID NO: 6202388 - DNA, 23 bp, Homo sapiens
gacatttatgtctcatgtaattt

SEQ ID NO: 6202389 - DNA, 16 bp, Homo sapiens
gacatttatgtgttga

SEQ ID NO: 6202390 - DNA, 14 bp, Homo sapiens
gacatttcactaaa

SEQ ID NO: 6202391 - DNA, 19 bp, Homo sapiens
gacatttcatccaccaata

SEQ ID NO: 6202392 - DNA, 13 bp, Homo sapiens
gacatttcatctg

SEQ ID NO: 6202393 - DNA, 15 bp, Homo sapiens
gacatttcccaagtc

SEQ ID NO: 6202394 - DNA, 22 bp, Homo sapiens
gacatttcccaagtcagacaga

SEQ ID NO: 6202395 - DNA, 11 bp, Homo sapiens
gacatttccct

SEQ ID NO: 6202396 - DNA, 22 bp, Homo sapiens
gacatttctaacatatgtatta

SEQ ID NO: 6202397 - DNA, 21 bp, Homo sapiens
gacatttctctaactcctgcc

SEQ ID NO: 6202398 - DNA, 20 bp, Homo sapiens
gacatttctcttactgcaaa

SEQ ID NO: 6202399 - DNA, 15 bp, Homo sapiens
gacatttctttctgt

SEQ ID NO: 6202400 - DNA, 16 bp, Homo sapiens
gacatttctttggaaa

SEQ ID NO: 6202401 - DNA, 16 bp, Homo sapiens
gacatttctttgtgct

SEQ ID NO: 6202402 - DNA, 23 bp, Homo sapiens
gacatttcttttctttttacata

SEQ ID NO: 6202403 - DNA, 17 bp, Homo sapiens
gacatttgctgaactca

SEQ ID NO: 6202404 - DNA, 19 bp, Homo sapiens
gacatttgggactgtcttg

SEQ ID NO: 6202405 - DNA, 23 bp, Homo sapiens
gacatttgggagacatgtgacat

SEQ ID NO: 6202406 - DNA, 14 bp, Homo sapiens
gacatttgtatatt

SEQ ID NO: 6202407 - DNA, 16 bp, Homo sapiens
gacatttgtcattttc

SEQ ID NO: 6202408 - DNA, 20 bp, Homo sapiens
gacatttgtcctgcagagct

SEQ ID NO: 6202409 - DNA, 22 bp, Homo sapiens
gacatttgtcctgcagagctgg

SEQ ID NO: 6202410 - DNA, 13 bp, Homo sapiens
gacattttaaaaa

SEQ ID NO: 6202411 - DNA, 20 bp, Homo sapiens
gacattttaaacacttacaa

SEQ ID NO: 6202412 - DNA, 19 bp, Homo sapiens
gacattttaacaagaagat

SEQ ID NO: 6202413 - DNA, 20 bp, Homo sapiens
gacattttaacaagaagatg

SEQ ID NO: 6202414 - DNA, 15 bp, Homo sapiens
gacattttacattaa

SEQ ID NO: 6202415 - DNA, 20 bp, Homo sapiens
gacattttatgtctttcttg

SEQ ID NO: 6202416 - DNA, 14 bp, Homo sapiens
gacattttcctcac

SEQ ID NO: 6202417 - DNA, 17 bp, Homo sapiens
gacattttctctttaaa

SEQ ID NO: 6202418 - DNA, 21 bp, Homo sapiens
gacattttctctttaaaagaa

SEQ ID NO: 6202419 - DNA, 12 bp, Homo sapiens
gacattttctgg

SEQ ID NO: 6202420 - DNA, 22 bp, Homo sapiens
gacattttcttttattatcagt

SEQ ID NO: 6202421 - DNA, 14 bp, Homo sapiens
gacattttcttttt

SEQ ID NO: 6202422 - DNA, 21 bp, Homo sapiens
gacattttgtttttactgtat

SEQ ID NO: 6202423 - DNA, 19 bp, Homo sapiens
gacatttttcattcatgaa

SEQ ID NO: 6202424 - DNA, 16 bp, Homo sapiens
gacatttttgtctgtc

SEQ ID NO: 6202425 - DNA, 19 bp, Homo sapiens
gacatttttgtctgtccta

SEQ ID NO: 6202426 - DNA, 20 bp, Homo sapiens
gacattttttcagtcatata

SEQ ID NO: 6202427 - DNA, 14 bp, Homo sapiens
gaccaaaaaaataa

SEQ ID NO: 6202428 - DNA, 23 bp, Homo sapiens
gaccaaaaaaggacgtaaaattt

SEQ ID NO: 6202429 - DNA, 23 bp, Homo sapiens
gaccaaaaaccaaaagtgcattc

SEQ ID NO: 6202430 - DNA, 18 bp, Homo sapiens
cttgctcccaatggtgct

SEQ ID NO: 6202431 - DNA, 14 bp, Homo sapiens
cttgctcccaggag

SEQ ID NO: 6202432 - DNA, 17 bp, Homo sapiens
cttgctccctgactggg

SEQ ID NO: 6202433 - DNA, 15 bp, Homo sapiens
cttgctccctgtgtc

SEQ ID NO: 6202434 - DNA, 20 bp, Homo sapiens
cttgctccctgtgtccacct

SEQ ID NO: 6202435 - DNA, 17 bp, Homo sapiens
cttgctcccttcagccc

SEQ ID NO: 6202436 - DNA, 18 bp, Homo sapiens
cttgctcccttcagcccc

SEQ ID NO: 6202437 - DNA, 19 bp, Homo sapiens
cttgctcccttcagccccc

SEQ ID NO: 6202438 - DNA, 23 bp, Homo sapiens
cttgctcccttcagcccccagcc

SEQ ID NO: 6202439 - DNA, 22 bp, Homo sapiens
cttgctcctaagcaaaagggaa

SEQ ID NO: 6202440 - DNA, 23 bp, Homo sapiens
cttgctcctagcagacagaaact

SEQ ID NO: 6202441 - DNA, 18 bp, Homo sapiens
cttgctcctccttctgct

SEQ ID NO: 6202442 - DNA, 18 bp, Homo sapiens
cttgctcctggaacctgg

SEQ ID NO: 6202443 - DNA, 21 bp, Homo sapiens
cttgctcctggaacctggcag

SEQ ID NO: 6202444 - DNA, 20 bp, Homo sapiens
cttgctcctggccttgctga

SEQ ID NO: 6202445 - DNA, 15 bp, Homo sapiens
cttgctcctggggag

SEQ ID NO: 6202446 - DNA, 16 bp, Homo sapiens
cttgctcctggggaga

SEQ ID NO: 6202447 - DNA, 22 bp, Homo sapiens
cttgctcctttccatcagcttt

SEQ ID NO: 6202448 - DNA, 14 bp, Homo sapiens
cttgctcgcttgct

SEQ ID NO: 6202449 - DNA, 17 bp, Homo sapiens
cttgctcgcttgctgga

SEQ ID NO: 6202450 - DNA, 15 bp, Homo sapiens
cttgctctacctggc

SEQ ID NO: 6202451 - DNA, 16 bp, Homo sapiens
cttgctctatctcaca

SEQ ID NO: 6202452 - DNA, 20 bp, Homo sapiens
cttgctctatctcacagcac

SEQ ID NO: 6202453 - DNA, 14 bp, Homo sapiens
cttgctctccctct

SEQ ID NO: 6202454 - DNA, 16 bp, Homo sapiens
cttgctctcctcatct

SEQ ID NO: 6202455 - DNA, 15 bp, Homo sapiens
cttgctctcctggag

SEQ ID NO: 6202456 - DNA, 21 bp, Homo sapiens
cttgctctcctggagcaagct

SEQ ID NO: 6202457 - DNA, 13 bp, Homo sapiens
cttgctctctctc

SEQ ID NO: 6202458 - DNA, 18 bp, Homo sapiens
cttgctctctgttctctt

SEQ ID NO: 6202459 - DNA, 18 bp, Homo sapiens
cttgctctcttcaataaa

SEQ ID NO: 6202460 - DNA, 20 bp, Homo sapiens
cttgctctcttcaataaacc

SEQ ID NO: 6202461 - DNA, 21 bp, Homo sapiens
cttgctctcttcaataaacca

SEQ ID NO: 6202462 - DNA, 14 bp, Homo sapiens
cttgctctcttgtg

SEQ ID NO: 6202463 - DNA, 15 bp, Homo sapiens
cttgctctcttgtga

SEQ ID NO: 6202464 - DNA, 18 bp, Homo sapiens
cttgctctcttttattct

SEQ ID NO: 6202465 - DNA, 16 bp, Homo sapiens
cttgctctgagcacag

SEQ ID NO: 6202466 - DNA, 14 bp, Homo sapiens
cttgctctgcaggc

SEQ ID NO: 6202467 - DNA, 14 bp, Homo sapiens
cttgctctgctgac

SEQ ID NO: 6202468 - DNA, 22 bp, Homo sapiens
cttgctctgctgacagacacag

SEQ ID NO: 6202469 - DNA, 15 bp, Homo sapiens
cttgctctggacctg

SEQ ID NO: 6202470 - DNA, 17 bp, Homo sapiens
cttgctctggacctgcc

SEQ ID NO: 6202471 - DNA, 17 bp, Homo sapiens
cttgctctgtcccccag

SEQ ID NO: 6202472 - DNA, 18 bp, Homo sapiens
cttgctctgtcccccagg

SEQ ID NO: 6202473 - DNA, 19 bp, Homo sapiens
cttgctctgtcccccaggc

SEQ ID NO: 6202474 - DNA, 14 bp, Homo sapiens
cttgctctgtggcc

SEQ ID NO: 6202475 - DNA, 15 bp, Homo sapiens
cttgctctgtggcct

SEQ ID NO: 6202476 - DNA, 22 bp, Homo sapiens
cttgctctgttacccaggctgg

SEQ ID NO: 6202477 - DNA, 18 bp, Homo sapiens
cttgctctgttttgcttt

SEQ ID NO: 6202478 - DNA, 18 bp, Homo sapiens
cttgctcttaagtaccag

SEQ ID NO: 6202479 - DNA, 16 bp, Homo sapiens
cttgctcttggggaag

SEQ ID NO: 6202480 - DNA, 19 bp, Homo sapiens
cttgctctttctactctga

SEQ ID NO: 6202481 - DNA, 21 bp, Homo sapiens
cttgctgaaacgcatctagtt

SEQ ID NO: 6202482 - DNA, 14 bp, Homo sapiens
cttgctgaacacac

SEQ ID NO: 6202483 - DNA, 16 bp, Homo sapiens
cttgctgaacacacac

SEQ ID NO: 6202484 - DNA, 17 bp, Homo sapiens
cttgctgaacacacaca

SEQ ID NO: 6202485 - DNA, 15 bp, Homo sapiens
cttgctgacaataaa

SEQ ID NO: 6202486 - DNA, 18 bp, Homo sapiens
cttgctgacaataaagat

SEQ ID NO: 6202487 - DNA, 14 bp, Homo sapiens
cttgctgaccccag

SEQ ID NO: 6202488 - DNA, 20 bp, Homo sapiens
cttgctgaccccaggtcagc

SEQ ID NO: 6202489 - DNA, 22 bp, Homo sapiens
cttgctgaccccaggtcagccc

SEQ ID NO: 6202490 - DNA, 15 bp, Homo sapiens
cttgctgagacttac

SEQ ID NO: 6202491 - DNA, 17 bp, Homo sapiens
cttgctgagaggggctg

SEQ ID NO: 6202492 - DNA, 19 bp, Homo sapiens
cttgctgaggggcagggag

SEQ ID NO: 6202493 - DNA, 22 bp, Homo sapiens
cttgctgaggggcagggagagc

SEQ ID NO: 6202494 - DNA, 12 bp, Homo sapiens
cttgctgagtga

SEQ ID NO: 6202495 - DNA, 13 bp, Homo sapiens
cttgctgagtgaa

SEQ ID NO: 6202496 - DNA, 21 bp, Homo sapiens
cttgctgatgctcctccgggt

SEQ ID NO: 6202497 - DNA, 20 bp, Homo sapiens
cttgctgatggcttgacatg

SEQ ID NO: 6202498 - DNA, 13 bp, Homo sapiens
cttgctgatttgc

SEQ ID NO: 6202499 - DNA, 23 bp, Homo sapiens
cttgctgcaaacccatgaagctg

SEQ ID NO: 6202500 - DNA, 21 bp, Homo sapiens
cttgctgcaagcacagccctt

SEQ ID NO: 6202501 - DNA, 13 bp, Homo sapiens
cttgctgcacctg

SEQ ID NO: 6202502 - DNA, 16 bp, Homo sapiens
cttgctgcacctgagg

SEQ ID NO: 6202503 - DNA, 17 bp, Homo sapiens
cttgctgcactcttgca

SEQ ID NO: 6202504 - DNA, 21 bp, Homo sapiens
cttgctgcactcttgcacatg

SEQ ID NO: 6202505 - DNA, 11 bp, Homo sapiens
cttgctgcagc

SEQ ID NO: 6202506 - DNA, 14 bp, Homo sapiens
cttgctgcagcctg

SEQ ID NO: 6202507 - DNA, 14 bp, Homo sapiens
cttgctgcaggccc

SEQ ID NO: 6202508 - DNA, 15 bp, Homo sapiens
cttgctgccaagtcc

SEQ ID NO: 6202509 - DNA, 17 bp, Homo sapiens
cttgctgccatgatgta

SEQ ID NO: 6202510 - DNA, 11 bp, Homo sapiens
cttgctgcctc

SEQ ID NO: 6202511 - DNA, 20 bp, Homo sapiens
cttgctgccttcaccctgaa

SEQ ID NO: 6202512 - DNA, 19 bp, Homo sapiens
cttgctgccttctggattc

SEQ ID NO: 6202513 - DNA, 13 bp, Homo sapiens
cttgctgctagaa

SEQ ID NO: 6202514 - DNA, 19 bp, Homo sapiens
cttgctgctgatttaaaca

SEQ ID NO: 6202515 - DNA, 16 bp, Homo sapiens
cttgctgctgccttca

SEQ ID NO: 6202516 - DNA, 16 bp, Homo sapiens
cttgctgctgctgcac

SEQ ID NO: 6202517 - DNA, 13 bp, Homo sapiens
cttgctgctggct

SEQ ID NO: 6202518 - DNA, 14 bp, Homo sapiens
cttgctgctggctc

SEQ ID NO: 6202519 - DNA, 12 bp, Homo sapiens
cttgctgctgtc

SEQ ID NO: 6202520 - DNA, 14 bp, Homo sapiens
cttgctgctgtgcc

SEQ ID NO: 6202521 - DNA, 15 bp, Homo sapiens
cttgctgctttagtc

SEQ ID NO: 6202522 - DNA, 18 bp, Homo sapiens
cttgctggaaaactgcca

SEQ ID NO: 6202523 - DNA, 20 bp, Homo sapiens
cttgctggaacacaggggcc

SEQ ID NO: 6202524 - DNA, 14 bp, Homo sapiens
cttgctggaagaca

SEQ ID NO: 6202525 - DNA, 16 bp, Homo sapiens
cttgctggacctgaat

SEQ ID NO: 6202526 - DNA, 22 bp, Homo sapiens
cttgctggacggggactgggga

SEQ ID NO: 6202527 - DNA, 16 bp, Homo sapiens
cttgctggattaatgt

SEQ ID NO: 6202528 - DNA, 16 bp, Homo sapiens
cttgctggcagggcct

SEQ ID NO: 6202529 - DNA, 15 bp, Homo sapiens
cttgctggccccagc

SEQ ID NO: 6202530 - DNA, 16 bp, Homo sapiens
cttgctggccccagcc

SEQ ID NO: 6202531 - DNA, 22 bp, Homo sapiens
cttgctggccccagccctgctg

SEQ ID NO: 6202532 - DNA, 22 bp, Homo sapiens
cttgctggctacgcctcttctg

SEQ ID NO: 6202533 - DNA, 16 bp, Homo sapiens
cttgctggctctgaga

SEQ ID NO: 6202534 - DNA, 15 bp, Homo sapiens
cttgctggctgtgaa

SEQ ID NO: 6202535 - DNA, 16 bp, Homo sapiens
cttgctggctgtgaaa

SEQ ID NO: 6202536 - DNA, 17 bp, Homo sapiens
cttgctggctgtgaaac

SEQ ID NO: 6202537 - DNA, 14 bp, Homo sapiens
cttgctgggccagg

SEQ ID NO: 6202538 - DNA, 15 bp, Homo sapiens
cttgctgggccaggg

SEQ ID NO: 6202539 - DNA, 13 bp, Homo sapiens
cttgctgggcctg

SEQ ID NO: 6202540 - DNA, 13 bp, Homo sapiens
cttgctgggcttt

SEQ ID NO: 6202541 - DNA, 18 bp, Homo sapiens
cttgctgggctttgggaa

SEQ ID NO: 6202542 - DNA, 23 bp, Homo sapiens
cttgctggggacggggggcccca

SEQ ID NO: 6202543 - DNA, 15 bp, Homo sapiens
cttgctggggtccag

SEQ ID NO: 6202544 - DNA, 18 bp, Homo sapiens
cttgctggggtccagggc

SEQ ID NO: 6202545 - DNA, 20 bp, Homo sapiens
cttgctggggtccagggctg

SEQ ID NO: 6202546 - DNA, 23 bp, Homo sapiens
cttgctgggtacctggtccccac

SEQ ID NO: 6202547 - DNA, 17 bp, Homo sapiens
cttgctggtgcacatga

SEQ ID NO: 6202548 - DNA, 22 bp, Homo sapiens
cttgctggtgcctgccaccttc

SEQ ID NO: 6202549 - DNA, 16 bp, Homo sapiens
cttgctgtatatgcag

SEQ ID NO: 6202550 - DNA, 19 bp, Homo sapiens
cttgctgtatgacccctgg

SEQ ID NO: 6202551 - DNA, 21 bp, Homo sapiens
cttgctgtatgacccctggcc

SEQ ID NO: 6202552 - DNA, 22 bp, Homo sapiens
cttgctgtatgacccctggcca

SEQ ID NO: 6202553 - DNA, 16 bp, Homo sapiens
cttgctgtccaggcag

SEQ ID NO: 6202554 - DNA, 14 bp, Homo sapiens
cttgctgtcctagg

SEQ ID NO: 6202555 - DNA, 15 bp, Homo sapiens
cttgctgtcctaggc

SEQ ID NO: 6202556 - DNA, 18 bp, Homo sapiens
cttgctgtcctgatctgt

SEQ ID NO: 6202557 - DNA, 13 bp, Homo sapiens
cttgctgtgaaac

SEQ ID NO: 6202558 - DNA, 17 bp, Homo sapiens
cttgctgtgaaacagtg

SEQ ID NO: 6202559 - DNA, 18 bp, Homo sapiens
cttgctgtgaaatgactg

SEQ ID NO: 6202560 - DNA, 15 bp, Homo sapiens
cttgctgtgaattaa

SEQ ID NO: 6202561 - DNA, 15 bp, Homo sapiens
cttgctgtgacttat

SEQ ID NO: 6202562 - DNA, 13 bp, Homo sapiens
cttgctgtgcttt

SEQ ID NO: 6202563 - DNA, 18 bp, Homo sapiens
cttgctgtggagctccac

SEQ ID NO: 6202564 - DNA, 19 bp, Homo sapiens
cttgctgtggggctacagg

SEQ ID NO: 6202565 - DNA, 11 bp, Homo sapiens
cttgctgtgtg

SEQ ID NO: 6202566 - DNA, 20 bp, Homo sapiens
cttgctgtgtgacctgaggc

SEQ ID NO: 6202567 - DNA, 16 bp, Homo sapiens
cttgctgttaaatcag

SEQ ID NO: 6202568 - DNA, 20 bp, Homo sapiens
cttgctgttgacatatttaa

SEQ ID NO: 6202569 - DNA, 19 bp, Homo sapiens
cttgctgtttaccgcccac

SEQ ID NO: 6202570 - DNA, 22 bp, Homo sapiens
cttgctgtttaccgcccaccca

SEQ ID NO: 6202571 - DNA, 18 bp, Homo sapiens
cttgctgttttgttctgt

SEQ ID NO: 6202572 - DNA, 15 bp, Homo sapiens
cttgctgtttttccg

SEQ ID NO: 6202573 - DNA, 16 bp, Homo sapiens
cttgctgttttttgga

SEQ ID NO: 6202574 - DNA, 14 bp, Homo sapiens
cttgcttaaatgtg

SEQ ID NO: 6202575 - DNA, 13 bp, Homo sapiens
cttgcttaaattt

SEQ ID NO: 6202576 - DNA, 21 bp, Homo sapiens
cttgcttaaggcatactttta

SEQ ID NO: 6202577 - DNA, 18 bp, Homo sapiens
cttgcttacaatctttat

SEQ ID NO: 6202578 - DNA, 19 bp, Homo sapiens
cttgcttacaatctttatt

SEQ ID NO: 6202579 - DNA, 17 bp, Homo sapiens
cttgcttacatcctctg

SEQ ID NO: 6202580 - DNA, 20 bp, Homo sapiens
cttgcttagagtgcccagca

SEQ ID NO: 6202581 - DNA, 21 bp, Homo sapiens
cttgcttagatgttccaaatt

SEQ ID NO: 6202582 - DNA, 23 bp, Homo sapiens
cttgcttagtatggttctcagat

SEQ ID NO: 6202583 - DNA, 14 bp, Homo sapiens
cttgcttattacat

SEQ ID NO: 6202584 - DNA, 15 bp, Homo sapiens
cttgcttccaagacc

SEQ ID NO: 6202585 - DNA, 13 bp, Homo sapiens
cttgcttcctgat

SEQ ID NO: 6202586 - DNA, 15 bp, Homo sapiens
cttgcttcctgcatg

SEQ ID NO: 6202587 - DNA, 13 bp, Homo sapiens
cttgcttctccca

SEQ ID NO: 6202588 - DNA, 20 bp, Homo sapiens
cttgcttctcccatttcctg

SEQ ID NO: 6202589 - DNA, 21 bp, Homo sapiens
cttgcttctcccatttcctga

SEQ ID NO: 6202590 - DNA, 12 bp, Homo sapiens
cttgcttctgca

SEQ ID NO: 6202591 - DNA, 16 bp, Homo sapiens
cttgcttctgcagcaa

SEQ ID NO: 6202592 - DNA, 22 bp, Homo sapiens
cttgcttctgcagcaactccca

SEQ ID NO: 6202593 - DNA, 20 bp, Homo sapiens
cttgcttcttactgataatt

SEQ ID NO: 6202594 - DNA, 19 bp, Homo sapiens
cttgcttcttcaccagtta

SEQ ID NO: 6202595 - DNA, 14 bp, Homo sapiens
cttgcttctttcta

SEQ ID NO: 6202596 - DNA, 19 bp, Homo sapiens
cttgcttgccgagcctaat

SEQ ID NO: 6202597 - DNA, 15 bp, Homo sapiens
cttgcttggaagcca

SEQ ID NO: 6202598 - DNA, 17 bp, Homo sapiens
cttgcttggaagccagg

SEQ ID NO: 6202599 - DNA, 18 bp, Homo sapiens
cttgcttggggaacttgt

SEQ ID NO: 6202600 - DNA, 12 bp, Homo sapiens
cttgcttgtacc

SEQ ID NO: 6202601 - DNA, 18 bp, Homo sapiens
cttgcttgtacctctggc

SEQ ID NO: 6202602 - DNA, 14 bp, Homo sapiens
cttgcttgtatgat

SEQ ID NO: 6202603 - DNA, 21 bp, Homo sapiens
cttgcttgttgggattcctga

SEQ ID NO: 6202604 - DNA, 13 bp, Homo sapiens
cttgctttaaaga

SEQ ID NO: 6202605 - DNA, 19 bp, Homo sapiens
cttgctttaccttttcagg

SEQ ID NO: 6202606 - DNA, 19 bp, Homo sapiens
cttgctttatttttcatta

SEQ ID NO: 6202607 - DNA, 19 bp, Homo sapiens
cttgctttcctgggccttt

SEQ ID NO: 6202608 - DNA, 24 bp, Homo sapiens
cttgctttcggagctcctgtccaa

SEQ ID NO: 6202609 - DNA, 15 bp, Homo sapiens
cttgctttctctctc

SEQ ID NO: 6202610 - DNA, 20 bp, Homo sapiens
gaccaaaaaccagtattgta

SEQ ID NO: 6202611 - DNA, 17 bp, Homo sapiens
gaccaaaaccagagggc

SEQ ID NO: 6202612 - DNA, 21 bp, Homo sapiens
gaccaaaaccagagggcagtc

SEQ ID NO: 6202613 - DNA, 20 bp, Homo sapiens
gaccaaaaggagagattatt

SEQ ID NO: 6202614 - DNA, 22 bp, Homo sapiens
gaccaaaagtgagatgggaagg

SEQ ID NO: 6202615 - DNA, 14 bp, Homo sapiens
gaccaaaatcagct

SEQ ID NO: 6202616 - DNA, 23 bp, Homo sapiens
gaccaaaatcaggaaccacagat

SEQ ID NO: 6202617 - DNA, 17 bp, Homo sapiens
gaccaaaatgacaatga

SEQ ID NO: 6202618 - DNA, 21 bp, Homo sapiens
gaccaaaatgacaatgatgat

SEQ ID NO: 6202619 - DNA, 17 bp, Homo sapiens
gaccaaacctagcccct

SEQ ID NO: 6202620 - DNA, 15 bp, Homo sapiens
gaccaaactacttca

SEQ ID NO: 6202621 - DNA, 21 bp, Homo sapiens
gaccaaactacttcattttct

SEQ ID NO: 6202622 - DNA, 23 bp, Homo sapiens
gaccaaactgtgggtattgttaa

SEQ ID NO: 6202623 - DNA, 19 bp, Homo sapiens
gaccaaagacgatacagct

SEQ ID NO: 6202624 - DNA, 17 bp, Homo sapiens
gaccaaagactgcagaa

SEQ ID NO: 6202625 - DNA, 19 bp, Homo sapiens
gaccaaagactgcagaacc

SEQ ID NO: 6202626 - DNA, 14 bp, Homo sapiens
gaccaaagccacct

SEQ ID NO: 6202627 - DNA, 15 bp, Homo sapiens
gaccaaagccacctg

SEQ ID NO: 6202628 - DNA, 16 bp, Homo sapiens
gaccaaagccacctgc

SEQ ID NO: 6202629 - DNA, 22 bp, Homo sapiens
gaccaaagggaagtgaggccca

SEQ ID NO: 6202630 - DNA, 23 bp, Homo sapiens
gaccaaagggaagtgaggcccaa

SEQ ID NO: 6202631 - DNA, 13 bp, Homo sapiens
gaccaaatggaaa

SEQ ID NO: 6202632 - DNA, 15 bp, Homo sapiens
gaccaaatgtaaaat

SEQ ID NO: 6202633 - DNA, 23 bp, Homo sapiens
gaccaaatgtcggggttggggtg

SEQ ID NO: 6202634 - DNA, 14 bp, Homo sapiens
gaccaaattgcttc

SEQ ID NO: 6202635 - DNA, 18 bp, Homo sapiens
gaccaaattgcttctagg

SEQ ID NO: 6202636 - DNA, 18 bp, Homo sapiens
gaccaacaagggcagtgg

SEQ ID NO: 6202637 - DNA, 19 bp, Homo sapiens
gaccaacatggagaaaccc

SEQ ID NO: 6202638 - DNA, 19 bp, Homo sapiens
gaccaacattcaaaagcac

SEQ ID NO: 6202639 - DNA, 15 bp, Homo sapiens
gaccaaccctgggac

SEQ ID NO: 6202640 - DNA, 17 bp, Homo sapiens
gaccaaccctgggacct

SEQ ID NO: 6202641 - DNA, 18 bp, Homo sapiens
gaccaaccctgggaccta

SEQ ID NO: 6202642 - DNA, 20 bp, Homo sapiens
gaccaaccctggggaaggag

SEQ ID NO: 6202643 - DNA, 14 bp, Homo sapiens
gaccaacctgacct

SEQ ID NO: 6202644 - DNA, 16 bp, Homo sapiens
gaccaacctgctctgt

SEQ ID NO: 6202645 - DNA, 18 bp, Homo sapiens
gaccaacctgctctgtcc

SEQ ID NO: 6202646 - DNA, 21 bp, Homo sapiens
gaccaacgatcctatgagaga

SEQ ID NO: 6202647 - DNA, 19 bp, Homo sapiens
gaccaactagacattctgt

SEQ ID NO: 6202648 - DNA, 15 bp, Homo sapiens
gaccaactccagact

SEQ ID NO: 6202649 - DNA, 13 bp, Homo sapiens
gaccaactgccct

SEQ ID NO: 6202650 - DNA, 15 bp, Homo sapiens
gaccaactggcttct

SEQ ID NO: 6202651 - DNA, 14 bp, Homo sapiens
gaccaactgggccc

SEQ ID NO: 6202652 - DNA, 14 bp, Homo sapiens
gaccaactgtcact

SEQ ID NO: 6202653 - DNA, 18 bp, Homo sapiens
gaccaactgtgttgtatt

SEQ ID NO: 6202654 - DNA, 19 bp, Homo sapiens
gaccaactgtgttgtatta

SEQ ID NO: 6202655 - DNA, 12 bp, Homo sapiens
gaccaagaactg

SEQ ID NO: 6202656 - DNA, 13 bp, Homo sapiens
gaccaagaactgc

SEQ ID NO: 6202657 - DNA, 16 bp, Homo sapiens
gaccaagagagaaaga

SEQ ID NO: 6202658 - DNA, 13 bp, Homo sapiens
gaccaagatgtca

SEQ ID NO: 6202659 - DNA, 20 bp, Homo sapiens
gaccaagcatcttggggggg

SEQ ID NO: 6202660 - DNA, 16 bp, Homo sapiens
gaccaagccggtgccc

SEQ ID NO: 6202661 - DNA, 18 bp, Homo sapiens
gaccaagcgaccaaggat

SEQ ID NO: 6202662 - DNA, 15 bp, Homo sapiens
gaccaaggaacaaaa

SEQ ID NO: 6202663 - DNA, 23 bp, Homo sapiens
gaccaaggaacaaaaaaaccaca

SEQ ID NO: 6202664 - DNA, 22 bp, Homo sapiens
gaccaaggaacaagacccccag

SEQ ID NO: 6202665 - DNA, 16 bp, Homo sapiens
gaccaaggacccctca

SEQ ID NO: 6202666 - DNA, 16 bp, Homo sapiens
gaccaaggagatgaag

SEQ ID NO: 6202667 - DNA, 13 bp, Homo sapiens
gaccaaggagcat

SEQ ID NO: 6202668 - DNA, 17 bp, Homo sapiens
gaccaaggcaaggcagg

SEQ ID NO: 6202669 - DNA, 16 bp, Homo sapiens
gaccaaggcagggccc

SEQ ID NO: 6202670 - DNA, 20 bp, Homo sapiens
gaccaaggcagggcccagca

SEQ ID NO: 6202671 - DNA, 20 bp, Homo sapiens
gaccaaggcctcggcagaac

SEQ ID NO: 6202672 - DNA, 18 bp, Homo sapiens
gaccaaggctctgaaata

SEQ ID NO: 6202673 - DNA, 14 bp, Homo sapiens
gaccaagggactcc

SEQ ID NO: 6202674 - DNA, 21 bp, Homo sapiens
gaccaagggatgggacctgat

SEQ ID NO: 6202675 - DNA, 13 bp, Homo sapiens
gaccaaggtgaag

SEQ ID NO: 6202676 - DNA, 15 bp, Homo sapiens
gaccaagtccaagcc

SEQ ID NO: 6202677 - DNA, 16 bp, Homo sapiens
gaccaagtcctggcta

SEQ ID NO: 6202678 - DNA, 14 bp, Homo sapiens
gaccaagtctctct

SEQ ID NO: 6202679 - DNA, 22 bp, Homo sapiens
gaccaagtctctctaagacaaa

SEQ ID NO: 6202680 - DNA, 21 bp, Homo sapiens
gaccaagtgatgtgtttacat

SEQ ID NO: 6202681 - DNA, 17 bp, Homo sapiens
gaccaagtgctggccca

SEQ ID NO: 6202682 - DNA, 14 bp, Homo sapiens
gaccaagttataaa

SEQ ID NO: 6202683 - DNA, 18 bp, Homo sapiens
gaccaataaacagctccc

SEQ ID NO: 6202684 - DNA, 12 bp, Homo sapiens
gaccaataaaga

SEQ ID NO: 6202685 - DNA, 18 bp, Homo sapiens
gaccaatacatttgtatt

SEQ ID NO: 6202686 - DNA, 12 bp, Homo sapiens
gaccaatatata

SEQ ID NO: 6202687 - DNA, 18 bp, Homo sapiens
gaccaatattgtacagtt

SEQ ID NO: 6202688 - DNA, 14 bp, Homo sapiens
gaccaatccccagc

SEQ ID NO: 6202689 - DNA, 19 bp, Homo sapiens
gaccaatcctgtttttcct

SEQ ID NO: 6202690 - DNA, 22 bp, Homo sapiens
gaccaatcgggagtagcaagga

SEQ ID NO: 6202691 - DNA, 14 bp, Homo sapiens
gaccaatctctgtg

SEQ ID NO: 6202692 - DNA, 12 bp, Homo sapiens
gaccaatgcctt

SEQ ID NO: 6202693 - DNA, 15 bp, Homo sapiens
gaccaatgcttgcat

SEQ ID NO: 6202694 - DNA, 22 bp, Homo sapiens
gaccaattactgcactcttaaa

SEQ ID NO: 6202695 - DNA, 18 bp, Homo sapiens
gaccaattattgatatat

SEQ ID NO: 6202696 - DNA, 13 bp, Homo sapiens
gaccaattcaacc

SEQ ID NO: 6202697 - DNA, 15 bp, Homo sapiens
gaccaattctggaca

SEQ ID NO: 6202698 - DNA, 21 bp, Homo sapiens
gaccaattctggacagacaga

SEQ ID NO: 6202699 - DNA, 18 bp, Homo sapiens
gaccaattgaagcatgaa

SEQ ID NO: 6202700 - DNA, 17 bp, Homo sapiens
gaccaattgccctgcca

SEQ ID NO: 6202701 - DNA, 13 bp, Homo sapiens
gaccaatttgcac

SEQ ID NO: 6202702 - DNA, 13 bp, Homo sapiens
gaccaattttaac

SEQ ID NO: 6202703 - DNA, 14 bp, Homo sapiens
gaccacaaaagagg

SEQ ID NO: 6202704 - DNA, 14 bp, Homo sapiens
gaccacacagtccc

SEQ ID NO: 6202705 - DNA, 15 bp, Homo sapiens
gaccacacagtcccc

SEQ ID NO: 6202706 - DNA, 21 bp, Homo sapiens
gaccacacagtccccagactc

SEQ ID NO: 6202707 - DNA, 17 bp, Homo sapiens
gaccacaccaaccaggc

SEQ ID NO: 6202708 - DNA, 22 bp, Homo sapiens
gaccacaccactaaccatcccc

SEQ ID NO: 6202709 - DNA, 22 bp, Homo sapiens
gaccacacccgaagtcctgtca

SEQ ID NO: 6202710 - DNA, 23 bp, Homo sapiens
gaccacacccgaagtcctgtcac

SEQ ID NO: 6202711 - DNA, 23 bp, Homo sapiens
gaccacacgctgtctcttgagaa

SEQ ID NO: 6202712 - DNA, 16 bp, Homo sapiens
gaccacactccagctg

SEQ ID NO: 6202713 - DNA, 20 bp, Homo sapiens
gaccacactctgcctggcct

SEQ ID NO: 6202714 - DNA, 22 bp, Homo sapiens
gaccacacttcctgtccagaga

SEQ ID NO: 6202715 - DNA, 18 bp, Homo sapiens
gaccacactttgagaacc

SEQ ID NO: 6202716 - DNA, 23 bp, Homo sapiens
gaccacagactcaatgtgctctg

SEQ ID NO: 6202717 - DNA, 11 bp, Homo sapiens
gaccacagagg

SEQ ID NO: 6202718 - DNA, 12 bp, Homo sapiens
gaccacagcaca

SEQ ID NO: 6202719 - DNA, 15 bp, Homo sapiens
gaccacagcacagcc

SEQ ID NO: 6202720 - DNA, 16 bp, Homo sapiens
gaccacagcacagcca

SEQ ID NO: 6202721 - DNA, 23 bp, Homo sapiens
gaccacagcatcattttgcattc

SEQ ID NO: 6202722 - DNA, 20 bp, Homo sapiens
gaccacagcccgctctctgg

SEQ ID NO: 6202723 - DNA, 13 bp, Homo sapiens
gaccacagctgct

SEQ ID NO: 6202724 - DNA, 15 bp, Homo sapiens
gaccacagctgctgg

SEQ ID NO: 6202725 - DNA, 16 bp, Homo sapiens
gaccacaggctcaggc

SEQ ID NO: 6202726 - DNA, 18 bp, Homo sapiens
gaccacaggctcaggcag

SEQ ID NO: 6202727 - DNA, 19 bp, Homo sapiens
gaccacaggtgcccgccac

SEQ ID NO: 6202728 - DNA, 19 bp, Homo sapiens
gaccacagtgggtggcacc

SEQ ID NO: 6202729 - DNA, 16 bp, Homo sapiens
gaccacatctgtcctc

SEQ ID NO: 6202730 - DNA, 22 bp, Homo sapiens
gaccacatctgtcctcaccctg

SEQ ID NO: 6202731 - DNA, 23 bp, Homo sapiens
gaccacatctttatctgttcttg

SEQ ID NO: 6202732 - DNA, 16 bp, Homo sapiens
gaccacatgccactgc

SEQ ID NO: 6202733 - DNA, 19 bp, Homo sapiens
gaccacatgccactgcctg

SEQ ID NO: 6202734 - DNA, 13 bp, Homo sapiens
gaccacatgcccc

SEQ ID NO: 6202735 - DNA, 21 bp, Homo sapiens
gaccacatgcgctcctggctt

SEQ ID NO: 6202736 - DNA, 13 bp, Homo sapiens
gaccacatgtgtt

SEQ ID NO: 6202737 - DNA, 16 bp, Homo sapiens
gaccaccaaagtcaaa

SEQ ID NO: 6202738 - DNA, 16 bp, Homo sapiens
gaccaccaacacacag

SEQ ID NO: 6202739 - DNA, 13 bp, Homo sapiens
gaccaccaagcct

SEQ ID NO: 6202740 - DNA, 15 bp, Homo sapiens
gaccaccacttgatg

SEQ ID NO: 6202741 - DNA, 20 bp, Homo sapiens
gaccaccacttgatgtctga

SEQ ID NO: 6202742 - DNA, 13 bp, Homo sapiens
gaccaccagcagg

SEQ ID NO: 6202743 - DNA, 13 bp, Homo sapiens
gaccaccagcccc

SEQ ID NO: 6202744 - DNA, 17 bp, Homo sapiens
gaccaccagccccagca

SEQ ID NO: 6202745 - DNA, 13 bp, Homo sapiens
gaccaccagggca

SEQ ID NO: 6202746 - DNA, 21 bp, Homo sapiens
gaccaccagggtcccaggaag

SEQ ID NO: 6202747 - DNA, 23 bp, Homo sapiens
gaccaccagggtcccaggaagcc

SEQ ID NO: 6202748 - DNA, 12 bp, Homo sapiens
gaccaccagtta

SEQ ID NO: 6202749 - DNA, 13 bp, Homo sapiens
gaccacccacctg

SEQ ID NO: 6202750 - DNA, 17 bp, Homo sapiens
gaccaccccacagagga

SEQ ID NO: 6202751 - DNA, 22 bp, Homo sapiens
gaccacccccaaacacaaaaca

SEQ ID NO: 6202752 - DNA, 19 bp, Homo sapiens
gaccaccccgcctgccctc

SEQ ID NO: 6202753 - DNA, 16 bp, Homo sapiens
gaccacccctctcgcc

SEQ ID NO: 6202754 - DNA, 22 bp, Homo sapiens
gaccacccctctcgcctcatta

SEQ ID NO: 6202755 - DNA, 14 bp, Homo sapiens
gaccacccctgtgc

SEQ ID NO: 6202756 - DNA, 15 bp, Homo sapiens
gaccacccctgtgcg

SEQ ID NO: 6202757 - DNA, 11 bp, Homo sapiens
gaccaccctcc

SEQ ID NO: 6202758 - DNA, 16 bp, Homo sapiens
gaccaccctcccctct

SEQ ID NO: 6202759 - DNA, 17 bp, Homo sapiens
gaccaccctcccctctc

SEQ ID NO: 6202760 - DNA, 18 bp, Homo sapiens
gaccaccctcccctctct

SEQ ID NO: 6202761 - DNA, 14 bp, Homo sapiens
gaccaccctgagcc

SEQ ID NO: 6202762 - DNA, 15 bp, Homo sapiens
gaccaccctgccaag

SEQ ID NO: 6202763 - DNA, 19 bp, Homo sapiens
gaccaccgcccctggccgc

SEQ ID NO: 6202764 - DNA, 23 bp, Homo sapiens
gaccacctccctgccctgtcctc

SEQ ID NO: 6202765 - DNA, 18 bp, Homo sapiens
gaccacctcctctgccag

SEQ ID NO: 6202766 - DNA, 23 bp, Homo sapiens
gaccacctcctctgccagcagga

SEQ ID NO: 6202767 - DNA, 24 bp, Homo sapiens
gaccacctcctctgccagcaggaa

SEQ ID NO: 6202768 - DNA, 10 bp, Homo sapiens
gaccacctgc

SEQ ID NO: 6202769 - DNA, 16 bp, Homo sapiens
gaccacctgccagcca

SEQ ID NO: 6202770 - DNA, 19 bp, Homo sapiens
gaccacctgccagccatca

SEQ ID NO: 6202771 - DNA, 17 bp, Homo sapiens
gaccacctgcttctgaa

SEQ ID NO: 6202772 - DNA, 19 bp, Homo sapiens
gaccacctgcttctgaact

SEQ ID NO: 6202773 - DNA, 21 bp, Homo sapiens
gaccacctgcttctgaactca

SEQ ID NO: 6202774 - DNA, 19 bp, Homo sapiens
gaccacgcacctccacgcc

SEQ ID NO: 6202775 - DNA, 16 bp, Homo sapiens
gaccacgccccaggac

SEQ ID NO: 6202776 - DNA, 18 bp, Homo sapiens
gaccacgccccaggacct

SEQ ID NO: 6202777 - DNA, 15 bp, Homo sapiens
gaccacgcccctgcc

SEQ ID NO: 6202778 - DNA, 14 bp, Homo sapiens
gaccacgccgccct

SEQ ID NO: 6202779 - DNA, 20 bp, Homo sapiens
gaccacgccgccctccatcc

SEQ ID NO: 6202780 - DNA, 21 bp, Homo sapiens
gaccacggacgtttccatcag

SEQ ID NO: 6202781 - DNA, 14 bp, Homo sapiens
gaccacggagggag

SEQ ID NO: 6202782 - DNA, 13 bp, Homo sapiens
gaccacggctcga

SEQ ID NO: 6202783 - DNA, 17 bp, Homo sapiens
gaccacgggaagcatct

SEQ ID NO: 6202784 - DNA, 21 bp, Homo sapiens
gaccacggtccaatccagcct

SEQ ID NO: 6202785 - DNA, 22 bp, Homo sapiens
gaccactagctaagcaagccag

SEQ ID NO: 6202786 - DNA, 13 bp, Homo sapiens
gaccactcagaga

SEQ ID NO: 6202787 - DNA, 15 bp, Homo sapiens
gaccactcagcccct

SEQ ID NO: 6202788 - DNA, 16 bp, Homo sapiens
gaccactcctcatagc

SEQ ID NO: 6202789 - DNA, 11 bp, Homo sapiens
cttgctttctt

SEQ ID NO: 6202790 - DNA, 19 bp, Homo sapiens
cttgctttcttctcctgtg

SEQ ID NO: 6202791 - DNA, 18 bp, Homo sapiens
cttgctttgaatgcatgt

SEQ ID NO: 6202792 - DNA, 21 bp, Homo sapiens
cttgctttgaatgcatgtgtg

SEQ ID NO: 6202793 - DNA, 21 bp, Homo sapiens
cttgctttgagactcctcagc

SEQ ID NO: 6202794 - DNA, 23 bp, Homo sapiens
cttgctttgagactcctcagcac

SEQ ID NO: 6202795 - DNA, 14 bp, Homo sapiens
cttgctttgagttg

SEQ ID NO: 6202796 - DNA, 14 bp, Homo sapiens
cttgctttgctgtc

SEQ ID NO: 6202797 - DNA, 21 bp, Homo sapiens
cttgctttgtctggcctcacg

SEQ ID NO: 6202798 - DNA, 19 bp, Homo sapiens
cttgctttgtgtatctcat

SEQ ID NO: 6202799 - DNA, 17 bp, Homo sapiens
cttgctttgtgttcttt

SEQ ID NO: 6202800 - DNA, 20 bp, Homo sapiens
cttgctttgttttaataaac

SEQ ID NO: 6202801 - DNA, 13 bp, Homo sapiens
cttgcttttcatg

SEQ ID NO: 6202802 - DNA, 14 bp, Homo sapiens
cttgcttttcatgc

SEQ ID NO: 6202803 - DNA, 19 bp, Homo sapiens
cttgcttttcatgcaaact

SEQ ID NO: 6202804 - DNA, 14 bp, Homo sapiens
cttgcttttctttt

SEQ ID NO: 6202805 - DNA, 20 bp, Homo sapiens
cttgcttttgcctctgccca

SEQ ID NO: 6202806 - DNA, 13 bp, Homo sapiens
cttgctttttcaa

SEQ ID NO: 6202807 - DNA, 16 bp, Homo sapiens
cttgctttttgcccgt

SEQ ID NO: 6202808 - DNA, 18 bp, Homo sapiens
cttgctttttgctgtgta

SEQ ID NO: 6202809 - DNA, 14 bp, Homo sapiens
cttgcttttttcca

SEQ ID NO: 6202810 - DNA, 16 bp, Homo sapiens
cttggaaaaagaaaga

SEQ ID NO: 6202811 - DNA, 21 bp, Homo sapiens
cttggaaaaagaaagaaacac

SEQ ID NO: 6202812 - DNA, 20 bp, Homo sapiens
cttggaaaaatccagaaaga

SEQ ID NO: 6202813 - DNA, 23 bp, Homo sapiens
cttggaaaagtggcaagaccaaa

SEQ ID NO: 6202814 - DNA, 14 bp, Homo sapiens
cttggaaaataaga

SEQ ID NO: 6202815 - DNA, 15 bp, Homo sapiens
cttggaaaataagac

SEQ ID NO: 6202816 - DNA, 19 bp, Homo sapiens
cttggaaaataagacaata

SEQ ID NO: 6202817 - DNA, 11 bp, Homo sapiens
cttggaaacat

SEQ ID NO: 6202818 - DNA, 14 bp, Homo sapiens
cttggaaacctgcc

SEQ ID NO: 6202819 - DNA, 17 bp, Homo sapiens
cttggaaacctgccctg

SEQ ID NO: 6202820 - DNA, 18 bp, Homo sapiens
cttggaaacctgccctgc

SEQ ID NO: 6202821 - DNA, 20 bp, Homo sapiens
cttggaaacctgccctgcct

SEQ ID NO: 6202822 - DNA, 12 bp, Homo sapiens
cttggaaagaaa

SEQ ID NO: 6202823 - DNA, 21 bp, Homo sapiens
cttggaaagaaacaaccgttg

SEQ ID NO: 6202824 - DNA, 14 bp, Homo sapiens
cttggaaagaggtt

SEQ ID NO: 6202825 - DNA, 23 bp, Homo sapiens
cttggaaaggggaggagcttctc

SEQ ID NO: 6202826 - DNA, 17 bp, Homo sapiens
cttggaaataataaatt

SEQ ID NO: 6202827 - DNA, 17 bp, Homo sapiens
cttggaaatagaaagaa

SEQ ID NO: 6202828 - DNA, 17 bp, Homo sapiens
cttggaaatcaggtaga

SEQ ID NO: 6202829 - DNA, 22 bp, Homo sapiens
cttggaaatcagtagaaagcta

SEQ ID NO: 6202830 - DNA, 16 bp, Homo sapiens
cttggaaatgtctgct

SEQ ID NO: 6202831 - DNA, 18 bp, Homo sapiens
cttggaaatgtctgctgg

SEQ ID NO: 6202832 - DNA, 19 bp, Homo sapiens
cttggaaatgtctgctggt

SEQ ID NO: 6202833 - DNA, 17 bp, Homo sapiens
cttggaaatgttaagaa

SEQ ID NO: 6202834 - DNA, 20 bp, Homo sapiens
cttggaaatgttaagaaaga

SEQ ID NO: 6202835 - DNA, 16 bp, Homo sapiens
cttggaaattcctgta

SEQ ID NO: 6202836 - DNA, 19 bp, Homo sapiens
cttggaaattcctgtactg

SEQ ID NO: 6202837 - DNA, 15 bp, Homo sapiens
cttggaaattccttg

SEQ ID NO: 6202838 - DNA, 16 bp, Homo sapiens
cttggaaattccttgc

SEQ ID NO: 6202839 - DNA, 15 bp, Homo sapiens
cttggaacaccctgg

SEQ ID NO: 6202840 - DNA, 21 bp, Homo sapiens
cttggaacaccctggatgctg

SEQ ID NO: 6202841 - DNA, 21 bp, Homo sapiens
cttggaacagtgtttacttta

SEQ ID NO: 6202842 - DNA, 18 bp, Homo sapiens
cttggaacatttgggaga

SEQ ID NO: 6202843 - DNA, 16 bp, Homo sapiens
cttggaaccacagtca

SEQ ID NO: 6202844 - DNA, 17 bp, Homo sapiens
cttggaaccacagtcat

SEQ ID NO: 6202845 - DNA, 15 bp, Homo sapiens
cttggaaccagcccc

SEQ ID NO: 6202846 - DNA, 16 bp, Homo sapiens
cttggaaccagcccca

SEQ ID NO: 6202847 - DNA, 22 bp, Homo sapiens
cttggaaccgtaggacccaagc

SEQ ID NO: 6202848 - DNA, 13 bp, Homo sapiens
cttggaactgcat

SEQ ID NO: 6202849 - DNA, 15 bp, Homo sapiens
cttggaacttgcctg

SEQ ID NO: 6202850 - DNA, 22 bp, Homo sapiens
cttggaacttgcctgcctttcc

SEQ ID NO: 6202851 - DNA, 15 bp, Homo sapiens
cttggaagagcctgc

SEQ ID NO: 6202852 - DNA, 19 bp, Homo sapiens
cttggaagagcctgcaggt

SEQ ID NO: 6202853 - DNA, 16 bp, Homo sapiens
cttggaagaggaggag

SEQ ID NO: 6202854 - DNA, 19 bp, Homo sapiens
cttggaagattctatttaa

SEQ ID NO: 6202855 - DNA, 20 bp, Homo sapiens
cttggaagcattcacaaagt

SEQ ID NO: 6202856 - DNA, 14 bp, Homo sapiens
cttggaagccaggt

SEQ ID NO: 6202857 - DNA, 15 bp, Homo sapiens
cttggaagccaggta

SEQ ID NO: 6202858 - DNA, 20 bp, Homo sapiens
cttggaagctgtttggaaaa

SEQ ID NO: 6202859 - DNA, 15 bp, Homo sapiens
cttggaagcttctgg

SEQ ID NO: 6202860 - DNA, 12 bp, Homo sapiens
cttggaagggcg

SEQ ID NO: 6202861 - DNA, 21 bp, Homo sapiens
cttggaagggcgttctaggta

SEQ ID NO: 6202862 - DNA, 23 bp, Homo sapiens
cttggaagggggagacaggaagt

SEQ ID NO: 6202863 - DNA, 22 bp, Homo sapiens
cttggaagtacatgaatacaaa

SEQ ID NO: 6202864 - DNA, 21 bp, Homo sapiens
cttggaagtcgtttcaggaca

SEQ ID NO: 6202865 - DNA, 22 bp, Homo sapiens
cttggaagtcgtttcaggacat

SEQ ID NO: 6202866 - DNA, 18 bp, Homo sapiens
cttggaatatctgctgta

SEQ ID NO: 6202867 - DNA, 19 bp, Homo sapiens
cttggaatatctgctgtat

SEQ ID NO: 6202868 - DNA, 21 bp, Homo sapiens
cttggaattactgaaagtctg

SEQ ID NO: 6202869 - DNA, 22 bp, Homo sapiens
cttggacaaacctagaattttc

SEQ ID NO: 6202870 - DNA, 14 bp, Homo sapiens
cttggacaaatcac

SEQ ID NO: 6202871 - DNA, 15 bp, Homo sapiens
cttggacaacagctc

SEQ ID NO: 6202872 - DNA, 21 bp, Homo sapiens
cttggacacttaattctgttc

SEQ ID NO: 6202873 - DNA, 14 bp, Homo sapiens
cttggacacttggt

SEQ ID NO: 6202874 - DNA, 13 bp, Homo sapiens
cttggacagttag

SEQ ID NO: 6202875 - DNA, 17 bp, Homo sapiens
cttggacatcctcctcc

SEQ ID NO: 6202876 - DNA, 15 bp, Homo sapiens
cttggacatctctct

SEQ ID NO: 6202877 - DNA, 17 bp, Homo sapiens
cttggacatctctctgg

SEQ ID NO: 6202878 - DNA, 20 bp, Homo sapiens
cttggacatctctctggctt

SEQ ID NO: 6202879 - DNA, 14 bp, Homo sapiens
cttggacattttat

SEQ ID NO: 6202880 - DNA, 19 bp, Homo sapiens
cttggaccagtttgcagag

SEQ ID NO: 6202881 - DNA, 15 bp, Homo sapiens
cttggacctccaggg

SEQ ID NO: 6202882 - DNA, 24 bp, Homo sapiens
cttggacctccaggggctcctggg

SEQ ID NO: 6202883 - DNA, 22 bp, Homo sapiens
cttggacctcgtgctttaagtg

SEQ ID NO: 6202884 - DNA, 14 bp, Homo sapiens
cttggacctctgct

SEQ ID NO: 6202885 - DNA, 15 bp, Homo sapiens
cttggacctctgctc

SEQ ID NO: 6202886 - DNA, 14 bp, Homo sapiens
cttggactacacaa

SEQ ID NO: 6202887 - DNA, 16 bp, Homo sapiens
cttggactacacaata

SEQ ID NO: 6202888 - DNA, 20 bp, Homo sapiens
cttggactacctataaatgg

SEQ ID NO: 6202889 - DNA, 15 bp, Homo sapiens
cttggactccctccc

SEQ ID NO: 6202890 - DNA, 23 bp, Homo sapiens
cttggactccctccccaccccaa

SEQ ID NO: 6202891 - DNA, 16 bp, Homo sapiens
cttggactcctcccac

SEQ ID NO: 6202892 - DNA, 17 bp, Homo sapiens
cttggacttcctggggc

SEQ ID NO: 6202893 - DNA, 19 bp, Homo sapiens
cttggacttcctggggccc

SEQ ID NO: 6202894 - DNA, 22 bp, Homo sapiens
cttggacttcttctcccccgcg

SEQ ID NO: 6202895 - DNA, 18 bp, Homo sapiens
cttggagaactttccatc

SEQ ID NO: 6202896 - DNA, 18 bp, Homo sapiens
cttggagaagtctcagct

SEQ ID NO: 6202897 - DNA, 19 bp, Homo sapiens
cttggagaagtctcagcta

SEQ ID NO: 6202898 - DNA, 17 bp, Homo sapiens
cttggagaatactgcca

SEQ ID NO: 6202899 - DNA, 20 bp, Homo sapiens
cttggagacaggattctgac

SEQ ID NO: 6202900 - DNA, 20 bp, Homo sapiens
cttggagactcctggtctgt

SEQ ID NO: 6202901 - DNA, 15 bp, Homo sapiens
cttggagagaatcat

SEQ ID NO: 6202902 - DNA, 13 bp, Homo sapiens
cttggagagagag

SEQ ID NO: 6202903 - DNA, 23 bp, Homo sapiens
cttggagagagaggctgcctcag

SEQ ID NO: 6202904 - DNA, 24 bp, Homo sapiens
cttggagagagaggctgcctcagc

SEQ ID NO: 6202905 - DNA, 14 bp, Homo sapiens
cttggagaggagag

SEQ ID NO: 6202906 - DNA, 21 bp, Homo sapiens
cttggagaggagagtggcagg

SEQ ID NO: 6202907 - DNA, 19 bp, Homo sapiens
cttggagaggaggtgtgga

SEQ ID NO: 6202908 - DNA, 14 bp, Homo sapiens
cttggagatggcag

SEQ ID NO: 6202909 - DNA, 15 bp, Homo sapiens
cttggagcagagacg

SEQ ID NO: 6202910 - DNA, 21 bp, Homo sapiens
cttggagcagagacggcagcc

SEQ ID NO: 6202911 - DNA, 22 bp, Homo sapiens
cttggagcagagacggcagccc

SEQ ID NO: 6202912 - DNA, 23 bp, Homo sapiens
cttggagcagagacggcagcccc

SEQ ID NO: 6202913 - DNA, 15 bp, Homo sapiens
cttggagcagaggtg

SEQ ID NO: 6202914 - DNA, 15 bp, Homo sapiens
cttggagccactggg

SEQ ID NO: 6202915 - DNA, 13 bp, Homo sapiens
cttggagccccag

SEQ ID NO: 6202916 - DNA, 21 bp, Homo sapiens
cttggagccccagtgccaagc

SEQ ID NO: 6202917 - DNA, 14 bp, Homo sapiens
cttggagccccctg

SEQ ID NO: 6202918 - DNA, 18 bp, Homo sapiens
cttggagccccctggcgg

SEQ ID NO: 6202919 - DNA, 19 bp, Homo sapiens
cttggagccccctggcggc

SEQ ID NO: 6202920 - DNA, 20 bp, Homo sapiens
cttggagccccctggcggca

SEQ ID NO: 6202921 - DNA, 21 bp, Homo sapiens
cttggagccccctggcggcag

SEQ ID NO: 6202922 - DNA, 23 bp, Homo sapiens
cttggagccccctggcggcaggg

SEQ ID NO: 6202923 - DNA, 15 bp, Homo sapiens
cttggagcccgtgca

SEQ ID NO: 6202924 - DNA, 18 bp, Homo sapiens
cttggagcccgtgcagta

SEQ ID NO: 6202925 - DNA, 18 bp, Homo sapiens
cttggagcctctttttcc

SEQ ID NO: 6202926 - DNA, 20 bp, Homo sapiens
cttggagcctctttttcctt

SEQ ID NO: 6202927 - DNA, 15 bp, Homo sapiens
cttggagcctgcaga

SEQ ID NO: 6202928 - DNA, 16 bp, Homo sapiens
cttggagcctgcagag

SEQ ID NO: 6202929 - DNA, 18 bp, Homo sapiens
cttggagcctgcagagct

SEQ ID NO: 6202930 - DNA, 20 bp, Homo sapiens
cttggagcctgcagagctgc

SEQ ID NO: 6202931 - DNA, 14 bp, Homo sapiens
cttggagccttcca

SEQ ID NO: 6202932 - DNA, 20 bp, Homo sapiens
cttggagcgtttttgctggc

SEQ ID NO: 6202933 - DNA, 14 bp, Homo sapiens
cttggagctctgag

SEQ ID NO: 6202934 - DNA, 12 bp, Homo sapiens
cttggagctgag

SEQ ID NO: 6202935 - DNA, 14 bp, Homo sapiens
cttggagctgagat

SEQ ID NO: 6202936 - DNA, 13 bp, Homo sapiens
cttggagctgagc

SEQ ID NO: 6202937 - DNA, 14 bp, Homo sapiens
cttggagctgagca

SEQ ID NO: 6202938 - DNA, 18 bp, Homo sapiens
cttggagctgagcctctc

SEQ ID NO: 6202939 - DNA, 13 bp, Homo sapiens
cttggagctgccg

SEQ ID NO: 6202940 - DNA, 22 bp, Homo sapiens
cttggagctgccgtgcctgtgt

SEQ ID NO: 6202941 - DNA, 14 bp, Homo sapiens
cttggagctgcttg

SEQ ID NO: 6202942 - DNA, 14 bp, Homo sapiens
cttggagctgtcct

SEQ ID NO: 6202943 - DNA, 21 bp, Homo sapiens
cttggagcttacatagtttta

SEQ ID NO: 6202944 - DNA, 15 bp, Homo sapiens
cttggagctttggaa

SEQ ID NO: 6202945 - DNA, 17 bp, Homo sapiens
cttggagctttttcaaa

SEQ ID NO: 6202946 - DNA, 22 bp, Homo sapiens
cttggaggaaacttaagatgaa

SEQ ID NO: 6202947 - DNA, 12 bp, Homo sapiens
cttggaggaaat

SEQ ID NO: 6202948 - DNA, 22 bp, Homo sapiens
cttggaggaaggaaacccagct

SEQ ID NO: 6202949 - DNA, 23 bp, Homo sapiens
cttggaggaagtatgagtgctga

SEQ ID NO: 6202950 - DNA, 15 bp, Homo sapiens
cttggaggaatgaca

SEQ ID NO: 6202951 - DNA, 13 bp, Homo sapiens
cttggaggacagt

SEQ ID NO: 6202952 - DNA, 15 bp, Homo sapiens
cttggaggagagaga

SEQ ID NO: 6202953 - DNA, 18 bp, Homo sapiens
cttggaggagagagaccc

SEQ ID NO: 6202954 - DNA, 17 bp, Homo sapiens
cttggaggagatgggga

SEQ ID NO: 6202955 - DNA, 12 bp, Homo sapiens
cttggaggaggg

SEQ ID NO: 6202956 - DNA, 17 bp, Homo sapiens
cttggaggcaacctccc

SEQ ID NO: 6202957 - DNA, 15 bp, Homo sapiens
cttggaggcctcaga

SEQ ID NO: 6202958 - DNA, 14 bp, Homo sapiens
cttggaggcttggc

SEQ ID NO: 6202959 - DNA, 14 bp, Homo sapiens
cttggagggaagcc

SEQ ID NO: 6202960 - DNA, 14 bp, Homo sapiens
cttggagggaccaa

SEQ ID NO: 6202961 - DNA, 23 bp, Homo sapiens
cttggagggagaggtggcaggaa

SEQ ID NO: 6202962 - DNA, 12 bp, Homo sapiens
cttggagggcat

SEQ ID NO: 6202963 - DNA, 19 bp, Homo sapiens
cttggagggcccacttgta

SEQ ID NO: 6202964 - DNA, 15 bp, Homo sapiens
cttggagggtcccaa

SEQ ID NO: 6202965 - DNA, 17 bp, Homo sapiens
cttggagggtcccaagc

SEQ ID NO: 6202966 - DNA, 21 bp, Homo sapiens
cttggagggtcccaagctggg

SEQ ID NO: 6202967 - DNA, 21 bp, Homo sapiens
cttggagggtctgggggcagc

SEQ ID NO: 6202968 - DNA, 17 bp, Homo sapiens
gaccactcctcatagca

SEQ ID NO: 6202969 - DNA, 15 bp, Homo sapiens
gaccactcttcttta

SEQ ID NO: 6202970 - DNA, 14 bp, Homo sapiens
gaccactgaattca

SEQ ID NO: 6202971 - DNA, 21 bp, Homo sapiens
gaccactgagtaccaggggct

SEQ ID NO: 6202972 - DNA, 12 bp, Homo sapiens
gaccactgcatg

SEQ ID NO: 6202973 - DNA, 11 bp, Homo sapiens
gaccactggcc

SEQ ID NO: 6202974 - DNA, 19 bp, Homo sapiens
gaccactggcctacccctt

SEQ ID NO: 6202975 - DNA, 12 bp, Homo sapiens
gaccactgggcc

SEQ ID NO: 6202976 - DNA, 13 bp, Homo sapiens
gaccactgggccc

SEQ ID NO: 6202977 - DNA, 15 bp, Homo sapiens
gaccactgggcctgc

SEQ ID NO: 6202978 - DNA, 17 bp, Homo sapiens
gaccactgggcctgcta

SEQ ID NO: 6202979 - DNA, 18 bp, Homo sapiens
gaccactgtttcttgctt

SEQ ID NO: 6202980 - DNA, 20 bp, Homo sapiens
gaccactgtttcttgcttgt

SEQ ID NO: 6202981 - DNA, 23 bp, Homo sapiens
gaccacttccaggggaacctgcc

SEQ ID NO: 6202982 - DNA, 16 bp, Homo sapiens
gaccacttccttaaca

SEQ ID NO: 6202983 - DNA, 17 bp, Homo sapiens
gaccacttttatttatt

SEQ ID NO: 6202984 - DNA, 19 bp, Homo sapiens
gaccagaaaatatgatata

SEQ ID NO: 6202985 - DNA, 22 bp, Homo sapiens
gaccagaaacagggacaaagaa

SEQ ID NO: 6202986 - DNA, 17 bp, Homo sapiens
gaccagaaacctgggag

SEQ ID NO: 6202987 - DNA, 16 bp, Homo sapiens
gaccagaaatcaaaaa

SEQ ID NO: 6202988 - DNA, 20 bp, Homo sapiens
gaccagaagacaaaggccca

SEQ ID NO: 6202989 - DNA, 13 bp, Homo sapiens
gaccagaagcctt

SEQ ID NO: 6202990 - DNA, 11 bp, Homo sapiens
gaccagaccta

SEQ ID NO: 6202991 - DNA, 18 bp, Homo sapiens
gaccagacctagacctgg

SEQ ID NO: 6202992 - DNA, 19 bp, Homo sapiens
gaccagacttttgcttacc

SEQ ID NO: 6202993 - DNA, 15 bp, Homo sapiens
gaccagagaagggaa

SEQ ID NO: 6202994 - DNA, 21 bp, Homo sapiens
gaccagagacccaacagcagt

SEQ ID NO: 6202995 - DNA, 13 bp, Homo sapiens
gaccagagcaaaa

SEQ ID NO: 6202996 - DNA, 20 bp, Homo sapiens
gaccagagcaaaaatgtaaa

SEQ ID NO: 6202997 - DNA, 15 bp, Homo sapiens
gaccagagccagatg

SEQ ID NO: 6202998 - DNA, 17 bp, Homo sapiens
gaccagagccagatgca

SEQ ID NO: 6202999 - DNA, 18 bp, Homo sapiens
gaccagagccagatgcag

SEQ ID NO: 6203000 - DNA, 21 bp, Homo sapiens
gaccagagccagatgcaggac

SEQ ID NO: 6203001 - DNA, 21 bp, Homo sapiens
gaccagagccccacacggagg

SEQ ID NO: 6203002 - DNA, 18 bp, Homo sapiens
gaccagagctgccacctg

SEQ ID NO: 6203003 - DNA, 19 bp, Homo sapiens
gaccagagctgccacctgc

SEQ ID NO: 6203004 - DNA, 21 bp, Homo sapiens
gaccagagctgccacctgcct

SEQ ID NO: 6203005 - DNA, 15 bp, Homo sapiens
gaccagaggagcctt

SEQ ID NO: 6203006 - DNA, 23 bp, Homo sapiens
gaccagaggtgggaggcccctgg

SEQ ID NO: 6203007 - DNA, 16 bp, Homo sapiens
gaccagatccaagatg

SEQ ID NO: 6203008 - DNA, 19 bp, Homo sapiens
gaccagatctttctcttcc

SEQ ID NO: 6203009 - DNA, 23 bp, Homo sapiens
gaccagatctttctcttccctga

SEQ ID NO: 6203010 - DNA, 23 bp, Homo sapiens
gaccagatgtccgtctctcttgc

SEQ ID NO: 6203011 - DNA, 13 bp, Homo sapiens
gaccagcacactc

SEQ ID NO: 6203012 - DNA, 14 bp, Homo sapiens
gaccagcacactcc

SEQ ID NO: 6203013 - DNA, 11 bp, Homo sapiens
gaccagcacat

SEQ ID NO: 6203014 - DNA, 15 bp, Homo sapiens
gaccagcactgaccc

SEQ ID NO: 6203015 - DNA, 17 bp, Homo sapiens
gaccagcactgtctcag

SEQ ID NO: 6203016 - DNA, 22 bp, Homo sapiens
gaccagcagacagagccaggag

SEQ ID NO: 6203017 - DNA, 16 bp, Homo sapiens
gaccagcagatcccag

SEQ ID NO: 6203018 - DNA, 12 bp, Homo sapiens
gaccagcagccc

SEQ ID NO: 6203019 - DNA, 23 bp, Homo sapiens
gaccagcagcgcctttcccaact

SEQ ID NO: 6203020 - DNA, 15 bp, Homo sapiens
gaccagcaggctcct

SEQ ID NO: 6203021 - DNA, 19 bp, Homo sapiens
gaccagcaggctcctcagc

SEQ ID NO: 6203022 - DNA, 14 bp, Homo sapiens
gaccagcataccag

SEQ ID NO: 6203023 - DNA, 19 bp, Homo sapiens
gaccagcatccttaagtat

SEQ ID NO: 6203024 - DNA, 13 bp, Homo sapiens
gaccagcatctgg

SEQ ID NO: 6203025 - DNA, 16 bp, Homo sapiens
gaccagcatctggtct

SEQ ID NO: 6203026 - DNA, 18 bp, Homo sapiens
gaccagcatctggtcttg

SEQ ID NO: 6203027 - DNA, 18 bp, Homo sapiens
gaccagccagcagcagcc

SEQ ID NO: 6203028 - DNA, 11 bp, Homo sapiens
gaccagccagg

SEQ ID NO: 6203029 - DNA, 23 bp, Homo sapiens
gaccagccagggaaagactggca

SEQ ID NO: 6203030 - DNA, 11 bp, Homo sapiens
gaccagcccac

SEQ ID NO: 6203031 - DNA, 15 bp, Homo sapiens
gaccagcccagcctg

SEQ ID NO: 6203032 - DNA, 13 bp, Homo sapiens
gaccagcccattg

SEQ ID NO: 6203033 - DNA, 21 bp, Homo sapiens
gaccagcccattggccgagct

SEQ ID NO: 6203034 - DNA, 18 bp, Homo sapiens
gaccagccccttcctggg

SEQ ID NO: 6203035 - DNA, 14 bp, Homo sapiens
gaccagcctccctg

SEQ ID NO: 6203036 - DNA, 22 bp, Homo sapiens
gaccagcctccctgtcggcctg

SEQ ID NO: 6203037 - DNA, 14 bp, Homo sapiens
gaccagcctctcca

SEQ ID NO: 6203038 - DNA, 17 bp, Homo sapiens
gaccagcctgccaggcc

SEQ ID NO: 6203039 - DNA, 19 bp, Homo sapiens
gaccagcctgccaggccct

SEQ ID NO: 6203040 - DNA, 20 bp, Homo sapiens
gaccagcctgccaggccctc

SEQ ID NO: 6203041 - DNA, 24 bp, Homo sapiens
gaccagcctgccaggccctccagc

SEQ ID NO: 6203042 - DNA, 11 bp, Homo sapiens
gaccagcctgg

SEQ ID NO: 6203043 - DNA, 13 bp, Homo sapiens
gaccagcctggcc

SEQ ID NO: 6203044 - DNA, 16 bp, Homo sapiens
gaccagcctggcccac

SEQ ID NO: 6203045 - DNA, 19 bp, Homo sapiens
gaccagcctgtaccttgct

SEQ ID NO: 6203046 - DNA, 23 bp, Homo sapiens
gaccagcctgttggacccgctct

SEQ ID NO: 6203047 - DNA, 20 bp, Homo sapiens
gaccagcgcccttgcacatg

SEQ ID NO: 6203048 - DNA, 15 bp, Homo sapiens
gaccagcggaaacag

SEQ ID NO: 6203049 - DNA, 19 bp, Homo sapiens
gaccagcggaaacaggtgt

SEQ ID NO: 6203050 - DNA, 15 bp, Homo sapiens
gaccagcggctgctc

SEQ ID NO: 6203051 - DNA, 16 bp, Homo sapiens
gaccagcggctgctca

SEQ ID NO: 6203052 - DNA, 23 bp, Homo sapiens
gaccagcgtcctcgttcaaaaca

SEQ ID NO: 6203053 - DNA, 12 bp, Homo sapiens
gaccagctcagg

SEQ ID NO: 6203054 - DNA, 22 bp, Homo sapiens
gaccagctcaggacagatgcca

SEQ ID NO: 6203055 - DNA, 21 bp, Homo sapiens
gaccagctcccagatggccct

SEQ ID NO: 6203056 - DNA, 21 bp, Homo sapiens
gaccagctccccctccctccc

SEQ ID NO: 6203057 - DNA, 13 bp, Homo sapiens
gaccagctgctcc

SEQ ID NO: 6203058 - DNA, 15 bp, Homo sapiens
gaccagctgctccga

SEQ ID NO: 6203059 - DNA, 14 bp, Homo sapiens
gaccagctggagtg

SEQ ID NO: 6203060 - DNA, 12 bp, Homo sapiens
gaccagctgggg

SEQ ID NO: 6203061 - DNA, 23 bp, Homo sapiens
gaccagctggggcgtggggaggg

SEQ ID NO: 6203062 - DNA, 17 bp, Homo sapiens
gaccagcttggctcagg

SEQ ID NO: 6203063 - DNA, 22 bp, Homo sapiens
gaccagcttttcccaaaagccc

SEQ ID NO: 6203064 - DNA, 20 bp, Homo sapiens
gaccaggaaagccacacgga

SEQ ID NO: 6203065 - DNA, 15 bp, Homo sapiens
gaccaggaaaggctt

SEQ ID NO: 6203066 - DNA, 13 bp, Homo sapiens
gaccaggaaggaa

SEQ ID NO: 6203067 - DNA, 15 bp, Homo sapiens
gaccaggacccaggg

SEQ ID NO: 6203068 - DNA, 18 bp, Homo sapiens
gaccaggacccagggaga

SEQ ID NO: 6203069 - DNA, 16 bp, Homo sapiens
gaccaggactccctcc

SEQ ID NO: 6203070 - DNA, 21 bp, Homo sapiens
gaccaggactccctcctcacc

SEQ ID NO: 6203071 - DNA, 23 bp, Homo sapiens
gaccaggactccctcctcacctc

SEQ ID NO: 6203072 - DNA, 16 bp, Homo sapiens
gaccaggagggcactg

SEQ ID NO: 6203073 - DNA, 20 bp, Homo sapiens
gaccaggatcccaagcctcc

SEQ ID NO: 6203074 - DNA, 21 bp, Homo sapiens
gaccaggatcccaagcctcct

SEQ ID NO: 6203075 - DNA, 18 bp, Homo sapiens
gaccaggatggagcaagc

SEQ ID NO: 6203076 - DNA, 14 bp, Homo sapiens
gaccaggccaatcc

SEQ ID NO: 6203077 - DNA, 16 bp, Homo sapiens
gaccaggccaatccct

SEQ ID NO: 6203078 - DNA, 12 bp, Homo sapiens
gaccaggccacc

SEQ ID NO: 6203079 - DNA, 19 bp, Homo sapiens
gaccaggccattctgccgc

SEQ ID NO: 6203080 - DNA, 17 bp, Homo sapiens
gaccaggctcacaactg

SEQ ID NO: 6203081 - DNA, 13 bp, Homo sapiens
gaccaggctccaa

SEQ ID NO: 6203082 - DNA, 16 bp, Homo sapiens
gaccaggctgcagcct

SEQ ID NO: 6203083 - DNA, 15 bp, Homo sapiens
gaccaggctgcctcc

SEQ ID NO: 6203084 - DNA, 12 bp, Homo sapiens
gaccaggctgga

SEQ ID NO: 6203085 - DNA, 22 bp, Homo sapiens
gaccaggctggacaccctctgc

SEQ ID NO: 6203086 - DNA, 15 bp, Homo sapiens
gaccaggctgggcat

SEQ ID NO: 6203087 - DNA, 21 bp, Homo sapiens
gaccaggctggggccagggga

SEQ ID NO: 6203088 - DNA, 13 bp, Homo sapiens
gaccaggctgtag

SEQ ID NO: 6203089 - DNA, 23 bp, Homo sapiens
gaccaggctgtgggtagatgtgc

SEQ ID NO: 6203090 - DNA, 16 bp, Homo sapiens
gaccaggcttcttcct

SEQ ID NO: 6203091 - DNA, 21 bp, Homo sapiens
gaccaggcttttgtagatggc

SEQ ID NO: 6203092 - DNA, 23 bp, Homo sapiens
gaccagggacagatccagcaggc

SEQ ID NO: 6203093 - DNA, 14 bp, Homo sapiens
gaccagggagcctt

SEQ ID NO: 6203094 - DNA, 15 bp, Homo sapiens
gaccagggagccttt

SEQ ID NO: 6203095 - DNA, 15 bp, Homo sapiens
gaccagggatgctgg

SEQ ID NO: 6203096 - DNA, 16 bp, Homo sapiens
gaccagggatgctggg

SEQ ID NO: 6203097 - DNA, 18 bp, Homo sapiens
gaccagggatgctgggct

SEQ ID NO: 6203098 - DNA, 19 bp, Homo sapiens
gaccagggatgctgggctg

SEQ ID NO: 6203099 - DNA, 22 bp, Homo sapiens
gaccagggatgggggatgggcc

SEQ ID NO: 6203100 - DNA, 16 bp, Homo sapiens
gaccagggcagggcca

SEQ ID NO: 6203101 - DNA, 14 bp, Homo sapiens
gaccagggccaccg

SEQ ID NO: 6203102 - DNA, 15 bp, Homo sapiens
gaccagggccaccgc

SEQ ID NO: 6203103 - DNA, 18 bp, Homo sapiens
gaccagggccctgggcag

SEQ ID NO: 6203104 - DNA, 11 bp, Homo sapiens
gaccagggcct

SEQ ID NO: 6203105 - DNA, 19 bp, Homo sapiens
gaccagggccttttctggc

SEQ ID NO: 6203106 - DNA, 18 bp, Homo sapiens
gaccagggctccagcccc

SEQ ID NO: 6203107 - DNA, 15 bp, Homo sapiens
gaccagggctgctct

SEQ ID NO: 6203108 - DNA, 17 bp, Homo sapiens
gaccaggggaccagagg

SEQ ID NO: 6203109 - DNA, 19 bp, Homo sapiens
gaccaggggaccagaggga

SEQ ID NO: 6203110 - DNA, 21 bp, Homo sapiens
gaccaggggcccaccctctgc

SEQ ID NO: 6203111 - DNA, 23 bp, Homo sapiens
gaccaggggcccaccctctgccc

SEQ ID NO: 6203112 - DNA, 22 bp, Homo sapiens
gaccagggtcttacctctctgg

SEQ ID NO: 6203113 - DNA, 23 bp, Homo sapiens
gaccagggtcttacctctctggg

SEQ ID NO: 6203114 - DNA, 16 bp, Homo sapiens
gaccagggtggagctg

SEQ ID NO: 6203115 - DNA, 22 bp, Homo sapiens
gaccagggtggccacacaggca

SEQ ID NO: 6203116 - DNA, 23 bp, Homo sapiens
gaccagggtggccacacaggcag

SEQ ID NO: 6203117 - DNA, 20 bp, Homo sapiens
gaccagggttggcaccttcc

SEQ ID NO: 6203118 - DNA, 14 bp, Homo sapiens
gaccaggtcctgct

SEQ ID NO: 6203119 - DNA, 15 bp, Homo sapiens
gaccaggtgctcagc

SEQ ID NO: 6203120 - DNA, 16 bp, Homo sapiens
gaccaggtgctcagcc

SEQ ID NO: 6203121 - DNA, 18 bp, Homo sapiens
gaccaggtgctcagccca

SEQ ID NO: 6203122 - DNA, 15 bp, Homo sapiens
gaccagtactgggaa

SEQ ID NO: 6203123 - DNA, 15 bp, Homo sapiens
gaccagtagacaact

SEQ ID NO: 6203124 - DNA, 15 bp, Homo sapiens
gaccagtagtgacca

SEQ ID NO: 6203125 - DNA, 16 bp, Homo sapiens
gaccagtagtgaccaa

SEQ ID NO: 6203126 - DNA, 21 bp, Homo sapiens
gaccagtcacagccatttcaa

SEQ ID NO: 6203127 - DNA, 15 bp, Homo sapiens
gaccagtcccacacc

SEQ ID NO: 6203128 - DNA, 17 bp, Homo sapiens
gaccagtcccagagcag

SEQ ID NO: 6203129 - DNA, 17 bp, Homo sapiens
gaccagtggctggtctc

SEQ ID NO: 6203130 - DNA, 18 bp, Homo sapiens
gaccagtggctggtctca

SEQ ID NO: 6203131 - DNA, 19 bp, Homo sapiens
gaccagtgggatgggctct

SEQ ID NO: 6203132 - DNA, 14 bp, Homo sapiens
gaccagtggtctca

SEQ ID NO: 6203133 - DNA, 21 bp, Homo sapiens
gaccagtgtatcaggtcaggg

SEQ ID NO: 6203134 - DNA, 23 bp, Homo sapiens
gaccagtgtatcaggtcagggac

SEQ ID NO: 6203135 - DNA, 16 bp, Homo sapiens
gaccagttctggccag

SEQ ID NO: 6203136 - DNA, 17 bp, Homo sapiens
gaccagttctggccagg

SEQ ID NO: 6203137 - DNA, 19 bp, Homo sapiens
gaccagtttaacctgatgc

SEQ ID NO: 6203138 - DNA, 12 bp, Homo sapiens
gaccagtttacc

SEQ ID NO: 6203139 - DNA, 16 bp, Homo sapiens
gaccagtttatgtttg

SEQ ID NO: 6203140 - DNA, 13 bp, Homo sapiens
gaccagtttctta

SEQ ID NO: 6203141 - DNA, 15 bp, Homo sapiens
gaccagtttgcatga

SEQ ID NO: 6203142 - DNA, 13 bp, Homo sapiens
gaccataaattaa

SEQ ID NO: 6203143 - DNA, 22 bp, Homo sapiens
gaccataagagaaacctgccaa

SEQ ID NO: 6203144 - DNA, 19 bp, Homo sapiens
gaccataatcctagccccg

SEQ ID NO: 6203145 - DNA, 15 bp, Homo sapiens
gaccataatgttaca

SEQ ID NO: 6203146 - DNA, 20 bp, Homo sapiens
gaccataatgttacattatt

SEQ ID NO: 6203147 - DNA, 19 bp, Homo sapiens
cttggagggttggtcctct

SEQ ID NO: 6203148 - DNA, 19 bp, Homo sapiens
cttggaggtcacagctgga

SEQ ID NO: 6203149 - DNA, 21 bp, Homo sapiens
cttggaggtcacagctggatc

SEQ ID NO: 6203150 - DNA, 14 bp, Homo sapiens
cttggagtcccagg

SEQ ID NO: 6203151 - DNA, 20 bp, Homo sapiens
cttggagtgccacgtggccg

SEQ ID NO: 6203152 - DNA, 14 bp, Homo sapiens
cttggagtgcccca

SEQ ID NO: 6203153 - DNA, 18 bp, Homo sapiens
cttggagtgccccaagga

SEQ ID NO: 6203154 - DNA, 18 bp, Homo sapiens
cttggataatgctgttgc

SEQ ID NO: 6203155 - DNA, 22 bp, Homo sapiens
cttggataatgctgttgcctca

SEQ ID NO: 6203156 - DNA, 16 bp, Homo sapiens
cttggatacttggatt

SEQ ID NO: 6203157 - DNA, 15 bp, Homo sapiens
cttggataggagctt

SEQ ID NO: 6203158 - DNA, 15 bp, Homo sapiens
cttggatcaagcaga

SEQ ID NO: 6203159 - DNA, 20 bp, Homo sapiens
cttggatcagatagcaggag

SEQ ID NO: 6203160 - DNA, 20 bp, Homo sapiens
cttggatcccaaagcaagga

SEQ ID NO: 6203161 - DNA, 13 bp, Homo sapiens
cttggatcctggg

SEQ ID NO: 6203162 - DNA, 21 bp, Homo sapiens
cttggatcgctaagctggctc

SEQ ID NO: 6203163 - DNA, 12 bp, Homo sapiens
cttggatgagga

SEQ ID NO: 6203164 - DNA, 14 bp, Homo sapiens
cttggatgcagtgc

SEQ ID NO: 6203165 - DNA, 23 bp, Homo sapiens
cttggatgcgagcttggccttgg

SEQ ID NO: 6203166 - DNA, 18 bp, Homo sapiens
cttggatgtacctgcccc

SEQ ID NO: 6203167 - DNA, 21 bp, Homo sapiens
cttggatgtcactgcctgaca

SEQ ID NO: 6203168 - DNA, 22 bp, Homo sapiens
cttggatgtcactgcctgacat

SEQ ID NO: 6203169 - DNA, 12 bp, Homo sapiens
cttggatgtcat

SEQ ID NO: 6203170 - DNA, 13 bp, Homo sapiens
cttggattaaata

SEQ ID NO: 6203171 - DNA, 17 bp, Homo sapiens
cttggattaaggaagac

SEQ ID NO: 6203172 - DNA, 21 bp, Homo sapiens
cttggattaattcatggtatc

SEQ ID NO: 6203173 - DNA, 21 bp, Homo sapiens
cttggattattttaaatcatt

SEQ ID NO: 6203174 - DNA, 14 bp, Homo sapiens
cttggattctctaa

SEQ ID NO: 6203175 - DNA, 20 bp, Homo sapiens
cttggattctctgagaaatg

SEQ ID NO: 6203176 - DNA, 22 bp, Homo sapiens
cttggattctctgagaaatgat

SEQ ID NO: 6203177 - DNA, 16 bp, Homo sapiens
cttggattctttccat

SEQ ID NO: 6203178 - DNA, 17 bp, Homo sapiens
cttggattctttccatt

SEQ ID NO: 6203179 - DNA, 21 bp, Homo sapiens
cttggattctttccatttgca

SEQ ID NO: 6203180 - DNA, 22 bp, Homo sapiens
cttggattggtaccagagccta

SEQ ID NO: 6203181 - DNA, 18 bp, Homo sapiens
cttggattgtccccgacc

SEQ ID NO: 6203182 - DNA, 22 bp, Homo sapiens
cttggattgtccccgacccttg

SEQ ID NO: 6203183 - DNA, 20 bp, Homo sapiens
cttggatttgcatttttgta

SEQ ID NO: 6203184 - DNA, 17 bp, Homo sapiens
cttggcaaaagccttgt

SEQ ID NO: 6203185 - DNA, 20 bp, Homo sapiens
cttggcaaaagccttgtgta

SEQ ID NO: 6203186 - DNA, 23 bp, Homo sapiens
cttggcaaaagccttgtgtatat

SEQ ID NO: 6203187 - DNA, 13 bp, Homo sapiens
cttggcaacagaa

SEQ ID NO: 6203188 - DNA, 14 bp, Homo sapiens
cttggcaagatgtt

SEQ ID NO: 6203189 - DNA, 23 bp, Homo sapiens
cttggcaataaattttgaaaagt

SEQ ID NO: 6203190 - DNA, 23 bp, Homo sapiens
cttggcacatttaagagacagtc

SEQ ID NO: 6203191 - DNA, 13 bp, Homo sapiens
cttggcaccaaag

SEQ ID NO: 6203192 - DNA, 16 bp, Homo sapiens
cttggcaccaaagatg

SEQ ID NO: 6203193 - DNA, 15 bp, Homo sapiens
cttggcaccaataaa

SEQ ID NO: 6203194 - DNA, 17 bp, Homo sapiens
cttggcaccaataaagg

SEQ ID NO: 6203195 - DNA, 22 bp, Homo sapiens
cttggcaccaataaaggaggaa

SEQ ID NO: 6203196 - DNA, 20 bp, Homo sapiens
cttggcaccagacacccagg

SEQ ID NO: 6203197 - DNA, 17 bp, Homo sapiens
cttggcacccccatgct

SEQ ID NO: 6203198 - DNA, 13 bp, Homo sapiens
cttggcacctgcc

SEQ ID NO: 6203199 - DNA, 17 bp, Homo sapiens
cttggcacttaagtgca

SEQ ID NO: 6203200 - DNA, 20 bp, Homo sapiens
cttggcacttattgaatata

SEQ ID NO: 6203201 - DNA, 18 bp, Homo sapiens
cttggcagcacctgtctc

SEQ ID NO: 6203202 - DNA, 19 bp, Homo sapiens
cttggcagcacctgtctcc

SEQ ID NO: 6203203 - DNA, 14 bp, Homo sapiens
cttggcagccttgt

SEQ ID NO: 6203204 - DNA, 16 bp, Homo sapiens
cttggcagctttttct

SEQ ID NO: 6203205 - DNA, 17 bp, Homo sapiens
cttggcagctttttctg

SEQ ID NO: 6203206 - DNA, 22 bp, Homo sapiens
cttggcaggaaccatggacctg

SEQ ID NO: 6203207 - DNA, 21 bp, Homo sapiens
cttggcaggagtgggctctga

SEQ ID NO: 6203208 - DNA, 23 bp, Homo sapiens
cttggcaggagtgggctctgagc

SEQ ID NO: 6203209 - DNA, 13 bp, Homo sapiens
cttggcaggctga

SEQ ID NO: 6203210 - DNA, 14 bp, Homo sapiens
cttggcaggctgag

SEQ ID NO: 6203211 - DNA, 16 bp, Homo sapiens
cttggcaggtgcctgt

SEQ ID NO: 6203212 - DNA, 13 bp, Homo sapiens
cttggcatacaaa

SEQ ID NO: 6203213 - DNA, 15 bp, Homo sapiens
cttggcatagacatg

SEQ ID NO: 6203214 - DNA, 18 bp, Homo sapiens
cttggcatcacagggcag

SEQ ID NO: 6203215 - DNA, 15 bp, Homo sapiens
cttggcatctgtgtg

SEQ ID NO: 6203216 - DNA, 17 bp, Homo sapiens
cttggcatctgtgtgcg

SEQ ID NO: 6203217 - DNA, 16 bp, Homo sapiens
cttggcatgccttcca

SEQ ID NO: 6203218 - DNA, 17 bp, Homo sapiens
cttggcatgccttccag

SEQ ID NO: 6203219 - DNA, 21 bp, Homo sapiens
cttggcatgggcgcaggccca

SEQ ID NO: 6203220 - DNA, 22 bp, Homo sapiens
cttggcatgggcgcaggcccag

SEQ ID NO: 6203221 - DNA, 12 bp, Homo sapiens
cttggcatttct

SEQ ID NO: 6203222 - DNA, 19 bp, Homo sapiens
cttggcatttctatacttt

SEQ ID NO: 6203223 - DNA, 14 bp, Homo sapiens
cttggccaagagaa

SEQ ID NO: 6203224 - DNA, 16 bp, Homo sapiens
cttggccaagagaagg

SEQ ID NO: 6203225 - DNA, 16 bp, Homo sapiens
cttggccacggcctgg

SEQ ID NO: 6203226 - DNA, 18 bp, Homo sapiens
cttggccacggcctggga

SEQ ID NO: 6203227 - DNA, 21 bp, Homo sapiens
cttggccacggcctgggaggg

SEQ ID NO: 6203228 - DNA, 13 bp, Homo sapiens
cttggccagagct

SEQ ID NO: 6203229 - DNA, 15 bp, Homo sapiens
cttggccagagctga

SEQ ID NO: 6203230 - DNA, 16 bp, Homo sapiens
cttggccagagctgag

SEQ ID NO: 6203231 - DNA, 23 bp, Homo sapiens
cttggccagagctgagtggcagc

SEQ ID NO: 6203232 - DNA, 18 bp, Homo sapiens
cttggccagcgctgttga

SEQ ID NO: 6203233 - DNA, 18 bp, Homo sapiens
cttggccagttatccctt

SEQ ID NO: 6203234 - DNA, 19 bp, Homo sapiens
cttggccatgggaggcctt

SEQ ID NO: 6203235 - DNA, 12 bp, Homo sapiens
cttggcccagag

SEQ ID NO: 6203236 - DNA, 18 bp, Homo sapiens
cttggcccagagacggag

SEQ ID NO: 6203237 - DNA, 12 bp, Homo sapiens
cttggcccagca

SEQ ID NO: 6203238 - DNA, 19 bp, Homo sapiens
cttggcccagcactgccca

SEQ ID NO: 6203239 - DNA, 21 bp, Homo sapiens
cttggcccagcagcggcccag

SEQ ID NO: 6203240 - DNA, 12 bp, Homo sapiens
cttggcccagga

SEQ ID NO: 6203241 - DNA, 13 bp, Homo sapiens
cttggcccaggag

SEQ ID NO: 6203242 - DNA, 18 bp, Homo sapiens
cttggcccaggagctctg

SEQ ID NO: 6203243 - DNA, 21 bp, Homo sapiens
cttggcccaggagctctgcgc

SEQ ID NO: 6203244 - DNA, 24 bp, Homo sapiens
cttggcccaggagctctgcgccag

SEQ ID NO: 6203245 - DNA, 15 bp, Homo sapiens
cttggcccagggggc

SEQ ID NO: 6203246 - DNA, 22 bp, Homo sapiens
cttggcccagggggcttcctga

SEQ ID NO: 6203247 - DNA, 21 bp, Homo sapiens
cttggcccatcccgccttctc

SEQ ID NO: 6203248 - DNA, 17 bp, Homo sapiens
cttggccccagaggacc

SEQ ID NO: 6203249 - DNA, 17 bp, Homo sapiens
cttggccccccaaagtg

SEQ ID NO: 6203250 - DNA, 15 bp, Homo sapiens
cttggcccctcacat

SEQ ID NO: 6203251 - DNA, 22 bp, Homo sapiens
cttggcccctcacatcctctcc

SEQ ID NO: 6203252 - DNA, 23 bp, Homo sapiens
cttggcccctccctcccggctgc

SEQ ID NO: 6203253 - DNA, 12 bp, Homo sapiens
cttggcccctct

SEQ ID NO: 6203254 - DNA, 15 bp, Homo sapiens
cttggcccctgtgtg

SEQ ID NO: 6203255 - DNA, 16 bp, Homo sapiens
cttggcccctgtgtga

SEQ ID NO: 6203256 - DNA, 15 bp, Homo sapiens
cttggcccgcggcct

SEQ ID NO: 6203257 - DNA, 19 bp, Homo sapiens
cttggcccgcggcctgcac

SEQ ID NO: 6203258 - DNA, 18 bp, Homo sapiens
cttggccctacagccctg

SEQ ID NO: 6203259 - DNA, 15 bp, Homo sapiens
cttggccctcccacc

SEQ ID NO: 6203260 - DNA, 16 bp, Homo sapiens
cttggccctgcgccct

SEQ ID NO: 6203261 - DNA, 19 bp, Homo sapiens
cttggccctgcgccctgtg

SEQ ID NO: 6203262 - DNA, 17 bp, Homo sapiens
cttggccgactcaggga

SEQ ID NO: 6203263 - DNA, 19 bp, Homo sapiens
cttggccgcataggcccag

SEQ ID NO: 6203264 - DNA, 21 bp, Homo sapiens
cttggccggctgtgctcagag

SEQ ID NO: 6203265 - DNA, 22 bp, Homo sapiens
cttggccggctgtgctcagaga

SEQ ID NO: 6203266 - DNA, 20 bp, Homo sapiens
cttggcctagcccaccctgc

SEQ ID NO: 6203267 - DNA, 20 bp, Homo sapiens
cttggcctcaccctctggct

SEQ ID NO: 6203268 - DNA, 12 bp, Homo sapiens
cttggcctcaga

SEQ ID NO: 6203269 - DNA, 23 bp, Homo sapiens
cttggcctcagaattcacaaaat

SEQ ID NO: 6203270 - DNA, 15 bp, Homo sapiens
cttggcctccagctg

SEQ ID NO: 6203271 - DNA, 11 bp, Homo sapiens
cttggcctccc

SEQ ID NO: 6203272 - DNA, 14 bp, Homo sapiens
cttggcctcccaaa

SEQ ID NO: 6203273 - DNA, 22 bp, Homo sapiens
cttggcctcccaaagtgctgag

SEQ ID NO: 6203274 - DNA, 21 bp, Homo sapiens
cttggcctcccaaagtgctgg

SEQ ID NO: 6203275 - DNA, 22 bp, Homo sapiens
cttggcctcccaaagtgctggg

SEQ ID NO: 6203276 - DNA, 19 bp, Homo sapiens
cttggcctcccaaggtgct

SEQ ID NO: 6203277 - DNA, 15 bp, Homo sapiens
cttggcctgctgtga

SEQ ID NO: 6203278 - DNA, 16 bp, Homo sapiens
cttggcctggagagga

SEQ ID NO: 6203279 - DNA, 12 bp, Homo sapiens
cttggcctgggc

SEQ ID NO: 6203280 - DNA, 14 bp, Homo sapiens
cttggcctgggccg

SEQ ID NO: 6203281 - DNA, 14 bp, Homo sapiens
cttggcctgtccac

SEQ ID NO: 6203282 - DNA, 13 bp, Homo sapiens
cttggccttctcc

SEQ ID NO: 6203283 - DNA, 14 bp, Homo sapiens
cttggccttctccc

SEQ ID NO: 6203284 - DNA, 16 bp, Homo sapiens
cttggccttctcccct

SEQ ID NO: 6203285 - DNA, 22 bp, Homo sapiens
cttggccttctcccctcttctg

SEQ ID NO: 6203286 - DNA, 10 bp, Homo sapiens
cttggccttg

SEQ ID NO: 6203287 - DNA, 17 bp, Homo sapiens
cttggccttgcagctgg

SEQ ID NO: 6203288 - DNA, 18 bp, Homo sapiens
cttggccttgcagctggc

SEQ ID NO: 6203289 - DNA, 21 bp, Homo sapiens
cttggccttgcagctggccca

SEQ ID NO: 6203290 - DNA, 12 bp, Homo sapiens
cttggccttggc

SEQ ID NO: 6203291 - DNA, 23 bp, Homo sapiens
cttggccttggcatgggcgcagg

SEQ ID NO: 6203292 - DNA, 14 bp, Homo sapiens
cttggccttgggct

SEQ ID NO: 6203293 - DNA, 14 bp, Homo sapiens
cttggcctttgcat

SEQ ID NO: 6203294 - DNA, 16 bp, Homo sapiens
cttggcctttgcattt

SEQ ID NO: 6203295 - DNA, 24 bp, Homo sapiens
cttggcgagggcagcagggtagag

SEQ ID NO: 6203296 - DNA, 16 bp, Homo sapiens
cttggcgctctcagct

SEQ ID NO: 6203297 - DNA, 17 bp, Homo sapiens
cttggcgctctcagctt

SEQ ID NO: 6203298 - DNA, 12 bp, Homo sapiens
cttggcgctgcc

SEQ ID NO: 6203299 - DNA, 17 bp, Homo sapiens
cttggcgctgcccctgg

SEQ ID NO: 6203300 - DNA, 23 bp, Homo sapiens
cttggcgctgcccctggcagccc

SEQ ID NO: 6203301 - DNA, 14 bp, Homo sapiens
cttggcggcagcag

SEQ ID NO: 6203302 - DNA, 16 bp, Homo sapiens
cttggcgtggagcagg

SEQ ID NO: 6203303 - DNA, 14 bp, Homo sapiens
cttggcgtggagcc

SEQ ID NO: 6203304 - DNA, 19 bp, Homo sapiens
cttggcgttcctgccaggc

SEQ ID NO: 6203305 - DNA, 17 bp, Homo sapiens
cttggctacacagggat

SEQ ID NO: 6203306 - DNA, 22 bp, Homo sapiens
cttggctatgaaaatgagccct

SEQ ID NO: 6203307 - DNA, 23 bp, Homo sapiens
cttggctatgaaaatgagccctg

SEQ ID NO: 6203308 - DNA, 15 bp, Homo sapiens
cttggctattgaaga

SEQ ID NO: 6203309 - DNA, 13 bp, Homo sapiens
cttggctattgac

SEQ ID NO: 6203310 - DNA, 19 bp, Homo sapiens
cttggctatttctgtgtcc

SEQ ID NO: 6203311 - DNA, 21 bp, Homo sapiens
cttggctatttctgtgtccag

SEQ ID NO: 6203312 - DNA, 21 bp, Homo sapiens
cttggctcaatcctctaagct

SEQ ID NO: 6203313 - DNA, 21 bp, Homo sapiens
cttggctcacaaggcccagga

SEQ ID NO: 6203314 - DNA, 23 bp, Homo sapiens
cttggctcacaaggcccaggaga

SEQ ID NO: 6203315 - DNA, 14 bp, Homo sapiens
cttggctcactgca

SEQ ID NO: 6203316 - DNA, 14 bp, Homo sapiens
cttggctccatgct

SEQ ID NO: 6203317 - DNA, 20 bp, Homo sapiens
cttggctcccgggggcccca

SEQ ID NO: 6203318 - DNA, 15 bp, Homo sapiens
cttggctcctgagaa

SEQ ID NO: 6203319 - DNA, 18 bp, Homo sapiens
cttggctcgaatctctgt

SEQ ID NO: 6203320 - DNA, 19 bp, Homo sapiens
cttggctcgatgtttgcca

SEQ ID NO: 6203321 - DNA, 17 bp, Homo sapiens
cttggctcgcaccccca

SEQ ID NO: 6203322 - DNA, 16 bp, Homo sapiens
cttggctctcctctgg

SEQ ID NO: 6203323 - DNA, 17 bp, Homo sapiens
cttggctctcctctggc

SEQ ID NO: 6203324 - DNA, 21 bp, Homo sapiens
cttggctctcctctggctaga

SEQ ID NO: 6203325 - DNA, 12 bp, Homo sapiens
gaccataatttt

SEQ ID NO: 6203326 - DNA, 22 bp, Homo sapiens
gaccatataactgtgatgaaat

SEQ ID NO: 6203327 - DNA, 19 bp, Homo sapiens
gaccatatagattttatta

SEQ ID NO: 6203328 - DNA, 19 bp, Homo sapiens
gaccatatttactctttct

SEQ ID NO: 6203329 - DNA, 16 bp, Homo sapiens
gaccatcaagggtcat

SEQ ID NO: 6203330 - DNA, 17 bp, Homo sapiens
gaccatcatgccctctc

SEQ ID NO: 6203331 - DNA, 19 bp, Homo sapiens
gaccatccactctaccctc

SEQ ID NO: 6203332 - DNA, 21 bp, Homo sapiens
gaccatccagaggaataaaaa

SEQ ID NO: 6203333 - DNA, 15 bp, Homo sapiens
gaccatccctgaagg

SEQ ID NO: 6203334 - DNA, 16 bp, Homo sapiens
gaccatccctgaaggc

SEQ ID NO: 6203335 - DNA, 20 bp, Homo sapiens
gaccatccctgaaggccccg

SEQ ID NO: 6203336 - DNA, 17 bp, Homo sapiens
gaccatcctggagggct

SEQ ID NO: 6203337 - DNA, 14 bp, Homo sapiens
gaccatcctggccc

SEQ ID NO: 6203338 - DNA, 15 bp, Homo sapiens
gaccatcctgtcctt

SEQ ID NO: 6203339 - DNA, 14 bp, Homo sapiens
gaccatcgtccagc

SEQ ID NO: 6203340 - DNA, 20 bp, Homo sapiens
gaccatcgtccagccctcct

SEQ ID NO: 6203341 - DNA, 18 bp, Homo sapiens
gaccatcgtccttcctct

SEQ ID NO: 6203342 - DNA, 16 bp, Homo sapiens
gaccatctgattaaaa

SEQ ID NO: 6203343 - DNA, 19 bp, Homo sapiens
gaccatctggaattggttt

SEQ ID NO: 6203344 - DNA, 18 bp, Homo sapiens
gaccatcttcataatttg

SEQ ID NO: 6203345 - DNA, 16 bp, Homo sapiens
gaccatctttagcagt

SEQ ID NO: 6203346 - DNA, 18 bp, Homo sapiens
gaccatctttagcagttt

SEQ ID NO: 6203347 - DNA, 21 bp, Homo sapiens
gaccatgaagtaaattatgta

SEQ ID NO: 6203348 - DNA, 17 bp, Homo sapiens
gaccatgcactatattt

SEQ ID NO: 6203349 - DNA, 15 bp, Homo sapiens
gaccatgccagattc

SEQ ID NO: 6203350 - DNA, 24 bp, Homo sapiens
gaccatgcgacactgggaggccag

SEQ ID NO: 6203351 - DNA, 15 bp, Homo sapiens
gaccatgctgtctgg

SEQ ID NO: 6203352 - DNA, 19 bp, Homo sapiens
gaccatgctgtctggcaca

SEQ ID NO: 6203353 - DNA, 23 bp, Homo sapiens
gaccatggccgaagccccttgga

SEQ ID NO: 6203354 - DNA, 13 bp, Homo sapiens
gaccatgtgaatc

SEQ ID NO: 6203355 - DNA, 14 bp, Homo sapiens
gaccatgtgattat

SEQ ID NO: 6203356 - DNA, 12 bp, Homo sapiens
gaccatgtgtca

SEQ ID NO: 6203357 - DNA, 21 bp, Homo sapiens
gaccatgtgtcacttgtgctt

SEQ ID NO: 6203358 - DNA, 23 bp, Homo sapiens
gaccatgttcattataatctcaa

SEQ ID NO: 6203359 - DNA, 13 bp, Homo sapiens
gaccattattcac

SEQ ID NO: 6203360 - DNA, 23 bp, Homo sapiens
gaccattccaaagttcttatctc

SEQ ID NO: 6203361 - DNA, 13 bp, Homo sapiens
gaccattcctgtc

SEQ ID NO: 6203362 - DNA, 15 bp, Homo sapiens
gaccattcctgtccc

SEQ ID NO: 6203363 - DNA, 21 bp, Homo sapiens
gaccattctccacctgccagg

SEQ ID NO: 6203364 - DNA, 15 bp, Homo sapiens
gaccattctgcctct

SEQ ID NO: 6203365 - DNA, 22 bp, Homo sapiens
gaccattctgtgaccaaaatac

SEQ ID NO: 6203366 - DNA, 18 bp, Homo sapiens
gaccattgaaaaaggaaa

SEQ ID NO: 6203367 - DNA, 21 bp, Homo sapiens
gaccattgaaaaaggaaaaat

SEQ ID NO: 6203368 - DNA, 17 bp, Homo sapiens
gaccattgacctcagct

SEQ ID NO: 6203369 - DNA, 20 bp, Homo sapiens
gaccattgacctcagctgca

SEQ ID NO: 6203370 - DNA, 20 bp, Homo sapiens
gaccattggggctcccagcc

SEQ ID NO: 6203371 - DNA, 20 bp, Homo sapiens
gaccattgtcttccaacccc

SEQ ID NO: 6203372 - DNA, 17 bp, Homo sapiens
gaccatttaacatgcaa

SEQ ID NO: 6203373 - DNA, 15 bp, Homo sapiens
gaccatttcaggggt

SEQ ID NO: 6203374 - DNA, 13 bp, Homo sapiens
gaccattttcctg

SEQ ID NO: 6203375 - DNA, 19 bp, Homo sapiens
gaccattttgttaaaatct

SEQ ID NO: 6203376 - DNA, 20 bp, Homo sapiens
gaccattttttaatttactt

SEQ ID NO: 6203377 - DNA, 15 bp, Homo sapiens
gacccaaaacagctt

SEQ ID NO: 6203378 - DNA, 16 bp, Homo sapiens
gacccaaaccccctgc

SEQ ID NO: 6203379 - DNA, 18 bp, Homo sapiens
gacccaaaccccctgcag

SEQ ID NO: 6203380 - DNA, 17 bp, Homo sapiens
gacccaaagcaaaacat

SEQ ID NO: 6203381 - DNA, 17 bp, Homo sapiens
gacccaaagcaggatga

SEQ ID NO: 6203382 - DNA, 16 bp, Homo sapiens
gacccaaccacagagg

SEQ ID NO: 6203383 - DNA, 23 bp, Homo sapiens
gacccaaccacagaggatgctga

SEQ ID NO: 6203384 - DNA, 17 bp, Homo sapiens
gacccaacccatgcccc

SEQ ID NO: 6203385 - DNA, 14 bp, Homo sapiens
gacccaacttgcca

SEQ ID NO: 6203386 - DNA, 16 bp, Homo sapiens
gacccaagaggtgggg

SEQ ID NO: 6203387 - DNA, 20 bp, Homo sapiens
gacccaagccctgaggcctg

SEQ ID NO: 6203388 - DNA, 23 bp, Homo sapiens
gacccaagtctgaacgtggaatt

SEQ ID NO: 6203389 - DNA, 14 bp, Homo sapiens
gacccaagtggata

SEQ ID NO: 6203390 - DNA, 19 bp, Homo sapiens
gacccaagtggggcctcct

SEQ ID NO: 6203391 - DNA, 22 bp, Homo sapiens
gacccaagtggggcctccttgt

SEQ ID NO: 6203392 - DNA, 12 bp, Homo sapiens
gacccacactgc

SEQ ID NO: 6203393 - DNA, 16 bp, Homo sapiens
gacccacagccctgaa

SEQ ID NO: 6203394 - DNA, 17 bp, Homo sapiens
gacccacagccctgaaa

SEQ ID NO: 6203395 - DNA, 12 bp, Homo sapiens
gacccacagctc

SEQ ID NO: 6203396 - DNA, 20 bp, Homo sapiens
gacccacagctctgggcctc

SEQ ID NO: 6203397 - DNA, 22 bp, Homo sapiens
gacccacagctctgggcctctt

SEQ ID NO: 6203398 - DNA, 12 bp, Homo sapiens
gacccaccagtg

SEQ ID NO: 6203399 - DNA, 13 bp, Homo sapiens
gacccaccagtgc

SEQ ID NO: 6203400 - DNA, 23 bp, Homo sapiens
gacccaccatccttccatcctga

SEQ ID NO: 6203401 - DNA, 21 bp, Homo sapiens
gacccacccatcttcctgctg

SEQ ID NO: 6203402 - DNA, 12 bp, Homo sapiens
gacccaccccaa

SEQ ID NO: 6203403 - DNA, 20 bp, Homo sapiens
gacccaccccaactctcccc

SEQ ID NO: 6203404 - DNA, 18 bp, Homo sapiens
gacccaccccacctgcag

SEQ ID NO: 6203405 - DNA, 16 bp, Homo sapiens
gacccacccccagcct

SEQ ID NO: 6203406 - DNA, 22 bp, Homo sapiens
gacccacccccagccttgccca

SEQ ID NO: 6203407 - DNA, 16 bp, Homo sapiens
gacccacctcaccccg

SEQ ID NO: 6203408 - DNA, 16 bp, Homo sapiens
gacccacctccccctc

SEQ ID NO: 6203409 - DNA, 16 bp, Homo sapiens
gacccacctgaggctc

SEQ ID NO: 6203410 - DNA, 11 bp, Homo sapiens
gacccacctgc

SEQ ID NO: 6203411 - DNA, 14 bp, Homo sapiens
gacccacctgcgct

SEQ ID NO: 6203412 - DNA, 12 bp, Homo sapiens
gacccacctgga

SEQ ID NO: 6203413 - DNA, 15 bp, Homo sapiens
gacccacctggagcc

SEQ ID NO: 6203414 - DNA, 21 bp, Homo sapiens
gacccacctgtggggcctggg

SEQ ID NO: 6203415 - DNA, 18 bp, Homo sapiens
gacccacggagccctccc

SEQ ID NO: 6203416 - DNA, 18 bp, Homo sapiens
gacccacgtggctgcgtg

SEQ ID NO: 6203417 - DNA, 13 bp, Homo sapiens
gacccactaaaga

SEQ ID NO: 6203418 - DNA, 14 bp, Homo sapiens
gacccactaccctt

SEQ ID NO: 6203419 - DNA, 23 bp, Homo sapiens
gacccactccgactccccctccc

SEQ ID NO: 6203420 - DNA, 20 bp, Homo sapiens
gacccactggttccttcttc

SEQ ID NO: 6203421 - DNA, 21 bp, Homo sapiens
gacccacttctcatcacacac

SEQ ID NO: 6203422 - DNA, 16 bp, Homo sapiens
gacccagaatggagcc

SEQ ID NO: 6203423 - DNA, 17 bp, Homo sapiens
gacccagacacatcgca

SEQ ID NO: 6203424 - DNA, 22 bp, Homo sapiens
gacccagagaaggacggtgcca

SEQ ID NO: 6203425 - DNA, 21 bp, Homo sapiens
gacccagagccctctgagccg

SEQ ID NO: 6203426 - DNA, 12 bp, Homo sapiens
gacccagagctg

SEQ ID NO: 6203427 - DNA, 14 bp, Homo sapiens
gacccagaggccct

SEQ ID NO: 6203428 - DNA, 18 bp, Homo sapiens
gacccagaggccctgaag

SEQ ID NO: 6203429 - DNA, 13 bp, Homo sapiens
gacccagaggtcc

SEQ ID NO: 6203430 - DNA, 20 bp, Homo sapiens
gacccagatatggaaacaga

SEQ ID NO: 6203431 - DNA, 23 bp, Homo sapiens
gacccagatatggaaacagaaga

SEQ ID NO: 6203432 - DNA, 20 bp, Homo sapiens
gacccagatcctcacaacca

SEQ ID NO: 6203433 - DNA, 16 bp, Homo sapiens
gacccagcaggaagcc

SEQ ID NO: 6203434 - DNA, 22 bp, Homo sapiens
gacccagcaggaagccaggctg

SEQ ID NO: 6203435 - DNA, 19 bp, Homo sapiens
gacccagcatctcccagca

SEQ ID NO: 6203436 - DNA, 11 bp, Homo sapiens
gacccagccag

SEQ ID NO: 6203437 - DNA, 13 bp, Homo sapiens
gacccagccagct

SEQ ID NO: 6203438 - DNA, 23 bp, Homo sapiens
gacccagccagctgcagggcacg

SEQ ID NO: 6203439 - DNA, 15 bp, Homo sapiens
gacccagccaggccc

SEQ ID NO: 6203440 - DNA, 22 bp, Homo sapiens
gacccagccaggcccagccgac

SEQ ID NO: 6203441 - DNA, 17 bp, Homo sapiens
gacccagccccttcccc

SEQ ID NO: 6203442 - DNA, 20 bp, Homo sapiens
gacccagccccttcccctgg

SEQ ID NO: 6203443 - DNA, 22 bp, Homo sapiens
gacccagccccttgagaaacct

SEQ ID NO: 6203444 - DNA, 17 bp, Homo sapiens
gacccagcccgcggcct

SEQ ID NO: 6203445 - DNA, 16 bp, Homo sapiens
gacccagccctcatcc

SEQ ID NO: 6203446 - DNA, 16 bp, Homo sapiens
gacccagcggacacac

SEQ ID NO: 6203447 - DNA, 15 bp, Homo sapiens
gacccagctactctg

SEQ ID NO: 6203448 - DNA, 20 bp, Homo sapiens
gacccagctactgaaccagc

SEQ ID NO: 6203449 - DNA, 23 bp, Homo sapiens
gacccagctactgaaccagccac

SEQ ID NO: 6203450 - DNA, 13 bp, Homo sapiens
gacccagctcctc

SEQ ID NO: 6203451 - DNA, 18 bp, Homo sapiens
gacccagcttagagttct

SEQ ID NO: 6203452 - DNA, 21 bp, Homo sapiens
gacccagcttagagttcttct

SEQ ID NO: 6203453 - DNA, 13 bp, Homo sapiens
gacccaggagccg

SEQ ID NO: 6203454 - DNA, 14 bp, Homo sapiens
gacccaggagtcca

SEQ ID NO: 6203455 - DNA, 17 bp, Homo sapiens
gacccaggagtccagcc

SEQ ID NO: 6203456 - DNA, 11 bp, Homo sapiens
gacccaggcac

SEQ ID NO: 6203457 - DNA, 12 bp, Homo sapiens
gacccaggccct

SEQ ID NO: 6203458 - DNA, 11 bp, Homo sapiens
gacccaggccg

SEQ ID NO: 6203459 - DNA, 15 bp, Homo sapiens
gacccaggcctgtgg

SEQ ID NO: 6203460 - DNA, 12 bp, Homo sapiens
gacccaggctcc

SEQ ID NO: 6203461 - DNA, 13 bp, Homo sapiens
gacccaggctccc

SEQ ID NO: 6203462 - DNA, 14 bp, Homo sapiens
gacccaggctccca

SEQ ID NO: 6203463 - DNA, 15 bp, Homo sapiens
gacccaggctcccag

SEQ ID NO: 6203464 - DNA, 16 bp, Homo sapiens
gacccaggctccgccc

SEQ ID NO: 6203465 - DNA, 18 bp, Homo sapiens
gacccaggctccgccctt

SEQ ID NO: 6203466 - DNA, 18 bp, Homo sapiens
gacccaggctgcctgagc

SEQ ID NO: 6203467 - DNA, 11 bp, Homo sapiens
gacccagggag

SEQ ID NO: 6203468 - DNA, 18 bp, Homo sapiens
gacccagggagaggctgt

SEQ ID NO: 6203469 - DNA, 13 bp, Homo sapiens
gacccagggggag

SEQ ID NO: 6203470 - DNA, 18 bp, Homo sapiens
gacccagggggctgaaac

SEQ ID NO: 6203471 - DNA, 16 bp, Homo sapiens
gacccagggttcccgc

SEQ ID NO: 6203472 - DNA, 13 bp, Homo sapiens
gacccaggtcttc

SEQ ID NO: 6203473 - DNA, 17 bp, Homo sapiens
gacccaggtcttccaga

SEQ ID NO: 6203474 - DNA, 20 bp, Homo sapiens
gacccaggtcttccagacct

SEQ ID NO: 6203475 - DNA, 20 bp, Homo sapiens
gacccaggtggagggcacag

SEQ ID NO: 6203476 - DNA, 13 bp, Homo sapiens
gacccaggtggct

SEQ ID NO: 6203477 - DNA, 15 bp, Homo sapiens
gacccaggtgggact

SEQ ID NO: 6203478 - DNA, 16 bp, Homo sapiens
gacccaggtgggactt

SEQ ID NO: 6203479 - DNA, 18 bp, Homo sapiens
gacccaggtgtgcctgtg

SEQ ID NO: 6203480 - DNA, 14 bp, Homo sapiens
gacccagtcccaca

SEQ ID NO: 6203481 - DNA, 22 bp, Homo sapiens
gacccagtgagattacagagga

SEQ ID NO: 6203482 - DNA, 23 bp, Homo sapiens
gacccagtgagattacagaggaa

SEQ ID NO: 6203483 - DNA, 10 bp, Homo sapiens
gacccagtgc

SEQ ID NO: 6203484 - DNA, 15 bp, Homo sapiens
gacccagtgcactcc

SEQ ID NO: 6203485 - DNA, 13 bp, Homo sapiens
gacccagtgcaga

SEQ ID NO: 6203486 - DNA, 16 bp, Homo sapiens
gacccagtgcccccac

SEQ ID NO: 6203487 - DNA, 17 bp, Homo sapiens
gacccagtgcccccact

SEQ ID NO: 6203488 - DNA, 12 bp, Homo sapiens
gacccagtggca

SEQ ID NO: 6203489 - DNA, 17 bp, Homo sapiens
gacccagtggcagggca

SEQ ID NO: 6203490 - DNA, 18 bp, Homo sapiens
gacccagtggcagggcac

SEQ ID NO: 6203491 - DNA, 19 bp, Homo sapiens
gacccagtggcagggcaca

SEQ ID NO: 6203492 - DNA, 15 bp, Homo sapiens
gacccagtggtcagc

SEQ ID NO: 6203493 - DNA, 20 bp, Homo sapiens
gacccagtgtgtgctcagca

SEQ ID NO: 6203494 - DNA, 17 bp, Homo sapiens
gacccatcacgcctgtg

SEQ ID NO: 6203495 - DNA, 14 bp, Homo sapiens
gacccatctttctc

SEQ ID NO: 6203496 - DNA, 17 bp, Homo sapiens
gacccatgctgccctgt

SEQ ID NO: 6203497 - DNA, 19 bp, Homo sapiens
gacccatgctgccctgtga

SEQ ID NO: 6203498 - DNA, 20 bp, Homo sapiens
gacccatgctgccctgtgag

SEQ ID NO: 6203499 - DNA, 15 bp, Homo sapiens
gacccatgctggtca

SEQ ID NO: 6203500 - DNA, 15 bp, Homo sapiens
gacccatgggcagga

SEQ ID NO: 6203501 - DNA, 13 bp, Homo sapiens
gacccatggtcat

SEQ ID NO: 6203502 - DNA, 22 bp, Homo sapiens
gacccatgtaaataccagactg

SEQ ID NO: 6203503 - DNA, 23 bp, Homo sapiens
gacccattcatactaaataaaac

SEQ ID NO: 6203504 - DNA, 16 bp, Homo sapiens
gacccattccttccca

SEQ ID NO: 6203505 - DNA, 14 bp, Homo sapiens
cttggctctgccag

SEQ ID NO: 6203506 - DNA, 18 bp, Homo sapiens
cttggctctgttgctgtc

SEQ ID NO: 6203507 - DNA, 19 bp, Homo sapiens
cttggctcttggcttccag

SEQ ID NO: 6203508 - DNA, 12 bp, Homo sapiens
cttggctgaccc

SEQ ID NO: 6203509 - DNA, 19 bp, Homo sapiens
cttggctgacccctctggt

SEQ ID NO: 6203510 - DNA, 14 bp, Homo sapiens
cttggctgactggg

SEQ ID NO: 6203511 - DNA, 16 bp, Homo sapiens
cttggctgactggggc

SEQ ID NO: 6203512 - DNA, 23 bp, Homo sapiens
cttggctgagatagcagaggggc

SEQ ID NO: 6203513 - DNA, 22 bp, Homo sapiens
cttggctgagccccctctcctg

SEQ ID NO: 6203514 - DNA, 20 bp, Homo sapiens
cttggctgcaaataaggaca

SEQ ID NO: 6203515 - DNA, 22 bp, Homo sapiens
cttggctgcaaataaggacagc

SEQ ID NO: 6203516 - DNA, 13 bp, Homo sapiens
cttggctgcagcc

SEQ ID NO: 6203517 - DNA, 21 bp, Homo sapiens
cttggctgcagccatcccgct

SEQ ID NO: 6203518 - DNA, 15 bp, Homo sapiens
cttggctgcaggcaa

SEQ ID NO: 6203519 - DNA, 13 bp, Homo sapiens
cttggctgcaggg

SEQ ID NO: 6203520 - DNA, 20 bp, Homo sapiens
cttggctgccccattccagc

SEQ ID NO: 6203521 - DNA, 21 bp, Homo sapiens
cttggctgccccattccagct

SEQ ID NO: 6203522 - DNA, 21 bp, Homo sapiens
cttggctgccctgtctggaac

SEQ ID NO: 6203523 - DNA, 15 bp, Homo sapiens
cttggctgctcagtt

SEQ ID NO: 6203524 - DNA, 15 bp, Homo sapiens
cttggctgctcttcc

SEQ ID NO: 6203525 - DNA, 16 bp, Homo sapiens
cttggctgcttcctgt

SEQ ID NO: 6203526 - DNA, 17 bp, Homo sapiens
cttggctggacccagcc

SEQ ID NO: 6203527 - DNA, 18 bp, Homo sapiens
cttggctggacccagcca

SEQ ID NO: 6203528 - DNA, 20 bp, Homo sapiens
cttggctggacccagccagg

SEQ ID NO: 6203529 - DNA, 13 bp, Homo sapiens
cttggctgggcct

SEQ ID NO: 6203530 - DNA, 11 bp, Homo sapiens
cttggctggtg

SEQ ID NO: 6203531 - DNA, 16 bp, Homo sapiens
cttggctggtgcacct

SEQ ID NO: 6203532 - DNA, 12 bp, Homo sapiens
cttggctggtgt

SEQ ID NO: 6203533 - DNA, 13 bp, Homo sapiens
cttggctggtgtg

SEQ ID NO: 6203534 - DNA, 19 bp, Homo sapiens
cttggctgtatgtcaaatt

SEQ ID NO: 6203535 - DNA, 14 bp, Homo sapiens
cttggctgtccttc

SEQ ID NO: 6203536 - DNA, 17 bp, Homo sapiens
cttggctgtggggctag

SEQ ID NO: 6203537 - DNA, 15 bp, Homo sapiens
cttggcttacctgac

SEQ ID NO: 6203538 - DNA, 17 bp, Homo sapiens
cttggcttcccctccac

SEQ ID NO: 6203539 - DNA, 20 bp, Homo sapiens
cttggcttcccctccaccct

SEQ ID NO: 6203540 - DNA, 17 bp, Homo sapiens
cttggcttcctggcgcc

SEQ ID NO: 6203541 - DNA, 16 bp, Homo sapiens
cttggcttcctttctt

SEQ ID NO: 6203542 - DNA, 14 bp, Homo sapiens
cttggcttctcagc

SEQ ID NO: 6203543 - DNA, 19 bp, Homo sapiens
cttggcttctcagcccctt

SEQ ID NO: 6203544 - DNA, 18 bp, Homo sapiens
cttggcttctgggacctg

SEQ ID NO: 6203545 - DNA, 13 bp, Homo sapiens
cttggcttctgtg

SEQ ID NO: 6203546 - DNA, 18 bp, Homo sapiens
cttggcttcttaaaaact

SEQ ID NO: 6203547 - DNA, 20 bp, Homo sapiens
cttggcttcttaaaaactgt

SEQ ID NO: 6203548 - DNA, 24 bp, Homo sapiens
cttggcttgatggaagtgggccag

SEQ ID NO: 6203549 - DNA, 17 bp, Homo sapiens
cttggcttgcctggtgg

SEQ ID NO: 6203550 - DNA, 18 bp, Homo sapiens
cttggcttggccctggca

SEQ ID NO: 6203551 - DNA, 16 bp, Homo sapiens
cttggcttgtgttatc

SEQ ID NO: 6203552 - DNA, 18 bp, Homo sapiens
cttggctttatgcaaata

SEQ ID NO: 6203553 - DNA, 21 bp, Homo sapiens
cttggctttatgcaaatacaa

SEQ ID NO: 6203554 - DNA, 18 bp, Homo sapiens
cttggctttcagagccag

SEQ ID NO: 6203555 - DNA, 20 bp, Homo sapiens
cttggctttcagagccagcc

SEQ ID NO: 6203556 - DNA, 14 bp, Homo sapiens
cttggctttcatgt

SEQ ID NO: 6203557 - DNA, 17 bp, Homo sapiens
cttggctttcctgtttc

SEQ ID NO: 6203558 - DNA, 18 bp, Homo sapiens
cttggctttcctgtttct

SEQ ID NO: 6203559 - DNA, 16 bp, Homo sapiens
cttggctttctccctc

SEQ ID NO: 6203560 - DNA, 20 bp, Homo sapiens
cttggctttgaggccgaagc

SEQ ID NO: 6203561 - DNA, 18 bp, Homo sapiens
cttgggaaaatatcactt

SEQ ID NO: 6203562 - DNA, 22 bp, Homo sapiens
cttgggaaaatatcactttgta

SEQ ID NO: 6203563 - DNA, 22 bp, Homo sapiens
cttgggaaacagagaaccctgt

SEQ ID NO: 6203564 - DNA, 23 bp, Homo sapiens
cttgggaaacagagaaccctgtg

SEQ ID NO: 6203565 - DNA, 16 bp, Homo sapiens
cttgggaactccactc

SEQ ID NO: 6203566 - DNA, 17 bp, Homo sapiens
cttgggaagaggacttc

SEQ ID NO: 6203567 - DNA, 14 bp, Homo sapiens
cttgggaagcagtt

SEQ ID NO: 6203568 - DNA, 16 bp, Homo sapiens
cttgggaagcagtttc

SEQ ID NO: 6203569 - DNA, 15 bp, Homo sapiens
cttgggaaggacaca

SEQ ID NO: 6203570 - DNA, 19 bp, Homo sapiens
cttgggacaacgtgctgct

SEQ ID NO: 6203571 - DNA, 19 bp, Homo sapiens
cttgggacagccagagctg

SEQ ID NO: 6203572 - DNA, 18 bp, Homo sapiens
cttgggaccagaagtgtt

SEQ ID NO: 6203573 - DNA, 16 bp, Homo sapiens
cttgggaccccagaga

SEQ ID NO: 6203574 - DNA, 20 bp, Homo sapiens
cttgggacccccactaagac

SEQ ID NO: 6203575 - DNA, 20 bp, Homo sapiens
cttgggacctttaaagagcc

SEQ ID NO: 6203576 - DNA, 17 bp, Homo sapiens
cttgggacggaagtggc

SEQ ID NO: 6203577 - DNA, 16 bp, Homo sapiens
cttgggacgtgtacag

SEQ ID NO: 6203578 - DNA, 23 bp, Homo sapiens
cttgggacgtgtacagcacagaa

SEQ ID NO: 6203579 - DNA, 20 bp, Homo sapiens
cttgggactaaatgccctgc

SEQ ID NO: 6203580 - DNA, 10 bp, Homo sapiens
cttgggactc

SEQ ID NO: 6203581 - DNA, 14 bp, Homo sapiens
cttgggactcaggt

SEQ ID NO: 6203582 - DNA, 19 bp, Homo sapiens
cttgggactcaggtctgta

SEQ ID NO: 6203583 - DNA, 23 bp, Homo sapiens
cttgggactcaggtctgtaactg

SEQ ID NO: 6203584 - DNA, 18 bp, Homo sapiens
cttgggagagcccctggg

SEQ ID NO: 6203585 - DNA, 18 bp, Homo sapiens
cttgggagagtcaggcag

SEQ ID NO: 6203586 - DNA, 14 bp, Homo sapiens
cttgggagcctgag

SEQ ID NO: 6203587 - DNA, 18 bp, Homo sapiens
cttgggagcctgaggcag

SEQ ID NO: 6203588 - DNA, 19 bp, Homo sapiens
cttgggagcctgaggcagg

SEQ ID NO: 6203589 - DNA, 20 bp, Homo sapiens
cttgggagcctgaggcagga

SEQ ID NO: 6203590 - DNA, 14 bp, Homo sapiens
cttgggagctgctg

SEQ ID NO: 6203591 - DNA, 15 bp, Homo sapiens
cttgggagctgctgg

SEQ ID NO: 6203592 - DNA, 22 bp, Homo sapiens
cttgggagctttaaagagcagg

SEQ ID NO: 6203593 - DNA, 14 bp, Homo sapiens
cttgggaggaagca

SEQ ID NO: 6203594 - DNA, 15 bp, Homo sapiens
cttgggaggaagcag

SEQ ID NO: 6203595 - DNA, 16 bp, Homo sapiens
cttgggaggaagcaga

SEQ ID NO: 6203596 - DNA, 23 bp, Homo sapiens
cttgggaggaagcagaataaagc

SEQ ID NO: 6203597 - DNA, 20 bp, Homo sapiens
cttgggaggacaggtcctga

SEQ ID NO: 6203598 - DNA, 23 bp, Homo sapiens
cttgggaggacatgcgtgtgtca

SEQ ID NO: 6203599 - DNA, 14 bp, Homo sapiens
cttgggaggcccca

SEQ ID NO: 6203600 - DNA, 15 bp, Homo sapiens
cttgggaggccccac

SEQ ID NO: 6203601 - DNA, 22 bp, Homo sapiens
cttgggaggccccactggggaa

SEQ ID NO: 6203602 - DNA, 16 bp, Homo sapiens
cttgggaggcttcccc

SEQ ID NO: 6203603 - DNA, 19 bp, Homo sapiens
cttgggaggttgaagcaga

SEQ ID NO: 6203604 - DNA, 22 bp, Homo sapiens
cttgggaggttttattctgact

SEQ ID NO: 6203605 - DNA, 16 bp, Homo sapiens
cttgggagtatgttgt

SEQ ID NO: 6203606 - DNA, 20 bp, Homo sapiens
cttgggagtatgttgtcata

SEQ ID NO: 6203607 - DNA, 23 bp, Homo sapiens
cttgggagtatgttgtcataaca

SEQ ID NO: 6203608 - DNA, 19 bp, Homo sapiens
cttgggataattccttggt

SEQ ID NO: 6203609 - DNA, 16 bp, Homo sapiens
cttgggataggactga

SEQ ID NO: 6203610 - DNA, 22 bp, Homo sapiens
cttgggatagtgttctgctcct

SEQ ID NO: 6203611 - DNA, 20 bp, Homo sapiens
cttgggatgatgcctcatga

SEQ ID NO: 6203612 - DNA, 17 bp, Homo sapiens
cttgggatgggcacagg

SEQ ID NO: 6203613 - DNA, 16 bp, Homo sapiens
cttgggattcctcccc

SEQ ID NO: 6203614 - DNA, 19 bp, Homo sapiens
cttgggcaatattctctgt

SEQ ID NO: 6203615 - DNA, 14 bp, Homo sapiens
cttgggcaccagct

SEQ ID NO: 6203616 - DNA, 15 bp, Homo sapiens
cttgggcaccagctt

SEQ ID NO: 6203617 - DNA, 20 bp, Homo sapiens
cttgggcaccagcttctttc

SEQ ID NO: 6203618 - DNA, 22 bp, Homo sapiens
cttgggcaccagcttctttctc

SEQ ID NO: 6203619 - DNA, 20 bp, Homo sapiens
cttgggcacccccagcctgg

SEQ ID NO: 6203620 - DNA, 19 bp, Homo sapiens
cttgggcacgggagagcgc

SEQ ID NO: 6203621 - DNA, 22 bp, Homo sapiens
cttgggcacgggagagcgccac

SEQ ID NO: 6203622 - DNA, 19 bp, Homo sapiens
cttgggcagagctggctct

SEQ ID NO: 6203623 - DNA, 20 bp, Homo sapiens
cttgggcagagctggctctg

SEQ ID NO: 6203624 - DNA, 14 bp, Homo sapiens
cttgggcagagtcc

SEQ ID NO: 6203625 - DNA, 14 bp, Homo sapiens
cttgggcagatctc

SEQ ID NO: 6203626 - DNA, 23 bp, Homo sapiens
cttgggcagatctcccacatgcc

SEQ ID NO: 6203627 - DNA, 14 bp, Homo sapiens
cttgggcagcatcc

SEQ ID NO: 6203628 - DNA, 23 bp, Homo sapiens
cttgggcagggtctctgctccag

SEQ ID NO: 6203629 - DNA, 18 bp, Homo sapiens
cttgggcagtctttcttg

SEQ ID NO: 6203630 - DNA, 17 bp, Homo sapiens
cttgggcagtgccccag

SEQ ID NO: 6203631 - DNA, 21 bp, Homo sapiens
cttgggcagtgccccagggag

SEQ ID NO: 6203632 - DNA, 17 bp, Homo sapiens
cttgggcatccacccag

SEQ ID NO: 6203633 - DNA, 19 bp, Homo sapiens
cttgggccaaatccgctct

SEQ ID NO: 6203634 - DNA, 20 bp, Homo sapiens
cttgggccaaatccgctctc

SEQ ID NO: 6203635 - DNA, 18 bp, Homo sapiens
cttgggccaagccagctg

SEQ ID NO: 6203636 - DNA, 21 bp, Homo sapiens
cttgggccaagccagctgcct

SEQ ID NO: 6203637 - DNA, 17 bp, Homo sapiens
cttgggccacccctcct

SEQ ID NO: 6203638 - DNA, 23 bp, Homo sapiens
cttgggccactgccctctccaca

SEQ ID NO: 6203639 - DNA, 14 bp, Homo sapiens
cttgggcccaggag

SEQ ID NO: 6203640 - DNA, 16 bp, Homo sapiens
cttgggcccaggaggt

SEQ ID NO: 6203641 - DNA, 13 bp, Homo sapiens
cttgggcccagta

SEQ ID NO: 6203642 - DNA, 19 bp, Homo sapiens
cttgggcccggtccacagg

SEQ ID NO: 6203643 - DNA, 14 bp, Homo sapiens
cttgggccctcctg

SEQ ID NO: 6203644 - DNA, 15 bp, Homo sapiens
cttgggccctctggt

SEQ ID NO: 6203645 - DNA, 13 bp, Homo sapiens
cttgggccctgca

SEQ ID NO: 6203646 - DNA, 18 bp, Homo sapiens
cttgggccctgcattggc

SEQ ID NO: 6203647 - DNA, 22 bp, Homo sapiens
cttgggccctgcattggcctgg

SEQ ID NO: 6203648 - DNA, 15 bp, Homo sapiens
cttgggcccttccct

SEQ ID NO: 6203649 - DNA, 17 bp, Homo sapiens
cttgggccctttgagtg

SEQ ID NO: 6203650 - DNA, 16 bp, Homo sapiens
cttgggccctttttcc

SEQ ID NO: 6203651 - DNA, 17 bp, Homo sapiens
cttgggcctaggctgca

SEQ ID NO: 6203652 - DNA, 17 bp, Homo sapiens
cttgggcctcatctgct

SEQ ID NO: 6203653 - DNA, 22 bp, Homo sapiens
cttgggcctccccccagcccct

SEQ ID NO: 6203654 - DNA, 22 bp, Homo sapiens
cttgggcctgacctccagtcct

SEQ ID NO: 6203655 - DNA, 12 bp, Homo sapiens
cttgggcctgca

SEQ ID NO: 6203656 - DNA, 16 bp, Homo sapiens
cttgggcctgcaccct

SEQ ID NO: 6203657 - DNA, 18 bp, Homo sapiens
cttgggcctgcacccttc

SEQ ID NO: 6203658 - DNA, 14 bp, Homo sapiens
cttgggcctggccc

SEQ ID NO: 6203659 - DNA, 15 bp, Homo sapiens
cttgggcctggcccg

SEQ ID NO: 6203660 - DNA, 19 bp, Homo sapiens
cttgggccttgctgctgct

SEQ ID NO: 6203661 - DNA, 22 bp, Homo sapiens
cttgggcgccgtgctgggcagc

SEQ ID NO: 6203662 - DNA, 23 bp, Homo sapiens
cttgggcgggccatttcacattc

SEQ ID NO: 6203663 - DNA, 13 bp, Homo sapiens
cttgggctactgg

SEQ ID NO: 6203664 - DNA, 18 bp, Homo sapiens
cttgggctactggcagct

SEQ ID NO: 6203665 - DNA, 13 bp, Homo sapiens
cttgggctccctg

SEQ ID NO: 6203666 - DNA, 21 bp, Homo sapiens
cttgggctccctgtaacctct

SEQ ID NO: 6203667 - DNA, 14 bp, Homo sapiens
cttgggctcctggc

SEQ ID NO: 6203668 - DNA, 18 bp, Homo sapiens
cttgggctctgatgaaaa

SEQ ID NO: 6203669 - DNA, 13 bp, Homo sapiens
cttgggctctgct

SEQ ID NO: 6203670 - DNA, 22 bp, Homo sapiens
cttgggctgacccagcatctcc

SEQ ID NO: 6203671 - DNA, 19 bp, Homo sapiens
cttgggctgagtgcagcca

SEQ ID NO: 6203672 - DNA, 19 bp, Homo sapiens
cttgggctggcacccactg

SEQ ID NO: 6203673 - DNA, 12 bp, Homo sapiens
cttgggctgggg

SEQ ID NO: 6203674 - DNA, 13 bp, Homo sapiens
cttgggctggggg

SEQ ID NO: 6203675 - DNA, 16 bp, Homo sapiens
cttgggctggtcagag

SEQ ID NO: 6203676 - DNA, 22 bp, Homo sapiens
cttgggctggtcagagtggcgt

SEQ ID NO: 6203677 - DNA, 21 bp, Homo sapiens
cttgggcttcaacagccaagc

SEQ ID NO: 6203678 - DNA, 20 bp, Homo sapiens
cttggggaaaatggccatgc

SEQ ID NO: 6203679 - DNA, 23 bp, Homo sapiens
cttggggaaaatggccatgcagg

SEQ ID NO: 6203680 - DNA, 11 bp, Homo sapiens
cttggggaaac

SEQ ID NO: 6203681 - DNA, 14 bp, Homo sapiens
cttggggaaatgtg

SEQ ID NO: 6203682 - DNA, 18 bp, Homo sapiens
cttggggaacaagggtgg

SEQ ID NO: 6203683 - DNA, 22 bp, Homo sapiens
gacccattgcgatggccgctcc

SEQ ID NO: 6203684 - DNA, 13 bp, Homo sapiens
gacccattgctgt

SEQ ID NO: 6203685 - DNA, 14 bp, Homo sapiens
gacccattgctgtt

SEQ ID NO: 6203686 - DNA, 22 bp, Homo sapiens
gacccatttccttgtgctcctg

SEQ ID NO: 6203687 - DNA, 22 bp, Homo sapiens
gacccatttgatattttttaaa

SEQ ID NO: 6203688 - DNA, 21 bp, Homo sapiens
gaccccaaagagcctggagaa

SEQ ID NO: 6203689 - DNA, 21 bp, Homo sapiens
gaccccaaaggaacactgaca

SEQ ID NO: 6203690 - DNA, 14 bp, Homo sapiens
gaccccaacctcag

SEQ ID NO: 6203691 - DNA, 22 bp, Homo sapiens
gaccccaagggggctgctgctc

SEQ ID NO: 6203692 - DNA, 20 bp, Homo sapiens
gaccccaatatatgtatttt

SEQ ID NO: 6203693 - DNA, 19 bp, Homo sapiens
gaccccacacgccggggct

SEQ ID NO: 6203694 - DNA, 20 bp, Homo sapiens
gaccccacacgccggggctg

SEQ ID NO: 6203695 - DNA, 15 bp, Homo sapiens
gaccccacatccttc

SEQ ID NO: 6203696 - DNA, 12 bp, Homo sapiens
gaccccacccaa

SEQ ID NO: 6203697 - DNA, 14 bp, Homo sapiens
gaccccacccaagc

SEQ ID NO: 6203698 - DNA, 22 bp, Homo sapiens
gaccccacccaagcttggcagc

SEQ ID NO: 6203699 - DNA, 20 bp, Homo sapiens
gaccccaccctgtctgcagg

SEQ ID NO: 6203700 - DNA, 22 bp, Homo sapiens
gaccccacctgaggcaggaggg

SEQ ID NO: 6203701 - DNA, 15 bp, Homo sapiens
gaccccactccggcc

SEQ ID NO: 6203702 - DNA, 17 bp, Homo sapiens
gaccccactccggccct

SEQ ID NO: 6203703 - DNA, 13 bp, Homo sapiens
gaccccactgcca

SEQ ID NO: 6203704 - DNA, 20 bp, Homo sapiens
gaccccactgccaagtgggg

SEQ ID NO: 6203705 - DNA, 19 bp, Homo sapiens
gaccccacttatgctgctg

SEQ ID NO: 6203706 - DNA, 20 bp, Homo sapiens
gaccccacttatgctgctgt

SEQ ID NO: 6203707 - DNA, 12 bp, Homo sapiens
gaccccagagaa

SEQ ID NO: 6203708 - DNA, 16 bp, Homo sapiens
gaccccagagaaaacc

SEQ ID NO: 6203709 - DNA, 15 bp, Homo sapiens
gaccccagagtgact

SEQ ID NO: 6203710 - DNA, 22 bp, Homo sapiens
gaccccagatacctgtgaggac

SEQ ID NO: 6203711 - DNA, 19 bp, Homo sapiens
gaccccagcaagtggtcct

SEQ ID NO: 6203712 - DNA, 15 bp, Homo sapiens
gaccccagcccagac

SEQ ID NO: 6203713 - DNA, 18 bp, Homo sapiens
gaccccagcccagacagc

SEQ ID NO: 6203714 - DNA, 12 bp, Homo sapiens
gaccccagcctt

SEQ ID NO: 6203715 - DNA, 17 bp, Homo sapiens
gaccccagctccaggca

SEQ ID NO: 6203716 - DNA, 18 bp, Homo sapiens
gaccccagctccaggcag

SEQ ID NO: 6203717 - DNA, 14 bp, Homo sapiens
gaccccagctgctc

SEQ ID NO: 6203718 - DNA, 13 bp, Homo sapiens
gaccccagctggg

SEQ ID NO: 6203719 - DNA, 14 bp, Homo sapiens
gaccccagctggga

SEQ ID NO: 6203720 - DNA, 16 bp, Homo sapiens
gaccccagctgggagg

SEQ ID NO: 6203721 - DNA, 21 bp, Homo sapiens
gaccccagctgggaggcaaga

SEQ ID NO: 6203722 - DNA, 15 bp, Homo sapiens
gaccccagcttttct

SEQ ID NO: 6203723 - DNA, 19 bp, Homo sapiens
gaccccaggcccactcagg

SEQ ID NO: 6203724 - DNA, 17 bp, Homo sapiens
gaccccaggctggacat

SEQ ID NO: 6203725 - DNA, 13 bp, Homo sapiens
gaccccagggcac

SEQ ID NO: 6203726 - DNA, 17 bp, Homo sapiens
gaccccagggcacagga

SEQ ID NO: 6203727 - DNA, 22 bp, Homo sapiens
gaccccaggtcagccctgtgtc

SEQ ID NO: 6203728 - DNA, 22 bp, Homo sapiens
gaccccaggtcaggggctccct

SEQ ID NO: 6203729 - DNA, 20 bp, Homo sapiens
gaccccagtcgtgatgtgga

SEQ ID NO: 6203730 - DNA, 23 bp, Homo sapiens
gaccccagtcgtgatgtggagga

SEQ ID NO: 6203731 - DNA, 19 bp, Homo sapiens
gaccccatcacctactcac

SEQ ID NO: 6203732 - DNA, 17 bp, Homo sapiens
gaccccatcactcgcag

SEQ ID NO: 6203733 - DNA, 14 bp, Homo sapiens
gaccccatccacct

SEQ ID NO: 6203734 - DNA, 18 bp, Homo sapiens
gaccccatccagccaggg

SEQ ID NO: 6203735 - DNA, 20 bp, Homo sapiens
gaccccatccagccaggggt

SEQ ID NO: 6203736 - DNA, 12 bp, Homo sapiens
gaccccatctct

SEQ ID NO: 6203737 - DNA, 18 bp, Homo sapiens
gaccccatctctgctgct

SEQ ID NO: 6203738 - DNA, 14 bp, Homo sapiens
gaccccatctgctg

SEQ ID NO: 6203739 - DNA, 17 bp, Homo sapiens
gaccccatctgctgagc

SEQ ID NO: 6203740 - DNA, 19 bp, Homo sapiens
gaccccatctgctgagctc

SEQ ID NO: 6203741 - DNA, 19 bp, Homo sapiens
gaccccattctgggactgc

SEQ ID NO: 6203742 - DNA, 12 bp, Homo sapiens
gacccccaacca

SEQ ID NO: 6203743 - DNA, 15 bp, Homo sapiens
gacccccacacctca

SEQ ID NO: 6203744 - DNA, 13 bp, Homo sapiens
gacccccacccct

SEQ ID NO: 6203745 - DNA, 14 bp, Homo sapiens
gacccccacccctt

SEQ ID NO: 6203746 - DNA, 18 bp, Homo sapiens
gacccccaccccttcccc

SEQ ID NO: 6203747 - DNA, 22 bp, Homo sapiens
gacccccaggaaggaaacagat

SEQ ID NO: 6203748 - DNA, 13 bp, Homo sapiens
gacccccaggaca

SEQ ID NO: 6203749 - DNA, 22 bp, Homo sapiens
gacccccaggcctgtccaccct

SEQ ID NO: 6203750 - DNA, 21 bp, Homo sapiens
gacccccagtgctcacacaat

SEQ ID NO: 6203751 - DNA, 13 bp, Homo sapiens
gacccccatcact

SEQ ID NO: 6203752 - DNA, 21 bp, Homo sapiens
gacccccatggtaatgtaact

SEQ ID NO: 6203753 - DNA, 13 bp, Homo sapiens
gacccccatgtaa

SEQ ID NO: 6203754 - DNA, 18 bp, Homo sapiens
gacccccatttgtcccag

SEQ ID NO: 6203755 - DNA, 16 bp, Homo sapiens
gaccccccagcccctc

SEQ ID NO: 6203756 - DNA, 21 bp, Homo sapiens
gacccccccccaatcggactg

SEQ ID NO: 6203757 - DNA, 19 bp, Homo sapiens
gaccccccccccccccgcc

SEQ ID NO: 6203758 - DNA, 20 bp, Homo sapiens
gacccccctaccccatgctg

SEQ ID NO: 6203759 - DNA, 15 bp, Homo sapiens
gacccccctttcaca

SEQ ID NO: 6203760 - DNA, 19 bp, Homo sapiens
gacccccctttcacaggca

SEQ ID NO: 6203761 - DNA, 21 bp, Homo sapiens
gacccccgaggggagggcagg

SEQ ID NO: 6203762 - DNA, 22 bp, Homo sapiens
gacccccggcctccaggctggg

SEQ ID NO: 6203763 - DNA, 13 bp, Homo sapiens
gacccccgtcagc

SEQ ID NO: 6203764 - DNA, 15 bp, Homo sapiens
gacccccgtggggca

SEQ ID NO: 6203765 - DNA, 14 bp, Homo sapiens
gaccccctcaccat

SEQ ID NO: 6203766 - DNA, 13 bp, Homo sapiens
gaccccctcagcc

SEQ ID NO: 6203767 - DNA, 11 bp, Homo sapiens
gaccccctccc

SEQ ID NO: 6203768 - DNA, 16 bp, Homo sapiens
gaccccctcccccacc

SEQ ID NO: 6203769 - DNA, 16 bp, Homo sapiens
gacccccttcctgtcc

SEQ ID NO: 6203770 - DNA, 21 bp, Homo sapiens
gacccccttgcccaggcctcc

SEQ ID NO: 6203771 - DNA, 20 bp, Homo sapiens
gaccccgagaaccctgagca

SEQ ID NO: 6203772 - DNA, 22 bp, Homo sapiens
gaccccgagggctgaggagcag

SEQ ID NO: 6203773 - DNA, 16 bp, Homo sapiens
gaccccgcactgcaga

SEQ ID NO: 6203774 - DNA, 17 bp, Homo sapiens
gaccccgcactgcagac

SEQ ID NO: 6203775 - DNA, 17 bp, Homo sapiens
gaccccgcaggatccct

SEQ ID NO: 6203776 - DNA, 22 bp, Homo sapiens
gaccccgcaggatccctcctga

SEQ ID NO: 6203777 - DNA, 23 bp, Homo sapiens
gaccccgcctcccagccccaggg

SEQ ID NO: 6203778 - DNA, 14 bp, Homo sapiens
gaccccgggccgga

SEQ ID NO: 6203779 - DNA, 20 bp, Homo sapiens
gaccccgggccggacctgag

SEQ ID NO: 6203780 - DNA, 16 bp, Homo sapiens
gacccctaccccctca

SEQ ID NO: 6203781 - DNA, 12 bp, Homo sapiens
gacccctaccct

SEQ ID NO: 6203782 - DNA, 16 bp, Homo sapiens
gacccctaccctttcc

SEQ ID NO: 6203783 - DNA, 18 bp, Homo sapiens
gacccctagttccctctg

SEQ ID NO: 6203784 - DNA, 15 bp, Homo sapiens
gacccctcaccaccc

SEQ ID NO: 6203785 - DNA, 20 bp, Homo sapiens
gacccctcaccacccccact

SEQ ID NO: 6203786 - DNA, 22 bp, Homo sapiens
gacccctcagccccagcccaga

SEQ ID NO: 6203787 - DNA, 15 bp, Homo sapiens
gacccctcagctccc

SEQ ID NO: 6203788 - DNA, 16 bp, Homo sapiens
gacccctcagctcccc

SEQ ID NO: 6203789 - DNA, 22 bp, Homo sapiens
gacccctcatagccctcaccct

SEQ ID NO: 6203790 - DNA, 13 bp, Homo sapiens
gacccctcatctg

SEQ ID NO: 6203791 - DNA, 14 bp, Homo sapiens
gacccctccatgtg

SEQ ID NO: 6203792 - DNA, 17 bp, Homo sapiens
gacccctcccctcgtgt

SEQ ID NO: 6203793 - DNA, 15 bp, Homo sapiens
gacccctcctcactg

SEQ ID NO: 6203794 - DNA, 13 bp, Homo sapiens
gacccctcctccc

SEQ ID NO: 6203795 - DNA, 14 bp, Homo sapiens
gacccctcctccct

SEQ ID NO: 6203796 - DNA, 20 bp, Homo sapiens
gacccctcctggggccaggc

SEQ ID NO: 6203797 - DNA, 22 bp, Homo sapiens
gacccctcctggggccaggccg

SEQ ID NO: 6203798 - DNA, 23 bp, Homo sapiens
gacccctcctggggccaggccgg

SEQ ID NO: 6203799 - DNA, 20 bp, Homo sapiens
gacccctccttgtaatgtag

SEQ ID NO: 6203800 - DNA, 19 bp, Homo sapiens
gacccctcgcaaccctgcc

SEQ ID NO: 6203801 - DNA, 14 bp, Homo sapiens
gacccctcgcccca

SEQ ID NO: 6203802 - DNA, 16 bp, Homo sapiens
gacccctcgccccagc

SEQ ID NO: 6203803 - DNA, 19 bp, Homo sapiens
gacccctcgccccagcctc

SEQ ID NO: 6203804 - DNA, 22 bp, Homo sapiens
gacccctcgtccaccccccaca

SEQ ID NO: 6203805 - DNA, 15 bp, Homo sapiens
gacccctctggccag

SEQ ID NO: 6203806 - DNA, 21 bp, Homo sapiens
gacccctgccagttctctgtg

SEQ ID NO: 6203807 - DNA, 12 bp, Homo sapiens
gacccctgccct

SEQ ID NO: 6203808 - DNA, 13 bp, Homo sapiens
gacccctgccctc

SEQ ID NO: 6203809 - DNA, 14 bp, Homo sapiens
gacccctgccctcg

SEQ ID NO: 6203810 - DNA, 11 bp, Homo sapiens
gacccctgcct

SEQ ID NO: 6203811 - DNA, 23 bp, Homo sapiens
gacccctgcctcgagggccgcct

SEQ ID NO: 6203812 - DNA, 20 bp, Homo sapiens
gacccctgctcccagcctgc

SEQ ID NO: 6203813 - DNA, 19 bp, Homo sapiens
gacccctgctttgccccac

SEQ ID NO: 6203814 - DNA, 21 bp, Homo sapiens
gacccctgctttgccccactg

SEQ ID NO: 6203815 - DNA, 22 bp, Homo sapiens
gacccctgctttgccccactgg

SEQ ID NO: 6203816 - DNA, 13 bp, Homo sapiens
gacccctggctct

SEQ ID NO: 6203817 - DNA, 16 bp, Homo sapiens
gacccctggctctggg

SEQ ID NO: 6203818 - DNA, 22 bp, Homo sapiens
gacccctggcttttcactgctg

SEQ ID NO: 6203819 - DNA, 12 bp, Homo sapiens
gacccctgggag

SEQ ID NO: 6203820 - DNA, 13 bp, Homo sapiens
gacccctggggga

SEQ ID NO: 6203821 - DNA, 18 bp, Homo sapiens
gacccctgggggaggctt

SEQ ID NO: 6203822 - DNA, 20 bp, Homo sapiens
gacccctggggtggccaggg

SEQ ID NO: 6203823 - DNA, 23 bp, Homo sapiens
gacccctggggtggccagggctt

SEQ ID NO: 6203824 - DNA, 21 bp, Homo sapiens
gacccctgtaaggggccagag

SEQ ID NO: 6203825 - DNA, 13 bp, Homo sapiens
gacccctgtccag

SEQ ID NO: 6203826 - DNA, 11 bp, Homo sapiens
gacccctgtgg

SEQ ID NO: 6203827 - DNA, 17 bp, Homo sapiens
gaccccttcctgtctgg

SEQ ID NO: 6203828 - DNA, 15 bp, Homo sapiens
gaccccttctctctc

SEQ ID NO: 6203829 - DNA, 23 bp, Homo sapiens
gaccccttggcttttgcttggca

SEQ ID NO: 6203830 - DNA, 17 bp, Homo sapiens
gaccccttgttgcactg

SEQ ID NO: 6203831 - DNA, 18 bp, Homo sapiens
gaccccttgttgcactgc

SEQ ID NO: 6203832 - DNA, 20 bp, Homo sapiens
gaccccttgttgcactgccc

SEQ ID NO: 6203833 - DNA, 16 bp, Homo sapiens
gacccctttaaactgt

SEQ ID NO: 6203834 - DNA, 12 bp, Homo sapiens
gacccctttgag

SEQ ID NO: 6203835 - DNA, 20 bp, Homo sapiens
gacccctttgagagacgcca

SEQ ID NO: 6203836 - DNA, 21 bp, Homo sapiens
gacccctttgagagacgccac

SEQ ID NO: 6203837 - DNA, 16 bp, Homo sapiens
gacccctttgccttcc

SEQ ID NO: 6203838 - DNA, 18 bp, Homo sapiens
gaccccttttcagcttct

SEQ ID NO: 6203839 - DNA, 21 bp, Homo sapiens
gacccgacactctcacccccc

SEQ ID NO: 6203840 - DNA, 15 bp, Homo sapiens
gacccgaggcccaga

SEQ ID NO: 6203841 - DNA, 14 bp, Homo sapiens
gacccgccagcccc

SEQ ID NO: 6203842 - DNA, 23 bp, Homo sapiens
gacccgccagccccgctcccacc

SEQ ID NO: 6203843 - DNA, 17 bp, Homo sapiens
gacccgcccgcggccct

SEQ ID NO: 6203844 - DNA, 13 bp, Homo sapiens
gacccgctctgga

SEQ ID NO: 6203845 - DNA, 13 bp, Homo sapiens
gacccgctggggg

SEQ ID NO: 6203846 - DNA, 21 bp, Homo sapiens
gacccggagctaacactggcc

SEQ ID NO: 6203847 - DNA, 13 bp, Homo sapiens
gacccggaggcca

SEQ ID NO: 6203848 - DNA, 17 bp, Homo sapiens
gacccggaggccacatg

SEQ ID NO: 6203849 - DNA, 18 bp, Homo sapiens
gacccggattggccctgc

SEQ ID NO: 6203850 - DNA, 22 bp, Homo sapiens
gacccggcccccgccctctgcc

SEQ ID NO: 6203851 - DNA, 18 bp, Homo sapiens
gacccggcccctaccagc

SEQ ID NO: 6203852 - DNA, 23 bp, Homo sapiens
gacccggccgccgccaggactgt

SEQ ID NO: 6203853 - DNA, 14 bp, Homo sapiens
gacccggcctctct

SEQ ID NO: 6203854 - DNA, 12 bp, Homo sapiens
gacccggcggcc

SEQ ID NO: 6203855 - DNA, 18 bp, Homo sapiens
gacccgggaccacagctg

SEQ ID NO: 6203856 - DNA, 23 bp, Homo sapiens
gacccggggatggattggcctcc

SEQ ID NO: 6203857 - DNA, 15 bp, Homo sapiens
gacccggggcagctg

SEQ ID NO: 6203858 - DNA, 17 bp, Homo sapiens
gacccggggtctcctgg

SEQ ID NO: 6203859 - DNA, 20 bp, Homo sapiens
gacccggggtctcctggacc

SEQ ID NO: 6203860 - DNA, 20 bp, Homo sapiens
gacccggtcacgttcttgga

SEQ ID NO: 6203861 - DNA, 21 bp, Homo sapiens
gacccggttattcgcccaccc

SEQ ID NO: 6203862 - DNA, 17 bp, Homo sapiens
cttggggaaggggacag

SEQ ID NO: 6203863 - DNA, 17 bp, Homo sapiens
cttggggaaggggcctg

SEQ ID NO: 6203864 - DNA, 20 bp, Homo sapiens
cttggggaaggggcctgggc

SEQ ID NO: 6203865 - DNA, 16 bp, Homo sapiens
cttggggaatttcctc

SEQ ID NO: 6203866 - DNA, 22 bp, Homo sapiens
cttggggacaaccttggcttgg

SEQ ID NO: 6203867 - DNA, 16 bp, Homo sapiens
cttggggacaccccag

SEQ ID NO: 6203868 - DNA, 17 bp, Homo sapiens
cttggggacataatttc

SEQ ID NO: 6203869 - DNA, 17 bp, Homo sapiens
cttggggaccagagctg

SEQ ID NO: 6203870 - DNA, 22 bp, Homo sapiens
cttggggaccagagctgccacc

SEQ ID NO: 6203871 - DNA, 10 bp, Homo sapiens
cttggggagc

SEQ ID NO: 6203872 - DNA, 12 bp, Homo sapiens
cttggggagcag

SEQ ID NO: 6203873 - DNA, 19 bp, Homo sapiens
cttggggagcaggtctctg

SEQ ID NO: 6203874 - DNA, 21 bp, Homo sapiens
cttggggagcaggtctctggc

SEQ ID NO: 6203875 - DNA, 19 bp, Homo sapiens
cttggggaggacaaaactt

SEQ ID NO: 6203876 - DNA, 13 bp, Homo sapiens
cttggggaggcaa

SEQ ID NO: 6203877 - DNA, 19 bp, Homo sapiens
cttggggaggggtcagctc

SEQ ID NO: 6203878 - DNA, 23 bp, Homo sapiens
cttggggaggggtcagctctggc

SEQ ID NO: 6203879 - DNA, 21 bp, Homo sapiens
cttggggagtttagggtgggg

SEQ ID NO: 6203880 - DNA, 22 bp, Homo sapiens
cttggggatgcccttcttccat

SEQ ID NO: 6203881 - DNA, 19 bp, Homo sapiens
cttggggattcttccatct

SEQ ID NO: 6203882 - DNA, 15 bp, Homo sapiens
cttggggattgtaca

SEQ ID NO: 6203883 - DNA, 23 bp, Homo sapiens
cttggggcaacattgttcacctt

SEQ ID NO: 6203884 - DNA, 14 bp, Homo sapiens
cttggggcaagact

SEQ ID NO: 6203885 - DNA, 14 bp, Homo sapiens
cttggggcaggcag

SEQ ID NO: 6203886 - DNA, 14 bp, Homo sapiens
cttggggcagggcc

SEQ ID NO: 6203887 - DNA, 22 bp, Homo sapiens
cttggggcagggcctgggcctc

SEQ ID NO: 6203888 - DNA, 18 bp, Homo sapiens
cttggggcatgacccagt

SEQ ID NO: 6203889 - DNA, 22 bp, Homo sapiens
cttggggccaccaaagctgccc

SEQ ID NO: 6203890 - DNA, 17 bp, Homo sapiens
cttggggccagactggc

SEQ ID NO: 6203891 - DNA, 17 bp, Homo sapiens
cttggggcccagtgcat

SEQ ID NO: 6203892 - DNA, 10 bp, Homo sapiens
cttggggcct

SEQ ID NO: 6203893 - DNA, 13 bp, Homo sapiens
cttggggcctggc

SEQ ID NO: 6203894 - DNA, 16 bp, Homo sapiens
cttggggcctggcgtg

SEQ ID NO: 6203895 - DNA, 23 bp, Homo sapiens
cttggggcctggcttgctccagg

SEQ ID NO: 6203896 - DNA, 19 bp, Homo sapiens
cttggggctgatgaagaag

SEQ ID NO: 6203897 - DNA, 16 bp, Homo sapiens
cttggggctgatgcag

SEQ ID NO: 6203898 - DNA, 18 bp, Homo sapiens
cttggggctgatgcagtt

SEQ ID NO: 6203899 - DNA, 14 bp, Homo sapiens
cttggggcttccta

SEQ ID NO: 6203900 - DNA, 20 bp, Homo sapiens
cttggggcttgacttttgta

SEQ ID NO: 6203901 - DNA, 21 bp, Homo sapiens
cttgggggaacgatgtgtctg

SEQ ID NO: 6203902 - DNA, 22 bp, Homo sapiens
cttgggggaacgatgtgtctgt

SEQ ID NO: 6203903 - DNA, 23 bp, Homo sapiens
cttgggggacagggctggcccag

SEQ ID NO: 6203904 - DNA, 24 bp, Homo sapiens
cttgggggatgactagaggcaggg

SEQ ID NO: 6203905 - DNA, 16 bp, Homo sapiens
cttgggggcagagcag

SEQ ID NO: 6203906 - DNA, 17 bp, Homo sapiens
cttgggggctcagcaag

SEQ ID NO: 6203907 - DNA, 17 bp, Homo sapiens
cttggggggctccaggg

SEQ ID NO: 6203908 - DNA, 22 bp, Homo sapiens
cttggggggctgaggtgggagg

SEQ ID NO: 6203909 - DNA, 23 bp, Homo sapiens
cttggggggctgaggtgggagga

SEQ ID NO: 6203910 - DNA, 15 bp, Homo sapiens
cttgggggggctgcc

SEQ ID NO: 6203911 - DNA, 16 bp, Homo sapiens
cttgggggggctgcct

SEQ ID NO: 6203912 - DNA, 18 bp, Homo sapiens
cttgggggggctgccttt

SEQ ID NO: 6203913 - DNA, 18 bp, Homo sapiens
cttgggggtcacccatgg

SEQ ID NO: 6203914 - DNA, 22 bp, Homo sapiens
cttgggggtcacccatggcctc

SEQ ID NO: 6203915 - DNA, 21 bp, Homo sapiens
cttgggggtcctcctccaggg

SEQ ID NO: 6203916 - DNA, 12 bp, Homo sapiens
cttgggggtctg

SEQ ID NO: 6203917 - DNA, 13 bp, Homo sapiens
cttgggggtctgc

SEQ ID NO: 6203918 - DNA, 22 bp, Homo sapiens
cttgggggtctgctctgtgcct

SEQ ID NO: 6203919 - DNA, 18 bp, Homo sapiens
cttgggggttcaggcccg

SEQ ID NO: 6203920 - DNA, 19 bp, Homo sapiens
cttggggtaagccagagcc

SEQ ID NO: 6203921 - DNA, 21 bp, Homo sapiens
cttggggtactcttgatgtga

SEQ ID NO: 6203922 - DNA, 22 bp, Homo sapiens
cttggggtcaggaacagtggct

SEQ ID NO: 6203923 - DNA, 18 bp, Homo sapiens
cttggggtggcgcgcctg

SEQ ID NO: 6203924 - DNA, 20 bp, Homo sapiens
cttggggtggcgcgcctgcc

SEQ ID NO: 6203925 - DNA, 21 bp, Homo sapiens
cttggggtggcgcgcctgcct

SEQ ID NO: 6203926 - DNA, 14 bp, Homo sapiens
cttggggtgggggc

SEQ ID NO: 6203927 - DNA, 16 bp, Homo sapiens
cttggggtgtggggtg

SEQ ID NO: 6203928 - DNA, 22 bp, Homo sapiens
cttggggttcataggggcaggt

SEQ ID NO: 6203929 - DNA, 22 bp, Homo sapiens
cttggggttcccccagacagag

SEQ ID NO: 6203930 - DNA, 20 bp, Homo sapiens
cttgggtaagtcccccaggg

SEQ ID NO: 6203931 - DNA, 22 bp, Homo sapiens
cttgggtagagtttacagctct

SEQ ID NO: 6203932 - DNA, 23 bp, Homo sapiens
cttgggtagagtttacagctctg

SEQ ID NO: 6203933 - DNA, 15 bp, Homo sapiens
cttgggtaggcggga

SEQ ID NO: 6203934 - DNA, 14 bp, Homo sapiens
cttgggtagggcag

SEQ ID NO: 6203935 - DNA, 16 bp, Homo sapiens
cttgggtagggcagac

SEQ ID NO: 6203936 - DNA, 16 bp, Homo sapiens
cttgggtcacatgact

SEQ ID NO: 6203937 - DNA, 17 bp, Homo sapiens
cttgggtcacatgactc

SEQ ID NO: 6203938 - DNA, 20 bp, Homo sapiens
cttgggtcacatgactctca

SEQ ID NO: 6203939 - DNA, 21 bp, Homo sapiens
cttgggtcattgacctctcag

SEQ ID NO: 6203940 - DNA, 23 bp, Homo sapiens
cttgggtcccccacgtgacagtg

SEQ ID NO: 6203941 - DNA, 20 bp, Homo sapiens
cttgggtcctactcctggag

SEQ ID NO: 6203942 - DNA, 21 bp, Homo sapiens
cttgggtcctactcctggagc

SEQ ID NO: 6203943 - DNA, 23 bp, Homo sapiens
cttgggtcctgcaatctccaggg

SEQ ID NO: 6203944 - DNA, 22 bp, Homo sapiens
cttgggtcgccctaccctcact

SEQ ID NO: 6203945 - DNA, 14 bp, Homo sapiens
cttgggtctctctc

SEQ ID NO: 6203946 - DNA, 12 bp, Homo sapiens
cttgggtctctg

SEQ ID NO: 6203947 - DNA, 14 bp, Homo sapiens
cttgggtctctgga

SEQ ID NO: 6203948 - DNA, 18 bp, Homo sapiens
cttgggtctgaatttatt

SEQ ID NO: 6203949 - DNA, 14 bp, Homo sapiens
cttgggtctgccct

SEQ ID NO: 6203950 - DNA, 18 bp, Homo sapiens
cttgggtctgccctgccc

SEQ ID NO: 6203951 - DNA, 19 bp, Homo sapiens
cttgggtctgtgtcacttg

SEQ ID NO: 6203952 - DNA, 21 bp, Homo sapiens
cttgggtgcggtttgctcagc

SEQ ID NO: 6203953 - DNA, 20 bp, Homo sapiens
cttgggtgggacagggcttc

SEQ ID NO: 6203954 - DNA, 15 bp, Homo sapiens
cttgggtgggtgaag

SEQ ID NO: 6203955 - DNA, 17 bp, Homo sapiens
cttgggtgggtgaaggc

SEQ ID NO: 6203956 - DNA, 22 bp, Homo sapiens
cttgggtgtaacaggtctcctc

SEQ ID NO: 6203957 - DNA, 17 bp, Homo sapiens
cttgggttccaaccagg

SEQ ID NO: 6203958 - DNA, 21 bp, Homo sapiens
cttgggttgatctcttagaag

SEQ ID NO: 6203959 - DNA, 16 bp, Homo sapiens
cttggtaaaacattac

SEQ ID NO: 6203960 - DNA, 23 bp, Homo sapiens
cttggtaaattgtaaacagctaa

SEQ ID NO: 6203961 - DNA, 15 bp, Homo sapiens
cttggtaagaagccg

SEQ ID NO: 6203962 - DNA, 15 bp, Homo sapiens
cttggtaagagggag

SEQ ID NO: 6203963 - DNA, 23 bp, Homo sapiens
cttggtaagagggagccggtttg

SEQ ID NO: 6203964 - DNA, 19 bp, Homo sapiens
cttggtaagatgactctga

SEQ ID NO: 6203965 - DNA, 20 bp, Homo sapiens
cttggtaagatgactctgag

SEQ ID NO: 6203966 - DNA, 21 bp, Homo sapiens
cttggtaagatgactctgaga

SEQ ID NO: 6203967 - DNA, 18 bp, Homo sapiens
cttggtaattatatctgt

SEQ ID NO: 6203968 - DNA, 18 bp, Homo sapiens
cttggtagattattcata

SEQ ID NO: 6203969 - DNA, 21 bp, Homo sapiens
cttggtaggtgtggtggcgtt

SEQ ID NO: 6203970 - DNA, 21 bp, Homo sapiens
cttggtagttctgtgcctccc

SEQ ID NO: 6203971 - DNA, 21 bp, Homo sapiens
cttggtattattctgttttgc

SEQ ID NO: 6203972 - DNA, 16 bp, Homo sapiens
cttggtatttggatat

SEQ ID NO: 6203973 - DNA, 12 bp, Homo sapiens
cttggtcaaact

SEQ ID NO: 6203974 - DNA, 13 bp, Homo sapiens
cttggtcaaactt

SEQ ID NO: 6203975 - DNA, 22 bp, Homo sapiens
cttggtcaaactttttccagca

SEQ ID NO: 6203976 - DNA, 16 bp, Homo sapiens
cttggtcaagaaagga

SEQ ID NO: 6203977 - DNA, 20 bp, Homo sapiens
cttggtcaagtttttctctc

SEQ ID NO: 6203978 - DNA, 17 bp, Homo sapiens
cttggtcacagccaggc

SEQ ID NO: 6203979 - DNA, 14 bp, Homo sapiens
cttggtcacataca

SEQ ID NO: 6203980 - DNA, 14 bp, Homo sapiens
cttggtcaccagct

SEQ ID NO: 6203981 - DNA, 14 bp, Homo sapiens
cttggtcacctcaa

SEQ ID NO: 6203982 - DNA, 15 bp, Homo sapiens
cttggtcacctcaaa

SEQ ID NO: 6203983 - DNA, 16 bp, Homo sapiens
cttggtcacttcgtgg

SEQ ID NO: 6203984 - DNA, 14 bp, Homo sapiens
cttggtcagagcca

SEQ ID NO: 6203985 - DNA, 17 bp, Homo sapiens
cttggtcccagacagct

SEQ ID NO: 6203986 - DNA, 20 bp, Homo sapiens
cttggtcccagacagctgga

SEQ ID NO: 6203987 - DNA, 21 bp, Homo sapiens
cttggtcccagacagctggac

SEQ ID NO: 6203988 - DNA, 17 bp, Homo sapiens
cttggtcccatggctga

SEQ ID NO: 6203989 - DNA, 19 bp, Homo sapiens
cttggtcccatggctgaag

SEQ ID NO: 6203990 - DNA, 17 bp, Homo sapiens
cttggtccctctcagat

SEQ ID NO: 6203991 - DNA, 14 bp, Homo sapiens
cttggtcctgctgc

SEQ ID NO: 6203992 - DNA, 18 bp, Homo sapiens
cttggtcctgctgcagtt

SEQ ID NO: 6203993 - DNA, 22 bp, Homo sapiens
cttggtctaacttttgtgtgaa

SEQ ID NO: 6203994 - DNA, 15 bp, Homo sapiens
cttggtctatgtgct

SEQ ID NO: 6203995 - DNA, 20 bp, Homo sapiens
cttggtctatgtgctctgta

SEQ ID NO: 6203996 - DNA, 15 bp, Homo sapiens
cttggtctcagcttc

SEQ ID NO: 6203997 - DNA, 16 bp, Homo sapiens
cttggtctcagcttca

SEQ ID NO: 6203998 - DNA, 16 bp, Homo sapiens
cttggtctcatgcccc

SEQ ID NO: 6203999 - DNA, 21 bp, Homo sapiens
cttggtctctccttcctcttg

SEQ ID NO: 6204000 - DNA, 12 bp, Homo sapiens
cttggtctcttt

SEQ ID NO: 6204001 - DNA, 20 bp, Homo sapiens
cttggtctgccaggccccca

SEQ ID NO: 6204002 - DNA, 19 bp, Homo sapiens
cttggtctggctttaagaa

SEQ ID NO: 6204003 - DNA, 22 bp, Homo sapiens
cttggtctgtgttctcaacaca

SEQ ID NO: 6204004 - DNA, 22 bp, Homo sapiens
cttggtctgttgcccaggctgg

SEQ ID NO: 6204005 - DNA, 14 bp, Homo sapiens
cttggtcttccatg

SEQ ID NO: 6204006 - DNA, 15 bp, Homo sapiens
cttggtcttccatgg

SEQ ID NO: 6204007 - DNA, 15 bp, Homo sapiens
cttggtcttcccagg

SEQ ID NO: 6204008 - DNA, 17 bp, Homo sapiens
cttggtcttctactgcc

SEQ ID NO: 6204009 - DNA, 19 bp, Homo sapiens
cttggtcttctactgcctt

SEQ ID NO: 6204010 - DNA, 21 bp, Homo sapiens
cttggtcttctactgccttga

SEQ ID NO: 6204011 - DNA, 18 bp, Homo sapiens
cttggtctttctgtgctt

SEQ ID NO: 6204012 - DNA, 20 bp, Homo sapiens
cttggtcttttttctgggtc

SEQ ID NO: 6204013 - DNA, 17 bp, Homo sapiens
cttggtgacaaaattca

SEQ ID NO: 6204014 - DNA, 18 bp, Homo sapiens
cttggtgaggaggaggca

SEQ ID NO: 6204015 - DNA, 19 bp, Homo sapiens
cttggtgaggaggaggcag

SEQ ID NO: 6204016 - DNA, 22 bp, Homo sapiens
cttggtgagtcttggttctaaa

SEQ ID NO: 6204017 - DNA, 20 bp, Homo sapiens
cttggtgattacctgaaagc

SEQ ID NO: 6204018 - DNA, 18 bp, Homo sapiens
cttggtgcacagattgct

SEQ ID NO: 6204019 - DNA, 23 bp, Homo sapiens
cttggtgcacagattgctgaaac

SEQ ID NO: 6204020 - DNA, 20 bp, Homo sapiens
cttggtgccaccaaaagtgc

SEQ ID NO: 6204021 - DNA, 18 bp, Homo sapiens
cttggtgccctcgcctcc

SEQ ID NO: 6204022 - DNA, 14 bp, Homo sapiens
cttggtgcctctgg

SEQ ID NO: 6204023 - DNA, 22 bp, Homo sapiens
cttggtgcggtaggtgctggcc

SEQ ID NO: 6204024 - DNA, 15 bp, Homo sapiens
cttggtgctctgtgt

SEQ ID NO: 6204025 - DNA, 14 bp, Homo sapiens
cttggtgctgtgtg

SEQ ID NO: 6204026 - DNA, 13 bp, Homo sapiens
cttggtggccaag

SEQ ID NO: 6204027 - DNA, 17 bp, Homo sapiens
cttggtggcttttcctt

SEQ ID NO: 6204028 - DNA, 17 bp, Homo sapiens
cttggtgggggagcctc

SEQ ID NO: 6204029 - DNA, 22 bp, Homo sapiens
cttggtgggggagcctctggaa

SEQ ID NO: 6204030 - DNA, 21 bp, Homo sapiens
cttggtgggtgtggccagcac

SEQ ID NO: 6204031 - DNA, 12 bp, Homo sapiens
cttggtgtaatt

SEQ ID NO: 6204032 - DNA, 20 bp, Homo sapiens
cttggtgtcctttccctcca

SEQ ID NO: 6204033 - DNA, 20 bp, Homo sapiens
cttggtgtcgggcatgacac

SEQ ID NO: 6204034 - DNA, 15 bp, Homo sapiens
cttggtgtcgtttcc

SEQ ID NO: 6204035 - DNA, 22 bp, Homo sapiens
cttggtgtctgcggggggtgtc

SEQ ID NO: 6204036 - DNA, 21 bp, Homo sapiens
cttggtgtctggtttctgtcc

SEQ ID NO: 6204037 - DNA, 14 bp, Homo sapiens
gacccggttgcagt

SEQ ID NO: 6204038 - DNA, 19 bp, Homo sapiens
gacccgtccattcttcagt

SEQ ID NO: 6204039 - DNA, 15 bp, Homo sapiens
gaccctaaatctgag

SEQ ID NO: 6204040 - DNA, 17 bp, Homo sapiens
gaccctaaatctgagga

SEQ ID NO: 6204041 - DNA, 16 bp, Homo sapiens
gaccctaaatcttgac

SEQ ID NO: 6204042 - DNA, 17 bp, Homo sapiens
gaccctaacccggaggg

SEQ ID NO: 6204043 - DNA, 18 bp, Homo sapiens
gaccctaagaccggcggc

SEQ ID NO: 6204044 - DNA, 11 bp, Homo sapiens
gaccctacccc

SEQ ID NO: 6204045 - DNA, 14 bp, Homo sapiens
gaccctaccccacc

SEQ ID NO: 6204046 - DNA, 18 bp, Homo sapiens
gaccctactattcatgtt

SEQ ID NO: 6204047 - DNA, 19 bp, Homo sapiens
gaccctactgaagtggctg

SEQ ID NO: 6204048 - DNA, 17 bp, Homo sapiens
gaccctacttcctgcac

SEQ ID NO: 6204049 - DNA, 20 bp, Homo sapiens
gaccctatgggtctaggaca

SEQ ID NO: 6204050 - DNA, 11 bp, Homo sapiens
gaccctcagca

SEQ ID NO: 6204051 - DNA, 18 bp, Homo sapiens
gaccctcagcagctctgg

SEQ ID NO: 6204052 - DNA, 19 bp, Homo sapiens
gaccctcagcagctctggc

SEQ ID NO: 6204053 - DNA, 17 bp, Homo sapiens
gaccctcagccccagga

SEQ ID NO: 6204054 - DNA, 21 bp, Homo sapiens
gaccctcagccccaggagaag

SEQ ID NO: 6204055 - DNA, 19 bp, Homo sapiens
gaccctcagccctggcctt

SEQ ID NO: 6204056 - DNA, 16 bp, Homo sapiens
gaccctcaggcacacc

SEQ ID NO: 6204057 - DNA, 18 bp, Homo sapiens
gaccctcaggcacacctt

SEQ ID NO: 6204058 - DNA, 22 bp, Homo sapiens
gaccctcaggcacaccttgcag

SEQ ID NO: 6204059 - DNA, 13 bp, Homo sapiens
gaccctcagttat

SEQ ID NO: 6204060 - DNA, 23 bp, Homo sapiens
gaccctcatgctgccaatatcct

SEQ ID NO: 6204061 - DNA, 20 bp, Homo sapiens
gaccctcatggcccccaggg

SEQ ID NO: 6204062 - DNA, 24 bp, Homo sapiens
gaccctcatggcccccaggggcag

SEQ ID NO: 6204063 - DNA, 12 bp, Homo sapiens
gaccctccactc

SEQ ID NO: 6204064 - DNA, 11 bp, Homo sapiens
gaccctcccac

SEQ ID NO: 6204065 - DNA, 12 bp, Homo sapiens
gaccctcccagg

SEQ ID NO: 6204066 - DNA, 12 bp, Homo sapiens
gaccctcccagt

SEQ ID NO: 6204067 - DNA, 18 bp, Homo sapiens
gaccctccccaaaggctt

SEQ ID NO: 6204068 - DNA, 23 bp, Homo sapiens
gaccctccccaaggatgaccaca

SEQ ID NO: 6204069 - DNA, 18 bp, Homo sapiens
gaccctcccggcctggct

SEQ ID NO: 6204070 - DNA, 18 bp, Homo sapiens
gaccctcctccactccac

SEQ ID NO: 6204071 - DNA, 19 bp, Homo sapiens
gaccctcctcctcccccag

SEQ ID NO: 6204072 - DNA, 11 bp, Homo sapiens
gaccctcctgg

SEQ ID NO: 6204073 - DNA, 18 bp, Homo sapiens
gaccctcctggccttcct

SEQ ID NO: 6204074 - DNA, 22 bp, Homo sapiens
gaccctcctgttgcacccagcc

SEQ ID NO: 6204075 - DNA, 10 bp, Homo sapiens
gaccctcctt

SEQ ID NO: 6204076 - DNA, 12 bp, Homo sapiens
gaccctccttcc

SEQ ID NO: 6204077 - DNA, 13 bp, Homo sapiens
gaccctccttccc

SEQ ID NO: 6204078 - DNA, 14 bp, Homo sapiens
gaccctccttcccc

SEQ ID NO: 6204079 - DNA, 17 bp, Homo sapiens
gaccctccttccccacc

SEQ ID NO: 6204080 - DNA, 21 bp, Homo sapiens
gaccctccttccccaccccat

SEQ ID NO: 6204081 - DNA, 14 bp, Homo sapiens
gaccctcgcagacc

SEQ ID NO: 6204082 - DNA, 15 bp, Homo sapiens
gaccctcgcagcagg

SEQ ID NO: 6204083 - DNA, 17 bp, Homo sapiens
gaccctcgctctctgtc

SEQ ID NO: 6204084 - DNA, 16 bp, Homo sapiens
gaccctcgctggcccc

SEQ ID NO: 6204085 - DNA, 20 bp, Homo sapiens
gaccctcgggccccatcctc

SEQ ID NO: 6204086 - DNA, 19 bp, Homo sapiens
gaccctcggggcaggaagt

SEQ ID NO: 6204087 - DNA, 15 bp, Homo sapiens
gaccctcgtggcctt

SEQ ID NO: 6204088 - DNA, 16 bp, Homo sapiens
gaccctctcaggctgt

SEQ ID NO: 6204089 - DNA, 20 bp, Homo sapiens
gaccctctcaggctgtccca

SEQ ID NO: 6204090 - DNA, 17 bp, Homo sapiens
gaccctctccaccccat

SEQ ID NO: 6204091 - DNA, 15 bp, Homo sapiens
gaccctctgaatggt

SEQ ID NO: 6204092 - DNA, 20 bp, Homo sapiens
gaccctctgaatggtccagg

SEQ ID NO: 6204093 - DNA, 16 bp, Homo sapiens
gaccctctgccaccag

SEQ ID NO: 6204094 - DNA, 22 bp, Homo sapiens
gaccctctgggaacctcccaga

SEQ ID NO: 6204095 - DNA, 12 bp, Homo sapiens
gaccctctgtcc

SEQ ID NO: 6204096 - DNA, 13 bp, Homo sapiens
gaccctctgtccc

SEQ ID NO: 6204097 - DNA, 17 bp, Homo sapiens
gaccctctgtccccagg

SEQ ID NO: 6204098 - DNA, 18 bp, Homo sapiens
gaccctctgtccccaggc

SEQ ID NO: 6204099 - DNA, 20 bp, Homo sapiens
gaccctctgtccccaggcct

SEQ ID NO: 6204100 - DNA, 16 bp, Homo sapiens
gaccctcttctctggg

SEQ ID NO: 6204101 - DNA, 17 bp, Homo sapiens
gaccctcttctctgggc

SEQ ID NO: 6204102 - DNA, 18 bp, Homo sapiens
gaccctcttctctgggcc

SEQ ID NO: 6204103 - DNA, 20 bp, Homo sapiens
gaccctcttctctgggccca

SEQ ID NO: 6204104 - DNA, 22 bp, Homo sapiens
gaccctcttctctgggcccaga

SEQ ID NO: 6204105 - DNA, 17 bp, Homo sapiens
gaccctcttgcccatcc

SEQ ID NO: 6204106 - DNA, 21 bp, Homo sapiens
gaccctgaaaggaacactggc

SEQ ID NO: 6204107 - DNA, 15 bp, Homo sapiens
gaccctgaaatgtgt

SEQ ID NO: 6204108 - DNA, 16 bp, Homo sapiens
gaccctgaaggggcca

SEQ ID NO: 6204109 - DNA, 22 bp, Homo sapiens
gaccctgaatccgtacttgggt

SEQ ID NO: 6204110 - DNA, 11 bp, Homo sapiens
gaccctgagac

SEQ ID NO: 6204111 - DNA, 16 bp, Homo sapiens
gaccctgagactccag

SEQ ID NO: 6204112 - DNA, 16 bp, Homo sapiens
gaccctgagctgacca

SEQ ID NO: 6204113 - DNA, 20 bp, Homo sapiens
gaccctgagctgaccagccg

SEQ ID NO: 6204114 - DNA, 11 bp, Homo sapiens
gaccctgaggc

SEQ ID NO: 6204115 - DNA, 18 bp, Homo sapiens
gaccctgaggcccagagg

SEQ ID NO: 6204116 - DNA, 23 bp, Homo sapiens
gaccctgaggcccagagggcctg

SEQ ID NO: 6204117 - DNA, 18 bp, Homo sapiens
gaccctgaggccctgggc

SEQ ID NO: 6204118 - DNA, 19 bp, Homo sapiens
gaccctgaggccctgggct

SEQ ID NO: 6204119 - DNA, 20 bp, Homo sapiens
gaccctgaggccctgggctg

SEQ ID NO: 6204120 - DNA, 15 bp, Homo sapiens
gaccctgagggctcc

SEQ ID NO: 6204121 - DNA, 16 bp, Homo sapiens
gaccctgagggctcct

SEQ ID NO: 6204122 - DNA, 19 bp, Homo sapiens
gaccctgagggctcctcca

SEQ ID NO: 6204123 - DNA, 22 bp, Homo sapiens
gaccctgagggctcctccatgg

SEQ ID NO: 6204124 - DNA, 19 bp, Homo sapiens
gaccctgagtccccacctg

SEQ ID NO: 6204125 - DNA, 17 bp, Homo sapiens
gaccctgatgcaggtca

SEQ ID NO: 6204126 - DNA, 23 bp, Homo sapiens
gaccctgatgcaggtcagcccat

SEQ ID NO: 6204127 - DNA, 18 bp, Homo sapiens
gaccctgcaaacagaaca

SEQ ID NO: 6204128 - DNA, 20 bp, Homo sapiens
gaccctgcaaacagaacagg

SEQ ID NO: 6204129 - DNA, 20 bp, Homo sapiens
gaccctgccaactttccaga

SEQ ID NO: 6204130 - DNA, 23 bp, Homo sapiens
gaccctgccaactttccagactt

SEQ ID NO: 6204131 - DNA, 17 bp, Homo sapiens
gaccctgccaggcacag

SEQ ID NO: 6204132 - DNA, 19 bp, Homo sapiens
gaccctgccaggcacaggc

SEQ ID NO: 6204133 - DNA, 21 bp, Homo sapiens
gaccctgccaggcacaggcag

SEQ ID NO: 6204134 - DNA, 15 bp, Homo sapiens
gaccctgcccacccc

SEQ ID NO: 6204135 - DNA, 17 bp, Homo sapiens
gaccctgcccaccccat

SEQ ID NO: 6204136 - DNA, 23 bp, Homo sapiens
gaccctgcccaccccatccctgg

SEQ ID NO: 6204137 - DNA, 19 bp, Homo sapiens
gaccctgcccagagctgag

SEQ ID NO: 6204138 - DNA, 14 bp, Homo sapiens
gaccctgccccctg

SEQ ID NO: 6204139 - DNA, 21 bp, Homo sapiens
gaccctgccccctgccagccg

SEQ ID NO: 6204140 - DNA, 12 bp, Homo sapiens
gaccctgccctg

SEQ ID NO: 6204141 - DNA, 17 bp, Homo sapiens
gaccctgccctgtgggc

SEQ ID NO: 6204142 - DNA, 22 bp, Homo sapiens
gaccctgccctgtgggccccca

SEQ ID NO: 6204143 - DNA, 15 bp, Homo sapiens
gaccctgcccttgtt

SEQ ID NO: 6204144 - DNA, 16 bp, Homo sapiens
gaccctgcctcagctg

SEQ ID NO: 6204145 - DNA, 16 bp, Homo sapiens
gaccctgcctgagccc

SEQ ID NO: 6204146 - DNA, 13 bp, Homo sapiens
gaccctgctcaca

SEQ ID NO: 6204147 - DNA, 21 bp, Homo sapiens
gaccctgctcctagcaccctg

SEQ ID NO: 6204148 - DNA, 14 bp, Homo sapiens
gaccctgcttagga

SEQ ID NO: 6204149 - DNA, 17 bp, Homo sapiens
gaccctgcttcaccctc

SEQ ID NO: 6204150 - DNA, 23 bp, Homo sapiens
gaccctggaattcagcaccctgg

SEQ ID NO: 6204151 - DNA, 23 bp, Homo sapiens
gaccctggagcccggcagtgcac

SEQ ID NO: 6204152 - DNA, 21 bp, Homo sapiens
gaccctggagcggctctcctg

SEQ ID NO: 6204153 - DNA, 15 bp, Homo sapiens
gaccctggcctcaag

SEQ ID NO: 6204154 - DNA, 14 bp, Homo sapiens
gaccctgggcaagt

SEQ ID NO: 6204155 - DNA, 14 bp, Homo sapiens
gaccctgggcctgg

SEQ ID NO: 6204156 - DNA, 21 bp, Homo sapiens
gaccctgggggcacaggaggc

SEQ ID NO: 6204157 - DNA, 16 bp, Homo sapiens
gaccctgggtcacctt

SEQ ID NO: 6204158 - DNA, 20 bp, Homo sapiens
gaccctgggtcaccttcctg

SEQ ID NO: 6204159 - DNA, 19 bp, Homo sapiens
gaccctgtagagtcactga

SEQ ID NO: 6204160 - DNA, 22 bp, Homo sapiens
gaccctgtagagtcactgaccc

SEQ ID NO: 6204161 - DNA, 19 bp, Homo sapiens
gaccctgtcccctagggac

SEQ ID NO: 6204162 - DNA, 21 bp, Homo sapiens
gaccctgtccggcccagtgcc

SEQ ID NO: 6204163 - DNA, 23 bp, Homo sapiens
gaccctgtccggcccagtgccac

SEQ ID NO: 6204164 - DNA, 22 bp, Homo sapiens
gaccctgtgacatggtgcctga

SEQ ID NO: 6204165 - DNA, 13 bp, Homo sapiens
gaccctgtgcctg

SEQ ID NO: 6204166 - DNA, 15 bp, Homo sapiens
gaccctgtgcctgtg

SEQ ID NO: 6204167 - DNA, 16 bp, Homo sapiens
gaccctgtgcctgtgt

SEQ ID NO: 6204168 - DNA, 16 bp, Homo sapiens
gaccctgtggagaaat

SEQ ID NO: 6204169 - DNA, 13 bp, Homo sapiens
gaccctgtggcca

SEQ ID NO: 6204170 - DNA, 15 bp, Homo sapiens
gaccctgtggccagg

SEQ ID NO: 6204171 - DNA, 20 bp, Homo sapiens
gaccctgtgtcctccaccat

SEQ ID NO: 6204172 - DNA, 11 bp, Homo sapiens
gaccctgtgtg

SEQ ID NO: 6204173 - DNA, 15 bp, Homo sapiens
gaccctgttgctaag

SEQ ID NO: 6204174 - DNA, 18 bp, Homo sapiens
gaccctgttttccacacc

SEQ ID NO: 6204175 - DNA, 19 bp, Homo sapiens
gaccctgttttccacacca

SEQ ID NO: 6204176 - DNA, 17 bp, Homo sapiens
gacccttacagcctctg

SEQ ID NO: 6204177 - DNA, 23 bp, Homo sapiens
gacccttaggatggggctcccag

SEQ ID NO: 6204178 - DNA, 17 bp, Homo sapiens
gacccttataaaatcct

SEQ ID NO: 6204179 - DNA, 16 bp, Homo sapiens
gacccttcagggccag

SEQ ID NO: 6204180 - DNA, 17 bp, Homo sapiens
gacccttcagggccaga

SEQ ID NO: 6204181 - DNA, 21 bp, Homo sapiens
gacccttcccaatcagcactg

SEQ ID NO: 6204182 - DNA, 17 bp, Homo sapiens
gacccttcccagccctc

SEQ ID NO: 6204183 - DNA, 19 bp, Homo sapiens
gacccttcccttgagccct

SEQ ID NO: 6204184 - DNA, 15 bp, Homo sapiens
gacccttctgggtcc

SEQ ID NO: 6204185 - DNA, 21 bp, Homo sapiens
gacccttctgggtccagggag

SEQ ID NO: 6204186 - DNA, 18 bp, Homo sapiens
gacccttcttgcctgctg

SEQ ID NO: 6204187 - DNA, 22 bp, Homo sapiens
gacccttcttgcctgctgggct

SEQ ID NO: 6204188 - DNA, 19 bp, Homo sapiens
gacccttgccgtctacctg

SEQ ID NO: 6204189 - DNA, 23 bp, Homo sapiens
gacccttgccgtctacctgaggg

SEQ ID NO: 6204190 - DNA, 15 bp, Homo sapiens
gacccttgcctgcct

SEQ ID NO: 6204191 - DNA, 18 bp, Homo sapiens
gacccttgcctgcctcct

SEQ ID NO: 6204192 - DNA, 18 bp, Homo sapiens
gacccttggcctccattt

SEQ ID NO: 6204193 - DNA, 18 bp, Homo sapiens
gacccttggtgtttccct

SEQ ID NO: 6204194 - DNA, 20 bp, Homo sapiens
gacccttgtggtcccacccc

SEQ ID NO: 6204195 - DNA, 21 bp, Homo sapiens
gacccttgtggtcccacccca

SEQ ID NO: 6204196 - DNA, 13 bp, Homo sapiens
gaccctttcctcc

SEQ ID NO: 6204197 - DNA, 20 bp, Homo sapiens
gaccctttccttccttccct

SEQ ID NO: 6204198 - DNA, 21 bp, Homo sapiens
gaccctttccttccttccctg

SEQ ID NO: 6204199 - DNA, 23 bp, Homo sapiens
gaccctttccttccttccctggc

SEQ ID NO: 6204200 - DNA, 16 bp, Homo sapiens
gaccctttctccacag

SEQ ID NO: 6204201 - DNA, 13 bp, Homo sapiens
gacccttttaagc

SEQ ID NO: 6204202 - DNA, 14 bp, Homo sapiens
gacccttttctcag

SEQ ID NO: 6204203 - DNA, 16 bp, Homo sapiens
gacccttttctcagga

SEQ ID NO: 6204204 - DNA, 17 bp, Homo sapiens
gacccttttgagcctag

SEQ ID NO: 6204205 - DNA, 16 bp, Homo sapiens
gaccgaaatctgtatt

SEQ ID NO: 6204206 - DNA, 14 bp, Homo sapiens
gaccgaattttatt

SEQ ID NO: 6204207 - DNA, 14 bp, Homo sapiens
gaccgacgcccctc

SEQ ID NO: 6204208 - DNA, 16 bp, Homo sapiens
gaccgacgcccctccg

SEQ ID NO: 6204209 - DNA, 18 bp, Homo sapiens
gaccgactaccccagtcc

SEQ ID NO: 6204210 - DNA, 15 bp, Homo sapiens
gaccgactttcccca

SEQ ID NO: 6204211 - DNA, 16 bp, Homo sapiens
gaccgagcccagcaga

SEQ ID NO: 6204212 - DNA, 13 bp, Homo sapiens
gaccgagccctgg

SEQ ID NO: 6204213 - DNA, 15 bp, Homo sapiens
gaccgagccctggag

SEQ ID NO: 6204214 - DNA, 19 bp, Homo sapiens
gaccgagccctggagagcc

SEQ ID NO: 6204215 - DNA, 17 bp, Homo sapiens
gaccgaggccagaaggc

SEQ ID NO: 6204216 - DNA, 15 bp, Homo sapiens
cttggtgtcttggca

SEQ ID NO: 6204217 - DNA, 15 bp, Homo sapiens
cttggtgtgaagact

SEQ ID NO: 6204218 - DNA, 21 bp, Homo sapiens
cttggttagacgccttccagg

SEQ ID NO: 6204219 - DNA, 17 bp, Homo sapiens
cttggttatacatgaca

SEQ ID NO: 6204220 - DNA, 19 bp, Homo sapiens
cttggttatacatgacact

SEQ ID NO: 6204221 - DNA, 13 bp, Homo sapiens
cttggttattctg

SEQ ID NO: 6204222 - DNA, 14 bp, Homo sapiens
cttggttcatgctt

SEQ ID NO: 6204223 - DNA, 17 bp, Homo sapiens
cttggttccagcctgcc

SEQ ID NO: 6204224 - DNA, 22 bp, Homo sapiens
cttggttccctcttccctggtc

SEQ ID NO: 6204225 - DNA, 12 bp, Homo sapiens
cttggttcctgg

SEQ ID NO: 6204226 - DNA, 16 bp, Homo sapiens
cttggttcctgggatg

SEQ ID NO: 6204227 - DNA, 18 bp, Homo sapiens
cttggttcctggggcatc

SEQ ID NO: 6204228 - DNA, 13 bp, Homo sapiens
cttggttcctgtt

SEQ ID NO: 6204229 - DNA, 16 bp, Homo sapiens
cttggttctgtgaaca

SEQ ID NO: 6204230 - DNA, 21 bp, Homo sapiens
cttggttcttcctagtgccta

SEQ ID NO: 6204231 - DNA, 22 bp, Homo sapiens
cttggttcttgaggggaccagg

SEQ ID NO: 6204232 - DNA, 14 bp, Homo sapiens
cttggttgaggaaa

SEQ ID NO: 6204233 - DNA, 23 bp, Homo sapiens
cttggttgatgtttaaagagaag

SEQ ID NO: 6204234 - DNA, 20 bp, Homo sapiens
cttggttggacctattgcca

SEQ ID NO: 6204235 - DNA, 21 bp, Homo sapiens
cttggttggctggcagctgag

SEQ ID NO: 6204236 - DNA, 15 bp, Homo sapiens
cttggttggctggcc

SEQ ID NO: 6204237 - DNA, 16 bp, Homo sapiens
cttggttggctggcct

SEQ ID NO: 6204238 - DNA, 21 bp, Homo sapiens
cttggttgtgtttttctttct

SEQ ID NO: 6204239 - DNA, 22 bp, Homo sapiens
cttggttgttcctttttctttt

SEQ ID NO: 6204240 - DNA, 16 bp, Homo sapiens
cttggtttccatcaaa

SEQ ID NO: 6204241 - DNA, 19 bp, Homo sapiens
cttggtttcctcaccttga

SEQ ID NO: 6204242 - DNA, 15 bp, Homo sapiens
cttggtttgccttcc

SEQ ID NO: 6204243 - DNA, 20 bp, Homo sapiens
cttggtttggacacagtgtt

SEQ ID NO: 6204244 - DNA, 21 bp, Homo sapiens
cttggtttggacacagtgttc

SEQ ID NO: 6204245 - DNA, 16 bp, Homo sapiens
cttggtttggggagaa

SEQ ID NO: 6204246 - DNA, 17 bp, Homo sapiens
cttggtttggggagaaa

SEQ ID NO: 6204247 - DNA, 18 bp, Homo sapiens
cttggtttggggagaaat

SEQ ID NO: 6204248 - DNA, 16 bp, Homo sapiens
cttggtttggttcatg

SEQ ID NO: 6204249 - DNA, 23 bp, Homo sapiens
cttggtttgtggcgtctccctcg

SEQ ID NO: 6204250 - DNA, 13 bp, Homo sapiens
cttggttttctct

SEQ ID NO: 6204251 - DNA, 17 bp, Homo sapiens
cttggttttctctctgg

SEQ ID NO: 6204252 - DNA, 21 bp, Homo sapiens
cttggttttgcctctttaaat

SEQ ID NO: 6204253 - DNA, 21 bp, Homo sapiens
cttggttttgctacataatta

SEQ ID NO: 6204254 - DNA, 14 bp, Homo sapiens
cttggttttgtatt

SEQ ID NO: 6204255 - DNA, 21 bp, Homo sapiens
cttggttttgtattgtttaaa

SEQ ID NO: 6204256 - DNA, 23 bp, Homo sapiens
cttggtttttactgctctgagaa

SEQ ID NO: 6204257 - DNA, 16 bp, Homo sapiens
cttggtttttggctct

SEQ ID NO: 6204258 - DNA, 11 bp, Homo sapiens
cttgtaaaaaa

SEQ ID NO: 6204259 - DNA, 16 bp, Homo sapiens
cttgtaaaaaaagcaa

SEQ ID NO: 6204260 - DNA, 19 bp, Homo sapiens
cttgtaaaaaaagcaaaaa

SEQ ID NO: 6204261 - DNA, 21 bp, Homo sapiens
cttgtaaaaaggggaggagaa

SEQ ID NO: 6204262 - DNA, 18 bp, Homo sapiens
cttgtaaaaattaaaagt

SEQ ID NO: 6204263 - DNA, 13 bp, Homo sapiens
cttgtaaaaccaa

SEQ ID NO: 6204264 - DNA, 16 bp, Homo sapiens
cttgtaaaactgtgac

SEQ ID NO: 6204265 - DNA, 16 bp, Homo sapiens
cttgtaaaatgctttt

SEQ ID NO: 6204266 - DNA, 18 bp, Homo sapiens
cttgtaaaggaatttaaa

SEQ ID NO: 6204267 - DNA, 19 bp, Homo sapiens
cttgtaaataaagccctgg

SEQ ID NO: 6204268 - DNA, 20 bp, Homo sapiens
cttgtaaataaagtctattt

SEQ ID NO: 6204269 - DNA, 14 bp, Homo sapiens
cttgtaaataaata

SEQ ID NO: 6204270 - DNA, 17 bp, Homo sapiens
cttgtaaataaatagat

SEQ ID NO: 6204271 - DNA, 19 bp, Homo sapiens
cttgtaaataaatagattt

SEQ ID NO: 6204272 - DNA, 23 bp, Homo sapiens
cttgtaaataaatagatttgatt

SEQ ID NO: 6204273 - DNA, 21 bp, Homo sapiens
cttgtaaataaccacaaggtc

SEQ ID NO: 6204274 - DNA, 12 bp, Homo sapiens
cttgtaaataca

SEQ ID NO: 6204275 - DNA, 13 bp, Homo sapiens
cttgtaaatacac

SEQ ID NO: 6204276 - DNA, 19 bp, Homo sapiens
cttgtaaatacataaaaca

SEQ ID NO: 6204277 - DNA, 22 bp, Homo sapiens
cttgtaaatacatgtccccctg

SEQ ID NO: 6204278 - DNA, 17 bp, Homo sapiens
cttgtaaatagctcagg

SEQ ID NO: 6204279 - DNA, 21 bp, Homo sapiens
cttgtaaatagctcaggtgtc

SEQ ID NO: 6204280 - DNA, 12 bp, Homo sapiens
cttgtaaatata

SEQ ID NO: 6204281 - DNA, 19 bp, Homo sapiens
cttgtaaatataaagacgt

SEQ ID NO: 6204282 - DNA, 13 bp, Homo sapiens
cttgtaaatgttt

SEQ ID NO: 6204283 - DNA, 20 bp, Homo sapiens
cttgtaacaactaattataa

SEQ ID NO: 6204284 - DNA, 17 bp, Homo sapiens
cttgtaactcaccgtgc

SEQ ID NO: 6204285 - DNA, 14 bp, Homo sapiens
cttgtaactccacc

SEQ ID NO: 6204286 - DNA, 15 bp, Homo sapiens
cttgtaactccacca

SEQ ID NO: 6204287 - DNA, 12 bp, Homo sapiens
cttgtaactttt

SEQ ID NO: 6204288 - DNA, 19 bp, Homo sapiens
cttgtaagagctatacagt

SEQ ID NO: 6204289 - DNA, 12 bp, Homo sapiens
cttgtaagattt

SEQ ID NO: 6204290 - DNA, 14 bp, Homo sapiens
cttgtaatatgtat

SEQ ID NO: 6204291 - DNA, 20 bp, Homo sapiens
cttgtaatattttgtattat

SEQ ID NO: 6204292 - DNA, 15 bp, Homo sapiens
cttgtaatgtaactg

SEQ ID NO: 6204293 - DNA, 20 bp, Homo sapiens
cttgtaatgtaactgctctt

SEQ ID NO: 6204294 - DNA, 16 bp, Homo sapiens
cttgtaattctaaatg

SEQ ID NO: 6204295 - DNA, 21 bp, Homo sapiens
cttgtaatttaaacaggccca

SEQ ID NO: 6204296 - DNA, 13 bp, Homo sapiens
cttgtacaaaaga

SEQ ID NO: 6204297 - DNA, 13 bp, Homo sapiens
cttgtacaaaata

SEQ ID NO: 6204298 - DNA, 14 bp, Homo sapiens
cttgtacacttaag

SEQ ID NO: 6204299 - DNA, 16 bp, Homo sapiens
cttgtacagacatgtg

SEQ ID NO: 6204300 - DNA, 21 bp, Homo sapiens
cttgtacagtctgctcctctt

SEQ ID NO: 6204301 - DNA, 13 bp, Homo sapiens
cttgtacagtgtc

SEQ ID NO: 6204302 - DNA, 20 bp, Homo sapiens
cttgtacagtgtctgtgcca

SEQ ID NO: 6204303 - DNA, 16 bp, Homo sapiens
cttgtacagttgactg

SEQ ID NO: 6204304 - DNA, 20 bp, Homo sapiens
cttgtacagttgactggctt

SEQ ID NO: 6204305 - DNA, 21 bp, Homo sapiens
cttgtacataatgcgtgcata

SEQ ID NO: 6204306 - DNA, 17 bp, Homo sapiens
cttgtacatagtaggca

SEQ ID NO: 6204307 - DNA, 23 bp, Homo sapiens
cttgtacatgtgtagcctgtgca

SEQ ID NO: 6204308 - DNA, 18 bp, Homo sapiens
cttgtacatttttaaatt

SEQ ID NO: 6204309 - DNA, 13 bp, Homo sapiens
cttgtaccccatc

SEQ ID NO: 6204310 - DNA, 19 bp, Homo sapiens
cttgtactctacaaaatat

SEQ ID NO: 6204311 - DNA, 16 bp, Homo sapiens
cttgtactcttaggat

SEQ ID NO: 6204312 - DNA, 15 bp, Homo sapiens
cttgtactgtgacct

SEQ ID NO: 6204313 - DNA, 15 bp, Homo sapiens
cttgtacttctgtgt

SEQ ID NO: 6204314 - DNA, 17 bp, Homo sapiens
cttgtacttctgtgttc

SEQ ID NO: 6204315 - DNA, 15 bp, Homo sapiens
cttgtactttacaat

SEQ ID NO: 6204316 - DNA, 23 bp, Homo sapiens
cttgtagaaaaatccctccacct

SEQ ID NO: 6204317 - DNA, 14 bp, Homo sapiens
cttgtagaaatctg

SEQ ID NO: 6204318 - DNA, 17 bp, Homo sapiens
cttgtagaactcactct

SEQ ID NO: 6204319 - DNA, 18 bp, Homo sapiens
cttgtagaactcactctg

SEQ ID NO: 6204320 - DNA, 17 bp, Homo sapiens
cttgtagaccactgtcc

SEQ ID NO: 6204321 - DNA, 22 bp, Homo sapiens
cttgtagaccactgtcctggct

SEQ ID NO: 6204322 - DNA, 18 bp, Homo sapiens
cttgtagcagtgtgcttt

SEQ ID NO: 6204323 - DNA, 10 bp, Homo sapiens
cttgtagcca

SEQ ID NO: 6204324 - DNA, 15 bp, Homo sapiens
cttgtagccagccgg

SEQ ID NO: 6204325 - DNA, 22 bp, Homo sapiens
cttgtagccctggatggcctct

SEQ ID NO: 6204326 - DNA, 12 bp, Homo sapiens
cttgtagccttt

SEQ ID NO: 6204327 - DNA, 17 bp, Homo sapiens
cttgtagccttttgact

SEQ ID NO: 6204328 - DNA, 13 bp, Homo sapiens
cttgtagctcctc

SEQ ID NO: 6204329 - DNA, 14 bp, Homo sapiens
cttgtagctcctcc

SEQ ID NO: 6204330 - DNA, 18 bp, Homo sapiens
cttgtagctcctcccctg

SEQ ID NO: 6204331 - DNA, 23 bp, Homo sapiens
cttgtagctcctcccctggaggg

SEQ ID NO: 6204332 - DNA, 21 bp, Homo sapiens
cttgtagctggactgcaatat

SEQ ID NO: 6204333 - DNA, 14 bp, Homo sapiens
cttgtagctgtaaa

SEQ ID NO: 6204334 - DNA, 21 bp, Homo sapiens
cttgtaggaatctgccttcca

SEQ ID NO: 6204335 - DNA, 23 bp, Homo sapiens
cttgtaggggaggggctcctttc

SEQ ID NO: 6204336 - DNA, 21 bp, Homo sapiens
cttgtaggtatgtctgtgcca

SEQ ID NO: 6204337 - DNA, 22 bp, Homo sapiens
cttgtaggtatgtctgtgccat

SEQ ID NO: 6204338 - DNA, 15 bp, Homo sapiens
cttgtagtgtgtgct

SEQ ID NO: 6204339 - DNA, 15 bp, Homo sapiens
cttgtagttctttaa

SEQ ID NO: 6204340 - DNA, 21 bp, Homo sapiens
cttgtagtttacctctttaaa

SEQ ID NO: 6204341 - DNA, 22 bp, Homo sapiens
cttgtagtttagtgtggttttc

SEQ ID NO: 6204342 - DNA, 14 bp, Homo sapiens
cttgtataaatgta

SEQ ID NO: 6204343 - DNA, 21 bp, Homo sapiens
cttgtataaggagctttgctc

SEQ ID NO: 6204344 - DNA, 16 bp, Homo sapiens
cttgtatagctgaaat

SEQ ID NO: 6204345 - DNA, 13 bp, Homo sapiens
cttgtatagcttt

SEQ ID NO: 6204346 - DNA, 15 bp, Homo sapiens
cttgtatagtgtaaa

SEQ ID NO: 6204347 - DNA, 16 bp, Homo sapiens
cttgtatagtgtaaaa

SEQ ID NO: 6204348 - DNA, 17 bp, Homo sapiens
cttgtatagtgtaaaat

SEQ ID NO: 6204349 - DNA, 14 bp, Homo sapiens
cttgtatatacata

SEQ ID NO: 6204350 - DNA, 22 bp, Homo sapiens
cttgtatatacatattataaat

SEQ ID NO: 6204351 - DNA, 23 bp, Homo sapiens
cttgtatatacatattataaata

SEQ ID NO: 6204352 - DNA, 23 bp, Homo sapiens
cttgtatatagagattgtacatt

SEQ ID NO: 6204353 - DNA, 13 bp, Homo sapiens
cttgtatattcca

SEQ ID NO: 6204354 - DNA, 23 bp, Homo sapiens
cttgtatattccaccattcacat

SEQ ID NO: 6204355 - DNA, 11 bp, Homo sapiens
cttgtatattt

SEQ ID NO: 6204356 - DNA, 14 bp, Homo sapiens
cttgtatatttgta

SEQ ID NO: 6204357 - DNA, 16 bp, Homo sapiens
cttgtatatttgtaca

SEQ ID NO: 6204358 - DNA, 17 bp, Homo sapiens
cttgtatattttaagaa

SEQ ID NO: 6204359 - DNA, 21 bp, Homo sapiens
cttgtatctgatatcagcact

SEQ ID NO: 6204360 - DNA, 20 bp, Homo sapiens
cttgtatgaataaaaggctg

SEQ ID NO: 6204361 - DNA, 15 bp, Homo sapiens
cttgtatgctgccca

SEQ ID NO: 6204362 - DNA, 22 bp, Homo sapiens
cttgtatgtggttgttgatctt

SEQ ID NO: 6204363 - DNA, 17 bp, Homo sapiens
cttgtattaaagacaga

SEQ ID NO: 6204364 - DNA, 23 bp, Homo sapiens
cttgtattaagttgttaataaaa

SEQ ID NO: 6204365 - DNA, 20 bp, Homo sapiens
cttgtattccaagcatataa

SEQ ID NO: 6204366 - DNA, 13 bp, Homo sapiens
cttgtattgactt

SEQ ID NO: 6204367 - DNA, 18 bp, Homo sapiens
cttgtattgctccatttt

SEQ ID NO: 6204368 - DNA, 14 bp, Homo sapiens
cttgtattgtaaat

SEQ ID NO: 6204369 - DNA, 21 bp, Homo sapiens
cttgtattgtaaatgtggatt

SEQ ID NO: 6204370 - DNA, 13 bp, Homo sapiens
cttgtatttccaa

SEQ ID NO: 6204371 - DNA, 13 bp, Homo sapiens
cttgtattttcca

SEQ ID NO: 6204372 - DNA, 20 bp, Homo sapiens
cttgtattttgttaaagctg

SEQ ID NO: 6204373 - DNA, 18 bp, Homo sapiens
cttgtcaaaagaaataat

SEQ ID NO: 6204374 - DNA, 15 bp, Homo sapiens
cttgtcaaagaaggt

SEQ ID NO: 6204375 - DNA, 21 bp, Homo sapiens
cttgtcaacaaagtgcttttt

SEQ ID NO: 6204376 - DNA, 18 bp, Homo sapiens
cttgtcaagcctgtgcaa

SEQ ID NO: 6204377 - DNA, 17 bp, Homo sapiens
cttgtcacaaagtgaga

SEQ ID NO: 6204378 - DNA, 14 bp, Homo sapiens
cttgtcacaataaa

SEQ ID NO: 6204379 - DNA, 15 bp, Homo sapiens
cttgtcacaataaat

SEQ ID NO: 6204380 - DNA, 16 bp, Homo sapiens
cttgtcacaataaatg

SEQ ID NO: 6204381 - DNA, 14 bp, Homo sapiens
cttgtcacaggaat

SEQ ID NO: 6204382 - DNA, 18 bp, Homo sapiens
cttgtcacccaaagcctg

SEQ ID NO: 6204383 - DNA, 18 bp, Homo sapiens
cttgtcacccaggctgga

SEQ ID NO: 6204384 - DNA, 22 bp, Homo sapiens
cttgtcacgaattccatcttgt

SEQ ID NO: 6204385 - DNA, 20 bp, Homo sapiens
cttgtcacgatcacaggcct

SEQ ID NO: 6204386 - DNA, 19 bp, Homo sapiens
cttgtcactagcagctgca

SEQ ID NO: 6204387 - DNA, 15 bp, Homo sapiens
cttgtcactatgcta

SEQ ID NO: 6204388 - DNA, 20 bp, Homo sapiens
cttgtcactgacacaaagga

SEQ ID NO: 6204389 - DNA, 21 bp, Homo sapiens
cttgtcactgacacaaaggaa

SEQ ID NO: 6204390 - DNA, 15 bp, Homo sapiens
cttgtcactggtaga

SEQ ID NO: 6204391 - DNA, 23 bp, Homo sapiens
cttgtcactggtagaccaaaata

SEQ ID NO: 6204392 - DNA, 15 bp, Homo sapiens
cttgtcagaaacact

SEQ ID NO: 6204393 - DNA, 15 bp, Homo sapiens
cttgtcagacataaa

SEQ ID NO: 6204394 - DNA, 13 bp, Homo sapiens
cttgtcagagctg

SEQ ID NO: 6204395 - DNA, 16 bp, Homo sapiens
gaccgaggctacagct

SEQ ID NO: 6204396 - DNA, 18 bp, Homo sapiens
gaccgagtgtggagctgc

SEQ ID NO: 6204397 - DNA, 21 bp, Homo sapiens
gaccgagtgtggagctgcttc

SEQ ID NO: 6204398 - DNA, 18 bp, Homo sapiens
gaccgatggtgtttggga

SEQ ID NO: 6204399 - DNA, 19 bp, Homo sapiens
gaccgattatgctttcttt

SEQ ID NO: 6204400 - DNA, 13 bp, Homo sapiens
gaccgcagaggga

SEQ ID NO: 6204401 - DNA, 15 bp, Homo sapiens
gaccgcaggagggca

SEQ ID NO: 6204402 - DNA, 16 bp, Homo sapiens
gaccgcaggagggcag

SEQ ID NO: 6204403 - DNA, 16 bp, Homo sapiens
gaccgcccagctctcc

SEQ ID NO: 6204404 - DNA, 18 bp, Homo sapiens
gaccgccccaaccctcgg

SEQ ID NO: 6204405 - DNA, 15 bp, Homo sapiens
gaccgccccaggcac

SEQ ID NO: 6204406 - DNA, 16 bp, Homo sapiens
gaccgccccaggcacc

SEQ ID NO: 6204407 - DNA, 14 bp, Homo sapiens
gaccgccccctcct

SEQ ID NO: 6204408 - DNA, 22 bp, Homo sapiens
gaccgccctccgcgaaaatagt

SEQ ID NO: 6204409 - DNA, 16 bp, Homo sapiens
gaccgccgatcccagg

SEQ ID NO: 6204410 - DNA, 18 bp, Homo sapiens
gaccgccgatcccaggtg

SEQ ID NO: 6204411 - DNA, 20 bp, Homo sapiens
gaccgccgcttccagcttcc

SEQ ID NO: 6204412 - DNA, 17 bp, Homo sapiens
gaccgcctcctgctctg

SEQ ID NO: 6204413 - DNA, 12 bp, Homo sapiens
gaccgcctggcc

SEQ ID NO: 6204414 - DNA, 16 bp, Homo sapiens
gaccgcctggccctcc

SEQ ID NO: 6204415 - DNA, 16 bp, Homo sapiens
gaccgcgcccctggga

SEQ ID NO: 6204416 - DNA, 19 bp, Homo sapiens
gaccgctacaccactctgg

SEQ ID NO: 6204417 - DNA, 14 bp, Homo sapiens
gaccgctgcccagg

SEQ ID NO: 6204418 - DNA, 15 bp, Homo sapiens
gaccgctgcccaggt

SEQ ID NO: 6204419 - DNA, 14 bp, Homo sapiens
gaccgcttcacccc

SEQ ID NO: 6204420 - DNA, 16 bp, Homo sapiens
gaccgcttcacccctg

SEQ ID NO: 6204421 - DNA, 17 bp, Homo sapiens
gaccgcttcacccctgc

SEQ ID NO: 6204422 - DNA, 15 bp, Homo sapiens
gaccgcttcccagag

SEQ ID NO: 6204423 - DNA, 17 bp, Homo sapiens
gaccgcttcccagaggc

SEQ ID NO: 6204424 - DNA, 21 bp, Homo sapiens
gaccgcttgtggggacccagg

SEQ ID NO: 6204425 - DNA, 22 bp, Homo sapiens
gaccgcttgtggggacccaggc

SEQ ID NO: 6204426 - DNA, 18 bp, Homo sapiens
gaccgcttgtttcttgtt

SEQ ID NO: 6204427 - DNA, 14 bp, Homo sapiens
gaccggaagctcct

SEQ ID NO: 6204428 - DNA, 17 bp, Homo sapiens
gaccggaagctcctggt

SEQ ID NO: 6204429 - DNA, 17 bp, Homo sapiens
gaccggacttttctgca

SEQ ID NO: 6204430 - DNA, 19 bp, Homo sapiens
gaccggagcggctgaggac

SEQ ID NO: 6204431 - DNA, 15 bp, Homo sapiens
gaccggcccgccacc

SEQ ID NO: 6204432 - DNA, 17 bp, Homo sapiens
gaccggcccgccacctt

SEQ ID NO: 6204433 - DNA, 23 bp, Homo sapiens
gaccggccgcagcccccactgac

SEQ ID NO: 6204434 - DNA, 20 bp, Homo sapiens
gaccgggacccggcggccct

SEQ ID NO: 6204435 - DNA, 14 bp, Homo sapiens
gaccgggagcctgc

SEQ ID NO: 6204436 - DNA, 23 bp, Homo sapiens
gaccgggagcctgcgtggcctgg

SEQ ID NO: 6204437 - DNA, 13 bp, Homo sapiens
gaccgggccaggc

SEQ ID NO: 6204438 - DNA, 16 bp, Homo sapiens
gaccgggcccccctga

SEQ ID NO: 6204439 - DNA, 17 bp, Homo sapiens
gaccgggcgcagccctc

SEQ ID NO: 6204440 - DNA, 13 bp, Homo sapiens
gaccgggggccag

SEQ ID NO: 6204441 - DNA, 15 bp, Homo sapiens
gaccgggggctgctg

SEQ ID NO: 6204442 - DNA, 19 bp, Homo sapiens
gaccgggggctgctgggcg

SEQ ID NO: 6204443 - DNA, 20 bp, Homo sapiens
gaccgggggctgctgggcgt

SEQ ID NO: 6204444 - DNA, 18 bp, Homo sapiens
gaccgggtctgcttctgc

SEQ ID NO: 6204445 - DNA, 14 bp, Homo sapiens
gaccgggtgggcct

SEQ ID NO: 6204446 - DNA, 16 bp, Homo sapiens
gaccgggtgggcctgg

SEQ ID NO: 6204447 - DNA, 21 bp, Homo sapiens
gaccgggtgggcctggcctga

SEQ ID NO: 6204448 - DNA, 14 bp, Homo sapiens
gaccgtactctcac

SEQ ID NO: 6204449 - DNA, 15 bp, Homo sapiens
gaccgtcagcatggg

SEQ ID NO: 6204450 - DNA, 13 bp, Homo sapiens
gaccgtccagggg

SEQ ID NO: 6204451 - DNA, 22 bp, Homo sapiens
gaccgtccaggggagatgggga

SEQ ID NO: 6204452 - DNA, 18 bp, Homo sapiens
gaccgtgaggccagagac

SEQ ID NO: 6204453 - DNA, 19 bp, Homo sapiens
gaccgtgaggccagagaca

SEQ ID NO: 6204454 - DNA, 23 bp, Homo sapiens
gaccgtgatttggaagagaggca

SEQ ID NO: 6204455 - DNA, 23 bp, Homo sapiens
gaccgtgcccacgagggtctccc

SEQ ID NO: 6204456 - DNA, 20 bp, Homo sapiens
gaccgtgccccacctcccca

SEQ ID NO: 6204457 - DNA, 14 bp, Homo sapiens
gaccgtgcgagctg

SEQ ID NO: 6204458 - DNA, 14 bp, Homo sapiens
gaccgtggacaggc

SEQ ID NO: 6204459 - DNA, 16 bp, Homo sapiens
gaccgtggacaggccc

SEQ ID NO: 6204460 - DNA, 20 bp, Homo sapiens
gaccgtgtcccaaggagctg

SEQ ID NO: 6204461 - DNA, 19 bp, Homo sapiens
gaccgttctctgtccccag

SEQ ID NO: 6204462 - DNA, 18 bp, Homo sapiens
gaccgttttcatcctggc

SEQ ID NO: 6204463 - DNA, 17 bp, Homo sapiens
gacctaaaaattggtgt

SEQ ID NO: 6204464 - DNA, 19 bp, Homo sapiens
gacctaaaatttgccctcc

SEQ ID NO: 6204465 - DNA, 20 bp, Homo sapiens
gacctaaaatttgccctccc

SEQ ID NO: 6204466 - DNA, 18 bp, Homo sapiens
gacctaaacagctgcttt

SEQ ID NO: 6204467 - DNA, 18 bp, Homo sapiens
gacctaaagggactacct

SEQ ID NO: 6204468 - DNA, 22 bp, Homo sapiens
gacctaaagggtatgagctgga

SEQ ID NO: 6204469 - DNA, 20 bp, Homo sapiens
gacctaaatgacctcagcaa

SEQ ID NO: 6204470 - DNA, 17 bp, Homo sapiens
gacctaaattagataaa

SEQ ID NO: 6204471 - DNA, 19 bp, Homo sapiens
gacctaaccagggccagaa

SEQ ID NO: 6204472 - DNA, 16 bp, Homo sapiens
gacctaacctaggagg

SEQ ID NO: 6204473 - DNA, 17 bp, Homo sapiens
gacctaacctaggaggg

SEQ ID NO: 6204474 - DNA, 13 bp, Homo sapiens
gacctaagaacaa

SEQ ID NO: 6204475 - DNA, 17 bp, Homo sapiens
gacctaaggcagacagg

SEQ ID NO: 6204476 - DNA, 18 bp, Homo sapiens
gacctaaggcagacagga

SEQ ID NO: 6204477 - DNA, 21 bp, Homo sapiens
gacctaaggcagacaggaagg

SEQ ID NO: 6204478 - DNA, 22 bp, Homo sapiens
gacctaaggcagacaggaagga

SEQ ID NO: 6204479 - DNA, 15 bp, Homo sapiens
gacctaatatcattt

SEQ ID NO: 6204480 - DNA, 22 bp, Homo sapiens
gacctaatgctccttgttccta

SEQ ID NO: 6204481 - DNA, 17 bp, Homo sapiens
gacctaattgatagcag

SEQ ID NO: 6204482 - DNA, 20 bp, Homo sapiens
gacctacagacagacataca

SEQ ID NO: 6204483 - DNA, 21 bp, Homo sapiens
gacctacagacagacatacat

SEQ ID NO: 6204484 - DNA, 14 bp, Homo sapiens
gacctacagacctg

SEQ ID NO: 6204485 - DNA, 17 bp, Homo sapiens
gacctacagacctggct

SEQ ID NO: 6204486 - DNA, 14 bp, Homo sapiens
gacctacagggaac

SEQ ID NO: 6204487 - DNA, 21 bp, Homo sapiens
gacctacagggggtctggctg

SEQ ID NO: 6204488 - DNA, 17 bp, Homo sapiens
gacctacatctgaaatc

SEQ ID NO: 6204489 - DNA, 14 bp, Homo sapiens
gacctacattccct

SEQ ID NO: 6204490 - DNA, 17 bp, Homo sapiens
gacctacattccctctc

SEQ ID NO: 6204491 - DNA, 14 bp, Homo sapiens
gacctaccccagcc

SEQ ID NO: 6204492 - DNA, 12 bp, Homo sapiens
gacctacctcag

SEQ ID NO: 6204493 - DNA, 21 bp, Homo sapiens
gacctacctccagacttcaaa

SEQ ID NO: 6204494 - DNA, 12 bp, Homo sapiens
gacctacctccc

SEQ ID NO: 6204495 - DNA, 20 bp, Homo sapiens
gacctactaaaaatataaaa

SEQ ID NO: 6204496 - DNA, 21 bp, Homo sapiens
gacctactaggagaggggggc

SEQ ID NO: 6204497 - DNA, 15 bp, Homo sapiens
gacctactgaaccca

SEQ ID NO: 6204498 - DNA, 18 bp, Homo sapiens
gacctactgttctaaagc

SEQ ID NO: 6204499 - DNA, 21 bp, Homo sapiens
gacctagaagcttaacactat

SEQ ID NO: 6204500 - DNA, 15 bp, Homo sapiens
gacctagacctgggc

SEQ ID NO: 6204501 - DNA, 18 bp, Homo sapiens
gacctagacctgggccaa

SEQ ID NO: 6204502 - DNA, 14 bp, Homo sapiens
gacctagcaggctg

SEQ ID NO: 6204503 - DNA, 16 bp, Homo sapiens
gacctagcaggctgtt

SEQ ID NO: 6204504 - DNA, 13 bp, Homo sapiens
gacctagcctgga

SEQ ID NO: 6204505 - DNA, 14 bp, Homo sapiens
gacctagcctggat

SEQ ID NO: 6204506 - DNA, 23 bp, Homo sapiens
gacctagcctggatggcccctcc

SEQ ID NO: 6204507 - DNA, 18 bp, Homo sapiens
gacctaggatatcttctc

SEQ ID NO: 6204508 - DNA, 20 bp, Homo sapiens
gacctaggatatcttctcca

SEQ ID NO: 6204509 - DNA, 13 bp, Homo sapiens
gacctaggctcct

SEQ ID NO: 6204510 - DNA, 20 bp, Homo sapiens
gacctagggatgttctggcc

SEQ ID NO: 6204511 - DNA, 21 bp, Homo sapiens
gacctagggatgttctggccc

SEQ ID NO: 6204512 - DNA, 22 bp, Homo sapiens
gacctagggggacggggctgac

SEQ ID NO: 6204513 - DNA, 16 bp, Homo sapiens
gacctaggggtttctg

SEQ ID NO: 6204514 - DNA, 15 bp, Homo sapiens
gacctataaaacaaa

SEQ ID NO: 6204515 - DNA, 17 bp, Homo sapiens
gacctataactgcccag

SEQ ID NO: 6204516 - DNA, 13 bp, Homo sapiens
gacctataatttt

SEQ ID NO: 6204517 - DNA, 16 bp, Homo sapiens
gacctatacctgtgtt

SEQ ID NO: 6204518 - DNA, 18 bp, Homo sapiens
gacctatagtaagtgctt

SEQ ID NO: 6204519 - DNA, 22 bp, Homo sapiens
gacctatcagtatggtgctaat

SEQ ID NO: 6204520 - DNA, 22 bp, Homo sapiens
gacctatgtcctaaggacacac

SEQ ID NO: 6204521 - DNA, 14 bp, Homo sapiens
gacctatgtttgct

SEQ ID NO: 6204522 - DNA, 21 bp, Homo sapiens
gacctattcaccctccacttc

SEQ ID NO: 6204523 - DNA, 17 bp, Homo sapiens
gacctattcctcctggg

SEQ ID NO: 6204524 - DNA, 15 bp, Homo sapiens
gacctcaaaagaaaa

SEQ ID NO: 6204525 - DNA, 20 bp, Homo sapiens
gacctcaaatcactgcattc

SEQ ID NO: 6204526 - DNA, 19 bp, Homo sapiens
gacctcaagccctgagggg

SEQ ID NO: 6204527 - DNA, 17 bp, Homo sapiens
gacctcaagtgatctgc

SEQ ID NO: 6204528 - DNA, 16 bp, Homo sapiens
gacctcacacacctct

SEQ ID NO: 6204529 - DNA, 19 bp, Homo sapiens
gacctcacacacctctgcc

SEQ ID NO: 6204530 - DNA, 23 bp, Homo sapiens
gacctcacacacctctgcccctt

SEQ ID NO: 6204531 - DNA, 20 bp, Homo sapiens
gacctcacacctgggggaca

SEQ ID NO: 6204532 - DNA, 21 bp, Homo sapiens
gacctcaccaagctgctgtgg

SEQ ID NO: 6204533 - DNA, 16 bp, Homo sapiens
gacctcacccctcctt

SEQ ID NO: 6204534 - DNA, 21 bp, Homo sapiens
gacctcaccggcatgctggcc

SEQ ID NO: 6204535 - DNA, 22 bp, Homo sapiens
gacctcaccggcatgctggcct

SEQ ID NO: 6204536 - DNA, 18 bp, Homo sapiens
gacctcacctccatcccc

SEQ ID NO: 6204537 - DNA, 13 bp, Homo sapiens
gacctcacctggt

SEQ ID NO: 6204538 - DNA, 13 bp, Homo sapiens
gacctcacctttg

SEQ ID NO: 6204539 - DNA, 14 bp, Homo sapiens
gacctcactggcct

SEQ ID NO: 6204540 - DNA, 15 bp, Homo sapiens
gacctcactggcctg

SEQ ID NO: 6204541 - DNA, 18 bp, Homo sapiens
gacctcactggcctgcca

SEQ ID NO: 6204542 - DNA, 16 bp, Homo sapiens
gacctcactgtcctgt

SEQ ID NO: 6204543 - DNA, 17 bp, Homo sapiens
gacctcagagtccaggc

SEQ ID NO: 6204544 - DNA, 14 bp, Homo sapiens
gacctcagcaagct

SEQ ID NO: 6204545 - DNA, 21 bp, Homo sapiens
gacctcagcaagctgcccagc

SEQ ID NO: 6204546 - DNA, 15 bp, Homo sapiens
gacctcagcagggca

SEQ ID NO: 6204547 - DNA, 11 bp, Homo sapiens
gacctcagcct

SEQ ID NO: 6204548 - DNA, 14 bp, Homo sapiens
gacctcagcctgca

SEQ ID NO: 6204549 - DNA, 16 bp, Homo sapiens
gacctcagcctgcacc

SEQ ID NO: 6204550 - DNA, 13 bp, Homo sapiens
gacctcagccttc

SEQ ID NO: 6204551 - DNA, 21 bp, Homo sapiens
gacctcagctgcacattcctg

SEQ ID NO: 6204552 - DNA, 23 bp, Homo sapiens
gacctcagctgcacattcctggc

SEQ ID NO: 6204553 - DNA, 18 bp, Homo sapiens
gacctcaggcaatctgcc

SEQ ID NO: 6204554 - DNA, 17 bp, Homo sapiens
gacctcaggcactagcc

SEQ ID NO: 6204555 - DNA, 19 bp, Homo sapiens
gacctcaggcactagcctt

SEQ ID NO: 6204556 - DNA, 13 bp, Homo sapiens
gacctcaggcctg

SEQ ID NO: 6204557 - DNA, 19 bp, Homo sapiens
gacctcaggcctgggggct

SEQ ID NO: 6204558 - DNA, 17 bp, Homo sapiens
gacctcaggcggggagg

SEQ ID NO: 6204559 - DNA, 12 bp, Homo sapiens
gacctcaggggc

SEQ ID NO: 6204560 - DNA, 23 bp, Homo sapiens
gacctcaggtaatcgacctgcct

SEQ ID NO: 6204561 - DNA, 13 bp, Homo sapiens
gacctcaggtgat

SEQ ID NO: 6204562 - DNA, 21 bp, Homo sapiens
gacctcaggtgatccacccac

SEQ ID NO: 6204563 - DNA, 17 bp, Homo sapiens
gacctcagtttctgttg

SEQ ID NO: 6204564 - DNA, 21 bp, Homo sapiens
gacctcatatcttcctcatca

SEQ ID NO: 6204565 - DNA, 22 bp, Homo sapiens
gacctcatatcttcctcatcag

SEQ ID NO: 6204566 - DNA, 20 bp, Homo sapiens
gacctcatcattaataagtg

SEQ ID NO: 6204567 - DNA, 16 bp, Homo sapiens
gacctcatctccaaga

SEQ ID NO: 6204568 - DNA, 20 bp, Homo sapiens
gacctcatctcccgagcaat

SEQ ID NO: 6204569 - DNA, 15 bp, Homo sapiens
gacctcatctgcctg

SEQ ID NO: 6204570 - DNA, 23 bp, Homo sapiens
gacctcatctgcctgcagtgtca

SEQ ID NO: 6204571 - DNA, 19 bp, Homo sapiens
gacctcatctgtggagctg

SEQ ID NO: 6204572 - DNA, 20 bp, Homo sapiens
gacctcatctgtggagctgc

SEQ ID NO: 6204573 - DNA, 19 bp, Homo sapiens
gacctcatgatccacccac

SEQ ID NO: 6204574 - DNA, 17 bp, Homo sapiens
gacctcatgcatctcca

SEQ ID NO: 6204575 - DNA, 21 bp, Homo sapiens
gacctcatgcatctccacctg

SEQ ID NO: 6204576 - DNA, 16 bp, Homo sapiens
gacctcatgcccagct

SEQ ID NO: 6204577 - DNA, 19 bp, Homo sapiens
gacctcatgcccagctctc

SEQ ID NO: 6204578 - DNA, 19 bp, Homo sapiens
gacctccaataaagtgcct

SEQ ID NO: 6204579 - DNA, 22 bp, Homo sapiens
gacctccaataaagtgccttct

SEQ ID NO: 6204580 - DNA, 18 bp, Homo sapiens
gacctccacctgggagat

SEQ ID NO: 6204581 - DNA, 22 bp, Homo sapiens
gacctccagattattttctata

SEQ ID NO: 6204582 - DNA, 15 bp, Homo sapiens
gacctccagctctca

SEQ ID NO: 6204583 - DNA, 18 bp, Homo sapiens
gacctccagctttcctgt

SEQ ID NO: 6204584 - DNA, 19 bp, Homo sapiens
gacctccaggctccagcac

SEQ ID NO: 6204585 - DNA, 21 bp, Homo sapiens
gacctccagggaatcagaaag

SEQ ID NO: 6204586 - DNA, 17 bp, Homo sapiens
gacctccaggggctcct

SEQ ID NO: 6204587 - DNA, 22 bp, Homo sapiens
gacctccaggggctcctgggtt

SEQ ID NO: 6204588 - DNA, 15 bp, Homo sapiens
gacctccagtcctgc

SEQ ID NO: 6204589 - DNA, 17 bp, Homo sapiens
gacctccagtcctgctg

SEQ ID NO: 6204590 - DNA, 18 bp, Homo sapiens
gacctccagtcctgctgg

SEQ ID NO: 6204591 - DNA, 23 bp, Homo sapiens
gacctccagtcctgctggcctgc

SEQ ID NO: 6204592 - DNA, 17 bp, Homo sapiens
gacctccatccctgctc

SEQ ID NO: 6204593 - DNA, 18 bp, Homo sapiens
gacctccatccctgctct

SEQ ID NO: 6204594 - DNA, 19 bp, Homo sapiens
gacctccatccctgctctg

SEQ ID NO: 6204595 - DNA, 13 bp, Homo sapiens
gacctccatgccc

SEQ ID NO: 6204596 - DNA, 15 bp, Homo sapiens
gacctccatgccccc

SEQ ID NO: 6204597 - DNA, 18 bp, Homo sapiens
gacctccatgcccccgcc

SEQ ID NO: 6204598 - DNA, 14 bp, Homo sapiens
gacctcccagccct

SEQ ID NO: 6204599 - DNA, 21 bp, Homo sapiens
gacctcccagccctatggatg

SEQ ID NO: 6204600 - DNA, 22 bp, Homo sapiens
gacctcccagccctatggatgt

SEQ ID NO: 6204601 - DNA, 19 bp, Homo sapiens
gacctcccaggacaagcac

SEQ ID NO: 6204602 - DNA, 13 bp, Homo sapiens
gacctccccagcc

SEQ ID NO: 6204603 - DNA, 14 bp, Homo sapiens
gacctccccagccc

SEQ ID NO: 6204604 - DNA, 15 bp, Homo sapiens
gacctccccagccca

SEQ ID NO: 6204605 - DNA, 14 bp, Homo sapiens
gacctcccccaggg

SEQ ID NO: 6204606 - DNA, 14 bp, Homo sapiens
gacctccccctcac

SEQ ID NO: 6204607 - DNA, 15 bp, Homo sapiens
gacctccccctcact

SEQ ID NO: 6204608 - DNA, 15 bp, Homo sapiens
gacctccccctcctt

SEQ ID NO: 6204609 - DNA, 17 bp, Homo sapiens
gacctcccctccccagc

SEQ ID NO: 6204610 - DNA, 15 bp, Homo sapiens
gacctcccctcttcc

SEQ ID NO: 6204611 - DNA, 16 bp, Homo sapiens
gacctcccctgaggct

SEQ ID NO: 6204612 - DNA, 21 bp, Homo sapiens
gacctccctccctccccagtg

SEQ ID NO: 6204613 - DNA, 13 bp, Homo sapiens
gacctccctggct

SEQ ID NO: 6204614 - DNA, 14 bp, Homo sapiens
gacctccctggctt

SEQ ID NO: 6204615 - DNA, 14 bp, Homo sapiens
gacctccctgtctc

SEQ ID NO: 6204616 - DNA, 22 bp, Homo sapiens
gacctcccttccgaccctctgg

SEQ ID NO: 6204617 - DNA, 14 bp, Homo sapiens
gacctcctccctca

SEQ ID NO: 6204618 - DNA, 15 bp, Homo sapiens
gacctcctccctcat

SEQ ID NO: 6204619 - DNA, 20 bp, Homo sapiens
gacctcctcttcccccttcc

SEQ ID NO: 6204620 - DNA, 14 bp, Homo sapiens
gacctcctggactg

SEQ ID NO: 6204621 - DNA, 19 bp, Homo sapiens
gacctcctggactgtagga

SEQ ID NO: 6204622 - DNA, 16 bp, Homo sapiens
gacctccttagaaaag

SEQ ID NO: 6204623 - DNA, 17 bp, Homo sapiens
gacctcggacagagccc

SEQ ID NO: 6204624 - DNA, 18 bp, Homo sapiens
gacctcggacagagcccc

SEQ ID NO: 6204625 - DNA, 22 bp, Homo sapiens
gacctcggatgaccatactcag

SEQ ID NO: 6204626 - DNA, 21 bp, Homo sapiens
gacctcgtcccatcttcactc

SEQ ID NO: 6204627 - DNA, 13 bp, Homo sapiens
gacctcgtcctcc

SEQ ID NO: 6204628 - DNA, 19 bp, Homo sapiens
gacctcgtcctccccctgc

SEQ ID NO: 6204629 - DNA, 21 bp, Homo sapiens
gacctcgtcctccccctgcca

SEQ ID NO: 6204630 - DNA, 15 bp, Homo sapiens
gacctcgtgatctac

SEQ ID NO: 6204631 - DNA, 19 bp, Homo sapiens
gacctcgtgatttgcctgc

SEQ ID NO: 6204632 - DNA, 17 bp, Homo sapiens
gacctcgtttgggagtg

SEQ ID NO: 6204633 - DNA, 21 bp, Homo sapiens
gacctctactttccaggctag

SEQ ID NO: 6204634 - DNA, 18 bp, Homo sapiens
gacctctagccctgcccg

SEQ ID NO: 6204635 - DNA, 14 bp, Homo sapiens
gacctctaggagga

SEQ ID NO: 6204636 - DNA, 13 bp, Homo sapiens
gacctctcagcag

SEQ ID NO: 6204637 - DNA, 15 bp, Homo sapiens
gacctctcagcagaa

SEQ ID NO: 6204638 - DNA, 19 bp, Homo sapiens
gacctctcagcagaaacac

SEQ ID NO: 6204639 - DNA, 23 bp, Homo sapiens
gacctctcagcatagcctgcctg

SEQ ID NO: 6204640 - DNA, 13 bp, Homo sapiens
gacctctcagggc

SEQ ID NO: 6204641 - DNA, 14 bp, Homo sapiens
gacctctcagggcc

SEQ ID NO: 6204642 - DNA, 15 bp, Homo sapiens
gacctctcagggcct

SEQ ID NO: 6204643 - DNA, 20 bp, Homo sapiens
gacctctcagggcctggcag

SEQ ID NO: 6204644 - DNA, 15 bp, Homo sapiens
gacctctccagcatc

SEQ ID NO: 6204645 - DNA, 23 bp, Homo sapiens
gacctctccagcatcccagcctc

SEQ ID NO: 6204646 - DNA, 15 bp, Homo sapiens
gacctctccggcctg

SEQ ID NO: 6204647 - DNA, 16 bp, Homo sapiens
gacctctctcagcccc

SEQ ID NO: 6204648 - DNA, 17 bp, Homo sapiens
gacctctctcagcccca

SEQ ID NO: 6204649 - DNA, 19 bp, Homo sapiens
gacctctctcagccccatc

SEQ ID NO: 6204650 - DNA, 11 bp, Homo sapiens
gacctctctcg

SEQ ID NO: 6204651 - DNA, 13 bp, Homo sapiens
gacctctctgcct

SEQ ID NO: 6204652 - DNA, 15 bp, Homo sapiens
gacctctctgcctct

SEQ ID NO: 6204653 - DNA, 17 bp, Homo sapiens
gacctctgaagagctga

SEQ ID NO: 6204654 - DNA, 20 bp, Homo sapiens
gacctctgaagagctgagta

SEQ ID NO: 6204655 - DNA, 20 bp, Homo sapiens
gacctctgacaactgtgaag

SEQ ID NO: 6204656 - DNA, 17 bp, Homo sapiens
gacctctgacagcagca

SEQ ID NO: 6204657 - DNA, 16 bp, Homo sapiens
gacctctgctgagtgc

SEQ ID NO: 6204658 - DNA, 11 bp, Homo sapiens
gacctctgctt

SEQ ID NO: 6204659 - DNA, 20 bp, Homo sapiens
gacctctgcttttgcacacc

SEQ ID NO: 6204660 - DNA, 11 bp, Homo sapiens
gacctctgggc

SEQ ID NO: 6204661 - DNA, 13 bp, Homo sapiens
gacctctgggctt

SEQ ID NO: 6204662 - DNA, 14 bp, Homo sapiens
gacctctgttgtcc

SEQ ID NO: 6204663 - DNA, 13 bp, Homo sapiens
gacctcttagaaa

SEQ ID NO: 6204664 - DNA, 15 bp, Homo sapiens
gacctcttagaaaat

SEQ ID NO: 6204665 - DNA, 21 bp, Homo sapiens
gacctcttcagctgctgacaa

SEQ ID NO: 6204666 - DNA, 17 bp, Homo sapiens
gacctcttccctctggg

SEQ ID NO: 6204667 - DNA, 21 bp, Homo sapiens
gacctcttctctcctccccta

SEQ ID NO: 6204668 - DNA, 14 bp, Homo sapiens
gacctcttctgaag

SEQ ID NO: 6204669 - DNA, 14 bp, Homo sapiens
gacctcttctggag

SEQ ID NO: 6204670 - DNA, 13 bp, Homo sapiens
gacctcttgctgt

SEQ ID NO: 6204671 - DNA, 14 bp, Homo sapiens
gacctcttgctgtc

SEQ ID NO: 6204672 - DNA, 23 bp, Homo sapiens
gacctctttggggcaagatccag

SEQ ID NO: 6204673 - DNA, 14 bp, Homo sapiens
gacctgaactctgc

SEQ ID NO: 6204674 - DNA, 12 bp, Homo sapiens
gacctgaagaat

SEQ ID NO: 6204675 - DNA, 16 bp, Homo sapiens
gacctgaagagtggtc

SEQ ID NO: 6204676 - DNA, 19 bp, Homo sapiens
gacctgaaggacctccccc

SEQ ID NO: 6204677 - DNA, 21 bp, Homo sapiens
gacctgaaggacctccccctg

SEQ ID NO: 6204678 - DNA, 16 bp, Homo sapiens
gacctgaaggcatctg

SEQ ID NO: 6204679 - DNA, 19 bp, Homo sapiens
gacctgaaggtattggcct

SEQ ID NO: 6204680 - DNA, 20 bp, Homo sapiens
gacctgaaggtattggcctg

SEQ ID NO: 6204681 - DNA, 22 bp, Homo sapiens
gacctgaaggtattggcctgtt

SEQ ID NO: 6204682 - DNA, 22 bp, Homo sapiens
gacctgaagttcaccattaaaa

SEQ ID NO: 6204683 - DNA, 22 bp, Homo sapiens
gacctgacaccgtccctcagtg

SEQ ID NO: 6204684 - DNA, 21 bp, Homo sapiens
gacctgacacctgccgctgct

SEQ ID NO: 6204685 - DNA, 16 bp, Homo sapiens
gacctgaccggcacct

SEQ ID NO: 6204686 - DNA, 18 bp, Homo sapiens
gacctgacgatcttcccc

SEQ ID NO: 6204687 - DNA, 20 bp, Homo sapiens
gacctgacgatcttccccct

SEQ ID NO: 6204688 - DNA, 15 bp, Homo sapiens
gacctgactattgaa

SEQ ID NO: 6204689 - DNA, 15 bp, Homo sapiens
gacctgactcaggca

SEQ ID NO: 6204690 - DNA, 16 bp, Homo sapiens
gacctgagacctgaag

SEQ ID NO: 6204691 - DNA, 14 bp, Homo sapiens
gacctgagatgaag

SEQ ID NO: 6204692 - DNA, 16 bp, Homo sapiens
gacctgagatgtgtga

SEQ ID NO: 6204693 - DNA, 12 bp, Homo sapiens
gacctgagcccg

SEQ ID NO: 6204694 - DNA, 13 bp, Homo sapiens
gacctgagcctgg

SEQ ID NO: 6204695 - DNA, 19 bp, Homo sapiens
gacctgagcggcaccctgg

SEQ ID NO: 6204696 - DNA, 21 bp, Homo sapiens
gacctgagcgggagtcaggga

SEQ ID NO: 6204697 - DNA, 16 bp, Homo sapiens
gacctgagctccccac

SEQ ID NO: 6204698 - DNA, 14 bp, Homo sapiens
gacctgaggaagcg

SEQ ID NO: 6204699 - DNA, 19 bp, Homo sapiens
gacctgaggacatggcttc

SEQ ID NO: 6204700 - DNA, 16 bp, Homo sapiens
gacctgaggcagatga

SEQ ID NO: 6204701 - DNA, 18 bp, Homo sapiens
gacctgaggccctcactg

SEQ ID NO: 6204702 - DNA, 15 bp, Homo sapiens
gacctgaggcccttc

SEQ ID NO: 6204703 - DNA, 14 bp, Homo sapiens
gacctgaggctcct

SEQ ID NO: 6204704 - DNA, 17 bp, Homo sapiens
gacctgaggctgtggtc

SEQ ID NO: 6204705 - DNA, 17 bp, Homo sapiens
gacctgagggacccttc

SEQ ID NO: 6204706 - DNA, 12 bp, Homo sapiens
gacctgagtatt

SEQ ID NO: 6204707 - DNA, 14 bp, Homo sapiens
gacctgagtatttt

SEQ ID NO: 6204708 - DNA, 19 bp, Homo sapiens
gacctgagtattttttata

SEQ ID NO: 6204709 - DNA, 21 bp, Homo sapiens
gacctgagtcggccccacatg

SEQ ID NO: 6204710 - DNA, 22 bp, Homo sapiens
gacctgagtttgggagagtggt

SEQ ID NO: 6204711 - DNA, 14 bp, Homo sapiens
gacctgatcactag

SEQ ID NO: 6204712 - DNA, 18 bp, Homo sapiens
gacctgatcctggaggcc

SEQ ID NO: 6204713 - DNA, 21 bp, Homo sapiens
gacctgatcctggaggcccag

SEQ ID NO: 6204714 - DNA, 14 bp, Homo sapiens
gacctgcagtgagg

SEQ ID NO: 6204715 - DNA, 12 bp, Homo sapiens
gacctgcatcct

SEQ ID NO: 6204716 - DNA, 18 bp, Homo sapiens
gacctgcatccttcctgg

SEQ ID NO: 6204717 - DNA, 19 bp, Homo sapiens
gacctgcatccttcctggg

SEQ ID NO: 6204718 - DNA, 20 bp, Homo sapiens
gacctgcatggtcaagcctc

SEQ ID NO: 6204719 - DNA, 16 bp, Homo sapiens
gacctgcattgtaaat

SEQ ID NO: 6204720 - DNA, 19 bp, Homo sapiens
gacctgccaccagggagct

SEQ ID NO: 6204721 - DNA, 22 bp, Homo sapiens
gacctgccagccactgtcaccg

SEQ ID NO: 6204722 - DNA, 16 bp, Homo sapiens
gacctgccaggcaggg

SEQ ID NO: 6204723 - DNA, 18 bp, Homo sapiens
gacctgccaggcaggggt

SEQ ID NO: 6204724 - DNA, 19 bp, Homo sapiens
gacctgccaggcaggggtg

SEQ ID NO: 6204725 - DNA, 20 bp, Homo sapiens
gacctgccaggcaggggtgg

SEQ ID NO: 6204726 - DNA, 20 bp, Homo sapiens
gacctgcccccgctctgcca

SEQ ID NO: 6204727 - DNA, 21 bp, Homo sapiens
gacctgccccgcccagctgca

SEQ ID NO: 6204728 - DNA, 21 bp, Homo sapiens
gacctgccccggacctacctc

SEQ ID NO: 6204729 - DNA, 17 bp, Homo sapiens
gacctgcccctgccgcc

SEQ ID NO: 6204730 - DNA, 13 bp, Homo sapiens
gacctgccctctc

SEQ ID NO: 6204731 - DNA, 16 bp, Homo sapiens
gacctgccctctctgc

SEQ ID NO: 6204732 - DNA, 19 bp, Homo sapiens
gacctgcctcctgcctgcc

SEQ ID NO: 6204733 - DNA, 22 bp, Homo sapiens
gacctgcctcctgcctgcccct

SEQ ID NO: 6204734 - DNA, 23 bp, Homo sapiens
gacctgcctcctgcctgcccctc

SEQ ID NO: 6204735 - DNA, 15 bp, Homo sapiens
gacctgcctcggcct

SEQ ID NO: 6204736 - DNA, 20 bp, Homo sapiens
gacctgcctctcacacacat

SEQ ID NO: 6204737 - DNA, 18 bp, Homo sapiens
gacctgcctcttccccct

SEQ ID NO: 6204738 - DNA, 12 bp, Homo sapiens
gacctgcctgta

SEQ ID NO: 6204739 - DNA, 15 bp, Homo sapiens
gacctgcctgtctcc

SEQ ID NO: 6204740 - DNA, 20 bp, Homo sapiens
gacctgcggctgctgtgtgc

SEQ ID NO: 6204741 - DNA, 16 bp, Homo sapiens
gacctgcgggtcctca

SEQ ID NO: 6204742 - DNA, 18 bp, Homo sapiens
gacctgctaggccagagc

SEQ ID NO: 6204743 - DNA, 12 bp, Homo sapiens
gacctgctcagg

SEQ ID NO: 6204744 - DNA, 20 bp, Homo sapiens
gacctgctcatcatattcca

SEQ ID NO: 6204745 - DNA, 11 bp, Homo sapiens
gacctgctcca

SEQ ID NO: 6204746 - DNA, 19 bp, Homo sapiens
gacctgctccgctgctcct

SEQ ID NO: 6204747 - DNA, 18 bp, Homo sapiens
gacctgctcctgcccacg

SEQ ID NO: 6204748 - DNA, 12 bp, Homo sapiens
gacctgctctgg

SEQ ID NO: 6204749 - DNA, 15 bp, Homo sapiens
gacctgctgaattgt

SEQ ID NO: 6204750 - DNA, 15 bp, Homo sapiens
gacctgctgacatag

SEQ ID NO: 6204751 - DNA, 18 bp, Homo sapiens
gacctgctgagctctgag

SEQ ID NO: 6204752 - DNA, 19 bp, Homo sapiens
gacctgctgagctctgaga

SEQ ID NO: 6204753 - DNA, 14 bp, Homo sapiens
cttgtcagagctgg

SEQ ID NO: 6204754 - DNA, 13 bp, Homo sapiens
cttgtcagcaaga

SEQ ID NO: 6204755 - DNA, 13 bp, Homo sapiens
cttgtcaggaccc

SEQ ID NO: 6204756 - DNA, 17 bp, Homo sapiens
cttgtcaggagtgtgtg

SEQ ID NO: 6204757 - DNA, 20 bp, Homo sapiens
cttgtcagggtctccttcct

SEQ ID NO: 6204758 - DNA, 22 bp, Homo sapiens
cttgtcagtgtagacacaggtc

SEQ ID NO: 6204759 - DNA, 22 bp, Homo sapiens
cttgtcataaaatgcatactgt

SEQ ID NO: 6204760 - DNA, 19 bp, Homo sapiens
cttgtcatatcactaaata

SEQ ID NO: 6204761 - DNA, 17 bp, Homo sapiens
cttgtcatatgtgttga

SEQ ID NO: 6204762 - DNA, 15 bp, Homo sapiens
cttgtcatccacaca

SEQ ID NO: 6204763 - DNA, 23 bp, Homo sapiens
cttgtcatccataaagcaagctc

SEQ ID NO: 6204764 - DNA, 14 bp, Homo sapiens
cttgtcatgtgaca

SEQ ID NO: 6204765 - DNA, 14 bp, Homo sapiens
cttgtcatgtgtat

SEQ ID NO: 6204766 - DNA, 16 bp, Homo sapiens
cttgtcatgtgtataa

SEQ ID NO: 6204767 - DNA, 17 bp, Homo sapiens
cttgtcatgtgtataaa

SEQ ID NO: 6204768 - DNA, 14 bp, Homo sapiens
cttgtcattccaga

SEQ ID NO: 6204769 - DNA, 15 bp, Homo sapiens
cttgtcattccagag

SEQ ID NO: 6204770 - DNA, 15 bp, Homo sapiens
cttgtcattctcatc

SEQ ID NO: 6204771 - DNA, 16 bp, Homo sapiens
cttgtcattctcatcc

SEQ ID NO: 6204772 - DNA, 15 bp, Homo sapiens
cttgtcattgagcct

SEQ ID NO: 6204773 - DNA, 21 bp, Homo sapiens
cttgtcattgagcctggcaat

SEQ ID NO: 6204774 - DNA, 15 bp, Homo sapiens
cttgtcattgccttc

SEQ ID NO: 6204775 - DNA, 21 bp, Homo sapiens
cttgtccaaagctgaaaatgt

SEQ ID NO: 6204776 - DNA, 23 bp, Homo sapiens
cttgtccaattaatgaagttgat

SEQ ID NO: 6204777 - DNA, 19 bp, Homo sapiens
cttgtccacagtctcccat

SEQ ID NO: 6204778 - DNA, 15 bp, Homo sapiens
cttgtccacccacct

SEQ ID NO: 6204779 - DNA, 17 bp, Homo sapiens
cttgtcccaattaaaat

SEQ ID NO: 6204780 - DNA, 18 bp, Homo sapiens
cttgtcccaattaaaata

SEQ ID NO: 6204781 - DNA, 21 bp, Homo sapiens
cttgtcccacgtgtcttccac

SEQ ID NO: 6204782 - DNA, 18 bp, Homo sapiens
cttgtcccactcaagcca

SEQ ID NO: 6204783 - DNA, 14 bp, Homo sapiens
cttgtcccagccag

SEQ ID NO: 6204784 - DNA, 13 bp, Homo sapiens
cttgtccccacac

SEQ ID NO: 6204785 - DNA, 20 bp, Homo sapiens
cttgtcccctcctcactccc

SEQ ID NO: 6204786 - DNA, 17 bp, Homo sapiens
cttgtcccctgcctgtg

SEQ ID NO: 6204787 - DNA, 22 bp, Homo sapiens
cttgtccctcagcaacatccca

SEQ ID NO: 6204788 - DNA, 16 bp, Homo sapiens
cttgtccctccaactg

SEQ ID NO: 6204789 - DNA, 12 bp, Homo sapiens
cttgtccctggg

SEQ ID NO: 6204790 - DNA, 13 bp, Homo sapiens
cttgtccctgggg

SEQ ID NO: 6204791 - DNA, 15 bp, Homo sapiens
cttgtccctggggca

SEQ ID NO: 6204792 - DNA, 17 bp, Homo sapiens
cttgtccctggggcact

SEQ ID NO: 6204793 - DNA, 18 bp, Homo sapiens
cttgtccctggggcactc

SEQ ID NO: 6204794 - DNA, 22 bp, Homo sapiens
cttgtccctggggcactccccc

SEQ ID NO: 6204795 - DNA, 12 bp, Homo sapiens
cttgtcccttgg

SEQ ID NO: 6204796 - DNA, 14 bp, Homo sapiens
cttgtccctttccc

SEQ ID NO: 6204797 - DNA, 21 bp, Homo sapiens
cttgtccctttccctaccttt

SEQ ID NO: 6204798 - DNA, 15 bp, Homo sapiens
cttgtcctcagccag

SEQ ID NO: 6204799 - DNA, 16 bp, Homo sapiens
cttgtcctcagccagt

SEQ ID NO: 6204800 - DNA, 13 bp, Homo sapiens
cttgtcctctcag

SEQ ID NO: 6204801 - DNA, 20 bp, Homo sapiens
cttgtcctctcagagcctca

SEQ ID NO: 6204802 - DNA, 16 bp, Homo sapiens
cttgtcctcttctgct

SEQ ID NO: 6204803 - DNA, 22 bp, Homo sapiens
cttgtcctcttctgctcttttc

SEQ ID NO: 6204804 - DNA, 14 bp, Homo sapiens
cttgtcctgaagcc

SEQ ID NO: 6204805 - DNA, 22 bp, Homo sapiens
cttgtcctgctcagatgctggt

SEQ ID NO: 6204806 - DNA, 15 bp, Homo sapiens
cttgtcctgctctct

SEQ ID NO: 6204807 - DNA, 21 bp, Homo sapiens
cttgtcctgctctcttcagga

SEQ ID NO: 6204808 - DNA, 16 bp, Homo sapiens
cttgtcctggcccttc

SEQ ID NO: 6204809 - DNA, 17 bp, Homo sapiens
cttgtcctggcccttca

SEQ ID NO: 6204810 - DNA, 12 bp, Homo sapiens
cttgtcctgtgc

SEQ ID NO: 6204811 - DNA, 17 bp, Homo sapiens
cttgtcctgtgcttgct

SEQ ID NO: 6204812 - DNA, 16 bp, Homo sapiens
cttgtccttagcctgg

SEQ ID NO: 6204813 - DNA, 20 bp, Homo sapiens
cttgtccttagcctggacct

SEQ ID NO: 6204814 - DNA, 23 bp, Homo sapiens
cttgtccttgctcctggaacctg

SEQ ID NO: 6204815 - DNA, 20 bp, Homo sapiens
cttgtcctttctctctaatt

SEQ ID NO: 6204816 - DNA, 23 bp, Homo sapiens
cttgtccttttgtaccatggtgt

SEQ ID NO: 6204817 - DNA, 19 bp, Homo sapiens
cttgtcgcgcgtctcccat

SEQ ID NO: 6204818 - DNA, 20 bp, Homo sapiens
cttgtcgcgcgtctcccatc

SEQ ID NO: 6204819 - DNA, 15 bp, Homo sapiens
cttgtcggccccacc

SEQ ID NO: 6204820 - DNA, 20 bp, Homo sapiens
cttgtcggccccaccagtgc

SEQ ID NO: 6204821 - DNA, 21 bp, Homo sapiens
cttgtcggccccaccagtgcc

SEQ ID NO: 6204822 - DNA, 14 bp, Homo sapiens
cttgtcggctccag

SEQ ID NO: 6204823 - DNA, 23 bp, Homo sapiens
cttgtcgtttgtgaacgctgtga

SEQ ID NO: 6204824 - DNA, 17 bp, Homo sapiens
cttgtctaaccccaggt

SEQ ID NO: 6204825 - DNA, 23 bp, Homo sapiens
cttgtctaaccccaggttttctg

SEQ ID NO: 6204826 - DNA, 18 bp, Homo sapiens
cttgtctagtttcccaca

SEQ ID NO: 6204827 - DNA, 16 bp, Homo sapiens
cttgtctataaagcat

SEQ ID NO: 6204828 - DNA, 17 bp, Homo sapiens
cttgtctataaagcatt

SEQ ID NO: 6204829 - DNA, 20 bp, Homo sapiens
cttgtctataaagcatttaa

SEQ ID NO: 6204830 - DNA, 17 bp, Homo sapiens
cttgtctatttttgtct

SEQ ID NO: 6204831 - DNA, 16 bp, Homo sapiens
cttgtctcaatgctca

SEQ ID NO: 6204832 - DNA, 17 bp, Homo sapiens
cttgtctcaatgctcat

SEQ ID NO: 6204833 - DNA, 19 bp, Homo sapiens
cttgtctcaatgctcataa

SEQ ID NO: 6204834 - DNA, 17 bp, Homo sapiens
cttgtctcagattttat

SEQ ID NO: 6204835 - DNA, 19 bp, Homo sapiens
cttgtctcattttaatgta

SEQ ID NO: 6204836 - DNA, 16 bp, Homo sapiens
cttgtctccctggttg

SEQ ID NO: 6204837 - DNA, 20 bp, Homo sapiens
cttgtctcctactcctgact

SEQ ID NO: 6204838 - DNA, 15 bp, Homo sapiens
cttgtctcctttctg

SEQ ID NO: 6204839 - DNA, 18 bp, Homo sapiens
cttgtctctcactgcatt

SEQ ID NO: 6204840 - DNA, 22 bp, Homo sapiens
cttgtctctcattctctttctt

SEQ ID NO: 6204841 - DNA, 14 bp, Homo sapiens
cttgtctctgaggc

SEQ ID NO: 6204842 - DNA, 14 bp, Homo sapiens
cttgtctctgggct

SEQ ID NO: 6204843 - DNA, 19 bp, Homo sapiens
cttgtctcttcatctaata

SEQ ID NO: 6204844 - DNA, 16 bp, Homo sapiens
cttgtctcttcctctg

SEQ ID NO: 6204845 - DNA, 22 bp, Homo sapiens
cttgtctgaatgtatttatgtg

SEQ ID NO: 6204846 - DNA, 17 bp, Homo sapiens
cttgtctgaggcctcat

SEQ ID NO: 6204847 - DNA, 19 bp, Homo sapiens
cttgtctgaggcctcatcc

SEQ ID NO: 6204848 - DNA, 11 bp, Homo sapiens
cttgtctgcct

SEQ ID NO: 6204849 - DNA, 17 bp, Homo sapiens
cttgtctgcctcctgct

SEQ ID NO: 6204850 - DNA, 19 bp, Homo sapiens
cttgtctgcctcctgcttt

SEQ ID NO: 6204851 - DNA, 20 bp, Homo sapiens
cttgtctgcctcctgctttg

SEQ ID NO: 6204852 - DNA, 22 bp, Homo sapiens
cttgtctgcctcctgctttggg

SEQ ID NO: 6204853 - DNA, 12 bp, Homo sapiens
cttgtctggctt

SEQ ID NO: 6204854 - DNA, 21 bp, Homo sapiens
cttgtctgggtgcagctgggc

SEQ ID NO: 6204855 - DNA, 13 bp, Homo sapiens
cttgtctgtagat

SEQ ID NO: 6204856 - DNA, 21 bp, Homo sapiens
cttgtctgtagcgtctgtata

SEQ ID NO: 6204857 - DNA, 23 bp, Homo sapiens
cttgtctgtcaaatgtttcctta

SEQ ID NO: 6204858 - DNA, 12 bp, Homo sapiens
cttgtctgtgat

SEQ ID NO: 6204859 - DNA, 11 bp, Homo sapiens
cttgtcttaaa

SEQ ID NO: 6204860 - DNA, 18 bp, Homo sapiens
cttgtcttaaataaaaga

SEQ ID NO: 6204861 - DNA, 17 bp, Homo sapiens
cttgtcttagctctgga

SEQ ID NO: 6204862 - DNA, 15 bp, Homo sapiens
cttgtcttcccccct

SEQ ID NO: 6204863 - DNA, 20 bp, Homo sapiens
cttgtcttcccccctctcct

SEQ ID NO: 6204864 - DNA, 24 bp, Homo sapiens
cttgtcttcccccctctcctccca

SEQ ID NO: 6204865 - DNA, 21 bp, Homo sapiens
cttgtcttctggtactttctg

SEQ ID NO: 6204866 - DNA, 23 bp, Homo sapiens
cttgtcttctggtactttctgtt

SEQ ID NO: 6204867 - DNA, 15 bp, Homo sapiens
cttgtcttgaaaact

SEQ ID NO: 6204868 - DNA, 15 bp, Homo sapiens
cttgtctttctgggg

SEQ ID NO: 6204869 - DNA, 21 bp, Homo sapiens
cttgtctttgtccctgttggt

SEQ ID NO: 6204870 - DNA, 20 bp, Homo sapiens
cttgtcttttcccctcattg

SEQ ID NO: 6204871 - DNA, 16 bp, Homo sapiens
cttgtcttttctgctg

SEQ ID NO: 6204872 - DNA, 16 bp, Homo sapiens
cttgtcttttgagcta

SEQ ID NO: 6204873 - DNA, 19 bp, Homo sapiens
cttgtgaaaaaataaagaa

SEQ ID NO: 6204874 - DNA, 13 bp, Homo sapiens
cttgtgaaaatgt

SEQ ID NO: 6204875 - DNA, 16 bp, Homo sapiens
cttgtgaaaatgtgtt

SEQ ID NO: 6204876 - DNA, 17 bp, Homo sapiens
cttgtgaaacgtctgga

SEQ ID NO: 6204877 - DNA, 16 bp, Homo sapiens
cttgtgaaagtgtaat

SEQ ID NO: 6204878 - DNA, 14 bp, Homo sapiens
cttgtgaaattgtg

SEQ ID NO: 6204879 - DNA, 23 bp, Homo sapiens
cttgtgaaattgtgtagagtgtt

SEQ ID NO: 6204880 - DNA, 13 bp, Homo sapiens
cttgtgaacatgc

SEQ ID NO: 6204881 - DNA, 17 bp, Homo sapiens
cttgtgaacatgcctta

SEQ ID NO: 6204882 - DNA, 18 bp, Homo sapiens
cttgtgaactccatcatt

SEQ ID NO: 6204883 - DNA, 13 bp, Homo sapiens
cttgtgaactttg

SEQ ID NO: 6204884 - DNA, 10 bp, Homo sapiens
cttgtgaagg

SEQ ID NO: 6204885 - DNA, 15 bp, Homo sapiens
cttgtgaaggaaaaa

SEQ ID NO: 6204886 - DNA, 20 bp, Homo sapiens
cttgtgaaggccatgatatt

SEQ ID NO: 6204887 - DNA, 19 bp, Homo sapiens
cttgtgaatcaagggtcag

SEQ ID NO: 6204888 - DNA, 22 bp, Homo sapiens
cttgtgaatcaagggtcaggcc

SEQ ID NO: 6204889 - DNA, 20 bp, Homo sapiens
cttgtgaatcttaacatttt

SEQ ID NO: 6204890 - DNA, 19 bp, Homo sapiens
cttgtgaatgcttctcact

SEQ ID NO: 6204891 - DNA, 20 bp, Homo sapiens
cttgtgaattcccagactct

SEQ ID NO: 6204892 - DNA, 21 bp, Homo sapiens
cttgtgacatattatgtcttc

SEQ ID NO: 6204893 - DNA, 22 bp, Homo sapiens
cttgtgacgtcgggcattcata

SEQ ID NO: 6204894 - DNA, 18 bp, Homo sapiens
cttgtgacgtgcactgtg

SEQ ID NO: 6204895 - DNA, 15 bp, Homo sapiens
cttgtgactaagttg

SEQ ID NO: 6204896 - DNA, 22 bp, Homo sapiens
cttgtgactagtgctgaagctt

SEQ ID NO: 6204897 - DNA, 12 bp, Homo sapiens
cttgtgactgaa

SEQ ID NO: 6204898 - DNA, 14 bp, Homo sapiens
cttgtgactgaagg

SEQ ID NO: 6204899 - DNA, 15 bp, Homo sapiens
cttgtgactgaaggg

SEQ ID NO: 6204900 - DNA, 21 bp, Homo sapiens
cttgtgacttacagtgccaac

SEQ ID NO: 6204901 - DNA, 12 bp, Homo sapiens
cttgtgactttt

SEQ ID NO: 6204902 - DNA, 22 bp, Homo sapiens
cttgtgacttttgctttaattc

SEQ ID NO: 6204903 - DNA, 15 bp, Homo sapiens
cttgtgagagcccat

SEQ ID NO: 6204904 - DNA, 15 bp, Homo sapiens
cttgtgagagctggt

SEQ ID NO: 6204905 - DNA, 15 bp, Homo sapiens
cttgtgagcatcaga

SEQ ID NO: 6204906 - DNA, 16 bp, Homo sapiens
cttgtgaggaaagtca

SEQ ID NO: 6204907 - DNA, 19 bp, Homo sapiens
cttgtgaggaaagtcattg

SEQ ID NO: 6204908 - DNA, 22 bp, Homo sapiens
cttgtgaggcccgaggcagaag

SEQ ID NO: 6204909 - DNA, 23 bp, Homo sapiens
cttgtgatccactcgcctcagcc

SEQ ID NO: 6204910 - DNA, 20 bp, Homo sapiens
cttgtgatcctttggggctt

SEQ ID NO: 6204911 - DNA, 15 bp, Homo sapiens
cttgtgatctgggaa

SEQ ID NO: 6204912 - DNA, 20 bp, Homo sapiens
cttgtgatgtcatacagaga

SEQ ID NO: 6204913 - DNA, 21 bp, Homo sapiens
cttgtgatgtcatacagagaa

SEQ ID NO: 6204914 - DNA, 20 bp, Homo sapiens
cttgtgatgtttgctcagag

SEQ ID NO: 6204915 - DNA, 15 bp, Homo sapiens
cttgtgattctggga

SEQ ID NO: 6204916 - DNA, 19 bp, Homo sapiens
cttgtgattctgggatgga

SEQ ID NO: 6204917 - DNA, 18 bp, Homo sapiens
cttgtgattgctgccata

SEQ ID NO: 6204918 - DNA, 17 bp, Homo sapiens
cttgtgattggctgcag

SEQ ID NO: 6204919 - DNA, 21 bp, Homo sapiens
cttgtgcaaaatatttgacta

SEQ ID NO: 6204920 - DNA, 19 bp, Homo sapiens
cttgtgcaaggtggccttt

SEQ ID NO: 6204921 - DNA, 15 bp, Homo sapiens
cttgtgcacaggcag

SEQ ID NO: 6204922 - DNA, 12 bp, Homo sapiens
cttgtgcactta

SEQ ID NO: 6204923 - DNA, 17 bp, Homo sapiens
cttgtgcagaaaacatt

SEQ ID NO: 6204924 - DNA, 19 bp, Homo sapiens
cttgtgcagaaaacattgt

SEQ ID NO: 6204925 - DNA, 23 bp, Homo sapiens
cttgtgcagacgccacagtctcc

SEQ ID NO: 6204926 - DNA, 15 bp, Homo sapiens
cttgtgcagtgttga

SEQ ID NO: 6204927 - DNA, 22 bp, Homo sapiens
cttgtgcataattcttccaaag

SEQ ID NO: 6204928 - DNA, 13 bp, Homo sapiens
cttgtgcatgcaa

SEQ ID NO: 6204929 - DNA, 14 bp, Homo sapiens
cttgtgcatgcaaa

SEQ ID NO: 6204930 - DNA, 15 bp, Homo sapiens
cttgtgcatgcaaaa

SEQ ID NO: 6204931 - DNA, 19 bp, Homo sapiens
gacctgctgagggaccagc

SEQ ID NO: 6204932 - DNA, 20 bp, Homo sapiens
gacctgctgagggaccagcc

SEQ ID NO: 6204933 - DNA, 21 bp, Homo sapiens
gacctgctgagggaccagcca

SEQ ID NO: 6204934 - DNA, 17 bp, Homo sapiens
gacctgctgctcagtaa

SEQ ID NO: 6204935 - DNA, 15 bp, Homo sapiens
gacctgctgtttcct

SEQ ID NO: 6204936 - DNA, 17 bp, Homo sapiens
gacctgcttagctgcct

SEQ ID NO: 6204937 - DNA, 18 bp, Homo sapiens
gacctgcttcctgaaata

SEQ ID NO: 6204938 - DNA, 23 bp, Homo sapiens
gacctgcttcctgaaataaacac

SEQ ID NO: 6204939 - DNA, 11 bp, Homo sapiens
gacctggacaa

SEQ ID NO: 6204940 - DNA, 23 bp, Homo sapiens
gacctggacgtcttcaagaactt

SEQ ID NO: 6204941 - DNA, 19 bp, Homo sapiens
gacctggactagggcctcg

SEQ ID NO: 6204942 - DNA, 18 bp, Homo sapiens
gacctggagctgccagca

SEQ ID NO: 6204943 - DNA, 19 bp, Homo sapiens
gacctggagctgccagcac

SEQ ID NO: 6204944 - DNA, 11 bp, Homo sapiens
gacctggaggg

SEQ ID NO: 6204945 - DNA, 17 bp, Homo sapiens
gacctggaggggagagg

SEQ ID NO: 6204946 - DNA, 22 bp, Homo sapiens
gacctggcactggatgcagaaa

SEQ ID NO: 6204947 - DNA, 20 bp, Homo sapiens
gacctggcatctaattctga

SEQ ID NO: 6204948 - DNA, 16 bp, Homo sapiens
gacctggccccaggct

SEQ ID NO: 6204949 - DNA, 20 bp, Homo sapiens
gacctggccccaggctgtca

SEQ ID NO: 6204950 - DNA, 16 bp, Homo sapiens
gacctggcctgtctgt

SEQ ID NO: 6204951 - DNA, 11 bp, Homo sapiens
gacctggcctt

SEQ ID NO: 6204952 - DNA, 18 bp, Homo sapiens
gacctggcggcaggaagc

SEQ ID NO: 6204953 - DNA, 14 bp, Homo sapiens
gacctggcgtgctc

SEQ ID NO: 6204954 - DNA, 16 bp, Homo sapiens
gacctggcgtgctcag

SEQ ID NO: 6204955 - DNA, 16 bp, Homo sapiens
gacctggctccactct

SEQ ID NO: 6204956 - DNA, 15 bp, Homo sapiens
gacctggctgcccct

SEQ ID NO: 6204957 - DNA, 16 bp, Homo sapiens
gacctggctgcccctc

SEQ ID NO: 6204958 - DNA, 18 bp, Homo sapiens
gacctgggaacgactgga

SEQ ID NO: 6204959 - DNA, 18 bp, Homo sapiens
gacctgggacaagcaggc

SEQ ID NO: 6204960 - DNA, 20 bp, Homo sapiens
gacctgggacaagcaggccg

SEQ ID NO: 6204961 - DNA, 16 bp, Homo sapiens
gacctgggcccacaga

SEQ ID NO: 6204962 - DNA, 18 bp, Homo sapiens
gacctgggcccacagagc

SEQ ID NO: 6204963 - DNA, 19 bp, Homo sapiens
gacctgggcccacagagcc

SEQ ID NO: 6204964 - DNA, 15 bp, Homo sapiens
gacctgggccctggt

SEQ ID NO: 6204965 - DNA, 13 bp, Homo sapiens
gacctggggcaca

SEQ ID NO: 6204966 - DNA, 20 bp, Homo sapiens
gacctggggcacagtccagg

SEQ ID NO: 6204967 - DNA, 19 bp, Homo sapiens
gacctggggctgctgtgaa

SEQ ID NO: 6204968 - DNA, 20 bp, Homo sapiens
gacctggggtcccccctccc

SEQ ID NO: 6204969 - DNA, 21 bp, Homo sapiens
gacctggggtcccccctccct

SEQ ID NO: 6204970 - DNA, 21 bp, Homo sapiens
gacctggggtggggaggcaga

SEQ ID NO: 6204971 - DNA, 19 bp, Homo sapiens
gacctggtctggtcaggca

SEQ ID NO: 6204972 - DNA, 20 bp, Homo sapiens
gacctggtctggtcaggcaa

SEQ ID NO: 6204973 - DNA, 17 bp, Homo sapiens
gacctggtgctgcctct

SEQ ID NO: 6204974 - DNA, 22 bp, Homo sapiens
gacctggtgctgcctctacctg

SEQ ID NO: 6204975 - DNA, 24 bp, Homo sapiens
gacctggtgtgcggaggcaggagc

SEQ ID NO: 6204976 - DNA, 17 bp, Homo sapiens
gacctggttgtccaggt

SEQ ID NO: 6204977 - DNA, 18 bp, Homo sapiens
gacctggttgtccaggtc

SEQ ID NO: 6204978 - DNA, 23 bp, Homo sapiens
gacctgtatatttgtaaagctat

SEQ ID NO: 6204979 - DNA, 21 bp, Homo sapiens
gacctgtatcaaactgctttt

SEQ ID NO: 6204980 - DNA, 16 bp, Homo sapiens
gacctgtcagaataaa

SEQ ID NO: 6204981 - DNA, 17 bp, Homo sapiens
gacctgtcatgcccccc

SEQ ID NO: 6204982 - DNA, 11 bp, Homo sapiens
gacctgtccag

SEQ ID NO: 6204983 - DNA, 12 bp, Homo sapiens
gacctgtccccc

SEQ ID NO: 6204984 - DNA, 20 bp, Homo sapiens
gacctgtcccccactctctc

SEQ ID NO: 6204985 - DNA, 19 bp, Homo sapiens
gacctgtcctcctggtggg

SEQ ID NO: 6204986 - DNA, 18 bp, Homo sapiens
gacctgtctccctggggt

SEQ ID NO: 6204987 - DNA, 13 bp, Homo sapiens
gacctgtcttcca

SEQ ID NO: 6204988 - DNA, 20 bp, Homo sapiens
gacctgtcttccaaggagac

SEQ ID NO: 6204989 - DNA, 12 bp, Homo sapiens
gacctgtgacca

SEQ ID NO: 6204990 - DNA, 14 bp, Homo sapiens
gacctgtgacctgg

SEQ ID NO: 6204991 - DNA, 15 bp, Homo sapiens
gacctgtgacctggt

SEQ ID NO: 6204992 - DNA, 19 bp, Homo sapiens
gacctgtgacctggtctgg

SEQ ID NO: 6204993 - DNA, 15 bp, Homo sapiens
gacctgtgaggggaa

SEQ ID NO: 6204994 - DNA, 14 bp, Homo sapiens
gacctgtgcacacc

SEQ ID NO: 6204995 - DNA, 19 bp, Homo sapiens
gacctgtgctagttttaca

SEQ ID NO: 6204996 - DNA, 14 bp, Homo sapiens
gacctgtggtgcaa

SEQ ID NO: 6204997 - DNA, 14 bp, Homo sapiens
gacctgtgtgaact

SEQ ID NO: 6204998 - DNA, 23 bp, Homo sapiens
gacctgttaggtctcatgcccac

SEQ ID NO: 6204999 - DNA, 23 bp, Homo sapiens
gacctgttctttccatctttaga

SEQ ID NO: 6205000 - DNA, 18 bp, Homo sapiens
gacctgttgccagcagat

SEQ ID NO: 6205001 - DNA, 15 bp, Homo sapiens
gacctgttggcctgt

SEQ ID NO: 6205002 - DNA, 22 bp, Homo sapiens
gacctgttggcctgtgggcctc

SEQ ID NO: 6205003 - DNA, 15 bp, Homo sapiens
gacctgttggttcca

SEQ ID NO: 6205004 - DNA, 19 bp, Homo sapiens
gacctgttggttccaagcc

SEQ ID NO: 6205005 - DNA, 17 bp, Homo sapiens
gaccttaagacactgtg

SEQ ID NO: 6205006 - DNA, 18 bp, Homo sapiens
gaccttaagacactgtga

SEQ ID NO: 6205007 - DNA, 18 bp, Homo sapiens
gaccttaaggaaaagtaa

SEQ ID NO: 6205008 - DNA, 22 bp, Homo sapiens
gaccttaataaaggcccccact

SEQ ID NO: 6205009 - DNA, 23 bp, Homo sapiens
gaccttaatttatattctccttc

SEQ ID NO: 6205010 - DNA, 14 bp, Homo sapiens
gaccttacaaatga

SEQ ID NO: 6205011 - DNA, 13 bp, Homo sapiens
gaccttagaaatc

SEQ ID NO: 6205012 - DNA, 20 bp, Homo sapiens
gaccttagtgtttctgtgca

SEQ ID NO: 6205013 - DNA, 21 bp, Homo sapiens
gaccttagtgtttctgtgcat

SEQ ID NO: 6205014 - DNA, 14 bp, Homo sapiens
gaccttatctgtgc

SEQ ID NO: 6205015 - DNA, 21 bp, Homo sapiens
gaccttcacagatgcctactt

SEQ ID NO: 6205016 - DNA, 22 bp, Homo sapiens
gaccttcacagggacagatctg

SEQ ID NO: 6205017 - DNA, 16 bp, Homo sapiens
gaccttcaccaaacat

SEQ ID NO: 6205018 - DNA, 19 bp, Homo sapiens
gaccttcagggagagctgg

SEQ ID NO: 6205019 - DNA, 20 bp, Homo sapiens
gaccttcagggagagctggg

SEQ ID NO: 6205020 - DNA, 17 bp, Homo sapiens
gaccttccaagagcctg

SEQ ID NO: 6205021 - DNA, 14 bp, Homo sapiens
gaccttccacaaag

SEQ ID NO: 6205022 - DNA, 22 bp, Homo sapiens
gaccttcctcatccaccccatc

SEQ ID NO: 6205023 - DNA, 17 bp, Homo sapiens
gaccttcctcgcagaga

SEQ ID NO: 6205024 - DNA, 21 bp, Homo sapiens
gaccttcctcgcagagaggcc

SEQ ID NO: 6205025 - DNA, 17 bp, Homo sapiens
gaccttcctctggggct

SEQ ID NO: 6205026 - DNA, 14 bp, Homo sapiens
gaccttcctgccac

SEQ ID NO: 6205027 - DNA, 19 bp, Homo sapiens
gaccttcctgccaccagtc

SEQ ID NO: 6205028 - DNA, 20 bp, Homo sapiens
gaccttcggcagtggctggg

SEQ ID NO: 6205029 - DNA, 19 bp, Homo sapiens
gaccttcgggctgtgcccg

SEQ ID NO: 6205030 - DNA, 19 bp, Homo sapiens
gaccttctagaattataag

SEQ ID NO: 6205031 - DNA, 19 bp, Homo sapiens
gaccttctccctagccctt

SEQ ID NO: 6205032 - DNA, 14 bp, Homo sapiens
gaccttctccttca

SEQ ID NO: 6205033 - DNA, 15 bp, Homo sapiens
gaccttctccttcac

SEQ ID NO: 6205034 - DNA, 21 bp, Homo sapiens
gaccttctccttcacctttgt

SEQ ID NO: 6205035 - DNA, 17 bp, Homo sapiens
gaccttctctccagagc

SEQ ID NO: 6205036 - DNA, 18 bp, Homo sapiens
gaccttctctccagagct

SEQ ID NO: 6205037 - DNA, 15 bp, Homo sapiens
gaccttctgaagatc

SEQ ID NO: 6205038 - DNA, 18 bp, Homo sapiens
gaccttctgaagatctca

SEQ ID NO: 6205039 - DNA, 18 bp, Homo sapiens
gaccttctggtatcttgt

SEQ ID NO: 6205040 - DNA, 19 bp, Homo sapiens
gaccttctgtcgtccccag

SEQ ID NO: 6205041 - DNA, 17 bp, Homo sapiens
gaccttgaactcctggg

SEQ ID NO: 6205042 - DNA, 19 bp, Homo sapiens
gaccttgagggtgggccag

SEQ ID NO: 6205043 - DNA, 14 bp, Homo sapiens
gaccttgattgcac

SEQ ID NO: 6205044 - DNA, 16 bp, Homo sapiens
gaccttgcctcccctc

SEQ ID NO: 6205045 - DNA, 12 bp, Homo sapiens
gaccttgcttcc

SEQ ID NO: 6205046 - DNA, 15 bp, Homo sapiens
gaccttggcctctcc

SEQ ID NO: 6205047 - DNA, 16 bp, Homo sapiens
gaccttggcctctcct

SEQ ID NO: 6205048 - DNA, 14 bp, Homo sapiens
gaccttggcgctct

SEQ ID NO: 6205049 - DNA, 22 bp, Homo sapiens
gaccttggcgctctcagctttc

SEQ ID NO: 6205050 - DNA, 18 bp, Homo sapiens
gaccttgggcacatctgc

SEQ ID NO: 6205051 - DNA, 13 bp, Homo sapiens
gaccttgggccaa

SEQ ID NO: 6205052 - DNA, 13 bp, Homo sapiens
gaccttgggccta

SEQ ID NO: 6205053 - DNA, 18 bp, Homo sapiens
gaccttggggtacaattg

SEQ ID NO: 6205054 - DNA, 14 bp, Homo sapiens
gaccttgggtcctg

SEQ ID NO: 6205055 - DNA, 16 bp, Homo sapiens
gaccttggtggtggga

SEQ ID NO: 6205056 - DNA, 18 bp, Homo sapiens
gaccttgtaaaagacagt

SEQ ID NO: 6205057 - DNA, 15 bp, Homo sapiens
gaccttgtaatgtaa

SEQ ID NO: 6205058 - DNA, 16 bp, Homo sapiens
gaccttgtgggaccag

SEQ ID NO: 6205059 - DNA, 21 bp, Homo sapiens
gacctttaagaaaaatgaaaa

SEQ ID NO: 6205060 - DNA, 22 bp, Homo sapiens
gacctttagtggtggccattta

SEQ ID NO: 6205061 - DNA, 17 bp, Homo sapiens
gacctttattcacccct

SEQ ID NO: 6205062 - DNA, 15 bp, Homo sapiens
gacctttatttatta

SEQ ID NO: 6205063 - DNA, 20 bp, Homo sapiens
gacctttcaataggaaaaac

SEQ ID NO: 6205064 - DNA, 17 bp, Homo sapiens
gacctttcagctgtgaa

SEQ ID NO: 6205065 - DNA, 19 bp, Homo sapiens
gacctttcctctcctgggt

SEQ ID NO: 6205066 - DNA, 15 bp, Homo sapiens
gacctttgcccacac

SEQ ID NO: 6205067 - DNA, 21 bp, Homo sapiens
gacctttgtcatctttcttct

SEQ ID NO: 6205068 - DNA, 19 bp, Homo sapiens
gacctttgtctgaaggatt

SEQ ID NO: 6205069 - DNA, 18 bp, Homo sapiens
gacctttgtcttctataa

SEQ ID NO: 6205070 - DNA, 16 bp, Homo sapiens
gaccttttcccttgct

SEQ ID NO: 6205071 - DNA, 15 bp, Homo sapiens
gaccttttcttcatt

SEQ ID NO: 6205072 - DNA, 17 bp, Homo sapiens
gaccttttgggggaggg

SEQ ID NO: 6205073 - DNA, 19 bp, Homo sapiens
gacctttttaatccaggcc

SEQ ID NO: 6205074 - DNA, 20 bp, Homo sapiens
gacctttttaatccaggccc

SEQ ID NO: 6205075 - DNA, 18 bp, Homo sapiens
gaccttttttttttttcc

SEQ ID NO: 6205076 - DNA, 12 bp, Homo sapiens
gacgaactggct

SEQ ID NO: 6205077 - DNA, 14 bp, Homo sapiens
gacgaacttccatg

SEQ ID NO: 6205078 - DNA, 21 bp, Homo sapiens
gacgaagcggagagagccaag

SEQ ID NO: 6205079 - DNA, 17 bp, Homo sapiens
gacgaagtgtaaactaa

SEQ ID NO: 6205080 - DNA, 14 bp, Homo sapiens
gacgaatatgaatg

SEQ ID NO: 6205081 - DNA, 21 bp, Homo sapiens
gacgaatatgaatgtcacatt

SEQ ID NO: 6205082 - DNA, 22 bp, Homo sapiens
gacgaatgcatattcaacacac

SEQ ID NO: 6205083 - DNA, 22 bp, Homo sapiens
gacgacacggtcggggcatctg

SEQ ID NO: 6205084 - DNA, 15 bp, Homo sapiens
gacgacgaatcttct

SEQ ID NO: 6205085 - DNA, 20 bp, Homo sapiens
gacgacgcgagggccccacg

SEQ ID NO: 6205086 - DNA, 18 bp, Homo sapiens
gacgactttctttaacat

SEQ ID NO: 6205087 - DNA, 11 bp, Homo sapiens
gacgagacccc

SEQ ID NO: 6205088 - DNA, 14 bp, Homo sapiens
gacgagacccccat

SEQ ID NO: 6205089 - DNA, 15 bp, Homo sapiens
gacgagactcctcgg

SEQ ID NO: 6205090 - DNA, 12 bp, Homo sapiens
gacgagagggct

SEQ ID NO: 6205091 - DNA, 15 bp, Homo sapiens
gacgagcatccccct

SEQ ID NO: 6205092 - DNA, 22 bp, Homo sapiens
gacgagcatccccctcctctcc

SEQ ID NO: 6205093 - DNA, 20 bp, Homo sapiens
gacgaggccaagctgaggag

SEQ ID NO: 6205094 - DNA, 20 bp, Homo sapiens
gacgaggcctttgctttaca

SEQ ID NO: 6205095 - DNA, 14 bp, Homo sapiens
gacgaggctgggcc

SEQ ID NO: 6205096 - DNA, 16 bp, Homo sapiens
gacgagggagtgtctg

SEQ ID NO: 6205097 - DNA, 16 bp, Homo sapiens
gacgagggccaggcac

SEQ ID NO: 6205098 - DNA, 21 bp, Homo sapiens
gacgaggggcagggaaggaca

SEQ ID NO: 6205099 - DNA, 20 bp, Homo sapiens
gacgagtgagctaccaggaa

SEQ ID NO: 6205100 - DNA, 15 bp, Homo sapiens
gacgagttgatttcc

SEQ ID NO: 6205101 - DNA, 23 bp, Homo sapiens
gacgatatttaattcacctcagc

SEQ ID NO: 6205102 - DNA, 15 bp, Homo sapiens
gacgatgggtgttgc

SEQ ID NO: 6205103 - DNA, 23 bp, Homo sapiens
gacgatgtgttgaccggctgccg

SEQ ID NO: 6205104 - DNA, 18 bp, Homo sapiens
gacgatgtttatgttctt

SEQ ID NO: 6205105 - DNA, 14 bp, Homo sapiens
gacgattatttatt

SEQ ID NO: 6205106 - DNA, 15 bp, Homo sapiens
gacgattatttattt

SEQ ID NO: 6205107 - DNA, 19 bp, Homo sapiens
gacgattatttatttctgt

SEQ ID NO: 6205108 - DNA, 15 bp, Homo sapiens
gacgattccttctct

SEQ ID NO: 6205109 - DNA, 16 bp, Homo sapiens
gacgcaagggagaaga

SEQ ID NO: 6205110 - DNA, 17 bp, Homo sapiens
gacgcacagcactgcct

SEQ ID NO: 6205111 - DNA, 19 bp, Homo sapiens
gacgcaccactgccaatgc

SEQ ID NO: 6205112 - DNA, 14 bp, Homo sapiens
gacgcaccagccca

SEQ ID NO: 6205113 - DNA, 22 bp, Homo sapiens
gacgcaccgcctgaaggcacag

SEQ ID NO: 6205114 - DNA, 17 bp, Homo sapiens
gacgcacgctcgctgcc

SEQ ID NO: 6205115 - DNA, 20 bp, Homo sapiens
gacgcacgctcgctgccatc

SEQ ID NO: 6205116 - DNA, 17 bp, Homo sapiens
gacgcagccccccacgc

SEQ ID NO: 6205117 - DNA, 22 bp, Homo sapiens
gacgcagccccccacgcttctg

SEQ ID NO: 6205118 - DNA, 21 bp, Homo sapiens
gacgcagccctgggggccagc

SEQ ID NO: 6205119 - DNA, 23 bp, Homo sapiens
gacgcagccctgggggccagctg

SEQ ID NO: 6205120 - DNA, 12 bp, Homo sapiens
gacgcagcctga

SEQ ID NO: 6205121 - DNA, 12 bp, Homo sapiens
gacgcaggcccc

SEQ ID NO: 6205122 - DNA, 16 bp, Homo sapiens
gacgcaggcccctctc

SEQ ID NO: 6205123 - DNA, 17 bp, Homo sapiens
gacgcaggcccctctcc

SEQ ID NO: 6205124 - DNA, 19 bp, Homo sapiens
gacgcaggcccctctcctc

SEQ ID NO: 6205125 - DNA, 18 bp, Homo sapiens
gacgcaggccctgtccag

SEQ ID NO: 6205126 - DNA, 21 bp, Homo sapiens
gacgcagggagaccctgggag

SEQ ID NO: 6205127 - DNA, 16 bp, Homo sapiens
gacgcatagactgagg

SEQ ID NO: 6205128 - DNA, 17 bp, Homo sapiens
gacgcattttggttttt

SEQ ID NO: 6205129 - DNA, 14 bp, Homo sapiens
gacgccaacttctc

SEQ ID NO: 6205130 - DNA, 15 bp, Homo sapiens
gacgccacagcccag

SEQ ID NO: 6205131 - DNA, 15 bp, Homo sapiens
gacgccaccattcct

SEQ ID NO: 6205132 - DNA, 12 bp, Homo sapiens
gacgccacccag

SEQ ID NO: 6205133 - DNA, 13 bp, Homo sapiens
gacgccacccagc

SEQ ID NO: 6205134 - DNA, 16 bp, Homo sapiens
gacgccacctggcggc

SEQ ID NO: 6205135 - DNA, 18 bp, Homo sapiens
gacgccacggagggctgg

SEQ ID NO: 6205136 - DNA, 19 bp, Homo sapiens
gacgccactcatttcatct

SEQ ID NO: 6205137 - DNA, 17 bp, Homo sapiens
gacgccactccctggga

SEQ ID NO: 6205138 - DNA, 19 bp, Homo sapiens
gacgccaggcaccacagcc

SEQ ID NO: 6205139 - DNA, 20 bp, Homo sapiens
gacgccaggcaccacagcct

SEQ ID NO: 6205140 - DNA, 22 bp, Homo sapiens
gacgccaggcaccacagcctcc

SEQ ID NO: 6205141 - DNA, 12 bp, Homo sapiens
gacgccatccca

SEQ ID NO: 6205142 - DNA, 13 bp, Homo sapiens
gacgccatcccag

SEQ ID NO: 6205143 - DNA, 15 bp, Homo sapiens
gacgccatcccagcc

SEQ ID NO: 6205144 - DNA, 17 bp, Homo sapiens
gacgccatcccagcccc

SEQ ID NO: 6205145 - DNA, 19 bp, Homo sapiens
gacgccatcccagccccaa

SEQ ID NO: 6205146 - DNA, 21 bp, Homo sapiens
gacgccatcccagccccaatg

SEQ ID NO: 6205147 - DNA, 11 bp, Homo sapiens
gacgcccacct

SEQ ID NO: 6205148 - DNA, 12 bp, Homo sapiens
gacgcccagccc

SEQ ID NO: 6205149 - DNA, 13 bp, Homo sapiens
gacgcccagcccc

SEQ ID NO: 6205150 - DNA, 14 bp, Homo sapiens
gacgcccagcccca

SEQ ID NO: 6205151 - DNA, 20 bp, Homo sapiens
gacgcccagccccatccctg

SEQ ID NO: 6205152 - DNA, 16 bp, Homo sapiens
gacgcccagcccccac

SEQ ID NO: 6205153 - DNA, 23 bp, Homo sapiens
gacgcccagcccccacccccgtc

SEQ ID NO: 6205154 - DNA, 22 bp, Homo sapiens
gacgcccccgcccgcacagctc

SEQ ID NO: 6205155 - DNA, 12 bp, Homo sapiens
gacgcccctccg

SEQ ID NO: 6205156 - DNA, 16 bp, Homo sapiens
gacgcccctccgggca

SEQ ID NO: 6205157 - DNA, 23 bp, Homo sapiens
gacgccctatttctatgtcattt

SEQ ID NO: 6205158 - DNA, 18 bp, Homo sapiens
gacgccctctccccaccc

SEQ ID NO: 6205159 - DNA, 20 bp, Homo sapiens
gacgccgagggcagccccga

SEQ ID NO: 6205160 - DNA, 18 bp, Homo sapiens
gacgcctgagacagcacc

SEQ ID NO: 6205161 - DNA, 13 bp, Homo sapiens
gacgcctgaggaa

SEQ ID NO: 6205162 - DNA, 14 bp, Homo sapiens
gacgcctgaggaac

SEQ ID NO: 6205163 - DNA, 12 bp, Homo sapiens
gacgcctgcagg

SEQ ID NO: 6205164 - DNA, 18 bp, Homo sapiens
gacgcctgccctgcccag

SEQ ID NO: 6205165 - DNA, 16 bp, Homo sapiens
gacgcctggctgctga

SEQ ID NO: 6205166 - DNA, 21 bp, Homo sapiens
gacgcctgtgccaccccttcc

SEQ ID NO: 6205167 - DNA, 20 bp, Homo sapiens
gacgccttcatctgggacaa

SEQ ID NO: 6205168 - DNA, 16 bp, Homo sapiens
gacgccttccaggtca

SEQ ID NO: 6205169 - DNA, 16 bp, Homo sapiens
gacgcgaggggaaagg

SEQ ID NO: 6205170 - DNA, 14 bp, Homo sapiens
gacgcgcacacaca

SEQ ID NO: 6205171 - DNA, 13 bp, Homo sapiens
gacgcggaggagg

SEQ ID NO: 6205172 - DNA, 14 bp, Homo sapiens
gacgcgtctcctgt

SEQ ID NO: 6205173 - DNA, 15 bp, Homo sapiens
gacgcgtctcctgtt

SEQ ID NO: 6205174 - DNA, 18 bp, Homo sapiens
gacgctacccgggaaggg

SEQ ID NO: 6205175 - DNA, 19 bp, Homo sapiens
gacgctcagccccaggcca

SEQ ID NO: 6205176 - DNA, 12 bp, Homo sapiens
gacgctctctct

SEQ ID NO: 6205177 - DNA, 17 bp, Homo sapiens
gacgctgaccgtggagc

SEQ ID NO: 6205178 - DNA, 22 bp, Homo sapiens
gacgctgccgggagactgccag

SEQ ID NO: 6205179 - DNA, 19 bp, Homo sapiens
gacgctggagaccctgcgc

SEQ ID NO: 6205180 - DNA, 16 bp, Homo sapiens
gacgctggagatgcaa

SEQ ID NO: 6205181 - DNA, 13 bp, Homo sapiens
gacgctgtgctgc

SEQ ID NO: 6205182 - DNA, 15 bp, Homo sapiens
gacgctgtgctgccc

SEQ ID NO: 6205183 - DNA, 16 bp, Homo sapiens
gacgctgtgctgccct

SEQ ID NO: 6205184 - DNA, 18 bp, Homo sapiens
gacgctgtgctggttctg

SEQ ID NO: 6205185 - DNA, 12 bp, Homo sapiens
gacgcttccaga

SEQ ID NO: 6205186 - DNA, 15 bp, Homo sapiens
gacgcttccagacca

SEQ ID NO: 6205187 - DNA, 22 bp, Homo sapiens
gacgcttccagaccacctgcca

SEQ ID NO: 6205188 - DNA, 18 bp, Homo sapiens
gacgcttgtgacagtgcc

SEQ ID NO: 6205189 - DNA, 21 bp, Homo sapiens
gacgcttttgagtgggccctg

SEQ ID NO: 6205190 - DNA, 12 bp, Homo sapiens
gacggaaaagtc

SEQ ID NO: 6205191 - DNA, 18 bp, Homo sapiens
gacggaaatgaaattgtc

SEQ ID NO: 6205192 - DNA, 14 bp, Homo sapiens
gacggacatccagg

SEQ ID NO: 6205193 - DNA, 15 bp, Homo sapiens
gacggacatccaggc

SEQ ID NO: 6205194 - DNA, 19 bp, Homo sapiens
gacggacgggacagcggcc

SEQ ID NO: 6205195 - DNA, 17 bp, Homo sapiens
gacggacgtcctgctgg

SEQ ID NO: 6205196 - DNA, 19 bp, Homo sapiens
gacggagagccttggcgag

SEQ ID NO: 6205197 - DNA, 19 bp, Homo sapiens
gacggagatgaagaacatc

SEQ ID NO: 6205198 - DNA, 17 bp, Homo sapiens
gacggagccactggggt

SEQ ID NO: 6205199 - DNA, 20 bp, Homo sapiens
gacggagcccacactgccac

SEQ ID NO: 6205200 - DNA, 15 bp, Homo sapiens
gacggagccgagcca

SEQ ID NO: 6205201 - DNA, 14 bp, Homo sapiens
gacggagccgggaa

SEQ ID NO: 6205202 - DNA, 20 bp, Homo sapiens
gacggaggaggggaaggggc

SEQ ID NO: 6205203 - DNA, 12 bp, Homo sapiens
gacggaggggag

SEQ ID NO: 6205204 - DNA, 22 bp, Homo sapiens
gacggaggtccccggttgctgg

SEQ ID NO: 6205205 - DNA, 18 bp, Homo sapiens
gacggagtcccaccttgg

SEQ ID NO: 6205206 - DNA, 15 bp, Homo sapiens
gacggagttcagagg

SEQ ID NO: 6205207 - DNA, 21 bp, Homo sapiens
gacggatggaaggagagaggt

SEQ ID NO: 6205208 - DNA, 17 bp, Homo sapiens
gacggattatctagaga

SEQ ID NO: 6205209 - DNA, 22 bp, Homo sapiens
gacggcaacctgcggaaggagg

SEQ ID NO: 6205210 - DNA, 23 bp, Homo sapiens
gacggcaacctgcggaaggaggt

SEQ ID NO: 6205211 - DNA, 20 bp, Homo sapiens
gacggcaaggctgaggtggc

SEQ ID NO: 6205212 - DNA, 19 bp, Homo sapiens
gacggcacccacccagcac

SEQ ID NO: 6205213 - DNA, 13 bp, Homo sapiens
gacggcacgcact

SEQ ID NO: 6205214 - DNA, 14 bp, Homo sapiens
gacggcagccccat

SEQ ID NO: 6205215 - DNA, 20 bp, Homo sapiens
gacggccaatggtgcttccc

SEQ ID NO: 6205216 - DNA, 15 bp, Homo sapiens
gacggccaggctccc

SEQ ID NO: 6205217 - DNA, 22 bp, Homo sapiens
gacggccaggctccctgaccac

SEQ ID NO: 6205218 - DNA, 19 bp, Homo sapiens
gacggccccgtcagccaca

SEQ ID NO: 6205219 - DNA, 11 bp, Homo sapiens
gacggccctgc

SEQ ID NO: 6205220 - DNA, 13 bp, Homo sapiens
gacggccctgcaa

SEQ ID NO: 6205221 - DNA, 13 bp, Homo sapiens
gacggccctgcct

SEQ ID NO: 6205222 - DNA, 15 bp, Homo sapiens
gacggccctgcctgc

SEQ ID NO: 6205223 - DNA, 20 bp, Homo sapiens
gacggcctaggggtggcgct

SEQ ID NO: 6205224 - DNA, 17 bp, Homo sapiens
gacggcctccaggaggg

SEQ ID NO: 6205225 - DNA, 22 bp, Homo sapiens
gacggcctccaggaggggcctg

SEQ ID NO: 6205226 - DNA, 12 bp, Homo sapiens
gacggcggccag

SEQ ID NO: 6205227 - DNA, 19 bp, Homo sapiens
gacggcggccaggcacagg

SEQ ID NO: 6205228 - DNA, 22 bp, Homo sapiens
gacggcggggtgtggtggcctg

SEQ ID NO: 6205229 - DNA, 18 bp, Homo sapiens
gacggctccactaggact

SEQ ID NO: 6205230 - DNA, 22 bp, Homo sapiens
gacggctcctcagagcgccagg

SEQ ID NO: 6205231 - DNA, 14 bp, Homo sapiens
gacggctggcatgg

SEQ ID NO: 6205232 - DNA, 22 bp, Homo sapiens
gacggctgggcacacgcctccc

SEQ ID NO: 6205233 - DNA, 13 bp, Homo sapiens
gacggctgtgacg

SEQ ID NO: 6205234 - DNA, 20 bp, Homo sapiens
gacggctgtgacgcagccgg

SEQ ID NO: 6205235 - DNA, 16 bp, Homo sapiens
gacggctgtgggacca

SEQ ID NO: 6205236 - DNA, 23 bp, Homo sapiens
gacgggaccctgcccagagctga

SEQ ID NO: 6205237 - DNA, 12 bp, Homo sapiens
gacgggagggga

SEQ ID NO: 6205238 - DNA, 19 bp, Homo sapiens
gacgggaggggaaaggctg

SEQ ID NO: 6205239 - DNA, 14 bp, Homo sapiens
gacgggatgacctc

SEQ ID NO: 6205240 - DNA, 17 bp, Homo sapiens
gacgggatgacctccag

SEQ ID NO: 6205241 - DNA, 18 bp, Homo sapiens
gacgggatgacctccaga

SEQ ID NO: 6205242 - DNA, 22 bp, Homo sapiens
gacgggatgacctccagaagtc

SEQ ID NO: 6205243 - DNA, 13 bp, Homo sapiens
gacgggatgctct

SEQ ID NO: 6205244 - DNA, 22 bp, Homo sapiens
gacgggatgctctttaaataat

SEQ ID NO: 6205245 - DNA, 12 bp, Homo sapiens
gacgggccaggc

SEQ ID NO: 6205246 - DNA, 16 bp, Homo sapiens
gacgggccaggccctg

SEQ ID NO: 6205247 - DNA, 13 bp, Homo sapiens
gacgggccctcct

SEQ ID NO: 6205248 - DNA, 13 bp, Homo sapiens
gacgggccgcagg

SEQ ID NO: 6205249 - DNA, 16 bp, Homo sapiens
gacggggactggggat

SEQ ID NO: 6205250 - DNA, 14 bp, Homo sapiens
gacggggcagagct

SEQ ID NO: 6205251 - DNA, 15 bp, Homo sapiens
gacggggcagagctg

SEQ ID NO: 6205252 - DNA, 19 bp, Homo sapiens
gacggggcccgccccaggc

SEQ ID NO: 6205253 - DNA, 20 bp, Homo sapiens
gacggggcgggccctgcctg

SEQ ID NO: 6205254 - DNA, 22 bp, Homo sapiens
gacggggcgggccctgcctgag

SEQ ID NO: 6205255 - DNA, 16 bp, Homo sapiens
gacgggggctgcttct

SEQ ID NO: 6205256 - DNA, 23 bp, Homo sapiens
gacggggggccccagtcagcctc

SEQ ID NO: 6205257 - DNA, 12 bp, Homo sapiens
gacgggggtggg

SEQ ID NO: 6205258 - DNA, 14 bp, Homo sapiens
gacgggggtgggag

SEQ ID NO: 6205259 - DNA, 17 bp, Homo sapiens
gacggggtttcaccatg

SEQ ID NO: 6205260 - DNA, 17 bp, Homo sapiens
gacgggttgaaagacat

SEQ ID NO: 6205261 - DNA, 16 bp, Homo sapiens
gacgggtttcaccatg

SEQ ID NO: 6205262 - DNA, 21 bp, Homo sapiens
gacggtattaaaatggagcga

SEQ ID NO: 6205263 - DNA, 21 bp, Homo sapiens
gacggtcctttaggcagcctg

SEQ ID NO: 6205264 - DNA, 14 bp, Homo sapiens
gacggtctgtgccc

SEQ ID NO: 6205265 - DNA, 16 bp, Homo sapiens
gacggtgcagtctggg

SEQ ID NO: 6205266 - DNA, 21 bp, Homo sapiens
gacggtgttaattttgctaac

SEQ ID NO: 6205267 - DNA, 23 bp, Homo sapiens
gacggtgttgcagagacgcaagg

SEQ ID NO: 6205268 - DNA, 16 bp, Homo sapiens
gacggttcctacacag

SEQ ID NO: 6205269 - DNA, 18 bp, Homo sapiens
gacggttcctacacagga

SEQ ID NO: 6205270 - DNA, 14 bp, Homo sapiens
gacggttttttatt

SEQ ID NO: 6205271 - DNA, 12 bp, Homo sapiens
gacgtaataaaa

SEQ ID NO: 6205272 - DNA, 18 bp, Homo sapiens
gacgtacaagtagttctg

SEQ ID NO: 6205273 - DNA, 21 bp, Homo sapiens
gacgtacgtatcagcggcccc

SEQ ID NO: 6205274 - DNA, 20 bp, Homo sapiens
gacgtactccaacagaagaa

SEQ ID NO: 6205275 - DNA, 23 bp, Homo sapiens
gacgtatgcttattttaaaattt

SEQ ID NO: 6205276 - DNA, 18 bp, Homo sapiens
gacgtcaagtctccttcc

SEQ ID NO: 6205277 - DNA, 15 bp, Homo sapiens
gacgtcagcctctta

SEQ ID NO: 6205278 - DNA, 22 bp, Homo sapiens
gacgtcagtagtttgagaccag

SEQ ID NO: 6205279 - DNA, 21 bp, Homo sapiens
gacgtccaccctgcagccagg

SEQ ID NO: 6205280 - DNA, 17 bp, Homo sapiens
gacgtcctatctccccc

SEQ ID NO: 6205281 - DNA, 18 bp, Homo sapiens
gacgtcctatctccccca

SEQ ID NO: 6205282 - DNA, 21 bp, Homo sapiens
gacgtcctatctcccccaacc

SEQ ID NO: 6205283 - DNA, 13 bp, Homo sapiens
gacgtccttccat

SEQ ID NO: 6205284 - DNA, 22 bp, Homo sapiens
gacgtccttccatatccctgcc

SEQ ID NO: 6205285 - DNA, 21 bp, Homo sapiens
gacgtcgctgtccgtcctgct

SEQ ID NO: 6205286 - DNA, 22 bp, Homo sapiens
gacgtcgctgtccgtcctgctc

SEQ ID NO: 6205287 - DNA, 16 bp, Homo sapiens
gacgtctcaagactga

SEQ ID NO: 6205288 - DNA, 19 bp, Homo sapiens
cttgtgcatgcaaaaatga

SEQ ID NO: 6205289 - DNA, 22 bp, Homo sapiens
cttgtgcatgcaaaaatgaatt

SEQ ID NO: 6205290 - DNA, 14 bp, Homo sapiens
cttgtgcatttggt

SEQ ID NO: 6205291 - DNA, 12 bp, Homo sapiens
cttgtgccagcc

SEQ ID NO: 6205292 - DNA, 17 bp, Homo sapiens
cttgtgccctccctgtc

SEQ ID NO: 6205293 - DNA, 17 bp, Homo sapiens
cttgtgcccttaaaacc

SEQ ID NO: 6205294 - DNA, 12 bp, Homo sapiens
cttgtgcctcag

SEQ ID NO: 6205295 - DNA, 18 bp, Homo sapiens
cttgtgcctccaatgtgg

SEQ ID NO: 6205296 - DNA, 18 bp, Homo sapiens
cttgtgcctcccttccca

SEQ ID NO: 6205297 - DNA, 18 bp, Homo sapiens
cttgtgcctctcatcttt

SEQ ID NO: 6205298 - DNA, 19 bp, Homo sapiens
cttgtgcctcttgggagac

SEQ ID NO: 6205299 - DNA, 19 bp, Homo sapiens
cttgtgctcctctcgcaca

SEQ ID NO: 6205300 - DNA, 14 bp, Homo sapiens
cttgtgctcctgcc

SEQ ID NO: 6205301 - DNA, 14 bp, Homo sapiens
cttgtgctgagaat

SEQ ID NO: 6205302 - DNA, 20 bp, Homo sapiens
cttgtgctgagcctgcccag

SEQ ID NO: 6205303 - DNA, 20 bp, Homo sapiens
cttgtgctgatcgtgctaaa

SEQ ID NO: 6205304 - DNA, 22 bp, Homo sapiens
cttgtgctggatggagcccagg

SEQ ID NO: 6205305 - DNA, 18 bp, Homo sapiens
cttgtgcttggtggggct

SEQ ID NO: 6205306 - DNA, 16 bp, Homo sapiens
cttgtggaagacactt

SEQ ID NO: 6205307 - DNA, 19 bp, Homo sapiens
cttgtggaagacacttgct

SEQ ID NO: 6205308 - DNA, 16 bp, Homo sapiens
cttgtggacacagctc

SEQ ID NO: 6205309 - DNA, 17 bp, Homo sapiens
cttgtggactaaaagat

SEQ ID NO: 6205310 - DNA, 18 bp, Homo sapiens
cttgtggactaaaagata

SEQ ID NO: 6205311 - DNA, 21 bp, Homo sapiens
cttgtggactggctgtgcccc

SEQ ID NO: 6205312 - DNA, 17 bp, Homo sapiens
cttgtggataagtggct

SEQ ID NO: 6205313 - DNA, 22 bp, Homo sapiens
cttgtggatgttttaattccat

SEQ ID NO: 6205314 - DNA, 13 bp, Homo sapiens
cttgtggcacatt

SEQ ID NO: 6205315 - DNA, 16 bp, Homo sapiens
cttgtggcagcctgat

SEQ ID NO: 6205316 - DNA, 17 bp, Homo sapiens
cttgtggcagcttccct

SEQ ID NO: 6205317 - DNA, 19 bp, Homo sapiens
cttgtggcagcttccctga

SEQ ID NO: 6205318 - DNA, 21 bp, Homo sapiens
cttgtggcagcttccctgaac

SEQ ID NO: 6205319 - DNA, 20 bp, Homo sapiens
cttgtggccccttttacttt

SEQ ID NO: 6205320 - DNA, 18 bp, Homo sapiens
cttgtggccctctccctt

SEQ ID NO: 6205321 - DNA, 16 bp, Homo sapiens
cttgtggcctatgaaa

SEQ ID NO: 6205322 - DNA, 14 bp, Homo sapiens
cttgtggcctcaag

SEQ ID NO: 6205323 - DNA, 14 bp, Homo sapiens
cttgtggcctggga

SEQ ID NO: 6205324 - DNA, 22 bp, Homo sapiens
cttgtggctccacacacacaaa

SEQ ID NO: 6205325 - DNA, 22 bp, Homo sapiens
cttgtgggagacagcagcctgt

SEQ ID NO: 6205326 - DNA, 23 bp, Homo sapiens
cttgtgggagcacagtcagtgac

SEQ ID NO: 6205327 - DNA, 21 bp, Homo sapiens
cttgtgggcaaaggcagggcc

SEQ ID NO: 6205328 - DNA, 19 bp, Homo sapiens
cttgtgggcactgtgccaa

SEQ ID NO: 6205329 - DNA, 12 bp, Homo sapiens
cttgtgggcctg

SEQ ID NO: 6205330 - DNA, 15 bp, Homo sapiens
cttgtgggcctgggc

SEQ ID NO: 6205331 - DNA, 18 bp, Homo sapiens
cttgtggggacccaggct

SEQ ID NO: 6205332 - DNA, 20 bp, Homo sapiens
cttgtggggacccaggctcc

SEQ ID NO: 6205333 - DNA, 15 bp, Homo sapiens
cttgtggggcctggg

SEQ ID NO: 6205334 - DNA, 16 bp, Homo sapiens
cttgtggggcctggga

SEQ ID NO: 6205335 - DNA, 15 bp, Homo sapiens
cttgtgggtcctggg

SEQ ID NO: 6205336 - DNA, 14 bp, Homo sapiens
cttgtggtccaaat

SEQ ID NO: 6205337 - DNA, 15 bp, Homo sapiens
cttgtggtccaaata

SEQ ID NO: 6205338 - DNA, 21 bp, Homo sapiens
cttgtggtggctgctccatga

SEQ ID NO: 6205339 - DNA, 15 bp, Homo sapiens
cttgtggtgtaaagc

SEQ ID NO: 6205340 - DNA, 18 bp, Homo sapiens
cttgtggtgttcctgaag

SEQ ID NO: 6205341 - DNA, 12 bp, Homo sapiens
cttgtggttaaa

SEQ ID NO: 6205342 - DNA, 22 bp, Homo sapiens
cttgtggttagcaagactgcaa

SEQ ID NO: 6205343 - DNA, 17 bp, Homo sapiens
cttgtggttgtgtgtgt

SEQ ID NO: 6205344 - DNA, 20 bp, Homo sapiens
cttgtggttgtgtgtgttct

SEQ ID NO: 6205345 - DNA, 16 bp, Homo sapiens
cttgtgtaatttatgt

SEQ ID NO: 6205346 - DNA, 17 bp, Homo sapiens
cttgtgtactttcttcc

SEQ ID NO: 6205347 - DNA, 23 bp, Homo sapiens
cttgtgtatattttaatgaatat

SEQ ID NO: 6205348 - DNA, 13 bp, Homo sapiens
cttgtgtatcttg

SEQ ID NO: 6205349 - DNA, 10 bp, Homo sapiens
cttgtgtatg

SEQ ID NO: 6205350 - DNA, 19 bp, Homo sapiens
cttgtgtcaaccactaaag

SEQ ID NO: 6205351 - DNA, 19 bp, Homo sapiens
cttgtgtcaagacatttct

SEQ ID NO: 6205352 - DNA, 13 bp, Homo sapiens
cttgtgtcctggt

SEQ ID NO: 6205353 - DNA, 21 bp, Homo sapiens
cttgtgtctctgtgcttttaa

SEQ ID NO: 6205354 - DNA, 15 bp, Homo sapiens
cttgtgtctgtacac

SEQ ID NO: 6205355 - DNA, 18 bp, Homo sapiens
cttgtgtctgtacacgtg

SEQ ID NO: 6205356 - DNA, 15 bp, Homo sapiens
cttgtgtgagtgtga

SEQ ID NO: 6205357 - DNA, 15 bp, Homo sapiens
cttgtgtgccacaga

SEQ ID NO: 6205358 - DNA, 17 bp, Homo sapiens
cttgtgtggtttggccc

SEQ ID NO: 6205359 - DNA, 15 bp, Homo sapiens
cttgtgtgtaccaca

SEQ ID NO: 6205360 - DNA, 21 bp, Homo sapiens
cttgtgtgtatgcacatgaac

SEQ ID NO: 6205361 - DNA, 18 bp, Homo sapiens
cttgtgtgtatgtctatg

SEQ ID NO: 6205362 - DNA, 14 bp, Homo sapiens
cttgtgtgtcaggc

SEQ ID NO: 6205363 - DNA, 16 bp, Homo sapiens
cttgtgtgtcaggccc

SEQ ID NO: 6205364 - DNA, 17 bp, Homo sapiens
cttgtgtgtcaggccct

SEQ ID NO: 6205365 - DNA, 23 bp, Homo sapiens
cttgtgtgtcaggccctctgcct

SEQ ID NO: 6205366 - DNA, 17 bp, Homo sapiens
cttgtgtgtgccctggg

SEQ ID NO: 6205367 - DNA, 21 bp, Homo sapiens
cttgtgtgtgccctgggccag

SEQ ID NO: 6205368 - DNA, 19 bp, Homo sapiens
cttgtgtgtgggctgtgag

SEQ ID NO: 6205369 - DNA, 21 bp, Homo sapiens
cttgtgtgtttattgtcaaag

SEQ ID NO: 6205370 - DNA, 19 bp, Homo sapiens
cttgtgtgttttgagagta

SEQ ID NO: 6205371 - DNA, 22 bp, Homo sapiens
cttgtgttactaatttgtataa

SEQ ID NO: 6205372 - DNA, 17 bp, Homo sapiens
cttgtgttacttgccaa

SEQ ID NO: 6205373 - DNA, 22 bp, Homo sapiens
cttgtgttatcggacattctaa

SEQ ID NO: 6205374 - DNA, 17 bp, Homo sapiens
cttgtgttcagaagaat

SEQ ID NO: 6205375 - DNA, 19 bp, Homo sapiens
cttgtgttcagaagaatct

SEQ ID NO: 6205376 - DNA, 21 bp, Homo sapiens
cttgtgttcagctctttccaa

SEQ ID NO: 6205377 - DNA, 23 bp, Homo sapiens
cttgtgttcagctctttccaaat

SEQ ID NO: 6205378 - DNA, 12 bp, Homo sapiens
cttgtgttcctt

SEQ ID NO: 6205379 - DNA, 15 bp, Homo sapiens
cttgtgttccttctg

SEQ ID NO: 6205380 - DNA, 14 bp, Homo sapiens
cttgtgttctgctc

SEQ ID NO: 6205381 - DNA, 21 bp, Homo sapiens
cttgtgttgctttctgactga

SEQ ID NO: 6205382 - DNA, 13 bp, Homo sapiens
cttgtgttggctg

SEQ ID NO: 6205383 - DNA, 17 bp, Homo sapiens
cttgtgttggctgtggc

SEQ ID NO: 6205384 - DNA, 15 bp, Homo sapiens
cttgtgtttgagaac

SEQ ID NO: 6205385 - DNA, 13 bp, Homo sapiens
cttgtgtttgctt

SEQ ID NO: 6205386 - DNA, 15 bp, Homo sapiens
cttgtgttttaaaat

SEQ ID NO: 6205387 - DNA, 22 bp, Homo sapiens
cttgtgttttactgtcagatta

SEQ ID NO: 6205388 - DNA, 14 bp, Homo sapiens
cttgtgttttgtcc

SEQ ID NO: 6205389 - DNA, 15 bp, Homo sapiens
cttgtgttttgtcct

SEQ ID NO: 6205390 - DNA, 16 bp, Homo sapiens
cttgttaaagatttca

SEQ ID NO: 6205391 - DNA, 18 bp, Homo sapiens
cttgttaatgctttctga

SEQ ID NO: 6205392 - DNA, 20 bp, Homo sapiens
cttgttaattgatttgggga

SEQ ID NO: 6205393 - DNA, 22 bp, Homo sapiens
cttgttacctttcccatgctga

SEQ ID NO: 6205394 - DNA, 21 bp, Homo sapiens
cttgttactgctgattcttgt

SEQ ID NO: 6205395 - DNA, 14 bp, Homo sapiens
cttgttacttctga

SEQ ID NO: 6205396 - DNA, 18 bp, Homo sapiens
cttgttagagagaaagag

SEQ ID NO: 6205397 - DNA, 16 bp, Homo sapiens
cttgttattaccaaaa

SEQ ID NO: 6205398 - DNA, 16 bp, Homo sapiens
cttgttattattgtta

SEQ ID NO: 6205399 - DNA, 15 bp, Homo sapiens
cttgttattgtgaat

SEQ ID NO: 6205400 - DNA, 16 bp, Homo sapiens
cttgttattgtgaatg

SEQ ID NO: 6205401 - DNA, 18 bp, Homo sapiens
cttgttattgtgaatgat

SEQ ID NO: 6205402 - DNA, 20 bp, Homo sapiens
cttgttcaaaatatgttctt

SEQ ID NO: 6205403 - DNA, 18 bp, Homo sapiens
cttgttcaaaatgcagat

SEQ ID NO: 6205404 - DNA, 23 bp, Homo sapiens
cttgttcaagtatctaactcttc

SEQ ID NO: 6205405 - DNA, 16 bp, Homo sapiens
cttgttcacactctca

SEQ ID NO: 6205406 - DNA, 22 bp, Homo sapiens
cttgttcagcaggctagacaga

SEQ ID NO: 6205407 - DNA, 23 bp, Homo sapiens
cttgttcagcaggctagacagaa

SEQ ID NO: 6205408 - DNA, 14 bp, Homo sapiens
cttgttcaggaaaa

SEQ ID NO: 6205409 - DNA, 13 bp, Homo sapiens
cttgttcatatgg

SEQ ID NO: 6205410 - DNA, 20 bp, Homo sapiens
cttgttcatccaaggaacct

SEQ ID NO: 6205411 - DNA, 21 bp, Homo sapiens
cttgttcatgttttgctaatg

SEQ ID NO: 6205412 - DNA, 14 bp, Homo sapiens
cttgttcattctgt

SEQ ID NO: 6205413 - DNA, 17 bp, Homo sapiens
cttgttcatttctgtct

SEQ ID NO: 6205414 - DNA, 18 bp, Homo sapiens
cttgttcatttctgtctc

SEQ ID NO: 6205415 - DNA, 22 bp, Homo sapiens
cttgttcatttctgtctcccct

SEQ ID NO: 6205416 - DNA, 13 bp, Homo sapiens
cttgttcatttgg

SEQ ID NO: 6205417 - DNA, 16 bp, Homo sapiens
cttgttccaaggccag

SEQ ID NO: 6205418 - DNA, 18 bp, Homo sapiens
cttgttccaatgccacat

SEQ ID NO: 6205419 - DNA, 23 bp, Homo sapiens
cttgttccactgcaaataaagcc

SEQ ID NO: 6205420 - DNA, 20 bp, Homo sapiens
cttgttccagccctattctg

SEQ ID NO: 6205421 - DNA, 13 bp, Homo sapiens
cttgttccagctc

SEQ ID NO: 6205422 - DNA, 14 bp, Homo sapiens
cttgttccctctcc

SEQ ID NO: 6205423 - DNA, 23 bp, Homo sapiens
cttgttcctgaaatgtgtttcct

SEQ ID NO: 6205424 - DNA, 15 bp, Homo sapiens
cttgttcctgtgcat

SEQ ID NO: 6205425 - DNA, 15 bp, Homo sapiens
cttgttctaatcttg

SEQ ID NO: 6205426 - DNA, 22 bp, Homo sapiens
cttgttctactcatatatatct

SEQ ID NO: 6205427 - DNA, 12 bp, Homo sapiens
cttgttctagag

SEQ ID NO: 6205428 - DNA, 17 bp, Homo sapiens
cttgttctatttttcaa

SEQ ID NO: 6205429 - DNA, 21 bp, Homo sapiens
cttgttctctaagttccactg

SEQ ID NO: 6205430 - DNA, 21 bp, Homo sapiens
cttgttctctggaacctgact

SEQ ID NO: 6205431 - DNA, 14 bp, Homo sapiens
cttgttctgtccct

SEQ ID NO: 6205432 - DNA, 16 bp, Homo sapiens
cttgttctgtcccttc

SEQ ID NO: 6205433 - DNA, 22 bp, Homo sapiens
cttgttctgtcccttccacttc

SEQ ID NO: 6205434 - DNA, 21 bp, Homo sapiens
cttgttctgtgatgaggggag

SEQ ID NO: 6205435 - DNA, 15 bp, Homo sapiens
cttgttctgttttgt

SEQ ID NO: 6205436 - DNA, 14 bp, Homo sapiens
cttgttcttacttt

SEQ ID NO: 6205437 - DNA, 18 bp, Homo sapiens
cttgttcttccaaagcag

SEQ ID NO: 6205438 - DNA, 12 bp, Homo sapiens
cttgttcttccc

SEQ ID NO: 6205439 - DNA, 12 bp, Homo sapiens
cttgttcttcct

SEQ ID NO: 6205440 - DNA, 16 bp, Homo sapiens
cttgttcttggttcct

SEQ ID NO: 6205441 - DNA, 19 bp, Homo sapiens
cttgttcttttctggtagg

SEQ ID NO: 6205442 - DNA, 16 bp, Homo sapiens
cttgttgaagtgctgt

SEQ ID NO: 6205443 - DNA, 17 bp, Homo sapiens
cttgttgaagtgctgtt

SEQ ID NO: 6205444 - DNA, 13 bp, Homo sapiens
cttgttgagccgt

SEQ ID NO: 6205445 - DNA, 19 bp, Homo sapiens
cttgttgagccgtgggcaa

SEQ ID NO: 6205446 - DNA, 18 bp, Homo sapiens
cttgttgcagactggtgt

SEQ ID NO: 6205447 - DNA, 20 bp, Homo sapiens
cttgttgctcaaaaaatgag

SEQ ID NO: 6205448 - DNA, 17 bp, Homo sapiens
cttgttgctgattttga

SEQ ID NO: 6205449 - DNA, 12 bp, Homo sapiens
cttgttgctttg

SEQ ID NO: 6205450 - DNA, 14 bp, Homo sapiens
cttgttgctttgtt

SEQ ID NO: 6205451 - DNA, 16 bp, Homo sapiens
cttgttgctttgttgc

SEQ ID NO: 6205452 - DNA, 14 bp, Homo sapiens
cttgttggagcctg

SEQ ID NO: 6205453 - DNA, 15 bp, Homo sapiens
cttgttggagcctgc

SEQ ID NO: 6205454 - DNA, 20 bp, Homo sapiens
cttgttgggattcctgaccc

SEQ ID NO: 6205455 - DNA, 19 bp, Homo sapiens
cttgttggtagcatgtact

SEQ ID NO: 6205456 - DNA, 22 bp, Homo sapiens
cttgttggttcaccattgagac

SEQ ID NO: 6205457 - DNA, 21 bp, Homo sapiens
cttgttggttgtcactctaca

SEQ ID NO: 6205458 - DNA, 22 bp, Homo sapiens
cttgttggttgtcactctacaa

SEQ ID NO: 6205459 - DNA, 14 bp, Homo sapiens
cttgttgtattcct

SEQ ID NO: 6205460 - DNA, 22 bp, Homo sapiens
cttgttgtattcctgcctttga

SEQ ID NO: 6205461 - DNA, 20 bp, Homo sapiens
cttgttgttggttgtttttt

SEQ ID NO: 6205462 - DNA, 15 bp, Homo sapiens
cttgttgtttatatg

SEQ ID NO: 6205463 - DNA, 20 bp, Homo sapiens
cttgttgtttgctttggtct

SEQ ID NO: 6205464 - DNA, 18 bp, Homo sapiens
cttgttgtttttaagtcc

SEQ ID NO: 6205465 - DNA, 15 bp, Homo sapiens
cttgtttaaaaaaag

SEQ ID NO: 6205466 - DNA, 15 bp, Homo sapiens
gacgtctccccttct

SEQ ID NO: 6205467 - DNA, 19 bp, Homo sapiens
gacgtctggggtgtgggga

SEQ ID NO: 6205468 - DNA, 18 bp, Homo sapiens
gacgtctgtcaggggctt

SEQ ID NO: 6205469 - DNA, 20 bp, Homo sapiens
gacgtctgtcaggggcttgg

SEQ ID NO: 6205470 - DNA, 13 bp, Homo sapiens
gacgtgaaatact

SEQ ID NO: 6205471 - DNA, 16 bp, Homo sapiens
gacgtgataatgcaga

SEQ ID NO: 6205472 - DNA, 21 bp, Homo sapiens
gacgtgatgggctaggcctcc

SEQ ID NO: 6205473 - DNA, 16 bp, Homo sapiens
gacgtgattttgctgt

SEQ ID NO: 6205474 - DNA, 17 bp, Homo sapiens
gacgtgattttgctgta

SEQ ID NO: 6205475 - DNA, 14 bp, Homo sapiens
gacgtgcactgaca

SEQ ID NO: 6205476 - DNA, 14 bp, Homo sapiens
gacgtgcactgtga

SEQ ID NO: 6205477 - DNA, 22 bp, Homo sapiens
gacgtgcactgtgaatcctggc

SEQ ID NO: 6205478 - DNA, 22 bp, Homo sapiens
gacgtgcagacaggctggcatt

SEQ ID NO: 6205479 - DNA, 21 bp, Homo sapiens
gacgtgcagcgcccctctgca

SEQ ID NO: 6205480 - DNA, 20 bp, Homo sapiens
gacgtgcgcgcccaggccag

SEQ ID NO: 6205481 - DNA, 22 bp, Homo sapiens
gacgtgctccgtagctctgctg

SEQ ID NO: 6205482 - DNA, 23 bp, Homo sapiens
gacgtgctccgtagctctgctgc

SEQ ID NO: 6205483 - DNA, 14 bp, Homo sapiens
gacgtgctggcctt

SEQ ID NO: 6205484 - DNA, 18 bp, Homo sapiens
gacgtggaacctctgtct

SEQ ID NO: 6205485 - DNA, 20 bp, Homo sapiens
gacgtggaacctctgtctca

SEQ ID NO: 6205486 - DNA, 22 bp, Homo sapiens
gacgtggaacctctgtctcatc

SEQ ID NO: 6205487 - DNA, 20 bp, Homo sapiens
gacgtggagcggggtatgaa

SEQ ID NO: 6205488 - DNA, 14 bp, Homo sapiens
gacgtggcacctcc

SEQ ID NO: 6205489 - DNA, 15 bp, Homo sapiens
gacgtggctcagcca

SEQ ID NO: 6205490 - DNA, 16 bp, Homo sapiens
gacgtggctcagccag

SEQ ID NO: 6205491 - DNA, 18 bp, Homo sapiens
gacgtgggaatttcaatg

SEQ ID NO: 6205492 - DNA, 19 bp, Homo sapiens
gacgtgggccctgcaggct

SEQ ID NO: 6205493 - DNA, 23 bp, Homo sapiens
gacgtgggccctgcaggctgcag

SEQ ID NO: 6205494 - DNA, 15 bp, Homo sapiens
gacgtggtaaaatgt

SEQ ID NO: 6205495 - DNA, 18 bp, Homo sapiens
gacgtggtctagaccagg

SEQ ID NO: 6205496 - DNA, 22 bp, Homo sapiens
gacgtggtggctcacacctgca

SEQ ID NO: 6205497 - DNA, 18 bp, Homo sapiens
gacgtgtacagcacagaa

SEQ ID NO: 6205498 - DNA, 13 bp, Homo sapiens
gacgtgtgtggct

SEQ ID NO: 6205499 - DNA, 14 bp, Homo sapiens
gacgtgtgtggctg

SEQ ID NO: 6205500 - DNA, 12 bp, Homo sapiens
gacgtgtgtggt

SEQ ID NO: 6205501 - DNA, 22 bp, Homo sapiens
gacgtgttatgactccagaatt

SEQ ID NO: 6205502 - DNA, 20 bp, Homo sapiens
gacgttaggcatttcctgct

SEQ ID NO: 6205503 - DNA, 20 bp, Homo sapiens
gacgttcatttgtgtgctca

SEQ ID NO: 6205504 - DNA, 20 bp, Homo sapiens
gacgttggcctcagggccag

SEQ ID NO: 6205505 - DNA, 21 bp, Homo sapiens
gacgttggcctcagggccagg

SEQ ID NO: 6205506 - DNA, 17 bp, Homo sapiens
gacgttggttctgcact

SEQ ID NO: 6205507 - DNA, 19 bp, Homo sapiens
gacgtttataaacagaaat

SEQ ID NO: 6205508 - DNA, 13 bp, Homo sapiens
gacgtttctggaa

SEQ ID NO: 6205509 - DNA, 12 bp, Homo sapiens
gacgttttctcc

SEQ ID NO: 6205510 - DNA, 19 bp, Homo sapiens
gactaaaaatatcacactg

SEQ ID NO: 6205511 - DNA, 18 bp, Homo sapiens
gactaaaaatattataac

SEQ ID NO: 6205512 - DNA, 13 bp, Homo sapiens
gactaaaagatat

SEQ ID NO: 6205513 - DNA, 18 bp, Homo sapiens
gactaaaagatataagtg

SEQ ID NO: 6205514 - DNA, 22 bp, Homo sapiens
gactaaaagatataagtgctgt

SEQ ID NO: 6205515 - DNA, 18 bp, Homo sapiens
gactaaaccattgtgcat

SEQ ID NO: 6205516 - DNA, 16 bp, Homo sapiens
gactaaactaccacct

SEQ ID NO: 6205517 - DNA, 17 bp, Homo sapiens
gactaaactaccacctc

SEQ ID NO: 6205518 - DNA, 20 bp, Homo sapiens
gactaaactttttttctgta

SEQ ID NO: 6205519 - DNA, 10 bp, Homo sapiens
gactaaagag

SEQ ID NO: 6205520 - DNA, 13 bp, Homo sapiens
gactaaagagaga

SEQ ID NO: 6205521 - DNA, 14 bp, Homo sapiens
gactaaagagagaa

SEQ ID NO: 6205522 - DNA, 18 bp, Homo sapiens
gactaaagagagaatgta

SEQ ID NO: 6205523 - DNA, 22 bp, Homo sapiens
gactaaagcatcacacagtggc

SEQ ID NO: 6205524 - DNA, 16 bp, Homo sapiens
gactaaagctatgtta

SEQ ID NO: 6205525 - DNA, 18 bp, Homo sapiens
gactaaataatgatcttc

SEQ ID NO: 6205526 - DNA, 20 bp, Homo sapiens
gactaaatgcctagttttta

SEQ ID NO: 6205527 - DNA, 18 bp, Homo sapiens
gactaaattttcttttaa

SEQ ID NO: 6205528 - DNA, 19 bp, Homo sapiens
gactaacaaaggcagctgt

SEQ ID NO: 6205529 - DNA, 18 bp, Homo sapiens
gactaacaagatttgtaa

SEQ ID NO: 6205530 - DNA, 16 bp, Homo sapiens
gactaacactcagaag

SEQ ID NO: 6205531 - DNA, 22 bp, Homo sapiens
gactaacactcagaagcctggg

SEQ ID NO: 6205532 - DNA, 10 bp, Homo sapiens
gactaacctt

SEQ ID NO: 6205533 - DNA, 21 bp, Homo sapiens
gactaactagacaccaaagtt

SEQ ID NO: 6205534 - DNA, 18 bp, Homo sapiens
gactaactatcaaataga

SEQ ID NO: 6205535 - DNA, 16 bp, Homo sapiens
gactaacttattttga

SEQ ID NO: 6205536 - DNA, 21 bp, Homo sapiens
gactaacttattttgattgtt

SEQ ID NO: 6205537 - DNA, 14 bp, Homo sapiens
gactaacttgaaaa

SEQ ID NO: 6205538 - DNA, 22 bp, Homo sapiens
gactaagagaaaccttgcaaac

SEQ ID NO: 6205539 - DNA, 16 bp, Homo sapiens
gactaagagaagttgt

SEQ ID NO: 6205540 - DNA, 18 bp, Homo sapiens
gactaagcagcccagaag

SEQ ID NO: 6205541 - DNA, 16 bp, Homo sapiens
gactaagccaagctgt

SEQ ID NO: 6205542 - DNA, 22 bp, Homo sapiens
gactaagccctgtcgagacact

SEQ ID NO: 6205543 - DNA, 15 bp, Homo sapiens
gactaagcctacctg

SEQ ID NO: 6205544 - DNA, 21 bp, Homo sapiens
gactaagcctacctgctctcc

SEQ ID NO: 6205545 - DNA, 19 bp, Homo sapiens
gactaaggggcagctcctg

SEQ ID NO: 6205546 - DNA, 16 bp, Homo sapiens
gactaagttgcaagat

SEQ ID NO: 6205547 - DNA, 17 bp, Homo sapiens
gactaataccttgtgtt

SEQ ID NO: 6205548 - DNA, 16 bp, Homo sapiens
gactaatccttaataa

SEQ ID NO: 6205549 - DNA, 22 bp, Homo sapiens
gactaatcttattcattttctc

SEQ ID NO: 6205550 - DNA, 17 bp, Homo sapiens
gactaatgctttctgtg

SEQ ID NO: 6205551 - DNA, 14 bp, Homo sapiens
gactaatggcatga

SEQ ID NO: 6205552 - DNA, 17 bp, Homo sapiens
gactaattaaaatctgg

SEQ ID NO: 6205553 - DNA, 21 bp, Homo sapiens
gactaattaaaatctggaaat

SEQ ID NO: 6205554 - DNA, 21 bp, Homo sapiens
gactaattagggtacatttat

SEQ ID NO: 6205555 - DNA, 22 bp, Homo sapiens
gactaattagggtacatttata

SEQ ID NO: 6205556 - DNA, 18 bp, Homo sapiens
gactaattgacttgcaaa

SEQ ID NO: 6205557 - DNA, 22 bp, Homo sapiens
gactacaaaataaaacttggtt

SEQ ID NO: 6205558 - DNA, 21 bp, Homo sapiens
gactacaaaatacaatcctgt

SEQ ID NO: 6205559 - DNA, 17 bp, Homo sapiens
gactacacaatacagta

SEQ ID NO: 6205560 - DNA, 19 bp, Homo sapiens
gactacacaatacagtatt

SEQ ID NO: 6205561 - DNA, 22 bp, Homo sapiens
gactacacaatacagtattata

SEQ ID NO: 6205562 - DNA, 18 bp, Homo sapiens
gactacacatcagggctt

SEQ ID NO: 6205563 - DNA, 13 bp, Homo sapiens
gactacagaattg

SEQ ID NO: 6205564 - DNA, 15 bp, Homo sapiens
gactacaggcaccca

SEQ ID NO: 6205565 - DNA, 20 bp, Homo sapiens
gactacaggtgagtgccacc

SEQ ID NO: 6205566 - DNA, 12 bp, Homo sapiens
gactacaggtgc

SEQ ID NO: 6205567 - DNA, 13 bp, Homo sapiens
gactacaggtgtg

SEQ ID NO: 6205568 - DNA, 22 bp, Homo sapiens
gactacatttagcccctctctt

SEQ ID NO: 6205569 - DNA, 21 bp, Homo sapiens
gactaccccagtcccagggaa

SEQ ID NO: 6205570 - DNA, 21 bp, Homo sapiens
gactacctactggtgtaatct

SEQ ID NO: 6205571 - DNA, 22 bp, Homo sapiens
gactacctactggtgtaatctc

SEQ ID NO: 6205572 - DNA, 15 bp, Homo sapiens
gactacctataaatg

SEQ ID NO: 6205573 - DNA, 14 bp, Homo sapiens
gactacctcagaac

SEQ ID NO: 6205574 - DNA, 14 bp, Homo sapiens
gactacctctgtgc

SEQ ID NO: 6205575 - DNA, 16 bp, Homo sapiens
gactacctctgtgcct

SEQ ID NO: 6205576 - DNA, 22 bp, Homo sapiens
gactacctctgtgccttgccac

SEQ ID NO: 6205577 - DNA, 19 bp, Homo sapiens
gactacggaactgcacact

SEQ ID NO: 6205578 - DNA, 20 bp, Homo sapiens
gactactattcctttccaga

SEQ ID NO: 6205579 - DNA, 15 bp, Homo sapiens
gactactgctcctgt

SEQ ID NO: 6205580 - DNA, 17 bp, Homo sapiens
gactactgctcctgtgg

SEQ ID NO: 6205581 - DNA, 14 bp, Homo sapiens
gactactgttcagc

SEQ ID NO: 6205582 - DNA, 19 bp, Homo sapiens
gactacttggaactaggct

SEQ ID NO: 6205583 - DNA, 15 bp, Homo sapiens
gactagaagggccag

SEQ ID NO: 6205584 - DNA, 16 bp, Homo sapiens
gactagaattctagtg

SEQ ID NO: 6205585 - DNA, 22 bp, Homo sapiens
gactagaattctagtgctgctg

SEQ ID NO: 6205586 - DNA, 19 bp, Homo sapiens
gactagacacacaaagcag

SEQ ID NO: 6205587 - DNA, 19 bp, Homo sapiens
gactagacctccagctgtt

SEQ ID NO: 6205588 - DNA, 21 bp, Homo sapiens
gactagagcaaaataatgcaa

SEQ ID NO: 6205589 - DNA, 18 bp, Homo sapiens
gactagagctttctttca

SEQ ID NO: 6205590 - DNA, 15 bp, Homo sapiens
gactagaggcaggga

SEQ ID NO: 6205591 - DNA, 16 bp, Homo sapiens
gactagaggcttgcat

SEQ ID NO: 6205592 - DNA, 17 bp, Homo sapiens
gactagagggacctctc

SEQ ID NO: 6205593 - DNA, 19 bp, Homo sapiens
gactagagggacctctccc

SEQ ID NO: 6205594 - DNA, 19 bp, Homo sapiens
gactagatcacaactgaag

SEQ ID NO: 6205595 - DNA, 17 bp, Homo sapiens
gactagatggacctgcc

SEQ ID NO: 6205596 - DNA, 17 bp, Homo sapiens
gactagatgtagtattt

SEQ ID NO: 6205597 - DNA, 18 bp, Homo sapiens
gactagatgtagtatttt

SEQ ID NO: 6205598 - DNA, 19 bp, Homo sapiens
gactagcaaacaaaaatag

SEQ ID NO: 6205599 - DNA, 20 bp, Homo sapiens
gactagcactagacatgtca

SEQ ID NO: 6205600 - DNA, 12 bp, Homo sapiens
gactagcaggca

SEQ ID NO: 6205601 - DNA, 16 bp, Homo sapiens
gactagcaggcatgcc

SEQ ID NO: 6205602 - DNA, 12 bp, Homo sapiens
gactagccagaa

SEQ ID NO: 6205603 - DNA, 15 bp, Homo sapiens
gactagccagccagg

SEQ ID NO: 6205604 - DNA, 17 bp, Homo sapiens
gactagccagccaggaa

SEQ ID NO: 6205605 - DNA, 20 bp, Homo sapiens
gactagccatctcaagcaag

SEQ ID NO: 6205606 - DNA, 14 bp, Homo sapiens
gactagcctggcca

SEQ ID NO: 6205607 - DNA, 17 bp, Homo sapiens
gactagcctggcttggg

SEQ ID NO: 6205608 - DNA, 14 bp, Homo sapiens
gactagctgccttc

SEQ ID NO: 6205609 - DNA, 17 bp, Homo sapiens
gactaggagaccagaag

SEQ ID NO: 6205610 - DNA, 14 bp, Homo sapiens
gactaggagcactg

SEQ ID NO: 6205611 - DNA, 21 bp, Homo sapiens
gactaggccctacacacagac

SEQ ID NO: 6205612 - DNA, 18 bp, Homo sapiens
gactagggattcaggctg

SEQ ID NO: 6205613 - DNA, 19 bp, Homo sapiens
gactagggattcaggctgc

SEQ ID NO: 6205614 - DNA, 22 bp, Homo sapiens
gactagggcctcggaggctcct

SEQ ID NO: 6205615 - DNA, 15 bp, Homo sapiens
gactagggtcctggg

SEQ ID NO: 6205616 - DNA, 18 bp, Homo sapiens
gactagggtcctggggaa

SEQ ID NO: 6205617 - DNA, 16 bp, Homo sapiens
gactaggtattgtcta

SEQ ID NO: 6205618 - DNA, 23 bp, Homo sapiens
gactaggttagcatcctgcccga

SEQ ID NO: 6205619 - DNA, 13 bp, Homo sapiens
gactagtacaaat

SEQ ID NO: 6205620 - DNA, 15 bp, Homo sapiens
gactagtagatttct

SEQ ID NO: 6205621 - DNA, 14 bp, Homo sapiens
gactagtcacctgg

SEQ ID NO: 6205622 - DNA, 13 bp, Homo sapiens
gactagtgctgaa

SEQ ID NO: 6205623 - DNA, 14 bp, Homo sapiens
gactagtgctgaag

SEQ ID NO: 6205624 - DNA, 15 bp, Homo sapiens
gactagtgctgaagc

SEQ ID NO: 6205625 - DNA, 17 bp, Homo sapiens
gactagtgctgaagctt

SEQ ID NO: 6205626 - DNA, 17 bp, Homo sapiens
gactagtttgttattaa

SEQ ID NO: 6205627 - DNA, 19 bp, Homo sapiens
gactataaagcagtagaca

SEQ ID NO: 6205628 - DNA, 14 bp, Homo sapiens
gactataaagctgt

SEQ ID NO: 6205629 - DNA, 18 bp, Homo sapiens
gactatagcccctggtgt

SEQ ID NO: 6205630 - DNA, 22 bp, Homo sapiens
gactatagcccctggtgtgtaa

SEQ ID NO: 6205631 - DNA, 17 bp, Homo sapiens
gactatagctgttctaa

SEQ ID NO: 6205632 - DNA, 22 bp, Homo sapiens
gactatataaagtactactgta

SEQ ID NO: 6205633 - DNA, 12 bp, Homo sapiens
gactatatacat

SEQ ID NO: 6205634 - DNA, 22 bp, Homo sapiens
gactatatacatgtgtgtatat

SEQ ID NO: 6205635 - DNA, 19 bp, Homo sapiens
gactatatatataaatgta

SEQ ID NO: 6205636 - DNA, 20 bp, Homo sapiens
gactatatatataaatgtat

SEQ ID NO: 6205637 - DNA, 21 bp, Homo sapiens
gactatatttgggcctgctcc

SEQ ID NO: 6205638 - DNA, 22 bp, Homo sapiens
gactatcaaactgaagccagaa

SEQ ID NO: 6205639 - DNA, 22 bp, Homo sapiens
gactatctaaatgttgaaagat

SEQ ID NO: 6205640 - DNA, 19 bp, Homo sapiens
gactatgaacttctctcag

SEQ ID NO: 6205641 - DNA, 20 bp, Homo sapiens
gactatgatgagaggccagc

SEQ ID NO: 6205642 - DNA, 17 bp, Homo sapiens
gactatgcagaggcctg

SEQ ID NO: 6205643 - DNA, 16 bp, Homo sapiens
cttgtttaacatatat

SEQ ID NO: 6205644 - DNA, 20 bp, Homo sapiens
cttgtttaaggttcttgctg

SEQ ID NO: 6205645 - DNA, 15 bp, Homo sapiens
cttgtttaatgttaa

SEQ ID NO: 6205646 - DNA, 22 bp, Homo sapiens
cttgtttaatgttaattatgca

SEQ ID NO: 6205647 - DNA, 17 bp, Homo sapiens
cttgtttaattctaaaa

SEQ ID NO: 6205648 - DNA, 19 bp, Homo sapiens
cttgtttacagcactactc

SEQ ID NO: 6205649 - DNA, 14 bp, Homo sapiens
cttgtttacatgct

SEQ ID NO: 6205650 - DNA, 21 bp, Homo sapiens
cttgtttacatgcttattcca

SEQ ID NO: 6205651 - DNA, 16 bp, Homo sapiens
cttgtttaccaaagaa

SEQ ID NO: 6205652 - DNA, 19 bp, Homo sapiens
cttgtttacctttctctct

SEQ ID NO: 6205653 - DNA, 22 bp, Homo sapiens
cttgtttacctttctctctcta

SEQ ID NO: 6205654 - DNA, 19 bp, Homo sapiens
cttgtttacgatttcacta

SEQ ID NO: 6205655 - DNA, 16 bp, Homo sapiens
cttgtttatagcaaaa

SEQ ID NO: 6205656 - DNA, 16 bp, Homo sapiens
cttgtttatatgccca

SEQ ID NO: 6205657 - DNA, 22 bp, Homo sapiens
cttgtttatcagatacatcact

SEQ ID NO: 6205658 - DNA, 14 bp, Homo sapiens
cttgtttatcagca

SEQ ID NO: 6205659 - DNA, 23 bp, Homo sapiens
cttgtttatgatatttcttgctt

SEQ ID NO: 6205660 - DNA, 19 bp, Homo sapiens
cttgtttattgagtttgta

SEQ ID NO: 6205661 - DNA, 15 bp, Homo sapiens
cttgtttcactgaaa

SEQ ID NO: 6205662 - DNA, 13 bp, Homo sapiens
cttgtttcagctt

SEQ ID NO: 6205663 - DNA, 13 bp, Homo sapiens
cttgtttccctgc

SEQ ID NO: 6205664 - DNA, 19 bp, Homo sapiens
cttgtttccctgctggcca

SEQ ID NO: 6205665 - DNA, 12 bp, Homo sapiens
cttgtttcctgt

SEQ ID NO: 6205666 - DNA, 13 bp, Homo sapiens
cttgtttcctgtg

SEQ ID NO: 6205667 - DNA, 13 bp, Homo sapiens
cttgtttccttgt

SEQ ID NO: 6205668 - DNA, 18 bp, Homo sapiens
cttgtttccttttgggct

SEQ ID NO: 6205669 - DNA, 17 bp, Homo sapiens
cttgtttctatactgtt

SEQ ID NO: 6205670 - DNA, 23 bp, Homo sapiens
cttgtttctatactgtttgtaat

SEQ ID NO: 6205671 - DNA, 12 bp, Homo sapiens
cttgtttctccc

SEQ ID NO: 6205672 - DNA, 15 bp, Homo sapiens
cttgtttctgtgccc

SEQ ID NO: 6205673 - DNA, 17 bp, Homo sapiens
cttgtttctgtttagtc

SEQ ID NO: 6205674 - DNA, 12 bp, Homo sapiens
cttgtttcttgg

SEQ ID NO: 6205675 - DNA, 16 bp, Homo sapiens
cttgtttctttctgaa

SEQ ID NO: 6205676 - DNA, 14 bp, Homo sapiens
cttgtttcttttca

SEQ ID NO: 6205677 - DNA, 17 bp, Homo sapiens
cttgtttgaatatttgt

SEQ ID NO: 6205678 - DNA, 19 bp, Homo sapiens
cttgtttgagtttttcctc

SEQ ID NO: 6205679 - DNA, 22 bp, Homo sapiens
cttgtttgagtttttcctccca

SEQ ID NO: 6205680 - DNA, 16 bp, Homo sapiens
cttgtttgatttcaac

SEQ ID NO: 6205681 - DNA, 13 bp, Homo sapiens
cttgtttgcactg

SEQ ID NO: 6205682 - DNA, 14 bp, Homo sapiens
cttgtttgcactgt

SEQ ID NO: 6205683 - DNA, 15 bp, Homo sapiens
cttgtttgcactgtg

SEQ ID NO: 6205684 - DNA, 17 bp, Homo sapiens
cttgtttgcactgtgtg

SEQ ID NO: 6205685 - DNA, 21 bp, Homo sapiens
cttgtttgcctttaggcagga

SEQ ID NO: 6205686 - DNA, 16 bp, Homo sapiens
cttgtttgctcacctg

SEQ ID NO: 6205687 - DNA, 20 bp, Homo sapiens
cttgtttgctcacctggggt

SEQ ID NO: 6205688 - DNA, 23 bp, Homo sapiens
cttgtttggagggatcattttct

SEQ ID NO: 6205689 - DNA, 19 bp, Homo sapiens
cttgtttggggcaggagta

SEQ ID NO: 6205690 - DNA, 12 bp, Homo sapiens
cttgtttgtcag

SEQ ID NO: 6205691 - DNA, 15 bp, Homo sapiens
cttgtttgtcttcca

SEQ ID NO: 6205692 - DNA, 20 bp, Homo sapiens
cttgtttgttactgtcattc

SEQ ID NO: 6205693 - DNA, 19 bp, Homo sapiens
cttgttttaaaagggttca

SEQ ID NO: 6205694 - DNA, 19 bp, Homo sapiens
cttgttttaagcaaatgca

SEQ ID NO: 6205695 - DNA, 23 bp, Homo sapiens
cttgttttaagcaaatgcattct

SEQ ID NO: 6205696 - DNA, 20 bp, Homo sapiens
cttgttttacataactgata

SEQ ID NO: 6205697 - DNA, 14 bp, Homo sapiens
cttgttttatatac

SEQ ID NO: 6205698 - DNA, 20 bp, Homo sapiens
cttgttttcaaagggacttt

SEQ ID NO: 6205699 - DNA, 18 bp, Homo sapiens
cttgttttcaatgtgttg

SEQ ID NO: 6205700 - DNA, 23 bp, Homo sapiens
cttgttttcaggacaacacttca

SEQ ID NO: 6205701 - DNA, 14 bp, Homo sapiens
cttgttttccaaag

SEQ ID NO: 6205702 - DNA, 16 bp, Homo sapiens
cttgttttccaaagaa

SEQ ID NO: 6205703 - DNA, 22 bp, Homo sapiens
cttgttttccagtctcttgtac

SEQ ID NO: 6205704 - DNA, 18 bp, Homo sapiens
cttgttttcttgccaatg

SEQ ID NO: 6205705 - DNA, 21 bp, Homo sapiens
cttgttttctttctttaaatg

SEQ ID NO: 6205706 - DNA, 14 bp, Homo sapiens
cttgttttgccatg

SEQ ID NO: 6205707 - DNA, 15 bp, Homo sapiens
cttgttttgcttccc

SEQ ID NO: 6205708 - DNA, 14 bp, Homo sapiens
cttgttttggactt

SEQ ID NO: 6205709 - DNA, 19 bp, Homo sapiens
cttgttttggactttgtta

SEQ ID NO: 6205710 - DNA, 13 bp, Homo sapiens
cttgttttggatg

SEQ ID NO: 6205711 - DNA, 15 bp, Homo sapiens
cttgttttgtttgtc

SEQ ID NO: 6205712 - DNA, 22 bp, Homo sapiens
cttgttttgtttgtctctcctt

SEQ ID NO: 6205713 - DNA, 12 bp, Homo sapiens
cttgtttttaag

SEQ ID NO: 6205714 - DNA, 20 bp, Homo sapiens
cttgtttttattaatttata

SEQ ID NO: 6205715 - DNA, 17 bp, Homo sapiens
cttgtttttcttcagca

SEQ ID NO: 6205716 - DNA, 12 bp, Homo sapiens
cttgtttttgag

SEQ ID NO: 6205717 - DNA, 14 bp, Homo sapiens
cttgtttttgtaaa

SEQ ID NO: 6205718 - DNA, 20 bp, Homo sapiens
cttgtttttgtaaagaaaaa

SEQ ID NO: 6205719 - DNA, 22 bp, Homo sapiens
cttgtttttgtaaagaaaaata

SEQ ID NO: 6205720 - DNA, 23 bp, Homo sapiens
cttgtttttgtaaagaaaaatat

SEQ ID NO: 6205721 - DNA, 17 bp, Homo sapiens
ctttaaaaaaaaaattg

SEQ ID NO: 6205722 - DNA, 20 bp, Homo sapiens
ctttaaaaaaaaatcttgtg

SEQ ID NO: 6205723 - DNA, 21 bp, Homo sapiens
ctttaaaaaaaaatcttgtgt

SEQ ID NO: 6205724 - DNA, 14 bp, Homo sapiens
ctttaaaaaaacaa

SEQ ID NO: 6205725 - DNA, 14 bp, Homo sapiens
ctttaaaaaaataa

SEQ ID NO: 6205726 - DNA, 21 bp, Homo sapiens
ctttaaaaaagaaattatctt

SEQ ID NO: 6205727 - DNA, 22 bp, Homo sapiens
ctttaaaaaagaaattatcttt

SEQ ID NO: 6205728 - DNA, 22 bp, Homo sapiens
ctttaaaaaagactgaacatgt

SEQ ID NO: 6205729 - DNA, 23 bp, Homo sapiens
ctttaaaaaagactgaacatgtt

SEQ ID NO: 6205730 - DNA, 19 bp, Homo sapiens
ctttaaaaaagctataaat

SEQ ID NO: 6205731 - DNA, 22 bp, Homo sapiens
ctttaaaaaattaatctgggcc

SEQ ID NO: 6205732 - DNA, 18 bp, Homo sapiens
ctttaaaaaattttttga

SEQ ID NO: 6205733 - DNA, 13 bp, Homo sapiens
ctttaaaaacaaa

SEQ ID NO: 6205734 - DNA, 13 bp, Homo sapiens
ctttaaaaactgt

SEQ ID NO: 6205735 - DNA, 14 bp, Homo sapiens
ctttaaaaactgtt

SEQ ID NO: 6205736 - DNA, 16 bp, Homo sapiens
ctttaaaaagaaatta

SEQ ID NO: 6205737 - DNA, 21 bp, Homo sapiens
ctttaaaaagggaagaaactg

SEQ ID NO: 6205738 - DNA, 22 bp, Homo sapiens
ctttaaaaaggtgcactacagt

SEQ ID NO: 6205739 - DNA, 17 bp, Homo sapiens
ctttaaaaataaaagct

SEQ ID NO: 6205740 - DNA, 20 bp, Homo sapiens
ctttaaaaataaaagctatt

SEQ ID NO: 6205741 - DNA, 14 bp, Homo sapiens
ctttaaaaatgcaa

SEQ ID NO: 6205742 - DNA, 12 bp, Homo sapiens
ctttaaaacaaa

SEQ ID NO: 6205743 - DNA, 23 bp, Homo sapiens
ctttaaaacaaagggaaaaaaga

SEQ ID NO: 6205744 - DNA, 18 bp, Homo sapiens
ctttaaaaccacagctgg

SEQ ID NO: 6205745 - DNA, 21 bp, Homo sapiens
ctttaaaaccagtaacgtgct

SEQ ID NO: 6205746 - DNA, 21 bp, Homo sapiens
ctttaaaagaaggtaaataat

SEQ ID NO: 6205747 - DNA, 16 bp, Homo sapiens
ctttaaaagaatgact

SEQ ID NO: 6205748 - DNA, 15 bp, Homo sapiens
ctttaaaagagagag

SEQ ID NO: 6205749 - DNA, 18 bp, Homo sapiens
ctttaaaaggaaagaaaa

SEQ ID NO: 6205750 - DNA, 15 bp, Homo sapiens
ctttaaaaggcaact

SEQ ID NO: 6205751 - DNA, 14 bp, Homo sapiens
ctttaaaagtatct

SEQ ID NO: 6205752 - DNA, 16 bp, Homo sapiens
ctttaaaagtatcttt

SEQ ID NO: 6205753 - DNA, 18 bp, Homo sapiens
ctttaaaagtatctttaa

SEQ ID NO: 6205754 - DNA, 21 bp, Homo sapiens
ctttaaaagtcattattcctg

SEQ ID NO: 6205755 - DNA, 15 bp, Homo sapiens
ctttaaaataaaaaa

SEQ ID NO: 6205756 - DNA, 15 bp, Homo sapiens
ctttaaaataaaata

SEQ ID NO: 6205757 - DNA, 16 bp, Homo sapiens
ctttaaaatgtaaagc

SEQ ID NO: 6205758 - DNA, 19 bp, Homo sapiens
ctttaaaatgtaaagccat

SEQ ID NO: 6205759 - DNA, 17 bp, Homo sapiens
ctttaaaattacaacta

SEQ ID NO: 6205760 - DNA, 12 bp, Homo sapiens
ctttaaaattct

SEQ ID NO: 6205761 - DNA, 21 bp, Homo sapiens
ctttaaaattgggttcacagc

SEQ ID NO: 6205762 - DNA, 13 bp, Homo sapiens
ctttaaaattgtc

SEQ ID NO: 6205763 - DNA, 16 bp, Homo sapiens
ctttaaacatgattat

SEQ ID NO: 6205764 - DNA, 21 bp, Homo sapiens
ctttaaacattggttcttgta

SEQ ID NO: 6205765 - DNA, 22 bp, Homo sapiens
ctttaaacctgtttttttttca

SEQ ID NO: 6205766 - DNA, 14 bp, Homo sapiens
ctttaaactactga

SEQ ID NO: 6205767 - DNA, 22 bp, Homo sapiens
ctttaaactactgaactgttac

SEQ ID NO: 6205768 - DNA, 15 bp, Homo sapiens
ctttaaactcaggga

SEQ ID NO: 6205769 - DNA, 11 bp, Homo sapiens
ctttaaactgt

SEQ ID NO: 6205770 - DNA, 12 bp, Homo sapiens
ctttaaactgtc

SEQ ID NO: 6205771 - DNA, 16 bp, Homo sapiens
ctttaaactttccctt

SEQ ID NO: 6205772 - DNA, 14 bp, Homo sapiens
ctttaaagacttaa

SEQ ID NO: 6205773 - DNA, 20 bp, Homo sapiens
ctttaaagacttaagattaa

SEQ ID NO: 6205774 - DNA, 16 bp, Homo sapiens
ctttaaagacttgatg

SEQ ID NO: 6205775 - DNA, 21 bp, Homo sapiens
ctttaaagacttgatgaataa

SEQ ID NO: 6205776 - DNA, 14 bp, Homo sapiens
ctttaaagagagtt

SEQ ID NO: 6205777 - DNA, 15 bp, Homo sapiens
ctttaaagaggctgt

SEQ ID NO: 6205778 - DNA, 20 bp, Homo sapiens
ctttaaagcaattgcataat

SEQ ID NO: 6205779 - DNA, 13 bp, Homo sapiens
ctttaaagccagt

SEQ ID NO: 6205780 - DNA, 22 bp, Homo sapiens
ctttaaagctgagagaccctgg

SEQ ID NO: 6205781 - DNA, 13 bp, Homo sapiens
ctttaaaggaaaa

SEQ ID NO: 6205782 - DNA, 21 bp, Homo sapiens
ctttaaaggaaaaaatgttgg

SEQ ID NO: 6205783 - DNA, 18 bp, Homo sapiens
ctttaaagggcctgcctg

SEQ ID NO: 6205784 - DNA, 13 bp, Homo sapiens
ctttaaagtaaag

SEQ ID NO: 6205785 - DNA, 22 bp, Homo sapiens
ctttaaagtgagtactgttaag

SEQ ID NO: 6205786 - DNA, 19 bp, Homo sapiens
ctttaaagtgtaataatat

SEQ ID NO: 6205787 - DNA, 21 bp, Homo sapiens
ctttaaagtgtaataatatga

SEQ ID NO: 6205788 - DNA, 10 bp, Homo sapiens
ctttaaataa

SEQ ID NO: 6205789 - DNA, 24 bp, Homo sapiens
ctttaaataaaagaggtccattaa

SEQ ID NO: 6205790 - DNA, 15 bp, Homo sapiens
ctttaaataaattaa

SEQ ID NO: 6205791 - DNA, 16 bp, Homo sapiens
ctttaaataaattaag

SEQ ID NO: 6205792 - DNA, 16 bp, Homo sapiens
ctttaaataatttaac

SEQ ID NO: 6205793 - DNA, 20 bp, Homo sapiens
ctttaaatacagtcaactta

SEQ ID NO: 6205794 - DNA, 15 bp, Homo sapiens
ctttaaatacttcat

SEQ ID NO: 6205795 - DNA, 18 bp, Homo sapiens
ctttaaatacttcatgag

SEQ ID NO: 6205796 - DNA, 13 bp, Homo sapiens
ctttaaatagata

SEQ ID NO: 6205797 - DNA, 12 bp, Homo sapiens
ctttaaatataa

SEQ ID NO: 6205798 - DNA, 13 bp, Homo sapiens
ctttaaatatata

SEQ ID NO: 6205799 - DNA, 21 bp, Homo sapiens
ctttaaatatcattctttgta

SEQ ID NO: 6205800 - DNA, 13 bp, Homo sapiens
ctttaaatcaaaa

SEQ ID NO: 6205801 - DNA, 15 bp, Homo sapiens
ctttaaatcagattt

SEQ ID NO: 6205802 - DNA, 12 bp, Homo sapiens
ctttaaatcatt

SEQ ID NO: 6205803 - DNA, 15 bp, Homo sapiens
ctttaaatcatttta

SEQ ID NO: 6205804 - DNA, 18 bp, Homo sapiens
ctttaaatcctaccaaag

SEQ ID NO: 6205805 - DNA, 19 bp, Homo sapiens
ctttaaatcctaccaaagt

SEQ ID NO: 6205806 - DNA, 18 bp, Homo sapiens
ctttaaatcttttcttca

SEQ ID NO: 6205807 - DNA, 13 bp, Homo sapiens
ctttaaatgaata

SEQ ID NO: 6205808 - DNA, 13 bp, Homo sapiens
ctttaaatgatgt

SEQ ID NO: 6205809 - DNA, 14 bp, Homo sapiens
ctttaaatgtgtat

SEQ ID NO: 6205810 - DNA, 18 bp, Homo sapiens
ctttaaatgtgtatttct

SEQ ID NO: 6205811 - DNA, 18 bp, Homo sapiens
ctttaaatgttttataag

SEQ ID NO: 6205812 - DNA, 22 bp, Homo sapiens
ctttaaatgttttataagttca

SEQ ID NO: 6205813 - DNA, 10 bp, Homo sapiens
ctttaaatta

SEQ ID NO: 6205814 - DNA, 14 bp, Homo sapiens
ctttaaattatatg

SEQ ID NO: 6205815 - DNA, 21 bp, Homo sapiens
ctttaaattatgacgtgcaca

SEQ ID NO: 6205816 - DNA, 13 bp, Homo sapiens
ctttaaattcaag

SEQ ID NO: 6205817 - DNA, 18 bp, Homo sapiens
ctttaaattgtggatgaa

SEQ ID NO: 6205818 - DNA, 15 bp, Homo sapiens
ctttaaatttcaaat

SEQ ID NO: 6205819 - DNA, 18 bp, Homo sapiens
ctttaacaaaacaagaaa

SEQ ID NO: 6205820 - DNA, 20 bp, Homo sapiens
ctttaacaaaacaagaaaga

SEQ ID NO: 6205821 - DNA, 22 bp, Homo sapiens
ctttaacaaaacaagaaagaaa

SEQ ID NO: 6205822 - DNA, 22 bp, Homo sapiens
ctttaacaacatgtttccagca

SEQ ID NO: 6205823 - DNA, 18 bp, Homo sapiens
gactatgcttttctcaaa

SEQ ID NO: 6205824 - DNA, 21 bp, Homo sapiens
gactatggagtcttgtgaaag

SEQ ID NO: 6205825 - DNA, 12 bp, Homo sapiens
gactatggtgct

SEQ ID NO: 6205826 - DNA, 23 bp, Homo sapiens
gactatggtgctgccttgcttct

SEQ ID NO: 6205827 - DNA, 17 bp, Homo sapiens
gactatgtatttttcta

SEQ ID NO: 6205828 - DNA, 22 bp, Homo sapiens
gactattcaaacagtctcagga

SEQ ID NO: 6205829 - DNA, 15 bp, Homo sapiens
gactattcatggcta

SEQ ID NO: 6205830 - DNA, 16 bp, Homo sapiens
gactattcatggctac

SEQ ID NO: 6205831 - DNA, 17 bp, Homo sapiens
gactattccttttctgt

SEQ ID NO: 6205832 - DNA, 16 bp, Homo sapiens
gactattgacatcagc

SEQ ID NO: 6205833 - DNA, 20 bp, Homo sapiens
gactatttaaacttataaat

SEQ ID NO: 6205834 - DNA, 19 bp, Homo sapiens
gactatttataactaatat

SEQ ID NO: 6205835 - DNA, 22 bp, Homo sapiens
gactatttgcttatttaataaa

SEQ ID NO: 6205836 - DNA, 15 bp, Homo sapiens
gactattttatatga

SEQ ID NO: 6205837 - DNA, 18 bp, Homo sapiens
gactatttttgtttttat

SEQ ID NO: 6205838 - DNA, 22 bp, Homo sapiens
gactatttttgtttttattaaa

SEQ ID NO: 6205839 - DNA, 16 bp, Homo sapiens
gactattttttaataa

SEQ ID NO: 6205840 - DNA, 18 bp, Homo sapiens
gactattttttaataaaa

SEQ ID NO: 6205841 - DNA, 14 bp, Homo sapiens
gactcaaaaataag

SEQ ID NO: 6205842 - DNA, 14 bp, Homo sapiens
gactcaaaacctgg

SEQ ID NO: 6205843 - DNA, 17 bp, Homo sapiens
gactcaaagaatataat

SEQ ID NO: 6205844 - DNA, 17 bp, Homo sapiens
gactcaaatgttctaag

SEQ ID NO: 6205845 - DNA, 18 bp, Homo sapiens
gactcaaatgttctaagt

SEQ ID NO: 6205846 - DNA, 12 bp, Homo sapiens
gactcaagattc

SEQ ID NO: 6205847 - DNA, 15 bp, Homo sapiens
gactcaagccccgga

SEQ ID NO: 6205848 - DNA, 23 bp, Homo sapiens
gactcaaggactgaattgtttta

SEQ ID NO: 6205849 - DNA, 21 bp, Homo sapiens
gactcaagggaaaggcaagct

SEQ ID NO: 6205850 - DNA, 16 bp, Homo sapiens
gactcaaggggctgga

SEQ ID NO: 6205851 - DNA, 18 bp, Homo sapiens
gactcaagtacccattct

SEQ ID NO: 6205852 - DNA, 21 bp, Homo sapiens
gactcaagtacccattctgtt

SEQ ID NO: 6205853 - DNA, 16 bp, Homo sapiens
gactcaagtgtctcag

SEQ ID NO: 6205854 - DNA, 17 bp, Homo sapiens
gactcaatgtgctctgt

SEQ ID NO: 6205855 - DNA, 22 bp, Homo sapiens
gactcaatgtggaaaaaatatt

SEQ ID NO: 6205856 - DNA, 20 bp, Homo sapiens
gactcaattcaacaatgtgg

SEQ ID NO: 6205857 - DNA, 18 bp, Homo sapiens
gactcaattgatcctccc

SEQ ID NO: 6205858 - DNA, 19 bp, Homo sapiens
gactcacaccactagcctc

SEQ ID NO: 6205859 - DNA, 23 bp, Homo sapiens
gactcacactctctgcagcccag

SEQ ID NO: 6205860 - DNA, 14 bp, Homo sapiens
gactcacaggaagg

SEQ ID NO: 6205861 - DNA, 17 bp, Homo sapiens
gactcaccaacttgcca

SEQ ID NO: 6205862 - DNA, 20 bp, Homo sapiens
gactcaccaacttgccacat

SEQ ID NO: 6205863 - DNA, 13 bp, Homo sapiens
gactcaccctcca

SEQ ID NO: 6205864 - DNA, 12 bp, Homo sapiens
gactcacctctg

SEQ ID NO: 6205865 - DNA, 12 bp, Homo sapiens
gactcacctgcg

SEQ ID NO: 6205866 - DNA, 18 bp, Homo sapiens
gactcacggctgcacctg

SEQ ID NO: 6205867 - DNA, 15 bp, Homo sapiens
gactcactcataaag

SEQ ID NO: 6205868 - DNA, 16 bp, Homo sapiens
gactcactggcagccc

SEQ ID NO: 6205869 - DNA, 23 bp, Homo sapiens
gactcacttatcccaagagaatg

SEQ ID NO: 6205870 - DNA, 18 bp, Homo sapiens
gactcacttctcagctga

SEQ ID NO: 6205871 - DNA, 21 bp, Homo sapiens
gactcagaaacagaagaaaaa

SEQ ID NO: 6205872 - DNA, 22 bp, Homo sapiens
gactcagaagaaaaagaagctg

SEQ ID NO: 6205873 - DNA, 16 bp, Homo sapiens
gactcagaagcctctg

SEQ ID NO: 6205874 - DNA, 19 bp, Homo sapiens
gactcagaagcctctgggt

SEQ ID NO: 6205875 - DNA, 23 bp, Homo sapiens
gactcagacaggaaagggaaggc

SEQ ID NO: 6205876 - DNA, 17 bp, Homo sapiens
gactcagactcctggct

SEQ ID NO: 6205877 - DNA, 23 bp, Homo sapiens
gactcagactcctggcttcatgt

SEQ ID NO: 6205878 - DNA, 18 bp, Homo sapiens
gactcagagagtgtgagc

SEQ ID NO: 6205879 - DNA, 18 bp, Homo sapiens
gactcagagctctctcta

SEQ ID NO: 6205880 - DNA, 17 bp, Homo sapiens
gactcagaggctgggag

SEQ ID NO: 6205881 - DNA, 22 bp, Homo sapiens
gactcagaggctgggagcatag

SEQ ID NO: 6205882 - DNA, 15 bp, Homo sapiens
gactcagaggtccag

SEQ ID NO: 6205883 - DNA, 19 bp, Homo sapiens
gactcagaggtccaggccc

SEQ ID NO: 6205884 - DNA, 20 bp, Homo sapiens
gactcagaggtccaggcccc

SEQ ID NO: 6205885 - DNA, 10 bp, Homo sapiens
gactcagcac

SEQ ID NO: 6205886 - DNA, 17 bp, Homo sapiens
gactcagcaccacattg

SEQ ID NO: 6205887 - DNA, 22 bp, Homo sapiens
gactcagcagaggcagtggcca

SEQ ID NO: 6205888 - DNA, 12 bp, Homo sapiens
gactcagcagtg

SEQ ID NO: 6205889 - DNA, 10 bp, Homo sapiens
gactcagcca

SEQ ID NO: 6205890 - DNA, 17 bp, Homo sapiens
gactcagcctctgctgg

SEQ ID NO: 6205891 - DNA, 18 bp, Homo sapiens
gactcagcctgcagttaa

SEQ ID NO: 6205892 - DNA, 12 bp, Homo sapiens
gactcagccttc

SEQ ID NO: 6205893 - DNA, 14 bp, Homo sapiens
gactcagccttcag

SEQ ID NO: 6205894 - DNA, 16 bp, Homo sapiens
gactcagcgctcctcc

SEQ ID NO: 6205895 - DNA, 17 bp, Homo sapiens
gactcagcgctcctcct

SEQ ID NO: 6205896 - DNA, 18 bp, Homo sapiens
gactcagcgctcctcctg

SEQ ID NO: 6205897 - DNA, 18 bp, Homo sapiens
gactcagctccccagagt

SEQ ID NO: 6205898 - DNA, 15 bp, Homo sapiens
gactcagctgctata

SEQ ID NO: 6205899 - DNA, 16 bp, Homo sapiens
gactcagctggaagtc

SEQ ID NO: 6205900 - DNA, 22 bp, Homo sapiens
gactcagctggaagtctacctg

SEQ ID NO: 6205901 - DNA, 16 bp, Homo sapiens
gactcaggaagcaggg

SEQ ID NO: 6205902 - DNA, 19 bp, Homo sapiens
gactcaggaccagatgtcc

SEQ ID NO: 6205903 - DNA, 16 bp, Homo sapiens
gactcaggagcctgtg

SEQ ID NO: 6205904 - DNA, 18 bp, Homo sapiens
gactcaggagtctgccac

SEQ ID NO: 6205905 - DNA, 19 bp, Homo sapiens
gactcaggagtctgccact

SEQ ID NO: 6205906 - DNA, 18 bp, Homo sapiens
gactcaggatgcccaggg

SEQ ID NO: 6205907 - DNA, 19 bp, Homo sapiens
gactcaggatgcccagggc

SEQ ID NO: 6205908 - DNA, 23 bp, Homo sapiens
gactcaggatgcccagggccact

SEQ ID NO: 6205909 - DNA, 22 bp, Homo sapiens
gactcaggatttaaaaactgga

SEQ ID NO: 6205910 - DNA, 23 bp, Homo sapiens
gactcaggcccacattgcccaca

SEQ ID NO: 6205911 - DNA, 12 bp, Homo sapiens
gactcaggcctg

SEQ ID NO: 6205912 - DNA, 15 bp, Homo sapiens
gactcaggcctgcca

SEQ ID NO: 6205913 - DNA, 16 bp, Homo sapiens
gactcaggcctgccaa

SEQ ID NO: 6205914 - DNA, 17 bp, Homo sapiens
gactcaggcctgccaat

SEQ ID NO: 6205915 - DNA, 20 bp, Homo sapiens
gactcaggctgctccttctc

SEQ ID NO: 6205916 - DNA, 12 bp, Homo sapiens
gactcagggacc

SEQ ID NO: 6205917 - DNA, 20 bp, Homo sapiens
gactcagggaccggtgctgc

SEQ ID NO: 6205918 - DNA, 13 bp, Homo sapiens
gactcagggcagc

SEQ ID NO: 6205919 - DNA, 23 bp, Homo sapiens
gactcagggcagcgccaggctga

SEQ ID NO: 6205920 - DNA, 21 bp, Homo sapiens
gactcagggccatgcctgccc

SEQ ID NO: 6205921 - DNA, 17 bp, Homo sapiens
gactcagggccccagca

SEQ ID NO: 6205922 - DNA, 18 bp, Homo sapiens
gactcagggccccagcac

SEQ ID NO: 6205923 - DNA, 20 bp, Homo sapiens
gactcaggttccagaacagc

SEQ ID NO: 6205924 - DNA, 23 bp, Homo sapiens
gactcaggttgtagtaaagaaat

SEQ ID NO: 6205925 - DNA, 23 bp, Homo sapiens
gactcagtgcagggacagcctgc

SEQ ID NO: 6205926 - DNA, 15 bp, Homo sapiens
gactcagttcttggc

SEQ ID NO: 6205927 - DNA, 17 bp, Homo sapiens
gactcagttcttggcct

SEQ ID NO: 6205928 - DNA, 18 bp, Homo sapiens
gactcagttcttggcctg

SEQ ID NO: 6205929 - DNA, 20 bp, Homo sapiens
gactcagttcttggcctgct

SEQ ID NO: 6205930 - DNA, 19 bp, Homo sapiens
gactcagttgttctgagca

SEQ ID NO: 6205931 - DNA, 14 bp, Homo sapiens
gactcagttttttg

SEQ ID NO: 6205932 - DNA, 17 bp, Homo sapiens
gactcagttttttgtaa

SEQ ID NO: 6205933 - DNA, 12 bp, Homo sapiens
gactcatatatt

SEQ ID NO: 6205934 - DNA, 14 bp, Homo sapiens
gactcatcatttgt

SEQ ID NO: 6205935 - DNA, 13 bp, Homo sapiens
gactcatccccac

SEQ ID NO: 6205936 - DNA, 15 bp, Homo sapiens
gactcatcctgaaca

SEQ ID NO: 6205937 - DNA, 17 bp, Homo sapiens
gactcatcctgaacagc

SEQ ID NO: 6205938 - DNA, 19 bp, Homo sapiens
gactcatcctgaacagcat

SEQ ID NO: 6205939 - DNA, 23 bp, Homo sapiens
gactcatcctgatttttactatc

SEQ ID NO: 6205940 - DNA, 15 bp, Homo sapiens
gactcatcttttgaa

SEQ ID NO: 6205941 - DNA, 15 bp, Homo sapiens
gactcatgaggaggg

SEQ ID NO: 6205942 - DNA, 14 bp, Homo sapiens
gactcatgcctctg

SEQ ID NO: 6205943 - DNA, 17 bp, Homo sapiens
gactcatgcctctgagc

SEQ ID NO: 6205944 - DNA, 17 bp, Homo sapiens
gactcatggcttagaaa

SEQ ID NO: 6205945 - DNA, 18 bp, Homo sapiens
gactcattaatttctctc

SEQ ID NO: 6205946 - DNA, 21 bp, Homo sapiens
gactcattttaaaaaatggaa

SEQ ID NO: 6205947 - DNA, 11 bp, Homo sapiens
gactccaaaga

SEQ ID NO: 6205948 - DNA, 15 bp, Homo sapiens
gactccaagccctgg

SEQ ID NO: 6205949 - DNA, 20 bp, Homo sapiens
gactccaagccctggggcag

SEQ ID NO: 6205950 - DNA, 18 bp, Homo sapiens
gactccaaggagctactg

SEQ ID NO: 6205951 - DNA, 21 bp, Homo sapiens
gactccaatggggccagcact

SEQ ID NO: 6205952 - DNA, 13 bp, Homo sapiens
gactccacctcaa

SEQ ID NO: 6205953 - DNA, 22 bp, Homo sapiens
gactccacggatgcgtgggcag

SEQ ID NO: 6205954 - DNA, 17 bp, Homo sapiens
gactccactggacagac

SEQ ID NO: 6205955 - DNA, 16 bp, Homo sapiens
gactccactgtggaaa

SEQ ID NO: 6205956 - DNA, 18 bp, Homo sapiens
gactccagaagcagcagc

SEQ ID NO: 6205957 - DNA, 16 bp, Homo sapiens
gactccagatctgcac

SEQ ID NO: 6205958 - DNA, 13 bp, Homo sapiens
gactccagccagc

SEQ ID NO: 6205959 - DNA, 22 bp, Homo sapiens
gactccagccagcgcctccctc

SEQ ID NO: 6205960 - DNA, 16 bp, Homo sapiens
gactccagcccctgga

SEQ ID NO: 6205961 - DNA, 13 bp, Homo sapiens
gactccaggaaga

SEQ ID NO: 6205962 - DNA, 12 bp, Homo sapiens
gactccaggaga

SEQ ID NO: 6205963 - DNA, 16 bp, Homo sapiens
gactccaggagaggag

SEQ ID NO: 6205964 - DNA, 16 bp, Homo sapiens
gactccaggcagcaga

SEQ ID NO: 6205965 - DNA, 17 bp, Homo sapiens
gactccaggcagcagac

SEQ ID NO: 6205966 - DNA, 15 bp, Homo sapiens
gactccaggccagct

SEQ ID NO: 6205967 - DNA, 12 bp, Homo sapiens
gactccaggccc

SEQ ID NO: 6205968 - DNA, 19 bp, Homo sapiens
gactccaggcccaaggctc

SEQ ID NO: 6205969 - DNA, 19 bp, Homo sapiens
gactccaggcctgaccagg

SEQ ID NO: 6205970 - DNA, 10 bp, Homo sapiens
gactccaggg

SEQ ID NO: 6205971 - DNA, 24 bp, Homo sapiens
gactccagggtgacaaggcctgct

SEQ ID NO: 6205972 - DNA, 12 bp, Homo sapiens
gactccaggtct

SEQ ID NO: 6205973 - DNA, 20 bp, Homo sapiens
gactccagtggggcaagatt

SEQ ID NO: 6205974 - DNA, 22 bp, Homo sapiens
gactccatatcccgggagcagt

SEQ ID NO: 6205975 - DNA, 12 bp, Homo sapiens
gactccatctca

SEQ ID NO: 6205976 - DNA, 17 bp, Homo sapiens
gactccatctctcatcc

SEQ ID NO: 6205977 - DNA, 15 bp, Homo sapiens
gactccatctcttct

SEQ ID NO: 6205978 - DNA, 12 bp, Homo sapiens
gactccatggcc

SEQ ID NO: 6205979 - DNA, 16 bp, Homo sapiens
gactcccaaagagctg

SEQ ID NO: 6205980 - DNA, 19 bp, Homo sapiens
gactcccaaagagctgcct

SEQ ID NO: 6205981 - DNA, 22 bp, Homo sapiens
gactcccaagtttccatagcaa

SEQ ID NO: 6205982 - DNA, 13 bp, Homo sapiens
gactcccagcaga

SEQ ID NO: 6205983 - DNA, 22 bp, Homo sapiens
gactcccagcagagcccaccag

SEQ ID NO: 6205984 - DNA, 17 bp, Homo sapiens
gactcccatgaagcctt

SEQ ID NO: 6205985 - DNA, 11 bp, Homo sapiens
gactcccatgc

SEQ ID NO: 6205986 - DNA, 20 bp, Homo sapiens
gactcccatgcaagtagctg

SEQ ID NO: 6205987 - DNA, 20 bp, Homo sapiens
gactccccagcccagcaccc

SEQ ID NO: 6205988 - DNA, 22 bp, Homo sapiens
gactccccagcccagcacccct

SEQ ID NO: 6205989 - DNA, 18 bp, Homo sapiens
gactccccaggccaggcc

SEQ ID NO: 6205990 - DNA, 15 bp, Homo sapiens
gactcccccaaccaa

SEQ ID NO: 6205991 - DNA, 21 bp, Homo sapiens
gactcccccaaccaaggaagg

SEQ ID NO: 6205992 - DNA, 23 bp, Homo sapiens
gactcccccaaccaaggaaggag

SEQ ID NO: 6205993 - DNA, 22 bp, Homo sapiens
gactcccccagtccccttcccg

SEQ ID NO: 6205994 - DNA, 16 bp, Homo sapiens
gactccccctccccgg

SEQ ID NO: 6205995 - DNA, 18 bp, Homo sapiens
gactccccctccccggca

SEQ ID NO: 6205996 - DNA, 16 bp, Homo sapiens
gactccccgcccgccc

SEQ ID NO: 6205997 - DNA, 21 bp, Homo sapiens
gactccccgcccgccctcctc

SEQ ID NO: 6205998 - DNA, 15 bp, Homo sapiens
gactcccctccctgc

SEQ ID NO: 6205999 - DNA, 15 bp, Homo sapiens
gactcccgcctttga

SEQ ID NO: 6206000 - DNA, 15 bp, Homo sapiens
gactcccggagcctg

SEQ ID NO: 6206001 - DNA, 10 bp, Homo sapiens
gactccctcc

SEQ ID NO: 6206002 - DNA, 15 bp, Homo sapiens
ctttaacacagtgtc

SEQ ID NO: 6206003 - DNA, 16 bp, Homo sapiens
ctttaacagctttctc

SEQ ID NO: 6206004 - DNA, 16 bp, Homo sapiens
ctttaacagtctaaaa

SEQ ID NO: 6206005 - DNA, 18 bp, Homo sapiens
ctttaacagtggagctga

SEQ ID NO: 6206006 - DNA, 18 bp, Homo sapiens
ctttaacatacaagaaaa

SEQ ID NO: 6206007 - DNA, 21 bp, Homo sapiens
ctttaacattttgtttccaaa

SEQ ID NO: 6206008 - DNA, 18 bp, Homo sapiens
ctttaaccagtctgaagt

SEQ ID NO: 6206009 - DNA, 22 bp, Homo sapiens
ctttaaccctcacactgctcca

SEQ ID NO: 6206010 - DNA, 19 bp, Homo sapiens
ctttaaccctctcttccct

SEQ ID NO: 6206011 - DNA, 19 bp, Homo sapiens
ctttaaccgtttttcaaga

SEQ ID NO: 6206012 - DNA, 20 bp, Homo sapiens
ctttaaccgtttttcaagaa

SEQ ID NO: 6206013 - DNA, 17 bp, Homo sapiens
ctttaacctgaaccttg

SEQ ID NO: 6206014 - DNA, 21 bp, Homo sapiens
ctttaactcaggactccagcc

SEQ ID NO: 6206015 - DNA, 22 bp, Homo sapiens
ctttaactgagggctgatcttt

SEQ ID NO: 6206016 - DNA, 18 bp, Homo sapiens
ctttaactggaaggctgc

SEQ ID NO: 6206017 - DNA, 20 bp, Homo sapiens
ctttaactggaaggctgctt

SEQ ID NO: 6206018 - DNA, 19 bp, Homo sapiens
ctttaacttaattgctatg

SEQ ID NO: 6206019 - DNA, 18 bp, Homo sapiens
ctttaacttccactttgt

SEQ ID NO: 6206020 - DNA, 19 bp, Homo sapiens
ctttaacttccactttgta

SEQ ID NO: 6206021 - DNA, 21 bp, Homo sapiens
ctttaacttccactttgtata

SEQ ID NO: 6206022 - DNA, 22 bp, Homo sapiens
ctttaacttttttttctctctt

SEQ ID NO: 6206023 - DNA, 20 bp, Homo sapiens
ctttaagaaaaacatctgga

SEQ ID NO: 6206024 - DNA, 18 bp, Homo sapiens
ctttaagaaaaatgaaaa

SEQ ID NO: 6206025 - DNA, 20 bp, Homo sapiens
ctttaagaaaaatgaaaact

SEQ ID NO: 6206026 - DNA, 23 bp, Homo sapiens
ctttaagaaccttaatgacaaca

SEQ ID NO: 6206027 - DNA, 14 bp, Homo sapiens
ctttaagaatgaac

SEQ ID NO: 6206028 - DNA, 22 bp, Homo sapiens
ctttaagacagaattcactgtc

SEQ ID NO: 6206029 - DNA, 12 bp, Homo sapiens
ctttaagagact

SEQ ID NO: 6206030 - DNA, 23 bp, Homo sapiens
ctttaagagactcactggtttta

SEQ ID NO: 6206031 - DNA, 15 bp, Homo sapiens
ctttaagccaaagaa

SEQ ID NO: 6206032 - DNA, 19 bp, Homo sapiens
ctttaagccaagagagcct

SEQ ID NO: 6206033 - DNA, 20 bp, Homo sapiens
ctttaagcctgcattcttaa

SEQ ID NO: 6206034 - DNA, 18 bp, Homo sapiens
ctttaagccttcaaaact

SEQ ID NO: 6206035 - DNA, 20 bp, Homo sapiens
ctttaagccttcaaaactat

SEQ ID NO: 6206036 - DNA, 17 bp, Homo sapiens
ctttaagcgaggcagaa

SEQ ID NO: 6206037 - DNA, 21 bp, Homo sapiens
ctttaagggagtgtactccca

SEQ ID NO: 6206038 - DNA, 23 bp, Homo sapiens
ctttaagggagtgtactcccagg

SEQ ID NO: 6206039 - DNA, 17 bp, Homo sapiens
ctttaaggttcagactt

SEQ ID NO: 6206040 - DNA, 17 bp, Homo sapiens
ctttaagtagataagca

SEQ ID NO: 6206041 - DNA, 18 bp, Homo sapiens
ctttaagtgtgctgggca

SEQ ID NO: 6206042 - DNA, 20 bp, Homo sapiens
ctttaagtgtgctgggcaga

SEQ ID NO: 6206043 - DNA, 11 bp, Homo sapiens
ctttaataaaa

SEQ ID NO: 6206044 - DNA, 13 bp, Homo sapiens
ctttaataagtaa

SEQ ID NO: 6206045 - DNA, 12 bp, Homo sapiens
ctttaatacagc

SEQ ID NO: 6206046 - DNA, 20 bp, Homo sapiens
ctttaatactcacctcctcc

SEQ ID NO: 6206047 - DNA, 15 bp, Homo sapiens
ctttaatataaatgc

SEQ ID NO: 6206048 - DNA, 21 bp, Homo sapiens
ctttaatataataaaagttat

SEQ ID NO: 6206049 - DNA, 19 bp, Homo sapiens
ctttaatatcatcagtatt

SEQ ID NO: 6206050 - DNA, 14 bp, Homo sapiens
ctttaatcaaaagt

SEQ ID NO: 6206051 - DNA, 19 bp, Homo sapiens
ctttaatcaaaagtcctta

SEQ ID NO: 6206052 - DNA, 15 bp, Homo sapiens
ctttaatcaatgtga

SEQ ID NO: 6206053 - DNA, 13 bp, Homo sapiens
ctttaatcaattc

SEQ ID NO: 6206054 - DNA, 17 bp, Homo sapiens
ctttaatcactgcattt

SEQ ID NO: 6206055 - DNA, 13 bp, Homo sapiens
ctttaatcccagt

SEQ ID NO: 6206056 - DNA, 13 bp, Homo sapiens
ctttaatgagaaa

SEQ ID NO: 6206057 - DNA, 14 bp, Homo sapiens
ctttaatgagaaaa

SEQ ID NO: 6206058 - DNA, 18 bp, Homo sapiens
ctttaatgagaatagaaa

SEQ ID NO: 6206059 - DNA, 12 bp, Homo sapiens
ctttaatgataa

SEQ ID NO: 6206060 - DNA, 16 bp, Homo sapiens
ctttaatgatatgctt

SEQ ID NO: 6206061 - DNA, 12 bp, Homo sapiens
ctttaatgcaat

SEQ ID NO: 6206062 - DNA, 14 bp, Homo sapiens
ctttaatgcatcta

SEQ ID NO: 6206063 - DNA, 23 bp, Homo sapiens
ctttaatgcatctagattatgga

SEQ ID NO: 6206064 - DNA, 19 bp, Homo sapiens
ctttaatgctgtctttgtg

SEQ ID NO: 6206065 - DNA, 20 bp, Homo sapiens
ctttaatgctgtctttgtgg

SEQ ID NO: 6206066 - DNA, 22 bp, Homo sapiens
ctttaatggacttatttcttca

SEQ ID NO: 6206067 - DNA, 17 bp, Homo sapiens
ctttaatgtcacaggca

SEQ ID NO: 6206068 - DNA, 18 bp, Homo sapiens
ctttaatgtcacaggcag

SEQ ID NO: 6206069 - DNA, 20 bp, Homo sapiens
ctttaatgtcacaggcaggt

SEQ ID NO: 6206070 - DNA, 22 bp, Homo sapiens
ctttaatgtcacaggcaggtcc

SEQ ID NO: 6206071 - DNA, 22 bp, Homo sapiens
ctttaattaaaacctgggatta

SEQ ID NO: 6206072 - DNA, 21 bp, Homo sapiens
ctttaattaattaagtatctg

SEQ ID NO: 6206073 - DNA, 19 bp, Homo sapiens
ctttaattaccaacctgtt

SEQ ID NO: 6206074 - DNA, 22 bp, Homo sapiens
ctttaattatatattttcatcc

SEQ ID NO: 6206075 - DNA, 23 bp, Homo sapiens
ctttaattccatgaatgttcctg

SEQ ID NO: 6206076 - DNA, 20 bp, Homo sapiens
ctttaattctcatgtgatcc

SEQ ID NO: 6206077 - DNA, 14 bp, Homo sapiens
ctttaattctgtat

SEQ ID NO: 6206078 - DNA, 17 bp, Homo sapiens
ctttaattgaagaactg

SEQ ID NO: 6206079 - DNA, 23 bp, Homo sapiens
ctttaattgaagaactgcacttt

SEQ ID NO: 6206080 - DNA, 20 bp, Homo sapiens
ctttaattgctttaaatctt

SEQ ID NO: 6206081 - DNA, 12 bp, Homo sapiens
ctttaattgtat

SEQ ID NO: 6206082 - DNA, 15 bp, Homo sapiens
ctttaattgtataag

SEQ ID NO: 6206083 - DNA, 19 bp, Homo sapiens
ctttaattgtataagtcaa

SEQ ID NO: 6206084 - DNA, 14 bp, Homo sapiens
ctttaattgtatct

SEQ ID NO: 6206085 - DNA, 20 bp, Homo sapiens
ctttaattgttgcttttacg

SEQ ID NO: 6206086 - DNA, 16 bp, Homo sapiens
ctttaatttatttttg

SEQ ID NO: 6206087 - DNA, 18 bp, Homo sapiens
ctttaatttatttttgca

SEQ ID NO: 6206088 - DNA, 16 bp, Homo sapiens
ctttaattttaactga

SEQ ID NO: 6206089 - DNA, 18 bp, Homo sapiens
ctttaatttttataaata

SEQ ID NO: 6206090 - DNA, 16 bp, Homo sapiens
ctttaatttttctgtt

SEQ ID NO: 6206091 - DNA, 23 bp, Homo sapiens
ctttaatttttttaaccaaaggt

SEQ ID NO: 6206092 - DNA, 23 bp, Homo sapiens
ctttacaaaacaaactcattcat

SEQ ID NO: 6206093 - DNA, 13 bp, Homo sapiens
ctttacaaataat

SEQ ID NO: 6206094 - DNA, 13 bp, Homo sapiens
ctttacaaatatt

SEQ ID NO: 6206095 - DNA, 18 bp, Homo sapiens
ctttacaaccatacttta

SEQ ID NO: 6206096 - DNA, 22 bp, Homo sapiens
ctttacaagatgggtccaggat

SEQ ID NO: 6206097 - DNA, 17 bp, Homo sapiens
ctttacaagcaggcact

SEQ ID NO: 6206098 - DNA, 16 bp, Homo sapiens
ctttacaatgtgaata

SEQ ID NO: 6206099 - DNA, 14 bp, Homo sapiens
ctttacacacacag

SEQ ID NO: 6206100 - DNA, 13 bp, Homo sapiens
ctttacacacacg

SEQ ID NO: 6206101 - DNA, 22 bp, Homo sapiens
ctttacacatcagtcacaagtt

SEQ ID NO: 6206102 - DNA, 21 bp, Homo sapiens
ctttacacattcggctccctg

SEQ ID NO: 6206103 - DNA, 15 bp, Homo sapiens
ctttacacctcgctg

SEQ ID NO: 6206104 - DNA, 15 bp, Homo sapiens
ctttacactcaggct

SEQ ID NO: 6206105 - DNA, 24 bp, Homo sapiens
ctttacactgcctggtactgatag

SEQ ID NO: 6206106 - DNA, 24 bp, Homo sapiens
ctttacagctctcctccagccctg

SEQ ID NO: 6206107 - DNA, 19 bp, Homo sapiens
ctttacaggaaaaaaaatt

SEQ ID NO: 6206108 - DNA, 17 bp, Homo sapiens
ctttacaggatcatgta

SEQ ID NO: 6206109 - DNA, 22 bp, Homo sapiens
ctttacagtcttttgtgtctgt

SEQ ID NO: 6206110 - DNA, 20 bp, Homo sapiens
ctttacagtttttttctttg

SEQ ID NO: 6206111 - DNA, 21 bp, Homo sapiens
ctttacatctaagaatttttt

SEQ ID NO: 6206112 - DNA, 14 bp, Homo sapiens
ctttacatgcaatt

SEQ ID NO: 6206113 - DNA, 19 bp, Homo sapiens
ctttacatggtggtgatgt

SEQ ID NO: 6206114 - DNA, 16 bp, Homo sapiens
ctttacatttctttta

SEQ ID NO: 6206115 - DNA, 19 bp, Homo sapiens
ctttacatttcttttaaaa

SEQ ID NO: 6206116 - DNA, 18 bp, Homo sapiens
ctttaccaaaaaccatgt

SEQ ID NO: 6206117 - DNA, 19 bp, Homo sapiens
ctttaccaaaaaccatgtt

SEQ ID NO: 6206118 - DNA, 20 bp, Homo sapiens
ctttaccaaacagcaaacca

SEQ ID NO: 6206119 - DNA, 17 bp, Homo sapiens
ctttaccacccccacac

SEQ ID NO: 6206120 - DNA, 14 bp, Homo sapiens
ctttaccactgtgg

SEQ ID NO: 6206121 - DNA, 19 bp, Homo sapiens
ctttaccataaagccttta

SEQ ID NO: 6206122 - DNA, 22 bp, Homo sapiens
ctttaccataaagcctttaaaa

SEQ ID NO: 6206123 - DNA, 15 bp, Homo sapiens
ctttacccctgctga

SEQ ID NO: 6206124 - DNA, 17 bp, Homo sapiens
ctttaccctcatctgtc

SEQ ID NO: 6206125 - DNA, 19 bp, Homo sapiens
ctttaccctctttgctgca

SEQ ID NO: 6206126 - DNA, 18 bp, Homo sapiens
ctttacccttgagccctc

SEQ ID NO: 6206127 - DNA, 19 bp, Homo sapiens
ctttacccttgagccctcc

SEQ ID NO: 6206128 - DNA, 20 bp, Homo sapiens
ctttaccgaggacagcctgc

SEQ ID NO: 6206129 - DNA, 19 bp, Homo sapiens
ctttacctaccaccttccc

SEQ ID NO: 6206130 - DNA, 15 bp, Homo sapiens
ctttacctatggaag

SEQ ID NO: 6206131 - DNA, 14 bp, Homo sapiens
ctttacctgcaggc

SEQ ID NO: 6206132 - DNA, 14 bp, Homo sapiens
ctttaccttcattt

SEQ ID NO: 6206133 - DNA, 14 bp, Homo sapiens
ctttaccttcctca

SEQ ID NO: 6206134 - DNA, 22 bp, Homo sapiens
ctttaccttcctcaggtaacag

SEQ ID NO: 6206135 - DNA, 14 bp, Homo sapiens
ctttaccttcctga

SEQ ID NO: 6206136 - DNA, 15 bp, Homo sapiens
ctttacctttaaaat

SEQ ID NO: 6206137 - DNA, 23 bp, Homo sapiens
ctttacctttttgtatgtgaaca

SEQ ID NO: 6206138 - DNA, 19 bp, Homo sapiens
ctttaccttttttatacat

SEQ ID NO: 6206139 - DNA, 20 bp, Homo sapiens
ctttaccttttttatacata

SEQ ID NO: 6206140 - DNA, 16 bp, Homo sapiens
ctttaccttttttctt

SEQ ID NO: 6206141 - DNA, 16 bp, Homo sapiens
ctttacgcccatctca

SEQ ID NO: 6206142 - DNA, 14 bp, Homo sapiens
ctttactaacactg

SEQ ID NO: 6206143 - DNA, 16 bp, Homo sapiens
ctttactactgcaagt

SEQ ID NO: 6206144 - DNA, 15 bp, Homo sapiens
ctttactactgtgga

SEQ ID NO: 6206145 - DNA, 22 bp, Homo sapiens
ctttactataagactataaata

SEQ ID NO: 6206146 - DNA, 19 bp, Homo sapiens
ctttactatcattctcagt

SEQ ID NO: 6206147 - DNA, 12 bp, Homo sapiens
ctttactccctt

SEQ ID NO: 6206148 - DNA, 18 bp, Homo sapiens
ctttactcccttcctggc

SEQ ID NO: 6206149 - DNA, 14 bp, Homo sapiens
ctttactcctcaca

SEQ ID NO: 6206150 - DNA, 18 bp, Homo sapiens
ctttactcctcacactta

SEQ ID NO: 6206151 - DNA, 23 bp, Homo sapiens
ctttactcctggctcaagccctg

SEQ ID NO: 6206152 - DNA, 21 bp, Homo sapiens
ctttactcggcgtgctccttt

SEQ ID NO: 6206153 - DNA, 15 bp, Homo sapiens
ctttactctctccga

SEQ ID NO: 6206154 - DNA, 22 bp, Homo sapiens
ctttactctgctctatgccagg

SEQ ID NO: 6206155 - DNA, 18 bp, Homo sapiens
ctttactctgtgtttaaa

SEQ ID NO: 6206156 - DNA, 15 bp, Homo sapiens
ctttactgaatgtaa

SEQ ID NO: 6206157 - DNA, 14 bp, Homo sapiens
ctttactgaccctg

SEQ ID NO: 6206158 - DNA, 16 bp, Homo sapiens
ctttactgaccctggg

SEQ ID NO: 6206159 - DNA, 23 bp, Homo sapiens
ctttactgcagcctgggctccct

SEQ ID NO: 6206160 - DNA, 18 bp, Homo sapiens
ctttactgcctgaataaa

SEQ ID NO: 6206161 - DNA, 14 bp, Homo sapiens
ctttactggaaatg

SEQ ID NO: 6206162 - DNA, 18 bp, Homo sapiens
ctttactgtgtatctcaa

SEQ ID NO: 6206163 - DNA, 13 bp, Homo sapiens
ctttactgtttct

SEQ ID NO: 6206164 - DNA, 14 bp, Homo sapiens
ctttactgtttctc

SEQ ID NO: 6206165 - DNA, 13 bp, Homo sapiens
ctttacttaaagt

SEQ ID NO: 6206166 - DNA, 15 bp, Homo sapiens
ctttacttagcttat

SEQ ID NO: 6206167 - DNA, 22 bp, Homo sapiens
ctttacttatctctcaaaacaa

SEQ ID NO: 6206168 - DNA, 18 bp, Homo sapiens
ctttacttgtctttctgg

SEQ ID NO: 6206169 - DNA, 20 bp, Homo sapiens
ctttacttgtctttctgggg

SEQ ID NO: 6206170 - DNA, 18 bp, Homo sapiens
ctttactttcccttgctt

SEQ ID NO: 6206171 - DNA, 19 bp, Homo sapiens
ctttactttcccttgcttt

SEQ ID NO: 6206172 - DNA, 14 bp, Homo sapiens
ctttacttttaaac

SEQ ID NO: 6206173 - DNA, 13 bp, Homo sapiens
ctttagaaaacat

SEQ ID NO: 6206174 - DNA, 14 bp, Homo sapiens
ctttagaaaaggca

SEQ ID NO: 6206175 - DNA, 15 bp, Homo sapiens
ctttagaaaaggcat

SEQ ID NO: 6206176 - DNA, 12 bp, Homo sapiens
ctttagaaaata

SEQ ID NO: 6206177 - DNA, 13 bp, Homo sapiens
ctttagaaaatat

SEQ ID NO: 6206178 - DNA, 20 bp, Homo sapiens
ctttagaaagaaattgtttt

SEQ ID NO: 6206179 - DNA, 14 bp, Homo sapiens
gactccctccatgt

SEQ ID NO: 6206180 - DNA, 17 bp, Homo sapiens
gactccctccccaccca

SEQ ID NO: 6206181 - DNA, 21 bp, Homo sapiens
gactccctccccacccaagag

SEQ ID NO: 6206182 - DNA, 23 bp, Homo sapiens
gactccctccccagatctgtcct

SEQ ID NO: 6206183 - DNA, 20 bp, Homo sapiens
gactccctcctcacctctgg

SEQ ID NO: 6206184 - DNA, 23 bp, Homo sapiens
gactccctcctcacctctggact

SEQ ID NO: 6206185 - DNA, 24 bp, Homo sapiens
gactccctcctcacctctggactg

SEQ ID NO: 6206186 - DNA, 21 bp, Homo sapiens
gactccctgagtctggacctc

SEQ ID NO: 6206187 - DNA, 12 bp, Homo sapiens
gactccctggga

SEQ ID NO: 6206188 - DNA, 12 bp, Homo sapiens
gactccctgtgg

SEQ ID NO: 6206189 - DNA, 23 bp, Homo sapiens
gactccctgtgggggtggccatc

SEQ ID NO: 6206190 - DNA, 19 bp, Homo sapiens
gactccgccctcctcgggc

SEQ ID NO: 6206191 - DNA, 17 bp, Homo sapiens
gactccgcctgaggcca

SEQ ID NO: 6206192 - DNA, 13 bp, Homo sapiens
gactccggaggac

SEQ ID NO: 6206193 - DNA, 16 bp, Homo sapiens
gactccggaggactga

SEQ ID NO: 6206194 - DNA, 18 bp, Homo sapiens
gactccggaggactgagc

SEQ ID NO: 6206195 - DNA, 21 bp, Homo sapiens
gactccggaggactgagcccc

SEQ ID NO: 6206196 - DNA, 22 bp, Homo sapiens
gactccggccctcctaccctgc

SEQ ID NO: 6206197 - DNA, 23 bp, Homo sapiens
gactccgggtttgagatggacac

SEQ ID NO: 6206198 - DNA, 15 bp, Homo sapiens
gactccgtcaagctg

SEQ ID NO: 6206199 - DNA, 21 bp, Homo sapiens
gactcctaatagcttttcctg

SEQ ID NO: 6206200 - DNA, 17 bp, Homo sapiens
gactcctacctgccctg

SEQ ID NO: 6206201 - DNA, 18 bp, Homo sapiens
gactcctacctgccctgg

SEQ ID NO: 6206202 - DNA, 14 bp, Homo sapiens
gactcctagctgtc

SEQ ID NO: 6206203 - DNA, 23 bp, Homo sapiens
gactcctaggcaggacatgctga

SEQ ID NO: 6206204 - DNA, 19 bp, Homo sapiens
gactcctcaaaccacttgc

SEQ ID NO: 6206205 - DNA, 20 bp, Homo sapiens
gactcctcaaaccacttgcc

SEQ ID NO: 6206206 - DNA, 21 bp, Homo sapiens
gactcctcaaaccacttgcct

SEQ ID NO: 6206207 - DNA, 23 bp, Homo sapiens
gactcctcaaaccacttgcctgg

SEQ ID NO: 6206208 - DNA, 12 bp, Homo sapiens
gactcctcagca

SEQ ID NO: 6206209 - DNA, 16 bp, Homo sapiens
gactcctcaggagaga

SEQ ID NO: 6206210 - DNA, 17 bp, Homo sapiens
gactcctcaggagagac

SEQ ID NO: 6206211 - DNA, 19 bp, Homo sapiens
gactcctcaggagagaccc

SEQ ID NO: 6206212 - DNA, 19 bp, Homo sapiens
gactcctccccaccctcct

SEQ ID NO: 6206213 - DNA, 17 bp, Homo sapiens
gactcctccctgggggt

SEQ ID NO: 6206214 - DNA, 19 bp, Homo sapiens
gactcctcctgggggctgg

SEQ ID NO: 6206215 - DNA, 20 bp, Homo sapiens
gactcctcctgggggctggc

SEQ ID NO: 6206216 - DNA, 15 bp, Homo sapiens
gactcctctgggcct

SEQ ID NO: 6206217 - DNA, 16 bp, Homo sapiens
gactcctctgggcctg

SEQ ID NO: 6206218 - DNA, 20 bp, Homo sapiens
gactcctctgggcctggggt

SEQ ID NO: 6206219 - DNA, 19 bp, Homo sapiens
gactcctcttcccagagtc

SEQ ID NO: 6206220 - DNA, 13 bp, Homo sapiens
gactcctgaccat

SEQ ID NO: 6206221 - DNA, 19 bp, Homo sapiens
gactcctgaggacagctgt

SEQ ID NO: 6206222 - DNA, 17 bp, Homo sapiens
gactcctgattgctctg

SEQ ID NO: 6206223 - DNA, 21 bp, Homo sapiens
gactcctgattgctctggaag

SEQ ID NO: 6206224 - DNA, 18 bp, Homo sapiens
gactcctgcaggcagcca

SEQ ID NO: 6206225 - DNA, 21 bp, Homo sapiens
gactcctgcctgagtttccag

SEQ ID NO: 6206226 - DNA, 14 bp, Homo sapiens
gactcctggactcc

SEQ ID NO: 6206227 - DNA, 21 bp, Homo sapiens
gactcctggcagggccacctg

SEQ ID NO: 6206228 - DNA, 12 bp, Homo sapiens
gactcctggctt

SEQ ID NO: 6206229 - DNA, 18 bp, Homo sapiens
gactcctggcttcatgtg

SEQ ID NO: 6206230 - DNA, 10 bp, Homo sapiens
gactcctggg

SEQ ID NO: 6206231 - DNA, 12 bp, Homo sapiens
gactcctgggct

SEQ ID NO: 6206232 - DNA, 11 bp, Homo sapiens
gactcctgggt

SEQ ID NO: 6206233 - DNA, 13 bp, Homo sapiens
gactcctggtgcc

SEQ ID NO: 6206234 - DNA, 16 bp, Homo sapiens
gactcctggtgcccct

SEQ ID NO: 6206235 - DNA, 14 bp, Homo sapiens
gactcctgtggaga

SEQ ID NO: 6206236 - DNA, 12 bp, Homo sapiens
gactccttagac

SEQ ID NO: 6206237 - DNA, 17 bp, Homo sapiens
gactccttctccccaat

SEQ ID NO: 6206238 - DNA, 23 bp, Homo sapiens
gactccttctccccaatcacgag

SEQ ID NO: 6206239 - DNA, 22 bp, Homo sapiens
gactccttgagagaccaggcaa

SEQ ID NO: 6206240 - DNA, 15 bp, Homo sapiens
gactcctttcctctg

SEQ ID NO: 6206241 - DNA, 23 bp, Homo sapiens
gactcctttcctgcatctttcat

SEQ ID NO: 6206242 - DNA, 13 bp, Homo sapiens
gactcctttctct

SEQ ID NO: 6206243 - DNA, 20 bp, Homo sapiens
gactcctttggtatttcact

SEQ ID NO: 6206244 - DNA, 16 bp, Homo sapiens
gactccttttggaacc

SEQ ID NO: 6206245 - DNA, 13 bp, Homo sapiens
gactcgaaactga

SEQ ID NO: 6206246 - DNA, 22 bp, Homo sapiens
gactcgaataaaatctgctgca

SEQ ID NO: 6206247 - DNA, 16 bp, Homo sapiens
gactcgactctgtgcc

SEQ ID NO: 6206248 - DNA, 17 bp, Homo sapiens
gactcgactctgtgcct

SEQ ID NO: 6206249 - DNA, 16 bp, Homo sapiens
gactcgagaactttca

SEQ ID NO: 6206250 - DNA, 17 bp, Homo sapiens
gactcgagagggctgag

SEQ ID NO: 6206251 - DNA, 18 bp, Homo sapiens
gactcgagtccccatgat

SEQ ID NO: 6206252 - DNA, 14 bp, Homo sapiens
gactcgccactggt

SEQ ID NO: 6206253 - DNA, 13 bp, Homo sapiens
gactcgcgacaat

SEQ ID NO: 6206254 - DNA, 19 bp, Homo sapiens
gactcgcgacaatgcaaac

SEQ ID NO: 6206255 - DNA, 19 bp, Homo sapiens
gactcgcttagctgaaacc

SEQ ID NO: 6206256 - DNA, 13 bp, Homo sapiens
gactcgcttgtaa

SEQ ID NO: 6206257 - DNA, 15 bp, Homo sapiens
gactcggccactgtg

SEQ ID NO: 6206258 - DNA, 22 bp, Homo sapiens
gactcggccactgtgtctctgt

SEQ ID NO: 6206259 - DNA, 16 bp, Homo sapiens
gactcggccccgtctc

SEQ ID NO: 6206260 - DNA, 20 bp, Homo sapiens
gactcggccccgtctcctga

SEQ ID NO: 6206261 - DNA, 16 bp, Homo sapiens
gactcgggagctgcac

SEQ ID NO: 6206262 - DNA, 21 bp, Homo sapiens
gactcgggctaagtccagctc

SEQ ID NO: 6206263 - DNA, 23 bp, Homo sapiens
gactcgggctaagtccagctctc

SEQ ID NO: 6206264 - DNA, 19 bp, Homo sapiens
gactcgggctcctgtgccc

SEQ ID NO: 6206265 - DNA, 15 bp, Homo sapiens
gactcggtgagccgg

SEQ ID NO: 6206266 - DNA, 16 bp, Homo sapiens
gactcggtgagccggg

SEQ ID NO: 6206267 - DNA, 19 bp, Homo sapiens
gactcgtggcgcgggagct

SEQ ID NO: 6206268 - DNA, 23 bp, Homo sapiens
gactcgtggcgcgggagctggga

SEQ ID NO: 6206269 - DNA, 21 bp, Homo sapiens
gactctaaaactatcagcagc

SEQ ID NO: 6206270 - DNA, 14 bp, Homo sapiens
gactctaaaatatg

SEQ ID NO: 6206271 - DNA, 23 bp, Homo sapiens
gactctaagatacactgcacttt

SEQ ID NO: 6206272 - DNA, 16 bp, Homo sapiens
gactctaagctggagc

SEQ ID NO: 6206273 - DNA, 13 bp, Homo sapiens
gactctaagctgt

SEQ ID NO: 6206274 - DNA, 17 bp, Homo sapiens
gactctaagctgtgtgc

SEQ ID NO: 6206275 - DNA, 21 bp, Homo sapiens
gactctaaggttatctacttt

SEQ ID NO: 6206276 - DNA, 15 bp, Homo sapiens
gactctacagaggcc

SEQ ID NO: 6206277 - DNA, 20 bp, Homo sapiens
gactctaccagactgtgtat

SEQ ID NO: 6206278 - DNA, 14 bp, Homo sapiens
gactctagcaaggc

SEQ ID NO: 6206279 - DNA, 15 bp, Homo sapiens
gactctagtccttgg

SEQ ID NO: 6206280 - DNA, 21 bp, Homo sapiens
gactctatactaccctgggct

SEQ ID NO: 6206281 - DNA, 12 bp, Homo sapiens
gactctatgctc

SEQ ID NO: 6206282 - DNA, 14 bp, Homo sapiens
gactctattcttta

SEQ ID NO: 6206283 - DNA, 15 bp, Homo sapiens
gactctattctttaa

SEQ ID NO: 6206284 - DNA, 12 bp, Homo sapiens
gactctcacctg

SEQ ID NO: 6206285 - DNA, 16 bp, Homo sapiens
gactctcagcccagaa

SEQ ID NO: 6206286 - DNA, 18 bp, Homo sapiens
gactctccaggcaccgcc

SEQ ID NO: 6206287 - DNA, 19 bp, Homo sapiens
gactctccaggcaccgcct

SEQ ID NO: 6206288 - DNA, 20 bp, Homo sapiens
gactctccaggcaccgcctg

SEQ ID NO: 6206289 - DNA, 24 bp, Homo sapiens
gactctccaggggtcctaggcctc

SEQ ID NO: 6206290 - DNA, 22 bp, Homo sapiens
gactctccatatgtgagcacta

SEQ ID NO: 6206291 - DNA, 23 bp, Homo sapiens
gactctccctgtacacagtgccc

SEQ ID NO: 6206292 - DNA, 18 bp, Homo sapiens
gactctcctcctcccctc

SEQ ID NO: 6206293 - DNA, 17 bp, Homo sapiens
gactctcctgcctcagc

SEQ ID NO: 6206294 - DNA, 22 bp, Homo sapiens
gactctcctgcctcagcctccc

SEQ ID NO: 6206295 - DNA, 19 bp, Homo sapiens
gactctcgtgatatgctgc

SEQ ID NO: 6206296 - DNA, 16 bp, Homo sapiens
gactctctccaggagg

SEQ ID NO: 6206297 - DNA, 18 bp, Homo sapiens
gactctctccatcagaag

SEQ ID NO: 6206298 - DNA, 14 bp, Homo sapiens
gactctctcctctc

SEQ ID NO: 6206299 - DNA, 16 bp, Homo sapiens
gactctctgagctggg

SEQ ID NO: 6206300 - DNA, 16 bp, Homo sapiens
gactctctgcctgctt

SEQ ID NO: 6206301 - DNA, 13 bp, Homo sapiens
gactctctgcttg

SEQ ID NO: 6206302 - DNA, 12 bp, Homo sapiens
gactctctgtga

SEQ ID NO: 6206303 - DNA, 15 bp, Homo sapiens
gactctctgtgacct

SEQ ID NO: 6206304 - DNA, 23 bp, Homo sapiens
gactctctttcttccactaccct

SEQ ID NO: 6206305 - DNA, 17 bp, Homo sapiens
gactctgaaactataga

SEQ ID NO: 6206306 - DNA, 14 bp, Homo sapiens
gactctgaaatctg

SEQ ID NO: 6206307 - DNA, 19 bp, Homo sapiens
gactctgaagcctctggga

SEQ ID NO: 6206308 - DNA, 21 bp, Homo sapiens
gactctgaatctttttcagaa

SEQ ID NO: 6206309 - DNA, 18 bp, Homo sapiens
gactctgagatgtggaga

SEQ ID NO: 6206310 - DNA, 10 bp, Homo sapiens
gactctgagc

SEQ ID NO: 6206311 - DNA, 14 bp, Homo sapiens
gactctgagccaag

SEQ ID NO: 6206312 - DNA, 22 bp, Homo sapiens
gactctgagccaagggagggaa

SEQ ID NO: 6206313 - DNA, 24 bp, Homo sapiens
gactctgagccaagggagggaagg

SEQ ID NO: 6206314 - DNA, 22 bp, Homo sapiens
gactctgaggctctttctgggc

SEQ ID NO: 6206315 - DNA, 20 bp, Homo sapiens
gactctgagtccactgctcc

SEQ ID NO: 6206316 - DNA, 20 bp, Homo sapiens
gactctgattctacagtgat

SEQ ID NO: 6206317 - DNA, 20 bp, Homo sapiens
gactctgcaagtgtctggag

SEQ ID NO: 6206318 - DNA, 15 bp, Homo sapiens
gactctgcacatgtc

SEQ ID NO: 6206319 - DNA, 19 bp, Homo sapiens
gactctgcacatgtcttgt

SEQ ID NO: 6206320 - DNA, 20 bp, Homo sapiens
gactctgcacatgtcttgta

SEQ ID NO: 6206321 - DNA, 12 bp, Homo sapiens
gactctgcactc

SEQ ID NO: 6206322 - DNA, 21 bp, Homo sapiens
gactctgcagatagtgcctct

SEQ ID NO: 6206323 - DNA, 22 bp, Homo sapiens
gactctgcagatagtgcctctg

SEQ ID NO: 6206324 - DNA, 15 bp, Homo sapiens
gactctgcagccctc

SEQ ID NO: 6206325 - DNA, 15 bp, Homo sapiens
gactctgcagcctca

SEQ ID NO: 6206326 - DNA, 11 bp, Homo sapiens
gactctgcccc

SEQ ID NO: 6206327 - DNA, 21 bp, Homo sapiens
gactctgccccctgctggctc

SEQ ID NO: 6206328 - DNA, 22 bp, Homo sapiens
gactctgccccctgctggctct

SEQ ID NO: 6206329 - DNA, 16 bp, Homo sapiens
gactctgccccttctg

SEQ ID NO: 6206330 - DNA, 23 bp, Homo sapiens
gactctgccccttctgtttccat

SEQ ID NO: 6206331 - DNA, 11 bp, Homo sapiens
gactctgccta

SEQ ID NO: 6206332 - DNA, 20 bp, Homo sapiens
gactctgcctaaccatgggc

SEQ ID NO: 6206333 - DNA, 17 bp, Homo sapiens
gactctgccttccaggc

SEQ ID NO: 6206334 - DNA, 22 bp, Homo sapiens
gactctgcgggaggctggggcc

SEQ ID NO: 6206335 - DNA, 23 bp, Homo sapiens
gactctgcgggaggctggggccc

SEQ ID NO: 6206336 - DNA, 13 bp, Homo sapiens
gactctgcttaaa

SEQ ID NO: 6206337 - DNA, 22 bp, Homo sapiens
gactctgcttaaacaaagcagt

SEQ ID NO: 6206338 - DNA, 23 bp, Homo sapiens
gactctgcttaaacaaagcagta

SEQ ID NO: 6206339 - DNA, 17 bp, Homo sapiens
gactctgcttggctgtc

SEQ ID NO: 6206340 - DNA, 23 bp, Homo sapiens
gactctggaaccatcctctgtta

SEQ ID NO: 6206341 - DNA, 18 bp, Homo sapiens
gactctggactgggaagg

SEQ ID NO: 6206342 - DNA, 20 bp, Homo sapiens
gactctggactttctctaat

SEQ ID NO: 6206343 - DNA, 22 bp, Homo sapiens
gactctggactttctctaataa

SEQ ID NO: 6206344 - DNA, 15 bp, Homo sapiens
gactctggagccaag

SEQ ID NO: 6206345 - DNA, 23 bp, Homo sapiens
gactctggaggtcatctggcgga

SEQ ID NO: 6206346 - DNA, 13 bp, Homo sapiens
gactctggcacag

SEQ ID NO: 6206347 - DNA, 16 bp, Homo sapiens
gactctggcacttcca

SEQ ID NO: 6206348 - DNA, 14 bp, Homo sapiens
gactctggccctgg

SEQ ID NO: 6206349 - DNA, 18 bp, Homo sapiens
gactctggccctggccct

SEQ ID NO: 6206350 - DNA, 13 bp, Homo sapiens
gactctggcctcc

SEQ ID NO: 6206351 - DNA, 16 bp, Homo sapiens
gactctggcttggcct

SEQ ID NO: 6206352 - DNA, 22 bp, Homo sapiens
gactctgggctatggacacagg

SEQ ID NO: 6206353 - DNA, 18 bp, Homo sapiens
gactctgggctgtgcctg

SEQ ID NO: 6206354 - DNA, 16 bp, Homo sapiens
gactctggggactccg

SEQ ID NO: 6206355 - DNA, 19 bp, Homo sapiens
gactctgggtccctcggag

SEQ ID NO: 6206356 - DNA, 19 bp, Homo sapiens
ctttagaaaggttttgagc

SEQ ID NO: 6206357 - DNA, 18 bp, Homo sapiens
ctttagaacaacataaaa

SEQ ID NO: 6206358 - DNA, 19 bp, Homo sapiens
ctttagaacaacataaaat

SEQ ID NO: 6206359 - DNA, 16 bp, Homo sapiens
ctttagaacaggagac

SEQ ID NO: 6206360 - DNA, 24 bp, Homo sapiens
ctttagaactctagagagccttaa

SEQ ID NO: 6206361 - DNA, 20 bp, Homo sapiens
ctttagaagtgcatttctga

SEQ ID NO: 6206362 - DNA, 19 bp, Homo sapiens
ctttagaatattaaaaatt

SEQ ID NO: 6206363 - DNA, 17 bp, Homo sapiens
ctttagaatgttttcct

SEQ ID NO: 6206364 - DNA, 18 bp, Homo sapiens
ctttagaatttttaccca

SEQ ID NO: 6206365 - DNA, 19 bp, Homo sapiens
ctttagaatttttacccaa

SEQ ID NO: 6206366 - DNA, 16 bp, Homo sapiens
ctttagacatttttgt

SEQ ID NO: 6206367 - DNA, 20 bp, Homo sapiens
ctttagaccctcgggcccca

SEQ ID NO: 6206368 - DNA, 14 bp, Homo sapiens
ctttagaccctggg

SEQ ID NO: 6206369 - DNA, 16 bp, Homo sapiens
ctttagaccctgggtg

SEQ ID NO: 6206370 - DNA, 13 bp, Homo sapiens
ctttagacttgaa

SEQ ID NO: 6206371 - DNA, 14 bp, Homo sapiens
ctttagagaagatg

SEQ ID NO: 6206372 - DNA, 16 bp, Homo sapiens
ctttagagaagccata

SEQ ID NO: 6206373 - DNA, 14 bp, Homo sapiens
ctttagagattata

SEQ ID NO: 6206374 - DNA, 15 bp, Homo sapiens
ctttagagcagcttt

SEQ ID NO: 6206375 - DNA, 19 bp, Homo sapiens
ctttagagcattgccattc

SEQ ID NO: 6206376 - DNA, 23 bp, Homo sapiens
ctttagagcattgccattccctg

SEQ ID NO: 6206377 - DNA, 20 bp, Homo sapiens
ctttagaggctttcaaatgt

SEQ ID NO: 6206378 - DNA, 17 bp, Homo sapiens
ctttagagtgactaaaa

SEQ ID NO: 6206379 - DNA, 14 bp, Homo sapiens
ctttagagttagac

SEQ ID NO: 6206380 - DNA, 17 bp, Homo sapiens
ctttagagttagactgt

SEQ ID NO: 6206381 - DNA, 19 bp, Homo sapiens
ctttagatagccctgtcct

SEQ ID NO: 6206382 - DNA, 13 bp, Homo sapiens
ctttagatgctga

SEQ ID NO: 6206383 - DNA, 23 bp, Homo sapiens
ctttagatggtggcacattcctt

SEQ ID NO: 6206384 - DNA, 12 bp, Homo sapiens
ctttagattaaa

SEQ ID NO: 6206385 - DNA, 18 bp, Homo sapiens
ctttagattgaaatttat

SEQ ID NO: 6206386 - DNA, 14 bp, Homo sapiens
ctttagatttaatg

SEQ ID NO: 6206387 - DNA, 12 bp, Homo sapiens
ctttagatttca

SEQ ID NO: 6206388 - DNA, 22 bp, Homo sapiens
ctttagattttgatagcaatgt

SEQ ID NO: 6206389 - DNA, 17 bp, Homo sapiens
ctttagatttttaaatt

SEQ ID NO: 6206390 - DNA, 19 bp, Homo sapiens
ctttagcagatattaaaaa

SEQ ID NO: 6206391 - DNA, 14 bp, Homo sapiens
ctttagcagggaag

SEQ ID NO: 6206392 - DNA, 21 bp, Homo sapiens
ctttagcagtttcctcagtga

SEQ ID NO: 6206393 - DNA, 19 bp, Homo sapiens
ctttagcataaaagaatat

SEQ ID NO: 6206394 - DNA, 19 bp, Homo sapiens
ctttagcatttttatgcag

SEQ ID NO: 6206395 - DNA, 22 bp, Homo sapiens
ctttagcatttttatgcagaca

SEQ ID NO: 6206396 - DNA, 22 bp, Homo sapiens
ctttagccactggtttctcaga

SEQ ID NO: 6206397 - DNA, 10 bp, Homo sapiens
ctttagcccc

SEQ ID NO: 6206398 - DNA, 17 bp, Homo sapiens
ctttagccccactgctt

SEQ ID NO: 6206399 - DNA, 23 bp, Homo sapiens
ctttagcccctcccaagctggct

SEQ ID NO: 6206400 - DNA, 13 bp, Homo sapiens
ctttagcctgggc

SEQ ID NO: 6206401 - DNA, 14 bp, Homo sapiens
ctttagcctgggca

SEQ ID NO: 6206402 - DNA, 15 bp, Homo sapiens
ctttagcgcccagtt

SEQ ID NO: 6206403 - DNA, 16 bp, Homo sapiens
ctttagctatgtggat

SEQ ID NO: 6206404 - DNA, 15 bp, Homo sapiens
ctttagcttacctgg

SEQ ID NO: 6206405 - DNA, 16 bp, Homo sapiens
ctttagcttacctggg

SEQ ID NO: 6206406 - DNA, 16 bp, Homo sapiens
ctttagcttcatttta

SEQ ID NO: 6206407 - DNA, 16 bp, Homo sapiens
ctttagcttctctgcc

SEQ ID NO: 6206408 - DNA, 11 bp, Homo sapiens
ctttaggaaat

SEQ ID NO: 6206409 - DNA, 21 bp, Homo sapiens
ctttaggacataaagagagcc

SEQ ID NO: 6206410 - DNA, 17 bp, Homo sapiens
ctttaggatgagcaaaa

SEQ ID NO: 6206411 - DNA, 14 bp, Homo sapiens
ctttaggcagcctg

SEQ ID NO: 6206412 - DNA, 16 bp, Homo sapiens
ctttaggcagcctgcc

SEQ ID NO: 6206413 - DNA, 17 bp, Homo sapiens
ctttaggctttcagctt

SEQ ID NO: 6206414 - DNA, 13 bp, Homo sapiens
ctttagggcagct

SEQ ID NO: 6206415 - DNA, 22 bp, Homo sapiens
ctttagggctgttgctagggag

SEQ ID NO: 6206416 - DNA, 21 bp, Homo sapiens
ctttagggcttatggccaggg

SEQ ID NO: 6206417 - DNA, 19 bp, Homo sapiens
ctttaggggaagtaaaaca

SEQ ID NO: 6206418 - DNA, 18 bp, Homo sapiens
ctttagggggtgggaggg

SEQ ID NO: 6206419 - DNA, 20 bp, Homo sapiens
ctttagggggtgggaggggg

SEQ ID NO: 6206420 - DNA, 23 bp, Homo sapiens
ctttaggtagtagaatctcagca

SEQ ID NO: 6206421 - DNA, 16 bp, Homo sapiens
ctttaggtctttgtaa

SEQ ID NO: 6206422 - DNA, 22 bp, Homo sapiens
ctttaggtgagtcacactcaga

SEQ ID NO: 6206423 - DNA, 21 bp, Homo sapiens
ctttaggtgcctcctgtctta

SEQ ID NO: 6206424 - DNA, 20 bp, Homo sapiens
ctttaggttgcttcagctga

SEQ ID NO: 6206425 - DNA, 20 bp, Homo sapiens
ctttaggtttttttaatgat

SEQ ID NO: 6206426 - DNA, 22 bp, Homo sapiens
ctttaggtttttttaatgatat

SEQ ID NO: 6206427 - DNA, 17 bp, Homo sapiens
ctttagtacaatttcaa

SEQ ID NO: 6206428 - DNA, 22 bp, Homo sapiens
ctttagtacatggagctcaggt

SEQ ID NO: 6206429 - DNA, 13 bp, Homo sapiens
ctttagtactcaa

SEQ ID NO: 6206430 - DNA, 21 bp, Homo sapiens
ctttagtactcaatgtttctg

SEQ ID NO: 6206431 - DNA, 22 bp, Homo sapiens
ctttagtagtaacaaaagggtt

SEQ ID NO: 6206432 - DNA, 16 bp, Homo sapiens
ctttagtcatttaaga

SEQ ID NO: 6206433 - DNA, 18 bp, Homo sapiens
ctttagtcatttaagaat

SEQ ID NO: 6206434 - DNA, 14 bp, Homo sapiens
ctttagtctgcaaa

SEQ ID NO: 6206435 - DNA, 20 bp, Homo sapiens
ctttagtgaacgtggactcc

SEQ ID NO: 6206436 - DNA, 16 bp, Homo sapiens
ctttagtgattgcttt

SEQ ID NO: 6206437 - DNA, 13 bp, Homo sapiens
ctttagtgccctg

SEQ ID NO: 6206438 - DNA, 16 bp, Homo sapiens
ctttagtgccctgccc

SEQ ID NO: 6206439 - DNA, 22 bp, Homo sapiens
ctttagtgccctgccccctggc

SEQ ID NO: 6206440 - DNA, 22 bp, Homo sapiens
ctttagtgccggctgtggagca

SEQ ID NO: 6206441 - DNA, 23 bp, Homo sapiens
ctttagtgttcaaatacttcaaa

SEQ ID NO: 6206442 - DNA, 15 bp, Homo sapiens
ctttagtgttctgtt

SEQ ID NO: 6206443 - DNA, 23 bp, Homo sapiens
ctttagtgttctgtttgaaacta

SEQ ID NO: 6206444 - DNA, 17 bp, Homo sapiens
ctttagttatattcact

SEQ ID NO: 6206445 - DNA, 19 bp, Homo sapiens
ctttagttgaattccaagt

SEQ ID NO: 6206446 - DNA, 21 bp, Homo sapiens
ctttagtttttggttgggaat

SEQ ID NO: 6206447 - DNA, 23 bp, Homo sapiens
ctttagtttttggttgggaatga

SEQ ID NO: 6206448 - DNA, 18 bp, Homo sapiens
ctttataaaaaaaagttg

SEQ ID NO: 6206449 - DNA, 20 bp, Homo sapiens
ctttataaagctgttcttga

SEQ ID NO: 6206450 - DNA, 11 bp, Homo sapiens
ctttataaata

SEQ ID NO: 6206451 - DNA, 13 bp, Homo sapiens
ctttataaataaa

SEQ ID NO: 6206452 - DNA, 13 bp, Homo sapiens
ctttataaatcca

SEQ ID NO: 6206453 - DNA, 18 bp, Homo sapiens
ctttataaatccagtgac

SEQ ID NO: 6206454 - DNA, 16 bp, Homo sapiens
ctttataaatctttct

SEQ ID NO: 6206455 - DNA, 20 bp, Homo sapiens
ctttataaatctttctctca

SEQ ID NO: 6206456 - DNA, 13 bp, Homo sapiens
ctttataaatgta

SEQ ID NO: 6206457 - DNA, 17 bp, Homo sapiens
ctttataaccaaagcaa

SEQ ID NO: 6206458 - DNA, 13 bp, Homo sapiens
ctttataagaaag

SEQ ID NO: 6206459 - DNA, 19 bp, Homo sapiens
ctttataaggaaatgtatt

SEQ ID NO: 6206460 - DNA, 18 bp, Homo sapiens
ctttataaggttgtctgt

SEQ ID NO: 6206461 - DNA, 20 bp, Homo sapiens
ctttataagtcattgtatgt

SEQ ID NO: 6206462 - DNA, 18 bp, Homo sapiens
ctttataataaactgttt

SEQ ID NO: 6206463 - DNA, 14 bp, Homo sapiens
ctttataatcaaga

SEQ ID NO: 6206464 - DNA, 20 bp, Homo sapiens
ctttataatggctctgggct

SEQ ID NO: 6206465 - DNA, 19 bp, Homo sapiens
ctttataattctactttga

SEQ ID NO: 6206466 - DNA, 15 bp, Homo sapiens
ctttatacaacagtg

SEQ ID NO: 6206467 - DNA, 17 bp, Homo sapiens
ctttatacaacagtgct

SEQ ID NO: 6206468 - DNA, 18 bp, Homo sapiens
ctttatacaacgattgta

SEQ ID NO: 6206469 - DNA, 19 bp, Homo sapiens
ctttatacacttctggctc

SEQ ID NO: 6206470 - DNA, 14 bp, Homo sapiens
ctttatacagaact

SEQ ID NO: 6206471 - DNA, 23 bp, Homo sapiens
ctttatacagctgtattgtctga

SEQ ID NO: 6206472 - DNA, 12 bp, Homo sapiens
ctttatacatta

SEQ ID NO: 6206473 - DNA, 18 bp, Homo sapiens
ctttatactctcttccct

SEQ ID NO: 6206474 - DNA, 14 bp, Homo sapiens
ctttatactgtgaa

SEQ ID NO: 6206475 - DNA, 15 bp, Homo sapiens
ctttatagagctctt

SEQ ID NO: 6206476 - DNA, 13 bp, Homo sapiens
ctttatagatgta

SEQ ID NO: 6206477 - DNA, 16 bp, Homo sapiens
ctttatagctcatcac

SEQ ID NO: 6206478 - DNA, 18 bp, Homo sapiens
ctttatagctctcatcac

SEQ ID NO: 6206479 - DNA, 20 bp, Homo sapiens
ctttatagctgcaagtgtat

SEQ ID NO: 6206480 - DNA, 17 bp, Homo sapiens
ctttataggcagtagac

SEQ ID NO: 6206481 - DNA, 17 bp, Homo sapiens
ctttatagtgaagtgtt

SEQ ID NO: 6206482 - DNA, 20 bp, Homo sapiens
ctttatagtgcacaaaatga

SEQ ID NO: 6206483 - DNA, 13 bp, Homo sapiens
ctttatataaggt

SEQ ID NO: 6206484 - DNA, 15 bp, Homo sapiens
ctttatatatggaca

SEQ ID NO: 6206485 - DNA, 12 bp, Homo sapiens
ctttatatatgt

SEQ ID NO: 6206486 - DNA, 15 bp, Homo sapiens
ctttatatattgatt

SEQ ID NO: 6206487 - DNA, 17 bp, Homo sapiens
ctttatatctgtaatga

SEQ ID NO: 6206488 - DNA, 18 bp, Homo sapiens
ctttatatcttgtttaca

SEQ ID NO: 6206489 - DNA, 19 bp, Homo sapiens
ctttatatgaacatagact

SEQ ID NO: 6206490 - DNA, 20 bp, Homo sapiens
ctttatatggcctcaagatc

SEQ ID NO: 6206491 - DNA, 22 bp, Homo sapiens
ctttatatttcaataaatgata

SEQ ID NO: 6206492 - DNA, 15 bp, Homo sapiens
ctttatatttgctcc

SEQ ID NO: 6206493 - DNA, 16 bp, Homo sapiens
ctttatattttctata

SEQ ID NO: 6206494 - DNA, 18 bp, Homo sapiens
ctttatattttctatatt

SEQ ID NO: 6206495 - DNA, 22 bp, Homo sapiens
ctttatattttctatatttgta

SEQ ID NO: 6206496 - DNA, 12 bp, Homo sapiens
ctttatattttg

SEQ ID NO: 6206497 - DNA, 16 bp, Homo sapiens
ctttatcaaagattgg

SEQ ID NO: 6206498 - DNA, 21 bp, Homo sapiens
ctttatcaaagggtgaaaatt

SEQ ID NO: 6206499 - DNA, 22 bp, Homo sapiens
ctttatcaaagggtgaaaatta

SEQ ID NO: 6206500 - DNA, 14 bp, Homo sapiens
ctttatcaatgtgt

SEQ ID NO: 6206501 - DNA, 20 bp, Homo sapiens
ctttatcacctggcttgttt

SEQ ID NO: 6206502 - DNA, 13 bp, Homo sapiens
ctttatcactttt

SEQ ID NO: 6206503 - DNA, 17 bp, Homo sapiens
ctttatcactttttgaa

SEQ ID NO: 6206504 - DNA, 22 bp, Homo sapiens
ctttatcaggggacaaaccagg

SEQ ID NO: 6206505 - DNA, 22 bp, Homo sapiens
ctttatcagtgatggtctcaca

SEQ ID NO: 6206506 - DNA, 23 bp, Homo sapiens
ctttatcataaacattttacatg

SEQ ID NO: 6206507 - DNA, 17 bp, Homo sapiens
ctttatcatgtgtttct

SEQ ID NO: 6206508 - DNA, 19 bp, Homo sapiens
ctttatcatgtgtttctgt

SEQ ID NO: 6206509 - DNA, 20 bp, Homo sapiens
ctttatcattaaacatgaat

SEQ ID NO: 6206510 - DNA, 22 bp, Homo sapiens
ctttatccagctagtgccaaat

SEQ ID NO: 6206511 - DNA, 20 bp, Homo sapiens
ctttatccaggggcttcacc

SEQ ID NO: 6206512 - DNA, 15 bp, Homo sapiens
ctttatcccctcctt

SEQ ID NO: 6206513 - DNA, 16 bp, Homo sapiens
ctttatccttaggaaa

SEQ ID NO: 6206514 - DNA, 19 bp, Homo sapiens
ctttatctaaggaaacatt

SEQ ID NO: 6206515 - DNA, 20 bp, Homo sapiens
ctttatctaccaactttcaa

SEQ ID NO: 6206516 - DNA, 21 bp, Homo sapiens
ctttatctaccaactttcaag

SEQ ID NO: 6206517 - DNA, 23 bp, Homo sapiens
ctttatctatgggagattaaaac

SEQ ID NO: 6206518 - DNA, 16 bp, Homo sapiens
ctttatctcctgctct

SEQ ID NO: 6206519 - DNA, 17 bp, Homo sapiens
ctttatctctgaggcta

SEQ ID NO: 6206520 - DNA, 13 bp, Homo sapiens
ctttatctgggct

SEQ ID NO: 6206521 - DNA, 18 bp, Homo sapiens
ctttatctgttcttgcta

SEQ ID NO: 6206522 - DNA, 19 bp, Homo sapiens
ctttatctttatctttata

SEQ ID NO: 6206523 - DNA, 18 bp, Homo sapiens
ctttatctttcacctttc

SEQ ID NO: 6206524 - DNA, 13 bp, Homo sapiens
ctttatctttgtg

SEQ ID NO: 6206525 - DNA, 19 bp, Homo sapiens
ctttatgaaaaaaaaagaa

SEQ ID NO: 6206526 - DNA, 23 bp, Homo sapiens
ctttatgaaatatccttacttta

SEQ ID NO: 6206527 - DNA, 22 bp, Homo sapiens
ctttatgaatgaaaaaacagtc

SEQ ID NO: 6206528 - DNA, 23 bp, Homo sapiens
ctttatgaattattttgataaat

SEQ ID NO: 6206529 - DNA, 15 bp, Homo sapiens
ctttatgagcagcaa

SEQ ID NO: 6206530 - DNA, 22 bp, Homo sapiens
ctttatgagctaaaaatatgca

SEQ ID NO: 6206531 - DNA, 20 bp, Homo sapiens
ctttatgataacaacactgt

SEQ ID NO: 6206532 - DNA, 20 bp, Homo sapiens
ctttatgataatagattctc

SEQ ID NO: 6206533 - DNA, 21 bp, Homo sapiens
gactctgggtccctcggagct

SEQ ID NO: 6206534 - DNA, 20 bp, Homo sapiens
gactctgggtccttcctgaa

SEQ ID NO: 6206535 - DNA, 22 bp, Homo sapiens
gactctgggtggaagtgcccag

SEQ ID NO: 6206536 - DNA, 20 bp, Homo sapiens
gactctgtaaccacctctct

SEQ ID NO: 6206537 - DNA, 17 bp, Homo sapiens
gactctgtccaactctg

SEQ ID NO: 6206538 - DNA, 19 bp, Homo sapiens
gactctgtctacctggtct

SEQ ID NO: 6206539 - DNA, 19 bp, Homo sapiens
gactctgtctcaaaaaaac

SEQ ID NO: 6206540 - DNA, 13 bp, Homo sapiens
gactctgtctcag

SEQ ID NO: 6206541 - DNA, 13 bp, Homo sapiens
gactctgtgctca

SEQ ID NO: 6206542 - DNA, 16 bp, Homo sapiens
gactctgtggggccac

SEQ ID NO: 6206543 - DNA, 17 bp, Homo sapiens
gactctgtggggccttg

SEQ ID NO: 6206544 - DNA, 12 bp, Homo sapiens
gactctgtgtgg

SEQ ID NO: 6206545 - DNA, 16 bp, Homo sapiens
gactctgtgtggctgt

SEQ ID NO: 6206546 - DNA, 13 bp, Homo sapiens
gactctgttattg

SEQ ID NO: 6206547 - DNA, 13 bp, Homo sapiens
gactctgttgctg

SEQ ID NO: 6206548 - DNA, 15 bp, Homo sapiens
gactcttaagaagac

SEQ ID NO: 6206549 - DNA, 17 bp, Homo sapiens
gactcttaagttttgtt

SEQ ID NO: 6206550 - DNA, 21 bp, Homo sapiens
gactcttactaaccaccattt

SEQ ID NO: 6206551 - DNA, 17 bp, Homo sapiens
gactcttcaaaaactgt

SEQ ID NO: 6206552 - DNA, 14 bp, Homo sapiens
gactcttccaccag

SEQ ID NO: 6206553 - DNA, 19 bp, Homo sapiens
gactcttccaccagagcag

SEQ ID NO: 6206554 - DNA, 19 bp, Homo sapiens
gactcttccattcagtttt

SEQ ID NO: 6206555 - DNA, 19 bp, Homo sapiens
gactcttcccctccctccc

SEQ ID NO: 6206556 - DNA, 20 bp, Homo sapiens
gactcttcccctccctccca

SEQ ID NO: 6206557 - DNA, 13 bp, Homo sapiens
gactcttccctca

SEQ ID NO: 6206558 - DNA, 16 bp, Homo sapiens
gactcttccctgggaa

SEQ ID NO: 6206559 - DNA, 10 bp, Homo sapiens
gactcttccg

SEQ ID NO: 6206560 - DNA, 13 bp, Homo sapiens
gactcttcctgca

SEQ ID NO: 6206561 - DNA, 16 bp, Homo sapiens
gactcttcctgcaaag

SEQ ID NO: 6206562 - DNA, 22 bp, Homo sapiens
gactcttcctttatcccctcct

SEQ ID NO: 6206563 - DNA, 17 bp, Homo sapiens
gactcttctcggctcag

SEQ ID NO: 6206564 - DNA, 13 bp, Homo sapiens
gactcttctctca

SEQ ID NO: 6206565 - DNA, 16 bp, Homo sapiens
gactcttgagttgttt

SEQ ID NO: 6206566 - DNA, 20 bp, Homo sapiens
gactcttgcctttccacctg

SEQ ID NO: 6206567 - DNA, 15 bp, Homo sapiens
gactcttgctctttc

SEQ ID NO: 6206568 - DNA, 16 bp, Homo sapiens
gactcttgctctttct

SEQ ID NO: 6206569 - DNA, 11 bp, Homo sapiens
gactcttggag

SEQ ID NO: 6206570 - DNA, 9 bp, Homo sapiens
gactcttgt

SEQ ID NO: 6206571 - DNA, 20 bp, Homo sapiens
gactctttagcaaaaaaaac

SEQ ID NO: 6206572 - DNA, 22 bp, Homo sapiens
gactctttatttttctctttct

SEQ ID NO: 6206573 - DNA, 15 bp, Homo sapiens
gactctttcaaagaa

SEQ ID NO: 6206574 - DNA, 19 bp, Homo sapiens
gactctttcaaagaaatcc

SEQ ID NO: 6206575 - DNA, 18 bp, Homo sapiens
gactctttcctaaagcca

SEQ ID NO: 6206576 - DNA, 19 bp, Homo sapiens
gactctttctgagtgcctt

SEQ ID NO: 6206577 - DNA, 12 bp, Homo sapiens
gactctttgctg

SEQ ID NO: 6206578 - DNA, 23 bp, Homo sapiens
gactctttgggtccattcagatg

SEQ ID NO: 6206579 - DNA, 20 bp, Homo sapiens
gactcttttatctgagtttt

SEQ ID NO: 6206580 - DNA, 18 bp, Homo sapiens
gactctttttgtacctgg

SEQ ID NO: 6206581 - DNA, 21 bp, Homo sapiens
gactctttttgtacctggtga

SEQ ID NO: 6206582 - DNA, 16 bp, Homo sapiens
gactctttttttgagt

SEQ ID NO: 6206583 - DNA, 20 bp, Homo sapiens
gactgaaacaaaatgttttt

SEQ ID NO: 6206584 - DNA, 14 bp, Homo sapiens
gactgaaaccattt

SEQ ID NO: 6206585 - DNA, 16 bp, Homo sapiens
gactgaaagaaactaa

SEQ ID NO: 6206586 - DNA, 17 bp, Homo sapiens
gactgaaagaaactaag

SEQ ID NO: 6206587 - DNA, 20 bp, Homo sapiens
gactgaaagaagaacagctg

SEQ ID NO: 6206588 - DNA, 16 bp, Homo sapiens
gactgaaagcagcagc

SEQ ID NO: 6206589 - DNA, 15 bp, Homo sapiens
gactgaaagtagggg

SEQ ID NO: 6206590 - DNA, 16 bp, Homo sapiens
gactgaaatggcttct

SEQ ID NO: 6206591 - DNA, 19 bp, Homo sapiens
gactgaaattacgggtacc

SEQ ID NO: 6206592 - DNA, 13 bp, Homo sapiens
gactgaagaagat

SEQ ID NO: 6206593 - DNA, 21 bp, Homo sapiens
gactgaagacaggcacaaaat

SEQ ID NO: 6206594 - DNA, 13 bp, Homo sapiens
gactgaagaggaa

SEQ ID NO: 6206595 - DNA, 18 bp, Homo sapiens
gactgaagatgcagctca

SEQ ID NO: 6206596 - DNA, 15 bp, Homo sapiens
gactgaagcacagca

SEQ ID NO: 6206597 - DNA, 18 bp, Homo sapiens
gactgaagcgaacatctt

SEQ ID NO: 6206598 - DNA, 16 bp, Homo sapiens
gactgaagctggggct

SEQ ID NO: 6206599 - DNA, 13 bp, Homo sapiens
gactgaagggaaa

SEQ ID NO: 6206600 - DNA, 14 bp, Homo sapiens
gactgaagggacta

SEQ ID NO: 6206601 - DNA, 13 bp, Homo sapiens
gactgaaggggca

SEQ ID NO: 6206602 - DNA, 23 bp, Homo sapiens
gactgaaggggcacaccactgcc

SEQ ID NO: 6206603 - DNA, 18 bp, Homo sapiens
gactgaagtcagtgtaga

SEQ ID NO: 6206604 - DNA, 12 bp, Homo sapiens
gactgaatagaa

SEQ ID NO: 6206605 - DNA, 21 bp, Homo sapiens
gactgaatgggatcatgaaag

SEQ ID NO: 6206606 - DNA, 15 bp, Homo sapiens
gactgaatgtgccta

SEQ ID NO: 6206607 - DNA, 14 bp, Homo sapiens
gactgaattatgaa

SEQ ID NO: 6206608 - DNA, 14 bp, Homo sapiens
gactgaattcaaat

SEQ ID NO: 6206609 - DNA, 13 bp, Homo sapiens
gactgaattccaa

SEQ ID NO: 6206610 - DNA, 19 bp, Homo sapiens
gactgaattctgccttggt

SEQ ID NO: 6206611 - DNA, 18 bp, Homo sapiens
gactgaattgtccccagt

SEQ ID NO: 6206612 - DNA, 14 bp, Homo sapiens
gactgaatttcttt

SEQ ID NO: 6206613 - DNA, 21 bp, Homo sapiens
gactgacaagaagctcccaga

SEQ ID NO: 6206614 - DNA, 14 bp, Homo sapiens
gactgacactcaga

SEQ ID NO: 6206615 - DNA, 17 bp, Homo sapiens
gactgacactcagatgc

SEQ ID NO: 6206616 - DNA, 21 bp, Homo sapiens
gactgacagtttacagacgct

SEQ ID NO: 6206617 - DNA, 14 bp, Homo sapiens
gactgaccaaagac

SEQ ID NO: 6206618 - DNA, 19 bp, Homo sapiens
gactgaccaaagactgcag

SEQ ID NO: 6206619 - DNA, 20 bp, Homo sapiens
gactgaccaaagactgcaga

SEQ ID NO: 6206620 - DNA, 22 bp, Homo sapiens
gactgaccaaatcacccaatcc

SEQ ID NO: 6206621 - DNA, 17 bp, Homo sapiens
gactgaccatgcactat

SEQ ID NO: 6206622 - DNA, 16 bp, Homo sapiens
gactgaccctgaggag

SEQ ID NO: 6206623 - DNA, 20 bp, Homo sapiens
gactgacctggtccacaggg

SEQ ID NO: 6206624 - DNA, 23 bp, Homo sapiens
gactgaccttcggcagtggctgg

SEQ ID NO: 6206625 - DNA, 21 bp, Homo sapiens
gactgaccttgtaaaagacag

SEQ ID NO: 6206626 - DNA, 17 bp, Homo sapiens
gactgacggctgtgtat

SEQ ID NO: 6206627 - DNA, 22 bp, Homo sapiens
gactgacggctgtgtatttctg

SEQ ID NO: 6206628 - DNA, 14 bp, Homo sapiens
gactgactgagcag

SEQ ID NO: 6206629 - DNA, 15 bp, Homo sapiens
gactgactgaggcag

SEQ ID NO: 6206630 - DNA, 16 bp, Homo sapiens
gactgactgaggcagt

SEQ ID NO: 6206631 - DNA, 18 bp, Homo sapiens
gactgactgcagccccct

SEQ ID NO: 6206632 - DNA, 15 bp, Homo sapiens
gactgactgtgttgg

SEQ ID NO: 6206633 - DNA, 23 bp, Homo sapiens
gactgacttatggcatgactctt

SEQ ID NO: 6206634 - DNA, 11 bp, Homo sapiens
gactgagaaat

SEQ ID NO: 6206635 - DNA, 13 bp, Homo sapiens
gactgagaacttt

SEQ ID NO: 6206636 - DNA, 20 bp, Homo sapiens
gactgagagcccactgcagt

SEQ ID NO: 6206637 - DNA, 15 bp, Homo sapiens
gactgagaggcagaa

SEQ ID NO: 6206638 - DNA, 18 bp, Homo sapiens
gactgagatttcttaaat

SEQ ID NO: 6206639 - DNA, 17 bp, Homo sapiens
gactgagatttgtaaat

SEQ ID NO: 6206640 - DNA, 18 bp, Homo sapiens
gactgagcaagaccctgt

SEQ ID NO: 6206641 - DNA, 21 bp, Homo sapiens
gactgagcaagaccctgtctc

SEQ ID NO: 6206642 - DNA, 16 bp, Homo sapiens
gactgagcaccctctg

SEQ ID NO: 6206643 - DNA, 13 bp, Homo sapiens
gactgagcagccg

SEQ ID NO: 6206644 - DNA, 17 bp, Homo sapiens
gactgagccaaggaggc

SEQ ID NO: 6206645 - DNA, 14 bp, Homo sapiens
gactgagcccccac

SEQ ID NO: 6206646 - DNA, 16 bp, Homo sapiens
gactgagcccccaccg

SEQ ID NO: 6206647 - DNA, 16 bp, Homo sapiens
gactgagcgaggaaaa

SEQ ID NO: 6206648 - DNA, 21 bp, Homo sapiens
gactgagcgaggaaaaacaac

SEQ ID NO: 6206649 - DNA, 14 bp, Homo sapiens
gactgagctctcca

SEQ ID NO: 6206650 - DNA, 15 bp, Homo sapiens
gactgagctggggag

SEQ ID NO: 6206651 - DNA, 16 bp, Homo sapiens
gactgagctggggagg

SEQ ID NO: 6206652 - DNA, 12 bp, Homo sapiens
gactgaggacaa

SEQ ID NO: 6206653 - DNA, 15 bp, Homo sapiens
gactgaggacaaagt

SEQ ID NO: 6206654 - DNA, 16 bp, Homo sapiens
gactgaggacaggccc

SEQ ID NO: 6206655 - DNA, 13 bp, Homo sapiens
gactgaggagtgg

SEQ ID NO: 6206656 - DNA, 21 bp, Homo sapiens
gactgaggcctgagcgctcct

SEQ ID NO: 6206657 - DNA, 13 bp, Homo sapiens
gactgaggcctgc

SEQ ID NO: 6206658 - DNA, 14 bp, Homo sapiens
gactgaggcctgct

SEQ ID NO: 6206659 - DNA, 12 bp, Homo sapiens
gactgagggaga

SEQ ID NO: 6206660 - DNA, 15 bp, Homo sapiens
gactgagggagagac

SEQ ID NO: 6206661 - DNA, 12 bp, Homo sapiens
gactgagggcag

SEQ ID NO: 6206662 - DNA, 15 bp, Homo sapiens
gactgagggctgggt

SEQ ID NO: 6206663 - DNA, 15 bp, Homo sapiens
gactgagggggcctg

SEQ ID NO: 6206664 - DNA, 15 bp, Homo sapiens
gactgaggtataaag

SEQ ID NO: 6206665 - DNA, 21 bp, Homo sapiens
gactgagtacgttgtgcattt

SEQ ID NO: 6206666 - DNA, 22 bp, Homo sapiens
gactgagtgggaagcccatcct

SEQ ID NO: 6206667 - DNA, 21 bp, Homo sapiens
gactgataacaaccttttaca

SEQ ID NO: 6206668 - DNA, 15 bp, Homo sapiens
gactgatcaggacct

SEQ ID NO: 6206669 - DNA, 18 bp, Homo sapiens
gactgatcatccaggcct

SEQ ID NO: 6206670 - DNA, 16 bp, Homo sapiens
gactgatccctggcca

SEQ ID NO: 6206671 - DNA, 23 bp, Homo sapiens
gactgatcctgaacaagaaagag

SEQ ID NO: 6206672 - DNA, 20 bp, Homo sapiens
gactgatctcgatgcaggtg

SEQ ID NO: 6206673 - DNA, 18 bp, Homo sapiens
gactgatgacaaacccag

SEQ ID NO: 6206674 - DNA, 19 bp, Homo sapiens
gactgatgacaaacccagg

SEQ ID NO: 6206675 - DNA, 12 bp, Homo sapiens
gactgatgagca

SEQ ID NO: 6206676 - DNA, 22 bp, Homo sapiens
gactgatgagcacatctctctg

SEQ ID NO: 6206677 - DNA, 17 bp, Homo sapiens
gactgatgattttcctt

SEQ ID NO: 6206678 - DNA, 22 bp, Homo sapiens
gactgatggtgtctgaggttct

SEQ ID NO: 6206679 - DNA, 13 bp, Homo sapiens
gactgatggttgc

SEQ ID NO: 6206680 - DNA, 17 bp, Homo sapiens
gactgatggtttggaaa

SEQ ID NO: 6206681 - DNA, 14 bp, Homo sapiens
gactgatgtctcct

SEQ ID NO: 6206682 - DNA, 15 bp, Homo sapiens
gactgatgtctccta

SEQ ID NO: 6206683 - DNA, 21 bp, Homo sapiens
gactgatgttaggctgggccc

SEQ ID NO: 6206684 - DNA, 16 bp, Homo sapiens
gactgatgtttgtgca

SEQ ID NO: 6206685 - DNA, 11 bp, Homo sapiens
gactgattgtt

SEQ ID NO: 6206686 - DNA, 14 bp, Homo sapiens
gactgatttagaaa

SEQ ID NO: 6206687 - DNA, 19 bp, Homo sapiens
gactgatttgtggaaagga

SEQ ID NO: 6206688 - DNA, 21 bp, Homo sapiens
gactgcaaagccagtgctgtc

SEQ ID NO: 6206689 - DNA, 19 bp, Homo sapiens
gactgcaagaactgttttt

SEQ ID NO: 6206690 - DNA, 18 bp, Homo sapiens
gactgcacagcggcccct

SEQ ID NO: 6206691 - DNA, 14 bp, Homo sapiens
gactgcacaggcag

SEQ ID NO: 6206692 - DNA, 15 bp, Homo sapiens
gactgcacaggcagc

SEQ ID NO: 6206693 - DNA, 20 bp, Homo sapiens
gactgcacccagctccaggg

SEQ ID NO: 6206694 - DNA, 14 bp, Homo sapiens
gactgcacccagga

SEQ ID NO: 6206695 - DNA, 13 bp, Homo sapiens
gactgcagaaccc

SEQ ID NO: 6206696 - DNA, 22 bp, Homo sapiens
gactgcagacaggctctgaggg

SEQ ID NO: 6206697 - DNA, 12 bp, Homo sapiens
gactgcagagca

SEQ ID NO: 6206698 - DNA, 15 bp, Homo sapiens
gactgcagaggagcc

SEQ ID NO: 6206699 - DNA, 16 bp, Homo sapiens
gactgcagaggagcca

SEQ ID NO: 6206700 - DNA, 14 bp, Homo sapiens
gactgcagccccct

SEQ ID NO: 6206701 - DNA, 15 bp, Homo sapiens
gactgcagcccccta

SEQ ID NO: 6206702 - DNA, 14 bp, Homo sapiens
gactgcagctgctg

SEQ ID NO: 6206703 - DNA, 21 bp, Homo sapiens
gactgcagggacacgggcagc

SEQ ID NO: 6206704 - DNA, 13 bp, Homo sapiens
gactgcaggtggg

SEQ ID NO: 6206705 - DNA, 21 bp, Homo sapiens
gactgcaggttggaccccaga

SEQ ID NO: 6206706 - DNA, 20 bp, Homo sapiens
gactgcagtcggcatgccag

SEQ ID NO: 6206707 - DNA, 21 bp, Homo sapiens
gactgcagtcggcatgccagg

SEQ ID NO: 6206708 - DNA, 20 bp, Homo sapiens
gactgcagtgtggagttcac

SEQ ID NO: 6206709 - DNA, 18 bp, Homo sapiens
gactgcatggtaatttat

SEQ ID NO: 6206710 - DNA, 21 bp, Homo sapiens
gactgcatgtaccatttgcat

SEQ ID NO: 6206711 - DNA, 15 bp, Homo sapiens
gactgcattgccgct

SEQ ID NO: 6206712 - DNA, 14 bp, Homo sapiens
gactgcattggact

SEQ ID NO: 6206713 - DNA, 18 bp, Homo sapiens
gactgcatttaaatttga

SEQ ID NO: 6206714 - DNA, 12 bp, Homo sapiens
ctttatgattct

SEQ ID NO: 6206715 - DNA, 19 bp, Homo sapiens
ctttatgattcttactgtt

SEQ ID NO: 6206716 - DNA, 16 bp, Homo sapiens
ctttatgatttcatga

SEQ ID NO: 6206717 - DNA, 16 bp, Homo sapiens
ctttatgcaaaaacat

SEQ ID NO: 6206718 - DNA, 19 bp, Homo sapiens
ctttatgcaaaaacatatg

SEQ ID NO: 6206719 - DNA, 13 bp, Homo sapiens
ctttatgcaataa

SEQ ID NO: 6206720 - DNA, 12 bp, Homo sapiens
ctttatgctgaa

SEQ ID NO: 6206721 - DNA, 15 bp, Homo sapiens
ctttatgctgtattt

SEQ ID NO: 6206722 - DNA, 19 bp, Homo sapiens
ctttatgctgtattttaac

SEQ ID NO: 6206723 - DNA, 21 bp, Homo sapiens
ctttatgctgtattttaacac

SEQ ID NO: 6206724 - DNA, 13 bp, Homo sapiens
ctttatgctgtgt

SEQ ID NO: 6206725 - DNA, 13 bp, Homo sapiens
ctttatgcttgca

SEQ ID NO: 6206726 - DNA, 20 bp, Homo sapiens
ctttatgcttgcttggggaa

SEQ ID NO: 6206727 - DNA, 11 bp, Homo sapiens
ctttatggtaa

SEQ ID NO: 6206728 - DNA, 13 bp, Homo sapiens
ctttatggtttct

SEQ ID NO: 6206729 - DNA, 16 bp, Homo sapiens
ctttatgtaagaagaa

SEQ ID NO: 6206730 - DNA, 20 bp, Homo sapiens
ctttatgtaagaagaaactg

SEQ ID NO: 6206731 - DNA, 19 bp, Homo sapiens
ctttatgtagtttttatat

SEQ ID NO: 6206732 - DNA, 16 bp, Homo sapiens
ctttatgtgaactttg

SEQ ID NO: 6206733 - DNA, 15 bp, Homo sapiens
ctttatgtgaatttt

SEQ ID NO: 6206734 - DNA, 17 bp, Homo sapiens
ctttatgtgaattttta

SEQ ID NO: 6206735 - DNA, 12 bp, Homo sapiens
ctttatgtgtaa

SEQ ID NO: 6206736 - DNA, 20 bp, Homo sapiens
ctttatgttactacatgcac

SEQ ID NO: 6206737 - DNA, 20 bp, Homo sapiens
ctttatgttcatttgtttgt

SEQ ID NO: 6206738 - DNA, 22 bp, Homo sapiens
ctttatgttgcggtgagaactc

SEQ ID NO: 6206739 - DNA, 16 bp, Homo sapiens
ctttatgttttaatat

SEQ ID NO: 6206740 - DNA, 14 bp, Homo sapiens
ctttattaaaaact

SEQ ID NO: 6206741 - DNA, 17 bp, Homo sapiens
ctttattaaaacaaaag

SEQ ID NO: 6206742 - DNA, 21 bp, Homo sapiens
ctttattaaaagaatgagtga

SEQ ID NO: 6206743 - DNA, 18 bp, Homo sapiens
ctttattaaaatcttaaa

SEQ ID NO: 6206744 - DNA, 15 bp, Homo sapiens
ctttattaatgaact

SEQ ID NO: 6206745 - DNA, 14 bp, Homo sapiens
ctttattaatgttt

SEQ ID NO: 6206746 - DNA, 15 bp, Homo sapiens
ctttattaatgtttt

SEQ ID NO: 6206747 - DNA, 22 bp, Homo sapiens
ctttattacaatttgtattact

SEQ ID NO: 6206748 - DNA, 23 bp, Homo sapiens
ctttattacacctcagaaattga

SEQ ID NO: 6206749 - DNA, 20 bp, Homo sapiens
ctttattaccccctccttca

SEQ ID NO: 6206750 - DNA, 22 bp, Homo sapiens
ctttattaccccctccttcaga

SEQ ID NO: 6206751 - DNA, 14 bp, Homo sapiens
ctttattactcccc

SEQ ID NO: 6206752 - DNA, 16 bp, Homo sapiens
ctttattagctttctc

SEQ ID NO: 6206753 - DNA, 15 bp, Homo sapiens
ctttattagtttaaa

SEQ ID NO: 6206754 - DNA, 17 bp, Homo sapiens
ctttattataaaatgct

SEQ ID NO: 6206755 - DNA, 18 bp, Homo sapiens
ctttattatgcattctta

SEQ ID NO: 6206756 - DNA, 15 bp, Homo sapiens
ctttattatggcttg

SEQ ID NO: 6206757 - DNA, 13 bp, Homo sapiens
ctttattattcct

SEQ ID NO: 6206758 - DNA, 19 bp, Homo sapiens
ctttattatttttctctct

SEQ ID NO: 6206759 - DNA, 15 bp, Homo sapiens
ctttattcacccctg

SEQ ID NO: 6206760 - DNA, 17 bp, Homo sapiens
ctttattcacccctgcc

SEQ ID NO: 6206761 - DNA, 16 bp, Homo sapiens
ctttattcagaacttt

SEQ ID NO: 6206762 - DNA, 23 bp, Homo sapiens
ctttattccagaatgctgtacat

SEQ ID NO: 6206763 - DNA, 18 bp, Homo sapiens
ctttattccttcatttca

SEQ ID NO: 6206764 - DNA, 14 bp, Homo sapiens
ctttattctcctcc

SEQ ID NO: 6206765 - DNA, 14 bp, Homo sapiens
ctttattctgtgtt

SEQ ID NO: 6206766 - DNA, 20 bp, Homo sapiens
ctttattcttgaaagaagaa

SEQ ID NO: 6206767 - DNA, 15 bp, Homo sapiens
ctttattcttgctgg

SEQ ID NO: 6206768 - DNA, 16 bp, Homo sapiens
ctttattcttgctggg

SEQ ID NO: 6206769 - DNA, 16 bp, Homo sapiens
ctttattctttactat

SEQ ID NO: 6206770 - DNA, 13 bp, Homo sapiens
ctttattctttgt

SEQ ID NO: 6206771 - DNA, 12 bp, Homo sapiens
ctttattgaatt

SEQ ID NO: 6206772 - DNA, 21 bp, Homo sapiens
ctttattgaattagaaaatta

SEQ ID NO: 6206773 - DNA, 16 bp, Homo sapiens
ctttattgagaaagag

SEQ ID NO: 6206774 - DNA, 16 bp, Homo sapiens
ctttattgcactagga

SEQ ID NO: 6206775 - DNA, 20 bp, Homo sapiens
ctttattgcactaggaattc

SEQ ID NO: 6206776 - DNA, 16 bp, Homo sapiens
ctttattgcagaatgt

SEQ ID NO: 6206777 - DNA, 17 bp, Homo sapiens
ctttattgcatatagat

SEQ ID NO: 6206778 - DNA, 23 bp, Homo sapiens
ctttattgccaaaacccagctgc

SEQ ID NO: 6206779 - DNA, 19 bp, Homo sapiens
ctttattgcccatgggata

SEQ ID NO: 6206780 - DNA, 13 bp, Homo sapiens
ctttattgcccct

SEQ ID NO: 6206781 - DNA, 20 bp, Homo sapiens
ctttattgggtatcaagaca

SEQ ID NO: 6206782 - DNA, 20 bp, Homo sapiens
ctttattgtacagactgttt

SEQ ID NO: 6206783 - DNA, 20 bp, Homo sapiens
ctttattgtccattccaata

SEQ ID NO: 6206784 - DNA, 13 bp, Homo sapiens
ctttattgtctgt

SEQ ID NO: 6206785 - DNA, 16 bp, Homo sapiens
ctttattgtgtttgtc

SEQ ID NO: 6206786 - DNA, 18 bp, Homo sapiens
ctttattgtgtttgtcat

SEQ ID NO: 6206787 - DNA, 20 bp, Homo sapiens
ctttatttaaatgcatgtct

SEQ ID NO: 6206788 - DNA, 21 bp, Homo sapiens
ctttatttaaatgcatgtctt

SEQ ID NO: 6206789 - DNA, 22 bp, Homo sapiens
ctttatttaaatgcatgtctta

SEQ ID NO: 6206790 - DNA, 15 bp, Homo sapiens
ctttatttaatttca

SEQ ID NO: 6206791 - DNA, 19 bp, Homo sapiens
ctttatttaatttcataaa

SEQ ID NO: 6206792 - DNA, 20 bp, Homo sapiens
ctttatttaatttcataaat

SEQ ID NO: 6206793 - DNA, 12 bp, Homo sapiens
ctttatttatgg

SEQ ID NO: 6206794 - DNA, 19 bp, Homo sapiens
ctttatttattaaacttca

SEQ ID NO: 6206795 - DNA, 15 bp, Homo sapiens
ctttatttatttcta

SEQ ID NO: 6206796 - DNA, 14 bp, Homo sapiens
ctttatttctagca

SEQ ID NO: 6206797 - DNA, 14 bp, Homo sapiens
ctttatttctgtca

SEQ ID NO: 6206798 - DNA, 14 bp, Homo sapiens
ctttatttctgtct

SEQ ID NO: 6206799 - DNA, 18 bp, Homo sapiens
ctttatttgaataacaag

SEQ ID NO: 6206800 - DNA, 14 bp, Homo sapiens
ctttatttgtaaat

SEQ ID NO: 6206801 - DNA, 17 bp, Homo sapiens
ctttatttgtaaattta

SEQ ID NO: 6206802 - DNA, 12 bp, Homo sapiens
ctttatttgtga

SEQ ID NO: 6206803 - DNA, 16 bp, Homo sapiens
ctttatttgtgaaact

SEQ ID NO: 6206804 - DNA, 22 bp, Homo sapiens
ctttatttgttaatagttcctg

SEQ ID NO: 6206805 - DNA, 13 bp, Homo sapiens
ctttatttgtttt

SEQ ID NO: 6206806 - DNA, 16 bp, Homo sapiens
ctttattttaaatgat

SEQ ID NO: 6206807 - DNA, 16 bp, Homo sapiens
ctttattttatataat

SEQ ID NO: 6206808 - DNA, 22 bp, Homo sapiens
ctttattttatataataaagta

SEQ ID NO: 6206809 - DNA, 18 bp, Homo sapiens
ctttattttattattcag

SEQ ID NO: 6206810 - DNA, 19 bp, Homo sapiens
ctttattttattattcaga

SEQ ID NO: 6206811 - DNA, 14 bp, Homo sapiens
ctttattttattga

SEQ ID NO: 6206812 - DNA, 22 bp, Homo sapiens
ctttattttattttttttcaaa

SEQ ID NO: 6206813 - DNA, 13 bp, Homo sapiens
ctttattttctgg

SEQ ID NO: 6206814 - DNA, 18 bp, Homo sapiens
ctttattttcttctccag

SEQ ID NO: 6206815 - DNA, 11 bp, Homo sapiens
ctttattttga

SEQ ID NO: 6206816 - DNA, 14 bp, Homo sapiens
ctttattttgaatg

SEQ ID NO: 6206817 - DNA, 17 bp, Homo sapiens
ctttattttgaatgtac

SEQ ID NO: 6206818 - DNA, 20 bp, Homo sapiens
ctttattttgaatgtacctc

SEQ ID NO: 6206819 - DNA, 13 bp, Homo sapiens
ctttattttgaga

SEQ ID NO: 6206820 - DNA, 17 bp, Homo sapiens
ctttattttgagatgta

SEQ ID NO: 6206821 - DNA, 14 bp, Homo sapiens
ctttattttgtgta

SEQ ID NO: 6206822 - DNA, 17 bp, Homo sapiens
ctttatttttataaaac

SEQ ID NO: 6206823 - DNA, 16 bp, Homo sapiens
ctttatttttctaagt

SEQ ID NO: 6206824 - DNA, 16 bp, Homo sapiens
ctttatttttctatct

SEQ ID NO: 6206825 - DNA, 17 bp, Homo sapiens
ctttatttttctctttc

SEQ ID NO: 6206826 - DNA, 19 bp, Homo sapiens
ctttatttttctctttctc

SEQ ID NO: 6206827 - DNA, 17 bp, Homo sapiens
ctttatttttctttaaa

SEQ ID NO: 6206828 - DNA, 20 bp, Homo sapiens
ctttatttttcttttcctgg

SEQ ID NO: 6206829 - DNA, 21 bp, Homo sapiens
ctttatttttgttaatattaa

SEQ ID NO: 6206830 - DNA, 19 bp, Homo sapiens
ctttattttttaaaaatga

SEQ ID NO: 6206831 - DNA, 23 bp, Homo sapiens
ctttattttttaagtatttatat

SEQ ID NO: 6206832 - DNA, 19 bp, Homo sapiens
ctttatttttttcccatga

SEQ ID NO: 6206833 - DNA, 17 bp, Homo sapiens
ctttatttttttgaact

SEQ ID NO: 6206834 - DNA, 14 bp, Homo sapiens
ctttcaaaaacatg

SEQ ID NO: 6206835 - DNA, 15 bp, Homo sapiens
ctttcaaaagcaaac

SEQ ID NO: 6206836 - DNA, 15 bp, Homo sapiens
ctttcaaaagggaag

SEQ ID NO: 6206837 - DNA, 15 bp, Homo sapiens
ctttcaaaatatatt

SEQ ID NO: 6206838 - DNA, 19 bp, Homo sapiens
ctttcaaaattaaatctgt

SEQ ID NO: 6206839 - DNA, 21 bp, Homo sapiens
ctttcaaacattgagactgct

SEQ ID NO: 6206840 - DNA, 21 bp, Homo sapiens
ctttcaaagaaggaattctag

SEQ ID NO: 6206841 - DNA, 17 bp, Homo sapiens
ctttcaaagccatttta

SEQ ID NO: 6206842 - DNA, 12 bp, Homo sapiens
ctttcaaagctt

SEQ ID NO: 6206843 - DNA, 15 bp, Homo sapiens
ctttcaaaggaacat

SEQ ID NO: 6206844 - DNA, 17 bp, Homo sapiens
ctttcaaagtgcacaca

SEQ ID NO: 6206845 - DNA, 21 bp, Homo sapiens
ctttcaaattgagagaatgga

SEQ ID NO: 6206846 - DNA, 11 bp, Homo sapiens
ctttcaaattt

SEQ ID NO: 6206847 - DNA, 15 bp, Homo sapiens
ctttcaaatttactg

SEQ ID NO: 6206848 - DNA, 19 bp, Homo sapiens
ctttcaaatttagaaacta

SEQ ID NO: 6206849 - DNA, 14 bp, Homo sapiens
ctttcaaatttcac

SEQ ID NO: 6206850 - DNA, 13 bp, Homo sapiens
ctttcaaccacct

SEQ ID NO: 6206851 - DNA, 15 bp, Homo sapiens
ctttcaactgtttca

SEQ ID NO: 6206852 - DNA, 12 bp, Homo sapiens
ctttcaacttaa

SEQ ID NO: 6206853 - DNA, 17 bp, Homo sapiens
ctttcaacttaaatcac

SEQ ID NO: 6206854 - DNA, 18 bp, Homo sapiens
ctttcaacttaaatcact

SEQ ID NO: 6206855 - DNA, 14 bp, Homo sapiens
ctttcaacttattt

SEQ ID NO: 6206856 - DNA, 13 bp, Homo sapiens
ctttcaagaactt

SEQ ID NO: 6206857 - DNA, 15 bp, Homo sapiens
ctttcaagaacttgt

SEQ ID NO: 6206858 - DNA, 17 bp, Homo sapiens
ctttcaagaacttgttt

SEQ ID NO: 6206859 - DNA, 16 bp, Homo sapiens
ctttcaagacagccta

SEQ ID NO: 6206860 - DNA, 16 bp, Homo sapiens
ctttcaagatctaaat

SEQ ID NO: 6206861 - DNA, 13 bp, Homo sapiens
ctttcaagatctt

SEQ ID NO: 6206862 - DNA, 23 bp, Homo sapiens
ctttcaagcagtcgtgcctgtgt

SEQ ID NO: 6206863 - DNA, 13 bp, Homo sapiens
ctttcaagctgca

SEQ ID NO: 6206864 - DNA, 14 bp, Homo sapiens
ctttcaaggctggg

SEQ ID NO: 6206865 - DNA, 16 bp, Homo sapiens
ctttcaaggctggggc

SEQ ID NO: 6206866 - DNA, 23 bp, Homo sapiens
ctttcaagtgcctttctgcagtt

SEQ ID NO: 6206867 - DNA, 18 bp, Homo sapiens
ctttcaataaactaaaga

SEQ ID NO: 6206868 - DNA, 13 bp, Homo sapiens
ctttcaataaagt

SEQ ID NO: 6206869 - DNA, 15 bp, Homo sapiens
ctttcaataaagttg

SEQ ID NO: 6206870 - DNA, 16 bp, Homo sapiens
ctttcaataaagttgt

SEQ ID NO: 6206871 - DNA, 20 bp, Homo sapiens
ctttcaataaagttgttgca

SEQ ID NO: 6206872 - DNA, 18 bp, Homo sapiens
ctttcaatacagatatat

SEQ ID NO: 6206873 - DNA, 20 bp, Homo sapiens
ctttcaatacagatatattt

SEQ ID NO: 6206874 - DNA, 22 bp, Homo sapiens
ctttcaatggtttgcaaggaag

SEQ ID NO: 6206875 - DNA, 17 bp, Homo sapiens
ctttcaattccaccagg

SEQ ID NO: 6206876 - DNA, 12 bp, Homo sapiens
ctttcaattgca

SEQ ID NO: 6206877 - DNA, 22 bp, Homo sapiens
ctttcaattgcagatgccaaaa

SEQ ID NO: 6206878 - DNA, 20 bp, Homo sapiens
ctttcaattgtcacttttta

SEQ ID NO: 6206879 - DNA, 16 bp, Homo sapiens
ctttcacaaaaaagaa

SEQ ID NO: 6206880 - DNA, 14 bp, Homo sapiens
ctttcacaaccttc

SEQ ID NO: 6206881 - DNA, 21 bp, Homo sapiens
ctttcacaagcaacagactct

SEQ ID NO: 6206882 - DNA, 15 bp, Homo sapiens
ctttcacacttccac

SEQ ID NO: 6206883 - DNA, 20 bp, Homo sapiens
ctttcacacttccaccagcc

SEQ ID NO: 6206884 - DNA, 14 bp, Homo sapiens
ctttcacagctcct

SEQ ID NO: 6206885 - DNA, 17 bp, Homo sapiens
ctttcacaggactctgc

SEQ ID NO: 6206886 - DNA, 19 bp, Homo sapiens
ctttcacaggcagccagtg

SEQ ID NO: 6206887 - DNA, 19 bp, Homo sapiens
ctttcacagtaccatctga

SEQ ID NO: 6206888 - DNA, 21 bp, Homo sapiens
ctttcacagtgaagtgccttt

SEQ ID NO: 6206889 - DNA, 12 bp, Homo sapiens
ctttcacagtgg

SEQ ID NO: 6206890 - DNA, 22 bp, Homo sapiens
ctttcacattgtttgctgctat

SEQ ID NO: 6206891 - DNA, 24 bp, Homo sapiens
ctttcacattgtttgctgctattg

SEQ ID NO: 6206892 - DNA, 14 bp, Homo sapiens
ctttcacatttaaa

SEQ ID NO: 6206893 - DNA, 17 bp, Homo sapiens
ctttcacatttggaatt

SEQ ID NO: 6206894 - DNA, 21 bp, Homo sapiens
ctttcacatttggaatttaaa

SEQ ID NO: 6206895 - DNA, 22 bp, Homo sapiens
gactgcatttaaatttgatttc

SEQ ID NO: 6206896 - DNA, 14 bp, Homo sapiens
gactgccaaagaag

SEQ ID NO: 6206897 - DNA, 11 bp, Homo sapiens
gactgccaaat

SEQ ID NO: 6206898 - DNA, 15 bp, Homo sapiens
gactgccaagccaga

SEQ ID NO: 6206899 - DNA, 16 bp, Homo sapiens
gactgccaagccatgg

SEQ ID NO: 6206900 - DNA, 14 bp, Homo sapiens
gactgccacaagga

SEQ ID NO: 6206901 - DNA, 18 bp, Homo sapiens
gactgccacaaggaagaa

SEQ ID NO: 6206902 - DNA, 15 bp, Homo sapiens
gactgccacctcccc

SEQ ID NO: 6206903 - DNA, 16 bp, Homo sapiens
gactgccacctcccct

SEQ ID NO: 6206904 - DNA, 20 bp, Homo sapiens
gactgccacgtgccttagga

SEQ ID NO: 6206905 - DNA, 18 bp, Homo sapiens
gactgccagctcttccta

SEQ ID NO: 6206906 - DNA, 13 bp, Homo sapiens
gactgccaggtgg

SEQ ID NO: 6206907 - DNA, 20 bp, Homo sapiens
gactgccagtccccctgccc

SEQ ID NO: 6206908 - DNA, 17 bp, Homo sapiens
gactgccatattaaatt

SEQ ID NO: 6206909 - DNA, 15 bp, Homo sapiens
gactgccatcattga

SEQ ID NO: 6206910 - DNA, 10 bp, Homo sapiens
gactgcccac

SEQ ID NO: 6206911 - DNA, 15 bp, Homo sapiens
gactgcccaccctgg

SEQ ID NO: 6206912 - DNA, 18 bp, Homo sapiens
gactgcccaccctgggcc

SEQ ID NO: 6206913 - DNA, 21 bp, Homo sapiens
gactgcccaccctgggcctcc

SEQ ID NO: 6206914 - DNA, 23 bp, Homo sapiens
gactgcccaccctgggcctcccg

SEQ ID NO: 6206915 - DNA, 12 bp, Homo sapiens
gactgcccagcc

SEQ ID NO: 6206916 - DNA, 15 bp, Homo sapiens
gactgcccagccact

SEQ ID NO: 6206917 - DNA, 20 bp, Homo sapiens
gactgcccagccactccaag

SEQ ID NO: 6206918 - DNA, 21 bp, Homo sapiens
gactgccccacggccctgtca

SEQ ID NO: 6206919 - DNA, 22 bp, Homo sapiens
gactgccccacggccctgtcag

SEQ ID NO: 6206920 - DNA, 16 bp, Homo sapiens
gactgccccagccaac

SEQ ID NO: 6206921 - DNA, 22 bp, Homo sapiens
gactgcccccagaaagcctcct

SEQ ID NO: 6206922 - DNA, 19 bp, Homo sapiens
gactgccccgtgcagactg

SEQ ID NO: 6206923 - DNA, 20 bp, Homo sapiens
gactgccccgtgcagactgg

SEQ ID NO: 6206924 - DNA, 21 bp, Homo sapiens
gactgccccgtgcagactgga

SEQ ID NO: 6206925 - DNA, 16 bp, Homo sapiens
gactgccccttctatg

SEQ ID NO: 6206926 - DNA, 13 bp, Homo sapiens
gactgcccggcag

SEQ ID NO: 6206927 - DNA, 17 bp, Homo sapiens
gactgccctctcgactg

SEQ ID NO: 6206928 - DNA, 11 bp, Homo sapiens
gactgcctccc

SEQ ID NO: 6206929 - DNA, 15 bp, Homo sapiens
gactgcctctgccac

SEQ ID NO: 6206930 - DNA, 21 bp, Homo sapiens
gactgcctctgccacactctg

SEQ ID NO: 6206931 - DNA, 10 bp, Homo sapiens
gactgcctgt

SEQ ID NO: 6206932 - DNA, 11 bp, Homo sapiens
gactgcctgtc

SEQ ID NO: 6206933 - DNA, 15 bp, Homo sapiens
gactgcctgtctcca

SEQ ID NO: 6206934 - DNA, 14 bp, Homo sapiens
gactgcgctggacg

SEQ ID NO: 6206935 - DNA, 15 bp, Homo sapiens
gactgcggagcagcc

SEQ ID NO: 6206936 - DNA, 22 bp, Homo sapiens
gactgcggagcagcctccagtg

SEQ ID NO: 6206937 - DNA, 23 bp, Homo sapiens
gactgcggagcagcctccagtgc

SEQ ID NO: 6206938 - DNA, 23 bp, Homo sapiens
gactgcggaggaaggaggaccca

SEQ ID NO: 6206939 - DNA, 18 bp, Homo sapiens
gactgcgggagccagact

SEQ ID NO: 6206940 - DNA, 18 bp, Homo sapiens
gactgctaaataaaattt

SEQ ID NO: 6206941 - DNA, 17 bp, Homo sapiens
gactgctacctctgaga

SEQ ID NO: 6206942 - DNA, 20 bp, Homo sapiens
gactgctacctctgagaaga

SEQ ID NO: 6206943 - DNA, 22 bp, Homo sapiens
gactgctattctagagctttta

SEQ ID NO: 6206944 - DNA, 13 bp, Homo sapiens
gactgctcaggcc

SEQ ID NO: 6206945 - DNA, 19 bp, Homo sapiens
gactgctcaggctccccaa

SEQ ID NO: 6206946 - DNA, 21 bp, Homo sapiens
gactgctcccggcccgcctgc

SEQ ID NO: 6206947 - DNA, 13 bp, Homo sapiens
gactgctcctggg

SEQ ID NO: 6206948 - DNA, 21 bp, Homo sapiens
gactgctgactatattttaaa

SEQ ID NO: 6206949 - DNA, 15 bp, Homo sapiens
gactgctgcctcccc

SEQ ID NO: 6206950 - DNA, 14 bp, Homo sapiens
gactgctgctcccc

SEQ ID NO: 6206951 - DNA, 16 bp, Homo sapiens
gactgctgctctccca

SEQ ID NO: 6206952 - DNA, 17 bp, Homo sapiens
gactgctgctctcccaa

SEQ ID NO: 6206953 - DNA, 11 bp, Homo sapiens
gactgctggct

SEQ ID NO: 6206954 - DNA, 20 bp, Homo sapiens
gactgctgggaggttaaaaa

SEQ ID NO: 6206955 - DNA, 15 bp, Homo sapiens
gactgctggtttgta

SEQ ID NO: 6206956 - DNA, 18 bp, Homo sapiens
gactgctgtggccaggag

SEQ ID NO: 6206957 - DNA, 22 bp, Homo sapiens
gactgcttcccatcctaccctc

SEQ ID NO: 6206958 - DNA, 17 bp, Homo sapiens
gactgcttgacaaagga

SEQ ID NO: 6206959 - DNA, 12 bp, Homo sapiens
gactgcttgccc

SEQ ID NO: 6206960 - DNA, 22 bp, Homo sapiens
gactgctttggatagtctccta

SEQ ID NO: 6206961 - DNA, 23 bp, Homo sapiens
gactggaaaaatgaactgtatta

SEQ ID NO: 6206962 - DNA, 15 bp, Homo sapiens
gactggaacactaga

SEQ ID NO: 6206963 - DNA, 17 bp, Homo sapiens
gactggaactgcaactc

SEQ ID NO: 6206964 - DNA, 14 bp, Homo sapiens
gactggaagcacag

SEQ ID NO: 6206965 - DNA, 15 bp, Homo sapiens
gactggaagcacagc

SEQ ID NO: 6206966 - DNA, 16 bp, Homo sapiens
gactggaagcacagct

SEQ ID NO: 6206967 - DNA, 20 bp, Homo sapiens
gactggaagctaatttgcat

SEQ ID NO: 6206968 - DNA, 21 bp, Homo sapiens
gactggaaggtccttgcctga

SEQ ID NO: 6206969 - DNA, 21 bp, Homo sapiens
gactggaagttcatacctaag

SEQ ID NO: 6206970 - DNA, 16 bp, Homo sapiens
gactggaatgcagtga

SEQ ID NO: 6206971 - DNA, 22 bp, Homo sapiens
gactggaatttttattatgcat

SEQ ID NO: 6206972 - DNA, 18 bp, Homo sapiens
gactggacagccagggca

SEQ ID NO: 6206973 - DNA, 16 bp, Homo sapiens
gactggaccgtttcca

SEQ ID NO: 6206974 - DNA, 23 bp, Homo sapiens
gactggaggcccctggagccaga

SEQ ID NO: 6206975 - DNA, 17 bp, Homo sapiens
gactggaggcctcgccc

SEQ ID NO: 6206976 - DNA, 17 bp, Homo sapiens
gactggaggctgggtgg

SEQ ID NO: 6206977 - DNA, 20 bp, Homo sapiens
gactggagtcagatgagcaa

SEQ ID NO: 6206978 - DNA, 16 bp, Homo sapiens
gactggagtgcagtgg

SEQ ID NO: 6206979 - DNA, 17 bp, Homo sapiens
gactggatgctcgccat

SEQ ID NO: 6206980 - DNA, 16 bp, Homo sapiens
gactggcaaaggacca

SEQ ID NO: 6206981 - DNA, 17 bp, Homo sapiens
gactggcaagaggcctc

SEQ ID NO: 6206982 - DNA, 23 bp, Homo sapiens
gactggcaagaggcctcatgcct

SEQ ID NO: 6206983 - DNA, 12 bp, Homo sapiens
gactggcaataa

SEQ ID NO: 6206984 - DNA, 13 bp, Homo sapiens
gactggcaataaa

SEQ ID NO: 6206985 - DNA, 15 bp, Homo sapiens
gactggcaataaact

SEQ ID NO: 6206986 - DNA, 16 bp, Homo sapiens
gactggcaataaactc

SEQ ID NO: 6206987 - DNA, 22 bp, Homo sapiens
gactggcacagttttctgagaa

SEQ ID NO: 6206988 - DNA, 20 bp, Homo sapiens
gactggcacttagcccaaga

SEQ ID NO: 6206989 - DNA, 13 bp, Homo sapiens
gactggcagaagc

SEQ ID NO: 6206990 - DNA, 14 bp, Homo sapiens
gactggcagaagca

SEQ ID NO: 6206991 - DNA, 14 bp, Homo sapiens
gactggcagccagg

SEQ ID NO: 6206992 - DNA, 15 bp, Homo sapiens
gactggcaggcgggg

SEQ ID NO: 6206993 - DNA, 19 bp, Homo sapiens
gactggcagtcgcacacac

SEQ ID NO: 6206994 - DNA, 22 bp, Homo sapiens
gactggcatactatgtggatgt

SEQ ID NO: 6206995 - DNA, 23 bp, Homo sapiens
gactggcatactatgtggatgtg

SEQ ID NO: 6206996 - DNA, 23 bp, Homo sapiens
gactggccaaggtttggggaaga

SEQ ID NO: 6206997 - DNA, 19 bp, Homo sapiens
gactggccatttttctggg

SEQ ID NO: 6206998 - DNA, 24 bp, Homo sapiens
gactggcccagtgccagcaagtcc

SEQ ID NO: 6206999 - DNA, 21 bp, Homo sapiens
gactggcccctaggctgctgc

SEQ ID NO: 6207000 - DNA, 22 bp, Homo sapiens
gactggcccctgacccagggac

SEQ ID NO: 6207001 - DNA, 16 bp, Homo sapiens
gactggcccctgggtc

SEQ ID NO: 6207002 - DNA, 14 bp, Homo sapiens
gactggcctgagga

SEQ ID NO: 6207003 - DNA, 21 bp, Homo sapiens
gactggcgttcacctccctgc

SEQ ID NO: 6207004 - DNA, 22 bp, Homo sapiens
gactggcgttcacctccctgct

SEQ ID NO: 6207005 - DNA, 23 bp, Homo sapiens
gactggctagagtcctcactccc

SEQ ID NO: 6207006 - DNA, 21 bp, Homo sapiens
gactggctcacccctctcccc

SEQ ID NO: 6207007 - DNA, 14 bp, Homo sapiens
gactggctgtgaga

SEQ ID NO: 6207008 - DNA, 17 bp, Homo sapiens
gactggctgtgcccctg

SEQ ID NO: 6207009 - DNA, 22 bp, Homo sapiens
gactggctgtgcccctgatgca

SEQ ID NO: 6207010 - DNA, 10 bp, Homo sapiens
gactggcttg

SEQ ID NO: 6207011 - DNA, 20 bp, Homo sapiens
gactggctttgtcccacagc

SEQ ID NO: 6207012 - DNA, 21 bp, Homo sapiens
gactggctttgtcccacagct

SEQ ID NO: 6207013 - DNA, 23 bp, Homo sapiens
gactggcttttattaatgcactt

SEQ ID NO: 6207014 - DNA, 20 bp, Homo sapiens
gactgggaagataggctctg

SEQ ID NO: 6207015 - DNA, 22 bp, Homo sapiens
gactgggaagataggctctgca

SEQ ID NO: 6207016 - DNA, 17 bp, Homo sapiens
gactgggaagggggcag

SEQ ID NO: 6207017 - DNA, 21 bp, Homo sapiens
gactgggaagggggcaggccc

SEQ ID NO: 6207018 - DNA, 16 bp, Homo sapiens
gactgggaccaggcac

SEQ ID NO: 6207019 - DNA, 21 bp, Homo sapiens
gactgggaccgtgcgagctgc

SEQ ID NO: 6207020 - DNA, 17 bp, Homo sapiens
gactgggagccacttct

SEQ ID NO: 6207021 - DNA, 22 bp, Homo sapiens
gactgggagccacttctcccca

SEQ ID NO: 6207022 - DNA, 17 bp, Homo sapiens
gactgggagcccccagc

SEQ ID NO: 6207023 - DNA, 19 bp, Homo sapiens
gactgggaggagggggagg

SEQ ID NO: 6207024 - DNA, 16 bp, Homo sapiens
gactgggagtcagagc

SEQ ID NO: 6207025 - DNA, 17 bp, Homo sapiens
gactgggagtcagagcc

SEQ ID NO: 6207026 - DNA, 17 bp, Homo sapiens
gactgggcacccctgcc

SEQ ID NO: 6207027 - DNA, 21 bp, Homo sapiens
gactgggcacccctgcctcct

SEQ ID NO: 6207028 - DNA, 22 bp, Homo sapiens
gactgggcacccctgcctcctg

SEQ ID NO: 6207029 - DNA, 16 bp, Homo sapiens
gactgggccaggggag

SEQ ID NO: 6207030 - DNA, 16 bp, Homo sapiens
gactgggccatgggtc

SEQ ID NO: 6207031 - DNA, 18 bp, Homo sapiens
gactgggccatgggtcct

SEQ ID NO: 6207032 - DNA, 19 bp, Homo sapiens
gactgggccatgggtcctc

SEQ ID NO: 6207033 - DNA, 17 bp, Homo sapiens
gactgggcccaggcagg

SEQ ID NO: 6207034 - DNA, 18 bp, Homo sapiens
gactgggcccaggcaggt

SEQ ID NO: 6207035 - DNA, 20 bp, Homo sapiens
gactgggcccaggcaggtct

SEQ ID NO: 6207036 - DNA, 15 bp, Homo sapiens
gactgggcccgaggg

SEQ ID NO: 6207037 - DNA, 17 bp, Homo sapiens
gactgggccctgcctct

SEQ ID NO: 6207038 - DNA, 14 bp, Homo sapiens
gactgggccctgtc

SEQ ID NO: 6207039 - DNA, 20 bp, Homo sapiens
gactgggccgggcccagggc

SEQ ID NO: 6207040 - DNA, 19 bp, Homo sapiens
gactgggcctaggccagga

SEQ ID NO: 6207041 - DNA, 15 bp, Homo sapiens
gactgggctctggct

SEQ ID NO: 6207042 - DNA, 15 bp, Homo sapiens
gactgggctgaggga

SEQ ID NO: 6207043 - DNA, 16 bp, Homo sapiens
gactgggctgagggag

SEQ ID NO: 6207044 - DNA, 13 bp, Homo sapiens
gactgggctgctg

SEQ ID NO: 6207045 - DNA, 15 bp, Homo sapiens
gactgggctgctggg

SEQ ID NO: 6207046 - DNA, 16 bp, Homo sapiens
gactgggctgctgggg

SEQ ID NO: 6207047 - DNA, 12 bp, Homo sapiens
gactgggctggg

SEQ ID NO: 6207048 - DNA, 17 bp, Homo sapiens
gactggggagggctgca

SEQ ID NO: 6207049 - DNA, 17 bp, Homo sapiens
gactggggatgtgggag

SEQ ID NO: 6207050 - DNA, 23 bp, Homo sapiens
gactggggatgtgggagggagca

SEQ ID NO: 6207051 - DNA, 19 bp, Homo sapiens
gactggggccactacattt

SEQ ID NO: 6207052 - DNA, 18 bp, Homo sapiens
gactgggggactgggagt

SEQ ID NO: 6207053 - DNA, 23 bp, Homo sapiens
gactgggggcagacatggtgggg

SEQ ID NO: 6207054 - DNA, 18 bp, Homo sapiens
gactgggggcggggcctg

SEQ ID NO: 6207055 - DNA, 14 bp, Homo sapiens
gactgggggtcttt

SEQ ID NO: 6207056 - DNA, 23 bp, Homo sapiens
gactgggggtgccaaccacctct

SEQ ID NO: 6207057 - DNA, 22 bp, Homo sapiens
gactggggtaagcggaataaac

SEQ ID NO: 6207058 - DNA, 23 bp, Homo sapiens
gactggggtcattttgactggct

SEQ ID NO: 6207059 - DNA, 14 bp, Homo sapiens
gactggggtggcct

SEQ ID NO: 6207060 - DNA, 18 bp, Homo sapiens
gactgggtaatttataaa

SEQ ID NO: 6207061 - DNA, 16 bp, Homo sapiens
gactgggtctgacctg

SEQ ID NO: 6207062 - DNA, 21 bp, Homo sapiens
gactgggtctgacctggtggg

SEQ ID NO: 6207063 - DNA, 20 bp, Homo sapiens
gactgggtgggccccacagt

SEQ ID NO: 6207064 - DNA, 21 bp, Homo sapiens
gactgggtttggaccccagct

SEQ ID NO: 6207065 - DNA, 18 bp, Homo sapiens
gactggtaggaggaggca

SEQ ID NO: 6207066 - DNA, 20 bp, Homo sapiens
gactggtaggaggaggcatg

SEQ ID NO: 6207067 - DNA, 10 bp, Homo sapiens
gactggtcac

SEQ ID NO: 6207068 - DNA, 9 bp, Homo sapiens
gactggtcc

SEQ ID NO: 6207069 - DNA, 10 bp, Homo sapiens
gactggtcca

SEQ ID NO: 6207070 - DNA, 12 bp, Homo sapiens
gactggtccagc

SEQ ID NO: 6207071 - DNA, 18 bp, Homo sapiens
gactggtccagctctgac

SEQ ID NO: 6207072 - DNA, 20 bp, Homo sapiens
gactggtccagctctgacat

SEQ ID NO: 6207073 - DNA, 16 bp, Homo sapiens
ctttcaccaccccctc

SEQ ID NO: 6207074 - DNA, 18 bp, Homo sapiens
ctttcacccacagaaaga

SEQ ID NO: 6207075 - DNA, 22 bp, Homo sapiens
ctttcacccatcctaggaacca

SEQ ID NO: 6207076 - DNA, 22 bp, Homo sapiens
ctttcaccccagggcctgagcc

SEQ ID NO: 6207077 - DNA, 12 bp, Homo sapiens
ctttcaccccca

SEQ ID NO: 6207078 - DNA, 16 bp, Homo sapiens
ctttcacccctcttcc

SEQ ID NO: 6207079 - DNA, 18 bp, Homo sapiens
ctttcaccctcatgaaaa

SEQ ID NO: 6207080 - DNA, 12 bp, Homo sapiens
ctttcaccctgc

SEQ ID NO: 6207081 - DNA, 20 bp, Homo sapiens
ctttcacccttttctgtttg

SEQ ID NO: 6207082 - DNA, 19 bp, Homo sapiens
ctttcactacatattaaat

SEQ ID NO: 6207083 - DNA, 15 bp, Homo sapiens
ctttcactataatgt

SEQ ID NO: 6207084 - DNA, 20 bp, Homo sapiens
ctttcactataatgtgaaat

SEQ ID NO: 6207085 - DNA, 21 bp, Homo sapiens
ctttcactatttcctttataa

SEQ ID NO: 6207086 - DNA, 22 bp, Homo sapiens
ctttcactatttcctttataat

SEQ ID NO: 6207087 - DNA, 18 bp, Homo sapiens
ctttcactctttagaaat

SEQ ID NO: 6207088 - DNA, 17 bp, Homo sapiens
ctttcactggaatgaag

SEQ ID NO: 6207089 - DNA, 17 bp, Homo sapiens
ctttcacttacctgaaa

SEQ ID NO: 6207090 - DNA, 15 bp, Homo sapiens
ctttcacttcttcct

SEQ ID NO: 6207091 - DNA, 21 bp, Homo sapiens
ctttcacttctttcccttcct

SEQ ID NO: 6207092 - DNA, 12 bp, Homo sapiens
ctttcactttga

SEQ ID NO: 6207093 - DNA, 16 bp, Homo sapiens
ctttcacttttaaact

SEQ ID NO: 6207094 - DNA, 18 bp, Homo sapiens
ctttcacttttagttggc

SEQ ID NO: 6207095 - DNA, 11 bp, Homo sapiens
ctttcagaaag

SEQ ID NO: 6207096 - DNA, 14 bp, Homo sapiens
ctttcagaaagctt

SEQ ID NO: 6207097 - DNA, 15 bp, Homo sapiens
ctttcagaaatataa

SEQ ID NO: 6207098 - DNA, 20 bp, Homo sapiens
ctttcagaactcacattggc

SEQ ID NO: 6207099 - DNA, 19 bp, Homo sapiens
ctttcagaactgctaccat

SEQ ID NO: 6207100 - DNA, 21 bp, Homo sapiens
ctttcagaatatgtcagtgct

SEQ ID NO: 6207101 - DNA, 16 bp, Homo sapiens
ctttcagaatattttc

SEQ ID NO: 6207102 - DNA, 21 bp, Homo sapiens
ctttcagaatattttcaaaat

SEQ ID NO: 6207103 - DNA, 13 bp, Homo sapiens
ctttcagaatgtt

SEQ ID NO: 6207104 - DNA, 14 bp, Homo sapiens
ctttcagaatgttg

SEQ ID NO: 6207105 - DNA, 16 bp, Homo sapiens
ctttcagacttgccat

SEQ ID NO: 6207106 - DNA, 18 bp, Homo sapiens
ctttcagacttgccatgt

SEQ ID NO: 6207107 - DNA, 21 bp, Homo sapiens
ctttcagagccagcctggctc

SEQ ID NO: 6207108 - DNA, 13 bp, Homo sapiens
ctttcagagcctc

SEQ ID NO: 6207109 - DNA, 14 bp, Homo sapiens
ctttcagagcctcc

SEQ ID NO: 6207110 - DNA, 19 bp, Homo sapiens
ctttcagatacatggttgt

SEQ ID NO: 6207111 - DNA, 18 bp, Homo sapiens
ctttcagatgcagttttc

SEQ ID NO: 6207112 - DNA, 16 bp, Homo sapiens
ctttcagatgtcttct

SEQ ID NO: 6207113 - DNA, 19 bp, Homo sapiens
ctttcagatgtcttctgcc

SEQ ID NO: 6207114 - DNA, 23 bp, Homo sapiens
ctttcagatgtcttctgcctgtt

SEQ ID NO: 6207115 - DNA, 17 bp, Homo sapiens
ctttcagattgtatctg

SEQ ID NO: 6207116 - DNA, 21 bp, Homo sapiens
ctttcagattgtatctgaact

SEQ ID NO: 6207117 - DNA, 17 bp, Homo sapiens
ctttcagcactcagaaa

SEQ ID NO: 6207118 - DNA, 14 bp, Homo sapiens
ctttcagcaggcag

SEQ ID NO: 6207119 - DNA, 15 bp, Homo sapiens
ctttcagcaggcagc

SEQ ID NO: 6207120 - DNA, 18 bp, Homo sapiens
ctttcagcaggcagcctt

SEQ ID NO: 6207121 - DNA, 20 bp, Homo sapiens
ctttcagccaagaattctta

SEQ ID NO: 6207122 - DNA, 14 bp, Homo sapiens
ctttcagcctgctt

SEQ ID NO: 6207123 - DNA, 12 bp, Homo sapiens
ctttcagcgccc

SEQ ID NO: 6207124 - DNA, 17 bp, Homo sapiens
ctttcagcgcccccagg

SEQ ID NO: 6207125 - DNA, 12 bp, Homo sapiens
ctttcagctcct

SEQ ID NO: 6207126 - DNA, 13 bp, Homo sapiens
ctttcagctcctg

SEQ ID NO: 6207127 - DNA, 14 bp, Homo sapiens
ctttcagctcctga

SEQ ID NO: 6207128 - DNA, 17 bp, Homo sapiens
ctttcagctcctgacca

SEQ ID NO: 6207129 - DNA, 19 bp, Homo sapiens
ctttcagctcctgaccagt

SEQ ID NO: 6207130 - DNA, 14 bp, Homo sapiens
ctttcagctgtgaa

SEQ ID NO: 6207131 - DNA, 21 bp, Homo sapiens
ctttcagctgtgtctgacatg

SEQ ID NO: 6207132 - DNA, 21 bp, Homo sapiens
ctttcaggaagggagaggagg

SEQ ID NO: 6207133 - DNA, 14 bp, Homo sapiens
ctttcaggcctaca

SEQ ID NO: 6207134 - DNA, 19 bp, Homo sapiens
ctttcaggctactgttctt

SEQ ID NO: 6207135 - DNA, 21 bp, Homo sapiens
ctttcagggcagcccctgcag

SEQ ID NO: 6207136 - DNA, 17 bp, Homo sapiens
ctttcagggccatggtt

SEQ ID NO: 6207137 - DNA, 15 bp, Homo sapiens
ctttcagggcctcca

SEQ ID NO: 6207138 - DNA, 17 bp, Homo sapiens
ctttcaggtccaggcca

SEQ ID NO: 6207139 - DNA, 21 bp, Homo sapiens
ctttcagtacttttttaaata

SEQ ID NO: 6207140 - DNA, 21 bp, Homo sapiens
ctttcagtattaaactctcct

SEQ ID NO: 6207141 - DNA, 17 bp, Homo sapiens
ctttcagtcccaaagcg

SEQ ID NO: 6207142 - DNA, 17 bp, Homo sapiens
ctttcagtgaaagcatc

SEQ ID NO: 6207143 - DNA, 17 bp, Homo sapiens
ctttcagtgcagtttct

SEQ ID NO: 6207144 - DNA, 13 bp, Homo sapiens
ctttcagtgcctg

SEQ ID NO: 6207145 - DNA, 16 bp, Homo sapiens
ctttcagtgcctgctg

SEQ ID NO: 6207146 - DNA, 23 bp, Homo sapiens
ctttcagtggaaaccctgagagt

SEQ ID NO: 6207147 - DNA, 14 bp, Homo sapiens
ctttcagttagcct

SEQ ID NO: 6207148 - DNA, 23 bp, Homo sapiens
ctttcagttcgttggtagagccc

SEQ ID NO: 6207149 - DNA, 19 bp, Homo sapiens
ctttcagtttcaggagtgc

SEQ ID NO: 6207150 - DNA, 19 bp, Homo sapiens
ctttcagtttgtccacaca

SEQ ID NO: 6207151 - DNA, 19 bp, Homo sapiens
ctttcataataaatagaca

SEQ ID NO: 6207152 - DNA, 23 bp, Homo sapiens
ctttcataatttaaaaatctcca

SEQ ID NO: 6207153 - DNA, 16 bp, Homo sapiens
ctttcatacattatat

SEQ ID NO: 6207154 - DNA, 22 bp, Homo sapiens
ctttcatacattatattcctct

SEQ ID NO: 6207155 - DNA, 18 bp, Homo sapiens
ctttcataccacttgaat

SEQ ID NO: 6207156 - DNA, 16 bp, Homo sapiens
ctttcatactacattt

SEQ ID NO: 6207157 - DNA, 19 bp, Homo sapiens
ctttcatagagaggcctgc

SEQ ID NO: 6207158 - DNA, 18 bp, Homo sapiens
ctttcatagtataacttt

SEQ ID NO: 6207159 - DNA, 22 bp, Homo sapiens
ctttcatagtataactttaaat

SEQ ID NO: 6207160 - DNA, 13 bp, Homo sapiens
ctttcatagttct

SEQ ID NO: 6207161 - DNA, 14 bp, Homo sapiens
ctttcatagttctg

SEQ ID NO: 6207162 - DNA, 17 bp, Homo sapiens
ctttcatagttctgtta

SEQ ID NO: 6207163 - DNA, 18 bp, Homo sapiens
ctttcatagttctgttaa

SEQ ID NO: 6207164 - DNA, 20 bp, Homo sapiens
ctttcatagttctgttaaat

SEQ ID NO: 6207165 - DNA, 22 bp, Homo sapiens
ctttcatagttctgttaaatat

SEQ ID NO: 6207166 - DNA, 13 bp, Homo sapiens
ctttcatatagtt

SEQ ID NO: 6207167 - DNA, 23 bp, Homo sapiens
ctttcatatagttagctaataaa

SEQ ID NO: 6207168 - DNA, 21 bp, Homo sapiens
ctttcatatgaggggacccag

SEQ ID NO: 6207169 - DNA, 13 bp, Homo sapiens
ctttcatatggta

SEQ ID NO: 6207170 - DNA, 14 bp, Homo sapiens
ctttcatatggtag

SEQ ID NO: 6207171 - DNA, 14 bp, Homo sapiens
ctttcatattttag

SEQ ID NO: 6207172 - DNA, 23 bp, Homo sapiens
ctttcatcaatgggattttctag

SEQ ID NO: 6207173 - DNA, 13 bp, Homo sapiens
ctttcatcctcag

SEQ ID NO: 6207174 - DNA, 17 bp, Homo sapiens
ctttcatcctgactctg

SEQ ID NO: 6207175 - DNA, 19 bp, Homo sapiens
ctttcatcctgactctgcc

SEQ ID NO: 6207176 - DNA, 16 bp, Homo sapiens
ctttcatcctgtgtcc

SEQ ID NO: 6207177 - DNA, 17 bp, Homo sapiens
ctttcatcggtgcctgg

SEQ ID NO: 6207178 - DNA, 13 bp, Homo sapiens
ctttcatctccca

SEQ ID NO: 6207179 - DNA, 14 bp, Homo sapiens
ctttcatctcccag

SEQ ID NO: 6207180 - DNA, 20 bp, Homo sapiens
ctttcatctcctgagtatgt

SEQ ID NO: 6207181 - DNA, 18 bp, Homo sapiens
ctttcatctctctacctc

SEQ ID NO: 6207182 - DNA, 20 bp, Homo sapiens
ctttcatctctctacctcca

SEQ ID NO: 6207183 - DNA, 21 bp, Homo sapiens
ctttcatctctctacctccac

SEQ ID NO: 6207184 - DNA, 21 bp, Homo sapiens
ctttcatctgagcttttacca

SEQ ID NO: 6207185 - DNA, 17 bp, Homo sapiens
ctttcatctggggtggg

SEQ ID NO: 6207186 - DNA, 15 bp, Homo sapiens
ctttcatcttaaact

SEQ ID NO: 6207187 - DNA, 18 bp, Homo sapiens
ctttcatgaacacagcct

SEQ ID NO: 6207188 - DNA, 23 bp, Homo sapiens
ctttcatgaccactgggcctgct

SEQ ID NO: 6207189 - DNA, 14 bp, Homo sapiens
ctttcatgcagtgc

SEQ ID NO: 6207190 - DNA, 18 bp, Homo sapiens
ctttcatgcagtgctctt

SEQ ID NO: 6207191 - DNA, 13 bp, Homo sapiens
ctttcatgccatt

SEQ ID NO: 6207192 - DNA, 21 bp, Homo sapiens
ctttcatgccattttatttct

SEQ ID NO: 6207193 - DNA, 23 bp, Homo sapiens
ctttcatggaatgcaatttgact

SEQ ID NO: 6207194 - DNA, 22 bp, Homo sapiens
ctttcatggctgctgttgctta

SEQ ID NO: 6207195 - DNA, 17 bp, Homo sapiens
ctttcatgtaaactgtg

SEQ ID NO: 6207196 - DNA, 13 bp, Homo sapiens
ctttcatgtaagt

SEQ ID NO: 6207197 - DNA, 20 bp, Homo sapiens
ctttcatgtaagtagcaaac

SEQ ID NO: 6207198 - DNA, 16 bp, Homo sapiens
ctttcatgtcttgtca

SEQ ID NO: 6207199 - DNA, 22 bp, Homo sapiens
ctttcatgtgtgccaaggctga

SEQ ID NO: 6207200 - DNA, 22 bp, Homo sapiens
ctttcatgttaatcaaacaagt

SEQ ID NO: 6207201 - DNA, 23 bp, Homo sapiens
ctttcatgttactgttgcagctt

SEQ ID NO: 6207202 - DNA, 18 bp, Homo sapiens
ctttcatgttgcaaagaa

SEQ ID NO: 6207203 - DNA, 19 bp, Homo sapiens
ctttcatgtttaagaaatg

SEQ ID NO: 6207204 - DNA, 20 bp, Homo sapiens
ctttcattaaagcatttact

SEQ ID NO: 6207205 - DNA, 23 bp, Homo sapiens
ctttcattaaaggcttctctctc

SEQ ID NO: 6207206 - DNA, 20 bp, Homo sapiens
ctttcattaccctacagaca

SEQ ID NO: 6207207 - DNA, 20 bp, Homo sapiens
ctttcattaggcaaagtaca

SEQ ID NO: 6207208 - DNA, 22 bp, Homo sapiens
ctttcattcagcctttagaaat

SEQ ID NO: 6207209 - DNA, 21 bp, Homo sapiens
ctttcattcagctaacaaact

SEQ ID NO: 6207210 - DNA, 19 bp, Homo sapiens
ctttcattcggtgtgaact

SEQ ID NO: 6207211 - DNA, 15 bp, Homo sapiens
ctttcattcttctca

SEQ ID NO: 6207212 - DNA, 15 bp, Homo sapiens
ctttcattgccagtg

SEQ ID NO: 6207213 - DNA, 18 bp, Homo sapiens
ctttcatttactgtggct

SEQ ID NO: 6207214 - DNA, 12 bp, Homo sapiens
ctttcatttctt

SEQ ID NO: 6207215 - DNA, 17 bp, Homo sapiens
ctttcatttgaaagtgg

SEQ ID NO: 6207216 - DNA, 22 bp, Homo sapiens
ctttcatttggggcatttgtaa

SEQ ID NO: 6207217 - DNA, 10 bp, Homo sapiens
ctttcatttt

SEQ ID NO: 6207218 - DNA, 21 bp, Homo sapiens
ctttcattttctctcaggtga

SEQ ID NO: 6207219 - DNA, 14 bp, Homo sapiens
ctttcattttctgt

SEQ ID NO: 6207220 - DNA, 22 bp, Homo sapiens
ctttcattttctttcctttccc

SEQ ID NO: 6207221 - DNA, 14 bp, Homo sapiens
ctttcattttgcac

SEQ ID NO: 6207222 - DNA, 14 bp, Homo sapiens
ctttcattttgctt

SEQ ID NO: 6207223 - DNA, 16 bp, Homo sapiens
ctttcattttgcttta

SEQ ID NO: 6207224 - DNA, 15 bp, Homo sapiens
ctttcatttttgata

SEQ ID NO: 6207225 - DNA, 22 bp, Homo sapiens
ctttcatttttttccaggctgg

SEQ ID NO: 6207226 - DNA, 11 bp, Homo sapiens
ctttccaaaga

SEQ ID NO: 6207227 - DNA, 10 bp, Homo sapiens
ctttccaaat

SEQ ID NO: 6207228 - DNA, 16 bp, Homo sapiens
ctttccaaatgcccag

SEQ ID NO: 6207229 - DNA, 18 bp, Homo sapiens
ctttccaaatgcccagct

SEQ ID NO: 6207230 - DNA, 11 bp, Homo sapiens
ctttccaaatt

SEQ ID NO: 6207231 - DNA, 15 bp, Homo sapiens
ctttccaaattaaaa

SEQ ID NO: 6207232 - DNA, 15 bp, Homo sapiens
ctttccaaattattt

SEQ ID NO: 6207233 - DNA, 13 bp, Homo sapiens
ctttccaacctca

SEQ ID NO: 6207234 - DNA, 18 bp, Homo sapiens
ctttccaacctcacttcc

SEQ ID NO: 6207235 - DNA, 17 bp, Homo sapiens
ctttccaacgtttggaa

SEQ ID NO: 6207236 - DNA, 14 bp, Homo sapiens
ctttccaagcttgg

SEQ ID NO: 6207237 - DNA, 14 bp, Homo sapiens
ctttccaaggaagc

SEQ ID NO: 6207238 - DNA, 17 bp, Homo sapiens
ctttccaaggaagcaga

SEQ ID NO: 6207239 - DNA, 22 bp, Homo sapiens
ctttccaatccagaggaacaag

SEQ ID NO: 6207240 - DNA, 14 bp, Homo sapiens
ctttccaattccaa

SEQ ID NO: 6207241 - DNA, 15 bp, Homo sapiens
ctttccaattctcct

SEQ ID NO: 6207242 - DNA, 14 bp, Homo sapiens
ctttccacaggagg

SEQ ID NO: 6207243 - DNA, 18 bp, Homo sapiens
ctttccacatttgtcaca

SEQ ID NO: 6207244 - DNA, 12 bp, Homo sapiens
ctttccacccag

SEQ ID NO: 6207245 - DNA, 13 bp, Homo sapiens
ctttccacccaga

SEQ ID NO: 6207246 - DNA, 16 bp, Homo sapiens
ctttccaccccctccc

SEQ ID NO: 6207247 - DNA, 22 bp, Homo sapiens
ctttccaccccctccctggcct

SEQ ID NO: 6207248 - DNA, 23 bp, Homo sapiens
ctttccaccccctccctggcctg

SEQ ID NO: 6207249 - DNA, 22 bp, Homo sapiens
ctttccaccctattccctaact

SEQ ID NO: 6207250 - DNA, 22 bp, Homo sapiens
ctttccacctgctttctcctgg

SEQ ID NO: 6207251 - DNA, 21 bp, Homo sapiens
ctttccacggagccactcctc

SEQ ID NO: 6207252 - DNA, 19 bp, Homo sapiens
gactggtcccccatgggct

SEQ ID NO: 6207253 - DNA, 22 bp, Homo sapiens
gactggtcttccttacctggaa

SEQ ID NO: 6207254 - DNA, 17 bp, Homo sapiens
gactggtgagagaagaa

SEQ ID NO: 6207255 - DNA, 14 bp, Homo sapiens
gactggtgagcaga

SEQ ID NO: 6207256 - DNA, 16 bp, Homo sapiens
gactggtgccctcctc

SEQ ID NO: 6207257 - DNA, 11 bp, Homo sapiens
gactggtgcga

SEQ ID NO: 6207258 - DNA, 13 bp, Homo sapiens
gactggtgggggt

SEQ ID NO: 6207259 - DNA, 21 bp, Homo sapiens
gactggtgggggttctggcag

SEQ ID NO: 6207260 - DNA, 19 bp, Homo sapiens
gactggtgtcataaacttt

SEQ ID NO: 6207261 - DNA, 14 bp, Homo sapiens
gactggtgttaatg

SEQ ID NO: 6207262 - DNA, 15 bp, Homo sapiens
gactggttatcttgt

SEQ ID NO: 6207263 - DNA, 16 bp, Homo sapiens
gactggttatcttgtt

SEQ ID NO: 6207264 - DNA, 22 bp, Homo sapiens
gactggttcagaaatagctcct

SEQ ID NO: 6207265 - DNA, 15 bp, Homo sapiens
gactggttccttcct

SEQ ID NO: 6207266 - DNA, 22 bp, Homo sapiens
gactgtaaacatcagcaagact

SEQ ID NO: 6207267 - DNA, 13 bp, Homo sapiens
gactgtaaagatt

SEQ ID NO: 6207268 - DNA, 18 bp, Homo sapiens
gactgtaaattccaaaga

SEQ ID NO: 6207269 - DNA, 19 bp, Homo sapiens
gactgtaaattccaaagat

SEQ ID NO: 6207270 - DNA, 13 bp, Homo sapiens
gactgtaagatgt

SEQ ID NO: 6207271 - DNA, 21 bp, Homo sapiens
gactgtaagcagattacaata

SEQ ID NO: 6207272 - DNA, 18 bp, Homo sapiens
gactgtacacactttatt

SEQ ID NO: 6207273 - DNA, 15 bp, Homo sapiens
gactgtacagagact

SEQ ID NO: 6207274 - DNA, 16 bp, Homo sapiens
gactgtacagagactc

SEQ ID NO: 6207275 - DNA, 20 bp, Homo sapiens
gactgtacataattgcatga

SEQ ID NO: 6207276 - DNA, 22 bp, Homo sapiens
gactgtacataattgcatgaaa

SEQ ID NO: 6207277 - DNA, 19 bp, Homo sapiens
gactgtacattatgaagaa

SEQ ID NO: 6207278 - DNA, 20 bp, Homo sapiens
gactgtacattatgaagaat

SEQ ID NO: 6207279 - DNA, 16 bp, Homo sapiens
gactgtaccacagaca

SEQ ID NO: 6207280 - DNA, 20 bp, Homo sapiens
gactgtaccacagacacaat

SEQ ID NO: 6207281 - DNA, 12 bp, Homo sapiens
gactgtacctgt

SEQ ID NO: 6207282 - DNA, 17 bp, Homo sapiens
gactgtacttattttcc

SEQ ID NO: 6207283 - DNA, 21 bp, Homo sapiens
gactgtagaaggtgagaggcg

SEQ ID NO: 6207284 - DNA, 22 bp, Homo sapiens
gactgtagagatttttatgtgt

SEQ ID NO: 6207285 - DNA, 20 bp, Homo sapiens
gactgtagattgcttctgta

SEQ ID NO: 6207286 - DNA, 22 bp, Homo sapiens
gactgtagattgcttctgtagt

SEQ ID NO: 6207287 - DNA, 20 bp, Homo sapiens
gactgtagccacagctgctg

SEQ ID NO: 6207288 - DNA, 20 bp, Homo sapiens
gactgtataggtagatccag

SEQ ID NO: 6207289 - DNA, 14 bp, Homo sapiens
gactgtatataaag

SEQ ID NO: 6207290 - DNA, 19 bp, Homo sapiens
gactgtatataaaggaaaa

SEQ ID NO: 6207291 - DNA, 14 bp, Homo sapiens
gactgtatattgct

SEQ ID NO: 6207292 - DNA, 15 bp, Homo sapiens
gactgtatattgcta

SEQ ID NO: 6207293 - DNA, 17 bp, Homo sapiens
gactgtatctgtgtaga

SEQ ID NO: 6207294 - DNA, 19 bp, Homo sapiens
gactgtatctgtgtagact

SEQ ID NO: 6207295 - DNA, 18 bp, Homo sapiens
gactgtattatacatggg

SEQ ID NO: 6207296 - DNA, 17 bp, Homo sapiens
gactgtatttgtgacta

SEQ ID NO: 6207297 - DNA, 19 bp, Homo sapiens
gactgtattttcaggaagg

SEQ ID NO: 6207298 - DNA, 18 bp, Homo sapiens
gactgtcaaatgaacttt

SEQ ID NO: 6207299 - DNA, 15 bp, Homo sapiens
gactgtcacactggt

SEQ ID NO: 6207300 - DNA, 20 bp, Homo sapiens
gactgtcatgtggcttggtt

SEQ ID NO: 6207301 - DNA, 11 bp, Homo sapiens
gactgtcccac

SEQ ID NO: 6207302 - DNA, 19 bp, Homo sapiens
gactgtcccaccgggagcc

SEQ ID NO: 6207303 - DNA, 15 bp, Homo sapiens
gactgtcctagccag

SEQ ID NO: 6207304 - DNA, 20 bp, Homo sapiens
gactgtcctagccaggtctc

SEQ ID NO: 6207305 - DNA, 13 bp, Homo sapiens
gactgtcctccca

SEQ ID NO: 6207306 - DNA, 23 bp, Homo sapiens
gactgtcgccacacgcctctgtg

SEQ ID NO: 6207307 - DNA, 23 bp, Homo sapiens
gactgtcggagaggctgtctggg

SEQ ID NO: 6207308 - DNA, 16 bp, Homo sapiens
gactgtcgttctccac

SEQ ID NO: 6207309 - DNA, 23 bp, Homo sapiens
gactgtctagccactccctccca

SEQ ID NO: 6207310 - DNA, 22 bp, Homo sapiens
gactgtctatatcataactata

SEQ ID NO: 6207311 - DNA, 22 bp, Homo sapiens
gactgtctcaagagggcactgg

SEQ ID NO: 6207312 - DNA, 17 bp, Homo sapiens
gactgtcttcaaccctg

SEQ ID NO: 6207313 - DNA, 13 bp, Homo sapiens
gactgtctttcag

SEQ ID NO: 6207314 - DNA, 14 bp, Homo sapiens
gactgtgaatttca

SEQ ID NO: 6207315 - DNA, 17 bp, Homo sapiens
gactgtgacaggcagca

SEQ ID NO: 6207316 - DNA, 14 bp, Homo sapiens
gactgtgaccaaag

SEQ ID NO: 6207317 - DNA, 17 bp, Homo sapiens
gactgtgaccaccttct

SEQ ID NO: 6207318 - DNA, 21 bp, Homo sapiens
gactgtgaggcggcagctggg

SEQ ID NO: 6207319 - DNA, 23 bp, Homo sapiens
gactgtgaggcggcagctggggc

SEQ ID NO: 6207320 - DNA, 13 bp, Homo sapiens
gactgtgatgcca

SEQ ID NO: 6207321 - DNA, 17 bp, Homo sapiens
gactgtgattagatcac

SEQ ID NO: 6207322 - DNA, 19 bp, Homo sapiens
gactgtgattcttagcaaa

SEQ ID NO: 6207323 - DNA, 12 bp, Homo sapiens
gactgtgcagaa

SEQ ID NO: 6207324 - DNA, 17 bp, Homo sapiens
gactgtgccagaggcca

SEQ ID NO: 6207325 - DNA, 13 bp, Homo sapiens
gactgtgccatgg

SEQ ID NO: 6207326 - DNA, 20 bp, Homo sapiens
gactgtgccatggtgagaaa

SEQ ID NO: 6207327 - DNA, 12 bp, Homo sapiens
gactgtgcctgg

SEQ ID NO: 6207328 - DNA, 14 bp, Homo sapiens
gactgtgcctggct

SEQ ID NO: 6207329 - DNA, 18 bp, Homo sapiens
gactgtgcctggctccct

SEQ ID NO: 6207330 - DNA, 13 bp, Homo sapiens
gactgtgctactg

SEQ ID NO: 6207331 - DNA, 15 bp, Homo sapiens
gactgtgctggtgca

SEQ ID NO: 6207332 - DNA, 19 bp, Homo sapiens
gactgtggagactgctcct

SEQ ID NO: 6207333 - DNA, 15 bp, Homo sapiens
gactgtggcctcagg

SEQ ID NO: 6207334 - DNA, 16 bp, Homo sapiens
gactgtggcctcagga

SEQ ID NO: 6207335 - DNA, 14 bp, Homo sapiens
gactgtggctgcag

SEQ ID NO: 6207336 - DNA, 15 bp, Homo sapiens
gactgtggctgcaga

SEQ ID NO: 6207337 - DNA, 11 bp, Homo sapiens
gactgtggggt

SEQ ID NO: 6207338 - DNA, 20 bp, Homo sapiens
gactgtggtaggggcaggga

SEQ ID NO: 6207339 - DNA, 21 bp, Homo sapiens
gactgtggtaggggcagggag

SEQ ID NO: 6207340 - DNA, 13 bp, Homo sapiens
gactgtggtgact

SEQ ID NO: 6207341 - DNA, 23 bp, Homo sapiens
gactgtggtgacttctgctgctg

SEQ ID NO: 6207342 - DNA, 19 bp, Homo sapiens
gactgtgtaactttctctt

SEQ ID NO: 6207343 - DNA, 22 bp, Homo sapiens
gactgtgtatagtgccaccaca

SEQ ID NO: 6207344 - DNA, 21 bp, Homo sapiens
gactgtgtctgcctgtcccca

SEQ ID NO: 6207345 - DNA, 14 bp, Homo sapiens
gactgtgtgctcag

SEQ ID NO: 6207346 - DNA, 17 bp, Homo sapiens
gactgtgtgctcaggag

SEQ ID NO: 6207347 - DNA, 20 bp, Homo sapiens
gactgtgtgctcaggagccc

SEQ ID NO: 6207348 - DNA, 17 bp, Homo sapiens
gactgtgtgtgccctct

SEQ ID NO: 6207349 - DNA, 22 bp, Homo sapiens
gactgtgtgttgccacaggaca

SEQ ID NO: 6207350 - DNA, 19 bp, Homo sapiens
gactgtgtgttgtgaaata

SEQ ID NO: 6207351 - DNA, 20 bp, Homo sapiens
gactgtgttcagtgccttgg

SEQ ID NO: 6207352 - DNA, 13 bp, Homo sapiens
gactgtgttgggc

SEQ ID NO: 6207353 - DNA, 12 bp, Homo sapiens
gactgtgtttaa

SEQ ID NO: 6207354 - DNA, 22 bp, Homo sapiens
gactgtgtttccaaaggttccc

SEQ ID NO: 6207355 - DNA, 20 bp, Homo sapiens
gactgtgtttcgtgaactgc

SEQ ID NO: 6207356 - DNA, 14 bp, Homo sapiens
gactgttcatttga

SEQ ID NO: 6207357 - DNA, 16 bp, Homo sapiens
gactgttcatttgaaa

SEQ ID NO: 6207358 - DNA, 14 bp, Homo sapiens
gactgttccaaagc

SEQ ID NO: 6207359 - DNA, 22 bp, Homo sapiens
gactgttccaggccctccagtg

SEQ ID NO: 6207360 - DNA, 20 bp, Homo sapiens
gactgttccttatttctctc

SEQ ID NO: 6207361 - DNA, 13 bp, Homo sapiens
gactgttgagtta

SEQ ID NO: 6207362 - DNA, 15 bp, Homo sapiens
gactgttgatgtact

SEQ ID NO: 6207363 - DNA, 14 bp, Homo sapiens
gactgttgccacca

SEQ ID NO: 6207364 - DNA, 14 bp, Homo sapiens
gactgttgcccccc

SEQ ID NO: 6207365 - DNA, 17 bp, Homo sapiens
gactgttgccccccagg

SEQ ID NO: 6207366 - DNA, 13 bp, Homo sapiens
gactgttgggaca

SEQ ID NO: 6207367 - DNA, 14 bp, Homo sapiens
gactgttgggacag

SEQ ID NO: 6207368 - DNA, 13 bp, Homo sapiens
gactgttgtccct

SEQ ID NO: 6207369 - DNA, 16 bp, Homo sapiens
gactgttgtccctgca

SEQ ID NO: 6207370 - DNA, 19 bp, Homo sapiens
gactgttgttatctgtttg

SEQ ID NO: 6207371 - DNA, 13 bp, Homo sapiens
gactgtttattgg

SEQ ID NO: 6207372 - DNA, 15 bp, Homo sapiens
gactgtttatttaag

SEQ ID NO: 6207373 - DNA, 20 bp, Homo sapiens
gactgtttatttaaggatgg

SEQ ID NO: 6207374 - DNA, 23 bp, Homo sapiens
gactgtttatttaaggatggatg

SEQ ID NO: 6207375 - DNA, 14 bp, Homo sapiens
gactgttttcaata

SEQ ID NO: 6207376 - DNA, 13 bp, Homo sapiens
gactgttttgaaa

SEQ ID NO: 6207377 - DNA, 22 bp, Homo sapiens
gactgtttttaagtaacttaag

SEQ ID NO: 6207378 - DNA, 13 bp, Homo sapiens
gactgtttttacc

SEQ ID NO: 6207379 - DNA, 19 bp, Homo sapiens
gactgtttttatatgcaca

SEQ ID NO: 6207380 - DNA, 18 bp, Homo sapiens
gactgtttttcggacagt

SEQ ID NO: 6207381 - DNA, 19 bp, Homo sapiens
gactgttttttcctgagct

SEQ ID NO: 6207382 - DNA, 21 bp, Homo sapiens
gactgttttttcctgagcttg

SEQ ID NO: 6207383 - DNA, 19 bp, Homo sapiens
gacttaaaacatggtgcct

SEQ ID NO: 6207384 - DNA, 19 bp, Homo sapiens
gacttaaaatattcctgca

SEQ ID NO: 6207385 - DNA, 13 bp, Homo sapiens
gacttaaagcaga

SEQ ID NO: 6207386 - DNA, 20 bp, Homo sapiens
gacttaaaggacaggaggag

SEQ ID NO: 6207387 - DNA, 22 bp, Homo sapiens
gacttaacgttctataaatgaa

SEQ ID NO: 6207388 - DNA, 14 bp, Homo sapiens
gacttaagattaaa

SEQ ID NO: 6207389 - DNA, 20 bp, Homo sapiens
gacttaagcaaaagaaaaag

SEQ ID NO: 6207390 - DNA, 19 bp, Homo sapiens
gacttaagcacacttgaca

SEQ ID NO: 6207391 - DNA, 21 bp, Homo sapiens
gacttaagcccagtgcactga

SEQ ID NO: 6207392 - DNA, 16 bp, Homo sapiens
gacttaatagaaacat

SEQ ID NO: 6207393 - DNA, 14 bp, Homo sapiens
gacttaatctttgc

SEQ ID NO: 6207394 - DNA, 16 bp, Homo sapiens
gacttaatctttgctg

SEQ ID NO: 6207395 - DNA, 14 bp, Homo sapiens
gacttaattctgat

SEQ ID NO: 6207396 - DNA, 12 bp, Homo sapiens
gacttaatttag

SEQ ID NO: 6207397 - DNA, 18 bp, Homo sapiens
gacttaattttagaaaga

SEQ ID NO: 6207398 - DNA, 23 bp, Homo sapiens
gacttaattttagaaagaaaatt

SEQ ID NO: 6207399 - DNA, 17 bp, Homo sapiens
gacttacaaaatgccaa

SEQ ID NO: 6207400 - DNA, 11 bp, Homo sapiens
gacttacaatt

SEQ ID NO: 6207401 - DNA, 12 bp, Homo sapiens
gacttacaattt

SEQ ID NO: 6207402 - DNA, 14 bp, Homo sapiens
gacttacatgattc

SEQ ID NO: 6207403 - DNA, 16 bp, Homo sapiens
gacttacctgttcagt

SEQ ID NO: 6207404 - DNA, 14 bp, Homo sapiens
gacttactctaaga

SEQ ID NO: 6207405 - DNA, 14 bp, Homo sapiens
gacttactgcattg

SEQ ID NO: 6207406 - DNA, 23 bp, Homo sapiens
gacttactgtacatgaaaacaca

SEQ ID NO: 6207407 - DNA, 22 bp, Homo sapiens
gacttactgtttcttaccttaa

SEQ ID NO: 6207408 - DNA, 23 bp, Homo sapiens
gacttagaaaaccagctcagcac

SEQ ID NO: 6207409 - DNA, 14 bp, Homo sapiens
gacttagaaagcag

SEQ ID NO: 6207410 - DNA, 16 bp, Homo sapiens
gacttagaagtagtat

SEQ ID NO: 6207411 - DNA, 12 bp, Homo sapiens
gacttagaatcc

SEQ ID NO: 6207412 - DNA, 18 bp, Homo sapiens
gacttagatattaaaatt

SEQ ID NO: 6207413 - DNA, 23 bp, Homo sapiens
gacttagatattaaaatttggtg

SEQ ID NO: 6207414 - DNA, 15 bp, Homo sapiens
gacttagcctaaaca

SEQ ID NO: 6207415 - DNA, 19 bp, Homo sapiens
gacttagcgtcaagacatt

SEQ ID NO: 6207416 - DNA, 20 bp, Homo sapiens
gacttagcgtcaagacattt

SEQ ID NO: 6207417 - DNA, 13 bp, Homo sapiens
gacttaggccaga

SEQ ID NO: 6207418 - DNA, 16 bp, Homo sapiens
gacttagggcaccagg

SEQ ID NO: 6207419 - DNA, 17 bp, Homo sapiens
gacttaggtgtgaagac

SEQ ID NO: 6207420 - DNA, 20 bp, Homo sapiens
gacttatatatttgaaagaa

SEQ ID NO: 6207421 - DNA, 21 bp, Homo sapiens
gacttatatatttgaaagaag

SEQ ID NO: 6207422 - DNA, 15 bp, Homo sapiens
gacttatgaaacttg

SEQ ID NO: 6207423 - DNA, 22 bp, Homo sapiens
gacttatgccatcccggcagcg

SEQ ID NO: 6207424 - DNA, 14 bp, Homo sapiens
gacttatggcatga

SEQ ID NO: 6207425 - DNA, 13 bp, Homo sapiens
gacttattatatc

SEQ ID NO: 6207426 - DNA, 18 bp, Homo sapiens
gacttattgccaaaaaca

SEQ ID NO: 6207427 - DNA, 20 bp, Homo sapiens
gacttattgtggataacaaa

SEQ ID NO: 6207428 - DNA, 23 bp, Homo sapiens
gacttattgtggataacaaagat

SEQ ID NO: 6207429 - DNA, 19 bp, Homo sapiens
gacttatttctgctctgga

SEQ ID NO: 6207430 - DNA, 12 bp, Homo sapiens
gacttcaaagca

SEQ ID NO: 6207431 - DNA, 22 bp, Homo sapiens
ctttccacggagccactcctct

SEQ ID NO: 6207432 - DNA, 12 bp, Homo sapiens
ctttccactccc

SEQ ID NO: 6207433 - DNA, 15 bp, Homo sapiens
ctttccactcccact

SEQ ID NO: 6207434 - DNA, 12 bp, Homo sapiens
ctttccactctg

SEQ ID NO: 6207435 - DNA, 23 bp, Homo sapiens
ctttccactttgttggcccttcc

SEQ ID NO: 6207436 - DNA, 19 bp, Homo sapiens
ctttccagaactaccaaaa

SEQ ID NO: 6207437 - DNA, 16 bp, Homo sapiens
ctttccagcctgggca

SEQ ID NO: 6207438 - DNA, 19 bp, Homo sapiens
ctttccaggcaccctcagg

SEQ ID NO: 6207439 - DNA, 21 bp, Homo sapiens
ctttccaggcttccctgactt

SEQ ID NO: 6207440 - DNA, 19 bp, Homo sapiens
ctttccagggtcaaagtac

SEQ ID NO: 6207441 - DNA, 21 bp, Homo sapiens
ctttccagggtcaaagtacag

SEQ ID NO: 6207442 - DNA, 15 bp, Homo sapiens
ctttccagtgaggaa

SEQ ID NO: 6207443 - DNA, 20 bp, Homo sapiens
ctttccagtgaggaaatggc

SEQ ID NO: 6207444 - DNA, 15 bp, Homo sapiens
ctttccagtgctgct

SEQ ID NO: 6207445 - DNA, 18 bp, Homo sapiens
ctttccagttagggctgt

SEQ ID NO: 6207446 - DNA, 22 bp, Homo sapiens
ctttccatatcaagagacatgg

SEQ ID NO: 6207447 - DNA, 13 bp, Homo sapiens
ctttccatcaact

SEQ ID NO: 6207448 - DNA, 13 bp, Homo sapiens
ctttccatcagct

SEQ ID NO: 6207449 - DNA, 21 bp, Homo sapiens
ctttccatccatggccagcag

SEQ ID NO: 6207450 - DNA, 22 bp, Homo sapiens
ctttccatccatggccagcagc

SEQ ID NO: 6207451 - DNA, 23 bp, Homo sapiens
ctttccatccattacctccatcc

SEQ ID NO: 6207452 - DNA, 15 bp, Homo sapiens
ctttccatctaccct

SEQ ID NO: 6207453 - DNA, 12 bp, Homo sapiens
ctttccatctct

SEQ ID NO: 6207454 - DNA, 13 bp, Homo sapiens
ctttccatgacac

SEQ ID NO: 6207455 - DNA, 18 bp, Homo sapiens
ctttccatgacagtagca

SEQ ID NO: 6207456 - DNA, 19 bp, Homo sapiens
ctttccatggcaaatgggc

SEQ ID NO: 6207457 - DNA, 18 bp, Homo sapiens
ctttccatgggagccagc

SEQ ID NO: 6207458 - DNA, 18 bp, Homo sapiens
ctttccatgttgctgcca

SEQ ID NO: 6207459 - DNA, 22 bp, Homo sapiens
ctttccatgttttttcttcaaa

SEQ ID NO: 6207460 - DNA, 17 bp, Homo sapiens
ctttccattaaatcaat

SEQ ID NO: 6207461 - DNA, 16 bp, Homo sapiens
ctttccattcttcttg

SEQ ID NO: 6207462 - DNA, 15 bp, Homo sapiens
ctttccatttctctc

SEQ ID NO: 6207463 - DNA, 14 bp, Homo sapiens
ctttccatttggta

SEQ ID NO: 6207464 - DNA, 15 bp, Homo sapiens
ctttccatttggtat

SEQ ID NO: 6207465 - DNA, 19 bp, Homo sapiens
ctttccatttttttcttta

SEQ ID NO: 6207466 - DNA, 22 bp, Homo sapiens
ctttccatttttttctttactt

SEQ ID NO: 6207467 - DNA, 20 bp, Homo sapiens
ctttcccaaaattagggagc

SEQ ID NO: 6207468 - DNA, 22 bp, Homo sapiens
ctttcccaaaattagggagctc

SEQ ID NO: 6207469 - DNA, 14 bp, Homo sapiens
ctttcccaaatgta

SEQ ID NO: 6207470 - DNA, 17 bp, Homo sapiens
ctttcccaaatgtattg

SEQ ID NO: 6207471 - DNA, 21 bp, Homo sapiens
ctttcccaaatgtattgatta

SEQ ID NO: 6207472 - DNA, 19 bp, Homo sapiens
ctttcccaacacttcagac

SEQ ID NO: 6207473 - DNA, 16 bp, Homo sapiens
ctttcccaactctagc

SEQ ID NO: 6207474 - DNA, 16 bp, Homo sapiens
ctttcccaccagcatg

SEQ ID NO: 6207475 - DNA, 21 bp, Homo sapiens
ctttcccaccattcctgcctt

SEQ ID NO: 6207476 - DNA, 22 bp, Homo sapiens
ctttcccaccattcctgccttt

SEQ ID NO: 6207477 - DNA, 17 bp, Homo sapiens
ctttcccacccagcctg

SEQ ID NO: 6207478 - DNA, 15 bp, Homo sapiens
ctttcccaccccaac

SEQ ID NO: 6207479 - DNA, 23 bp, Homo sapiens
ctttcccaccccaacctgctctc

SEQ ID NO: 6207480 - DNA, 22 bp, Homo sapiens
ctttcccaccccacgccttatc

SEQ ID NO: 6207481 - DNA, 22 bp, Homo sapiens
ctttcccaccctgttcccagtc

SEQ ID NO: 6207482 - DNA, 18 bp, Homo sapiens
ctttcccactttcttcta

SEQ ID NO: 6207483 - DNA, 21 bp, Homo sapiens
ctttcccagcctcttccattc

SEQ ID NO: 6207484 - DNA, 13 bp, Homo sapiens
ctttcccaggaga

SEQ ID NO: 6207485 - DNA, 15 bp, Homo sapiens
ctttcccagtctgtc

SEQ ID NO: 6207486 - DNA, 16 bp, Homo sapiens
ctttcccatcttccaa

SEQ ID NO: 6207487 - DNA, 13 bp, Homo sapiens
ctttcccatgctg

SEQ ID NO: 6207488 - DNA, 21 bp, Homo sapiens
ctttcccatgctgaattattt

SEQ ID NO: 6207489 - DNA, 19 bp, Homo sapiens
ctttcccatgtatttgtta

SEQ ID NO: 6207490 - DNA, 17 bp, Homo sapiens
ctttccccaacaatgtg

SEQ ID NO: 6207491 - DNA, 18 bp, Homo sapiens
ctttccccaaggacccag

SEQ ID NO: 6207492 - DNA, 19 bp, Homo sapiens
ctttccccaaggacccagc

SEQ ID NO: 6207493 - DNA, 22 bp, Homo sapiens
ctttccccaaggacccagccct

SEQ ID NO: 6207494 - DNA, 19 bp, Homo sapiens
ctttccccaccagatgctg

SEQ ID NO: 6207495 - DNA, 17 bp, Homo sapiens
ctttccccacctcttcc

SEQ ID NO: 6207496 - DNA, 13 bp, Homo sapiens
ctttccccagagg

SEQ ID NO: 6207497 - DNA, 20 bp, Homo sapiens
ctttccccagcatcactccc

SEQ ID NO: 6207498 - DNA, 22 bp, Homo sapiens
ctttccccagcatcactcccca

SEQ ID NO: 6207499 - DNA, 15 bp, Homo sapiens
ctttccccagcccag

SEQ ID NO: 6207500 - DNA, 15 bp, Homo sapiens
ctttccccaggggca

SEQ ID NO: 6207501 - DNA, 15 bp, Homo sapiens
ctttccccatgtctc

SEQ ID NO: 6207502 - DNA, 20 bp, Homo sapiens
ctttccccatgtctcgactc

SEQ ID NO: 6207503 - DNA, 18 bp, Homo sapiens
ctttccccattcagtgac

SEQ ID NO: 6207504 - DNA, 19 bp, Homo sapiens
ctttcccccaccagctaag

SEQ ID NO: 6207505 - DNA, 13 bp, Homo sapiens
ctttcccccaccc

SEQ ID NO: 6207506 - DNA, 17 bp, Homo sapiens
ctttcccccttctctta

SEQ ID NO: 6207507 - DNA, 18 bp, Homo sapiens
ctttccccgggggaggaa

SEQ ID NO: 6207508 - DNA, 21 bp, Homo sapiens
ctttccccgggggaggaaggg

SEQ ID NO: 6207509 - DNA, 17 bp, Homo sapiens
ctttcccctcagagctc

SEQ ID NO: 6207510 - DNA, 14 bp, Homo sapiens
ctttcccctctcat

SEQ ID NO: 6207511 - DNA, 17 bp, Homo sapiens
ctttcccctgtggggat

SEQ ID NO: 6207512 - DNA, 12 bp, Homo sapiens
ctttcccctttt

SEQ ID NO: 6207513 - DNA, 17 bp, Homo sapiens
ctttcccgcccagcctc

SEQ ID NO: 6207514 - DNA, 18 bp, Homo sapiens
ctttcccgcccagcctca

SEQ ID NO: 6207515 - DNA, 22 bp, Homo sapiens
ctttcccgggccctcagccctc

SEQ ID NO: 6207516 - DNA, 17 bp, Homo sapiens
ctttcccgggctgtcca

SEQ ID NO: 6207517 - DNA, 19 bp, Homo sapiens
ctttcccgggctgtccact

SEQ ID NO: 6207518 - DNA, 16 bp, Homo sapiens
ctttccctaaattgat

SEQ ID NO: 6207519 - DNA, 18 bp, Homo sapiens
ctttccctaattctgcct

SEQ ID NO: 6207520 - DNA, 21 bp, Homo sapiens
ctttccctaatttatcttcat

SEQ ID NO: 6207521 - DNA, 15 bp, Homo sapiens
ctttccctaccctct

SEQ ID NO: 6207522 - DNA, 16 bp, Homo sapiens
ctttccctaccctcta

SEQ ID NO: 6207523 - DNA, 15 bp, Homo sapiens
ctttccctagaaagc

SEQ ID NO: 6207524 - DNA, 22 bp, Homo sapiens
ctttccctagaaagccatattc

SEQ ID NO: 6207525 - DNA, 16 bp, Homo sapiens
ctttccctcaccccct

SEQ ID NO: 6207526 - DNA, 19 bp, Homo sapiens
ctttccctcaccccctccc

SEQ ID NO: 6207527 - DNA, 11 bp, Homo sapiens
ctttccctccc

SEQ ID NO: 6207528 - DNA, 16 bp, Homo sapiens
ctttccctccccagag

SEQ ID NO: 6207529 - DNA, 22 bp, Homo sapiens
ctttccctccgaacgctgctcc

SEQ ID NO: 6207530 - DNA, 16 bp, Homo sapiens
ctttccctctcccagt

SEQ ID NO: 6207531 - DNA, 13 bp, Homo sapiens
ctttccctcttcc

SEQ ID NO: 6207532 - DNA, 13 bp, Homo sapiens
ctttccctgaact

SEQ ID NO: 6207533 - DNA, 13 bp, Homo sapiens
ctttccctgaagc

SEQ ID NO: 6207534 - DNA, 13 bp, Homo sapiens
ctttccctgagga

SEQ ID NO: 6207535 - DNA, 22 bp, Homo sapiens
ctttccctgcatatgcttctga

SEQ ID NO: 6207536 - DNA, 17 bp, Homo sapiens
ctttccctgcatccctt

SEQ ID NO: 6207537 - DNA, 19 bp, Homo sapiens
ctttccctgcttaatgaaa

SEQ ID NO: 6207538 - DNA, 14 bp, Homo sapiens
ctttccctggagct

SEQ ID NO: 6207539 - DNA, 11 bp, Homo sapiens
ctttccctggc

SEQ ID NO: 6207540 - DNA, 13 bp, Homo sapiens
ctttccctggtcc

SEQ ID NO: 6207541 - DNA, 21 bp, Homo sapiens
ctttccctgtgtaccctccat

SEQ ID NO: 6207542 - DNA, 23 bp, Homo sapiens
ctttcccttattgcctcccaggc

SEQ ID NO: 6207543 - DNA, 10 bp, Homo sapiens
ctttcccttc

SEQ ID NO: 6207544 - DNA, 14 bp, Homo sapiens
ctttcccttccagt

SEQ ID NO: 6207545 - DNA, 17 bp, Homo sapiens
ctttcccttccagttcc

SEQ ID NO: 6207546 - DNA, 19 bp, Homo sapiens
ctttcccttgcttttccct

SEQ ID NO: 6207547 - DNA, 15 bp, Homo sapiens
ctttccgctgtcgcc

SEQ ID NO: 6207548 - DNA, 19 bp, Homo sapiens
ctttccgctgtcgccccag

SEQ ID NO: 6207549 - DNA, 20 bp, Homo sapiens
ctttccgctgtcgccccagg

SEQ ID NO: 6207550 - DNA, 21 bp, Homo sapiens
ctttccgctgtcgccccaggc

SEQ ID NO: 6207551 - DNA, 15 bp, Homo sapiens
ctttccggggaggag

SEQ ID NO: 6207552 - DNA, 23 bp, Homo sapiens
ctttccggggaggagccttggag

SEQ ID NO: 6207553 - DNA, 18 bp, Homo sapiens
ctttccggggctgctggc

SEQ ID NO: 6207554 - DNA, 22 bp, Homo sapiens
ctttccgtcaacgttgtactgt

SEQ ID NO: 6207555 - DNA, 22 bp, Homo sapiens
ctttccgtctccctaaaataaa

SEQ ID NO: 6207556 - DNA, 22 bp, Homo sapiens
ctttccgtttttttctttcctg

SEQ ID NO: 6207557 - DNA, 15 bp, Homo sapiens
ctttcctaaagccaa

SEQ ID NO: 6207558 - DNA, 20 bp, Homo sapiens
ctttcctaaagtctctgctg

SEQ ID NO: 6207559 - DNA, 22 bp, Homo sapiens
ctttcctaaagtctctgctgct

SEQ ID NO: 6207560 - DNA, 16 bp, Homo sapiens
ctttcctaagacctgg

SEQ ID NO: 6207561 - DNA, 20 bp, Homo sapiens
ctttcctaagacctggggtt

SEQ ID NO: 6207562 - DNA, 17 bp, Homo sapiens
ctttcctaaggctgcaa

SEQ ID NO: 6207563 - DNA, 16 bp, Homo sapiens
ctttcctacaaaatgg

SEQ ID NO: 6207564 - DNA, 18 bp, Homo sapiens
ctttcctacatgccccct

SEQ ID NO: 6207565 - DNA, 17 bp, Homo sapiens
ctttcctactctgggaa

SEQ ID NO: 6207566 - DNA, 20 bp, Homo sapiens
ctttcctactgtcctggaac

SEQ ID NO: 6207567 - DNA, 19 bp, Homo sapiens
ctttcctaggcccaggcct

SEQ ID NO: 6207568 - DNA, 13 bp, Homo sapiens
ctttcctatcacc

SEQ ID NO: 6207569 - DNA, 18 bp, Homo sapiens
ctttcctatcatggagtg

SEQ ID NO: 6207570 - DNA, 16 bp, Homo sapiens
ctttcctcaaatcaaa

SEQ ID NO: 6207571 - DNA, 13 bp, Homo sapiens
ctttcctcacatt

SEQ ID NO: 6207572 - DNA, 23 bp, Homo sapiens
ctttcctccaaactcctgcctgt

SEQ ID NO: 6207573 - DNA, 14 bp, Homo sapiens
ctttcctccaccca

SEQ ID NO: 6207574 - DNA, 15 bp, Homo sapiens
ctttcctccccaccc

SEQ ID NO: 6207575 - DNA, 14 bp, Homo sapiens
ctttcctccccata

SEQ ID NO: 6207576 - DNA, 16 bp, Homo sapiens
ctttcctccccataca

SEQ ID NO: 6207577 - DNA, 20 bp, Homo sapiens
ctttcctccccatacacaca

SEQ ID NO: 6207578 - DNA, 22 bp, Homo sapiens
ctttcctccccatacacacaca

SEQ ID NO: 6207579 - DNA, 14 bp, Homo sapiens
ctttcctcccccag

SEQ ID NO: 6207580 - DNA, 16 bp, Homo sapiens
ctttcctcccccagcg

SEQ ID NO: 6207581 - DNA, 17 bp, Homo sapiens
ctttcctccccctgcaa

SEQ ID NO: 6207582 - DNA, 19 bp, Homo sapiens
ctttcctcccttctttgct

SEQ ID NO: 6207583 - DNA, 17 bp, Homo sapiens
ctttcctcctctgactt

SEQ ID NO: 6207584 - DNA, 13 bp, Homo sapiens
ctttcctccttcc

SEQ ID NO: 6207585 - DNA, 12 bp, Homo sapiens
ctttcctccttt

SEQ ID NO: 6207586 - DNA, 13 bp, Homo sapiens
ctttcctcctttc

SEQ ID NO: 6207587 - DNA, 14 bp, Homo sapiens
ctttcctcctttcc

SEQ ID NO: 6207588 - DNA, 13 bp, Homo sapiens
ctttcctcggtct

SEQ ID NO: 6207589 - DNA, 20 bp, Homo sapiens
ctttcctctaactcactgcc

SEQ ID NO: 6207590 - DNA, 13 bp, Homo sapiens
ctttcctctccct

SEQ ID NO: 6207591 - DNA, 16 bp, Homo sapiens
ctttcctctccctcag

SEQ ID NO: 6207592 - DNA, 16 bp, Homo sapiens
ctttcctctcctgggt

SEQ ID NO: 6207593 - DNA, 13 bp, Homo sapiens
ctttcctctgcac

SEQ ID NO: 6207594 - DNA, 20 bp, Homo sapiens
ctttcctgagctgtcgctgc

SEQ ID NO: 6207595 - DNA, 21 bp, Homo sapiens
ctttcctgagctgtcgctgcc

SEQ ID NO: 6207596 - DNA, 13 bp, Homo sapiens
ctttcctgaggct

SEQ ID NO: 6207597 - DNA, 15 bp, Homo sapiens
ctttcctgaggctgg

SEQ ID NO: 6207598 - DNA, 16 bp, Homo sapiens
ctttcctgaggctggg

SEQ ID NO: 6207599 - DNA, 17 bp, Homo sapiens
ctttcctgaggctgggc

SEQ ID NO: 6207600 - DNA, 18 bp, Homo sapiens
ctttcctgagtcccatcc

SEQ ID NO: 6207601 - DNA, 22 bp, Homo sapiens
ctttcctgagtcccatccctgc

SEQ ID NO: 6207602 - DNA, 13 bp, Homo sapiens
ctttcctgatgac

SEQ ID NO: 6207603 - DNA, 17 bp, Homo sapiens
ctttcctgatgatgctg

SEQ ID NO: 6207604 - DNA, 10 bp, Homo sapiens
ctttcctgcc

SEQ ID NO: 6207605 - DNA, 23 bp, Homo sapiens
ctttcctgccataaaagctatga

SEQ ID NO: 6207606 - DNA, 18 bp, Homo sapiens
ctttcctgccctgtccaa

SEQ ID NO: 6207607 - DNA, 19 bp, Homo sapiens
ctttcctgcccttttcctg

SEQ ID NO: 6207608 - DNA, 20 bp, Homo sapiens
ctttcctgcccttttcctgg

SEQ ID NO: 6207609 - DNA, 20 bp, Homo sapiens
ctttcctgccgagtgctctg

SEQ ID NO: 6207610 - DNA, 16 bp, Homo sapiens
gacttcaagatcctct

SEQ ID NO: 6207611 - DNA, 15 bp, Homo sapiens
gacttcaagatgcct

SEQ ID NO: 6207612 - DNA, 17 bp, Homo sapiens
gacttcaagatgcctct

SEQ ID NO: 6207613 - DNA, 15 bp, Homo sapiens
gacttcaatattaaa

SEQ ID NO: 6207614 - DNA, 17 bp, Homo sapiens
gacttcaccaaatatat

SEQ ID NO: 6207615 - DNA, 22 bp, Homo sapiens
gacttcactaggcattgtgatg

SEQ ID NO: 6207616 - DNA, 14 bp, Homo sapiens
gacttcactgcagc

SEQ ID NO: 6207617 - DNA, 20 bp, Homo sapiens
gacttcactgtatataaaca

SEQ ID NO: 6207618 - DNA, 18 bp, Homo sapiens
gacttcagaacatgctgg

SEQ ID NO: 6207619 - DNA, 19 bp, Homo sapiens
gacttcagaacatgctgga

SEQ ID NO: 6207620 - DNA, 19 bp, Homo sapiens
gacttcagactctctcctc

SEQ ID NO: 6207621 - DNA, 15 bp, Homo sapiens
gacttcagatttcaa

SEQ ID NO: 6207622 - DNA, 16 bp, Homo sapiens
gacttcagcaggggtg

SEQ ID NO: 6207623 - DNA, 20 bp, Homo sapiens
gacttcagcaggggtgggag

SEQ ID NO: 6207624 - DNA, 14 bp, Homo sapiens
gacttcagctctgt

SEQ ID NO: 6207625 - DNA, 21 bp, Homo sapiens
gacttcagctgcctgaaacag

SEQ ID NO: 6207626 - DNA, 22 bp, Homo sapiens
gacttcagggagtcagctgttt

SEQ ID NO: 6207627 - DNA, 17 bp, Homo sapiens
gacttcaggggctgccc

SEQ ID NO: 6207628 - DNA, 19 bp, Homo sapiens
gacttcaggggctgcccgc

SEQ ID NO: 6207629 - DNA, 17 bp, Homo sapiens
gacttcaggttgttctg

SEQ ID NO: 6207630 - DNA, 18 bp, Homo sapiens
gacttcaggttgttctgt

SEQ ID NO: 6207631 - DNA, 13 bp, Homo sapiens
gacttcagtatgt

SEQ ID NO: 6207632 - DNA, 20 bp, Homo sapiens
gacttcagtatgttgtcaaa

SEQ ID NO: 6207633 - DNA, 22 bp, Homo sapiens
gacttcagtcctggtctgctca

SEQ ID NO: 6207634 - DNA, 16 bp, Homo sapiens
gacttcataactagga

SEQ ID NO: 6207635 - DNA, 21 bp, Homo sapiens
gacttcatagatttccttccc

SEQ ID NO: 6207636 - DNA, 21 bp, Homo sapiens
gacttcatcaaacatgggttt

SEQ ID NO: 6207637 - DNA, 12 bp, Homo sapiens
gacttcatccct

SEQ ID NO: 6207638 - DNA, 24 bp, Homo sapiens
gacttcatctcccacctagcagca

SEQ ID NO: 6207639 - DNA, 23 bp, Homo sapiens
gacttcattgtccctcttcactc

SEQ ID NO: 6207640 - DNA, 14 bp, Homo sapiens
gacttcatttgtgc

SEQ ID NO: 6207641 - DNA, 17 bp, Homo sapiens
gacttcatttgtgccac

SEQ ID NO: 6207642 - DNA, 12 bp, Homo sapiens
gacttcatttta

SEQ ID NO: 6207643 - DNA, 15 bp, Homo sapiens
gacttcatttttcct

SEQ ID NO: 6207644 - DNA, 21 bp, Homo sapiens
gacttccacaaaattatgctg

SEQ ID NO: 6207645 - DNA, 15 bp, Homo sapiens
gacttccacattttt

SEQ ID NO: 6207646 - DNA, 14 bp, Homo sapiens
gacttccatctagt

SEQ ID NO: 6207647 - DNA, 19 bp, Homo sapiens
gacttcccaacagccttag

SEQ ID NO: 6207648 - DNA, 19 bp, Homo sapiens
gacttcccactctagggca

SEQ ID NO: 6207649 - DNA, 15 bp, Homo sapiens
gacttcccagctggc

SEQ ID NO: 6207650 - DNA, 22 bp, Homo sapiens
gacttcccagctggcagcgcct

SEQ ID NO: 6207651 - DNA, 13 bp, Homo sapiens
gacttcccagctt

SEQ ID NO: 6207652 - DNA, 20 bp, Homo sapiens
gacttccccaaacccagaaa

SEQ ID NO: 6207653 - DNA, 20 bp, Homo sapiens
gacttccccaagcctggcag

SEQ ID NO: 6207654 - DNA, 22 bp, Homo sapiens
gacttccccaagcctggcaggg

SEQ ID NO: 6207655 - DNA, 11 bp, Homo sapiens
gacttccccat

SEQ ID NO: 6207656 - DNA, 15 bp, Homo sapiens
gacttccccatcccg

SEQ ID NO: 6207657 - DNA, 20 bp, Homo sapiens
gacttcccccaccccagaag

SEQ ID NO: 6207658 - DNA, 19 bp, Homo sapiens
gacttccccggagggctgc

SEQ ID NO: 6207659 - DNA, 17 bp, Homo sapiens
gacttcccgggaacgct

SEQ ID NO: 6207660 - DNA, 21 bp, Homo sapiens
gacttccctaacacttacccc

SEQ ID NO: 6207661 - DNA, 16 bp, Homo sapiens
gacttccctggtcacc

SEQ ID NO: 6207662 - DNA, 13 bp, Homo sapiens
gacttccctgtgt

SEQ ID NO: 6207663 - DNA, 21 bp, Homo sapiens
gacttcctagggatctgaaat

SEQ ID NO: 6207664 - DNA, 21 bp, Homo sapiens
gacttcctattaatttattaa

SEQ ID NO: 6207665 - DNA, 22 bp, Homo sapiens
gacttcctccaatccccactcc

SEQ ID NO: 6207666 - DNA, 22 bp, Homo sapiens
gacttcctctggctccccaagg

SEQ ID NO: 6207667 - DNA, 22 bp, Homo sapiens
gacttcctctttctctccttct

SEQ ID NO: 6207668 - DNA, 13 bp, Homo sapiens
gacttcctggggc

SEQ ID NO: 6207669 - DNA, 22 bp, Homo sapiens
gacttcctggggccccgctggg

SEQ ID NO: 6207670 - DNA, 22 bp, Homo sapiens
gacttcctggtgaggcccagcc

SEQ ID NO: 6207671 - DNA, 21 bp, Homo sapiens
gacttcctgtccagctccaac

SEQ ID NO: 6207672 - DNA, 14 bp, Homo sapiens
gacttccttactaa

SEQ ID NO: 6207673 - DNA, 19 bp, Homo sapiens
gacttccttattggttgaa

SEQ ID NO: 6207674 - DNA, 14 bp, Homo sapiens
gacttccttgagac

SEQ ID NO: 6207675 - DNA, 16 bp, Homo sapiens
gacttccttgagacac

SEQ ID NO: 6207676 - DNA, 18 bp, Homo sapiens
gacttcgctattcccagg

SEQ ID NO: 6207677 - DNA, 20 bp, Homo sapiens
gacttcgctattcccaggca

SEQ ID NO: 6207678 - DNA, 23 bp, Homo sapiens
gacttcgctattcccaggcaggg

SEQ ID NO: 6207679 - DNA, 23 bp, Homo sapiens
gacttcgggggcggctctgggaa

SEQ ID NO: 6207680 - DNA, 14 bp, Homo sapiens
gacttctaaatcat

SEQ ID NO: 6207681 - DNA, 19 bp, Homo sapiens
gacttctaagtaaaaccac

SEQ ID NO: 6207682 - DNA, 19 bp, Homo sapiens
gacttctaatatcattcac

SEQ ID NO: 6207683 - DNA, 17 bp, Homo sapiens
gacttctaatttatatt

SEQ ID NO: 6207684 - DNA, 15 bp, Homo sapiens
gacttctacctgccc

SEQ ID NO: 6207685 - DNA, 19 bp, Homo sapiens
gacttctaggaggatgctg

SEQ ID NO: 6207686 - DNA, 16 bp, Homo sapiens
gacttctatcctgtta

SEQ ID NO: 6207687 - DNA, 17 bp, Homo sapiens
gacttctattttaaaga

SEQ ID NO: 6207688 - DNA, 21 bp, Homo sapiens
gacttctattttttaaagact

SEQ ID NO: 6207689 - DNA, 21 bp, Homo sapiens
gacttctcaggacgacgaatc

SEQ ID NO: 6207690 - DNA, 17 bp, Homo sapiens
gacttctccaggcagag

SEQ ID NO: 6207691 - DNA, 22 bp, Homo sapiens
gacttctccaggtctcacgggc

SEQ ID NO: 6207692 - DNA, 13 bp, Homo sapiens
gacttctcccccg

SEQ ID NO: 6207693 - DNA, 21 bp, Homo sapiens
gacttctctgtgaacttccct

SEQ ID NO: 6207694 - DNA, 13 bp, Homo sapiens
gacttctcttaca

SEQ ID NO: 6207695 - DNA, 16 bp, Homo sapiens
gacttctcttacattt

SEQ ID NO: 6207696 - DNA, 21 bp, Homo sapiens
gacttctcttccagtttctgt

SEQ ID NO: 6207697 - DNA, 23 bp, Homo sapiens
gacttctctttcttattttgtaa

SEQ ID NO: 6207698 - DNA, 18 bp, Homo sapiens
gacttctctttgcctcaa

SEQ ID NO: 6207699 - DNA, 13 bp, Homo sapiens
gacttctgagatc

SEQ ID NO: 6207700 - DNA, 22 bp, Homo sapiens
gacttctgcccaaatcccctcc

SEQ ID NO: 6207701 - DNA, 13 bp, Homo sapiens
gacttctgcctgg

SEQ ID NO: 6207702 - DNA, 12 bp, Homo sapiens
gacttctgctgc

SEQ ID NO: 6207703 - DNA, 17 bp, Homo sapiens
gacttctgctgctggcc

SEQ ID NO: 6207704 - DNA, 15 bp, Homo sapiens
gacttctggagatgg

SEQ ID NO: 6207705 - DNA, 12 bp, Homo sapiens
gacttctggagg

SEQ ID NO: 6207706 - DNA, 21 bp, Homo sapiens
gacttctggttgtatttctat

SEQ ID NO: 6207707 - DNA, 14 bp, Homo sapiens
gacttctgtcttct

SEQ ID NO: 6207708 - DNA, 13 bp, Homo sapiens
gacttctgtgggc

SEQ ID NO: 6207709 - DNA, 23 bp, Homo sapiens
gacttctgtgggcccctcaacag

SEQ ID NO: 6207710 - DNA, 16 bp, Homo sapiens
gacttctgttttcaat

SEQ ID NO: 6207711 - DNA, 20 bp, Homo sapiens
gacttcttccctaaaatgta

SEQ ID NO: 6207712 - DNA, 21 bp, Homo sapiens
gacttcttcggaggtggcagc

SEQ ID NO: 6207713 - DNA, 21 bp, Homo sapiens
gacttcttggtttggggagaa

SEQ ID NO: 6207714 - DNA, 16 bp, Homo sapiens
gacttctttaattttg

SEQ ID NO: 6207715 - DNA, 17 bp, Homo sapiens
gacttctttaattttgg

SEQ ID NO: 6207716 - DNA, 18 bp, Homo sapiens
gacttctttaattttgga

SEQ ID NO: 6207717 - DNA, 19 bp, Homo sapiens
gacttctttaattttggaa

SEQ ID NO: 6207718 - DNA, 20 bp, Homo sapiens
gacttctttaattttggaat

SEQ ID NO: 6207719 - DNA, 16 bp, Homo sapiens
gacttcttttcacatt

SEQ ID NO: 6207720 - DNA, 18 bp, Homo sapiens
gacttcttttcacattct

SEQ ID NO: 6207721 - DNA, 19 bp, Homo sapiens
gacttcttttcacattctt

SEQ ID NO: 6207722 - DNA, 22 bp, Homo sapiens
gacttcttttgagttaggttaa

SEQ ID NO: 6207723 - DNA, 15 bp, Homo sapiens
gacttgaaaaatatt

SEQ ID NO: 6207724 - DNA, 13 bp, Homo sapiens
gacttgaaaagaa

SEQ ID NO: 6207725 - DNA, 17 bp, Homo sapiens
gacttgaaaagaaagaa

SEQ ID NO: 6207726 - DNA, 21 bp, Homo sapiens
gacttgaaaccagaagaagtg

SEQ ID NO: 6207727 - DNA, 16 bp, Homo sapiens
gacttgaaagaaaggg

SEQ ID NO: 6207728 - DNA, 15 bp, Homo sapiens
gacttgaaagttttc

SEQ ID NO: 6207729 - DNA, 17 bp, Homo sapiens
gacttgaagcacagagg

SEQ ID NO: 6207730 - DNA, 15 bp, Homo sapiens
gacttgaatgtacaa

SEQ ID NO: 6207731 - DNA, 23 bp, Homo sapiens
gacttgacaacatcccacagtgg

SEQ ID NO: 6207732 - DNA, 16 bp, Homo sapiens
gacttgacagtggaac

SEQ ID NO: 6207733 - DNA, 19 bp, Homo sapiens
gacttgactttagtctgca

SEQ ID NO: 6207734 - DNA, 19 bp, Homo sapiens
gacttgagaaatttgaaag

SEQ ID NO: 6207735 - DNA, 18 bp, Homo sapiens
gacttgagacaatgtttt

SEQ ID NO: 6207736 - DNA, 20 bp, Homo sapiens
gacttgagcctccatttctg

SEQ ID NO: 6207737 - DNA, 23 bp, Homo sapiens
gacttgaggattttgagtatctc

SEQ ID NO: 6207738 - DNA, 15 bp, Homo sapiens
gacttgagtctattt

SEQ ID NO: 6207739 - DNA, 14 bp, Homo sapiens
gacttgattgtact

SEQ ID NO: 6207740 - DNA, 21 bp, Homo sapiens
gacttgcacacagggaggctg

SEQ ID NO: 6207741 - DNA, 17 bp, Homo sapiens
gacttgcacagggattc

SEQ ID NO: 6207742 - DNA, 20 bp, Homo sapiens
gacttgcacatctctgcagt

SEQ ID NO: 6207743 - DNA, 16 bp, Homo sapiens
gacttgcactgaagcc

SEQ ID NO: 6207744 - DNA, 19 bp, Homo sapiens
gacttgcatacctgctttt

SEQ ID NO: 6207745 - DNA, 15 bp, Homo sapiens
gacttgcatttttgc

SEQ ID NO: 6207746 - DNA, 20 bp, Homo sapiens
gacttgccactgccataact

SEQ ID NO: 6207747 - DNA, 11 bp, Homo sapiens
gacttgcctcc

SEQ ID NO: 6207748 - DNA, 14 bp, Homo sapiens
gacttgcctggggc

SEQ ID NO: 6207749 - DNA, 22 bp, Homo sapiens
gacttgccttcctaagcctgtg

SEQ ID NO: 6207750 - DNA, 16 bp, Homo sapiens
gacttgcggccacagc

SEQ ID NO: 6207751 - DNA, 18 bp, Homo sapiens
gacttgctccctctccaa

SEQ ID NO: 6207752 - DNA, 22 bp, Homo sapiens
gacttgctgtgtgaccctgggc

SEQ ID NO: 6207753 - DNA, 21 bp, Homo sapiens
gacttggacatctctctggct

SEQ ID NO: 6207754 - DNA, 22 bp, Homo sapiens
gacttggacatctctctggctt

SEQ ID NO: 6207755 - DNA, 15 bp, Homo sapiens
gacttggacttttga

SEQ ID NO: 6207756 - DNA, 18 bp, Homo sapiens
gacttggagaatactgcc

SEQ ID NO: 6207757 - DNA, 20 bp, Homo sapiens
gacttggagactcctggtct

SEQ ID NO: 6207758 - DNA, 15 bp, Homo sapiens
gacttggagagcaaa

SEQ ID NO: 6207759 - DNA, 18 bp, Homo sapiens
gacttggagagcaaaggc

SEQ ID NO: 6207760 - DNA, 21 bp, Homo sapiens
gacttggagagcaaaggccca

SEQ ID NO: 6207761 - DNA, 19 bp, Homo sapiens
gacttggatcccaaagcaa

SEQ ID NO: 6207762 - DNA, 15 bp, Homo sapiens
gacttggatcccagg

SEQ ID NO: 6207763 - DNA, 17 bp, Homo sapiens
gacttggcaacagaagc

SEQ ID NO: 6207764 - DNA, 12 bp, Homo sapiens
gacttggcactt

SEQ ID NO: 6207765 - DNA, 16 bp, Homo sapiens
gacttggccgcttccc

SEQ ID NO: 6207766 - DNA, 21 bp, Homo sapiens
gacttggccgcttccctaccc

SEQ ID NO: 6207767 - DNA, 12 bp, Homo sapiens
gacttggcctct

SEQ ID NO: 6207768 - DNA, 13 bp, Homo sapiens
gacttggcctctc

SEQ ID NO: 6207769 - DNA, 13 bp, Homo sapiens
gacttggctgtcc

SEQ ID NO: 6207770 - DNA, 19 bp, Homo sapiens
gacttggctgtccttcccc

SEQ ID NO: 6207771 - DNA, 22 bp, Homo sapiens
gacttgggagagggagcaagcc

SEQ ID NO: 6207772 - DNA, 18 bp, Homo sapiens
gacttgggataggactga

SEQ ID NO: 6207773 - DNA, 22 bp, Homo sapiens
gacttgggcacccccagcctgg

SEQ ID NO: 6207774 - DNA, 15 bp, Homo sapiens
gacttggggaccaga

SEQ ID NO: 6207775 - DNA, 19 bp, Homo sapiens
gacttggggatttctggtc

SEQ ID NO: 6207776 - DNA, 15 bp, Homo sapiens
gacttggggcctctg

SEQ ID NO: 6207777 - DNA, 22 bp, Homo sapiens
gacttgggggaacgatgtgtct

SEQ ID NO: 6207778 - DNA, 18 bp, Homo sapiens
gacttgggggcagagcag

SEQ ID NO: 6207779 - DNA, 23 bp, Homo sapiens
gacttggtaagatgactctgaga

SEQ ID NO: 6207780 - DNA, 20 bp, Homo sapiens
gacttggtacagttgcagga

SEQ ID NO: 6207781 - DNA, 22 bp, Homo sapiens
gacttggtacagttgcaggagc

SEQ ID NO: 6207782 - DNA, 19 bp, Homo sapiens
gacttggtcaccagctcct

SEQ ID NO: 6207783 - DNA, 23 bp, Homo sapiens
gacttggtgtcctttccctccac

SEQ ID NO: 6207784 - DNA, 20 bp, Homo sapiens
gacttggttggtagggtggg

SEQ ID NO: 6207785 - DNA, 19 bp, Homo sapiens
gacttgtacaaacagtatt

SEQ ID NO: 6207786 - DNA, 21 bp, Homo sapiens
ctttcctgccgtccctcctgt

SEQ ID NO: 6207787 - DNA, 12 bp, Homo sapiens
ctttcctgcctc

SEQ ID NO: 6207788 - DNA, 20 bp, Homo sapiens
ctttcctggacactcagacc

SEQ ID NO: 6207789 - DNA, 23 bp, Homo sapiens
ctttcctggacactcagacctga

SEQ ID NO: 6207790 - DNA, 13 bp, Homo sapiens
ctttcctggcagt

SEQ ID NO: 6207791 - DNA, 19 bp, Homo sapiens
ctttcctgggggatgtgca

SEQ ID NO: 6207792 - DNA, 17 bp, Homo sapiens
ctttcctgggtgagttt

SEQ ID NO: 6207793 - DNA, 11 bp, Homo sapiens
ctttcctggtt

SEQ ID NO: 6207794 - DNA, 18 bp, Homo sapiens
ctttcctggtttccgaaa

SEQ ID NO: 6207795 - DNA, 10 bp, Homo sapiens
ctttcctgtc

SEQ ID NO: 6207796 - DNA, 15 bp, Homo sapiens
ctttcctgtcttcct

SEQ ID NO: 6207797 - DNA, 17 bp, Homo sapiens
ctttcctgtgccaggac

SEQ ID NO: 6207798 - DNA, 19 bp, Homo sapiens
ctttcctgtgtgaagaaag

SEQ ID NO: 6207799 - DNA, 21 bp, Homo sapiens
ctttcctgtgtgtactctgtc

SEQ ID NO: 6207800 - DNA, 18 bp, Homo sapiens
ctttcctgttcagcattc

SEQ ID NO: 6207801 - DNA, 16 bp, Homo sapiens
ctttcctgtttccagg

SEQ ID NO: 6207802 - DNA, 18 bp, Homo sapiens
ctttcctgtttccagggt

SEQ ID NO: 6207803 - DNA, 22 bp, Homo sapiens
ctttccttagacccgccaggtc

SEQ ID NO: 6207804 - DNA, 17 bp, Homo sapiens
ctttccttagttaaaaa

SEQ ID NO: 6207805 - DNA, 18 bp, Homo sapiens
ctttccttcactgcccca

SEQ ID NO: 6207806 - DNA, 20 bp, Homo sapiens
ctttccttcccaggcccttt

SEQ ID NO: 6207807 - DNA, 14 bp, Homo sapiens
ctttccttccctct

SEQ ID NO: 6207808 - DNA, 20 bp, Homo sapiens
ctttccttccctctcctgct

SEQ ID NO: 6207809 - DNA, 16 bp, Homo sapiens
ctttccttcctctcat

SEQ ID NO: 6207810 - DNA, 14 bp, Homo sapiens
ctttccttctcgtc

SEQ ID NO: 6207811 - DNA, 17 bp, Homo sapiens
ctttccttctgcccttc

SEQ ID NO: 6207812 - DNA, 19 bp, Homo sapiens
ctttccttgaaaataaaaa

SEQ ID NO: 6207813 - DNA, 17 bp, Homo sapiens
ctttccttgagtagttt

SEQ ID NO: 6207814 - DNA, 13 bp, Homo sapiens
ctttccttgcctt

SEQ ID NO: 6207815 - DNA, 12 bp, Homo sapiens
ctttccttgtct

SEQ ID NO: 6207816 - DNA, 16 bp, Homo sapiens
ctttccttgtctctca

SEQ ID NO: 6207817 - DNA, 18 bp, Homo sapiens
ctttccttgtggcagagg

SEQ ID NO: 6207818 - DNA, 15 bp, Homo sapiens
ctttccttgttcagc

SEQ ID NO: 6207819 - DNA, 13 bp, Homo sapiens
ctttcctttaaaa

SEQ ID NO: 6207820 - DNA, 14 bp, Homo sapiens
ctttcctttaaaaa

SEQ ID NO: 6207821 - DNA, 17 bp, Homo sapiens
ctttcctttaaaaatac

SEQ ID NO: 6207822 - DNA, 20 bp, Homo sapiens
ctttcctttaaaaatacata

SEQ ID NO: 6207823 - DNA, 19 bp, Homo sapiens
ctttcctttaactcccttt

SEQ ID NO: 6207824 - DNA, 18 bp, Homo sapiens
ctttcctttacagctgtt

SEQ ID NO: 6207825 - DNA, 14 bp, Homo sapiens
ctttcctttcaata

SEQ ID NO: 6207826 - DNA, 16 bp, Homo sapiens
ctttcctttcaataaa

SEQ ID NO: 6207827 - DNA, 18 bp, Homo sapiens
ctttcctttcaataaagt

SEQ ID NO: 6207828 - DNA, 19 bp, Homo sapiens
ctttcctttcaataaagtt

SEQ ID NO: 6207829 - DNA, 19 bp, Homo sapiens
ctttcctttcatcctcagc

SEQ ID NO: 6207830 - DNA, 16 bp, Homo sapiens
ctttcctttccccagc

SEQ ID NO: 6207831 - DNA, 20 bp, Homo sapiens
ctttcctttccccagcccag

SEQ ID NO: 6207832 - DNA, 16 bp, Homo sapiens
ctttcctttcctttca

SEQ ID NO: 6207833 - DNA, 13 bp, Homo sapiens
ctttcctttcttt

SEQ ID NO: 6207834 - DNA, 14 bp, Homo sapiens
ctttcctttgccct

SEQ ID NO: 6207835 - DNA, 22 bp, Homo sapiens
ctttccttttcttgtctctgag

SEQ ID NO: 6207836 - DNA, 15 bp, Homo sapiens
ctttccttttcttta

SEQ ID NO: 6207837 - DNA, 17 bp, Homo sapiens
ctttccttttttaaaaa

SEQ ID NO: 6207838 - DNA, 18 bp, Homo sapiens
ctttccttttttgagatt

SEQ ID NO: 6207839 - DNA, 20 bp, Homo sapiens
ctttcgaggcctgaagccag

SEQ ID NO: 6207840 - DNA, 12 bp, Homo sapiens
ctttcgcctcct

SEQ ID NO: 6207841 - DNA, 14 bp, Homo sapiens
ctttcgcctcctcc

SEQ ID NO: 6207842 - DNA, 17 bp, Homo sapiens
ctttcggagcctgcctc

SEQ ID NO: 6207843 - DNA, 15 bp, Homo sapiens
ctttcggagctcctg

SEQ ID NO: 6207844 - DNA, 23 bp, Homo sapiens
ctttcggcagaggaacccccacc

SEQ ID NO: 6207845 - DNA, 14 bp, Homo sapiens
ctttcgggccatgt

SEQ ID NO: 6207846 - DNA, 14 bp, Homo sapiens
ctttcgtcaccctt

SEQ ID NO: 6207847 - DNA, 19 bp, Homo sapiens
ctttcgtccacagcttcct

SEQ ID NO: 6207848 - DNA, 21 bp, Homo sapiens
ctttcgtgtttttggttttct

SEQ ID NO: 6207849 - DNA, 23 bp, Homo sapiens
ctttcgtgtttttggttttctcc

SEQ ID NO: 6207850 - DNA, 22 bp, Homo sapiens
ctttcgttaatcttgctgctta

SEQ ID NO: 6207851 - DNA, 14 bp, Homo sapiens
ctttcgttctgctg

SEQ ID NO: 6207852 - DNA, 22 bp, Homo sapiens
ctttcgttctgctgaccaaatg

SEQ ID NO: 6207853 - DNA, 13 bp, Homo sapiens
ctttctaaaactg

SEQ ID NO: 6207854 - DNA, 18 bp, Homo sapiens
ctttctaaacaagatttt

SEQ ID NO: 6207855 - DNA, 20 bp, Homo sapiens
ctttctaacccactaagtaa

SEQ ID NO: 6207856 - DNA, 16 bp, Homo sapiens
ctttctaactgtagct

SEQ ID NO: 6207857 - DNA, 18 bp, Homo sapiens
ctttctaagcaaccacac

SEQ ID NO: 6207858 - DNA, 17 bp, Homo sapiens
ctttctaaggacccaaa

SEQ ID NO: 6207859 - DNA, 15 bp, Homo sapiens
ctttctaatgtttct

SEQ ID NO: 6207860 - DNA, 18 bp, Homo sapiens
ctttctacaatgtgaact

SEQ ID NO: 6207861 - DNA, 20 bp, Homo sapiens
ctttctacagggctgacatt

SEQ ID NO: 6207862 - DNA, 19 bp, Homo sapiens
ctttctacagtattatgta

SEQ ID NO: 6207863 - DNA, 23 bp, Homo sapiens
ctttctacagtattatgtactct

SEQ ID NO: 6207864 - DNA, 19 bp, Homo sapiens
ctttctacatgactgggcc

SEQ ID NO: 6207865 - DNA, 22 bp, Homo sapiens
ctttctacatgactgggcctcc

SEQ ID NO: 6207866 - DNA, 20 bp, Homo sapiens
ctttctaccacacacagcct

SEQ ID NO: 6207867 - DNA, 21 bp, Homo sapiens
ctttctaccacacacagcctg

SEQ ID NO: 6207868 - DNA, 17 bp, Homo sapiens
ctttctacccagcgagc

SEQ ID NO: 6207869 - DNA, 16 bp, Homo sapiens
ctttctacttccaaga

SEQ ID NO: 6207870 - DNA, 20 bp, Homo sapiens
ctttctagcaaatatgctgt

SEQ ID NO: 6207871 - DNA, 20 bp, Homo sapiens
ctttctagccttagacaaat

SEQ ID NO: 6207872 - DNA, 22 bp, Homo sapiens
ctttctagccttagacaaatga

SEQ ID NO: 6207873 - DNA, 23 bp, Homo sapiens
ctttctagctgttgagctgtttt

SEQ ID NO: 6207874 - DNA, 17 bp, Homo sapiens
ctttctagttcagctgc

SEQ ID NO: 6207875 - DNA, 14 bp, Homo sapiens
ctttctagttgaaa

SEQ ID NO: 6207876 - DNA, 21 bp, Homo sapiens
ctttctagttgaaaataaagt

SEQ ID NO: 6207877 - DNA, 23 bp, Homo sapiens
ctttctatataaaatgtattcaa

SEQ ID NO: 6207878 - DNA, 15 bp, Homo sapiens
ctttctatatccttg

SEQ ID NO: 6207879 - DNA, 14 bp, Homo sapiens
ctttctatcatttt

SEQ ID NO: 6207880 - DNA, 17 bp, Homo sapiens
ctttctatcctctgtaa

SEQ ID NO: 6207881 - DNA, 13 bp, Homo sapiens
ctttctatctaat

SEQ ID NO: 6207882 - DNA, 16 bp, Homo sapiens
ctttctatctcatctg

SEQ ID NO: 6207883 - DNA, 20 bp, Homo sapiens
ctttctatctcatctgtctc

SEQ ID NO: 6207884 - DNA, 15 bp, Homo sapiens
ctttctatgctgctt

SEQ ID NO: 6207885 - DNA, 14 bp, Homo sapiens
ctttctatgtgaca

SEQ ID NO: 6207886 - DNA, 16 bp, Homo sapiens
ctttctattgaaaaat

SEQ ID NO: 6207887 - DNA, 17 bp, Homo sapiens
ctttctattgtacagaa

SEQ ID NO: 6207888 - DNA, 17 bp, Homo sapiens
ctttctatttttatgat

SEQ ID NO: 6207889 - DNA, 20 bp, Homo sapiens
ctttctcaaagagggggctc

SEQ ID NO: 6207890 - DNA, 15 bp, Homo sapiens
ctttctcaccagccc

SEQ ID NO: 6207891 - DNA, 17 bp, Homo sapiens
ctttctcacctttccca

SEQ ID NO: 6207892 - DNA, 15 bp, Homo sapiens
ctttctcactgctgt

SEQ ID NO: 6207893 - DNA, 19 bp, Homo sapiens
ctttctcagcatatatata

SEQ ID NO: 6207894 - DNA, 21 bp, Homo sapiens
ctttctcagccgcttctgact

SEQ ID NO: 6207895 - DNA, 21 bp, Homo sapiens
ctttctcaggagcttgggcag

SEQ ID NO: 6207896 - DNA, 16 bp, Homo sapiens
ctttctcagttttcat

SEQ ID NO: 6207897 - DNA, 20 bp, Homo sapiens
ctttctcagttttcataagt

SEQ ID NO: 6207898 - DNA, 15 bp, Homo sapiens
ctttctcataaaact

SEQ ID NO: 6207899 - DNA, 16 bp, Homo sapiens
ctttctcatttctttc

SEQ ID NO: 6207900 - DNA, 21 bp, Homo sapiens
ctttctccaaaggcactgacc

SEQ ID NO: 6207901 - DNA, 15 bp, Homo sapiens
ctttctccactgggt

SEQ ID NO: 6207902 - DNA, 14 bp, Homo sapiens
ctttctccagccag

SEQ ID NO: 6207903 - DNA, 15 bp, Homo sapiens
ctttctccagccagc

SEQ ID NO: 6207904 - DNA, 21 bp, Homo sapiens
ctttctccagcccatgctggc

SEQ ID NO: 6207905 - DNA, 13 bp, Homo sapiens
ctttctccaggac

SEQ ID NO: 6207906 - DNA, 15 bp, Homo sapiens
ctttctccaggacca

SEQ ID NO: 6207907 - DNA, 18 bp, Homo sapiens
ctttctcccactgagttt

SEQ ID NO: 6207908 - DNA, 18 bp, Homo sapiens
ctttctcccctgccccca

SEQ ID NO: 6207909 - DNA, 13 bp, Homo sapiens
ctttctccctcaa

SEQ ID NO: 6207910 - DNA, 19 bp, Homo sapiens
ctttctccctcaactgaag

SEQ ID NO: 6207911 - DNA, 17 bp, Homo sapiens
ctttctccgtatttatt

SEQ ID NO: 6207912 - DNA, 14 bp, Homo sapiens
ctttctcctcccca

SEQ ID NO: 6207913 - DNA, 22 bp, Homo sapiens
ctttctcctctgctatgcattt

SEQ ID NO: 6207914 - DNA, 13 bp, Homo sapiens
ctttctcctcttt

SEQ ID NO: 6207915 - DNA, 17 bp, Homo sapiens
ctttctcctctttgaga

SEQ ID NO: 6207916 - DNA, 12 bp, Homo sapiens
ctttctcctgga

SEQ ID NO: 6207917 - DNA, 17 bp, Homo sapiens
ctttctcctggcccctg

SEQ ID NO: 6207918 - DNA, 23 bp, Homo sapiens
ctttctcctggcccctgcctgct

SEQ ID NO: 6207919 - DNA, 15 bp, Homo sapiens
ctttctcctgtgaat

SEQ ID NO: 6207920 - DNA, 22 bp, Homo sapiens
ctttctcctgtgaatggaggca

SEQ ID NO: 6207921 - DNA, 21 bp, Homo sapiens
ctttctcctgtggtttgctcc

SEQ ID NO: 6207922 - DNA, 19 bp, Homo sapiens
ctttctcctgtttatgggt

SEQ ID NO: 6207923 - DNA, 23 bp, Homo sapiens
ctttctccttagtcttctcatag

SEQ ID NO: 6207924 - DNA, 15 bp, Homo sapiens
ctttctccttgaata

SEQ ID NO: 6207925 - DNA, 19 bp, Homo sapiens
ctttctcgattttatcttt

SEQ ID NO: 6207926 - DNA, 20 bp, Homo sapiens
ctttctcggtccactcttgt

SEQ ID NO: 6207927 - DNA, 23 bp, Homo sapiens
ctttctcgtgggtcctttggcag

SEQ ID NO: 6207928 - DNA, 19 bp, Homo sapiens
ctttctctaaatatgatta

SEQ ID NO: 6207929 - DNA, 13 bp, Homo sapiens
ctttctctacttt

SEQ ID NO: 6207930 - DNA, 16 bp, Homo sapiens
ctttctctactttgag

SEQ ID NO: 6207931 - DNA, 17 bp, Homo sapiens
ctttctctcactgtcta

SEQ ID NO: 6207932 - DNA, 19 bp, Homo sapiens
ctttctctcccctcctctg

SEQ ID NO: 6207933 - DNA, 22 bp, Homo sapiens
ctttctctcctcagtttacatc

SEQ ID NO: 6207934 - DNA, 17 bp, Homo sapiens
ctttctctcctggctcg

SEQ ID NO: 6207935 - DNA, 21 bp, Homo sapiens
ctttctctccttcttccctgt

SEQ ID NO: 6207936 - DNA, 11 bp, Homo sapiens
ctttctctctc

SEQ ID NO: 6207937 - DNA, 14 bp, Homo sapiens
ctttctctctcttt

SEQ ID NO: 6207938 - DNA, 16 bp, Homo sapiens
ctttctctctgtgtgg

SEQ ID NO: 6207939 - DNA, 20 bp, Homo sapiens
ctttctctctgtgtggcaaa

SEQ ID NO: 6207940 - DNA, 22 bp, Homo sapiens
ctttctctctttatacagctgt

SEQ ID NO: 6207941 - DNA, 10 bp, Homo sapiens
ctttctctga

SEQ ID NO: 6207942 - DNA, 20 bp, Homo sapiens
ctttctctgagagagatgat

SEQ ID NO: 6207943 - DNA, 12 bp, Homo sapiens
ctttctctgagg

SEQ ID NO: 6207944 - DNA, 11 bp, Homo sapiens
ctttctctgca

SEQ ID NO: 6207945 - DNA, 18 bp, Homo sapiens
ctttctctgccagtgaca

SEQ ID NO: 6207946 - DNA, 12 bp, Homo sapiens
ctttctctgcct

SEQ ID NO: 6207947 - DNA, 17 bp, Homo sapiens
ctttctctgcctctggg

SEQ ID NO: 6207948 - DNA, 18 bp, Homo sapiens
ctttctctgcctctgggc

SEQ ID NO: 6207949 - DNA, 17 bp, Homo sapiens
ctttctctgcctggcaa

SEQ ID NO: 6207950 - DNA, 14 bp, Homo sapiens
ctttctctgcttca

SEQ ID NO: 6207951 - DNA, 17 bp, Homo sapiens
ctttctctgcttcagct

SEQ ID NO: 6207952 - DNA, 21 bp, Homo sapiens
ctttctctgcttcagcttgct

SEQ ID NO: 6207953 - DNA, 18 bp, Homo sapiens
ctttctctggctccagaa

SEQ ID NO: 6207954 - DNA, 20 bp, Homo sapiens
ctttctctggtggtcttcct

SEQ ID NO: 6207955 - DNA, 21 bp, Homo sapiens
ctttctctggtggtcttcctt

SEQ ID NO: 6207956 - DNA, 11 bp, Homo sapiens
ctttctctgta

SEQ ID NO: 6207957 - DNA, 12 bp, Homo sapiens
ctttctctgtgt

SEQ ID NO: 6207958 - DNA, 17 bp, Homo sapiens
ctttctcttccccttcc

SEQ ID NO: 6207959 - DNA, 13 bp, Homo sapiens
ctttctcttccct

SEQ ID NO: 6207960 - DNA, 16 bp, Homo sapiens
ctttctcttccctcct

SEQ ID NO: 6207961 - DNA, 19 bp, Homo sapiens
ctttctcttccctccttcc

SEQ ID NO: 6207962 - DNA, 16 bp, Homo sapiens
ctttctcttccctgaa

SEQ ID NO: 6207963 - DNA, 14 bp, Homo sapiens
ctttctcttctaat

SEQ ID NO: 6207964 - DNA, 20 bp, Homo sapiens
ctttctcttggacattgtaa

SEQ ID NO: 6207965 - DNA, 21 bp, Homo sapiens
gacttgtacagttgactggct

SEQ ID NO: 6207966 - DNA, 18 bp, Homo sapiens
gacttgtagcatattctt

SEQ ID NO: 6207967 - DNA, 20 bp, Homo sapiens
gacttgtaggaatctgcctt

SEQ ID NO: 6207968 - DNA, 21 bp, Homo sapiens
gacttgtaggaatctgccttc

SEQ ID NO: 6207969 - DNA, 22 bp, Homo sapiens
gacttgtatagcatgaaataaa

SEQ ID NO: 6207970 - DNA, 18 bp, Homo sapiens
gacttgtatattctattt

SEQ ID NO: 6207971 - DNA, 19 bp, Homo sapiens
gacttgtatatttgtacaa

SEQ ID NO: 6207972 - DNA, 22 bp, Homo sapiens
gacttgtcccaagtctgacagc

SEQ ID NO: 6207973 - DNA, 14 bp, Homo sapiens
gacttgtctgcctc

SEQ ID NO: 6207974 - DNA, 20 bp, Homo sapiens
gacttgtctgcctcctgctt

SEQ ID NO: 6207975 - DNA, 14 bp, Homo sapiens
gacttgtgcctctt

SEQ ID NO: 6207976 - DNA, 20 bp, Homo sapiens
gacttgtgcctcttgggaga

SEQ ID NO: 6207977 - DNA, 19 bp, Homo sapiens
gacttgtgcgccggcgccc

SEQ ID NO: 6207978 - DNA, 12 bp, Homo sapiens
gacttgtgtctg

SEQ ID NO: 6207979 - DNA, 16 bp, Homo sapiens
gacttgtgtgcatgga

SEQ ID NO: 6207980 - DNA, 15 bp, Homo sapiens
gacttgttaaatgta

SEQ ID NO: 6207981 - DNA, 18 bp, Homo sapiens
gacttgttcatttttctc

SEQ ID NO: 6207982 - DNA, 23 bp, Homo sapiens
gacttgttggcgtaggctacaga

SEQ ID NO: 6207983 - DNA, 17 bp, Homo sapiens
gacttgtttagagagcc

SEQ ID NO: 6207984 - DNA, 13 bp, Homo sapiens
gacttgtttcctg

SEQ ID NO: 6207985 - DNA, 15 bp, Homo sapiens
gacttgtttcctgtg

SEQ ID NO: 6207986 - DNA, 17 bp, Homo sapiens
gacttgtttctttctgt

SEQ ID NO: 6207987 - DNA, 18 bp, Homo sapiens
gacttgtttctttctgtc

SEQ ID NO: 6207988 - DNA, 16 bp, Homo sapiens
gacttgtttttgcaca

SEQ ID NO: 6207989 - DNA, 14 bp, Homo sapiens
gacttgtttttgtt

SEQ ID NO: 6207990 - DNA, 15 bp, Homo sapiens
gactttaaaaaaaca

SEQ ID NO: 6207991 - DNA, 21 bp, Homo sapiens
gactttaaaaggattaatctg

SEQ ID NO: 6207992 - DNA, 22 bp, Homo sapiens
gactttaatcactgctgaagat

SEQ ID NO: 6207993 - DNA, 14 bp, Homo sapiens
gactttaattgtgt

SEQ ID NO: 6207994 - DNA, 15 bp, Homo sapiens
gactttaatttatgt

SEQ ID NO: 6207995 - DNA, 16 bp, Homo sapiens
gactttacaaaccttt

SEQ ID NO: 6207996 - DNA, 21 bp, Homo sapiens
gactttacccatttgggtggg

SEQ ID NO: 6207997 - DNA, 13 bp, Homo sapiens
gactttagaaata

SEQ ID NO: 6207998 - DNA, 16 bp, Homo sapiens
gactttagcttttcct

SEQ ID NO: 6207999 - DNA, 17 bp, Homo sapiens
gactttaggctttcagc

SEQ ID NO: 6208000 - DNA, 16 bp, Homo sapiens
gactttagggatctgg

SEQ ID NO: 6208001 - DNA, 14 bp, Homo sapiens
gactttagtagttt

SEQ ID NO: 6208002 - DNA, 17 bp, Homo sapiens
gactttagtctgcaaaa

SEQ ID NO: 6208003 - DNA, 23 bp, Homo sapiens
gactttagtgccctgccccctgg

SEQ ID NO: 6208004 - DNA, 22 bp, Homo sapiens
gactttagttaccgagacatga

SEQ ID NO: 6208005 - DNA, 19 bp, Homo sapiens
gactttataattccttctg

SEQ ID NO: 6208006 - DNA, 22 bp, Homo sapiens
gactttatctaatacctctgtg

SEQ ID NO: 6208007 - DNA, 16 bp, Homo sapiens
gactttatctcctgct

SEQ ID NO: 6208008 - DNA, 18 bp, Homo sapiens
gactttatctcctgctct

SEQ ID NO: 6208009 - DNA, 19 bp, Homo sapiens
gactttatgaataatttca

SEQ ID NO: 6208010 - DNA, 16 bp, Homo sapiens
gactttatgcaataaa

SEQ ID NO: 6208011 - DNA, 17 bp, Homo sapiens
gactttatgcaataaat

SEQ ID NO: 6208012 - DNA, 14 bp, Homo sapiens
gactttatgtatta

SEQ ID NO: 6208013 - DNA, 12 bp, Homo sapiens
gactttatttaa

SEQ ID NO: 6208014 - DNA, 16 bp, Homo sapiens
gactttatttatttct

SEQ ID NO: 6208015 - DNA, 22 bp, Homo sapiens
gactttatttctgagcaaagca

SEQ ID NO: 6208016 - DNA, 23 bp, Homo sapiens
gactttcacatttggaatttaaa

SEQ ID NO: 6208017 - DNA, 14 bp, Homo sapiens
gactttcaggtact

SEQ ID NO: 6208018 - DNA, 13 bp, Homo sapiens
gactttcatttgg

SEQ ID NO: 6208019 - DNA, 15 bp, Homo sapiens
gactttccaaatcca

SEQ ID NO: 6208020 - DNA, 19 bp, Homo sapiens
gactttccaccccctccct

SEQ ID NO: 6208021 - DNA, 19 bp, Homo sapiens
gactttccagaatgacctt

SEQ ID NO: 6208022 - DNA, 15 bp, Homo sapiens
gactttcccacccag

SEQ ID NO: 6208023 - DNA, 23 bp, Homo sapiens
gactttccttagacccgccaggt

SEQ ID NO: 6208024 - DNA, 18 bp, Homo sapiens
gactttctacatgcaaat

SEQ ID NO: 6208025 - DNA, 23 bp, Homo sapiens
gactttctcagcctctgaatatg

SEQ ID NO: 6208026 - DNA, 21 bp, Homo sapiens
gactttctctaataataaata

SEQ ID NO: 6208027 - DNA, 14 bp, Homo sapiens
gactttctctgtgt

SEQ ID NO: 6208028 - DNA, 17 bp, Homo sapiens
gactttctgaaactccc

SEQ ID NO: 6208029 - DNA, 12 bp, Homo sapiens
gactttctgaag

SEQ ID NO: 6208030 - DNA, 19 bp, Homo sapiens
gactttctgattactgtcc

SEQ ID NO: 6208031 - DNA, 12 bp, Homo sapiens
gactttctgcct

SEQ ID NO: 6208032 - DNA, 14 bp, Homo sapiens
gactttctgcctgg

SEQ ID NO: 6208033 - DNA, 16 bp, Homo sapiens
gactttctgcctggag

SEQ ID NO: 6208034 - DNA, 13 bp, Homo sapiens
gactttctgtgac

SEQ ID NO: 6208035 - DNA, 13 bp, Homo sapiens
gactttctgttgg

SEQ ID NO: 6208036 - DNA, 23 bp, Homo sapiens
gactttctgttttctgtttgtaa

SEQ ID NO: 6208037 - DNA, 11 bp, Homo sapiens
gactttcttct

SEQ ID NO: 6208038 - DNA, 19 bp, Homo sapiens
gactttcttctagtgcttt

SEQ ID NO: 6208039 - DNA, 18 bp, Homo sapiens
gactttcttgcatgaatc

SEQ ID NO: 6208040 - DNA, 14 bp, Homo sapiens
gactttctttttct

SEQ ID NO: 6208041 - DNA, 19 bp, Homo sapiens
gactttctttttgtagctg

SEQ ID NO: 6208042 - DNA, 21 bp, Homo sapiens
gactttcttttttgatataga

SEQ ID NO: 6208043 - DNA, 17 bp, Homo sapiens
gactttgaataaaataa

SEQ ID NO: 6208044 - DNA, 18 bp, Homo sapiens
gactttgaatttatataa

SEQ ID NO: 6208045 - DNA, 23 bp, Homo sapiens
gactttgacaattactcaggttt

SEQ ID NO: 6208046 - DNA, 22 bp, Homo sapiens
gactttgagcctgcatcttctt

SEQ ID NO: 6208047 - DNA, 14 bp, Homo sapiens
gactttgatccttg

SEQ ID NO: 6208048 - DNA, 22 bp, Homo sapiens
gactttgatgcatttccacact

SEQ ID NO: 6208049 - DNA, 20 bp, Homo sapiens
gactttgattgcacattgtt

SEQ ID NO: 6208050 - DNA, 17 bp, Homo sapiens
gactttgcagatggaaa

SEQ ID NO: 6208051 - DNA, 20 bp, Homo sapiens
gactttgcagatggaaagag

SEQ ID NO: 6208052 - DNA, 14 bp, Homo sapiens
gactttgcaggagt

SEQ ID NO: 6208053 - DNA, 22 bp, Homo sapiens
gactttgcccagggtcctgtgc

SEQ ID NO: 6208054 - DNA, 20 bp, Homo sapiens
gactttgcccccttgcccat

SEQ ID NO: 6208055 - DNA, 19 bp, Homo sapiens
gactttgctgcattttaca

SEQ ID NO: 6208056 - DNA, 21 bp, Homo sapiens
gactttgctgcattttacaca

SEQ ID NO: 6208057 - DNA, 13 bp, Homo sapiens
gactttgctgtta

SEQ ID NO: 6208058 - DNA, 15 bp, Homo sapiens
gactttgcttcccat

SEQ ID NO: 6208059 - DNA, 17 bp, Homo sapiens
gactttgcttcccctcc

SEQ ID NO: 6208060 - DNA, 22 bp, Homo sapiens
gactttgcttcccctccaggag

SEQ ID NO: 6208061 - DNA, 15 bp, Homo sapiens
gactttgcttgcttt

SEQ ID NO: 6208062 - DNA, 14 bp, Homo sapiens
gactttggaaagag

SEQ ID NO: 6208063 - DNA, 19 bp, Homo sapiens
gactttggataataaggaa

SEQ ID NO: 6208064 - DNA, 22 bp, Homo sapiens
gactttggggacaccctcctgc

SEQ ID NO: 6208065 - DNA, 22 bp, Homo sapiens
gactttgtaccccccaacccct

SEQ ID NO: 6208066 - DNA, 13 bp, Homo sapiens
gactttgtatgaa

SEQ ID NO: 6208067 - DNA, 21 bp, Homo sapiens
gactttgtctctcctggctgg

SEQ ID NO: 6208068 - DNA, 20 bp, Homo sapiens
gactttgtgttcatttcatt

SEQ ID NO: 6208069 - DNA, 12 bp, Homo sapiens
gactttgttaca

SEQ ID NO: 6208070 - DNA, 19 bp, Homo sapiens
gacttttacagcttttctc

SEQ ID NO: 6208071 - DNA, 23 bp, Homo sapiens
gacttttagacagtggtaaatat

SEQ ID NO: 6208072 - DNA, 21 bp, Homo sapiens
gacttttagcggtttgcaaac

SEQ ID NO: 6208073 - DNA, 17 bp, Homo sapiens
gacttttattaataaaa

SEQ ID NO: 6208074 - DNA, 18 bp, Homo sapiens
gacttttatttccagtga

SEQ ID NO: 6208075 - DNA, 14 bp, Homo sapiens
gacttttcaagtat

SEQ ID NO: 6208076 - DNA, 18 bp, Homo sapiens
gacttttcaataaatcag

SEQ ID NO: 6208077 - DNA, 14 bp, Homo sapiens
gacttttcagactg

SEQ ID NO: 6208078 - DNA, 14 bp, Homo sapiens
gacttttccaaccc

SEQ ID NO: 6208079 - DNA, 17 bp, Homo sapiens
gacttttccatgtatct

SEQ ID NO: 6208080 - DNA, 18 bp, Homo sapiens
gacttttccatgtatcta

SEQ ID NO: 6208081 - DNA, 19 bp, Homo sapiens
gacttttccattgaccagc

SEQ ID NO: 6208082 - DNA, 22 bp, Homo sapiens
gacttttccattgaccagctct

SEQ ID NO: 6208083 - DNA, 17 bp, Homo sapiens
gacttttcgttaacatt

SEQ ID NO: 6208084 - DNA, 16 bp, Homo sapiens
gacttttctaaagctc

SEQ ID NO: 6208085 - DNA, 13 bp, Homo sapiens
gacttttctgatt

SEQ ID NO: 6208086 - DNA, 22 bp, Homo sapiens
gacttttctgattaatatattt

SEQ ID NO: 6208087 - DNA, 14 bp, Homo sapiens
gacttttctgcaaa

SEQ ID NO: 6208088 - DNA, 14 bp, Homo sapiens
gacttttctgccct

SEQ ID NO: 6208089 - DNA, 12 bp, Homo sapiens
gacttttctgta

SEQ ID NO: 6208090 - DNA, 13 bp, Homo sapiens
gacttttctgtaa

SEQ ID NO: 6208091 - DNA, 18 bp, Homo sapiens
gacttttctgtaattcag

SEQ ID NO: 6208092 - DNA, 23 bp, Homo sapiens
gacttttgaagaacaaaaggctt

SEQ ID NO: 6208093 - DNA, 19 bp, Homo sapiens
gacttttgaattacagaga

SEQ ID NO: 6208094 - DNA, 13 bp, Homo sapiens
gacttttgcttta

SEQ ID NO: 6208095 - DNA, 14 bp, Homo sapiens
gacttttgctttaa

SEQ ID NO: 6208096 - DNA, 17 bp, Homo sapiens
gacttttgctttaattc

SEQ ID NO: 6208097 - DNA, 22 bp, Homo sapiens
gacttttgggggttggatggga

SEQ ID NO: 6208098 - DNA, 15 bp, Homo sapiens
gacttttgtacatct

SEQ ID NO: 6208099 - DNA, 23 bp, Homo sapiens
gacttttgtataggtagatgttc

SEQ ID NO: 6208100 - DNA, 12 bp, Homo sapiens
gacttttgtgaa

SEQ ID NO: 6208101 - DNA, 14 bp, Homo sapiens
gacttttgttgaaa

SEQ ID NO: 6208102 - DNA, 20 bp, Homo sapiens
gactttttaaaaaatgctgg

SEQ ID NO: 6208103 - DNA, 17 bp, Homo sapiens
gactttttaaaatataa

SEQ ID NO: 6208104 - DNA, 16 bp, Homo sapiens
gactttttagccagtg

SEQ ID NO: 6208105 - DNA, 13 bp, Homo sapiens
gactttttataat

SEQ ID NO: 6208106 - DNA, 16 bp, Homo sapiens
gactttttataatgtg

SEQ ID NO: 6208107 - DNA, 18 bp, Homo sapiens
gactttttggaattcagc

SEQ ID NO: 6208108 - DNA, 20 bp, Homo sapiens
gactttttgtttctttgtgt

SEQ ID NO: 6208109 - DNA, 14 bp, Homo sapiens
gacttttttgtaca

SEQ ID NO: 6208110 - DNA, 19 bp, Homo sapiens
gactttttttaagctgaat

SEQ ID NO: 6208111 - DNA, 23 bp, Homo sapiens
gactttttttctgattcaaaagt

SEQ ID NO: 6208112 - DNA, 23 bp, Homo sapiens
gactttttttggtataatgttta

SEQ ID NO: 6208113 - DNA, 18 bp, Homo sapiens
gacttttttttttctttt

SEQ ID NO: 6208114 - DNA, 21 bp, Homo sapiens
gagaaaaaaaaacacacaaaa

SEQ ID NO: 6208115 - DNA, 23 bp, Homo sapiens
gagaaaaaaaaacacacaaaaag

SEQ ID NO: 6208116 - DNA, 16 bp, Homo sapiens
gagaaaaaaaaagcaa

SEQ ID NO: 6208117 - DNA, 17 bp, Homo sapiens
gagaaaaaaaaagcaaa

SEQ ID NO: 6208118 - DNA, 14 bp, Homo sapiens
gagaaaaaaaacct

SEQ ID NO: 6208119 - DNA, 23 bp, Homo sapiens
gagaaaaaaaaccttgtaaaaaa

SEQ ID NO: 6208120 - DNA, 23 bp, Homo sapiens
gagaaaaaaatataaaatttctg

SEQ ID NO: 6208121 - DNA, 24 bp, Homo sapiens
gagaaaaaagtcaccattctgcat

SEQ ID NO: 6208122 - DNA, 12 bp, Homo sapiens
gagaaaaaccaa

SEQ ID NO: 6208123 - DNA, 17 bp, Homo sapiens
gagaaaaaccaatgatt

SEQ ID NO: 6208124 - DNA, 17 bp, Homo sapiens
gagaaaaactttcattt

SEQ ID NO: 6208125 - DNA, 13 bp, Homo sapiens
gagaaaaagaaga

SEQ ID NO: 6208126 - DNA, 17 bp, Homo sapiens
gagaaaaagagagagca

SEQ ID NO: 6208127 - DNA, 13 bp, Homo sapiens
gagaaaaagccct

SEQ ID NO: 6208128 - DNA, 19 bp, Homo sapiens
gagaaaaagctcctgtcct

SEQ ID NO: 6208129 - DNA, 13 bp, Homo sapiens
gagaaaaatgctt

SEQ ID NO: 6208130 - DNA, 17 bp, Homo sapiens
gagaaaaatggcctgca

SEQ ID NO: 6208131 - DNA, 15 bp, Homo sapiens
gagaaaacctgttct

SEQ ID NO: 6208132 - DNA, 12 bp, Homo sapiens
gagaaaacctta

SEQ ID NO: 6208133 - DNA, 18 bp, Homo sapiens
gagaaaacgccagtgtgt

SEQ ID NO: 6208134 - DNA, 16 bp, Homo sapiens
gagaaaactaaagaaa

SEQ ID NO: 6208135 - DNA, 23 bp, Homo sapiens
gagaaaactcttctgaggatcat

SEQ ID NO: 6208136 - DNA, 16 bp, Homo sapiens
gagaaaacttcagaga

SEQ ID NO: 6208137 - DNA, 13 bp, Homo sapiens
gagaaaagaaaaa

SEQ ID NO: 6208138 - DNA, 14 bp, Homo sapiens
gagaaaagaaaaaa

SEQ ID NO: 6208139 - DNA, 15 bp, Homo sapiens
gagaaaagaaaaaaa

SEQ ID NO: 6208140 - DNA, 23 bp, Homo sapiens
gagaaaagacagggtgggaggga

SEQ ID NO: 6208141 - DNA, 13 bp, Homo sapiens
gagaaaagacatg

SEQ ID NO: 6208142 - DNA, 18 bp, Homo sapiens
gagaaaagcacttaaagt

SEQ ID NO: 6208143 - DNA, 14 bp, Homo sapiens
gagaaaagccagat

SEQ ID NO: 6208144 - DNA, 14 bp, Homo sapiens
ctttctcttgttta

SEQ ID NO: 6208145 - DNA, 15 bp, Homo sapiens
ctttctcttgtttaa

SEQ ID NO: 6208146 - DNA, 18 bp, Homo sapiens
ctttctctttcttccttt

SEQ ID NO: 6208147 - DNA, 13 bp, Homo sapiens
ctttctctttgcc

SEQ ID NO: 6208148 - DNA, 14 bp, Homo sapiens
ctttctctttgcca

SEQ ID NO: 6208149 - DNA, 20 bp, Homo sapiens
ctttctctttgccatttctt

SEQ ID NO: 6208150 - DNA, 11 bp, Homo sapiens
ctttctgaaaa

SEQ ID NO: 6208151 - DNA, 13 bp, Homo sapiens
ctttctgaaaaca

SEQ ID NO: 6208152 - DNA, 20 bp, Homo sapiens
ctttctgaaaatttatataa

SEQ ID NO: 6208153 - DNA, 19 bp, Homo sapiens
ctttctgaaactcccttgt

SEQ ID NO: 6208154 - DNA, 14 bp, Homo sapiens
ctttctgaaattca

SEQ ID NO: 6208155 - DNA, 16 bp, Homo sapiens
ctttctgaaattcaca

SEQ ID NO: 6208156 - DNA, 15 bp, Homo sapiens
ctttctgaacagctg

SEQ ID NO: 6208157 - DNA, 23 bp, Homo sapiens
ctttctgaacagctggtgtagct

SEQ ID NO: 6208158 - DNA, 18 bp, Homo sapiens
ctttctgaattggaaggg

SEQ ID NO: 6208159 - DNA, 20 bp, Homo sapiens
ctttctgaattggaagggaa

SEQ ID NO: 6208160 - DNA, 22 bp, Homo sapiens
ctttctgaattggaagggaaaa

SEQ ID NO: 6208161 - DNA, 15 bp, Homo sapiens
ctttctgacaataaa

SEQ ID NO: 6208162 - DNA, 19 bp, Homo sapiens
ctttctgacaataaataat

SEQ ID NO: 6208163 - DNA, 14 bp, Homo sapiens
ctttctgaccttca

SEQ ID NO: 6208164 - DNA, 18 bp, Homo sapiens
ctttctgaccttcagctc

SEQ ID NO: 6208165 - DNA, 15 bp, Homo sapiens
ctttctgactgcaac

SEQ ID NO: 6208166 - DNA, 16 bp, Homo sapiens
ctttctgactgtccct

SEQ ID NO: 6208167 - DNA, 22 bp, Homo sapiens
ctttctgagagttggctcaggc

SEQ ID NO: 6208168 - DNA, 21 bp, Homo sapiens
ctttctgagcacactttagtg

SEQ ID NO: 6208169 - DNA, 15 bp, Homo sapiens
ctttctgagggcccg

SEQ ID NO: 6208170 - DNA, 23 bp, Homo sapiens
ctttctgagggcccgtgtaaata

SEQ ID NO: 6208171 - DNA, 20 bp, Homo sapiens
ctttctgagtgacatgggtg

SEQ ID NO: 6208172 - DNA, 16 bp, Homo sapiens
ctttctgagtgccttc

SEQ ID NO: 6208173 - DNA, 17 bp, Homo sapiens
ctttctgagtgccttct

SEQ ID NO: 6208174 - DNA, 18 bp, Homo sapiens
ctttctgagtgccttctg

SEQ ID NO: 6208175 - DNA, 19 bp, Homo sapiens
ctttctgagtgccttctgt

SEQ ID NO: 6208176 - DNA, 20 bp, Homo sapiens
ctttctgagtgccttctgtg

SEQ ID NO: 6208177 - DNA, 16 bp, Homo sapiens
ctttctgatcaaggcc

SEQ ID NO: 6208178 - DNA, 20 bp, Homo sapiens
ctttctgatcaaggccttat

SEQ ID NO: 6208179 - DNA, 21 bp, Homo sapiens
ctttctgatgacgcctgtctg

SEQ ID NO: 6208180 - DNA, 22 bp, Homo sapiens
ctttctgatgacgcctgtctgt

SEQ ID NO: 6208181 - DNA, 17 bp, Homo sapiens
ctttctgattactgtcc

SEQ ID NO: 6208182 - DNA, 19 bp, Homo sapiens
ctttctgcagtttttcagg

SEQ ID NO: 6208183 - DNA, 21 bp, Homo sapiens
ctttctgccatctagccagcc

SEQ ID NO: 6208184 - DNA, 13 bp, Homo sapiens
ctttctgcccagc

SEQ ID NO: 6208185 - DNA, 22 bp, Homo sapiens
ctttctgcccagcctgctcagc

SEQ ID NO: 6208186 - DNA, 19 bp, Homo sapiens
ctttctgccccccagggct

SEQ ID NO: 6208187 - DNA, 13 bp, Homo sapiens
ctttctgcccggc

SEQ ID NO: 6208188 - DNA, 21 bp, Homo sapiens
ctttctgcccttctccccact

SEQ ID NO: 6208189 - DNA, 14 bp, Homo sapiens
ctttctgcctctca

SEQ ID NO: 6208190 - DNA, 14 bp, Homo sapiens
ctttctgcctctcc

SEQ ID NO: 6208191 - DNA, 13 bp, Homo sapiens
ctttctgccttgg

SEQ ID NO: 6208192 - DNA, 13 bp, Homo sapiens
ctttctgctcagc

SEQ ID NO: 6208193 - DNA, 14 bp, Homo sapiens
ctttctgctcagct

SEQ ID NO: 6208194 - DNA, 20 bp, Homo sapiens
ctttctgctctatactgtgg

SEQ ID NO: 6208195 - DNA, 13 bp, Homo sapiens
ctttctgctctgc

SEQ ID NO: 6208196 - DNA, 15 bp, Homo sapiens
ctttctgctctgcca

SEQ ID NO: 6208197 - DNA, 15 bp, Homo sapiens
ctttctgctggctga

SEQ ID NO: 6208198 - DNA, 19 bp, Homo sapiens
ctttctggaaaaacaggat

SEQ ID NO: 6208199 - DNA, 17 bp, Homo sapiens
ctttctggaccagatcc

SEQ ID NO: 6208200 - DNA, 18 bp, Homo sapiens
ctttctggcaggtcctcc

SEQ ID NO: 6208201 - DNA, 20 bp, Homo sapiens
ctttctggccccagcctagg

SEQ ID NO: 6208202 - DNA, 19 bp, Homo sapiens
ctttctggcccttctttca

SEQ ID NO: 6208203 - DNA, 21 bp, Homo sapiens
ctttctggccctttctggacc

SEQ ID NO: 6208204 - DNA, 15 bp, Homo sapiens
ctttctggcttttaa

SEQ ID NO: 6208205 - DNA, 18 bp, Homo sapiens
ctttctgggatgtcacag

SEQ ID NO: 6208206 - DNA, 17 bp, Homo sapiens
ctttctgggctctggac

SEQ ID NO: 6208207 - DNA, 21 bp, Homo sapiens
ctttctgggctctggactcca

SEQ ID NO: 6208208 - DNA, 15 bp, Homo sapiens
ctttctgggctttct

SEQ ID NO: 6208209 - DNA, 20 bp, Homo sapiens
ctttctgggctttctcctgg

SEQ ID NO: 6208210 - DNA, 21 bp, Homo sapiens
ctttctgggctttctcctgga

SEQ ID NO: 6208211 - DNA, 23 bp, Homo sapiens
ctttctggggggatatttcctaa

SEQ ID NO: 6208212 - DNA, 17 bp, Homo sapiens
ctttctgggtgtgtcca

SEQ ID NO: 6208213 - DNA, 20 bp, Homo sapiens
ctttctgtaggtttctctct

SEQ ID NO: 6208214 - DNA, 18 bp, Homo sapiens
ctttctgtatatactttt

SEQ ID NO: 6208215 - DNA, 19 bp, Homo sapiens
ctttctgtatatacttttt

SEQ ID NO: 6208216 - DNA, 20 bp, Homo sapiens
ctttctgtatcaagcccctg

SEQ ID NO: 6208217 - DNA, 12 bp, Homo sapiens
ctttctgtccca

SEQ ID NO: 6208218 - DNA, 13 bp, Homo sapiens
ctttctgtcccac

SEQ ID NO: 6208219 - DNA, 23 bp, Homo sapiens
ctttctgtcccttctgtccctca

SEQ ID NO: 6208220 - DNA, 15 bp, Homo sapiens
ctttctgtctccctt

SEQ ID NO: 6208221 - DNA, 17 bp, Homo sapiens
ctttctgtctcccttct

SEQ ID NO: 6208222 - DNA, 22 bp, Homo sapiens
ctttctgtctcccttctctctc

SEQ ID NO: 6208223 - DNA, 16 bp, Homo sapiens
ctttctgtctctctct

SEQ ID NO: 6208224 - DNA, 18 bp, Homo sapiens
ctttctgtcttctacaga

SEQ ID NO: 6208225 - DNA, 15 bp, Homo sapiens
ctttctgtgcatgtg

SEQ ID NO: 6208226 - DNA, 16 bp, Homo sapiens
ctttctgtgcatgtgc

SEQ ID NO: 6208227 - DNA, 13 bp, Homo sapiens
ctttctgtgccct

SEQ ID NO: 6208228 - DNA, 20 bp, Homo sapiens
ctttctgtgcttctctttgt

SEQ ID NO: 6208229 - DNA, 15 bp, Homo sapiens
ctttctgtgtgcaca

SEQ ID NO: 6208230 - DNA, 16 bp, Homo sapiens
ctttctgtgtgcacag

SEQ ID NO: 6208231 - DNA, 13 bp, Homo sapiens
ctttctgttaaaa

SEQ ID NO: 6208232 - DNA, 19 bp, Homo sapiens
ctttctgttaaaatgcatg

SEQ ID NO: 6208233 - DNA, 15 bp, Homo sapiens
ctttctgttatctag

SEQ ID NO: 6208234 - DNA, 17 bp, Homo sapiens
ctttctgttatctagaa

SEQ ID NO: 6208235 - DNA, 17 bp, Homo sapiens
ctttctgttcatctctt

SEQ ID NO: 6208236 - DNA, 21 bp, Homo sapiens
ctttctgttcatctctttgtc

SEQ ID NO: 6208237 - DNA, 16 bp, Homo sapiens
ctttctgttccaaatt

SEQ ID NO: 6208238 - DNA, 14 bp, Homo sapiens
ctttctgttcccta

SEQ ID NO: 6208239 - DNA, 21 bp, Homo sapiens
ctttctgttccctatggagag

SEQ ID NO: 6208240 - DNA, 21 bp, Homo sapiens
ctttctgttggattccatgct

SEQ ID NO: 6208241 - DNA, 18 bp, Homo sapiens
ctttctgtttcctggcct

SEQ ID NO: 6208242 - DNA, 21 bp, Homo sapiens
ctttctgtttcctggcctcag

SEQ ID NO: 6208243 - DNA, 23 bp, Homo sapiens
ctttctgtttggacccatggtca

SEQ ID NO: 6208244 - DNA, 13 bp, Homo sapiens
ctttctgttttct

SEQ ID NO: 6208245 - DNA, 21 bp, Homo sapiens
ctttctgttttctgtttgtaa

SEQ ID NO: 6208246 - DNA, 22 bp, Homo sapiens
ctttctgttttctgtttgtaaa

SEQ ID NO: 6208247 - DNA, 18 bp, Homo sapiens
ctttcttaaaactgacat

SEQ ID NO: 6208248 - DNA, 22 bp, Homo sapiens
ctttcttacctactattggccc

SEQ ID NO: 6208249 - DNA, 15 bp, Homo sapiens
ctttcttagattaaa

SEQ ID NO: 6208250 - DNA, 21 bp, Homo sapiens
ctttcttagctgatgtctttg

SEQ ID NO: 6208251 - DNA, 14 bp, Homo sapiens
ctttcttataaatt

SEQ ID NO: 6208252 - DNA, 18 bp, Homo sapiens
ctttcttatcttgaccat

SEQ ID NO: 6208253 - DNA, 12 bp, Homo sapiens
ctttcttattca

SEQ ID NO: 6208254 - DNA, 16 bp, Homo sapiens
ctttcttattctgtat

SEQ ID NO: 6208255 - DNA, 18 bp, Homo sapiens
ctttcttattttgtaata

SEQ ID NO: 6208256 - DNA, 21 bp, Homo sapiens
ctttcttattttgtaataaac

SEQ ID NO: 6208257 - DNA, 16 bp, Homo sapiens
ctttcttcaccaagtg

SEQ ID NO: 6208258 - DNA, 13 bp, Homo sapiens
ctttcttcactct

SEQ ID NO: 6208259 - DNA, 13 bp, Homo sapiens
ctttcttcagctg

SEQ ID NO: 6208260 - DNA, 18 bp, Homo sapiens
ctttcttccatcagctct

SEQ ID NO: 6208261 - DNA, 15 bp, Homo sapiens
ctttcttccccaccc

SEQ ID NO: 6208262 - DNA, 21 bp, Homo sapiens
ctttcttcctcattccctcgt

SEQ ID NO: 6208263 - DNA, 12 bp, Homo sapiens
ctttcttcctct

SEQ ID NO: 6208264 - DNA, 14 bp, Homo sapiens
ctttcttcctctgc

SEQ ID NO: 6208265 - DNA, 15 bp, Homo sapiens
ctttcttccttcctt

SEQ ID NO: 6208266 - DNA, 12 bp, Homo sapiens
ctttcttccttt

SEQ ID NO: 6208267 - DNA, 13 bp, Homo sapiens
ctttcttcctttc

SEQ ID NO: 6208268 - DNA, 14 bp, Homo sapiens
ctttcttcctttct

SEQ ID NO: 6208269 - DNA, 21 bp, Homo sapiens
ctttcttctacaaccagagcc

SEQ ID NO: 6208270 - DNA, 22 bp, Homo sapiens
ctttcttctacaaccagagccc

SEQ ID NO: 6208271 - DNA, 15 bp, Homo sapiens
ctttcttctaccaga

SEQ ID NO: 6208272 - DNA, 12 bp, Homo sapiens
ctttcttctagt

SEQ ID NO: 6208273 - DNA, 12 bp, Homo sapiens
ctttcttctccc

SEQ ID NO: 6208274 - DNA, 21 bp, Homo sapiens
ctttcttctcgcctaggattt

SEQ ID NO: 6208275 - DNA, 13 bp, Homo sapiens
ctttcttctctgc

SEQ ID NO: 6208276 - DNA, 13 bp, Homo sapiens
ctttcttctcttt

SEQ ID NO: 6208277 - DNA, 14 bp, Homo sapiens
ctttcttctgccct

SEQ ID NO: 6208278 - DNA, 12 bp, Homo sapiens
ctttcttcttgt

SEQ ID NO: 6208279 - DNA, 13 bp, Homo sapiens
ctttcttgaaatt

SEQ ID NO: 6208280 - DNA, 16 bp, Homo sapiens
ctttcttgagcaccag

SEQ ID NO: 6208281 - DNA, 14 bp, Homo sapiens
ctttcttgcactgt

SEQ ID NO: 6208282 - DNA, 13 bp, Homo sapiens
ctttcttgcagat

SEQ ID NO: 6208283 - DNA, 14 bp, Homo sapiens
ctttcttgctccct

SEQ ID NO: 6208284 - DNA, 16 bp, Homo sapiens
ctttcttgctcccttc

SEQ ID NO: 6208285 - DNA, 16 bp, Homo sapiens
ctttcttgctggctct

SEQ ID NO: 6208286 - DNA, 19 bp, Homo sapiens
ctttcttgctggctctgag

SEQ ID NO: 6208287 - DNA, 16 bp, Homo sapiens
ctttcttgctgtccaa

SEQ ID NO: 6208288 - DNA, 15 bp, Homo sapiens
ctttcttgcttcaaa

SEQ ID NO: 6208289 - DNA, 21 bp, Homo sapiens
ctttcttggagtgccaagttt

SEQ ID NO: 6208290 - DNA, 13 bp, Homo sapiens
ctttcttggccag

SEQ ID NO: 6208291 - DNA, 14 bp, Homo sapiens
ctttcttggccagt

SEQ ID NO: 6208292 - DNA, 13 bp, Homo sapiens
ctttcttgggata

SEQ ID NO: 6208293 - DNA, 22 bp, Homo sapiens
ctttcttggttcataaatgaat

SEQ ID NO: 6208294 - DNA, 12 bp, Homo sapiens
ctttcttgtttg

SEQ ID NO: 6208295 - DNA, 13 bp, Homo sapiens
ctttctttaacat

SEQ ID NO: 6208296 - DNA, 21 bp, Homo sapiens
ctttctttaacatatcattca

SEQ ID NO: 6208297 - DNA, 15 bp, Homo sapiens
ctttctttacctgag

SEQ ID NO: 6208298 - DNA, 17 bp, Homo sapiens
ctttctttacctgagac

SEQ ID NO: 6208299 - DNA, 15 bp, Homo sapiens
ctttctttagaattt

SEQ ID NO: 6208300 - DNA, 21 bp, Homo sapiens
ctttctttcaataaaacgcag

SEQ ID NO: 6208301 - DNA, 15 bp, Homo sapiens
ctttctttcagatgt

SEQ ID NO: 6208302 - DNA, 17 bp, Homo sapiens
ctttctttctaactcca

SEQ ID NO: 6208303 - DNA, 13 bp, Homo sapiens
ctttctttctcta

SEQ ID NO: 6208304 - DNA, 17 bp, Homo sapiens
ctttctttctctttctg

SEQ ID NO: 6208305 - DNA, 16 bp, Homo sapiens
ctttctttctttcttt

SEQ ID NO: 6208306 - DNA, 17 bp, Homo sapiens
ctttctttgattctcct

SEQ ID NO: 6208307 - DNA, 21 bp, Homo sapiens
ctttctttgcaccaaagacat

SEQ ID NO: 6208308 - DNA, 12 bp, Homo sapiens
ctttctttgcct

SEQ ID NO: 6208309 - DNA, 14 bp, Homo sapiens
ctttctttgctgct

SEQ ID NO: 6208310 - DNA, 16 bp, Homo sapiens
ctttctttgctgctgt

SEQ ID NO: 6208311 - DNA, 18 bp, Homo sapiens
ctttctttgggaatattt

SEQ ID NO: 6208312 - DNA, 20 bp, Homo sapiens
ctttctttgggaatatttga

SEQ ID NO: 6208313 - DNA, 22 bp, Homo sapiens
ctttctttggggaaaaattctt

SEQ ID NO: 6208314 - DNA, 21 bp, Homo sapiens
ctttctttggtgcctttcctg

SEQ ID NO: 6208315 - DNA, 19 bp, Homo sapiens
ctttctttgtttctttctt

SEQ ID NO: 6208316 - DNA, 22 bp, Homo sapiens
ctttctttgttttattttaata

SEQ ID NO: 6208317 - DNA, 13 bp, Homo sapiens
ctttcttttaagc

SEQ ID NO: 6208318 - DNA, 22 bp, Homo sapiens
ctttcttttctaattcctgttg

SEQ ID NO: 6208319 - DNA, 15 bp, Homo sapiens
ctttcttttctttct

SEQ ID NO: 6208320 - DNA, 20 bp, Homo sapiens
ctttcttttgaatcaatctg

SEQ ID NO: 6208321 - DNA, 23 bp, Homo sapiens
ctttcttttgaatcaatctggct

SEQ ID NO: 6208322 - DNA, 16 bp, Homo sapiens
ctttcttttgataaat

SEQ ID NO: 6208323 - DNA, 13 bp, Homo sapiens
ctttcttttgtgc

SEQ ID NO: 6208324 - DNA, 13 bp, Homo sapiens
gagaaaaggaaaa

SEQ ID NO: 6208325 - DNA, 19 bp, Homo sapiens
gagaaaaggaaaagaaaaa

SEQ ID NO: 6208326 - DNA, 16 bp, Homo sapiens
gagaaaagggaaaaaa

SEQ ID NO: 6208327 - DNA, 11 bp, Homo sapiens
gagaaaataaa

SEQ ID NO: 6208328 - DNA, 18 bp, Homo sapiens
gagaaaataaaaagttaa

SEQ ID NO: 6208329 - DNA, 16 bp, Homo sapiens
gagaaaataaatttaa

SEQ ID NO: 6208330 - DNA, 11 bp, Homo sapiens
gagaaaatata

SEQ ID NO: 6208331 - DNA, 16 bp, Homo sapiens
gagaaaatatatgtat

SEQ ID NO: 6208332 - DNA, 18 bp, Homo sapiens
gagaaaatatatgtattt

SEQ ID NO: 6208333 - DNA, 15 bp, Homo sapiens
gagaaaatcatcaag

SEQ ID NO: 6208334 - DNA, 23 bp, Homo sapiens
gagaaaatgcctcaattcacata

SEQ ID NO: 6208335 - DNA, 22 bp, Homo sapiens
gagaaaatgctttctcatgcat

SEQ ID NO: 6208336 - DNA, 21 bp, Homo sapiens
gagaaaatggacgtgttatga

SEQ ID NO: 6208337 - DNA, 14 bp, Homo sapiens
gagaaaattcaggt

SEQ ID NO: 6208338 - DNA, 13 bp, Homo sapiens
gagaaacaaactt

SEQ ID NO: 6208339 - DNA, 15 bp, Homo sapiens
gagaaacaaactttt

SEQ ID NO: 6208340 - DNA, 14 bp, Homo sapiens
gagaaacagctcag

SEQ ID NO: 6208341 - DNA, 18 bp, Homo sapiens
gagaaacagttggtaact

SEQ ID NO: 6208342 - DNA, 21 bp, Homo sapiens
gagaaacagttggtaactttt

SEQ ID NO: 6208343 - DNA, 16 bp, Homo sapiens
gagaaaccagcttcct

SEQ ID NO: 6208344 - DNA, 21 bp, Homo sapiens
gagaaaccagcttccttcaga

SEQ ID NO: 6208345 - DNA, 19 bp, Homo sapiens
gagaaaccatcctctccct

SEQ ID NO: 6208346 - DNA, 17 bp, Homo sapiens
gagaaacccaccagcct

SEQ ID NO: 6208347 - DNA, 19 bp, Homo sapiens
gagaaaccctaaaaagaga

SEQ ID NO: 6208348 - DNA, 21 bp, Homo sapiens
gagaaaccctaaaaagagaag

SEQ ID NO: 6208349 - DNA, 15 bp, Homo sapiens
gagaaaccttgcaaa

SEQ ID NO: 6208350 - DNA, 20 bp, Homo sapiens
gagaaacgtccatctctctc

SEQ ID NO: 6208351 - DNA, 12 bp, Homo sapiens
gagaaactcatc

SEQ ID NO: 6208352 - DNA, 17 bp, Homo sapiens
gagaaactcatcatttt

SEQ ID NO: 6208353 - DNA, 14 bp, Homo sapiens
gagaaactccaaag

SEQ ID NO: 6208354 - DNA, 13 bp, Homo sapiens
gagaaactgaagc

SEQ ID NO: 6208355 - DNA, 15 bp, Homo sapiens
gagaaactgaagccg

SEQ ID NO: 6208356 - DNA, 17 bp, Homo sapiens
gagaaactgctgcagat

SEQ ID NO: 6208357 - DNA, 18 bp, Homo sapiens
gagaaactggcaaagcag

SEQ ID NO: 6208358 - DNA, 23 bp, Homo sapiens
gagaaacttaaatgaacacagct

SEQ ID NO: 6208359 - DNA, 24 bp, Homo sapiens
gagaaacttaaatgttattatctg

SEQ ID NO: 6208360 - DNA, 21 bp, Homo sapiens
gagaaactttgagtacagata

SEQ ID NO: 6208361 - DNA, 13 bp, Homo sapiens
gagaaagaaaact

SEQ ID NO: 6208362 - DNA, 22 bp, Homo sapiens
gagaaagaaaaggaatgcaaga

SEQ ID NO: 6208363 - DNA, 15 bp, Homo sapiens
gagaaagaaaaggca

SEQ ID NO: 6208364 - DNA, 17 bp, Homo sapiens
gagaaagaaaaggcaaa

SEQ ID NO: 6208365 - DNA, 18 bp, Homo sapiens
gagaaagaaaaggcaaaa

SEQ ID NO: 6208366 - DNA, 23 bp, Homo sapiens
gagaaagaaaaggcaaaagactg

SEQ ID NO: 6208367 - DNA, 21 bp, Homo sapiens
gagaaagaaagagaaagtact

SEQ ID NO: 6208368 - DNA, 13 bp, Homo sapiens
gagaaagaagaga

SEQ ID NO: 6208369 - DNA, 13 bp, Homo sapiens
gagaaagaaggct

SEQ ID NO: 6208370 - DNA, 19 bp, Homo sapiens
gagaaagaatttgagacgc

SEQ ID NO: 6208371 - DNA, 17 bp, Homo sapiens
gagaaagacaaaatgtg

SEQ ID NO: 6208372 - DNA, 18 bp, Homo sapiens
gagaaagacaaaatgtga

SEQ ID NO: 6208373 - DNA, 15 bp, Homo sapiens
gagaaagactattca

SEQ ID NO: 6208374 - DNA, 18 bp, Homo sapiens
gagaaagactattcaaac

SEQ ID NO: 6208375 - DNA, 12 bp, Homo sapiens
gagaaagagaac

SEQ ID NO: 6208376 - DNA, 14 bp, Homo sapiens
gagaaagagctgcc

SEQ ID NO: 6208377 - DNA, 18 bp, Homo sapiens
gagaaagagctgcctgga

SEQ ID NO: 6208378 - DNA, 16 bp, Homo sapiens
gagaaagaggaagctt

SEQ ID NO: 6208379 - DNA, 19 bp, Homo sapiens
gagaaagaggcaccaggaa

SEQ ID NO: 6208380 - DNA, 16 bp, Homo sapiens
gagaaagaggggcctg

SEQ ID NO: 6208381 - DNA, 21 bp, Homo sapiens
gagaaagatctaagcagctgg

SEQ ID NO: 6208382 - DNA, 17 bp, Homo sapiens
gagaaagatgaaactga

SEQ ID NO: 6208383 - DNA, 19 bp, Homo sapiens
gagaaagatgaaactgaaa

SEQ ID NO: 6208384 - DNA, 19 bp, Homo sapiens
gagaaagcagatcatctcc

SEQ ID NO: 6208385 - DNA, 20 bp, Homo sapiens
gagaaagccacgccctccct

SEQ ID NO: 6208386 - DNA, 15 bp, Homo sapiens
gagaaagccaggcag

SEQ ID NO: 6208387 - DNA, 16 bp, Homo sapiens
gagaaagccaggcagg

SEQ ID NO: 6208388 - DNA, 17 bp, Homo sapiens
gagaaagccgggggagg

SEQ ID NO: 6208389 - DNA, 19 bp, Homo sapiens
gagaaagcgcagatgctag

SEQ ID NO: 6208390 - DNA, 14 bp, Homo sapiens
gagaaagctcaaag

SEQ ID NO: 6208391 - DNA, 21 bp, Homo sapiens
gagaaagctgacttggctggt

SEQ ID NO: 6208392 - DNA, 16 bp, Homo sapiens
gagaaagctgtgcaga

SEQ ID NO: 6208393 - DNA, 15 bp, Homo sapiens
gagaaagcttttatt

SEQ ID NO: 6208394 - DNA, 13 bp, Homo sapiens
gagaaaggaacat

SEQ ID NO: 6208395 - DNA, 12 bp, Homo sapiens
gagaaaggacag

SEQ ID NO: 6208396 - DNA, 12 bp, Homo sapiens
gagaaaggagaa

SEQ ID NO: 6208397 - DNA, 18 bp, Homo sapiens
gagaaaggagaaattttg

SEQ ID NO: 6208398 - DNA, 21 bp, Homo sapiens
gagaaaggatggcagcctcag

SEQ ID NO: 6208399 - DNA, 16 bp, Homo sapiens
gagaaaggattaagat

SEQ ID NO: 6208400 - DNA, 17 bp, Homo sapiens
gagaaaggattaagata

SEQ ID NO: 6208401 - DNA, 18 bp, Homo sapiens
gagaaaggcctgcacaca

SEQ ID NO: 6208402 - DNA, 19 bp, Homo sapiens
gagaaagggattgctgagg

SEQ ID NO: 6208403 - DNA, 18 bp, Homo sapiens
gagaaaggggagcccact

SEQ ID NO: 6208404 - DNA, 16 bp, Homo sapiens
gagaaaggttgaagca

SEQ ID NO: 6208405 - DNA, 23 bp, Homo sapiens
gagaaagttagagtacagatcct

SEQ ID NO: 6208406 - DNA, 16 bp, Homo sapiens
gagaaataatgcattt

SEQ ID NO: 6208407 - DNA, 17 bp, Homo sapiens
gagaaatacagaagaaa

SEQ ID NO: 6208408 - DNA, 21 bp, Homo sapiens
gagaaatacagaagaaaataa

SEQ ID NO: 6208409 - DNA, 13 bp, Homo sapiens
gagaaatacagct

SEQ ID NO: 6208410 - DNA, 17 bp, Homo sapiens
gagaaatacagctggct

SEQ ID NO: 6208411 - DNA, 16 bp, Homo sapiens
gagaaatcacaggggc

SEQ ID NO: 6208412 - DNA, 19 bp, Homo sapiens
gagaaatcagaaaaattaa

SEQ ID NO: 6208413 - DNA, 15 bp, Homo sapiens
gagaaatcaggcctg

SEQ ID NO: 6208414 - DNA, 22 bp, Homo sapiens
gagaaatcatcctgttttctct

SEQ ID NO: 6208415 - DNA, 23 bp, Homo sapiens
gagaaatcatcctgttttctctg

SEQ ID NO: 6208416 - DNA, 16 bp, Homo sapiens
gagaaatgaagcagag

SEQ ID NO: 6208417 - DNA, 19 bp, Homo sapiens
gagaaatgaagcagaggaa

SEQ ID NO: 6208418 - DNA, 20 bp, Homo sapiens
gagaaatgaagcagaggaag

SEQ ID NO: 6208419 - DNA, 15 bp, Homo sapiens
gagaaatgaggaaga

SEQ ID NO: 6208420 - DNA, 17 bp, Homo sapiens
gagaaatgaggaagaat

SEQ ID NO: 6208421 - DNA, 20 bp, Homo sapiens
gagaaatgcaaatcgaaaca

SEQ ID NO: 6208422 - DNA, 13 bp, Homo sapiens
gagaaatgcaata

SEQ ID NO: 6208423 - DNA, 17 bp, Homo sapiens
gagaaatgcagagaaga

SEQ ID NO: 6208424 - DNA, 12 bp, Homo sapiens
gagaaatgcata

SEQ ID NO: 6208425 - DNA, 14 bp, Homo sapiens
gagaaatgctgttc

SEQ ID NO: 6208426 - DNA, 20 bp, Homo sapiens
gagaaatggtccgctttcct

SEQ ID NO: 6208427 - DNA, 14 bp, Homo sapiens
gagaaatggttctg

SEQ ID NO: 6208428 - DNA, 23 bp, Homo sapiens
gagaaatgtaatgcgattttatt

SEQ ID NO: 6208429 - DNA, 16 bp, Homo sapiens
gagaaatgtcataaat

SEQ ID NO: 6208430 - DNA, 17 bp, Homo sapiens
gagaaatgtgaagggtg

SEQ ID NO: 6208431 - DNA, 12 bp, Homo sapiens
gagaaattagaa

SEQ ID NO: 6208432 - DNA, 19 bp, Homo sapiens
gagaaattcgtgtgttttt

SEQ ID NO: 6208433 - DNA, 12 bp, Homo sapiens
gagaaattctgt

SEQ ID NO: 6208434 - DNA, 15 bp, Homo sapiens
gagaaattgaatgta

SEQ ID NO: 6208435 - DNA, 23 bp, Homo sapiens
gagaaatttctgtgaaacctgtg

SEQ ID NO: 6208436 - DNA, 13 bp, Homo sapiens
gagaacaaagatg

SEQ ID NO: 6208437 - DNA, 22 bp, Homo sapiens
gagaacaacaaatatgttctct

SEQ ID NO: 6208438 - DNA, 23 bp, Homo sapiens
gagaacaagaggtgctagctctt

SEQ ID NO: 6208439 - DNA, 21 bp, Homo sapiens
gagaacacaagccacgcctgc

SEQ ID NO: 6208440 - DNA, 16 bp, Homo sapiens
gagaacacactgagtg

SEQ ID NO: 6208441 - DNA, 22 bp, Homo sapiens
gagaacacctccagcttttctt

SEQ ID NO: 6208442 - DNA, 12 bp, Homo sapiens
gagaacaggact

SEQ ID NO: 6208443 - DNA, 22 bp, Homo sapiens
gagaacagtattgggcaggagg

SEQ ID NO: 6208444 - DNA, 12 bp, Homo sapiens
gagaacagtggt

SEQ ID NO: 6208445 - DNA, 20 bp, Homo sapiens
gagaacagtggttgcctggg

SEQ ID NO: 6208446 - DNA, 21 bp, Homo sapiens
gagaacagtggttgcctgggg

SEQ ID NO: 6208447 - DNA, 20 bp, Homo sapiens
gagaacagtttcatcaggac

SEQ ID NO: 6208448 - DNA, 22 bp, Homo sapiens
gagaacagtttcatcaggacca

SEQ ID NO: 6208449 - DNA, 22 bp, Homo sapiens
gagaacatctgccttgctgcac

SEQ ID NO: 6208450 - DNA, 24 bp, Homo sapiens
gagaacatctgccttgctgcacct

SEQ ID NO: 6208451 - DNA, 19 bp, Homo sapiens
gagaacatggtgtgtgtct

SEQ ID NO: 6208452 - DNA, 17 bp, Homo sapiens
gagaacatgttggtatt

SEQ ID NO: 6208453 - DNA, 17 bp, Homo sapiens
gagaacattaggcccca

SEQ ID NO: 6208454 - DNA, 19 bp, Homo sapiens
gagaacattcaatcttgcc

SEQ ID NO: 6208455 - DNA, 19 bp, Homo sapiens
gagaacattccctggaatt

SEQ ID NO: 6208456 - DNA, 12 bp, Homo sapiens
gagaacatttta

SEQ ID NO: 6208457 - DNA, 18 bp, Homo sapiens
gagaaccaaatctggaag

SEQ ID NO: 6208458 - DNA, 16 bp, Homo sapiens
gagaaccaccactgcc

SEQ ID NO: 6208459 - DNA, 14 bp, Homo sapiens
gagaaccaggaggg

SEQ ID NO: 6208460 - DNA, 14 bp, Homo sapiens
gagaaccatgtgct

SEQ ID NO: 6208461 - DNA, 21 bp, Homo sapiens
gagaaccccccgcaatgtgct

SEQ ID NO: 6208462 - DNA, 21 bp, Homo sapiens
gagaaccctgcgtggggacag

SEQ ID NO: 6208463 - DNA, 15 bp, Homo sapiens
gagaacccttcctgc

SEQ ID NO: 6208464 - DNA, 23 bp, Homo sapiens
gagaacctcaggtacggagaaga

SEQ ID NO: 6208465 - DNA, 15 bp, Homo sapiens
gagaaccttttcaaa

SEQ ID NO: 6208466 - DNA, 13 bp, Homo sapiens
gagaacgcagccc

SEQ ID NO: 6208467 - DNA, 14 bp, Homo sapiens
gagaacgcagccct

SEQ ID NO: 6208468 - DNA, 24 bp, Homo sapiens
gagaacgcagccctagagcctgcc

SEQ ID NO: 6208469 - DNA, 16 bp, Homo sapiens
gagaacgccagtctcc

SEQ ID NO: 6208470 - DNA, 15 bp, Homo sapiens
gagaacgtatcaata

SEQ ID NO: 6208471 - DNA, 22 bp, Homo sapiens
gagaactagtggtggctctgag

SEQ ID NO: 6208472 - DNA, 17 bp, Homo sapiens
gagaactcagaagagaa

SEQ ID NO: 6208473 - DNA, 23 bp, Homo sapiens
gagaactcatccctaatgctgca

SEQ ID NO: 6208474 - DNA, 13 bp, Homo sapiens
gagaactccagct

SEQ ID NO: 6208475 - DNA, 15 bp, Homo sapiens
gagaactcctagggt

SEQ ID NO: 6208476 - DNA, 17 bp, Homo sapiens
gagaactcgaagccctt

SEQ ID NO: 6208477 - DNA, 18 bp, Homo sapiens
gagaactcgaagcccttc

SEQ ID NO: 6208478 - DNA, 20 bp, Homo sapiens
gagaactcgcgctcagtaaa

SEQ ID NO: 6208479 - DNA, 21 bp, Homo sapiens
gagaactcgttcacctccaag

SEQ ID NO: 6208480 - DNA, 14 bp, Homo sapiens
gagaactctggctt

SEQ ID NO: 6208481 - DNA, 11 bp, Homo sapiens
gagaactgaaa

SEQ ID NO: 6208482 - DNA, 16 bp, Homo sapiens
gagaactgaaaagaga

SEQ ID NO: 6208483 - DNA, 18 bp, Homo sapiens
gagaactgaaaagagagc

SEQ ID NO: 6208484 - DNA, 21 bp, Homo sapiens
gagaactgaattttgggactt

SEQ ID NO: 6208485 - DNA, 11 bp, Homo sapiens
gagaactgact

SEQ ID NO: 6208486 - DNA, 22 bp, Homo sapiens
gagaactgaggagcggactcac

SEQ ID NO: 6208487 - DNA, 19 bp, Homo sapiens
gagaactgcatatgtttcg

SEQ ID NO: 6208488 - DNA, 20 bp, Homo sapiens
gagaactgtgaatatgtgta

SEQ ID NO: 6208489 - DNA, 13 bp, Homo sapiens
gagaactgtgctc

SEQ ID NO: 6208490 - DNA, 15 bp, Homo sapiens
gagaactgtggccgt

SEQ ID NO: 6208491 - DNA, 21 bp, Homo sapiens
gagaacttaagtggctaaaga

SEQ ID NO: 6208492 - DNA, 14 bp, Homo sapiens
gagaacttgaacaa

SEQ ID NO: 6208493 - DNA, 14 bp, Homo sapiens
gagaacttgctgcc

SEQ ID NO: 6208494 - DNA, 16 bp, Homo sapiens
gagaacttgctgcctc

SEQ ID NO: 6208495 - DNA, 19 bp, Homo sapiens
gagaactttattttggatt

SEQ ID NO: 6208496 - DNA, 22 bp, Homo sapiens
gagaactttcggagcctgcctc

SEQ ID NO: 6208497 - DNA, 12 bp, Homo sapiens
gagaactttctt

SEQ ID NO: 6208498 - DNA, 13 bp, Homo sapiens
gagaacttttcat

SEQ ID NO: 6208499 - DNA, 20 bp, Homo sapiens
gagaacttttcatagatgaa

SEQ ID NO: 6208500 - DNA, 15 bp, Homo sapiens
gagaagaaaaatgga

SEQ ID NO: 6208501 - DNA, 21 bp, Homo sapiens
gagaagaaagaagcactctgc

SEQ ID NO: 6208502 - DNA, 15 bp, Homo sapiens
gagaagaaatagact

SEQ ID NO: 6208503 - DNA, 16 bp, Homo sapiens
ctttcttttgtgttgg

SEQ ID NO: 6208504 - DNA, 10 bp, Homo sapiens
ctttcttttt

SEQ ID NO: 6208505 - DNA, 16 bp, Homo sapiens
ctttctttttctacat

SEQ ID NO: 6208506 - DNA, 16 bp, Homo sapiens
ctttctttttctggaa

SEQ ID NO: 6208507 - DNA, 17 bp, Homo sapiens
ctttctttttctggaaa

SEQ ID NO: 6208508 - DNA, 18 bp, Homo sapiens
ctttctttttctggaaat

SEQ ID NO: 6208509 - DNA, 19 bp, Homo sapiens
ctttctttttctgtctctc

SEQ ID NO: 6208510 - DNA, 20 bp, Homo sapiens
ctttctttttgaatctctca

SEQ ID NO: 6208511 - DNA, 16 bp, Homo sapiens
ctttctttttgtagct

SEQ ID NO: 6208512 - DNA, 22 bp, Homo sapiens
ctttcttttttttttattatgg

SEQ ID NO: 6208513 - DNA, 13 bp, Homo sapiens
ctttgaaaaagcc

SEQ ID NO: 6208514 - DNA, 23 bp, Homo sapiens
ctttgaaaaagttaatgcttaag

SEQ ID NO: 6208515 - DNA, 20 bp, Homo sapiens
ctttgaaaaatctcattatt

SEQ ID NO: 6208516 - DNA, 13 bp, Homo sapiens
ctttgaaaagaaa

SEQ ID NO: 6208517 - DNA, 19 bp, Homo sapiens
ctttgaaaagttggaagga

SEQ ID NO: 6208518 - DNA, 12 bp, Homo sapiens
ctttgaaaatac

SEQ ID NO: 6208519 - DNA, 20 bp, Homo sapiens
ctttgaaaatatttctatgt

SEQ ID NO: 6208520 - DNA, 21 bp, Homo sapiens
ctttgaaaatatttctatgta

SEQ ID NO: 6208521 - DNA, 20 bp, Homo sapiens
ctttgaaacctcagggctgt

SEQ ID NO: 6208522 - DNA, 17 bp, Homo sapiens
ctttgaaacctgctctg

SEQ ID NO: 6208523 - DNA, 15 bp, Homo sapiens
ctttgaaactagact

SEQ ID NO: 6208524 - DNA, 22 bp, Homo sapiens
ctttgaaactggaataagtgtt

SEQ ID NO: 6208525 - DNA, 14 bp, Homo sapiens
ctttgaaagaagca

SEQ ID NO: 6208526 - DNA, 17 bp, Homo sapiens
ctttgaaagaagcaaga

SEQ ID NO: 6208527 - DNA, 21 bp, Homo sapiens
ctttgaaagacttccaaagaa

SEQ ID NO: 6208528 - DNA, 19 bp, Homo sapiens
ctttgaaagccccagaaat

SEQ ID NO: 6208529 - DNA, 15 bp, Homo sapiens
ctttgaaataaaaaa

SEQ ID NO: 6208530 - DNA, 13 bp, Homo sapiens
ctttgaaatacct

SEQ ID NO: 6208531 - DNA, 22 bp, Homo sapiens
ctttgaaatacctcatgtttat

SEQ ID NO: 6208532 - DNA, 23 bp, Homo sapiens
ctttgaaatatatggtctaatgt

SEQ ID NO: 6208533 - DNA, 16 bp, Homo sapiens
ctttgaaatgaatata

SEQ ID NO: 6208534 - DNA, 18 bp, Homo sapiens
ctttgaaatgctaaactt

SEQ ID NO: 6208535 - DNA, 21 bp, Homo sapiens
ctttgaaatgtgtttctgtat

SEQ ID NO: 6208536 - DNA, 22 bp, Homo sapiens
ctttgaaatgtgtttctgtata

SEQ ID NO: 6208537 - DNA, 18 bp, Homo sapiens
ctttgaaattgaaccttt

SEQ ID NO: 6208538 - DNA, 21 bp, Homo sapiens
ctttgaacattaatgttgaaa

SEQ ID NO: 6208539 - DNA, 18 bp, Homo sapiens
ctttgaacctcagcaaga

SEQ ID NO: 6208540 - DNA, 18 bp, Homo sapiens
ctttgaacgtgcttcttt

SEQ ID NO: 6208541 - DNA, 21 bp, Homo sapiens
ctttgaacgtgcttctttgta

SEQ ID NO: 6208542 - DNA, 24 bp, Homo sapiens
ctttgaactgaaacttttctaaag

SEQ ID NO: 6208543 - DNA, 16 bp, Homo sapiens
ctttgaactgcagcaa

SEQ ID NO: 6208544 - DNA, 14 bp, Homo sapiens
ctttgaactttagt

SEQ ID NO: 6208545 - DNA, 19 bp, Homo sapiens
ctttgaagaaggaatcttt

SEQ ID NO: 6208546 - DNA, 14 bp, Homo sapiens
ctttgaagaaggca

SEQ ID NO: 6208547 - DNA, 13 bp, Homo sapiens
ctttgaagaggaa

SEQ ID NO: 6208548 - DNA, 18 bp, Homo sapiens
ctttgaagagtgaaatac

SEQ ID NO: 6208549 - DNA, 23 bp, Homo sapiens
ctttgaagcatagctacaatttg

SEQ ID NO: 6208550 - DNA, 11 bp, Homo sapiens
ctttgaagcca

SEQ ID NO: 6208551 - DNA, 13 bp, Homo sapiens
ctttgaagcctca

SEQ ID NO: 6208552 - DNA, 19 bp, Homo sapiens
ctttgaagctgaaaatata

SEQ ID NO: 6208553 - DNA, 23 bp, Homo sapiens
ctttgaagctgaaaatataaaac

SEQ ID NO: 6208554 - DNA, 17 bp, Homo sapiens
ctttgaaggtaataaat

SEQ ID NO: 6208555 - DNA, 18 bp, Homo sapiens
ctttgaaggtaataaata

SEQ ID NO: 6208556 - DNA, 22 bp, Homo sapiens
ctttgaaggtaataaatacaca

SEQ ID NO: 6208557 - DNA, 18 bp, Homo sapiens
ctttgaagtgcagctcat

SEQ ID NO: 6208558 - DNA, 19 bp, Homo sapiens
ctttgaagtgcctctgatt

SEQ ID NO: 6208559 - DNA, 21 bp, Homo sapiens
ctttgaagttagctttaactt

SEQ ID NO: 6208560 - DNA, 11 bp, Homo sapiens
ctttgaataaa

SEQ ID NO: 6208561 - DNA, 18 bp, Homo sapiens
ctttgaataaagaatact

SEQ ID NO: 6208562 - DNA, 17 bp, Homo sapiens
ctttgaataaagtctga

SEQ ID NO: 6208563 - DNA, 20 bp, Homo sapiens
ctttgaataaagtctgagtg

SEQ ID NO: 6208564 - DNA, 16 bp, Homo sapiens
ctttgaataaatgtgt

SEQ ID NO: 6208565 - DNA, 18 bp, Homo sapiens
ctttgaatacccccagag

SEQ ID NO: 6208566 - DNA, 19 bp, Homo sapiens
ctttgaatacccccagaga

SEQ ID NO: 6208567 - DNA, 23 bp, Homo sapiens
ctttgaatacccccagagacctt

SEQ ID NO: 6208568 - DNA, 20 bp, Homo sapiens
ctttgaatagtcctaaaaag

SEQ ID NO: 6208569 - DNA, 15 bp, Homo sapiens
ctttgaatcaaaata

SEQ ID NO: 6208570 - DNA, 16 bp, Homo sapiens
ctttgaatctctgtat

SEQ ID NO: 6208571 - DNA, 15 bp, Homo sapiens
ctttgaatgacaaag

SEQ ID NO: 6208572 - DNA, 18 bp, Homo sapiens
ctttgaatgcagaagcaa

SEQ ID NO: 6208573 - DNA, 21 bp, Homo sapiens
ctttgaatgcagaagcaaaca

SEQ ID NO: 6208574 - DNA, 16 bp, Homo sapiens
ctttgaatgcatgtgt

SEQ ID NO: 6208575 - DNA, 14 bp, Homo sapiens
ctttgaatgtaacc

SEQ ID NO: 6208576 - DNA, 23 bp, Homo sapiens
ctttgaatgtgtttcacagtttg

SEQ ID NO: 6208577 - DNA, 13 bp, Homo sapiens
ctttgaatgttaa

SEQ ID NO: 6208578 - DNA, 14 bp, Homo sapiens
ctttgaatgttaat

SEQ ID NO: 6208579 - DNA, 21 bp, Homo sapiens
ctttgaattatttctttatta

SEQ ID NO: 6208580 - DNA, 17 bp, Homo sapiens
ctttgaatttatataaa

SEQ ID NO: 6208581 - DNA, 14 bp, Homo sapiens
ctttgacaaaagta

SEQ ID NO: 6208582 - DNA, 18 bp, Homo sapiens
ctttgacaaaatgactgg

SEQ ID NO: 6208583 - DNA, 17 bp, Homo sapiens
ctttgacaaaggtaaat

SEQ ID NO: 6208584 - DNA, 16 bp, Homo sapiens
ctttgacaactaaaat

SEQ ID NO: 6208585 - DNA, 19 bp, Homo sapiens
ctttgacaattctgggtgc

SEQ ID NO: 6208586 - DNA, 20 bp, Homo sapiens
ctttgacaattctgggtgcg

SEQ ID NO: 6208587 - DNA, 21 bp, Homo sapiens
ctttgacaattgggagctgcc

SEQ ID NO: 6208588 - DNA, 14 bp, Homo sapiens
ctttgacacccagg

SEQ ID NO: 6208589 - DNA, 13 bp, Homo sapiens
ctttgacatgaaa

SEQ ID NO: 6208590 - DNA, 16 bp, Homo sapiens
ctttgacatgaaaaga

SEQ ID NO: 6208591 - DNA, 23 bp, Homo sapiens
ctttgacatttccttctttgtct

SEQ ID NO: 6208592 - DNA, 21 bp, Homo sapiens
ctttgaccagatctttctctt

SEQ ID NO: 6208593 - DNA, 21 bp, Homo sapiens
ctttgacctaaattatttact

SEQ ID NO: 6208594 - DNA, 18 bp, Homo sapiens
ctttgacctcaacctgtg

SEQ ID NO: 6208595 - DNA, 21 bp, Homo sapiens
ctttgacctcaatggaggttt

SEQ ID NO: 6208596 - DNA, 14 bp, Homo sapiens
ctttgacctctgca

SEQ ID NO: 6208597 - DNA, 15 bp, Homo sapiens
ctttgacctctgcag

SEQ ID NO: 6208598 - DNA, 24 bp, Homo sapiens
ctttgacctctgcagcaataaagc

SEQ ID NO: 6208599 - DNA, 21 bp, Homo sapiens
ctttgacctgacgatcttccc

SEQ ID NO: 6208600 - DNA, 23 bp, Homo sapiens
ctttgacctgcctcccttcatgc

SEQ ID NO: 6208601 - DNA, 15 bp, Homo sapiens
ctttgacctgttcag

SEQ ID NO: 6208602 - DNA, 16 bp, Homo sapiens
ctttgacgccatccca

SEQ ID NO: 6208603 - DNA, 21 bp, Homo sapiens
ctttgacgccatcccagcccc

SEQ ID NO: 6208604 - DNA, 16 bp, Homo sapiens
ctttgacgggccaggc

SEQ ID NO: 6208605 - DNA, 21 bp, Homo sapiens
ctttgacgggccaggccctgg

SEQ ID NO: 6208606 - DNA, 21 bp, Homo sapiens
ctttgacgtaattaaatccaa

SEQ ID NO: 6208607 - DNA, 14 bp, Homo sapiens
ctttgactcacctg

SEQ ID NO: 6208608 - DNA, 18 bp, Homo sapiens
ctttgactcagaggctgg

SEQ ID NO: 6208609 - DNA, 22 bp, Homo sapiens
ctttgactcagaggctgggagc

SEQ ID NO: 6208610 - DNA, 20 bp, Homo sapiens
ctttgactctataagcaaat

SEQ ID NO: 6208611 - DNA, 21 bp, Homo sapiens
ctttgactcttttgccattaa

SEQ ID NO: 6208612 - DNA, 12 bp, Homo sapiens
ctttgactgaaa

SEQ ID NO: 6208613 - DNA, 21 bp, Homo sapiens
ctttgactgatgctgagattc

SEQ ID NO: 6208614 - DNA, 15 bp, Homo sapiens
ctttgacttcagctg

SEQ ID NO: 6208615 - DNA, 18 bp, Homo sapiens
ctttgacttcttgcttca

SEQ ID NO: 6208616 - DNA, 16 bp, Homo sapiens
ctttgactttctgtgt

SEQ ID NO: 6208617 - DNA, 15 bp, Homo sapiens
ctttgactttttgca

SEQ ID NO: 6208618 - DNA, 19 bp, Homo sapiens
ctttgagaaaggattaaga

SEQ ID NO: 6208619 - DNA, 23 bp, Homo sapiens
ctttgagaactgcttctaagatg

SEQ ID NO: 6208620 - DNA, 15 bp, Homo sapiens
ctttgagaagccttc

SEQ ID NO: 6208621 - DNA, 22 bp, Homo sapiens
ctttgagaagccttcagctcca

SEQ ID NO: 6208622 - DNA, 20 bp, Homo sapiens
ctttgagaagctcagctgcc

SEQ ID NO: 6208623 - DNA, 17 bp, Homo sapiens
ctttgagaatattataa

SEQ ID NO: 6208624 - DNA, 17 bp, Homo sapiens
ctttgagaatgtgattc

SEQ ID NO: 6208625 - DNA, 18 bp, Homo sapiens
ctttgagacaggtgcctg

SEQ ID NO: 6208626 - DNA, 19 bp, Homo sapiens
ctttgagacaggtgcctgg

SEQ ID NO: 6208627 - DNA, 21 bp, Homo sapiens
ctttgagacaggtgcctgggg

SEQ ID NO: 6208628 - DNA, 15 bp, Homo sapiens
ctttgagacagtttc

SEQ ID NO: 6208629 - DNA, 17 bp, Homo sapiens
ctttgagaccagaagaa

SEQ ID NO: 6208630 - DNA, 21 bp, Homo sapiens
ctttgagaccagaagaaaaga

SEQ ID NO: 6208631 - DNA, 22 bp, Homo sapiens
ctttgagaccccagtgcctgca

SEQ ID NO: 6208632 - DNA, 18 bp, Homo sapiens
ctttgagacctttcctct

SEQ ID NO: 6208633 - DNA, 18 bp, Homo sapiens
ctttgagactcctcagca

SEQ ID NO: 6208634 - DNA, 15 bp, Homo sapiens
ctttgagagacgcca

SEQ ID NO: 6208635 - DNA, 15 bp, Homo sapiens
ctttgagaggctgag

SEQ ID NO: 6208636 - DNA, 17 bp, Homo sapiens
ctttgagaggctgaggt

SEQ ID NO: 6208637 - DNA, 17 bp, Homo sapiens
ctttgagataatacatt

SEQ ID NO: 6208638 - DNA, 20 bp, Homo sapiens
ctttgagataatacattccg

SEQ ID NO: 6208639 - DNA, 20 bp, Homo sapiens
ctttgagatagaagaactgc

SEQ ID NO: 6208640 - DNA, 19 bp, Homo sapiens
ctttgagatctaaaaataa

SEQ ID NO: 6208641 - DNA, 22 bp, Homo sapiens
ctttgagatctaaaaataactg

SEQ ID NO: 6208642 - DNA, 21 bp, Homo sapiens
ctttgagatctggggaggcag

SEQ ID NO: 6208643 - DNA, 16 bp, Homo sapiens
ctttgagatgtgttcc

SEQ ID NO: 6208644 - DNA, 21 bp, Homo sapiens
ctttgagatgtgttcctcctg

SEQ ID NO: 6208645 - DNA, 22 bp, Homo sapiens
ctttgagatgtgttcctcctgc

SEQ ID NO: 6208646 - DNA, 16 bp, Homo sapiens
ctttgagcccacagga

SEQ ID NO: 6208647 - DNA, 21 bp, Homo sapiens
ctttgagcccattcttctggg

SEQ ID NO: 6208648 - DNA, 19 bp, Homo sapiens
ctttgagcctgcatcttct

SEQ ID NO: 6208649 - DNA, 19 bp, Homo sapiens
ctttgagcctgggaaataa

SEQ ID NO: 6208650 - DNA, 23 bp, Homo sapiens
ctttgagctcccacttctgccag

SEQ ID NO: 6208651 - DNA, 14 bp, Homo sapiens
ctttgagcttctcc

SEQ ID NO: 6208652 - DNA, 18 bp, Homo sapiens
ctttgagcttctcctctg

SEQ ID NO: 6208653 - DNA, 20 bp, Homo sapiens
ctttgagcttctcctctgct

SEQ ID NO: 6208654 - DNA, 19 bp, Homo sapiens
ctttgaggaggaagcagaa

SEQ ID NO: 6208655 - DNA, 23 bp, Homo sapiens
ctttgaggcagcgcattgttttg

SEQ ID NO: 6208656 - DNA, 17 bp, Homo sapiens
ctttgaggccccaactc

SEQ ID NO: 6208657 - DNA, 19 bp, Homo sapiens
ctttgaggctctgtcactg

SEQ ID NO: 6208658 - DNA, 19 bp, Homo sapiens
ctttgagggactgcctctg

SEQ ID NO: 6208659 - DNA, 22 bp, Homo sapiens
ctttgagggactgcctctgcca

SEQ ID NO: 6208660 - DNA, 12 bp, Homo sapiens
ctttgaggtcta

SEQ ID NO: 6208661 - DNA, 14 bp, Homo sapiens
ctttgaggtggaag

SEQ ID NO: 6208662 - DNA, 16 bp, Homo sapiens
ctttgaggtggaagag

SEQ ID NO: 6208663 - DNA, 22 bp, Homo sapiens
ctttgaggtggaagagggctgc

SEQ ID NO: 6208664 - DNA, 12 bp, Homo sapiens
ctttgaggtttt

SEQ ID NO: 6208665 - DNA, 14 bp, Homo sapiens
ctttgagtccacgc

SEQ ID NO: 6208666 - DNA, 23 bp, Homo sapiens
ctttgagtccacgcccaccagcc

SEQ ID NO: 6208667 - DNA, 19 bp, Homo sapiens
ctttgagtcccccagagat

SEQ ID NO: 6208668 - DNA, 20 bp, Homo sapiens
ctttgagtcccccagagatg

SEQ ID NO: 6208669 - DNA, 21 bp, Homo sapiens
ctttgagtgcagtcctgatca

SEQ ID NO: 6208670 - DNA, 17 bp, Homo sapiens
ctttgagtgtcaggctc

SEQ ID NO: 6208671 - DNA, 20 bp, Homo sapiens
ctttgagtgtcaggctctga

SEQ ID NO: 6208672 - DNA, 13 bp, Homo sapiens
ctttgagttatag

SEQ ID NO: 6208673 - DNA, 16 bp, Homo sapiens
ctttgagtttcctcag

SEQ ID NO: 6208674 - DNA, 15 bp, Homo sapiens
ctttgagttttaaat

SEQ ID NO: 6208675 - DNA, 21 bp, Homo sapiens
ctttgagttttaaattatgta

SEQ ID NO: 6208676 - DNA, 18 bp, Homo sapiens
ctttgataaaataaatga

SEQ ID NO: 6208677 - DNA, 14 bp, Homo sapiens
ctttgataaaatat

SEQ ID NO: 6208678 - DNA, 15 bp, Homo sapiens
ctttgataaagtaaa

SEQ ID NO: 6208679 - DNA, 18 bp, Homo sapiens
gagaagaacaagaaatgg

SEQ ID NO: 6208680 - DNA, 13 bp, Homo sapiens
gagaagaactgaa

SEQ ID NO: 6208681 - DNA, 16 bp, Homo sapiens
gagaagaactgaaatc

SEQ ID NO: 6208682 - DNA, 11 bp, Homo sapiens
gagaagaagaa

SEQ ID NO: 6208683 - DNA, 16 bp, Homo sapiens
gagaagaagctgagga

SEQ ID NO: 6208684 - DNA, 11 bp, Homo sapiens
gagaagaatag

SEQ ID NO: 6208685 - DNA, 19 bp, Homo sapiens
gagaagacttccccaagcc

SEQ ID NO: 6208686 - DNA, 14 bp, Homo sapiens
gagaagagaaaatg

SEQ ID NO: 6208687 - DNA, 19 bp, Homo sapiens
gagaagagagaaatagcct

SEQ ID NO: 6208688 - DNA, 21 bp, Homo sapiens
gagaagagccccactctcaga

SEQ ID NO: 6208689 - DNA, 21 bp, Homo sapiens
gagaagagcttgcacagccaa

SEQ ID NO: 6208690 - DNA, 12 bp, Homo sapiens
gagaagaggagc

SEQ ID NO: 6208691 - DNA, 13 bp, Homo sapiens
gagaagaggagga

SEQ ID NO: 6208692 - DNA, 15 bp, Homo sapiens
gagaagaggaggagg

SEQ ID NO: 6208693 - DNA, 21 bp, Homo sapiens
gagaagaggaggaggtggggg

SEQ ID NO: 6208694 - DNA, 13 bp, Homo sapiens
gagaagaggctgg

SEQ ID NO: 6208695 - DNA, 18 bp, Homo sapiens
gagaagagggcccagccc

SEQ ID NO: 6208696 - DNA, 20 bp, Homo sapiens
gagaagagggcccagcccag

SEQ ID NO: 6208697 - DNA, 15 bp, Homo sapiens
gagaagaggtccttg

SEQ ID NO: 6208698 - DNA, 14 bp, Homo sapiens
gagaagagtatttt

SEQ ID NO: 6208699 - DNA, 20 bp, Homo sapiens
gagaagagtgccctgctttg

SEQ ID NO: 6208700 - DNA, 14 bp, Homo sapiens
gagaagagttttct

SEQ ID NO: 6208701 - DNA, 16 bp, Homo sapiens
gagaagatcgcatggc

SEQ ID NO: 6208702 - DNA, 20 bp, Homo sapiens
gagaagatggatatgaccag

SEQ ID NO: 6208703 - DNA, 15 bp, Homo sapiens
gagaagatggcactg

SEQ ID NO: 6208704 - DNA, 21 bp, Homo sapiens
gagaagatggcactgtccagg

SEQ ID NO: 6208705 - DNA, 17 bp, Homo sapiens
gagaagatgtgatttat

SEQ ID NO: 6208706 - DNA, 23 bp, Homo sapiens
gagaagatgttaattacttttga

SEQ ID NO: 6208707 - DNA, 20 bp, Homo sapiens
gagaagcacagctcctgcca

SEQ ID NO: 6208708 - DNA, 15 bp, Homo sapiens
gagaagcaccccacc

SEQ ID NO: 6208709 - DNA, 12 bp, Homo sapiens
gagaagcactgt

SEQ ID NO: 6208710 - DNA, 15 bp, Homo sapiens
gagaagcagcctcct

SEQ ID NO: 6208711 - DNA, 18 bp, Homo sapiens
gagaagcattctcattgg

SEQ ID NO: 6208712 - DNA, 18 bp, Homo sapiens
gagaagccaagcctggag

SEQ ID NO: 6208713 - DNA, 12 bp, Homo sapiens
gagaagccaagg

SEQ ID NO: 6208714 - DNA, 15 bp, Homo sapiens
gagaagccaccttcc

SEQ ID NO: 6208715 - DNA, 11 bp, Homo sapiens
gagaagccagc

SEQ ID NO: 6208716 - DNA, 14 bp, Homo sapiens
gagaagccagccac

SEQ ID NO: 6208717 - DNA, 13 bp, Homo sapiens
gagaagccagctt

SEQ ID NO: 6208718 - DNA, 15 bp, Homo sapiens
gagaagccagcttgt

SEQ ID NO: 6208719 - DNA, 22 bp, Homo sapiens
gagaagccagctttcctcatca

SEQ ID NO: 6208720 - DNA, 22 bp, Homo sapiens
gagaagccaggaatttcccagg

SEQ ID NO: 6208721 - DNA, 23 bp, Homo sapiens
gagaagccagtgtctaggcactg

SEQ ID NO: 6208722 - DNA, 20 bp, Homo sapiens
gagaagccatcacctcagat

SEQ ID NO: 6208723 - DNA, 22 bp, Homo sapiens
gagaagccatcacctcagatgg

SEQ ID NO: 6208724 - DNA, 15 bp, Homo sapiens
gagaagccattgtct

SEQ ID NO: 6208725 - DNA, 20 bp, Homo sapiens
gagaagccattgtcttcgga

SEQ ID NO: 6208726 - DNA, 19 bp, Homo sapiens
gagaagccggctcttcaaa

SEQ ID NO: 6208727 - DNA, 16 bp, Homo sapiens
gagaagcctcatggga

SEQ ID NO: 6208728 - DNA, 18 bp, Homo sapiens
gagaagcctcatgggagt

SEQ ID NO: 6208729 - DNA, 22 bp, Homo sapiens
gagaagcctgggtggctcagca

SEQ ID NO: 6208730 - DNA, 18 bp, Homo sapiens
gagaagccttcaagctct

SEQ ID NO: 6208731 - DNA, 17 bp, Homo sapiens
gagaagcgctgccctgt

SEQ ID NO: 6208732 - DNA, 19 bp, Homo sapiens
gagaagcgctgccctgtga

SEQ ID NO: 6208733 - DNA, 16 bp, Homo sapiens
gagaagcggatttcca

SEQ ID NO: 6208734 - DNA, 17 bp, Homo sapiens
gagaagcggctggcagc

SEQ ID NO: 6208735 - DNA, 20 bp, Homo sapiens
gagaagcggtggataactag

SEQ ID NO: 6208736 - DNA, 15 bp, Homo sapiens
gagaagcgtttttaa

SEQ ID NO: 6208737 - DNA, 19 bp, Homo sapiens
gagaagctaaaacctgagc

SEQ ID NO: 6208738 - DNA, 20 bp, Homo sapiens
gagaagctaaaacctgagct

SEQ ID NO: 6208739 - DNA, 20 bp, Homo sapiens
gagaagctaatatgattttt

SEQ ID NO: 6208740 - DNA, 17 bp, Homo sapiens
gagaagctcagctgcat

SEQ ID NO: 6208741 - DNA, 19 bp, Homo sapiens
gagaagctcctctccccag

SEQ ID NO: 6208742 - DNA, 13 bp, Homo sapiens
gagaagctctgaa

SEQ ID NO: 6208743 - DNA, 17 bp, Homo sapiens
gagaagctgaagccccc

SEQ ID NO: 6208744 - DNA, 16 bp, Homo sapiens
gagaagctgaggccta

SEQ ID NO: 6208745 - DNA, 20 bp, Homo sapiens
gagaagctgctccaggcctg

SEQ ID NO: 6208746 - DNA, 17 bp, Homo sapiens
gagaagctgctgaccaa

SEQ ID NO: 6208747 - DNA, 17 bp, Homo sapiens
gagaagctggacttctg

SEQ ID NO: 6208748 - DNA, 12 bp, Homo sapiens
gagaagctgtgt

SEQ ID NO: 6208749 - DNA, 21 bp, Homo sapiens
gagaagctttttttcttgcta

SEQ ID NO: 6208750 - DNA, 15 bp, Homo sapiens
gagaaggaaaaagaa

SEQ ID NO: 6208751 - DNA, 12 bp, Homo sapiens
gagaaggaaaac

SEQ ID NO: 6208752 - DNA, 15 bp, Homo sapiens
gagaaggaaagcttt

SEQ ID NO: 6208753 - DNA, 12 bp, Homo sapiens
gagaaggaagcc

SEQ ID NO: 6208754 - DNA, 13 bp, Homo sapiens
gagaaggaagcca

SEQ ID NO: 6208755 - DNA, 14 bp, Homo sapiens
gagaaggaaggaga

SEQ ID NO: 6208756 - DNA, 21 bp, Homo sapiens
gagaaggaaggagactcacct

SEQ ID NO: 6208757 - DNA, 12 bp, Homo sapiens
gagaaggaaggg

SEQ ID NO: 6208758 - DNA, 14 bp, Homo sapiens
gagaaggaagggca

SEQ ID NO: 6208759 - DNA, 16 bp, Homo sapiens
gagaaggaatgtcttt

SEQ ID NO: 6208760 - DNA, 22 bp, Homo sapiens
gagaaggacccggaggggcctg

SEQ ID NO: 6208761 - DNA, 21 bp, Homo sapiens
gagaaggacggtgccaagggc

SEQ ID NO: 6208762 - DNA, 12 bp, Homo sapiens
gagaaggagaga

SEQ ID NO: 6208763 - DNA, 15 bp, Homo sapiens
gagaaggagaggctc

SEQ ID NO: 6208764 - DNA, 15 bp, Homo sapiens
gagaaggagagggag

SEQ ID NO: 6208765 - DNA, 11 bp, Homo sapiens
gagaaggagcc

SEQ ID NO: 6208766 - DNA, 12 bp, Homo sapiens
gagaaggaggaa

SEQ ID NO: 6208767 - DNA, 20 bp, Homo sapiens
gagaaggatagcctcagcca

SEQ ID NO: 6208768 - DNA, 17 bp, Homo sapiens
gagaaggattctttttt

SEQ ID NO: 6208769 - DNA, 18 bp, Homo sapiens
gagaaggcaagctggcag

SEQ ID NO: 6208770 - DNA, 20 bp, Homo sapiens
gagaaggcaagctggcagga

SEQ ID NO: 6208771 - DNA, 20 bp, Homo sapiens
gagaaggcagagaaaacaca

SEQ ID NO: 6208772 - DNA, 12 bp, Homo sapiens
gagaaggcagcc

SEQ ID NO: 6208773 - DNA, 17 bp, Homo sapiens
gagaaggccccagggca

SEQ ID NO: 6208774 - DNA, 19 bp, Homo sapiens
gagaaggccccagggcagc

SEQ ID NO: 6208775 - DNA, 17 bp, Homo sapiens
gagaaggccctgtgccc

SEQ ID NO: 6208776 - DNA, 18 bp, Homo sapiens
gagaaggccctgtgccct

SEQ ID NO: 6208777 - DNA, 15 bp, Homo sapiens
gagaaggcctcccct

SEQ ID NO: 6208778 - DNA, 16 bp, Homo sapiens
gagaaggcctcccctg

SEQ ID NO: 6208779 - DNA, 21 bp, Homo sapiens
gagaaggcctgccccccttcc

SEQ ID NO: 6208780 - DNA, 13 bp, Homo sapiens
gagaaggcctggt

SEQ ID NO: 6208781 - DNA, 18 bp, Homo sapiens
gagaaggcctggtcagca

SEQ ID NO: 6208782 - DNA, 18 bp, Homo sapiens
gagaaggctaaagaagac

SEQ ID NO: 6208783 - DNA, 13 bp, Homo sapiens
gagaaggctatgt

SEQ ID NO: 6208784 - DNA, 23 bp, Homo sapiens
gagaagggaagaaggggccatca

SEQ ID NO: 6208785 - DNA, 20 bp, Homo sapiens
gagaagggataaccctacac

SEQ ID NO: 6208786 - DNA, 14 bp, Homo sapiens
gagaagggccagcc

SEQ ID NO: 6208787 - DNA, 20 bp, Homo sapiens
gagaagggccaggccggcag

SEQ ID NO: 6208788 - DNA, 15 bp, Homo sapiens
gagaagggcctgctc

SEQ ID NO: 6208789 - DNA, 19 bp, Homo sapiens
gagaagggcctgctctgct

SEQ ID NO: 6208790 - DNA, 22 bp, Homo sapiens
gagaagggctcagagaggacaa

SEQ ID NO: 6208791 - DNA, 23 bp, Homo sapiens
gagaagggctcagagaggacaaa

SEQ ID NO: 6208792 - DNA, 21 bp, Homo sapiens
gagaaggggaaaaatgggaaa

SEQ ID NO: 6208793 - DNA, 17 bp, Homo sapiens
gagaaggggaagcactc

SEQ ID NO: 6208794 - DNA, 15 bp, Homo sapiens
gagaagggggattgg

SEQ ID NO: 6208795 - DNA, 21 bp, Homo sapiens
gagaagggggattggagggaa

SEQ ID NO: 6208796 - DNA, 17 bp, Homo sapiens
gagaagggggctctgcc

SEQ ID NO: 6208797 - DNA, 22 bp, Homo sapiens
gagaagggggtcaaagcaagga

SEQ ID NO: 6208798 - DNA, 23 bp, Homo sapiens
gagaagggttagacaagcctgga

SEQ ID NO: 6208799 - DNA, 13 bp, Homo sapiens
gagaagggttctg

SEQ ID NO: 6208800 - DNA, 17 bp, Homo sapiens
gagaagggttctgccct

SEQ ID NO: 6208801 - DNA, 23 bp, Homo sapiens
gagaagggttctgccctgcctga

SEQ ID NO: 6208802 - DNA, 22 bp, Homo sapiens
gagaaggtcacaacccttctct

SEQ ID NO: 6208803 - DNA, 16 bp, Homo sapiens
gagaaggtggtctgca

SEQ ID NO: 6208804 - DNA, 17 bp, Homo sapiens
gagaaggtggtctgcac

SEQ ID NO: 6208805 - DNA, 18 bp, Homo sapiens
gagaaggtggtctgcacc

SEQ ID NO: 6208806 - DNA, 20 bp, Homo sapiens
gagaaggtggtggcattttt

SEQ ID NO: 6208807 - DNA, 22 bp, Homo sapiens
gagaaggttctgagctgtccca

SEQ ID NO: 6208808 - DNA, 20 bp, Homo sapiens
gagaaggttggcgtgccctg

SEQ ID NO: 6208809 - DNA, 13 bp, Homo sapiens
gagaaggtttatt

SEQ ID NO: 6208810 - DNA, 15 bp, Homo sapiens
gagaagtactaagac

SEQ ID NO: 6208811 - DNA, 15 bp, Homo sapiens
gagaagtacttttga

SEQ ID NO: 6208812 - DNA, 14 bp, Homo sapiens
gagaagtcaaacat

SEQ ID NO: 6208813 - DNA, 17 bp, Homo sapiens
gagaagtcacagggcag

SEQ ID NO: 6208814 - DNA, 18 bp, Homo sapiens
gagaagtcacagggcagt

SEQ ID NO: 6208815 - DNA, 15 bp, Homo sapiens
gagaagtctggtcag

SEQ ID NO: 6208816 - DNA, 16 bp, Homo sapiens
gagaagtctggtcaga

SEQ ID NO: 6208817 - DNA, 20 bp, Homo sapiens
gagaagtctggtcagagcca

SEQ ID NO: 6208818 - DNA, 22 bp, Homo sapiens
gagaagtctggtcagagccaca

SEQ ID NO: 6208819 - DNA, 18 bp, Homo sapiens
gagaagtctttcaagaat

SEQ ID NO: 6208820 - DNA, 20 bp, Homo sapiens
gagaagtctttcaagaatga

SEQ ID NO: 6208821 - DNA, 19 bp, Homo sapiens
gagaagtgaatgctgggac

SEQ ID NO: 6208822 - DNA, 15 bp, Homo sapiens
gagaagtgacaggga

SEQ ID NO: 6208823 - DNA, 16 bp, Homo sapiens
gagaagtgacagggaa

SEQ ID NO: 6208824 - DNA, 24 bp, Homo sapiens
gagaagtgacagggaagctacagg

SEQ ID NO: 6208825 - DNA, 22 bp, Homo sapiens
gagaagtgatatggtgaaggga

SEQ ID NO: 6208826 - DNA, 17 bp, Homo sapiens
gagaagtgcccctgctg

SEQ ID NO: 6208827 - DNA, 22 bp, Homo sapiens
gagaagtgcccctgctgcctcc

SEQ ID NO: 6208828 - DNA, 12 bp, Homo sapiens
gagaagtgccct

SEQ ID NO: 6208829 - DNA, 14 bp, Homo sapiens
gagaagtgccttct

SEQ ID NO: 6208830 - DNA, 14 bp, Homo sapiens
gagaagtgctccct

SEQ ID NO: 6208831 - DNA, 19 bp, Homo sapiens
gagaagtgctccctggagg

SEQ ID NO: 6208832 - DNA, 21 bp, Homo sapiens
gagaagtgctcttggctgacc

SEQ ID NO: 6208833 - DNA, 22 bp, Homo sapiens
gagaagtgcttaacgttttctt

SEQ ID NO: 6208834 - DNA, 17 bp, Homo sapiens
gagaagtggaaatttat

SEQ ID NO: 6208835 - DNA, 14 bp, Homo sapiens
gagaagtggcccct

SEQ ID NO: 6208836 - DNA, 14 bp, Homo sapiens
gagaagtgggtggg

SEQ ID NO: 6208837 - DNA, 15 bp, Homo sapiens
gagaagtgggtgggg

SEQ ID NO: 6208838 - DNA, 16 bp, Homo sapiens
gagaagtgtgttctga

SEQ ID NO: 6208839 - DNA, 17 bp, Homo sapiens
gagaagttgaggggagc

SEQ ID NO: 6208840 - DNA, 22 bp, Homo sapiens
gagaagttgaggggagcatgct

SEQ ID NO: 6208841 - DNA, 16 bp, Homo sapiens
gagaagttgtgaaaga

SEQ ID NO: 6208842 - DNA, 20 bp, Homo sapiens
gagaagtttaacaagtattt

SEQ ID NO: 6208843 - DNA, 16 bp, Homo sapiens
gagaagtttctggccc

SEQ ID NO: 6208844 - DNA, 19 bp, Homo sapiens
gagaagtttgtagccaggt

SEQ ID NO: 6208845 - DNA, 23 bp, Homo sapiens
gagaagtttgtagccaggtactg

SEQ ID NO: 6208846 - DNA, 18 bp, Homo sapiens
gagaagttttgtacagag

SEQ ID NO: 6208847 - DNA, 19 bp, Homo sapiens
gagaagttttgtacagaga

SEQ ID NO: 6208848 - DNA, 16 bp, Homo sapiens
gagaataaaattccta

SEQ ID NO: 6208849 - DNA, 21 bp, Homo sapiens
gagaataaatgagcatttttt

SEQ ID NO: 6208850 - DNA, 11 bp, Homo sapiens
gagaataaatt

SEQ ID NO: 6208851 - DNA, 20 bp, Homo sapiens
gagaataaattgatttttat

SEQ ID NO: 6208852 - DNA, 14 bp, Homo sapiens
gagaataattgtgt

SEQ ID NO: 6208853 - DNA, 15 bp, Homo sapiens
gagaataatttctgt

SEQ ID NO: 6208854 - DNA, 19 bp, Homo sapiens
gagaatacatcttgtttct

SEQ ID NO: 6208855 - DNA, 17 bp, Homo sapiens
gagaatactttgcttca

SEQ ID NO: 6208856 - DNA, 18 bp, Homo sapiens
gagaatactttgcttcat

SEQ ID NO: 6208857 - DNA, 22 bp, Homo sapiens
gagaatagaaggaaactagctt

SEQ ID NO: 6208858 - DNA, 13 bp, Homo sapiens
ctttgataacaaa

SEQ ID NO: 6208859 - DNA, 15 bp, Homo sapiens
ctttgataacaaaaa

SEQ ID NO: 6208860 - DNA, 13 bp, Homo sapiens
ctttgataatgtt

SEQ ID NO: 6208861 - DNA, 21 bp, Homo sapiens
ctttgataattactttccagc

SEQ ID NO: 6208862 - DNA, 15 bp, Homo sapiens
ctttgataattgttt

SEQ ID NO: 6208863 - DNA, 22 bp, Homo sapiens
ctttgatacagtcaacaagcct

SEQ ID NO: 6208864 - DNA, 19 bp, Homo sapiens
ctttgatactaccagggtc

SEQ ID NO: 6208865 - DNA, 17 bp, Homo sapiens
ctttgatattgagacat

SEQ ID NO: 6208866 - DNA, 14 bp, Homo sapiens
ctttgatcacagga

SEQ ID NO: 6208867 - DNA, 15 bp, Homo sapiens
ctttgatcatcatgt

SEQ ID NO: 6208868 - DNA, 14 bp, Homo sapiens
ctttgatcatgaat

SEQ ID NO: 6208869 - DNA, 20 bp, Homo sapiens
ctttgatcatgaataactga

SEQ ID NO: 6208870 - DNA, 13 bp, Homo sapiens
ctttgatccttgg

SEQ ID NO: 6208871 - DNA, 14 bp, Homo sapiens
ctttgatccttgga

SEQ ID NO: 6208872 - DNA, 15 bp, Homo sapiens
ctttgatccttggaa

SEQ ID NO: 6208873 - DNA, 20 bp, Homo sapiens
ctttgatcgcctctttgaca

SEQ ID NO: 6208874 - DNA, 21 bp, Homo sapiens
ctttgatcgcctctttgacat

SEQ ID NO: 6208875 - DNA, 23 bp, Homo sapiens
ctttgatcgtatatttctcataa

SEQ ID NO: 6208876 - DNA, 18 bp, Homo sapiens
ctttgatctacttgcctc

SEQ ID NO: 6208877 - DNA, 18 bp, Homo sapiens
ctttgatctggacagaac

SEQ ID NO: 6208878 - DNA, 22 bp, Homo sapiens
ctttgatctggacagaacattt

SEQ ID NO: 6208879 - DNA, 23 bp, Homo sapiens
ctttgatctggacagaacattta

SEQ ID NO: 6208880 - DNA, 15 bp, Homo sapiens
ctttgatcttcagga

SEQ ID NO: 6208881 - DNA, 17 bp, Homo sapiens
ctttgatgaattcttcc

SEQ ID NO: 6208882 - DNA, 21 bp, Homo sapiens
ctttgatgaattcttcctctc

SEQ ID NO: 6208883 - DNA, 21 bp, Homo sapiens
ctttgatgattaattcacctt

SEQ ID NO: 6208884 - DNA, 23 bp, Homo sapiens
ctttgatgattgccaacagtggc

SEQ ID NO: 6208885 - DNA, 22 bp, Homo sapiens
ctttgatgtcagcagttgctgg

SEQ ID NO: 6208886 - DNA, 18 bp, Homo sapiens
ctttgatgtcatgtgttc

SEQ ID NO: 6208887 - DNA, 12 bp, Homo sapiens
ctttgatgtgtt

SEQ ID NO: 6208888 - DNA, 16 bp, Homo sapiens
ctttgatgtgtttttg

SEQ ID NO: 6208889 - DNA, 17 bp, Homo sapiens
ctttgattaatccagaa

SEQ ID NO: 6208890 - DNA, 23 bp, Homo sapiens
ctttgattagttttcttgttgct

SEQ ID NO: 6208891 - DNA, 16 bp, Homo sapiens
ctttgattatgcagac

SEQ ID NO: 6208892 - DNA, 21 bp, Homo sapiens
ctttgattatttgcatgttat

SEQ ID NO: 6208893 - DNA, 24 bp, Homo sapiens
ctttgattatttgcatgttatgtt

SEQ ID NO: 6208894 - DNA, 15 bp, Homo sapiens
ctttgattcacatgt

SEQ ID NO: 6208895 - DNA, 16 bp, Homo sapiens
ctttgattcacatgtt

SEQ ID NO: 6208896 - DNA, 21 bp, Homo sapiens
ctttgattcacatgttttcaa

SEQ ID NO: 6208897 - DNA, 14 bp, Homo sapiens
ctttgattcagaca

SEQ ID NO: 6208898 - DNA, 12 bp, Homo sapiens
ctttgattcata

SEQ ID NO: 6208899 - DNA, 15 bp, Homo sapiens
ctttgattccatctc

SEQ ID NO: 6208900 - DNA, 16 bp, Homo sapiens
ctttgattccatctcc

SEQ ID NO: 6208901 - DNA, 14 bp, Homo sapiens
ctttgattccattt

SEQ ID NO: 6208902 - DNA, 19 bp, Homo sapiens
ctttgattctccttcagcc

SEQ ID NO: 6208903 - DNA, 20 bp, Homo sapiens
ctttgattctccttcagccc

SEQ ID NO: 6208904 - DNA, 22 bp, Homo sapiens
ctttgattctccttttatgtgt

SEQ ID NO: 6208905 - DNA, 21 bp, Homo sapiens
ctttgattggttgtgccttcc

SEQ ID NO: 6208906 - DNA, 23 bp, Homo sapiens
ctttgattggttgtgccttccct

SEQ ID NO: 6208907 - DNA, 13 bp, Homo sapiens
ctttgatttacag

SEQ ID NO: 6208908 - DNA, 14 bp, Homo sapiens
ctttgatttagatt

SEQ ID NO: 6208909 - DNA, 19 bp, Homo sapiens
ctttgatttagattgagta

SEQ ID NO: 6208910 - DNA, 16 bp, Homo sapiens
ctttgatttgtaccat

SEQ ID NO: 6208911 - DNA, 15 bp, Homo sapiens
ctttgcaaagacccg

SEQ ID NO: 6208912 - DNA, 16 bp, Homo sapiens
ctttgcaaaggagctc

SEQ ID NO: 6208913 - DNA, 21 bp, Homo sapiens
ctttgcaaagtattgtaaatt

SEQ ID NO: 6208914 - DNA, 22 bp, Homo sapiens
ctttgcaaagtattgtaaatta

SEQ ID NO: 6208915 - DNA, 20 bp, Homo sapiens
ctttgcaaattatttattac

SEQ ID NO: 6208916 - DNA, 21 bp, Homo sapiens
ctttgcaaattatttattact

SEQ ID NO: 6208917 - DNA, 14 bp, Homo sapiens
ctttgcaacaataa

SEQ ID NO: 6208918 - DNA, 20 bp, Homo sapiens
ctttgcaacaataataaatg

SEQ ID NO: 6208919 - DNA, 16 bp, Homo sapiens
ctttgcaagaaagtca

SEQ ID NO: 6208920 - DNA, 17 bp, Homo sapiens
ctttgcaagatgcttgg

SEQ ID NO: 6208921 - DNA, 22 bp, Homo sapiens
ctttgcacacacactagccttc

SEQ ID NO: 6208922 - DNA, 19 bp, Homo sapiens
ctttgcacactttggccca

SEQ ID NO: 6208923 - DNA, 15 bp, Homo sapiens
ctttgcaccaaagac

SEQ ID NO: 6208924 - DNA, 17 bp, Homo sapiens
ctttgcaccaaagacat

SEQ ID NO: 6208925 - DNA, 18 bp, Homo sapiens
ctttgcaccagatactca

SEQ ID NO: 6208926 - DNA, 23 bp, Homo sapiens
ctttgcacccctttcctccccat

SEQ ID NO: 6208927 - DNA, 17 bp, Homo sapiens
ctttgcacctctgctga

SEQ ID NO: 6208928 - DNA, 16 bp, Homo sapiens
ctttgcacctgagacc

SEQ ID NO: 6208929 - DNA, 13 bp, Homo sapiens
ctttgcacctgca

SEQ ID NO: 6208930 - DNA, 18 bp, Homo sapiens
ctttgcacgacgccctct

SEQ ID NO: 6208931 - DNA, 14 bp, Homo sapiens
ctttgcacgtgctg

SEQ ID NO: 6208932 - DNA, 20 bp, Homo sapiens
ctttgcactgaagttgtctg

SEQ ID NO: 6208933 - DNA, 14 bp, Homo sapiens
ctttgcactgaggg

SEQ ID NO: 6208934 - DNA, 18 bp, Homo sapiens
ctttgcactgagggccac

SEQ ID NO: 6208935 - DNA, 22 bp, Homo sapiens
ctttgcactgagggccacacta

SEQ ID NO: 6208936 - DNA, 16 bp, Homo sapiens
ctttgcactgtaatga

SEQ ID NO: 6208937 - DNA, 16 bp, Homo sapiens
ctttgcacttgacctc

SEQ ID NO: 6208938 - DNA, 17 bp, Homo sapiens
ctttgcactttttctta

SEQ ID NO: 6208939 - DNA, 15 bp, Homo sapiens
ctttgcagacaggca

SEQ ID NO: 6208940 - DNA, 16 bp, Homo sapiens
ctttgcagacctggga

SEQ ID NO: 6208941 - DNA, 19 bp, Homo sapiens
ctttgcagacctgggactt

SEQ ID NO: 6208942 - DNA, 20 bp, Homo sapiens
ctttgcagacctgggacttt

SEQ ID NO: 6208943 - DNA, 13 bp, Homo sapiens
ctttgcagagcct

SEQ ID NO: 6208944 - DNA, 13 bp, Homo sapiens
ctttgcagcatac

SEQ ID NO: 6208945 - DNA, 23 bp, Homo sapiens
ctttgcagccaaggtgctaaaag

SEQ ID NO: 6208946 - DNA, 13 bp, Homo sapiens
ctttgcagctgct

SEQ ID NO: 6208947 - DNA, 14 bp, Homo sapiens
ctttgcaggaaatc

SEQ ID NO: 6208948 - DNA, 23 bp, Homo sapiens
ctttgcaggacttgcacacaggg

SEQ ID NO: 6208949 - DNA, 21 bp, Homo sapiens
ctttgcaggagttcctttccc

SEQ ID NO: 6208950 - DNA, 12 bp, Homo sapiens
ctttgcaggcat

SEQ ID NO: 6208951 - DNA, 13 bp, Homo sapiens
ctttgcaggctca

SEQ ID NO: 6208952 - DNA, 18 bp, Homo sapiens
ctttgcaggctctgggct

SEQ ID NO: 6208953 - DNA, 16 bp, Homo sapiens
ctttgcagggcacaga

SEQ ID NO: 6208954 - DNA, 18 bp, Homo sapiens
ctttgcagggcacagatg

SEQ ID NO: 6208955 - DNA, 15 bp, Homo sapiens
ctttgcagggcagcc

SEQ ID NO: 6208956 - DNA, 17 bp, Homo sapiens
ctttgcaggttgctttg

SEQ ID NO: 6208957 - DNA, 20 bp, Homo sapiens
ctttgcagttggactctcag

SEQ ID NO: 6208958 - DNA, 15 bp, Homo sapiens
ctttgcataaattaa

SEQ ID NO: 6208959 - DNA, 13 bp, Homo sapiens
ctttgcatattat

SEQ ID NO: 6208960 - DNA, 23 bp, Homo sapiens
ctttgcatattataaaggataaa

SEQ ID NO: 6208961 - DNA, 15 bp, Homo sapiens
ctttgcatcatagaa

SEQ ID NO: 6208962 - DNA, 17 bp, Homo sapiens
ctttgcatcgtcccctc

SEQ ID NO: 6208963 - DNA, 18 bp, Homo sapiens
ctttgcatgatctgtcaa

SEQ ID NO: 6208964 - DNA, 21 bp, Homo sapiens
ctttgcatggagacttgagga

SEQ ID NO: 6208965 - DNA, 13 bp, Homo sapiens
ctttgcatggcag

SEQ ID NO: 6208966 - DNA, 18 bp, Homo sapiens
ctttgcatggcagggcct

SEQ ID NO: 6208967 - DNA, 23 bp, Homo sapiens
ctttgcatggcagggcctcatct

SEQ ID NO: 6208968 - DNA, 15 bp, Homo sapiens
ctttgcatgtattag

SEQ ID NO: 6208969 - DNA, 11 bp, Homo sapiens
ctttgcatgtt

SEQ ID NO: 6208970 - DNA, 13 bp, Homo sapiens
ctttgcatgttct

SEQ ID NO: 6208971 - DNA, 11 bp, Homo sapiens
ctttgcattca

SEQ ID NO: 6208972 - DNA, 11 bp, Homo sapiens
ctttgcatttc

SEQ ID NO: 6208973 - DNA, 14 bp, Homo sapiens
ctttgcatttggaa

SEQ ID NO: 6208974 - DNA, 22 bp, Homo sapiens
ctttgcatttggaatttttgct

SEQ ID NO: 6208975 - DNA, 19 bp, Homo sapiens
ctttgcattttaaaaatga

SEQ ID NO: 6208976 - DNA, 22 bp, Homo sapiens
ctttgccaaaaatacaacacag

SEQ ID NO: 6208977 - DNA, 15 bp, Homo sapiens
ctttgccaaaatacc

SEQ ID NO: 6208978 - DNA, 16 bp, Homo sapiens
ctttgccaaaatacca

SEQ ID NO: 6208979 - DNA, 19 bp, Homo sapiens
ctttgccaacttgccatgt

SEQ ID NO: 6208980 - DNA, 22 bp, Homo sapiens
ctttgccaaggctctcccctct

SEQ ID NO: 6208981 - DNA, 23 bp, Homo sapiens
ctttgccaaggctctcccctctc

SEQ ID NO: 6208982 - DNA, 23 bp, Homo sapiens
ctttgccaagggaggggagaaag

SEQ ID NO: 6208983 - DNA, 23 bp, Homo sapiens
ctttgccaagttgctgtcactgt

SEQ ID NO: 6208984 - DNA, 17 bp, Homo sapiens
ctttgccaccctcatgc

SEQ ID NO: 6208985 - DNA, 15 bp, Homo sapiens
ctttgccactgctgt

SEQ ID NO: 6208986 - DNA, 23 bp, Homo sapiens
ctttgccagcagagccagggcag

SEQ ID NO: 6208987 - DNA, 17 bp, Homo sapiens
ctttgccagctgctgct

SEQ ID NO: 6208988 - DNA, 13 bp, Homo sapiens
ctttgccagcttt

SEQ ID NO: 6208989 - DNA, 22 bp, Homo sapiens
ctttgccaggtgactgtctggg

SEQ ID NO: 6208990 - DNA, 21 bp, Homo sapiens
ctttgccataaccacatttaa

SEQ ID NO: 6208991 - DNA, 21 bp, Homo sapiens
ctttgccatcaatgatcatat

SEQ ID NO: 6208992 - DNA, 19 bp, Homo sapiens
ctttgccatctctgctcca

SEQ ID NO: 6208993 - DNA, 15 bp, Homo sapiens
ctttgccatgtgctt

SEQ ID NO: 6208994 - DNA, 14 bp, Homo sapiens
ctttgcccacaatg

SEQ ID NO: 6208995 - DNA, 20 bp, Homo sapiens
ctttgcccacacacactcct

SEQ ID NO: 6208996 - DNA, 12 bp, Homo sapiens
ctttgcccaccc

SEQ ID NO: 6208997 - DNA, 14 bp, Homo sapiens
ctttgcccacccct

SEQ ID NO: 6208998 - DNA, 17 bp, Homo sapiens
ctttgcccacccctcac

SEQ ID NO: 6208999 - DNA, 19 bp, Homo sapiens
ctttgcccacccctcactc

SEQ ID NO: 6209000 - DNA, 16 bp, Homo sapiens
ctttgcccaggcatga

SEQ ID NO: 6209001 - DNA, 19 bp, Homo sapiens
ctttgcccagttcatccca

SEQ ID NO: 6209002 - DNA, 19 bp, Homo sapiens
ctttgccccaaggctgctc

SEQ ID NO: 6209003 - DNA, 23 bp, Homo sapiens
ctttgcccccaaacccccattct

SEQ ID NO: 6209004 - DNA, 20 bp, Homo sapiens
ctttgccctggtagggcagt

SEQ ID NO: 6209005 - DNA, 17 bp, Homo sapiens
ctttgcccttcctcctg

SEQ ID NO: 6209006 - DNA, 16 bp, Homo sapiens
ctttgcccttctttct

SEQ ID NO: 6209007 - DNA, 19 bp, Homo sapiens
ctttgcccttctttctacc

SEQ ID NO: 6209008 - DNA, 10 bp, Homo sapiens
ctttgcctca

SEQ ID NO: 6209009 - DNA, 11 bp, Homo sapiens
ctttgcctcaa

SEQ ID NO: 6209010 - DNA, 12 bp, Homo sapiens
ctttgcctcaaa

SEQ ID NO: 6209011 - DNA, 14 bp, Homo sapiens
ctttgcctcaagac

SEQ ID NO: 6209012 - DNA, 15 bp, Homo sapiens
ctttgcctcaagact

SEQ ID NO: 6209013 - DNA, 14 bp, Homo sapiens
ctttgcctccctca

SEQ ID NO: 6209014 - DNA, 14 bp, Homo sapiens
ctttgcctcctgtg

SEQ ID NO: 6209015 - DNA, 21 bp, Homo sapiens
ctttgcctctaccagttggca

SEQ ID NO: 6209016 - DNA, 15 bp, Homo sapiens
ctttgcctctgctac

SEQ ID NO: 6209017 - DNA, 13 bp, Homo sapiens
ctttgcctctgtc

SEQ ID NO: 6209018 - DNA, 15 bp, Homo sapiens
ctttgcctctgtcct

SEQ ID NO: 6209019 - DNA, 16 bp, Homo sapiens
ctttgcctctgtcctc

SEQ ID NO: 6209020 - DNA, 13 bp, Homo sapiens
ctttgcctcttct

SEQ ID NO: 6209021 - DNA, 21 bp, Homo sapiens
ctttgcctcttctttgtgcct

SEQ ID NO: 6209022 - DNA, 14 bp, Homo sapiens
ctttgcctgtgtga

SEQ ID NO: 6209023 - DNA, 17 bp, Homo sapiens
ctttgcctgtgtgagca

SEQ ID NO: 6209024 - DNA, 21 bp, Homo sapiens
ctttgcctgtgtgagcatctc

SEQ ID NO: 6209025 - DNA, 22 bp, Homo sapiens
ctttgcctgttcagttacagaa

SEQ ID NO: 6209026 - DNA, 21 bp, Homo sapiens
ctttgccttaaacctgaagat

SEQ ID NO: 6209027 - DNA, 13 bp, Homo sapiens
ctttgccttccaa

SEQ ID NO: 6209028 - DNA, 13 bp, Homo sapiens
ctttgccttctct

SEQ ID NO: 6209029 - DNA, 18 bp, Homo sapiens
ctttgccttgatgttgtg

SEQ ID NO: 6209030 - DNA, 21 bp, Homo sapiens
ctttgccttgatgttgtgttg

SEQ ID NO: 6209031 - DNA, 16 bp, Homo sapiens
ctttgccttgggctgc

SEQ ID NO: 6209032 - DNA, 18 bp, Homo sapiens
ctttgccttgggctgctc

SEQ ID NO: 6209033 - DNA, 14 bp, Homo sapiens
ctttgccttttgca

SEQ ID NO: 6209034 - DNA, 15 bp, Homo sapiens
ctttgcgcctgtgac

SEQ ID NO: 6209035 - DNA, 17 bp, Homo sapiens
ctttgcgctctgggttt

SEQ ID NO: 6209036 - DNA, 16 bp, Homo sapiens
ctttgcgggatattta

SEQ ID NO: 6209037 - DNA, 14 bp, Homo sapiens
gagaatagagctgc

SEQ ID NO: 6209038 - DNA, 15 bp, Homo sapiens
gagaatagagctgcc

SEQ ID NO: 6209039 - DNA, 19 bp, Homo sapiens
gagaatagagctgccactg

SEQ ID NO: 6209040 - DNA, 19 bp, Homo sapiens
gagaatagatcagtatttc

SEQ ID NO: 6209041 - DNA, 14 bp, Homo sapiens
gagaatagcagaga

SEQ ID NO: 6209042 - DNA, 20 bp, Homo sapiens
gagaatagcagagagccaaa

SEQ ID NO: 6209043 - DNA, 17 bp, Homo sapiens
gagaatagcagtttcac

SEQ ID NO: 6209044 - DNA, 18 bp, Homo sapiens
gagaatagcagtttcact

SEQ ID NO: 6209045 - DNA, 16 bp, Homo sapiens
gagaatagcttttact

SEQ ID NO: 6209046 - DNA, 21 bp, Homo sapiens
gagaatattataaaaatatca

SEQ ID NO: 6209047 - DNA, 20 bp, Homo sapiens
gagaatattcctacttgcag

SEQ ID NO: 6209048 - DNA, 21 bp, Homo sapiens
gagaatcacacaagtttgtgc

SEQ ID NO: 6209049 - DNA, 14 bp, Homo sapiens
gagaatcacaggct

SEQ ID NO: 6209050 - DNA, 16 bp, Homo sapiens
gagaatcacaggctgg

SEQ ID NO: 6209051 - DNA, 18 bp, Homo sapiens
gagaatcactgctccagg

SEQ ID NO: 6209052 - DNA, 19 bp, Homo sapiens
gagaatcactgctccaggc

SEQ ID NO: 6209053 - DNA, 19 bp, Homo sapiens
gagaatcacttttctagac

SEQ ID NO: 6209054 - DNA, 13 bp, Homo sapiens
gagaatcagcaga

SEQ ID NO: 6209055 - DNA, 15 bp, Homo sapiens
gagaatcagcagaac

SEQ ID NO: 6209056 - DNA, 20 bp, Homo sapiens
gagaatcagcagaacctgta

SEQ ID NO: 6209057 - DNA, 14 bp, Homo sapiens
gagaatcatcagga

SEQ ID NO: 6209058 - DNA, 16 bp, Homo sapiens
gagaatcatgtttctt

SEQ ID NO: 6209059 - DNA, 20 bp, Homo sapiens
gagaatcatgtttctttgat

SEQ ID NO: 6209060 - DNA, 22 bp, Homo sapiens
gagaatccaagcctaaaattaa

SEQ ID NO: 6209061 - DNA, 22 bp, Homo sapiens
gagaatcccttaaaattaccag

SEQ ID NO: 6209062 - DNA, 18 bp, Homo sapiens
gagaatcgacctcactgt

SEQ ID NO: 6209063 - DNA, 21 bp, Homo sapiens
gagaatctacccccagatcca

SEQ ID NO: 6209064 - DNA, 17 bp, Homo sapiens
gagaatctcaacatgtc

SEQ ID NO: 6209065 - DNA, 16 bp, Homo sapiens
gagaatctgaagctat

SEQ ID NO: 6209066 - DNA, 13 bp, Homo sapiens
gagaatctgatca

SEQ ID NO: 6209067 - DNA, 23 bp, Homo sapiens
gagaatctggctcctgtttccat

SEQ ID NO: 6209068 - DNA, 20 bp, Homo sapiens
gagaatctgggggtgaggag

SEQ ID NO: 6209069 - DNA, 17 bp, Homo sapiens
gagaatcttaaggtcta

SEQ ID NO: 6209070 - DNA, 23 bp, Homo sapiens
gagaatcttacagagtgattgta

SEQ ID NO: 6209071 - DNA, 19 bp, Homo sapiens
gagaatctttattgagaaa

SEQ ID NO: 6209072 - DNA, 16 bp, Homo sapiens
gagaatgaaaggagca

SEQ ID NO: 6209073 - DNA, 11 bp, Homo sapiens
gagaatgaaca

SEQ ID NO: 6209074 - DNA, 16 bp, Homo sapiens
gagaatgaacccgagg

SEQ ID NO: 6209075 - DNA, 13 bp, Homo sapiens
gagaatgaactgt

SEQ ID NO: 6209076 - DNA, 13 bp, Homo sapiens
gagaatgagcctc

SEQ ID NO: 6209077 - DNA, 17 bp, Homo sapiens
gagaatgagggccaaga

SEQ ID NO: 6209078 - DNA, 23 bp, Homo sapiens
gagaatgagtccttgatttcaaa

SEQ ID NO: 6209079 - DNA, 18 bp, Homo sapiens
gagaatgattttgctgac

SEQ ID NO: 6209080 - DNA, 20 bp, Homo sapiens
gagaatgcacaaacagaggc

SEQ ID NO: 6209081 - DNA, 21 bp, Homo sapiens
gagaatgcacaaacagaggcc

SEQ ID NO: 6209082 - DNA, 12 bp, Homo sapiens
gagaatgcacag

SEQ ID NO: 6209083 - DNA, 17 bp, Homo sapiens
gagaatgcacagatata

SEQ ID NO: 6209084 - DNA, 14 bp, Homo sapiens
gagaatgcagccca

SEQ ID NO: 6209085 - DNA, 15 bp, Homo sapiens
gagaatgcagcccac

SEQ ID NO: 6209086 - DNA, 17 bp, Homo sapiens
gagaatgcagcccacca

SEQ ID NO: 6209087 - DNA, 20 bp, Homo sapiens
gagaatgcaggccccgcccc

SEQ ID NO: 6209088 - DNA, 12 bp, Homo sapiens
gagaatgccagc

SEQ ID NO: 6209089 - DNA, 18 bp, Homo sapiens
gagaatgccagcccaaag

SEQ ID NO: 6209090 - DNA, 14 bp, Homo sapiens
gagaatgcctaggc

SEQ ID NO: 6209091 - DNA, 19 bp, Homo sapiens
gagaatgcctaggccagct

SEQ ID NO: 6209092 - DNA, 20 bp, Homo sapiens
gagaatgcctaggccagctc

SEQ ID NO: 6209093 - DNA, 19 bp, Homo sapiens
gagaatggaaaccacaact

SEQ ID NO: 6209094 - DNA, 17 bp, Homo sapiens
gagaatggcatgaaccc

SEQ ID NO: 6209095 - DNA, 16 bp, Homo sapiens
gagaatggcatggcag

SEQ ID NO: 6209096 - DNA, 20 bp, Homo sapiens
gagaatggcatggcaggagt

SEQ ID NO: 6209097 - DNA, 23 bp, Homo sapiens
gagaatggcccagtcctctccca

SEQ ID NO: 6209098 - DNA, 17 bp, Homo sapiens
gagaatggcctggagca

SEQ ID NO: 6209099 - DNA, 19 bp, Homo sapiens
gagaatggctgggtcaggg

SEQ ID NO: 6209100 - DNA, 17 bp, Homo sapiens
gagaatggggttcctgc

SEQ ID NO: 6209101 - DNA, 19 bp, Homo sapiens
gagaatggggttcctgctg

SEQ ID NO: 6209102 - DNA, 18 bp, Homo sapiens
gagaatgtatcagccagc

SEQ ID NO: 6209103 - DNA, 12 bp, Homo sapiens
gagaatgtgacc

SEQ ID NO: 6209104 - DNA, 14 bp, Homo sapiens
gagaatgtgtgtag

SEQ ID NO: 6209105 - DNA, 16 bp, Homo sapiens
gagaatgtgtttcaaa

SEQ ID NO: 6209106 - DNA, 15 bp, Homo sapiens
gagaatgttaccaga

SEQ ID NO: 6209107 - DNA, 19 bp, Homo sapiens
gagaatgttcccaatttga

SEQ ID NO: 6209108 - DNA, 13 bp, Homo sapiens
gagaattaaaata

SEQ ID NO: 6209109 - DNA, 15 bp, Homo sapiens
gagaattaaactcct

SEQ ID NO: 6209110 - DNA, 22 bp, Homo sapiens
gagaattaagttttaaataaac

SEQ ID NO: 6209111 - DNA, 17 bp, Homo sapiens
gagaattactgtttgaa

SEQ ID NO: 6209112 - DNA, 17 bp, Homo sapiens
gagaattaggaaggcca

SEQ ID NO: 6209113 - DNA, 14 bp, Homo sapiens
gagaattatctcaa

SEQ ID NO: 6209114 - DNA, 17 bp, Homo sapiens
gagaattatctcaagta

SEQ ID NO: 6209115 - DNA, 22 bp, Homo sapiens
gagaattatctcaagtaaaaca

SEQ ID NO: 6209116 - DNA, 16 bp, Homo sapiens
gagaattatgggaaac

SEQ ID NO: 6209117 - DNA, 18 bp, Homo sapiens
gagaattcagctgccccc

SEQ ID NO: 6209118 - DNA, 16 bp, Homo sapiens
gagaattcagtatttt

SEQ ID NO: 6209119 - DNA, 23 bp, Homo sapiens
gagaattccagttgtatttgaag

SEQ ID NO: 6209120 - DNA, 18 bp, Homo sapiens
gagaattcttacatgttt

SEQ ID NO: 6209121 - DNA, 22 bp, Homo sapiens
gagaattcttacatgttttctt

SEQ ID NO: 6209122 - DNA, 20 bp, Homo sapiens
gagaattgactgaagcacag

SEQ ID NO: 6209123 - DNA, 19 bp, Homo sapiens
gagaattgaggggaggtgg

SEQ ID NO: 6209124 - DNA, 16 bp, Homo sapiens
gagaattgcaaaacta

SEQ ID NO: 6209125 - DNA, 15 bp, Homo sapiens
gagaattgcacacag

SEQ ID NO: 6209126 - DNA, 17 bp, Homo sapiens
gagaattggccagagcc

SEQ ID NO: 6209127 - DNA, 17 bp, Homo sapiens
gagaattgggactctgt

SEQ ID NO: 6209128 - DNA, 17 bp, Homo sapiens
gagaattgggattacat

SEQ ID NO: 6209129 - DNA, 14 bp, Homo sapiens
gagaattgggggct

SEQ ID NO: 6209130 - DNA, 23 bp, Homo sapiens
gagaatttctaaaaagattagca

SEQ ID NO: 6209131 - DNA, 21 bp, Homo sapiens
gagaatttctaccatttcaga

SEQ ID NO: 6209132 - DNA, 14 bp, Homo sapiens
gagacaaaagaaaa

SEQ ID NO: 6209133 - DNA, 19 bp, Homo sapiens
gagacaaaagaaaaaatat

SEQ ID NO: 6209134 - DNA, 22 bp, Homo sapiens
gagacaaacacctcccaggaga

SEQ ID NO: 6209135 - DNA, 18 bp, Homo sapiens
gagacaaacagcccttcc

SEQ ID NO: 6209136 - DNA, 15 bp, Homo sapiens
gagacaaagcaggag

SEQ ID NO: 6209137 - DNA, 23 bp, Homo sapiens
gagacaaagtttggaagtacata

SEQ ID NO: 6209138 - DNA, 18 bp, Homo sapiens
gagacaaatctatgccac

SEQ ID NO: 6209139 - DNA, 17 bp, Homo sapiens
gagacaacagcacacag

SEQ ID NO: 6209140 - DNA, 17 bp, Homo sapiens
gagacaacgtgctcttt

SEQ ID NO: 6209141 - DNA, 21 bp, Homo sapiens
gagacaagaaaggcagacaca

SEQ ID NO: 6209142 - DNA, 14 bp, Homo sapiens
gagacaagcagagt

SEQ ID NO: 6209143 - DNA, 14 bp, Homo sapiens
gagacaagccctgg

SEQ ID NO: 6209144 - DNA, 22 bp, Homo sapiens
gagacaagttccatgggataca

SEQ ID NO: 6209145 - DNA, 22 bp, Homo sapiens
gagacaataaaaaccaaagcat

SEQ ID NO: 6209146 - DNA, 13 bp, Homo sapiens
gagacaataaaca

SEQ ID NO: 6209147 - DNA, 14 bp, Homo sapiens
gagacaataaacag

SEQ ID NO: 6209148 - DNA, 14 bp, Homo sapiens
gagacaatctattt

SEQ ID NO: 6209149 - DNA, 14 bp, Homo sapiens
gagacaatgaaaca

SEQ ID NO: 6209150 - DNA, 18 bp, Homo sapiens
gagacaattagcagaatg

SEQ ID NO: 6209151 - DNA, 15 bp, Homo sapiens
gagacacacctgagg

SEQ ID NO: 6209152 - DNA, 14 bp, Homo sapiens
gagacacagagatg

SEQ ID NO: 6209153 - DNA, 16 bp, Homo sapiens
gagacacagagatgga

SEQ ID NO: 6209154 - DNA, 13 bp, Homo sapiens
gagacacagatgt

SEQ ID NO: 6209155 - DNA, 14 bp, Homo sapiens
gagacacagatgtt

SEQ ID NO: 6209156 - DNA, 11 bp, Homo sapiens
gagacacagga

SEQ ID NO: 6209157 - DNA, 17 bp, Homo sapiens
gagacacaggatgaagc

SEQ ID NO: 6209158 - DNA, 22 bp, Homo sapiens
gagacacaggcacgggtccctg

SEQ ID NO: 6209159 - DNA, 20 bp, Homo sapiens
gagacacattaaagggtagc

SEQ ID NO: 6209160 - DNA, 13 bp, Homo sapiens
gagacacattgcc

SEQ ID NO: 6209161 - DNA, 22 bp, Homo sapiens
gagacacattggaccagatgag

SEQ ID NO: 6209162 - DNA, 14 bp, Homo sapiens
gagacaccaagctc

SEQ ID NO: 6209163 - DNA, 20 bp, Homo sapiens
gagacaccatcctgagccag

SEQ ID NO: 6209164 - DNA, 23 bp, Homo sapiens
gagacaccggagtatgtgcagtg

SEQ ID NO: 6209165 - DNA, 12 bp, Homo sapiens
gagacacctcag

SEQ ID NO: 6209166 - DNA, 20 bp, Homo sapiens
gagacacctgcacctccccc

SEQ ID NO: 6209167 - DNA, 23 bp, Homo sapiens
gagacactcccccctccattccc

SEQ ID NO: 6209168 - DNA, 12 bp, Homo sapiens
gagacactgagc

SEQ ID NO: 6209169 - DNA, 15 bp, Homo sapiens
gagacactgagccag

SEQ ID NO: 6209170 - DNA, 22 bp, Homo sapiens
gagacactggtctcagaggagg

SEQ ID NO: 6209171 - DNA, 14 bp, Homo sapiens
gagacactgtcaag

SEQ ID NO: 6209172 - DNA, 17 bp, Homo sapiens
gagacacttgccttctt

SEQ ID NO: 6209173 - DNA, 17 bp, Homo sapiens
gagacagaaacagagag

SEQ ID NO: 6209174 - DNA, 20 bp, Homo sapiens
gagacagaaagcctccgctg

SEQ ID NO: 6209175 - DNA, 15 bp, Homo sapiens
gagacagaagcaggc

SEQ ID NO: 6209176 - DNA, 16 bp, Homo sapiens
gagacagaagtcaggt

SEQ ID NO: 6209177 - DNA, 12 bp, Homo sapiens
gagacagaccac

SEQ ID NO: 6209178 - DNA, 15 bp, Homo sapiens
gagacagactagaag

SEQ ID NO: 6209179 - DNA, 15 bp, Homo sapiens
gagacagagaatctt

SEQ ID NO: 6209180 - DNA, 15 bp, Homo sapiens
gagacagagagagac

SEQ ID NO: 6209181 - DNA, 19 bp, Homo sapiens
gagacagagcaacccctgg

SEQ ID NO: 6209182 - DNA, 15 bp, Homo sapiens
gagacagagccaagc

SEQ ID NO: 6209183 - DNA, 23 bp, Homo sapiens
gagacagagcccccaagcctctg

SEQ ID NO: 6209184 - DNA, 15 bp, Homo sapiens
gagacagaggatgtg

SEQ ID NO: 6209185 - DNA, 18 bp, Homo sapiens
gagacagagtctcgctct

SEQ ID NO: 6209186 - DNA, 20 bp, Homo sapiens
gagacagagtcttgctctgt

SEQ ID NO: 6209187 - DNA, 15 bp, Homo sapiens
gagacagatacctcc

SEQ ID NO: 6209188 - DNA, 15 bp, Homo sapiens
gagacagatcactcc

SEQ ID NO: 6209189 - DNA, 17 bp, Homo sapiens
gagacagatcactcctg

SEQ ID NO: 6209190 - DNA, 20 bp, Homo sapiens
gagacagatcactcctggag

SEQ ID NO: 6209191 - DNA, 23 bp, Homo sapiens
gagacagatgctggtggaggaag

SEQ ID NO: 6209192 - DNA, 16 bp, Homo sapiens
gagacagcaagtttat

SEQ ID NO: 6209193 - DNA, 23 bp, Homo sapiens
gagacagcacaggcagccccacg

SEQ ID NO: 6209194 - DNA, 19 bp, Homo sapiens
gagacagcaccactgctga

SEQ ID NO: 6209195 - DNA, 16 bp, Homo sapiens
gagacagcagcaccca

SEQ ID NO: 6209196 - DNA, 16 bp, Homo sapiens
gagacagccaactatg

SEQ ID NO: 6209197 - DNA, 20 bp, Homo sapiens
gagacagccaggtggcacct

SEQ ID NO: 6209198 - DNA, 18 bp, Homo sapiens
gagacagcccgggctctg

SEQ ID NO: 6209199 - DNA, 23 bp, Homo sapiens
gagacagcccgggctctgcctcc

SEQ ID NO: 6209200 - DNA, 16 bp, Homo sapiens
gagacagccctgccta

SEQ ID NO: 6209201 - DNA, 20 bp, Homo sapiens
gagacagccggatcttggag

SEQ ID NO: 6209202 - DNA, 21 bp, Homo sapiens
gagacagccgggaggagcctg

SEQ ID NO: 6209203 - DNA, 20 bp, Homo sapiens
gagacagcgaactagaagaa

SEQ ID NO: 6209204 - DNA, 21 bp, Homo sapiens
gagacagcgcgagtagcaccc

SEQ ID NO: 6209205 - DNA, 18 bp, Homo sapiens
gagacagcggtcccaggg

SEQ ID NO: 6209206 - DNA, 19 bp, Homo sapiens
gagacagcggtcccagggg

SEQ ID NO: 6209207 - DNA, 18 bp, Homo sapiens
gagacagctctgcatact

SEQ ID NO: 6209208 - DNA, 21 bp, Homo sapiens
gagacagctgatacttcattt

SEQ ID NO: 6209209 - DNA, 13 bp, Homo sapiens
gagacaggaagcc

SEQ ID NO: 6209210 - DNA, 18 bp, Homo sapiens
gagacaggaagcctcaag

SEQ ID NO: 6209211 - DNA, 13 bp, Homo sapiens
gagacaggacaga

SEQ ID NO: 6209212 - DNA, 17 bp, Homo sapiens
gagacaggacagaatgt

SEQ ID NO: 6209213 - DNA, 18 bp, Homo sapiens
gagacaggacagaatgtg

SEQ ID NO: 6209214 - DNA, 23 bp, Homo sapiens
gagacaggacagaatgtgttctt

SEQ ID NO: 6209215 - DNA, 20 bp, Homo sapiens
ctttgcgggatatttagggt

SEQ ID NO: 6209216 - DNA, 22 bp, Homo sapiens
ctttgcgtcaggagcagcatca

SEQ ID NO: 6209217 - DNA, 16 bp, Homo sapiens
ctttgcgtggatcaag

SEQ ID NO: 6209218 - DNA, 18 bp, Homo sapiens
ctttgcgtggatcaagct

SEQ ID NO: 6209219 - DNA, 18 bp, Homo sapiens
ctttgctaaagacatgaa

SEQ ID NO: 6209220 - DNA, 14 bp, Homo sapiens
ctttgctacaaatt

SEQ ID NO: 6209221 - DNA, 16 bp, Homo sapiens
ctttgctacaaattta

SEQ ID NO: 6209222 - DNA, 15 bp, Homo sapiens
ctttgctacaataaa

SEQ ID NO: 6209223 - DNA, 17 bp, Homo sapiens
ctttgctacgaagaaag

SEQ ID NO: 6209224 - DNA, 20 bp, Homo sapiens
ctttgctagttggagtgctt

SEQ ID NO: 6209225 - DNA, 21 bp, Homo sapiens
ctttgctagttggagtgcttg

SEQ ID NO: 6209226 - DNA, 13 bp, Homo sapiens
ctttgctatgtaa

SEQ ID NO: 6209227 - DNA, 17 bp, Homo sapiens
ctttgctcatatttccc

SEQ ID NO: 6209228 - DNA, 12 bp, Homo sapiens
ctttgctccagg

SEQ ID NO: 6209229 - DNA, 15 bp, Homo sapiens
ctttgctccgctccc

SEQ ID NO: 6209230 - DNA, 17 bp, Homo sapiens
ctttgctccgctcccac

SEQ ID NO: 6209231 - DNA, 20 bp, Homo sapiens
ctttgctccgctcccaccgc

SEQ ID NO: 6209232 - DNA, 13 bp, Homo sapiens
ctttgctcctccc

SEQ ID NO: 6209233 - DNA, 18 bp, Homo sapiens
ctttgctccttttgtagt

SEQ ID NO: 6209234 - DNA, 20 bp, Homo sapiens
ctttgctctcaaggcttgga

SEQ ID NO: 6209235 - DNA, 22 bp, Homo sapiens
ctttgctctcaattaaagtcta

SEQ ID NO: 6209236 - DNA, 21 bp, Homo sapiens
ctttgctctggaggaagttct

SEQ ID NO: 6209237 - DNA, 17 bp, Homo sapiens
ctttgctcttcaagaaa

SEQ ID NO: 6209238 - DNA, 12 bp, Homo sapiens
ctttgctcttgc

SEQ ID NO: 6209239 - DNA, 19 bp, Homo sapiens
ctttgctgatttcccctct

SEQ ID NO: 6209240 - DNA, 15 bp, Homo sapiens
ctttgctgcatggca

SEQ ID NO: 6209241 - DNA, 17 bp, Homo sapiens
ctttgctgcattccttt

SEQ ID NO: 6209242 - DNA, 14 bp, Homo sapiens
ctttgctgcatttt

SEQ ID NO: 6209243 - DNA, 21 bp, Homo sapiens
ctttgctgccagctctcagga

SEQ ID NO: 6209244 - DNA, 16 bp, Homo sapiens
ctttgctgcccctgtc

SEQ ID NO: 6209245 - DNA, 18 bp, Homo sapiens
ctttgctgcccctgtctg

SEQ ID NO: 6209246 - DNA, 22 bp, Homo sapiens
ctttgctgcccctgtctggaag

SEQ ID NO: 6209247 - DNA, 13 bp, Homo sapiens
ctttgctgccttc

SEQ ID NO: 6209248 - DNA, 16 bp, Homo sapiens
ctttgctgccttctgt

SEQ ID NO: 6209249 - DNA, 20 bp, Homo sapiens
ctttgctgccttctgtctct

SEQ ID NO: 6209250 - DNA, 22 bp, Homo sapiens
ctttgctgctatgaaaatgagc

SEQ ID NO: 6209251 - DNA, 11 bp, Homo sapiens
ctttgctgctg

SEQ ID NO: 6209252 - DNA, 19 bp, Homo sapiens
ctttgctgctgaaggctca

SEQ ID NO: 6209253 - DNA, 14 bp, Homo sapiens
ctttgctgctgtgg

SEQ ID NO: 6209254 - DNA, 18 bp, Homo sapiens
ctttgctggaaaatctgt

SEQ ID NO: 6209255 - DNA, 14 bp, Homo sapiens
ctttgctggagtcc

SEQ ID NO: 6209256 - DNA, 18 bp, Homo sapiens
ctttgctggagtcctgtt

SEQ ID NO: 6209257 - DNA, 20 bp, Homo sapiens
ctttgctggagtcctgttct

SEQ ID NO: 6209258 - DNA, 15 bp, Homo sapiens
ctttgctggttgctg

SEQ ID NO: 6209259 - DNA, 19 bp, Homo sapiens
ctttgctgtaagatgtctg

SEQ ID NO: 6209260 - DNA, 20 bp, Homo sapiens
ctttgctgtaagatgtctgt

SEQ ID NO: 6209261 - DNA, 14 bp, Homo sapiens
ctttgctgtactct

SEQ ID NO: 6209262 - DNA, 22 bp, Homo sapiens
ctttgctgtactcttgctgatg

SEQ ID NO: 6209263 - DNA, 13 bp, Homo sapiens
ctttgctgtcact

SEQ ID NO: 6209264 - DNA, 14 bp, Homo sapiens
ctttgctgtcccat

SEQ ID NO: 6209265 - DNA, 22 bp, Homo sapiens
ctttgctgtcccatagtccctg

SEQ ID NO: 6209266 - DNA, 21 bp, Homo sapiens
ctttgctgtgaggctgtcctg

SEQ ID NO: 6209267 - DNA, 23 bp, Homo sapiens
ctttgctgttactgcttctcttt

SEQ ID NO: 6209268 - DNA, 19 bp, Homo sapiens
ctttgctgttattgacagc

SEQ ID NO: 6209269 - DNA, 12 bp, Homo sapiens
ctttgctgttcg

SEQ ID NO: 6209270 - DNA, 15 bp, Homo sapiens
ctttgctgttgacgt

SEQ ID NO: 6209271 - DNA, 15 bp, Homo sapiens
ctttgctgtttatat

SEQ ID NO: 6209272 - DNA, 17 bp, Homo sapiens
ctttgcttaagatgcta

SEQ ID NO: 6209273 - DNA, 17 bp, Homo sapiens
ctttgcttaccttgttt

SEQ ID NO: 6209274 - DNA, 20 bp, Homo sapiens
ctttgcttatgaatatttat

SEQ ID NO: 6209275 - DNA, 23 bp, Homo sapiens
ctttgcttatgaatatttataac

SEQ ID NO: 6209276 - DNA, 12 bp, Homo sapiens
ctttgcttcatt

SEQ ID NO: 6209277 - DNA, 15 bp, Homo sapiens
ctttgcttcccattg

SEQ ID NO: 6209278 - DNA, 18 bp, Homo sapiens
ctttgcttcccctccagg

SEQ ID NO: 6209279 - DNA, 19 bp, Homo sapiens
ctttgcttcccctccagga

SEQ ID NO: 6209280 - DNA, 18 bp, Homo sapiens
ctttgcttccgccactca

SEQ ID NO: 6209281 - DNA, 19 bp, Homo sapiens
ctttgcttccttgctttta

SEQ ID NO: 6209282 - DNA, 20 bp, Homo sapiens
ctttgcttccttgcttttat

SEQ ID NO: 6209283 - DNA, 13 bp, Homo sapiens
ctttgcttctctc

SEQ ID NO: 6209284 - DNA, 20 bp, Homo sapiens
ctttgcttgaacacagtatt

SEQ ID NO: 6209285 - DNA, 22 bp, Homo sapiens
ctttgcttgaacacagtatttt

SEQ ID NO: 6209286 - DNA, 23 bp, Homo sapiens
ctttgcttgaacacagtattttc

SEQ ID NO: 6209287 - DNA, 14 bp, Homo sapiens
ctttgcttgagaat

SEQ ID NO: 6209288 - DNA, 17 bp, Homo sapiens
ctttgcttgagaatcct

SEQ ID NO: 6209289 - DNA, 17 bp, Homo sapiens
ctttgcttgcctctctg

SEQ ID NO: 6209290 - DNA, 13 bp, Homo sapiens
ctttgcttgcttt

SEQ ID NO: 6209291 - DNA, 18 bp, Homo sapiens
ctttgcttgtcctgctca

SEQ ID NO: 6209292 - DNA, 19 bp, Homo sapiens
ctttgctttaatataaatg

SEQ ID NO: 6209293 - DNA, 13 bp, Homo sapiens
ctttgctttctcg

SEQ ID NO: 6209294 - DNA, 12 bp, Homo sapiens
ctttgctttctg

SEQ ID NO: 6209295 - DNA, 22 bp, Homo sapiens
ctttgctttctgaattggaagg

SEQ ID NO: 6209296 - DNA, 13 bp, Homo sapiens
ctttgctttctgc

SEQ ID NO: 6209297 - DNA, 17 bp, Homo sapiens
ctttgctttgtagtttg

SEQ ID NO: 6209298 - DNA, 19 bp, Homo sapiens
ctttggaaaaatcttgggc

SEQ ID NO: 6209299 - DNA, 22 bp, Homo sapiens
ctttggaaaaatgggtctttta

SEQ ID NO: 6209300 - DNA, 23 bp, Homo sapiens
ctttggaaaaatgggtcttttat

SEQ ID NO: 6209301 - DNA, 17 bp, Homo sapiens
ctttggaaaaatgtttg

SEQ ID NO: 6209302 - DNA, 20 bp, Homo sapiens
ctttggaaaatgcattgtat

SEQ ID NO: 6209303 - DNA, 12 bp, Homo sapiens
ctttggaaagac

SEQ ID NO: 6209304 - DNA, 20 bp, Homo sapiens
ctttggaaagacctgtgagg

SEQ ID NO: 6209305 - DNA, 21 bp, Homo sapiens
ctttggaaagacctgtgaggg

SEQ ID NO: 6209306 - DNA, 23 bp, Homo sapiens
ctttggaaagagtaggaagactt

SEQ ID NO: 6209307 - DNA, 13 bp, Homo sapiens
ctttggaaagcca

SEQ ID NO: 6209308 - DNA, 22 bp, Homo sapiens
ctttggaaagtacactctgctg

SEQ ID NO: 6209309 - DNA, 16 bp, Homo sapiens
ctttggaaatcctcta

SEQ ID NO: 6209310 - DNA, 22 bp, Homo sapiens
ctttggaacaagacagccttca

SEQ ID NO: 6209311 - DNA, 16 bp, Homo sapiens
ctttggaacaagatgg

SEQ ID NO: 6209312 - DNA, 15 bp, Homo sapiens
ctttggaaccagact

SEQ ID NO: 6209313 - DNA, 21 bp, Homo sapiens
ctttggaaccagactcttgcc

SEQ ID NO: 6209314 - DNA, 17 bp, Homo sapiens
ctttggaagatgcagaa

SEQ ID NO: 6209315 - DNA, 18 bp, Homo sapiens
ctttggaagatgcagaag

SEQ ID NO: 6209316 - DNA, 13 bp, Homo sapiens
ctttggaagcact

SEQ ID NO: 6209317 - DNA, 19 bp, Homo sapiens
ctttggaagcactttttct

SEQ ID NO: 6209318 - DNA, 12 bp, Homo sapiens
ctttggaagcag

SEQ ID NO: 6209319 - DNA, 16 bp, Homo sapiens
ctttggaaggtgacac

SEQ ID NO: 6209320 - DNA, 20 bp, Homo sapiens
ctttggaatgaaattcctcc

SEQ ID NO: 6209321 - DNA, 13 bp, Homo sapiens
ctttggaatgaac

SEQ ID NO: 6209322 - DNA, 23 bp, Homo sapiens
ctttggaatgactataaacatta

SEQ ID NO: 6209323 - DNA, 15 bp, Homo sapiens
ctttggaatgctcca

SEQ ID NO: 6209324 - DNA, 16 bp, Homo sapiens
ctttggacaagaggaa

SEQ ID NO: 6209325 - DNA, 17 bp, Homo sapiens
ctttggacaagaggaaa

SEQ ID NO: 6209326 - DNA, 21 bp, Homo sapiens
ctttggacacacacagcttct

SEQ ID NO: 6209327 - DNA, 20 bp, Homo sapiens
ctttggacacagtgttttat

SEQ ID NO: 6209328 - DNA, 19 bp, Homo sapiens
ctttggacagaagcagctc

SEQ ID NO: 6209329 - DNA, 23 bp, Homo sapiens
ctttggacagctgactgaatgca

SEQ ID NO: 6209330 - DNA, 17 bp, Homo sapiens
ctttggacccagggcct

SEQ ID NO: 6209331 - DNA, 18 bp, Homo sapiens
ctttggacccagggcctg

SEQ ID NO: 6209332 - DNA, 15 bp, Homo sapiens
ctttggaccctgagg

SEQ ID NO: 6209333 - DNA, 18 bp, Homo sapiens
ctttggaccctgaggccc

SEQ ID NO: 6209334 - DNA, 21 bp, Homo sapiens
ctttggacctaaatggcctca

SEQ ID NO: 6209335 - DNA, 17 bp, Homo sapiens
ctttggacctaatccaa

SEQ ID NO: 6209336 - DNA, 15 bp, Homo sapiens
ctttggactctcccc

SEQ ID NO: 6209337 - DNA, 14 bp, Homo sapiens
ctttggacttctga

SEQ ID NO: 6209338 - DNA, 21 bp, Homo sapiens
ctttggagaactcatttcaag

SEQ ID NO: 6209339 - DNA, 11 bp, Homo sapiens
ctttggagact

SEQ ID NO: 6209340 - DNA, 15 bp, Homo sapiens
ctttggagactttct

SEQ ID NO: 6209341 - DNA, 20 bp, Homo sapiens
ctttggagactttctttaaa

SEQ ID NO: 6209342 - DNA, 24 bp, Homo sapiens
ctttggagagggaaaatcttcact

SEQ ID NO: 6209343 - DNA, 23 bp, Homo sapiens
ctttggagatcaaggagaggagg

SEQ ID NO: 6209344 - DNA, 18 bp, Homo sapiens
ctttggagatgctgaggg

SEQ ID NO: 6209345 - DNA, 13 bp, Homo sapiens
ctttggagctttt

SEQ ID NO: 6209346 - DNA, 23 bp, Homo sapiens
ctttggagcttttttctttaaga

SEQ ID NO: 6209347 - DNA, 14 bp, Homo sapiens
ctttggaggggaaa

SEQ ID NO: 6209348 - DNA, 23 bp, Homo sapiens
ctttggaggggaaatggggaaag

SEQ ID NO: 6209349 - DNA, 14 bp, Homo sapiens
ctttggaggtgctg

SEQ ID NO: 6209350 - DNA, 22 bp, Homo sapiens
ctttggagtcccctcacctcct

SEQ ID NO: 6209351 - DNA, 14 bp, Homo sapiens
ctttggagttaaaa

SEQ ID NO: 6209352 - DNA, 17 bp, Homo sapiens
ctttggagttaaaatgc

SEQ ID NO: 6209353 - DNA, 17 bp, Homo sapiens
ctttggataataggaat

SEQ ID NO: 6209354 - DNA, 15 bp, Homo sapiens
ctttggatgacttgt

SEQ ID NO: 6209355 - DNA, 18 bp, Homo sapiens
ctttggatgcaattaaaa

SEQ ID NO: 6209356 - DNA, 21 bp, Homo sapiens
ctttggatgcaattaaaacta

SEQ ID NO: 6209357 - DNA, 21 bp, Homo sapiens
ctttggattctaaatacatgc

SEQ ID NO: 6209358 - DNA, 22 bp, Homo sapiens
ctttggattgctggggccaggc

SEQ ID NO: 6209359 - DNA, 15 bp, Homo sapiens
ctttggatttgacat

SEQ ID NO: 6209360 - DNA, 16 bp, Homo sapiens
ctttggatttgacatt

SEQ ID NO: 6209361 - DNA, 17 bp, Homo sapiens
ctttggatttgacattg

SEQ ID NO: 6209362 - DNA, 23 bp, Homo sapiens
ctttggcaattcttcttctcaag

SEQ ID NO: 6209363 - DNA, 18 bp, Homo sapiens
ctttggcaatttcctggc

SEQ ID NO: 6209364 - DNA, 16 bp, Homo sapiens
ctttggcactctctgc

SEQ ID NO: 6209365 - DNA, 18 bp, Homo sapiens
ctttggcactctctgcca

SEQ ID NO: 6209366 - DNA, 14 bp, Homo sapiens
ctttggcactggat

SEQ ID NO: 6209367 - DNA, 18 bp, Homo sapiens
ctttggcactggggcact

SEQ ID NO: 6209368 - DNA, 18 bp, Homo sapiens
ctttggcagaccatctcc

SEQ ID NO: 6209369 - DNA, 20 bp, Homo sapiens
ctttggcagaccatctccag

SEQ ID NO: 6209370 - DNA, 14 bp, Homo sapiens
ctttggcagagttc

SEQ ID NO: 6209371 - DNA, 24 bp, Homo sapiens
ctttggcaggtgcagcccccactg

SEQ ID NO: 6209372 - DNA, 14 bp, Homo sapiens
ctttggcagttgca

SEQ ID NO: 6209373 - DNA, 22 bp, Homo sapiens
ctttggcatcttttggaggaaa

SEQ ID NO: 6209374 - DNA, 18 bp, Homo sapiens
ctttggcatgatttaaag

SEQ ID NO: 6209375 - DNA, 13 bp, Homo sapiens
ctttggccacagc

SEQ ID NO: 6209376 - DNA, 17 bp, Homo sapiens
ctttggccactgtattt

SEQ ID NO: 6209377 - DNA, 22 bp, Homo sapiens
ctttggccactgtatttgttaa

SEQ ID NO: 6209378 - DNA, 17 bp, Homo sapiens
ctttggccattccaaca

SEQ ID NO: 6209379 - DNA, 11 bp, Homo sapiens
ctttggcccaa

SEQ ID NO: 6209380 - DNA, 14 bp, Homo sapiens
ctttggcccagggt

SEQ ID NO: 6209381 - DNA, 16 bp, Homo sapiens
ctttggcccagggtgg

SEQ ID NO: 6209382 - DNA, 21 bp, Homo sapiens
ctttggccccactttgaaggg

SEQ ID NO: 6209383 - DNA, 22 bp, Homo sapiens
ctttggcctggggtgcatctcc

SEQ ID NO: 6209384 - DNA, 11 bp, Homo sapiens
ctttggccttt

SEQ ID NO: 6209385 - DNA, 15 bp, Homo sapiens
ctttggctcccgctt

SEQ ID NO: 6209386 - DNA, 20 bp, Homo sapiens
ctttggctgaggggcttggg

SEQ ID NO: 6209387 - DNA, 12 bp, Homo sapiens
ctttggctgcag

SEQ ID NO: 6209388 - DNA, 18 bp, Homo sapiens
ctttggctggtagcagca

SEQ ID NO: 6209389 - DNA, 20 bp, Homo sapiens
ctttggctggtagcagcagg

SEQ ID NO: 6209390 - DNA, 16 bp, Homo sapiens
ctttggcttaattcca

SEQ ID NO: 6209391 - DNA, 16 bp, Homo sapiens
ctttggcttctcctgt

SEQ ID NO: 6209392 - DNA, 21 bp, Homo sapiens
ctttggcttctcctgtgaccc

SEQ ID NO: 6209393 - DNA, 22 bp, Homo sapiens
gagacaggagcagcccacccag

SEQ ID NO: 6209394 - DNA, 19 bp, Homo sapiens
gagacaggcagagctgctc

SEQ ID NO: 6209395 - DNA, 12 bp, Homo sapiens
gagacaggcagc

SEQ ID NO: 6209396 - DNA, 16 bp, Homo sapiens
gagacaggcagcccag

SEQ ID NO: 6209397 - DNA, 12 bp, Homo sapiens
gagacagggccc

SEQ ID NO: 6209398 - DNA, 15 bp, Homo sapiens
gagacagggctgctc

SEQ ID NO: 6209399 - DNA, 16 bp, Homo sapiens
gagacagggctgctcc

SEQ ID NO: 6209400 - DNA, 16 bp, Homo sapiens
gagacagggtaggaaa

SEQ ID NO: 6209401 - DNA, 16 bp, Homo sapiens
gagacagggtctcact

SEQ ID NO: 6209402 - DNA, 20 bp, Homo sapiens
gagacagggtctcactctgt

SEQ ID NO: 6209403 - DNA, 18 bp, Homo sapiens
gagacagggtctcactgt

SEQ ID NO: 6209404 - DNA, 18 bp, Homo sapiens
gagacagggtcttgctct

SEQ ID NO: 6209405 - DNA, 22 bp, Homo sapiens
gagacagggtttcaccatgttg

SEQ ID NO: 6209406 - DNA, 13 bp, Homo sapiens
gagacagggtttg

SEQ ID NO: 6209407 - DNA, 23 bp, Homo sapiens
gagacaggtgcctaacctgggac

SEQ ID NO: 6209408 - DNA, 14 bp, Homo sapiens
gagacaggtgcctg

SEQ ID NO: 6209409 - DNA, 21 bp, Homo sapiens
gagacaggtgcctggggctgg

SEQ ID NO: 6209410 - DNA, 22 bp, Homo sapiens
gagacaggtggcctagcaggca

SEQ ID NO: 6209411 - DNA, 18 bp, Homo sapiens
gagacagtagaggcatga

SEQ ID NO: 6209412 - DNA, 16 bp, Homo sapiens
gagacagtcaggaagc

SEQ ID NO: 6209413 - DNA, 17 bp, Homo sapiens
gagacagtccagcctgg

SEQ ID NO: 6209414 - DNA, 17 bp, Homo sapiens
gagacagtccagtgtca

SEQ ID NO: 6209415 - DNA, 19 bp, Homo sapiens
gagacagtccagtgtcacc

SEQ ID NO: 6209416 - DNA, 15 bp, Homo sapiens
gagacagtctcactc

SEQ ID NO: 6209417 - DNA, 13 bp, Homo sapiens
gagacagtgaatt

SEQ ID NO: 6209418 - DNA, 17 bp, Homo sapiens
gagacagtgcacatgaa

SEQ ID NO: 6209419 - DNA, 14 bp, Homo sapiens
gagacagtgggaaa

SEQ ID NO: 6209420 - DNA, 22 bp, Homo sapiens
gagacagtgttttgccatgttg

SEQ ID NO: 6209421 - DNA, 16 bp, Homo sapiens
gagacagttcaagaaa

SEQ ID NO: 6209422 - DNA, 18 bp, Homo sapiens
gagacagttcaagaaagc

SEQ ID NO: 6209423 - DNA, 15 bp, Homo sapiens
gagacagttgcccga

SEQ ID NO: 6209424 - DNA, 22 bp, Homo sapiens
gagacagttgggtgagaacaac

SEQ ID NO: 6209425 - DNA, 18 bp, Homo sapiens
gagacatacttgaagggc

SEQ ID NO: 6209426 - DNA, 13 bp, Homo sapiens
gagacatatatag

SEQ ID NO: 6209427 - DNA, 18 bp, Homo sapiens
gagacatccctcatctag

SEQ ID NO: 6209428 - DNA, 14 bp, Homo sapiens
gagacatctggaaa

SEQ ID NO: 6209429 - DNA, 13 bp, Homo sapiens
gagacatcttgcc

SEQ ID NO: 6209430 - DNA, 19 bp, Homo sapiens
gagacatggaccagcatct

SEQ ID NO: 6209431 - DNA, 20 bp, Homo sapiens
gagacatggctttcagaaaa

SEQ ID NO: 6209432 - DNA, 13 bp, Homo sapiens
gagacatggtatt

SEQ ID NO: 6209433 - DNA, 16 bp, Homo sapiens
gagacattaactcatt

SEQ ID NO: 6209434 - DNA, 16 bp, Homo sapiens
gagacattagaaaaaa

SEQ ID NO: 6209435 - DNA, 18 bp, Homo sapiens
gagacattccaaaacgaa

SEQ ID NO: 6209436 - DNA, 19 bp, Homo sapiens
gagacattcctgggcacag

SEQ ID NO: 6209437 - DNA, 14 bp, Homo sapiens
gagacattgcctcc

SEQ ID NO: 6209438 - DNA, 13 bp, Homo sapiens
gagacatttcaaa

SEQ ID NO: 6209439 - DNA, 11 bp, Homo sapiens
gagaccaaata

SEQ ID NO: 6209440 - DNA, 23 bp, Homo sapiens
gagaccaaatgtcggggttgggg

SEQ ID NO: 6209441 - DNA, 22 bp, Homo sapiens
gagaccaagactctgaaatctc

SEQ ID NO: 6209442 - DNA, 12 bp, Homo sapiens
gagaccaagctt

SEQ ID NO: 6209443 - DNA, 21 bp, Homo sapiens
gagaccaagcttgtttccctg

SEQ ID NO: 6209444 - DNA, 17 bp, Homo sapiens
gagaccaagtcctggct

SEQ ID NO: 6209445 - DNA, 12 bp, Homo sapiens
gagaccaccccc

SEQ ID NO: 6209446 - DNA, 21 bp, Homo sapiens
gagaccacttccttaacagct

SEQ ID NO: 6209447 - DNA, 13 bp, Homo sapiens
gagaccagcctcg

SEQ ID NO: 6209448 - DNA, 12 bp, Homo sapiens
gagaccagcctg

SEQ ID NO: 6209449 - DNA, 22 bp, Homo sapiens
gagaccagcctgccaggccctc

SEQ ID NO: 6209450 - DNA, 13 bp, Homo sapiens
gagaccagcctgg

SEQ ID NO: 6209451 - DNA, 16 bp, Homo sapiens
gagaccagcctgggca

SEQ ID NO: 6209452 - DNA, 23 bp, Homo sapiens
gagaccagcctgggcaacaaagt

SEQ ID NO: 6209453 - DNA, 19 bp, Homo sapiens
gagaccagctcagaggccc

SEQ ID NO: 6209454 - DNA, 22 bp, Homo sapiens
gagaccagctcagaggcccagg

SEQ ID NO: 6209455 - DNA, 12 bp, Homo sapiens
gagaccaggact

SEQ ID NO: 6209456 - DNA, 13 bp, Homo sapiens
gagaccaggaggg

SEQ ID NO: 6209457 - DNA, 17 bp, Homo sapiens
gagaccaggagggcact

SEQ ID NO: 6209458 - DNA, 18 bp, Homo sapiens
gagaccaggcaaagcaag

SEQ ID NO: 6209459 - DNA, 17 bp, Homo sapiens
gagaccaggggaccaga

SEQ ID NO: 6209460 - DNA, 18 bp, Homo sapiens
gagaccaggggaccagag

SEQ ID NO: 6209461 - DNA, 24 bp, Homo sapiens
gagaccagggtcttacctctctgg

SEQ ID NO: 6209462 - DNA, 14 bp, Homo sapiens
gagaccagggtggc

SEQ ID NO: 6209463 - DNA, 22 bp, Homo sapiens
gagaccagggtggccacacagg

SEQ ID NO: 6209464 - DNA, 21 bp, Homo sapiens
gagaccagtgtatcaggtcag

SEQ ID NO: 6209465 - DNA, 23 bp, Homo sapiens
gagaccagttgggagcactggag

SEQ ID NO: 6209466 - DNA, 17 bp, Homo sapiens
gagaccataagagaaac

SEQ ID NO: 6209467 - DNA, 21 bp, Homo sapiens
gagaccatccattctcctcag

SEQ ID NO: 6209468 - DNA, 14 bp, Homo sapiens
gagaccatccctga

SEQ ID NO: 6209469 - DNA, 14 bp, Homo sapiens
gagaccatcctggc

SEQ ID NO: 6209470 - DNA, 15 bp, Homo sapiens
gagaccatcctggcc

SEQ ID NO: 6209471 - DNA, 17 bp, Homo sapiens
gagaccatcctggcccc

SEQ ID NO: 6209472 - DNA, 16 bp, Homo sapiens
gagaccatcctggcta

SEQ ID NO: 6209473 - DNA, 17 bp, Homo sapiens
gagacccacagccctga

SEQ ID NO: 6209474 - DNA, 18 bp, Homo sapiens
gagacccaccatccttcc

SEQ ID NO: 6209475 - DNA, 17 bp, Homo sapiens
gagacccaccccacctg

SEQ ID NO: 6209476 - DNA, 21 bp, Homo sapiens
gagacccacctgaggctcagc

SEQ ID NO: 6209477 - DNA, 22 bp, Homo sapiens
gagacccacctgaggctcagcc

SEQ ID NO: 6209478 - DNA, 13 bp, Homo sapiens
gagacccagatct

SEQ ID NO: 6209479 - DNA, 19 bp, Homo sapiens
gagacccagatctcatgga

SEQ ID NO: 6209480 - DNA, 11 bp, Homo sapiens
gagacccagcg

SEQ ID NO: 6209481 - DNA, 15 bp, Homo sapiens
gagacccagctgcag

SEQ ID NO: 6209482 - DNA, 13 bp, Homo sapiens
gagacccaggagc

SEQ ID NO: 6209483 - DNA, 22 bp, Homo sapiens
gagaccccaaagactctggagg

SEQ ID NO: 6209484 - DNA, 23 bp, Homo sapiens
gagaccccaaagactctggaggt

SEQ ID NO: 6209485 - DNA, 23 bp, Homo sapiens
gagaccccaccgccaccgtgtgc

SEQ ID NO: 6209486 - DNA, 20 bp, Homo sapiens
gagaccccagtcgtgatgtg

SEQ ID NO: 6209487 - DNA, 17 bp, Homo sapiens
gagaccccagtgcctgc

SEQ ID NO: 6209488 - DNA, 18 bp, Homo sapiens
gagaccccagtgcctgca

SEQ ID NO: 6209489 - DNA, 14 bp, Homo sapiens
gagacccccacacc

SEQ ID NO: 6209490 - DNA, 15 bp, Homo sapiens
gagacccccacacct

SEQ ID NO: 6209491 - DNA, 14 bp, Homo sapiens
gagacccccaggcc

SEQ ID NO: 6209492 - DNA, 19 bp, Homo sapiens
gagacccccatccagcctc

SEQ ID NO: 6209493 - DNA, 20 bp, Homo sapiens
gagacccccatccagcctcc

SEQ ID NO: 6209494 - DNA, 19 bp, Homo sapiens
gagaccccgcacccggctc

SEQ ID NO: 6209495 - DNA, 16 bp, Homo sapiens
gagaccccgcactgca

SEQ ID NO: 6209496 - DNA, 19 bp, Homo sapiens
gagaccccgcactgcagac

SEQ ID NO: 6209497 - DNA, 17 bp, Homo sapiens
gagacccctggcctccg

SEQ ID NO: 6209498 - DNA, 17 bp, Homo sapiens
gagaccccttcctttcc

SEQ ID NO: 6209499 - DNA, 19 bp, Homo sapiens
gagaccccttcctttcctc

SEQ ID NO: 6209500 - DNA, 20 bp, Homo sapiens
gagacccctttaaactgtct

SEQ ID NO: 6209501 - DNA, 22 bp, Homo sapiens
gagacccgggaaggaaggctct

SEQ ID NO: 6209502 - DNA, 14 bp, Homo sapiens
gagaccctacagac

SEQ ID NO: 6209503 - DNA, 12 bp, Homo sapiens
gagaccctcact

SEQ ID NO: 6209504 - DNA, 14 bp, Homo sapiens
gagaccctccccac

SEQ ID NO: 6209505 - DNA, 20 bp, Homo sapiens
gagaccctccccacagtgcc

SEQ ID NO: 6209506 - DNA, 17 bp, Homo sapiens
gagaccctcgcagacct

SEQ ID NO: 6209507 - DNA, 21 bp, Homo sapiens
gagaccctctgccaccagaga

SEQ ID NO: 6209508 - DNA, 22 bp, Homo sapiens
gagaccctgcaaacagaacagg

SEQ ID NO: 6209509 - DNA, 16 bp, Homo sapiens
gagaccctgcaagacc

SEQ ID NO: 6209510 - DNA, 12 bp, Homo sapiens
gagaccctgcca

SEQ ID NO: 6209511 - DNA, 15 bp, Homo sapiens
gagaccctgccacag

SEQ ID NO: 6209512 - DNA, 19 bp, Homo sapiens
gagaccctgccacagccag

SEQ ID NO: 6209513 - DNA, 20 bp, Homo sapiens
gagaccctgccacagccaga

SEQ ID NO: 6209514 - DNA, 18 bp, Homo sapiens
gagaccctgcgcccctgc

SEQ ID NO: 6209515 - DNA, 19 bp, Homo sapiens
gagaccctgcgcccctgcc

SEQ ID NO: 6209516 - DNA, 20 bp, Homo sapiens
gagaccctgcgcccctgccc

SEQ ID NO: 6209517 - DNA, 13 bp, Homo sapiens
gagaccctggaat

SEQ ID NO: 6209518 - DNA, 13 bp, Homo sapiens
gagaccctggcct

SEQ ID NO: 6209519 - DNA, 18 bp, Homo sapiens
gagacccttttctcagga

SEQ ID NO: 6209520 - DNA, 15 bp, Homo sapiens
gagaccgagtgaacc

SEQ ID NO: 6209521 - DNA, 16 bp, Homo sapiens
gagaccgagtgtggag

SEQ ID NO: 6209522 - DNA, 20 bp, Homo sapiens
gagaccgagtgtggagctgc

SEQ ID NO: 6209523 - DNA, 19 bp, Homo sapiens
gagaccgcttcacccctgc

SEQ ID NO: 6209524 - DNA, 19 bp, Homo sapiens
gagaccggcctgccaggag

SEQ ID NO: 6209525 - DNA, 13 bp, Homo sapiens
gagaccgtcctca

SEQ ID NO: 6209526 - DNA, 16 bp, Homo sapiens
gagaccgtgagcgccc

SEQ ID NO: 6209527 - DNA, 18 bp, Homo sapiens
gagacctacctcaggttg

SEQ ID NO: 6209528 - DNA, 21 bp, Homo sapiens
gagacctacctcaggttgctg

SEQ ID NO: 6209529 - DNA, 16 bp, Homo sapiens
gagacctatgtaagaa

SEQ ID NO: 6209530 - DNA, 13 bp, Homo sapiens
gagacctcagaag

SEQ ID NO: 6209531 - DNA, 12 bp, Homo sapiens
gagacctcatca

SEQ ID NO: 6209532 - DNA, 17 bp, Homo sapiens
gagacctcatcagcctt

SEQ ID NO: 6209533 - DNA, 19 bp, Homo sapiens
gagacctcatcagccttgg

SEQ ID NO: 6209534 - DNA, 20 bp, Homo sapiens
gagacctcatcaggatgaac

SEQ ID NO: 6209535 - DNA, 20 bp, Homo sapiens
gagacctcatcctgctcttt

SEQ ID NO: 6209536 - DNA, 13 bp, Homo sapiens
gagacctccagct

SEQ ID NO: 6209537 - DNA, 16 bp, Homo sapiens
gagacctcccccaggg

SEQ ID NO: 6209538 - DNA, 17 bp, Homo sapiens
gagacctcccccaggga

SEQ ID NO: 6209539 - DNA, 19 bp, Homo sapiens
gagacctcccccagggagg

SEQ ID NO: 6209540 - DNA, 16 bp, Homo sapiens
gagacctcttctatct

SEQ ID NO: 6209541 - DNA, 19 bp, Homo sapiens
gagacctgacaagcactgc

SEQ ID NO: 6209542 - DNA, 15 bp, Homo sapiens
gagacctgacccaac

SEQ ID NO: 6209543 - DNA, 17 bp, Homo sapiens
gagacctgccctctctg

SEQ ID NO: 6209544 - DNA, 13 bp, Homo sapiens
gagacctgctcag

SEQ ID NO: 6209545 - DNA, 15 bp, Homo sapiens
gagacctgctcaggc

SEQ ID NO: 6209546 - DNA, 17 bp, Homo sapiens
gagacctgctcaggcgt

SEQ ID NO: 6209547 - DNA, 14 bp, Homo sapiens
gagacctgctctcc

SEQ ID NO: 6209548 - DNA, 19 bp, Homo sapiens
gagacctggaaccagagcc

SEQ ID NO: 6209549 - DNA, 19 bp, Homo sapiens
gagacctggacacaggcct

SEQ ID NO: 6209550 - DNA, 19 bp, Homo sapiens
gagacctggcactggatgc

SEQ ID NO: 6209551 - DNA, 10 bp, Homo sapiens
gagacctggt

SEQ ID NO: 6209552 - DNA, 18 bp, Homo sapiens
gagacctgttggcctgtg

SEQ ID NO: 6209553 - DNA, 19 bp, Homo sapiens
gagacctgttggcctgtgg

SEQ ID NO: 6209554 - DNA, 17 bp, Homo sapiens
gagaccttaatttatat

SEQ ID NO: 6209555 - DNA, 22 bp, Homo sapiens
gagaccttacccctggctgttt

SEQ ID NO: 6209556 - DNA, 16 bp, Homo sapiens
gagacctttgcccaca

SEQ ID NO: 6209557 - DNA, 18 bp, Homo sapiens
gagaccttttctctccca

SEQ ID NO: 6209558 - DNA, 20 bp, Homo sapiens
gagaccttttctctcccata

SEQ ID NO: 6209559 - DNA, 14 bp, Homo sapiens
gagacgaggcaggg

SEQ ID NO: 6209560 - DNA, 19 bp, Homo sapiens
gagacgcacacagctgagc

SEQ ID NO: 6209561 - DNA, 22 bp, Homo sapiens
gagacggagaccccggtggcag

SEQ ID NO: 6209562 - DNA, 16 bp, Homo sapiens
gagacggagtcccacc

SEQ ID NO: 6209563 - DNA, 17 bp, Homo sapiens
gagacggatggaaggag

SEQ ID NO: 6209564 - DNA, 19 bp, Homo sapiens
gagacggatggaaggagag

SEQ ID NO: 6209565 - DNA, 22 bp, Homo sapiens
gagacggatggaaggagagagg

SEQ ID NO: 6209566 - DNA, 14 bp, Homo sapiens
gagacggcagcccc

SEQ ID NO: 6209567 - DNA, 15 bp, Homo sapiens
gagacggcagcccca

SEQ ID NO: 6209568 - DNA, 16 bp, Homo sapiens
gagacggcagccccat

SEQ ID NO: 6209569 - DNA, 14 bp, Homo sapiens
gagacggccctgct

SEQ ID NO: 6209570 - DNA, 16 bp, Homo sapiens
gagacggctggacctg

SEQ ID NO: 6209571 - DNA, 19 bp, Homo sapiens
gagacgggcatcgcaggag

SEQ ID NO: 6209572 - DNA, 18 bp, Homo sapiens
gagacgggggcagagagg

SEQ ID NO: 6209573 - DNA, 13 bp, Homo sapiens
ctttggctttttc

SEQ ID NO: 6209574 - DNA, 12 bp, Homo sapiens
ctttgggaaagc

SEQ ID NO: 6209575 - DNA, 14 bp, Homo sapiens
ctttgggaaagccc

SEQ ID NO: 6209576 - DNA, 15 bp, Homo sapiens
ctttgggaaagccca

SEQ ID NO: 6209577 - DNA, 17 bp, Homo sapiens
ctttgggaaagcccaga

SEQ ID NO: 6209578 - DNA, 16 bp, Homo sapiens
ctttgggaaagctctt

SEQ ID NO: 6209579 - DNA, 18 bp, Homo sapiens
ctttgggaagctgaggca

SEQ ID NO: 6209580 - DNA, 13 bp, Homo sapiens
ctttgggaagggg

SEQ ID NO: 6209581 - DNA, 22 bp, Homo sapiens
ctttgggaagtttgctgtgctt

SEQ ID NO: 6209582 - DNA, 17 bp, Homo sapiens
ctttgggaatatttgaa

SEQ ID NO: 6209583 - DNA, 13 bp, Homo sapiens
ctttgggaatgtt

SEQ ID NO: 6209584 - DNA, 19 bp, Homo sapiens
ctttgggacacctcagaaa

SEQ ID NO: 6209585 - DNA, 13 bp, Homo sapiens
ctttgggacattc

SEQ ID NO: 6209586 - DNA, 20 bp, Homo sapiens
ctttgggacttgggagctgg

SEQ ID NO: 6209587 - DNA, 16 bp, Homo sapiens
ctttgggagagttcat

SEQ ID NO: 6209588 - DNA, 18 bp, Homo sapiens
ctttgggagcaaaataag

SEQ ID NO: 6209589 - DNA, 13 bp, Homo sapiens
ctttgggaggcca

SEQ ID NO: 6209590 - DNA, 18 bp, Homo sapiens
ctttgggaggccaaggca

SEQ ID NO: 6209591 - DNA, 18 bp, Homo sapiens
ctttgggaggccgaggca

SEQ ID NO: 6209592 - DNA, 17 bp, Homo sapiens
ctttgggaggctgaggc

SEQ ID NO: 6209593 - DNA, 21 bp, Homo sapiens
ctttgggaggtgtctgtgaag

SEQ ID NO: 6209594 - DNA, 18 bp, Homo sapiens
ctttgggatatggtcttg

SEQ ID NO: 6209595 - DNA, 17 bp, Homo sapiens
ctttgggatcccaccct

SEQ ID NO: 6209596 - DNA, 19 bp, Homo sapiens
ctttgggatcccaccctgg

SEQ ID NO: 6209597 - DNA, 20 bp, Homo sapiens
ctttgggatcccaccctggg

SEQ ID NO: 6209598 - DNA, 21 bp, Homo sapiens
ctttgggatcccaccctgggg

SEQ ID NO: 6209599 - DNA, 18 bp, Homo sapiens
ctttgggatgctatttca

SEQ ID NO: 6209600 - DNA, 19 bp, Homo sapiens
ctttgggattctaggaaac

SEQ ID NO: 6209601 - DNA, 19 bp, Homo sapiens
ctttgggatttaatttcca

SEQ ID NO: 6209602 - DNA, 20 bp, Homo sapiens
ctttgggcacaattcctgtg

SEQ ID NO: 6209603 - DNA, 14 bp, Homo sapiens
ctttgggcagattt

SEQ ID NO: 6209604 - DNA, 16 bp, Homo sapiens
ctttgggcagatttgc

SEQ ID NO: 6209605 - DNA, 14 bp, Homo sapiens
ctttgggcagtgcc

SEQ ID NO: 6209606 - DNA, 22 bp, Homo sapiens
ctttgggccaatttactggcca

SEQ ID NO: 6209607 - DNA, 24 bp, Homo sapiens
ctttgggccaatttactggccact

SEQ ID NO: 6209608 - DNA, 13 bp, Homo sapiens
ctttgggcccagg

SEQ ID NO: 6209609 - DNA, 16 bp, Homo sapiens
ctttgggcccagggac

SEQ ID NO: 6209610 - DNA, 14 bp, Homo sapiens
ctttgggccctgca

SEQ ID NO: 6209611 - DNA, 22 bp, Homo sapiens
ctttgggccgaatcccccaggg

SEQ ID NO: 6209612 - DNA, 17 bp, Homo sapiens
ctttgggcctggctccc

SEQ ID NO: 6209613 - DNA, 14 bp, Homo sapiens
ctttgggctgccct

SEQ ID NO: 6209614 - DNA, 21 bp, Homo sapiens
ctttgggctgccctggtgctg

SEQ ID NO: 6209615 - DNA, 22 bp, Homo sapiens
ctttgggcttagtatttctcag

SEQ ID NO: 6209616 - DNA, 12 bp, Homo sapiens
ctttgggctttg

SEQ ID NO: 6209617 - DNA, 17 bp, Homo sapiens
ctttgggctttgcaggc

SEQ ID NO: 6209618 - DNA, 15 bp, Homo sapiens
ctttggggaaaaatt

SEQ ID NO: 6209619 - DNA, 19 bp, Homo sapiens
ctttggggaaactaacaat

SEQ ID NO: 6209620 - DNA, 20 bp, Homo sapiens
ctttggggaaagggaggaag

SEQ ID NO: 6209621 - DNA, 17 bp, Homo sapiens
ctttggggaagggggag

SEQ ID NO: 6209622 - DNA, 20 bp, Homo sapiens
ctttggggaagtttatttga

SEQ ID NO: 6209623 - DNA, 21 bp, Homo sapiens
ctttggggaatttttttttaa

SEQ ID NO: 6209624 - DNA, 22 bp, Homo sapiens
ctttggggaatttttttttaag

SEQ ID NO: 6209625 - DNA, 19 bp, Homo sapiens
ctttggggacagttggcag

SEQ ID NO: 6209626 - DNA, 24 bp, Homo sapiens
ctttggggacagttggcagagaag

SEQ ID NO: 6209627 - DNA, 18 bp, Homo sapiens
ctttggggagagctggca

SEQ ID NO: 6209628 - DNA, 18 bp, Homo sapiens
ctttggggctaatttaac

SEQ ID NO: 6209629 - DNA, 14 bp, Homo sapiens
ctttggggcttctg

SEQ ID NO: 6209630 - DNA, 23 bp, Homo sapiens
ctttgggggaaacgggctccttc

SEQ ID NO: 6209631 - DNA, 23 bp, Homo sapiens
ctttgggggaggagaacatgagt

SEQ ID NO: 6209632 - DNA, 18 bp, Homo sapiens
ctttgggggattcaaatg

SEQ ID NO: 6209633 - DNA, 22 bp, Homo sapiens
ctttgggggattcaaatgcatg

SEQ ID NO: 6209634 - DNA, 20 bp, Homo sapiens
ctttgggggtggaaaaggaa

SEQ ID NO: 6209635 - DNA, 20 bp, Homo sapiens
ctttggggtagaccttgagg

SEQ ID NO: 6209636 - DNA, 17 bp, Homo sapiens
ctttggggtcagccagg

SEQ ID NO: 6209637 - DNA, 23 bp, Homo sapiens
ctttggggtctacactgcaatca

SEQ ID NO: 6209638 - DNA, 19 bp, Homo sapiens
ctttgggtactactgctgc

SEQ ID NO: 6209639 - DNA, 22 bp, Homo sapiens
ctttgggtacttatactaaatt

SEQ ID NO: 6209640 - DNA, 23 bp, Homo sapiens
ctttgggtagtgccatggccagg

SEQ ID NO: 6209641 - DNA, 14 bp, Homo sapiens
ctttgggtcatttt

SEQ ID NO: 6209642 - DNA, 17 bp, Homo sapiens
ctttgggtcatttttaa

SEQ ID NO: 6209643 - DNA, 14 bp, Homo sapiens
ctttgggtggctca

SEQ ID NO: 6209644 - DNA, 22 bp, Homo sapiens
ctttgggtggctcactactgaa

SEQ ID NO: 6209645 - DNA, 19 bp, Homo sapiens
ctttgggttctttctgggg

SEQ ID NO: 6209646 - DNA, 10 bp, Homo sapiens
ctttggtaat

SEQ ID NO: 6209647 - DNA, 16 bp, Homo sapiens
ctttggtaatgtgtca

SEQ ID NO: 6209648 - DNA, 15 bp, Homo sapiens
ctttggtacccccaa

SEQ ID NO: 6209649 - DNA, 19 bp, Homo sapiens
ctttggtacccccaaaccc

SEQ ID NO: 6209650 - DNA, 14 bp, Homo sapiens
ctttggtagaaaag

SEQ ID NO: 6209651 - DNA, 22 bp, Homo sapiens
ctttggtcacaagtaggagaca

SEQ ID NO: 6209652 - DNA, 20 bp, Homo sapiens
ctttggtctacactgtgctg

SEQ ID NO: 6209653 - DNA, 15 bp, Homo sapiens
ctttggtctattttc

SEQ ID NO: 6209654 - DNA, 19 bp, Homo sapiens
ctttggtctccatttttcc

SEQ ID NO: 6209655 - DNA, 17 bp, Homo sapiens
ctttggtctcttgcttg

SEQ ID NO: 6209656 - DNA, 15 bp, Homo sapiens
ctttggtcttgcccc

SEQ ID NO: 6209657 - DNA, 15 bp, Homo sapiens
ctttggtgaacattg

SEQ ID NO: 6209658 - DNA, 16 bp, Homo sapiens
ctttggtgaattcctt

SEQ ID NO: 6209659 - DNA, 17 bp, Homo sapiens
ctttggtgaattccttc

SEQ ID NO: 6209660 - DNA, 19 bp, Homo sapiens
ctttggtgagaacctgggt

SEQ ID NO: 6209661 - DNA, 23 bp, Homo sapiens
ctttggtgccaactggtgtttga

SEQ ID NO: 6209662 - DNA, 15 bp, Homo sapiens
ctttggtgcctcact

SEQ ID NO: 6209663 - DNA, 13 bp, Homo sapiens
ctttggtgccttt

SEQ ID NO: 6209664 - DNA, 14 bp, Homo sapiens
ctttggtgcctttc

SEQ ID NO: 6209665 - DNA, 21 bp, Homo sapiens
ctttggtgcgggcacaataaa

SEQ ID NO: 6209666 - DNA, 16 bp, Homo sapiens
ctttggtggccaggga

SEQ ID NO: 6209667 - DNA, 17 bp, Homo sapiens
ctttggtggctttgcat

SEQ ID NO: 6209668 - DNA, 22 bp, Homo sapiens
ctttggtggtttaaaaatggta

SEQ ID NO: 6209669 - DNA, 18 bp, Homo sapiens
ctttggtgttctggcctc

SEQ ID NO: 6209670 - DNA, 20 bp, Homo sapiens
ctttggttaataaataaatg

SEQ ID NO: 6209671 - DNA, 14 bp, Homo sapiens
ctttggttaataca

SEQ ID NO: 6209672 - DNA, 17 bp, Homo sapiens
ctttggttaatacatct

SEQ ID NO: 6209673 - DNA, 14 bp, Homo sapiens
ctttggttaatctc

SEQ ID NO: 6209674 - DNA, 21 bp, Homo sapiens
ctttggttatttcagccccca

SEQ ID NO: 6209675 - DNA, 14 bp, Homo sapiens
ctttggttcagcta

SEQ ID NO: 6209676 - DNA, 18 bp, Homo sapiens
ctttggttccttctctgg

SEQ ID NO: 6209677 - DNA, 13 bp, Homo sapiens
ctttggttctaag

SEQ ID NO: 6209678 - DNA, 15 bp, Homo sapiens
ctttggttctctcca

SEQ ID NO: 6209679 - DNA, 20 bp, Homo sapiens
ctttggttctctccaggaag

SEQ ID NO: 6209680 - DNA, 14 bp, Homo sapiens
ctttggttctggcc

SEQ ID NO: 6209681 - DNA, 19 bp, Homo sapiens
ctttggttctggccagaat

SEQ ID NO: 6209682 - DNA, 17 bp, Homo sapiens
ctttggttggaacttta

SEQ ID NO: 6209683 - DNA, 21 bp, Homo sapiens
ctttggtttgacaattttgtc

SEQ ID NO: 6209684 - DNA, 23 bp, Homo sapiens
ctttggtttgacaattttgtctt

SEQ ID NO: 6209685 - DNA, 17 bp, Homo sapiens
ctttggtttggcctcca

SEQ ID NO: 6209686 - DNA, 20 bp, Homo sapiens
ctttggtttggcctccatcc

SEQ ID NO: 6209687 - DNA, 14 bp, Homo sapiens
ctttggttttacta

SEQ ID NO: 6209688 - DNA, 11 bp, Homo sapiens
ctttggttttg

SEQ ID NO: 6209689 - DNA, 9 bp, Homo sapiens
ctttgtaaa

SEQ ID NO: 6209690 - DNA, 16 bp, Homo sapiens
ctttgtaaaaatcttt

SEQ ID NO: 6209691 - DNA, 16 bp, Homo sapiens
ctttgtaaaacagcct

SEQ ID NO: 6209692 - DNA, 13 bp, Homo sapiens
ctttgtaaaatct

SEQ ID NO: 6209693 - DNA, 21 bp, Homo sapiens
ctttgtaaatatcggatgggt

SEQ ID NO: 6209694 - DNA, 21 bp, Homo sapiens
ctttgtaaatgcatattaaat

SEQ ID NO: 6209695 - DNA, 23 bp, Homo sapiens
ctttgtaaatgcatattaaataa

SEQ ID NO: 6209696 - DNA, 15 bp, Homo sapiens
ctttgtaaattattt

SEQ ID NO: 6209697 - DNA, 13 bp, Homo sapiens
ctttgtaagaaaa

SEQ ID NO: 6209698 - DNA, 18 bp, Homo sapiens
ctttgtaagaaaaccaaa

SEQ ID NO: 6209699 - DNA, 16 bp, Homo sapiens
ctttgtaagacacaca

SEQ ID NO: 6209700 - DNA, 17 bp, Homo sapiens
ctttgtaagagtgtaga

SEQ ID NO: 6209701 - DNA, 18 bp, Homo sapiens
ctttgtaagagtgtagaa

SEQ ID NO: 6209702 - DNA, 20 bp, Homo sapiens
ctttgtaaggacttgtgcct

SEQ ID NO: 6209703 - DNA, 21 bp, Homo sapiens
ctttgtaaggacttgtgcctc

SEQ ID NO: 6209704 - DNA, 21 bp, Homo sapiens
ctttgtaagtcagtgttgaga

SEQ ID NO: 6209705 - DNA, 12 bp, Homo sapiens
ctttgtaataaa

SEQ ID NO: 6209706 - DNA, 14 bp, Homo sapiens
ctttgtaatatgag

SEQ ID NO: 6209707 - DNA, 18 bp, Homo sapiens
ctttgtaatatgagaatg

SEQ ID NO: 6209708 - DNA, 18 bp, Homo sapiens
ctttgtaatcactcccat

SEQ ID NO: 6209709 - DNA, 19 bp, Homo sapiens
ctttgtaatcactcccatt

SEQ ID NO: 6209710 - DNA, 19 bp, Homo sapiens
ctttgtaatcgttatgtgt

SEQ ID NO: 6209711 - DNA, 21 bp, Homo sapiens
ctttgtaatcgttatgtgtgt

SEQ ID NO: 6209712 - DNA, 14 bp, Homo sapiens
ctttgtaatgcttg

SEQ ID NO: 6209713 - DNA, 16 bp, Homo sapiens
ctttgtaatgcttgta

SEQ ID NO: 6209714 - DNA, 13 bp, Homo sapiens
ctttgtaatggga

SEQ ID NO: 6209715 - DNA, 21 bp, Homo sapiens
ctttgtaatgtcaccaccttc

SEQ ID NO: 6209716 - DNA, 19 bp, Homo sapiens
ctttgtaatttaatgaaaa

SEQ ID NO: 6209717 - DNA, 15 bp, Homo sapiens
ctttgtaatttttgg

SEQ ID NO: 6209718 - DNA, 16 bp, Homo sapiens
ctttgtaatttttggg

SEQ ID NO: 6209719 - DNA, 22 bp, Homo sapiens
ctttgtacacccatgaaagaaa

SEQ ID NO: 6209720 - DNA, 22 bp, Homo sapiens
ctttgtacagaccgagaggcca

SEQ ID NO: 6209721 - DNA, 15 bp, Homo sapiens
ctttgtacagagtgc

SEQ ID NO: 6209722 - DNA, 15 bp, Homo sapiens
ctttgtacagcccag

SEQ ID NO: 6209723 - DNA, 17 bp, Homo sapiens
ctttgtacagcccagag

SEQ ID NO: 6209724 - DNA, 20 bp, Homo sapiens
ctttgtaccttttgtagttt

SEQ ID NO: 6209725 - DNA, 21 bp, Homo sapiens
ctttgtactaatacagggagc

SEQ ID NO: 6209726 - DNA, 16 bp, Homo sapiens
ctttgtagaaattaaa

SEQ ID NO: 6209727 - DNA, 11 bp, Homo sapiens
ctttgtagaac

SEQ ID NO: 6209728 - DNA, 17 bp, Homo sapiens
ctttgtagacattttga

SEQ ID NO: 6209729 - DNA, 16 bp, Homo sapiens
ctttgtagcatttggt

SEQ ID NO: 6209730 - DNA, 18 bp, Homo sapiens
ctttgtagctaacagtga

SEQ ID NO: 6209731 - DNA, 14 bp, Homo sapiens
ctttgtagctccta

SEQ ID NO: 6209732 - DNA, 18 bp, Homo sapiens
ctttgtaggtgagatgca

SEQ ID NO: 6209733 - DNA, 20 bp, Homo sapiens
ctttgtagtgtttggtgctc

SEQ ID NO: 6209734 - DNA, 20 bp, Homo sapiens
ctttgtagtttgcccagagt

SEQ ID NO: 6209735 - DNA, 15 bp, Homo sapiens
ctttgtataatccca

SEQ ID NO: 6209736 - DNA, 23 bp, Homo sapiens
ctttgtataatcccacccacctc

SEQ ID NO: 6209737 - DNA, 16 bp, Homo sapiens
ctttgtatacaagtac

SEQ ID NO: 6209738 - DNA, 16 bp, Homo sapiens
ctttgtatactttaaa

SEQ ID NO: 6209739 - DNA, 20 bp, Homo sapiens
ctttgtatagaacctctttg

SEQ ID NO: 6209740 - DNA, 15 bp, Homo sapiens
ctttgtatagttatg

SEQ ID NO: 6209741 - DNA, 19 bp, Homo sapiens
ctttgtatagttatgtaaa

SEQ ID NO: 6209742 - DNA, 10 bp, Homo sapiens
ctttgtatat

SEQ ID NO: 6209743 - DNA, 21 bp, Homo sapiens
ctttgtatataggcttctcac

SEQ ID NO: 6209744 - DNA, 12 bp, Homo sapiens
ctttgtatatta

SEQ ID NO: 6209745 - DNA, 15 bp, Homo sapiens
ctttgtatattattt

SEQ ID NO: 6209746 - DNA, 20 bp, Homo sapiens
ctttgtatcagtcagtgctg

SEQ ID NO: 6209747 - DNA, 18 bp, Homo sapiens
ctttgtatcattcatctt

SEQ ID NO: 6209748 - DNA, 19 bp, Homo sapiens
ctttgtatcattcatcttc

SEQ ID NO: 6209749 - DNA, 20 bp, Homo sapiens
ctttgtatgatattccatag

SEQ ID NO: 6209750 - DNA, 23 bp, Homo sapiens
ctttgtatgatgaaaagaatgtg

SEQ ID NO: 6209751 - DNA, 21 bp, Homo sapiens
gagacggggtctccctgtgtt

SEQ ID NO: 6209752 - DNA, 22 bp, Homo sapiens
gagacggtcatgcaagaaagca

SEQ ID NO: 6209753 - DNA, 18 bp, Homo sapiens
gagacggtgggaaaataa

SEQ ID NO: 6209754 - DNA, 18 bp, Homo sapiens
gagacgtccaccctgcag

SEQ ID NO: 6209755 - DNA, 18 bp, Homo sapiens
gagacgtggaacctctgt

SEQ ID NO: 6209756 - DNA, 21 bp, Homo sapiens
gagacgtggaacctctgtctc

SEQ ID NO: 6209757 - DNA, 19 bp, Homo sapiens
gagacgtggtgggactcca

SEQ ID NO: 6209758 - DNA, 15 bp, Homo sapiens
gagacgtgtacatag

SEQ ID NO: 6209759 - DNA, 23 bp, Homo sapiens
gagactaaccccaccacaccctc

SEQ ID NO: 6209760 - DNA, 13 bp, Homo sapiens
gagactaagagaa

SEQ ID NO: 6209761 - DNA, 17 bp, Homo sapiens
gagactaagagaaacct

SEQ ID NO: 6209762 - DNA, 22 bp, Homo sapiens
gagactaagccctgtcgagaca

SEQ ID NO: 6209763 - DNA, 21 bp, Homo sapiens
gagactaatagagacacagag

SEQ ID NO: 6209764 - DNA, 15 bp, Homo sapiens
gagactactctgcct

SEQ ID NO: 6209765 - DNA, 18 bp, Homo sapiens
gagactatgcgtttttat

SEQ ID NO: 6209766 - DNA, 20 bp, Homo sapiens
gagactatgcgtttttataa

SEQ ID NO: 6209767 - DNA, 15 bp, Homo sapiens
gagactatggcctcg

SEQ ID NO: 6209768 - DNA, 13 bp, Homo sapiens
gagactatgtgtc

SEQ ID NO: 6209769 - DNA, 23 bp, Homo sapiens
gagactattcatcaagaatgagg

SEQ ID NO: 6209770 - DNA, 19 bp, Homo sapiens
gagactcacactctctgca

SEQ ID NO: 6209771 - DNA, 20 bp, Homo sapiens
gagactcacactctctgcag

SEQ ID NO: 6209772 - DNA, 22 bp, Homo sapiens
gagactcacactctctgcagcc

SEQ ID NO: 6209773 - DNA, 15 bp, Homo sapiens
gagactcacctctgc

SEQ ID NO: 6209774 - DNA, 16 bp, Homo sapiens
gagactcacctctgcc

SEQ ID NO: 6209775 - DNA, 17 bp, Homo sapiens
gagactcacctctgcct

SEQ ID NO: 6209776 - DNA, 20 bp, Homo sapiens
gagactcacctctgcctcaa

SEQ ID NO: 6209777 - DNA, 23 bp, Homo sapiens
gagactcacctctgcctcaatgt

SEQ ID NO: 6209778 - DNA, 13 bp, Homo sapiens
gagactcagatga

SEQ ID NO: 6209779 - DNA, 16 bp, Homo sapiens
gagactcagcctctgc

SEQ ID NO: 6209780 - DNA, 18 bp, Homo sapiens
gagactcagcctctgctg

SEQ ID NO: 6209781 - DNA, 19 bp, Homo sapiens
gagactcagcctctgctgg

SEQ ID NO: 6209782 - DNA, 20 bp, Homo sapiens
gagactcagcctctgctgga

SEQ ID NO: 6209783 - DNA, 15 bp, Homo sapiens
gagactcagcgctcc

SEQ ID NO: 6209784 - DNA, 17 bp, Homo sapiens
gagactcagcgctcctc

SEQ ID NO: 6209785 - DNA, 20 bp, Homo sapiens
gagactcagcgctcctcctg

SEQ ID NO: 6209786 - DNA, 21 bp, Homo sapiens
gagactcagcgctcctcctgt

SEQ ID NO: 6209787 - DNA, 22 bp, Homo sapiens
gagactcagcgctcctcctgtg

SEQ ID NO: 6209788 - DNA, 23 bp, Homo sapiens
gagactcagtgcagatggagaga

SEQ ID NO: 6209789 - DNA, 13 bp, Homo sapiens
gagactccaagga

SEQ ID NO: 6209790 - DNA, 17 bp, Homo sapiens
gagactccagaatctgc

SEQ ID NO: 6209791 - DNA, 13 bp, Homo sapiens
gagactccatctt

SEQ ID NO: 6209792 - DNA, 16 bp, Homo sapiens
gagactccatgagaag

SEQ ID NO: 6209793 - DNA, 16 bp, Homo sapiens
gagactcccaggagtt

SEQ ID NO: 6209794 - DNA, 17 bp, Homo sapiens
gagactcccatgaagcc

SEQ ID NO: 6209795 - DNA, 18 bp, Homo sapiens
gagactccgtctcaagga

SEQ ID NO: 6209796 - DNA, 13 bp, Homo sapiens
gagactcctcagc

SEQ ID NO: 6209797 - DNA, 22 bp, Homo sapiens
gagactcctcagcacccctcca

SEQ ID NO: 6209798 - DNA, 12 bp, Homo sapiens
gagactcctcgg

SEQ ID NO: 6209799 - DNA, 14 bp, Homo sapiens
gagactcctgaagg

SEQ ID NO: 6209800 - DNA, 13 bp, Homo sapiens
gagactcctgcag

SEQ ID NO: 6209801 - DNA, 16 bp, Homo sapiens
gagactcctgcaggca

SEQ ID NO: 6209802 - DNA, 17 bp, Homo sapiens
gagactcctgccctgtt

SEQ ID NO: 6209803 - DNA, 16 bp, Homo sapiens
gagactcctggtctgt

SEQ ID NO: 6209804 - DNA, 15 bp, Homo sapiens
gagactcgagaactt

SEQ ID NO: 6209805 - DNA, 16 bp, Homo sapiens
gagactcgagtcccca

SEQ ID NO: 6209806 - DNA, 19 bp, Homo sapiens
gagactcgagtccccatga

SEQ ID NO: 6209807 - DNA, 14 bp, Homo sapiens
gagactcgcctggg

SEQ ID NO: 6209808 - DNA, 16 bp, Homo sapiens
gagactcgcctgggaa

SEQ ID NO: 6209809 - DNA, 20 bp, Homo sapiens
gagactcgcgacaatgcaaa

SEQ ID NO: 6209810 - DNA, 19 bp, Homo sapiens
gagactctcttaggagcag

SEQ ID NO: 6209811 - DNA, 12 bp, Homo sapiens
gagactctgaga

SEQ ID NO: 6209812 - DNA, 12 bp, Homo sapiens
gagactctggcc

SEQ ID NO: 6209813 - DNA, 14 bp, Homo sapiens
gagactctggcctc

SEQ ID NO: 6209814 - DNA, 24 bp, Homo sapiens
gagactctttatttttctctttct

SEQ ID NO: 6209815 - DNA, 21 bp, Homo sapiens
gagactgaaagcagcagctag

SEQ ID NO: 6209816 - DNA, 18 bp, Homo sapiens
gagactgacacctcactg

SEQ ID NO: 6209817 - DNA, 14 bp, Homo sapiens
gagactgagcagcc

SEQ ID NO: 6209818 - DNA, 15 bp, Homo sapiens
gagactgagcagccg

SEQ ID NO: 6209819 - DNA, 16 bp, Homo sapiens
gagactgagcagccgc

SEQ ID NO: 6209820 - DNA, 16 bp, Homo sapiens
gagactgagggagaga

SEQ ID NO: 6209821 - DNA, 18 bp, Homo sapiens
gagactgagggagagact

SEQ ID NO: 6209822 - DNA, 21 bp, Homo sapiens
gagactgatccctggccactg

SEQ ID NO: 6209823 - DNA, 12 bp, Homo sapiens
gagactgatggg

SEQ ID NO: 6209824 - DNA, 16 bp, Homo sapiens
gagactgcaagtaagg

SEQ ID NO: 6209825 - DNA, 20 bp, Homo sapiens
gagactgcaagtaaggcttt

SEQ ID NO: 6209826 - DNA, 15 bp, Homo sapiens
gagactgcagaggag

SEQ ID NO: 6209827 - DNA, 18 bp, Homo sapiens
gagactgcaggtgggctg

SEQ ID NO: 6209828 - DNA, 19 bp, Homo sapiens
gagactgccatacataata

SEQ ID NO: 6209829 - DNA, 17 bp, Homo sapiens
gagactgcccaccctgg

SEQ ID NO: 6209830 - DNA, 19 bp, Homo sapiens
gagactgcccaccctgggc

SEQ ID NO: 6209831 - DNA, 22 bp, Homo sapiens
gagactgcgggatggtcctggg

SEQ ID NO: 6209832 - DNA, 16 bp, Homo sapiens
gagactgcgttctgca

SEQ ID NO: 6209833 - DNA, 22 bp, Homo sapiens
gagactgctagaaccaagcact

SEQ ID NO: 6209834 - DNA, 14 bp, Homo sapiens
gagactgcttccca

SEQ ID NO: 6209835 - DNA, 12 bp, Homo sapiens
gagactggagca

SEQ ID NO: 6209836 - DNA, 15 bp, Homo sapiens
gagactggcagccag

SEQ ID NO: 6209837 - DNA, 16 bp, Homo sapiens
gagactggcaggcggg

SEQ ID NO: 6209838 - DNA, 16 bp, Homo sapiens
gagactggccagaggc

SEQ ID NO: 6209839 - DNA, 22 bp, Homo sapiens
gagactggcgtgaacccaggag

SEQ ID NO: 6209840 - DNA, 13 bp, Homo sapiens
gagactgggaaga

SEQ ID NO: 6209841 - DNA, 17 bp, Homo sapiens
gagactgggaaggcttg

SEQ ID NO: 6209842 - DNA, 22 bp, Homo sapiens
gagactgggaaggcttgggatt

SEQ ID NO: 6209843 - DNA, 17 bp, Homo sapiens
gagactgggcacccctg

SEQ ID NO: 6209844 - DNA, 18 bp, Homo sapiens
gagactgggcacccctgc

SEQ ID NO: 6209845 - DNA, 23 bp, Homo sapiens
gagactgggcctaggccaggagt

SEQ ID NO: 6209846 - DNA, 17 bp, Homo sapiens
gagactgggctctggct

SEQ ID NO: 6209847 - DNA, 20 bp, Homo sapiens
gagactgggctgagggagcc

SEQ ID NO: 6209848 - DNA, 21 bp, Homo sapiens
gagactgggctgagggagcct

SEQ ID NO: 6209849 - DNA, 19 bp, Homo sapiens
gagactggggggcttgaaa

SEQ ID NO: 6209850 - DNA, 12 bp, Homo sapiens
gagactggggtg

SEQ ID NO: 6209851 - DNA, 23 bp, Homo sapiens
gagactggtaggaggaggcatgg

SEQ ID NO: 6209852 - DNA, 15 bp, Homo sapiens
gagactgtaaaacaa

SEQ ID NO: 6209853 - DNA, 12 bp, Homo sapiens
gagactgtacat

SEQ ID NO: 6209854 - DNA, 15 bp, Homo sapiens
gagactgtcaggaag

SEQ ID NO: 6209855 - DNA, 13 bp, Homo sapiens
gagactgtcccga

SEQ ID NO: 6209856 - DNA, 19 bp, Homo sapiens
gagactgtcggagaggctg

SEQ ID NO: 6209857 - DNA, 20 bp, Homo sapiens
gagactgtcggagaggctgt

SEQ ID NO: 6209858 - DNA, 12 bp, Homo sapiens
gagactgtgcca

SEQ ID NO: 6209859 - DNA, 14 bp, Homo sapiens
gagactgtggggag

SEQ ID NO: 6209860 - DNA, 18 bp, Homo sapiens
gagactgtggggagggtc

SEQ ID NO: 6209861 - DNA, 20 bp, Homo sapiens
gagactgtggtaggggcagg

SEQ ID NO: 6209862 - DNA, 22 bp, Homo sapiens
gagactgtggtaggggcaggga

SEQ ID NO: 6209863 - DNA, 22 bp, Homo sapiens
gagactgtgtgtgccctctggg

SEQ ID NO: 6209864 - DNA, 23 bp, Homo sapiens
gagactgtgtgtgccctctgggc

SEQ ID NO: 6209865 - DNA, 23 bp, Homo sapiens
gagactgtttgaatcttgtctca

SEQ ID NO: 6209866 - DNA, 16 bp, Homo sapiens
gagactgtttggaaat

SEQ ID NO: 6209867 - DNA, 14 bp, Homo sapiens
gagacttaaaacat

SEQ ID NO: 6209868 - DNA, 15 bp, Homo sapiens
gagacttaaaacatg

SEQ ID NO: 6209869 - DNA, 20 bp, Homo sapiens
gagacttaatagacattttt

SEQ ID NO: 6209870 - DNA, 20 bp, Homo sapiens
gagacttacgccctgttccc

SEQ ID NO: 6209871 - DNA, 18 bp, Homo sapiens
gagacttagggcaccagg

SEQ ID NO: 6209872 - DNA, 20 bp, Homo sapiens
gagacttccaaacctgacag

SEQ ID NO: 6209873 - DNA, 15 bp, Homo sapiens
gagacttccgtcacc

SEQ ID NO: 6209874 - DNA, 19 bp, Homo sapiens
gagacttcctattaattta

SEQ ID NO: 6209875 - DNA, 22 bp, Homo sapiens
gagacttctgtttgatcactgt

SEQ ID NO: 6209876 - DNA, 19 bp, Homo sapiens
gagacttgcagttagactc

SEQ ID NO: 6209877 - DNA, 14 bp, Homo sapiens
gagacttgctctct

SEQ ID NO: 6209878 - DNA, 20 bp, Homo sapiens
gagacttggaagaggaggag

SEQ ID NO: 6209879 - DNA, 21 bp, Homo sapiens
gagacttggatgaggagtggt

SEQ ID NO: 6209880 - DNA, 17 bp, Homo sapiens
gagacttggggaccaga

SEQ ID NO: 6209881 - DNA, 12 bp, Homo sapiens
gagacttgtgtc

SEQ ID NO: 6209882 - DNA, 16 bp, Homo sapiens
gagactttaaaagcat

SEQ ID NO: 6209883 - DNA, 17 bp, Homo sapiens
gagactttaaaagcatt

SEQ ID NO: 6209884 - DNA, 13 bp, Homo sapiens
gagactttctgaa

SEQ ID NO: 6209885 - DNA, 14 bp, Homo sapiens
gagactttctgctg

SEQ ID NO: 6209886 - DNA, 19 bp, Homo sapiens
gagactttgatgtcagcag

SEQ ID NO: 6209887 - DNA, 20 bp, Homo sapiens
gagactttgctgttactgct

SEQ ID NO: 6209888 - DNA, 22 bp, Homo sapiens
gagacttttaatcagacaaagt

SEQ ID NO: 6209889 - DNA, 21 bp, Homo sapiens
gagactttttggtggatgtaa

SEQ ID NO: 6209890 - DNA, 14 bp, Homo sapiens
gagacttttttcta

SEQ ID NO: 6209891 - DNA, 14 bp, Homo sapiens
gagagaaaaagaga

SEQ ID NO: 6209892 - DNA, 15 bp, Homo sapiens
gagagaaaaagagag

SEQ ID NO: 6209893 - DNA, 12 bp, Homo sapiens
gagagaaaagaa

SEQ ID NO: 6209894 - DNA, 13 bp, Homo sapiens
gagagaaaagaaa

SEQ ID NO: 6209895 - DNA, 14 bp, Homo sapiens
gagagaaaataaaa

SEQ ID NO: 6209896 - DNA, 19 bp, Homo sapiens
gagagaaaataaaaagtta

SEQ ID NO: 6209897 - DNA, 13 bp, Homo sapiens
gagagaaaatata

SEQ ID NO: 6209898 - DNA, 21 bp, Homo sapiens
gagagaaaatatatgtatttt

SEQ ID NO: 6209899 - DNA, 13 bp, Homo sapiens
gagagaaacaaac

SEQ ID NO: 6209900 - DNA, 16 bp, Homo sapiens
gagagaaagaatgaga

SEQ ID NO: 6209901 - DNA, 14 bp, Homo sapiens
gagagaaagagaac

SEQ ID NO: 6209902 - DNA, 13 bp, Homo sapiens
gagagaaagagag

SEQ ID NO: 6209903 - DNA, 17 bp, Homo sapiens
gagagaaagagagaagc

SEQ ID NO: 6209904 - DNA, 19 bp, Homo sapiens
gagagaaagagagaagcca

SEQ ID NO: 6209905 - DNA, 16 bp, Homo sapiens
gagagaaagtgacatg

SEQ ID NO: 6209906 - DNA, 18 bp, Homo sapiens
gagagaaagtgggtgaga

SEQ ID NO: 6209907 - DNA, 11 bp, Homo sapiens
gagagaaatat

SEQ ID NO: 6209908 - DNA, 13 bp, Homo sapiens
gagagaaattctg

SEQ ID NO: 6209909 - DNA, 16 bp, Homo sapiens
gagagaaattctgtta

SEQ ID NO: 6209910 - DNA, 23 bp, Homo sapiens
gagagaacaacaggcaggggccc

SEQ ID NO: 6209911 - DNA, 15 bp, Homo sapiens
gagagaaccaggagg

SEQ ID NO: 6209912 - DNA, 18 bp, Homo sapiens
gagagaacctaactgtat

SEQ ID NO: 6209913 - DNA, 14 bp, Homo sapiens
gagagaacttaaaa

SEQ ID NO: 6209914 - DNA, 14 bp, Homo sapiens
gagagaagaggact

SEQ ID NO: 6209915 - DNA, 11 bp, Homo sapiens
gagagaagcca

SEQ ID NO: 6209916 - DNA, 16 bp, Homo sapiens
gagagaagccagccac

SEQ ID NO: 6209917 - DNA, 13 bp, Homo sapiens
gagagaagctgat

SEQ ID NO: 6209918 - DNA, 15 bp, Homo sapiens
gagagaagggaattt

SEQ ID NO: 6209919 - DNA, 12 bp, Homo sapiens
gagagaagggga

SEQ ID NO: 6209920 - DNA, 16 bp, Homo sapiens
gagagaaggggaggag

SEQ ID NO: 6209921 - DNA, 12 bp, Homo sapiens
gagagaaggggc

SEQ ID NO: 6209922 - DNA, 22 bp, Homo sapiens
gagagaaggggcccaagagaga

SEQ ID NO: 6209923 - DNA, 18 bp, Homo sapiens
gagagaagtcggccaggt

SEQ ID NO: 6209924 - DNA, 21 bp, Homo sapiens
gagagaagtgcccctgctgcc

SEQ ID NO: 6209925 - DNA, 12 bp, Homo sapiens
gagagaataaat

SEQ ID NO: 6209926 - DNA, 13 bp, Homo sapiens
gagagaataaatt

SEQ ID NO: 6209927 - DNA, 21 bp, Homo sapiens
gagagaataaattggattatt

SEQ ID NO: 6209928 - DNA, 22 bp, Homo sapiens
gagagaataaattggattattt

SEQ ID NO: 6209929 - DNA, 16 bp, Homo sapiens
gagagaatagagctgc

SEQ ID NO: 6209930 - DNA, 14 bp, Homo sapiens
gagagaatcagacc

SEQ ID NO: 6209931 - DNA, 13 bp, Homo sapiens
ctttgtattactt

SEQ ID NO: 6209932 - DNA, 16 bp, Homo sapiens
ctttgtattataattg

SEQ ID NO: 6209933 - DNA, 11 bp, Homo sapiens
ctttgtattct

SEQ ID NO: 6209934 - DNA, 14 bp, Homo sapiens
ctttgtattctctg

SEQ ID NO: 6209935 - DNA, 15 bp, Homo sapiens
ctttgtattcttcat

SEQ ID NO: 6209936 - DNA, 13 bp, Homo sapiens
ctttgtattttga

SEQ ID NO: 6209937 - DNA, 21 bp, Homo sapiens
ctttgtcaataaacctgtcat

SEQ ID NO: 6209938 - DNA, 16 bp, Homo sapiens
ctttgtcaatgctcta

SEQ ID NO: 6209939 - DNA, 14 bp, Homo sapiens
ctttgtcacttatt

SEQ ID NO: 6209940 - DNA, 21 bp, Homo sapiens
ctttgtcacttctgctgtaca

SEQ ID NO: 6209941 - DNA, 18 bp, Homo sapiens
ctttgtcacttgccacat

SEQ ID NO: 6209942 - DNA, 22 bp, Homo sapiens
ctttgtcacttttccttttctt

SEQ ID NO: 6209943 - DNA, 14 bp, Homo sapiens
ctttgtcagggagt

SEQ ID NO: 6209944 - DNA, 13 bp, Homo sapiens
ctttgtcagtgtt

SEQ ID NO: 6209945 - DNA, 21 bp, Homo sapiens
ctttgtcatgcgtctctggcc

SEQ ID NO: 6209946 - DNA, 15 bp, Homo sapiens
ctttgtcccagtcct

SEQ ID NO: 6209947 - DNA, 18 bp, Homo sapiens
ctttgtccccacacagcc

SEQ ID NO: 6209948 - DNA, 19 bp, Homo sapiens
ctttgtccccacacagcct

SEQ ID NO: 6209949 - DNA, 21 bp, Homo sapiens
ctttgtcccctcacctccacc

SEQ ID NO: 6209950 - DNA, 15 bp, Homo sapiens
ctttgtcccggggct

SEQ ID NO: 6209951 - DNA, 18 bp, Homo sapiens
ctttgtcctgaatggctt

SEQ ID NO: 6209952 - DNA, 21 bp, Homo sapiens
ctttgtcctgaatggctttgt

SEQ ID NO: 6209953 - DNA, 18 bp, Homo sapiens
ctttgtccttttgctctt

SEQ ID NO: 6209954 - DNA, 23 bp, Homo sapiens
ctttgtcgctgggtcagtgctgg

SEQ ID NO: 6209955 - DNA, 17 bp, Homo sapiens
ctttgtcgtggttctta

SEQ ID NO: 6209956 - DNA, 19 bp, Homo sapiens
ctttgtctaaaacaataaa

SEQ ID NO: 6209957 - DNA, 20 bp, Homo sapiens
ctttgtctaactcagaatta

SEQ ID NO: 6209958 - DNA, 20 bp, Homo sapiens
ctttgtctcaaaataaagca

SEQ ID NO: 6209959 - DNA, 21 bp, Homo sapiens
ctttgtctcaccagctcagcc

SEQ ID NO: 6209960 - DNA, 19 bp, Homo sapiens
ctttgtctcctctatcctg

SEQ ID NO: 6209961 - DNA, 16 bp, Homo sapiens
ctttgtctctcctggc

SEQ ID NO: 6209962 - DNA, 18 bp, Homo sapiens
ctttgtctggatgcacac

SEQ ID NO: 6209963 - DNA, 19 bp, Homo sapiens
ctttgtctggatgcacact

SEQ ID NO: 6209964 - DNA, 14 bp, Homo sapiens
ctttgtctggccac

SEQ ID NO: 6209965 - DNA, 15 bp, Homo sapiens
ctttgtctggcctca

SEQ ID NO: 6209966 - DNA, 14 bp, Homo sapiens
ctttgtctgtacat

SEQ ID NO: 6209967 - DNA, 13 bp, Homo sapiens
ctttgtctgtcca

SEQ ID NO: 6209968 - DNA, 17 bp, Homo sapiens
ctttgtcttgatcctca

SEQ ID NO: 6209969 - DNA, 12 bp, Homo sapiens
ctttgtcttgga

SEQ ID NO: 6209970 - DNA, 15 bp, Homo sapiens
ctttgtcttgtactt

SEQ ID NO: 6209971 - DNA, 19 bp, Homo sapiens
ctttgtcttgtacttctgt

SEQ ID NO: 6209972 - DNA, 19 bp, Homo sapiens
ctttgtctttctttgtcat

SEQ ID NO: 6209973 - DNA, 14 bp, Homo sapiens
ctttgtcttttcaa

SEQ ID NO: 6209974 - DNA, 13 bp, Homo sapiens
ctttgtctttttc

SEQ ID NO: 6209975 - DNA, 13 bp, Homo sapiens
ctttgtgaacatt

SEQ ID NO: 6209976 - DNA, 15 bp, Homo sapiens
ctttgtgaacattct

SEQ ID NO: 6209977 - DNA, 12 bp, Homo sapiens
ctttgtgaatat

SEQ ID NO: 6209978 - DNA, 22 bp, Homo sapiens
ctttgtgacaggaaagccctcc

SEQ ID NO: 6209979 - DNA, 15 bp, Homo sapiens
ctttgtgactgtata

SEQ ID NO: 6209980 - DNA, 23 bp, Homo sapiens
ctttgtgactgtatataaaggaa

SEQ ID NO: 6209981 - DNA, 14 bp, Homo sapiens
ctttgtgacttctt

SEQ ID NO: 6209982 - DNA, 21 bp, Homo sapiens
ctttgtgacttcttcttcttt

SEQ ID NO: 6209983 - DNA, 11 bp, Homo sapiens
ctttgtgagag

SEQ ID NO: 6209984 - DNA, 17 bp, Homo sapiens
ctttgtgagcctatgat

SEQ ID NO: 6209985 - DNA, 23 bp, Homo sapiens
ctttgtgaggaagccgctggggc

SEQ ID NO: 6209986 - DNA, 15 bp, Homo sapiens
ctttgtgataattta

SEQ ID NO: 6209987 - DNA, 18 bp, Homo sapiens
ctttgtgattatttcact

SEQ ID NO: 6209988 - DNA, 12 bp, Homo sapiens
ctttgtgatttt

SEQ ID NO: 6209989 - DNA, 18 bp, Homo sapiens
ctttgtgatttttgtaat

SEQ ID NO: 6209990 - DNA, 12 bp, Homo sapiens
ctttgtgcaaaa

SEQ ID NO: 6209991 - DNA, 16 bp, Homo sapiens
ctttgtgcacatttat

SEQ ID NO: 6209992 - DNA, 18 bp, Homo sapiens
ctttgtgcacatttattt

SEQ ID NO: 6209993 - DNA, 23 bp, Homo sapiens
ctttgtgcacatttatttcctcc

SEQ ID NO: 6209994 - DNA, 19 bp, Homo sapiens
ctttgtgcagggtcctccg

SEQ ID NO: 6209995 - DNA, 13 bp, Homo sapiens
ctttgtgcctttg

SEQ ID NO: 6209996 - DNA, 14 bp, Homo sapiens
ctttgtgcctttgg

SEQ ID NO: 6209997 - DNA, 18 bp, Homo sapiens
ctttgtgcctttggcctg

SEQ ID NO: 6209998 - DNA, 13 bp, Homo sapiens
ctttgtgctgctg

SEQ ID NO: 6209999 - DNA, 22 bp, Homo sapiens
ctttgtgctggggttatctgaa

SEQ ID NO: 6210000 - DNA, 17 bp, Homo sapiens
ctttgtgctgtggggct

SEQ ID NO: 6210001 - DNA, 22 bp, Homo sapiens
ctttgtgcttgtcattccagag

SEQ ID NO: 6210002 - DNA, 15 bp, Homo sapiens
ctttgtgcttgttct

SEQ ID NO: 6210003 - DNA, 18 bp, Homo sapiens
ctttgtgctttttgtcat

SEQ ID NO: 6210004 - DNA, 17 bp, Homo sapiens
ctttgtggaaacagctg

SEQ ID NO: 6210005 - DNA, 13 bp, Homo sapiens
ctttgtggacttt

SEQ ID NO: 6210006 - DNA, 20 bp, Homo sapiens
ctttgtggactttatttaat

SEQ ID NO: 6210007 - DNA, 20 bp, Homo sapiens
ctttgtggatgtcttccttg

SEQ ID NO: 6210008 - DNA, 13 bp, Homo sapiens
ctttgtggcagtg

SEQ ID NO: 6210009 - DNA, 15 bp, Homo sapiens
ctttgtggcagtggc

SEQ ID NO: 6210010 - DNA, 12 bp, Homo sapiens
ctttgtggccaa

SEQ ID NO: 6210011 - DNA, 15 bp, Homo sapiens
ctttgtggccaagga

SEQ ID NO: 6210012 - DNA, 21 bp, Homo sapiens
ctttgtggccaaggagctgct

SEQ ID NO: 6210013 - DNA, 22 bp, Homo sapiens
ctttgtggccaaggagctgcta

SEQ ID NO: 6210014 - DNA, 13 bp, Homo sapiens
ctttgtggccttc

SEQ ID NO: 6210015 - DNA, 12 bp, Homo sapiens
ctttgtggggct

SEQ ID NO: 6210016 - DNA, 20 bp, Homo sapiens
ctttgtggtctttttcctga

SEQ ID NO: 6210017 - DNA, 15 bp, Homo sapiens
ctttgtggtgagaat

SEQ ID NO: 6210018 - DNA, 22 bp, Homo sapiens
ctttgtggtgggcgctggggaa

SEQ ID NO: 6210019 - DNA, 12 bp, Homo sapiens
ctttgtgtaaag

SEQ ID NO: 6210020 - DNA, 13 bp, Homo sapiens
ctttgtgtaaaga

SEQ ID NO: 6210021 - DNA, 22 bp, Homo sapiens
ctttgtgtaataaaaatttgtt

SEQ ID NO: 6210022 - DNA, 16 bp, Homo sapiens
ctttgtgtagctttgc

SEQ ID NO: 6210023 - DNA, 18 bp, Homo sapiens
ctttgtgtagctttgctc

SEQ ID NO: 6210024 - DNA, 20 bp, Homo sapiens
ctttgtgtctagggcagagt

SEQ ID NO: 6210025 - DNA, 14 bp, Homo sapiens
ctttgtgtctggcc

SEQ ID NO: 6210026 - DNA, 20 bp, Homo sapiens
ctttgtgtcttttgttctct

SEQ ID NO: 6210027 - DNA, 15 bp, Homo sapiens
ctttgtgtgattgaa

SEQ ID NO: 6210028 - DNA, 16 bp, Homo sapiens
ctttgtgtggctcctg

SEQ ID NO: 6210029 - DNA, 18 bp, Homo sapiens
ctttgtgtggctcctggt

SEQ ID NO: 6210030 - DNA, 19 bp, Homo sapiens
ctttgtgtggctcctggta

SEQ ID NO: 6210031 - DNA, 16 bp, Homo sapiens
ctttgtgtggctgccc

SEQ ID NO: 6210032 - DNA, 20 bp, Homo sapiens
ctttgtgtgttatattccaa

SEQ ID NO: 6210033 - DNA, 14 bp, Homo sapiens
ctttgtgttcattt

SEQ ID NO: 6210034 - DNA, 15 bp, Homo sapiens
ctttgtgttgtaatt

SEQ ID NO: 6210035 - DNA, 12 bp, Homo sapiens
ctttgtgtttat

SEQ ID NO: 6210036 - DNA, 15 bp, Homo sapiens
ctttgtgtttatatg

SEQ ID NO: 6210037 - DNA, 23 bp, Homo sapiens
ctttgtgtttctattgacttcaa

SEQ ID NO: 6210038 - DNA, 17 bp, Homo sapiens
ctttgtgtttgcttggt

SEQ ID NO: 6210039 - DNA, 19 bp, Homo sapiens
ctttgtgtttggtttacat

SEQ ID NO: 6210040 - DNA, 22 bp, Homo sapiens
ctttgtgtttttttaatttcta

SEQ ID NO: 6210041 - DNA, 14 bp, Homo sapiens
ctttgttaaaaaaa

SEQ ID NO: 6210042 - DNA, 17 bp, Homo sapiens
ctttgttaaaaacactg

SEQ ID NO: 6210043 - DNA, 15 bp, Homo sapiens
ctttgttaaaatata

SEQ ID NO: 6210044 - DNA, 20 bp, Homo sapiens
ctttgttaaacttatttcaa

SEQ ID NO: 6210045 - DNA, 13 bp, Homo sapiens
ctttgttaacctt

SEQ ID NO: 6210046 - DNA, 22 bp, Homo sapiens
ctttgttaaccttaaatacact

SEQ ID NO: 6210047 - DNA, 14 bp, Homo sapiens
ctttgttaacttca

SEQ ID NO: 6210048 - DNA, 18 bp, Homo sapiens
ctttgttaatgaaaatga

SEQ ID NO: 6210049 - DNA, 13 bp, Homo sapiens
ctttgttaattta

SEQ ID NO: 6210050 - DNA, 15 bp, Homo sapiens
ctttgttacaataaa

SEQ ID NO: 6210051 - DNA, 18 bp, Homo sapiens
ctttgttacaataaaact

SEQ ID NO: 6210052 - DNA, 19 bp, Homo sapiens
ctttgttaccttaaaacta

SEQ ID NO: 6210053 - DNA, 18 bp, Homo sapiens
ctttgttagaaagtgctt

SEQ ID NO: 6210054 - DNA, 22 bp, Homo sapiens
ctttgttcaataaaggaaatat

SEQ ID NO: 6210055 - DNA, 16 bp, Homo sapiens
ctttgttcagttgact

SEQ ID NO: 6210056 - DNA, 18 bp, Homo sapiens
ctttgttcatagcccagt

SEQ ID NO: 6210057 - DNA, 15 bp, Homo sapiens
ctttgttcatcattg

SEQ ID NO: 6210058 - DNA, 13 bp, Homo sapiens
ctttgttccactg

SEQ ID NO: 6210059 - DNA, 16 bp, Homo sapiens
ctttgttcccactgtc

SEQ ID NO: 6210060 - DNA, 22 bp, Homo sapiens
ctttgttccccactggagcaga

SEQ ID NO: 6210061 - DNA, 16 bp, Homo sapiens
ctttgttcctgctttc

SEQ ID NO: 6210062 - DNA, 18 bp, Homo sapiens
ctttgttctaaagatgga

SEQ ID NO: 6210063 - DNA, 14 bp, Homo sapiens
ctttgttctcagct

SEQ ID NO: 6210064 - DNA, 23 bp, Homo sapiens
ctttgttctcagctccccctgtc

SEQ ID NO: 6210065 - DNA, 14 bp, Homo sapiens
ctttgttctgagca

SEQ ID NO: 6210066 - DNA, 15 bp, Homo sapiens
ctttgttctgagcat

SEQ ID NO: 6210067 - DNA, 23 bp, Homo sapiens
ctttgttctgagcattcgctgta

SEQ ID NO: 6210068 - DNA, 16 bp, Homo sapiens
ctttgttctggctctt

SEQ ID NO: 6210069 - DNA, 15 bp, Homo sapiens
ctttgttcttgtcat

SEQ ID NO: 6210070 - DNA, 20 bp, Homo sapiens
ctttgttctttaggagattt

SEQ ID NO: 6210071 - DNA, 16 bp, Homo sapiens
ctttgttgaaagaaag

SEQ ID NO: 6210072 - DNA, 11 bp, Homo sapiens
ctttgttgaag

SEQ ID NO: 6210073 - DNA, 16 bp, Homo sapiens
ctttgttgaataatac

SEQ ID NO: 6210074 - DNA, 21 bp, Homo sapiens
ctttgttgcaagatgtgaatt

SEQ ID NO: 6210075 - DNA, 14 bp, Homo sapiens
ctttgttgctgttg

SEQ ID NO: 6210076 - DNA, 21 bp, Homo sapiens
ctttgttggcattgatcctag

SEQ ID NO: 6210077 - DNA, 17 bp, Homo sapiens
ctttgttggcttctttg

SEQ ID NO: 6210078 - DNA, 14 bp, Homo sapiens
ctttgttgtcctcc

SEQ ID NO: 6210079 - DNA, 18 bp, Homo sapiens
ctttgttgtctccctctt

SEQ ID NO: 6210080 - DNA, 23 bp, Homo sapiens
ctttgttgtctccctctttctca

SEQ ID NO: 6210081 - DNA, 13 bp, Homo sapiens
ctttgttgtgtgc

SEQ ID NO: 6210082 - DNA, 22 bp, Homo sapiens
ctttgttgtgtgcctctagctg

SEQ ID NO: 6210083 - DNA, 15 bp, Homo sapiens
ctttgtttaaatgcc

SEQ ID NO: 6210084 - DNA, 17 bp, Homo sapiens
ctttgtttaaatgccaa

SEQ ID NO: 6210085 - DNA, 18 bp, Homo sapiens
ctttgtttaataaaggct

SEQ ID NO: 6210086 - DNA, 15 bp, Homo sapiens
ctttgtttactaaag

SEQ ID NO: 6210087 - DNA, 13 bp, Homo sapiens
ctttgtttactct

SEQ ID NO: 6210088 - DNA, 16 bp, Homo sapiens
ctttgtttatgcatat

SEQ ID NO: 6210089 - DNA, 12 bp, Homo sapiens
ctttgtttattt

SEQ ID NO: 6210090 - DNA, 17 bp, Homo sapiens
ctttgtttcaaccaagt

SEQ ID NO: 6210091 - DNA, 17 bp, Homo sapiens
ctttgtttcaactttct

SEQ ID NO: 6210092 - DNA, 19 bp, Homo sapiens
ctttgtttccagaaattct

SEQ ID NO: 6210093 - DNA, 18 bp, Homo sapiens
ctttgtttccttattcag

SEQ ID NO: 6210094 - DNA, 13 bp, Homo sapiens
ctttgtttctcat

SEQ ID NO: 6210095 - DNA, 18 bp, Homo sapiens
ctttgtttctcatccata

SEQ ID NO: 6210096 - DNA, 15 bp, Homo sapiens
ctttgtttctccccc

SEQ ID NO: 6210097 - DNA, 13 bp, Homo sapiens
ctttgtttcttgt

SEQ ID NO: 6210098 - DNA, 19 bp, Homo sapiens
ctttgtttctttcttcctc

SEQ ID NO: 6210099 - DNA, 13 bp, Homo sapiens
ctttgtttctttt

SEQ ID NO: 6210100 - DNA, 18 bp, Homo sapiens
ctttgtttcttttgctta

SEQ ID NO: 6210101 - DNA, 22 bp, Homo sapiens
ctttgtttctttttacagcatt

SEQ ID NO: 6210102 - DNA, 20 bp, Homo sapiens
ctttgtttgaggcctgacgt

SEQ ID NO: 6210103 - DNA, 20 bp, Homo sapiens
ctttgtttggatgtaattta

SEQ ID NO: 6210104 - DNA, 22 bp, Homo sapiens
ctttgtttgtcacaagtggtgt

SEQ ID NO: 6210105 - DNA, 14 bp, Homo sapiens
ctttgtttgttctt

SEQ ID NO: 6210106 - DNA, 21 bp, Homo sapiens
ctttgtttgttcttgttttta

SEQ ID NO: 6210107 - DNA, 22 bp, Homo sapiens
ctttgttttaaaaagcatcaga

SEQ ID NO: 6210108 - DNA, 19 bp, Homo sapiens
ctttgttttcccacacata

SEQ ID NO: 6210109 - DNA, 17 bp, Homo sapiens
ctttgttttctgactaa

SEQ ID NO: 6210110 - DNA, 16 bp, Homo sapiens
ctttgttttcttagtt

SEQ ID NO: 6210111 - DNA, 21 bp, Homo sapiens
ctttgttttcttagttacttt

SEQ ID NO: 6210112 - DNA, 15 bp, Homo sapiens
gagagaatgagcaga

SEQ ID NO: 6210113 - DNA, 17 bp, Homo sapiens
gagagaattggctcaat

SEQ ID NO: 6210114 - DNA, 19 bp, Homo sapiens
gagagacactcccagggac

SEQ ID NO: 6210115 - DNA, 15 bp, Homo sapiens
gagagacagagacag

SEQ ID NO: 6210116 - DNA, 21 bp, Homo sapiens
gagagacagagacagagagag

SEQ ID NO: 6210117 - DNA, 17 bp, Homo sapiens
gagagacagcacaggca

SEQ ID NO: 6210118 - DNA, 19 bp, Homo sapiens
gagagacagcacaggcagc

SEQ ID NO: 6210119 - DNA, 17 bp, Homo sapiens
gagagacattgcctcca

SEQ ID NO: 6210120 - DNA, 16 bp, Homo sapiens
gagagaccacacattt

SEQ ID NO: 6210121 - DNA, 16 bp, Homo sapiens
gagagaccaggcaaag

SEQ ID NO: 6210122 - DNA, 13 bp, Homo sapiens
gagagaccccacc

SEQ ID NO: 6210123 - DNA, 15 bp, Homo sapiens
gagagaccccgcacc

SEQ ID NO: 6210124 - DNA, 19 bp, Homo sapiens
gagagaccccgcacccggc

SEQ ID NO: 6210125 - DNA, 21 bp, Homo sapiens
gagagaccccgcacccggctc

SEQ ID NO: 6210126 - DNA, 16 bp, Homo sapiens
gagagacccctcccct

SEQ ID NO: 6210127 - DNA, 14 bp, Homo sapiens
gagagaccctcact

SEQ ID NO: 6210128 - DNA, 15 bp, Homo sapiens
gagagaccctcactg

SEQ ID NO: 6210129 - DNA, 22 bp, Homo sapiens
gagagaccctcactgctgggga

SEQ ID NO: 6210130 - DNA, 20 bp, Homo sapiens
gagagaccctcgcaaaatga

SEQ ID NO: 6210131 - DNA, 17 bp, Homo sapiens
gagagaccctggcctca

SEQ ID NO: 6210132 - DNA, 19 bp, Homo sapiens
gagagaccgaggagggaga

SEQ ID NO: 6210133 - DNA, 20 bp, Homo sapiens
gagagacctagataggtcat

SEQ ID NO: 6210134 - DNA, 15 bp, Homo sapiens
gagagacctgctcag

SEQ ID NO: 6210135 - DNA, 15 bp, Homo sapiens
gagagaccttctctt

SEQ ID NO: 6210136 - DNA, 21 bp, Homo sapiens
gagagacgcagccctgggggc

SEQ ID NO: 6210137 - DNA, 14 bp, Homo sapiens
gagagactaacctt

SEQ ID NO: 6210138 - DNA, 16 bp, Homo sapiens
gagagactcaaagaga

SEQ ID NO: 6210139 - DNA, 20 bp, Homo sapiens
gagagactccacgcaggcga

SEQ ID NO: 6210140 - DNA, 17 bp, Homo sapiens
gagagactgaaagcagc

SEQ ID NO: 6210141 - DNA, 15 bp, Homo sapiens
gagagactgagcagc

SEQ ID NO: 6210142 - DNA, 16 bp, Homo sapiens
gagagactgagggaga

SEQ ID NO: 6210143 - DNA, 22 bp, Homo sapiens
gagagactgatggggtcgctct

SEQ ID NO: 6210144 - DNA, 17 bp, Homo sapiens
gagagactggccagagg

SEQ ID NO: 6210145 - DNA, 19 bp, Homo sapiens
gagagactggttttttcca

SEQ ID NO: 6210146 - DNA, 14 bp, Homo sapiens
gagagactgtggag

SEQ ID NO: 6210147 - DNA, 12 bp, Homo sapiens
gagagacttgtt

SEQ ID NO: 6210148 - DNA, 20 bp, Homo sapiens
gagagacttgttttggatgc

SEQ ID NO: 6210149 - DNA, 19 bp, Homo sapiens
gagagagaaacaaactttt

SEQ ID NO: 6210150 - DNA, 12 bp, Homo sapiens
gagagagaaaga

SEQ ID NO: 6210151 - DNA, 13 bp, Homo sapiens
gagagagaaagaa

SEQ ID NO: 6210152 - DNA, 18 bp, Homo sapiens
gagagagaaagccaggca

SEQ ID NO: 6210153 - DNA, 10 bp, Homo sapiens
gagagagaag

SEQ ID NO: 6210154 - DNA, 23 bp, Homo sapiens
gagagagaagtgcccctgctgcc

SEQ ID NO: 6210155 - DNA, 12 bp, Homo sapiens
gagagagactga

SEQ ID NO: 6210156 - DNA, 22 bp, Homo sapiens
gagagagactgagggagagact

SEQ ID NO: 6210157 - DNA, 9 bp, Homo sapiens
gagagagag

SEQ ID NO: 6210158 - DNA, 14 bp, Homo sapiens
gagagagagaaaga

SEQ ID NO: 6210159 - DNA, 14 bp, Homo sapiens
gagagagagaaatt

SEQ ID NO: 6210160 - DNA, 16 bp, Homo sapiens
gagagagagagaaaga

SEQ ID NO: 6210161 - DNA, 16 bp, Homo sapiens
gagagagagagaaggg

SEQ ID NO: 6210162 - DNA, 15 bp, Homo sapiens
gagagagagagagaa

SEQ ID NO: 6210163 - DNA, 16 bp, Homo sapiens
gagagagagagaggtt

SEQ ID NO: 6210164 - DNA, 13 bp, Homo sapiens
gagagagagagga

SEQ ID NO: 6210165 - DNA, 12 bp, Homo sapiens
gagagagaggct

SEQ ID NO: 6210166 - DNA, 11 bp, Homo sapiens
gagagagaggt

SEQ ID NO: 6210167 - DNA, 18 bp, Homo sapiens
gagagagatgctgctccc

SEQ ID NO: 6210168 - DNA, 22 bp, Homo sapiens
gagagagatgtgtaatttttct

SEQ ID NO: 6210169 - DNA, 13 bp, Homo sapiens
gagagagccaaga

SEQ ID NO: 6210170 - DNA, 14 bp, Homo sapiens
gagagagccaagac

SEQ ID NO: 6210171 - DNA, 22 bp, Homo sapiens
gagagagcccttcccagggcac

SEQ ID NO: 6210172 - DNA, 13 bp, Homo sapiens
gagagagccttgg

SEQ ID NO: 6210173 - DNA, 19 bp, Homo sapiens
gagagagctcgctcttggg

SEQ ID NO: 6210174 - DNA, 21 bp, Homo sapiens
gagagagctcgctcttgggag

SEQ ID NO: 6210175 - DNA, 20 bp, Homo sapiens
gagagagctgagtgagctga

SEQ ID NO: 6210176 - DNA, 19 bp, Homo sapiens
gagagaggacctccatgcc

SEQ ID NO: 6210177 - DNA, 14 bp, Homo sapiens
gagagaggaggaaa

SEQ ID NO: 6210178 - DNA, 13 bp, Homo sapiens
gagagaggcagag

SEQ ID NO: 6210179 - DNA, 19 bp, Homo sapiens
gagagaggctaaaatgttt

SEQ ID NO: 6210180 - DNA, 20 bp, Homo sapiens
gagagaggctaaaatgtttt

SEQ ID NO: 6210181 - DNA, 19 bp, Homo sapiens
gagagaggctgcctcagcc

SEQ ID NO: 6210182 - DNA, 13 bp, Homo sapiens
gagagagggactc

SEQ ID NO: 6210183 - DNA, 17 bp, Homo sapiens
gagagagggcacatctc

SEQ ID NO: 6210184 - DNA, 19 bp, Homo sapiens
gagagagggcgcccagccc

SEQ ID NO: 6210185 - DNA, 13 bp, Homo sapiens
gagagaggggaag

SEQ ID NO: 6210186 - DNA, 15 bp, Homo sapiens
gagagaggggcctgc

SEQ ID NO: 6210187 - DNA, 15 bp, Homo sapiens
gagagagggggagac

SEQ ID NO: 6210188 - DNA, 12 bp, Homo sapiens
gagagagggggc

SEQ ID NO: 6210189 - DNA, 13 bp, Homo sapiens
gagagagggggca

SEQ ID NO: 6210190 - DNA, 17 bp, Homo sapiens
gagagaggtgggcagca

SEQ ID NO: 6210191 - DNA, 19 bp, Homo sapiens
gagagagtgagagcacaaa

SEQ ID NO: 6210192 - DNA, 22 bp, Homo sapiens
gagagagtggtaaaaaagaaat

SEQ ID NO: 6210193 - DNA, 19 bp, Homo sapiens
gagagagttgctggctatt

SEQ ID NO: 6210194 - DNA, 18 bp, Homo sapiens
gagagataccttgaaaaa

SEQ ID NO: 6210195 - DNA, 14 bp, Homo sapiens
gagagatactctgg

SEQ ID NO: 6210196 - DNA, 16 bp, Homo sapiens
gagagatagcctgtgg

SEQ ID NO: 6210197 - DNA, 20 bp, Homo sapiens
gagagatagcctgtggccct

SEQ ID NO: 6210198 - DNA, 14 bp, Homo sapiens
gagagatatatctg

SEQ ID NO: 6210199 - DNA, 17 bp, Homo sapiens
gagagatatatctgaaa

SEQ ID NO: 6210200 - DNA, 21 bp, Homo sapiens
gagagatctagaaagtgggtt

SEQ ID NO: 6210201 - DNA, 13 bp, Homo sapiens
gagagatctccaa

SEQ ID NO: 6210202 - DNA, 13 bp, Homo sapiens
gagagatctgctg

SEQ ID NO: 6210203 - DNA, 16 bp, Homo sapiens
gagagatctgctgtca

SEQ ID NO: 6210204 - DNA, 22 bp, Homo sapiens
gagagatgagaaagcttttatt

SEQ ID NO: 6210205 - DNA, 23 bp, Homo sapiens
gagagatgtctgttctaagtcca

SEQ ID NO: 6210206 - DNA, 18 bp, Homo sapiens
gagagatgtgtaattttt

SEQ ID NO: 6210207 - DNA, 19 bp, Homo sapiens
gagagatgtgtaatttttc

SEQ ID NO: 6210208 - DNA, 13 bp, Homo sapiens
gagagatgtgtgt

SEQ ID NO: 6210209 - DNA, 14 bp, Homo sapiens
gagagatgtgtgtt

SEQ ID NO: 6210210 - DNA, 23 bp, Homo sapiens
gagagattttgtcgggacagaga

SEQ ID NO: 6210211 - DNA, 15 bp, Homo sapiens
gagagcaaaggccca

SEQ ID NO: 6210212 - DNA, 20 bp, Homo sapiens
gagagcaaaggcccatgccc

SEQ ID NO: 6210213 - DNA, 19 bp, Homo sapiens
gagagcaacaagtagagat

SEQ ID NO: 6210214 - DNA, 13 bp, Homo sapiens
gagagcaactctg

SEQ ID NO: 6210215 - DNA, 17 bp, Homo sapiens
gagagcactagaagtgg

SEQ ID NO: 6210216 - DNA, 11 bp, Homo sapiens
gagagcactgc

SEQ ID NO: 6210217 - DNA, 12 bp, Homo sapiens
gagagcactgcc

SEQ ID NO: 6210218 - DNA, 13 bp, Homo sapiens
gagagcactgcct

SEQ ID NO: 6210219 - DNA, 22 bp, Homo sapiens
gagagcactgcctctatgccct

SEQ ID NO: 6210220 - DNA, 23 bp, Homo sapiens
gagagcactgcctctatgccctg

SEQ ID NO: 6210221 - DNA, 13 bp, Homo sapiens
gagagcagagaat

SEQ ID NO: 6210222 - DNA, 14 bp, Homo sapiens
gagagcagagggtt

SEQ ID NO: 6210223 - DNA, 16 bp, Homo sapiens
gagagcagcaggtgct

SEQ ID NO: 6210224 - DNA, 14 bp, Homo sapiens
gagagcagctccct

SEQ ID NO: 6210225 - DNA, 22 bp, Homo sapiens
gagagcagctccctttctcagg

SEQ ID NO: 6210226 - DNA, 12 bp, Homo sapiens
gagagcagctgg

SEQ ID NO: 6210227 - DNA, 21 bp, Homo sapiens
gagagcagctttaaactcagg

SEQ ID NO: 6210228 - DNA, 17 bp, Homo sapiens
gagagcaggctggcagc

SEQ ID NO: 6210229 - DNA, 23 bp, Homo sapiens
gagagcaggctggcagctctcca

SEQ ID NO: 6210230 - DNA, 14 bp, Homo sapiens
gagagcaggggagc

SEQ ID NO: 6210231 - DNA, 15 bp, Homo sapiens
gagagcaggggagct

SEQ ID NO: 6210232 - DNA, 16 bp, Homo sapiens
gagagcagtgcttttg

SEQ ID NO: 6210233 - DNA, 13 bp, Homo sapiens
gagagcagtgggc

SEQ ID NO: 6210234 - DNA, 15 bp, Homo sapiens
gagagcagtgggcag

SEQ ID NO: 6210235 - DNA, 12 bp, Homo sapiens
gagagcataatt

SEQ ID NO: 6210236 - DNA, 16 bp, Homo sapiens
gagagcataatttaaa

SEQ ID NO: 6210237 - DNA, 15 bp, Homo sapiens
gagagcatcggccta

SEQ ID NO: 6210238 - DNA, 22 bp, Homo sapiens
gagagcattataatcaccaggg

SEQ ID NO: 6210239 - DNA, 11 bp, Homo sapiens
gagagccaaac

SEQ ID NO: 6210240 - DNA, 21 bp, Homo sapiens
gagagccaacctcggcttgtg

SEQ ID NO: 6210241 - DNA, 16 bp, Homo sapiens
gagagccaagacggag

SEQ ID NO: 6210242 - DNA, 20 bp, Homo sapiens
gagagccaaggcctatgcca

SEQ ID NO: 6210243 - DNA, 16 bp, Homo sapiens
gagagccactgggccc

SEQ ID NO: 6210244 - DNA, 17 bp, Homo sapiens
gagagccactgggcccc

SEQ ID NO: 6210245 - DNA, 15 bp, Homo sapiens
gagagccagagaagt

SEQ ID NO: 6210246 - DNA, 20 bp, Homo sapiens
gagagccagccctccctgtc

SEQ ID NO: 6210247 - DNA, 22 bp, Homo sapiens
gagagccagctaaggggtgggg

SEQ ID NO: 6210248 - DNA, 14 bp, Homo sapiens
gagagccagctctc

SEQ ID NO: 6210249 - DNA, 18 bp, Homo sapiens
gagagccaggatgcccag

SEQ ID NO: 6210250 - DNA, 11 bp, Homo sapiens
gagagccagta

SEQ ID NO: 6210251 - DNA, 19 bp, Homo sapiens
gagagcccaatcactgcct

SEQ ID NO: 6210252 - DNA, 21 bp, Homo sapiens
gagagcccaatcactgcctat

SEQ ID NO: 6210253 - DNA, 19 bp, Homo sapiens
gagagcccagagtcccccc

SEQ ID NO: 6210254 - DNA, 11 bp, Homo sapiens
gagagcccagc

SEQ ID NO: 6210255 - DNA, 16 bp, Homo sapiens
gagagcccaggagctc

SEQ ID NO: 6210256 - DNA, 14 bp, Homo sapiens
gagagccccagctg

SEQ ID NO: 6210257 - DNA, 15 bp, Homo sapiens
gagagccccagctga

SEQ ID NO: 6210258 - DNA, 16 bp, Homo sapiens
gagagcccccaccagc

SEQ ID NO: 6210259 - DNA, 18 bp, Homo sapiens
gagagcccccaccagcag

SEQ ID NO: 6210260 - DNA, 15 bp, Homo sapiens
gagagcccctggggc

SEQ ID NO: 6210261 - DNA, 20 bp, Homo sapiens
gagagcccggcgcccctgcc

SEQ ID NO: 6210262 - DNA, 15 bp, Homo sapiens
gagagcccgggagct

SEQ ID NO: 6210263 - DNA, 20 bp, Homo sapiens
gagagcccgtgggggcaggg

SEQ ID NO: 6210264 - DNA, 18 bp, Homo sapiens
gagagccctagaaagctg

SEQ ID NO: 6210265 - DNA, 22 bp, Homo sapiens
gagagccctcagtcggggcagg

SEQ ID NO: 6210266 - DNA, 10 bp, Homo sapiens
gagagccctg

SEQ ID NO: 6210267 - DNA, 14 bp, Homo sapiens
gagagccctgaggc

SEQ ID NO: 6210268 - DNA, 12 bp, Homo sapiens
gagagccctgct

SEQ ID NO: 6210269 - DNA, 14 bp, Homo sapiens
gagagccctgctgt

SEQ ID NO: 6210270 - DNA, 16 bp, Homo sapiens
gagagccctgctgtgg

SEQ ID NO: 6210271 - DNA, 12 bp, Homo sapiens
gagagccctgga

SEQ ID NO: 6210272 - DNA, 21 bp, Homo sapiens
gagagccctggattaggaggg

SEQ ID NO: 6210273 - DNA, 13 bp, Homo sapiens
gagagccctggga

SEQ ID NO: 6210274 - DNA, 16 bp, Homo sapiens
gagagccctgtccctg

SEQ ID NO: 6210275 - DNA, 21 bp, Homo sapiens
gagagccctgtccctgccctc

SEQ ID NO: 6210276 - DNA, 15 bp, Homo sapiens
gagagcccttcccag

SEQ ID NO: 6210277 - DNA, 18 bp, Homo sapiens
gagagcccttcccagggc

SEQ ID NO: 6210278 - DNA, 19 bp, Homo sapiens
gagagcctccaggttcctc

SEQ ID NO: 6210279 - DNA, 14 bp, Homo sapiens
gagagcctctgttt

SEQ ID NO: 6210280 - DNA, 14 bp, Homo sapiens
gagagcctgcagga

SEQ ID NO: 6210281 - DNA, 11 bp, Homo sapiens
gagagcctgcc

SEQ ID NO: 6210282 - DNA, 14 bp, Homo sapiens
gagagcctgctccc

SEQ ID NO: 6210283 - DNA, 17 bp, Homo sapiens
gagagcctgctccccca

SEQ ID NO: 6210284 - DNA, 12 bp, Homo sapiens
gagagcctggca

SEQ ID NO: 6210285 - DNA, 16 bp, Homo sapiens
gagagcctggcaaggc

SEQ ID NO: 6210286 - DNA, 17 bp, Homo sapiens
gagagcctgtcaccaga

SEQ ID NO: 6210287 - DNA, 19 bp, Homo sapiens
gagagcctgtcaccagagc

SEQ ID NO: 6210288 - DNA, 14 bp, Homo sapiens
gagagcctgtgatc

SEQ ID NO: 6210289 - DNA, 21 bp, Homo sapiens
gagagcctgtggaggggcttg

SEQ ID NO: 6210290 - DNA, 17 bp, Homo sapiens
gagagccttaacttctt

SEQ ID NO: 6210291 - DNA, 14 bp, Homo sapiens
gagagccttccagg

SEQ ID NO: 6210292 - DNA, 15 bp, Homo sapiens
gagagccttccaggg

SEQ ID NO: 6210293 - DNA, 18 bp, Homo sapiens
gagagccttccaggggtg

SEQ ID NO: 6210294 - DNA, 14 bp, Homo sapiens
gagagcgcagcccg

SEQ ID NO: 6210295 - DNA, 23 bp, Homo sapiens
ctttgttttgcacactttgccat

SEQ ID NO: 6210296 - DNA, 17 bp, Homo sapiens
ctttgttttgtgtctct

SEQ ID NO: 6210297 - DNA, 19 bp, Homo sapiens
ctttgttttgttttaagga

SEQ ID NO: 6210298 - DNA, 21 bp, Homo sapiens
ctttgtttttaaaatagaatg

SEQ ID NO: 6210299 - DNA, 16 bp, Homo sapiens
ctttgtttttaaatga

SEQ ID NO: 6210300 - DNA, 14 bp, Homo sapiens
ctttgtttttattt

SEQ ID NO: 6210301 - DNA, 16 bp, Homo sapiens
ctttgtttttccatgt

SEQ ID NO: 6210302 - DNA, 22 bp, Homo sapiens
ctttgtttttccatgtgttttg

SEQ ID NO: 6210303 - DNA, 19 bp, Homo sapiens
ctttgttttttgttttcat

SEQ ID NO: 6210304 - DNA, 22 bp, Homo sapiens
ctttgttttttgttttcattaa

SEQ ID NO: 6210305 - DNA, 22 bp, Homo sapiens
cttttaaaaaaatttttataaa

SEQ ID NO: 6210306 - DNA, 17 bp, Homo sapiens
cttttaaaaaacaaaaa

SEQ ID NO: 6210307 - DNA, 14 bp, Homo sapiens
cttttaaaaaatat

SEQ ID NO: 6210308 - DNA, 16 bp, Homo sapiens
cttttaaaaaatattt

SEQ ID NO: 6210309 - DNA, 23 bp, Homo sapiens
cttttaaaaaatattttaagaaa

SEQ ID NO: 6210310 - DNA, 16 bp, Homo sapiens
cttttaaaaagtattg

SEQ ID NO: 6210311 - DNA, 19 bp, Homo sapiens
cttttaaaaagtattgcca

SEQ ID NO: 6210312 - DNA, 16 bp, Homo sapiens
cttttaaaaatacaat

SEQ ID NO: 6210313 - DNA, 17 bp, Homo sapiens
cttttaaaaatacaatt

SEQ ID NO: 6210314 - DNA, 13 bp, Homo sapiens
cttttaaaaatgt

SEQ ID NO: 6210315 - DNA, 21 bp, Homo sapiens
cttttaaaaatgtagaaattc

SEQ ID NO: 6210316 - DNA, 14 bp, Homo sapiens
cttttaaaaatgtt

SEQ ID NO: 6210317 - DNA, 16 bp, Homo sapiens
cttttaaaaatgtttg

SEQ ID NO: 6210318 - DNA, 18 bp, Homo sapiens
cttttaaaacacttccat

SEQ ID NO: 6210319 - DNA, 14 bp, Homo sapiens
cttttaaaactact

SEQ ID NO: 6210320 - DNA, 19 bp, Homo sapiens
cttttaaaactatatttat

SEQ ID NO: 6210321 - DNA, 14 bp, Homo sapiens
cttttaaaagaaaa

SEQ ID NO: 6210322 - DNA, 22 bp, Homo sapiens
cttttaaaagacaagacttcag

SEQ ID NO: 6210323 - DNA, 17 bp, Homo sapiens
cttttaaaagccccagt

SEQ ID NO: 6210324 - DNA, 15 bp, Homo sapiens
cttttaaaaggaaaa

SEQ ID NO: 6210325 - DNA, 20 bp, Homo sapiens
cttttaaaataaattctctc

SEQ ID NO: 6210326 - DNA, 20 bp, Homo sapiens
cttttaaaataagctttctc

SEQ ID NO: 6210327 - DNA, 18 bp, Homo sapiens
cttttaaaatgaaatgtt

SEQ ID NO: 6210328 - DNA, 18 bp, Homo sapiens
cttttaaaatgaagcttt

SEQ ID NO: 6210329 - DNA, 20 bp, Homo sapiens
cttttaaaatgtagaaactt

SEQ ID NO: 6210330 - DNA, 17 bp, Homo sapiens
cttttaaaattgaatag

SEQ ID NO: 6210331 - DNA, 17 bp, Homo sapiens
cttttaaacaaaagtgt

SEQ ID NO: 6210332 - DNA, 17 bp, Homo sapiens
cttttaaacaagtcatt

SEQ ID NO: 6210333 - DNA, 14 bp, Homo sapiens
cttttaaacctgtt

SEQ ID NO: 6210334 - DNA, 15 bp, Homo sapiens
cttttaaactgtgta

SEQ ID NO: 6210335 - DNA, 21 bp, Homo sapiens
cttttaaagaaaaaaattgaa

SEQ ID NO: 6210336 - DNA, 22 bp, Homo sapiens
cttttaaagaaaaaaattgaaa

SEQ ID NO: 6210337 - DNA, 15 bp, Homo sapiens
cttttaaagaagctt

SEQ ID NO: 6210338 - DNA, 18 bp, Homo sapiens
cttttaaagaagctttat

SEQ ID NO: 6210339 - DNA, 20 bp, Homo sapiens
cttttaaagaagtaaatttg

SEQ ID NO: 6210340 - DNA, 15 bp, Homo sapiens
cttttaaagaatttc

SEQ ID NO: 6210341 - DNA, 19 bp, Homo sapiens
cttttaaagactacctggg

SEQ ID NO: 6210342 - DNA, 20 bp, Homo sapiens
cttttaaaggaatgtgaaat

SEQ ID NO: 6210343 - DNA, 21 bp, Homo sapiens
cttttaaagtatttataaaaa

SEQ ID NO: 6210344 - DNA, 11 bp, Homo sapiens
cttttaaagtg

SEQ ID NO: 6210345 - DNA, 17 bp, Homo sapiens
cttttaaagtgttactt

SEQ ID NO: 6210346 - DNA, 16 bp, Homo sapiens
cttttaaagtgtttca

SEQ ID NO: 6210347 - DNA, 17 bp, Homo sapiens
cttttaaagtgtttcag

SEQ ID NO: 6210348 - DNA, 21 bp, Homo sapiens
cttttaaagttggagacagca

SEQ ID NO: 6210349 - DNA, 12 bp, Homo sapiens
cttttaaatcat

SEQ ID NO: 6210350 - DNA, 14 bp, Homo sapiens
cttttaaatcctgt

SEQ ID NO: 6210351 - DNA, 18 bp, Homo sapiens
cttttaaatcctgttgaa

SEQ ID NO: 6210352 - DNA, 19 bp, Homo sapiens
cttttaaatcctgttgaaa

SEQ ID NO: 6210353 - DNA, 20 bp, Homo sapiens
cttttaaatcctgttgaaaa

SEQ ID NO: 6210354 - DNA, 13 bp, Homo sapiens
cttttaaatggca

SEQ ID NO: 6210355 - DNA, 18 bp, Homo sapiens
cttttaaatggcagtatt

SEQ ID NO: 6210356 - DNA, 22 bp, Homo sapiens
cttttaaatggcagtatttcat

SEQ ID NO: 6210357 - DNA, 23 bp, Homo sapiens
cttttaaatggcagtatttcatt

SEQ ID NO: 6210358 - DNA, 19 bp, Homo sapiens
cttttaaattagaaaatat

SEQ ID NO: 6210359 - DNA, 15 bp, Homo sapiens
cttttaaattctttt

SEQ ID NO: 6210360 - DNA, 23 bp, Homo sapiens
cttttaacaaaaaaggaaaatga

SEQ ID NO: 6210361 - DNA, 21 bp, Homo sapiens
cttttaacacctgatgtgtac

SEQ ID NO: 6210362 - DNA, 14 bp, Homo sapiens
cttttaacaccttt

SEQ ID NO: 6210363 - DNA, 23 bp, Homo sapiens
cttttaacatagagaactgtcac

SEQ ID NO: 6210364 - DNA, 13 bp, Homo sapiens
cttttaacatttt

SEQ ID NO: 6210365 - DNA, 14 bp, Homo sapiens
cttttaacattttg

SEQ ID NO: 6210366 - DNA, 16 bp, Homo sapiens
cttttaaccaaacaat

SEQ ID NO: 6210367 - DNA, 21 bp, Homo sapiens
cttttaacctctttaagtatt

SEQ ID NO: 6210368 - DNA, 18 bp, Homo sapiens
cttttaacgtatgtattt

SEQ ID NO: 6210369 - DNA, 19 bp, Homo sapiens
cttttaacgtatgtatttc

SEQ ID NO: 6210370 - DNA, 22 bp, Homo sapiens
cttttaacgtatgtatttcatt

SEQ ID NO: 6210371 - DNA, 17 bp, Homo sapiens
cttttaactatgtaata

SEQ ID NO: 6210372 - DNA, 23 bp, Homo sapiens
cttttaactatgtaataatgtac

SEQ ID NO: 6210373 - DNA, 15 bp, Homo sapiens
cttttaacttctttc

SEQ ID NO: 6210374 - DNA, 17 bp, Homo sapiens
cttttaactttagaatt

SEQ ID NO: 6210375 - DNA, 19 bp, Homo sapiens
cttttaagatgtgtcttca

SEQ ID NO: 6210376 - DNA, 23 bp, Homo sapiens
cttttaagcagacccataccttt

SEQ ID NO: 6210377 - DNA, 12 bp, Homo sapiens
cttttaagcagt

SEQ ID NO: 6210378 - DNA, 23 bp, Homo sapiens
cttttaagcatgtgatgttgtct

SEQ ID NO: 6210379 - DNA, 14 bp, Homo sapiens
cttttaagcatttg

SEQ ID NO: 6210380 - DNA, 21 bp, Homo sapiens
cttttaagcatttgtatatta

SEQ ID NO: 6210381 - DNA, 21 bp, Homo sapiens
cttttaaggtttcaacaaatt

SEQ ID NO: 6210382 - DNA, 22 bp, Homo sapiens
cttttaagtatacaacaggaga

SEQ ID NO: 6210383 - DNA, 17 bp, Homo sapiens
cttttaagtgccttgga

SEQ ID NO: 6210384 - DNA, 23 bp, Homo sapiens
cttttaagtggactctctgacaa

SEQ ID NO: 6210385 - DNA, 16 bp, Homo sapiens
cttttaagttaatgaa

SEQ ID NO: 6210386 - DNA, 20 bp, Homo sapiens
cttttaagttaatgaaataa

SEQ ID NO: 6210387 - DNA, 18 bp, Homo sapiens
cttttaagtttttctctt

SEQ ID NO: 6210388 - DNA, 23 bp, Homo sapiens
cttttaataaagtatgaatattt

SEQ ID NO: 6210389 - DNA, 18 bp, Homo sapiens
cttttaatatgctgtggg

SEQ ID NO: 6210390 - DNA, 22 bp, Homo sapiens
cttttaatcatgagcctgttta

SEQ ID NO: 6210391 - DNA, 17 bp, Homo sapiens
cttttaatccatttcag

SEQ ID NO: 6210392 - DNA, 16 bp, Homo sapiens
cttttaatgaaaagga

SEQ ID NO: 6210393 - DNA, 16 bp, Homo sapiens
cttttaatgaacaaat

SEQ ID NO: 6210394 - DNA, 15 bp, Homo sapiens
cttttaatgaattta

SEQ ID NO: 6210395 - DNA, 23 bp, Homo sapiens
cttttaatgaatttaaggcaaaa

SEQ ID NO: 6210396 - DNA, 24 bp, Homo sapiens
cttttaatgatactgtctaagaat

SEQ ID NO: 6210397 - DNA, 15 bp, Homo sapiens
cttttaatgcttcat

SEQ ID NO: 6210398 - DNA, 22 bp, Homo sapiens
cttttaattaaataaaagctgg

SEQ ID NO: 6210399 - DNA, 19 bp, Homo sapiens
cttttaattaatgaaatat

SEQ ID NO: 6210400 - DNA, 18 bp, Homo sapiens
cttttaattgacagtcac

SEQ ID NO: 6210401 - DNA, 19 bp, Homo sapiens
cttttaattgtttcagaat

SEQ ID NO: 6210402 - DNA, 13 bp, Homo sapiens
cttttaatttaaa

SEQ ID NO: 6210403 - DNA, 11 bp, Homo sapiens
cttttaatttt

SEQ ID NO: 6210404 - DNA, 13 bp, Homo sapiens
cttttacaaaaca

SEQ ID NO: 6210405 - DNA, 18 bp, Homo sapiens
cttttacagaataaaaga

SEQ ID NO: 6210406 - DNA, 15 bp, Homo sapiens
cttttacagaatgca

SEQ ID NO: 6210407 - DNA, 22 bp, Homo sapiens
cttttacagaatgcattaaaaa

SEQ ID NO: 6210408 - DNA, 15 bp, Homo sapiens
cttttacagcttttc

SEQ ID NO: 6210409 - DNA, 19 bp, Homo sapiens
cttttacagcttttctctt

SEQ ID NO: 6210410 - DNA, 17 bp, Homo sapiens
cttttacatactgctgt

SEQ ID NO: 6210411 - DNA, 16 bp, Homo sapiens
cttttacattctgtgt

SEQ ID NO: 6210412 - DNA, 12 bp, Homo sapiens
cttttacattgt

SEQ ID NO: 6210413 - DNA, 21 bp, Homo sapiens
cttttacatttttctgatggg

SEQ ID NO: 6210414 - DNA, 16 bp, Homo sapiens
cttttaccaacccaaa

SEQ ID NO: 6210415 - DNA, 13 bp, Homo sapiens
cttttaccaactt

SEQ ID NO: 6210416 - DNA, 15 bp, Homo sapiens
cttttaccactccca

SEQ ID NO: 6210417 - DNA, 18 bp, Homo sapiens
cttttaccagcttttaac

SEQ ID NO: 6210418 - DNA, 16 bp, Homo sapiens
cttttaccagtttctt

SEQ ID NO: 6210419 - DNA, 19 bp, Homo sapiens
cttttaccagtttctttgt

SEQ ID NO: 6210420 - DNA, 20 bp, Homo sapiens
cttttaccatgaattcttga

SEQ ID NO: 6210421 - DNA, 14 bp, Homo sapiens
cttttaccctgtgt

SEQ ID NO: 6210422 - DNA, 16 bp, Homo sapiens
cttttaccctgtgtca

SEQ ID NO: 6210423 - DNA, 19 bp, Homo sapiens
cttttacctgagactttca

SEQ ID NO: 6210424 - DNA, 14 bp, Homo sapiens
cttttacctgctgc

SEQ ID NO: 6210425 - DNA, 20 bp, Homo sapiens
cttttacgtagtaaaagtca

SEQ ID NO: 6210426 - DNA, 17 bp, Homo sapiens
cttttactatcttttca

SEQ ID NO: 6210427 - DNA, 14 bp, Homo sapiens
cttttactctgcct

SEQ ID NO: 6210428 - DNA, 22 bp, Homo sapiens
cttttactggactgtctgatca

SEQ ID NO: 6210429 - DNA, 18 bp, Homo sapiens
cttttactggttgcatgg

SEQ ID NO: 6210430 - DNA, 21 bp, Homo sapiens
cttttactgtggaggtggctg

SEQ ID NO: 6210431 - DNA, 23 bp, Homo sapiens
cttttactgtggaggtggctggt

SEQ ID NO: 6210432 - DNA, 17 bp, Homo sapiens
cttttactttttttctg

SEQ ID NO: 6210433 - DNA, 19 bp, Homo sapiens
cttttagaaatactgcaag

SEQ ID NO: 6210434 - DNA, 17 bp, Homo sapiens
cttttagacaactagat

SEQ ID NO: 6210435 - DNA, 20 bp, Homo sapiens
cttttagacacattagctct

SEQ ID NO: 6210436 - DNA, 17 bp, Homo sapiens
cttttagacagtggtaa

SEQ ID NO: 6210437 - DNA, 18 bp, Homo sapiens
cttttagacttttagcat

SEQ ID NO: 6210438 - DNA, 21 bp, Homo sapiens
cttttagccagagatgcaata

SEQ ID NO: 6210439 - DNA, 18 bp, Homo sapiens
cttttagcggtttgcaaa

SEQ ID NO: 6210440 - DNA, 14 bp, Homo sapiens
cttttaggaaaatc

SEQ ID NO: 6210441 - DNA, 21 bp, Homo sapiens
cttttaggaaaatcactttgt

SEQ ID NO: 6210442 - DNA, 17 bp, Homo sapiens
cttttaggacccttccc

SEQ ID NO: 6210443 - DNA, 16 bp, Homo sapiens
cttttaggccaaaaaa

SEQ ID NO: 6210444 - DNA, 16 bp, Homo sapiens
cttttagggagagtca

SEQ ID NO: 6210445 - DNA, 20 bp, Homo sapiens
cttttagggagagtcatatt

SEQ ID NO: 6210446 - DNA, 21 bp, Homo sapiens
cttttagggagagtcatattt

SEQ ID NO: 6210447 - DNA, 18 bp, Homo sapiens
cttttagtaaaaacattt

SEQ ID NO: 6210448 - DNA, 21 bp, Homo sapiens
cttttagtaaagtcaaggaga

SEQ ID NO: 6210449 - DNA, 15 bp, Homo sapiens
cttttagtacccacc

SEQ ID NO: 6210450 - DNA, 16 bp, Homo sapiens
cttttagtacccacct

SEQ ID NO: 6210451 - DNA, 15 bp, Homo sapiens
cttttagtgtttact

SEQ ID NO: 6210452 - DNA, 21 bp, Homo sapiens
cttttagttcctgtgcacagc

SEQ ID NO: 6210453 - DNA, 21 bp, Homo sapiens
cttttagttgtatctcttttg

SEQ ID NO: 6210454 - DNA, 21 bp, Homo sapiens
cttttagtttgatcagacagc

SEQ ID NO: 6210455 - DNA, 20 bp, Homo sapiens
cttttagttttaaaactctt

SEQ ID NO: 6210456 - DNA, 18 bp, Homo sapiens
cttttagtttttctgtcc

SEQ ID NO: 6210457 - DNA, 20 bp, Homo sapiens
cttttagtttttctgtccct

SEQ ID NO: 6210458 - DNA, 13 bp, Homo sapiens
cttttataaaaaa

SEQ ID NO: 6210459 - DNA, 16 bp, Homo sapiens
cttttataaactttac

SEQ ID NO: 6210460 - DNA, 19 bp, Homo sapiens
cttttataaactttacctt

SEQ ID NO: 6210461 - DNA, 13 bp, Homo sapiens
cttttataaagca

SEQ ID NO: 6210462 - DNA, 15 bp, Homo sapiens
cttttataaatgttt

SEQ ID NO: 6210463 - DNA, 15 bp, Homo sapiens
cttttataaattaaa

SEQ ID NO: 6210464 - DNA, 22 bp, Homo sapiens
cttttataactagtcctttact

SEQ ID NO: 6210465 - DNA, 15 bp, Homo sapiens
cttttataagacaaa

SEQ ID NO: 6210466 - DNA, 12 bp, Homo sapiens
cttttatacatg

SEQ ID NO: 6210467 - DNA, 11 bp, Homo sapiens
cttttatacca

SEQ ID NO: 6210468 - DNA, 18 bp, Homo sapiens
cttttataccagagacct

SEQ ID NO: 6210469 - DNA, 19 bp, Homo sapiens
cttttataccatcatgagt

SEQ ID NO: 6210470 - DNA, 19 bp, Homo sapiens
cttttatactctttctgta

SEQ ID NO: 6210471 - DNA, 14 bp, Homo sapiens
cttttatagctatt

SEQ ID NO: 6210472 - DNA, 18 bp, Homo sapiens
gagagcgccacccgcccg

SEQ ID NO: 6210473 - DNA, 14 bp, Homo sapiens
gagagcgcctcttc

SEQ ID NO: 6210474 - DNA, 16 bp, Homo sapiens
gagagcgcgggagaga

SEQ ID NO: 6210475 - DNA, 15 bp, Homo sapiens
gagagcggctggaga

SEQ ID NO: 6210476 - DNA, 16 bp, Homo sapiens
gagagcggctggagaa

SEQ ID NO: 6210477 - DNA, 20 bp, Homo sapiens
gagagcggctggagaaagat

SEQ ID NO: 6210478 - DNA, 15 bp, Homo sapiens
gagagcggcttcccc

SEQ ID NO: 6210479 - DNA, 16 bp, Homo sapiens
gagagcggcttcccca

SEQ ID NO: 6210480 - DNA, 21 bp, Homo sapiens
gagagcggcttccccatcgcc

SEQ ID NO: 6210481 - DNA, 18 bp, Homo sapiens
gagagctagaacctggag

SEQ ID NO: 6210482 - DNA, 15 bp, Homo sapiens
gagagctagcagcag

SEQ ID NO: 6210483 - DNA, 19 bp, Homo sapiens
gagagctcaagtttcagag

SEQ ID NO: 6210484 - DNA, 20 bp, Homo sapiens
gagagctcagtacagggcag

SEQ ID NO: 6210485 - DNA, 17 bp, Homo sapiens
gagagctctggccccgc

SEQ ID NO: 6210486 - DNA, 22 bp, Homo sapiens
gagagctcttagtttttaaaaa

SEQ ID NO: 6210487 - DNA, 15 bp, Homo sapiens
gagagctgaagtact

SEQ ID NO: 6210488 - DNA, 14 bp, Homo sapiens
gagagctgctgagg

SEQ ID NO: 6210489 - DNA, 14 bp, Homo sapiens
gagagctgggcaga

SEQ ID NO: 6210490 - DNA, 23 bp, Homo sapiens
gagagctggggaagcttcttaaa

SEQ ID NO: 6210491 - DNA, 20 bp, Homo sapiens
gagagctgggtgtcaagagg

SEQ ID NO: 6210492 - DNA, 12 bp, Homo sapiens
gagagctggtga

SEQ ID NO: 6210493 - DNA, 13 bp, Homo sapiens
gagagctggtgcc

SEQ ID NO: 6210494 - DNA, 17 bp, Homo sapiens
gagagctggtgcccgga

SEQ ID NO: 6210495 - DNA, 14 bp, Homo sapiens
gagagctgtattaa

SEQ ID NO: 6210496 - DNA, 20 bp, Homo sapiens
gagagctgtattaagtgact

SEQ ID NO: 6210497 - DNA, 22 bp, Homo sapiens
gagagcttattgttttaaaaag

SEQ ID NO: 6210498 - DNA, 19 bp, Homo sapiens
gagagcttggactacacaa

SEQ ID NO: 6210499 - DNA, 14 bp, Homo sapiens
gagaggaaaagcca

SEQ ID NO: 6210500 - DNA, 23 bp, Homo sapiens
gagaggaactccttggcctagcc

SEQ ID NO: 6210501 - DNA, 12 bp, Homo sapiens
gagaggaagaaa

SEQ ID NO: 6210502 - DNA, 15 bp, Homo sapiens
gagaggaagatgaag

SEQ ID NO: 6210503 - DNA, 20 bp, Homo sapiens
gagaggaagcacactgcagg

SEQ ID NO: 6210504 - DNA, 12 bp, Homo sapiens
gagaggaaggac

SEQ ID NO: 6210505 - DNA, 18 bp, Homo sapiens
gagaggacaaaataaagt

SEQ ID NO: 6210506 - DNA, 17 bp, Homo sapiens
gagaggacaagatgggt

SEQ ID NO: 6210507 - DNA, 11 bp, Homo sapiens
gagaggacaga

SEQ ID NO: 6210508 - DNA, 12 bp, Homo sapiens
gagaggacagag

SEQ ID NO: 6210509 - DNA, 13 bp, Homo sapiens
gagaggacagagg

SEQ ID NO: 6210510 - DNA, 20 bp, Homo sapiens
gagaggacccatcctgccac

SEQ ID NO: 6210511 - DNA, 15 bp, Homo sapiens
gagaggaccccctga

SEQ ID NO: 6210512 - DNA, 18 bp, Homo sapiens
gagaggacggccctgcct

SEQ ID NO: 6210513 - DNA, 22 bp, Homo sapiens
gagaggacggccctgcctgcct

SEQ ID NO: 6210514 - DNA, 20 bp, Homo sapiens
gagaggactgtagggagggc

SEQ ID NO: 6210515 - DNA, 13 bp, Homo sapiens
gagaggagaaaaa

SEQ ID NO: 6210516 - DNA, 24 bp, Homo sapiens
gagaggagaaaaaaaaagtgaaaa

SEQ ID NO: 6210517 - DNA, 16 bp, Homo sapiens
gagaggagacagacac

SEQ ID NO: 6210518 - DNA, 17 bp, Homo sapiens
gagaggagacggagggg

SEQ ID NO: 6210519 - DNA, 18 bp, Homo sapiens
gagaggagacggagggga

SEQ ID NO: 6210520 - DNA, 12 bp, Homo sapiens
gagaggagactt

SEQ ID NO: 6210521 - DNA, 18 bp, Homo sapiens
gagaggagagaggcagag

SEQ ID NO: 6210522 - DNA, 15 bp, Homo sapiens
gagaggagagcatct

SEQ ID NO: 6210523 - DNA, 13 bp, Homo sapiens
gagaggagagcca

SEQ ID NO: 6210524 - DNA, 15 bp, Homo sapiens
gagaggagagccaga

SEQ ID NO: 6210525 - DNA, 18 bp, Homo sapiens
gagaggagcacctgaacc

SEQ ID NO: 6210526 - DNA, 19 bp, Homo sapiens
gagaggagcacctgaaccc

SEQ ID NO: 6210527 - DNA, 13 bp, Homo sapiens
gagaggagccaga

SEQ ID NO: 6210528 - DNA, 15 bp, Homo sapiens
gagaggagccctgcc

SEQ ID NO: 6210529 - DNA, 21 bp, Homo sapiens
gagaggagcgggacctgtggc

SEQ ID NO: 6210530 - DNA, 17 bp, Homo sapiens
gagaggaggcagccccc

SEQ ID NO: 6210531 - DNA, 21 bp, Homo sapiens
gagaggaggcagccccctcca

SEQ ID NO: 6210532 - DNA, 14 bp, Homo sapiens
gagaggaggcctgg

SEQ ID NO: 6210533 - DNA, 15 bp, Homo sapiens
gagaggaggcctgga

SEQ ID NO: 6210534 - DNA, 15 bp, Homo sapiens
gagaggaggggtaaa

SEQ ID NO: 6210535 - DNA, 15 bp, Homo sapiens
gagaggaggtgtgga

SEQ ID NO: 6210536 - DNA, 21 bp, Homo sapiens
gagaggatacatttaataaaa

SEQ ID NO: 6210537 - DNA, 21 bp, Homo sapiens
gagaggatgaatgtatgtgca

SEQ ID NO: 6210538 - DNA, 14 bp, Homo sapiens
gagaggatgagagc

SEQ ID NO: 6210539 - DNA, 19 bp, Homo sapiens
gagaggatgagagcccaga

SEQ ID NO: 6210540 - DNA, 20 bp, Homo sapiens
gagaggatgagagcccagag

SEQ ID NO: 6210541 - DNA, 20 bp, Homo sapiens
gagaggatgggagtgggcag

SEQ ID NO: 6210542 - DNA, 14 bp, Homo sapiens
gagaggatgtgcaa

SEQ ID NO: 6210543 - DNA, 21 bp, Homo sapiens
gagaggatgtggaaagcactt

SEQ ID NO: 6210544 - DNA, 21 bp, Homo sapiens
gagaggatttggctcgctgtg

SEQ ID NO: 6210545 - DNA, 21 bp, Homo sapiens
gagaggcaataaataaatgtt

SEQ ID NO: 6210546 - DNA, 14 bp, Homo sapiens
gagaggcaatgatt

SEQ ID NO: 6210547 - DNA, 15 bp, Homo sapiens
gagaggcaatggcca

SEQ ID NO: 6210548 - DNA, 14 bp, Homo sapiens
gagaggcacctccc

SEQ ID NO: 6210549 - DNA, 16 bp, Homo sapiens
gagaggcagagtgccc

SEQ ID NO: 6210550 - DNA, 12 bp, Homo sapiens
gagaggcagcaa

SEQ ID NO: 6210551 - DNA, 11 bp, Homo sapiens
gagaggcaggc

SEQ ID NO: 6210552 - DNA, 14 bp, Homo sapiens
gagaggcatccagt

SEQ ID NO: 6210553 - DNA, 22 bp, Homo sapiens
gagaggcatccagtatcttgaa

SEQ ID NO: 6210554 - DNA, 18 bp, Homo sapiens
gagaggccaaaggctggt

SEQ ID NO: 6210555 - DNA, 14 bp, Homo sapiens
gagaggccactgtg

SEQ ID NO: 6210556 - DNA, 14 bp, Homo sapiens
gagaggccaggtgc

SEQ ID NO: 6210557 - DNA, 21 bp, Homo sapiens
gagaggccaggtgcaggttgg

SEQ ID NO: 6210558 - DNA, 10 bp, Homo sapiens
gagaggcccc

SEQ ID NO: 6210559 - DNA, 13 bp, Homo sapiens
gagaggccctgga

SEQ ID NO: 6210560 - DNA, 15 bp, Homo sapiens
gagaggcctcggctg

SEQ ID NO: 6210561 - DNA, 19 bp, Homo sapiens
gagaggcctcggctgtctc

SEQ ID NO: 6210562 - DNA, 20 bp, Homo sapiens
gagaggcctgggtgtgacct

SEQ ID NO: 6210563 - DNA, 15 bp, Homo sapiens
gagaggccttttgga

SEQ ID NO: 6210564 - DNA, 18 bp, Homo sapiens
gagaggccttttgtttaa

SEQ ID NO: 6210565 - DNA, 21 bp, Homo sapiens
gagaggcgagtcaccctcctc

SEQ ID NO: 6210566 - DNA, 22 bp, Homo sapiens
gagaggcgttagtgggcaggtg

SEQ ID NO: 6210567 - DNA, 17 bp, Homo sapiens
gagaggcgtttggagaa

SEQ ID NO: 6210568 - DNA, 14 bp, Homo sapiens
gagaggctctgggg

SEQ ID NO: 6210569 - DNA, 17 bp, Homo sapiens
gagaggctgaggtgggc

SEQ ID NO: 6210570 - DNA, 17 bp, Homo sapiens
gagaggctgcctccgca

SEQ ID NO: 6210571 - DNA, 22 bp, Homo sapiens
gagaggctggtgtatgcactgc

SEQ ID NO: 6210572 - DNA, 13 bp, Homo sapiens
gagaggctgtggt

SEQ ID NO: 6210573 - DNA, 18 bp, Homo sapiens
gagaggctgtggtggctg

SEQ ID NO: 6210574 - DNA, 21 bp, Homo sapiens
gagaggctgtggtttggggga

SEQ ID NO: 6210575 - DNA, 13 bp, Homo sapiens
gagaggcttccct

SEQ ID NO: 6210576 - DNA, 22 bp, Homo sapiens
gagaggcttccctacacagggc

SEQ ID NO: 6210577 - DNA, 13 bp, Homo sapiens
gagagggaaaagg

SEQ ID NO: 6210578 - DNA, 18 bp, Homo sapiens
gagagggaaaaggcaggt

SEQ ID NO: 6210579 - DNA, 19 bp, Homo sapiens
gagagggaagctgaggccc

SEQ ID NO: 6210580 - DNA, 15 bp, Homo sapiens
gagagggaagctggc

SEQ ID NO: 6210581 - DNA, 17 bp, Homo sapiens
gagagggacacatgccc

SEQ ID NO: 6210582 - DNA, 18 bp, Homo sapiens
gagagggacaggcactcc

SEQ ID NO: 6210583 - DNA, 22 bp, Homo sapiens
gagagggacatagaatctgtga

SEQ ID NO: 6210584 - DNA, 10 bp, Homo sapiens
gagagggaga

SEQ ID NO: 6210585 - DNA, 15 bp, Homo sapiens
gagagggagaaagga

SEQ ID NO: 6210586 - DNA, 15 bp, Homo sapiens
gagagggagaagaag

SEQ ID NO: 6210587 - DNA, 17 bp, Homo sapiens
gagagggagatgtgtga

SEQ ID NO: 6210588 - DNA, 16 bp, Homo sapiens
gagagggagcaagcct

SEQ ID NO: 6210589 - DNA, 14 bp, Homo sapiens
gagagggaggcagg

SEQ ID NO: 6210590 - DNA, 22 bp, Homo sapiens
gagagggagtacaaagacaggg

SEQ ID NO: 6210591 - DNA, 17 bp, Homo sapiens
gagagggatttccctgc

SEQ ID NO: 6210592 - DNA, 21 bp, Homo sapiens
gagagggcatgcgcacaaggc

SEQ ID NO: 6210593 - DNA, 22 bp, Homo sapiens
gagagggccaacaactgtccct

SEQ ID NO: 6210594 - DNA, 11 bp, Homo sapiens
gagagggcctt

SEQ ID NO: 6210595 - DNA, 19 bp, Homo sapiens
gagagggccttcccctccc

SEQ ID NO: 6210596 - DNA, 16 bp, Homo sapiens
gagagggcgcaggccg

SEQ ID NO: 6210597 - DNA, 17 bp, Homo sapiens
gagagggcgcccagccc

SEQ ID NO: 6210598 - DNA, 16 bp, Homo sapiens
gagagggctgagcccc

SEQ ID NO: 6210599 - DNA, 17 bp, Homo sapiens
gagagggctgagcccct

SEQ ID NO: 6210600 - DNA, 20 bp, Homo sapiens
gagagggctgagcccctcct

SEQ ID NO: 6210601 - DNA, 18 bp, Homo sapiens
gagagggctggtccttat

SEQ ID NO: 6210602 - DNA, 21 bp, Homo sapiens
gagagggctggtccttattta

SEQ ID NO: 6210603 - DNA, 13 bp, Homo sapiens
gagaggggaacag

SEQ ID NO: 6210604 - DNA, 16 bp, Homo sapiens
gagaggggaagaattt

SEQ ID NO: 6210605 - DNA, 20 bp, Homo sapiens
gagaggggaagagtgtactg

SEQ ID NO: 6210606 - DNA, 16 bp, Homo sapiens
gagaggggaagggcca

SEQ ID NO: 6210607 - DNA, 22 bp, Homo sapiens
gagaggggacaaaacccacctt

SEQ ID NO: 6210608 - DNA, 15 bp, Homo sapiens
gagaggggacgcagg

SEQ ID NO: 6210609 - DNA, 17 bp, Homo sapiens
gagaggggacgcaggcc

SEQ ID NO: 6210610 - DNA, 19 bp, Homo sapiens
gagaggggagggctcctgg

SEQ ID NO: 6210611 - DNA, 20 bp, Homo sapiens
gagaggggagggctcctggg

SEQ ID NO: 6210612 - DNA, 21 bp, Homo sapiens
gagaggggccgatgcccagag

SEQ ID NO: 6210613 - DNA, 20 bp, Homo sapiens
gagaggggcctctggctgcc

SEQ ID NO: 6210614 - DNA, 21 bp, Homo sapiens
gagaggggcctctggctgcct

SEQ ID NO: 6210615 - DNA, 22 bp, Homo sapiens
gagaggggcctctggctgcctg

SEQ ID NO: 6210616 - DNA, 18 bp, Homo sapiens
gagaggggcctgggaaag

SEQ ID NO: 6210617 - DNA, 19 bp, Homo sapiens
gagaggggcctgggaaagg

SEQ ID NO: 6210618 - DNA, 16 bp, Homo sapiens
gagagggggatgcccc

SEQ ID NO: 6210619 - DNA, 13 bp, Homo sapiens
gagagggggctgg

SEQ ID NO: 6210620 - DNA, 24 bp, Homo sapiens
gagagggggtaatggaggccaagc

SEQ ID NO: 6210621 - DNA, 21 bp, Homo sapiens
gagagggtctccagtgttccc

SEQ ID NO: 6210622 - DNA, 14 bp, Homo sapiens
gagagggtgggagt

SEQ ID NO: 6210623 - DNA, 22 bp, Homo sapiens
gagagggtgtgggtgccctgtt

SEQ ID NO: 6210624 - DNA, 11 bp, Homo sapiens
gagaggtattt

SEQ ID NO: 6210625 - DNA, 14 bp, Homo sapiens
gagaggtccagccc

SEQ ID NO: 6210626 - DNA, 16 bp, Homo sapiens
gagaggtccagccccc

SEQ ID NO: 6210627 - DNA, 21 bp, Homo sapiens
gagaggtgattctcagggctg

SEQ ID NO: 6210628 - DNA, 22 bp, Homo sapiens
gagaggtgattctcagggctgg

SEQ ID NO: 6210629 - DNA, 17 bp, Homo sapiens
gagaggtggagaactgg

SEQ ID NO: 6210630 - DNA, 12 bp, Homo sapiens
gagaggtggagc

SEQ ID NO: 6210631 - DNA, 21 bp, Homo sapiens
gagaggtggccaccgggggtg

SEQ ID NO: 6210632 - DNA, 21 bp, Homo sapiens
gagaggtgggggatgctgagg

SEQ ID NO: 6210633 - DNA, 19 bp, Homo sapiens
gagaggttataggtcactc

SEQ ID NO: 6210634 - DNA, 16 bp, Homo sapiens
gagaggttctggggag

SEQ ID NO: 6210635 - DNA, 19 bp, Homo sapiens
gagaggttctggggaggaa

SEQ ID NO: 6210636 - DNA, 20 bp, Homo sapiens
gagaggttctggggaggaag

SEQ ID NO: 6210637 - DNA, 13 bp, Homo sapiens
gagaggttgagga

SEQ ID NO: 6210638 - DNA, 19 bp, Homo sapiens
gagaggttgaggatgcact

SEQ ID NO: 6210639 - DNA, 22 bp, Homo sapiens
gagaggttgaggatgcactggc

SEQ ID NO: 6210640 - DNA, 17 bp, Homo sapiens
gagaggttgtctgtggc

SEQ ID NO: 6210641 - DNA, 19 bp, Homo sapiens
gagaggtttcgatatttat

SEQ ID NO: 6210642 - DNA, 21 bp, Homo sapiens
gagaggtttcgatatttattg

SEQ ID NO: 6210643 - DNA, 20 bp, Homo sapiens
gagaggtttgtcaacacaaa

SEQ ID NO: 6210644 - DNA, 18 bp, Homo sapiens
gagaggtttttcttggga

SEQ ID NO: 6210645 - DNA, 21 bp, Homo sapiens
gagaggtttttcttgggaaag

SEQ ID NO: 6210646 - DNA, 17 bp, Homo sapiens
gagagtacaccctttcc

SEQ ID NO: 6210647 - DNA, 15 bp, Homo sapiens
gagagtacactgtgt

SEQ ID NO: 6210648 - DNA, 11 bp, Homo sapiens
gagagtaccat

SEQ ID NO: 6210649 - DNA, 14 bp, Homo sapiens
gagagtaccatgct

SEQ ID NO: 6210650 - DNA, 22 bp, Homo sapiens
gagagtagccgagagcctgctc

SEQ ID NO: 6210651 - DNA, 12 bp, Homo sapiens
cttttatagtgg

SEQ ID NO: 6210652 - DNA, 15 bp, Homo sapiens
cttttatagtggaaa

SEQ ID NO: 6210653 - DNA, 20 bp, Homo sapiens
cttttatagtggaaaaacac

SEQ ID NO: 6210654 - DNA, 10 bp, Homo sapiens
cttttatata

SEQ ID NO: 6210655 - DNA, 21 bp, Homo sapiens
cttttatataagtgacttgaa

SEQ ID NO: 6210656 - DNA, 12 bp, Homo sapiens
cttttatatata

SEQ ID NO: 6210657 - DNA, 23 bp, Homo sapiens
cttttatatataaaataaatata

SEQ ID NO: 6210658 - DNA, 17 bp, Homo sapiens
cttttatatatgaagtt

SEQ ID NO: 6210659 - DNA, 14 bp, Homo sapiens
cttttatatcccat

SEQ ID NO: 6210660 - DNA, 13 bp, Homo sapiens
cttttatatctgt

SEQ ID NO: 6210661 - DNA, 21 bp, Homo sapiens
cttttatatggcccagccttg

SEQ ID NO: 6210662 - DNA, 15 bp, Homo sapiens
cttttatattctaat

SEQ ID NO: 6210663 - DNA, 22 bp, Homo sapiens
cttttatattctaatagttttt

SEQ ID NO: 6210664 - DNA, 20 bp, Homo sapiens
cttttatatttgaaaaaatt

SEQ ID NO: 6210665 - DNA, 16 bp, Homo sapiens
cttttatatttgtatc

SEQ ID NO: 6210666 - DNA, 17 bp, Homo sapiens
cttttatcaataaagca

SEQ ID NO: 6210667 - DNA, 21 bp, Homo sapiens
cttttatccactggcattttt

SEQ ID NO: 6210668 - DNA, 13 bp, Homo sapiens
cttttatctattt

SEQ ID NO: 6210669 - DNA, 17 bp, Homo sapiens
cttttatctatttgaga

SEQ ID NO: 6210670 - DNA, 13 bp, Homo sapiens
cttttatctcaga

SEQ ID NO: 6210671 - DNA, 15 bp, Homo sapiens
cttttatctgcagaa

SEQ ID NO: 6210672 - DNA, 16 bp, Homo sapiens
cttttatgaaattaac

SEQ ID NO: 6210673 - DNA, 14 bp, Homo sapiens
cttttatgaagttt

SEQ ID NO: 6210674 - DNA, 16 bp, Homo sapiens
cttttatgaagttttt

SEQ ID NO: 6210675 - DNA, 14 bp, Homo sapiens
cttttatgacaaat

SEQ ID NO: 6210676 - DNA, 18 bp, Homo sapiens
cttttatgatgtatattt

SEQ ID NO: 6210677 - DNA, 19 bp, Homo sapiens
cttttatgcgcaaatacaa

SEQ ID NO: 6210678 - DNA, 22 bp, Homo sapiens
cttttatgcgcaaatacaaaat

SEQ ID NO: 6210679 - DNA, 13 bp, Homo sapiens
cttttatggatga

SEQ ID NO: 6210680 - DNA, 18 bp, Homo sapiens
cttttatggatgattaaa

SEQ ID NO: 6210681 - DNA, 19 bp, Homo sapiens
cttttatggatgattaaat

SEQ ID NO: 6210682 - DNA, 13 bp, Homo sapiens
cttttatgtaaat

SEQ ID NO: 6210683 - DNA, 13 bp, Homo sapiens
cttttatgtagca

SEQ ID NO: 6210684 - DNA, 14 bp, Homo sapiens
cttttatgtatttt

SEQ ID NO: 6210685 - DNA, 13 bp, Homo sapiens
cttttatgtgaga

SEQ ID NO: 6210686 - DNA, 15 bp, Homo sapiens
cttttatgtttgaat

SEQ ID NO: 6210687 - DNA, 17 bp, Homo sapiens
cttttatgtttgaatat

SEQ ID NO: 6210688 - DNA, 22 bp, Homo sapiens
cttttatgtttgaatatggaca

SEQ ID NO: 6210689 - DNA, 15 bp, Homo sapiens
cttttatgtttgtac

SEQ ID NO: 6210690 - DNA, 14 bp, Homo sapiens
cttttattaatgca

SEQ ID NO: 6210691 - DNA, 16 bp, Homo sapiens
cttttattaatgcact

SEQ ID NO: 6210692 - DNA, 19 bp, Homo sapiens
cttttattaatgcactttc

SEQ ID NO: 6210693 - DNA, 12 bp, Homo sapiens
cttttattattt

SEQ ID NO: 6210694 - DNA, 17 bp, Homo sapiens
cttttattcctttgaat

SEQ ID NO: 6210695 - DNA, 20 bp, Homo sapiens
cttttattctgttatatagt

SEQ ID NO: 6210696 - DNA, 17 bp, Homo sapiens
cttttattgagtaatat

SEQ ID NO: 6210697 - DNA, 20 bp, Homo sapiens
cttttattgagtaatattac

SEQ ID NO: 6210698 - DNA, 22 bp, Homo sapiens
cttttattgagtaatattacat

SEQ ID NO: 6210699 - DNA, 16 bp, Homo sapiens
cttttattgtaaagtc

SEQ ID NO: 6210700 - DNA, 12 bp, Homo sapiens
cttttatttcat

SEQ ID NO: 6210701 - DNA, 23 bp, Homo sapiens
cttttatttcattcatatcctcc

SEQ ID NO: 6210702 - DNA, 14 bp, Homo sapiens
cttttatttccaaa

SEQ ID NO: 6210703 - DNA, 19 bp, Homo sapiens
cttttatttgcaacattta

SEQ ID NO: 6210704 - DNA, 17 bp, Homo sapiens
cttttatttggtgtgtt

SEQ ID NO: 6210705 - DNA, 14 bp, Homo sapiens
cttttattttaata

SEQ ID NO: 6210706 - DNA, 23 bp, Homo sapiens
cttttattttaatattgatgtca

SEQ ID NO: 6210707 - DNA, 14 bp, Homo sapiens
cttttattttcatt

SEQ ID NO: 6210708 - DNA, 16 bp, Homo sapiens
cttttattttcattgt

SEQ ID NO: 6210709 - DNA, 17 bp, Homo sapiens
cttttattttcctgtct

SEQ ID NO: 6210710 - DNA, 12 bp, Homo sapiens
cttttattttga

SEQ ID NO: 6210711 - DNA, 23 bp, Homo sapiens
cttttattttttaaatgtaaaat

SEQ ID NO: 6210712 - DNA, 16 bp, Homo sapiens
cttttattttttaagt

SEQ ID NO: 6210713 - DNA, 20 bp, Homo sapiens
cttttattttttaagttcaa

SEQ ID NO: 6210714 - DNA, 23 bp, Homo sapiens
cttttattttttcttttgtaatt

SEQ ID NO: 6210715 - DNA, 18 bp, Homo sapiens
cttttatttttttctaat

SEQ ID NO: 6210716 - DNA, 15 bp, Homo sapiens
cttttcaaaacattt

SEQ ID NO: 6210717 - DNA, 18 bp, Homo sapiens
cttttcaaaagaagacat

SEQ ID NO: 6210718 - DNA, 14 bp, Homo sapiens
cttttcaaaataaa

SEQ ID NO: 6210719 - DNA, 22 bp, Homo sapiens
cttttcaaatagggtctaactc

SEQ ID NO: 6210720 - DNA, 19 bp, Homo sapiens
cttttcaaatgcagcaatc

SEQ ID NO: 6210721 - DNA, 23 bp, Homo sapiens
cttttcaaggaaaaatgctgctt

SEQ ID NO: 6210722 - DNA, 16 bp, Homo sapiens
cttttcaaggcttata

SEQ ID NO: 6210723 - DNA, 17 bp, Homo sapiens
cttttcaagtatttaag

SEQ ID NO: 6210724 - DNA, 14 bp, Homo sapiens
cttttcaatcttct

SEQ ID NO: 6210725 - DNA, 22 bp, Homo sapiens
cttttcaatcttctacttttaa

SEQ ID NO: 6210726 - DNA, 15 bp, Homo sapiens
cttttcaatgacatt

SEQ ID NO: 6210727 - DNA, 17 bp, Homo sapiens
cttttcaatgtctaaaa

SEQ ID NO: 6210728 - DNA, 13 bp, Homo sapiens
cttttcacactgt

SEQ ID NO: 6210729 - DNA, 19 bp, Homo sapiens
cttttcacactgtcttccc

SEQ ID NO: 6210730 - DNA, 20 bp, Homo sapiens
cttttcacatagctgtctag

SEQ ID NO: 6210731 - DNA, 14 bp, Homo sapiens
cttttcacattctt

SEQ ID NO: 6210732 - DNA, 17 bp, Homo sapiens
cttttcacattcttata

SEQ ID NO: 6210733 - DNA, 12 bp, Homo sapiens
cttttcacattt

SEQ ID NO: 6210734 - DNA, 18 bp, Homo sapiens
cttttcaccccagaggac

SEQ ID NO: 6210735 - DNA, 14 bp, Homo sapiens
cttttcacccttct

SEQ ID NO: 6210736 - DNA, 17 bp, Homo sapiens
cttttcacccttctact

SEQ ID NO: 6210737 - DNA, 19 bp, Homo sapiens
cttttcactccctccatca

SEQ ID NO: 6210738 - DNA, 17 bp, Homo sapiens
cttttcactgctggctg

SEQ ID NO: 6210739 - DNA, 15 bp, Homo sapiens
cttttcacttcttaa

SEQ ID NO: 6210740 - DNA, 20 bp, Homo sapiens
cttttcacttgtcttgctct

SEQ ID NO: 6210741 - DNA, 20 bp, Homo sapiens
cttttcagaagcaagccaga

SEQ ID NO: 6210742 - DNA, 17 bp, Homo sapiens
cttttcagataatgatg

SEQ ID NO: 6210743 - DNA, 15 bp, Homo sapiens
cttttcagcatggtt

SEQ ID NO: 6210744 - DNA, 20 bp, Homo sapiens
cttttcagccaatttgtctc

SEQ ID NO: 6210745 - DNA, 21 bp, Homo sapiens
cttttcagccaatttgtctcc

SEQ ID NO: 6210746 - DNA, 11 bp, Homo sapiens
cttttcagccc

SEQ ID NO: 6210747 - DNA, 20 bp, Homo sapiens
cttttcagctgagccctggg

SEQ ID NO: 6210748 - DNA, 15 bp, Homo sapiens
cttttcagcttgttt

SEQ ID NO: 6210749 - DNA, 14 bp, Homo sapiens
cttttcaggaaaat

SEQ ID NO: 6210750 - DNA, 18 bp, Homo sapiens
cttttcaggaagctctct

SEQ ID NO: 6210751 - DNA, 17 bp, Homo sapiens
cttttcagggctggctc

SEQ ID NO: 6210752 - DNA, 23 bp, Homo sapiens
cttttcagggctggctcctgatc

SEQ ID NO: 6210753 - DNA, 21 bp, Homo sapiens
cttttcaggtttgtcatcaga

SEQ ID NO: 6210754 - DNA, 20 bp, Homo sapiens
cttttcagttcccgctctgc

SEQ ID NO: 6210755 - DNA, 22 bp, Homo sapiens
cttttcataaagggttgaaaat

SEQ ID NO: 6210756 - DNA, 22 bp, Homo sapiens
cttttcataacctagccttaga

SEQ ID NO: 6210757 - DNA, 18 bp, Homo sapiens
cttttcataggtctgaaa

SEQ ID NO: 6210758 - DNA, 14 bp, Homo sapiens
cttttcatatcatt

SEQ ID NO: 6210759 - DNA, 16 bp, Homo sapiens
cttttcatatcatttc

SEQ ID NO: 6210760 - DNA, 17 bp, Homo sapiens
cttttcatatttgcact

SEQ ID NO: 6210761 - DNA, 16 bp, Homo sapiens
cttttcatccttcccc

SEQ ID NO: 6210762 - DNA, 17 bp, Homo sapiens
cttttcatgcaaactct

SEQ ID NO: 6210763 - DNA, 19 bp, Homo sapiens
cttttcatgcaaactcttt

SEQ ID NO: 6210764 - DNA, 15 bp, Homo sapiens
cttttcatggaagtg

SEQ ID NO: 6210765 - DNA, 20 bp, Homo sapiens
cttttcatggagtagagtca

SEQ ID NO: 6210766 - DNA, 19 bp, Homo sapiens
cttttcatggtaccaggcc

SEQ ID NO: 6210767 - DNA, 15 bp, Homo sapiens
cttttcatgtacagc

SEQ ID NO: 6210768 - DNA, 16 bp, Homo sapiens
cttttcatgtacagca

SEQ ID NO: 6210769 - DNA, 13 bp, Homo sapiens
cttttcattgcaa

SEQ ID NO: 6210770 - DNA, 17 bp, Homo sapiens
cttttcatttcagattt

SEQ ID NO: 6210771 - DNA, 19 bp, Homo sapiens
cttttcattttaatatata

SEQ ID NO: 6210772 - DNA, 18 bp, Homo sapiens
cttttccaaataaacatt

SEQ ID NO: 6210773 - DNA, 17 bp, Homo sapiens
cttttccaaatgcccaa

SEQ ID NO: 6210774 - DNA, 17 bp, Homo sapiens
cttttccaacccatgag

SEQ ID NO: 6210775 - DNA, 19 bp, Homo sapiens
cttttccaacctacctcac

SEQ ID NO: 6210776 - DNA, 19 bp, Homo sapiens
cttttccaatatgtgattt

SEQ ID NO: 6210777 - DNA, 16 bp, Homo sapiens
cttttccacaaatatg

SEQ ID NO: 6210778 - DNA, 17 bp, Homo sapiens
cttttccactccaagat

SEQ ID NO: 6210779 - DNA, 19 bp, Homo sapiens
cttttccactccattgtcg

SEQ ID NO: 6210780 - DNA, 22 bp, Homo sapiens
cttttccagaaagaaaatgaat

SEQ ID NO: 6210781 - DNA, 19 bp, Homo sapiens
cttttccaggatcctgcag

SEQ ID NO: 6210782 - DNA, 18 bp, Homo sapiens
cttttccagtattttagt

SEQ ID NO: 6210783 - DNA, 11 bp, Homo sapiens
cttttccagtg

SEQ ID NO: 6210784 - DNA, 14 bp, Homo sapiens
cttttccagtgtgt

SEQ ID NO: 6210785 - DNA, 20 bp, Homo sapiens
cttttccagttgctgtggac

SEQ ID NO: 6210786 - DNA, 19 bp, Homo sapiens
cttttccatcccactccac

SEQ ID NO: 6210787 - DNA, 20 bp, Homo sapiens
cttttccattgaccagctct

SEQ ID NO: 6210788 - DNA, 18 bp, Homo sapiens
cttttcccaaaatgttga

SEQ ID NO: 6210789 - DNA, 14 bp, Homo sapiens
cttttcccaaccat

SEQ ID NO: 6210790 - DNA, 21 bp, Homo sapiens
cttttcccaatactagccccc

SEQ ID NO: 6210791 - DNA, 17 bp, Homo sapiens
cttttcccactccaagc

SEQ ID NO: 6210792 - DNA, 17 bp, Homo sapiens
cttttcccaggaatatc

SEQ ID NO: 6210793 - DNA, 18 bp, Homo sapiens
cttttcccataaataaaa

SEQ ID NO: 6210794 - DNA, 12 bp, Homo sapiens
cttttccccagg

SEQ ID NO: 6210795 - DNA, 14 bp, Homo sapiens
cttttccccaggag

SEQ ID NO: 6210796 - DNA, 19 bp, Homo sapiens
cttttcccccaaagtggtt

SEQ ID NO: 6210797 - DNA, 14 bp, Homo sapiens
cttttcccccaccc

SEQ ID NO: 6210798 - DNA, 15 bp, Homo sapiens
cttttcccccaccct

SEQ ID NO: 6210799 - DNA, 16 bp, Homo sapiens
cttttcccccaccctc

SEQ ID NO: 6210800 - DNA, 23 bp, Homo sapiens
cttttcccccaccctcccatgag

SEQ ID NO: 6210801 - DNA, 23 bp, Homo sapiens
cttttcccccttcccatttcttc

SEQ ID NO: 6210802 - DNA, 14 bp, Homo sapiens
cttttccccggtcc

SEQ ID NO: 6210803 - DNA, 20 bp, Homo sapiens
cttttcccctacagaatttt

SEQ ID NO: 6210804 - DNA, 18 bp, Homo sapiens
cttttcccctgttaaaca

SEQ ID NO: 6210805 - DNA, 21 bp, Homo sapiens
cttttcccctgttaaacagta

SEQ ID NO: 6210806 - DNA, 15 bp, Homo sapiens
cttttcccctttcct

SEQ ID NO: 6210807 - DNA, 17 bp, Homo sapiens
cttttcccctttcctgt

SEQ ID NO: 6210808 - DNA, 21 bp, Homo sapiens
cttttcccctttcctgtccca

SEQ ID NO: 6210809 - DNA, 22 bp, Homo sapiens
cttttcccctttcctgtcccac

SEQ ID NO: 6210810 - DNA, 22 bp, Homo sapiens
cttttcccgtatgctttcttca

SEQ ID NO: 6210811 - DNA, 17 bp, Homo sapiens
cttttccctcctttcct

SEQ ID NO: 6210812 - DNA, 22 bp, Homo sapiens
cttttccctctttggctcccct

SEQ ID NO: 6210813 - DNA, 15 bp, Homo sapiens
cttttccctgcttcc

SEQ ID NO: 6210814 - DNA, 13 bp, Homo sapiens
cttttccctgggt

SEQ ID NO: 6210815 - DNA, 18 bp, Homo sapiens
cttttccctgtacttttc

SEQ ID NO: 6210816 - DNA, 17 bp, Homo sapiens
cttttcccttaaataca

SEQ ID NO: 6210817 - DNA, 14 bp, Homo sapiens
cttttcccttcttt

SEQ ID NO: 6210818 - DNA, 16 bp, Homo sapiens
cttttcccttgctgta

SEQ ID NO: 6210819 - DNA, 17 bp, Homo sapiens
cttttcccttgctgtac

SEQ ID NO: 6210820 - DNA, 15 bp, Homo sapiens
cttttcccttgcttc

SEQ ID NO: 6210821 - DNA, 14 bp, Homo sapiens
cttttcccttgtgt

SEQ ID NO: 6210822 - DNA, 16 bp, Homo sapiens
cttttcctaacattgt

SEQ ID NO: 6210823 - DNA, 20 bp, Homo sapiens
cttttcctacggtacaagct

SEQ ID NO: 6210824 - DNA, 21 bp, Homo sapiens
cttttcctacttttccttccc

SEQ ID NO: 6210825 - DNA, 22 bp, Homo sapiens
cttttcctacttttccttccct

SEQ ID NO: 6210826 - DNA, 15 bp, Homo sapiens
cttttcctagtttta

SEQ ID NO: 6210827 - DNA, 20 bp, Homo sapiens
cttttcctattctgttgcca

SEQ ID NO: 6210828 - DNA, 19 bp, Homo sapiens
cttttcctattttcgatga

SEQ ID NO: 6210829 - DNA, 14 bp, Homo sapiens
cttttcctcaagca

SEQ ID NO: 6210830 - DNA, 15 bp, Homo sapiens
gagagtatggtgctg

SEQ ID NO: 6210831 - DNA, 21 bp, Homo sapiens
gagagtattaaatatttaaca

SEQ ID NO: 6210832 - DNA, 17 bp, Homo sapiens
gagagtatttttataca

SEQ ID NO: 6210833 - DNA, 22 bp, Homo sapiens
gagagtatttttatacaaacct

SEQ ID NO: 6210834 - DNA, 24 bp, Homo sapiens
gagagtcagactgatagacaccat

SEQ ID NO: 6210835 - DNA, 20 bp, Homo sapiens
gagagtcccactgcctcagg

SEQ ID NO: 6210836 - DNA, 22 bp, Homo sapiens
gagagtcccactgcctcaggtt

SEQ ID NO: 6210837 - DNA, 15 bp, Homo sapiens
gagagtcccagagca

SEQ ID NO: 6210838 - DNA, 17 bp, Homo sapiens
gagagtcccagagcagg

SEQ ID NO: 6210839 - DNA, 12 bp, Homo sapiens
gagagtcctggg

SEQ ID NO: 6210840 - DNA, 17 bp, Homo sapiens
gagagtccttagcctgg

SEQ ID NO: 6210841 - DNA, 18 bp, Homo sapiens
gagagtccttagcctggg

SEQ ID NO: 6210842 - DNA, 19 bp, Homo sapiens
gagagtccttagcctgggc

SEQ ID NO: 6210843 - DNA, 21 bp, Homo sapiens
gagagtccttagcctgggcct

SEQ ID NO: 6210844 - DNA, 23 bp, Homo sapiens
gagagtccttagcctgggcctcc

SEQ ID NO: 6210845 - DNA, 21 bp, Homo sapiens
gagagtcctttgggattctag

SEQ ID NO: 6210846 - DNA, 14 bp, Homo sapiens
gagagtctggccct

SEQ ID NO: 6210847 - DNA, 15 bp, Homo sapiens
gagagtctggcccta

SEQ ID NO: 6210848 - DNA, 20 bp, Homo sapiens
gagagtcttgggcctggccc

SEQ ID NO: 6210849 - DNA, 19 bp, Homo sapiens
gagagtgaacaaatttaca

SEQ ID NO: 6210850 - DNA, 17 bp, Homo sapiens
gagagtgaatacactgg

SEQ ID NO: 6210851 - DNA, 13 bp, Homo sapiens
gagagtgagaata

SEQ ID NO: 6210852 - DNA, 14 bp, Homo sapiens
gagagtgagagaga

SEQ ID NO: 6210853 - DNA, 21 bp, Homo sapiens
gagagtgagagcacaaagata

SEQ ID NO: 6210854 - DNA, 14 bp, Homo sapiens
gagagtgagagcat

SEQ ID NO: 6210855 - DNA, 18 bp, Homo sapiens
gagagtgcaacagtagca

SEQ ID NO: 6210856 - DNA, 21 bp, Homo sapiens
gagagtgcccttttgtatctt

SEQ ID NO: 6210857 - DNA, 13 bp, Homo sapiens
gagagtgctgaga

SEQ ID NO: 6210858 - DNA, 13 bp, Homo sapiens
gagagtggagaga

SEQ ID NO: 6210859 - DNA, 14 bp, Homo sapiens
gagagtggctgggg

SEQ ID NO: 6210860 - DNA, 20 bp, Homo sapiens
gagagtggctggggcatgga

SEQ ID NO: 6210861 - DNA, 12 bp, Homo sapiens
gagagtggctta

SEQ ID NO: 6210862 - DNA, 13 bp, Homo sapiens
gagagtggggaga

SEQ ID NO: 6210863 - DNA, 20 bp, Homo sapiens
gagagtgggtaaatcaggga

SEQ ID NO: 6210864 - DNA, 19 bp, Homo sapiens
gagagtgggtcacatttgt

SEQ ID NO: 6210865 - DNA, 20 bp, Homo sapiens
gagagtgtgaaatagacatt

SEQ ID NO: 6210866 - DNA, 11 bp, Homo sapiens
gagagtgtgac

SEQ ID NO: 6210867 - DNA, 23 bp, Homo sapiens
gagagtgtgcaactggccagcca

SEQ ID NO: 6210868 - DNA, 22 bp, Homo sapiens
gagagtgtggaaaaaaaaagaa

SEQ ID NO: 6210869 - DNA, 17 bp, Homo sapiens
gagagttaaaagcagca

SEQ ID NO: 6210870 - DNA, 21 bp, Homo sapiens
gagagttaataggagtatttt

SEQ ID NO: 6210871 - DNA, 15 bp, Homo sapiens
gagagttccggggag

SEQ ID NO: 6210872 - DNA, 18 bp, Homo sapiens
gagagttccggggagaaa

SEQ ID NO: 6210873 - DNA, 23 bp, Homo sapiens
gagagttcgtgaagagggaagcc

SEQ ID NO: 6210874 - DNA, 21 bp, Homo sapiens
gagagttctggatgtctggct

SEQ ID NO: 6210875 - DNA, 20 bp, Homo sapiens
gagagttctttgctgcccct

SEQ ID NO: 6210876 - DNA, 17 bp, Homo sapiens
gagagtttactgatgaa

SEQ ID NO: 6210877 - DNA, 14 bp, Homo sapiens
gagagtttagctgt

SEQ ID NO: 6210878 - DNA, 14 bp, Homo sapiens
gagagtttcctgaa

SEQ ID NO: 6210879 - DNA, 22 bp, Homo sapiens
gagagtttctatggattcactt

SEQ ID NO: 6210880 - DNA, 17 bp, Homo sapiens
gagagttttgtcttgaa

SEQ ID NO: 6210881 - DNA, 22 bp, Homo sapiens
gagagttttgtcttgaatgtct

SEQ ID NO: 6210882 - DNA, 18 bp, Homo sapiens
gagagtttttaatagaac

SEQ ID NO: 6210883 - DNA, 23 bp, Homo sapiens
gagataaaaggtggagtttctct

SEQ ID NO: 6210884 - DNA, 22 bp, Homo sapiens
gagataaacaccaacccaggaa

SEQ ID NO: 6210885 - DNA, 20 bp, Homo sapiens
gagataaacgaccaaactca

SEQ ID NO: 6210886 - DNA, 21 bp, Homo sapiens
gagataaagtcaaatgccaaa

SEQ ID NO: 6210887 - DNA, 15 bp, Homo sapiens
gagataaatatttat

SEQ ID NO: 6210888 - DNA, 18 bp, Homo sapiens
gagataaatgagctttcc

SEQ ID NO: 6210889 - DNA, 22 bp, Homo sapiens
gagataaccacaaccaggaaga

SEQ ID NO: 6210890 - DNA, 15 bp, Homo sapiens
gagataatatgagaa

SEQ ID NO: 6210891 - DNA, 16 bp, Homo sapiens
gagataatgaggcaac

SEQ ID NO: 6210892 - DNA, 17 bp, Homo sapiens
gagataatgaggcaact

SEQ ID NO: 6210893 - DNA, 19 bp, Homo sapiens
gagataattactgccttga

SEQ ID NO: 6210894 - DNA, 12 bp, Homo sapiens
gagataattgtt

SEQ ID NO: 6210895 - DNA, 16 bp, Homo sapiens
gagatacaaggcccag

SEQ ID NO: 6210896 - DNA, 13 bp, Homo sapiens
gagatacatacag

SEQ ID NO: 6210897 - DNA, 17 bp, Homo sapiens
gagataccaagatgcca

SEQ ID NO: 6210898 - DNA, 19 bp, Homo sapiens
gagatacccacagagtgtg

SEQ ID NO: 6210899 - DNA, 23 bp, Homo sapiens
gagatacccagagagaaaaagag

SEQ ID NO: 6210900 - DNA, 15 bp, Homo sapiens
gagatactattttca

SEQ ID NO: 6210901 - DNA, 18 bp, Homo sapiens
gagatacttatgcaagat

SEQ ID NO: 6210902 - DNA, 18 bp, Homo sapiens
gagatactttttcttttg

SEQ ID NO: 6210903 - DNA, 17 bp, Homo sapiens
gagatagaactgtggca

SEQ ID NO: 6210904 - DNA, 16 bp, Homo sapiens
gagatagaagaactgc

SEQ ID NO: 6210905 - DNA, 20 bp, Homo sapiens
gagatagacgggttgaaaga

SEQ ID NO: 6210906 - DNA, 21 bp, Homo sapiens
gagatagacgggttgaaagac

SEQ ID NO: 6210907 - DNA, 22 bp, Homo sapiens
gagatagacgggttgaaagaca

SEQ ID NO: 6210908 - DNA, 13 bp, Homo sapiens
gagatagcagagg

SEQ ID NO: 6210909 - DNA, 21 bp, Homo sapiens
gagatagccaaggccaaagga

SEQ ID NO: 6210910 - DNA, 20 bp, Homo sapiens
gagatagcctgtggccctgt

SEQ ID NO: 6210911 - DNA, 16 bp, Homo sapiens
gagatagctggggctt

SEQ ID NO: 6210912 - DNA, 14 bp, Homo sapiens
gagataggggaggg

SEQ ID NO: 6210913 - DNA, 19 bp, Homo sapiens
gagatagttggttctttta

SEQ ID NO: 6210914 - DNA, 16 bp, Homo sapiens
gagatagttttcatcc

SEQ ID NO: 6210915 - DNA, 15 bp, Homo sapiens
gagatagttttcatt

SEQ ID NO: 6210916 - DNA, 18 bp, Homo sapiens
gagatagttttcatttta

SEQ ID NO: 6210917 - DNA, 13 bp, Homo sapiens
gagatataaaatc

SEQ ID NO: 6210918 - DNA, 14 bp, Homo sapiens
gagatataaatgaa

SEQ ID NO: 6210919 - DNA, 17 bp, Homo sapiens
gagatatacaaatatat

SEQ ID NO: 6210920 - DNA, 18 bp, Homo sapiens
gagatatatctgaaaact

SEQ ID NO: 6210921 - DNA, 15 bp, Homo sapiens
gagatatatttttaa

SEQ ID NO: 6210922 - DNA, 22 bp, Homo sapiens
gagatatgcacacacacggatg

SEQ ID NO: 6210923 - DNA, 17 bp, Homo sapiens
gagatatggcattgcac

SEQ ID NO: 6210924 - DNA, 11 bp, Homo sapiens
gagatattaat

SEQ ID NO: 6210925 - DNA, 23 bp, Homo sapiens
gagatattattttaaatttcttt

SEQ ID NO: 6210926 - DNA, 16 bp, Homo sapiens
gagatattgtgaggac

SEQ ID NO: 6210927 - DNA, 22 bp, Homo sapiens
gagatatttaaaagacaaacac

SEQ ID NO: 6210928 - DNA, 11 bp, Homo sapiens
gagatatttac

SEQ ID NO: 6210929 - DNA, 16 bp, Homo sapiens
gagatatttgtattta

SEQ ID NO: 6210930 - DNA, 18 bp, Homo sapiens
gagatattttccatttta

SEQ ID NO: 6210931 - DNA, 22 bp, Homo sapiens
gagatattttgtaaaatgtatt

SEQ ID NO: 6210932 - DNA, 18 bp, Homo sapiens
gagatcaaaaaaatatat

SEQ ID NO: 6210933 - DNA, 15 bp, Homo sapiens
gagatcaaagatgaa

SEQ ID NO: 6210934 - DNA, 20 bp, Homo sapiens
gagatcaaccccttcgctcc

SEQ ID NO: 6210935 - DNA, 19 bp, Homo sapiens
gagatcacagccccaccct

SEQ ID NO: 6210936 - DNA, 23 bp, Homo sapiens
gagatcacagccccacccttgtc

SEQ ID NO: 6210937 - DNA, 20 bp, Homo sapiens
gagatcacagcctccagggc

SEQ ID NO: 6210938 - DNA, 19 bp, Homo sapiens
gagatcacgccactgcact

SEQ ID NO: 6210939 - DNA, 20 bp, Homo sapiens
gagatcacgccactgcactc

SEQ ID NO: 6210940 - DNA, 20 bp, Homo sapiens
gagatcacgccattgcactc

SEQ ID NO: 6210941 - DNA, 15 bp, Homo sapiens
gagatcactgaactt

SEQ ID NO: 6210942 - DNA, 12 bp, Homo sapiens
gagatcagaaaa

SEQ ID NO: 6210943 - DNA, 11 bp, Homo sapiens
gagatcagcat

SEQ ID NO: 6210944 - DNA, 14 bp, Homo sapiens
gagatcagcctggg

SEQ ID NO: 6210945 - DNA, 14 bp, Homo sapiens
gagatccagttttt

SEQ ID NO: 6210946 - DNA, 20 bp, Homo sapiens
gagatcccaacactgccagc

SEQ ID NO: 6210947 - DNA, 18 bp, Homo sapiens
gagatcccacatatttca

SEQ ID NO: 6210948 - DNA, 19 bp, Homo sapiens
gagatcccatccccttgtc

SEQ ID NO: 6210949 - DNA, 11 bp, Homo sapiens
gagatccccag

SEQ ID NO: 6210950 - DNA, 16 bp, Homo sapiens
gagatccccagggcag

SEQ ID NO: 6210951 - DNA, 23 bp, Homo sapiens
gagatcccgtctccgaagaaaag

SEQ ID NO: 6210952 - DNA, 23 bp, Homo sapiens
gagatccgccctgggctctgggt

SEQ ID NO: 6210953 - DNA, 17 bp, Homo sapiens
gagatcctaactgagaa

SEQ ID NO: 6210954 - DNA, 20 bp, Homo sapiens
gagatcctaatatgaaagaa

SEQ ID NO: 6210955 - DNA, 14 bp, Homo sapiens
gagatcctcctgca

SEQ ID NO: 6210956 - DNA, 15 bp, Homo sapiens
gagatccttatcgaa

SEQ ID NO: 6210957 - DNA, 18 bp, Homo sapiens
gagatccttgtgtttatc

SEQ ID NO: 6210958 - DNA, 15 bp, Homo sapiens
gagatcgaagaggcc

SEQ ID NO: 6210959 - DNA, 21 bp, Homo sapiens
gagatcgacaccatcctggct

SEQ ID NO: 6210960 - DNA, 14 bp, Homo sapiens
gagatcgacagaca

SEQ ID NO: 6210961 - DNA, 19 bp, Homo sapiens
gagatcgagaccatcctgg

SEQ ID NO: 6210962 - DNA, 22 bp, Homo sapiens
gagatcgagaccatcctggcta

SEQ ID NO: 6210963 - DNA, 21 bp, Homo sapiens
gagatcgcgccactgcactcc

SEQ ID NO: 6210964 - DNA, 18 bp, Homo sapiens
gagatcgcttttctcaga

SEQ ID NO: 6210965 - DNA, 22 bp, Homo sapiens
gagatcgtacctattgcactcc

SEQ ID NO: 6210966 - DNA, 15 bp, Homo sapiens
gagatcgtgccactg

SEQ ID NO: 6210967 - DNA, 21 bp, Homo sapiens
gagatctaagcctttccataa

SEQ ID NO: 6210968 - DNA, 16 bp, Homo sapiens
gagatctatatttttg

SEQ ID NO: 6210969 - DNA, 17 bp, Homo sapiens
gagatctccctccaggg

SEQ ID NO: 6210970 - DNA, 15 bp, Homo sapiens
gagatctcccttctc

SEQ ID NO: 6210971 - DNA, 16 bp, Homo sapiens
gagatctcccttctca

SEQ ID NO: 6210972 - DNA, 15 bp, Homo sapiens
gagatctctgtagaa

SEQ ID NO: 6210973 - DNA, 18 bp, Homo sapiens
gagatctgaacccagctg

SEQ ID NO: 6210974 - DNA, 18 bp, Homo sapiens
gagatctgcacagtcaga

SEQ ID NO: 6210975 - DNA, 14 bp, Homo sapiens
gagatctggggagg

SEQ ID NO: 6210976 - DNA, 18 bp, Homo sapiens
gagatctgtataaataag

SEQ ID NO: 6210977 - DNA, 15 bp, Homo sapiens
gagatctgtgtggct

SEQ ID NO: 6210978 - DNA, 21 bp, Homo sapiens
gagatctttctttccaaaaca

SEQ ID NO: 6210979 - DNA, 18 bp, Homo sapiens
gagatgaaactggttcct

SEQ ID NO: 6210980 - DNA, 21 bp, Homo sapiens
gagatgaaccctggcatttgg

SEQ ID NO: 6210981 - DNA, 19 bp, Homo sapiens
gagatgaatagaagaaaga

SEQ ID NO: 6210982 - DNA, 14 bp, Homo sapiens
gagatgaccaggga

SEQ ID NO: 6210983 - DNA, 21 bp, Homo sapiens
gagatgacccctaccccctca

SEQ ID NO: 6210984 - DNA, 16 bp, Homo sapiens
gagatgactgagtcct

SEQ ID NO: 6210985 - DNA, 21 bp, Homo sapiens
gagatgactgagtcctcgtag

SEQ ID NO: 6210986 - DNA, 20 bp, Homo sapiens
gagatgagaaagcttttatt

SEQ ID NO: 6210987 - DNA, 23 bp, Homo sapiens
gagatgagaaagcttttattcct

SEQ ID NO: 6210988 - DNA, 22 bp, Homo sapiens
gagatgagaaatgatgaaaagg

SEQ ID NO: 6210989 - DNA, 16 bp, Homo sapiens
gagatgagagtgggta

SEQ ID NO: 6210990 - DNA, 16 bp, Homo sapiens
gagatgaggagtaaaa

SEQ ID NO: 6210991 - DNA, 20 bp, Homo sapiens
gagatgaggagtaaaattca

SEQ ID NO: 6210992 - DNA, 15 bp, Homo sapiens
gagatgaggccagac

SEQ ID NO: 6210993 - DNA, 14 bp, Homo sapiens
gagatgaggctgga

SEQ ID NO: 6210994 - DNA, 17 bp, Homo sapiens
gagatgagtgggcttcg

SEQ ID NO: 6210995 - DNA, 22 bp, Homo sapiens
gagatgagtttctggggaaaaa

SEQ ID NO: 6210996 - DNA, 19 bp, Homo sapiens
gagatgatgaaaatattta

SEQ ID NO: 6210997 - DNA, 15 bp, Homo sapiens
gagatgatgatgatg

SEQ ID NO: 6210998 - DNA, 21 bp, Homo sapiens
gagatgatgccatgggccctc

SEQ ID NO: 6210999 - DNA, 16 bp, Homo sapiens
gagatgattcagaggt

SEQ ID NO: 6211000 - DNA, 18 bp, Homo sapiens
gagatgcaccaccaagcc

SEQ ID NO: 6211001 - DNA, 12 bp, Homo sapiens
gagatgccagcc

SEQ ID NO: 6211002 - DNA, 16 bp, Homo sapiens
gagatgccagcccttc

SEQ ID NO: 6211003 - DNA, 20 bp, Homo sapiens
gagatgcctccaccgctgcc

SEQ ID NO: 6211004 - DNA, 22 bp, Homo sapiens
gagatgcctccaccgctgccta

SEQ ID NO: 6211005 - DNA, 23 bp, Homo sapiens
gagatgcctccaccgctgcctaa

SEQ ID NO: 6211006 - DNA, 21 bp, Homo sapiens
gagatgcgttgttacaggaag

SEQ ID NO: 6211007 - DNA, 15 bp, Homo sapiens
cttttcctcaagcaa

SEQ ID NO: 6211008 - DNA, 20 bp, Homo sapiens
cttttcctcaagcaataatt

SEQ ID NO: 6211009 - DNA, 22 bp, Homo sapiens
cttttcctcaagcaataattgt

SEQ ID NO: 6211010 - DNA, 23 bp, Homo sapiens
cttttcctcccttgggttctgat

SEQ ID NO: 6211011 - DNA, 20 bp, Homo sapiens
cttttcctcgcttctttcaa

SEQ ID NO: 6211012 - DNA, 14 bp, Homo sapiens
cttttcctctgcct

SEQ ID NO: 6211013 - DNA, 19 bp, Homo sapiens
cttttcctcttagaagaat

SEQ ID NO: 6211014 - DNA, 12 bp, Homo sapiens
cttttcctgaag

SEQ ID NO: 6211015 - DNA, 20 bp, Homo sapiens
cttttcctgaggtcatctgt

SEQ ID NO: 6211016 - DNA, 19 bp, Homo sapiens
cttttcctgataaagcaca

SEQ ID NO: 6211017 - DNA, 18 bp, Homo sapiens
cttttcctgcttagaatt

SEQ ID NO: 6211018 - DNA, 21 bp, Homo sapiens
cttttcctggcagctgctgtg

SEQ ID NO: 6211019 - DNA, 19 bp, Homo sapiens
cttttcctgggccttctca

SEQ ID NO: 6211020 - DNA, 18 bp, Homo sapiens
cttttcctgggtgctcag

SEQ ID NO: 6211021 - DNA, 22 bp, Homo sapiens
cttttcctgggtgctcagggca

SEQ ID NO: 6211022 - DNA, 22 bp, Homo sapiens
cttttcctgtcagtgtttttga

SEQ ID NO: 6211023 - DNA, 18 bp, Homo sapiens
cttttcctgttaaggcag

SEQ ID NO: 6211024 - DNA, 18 bp, Homo sapiens
cttttccttatttgcctt

SEQ ID NO: 6211025 - DNA, 16 bp, Homo sapiens
cttttccttccctttt

SEQ ID NO: 6211026 - DNA, 15 bp, Homo sapiens
cttttccttgcatac

SEQ ID NO: 6211027 - DNA, 13 bp, Homo sapiens
cttttccttggca

SEQ ID NO: 6211028 - DNA, 17 bp, Homo sapiens
cttttcctttatccact

SEQ ID NO: 6211029 - DNA, 17 bp, Homo sapiens
cttttcctttctggccc

SEQ ID NO: 6211030 - DNA, 12 bp, Homo sapiens
cttttccttttt

SEQ ID NO: 6211031 - DNA, 16 bp, Homo sapiens
cttttcgaactgtgct

SEQ ID NO: 6211032 - DNA, 20 bp, Homo sapiens
cttttcgaactgtgctccca

SEQ ID NO: 6211033 - DNA, 18 bp, Homo sapiens
cttttcgccccctgcctg

SEQ ID NO: 6211034 - DNA, 20 bp, Homo sapiens
cttttcgccccctgcctgcc

SEQ ID NO: 6211035 - DNA, 14 bp, Homo sapiens
cttttcgcctttcc

SEQ ID NO: 6211036 - DNA, 15 bp, Homo sapiens
cttttcgttaacatt

SEQ ID NO: 6211037 - DNA, 16 bp, Homo sapiens
cttttcgttaacattg

SEQ ID NO: 6211038 - DNA, 18 bp, Homo sapiens
cttttctaaaagacttcc

SEQ ID NO: 6211039 - DNA, 15 bp, Homo sapiens
cttttctaaactgca

SEQ ID NO: 6211040 - DNA, 19 bp, Homo sapiens
cttttctaaactgcatctg

SEQ ID NO: 6211041 - DNA, 14 bp, Homo sapiens
cttttctaaagtgc

SEQ ID NO: 6211042 - DNA, 16 bp, Homo sapiens
cttttctaacagaaag

SEQ ID NO: 6211043 - DNA, 23 bp, Homo sapiens
cttttctaagaataatggactct

SEQ ID NO: 6211044 - DNA, 19 bp, Homo sapiens
cttttctaagtggcgtgtg

SEQ ID NO: 6211045 - DNA, 19 bp, Homo sapiens
cttttctacagcaaattta

SEQ ID NO: 6211046 - DNA, 20 bp, Homo sapiens
cttttctacagcaaatttat

SEQ ID NO: 6211047 - DNA, 23 bp, Homo sapiens
cttttctacagcaaatttataat

SEQ ID NO: 6211048 - DNA, 17 bp, Homo sapiens
cttttctagagacacat

SEQ ID NO: 6211049 - DNA, 17 bp, Homo sapiens
cttttctagttaacttt

SEQ ID NO: 6211050 - DNA, 18 bp, Homo sapiens
cttttctagttaactttt

SEQ ID NO: 6211051 - DNA, 12 bp, Homo sapiens
cttttctagttt

SEQ ID NO: 6211052 - DNA, 11 bp, Homo sapiens
cttttctataa

SEQ ID NO: 6211053 - DNA, 15 bp, Homo sapiens
cttttctataagttg

SEQ ID NO: 6211054 - DNA, 17 bp, Homo sapiens
cttttctataagttgta

SEQ ID NO: 6211055 - DNA, 23 bp, Homo sapiens
cttttctatgttgctattgtaag

SEQ ID NO: 6211056 - DNA, 16 bp, Homo sapiens
cttttctattaatcat

SEQ ID NO: 6211057 - DNA, 17 bp, Homo sapiens
cttttctatttacctcc

SEQ ID NO: 6211058 - DNA, 18 bp, Homo sapiens
cttttctatttataagtg

SEQ ID NO: 6211059 - DNA, 13 bp, Homo sapiens
cttttctcagctg

SEQ ID NO: 6211060 - DNA, 20 bp, Homo sapiens
cttttctcaggagcttcaat

SEQ ID NO: 6211061 - DNA, 17 bp, Homo sapiens
cttttctccaatatcag

SEQ ID NO: 6211062 - DNA, 15 bp, Homo sapiens
cttttctccccacga

SEQ ID NO: 6211063 - DNA, 17 bp, Homo sapiens
cttttctcctccgcctg

SEQ ID NO: 6211064 - DNA, 15 bp, Homo sapiens
cttttctcctgcaga

SEQ ID NO: 6211065 - DNA, 16 bp, Homo sapiens
cttttctcctttacca

SEQ ID NO: 6211066 - DNA, 22 bp, Homo sapiens
cttttctctgagattctggtcc

SEQ ID NO: 6211067 - DNA, 13 bp, Homo sapiens
cttttctctgctc

SEQ ID NO: 6211068 - DNA, 17 bp, Homo sapiens
cttttctctgctcttgt

SEQ ID NO: 6211069 - DNA, 13 bp, Homo sapiens
cttttctctgctt

SEQ ID NO: 6211070 - DNA, 11 bp, Homo sapiens
cttttctcttt

SEQ ID NO: 6211071 - DNA, 17 bp, Homo sapiens
cttttctcttttgcttt

SEQ ID NO: 6211072 - DNA, 16 bp, Homo sapiens
cttttctctttttagt

SEQ ID NO: 6211073 - DNA, 12 bp, Homo sapiens
cttttctgaccc

SEQ ID NO: 6211074 - DNA, 11 bp, Homo sapiens
cttttctgata

SEQ ID NO: 6211075 - DNA, 15 bp, Homo sapiens
cttttctgatccagt

SEQ ID NO: 6211076 - DNA, 18 bp, Homo sapiens
cttttctgatccagtttt

SEQ ID NO: 6211077 - DNA, 18 bp, Homo sapiens
cttttctgccaaaataaa

SEQ ID NO: 6211078 - DNA, 16 bp, Homo sapiens
cttttctgccactcca

SEQ ID NO: 6211079 - DNA, 15 bp, Homo sapiens
cttttctgccctggc

SEQ ID NO: 6211080 - DNA, 19 bp, Homo sapiens
cttttctgccctggctgct

SEQ ID NO: 6211081 - DNA, 11 bp, Homo sapiens
cttttctgctg

SEQ ID NO: 6211082 - DNA, 14 bp, Homo sapiens
cttttctgctgagg

SEQ ID NO: 6211083 - DNA, 12 bp, Homo sapiens
cttttctggcac

SEQ ID NO: 6211084 - DNA, 15 bp, Homo sapiens
cttttctggcaccgc

SEQ ID NO: 6211085 - DNA, 19 bp, Homo sapiens
cttttctggccaaaagcag

SEQ ID NO: 6211086 - DNA, 16 bp, Homo sapiens
cttttctggctcctgt

SEQ ID NO: 6211087 - DNA, 18 bp, Homo sapiens
cttttctggctcctgtgt

SEQ ID NO: 6211088 - DNA, 21 bp, Homo sapiens
cttttctggctcctgtgtgga

SEQ ID NO: 6211089 - DNA, 14 bp, Homo sapiens
cttttctgggatgt

SEQ ID NO: 6211090 - DNA, 17 bp, Homo sapiens
cttttctggggcccagg

SEQ ID NO: 6211091 - DNA, 22 bp, Homo sapiens
cttttctggggcccaggaagcc

SEQ ID NO: 6211092 - DNA, 23 bp, Homo sapiens
cttttctgggtttgaagctgctg

SEQ ID NO: 6211093 - DNA, 15 bp, Homo sapiens
cttttctggtccctc

SEQ ID NO: 6211094 - DNA, 18 bp, Homo sapiens
cttttctggtccctcttc

SEQ ID NO: 6211095 - DNA, 12 bp, Homo sapiens
cttttctggttc

SEQ ID NO: 6211096 - DNA, 17 bp, Homo sapiens
cttttctggttccaaac

SEQ ID NO: 6211097 - DNA, 13 bp, Homo sapiens
cttttctgtaatt

SEQ ID NO: 6211098 - DNA, 14 bp, Homo sapiens
cttttctgtaattc

SEQ ID NO: 6211099 - DNA, 14 bp, Homo sapiens
cttttctgtcacca

SEQ ID NO: 6211100 - DNA, 17 bp, Homo sapiens
cttttctgtcttacaag

SEQ ID NO: 6211101 - DNA, 20 bp, Homo sapiens
cttttctgtgaagccctttg

SEQ ID NO: 6211102 - DNA, 22 bp, Homo sapiens
cttttctgtgccagacattgct

SEQ ID NO: 6211103 - DNA, 22 bp, Homo sapiens
cttttctgtggttgcagcctga

SEQ ID NO: 6211104 - DNA, 16 bp, Homo sapiens
cttttctgtgtgcata

SEQ ID NO: 6211105 - DNA, 14 bp, Homo sapiens
cttttctgttgtac

SEQ ID NO: 6211106 - DNA, 16 bp, Homo sapiens
cttttctgtttaggaa

SEQ ID NO: 6211107 - DNA, 22 bp, Homo sapiens
cttttctgtttaggaagaagtg

SEQ ID NO: 6211108 - DNA, 12 bp, Homo sapiens
cttttctgtttc

SEQ ID NO: 6211109 - DNA, 13 bp, Homo sapiens
cttttctgtttga

SEQ ID NO: 6211110 - DNA, 19 bp, Homo sapiens
cttttcttaacaacctggc

SEQ ID NO: 6211111 - DNA, 22 bp, Homo sapiens
cttttcttacccagattgtgta

SEQ ID NO: 6211112 - DNA, 17 bp, Homo sapiens
cttttcttactcctcct

SEQ ID NO: 6211113 - DNA, 23 bp, Homo sapiens
cttttcttactcctcctctttct

SEQ ID NO: 6211114 - DNA, 11 bp, Homo sapiens
cttttcttatt

SEQ ID NO: 6211115 - DNA, 16 bp, Homo sapiens
cttttcttattccttt

SEQ ID NO: 6211116 - DNA, 13 bp, Homo sapiens
cttttcttcccct

SEQ ID NO: 6211117 - DNA, 10 bp, Homo sapiens
cttttcttct

SEQ ID NO: 6211118 - DNA, 19 bp, Homo sapiens
cttttcttctattgcctct

SEQ ID NO: 6211119 - DNA, 13 bp, Homo sapiens
cttttcttcttcc

SEQ ID NO: 6211120 - DNA, 12 bp, Homo sapiens
cttttcttgata

SEQ ID NO: 6211121 - DNA, 20 bp, Homo sapiens
cttttcttggaactgtccca

SEQ ID NO: 6211122 - DNA, 23 bp, Homo sapiens
cttttcttggaactgtcccagct

SEQ ID NO: 6211123 - DNA, 20 bp, Homo sapiens
cttttcttggacacttaatt

SEQ ID NO: 6211124 - DNA, 22 bp, Homo sapiens
cttttcttggcaaaagccttgt

SEQ ID NO: 6211125 - DNA, 16 bp, Homo sapiens
cttttcttgtatctgg

SEQ ID NO: 6211126 - DNA, 16 bp, Homo sapiens
cttttcttgtctctga

SEQ ID NO: 6211127 - DNA, 21 bp, Homo sapiens
cttttcttgtttatcagcagt

SEQ ID NO: 6211128 - DNA, 14 bp, Homo sapiens
cttttctttaaaga

SEQ ID NO: 6211129 - DNA, 17 bp, Homo sapiens
cttttctttaaagaagt

SEQ ID NO: 6211130 - DNA, 23 bp, Homo sapiens
cttttctttaagttttatttaac

SEQ ID NO: 6211131 - DNA, 22 bp, Homo sapiens
cttttctttagagaactgaaaa

SEQ ID NO: 6211132 - DNA, 21 bp, Homo sapiens
cttttctttattgctgtgaat

SEQ ID NO: 6211133 - DNA, 18 bp, Homo sapiens
cttttctttccttttcat

SEQ ID NO: 6211134 - DNA, 21 bp, Homo sapiens
cttttctttgccatctctgct

SEQ ID NO: 6211135 - DNA, 20 bp, Homo sapiens
cttttcttttctaccctagc

SEQ ID NO: 6211136 - DNA, 22 bp, Homo sapiens
cttttcttttgctttcctttcc

SEQ ID NO: 6211137 - DNA, 16 bp, Homo sapiens
cttttcttttgttact

SEQ ID NO: 6211138 - DNA, 18 bp, Homo sapiens
cttttcttttgttactgt

SEQ ID NO: 6211139 - DNA, 20 bp, Homo sapiens
cttttcttttgttactgttc

SEQ ID NO: 6211140 - DNA, 16 bp, Homo sapiens
cttttctttttaaatg

SEQ ID NO: 6211141 - DNA, 16 bp, Homo sapiens
cttttctttttacata

SEQ ID NO: 6211142 - DNA, 22 bp, Homo sapiens
cttttctttttttctttaataa

SEQ ID NO: 6211143 - DNA, 15 bp, Homo sapiens
cttttgaaaaaggat

SEQ ID NO: 6211144 - DNA, 22 bp, Homo sapiens
cttttgaaaaaggatcatggtt

SEQ ID NO: 6211145 - DNA, 20 bp, Homo sapiens
cttttgaaaaagtgtacatg

SEQ ID NO: 6211146 - DNA, 22 bp, Homo sapiens
cttttgaaaagaccaagacttt

SEQ ID NO: 6211147 - DNA, 13 bp, Homo sapiens
cttttgaaacaat

SEQ ID NO: 6211148 - DNA, 16 bp, Homo sapiens
cttttgaaacaatact

SEQ ID NO: 6211149 - DNA, 21 bp, Homo sapiens
cttttgaaagtttgttctgca

SEQ ID NO: 6211150 - DNA, 19 bp, Homo sapiens
cttttgaaatttaaaaatc

SEQ ID NO: 6211151 - DNA, 22 bp, Homo sapiens
cttttgaaccatgtatgtggta

SEQ ID NO: 6211152 - DNA, 13 bp, Homo sapiens
cttttgaacccag

SEQ ID NO: 6211153 - DNA, 18 bp, Homo sapiens
cttttgaacgtatgtgct

SEQ ID NO: 6211154 - DNA, 12 bp, Homo sapiens
cttttgaacttg

SEQ ID NO: 6211155 - DNA, 21 bp, Homo sapiens
cttttgaagaacaaaaggctt

SEQ ID NO: 6211156 - DNA, 22 bp, Homo sapiens
cttttgaagaacaaaaggcttt

SEQ ID NO: 6211157 - DNA, 22 bp, Homo sapiens
cttttgaagaagttcttaaata

SEQ ID NO: 6211158 - DNA, 23 bp, Homo sapiens
cttttgaagaagttcttaaatac

SEQ ID NO: 6211159 - DNA, 21 bp, Homo sapiens
cttttgaagggagaagacact

SEQ ID NO: 6211160 - DNA, 20 bp, Homo sapiens
cttttgaagtagtttgtata

SEQ ID NO: 6211161 - DNA, 22 bp, Homo sapiens
cttttgaagtagtttgtataac

SEQ ID NO: 6211162 - DNA, 21 bp, Homo sapiens
cttttgaagtcttccctcaga

SEQ ID NO: 6211163 - DNA, 14 bp, Homo sapiens
cttttgaagtgttt

SEQ ID NO: 6211164 - DNA, 15 bp, Homo sapiens
cttttgaagtgtttt

SEQ ID NO: 6211165 - DNA, 20 bp, Homo sapiens
cttttgaagtgttttagtct

SEQ ID NO: 6211166 - DNA, 19 bp, Homo sapiens
cttttgaataatgtagtgc

SEQ ID NO: 6211167 - DNA, 18 bp, Homo sapiens
cttttgaatacatttgta

SEQ ID NO: 6211168 - DNA, 15 bp, Homo sapiens
cttttgaatatcttc

SEQ ID NO: 6211169 - DNA, 16 bp, Homo sapiens
cttttgaatcaaagaa

SEQ ID NO: 6211170 - DNA, 16 bp, Homo sapiens
cttttgaatcaatctg

SEQ ID NO: 6211171 - DNA, 17 bp, Homo sapiens
cttttgaatcaatctgg

SEQ ID NO: 6211172 - DNA, 21 bp, Homo sapiens
cttttgaatccatgcttgggt

SEQ ID NO: 6211173 - DNA, 23 bp, Homo sapiens
cttttgacggaaggacctatgtt

SEQ ID NO: 6211174 - DNA, 20 bp, Homo sapiens
cttttgacggccttcttggt

SEQ ID NO: 6211175 - DNA, 21 bp, Homo sapiens
cttttgacgtcttaggtggca

SEQ ID NO: 6211176 - DNA, 15 bp, Homo sapiens
cttttgactaagaat

SEQ ID NO: 6211177 - DNA, 14 bp, Homo sapiens
cttttgactctttt

SEQ ID NO: 6211178 - DNA, 18 bp, Homo sapiens
cttttgagactttttggt

SEQ ID NO: 6211179 - DNA, 16 bp, Homo sapiens
cttttgagcatttaga

SEQ ID NO: 6211180 - DNA, 15 bp, Homo sapiens
cttttgagcctcaga

SEQ ID NO: 6211181 - DNA, 16 bp, Homo sapiens
cttttgagcctcagac

SEQ ID NO: 6211182 - DNA, 19 bp, Homo sapiens
cttttgaggagctggaggg

SEQ ID NO: 6211183 - DNA, 21 bp, Homo sapiens
cttttgaggagctggaggggt

SEQ ID NO: 6211184 - DNA, 17 bp, Homo sapiens
cttttgaggcttctgtt

SEQ ID NO: 6211185 - DNA, 20 bp, Homo sapiens
gagatgctagaactcccttt

SEQ ID NO: 6211186 - DNA, 23 bp, Homo sapiens
gagatgctctctgaggcaaggcc

SEQ ID NO: 6211187 - DNA, 19 bp, Homo sapiens
gagatgctggcttgggcag

SEQ ID NO: 6211188 - DNA, 14 bp, Homo sapiens
gagatgctgggagg

SEQ ID NO: 6211189 - DNA, 18 bp, Homo sapiens
gagatgctgggagggctg

SEQ ID NO: 6211190 - DNA, 17 bp, Homo sapiens
gagatgctgtaacttaa

SEQ ID NO: 6211191 - DNA, 13 bp, Homo sapiens
gagatgcttctct

SEQ ID NO: 6211192 - DNA, 14 bp, Homo sapiens
gagatgcttctctc

SEQ ID NO: 6211193 - DNA, 14 bp, Homo sapiens
gagatgcttggagc

SEQ ID NO: 6211194 - DNA, 21 bp, Homo sapiens
gagatggaaacaatgtggagt

SEQ ID NO: 6211195 - DNA, 18 bp, Homo sapiens
gagatggaagcttgttga

SEQ ID NO: 6211196 - DNA, 17 bp, Homo sapiens
gagatggaatatcaatg

SEQ ID NO: 6211197 - DNA, 22 bp, Homo sapiens
gagatggacagttcacaccctg

SEQ ID NO: 6211198 - DNA, 18 bp, Homo sapiens
gagatggacccctccctt

SEQ ID NO: 6211199 - DNA, 16 bp, Homo sapiens
gagatggagaaataga

SEQ ID NO: 6211200 - DNA, 13 bp, Homo sapiens
gagatggaggagg

SEQ ID NO: 6211201 - DNA, 16 bp, Homo sapiens
gagatggaggaggagg

SEQ ID NO: 6211202 - DNA, 20 bp, Homo sapiens
gagatggaggtagggctggc

SEQ ID NO: 6211203 - DNA, 17 bp, Homo sapiens
gagatggagtcttgcta

SEQ ID NO: 6211204 - DNA, 18 bp, Homo sapiens
gagatggagtcttgctct

SEQ ID NO: 6211205 - DNA, 16 bp, Homo sapiens
gagatggatggacaga

SEQ ID NO: 6211206 - DNA, 19 bp, Homo sapiens
gagatggatggacagacag

SEQ ID NO: 6211207 - DNA, 12 bp, Homo sapiens
gagatggcagca

SEQ ID NO: 6211208 - DNA, 15 bp, Homo sapiens
gagatggccctctgg

SEQ ID NO: 6211209 - DNA, 20 bp, Homo sapiens
gagatggcgctattgcactc

SEQ ID NO: 6211210 - DNA, 19 bp, Homo sapiens
gagatggctgctgctcacc

SEQ ID NO: 6211211 - DNA, 16 bp, Homo sapiens
gagatgggaagggctt

SEQ ID NO: 6211212 - DNA, 21 bp, Homo sapiens
gagatgggacaagcagtccct

SEQ ID NO: 6211213 - DNA, 17 bp, Homo sapiens
gagatgggactgggagg

SEQ ID NO: 6211214 - DNA, 16 bp, Homo sapiens
gagatgggccaggcag

SEQ ID NO: 6211215 - DNA, 23 bp, Homo sapiens
gagatgggccggcccccttcctg

SEQ ID NO: 6211216 - DNA, 21 bp, Homo sapiens
gagatgggctgaactgagcct

SEQ ID NO: 6211217 - DNA, 18 bp, Homo sapiens
gagatgggcttgttttct

SEQ ID NO: 6211218 - DNA, 23 bp, Homo sapiens
gagatggggaataatttccttca

SEQ ID NO: 6211219 - DNA, 21 bp, Homo sapiens
gagatggggagggcgcttttg

SEQ ID NO: 6211220 - DNA, 18 bp, Homo sapiens
gagatggggataaaatga

SEQ ID NO: 6211221 - DNA, 13 bp, Homo sapiens
gagatggggcggg

SEQ ID NO: 6211222 - DNA, 23 bp, Homo sapiens
gagatggggcgggggtgtgtctg

SEQ ID NO: 6211223 - DNA, 21 bp, Homo sapiens
gagatgggggcttcttcctca

SEQ ID NO: 6211224 - DNA, 13 bp, Homo sapiens
gagatgggtcctg

SEQ ID NO: 6211225 - DNA, 15 bp, Homo sapiens
gagatggtaacagat

SEQ ID NO: 6211226 - DNA, 20 bp, Homo sapiens
gagatggtaatctacagctc

SEQ ID NO: 6211227 - DNA, 15 bp, Homo sapiens
gagatggtcagtgtg

SEQ ID NO: 6211228 - DNA, 23 bp, Homo sapiens
gagatggtcagtgtggagagggg

SEQ ID NO: 6211229 - DNA, 13 bp, Homo sapiens
gagatggtgaggc

SEQ ID NO: 6211230 - DNA, 18 bp, Homo sapiens
gagatggtgccccctggg

SEQ ID NO: 6211231 - DNA, 16 bp, Homo sapiens
gagatggttaaaaagg

SEQ ID NO: 6211232 - DNA, 14 bp, Homo sapiens
gagatggttcccaa

SEQ ID NO: 6211233 - DNA, 18 bp, Homo sapiens
gagatggttttgccctcc

SEQ ID NO: 6211234 - DNA, 16 bp, Homo sapiens
gagatgtaatgacaga

SEQ ID NO: 6211235 - DNA, 17 bp, Homo sapiens
gagatgtaatgacagag

SEQ ID NO: 6211236 - DNA, 14 bp, Homo sapiens
gagatgtaattgtt

SEQ ID NO: 6211237 - DNA, 16 bp, Homo sapiens
gagatgtatgaaggct

SEQ ID NO: 6211238 - DNA, 12 bp, Homo sapiens
gagatgtcttcg

SEQ ID NO: 6211239 - DNA, 22 bp, Homo sapiens
gagatgtcttcgtacagttctt

SEQ ID NO: 6211240 - DNA, 18 bp, Homo sapiens
gagatgtgacccaccagt

SEQ ID NO: 6211241 - DNA, 16 bp, Homo sapiens
gagatgtgagccttgt

SEQ ID NO: 6211242 - DNA, 16 bp, Homo sapiens
gagatgtgagtcctgt

SEQ ID NO: 6211243 - DNA, 23 bp, Homo sapiens
gagatgtgagtcctgttgaagac

SEQ ID NO: 6211244 - DNA, 18 bp, Homo sapiens
gagatgtgatcaggcccc

SEQ ID NO: 6211245 - DNA, 14 bp, Homo sapiens
gagatgtgctttgc

SEQ ID NO: 6211246 - DNA, 17 bp, Homo sapiens
gagatgtgtaatttttc

SEQ ID NO: 6211247 - DNA, 16 bp, Homo sapiens
gagatgtgtatcagtg

SEQ ID NO: 6211248 - DNA, 21 bp, Homo sapiens
gagatgtgtgttgatactgtt

SEQ ID NO: 6211249 - DNA, 15 bp, Homo sapiens
gagatgtttgccaaa

SEQ ID NO: 6211250 - DNA, 14 bp, Homo sapiens
gagatgttttagag

SEQ ID NO: 6211251 - DNA, 14 bp, Homo sapiens
gagatgttttcaag

SEQ ID NO: 6211252 - DNA, 17 bp, Homo sapiens
gagatgtttttaaaagt

SEQ ID NO: 6211253 - DNA, 18 bp, Homo sapiens
gagattaagatgccttga

SEQ ID NO: 6211254 - DNA, 13 bp, Homo sapiens
gagattaatttgt

SEQ ID NO: 6211255 - DNA, 14 bp, Homo sapiens
gagattacaggcat

SEQ ID NO: 6211256 - DNA, 16 bp, Homo sapiens
gagattagagggaggt

SEQ ID NO: 6211257 - DNA, 16 bp, Homo sapiens
gagattattaaatcgt

SEQ ID NO: 6211258 - DNA, 18 bp, Homo sapiens
gagattattcaacagaga

SEQ ID NO: 6211259 - DNA, 22 bp, Homo sapiens
gagattcaaaaaaaaaatataa

SEQ ID NO: 6211260 - DNA, 14 bp, Homo sapiens
gagattcaagacaa

SEQ ID NO: 6211261 - DNA, 12 bp, Homo sapiens
gagattcagact

SEQ ID NO: 6211262 - DNA, 12 bp, Homo sapiens
gagattcatttt

SEQ ID NO: 6211263 - DNA, 13 bp, Homo sapiens
gagattcattttc

SEQ ID NO: 6211264 - DNA, 21 bp, Homo sapiens
gagattcattttctagataca

SEQ ID NO: 6211265 - DNA, 16 bp, Homo sapiens
gagattcccgcgggtt

SEQ ID NO: 6211266 - DNA, 20 bp, Homo sapiens
gagattccctctcctccccc

SEQ ID NO: 6211267 - DNA, 18 bp, Homo sapiens
gagattcctattactgca

SEQ ID NO: 6211268 - DNA, 20 bp, Homo sapiens
gagattctcataacttgaga

SEQ ID NO: 6211269 - DNA, 14 bp, Homo sapiens
gagattctgccttt

SEQ ID NO: 6211270 - DNA, 19 bp, Homo sapiens
gagattctggatctcctgc

SEQ ID NO: 6211271 - DNA, 14 bp, Homo sapiens
gagattctgggttt

SEQ ID NO: 6211272 - DNA, 21 bp, Homo sapiens
gagattctggtccctggaaat

SEQ ID NO: 6211273 - DNA, 18 bp, Homo sapiens
gagattctttaaggagat

SEQ ID NO: 6211274 - DNA, 20 bp, Homo sapiens
gagattctttaaggagatag

SEQ ID NO: 6211275 - DNA, 23 bp, Homo sapiens
gagattctttaaggagatagacg

SEQ ID NO: 6211276 - DNA, 12 bp, Homo sapiens
gagattgaactt

SEQ ID NO: 6211277 - DNA, 22 bp, Homo sapiens
gagattgaatttcactgtcttt

SEQ ID NO: 6211278 - DNA, 17 bp, Homo sapiens
gagattgagaaggagag

SEQ ID NO: 6211279 - DNA, 20 bp, Homo sapiens
gagattgagaaggagagaaa

SEQ ID NO: 6211280 - DNA, 21 bp, Homo sapiens
gagattgcaccactgcactcc

SEQ ID NO: 6211281 - DNA, 18 bp, Homo sapiens
gagattgccccagagccc

SEQ ID NO: 6211282 - DNA, 19 bp, Homo sapiens
gagattgcctcaaaattgt

SEQ ID NO: 6211283 - DNA, 17 bp, Homo sapiens
gagattgcgccactgca

SEQ ID NO: 6211284 - DNA, 21 bp, Homo sapiens
gagattgcgccattgcactcc

SEQ ID NO: 6211285 - DNA, 13 bp, Homo sapiens
gagattgctaatt

SEQ ID NO: 6211286 - DNA, 23 bp, Homo sapiens
gagattgctgtgtgttgcctggg

SEQ ID NO: 6211287 - DNA, 16 bp, Homo sapiens
gagattggatcaagta

SEQ ID NO: 6211288 - DNA, 17 bp, Homo sapiens
gagattggatttgctgt

SEQ ID NO: 6211289 - DNA, 18 bp, Homo sapiens
gagattggatttgctgtg

SEQ ID NO: 6211290 - DNA, 17 bp, Homo sapiens
gagattggccagtgaga

SEQ ID NO: 6211291 - DNA, 20 bp, Homo sapiens
gagattggccagtgagaagc

SEQ ID NO: 6211292 - DNA, 17 bp, Homo sapiens
gagattgggagaaatca

SEQ ID NO: 6211293 - DNA, 17 bp, Homo sapiens
gagattgggggggcttg

SEQ ID NO: 6211294 - DNA, 15 bp, Homo sapiens
gagattgtacatttt

SEQ ID NO: 6211295 - DNA, 22 bp, Homo sapiens
gagattgtactgttcatacagt

SEQ ID NO: 6211296 - DNA, 21 bp, Homo sapiens
gagattgtgccacttcactcc

SEQ ID NO: 6211297 - DNA, 22 bp, Homo sapiens
gagatttaacactaaaattcca

SEQ ID NO: 6211298 - DNA, 22 bp, Homo sapiens
gagatttaacccctccactgct

SEQ ID NO: 6211299 - DNA, 23 bp, Homo sapiens
gagatttaattaatcatgaatgt

SEQ ID NO: 6211300 - DNA, 20 bp, Homo sapiens
gagatttacccagactggtt

SEQ ID NO: 6211301 - DNA, 15 bp, Homo sapiens
gagatttactgctct

SEQ ID NO: 6211302 - DNA, 14 bp, Homo sapiens
gagatttcaacata

SEQ ID NO: 6211303 - DNA, 20 bp, Homo sapiens
gagatttcccttcatttaaa

SEQ ID NO: 6211304 - DNA, 20 bp, Homo sapiens
gagatttctggatggtggtg

SEQ ID NO: 6211305 - DNA, 17 bp, Homo sapiens
gagatttcttaaatctt

SEQ ID NO: 6211306 - DNA, 20 bp, Homo sapiens
gagatttctttgaatgtatt

SEQ ID NO: 6211307 - DNA, 21 bp, Homo sapiens
gagatttcttttttatgtgat

SEQ ID NO: 6211308 - DNA, 15 bp, Homo sapiens
gagatttgtaaatct

SEQ ID NO: 6211309 - DNA, 17 bp, Homo sapiens
gagatttgtatttatat

SEQ ID NO: 6211310 - DNA, 15 bp, Homo sapiens
gagattttcatttta

SEQ ID NO: 6211311 - DNA, 12 bp, Homo sapiens
gagattttcctt

SEQ ID NO: 6211312 - DNA, 14 bp, Homo sapiens
gagattttctcttc

SEQ ID NO: 6211313 - DNA, 16 bp, Homo sapiens
gagattttcttggcag

SEQ ID NO: 6211314 - DNA, 18 bp, Homo sapiens
gagattttcttggcagta

SEQ ID NO: 6211315 - DNA, 18 bp, Homo sapiens
gagattttgtcgggacag

SEQ ID NO: 6211316 - DNA, 11 bp, Homo sapiens
gagatttttaa

SEQ ID NO: 6211317 - DNA, 19 bp, Homo sapiens
gagatttttaaaaaatatt

SEQ ID NO: 6211318 - DNA, 14 bp, Homo sapiens
gagatttttaagaa

SEQ ID NO: 6211319 - DNA, 21 bp, Homo sapiens
gagatttttcatacttttctt

SEQ ID NO: 6211320 - DNA, 18 bp, Homo sapiens
gagatttttcatgtatct

SEQ ID NO: 6211321 - DNA, 23 bp, Homo sapiens
gagatttttcttttaagccctgc

SEQ ID NO: 6211322 - DNA, 19 bp, Homo sapiens
gagatttttgatatctcaa

SEQ ID NO: 6211323 - DNA, 14 bp, Homo sapiens
gagatttttgtttg

SEQ ID NO: 6211324 - DNA, 17 bp, Homo sapiens
gagattttttttccgtg

SEQ ID NO: 6211325 - DNA, 20 bp, Homo sapiens
gagcaaaaatatcccttccg

SEQ ID NO: 6211326 - DNA, 18 bp, Homo sapiens
gagcaaaaatctgagaaa

SEQ ID NO: 6211327 - DNA, 20 bp, Homo sapiens
gagcaaaaatgtaaaaaaca

SEQ ID NO: 6211328 - DNA, 23 bp, Homo sapiens
gagcaaaagaaacaccagtgtta

SEQ ID NO: 6211329 - DNA, 19 bp, Homo sapiens
gagcaaaagacttgagcca

SEQ ID NO: 6211330 - DNA, 22 bp, Homo sapiens
gagcaaaagcctcagaaaggga

SEQ ID NO: 6211331 - DNA, 14 bp, Homo sapiens
gagcaaaaggcagc

SEQ ID NO: 6211332 - DNA, 15 bp, Homo sapiens
gagcaaaaggcagct

SEQ ID NO: 6211333 - DNA, 22 bp, Homo sapiens
gagcaaaaggcagctcacccct

SEQ ID NO: 6211334 - DNA, 24 bp, Homo sapiens
gagcaaaaggcagctcacccctgg

SEQ ID NO: 6211335 - DNA, 20 bp, Homo sapiens
gagcaaaatcaacatgactg

SEQ ID NO: 6211336 - DNA, 20 bp, Homo sapiens
gagcaaaatgcatgtaatca

SEQ ID NO: 6211337 - DNA, 15 bp, Homo sapiens
gagcaaaattcaaaa

SEQ ID NO: 6211338 - DNA, 15 bp, Homo sapiens
gagcaaacagaaaaa

SEQ ID NO: 6211339 - DNA, 14 bp, Homo sapiens
gagcaaacagagga

SEQ ID NO: 6211340 - DNA, 18 bp, Homo sapiens
gagcaaacagaggaggcc

SEQ ID NO: 6211341 - DNA, 23 bp, Homo sapiens
gagcaaaccagcttgttctgggc

SEQ ID NO: 6211342 - DNA, 20 bp, Homo sapiens
gagcaaacctaacaggagaa

SEQ ID NO: 6211343 - DNA, 14 bp, Homo sapiens
gagcaaacctgccc

SEQ ID NO: 6211344 - DNA, 15 bp, Homo sapiens
gagcaaacctgcccc

SEQ ID NO: 6211345 - DNA, 20 bp, Homo sapiens
gagcaaactgcatgcccaga

SEQ ID NO: 6211346 - DNA, 22 bp, Homo sapiens
gagcaaagaaacttgtgcttta

SEQ ID NO: 6211347 - DNA, 19 bp, Homo sapiens
gagcaaagaaggagctgag

SEQ ID NO: 6211348 - DNA, 18 bp, Homo sapiens
gagcaaagatcaaaataa

SEQ ID NO: 6211349 - DNA, 22 bp, Homo sapiens
gagcaaagatcaaaataaaaag

SEQ ID NO: 6211350 - DNA, 17 bp, Homo sapiens
gagcaaagatggcttcc

SEQ ID NO: 6211351 - DNA, 12 bp, Homo sapiens
gagcaaagcctg

SEQ ID NO: 6211352 - DNA, 14 bp, Homo sapiens
gagcaaagcctgtt

SEQ ID NO: 6211353 - DNA, 22 bp, Homo sapiens
gagcaaagcctgttcatggcag

SEQ ID NO: 6211354 - DNA, 19 bp, Homo sapiens
gagcaaagcgcccacccag

SEQ ID NO: 6211355 - DNA, 20 bp, Homo sapiens
gagcaaaggagacaaagcag

SEQ ID NO: 6211356 - DNA, 13 bp, Homo sapiens
gagcaaaggccct

SEQ ID NO: 6211357 - DNA, 19 bp, Homo sapiens
gagcaaagtcatgtcagaa

SEQ ID NO: 6211358 - DNA, 16 bp, Homo sapiens
gagcaaatcctggcaa

SEQ ID NO: 6211359 - DNA, 22 bp, Homo sapiens
gagcaaatcctggcaagtgacc

SEQ ID NO: 6211360 - DNA, 17 bp, Homo sapiens
gagcaaatgagggaggg

SEQ ID NO: 6211361 - DNA, 22 bp, Homo sapiens
gagcaaatttcatctttccaaa

SEQ ID NO: 6211362 - DNA, 20 bp, Homo sapiens
cttttgagtggtaatcatat

SEQ ID NO: 6211363 - DNA, 15 bp, Homo sapiens
cttttgagtgtgtgt

SEQ ID NO: 6211364 - DNA, 20 bp, Homo sapiens
cttttgagtgtgtgtgtgca

SEQ ID NO: 6211365 - DNA, 15 bp, Homo sapiens
cttttgataaatcct

SEQ ID NO: 6211366 - DNA, 14 bp, Homo sapiens
cttttgataagaaa

SEQ ID NO: 6211367 - DNA, 22 bp, Homo sapiens
cttttgatacatttatcttctg

SEQ ID NO: 6211368 - DNA, 16 bp, Homo sapiens
cttttgatagatccac

SEQ ID NO: 6211369 - DNA, 18 bp, Homo sapiens
cttttgatgaaataaaat

SEQ ID NO: 6211370 - DNA, 14 bp, Homo sapiens
cttttgatgtctcc

SEQ ID NO: 6211371 - DNA, 20 bp, Homo sapiens
cttttgatgttcagagtggc

SEQ ID NO: 6211372 - DNA, 22 bp, Homo sapiens
cttttgcaaacaattttaatga

SEQ ID NO: 6211373 - DNA, 14 bp, Homo sapiens
cttttgcaaacttt

SEQ ID NO: 6211374 - DNA, 20 bp, Homo sapiens
cttttgcaacatggtccagt

SEQ ID NO: 6211375 - DNA, 19 bp, Homo sapiens
cttttgcaaggttccacag

SEQ ID NO: 6211376 - DNA, 12 bp, Homo sapiens
cttttgcacata

SEQ ID NO: 6211377 - DNA, 17 bp, Homo sapiens
cttttgcacatatattt

SEQ ID NO: 6211378 - DNA, 18 bp, Homo sapiens
cttttgcacatatatttt

SEQ ID NO: 6211379 - DNA, 19 bp, Homo sapiens
cttttgcacctgctctctt

SEQ ID NO: 6211380 - DNA, 23 bp, Homo sapiens
cttttgcagaagagggtgtgttt

SEQ ID NO: 6211381 - DNA, 19 bp, Homo sapiens
cttttgcagcagaggagct

SEQ ID NO: 6211382 - DNA, 13 bp, Homo sapiens
cttttgcagcttc

SEQ ID NO: 6211383 - DNA, 21 bp, Homo sapiens
cttttgcaggaaaaggctaag

SEQ ID NO: 6211384 - DNA, 15 bp, Homo sapiens
cttttgcaggataat

SEQ ID NO: 6211385 - DNA, 17 bp, Homo sapiens
cttttgcataatgcaat

SEQ ID NO: 6211386 - DNA, 20 bp, Homo sapiens
cttttgcataatgcaatcaa

SEQ ID NO: 6211387 - DNA, 13 bp, Homo sapiens
cttttgcattctc

SEQ ID NO: 6211388 - DNA, 20 bp, Homo sapiens
cttttgccactttggcttct

SEQ ID NO: 6211389 - DNA, 16 bp, Homo sapiens
cttttgcccatataaa

SEQ ID NO: 6211390 - DNA, 20 bp, Homo sapiens
cttttgcccttcacagtgtt

SEQ ID NO: 6211391 - DNA, 16 bp, Homo sapiens
cttttgccgttattaa

SEQ ID NO: 6211392 - DNA, 16 bp, Homo sapiens
cttttgcctgcaggtc

SEQ ID NO: 6211393 - DNA, 23 bp, Homo sapiens
cttttgcggttcaggaaaattga

SEQ ID NO: 6211394 - DNA, 17 bp, Homo sapiens
cttttgctaataccaaa

SEQ ID NO: 6211395 - DNA, 18 bp, Homo sapiens
cttttgctaataccaaaa

SEQ ID NO: 6211396 - DNA, 16 bp, Homo sapiens
cttttgctagatggaa

SEQ ID NO: 6211397 - DNA, 23 bp, Homo sapiens
cttttgctatagttatacatcaa

SEQ ID NO: 6211398 - DNA, 14 bp, Homo sapiens
cttttgctctctgt

SEQ ID NO: 6211399 - DNA, 23 bp, Homo sapiens
cttttgctctgcaggcagccttg

SEQ ID NO: 6211400 - DNA, 22 bp, Homo sapiens
cttttgctcttagctgtctgct

SEQ ID NO: 6211401 - DNA, 19 bp, Homo sapiens
cttttgctgaacaggaaag

SEQ ID NO: 6211402 - DNA, 21 bp, Homo sapiens
cttttgctgcgcaccaatgcc

SEQ ID NO: 6211403 - DNA, 12 bp, Homo sapiens
cttttgctgctg

SEQ ID NO: 6211404 - DNA, 12 bp, Homo sapiens
cttttgctgtgc

SEQ ID NO: 6211405 - DNA, 12 bp, Homo sapiens
cttttgctgtgt

SEQ ID NO: 6211406 - DNA, 21 bp, Homo sapiens
cttttgctgtgtgaaatcttt

SEQ ID NO: 6211407 - DNA, 23 bp, Homo sapiens
cttttgctgtgtgaaatctttca

SEQ ID NO: 6211408 - DNA, 16 bp, Homo sapiens
cttttgctgtttatac

SEQ ID NO: 6211409 - DNA, 19 bp, Homo sapiens
cttttgcttaccttttcct

SEQ ID NO: 6211410 - DNA, 16 bp, Homo sapiens
cttttgcttggcagag

SEQ ID NO: 6211411 - DNA, 14 bp, Homo sapiens
cttttgctttaatt

SEQ ID NO: 6211412 - DNA, 16 bp, Homo sapiens
cttttgctttccctga

SEQ ID NO: 6211413 - DNA, 14 bp, Homo sapiens
cttttgctttcctt

SEQ ID NO: 6211414 - DNA, 11 bp, Homo sapiens
cttttgctttt

SEQ ID NO: 6211415 - DNA, 12 bp, Homo sapiens
cttttggaaagt

SEQ ID NO: 6211416 - DNA, 14 bp, Homo sapiens
cttttggaacattt

SEQ ID NO: 6211417 - DNA, 16 bp, Homo sapiens
cttttggaacatttct

SEQ ID NO: 6211418 - DNA, 18 bp, Homo sapiens
cttttggaacatttcttt

SEQ ID NO: 6211419 - DNA, 19 bp, Homo sapiens
cttttggaaccatgccttc

SEQ ID NO: 6211420 - DNA, 19 bp, Homo sapiens
cttttggaagttttgctag

SEQ ID NO: 6211421 - DNA, 24 bp, Homo sapiens
cttttggaagttttgctagtgtgc

SEQ ID NO: 6211422 - DNA, 20 bp, Homo sapiens
cttttggaatctagaagaaa

SEQ ID NO: 6211423 - DNA, 21 bp, Homo sapiens
cttttggaatctagaagaaat

SEQ ID NO: 6211424 - DNA, 23 bp, Homo sapiens
cttttggaatctagaagaaatga

SEQ ID NO: 6211425 - DNA, 13 bp, Homo sapiens
cttttggagtcag

SEQ ID NO: 6211426 - DNA, 18 bp, Homo sapiens
cttttggattggacaaaa

SEQ ID NO: 6211427 - DNA, 19 bp, Homo sapiens
cttttggattggacaaaat

SEQ ID NO: 6211428 - DNA, 21 bp, Homo sapiens
cttttggattggacaaaatga

SEQ ID NO: 6211429 - DNA, 23 bp, Homo sapiens
cttttggattggacaaaatgact

SEQ ID NO: 6211430 - DNA, 15 bp, Homo sapiens
cttttggatttagag

SEQ ID NO: 6211431 - DNA, 13 bp, Homo sapiens
cttttggcccccg

SEQ ID NO: 6211432 - DNA, 13 bp, Homo sapiens
cttttggcctggg

SEQ ID NO: 6211433 - DNA, 23 bp, Homo sapiens
cttttggcctgggggaggtcaga

SEQ ID NO: 6211434 - DNA, 12 bp, Homo sapiens
cttttggccttg

SEQ ID NO: 6211435 - DNA, 14 bp, Homo sapiens
cttttggcttccat

SEQ ID NO: 6211436 - DNA, 19 bp, Homo sapiens
cttttgggatttgttgaaa

SEQ ID NO: 6211437 - DNA, 12 bp, Homo sapiens
cttttgggcctt

SEQ ID NO: 6211438 - DNA, 15 bp, Homo sapiens
cttttggggaggagt

SEQ ID NO: 6211439 - DNA, 22 bp, Homo sapiens
cttttggggaggagttgtctgt

SEQ ID NO: 6211440 - DNA, 15 bp, Homo sapiens
cttttgggggagggc

SEQ ID NO: 6211441 - DNA, 22 bp, Homo sapiens
cttttgggggtcagcatccagt

SEQ ID NO: 6211442 - DNA, 20 bp, Homo sapiens
cttttgggggttggatggga

SEQ ID NO: 6211443 - DNA, 17 bp, Homo sapiens
cttttgggtttctgccc

SEQ ID NO: 6211444 - DNA, 20 bp, Homo sapiens
cttttgggtttctgccctgc

SEQ ID NO: 6211445 - DNA, 17 bp, Homo sapiens
cttttgggtttgcctta

SEQ ID NO: 6211446 - DNA, 21 bp, Homo sapiens
cttttggtaaagactggcttt

SEQ ID NO: 6211447 - DNA, 22 bp, Homo sapiens
cttttggtcattatttcagtgt

SEQ ID NO: 6211448 - DNA, 19 bp, Homo sapiens
cttttggtcttcagcctcc

SEQ ID NO: 6211449 - DNA, 22 bp, Homo sapiens
cttttggtcttcagcctccctc

SEQ ID NO: 6211450 - DNA, 15 bp, Homo sapiens
cttttggtgtgttgg

SEQ ID NO: 6211451 - DNA, 19 bp, Homo sapiens
cttttggtgtgttggacag

SEQ ID NO: 6211452 - DNA, 17 bp, Homo sapiens
cttttggttaatatgtc

SEQ ID NO: 6211453 - DNA, 19 bp, Homo sapiens
cttttggttcattttcaga

SEQ ID NO: 6211454 - DNA, 21 bp, Homo sapiens
cttttggttcctcacatatta

SEQ ID NO: 6211455 - DNA, 19 bp, Homo sapiens
cttttggtttcaccttccc

SEQ ID NO: 6211456 - DNA, 22 bp, Homo sapiens
cttttggtttcaccttccctcg

SEQ ID NO: 6211457 - DNA, 19 bp, Homo sapiens
cttttggtttctgcttctc

SEQ ID NO: 6211458 - DNA, 17 bp, Homo sapiens
cttttggtttgggggcg

SEQ ID NO: 6211459 - DNA, 10 bp, Homo sapiens
cttttgtaaa

SEQ ID NO: 6211460 - DNA, 23 bp, Homo sapiens
cttttgtaaaataaaaccaccaa

SEQ ID NO: 6211461 - DNA, 21 bp, Homo sapiens
cttttgtaaagaaatttacta

SEQ ID NO: 6211462 - DNA, 12 bp, Homo sapiens
cttttgtaaagt

SEQ ID NO: 6211463 - DNA, 15 bp, Homo sapiens
cttttgtaaagtaaa

SEQ ID NO: 6211464 - DNA, 14 bp, Homo sapiens
cttttgtaaatatt

SEQ ID NO: 6211465 - DNA, 16 bp, Homo sapiens
cttttgtaaatattct

SEQ ID NO: 6211466 - DNA, 17 bp, Homo sapiens
cttttgtaaatattctt

SEQ ID NO: 6211467 - DNA, 18 bp, Homo sapiens
cttttgtaaatattcttg

SEQ ID NO: 6211468 - DNA, 14 bp, Homo sapiens
cttttgtaagtatg

SEQ ID NO: 6211469 - DNA, 14 bp, Homo sapiens
cttttgtaataaac

SEQ ID NO: 6211470 - DNA, 11 bp, Homo sapiens
cttttgtaatt

SEQ ID NO: 6211471 - DNA, 15 bp, Homo sapiens
cttttgtaatttgaa

SEQ ID NO: 6211472 - DNA, 18 bp, Homo sapiens
cttttgtaatttgaattg

SEQ ID NO: 6211473 - DNA, 17 bp, Homo sapiens
cttttgtacccaatact

SEQ ID NO: 6211474 - DNA, 17 bp, Homo sapiens
cttttgtactgaatttt

SEQ ID NO: 6211475 - DNA, 19 bp, Homo sapiens
cttttgtagaagtcacatt

SEQ ID NO: 6211476 - DNA, 22 bp, Homo sapiens
cttttgtagatggcactttagt

SEQ ID NO: 6211477 - DNA, 15 bp, Homo sapiens
cttttgtagatggcg

SEQ ID NO: 6211478 - DNA, 12 bp, Homo sapiens
cttttgtagctg

SEQ ID NO: 6211479 - DNA, 15 bp, Homo sapiens
cttttgtaggctgtt

SEQ ID NO: 6211480 - DNA, 20 bp, Homo sapiens
cttttgtaggctgttccctt

SEQ ID NO: 6211481 - DNA, 21 bp, Homo sapiens
cttttgtaggctgttcccttt

SEQ ID NO: 6211482 - DNA, 17 bp, Homo sapiens
cttttgtagtcttatga

SEQ ID NO: 6211483 - DNA, 22 bp, Homo sapiens
cttttgtagtcttatgaataga

SEQ ID NO: 6211484 - DNA, 20 bp, Homo sapiens
cttttgtagttttatttgta

SEQ ID NO: 6211485 - DNA, 21 bp, Homo sapiens
cttttgtagttttatttgtat

SEQ ID NO: 6211486 - DNA, 19 bp, Homo sapiens
cttttgtatagaaaattct

SEQ ID NO: 6211487 - DNA, 22 bp, Homo sapiens
cttttgtatagaaaattcttga

SEQ ID NO: 6211488 - DNA, 14 bp, Homo sapiens
cttttgtatcctcc

SEQ ID NO: 6211489 - DNA, 15 bp, Homo sapiens
cttttgtatcttcct

SEQ ID NO: 6211490 - DNA, 21 bp, Homo sapiens
cttttgtatgtaaatgtgcat

SEQ ID NO: 6211491 - DNA, 17 bp, Homo sapiens
cttttgtcatgtggcta

SEQ ID NO: 6211492 - DNA, 17 bp, Homo sapiens
cttttgtccccagggcc

SEQ ID NO: 6211493 - DNA, 18 bp, Homo sapiens
cttttgtccccagggccc

SEQ ID NO: 6211494 - DNA, 21 bp, Homo sapiens
cttttgtcctcacatgcagag

SEQ ID NO: 6211495 - DNA, 13 bp, Homo sapiens
cttttgtcctgca

SEQ ID NO: 6211496 - DNA, 16 bp, Homo sapiens
cttttgtcctgttatt

SEQ ID NO: 6211497 - DNA, 19 bp, Homo sapiens
cttttgtccttcctgtgcc

SEQ ID NO: 6211498 - DNA, 15 bp, Homo sapiens
cttttgtctctgcaa

SEQ ID NO: 6211499 - DNA, 22 bp, Homo sapiens
cttttgtgagacggctggaaat

SEQ ID NO: 6211500 - DNA, 13 bp, Homo sapiens
cttttgtgatgaa

SEQ ID NO: 6211501 - DNA, 17 bp, Homo sapiens
cttttgtgatgaacata

SEQ ID NO: 6211502 - DNA, 20 bp, Homo sapiens
cttttgtgatggagtgctgt

SEQ ID NO: 6211503 - DNA, 12 bp, Homo sapiens
cttttgtgcatt

SEQ ID NO: 6211504 - DNA, 21 bp, Homo sapiens
cttttgtgggggactgtaagt

SEQ ID NO: 6211505 - DNA, 21 bp, Homo sapiens
cttttgtgggtttctctgtgc

SEQ ID NO: 6211506 - DNA, 15 bp, Homo sapiens
cttttgtggtgtctt

SEQ ID NO: 6211507 - DNA, 16 bp, Homo sapiens
cttttgtggtgtcttc

SEQ ID NO: 6211508 - DNA, 19 bp, Homo sapiens
cttttgtgtaattttaaag

SEQ ID NO: 6211509 - DNA, 15 bp, Homo sapiens
cttttgtgtattctg

SEQ ID NO: 6211510 - DNA, 21 bp, Homo sapiens
cttttgtgtccctgaagtatt

SEQ ID NO: 6211511 - DNA, 21 bp, Homo sapiens
cttttgtgttcctatggaaac

SEQ ID NO: 6211512 - DNA, 18 bp, Homo sapiens
cttttgttactcttggga

SEQ ID NO: 6211513 - DNA, 13 bp, Homo sapiens
cttttgttactgt

SEQ ID NO: 6211514 - DNA, 15 bp, Homo sapiens
cttttgttactgttc

SEQ ID NO: 6211515 - DNA, 18 bp, Homo sapiens
cttttgttcatttcatcc

SEQ ID NO: 6211516 - DNA, 16 bp, Homo sapiens
cttttgttctgagggg

SEQ ID NO: 6211517 - DNA, 16 bp, Homo sapiens
cttttgttctgcttta

SEQ ID NO: 6211518 - DNA, 22 bp, Homo sapiens
cttttgttctgctttatctttt

SEQ ID NO: 6211519 - DNA, 15 bp, Homo sapiens
cttttgttcttcccc

SEQ ID NO: 6211520 - DNA, 22 bp, Homo sapiens
cttttgttcttggtttgtaaat

SEQ ID NO: 6211521 - DNA, 15 bp, Homo sapiens
cttttgttgtccttg

SEQ ID NO: 6211522 - DNA, 12 bp, Homo sapiens
cttttgtttcca

SEQ ID NO: 6211523 - DNA, 11 bp, Homo sapiens
cttttgtttct

SEQ ID NO: 6211524 - DNA, 22 bp, Homo sapiens
cttttgtttcttcccttcaagg

SEQ ID NO: 6211525 - DNA, 23 bp, Homo sapiens
cttttgtttgcggggcttttaaa

SEQ ID NO: 6211526 - DNA, 19 bp, Homo sapiens
cttttgttttcctgctggt

SEQ ID NO: 6211527 - DNA, 20 bp, Homo sapiens
cttttgttttctgatggcca

SEQ ID NO: 6211528 - DNA, 22 bp, Homo sapiens
cttttgttttctgatggccaaa

SEQ ID NO: 6211529 - DNA, 16 bp, Homo sapiens
cttttgtttttccagt

SEQ ID NO: 6211530 - DNA, 17 bp, Homo sapiens
cttttgttttttgaagt

SEQ ID NO: 6211531 - DNA, 14 bp, Homo sapiens
cttttgttttttgg

SEQ ID NO: 6211532 - DNA, 21 bp, Homo sapiens
ctttttaaaaaaataaaacag

SEQ ID NO: 6211533 - DNA, 18 bp, Homo sapiens
ctttttaaaaaactattt

SEQ ID NO: 6211534 - DNA, 13 bp, Homo sapiens
ctttttaaaaaat

SEQ ID NO: 6211535 - DNA, 16 bp, Homo sapiens
ctttttaaaaaatacc

SEQ ID NO: 6211536 - DNA, 20 bp, Homo sapiens
ctttttaaaaaatgctgggt

SEQ ID NO: 6211537 - DNA, 18 bp, Homo sapiens
ctttttaaaaactcttca

SEQ ID NO: 6211538 - DNA, 21 bp, Homo sapiens
ctttttaaaaagttgcacatt

SEQ ID NO: 6211539 - DNA, 13 bp, Homo sapiens
ctttttaaaaata

SEQ ID NO: 6211540 - DNA, 18 bp, Homo sapiens
gagcaaccagctggaagg

SEQ ID NO: 6211541 - DNA, 21 bp, Homo sapiens
gagcaacccctggaccccagc

SEQ ID NO: 6211542 - DNA, 16 bp, Homo sapiens
gagcaacccctgtacc

SEQ ID NO: 6211543 - DNA, 21 bp, Homo sapiens
gagcaacccctgtacccagct

SEQ ID NO: 6211544 - DNA, 14 bp, Homo sapiens
gagcaaccctctga

SEQ ID NO: 6211545 - DNA, 16 bp, Homo sapiens
gagcaaccgtggccct

SEQ ID NO: 6211546 - DNA, 19 bp, Homo sapiens
gagcaacctctcactcccc

SEQ ID NO: 6211547 - DNA, 21 bp, Homo sapiens
gagcaacctcttcagctggga

SEQ ID NO: 6211548 - DNA, 13 bp, Homo sapiens
gagcaactctcca

SEQ ID NO: 6211549 - DNA, 15 bp, Homo sapiens
gagcaactctccact

SEQ ID NO: 6211550 - DNA, 18 bp, Homo sapiens
gagcaactctccactcca

SEQ ID NO: 6211551 - DNA, 15 bp, Homo sapiens
gagcaactgtgcagc

SEQ ID NO: 6211552 - DNA, 13 bp, Homo sapiens
gagcaacttgagt

SEQ ID NO: 6211553 - DNA, 14 bp, Homo sapiens
gagcaagaaggaaa

SEQ ID NO: 6211554 - DNA, 22 bp, Homo sapiens
gagcaagaccctgtcttaaaaa

SEQ ID NO: 6211555 - DNA, 18 bp, Homo sapiens
gagcaagacgctgtgctg

SEQ ID NO: 6211556 - DNA, 12 bp, Homo sapiens
gagcaagactct

SEQ ID NO: 6211557 - DNA, 14 bp, Homo sapiens
gagcaagactctgt

SEQ ID NO: 6211558 - DNA, 16 bp, Homo sapiens
gagcaagagagggcaa

SEQ ID NO: 6211559 - DNA, 15 bp, Homo sapiens
gagcaagagccaggg

SEQ ID NO: 6211560 - DNA, 17 bp, Homo sapiens
gagcaagagccaggggt

SEQ ID NO: 6211561 - DNA, 13 bp, Homo sapiens
gagcaagagctgg

SEQ ID NO: 6211562 - DNA, 20 bp, Homo sapiens
gagcaagcatttatgtttat

SEQ ID NO: 6211563 - DNA, 14 bp, Homo sapiens
gagcaagccctact

SEQ ID NO: 6211564 - DNA, 17 bp, Homo sapiens
gagcaagccctgaccca

SEQ ID NO: 6211565 - DNA, 12 bp, Homo sapiens
gagcaagcctag

SEQ ID NO: 6211566 - DNA, 23 bp, Homo sapiens
gagcaagcgaaagagcaaagtca

SEQ ID NO: 6211567 - DNA, 12 bp, Homo sapiens
gagcaaggaagc

SEQ ID NO: 6211568 - DNA, 20 bp, Homo sapiens
gagcaaggacaacctgcccc

SEQ ID NO: 6211569 - DNA, 12 bp, Homo sapiens
gagcaaggacat

SEQ ID NO: 6211570 - DNA, 17 bp, Homo sapiens
gagcaaggacattgccc

SEQ ID NO: 6211571 - DNA, 23 bp, Homo sapiens
gagcaaggacattgccccaagat

SEQ ID NO: 6211572 - DNA, 16 bp, Homo sapiens
gagcaaggccttctct

SEQ ID NO: 6211573 - DNA, 12 bp, Homo sapiens
gagcaaggctgc

SEQ ID NO: 6211574 - DNA, 15 bp, Homo sapiens
gagcaaggctgccct

SEQ ID NO: 6211575 - DNA, 20 bp, Homo sapiens
gagcaagggttccctcaaga

SEQ ID NO: 6211576 - DNA, 15 bp, Homo sapiens
gagcaagtctgcagg

SEQ ID NO: 6211577 - DNA, 17 bp, Homo sapiens
gagcaataacactatat

SEQ ID NO: 6211578 - DNA, 19 bp, Homo sapiens
gagcaataacactatattt

SEQ ID NO: 6211579 - DNA, 20 bp, Homo sapiens
gagcaataacactatattta

SEQ ID NO: 6211580 - DNA, 14 bp, Homo sapiens
gagcaataacttct

SEQ ID NO: 6211581 - DNA, 17 bp, Homo sapiens
gagcaatgggactggag

SEQ ID NO: 6211582 - DNA, 15 bp, Homo sapiens
gagcaatgggagggg

SEQ ID NO: 6211583 - DNA, 23 bp, Homo sapiens
gagcaatgttggttttttataaa

SEQ ID NO: 6211584 - DNA, 12 bp, Homo sapiens
gagcaatgtttt

SEQ ID NO: 6211585 - DNA, 16 bp, Homo sapiens
gagcaattcatttcac

SEQ ID NO: 6211586 - DNA, 17 bp, Homo sapiens
gagcaattcatttcact

SEQ ID NO: 6211587 - DNA, 19 bp, Homo sapiens
gagcaattcatttcacttt

SEQ ID NO: 6211588 - DNA, 15 bp, Homo sapiens
gagcaattccaggct

SEQ ID NO: 6211589 - DNA, 21 bp, Homo sapiens
gagcaattccaggctgagcca

SEQ ID NO: 6211590 - DNA, 17 bp, Homo sapiens
gagcaattctgggagaa

SEQ ID NO: 6211591 - DNA, 19 bp, Homo sapiens
gagcacaaaacctgtccta

SEQ ID NO: 6211592 - DNA, 18 bp, Homo sapiens
gagcacaaaagcctctca

SEQ ID NO: 6211593 - DNA, 16 bp, Homo sapiens
gagcacaaaattcaaa

SEQ ID NO: 6211594 - DNA, 19 bp, Homo sapiens
gagcacaacccccagctcc

SEQ ID NO: 6211595 - DNA, 15 bp, Homo sapiens
gagcacaagaaggcc

SEQ ID NO: 6211596 - DNA, 20 bp, Homo sapiens
gagcacaagaaggccagccc

SEQ ID NO: 6211597 - DNA, 22 bp, Homo sapiens
gagcacaagaaggccagcccac

SEQ ID NO: 6211598 - DNA, 21 bp, Homo sapiens
gagcacaagaagtttcttcag

SEQ ID NO: 6211599 - DNA, 19 bp, Homo sapiens
gagcacaatctgttctact

SEQ ID NO: 6211600 - DNA, 20 bp, Homo sapiens
gagcacacaacaggctgtgt

SEQ ID NO: 6211601 - DNA, 15 bp, Homo sapiens
gagcacacggccctg

SEQ ID NO: 6211602 - DNA, 15 bp, Homo sapiens
gagcacactggctca

SEQ ID NO: 6211603 - DNA, 17 bp, Homo sapiens
gagcacacttatttatg

SEQ ID NO: 6211604 - DNA, 20 bp, Homo sapiens
gagcacactttagtggccga

SEQ ID NO: 6211605 - DNA, 14 bp, Homo sapiens
gagcacagacacag

SEQ ID NO: 6211606 - DNA, 20 bp, Homo sapiens
gagcacagacggaggaagcc

SEQ ID NO: 6211607 - DNA, 21 bp, Homo sapiens
gagcacagacggaggaagccg

SEQ ID NO: 6211608 - DNA, 20 bp, Homo sapiens
gagcacagaggggctagggg

SEQ ID NO: 6211609 - DNA, 17 bp, Homo sapiens
gagcacagcatgcctta

SEQ ID NO: 6211610 - DNA, 14 bp, Homo sapiens
gagcacagccatag

SEQ ID NO: 6211611 - DNA, 13 bp, Homo sapiens
gagcacagcccac

SEQ ID NO: 6211612 - DNA, 14 bp, Homo sapiens
gagcacagcccacg

SEQ ID NO: 6211613 - DNA, 12 bp, Homo sapiens
gagcacagccct

SEQ ID NO: 6211614 - DNA, 13 bp, Homo sapiens
gagcacagccctg

SEQ ID NO: 6211615 - DNA, 15 bp, Homo sapiens
gagcacagccctggg

SEQ ID NO: 6211616 - DNA, 23 bp, Homo sapiens
gagcacaggcatattattttctg

SEQ ID NO: 6211617 - DNA, 14 bp, Homo sapiens
gagcacaggtccca

SEQ ID NO: 6211618 - DNA, 18 bp, Homo sapiens
gagcacaggtcccacctc

SEQ ID NO: 6211619 - DNA, 15 bp, Homo sapiens
gagcacatactacct

SEQ ID NO: 6211620 - DNA, 23 bp, Homo sapiens
gagcacatactacctagaagtaa

SEQ ID NO: 6211621 - DNA, 23 bp, Homo sapiens
gagcacatagagctttttaatag

SEQ ID NO: 6211622 - DNA, 21 bp, Homo sapiens
gagcacatagccctgttgacc

SEQ ID NO: 6211623 - DNA, 22 bp, Homo sapiens
gagcacatagccctgttgacct

SEQ ID NO: 6211624 - DNA, 21 bp, Homo sapiens
gagcacatagtgtcctgccca

SEQ ID NO: 6211625 - DNA, 22 bp, Homo sapiens
gagcacatagtgtcctgcccac

SEQ ID NO: 6211626 - DNA, 13 bp, Homo sapiens
gagcacatggccc

SEQ ID NO: 6211627 - DNA, 21 bp, Homo sapiens
gagcacatgttactgcttcat

SEQ ID NO: 6211628 - DNA, 22 bp, Homo sapiens
gagcacatgttactgcttcatt

SEQ ID NO: 6211629 - DNA, 17 bp, Homo sapiens
gagcaccacggccagaa

SEQ ID NO: 6211630 - DNA, 13 bp, Homo sapiens
gagcacccagagc

SEQ ID NO: 6211631 - DNA, 14 bp, Homo sapiens
gagcacccagagca

SEQ ID NO: 6211632 - DNA, 19 bp, Homo sapiens
gagcacccagatcagactc

SEQ ID NO: 6211633 - DNA, 12 bp, Homo sapiens
gagcacccccag

SEQ ID NO: 6211634 - DNA, 14 bp, Homo sapiens
gagcaccctctgga

SEQ ID NO: 6211635 - DNA, 15 bp, Homo sapiens
gagcaccctctggat

SEQ ID NO: 6211636 - DNA, 14 bp, Homo sapiens
gagcaccctgaggg

SEQ ID NO: 6211637 - DNA, 22 bp, Homo sapiens
gagcaccgcctgtgaaatacca

SEQ ID NO: 6211638 - DNA, 21 bp, Homo sapiens
gagcaccgtgtcaagctgctc

SEQ ID NO: 6211639 - DNA, 22 bp, Homo sapiens
gagcaccgtgtcaagctgctct

SEQ ID NO: 6211640 - DNA, 23 bp, Homo sapiens
gagcaccgtgtcaagctgctctg

SEQ ID NO: 6211641 - DNA, 23 bp, Homo sapiens
gagcacctactttatgtatggag

SEQ ID NO: 6211642 - DNA, 22 bp, Homo sapiens
gagcacctcacctcccgaagcc

SEQ ID NO: 6211643 - DNA, 11 bp, Homo sapiens
gagcacctcag

SEQ ID NO: 6211644 - DNA, 12 bp, Homo sapiens
gagcacctccca

SEQ ID NO: 6211645 - DNA, 16 bp, Homo sapiens
gagcacctctatacag

SEQ ID NO: 6211646 - DNA, 14 bp, Homo sapiens
gagcacctgctgtc

SEQ ID NO: 6211647 - DNA, 15 bp, Homo sapiens
gagcacctgctgtct

SEQ ID NO: 6211648 - DNA, 12 bp, Homo sapiens
gagcacctgctt

SEQ ID NO: 6211649 - DNA, 23 bp, Homo sapiens
gagcacctgcttcatgctcagcc

SEQ ID NO: 6211650 - DNA, 22 bp, Homo sapiens
gagcacctggaccccctgcccg

SEQ ID NO: 6211651 - DNA, 14 bp, Homo sapiens
gagcacctgggccc

SEQ ID NO: 6211652 - DNA, 17 bp, Homo sapiens
gagcaccttagacagtc

SEQ ID NO: 6211653 - DNA, 20 bp, Homo sapiens
gagcaccttcctcacttcca

SEQ ID NO: 6211654 - DNA, 17 bp, Homo sapiens
gagcacgcctgccatct

SEQ ID NO: 6211655 - DNA, 23 bp, Homo sapiens
gagcacgcctgccatcttctccc

SEQ ID NO: 6211656 - DNA, 13 bp, Homo sapiens
gagcacggctctg

SEQ ID NO: 6211657 - DNA, 15 bp, Homo sapiens
gagcacggttgcctg

SEQ ID NO: 6211658 - DNA, 17 bp, Homo sapiens
gagcacggttgcctgag

SEQ ID NO: 6211659 - DNA, 20 bp, Homo sapiens
gagcacggttgcctgaggtc

SEQ ID NO: 6211660 - DNA, 19 bp, Homo sapiens
gagcacgtggagatagtgc

SEQ ID NO: 6211661 - DNA, 23 bp, Homo sapiens
gagcacgttggcgaggaaaaaca

SEQ ID NO: 6211662 - DNA, 17 bp, Homo sapiens
gagcactcctgattttt

SEQ ID NO: 6211663 - DNA, 14 bp, Homo sapiens
gagcactcctggtg

SEQ ID NO: 6211664 - DNA, 21 bp, Homo sapiens
gagcactctgagtttaccatt

SEQ ID NO: 6211665 - DNA, 13 bp, Homo sapiens
gagcactgaacca

SEQ ID NO: 6211666 - DNA, 13 bp, Homo sapiens
gagcactgcacct

SEQ ID NO: 6211667 - DNA, 21 bp, Homo sapiens
gagcactgcatgtcagagcac

SEQ ID NO: 6211668 - DNA, 22 bp, Homo sapiens
gagcactgcatgtcagagcact

SEQ ID NO: 6211669 - DNA, 20 bp, Homo sapiens
gagcactgccaggagggaca

SEQ ID NO: 6211670 - DNA, 11 bp, Homo sapiens
gagcactgcct

SEQ ID NO: 6211671 - DNA, 19 bp, Homo sapiens
gagcactgcctctatgccc

SEQ ID NO: 6211672 - DNA, 22 bp, Homo sapiens
gagcactgcctctatgccctgc

SEQ ID NO: 6211673 - DNA, 13 bp, Homo sapiens
gagcactggactc

SEQ ID NO: 6211674 - DNA, 14 bp, Homo sapiens
gagcactggaggcc

SEQ ID NO: 6211675 - DNA, 15 bp, Homo sapiens
gagcactggaggcct

SEQ ID NO: 6211676 - DNA, 17 bp, Homo sapiens
gagcactggaggcctct

SEQ ID NO: 6211677 - DNA, 20 bp, Homo sapiens
gagcactggaggcctctgca

SEQ ID NO: 6211678 - DNA, 14 bp, Homo sapiens
gagcactggagtgc

SEQ ID NO: 6211679 - DNA, 20 bp, Homo sapiens
gagcactggagtgcagggag

SEQ ID NO: 6211680 - DNA, 22 bp, Homo sapiens
gagcactggagtggctcgccag

SEQ ID NO: 6211681 - DNA, 13 bp, Homo sapiens
gagcactggccag

SEQ ID NO: 6211682 - DNA, 14 bp, Homo sapiens
gagcactggccaga

SEQ ID NO: 6211683 - DNA, 17 bp, Homo sapiens
gagcactggccagagag

SEQ ID NO: 6211684 - DNA, 23 bp, Homo sapiens
gagcactggccagagagggccca

SEQ ID NO: 6211685 - DNA, 14 bp, Homo sapiens
gagcactgggctcc

SEQ ID NO: 6211686 - DNA, 15 bp, Homo sapiens
gagcactgtataccc

SEQ ID NO: 6211687 - DNA, 16 bp, Homo sapiens
gagcactgtgcagccg

SEQ ID NO: 6211688 - DNA, 19 bp, Homo sapiens
gagcactgtgtaaccagca

SEQ ID NO: 6211689 - DNA, 14 bp, Homo sapiens
gagcactgttttct

SEQ ID NO: 6211690 - DNA, 23 bp, Homo sapiens
gagcacttcacacagacaagtgg

SEQ ID NO: 6211691 - DNA, 18 bp, Homo sapiens
gagcacttgcgtcctgca

SEQ ID NO: 6211692 - DNA, 20 bp, Homo sapiens
gagcacttgcgtcctgcaga

SEQ ID NO: 6211693 - DNA, 14 bp, Homo sapiens
gagcacttgctgta

SEQ ID NO: 6211694 - DNA, 19 bp, Homo sapiens
gagcactttaaaaacaggc

SEQ ID NO: 6211695 - DNA, 20 bp, Homo sapiens
gagcactttattctcctccg

SEQ ID NO: 6211696 - DNA, 21 bp, Homo sapiens
gagcactttattctcctccga

SEQ ID NO: 6211697 - DNA, 23 bp, Homo sapiens
gagcagaaaacccttgggccaga

SEQ ID NO: 6211698 - DNA, 18 bp, Homo sapiens
gagcagaactttttttgt

SEQ ID NO: 6211699 - DNA, 13 bp, Homo sapiens
gagcagaatacaa

SEQ ID NO: 6211700 - DNA, 16 bp, Homo sapiens
gagcagaatacaatgg

SEQ ID NO: 6211701 - DNA, 18 bp, Homo sapiens
gagcagaatgttgtactt

SEQ ID NO: 6211702 - DNA, 13 bp, Homo sapiens
gagcagacagaga

SEQ ID NO: 6211703 - DNA, 16 bp, Homo sapiens
gagcagacagagaaat

SEQ ID NO: 6211704 - DNA, 14 bp, Homo sapiens
gagcagacaggagg

SEQ ID NO: 6211705 - DNA, 13 bp, Homo sapiens
gagcagacaggct

SEQ ID NO: 6211706 - DNA, 20 bp, Homo sapiens
gagcagacaggctacaaagc

SEQ ID NO: 6211707 - DNA, 17 bp, Homo sapiens
gagcagaccagcacttc

SEQ ID NO: 6211708 - DNA, 15 bp, Homo sapiens
gagcagaccagcttt

SEQ ID NO: 6211709 - DNA, 20 bp, Homo sapiens
gagcagagaagtacaggtca

SEQ ID NO: 6211710 - DNA, 15 bp, Homo sapiens
gagcagagaatataa

SEQ ID NO: 6211711 - DNA, 21 bp, Homo sapiens
gagcagagacactaacgactt

SEQ ID NO: 6211712 - DNA, 18 bp, Homo sapiens
gagcagagaccatccctg

SEQ ID NO: 6211713 - DNA, 19 bp, Homo sapiens
gagcagagacgaagacccc

SEQ ID NO: 6211714 - DNA, 21 bp, Homo sapiens
gagcagagacggcagccccat

SEQ ID NO: 6211715 - DNA, 19 bp, Homo sapiens
gagcagagaggtggccacc

SEQ ID NO: 6211716 - DNA, 15 bp, Homo sapiens
gagcagagcaggcaa

SEQ ID NO: 6211717 - DNA, 15 bp, Homo sapiens
gagcagagcccccat

SEQ ID NO: 6211718 - DNA, 18 bp, Homo sapiens
gagcagagcccggagctc

SEQ ID NO: 6211719 - DNA, 19 bp, Homo sapiens
ctttttaaaaatagacact

SEQ ID NO: 6211720 - DNA, 14 bp, Homo sapiens
ctttttaaaacaca

SEQ ID NO: 6211721 - DNA, 13 bp, Homo sapiens
ctttttaaaatac

SEQ ID NO: 6211722 - DNA, 14 bp, Homo sapiens
ctttttaaaataga

SEQ ID NO: 6211723 - DNA, 22 bp, Homo sapiens
ctttttaaaatggtgcttaagt

SEQ ID NO: 6211724 - DNA, 19 bp, Homo sapiens
ctttttaaacaaatggctt

SEQ ID NO: 6211725 - DNA, 22 bp, Homo sapiens
ctttttaaagaagtgcatgaaa

SEQ ID NO: 6211726 - DNA, 23 bp, Homo sapiens
ctttttaaagagatagcttctct

SEQ ID NO: 6211727 - DNA, 14 bp, Homo sapiens
ctttttaaagctta

SEQ ID NO: 6211728 - DNA, 21 bp, Homo sapiens
ctttttaaagtaaattattaa

SEQ ID NO: 6211729 - DNA, 23 bp, Homo sapiens
ctttttaaagtgtttctgttatt

SEQ ID NO: 6211730 - DNA, 15 bp, Homo sapiens
ctttttaaatgtgaa

SEQ ID NO: 6211731 - DNA, 15 bp, Homo sapiens
ctttttaaatgtgct

SEQ ID NO: 6211732 - DNA, 23 bp, Homo sapiens
ctttttaacaaaaaacagattct

SEQ ID NO: 6211733 - DNA, 14 bp, Homo sapiens
ctttttaaccaagt

SEQ ID NO: 6211734 - DNA, 22 bp, Homo sapiens
ctttttaaccaagttgtttatt

SEQ ID NO: 6211735 - DNA, 17 bp, Homo sapiens
ctttttaactttaccaa

SEQ ID NO: 6211736 - DNA, 22 bp, Homo sapiens
ctttttaagaattctgtacttc

SEQ ID NO: 6211737 - DNA, 22 bp, Homo sapiens
ctttttaaggacactggggtct

SEQ ID NO: 6211738 - DNA, 20 bp, Homo sapiens
ctttttaaggtctttcagta

SEQ ID NO: 6211739 - DNA, 14 bp, Homo sapiens
ctttttaagttatt

SEQ ID NO: 6211740 - DNA, 15 bp, Homo sapiens
ctttttaataaaaag

SEQ ID NO: 6211741 - DNA, 20 bp, Homo sapiens
ctttttaataaaaaggcacc

SEQ ID NO: 6211742 - DNA, 17 bp, Homo sapiens
ctttttaataaaaatac

SEQ ID NO: 6211743 - DNA, 16 bp, Homo sapiens
ctttttaatatgctta

SEQ ID NO: 6211744 - DNA, 22 bp, Homo sapiens
ctttttaatattgatatgctta

SEQ ID NO: 6211745 - DNA, 16 bp, Homo sapiens
ctttttaatcatgaat

SEQ ID NO: 6211746 - DNA, 18 bp, Homo sapiens
ctttttaatcatgaatat

SEQ ID NO: 6211747 - DNA, 23 bp, Homo sapiens
ctttttaattgttgtttctttct

SEQ ID NO: 6211748 - DNA, 22 bp, Homo sapiens
ctttttaatttctgcaaatgta

SEQ ID NO: 6211749 - DNA, 11 bp, Homo sapiens
ctttttacata

SEQ ID NO: 6211750 - DNA, 18 bp, Homo sapiens
ctttttacataactgcct

SEQ ID NO: 6211751 - DNA, 18 bp, Homo sapiens
ctttttacattacagaat

SEQ ID NO: 6211752 - DNA, 22 bp, Homo sapiens
ctttttacccatttgttcatat

SEQ ID NO: 6211753 - DNA, 19 bp, Homo sapiens
ctttttaccctttaaaaaa

SEQ ID NO: 6211754 - DNA, 13 bp, Homo sapiens
ctttttacctggc

SEQ ID NO: 6211755 - DNA, 21 bp, Homo sapiens
ctttttacctggcctagaaag

SEQ ID NO: 6211756 - DNA, 16 bp, Homo sapiens
ctttttacctttcata

SEQ ID NO: 6211757 - DNA, 17 bp, Homo sapiens
ctttttacctttcatac

SEQ ID NO: 6211758 - DNA, 15 bp, Homo sapiens
ctttttactcccctt

SEQ ID NO: 6211759 - DNA, 12 bp, Homo sapiens
ctttttactgtt

SEQ ID NO: 6211760 - DNA, 14 bp, Homo sapiens
ctttttactgttga

SEQ ID NO: 6211761 - DNA, 16 bp, Homo sapiens
ctttttactgttgaac

SEQ ID NO: 6211762 - DNA, 20 bp, Homo sapiens
ctttttagatgtatttttga

SEQ ID NO: 6211763 - DNA, 19 bp, Homo sapiens
ctttttaggctctgagact

SEQ ID NO: 6211764 - DNA, 16 bp, Homo sapiens
ctttttagggcagatt

SEQ ID NO: 6211765 - DNA, 15 bp, Homo sapiens
ctttttagtctttta

SEQ ID NO: 6211766 - DNA, 18 bp, Homo sapiens
ctttttagtcttttactc

SEQ ID NO: 6211767 - DNA, 13 bp, Homo sapiens
ctttttataaaaa

SEQ ID NO: 6211768 - DNA, 15 bp, Homo sapiens
ctttttataaaaaga

SEQ ID NO: 6211769 - DNA, 19 bp, Homo sapiens
ctttttataaaaagataat

SEQ ID NO: 6211770 - DNA, 23 bp, Homo sapiens
ctttttataatgtggatttccta

SEQ ID NO: 6211771 - DNA, 13 bp, Homo sapiens
ctttttatactcc

SEQ ID NO: 6211772 - DNA, 16 bp, Homo sapiens
ctttttataggtttta

SEQ ID NO: 6211773 - DNA, 23 bp, Homo sapiens
ctttttatgctatttctgtatat

SEQ ID NO: 6211774 - DNA, 22 bp, Homo sapiens
ctttttatgttgccagtttaat

SEQ ID NO: 6211775 - DNA, 13 bp, Homo sapiens
ctttttattaaaa

SEQ ID NO: 6211776 - DNA, 12 bp, Homo sapiens
ctttttattcat

SEQ ID NO: 6211777 - DNA, 18 bp, Homo sapiens
ctttttattccctgccca

SEQ ID NO: 6211778 - DNA, 19 bp, Homo sapiens
ctttttattgaatctattt

SEQ ID NO: 6211779 - DNA, 13 bp, Homo sapiens
ctttttattgcat

SEQ ID NO: 6211780 - DNA, 16 bp, Homo sapiens
ctttttattgcatggt

SEQ ID NO: 6211781 - DNA, 16 bp, Homo sapiens
ctttttattgccttct

SEQ ID NO: 6211782 - DNA, 17 bp, Homo sapiens
ctttttatttatatgta

SEQ ID NO: 6211783 - DNA, 19 bp, Homo sapiens
ctttttatttatatgtatg

SEQ ID NO: 6211784 - DNA, 13 bp, Homo sapiens
ctttttatttcta

SEQ ID NO: 6211785 - DNA, 20 bp, Homo sapiens
ctttttatttctaaagttgt

SEQ ID NO: 6211786 - DNA, 21 bp, Homo sapiens
ctttttatttctaaagttgta

SEQ ID NO: 6211787 - DNA, 16 bp, Homo sapiens
ctttttatttctgata

SEQ ID NO: 6211788 - DNA, 17 bp, Homo sapiens
ctttttattttaaccag

SEQ ID NO: 6211789 - DNA, 18 bp, Homo sapiens
ctttttattttaggcact

SEQ ID NO: 6211790 - DNA, 22 bp, Homo sapiens
ctttttcaaaaattacactaca

SEQ ID NO: 6211791 - DNA, 19 bp, Homo sapiens
ctttttcaaaactagttct

SEQ ID NO: 6211792 - DNA, 15 bp, Homo sapiens
ctttttcaagattga

SEQ ID NO: 6211793 - DNA, 21 bp, Homo sapiens
ctttttcaagattgatcattt

SEQ ID NO: 6211794 - DNA, 11 bp, Homo sapiens
ctttttcaatg

SEQ ID NO: 6211795 - DNA, 12 bp, Homo sapiens
ctttttcaatgg

SEQ ID NO: 6211796 - DNA, 12 bp, Homo sapiens
ctttttcacata

SEQ ID NO: 6211797 - DNA, 21 bp, Homo sapiens
ctttttcagaaacagggcagc

SEQ ID NO: 6211798 - DNA, 20 bp, Homo sapiens
ctttttcagaggtgaattaa

SEQ ID NO: 6211799 - DNA, 15 bp, Homo sapiens
ctttttcagagtcat

SEQ ID NO: 6211800 - DNA, 23 bp, Homo sapiens
ctttttcaggctcgccaaggcct

SEQ ID NO: 6211801 - DNA, 12 bp, Homo sapiens
ctttttcagtga

SEQ ID NO: 6211802 - DNA, 20 bp, Homo sapiens
ctttttcatagtaagtgcga

SEQ ID NO: 6211803 - DNA, 17 bp, Homo sapiens
ctttttcatatgttgct

SEQ ID NO: 6211804 - DNA, 15 bp, Homo sapiens
ctttttcatcccctt

SEQ ID NO: 6211805 - DNA, 20 bp, Homo sapiens
ctttttcatgaaaatggagt

SEQ ID NO: 6211806 - DNA, 12 bp, Homo sapiens
ctttttcattat

SEQ ID NO: 6211807 - DNA, 14 bp, Homo sapiens
ctttttcattccct

SEQ ID NO: 6211808 - DNA, 15 bp, Homo sapiens
ctttttcatttaact

SEQ ID NO: 6211809 - DNA, 21 bp, Homo sapiens
ctttttcatttaactttataa

SEQ ID NO: 6211810 - DNA, 18 bp, Homo sapiens
ctttttcatttgcctatt

SEQ ID NO: 6211811 - DNA, 15 bp, Homo sapiens
ctttttcattttcca

SEQ ID NO: 6211812 - DNA, 18 bp, Homo sapiens
ctttttcattttccaata

SEQ ID NO: 6211813 - DNA, 13 bp, Homo sapiens
ctttttcattttg

SEQ ID NO: 6211814 - DNA, 23 bp, Homo sapiens
ctttttcattttgcagaaggaaa

SEQ ID NO: 6211815 - DNA, 13 bp, Homo sapiens
ctttttccaaaca

SEQ ID NO: 6211816 - DNA, 19 bp, Homo sapiens
ctttttccaaatgcttcta

SEQ ID NO: 6211817 - DNA, 22 bp, Homo sapiens
ctttttccaaatgcttctattt

SEQ ID NO: 6211818 - DNA, 23 bp, Homo sapiens
ctttttccaaatgcttctattta

SEQ ID NO: 6211819 - DNA, 23 bp, Homo sapiens
ctttttccaacttggctgcagga

SEQ ID NO: 6211820 - DNA, 12 bp, Homo sapiens
ctttttccagaa

SEQ ID NO: 6211821 - DNA, 13 bp, Homo sapiens
ctttttccagaat

SEQ ID NO: 6211822 - DNA, 22 bp, Homo sapiens
ctttttccagacacttttttga

SEQ ID NO: 6211823 - DNA, 19 bp, Homo sapiens
ctttttccatatccctctt

SEQ ID NO: 6211824 - DNA, 21 bp, Homo sapiens
ctttttccatcattttacagt

SEQ ID NO: 6211825 - DNA, 12 bp, Homo sapiens
ctttttcccagc

SEQ ID NO: 6211826 - DNA, 17 bp, Homo sapiens
ctttttcccctttctgt

SEQ ID NO: 6211827 - DNA, 16 bp, Homo sapiens
ctttttcccttccctc

SEQ ID NO: 6211828 - DNA, 16 bp, Homo sapiens
ctttttccctttcctt

SEQ ID NO: 6211829 - DNA, 18 bp, Homo sapiens
ctttttcctactccgttc

SEQ ID NO: 6211830 - DNA, 12 bp, Homo sapiens
ctttttcctcct

SEQ ID NO: 6211831 - DNA, 16 bp, Homo sapiens
ctttttcctctgagcc

SEQ ID NO: 6211832 - DNA, 18 bp, Homo sapiens
ctttttcctctgagccca

SEQ ID NO: 6211833 - DNA, 13 bp, Homo sapiens
ctttttcctgaaa

SEQ ID NO: 6211834 - DNA, 11 bp, Homo sapiens
ctttttcctgc

SEQ ID NO: 6211835 - DNA, 13 bp, Homo sapiens
ctttttcctgcgt

SEQ ID NO: 6211836 - DNA, 22 bp, Homo sapiens
ctttttcctgcgtcccagcctg

SEQ ID NO: 6211837 - DNA, 14 bp, Homo sapiens
ctttttccttactg

SEQ ID NO: 6211838 - DNA, 15 bp, Homo sapiens
ctttttccttactgt

SEQ ID NO: 6211839 - DNA, 14 bp, Homo sapiens
ctttttccttcttc

SEQ ID NO: 6211840 - DNA, 15 bp, Homo sapiens
ctttttccttcttca

SEQ ID NO: 6211841 - DNA, 17 bp, Homo sapiens
ctttttccttcttcagc

SEQ ID NO: 6211842 - DNA, 11 bp, Homo sapiens
ctttttccttt

SEQ ID NO: 6211843 - DNA, 12 bp, Homo sapiens
ctttttccttta

SEQ ID NO: 6211844 - DNA, 13 bp, Homo sapiens
ctttttcgccaaa

SEQ ID NO: 6211845 - DNA, 23 bp, Homo sapiens
ctttttcgccaaactgtctctgc

SEQ ID NO: 6211846 - DNA, 19 bp, Homo sapiens
ctttttcgtgtggatcttg

SEQ ID NO: 6211847 - DNA, 17 bp, Homo sapiens
ctttttctaaaaagcta

SEQ ID NO: 6211848 - DNA, 22 bp, Homo sapiens
ctttttctaatgaggagagaaa

SEQ ID NO: 6211849 - DNA, 18 bp, Homo sapiens
ctttttctaatgtggtta

SEQ ID NO: 6211850 - DNA, 11 bp, Homo sapiens
ctttttctacc

SEQ ID NO: 6211851 - DNA, 12 bp, Homo sapiens
ctttttctcaga

SEQ ID NO: 6211852 - DNA, 14 bp, Homo sapiens
ctttttctcagatc

SEQ ID NO: 6211853 - DNA, 22 bp, Homo sapiens
ctttttctccacactccactga

SEQ ID NO: 6211854 - DNA, 14 bp, Homo sapiens
ctttttctccaccc

SEQ ID NO: 6211855 - DNA, 11 bp, Homo sapiens
ctttttctctg

SEQ ID NO: 6211856 - DNA, 20 bp, Homo sapiens
ctttttctctttccatgaca

SEQ ID NO: 6211857 - DNA, 17 bp, Homo sapiens
ctttttctgactccagt

SEQ ID NO: 6211858 - DNA, 19 bp, Homo sapiens
ctttttctgattagctttg

SEQ ID NO: 6211859 - DNA, 13 bp, Homo sapiens
ctttttctgcact

SEQ ID NO: 6211860 - DNA, 22 bp, Homo sapiens
ctttttctgcactatatgcaaa

SEQ ID NO: 6211861 - DNA, 13 bp, Homo sapiens
ctttttctgcgct

SEQ ID NO: 6211862 - DNA, 12 bp, Homo sapiens
ctttttctggac

SEQ ID NO: 6211863 - DNA, 16 bp, Homo sapiens
ctttttctggactctg

SEQ ID NO: 6211864 - DNA, 15 bp, Homo sapiens
ctttttctgggtctc

SEQ ID NO: 6211865 - DNA, 12 bp, Homo sapiens
ctttttctgtgg

SEQ ID NO: 6211866 - DNA, 14 bp, Homo sapiens
ctttttctgttgta

SEQ ID NO: 6211867 - DNA, 15 bp, Homo sapiens
ctttttctgttgtaa

SEQ ID NO: 6211868 - DNA, 22 bp, Homo sapiens
ctttttcttaccagtctcctcc

SEQ ID NO: 6211869 - DNA, 18 bp, Homo sapiens
ctttttcttaccctctct

SEQ ID NO: 6211870 - DNA, 21 bp, Homo sapiens
ctttttcttaccctctctttc

SEQ ID NO: 6211871 - DNA, 12 bp, Homo sapiens
ctttttcttccc

SEQ ID NO: 6211872 - DNA, 13 bp, Homo sapiens
ctttttcttccct

SEQ ID NO: 6211873 - DNA, 14 bp, Homo sapiens
ctttttcttcctca

SEQ ID NO: 6211874 - DNA, 15 bp, Homo sapiens
ctttttcttcttccc

SEQ ID NO: 6211875 - DNA, 16 bp, Homo sapiens
ctttttcttgtattca

SEQ ID NO: 6211876 - DNA, 12 bp, Homo sapiens
ctttttctttcc

SEQ ID NO: 6211877 - DNA, 18 bp, Homo sapiens
ctttttcttttctatgga

SEQ ID NO: 6211878 - DNA, 15 bp, Homo sapiens
ctttttcttttgtaa

SEQ ID NO: 6211879 - DNA, 19 bp, Homo sapiens
ctttttcttttttgagtgt

SEQ ID NO: 6211880 - DNA, 13 bp, Homo sapiens
ctttttgaaatga

SEQ ID NO: 6211881 - DNA, 13 bp, Homo sapiens
ctttttgaagtgt

SEQ ID NO: 6211882 - DNA, 19 bp, Homo sapiens
ctttttgaatgttatttgt

SEQ ID NO: 6211883 - DNA, 22 bp, Homo sapiens
ctttttgaattaatctagaaaa

SEQ ID NO: 6211884 - DNA, 13 bp, Homo sapiens
ctttttgaattgt

SEQ ID NO: 6211885 - DNA, 13 bp, Homo sapiens
ctttttgacactg

SEQ ID NO: 6211886 - DNA, 14 bp, Homo sapiens
ctttttgacactga

SEQ ID NO: 6211887 - DNA, 15 bp, Homo sapiens
ctttttgacactgaa

SEQ ID NO: 6211888 - DNA, 20 bp, Homo sapiens
ctttttgagatactattttc

SEQ ID NO: 6211889 - DNA, 14 bp, Homo sapiens
ctttttgatgtata

SEQ ID NO: 6211890 - DNA, 13 bp, Homo sapiens
ctttttgcagctt

SEQ ID NO: 6211891 - DNA, 23 bp, Homo sapiens
ctttttgcaggggactgggccat

SEQ ID NO: 6211892 - DNA, 16 bp, Homo sapiens
ctttttgccctttagg

SEQ ID NO: 6211893 - DNA, 22 bp, Homo sapiens
ctttttgctgtgtagttccctc

SEQ ID NO: 6211894 - DNA, 12 bp, Homo sapiens
ctttttgcttct

SEQ ID NO: 6211895 - DNA, 13 bp, Homo sapiens
ctttttgctttcg

SEQ ID NO: 6211896 - DNA, 19 bp, Homo sapiens
ctttttggaaaagagctgg

SEQ ID NO: 6211897 - DNA, 22 bp, Homo sapiens
ctttttggaattcagcagtttt

SEQ ID NO: 6211898 - DNA, 18 bp, Homo sapiens
ctttttggactcagccca

SEQ ID NO: 6211899 - DNA, 21 bp, Homo sapiens
ctttttggaggtgcttaagca

SEQ ID NO: 6211900 - DNA, 20 bp, Homo sapiens
gagcagagcccggagctccg

SEQ ID NO: 6211901 - DNA, 15 bp, Homo sapiens
gagcagagcgcagcc

SEQ ID NO: 6211902 - DNA, 19 bp, Homo sapiens
gagcagagcgcagccccca

SEQ ID NO: 6211903 - DNA, 21 bp, Homo sapiens
gagcagagcgcagcccccacg

SEQ ID NO: 6211904 - DNA, 22 bp, Homo sapiens
gagcagagctctcccctcctgc

SEQ ID NO: 6211905 - DNA, 14 bp, Homo sapiens
gagcagagggcagg

SEQ ID NO: 6211906 - DNA, 19 bp, Homo sapiens
gagcagagggcaggggtgc

SEQ ID NO: 6211907 - DNA, 20 bp, Homo sapiens
gagcagaggggcagaggccc

SEQ ID NO: 6211908 - DNA, 15 bp, Homo sapiens
gagcagaggtggaaa

SEQ ID NO: 6211909 - DNA, 16 bp, Homo sapiens
gagcagagtctgggcc

SEQ ID NO: 6211910 - DNA, 17 bp, Homo sapiens
gagcagagtctgggcct

SEQ ID NO: 6211911 - DNA, 18 bp, Homo sapiens
gagcagatcgtgccgtgg

SEQ ID NO: 6211912 - DNA, 14 bp, Homo sapiens
gagcagatgcagag

SEQ ID NO: 6211913 - DNA, 14 bp, Homo sapiens
gagcagcacctcct

SEQ ID NO: 6211914 - DNA, 21 bp, Homo sapiens
gagcagcacctcctcagcctg

SEQ ID NO: 6211915 - DNA, 24 bp, Homo sapiens
gagcagcacgccaaccccagcagt

SEQ ID NO: 6211916 - DNA, 19 bp, Homo sapiens
gagcagcagcacctttctc

SEQ ID NO: 6211917 - DNA, 21 bp, Homo sapiens
gagcagcagcacctttctctg

SEQ ID NO: 6211918 - DNA, 14 bp, Homo sapiens
gagcagcagccagc

SEQ ID NO: 6211919 - DNA, 15 bp, Homo sapiens
gagcagcagccagca

SEQ ID NO: 6211920 - DNA, 16 bp, Homo sapiens
gagcagcagccagcac

SEQ ID NO: 6211921 - DNA, 17 bp, Homo sapiens
gagcagcagccagcacc

SEQ ID NO: 6211922 - DNA, 16 bp, Homo sapiens
gagcagcagcttctcc

SEQ ID NO: 6211923 - DNA, 22 bp, Homo sapiens
gagcagcaggaggggggaggga

SEQ ID NO: 6211924 - DNA, 14 bp, Homo sapiens
gagcagcaggcctc

SEQ ID NO: 6211925 - DNA, 15 bp, Homo sapiens
gagcagcaggcctct

SEQ ID NO: 6211926 - DNA, 20 bp, Homo sapiens
gagcagcaggcctctgggac

SEQ ID NO: 6211927 - DNA, 21 bp, Homo sapiens
gagcagcaggcctctgggacc

SEQ ID NO: 6211928 - DNA, 23 bp, Homo sapiens
gagcagcaggcctctgggaccca

SEQ ID NO: 6211929 - DNA, 21 bp, Homo sapiens
gagcagcaggtagcctgctgg

SEQ ID NO: 6211930 - DNA, 13 bp, Homo sapiens
gagcagcaggtgc

SEQ ID NO: 6211931 - DNA, 17 bp, Homo sapiens
gagcagcattcccaggg

SEQ ID NO: 6211932 - DNA, 21 bp, Homo sapiens
gagcagccaaggccgccagcg

SEQ ID NO: 6211933 - DNA, 18 bp, Homo sapiens
gagcagccacattcctga

SEQ ID NO: 6211934 - DNA, 21 bp, Homo sapiens
gagcagccacattcctgatgc

SEQ ID NO: 6211935 - DNA, 15 bp, Homo sapiens
gagcagccagagctg

SEQ ID NO: 6211936 - DNA, 11 bp, Homo sapiens
gagcagcccag

SEQ ID NO: 6211937 - DNA, 13 bp, Homo sapiens
gagcagcccaggg

SEQ ID NO: 6211938 - DNA, 14 bp, Homo sapiens
gagcagcccagggc

SEQ ID NO: 6211939 - DNA, 17 bp, Homo sapiens
gagcagcccagggccta

SEQ ID NO: 6211940 - DNA, 13 bp, Homo sapiens
gagcagcccccaa

SEQ ID NO: 6211941 - DNA, 16 bp, Homo sapiens
gagcagcccccaaaga

SEQ ID NO: 6211942 - DNA, 14 bp, Homo sapiens
gagcagccctggcc

SEQ ID NO: 6211943 - DNA, 10 bp, Homo sapiens
gagcagcctc

SEQ ID NO: 6211944 - DNA, 13 bp, Homo sapiens
gagcagcctccac

SEQ ID NO: 6211945 - DNA, 22 bp, Homo sapiens
gagcagcctccactgtgtccag

SEQ ID NO: 6211946 - DNA, 21 bp, Homo sapiens
gagcagcctccagtgctggct

SEQ ID NO: 6211947 - DNA, 24 bp, Homo sapiens
gagcagcctccagtgctggctgct

SEQ ID NO: 6211948 - DNA, 17 bp, Homo sapiens
gagcagcctcgtggagc

SEQ ID NO: 6211949 - DNA, 17 bp, Homo sapiens
gagcagcctctgccagg

SEQ ID NO: 6211950 - DNA, 13 bp, Homo sapiens
gagcagcctctgg

SEQ ID NO: 6211951 - DNA, 21 bp, Homo sapiens
gagcagcctctggacagccag

SEQ ID NO: 6211952 - DNA, 24 bp, Homo sapiens
gagcagcctctggacagccagtga

SEQ ID NO: 6211953 - DNA, 22 bp, Homo sapiens
gagcagcctggagccctggaga

SEQ ID NO: 6211954 - DNA, 15 bp, Homo sapiens
gagcagcctgtggca

SEQ ID NO: 6211955 - DNA, 15 bp, Homo sapiens
gagcagcgagcctgc

SEQ ID NO: 6211956 - DNA, 15 bp, Homo sapiens
gagcagcgcccaggc

SEQ ID NO: 6211957 - DNA, 18 bp, Homo sapiens
gagcagcggacttcaaaa

SEQ ID NO: 6211958 - DNA, 13 bp, Homo sapiens
gagcagcggctct

SEQ ID NO: 6211959 - DNA, 18 bp, Homo sapiens
gagcagcggctctggtcc

SEQ ID NO: 6211960 - DNA, 18 bp, Homo sapiens
gagcagctccccaggagc

SEQ ID NO: 6211961 - DNA, 23 bp, Homo sapiens
gagcagctgaataacctgcacag

SEQ ID NO: 6211962 - DNA, 18 bp, Homo sapiens
gagcagctgagcagggcc

SEQ ID NO: 6211963 - DNA, 14 bp, Homo sapiens
gagcagctggctct

SEQ ID NO: 6211964 - DNA, 19 bp, Homo sapiens
gagcagctggctctccacc

SEQ ID NO: 6211965 - DNA, 18 bp, Homo sapiens
gagcagctgggcactggg

SEQ ID NO: 6211966 - DNA, 14 bp, Homo sapiens
gagcagctggggta

SEQ ID NO: 6211967 - DNA, 17 bp, Homo sapiens
gagcagcttccttctgg

SEQ ID NO: 6211968 - DNA, 16 bp, Homo sapiens
gagcagcttctgccac

SEQ ID NO: 6211969 - DNA, 23 bp, Homo sapiens
gagcagctttaaactcagggaca

SEQ ID NO: 6211970 - DNA, 14 bp, Homo sapiens
gagcagctttggga

SEQ ID NO: 6211971 - DNA, 17 bp, Homo sapiens
gagcagcttttggtctc

SEQ ID NO: 6211972 - DNA, 22 bp, Homo sapiens
gagcagcttttggtctccttgg

SEQ ID NO: 6211973 - DNA, 19 bp, Homo sapiens
gagcaggaagcaaggccag

SEQ ID NO: 6211974 - DNA, 16 bp, Homo sapiens
gagcaggaagcattca

SEQ ID NO: 6211975 - DNA, 23 bp, Homo sapiens
gagcaggaagcattcagagagca

SEQ ID NO: 6211976 - DNA, 13 bp, Homo sapiens
gagcaggaagccg

SEQ ID NO: 6211977 - DNA, 15 bp, Homo sapiens
gagcaggaaggcctg

SEQ ID NO: 6211978 - DNA, 17 bp, Homo sapiens
gagcaggaaggcctggg

SEQ ID NO: 6211979 - DNA, 19 bp, Homo sapiens
gagcaggacagccagcagc

SEQ ID NO: 6211980 - DNA, 14 bp, Homo sapiens
gagcaggacctggg

SEQ ID NO: 6211981 - DNA, 18 bp, Homo sapiens
gagcaggacctgggacag

SEQ ID NO: 6211982 - DNA, 22 bp, Homo sapiens
gagcaggactaacaactgggaa

SEQ ID NO: 6211983 - DNA, 15 bp, Homo sapiens
gagcaggactccagg

SEQ ID NO: 6211984 - DNA, 19 bp, Homo sapiens
gagcaggactccaggccca

SEQ ID NO: 6211985 - DNA, 20 bp, Homo sapiens
gagcaggactccaggcccaa

SEQ ID NO: 6211986 - DNA, 19 bp, Homo sapiens
gagcaggactctattttaa

SEQ ID NO: 6211987 - DNA, 11 bp, Homo sapiens
gagcaggagcc

SEQ ID NO: 6211988 - DNA, 14 bp, Homo sapiens
gagcaggagcccct

SEQ ID NO: 6211989 - DNA, 13 bp, Homo sapiens
gagcaggagcttg

SEQ ID NO: 6211990 - DNA, 14 bp, Homo sapiens
gagcaggagcttgg

SEQ ID NO: 6211991 - DNA, 22 bp, Homo sapiens
gagcaggaggaggaaaggtagc

SEQ ID NO: 6211992 - DNA, 23 bp, Homo sapiens
gagcaggaggaggaaaggtagcc

SEQ ID NO: 6211993 - DNA, 12 bp, Homo sapiens
gagcaggaggcc

SEQ ID NO: 6211994 - DNA, 17 bp, Homo sapiens
gagcaggaggcccctgg

SEQ ID NO: 6211995 - DNA, 21 bp, Homo sapiens
gagcaggaggcctaggagggt

SEQ ID NO: 6211996 - DNA, 20 bp, Homo sapiens
gagcaggaggggggctgggt

SEQ ID NO: 6211997 - DNA, 18 bp, Homo sapiens
gagcaggatagctcttcc

SEQ ID NO: 6211998 - DNA, 22 bp, Homo sapiens
gagcaggattgccaggtatttt

SEQ ID NO: 6211999 - DNA, 19 bp, Homo sapiens
gagcaggcacatggaggag

SEQ ID NO: 6212000 - DNA, 17 bp, Homo sapiens
gagcaggcagccagcat

SEQ ID NO: 6212001 - DNA, 19 bp, Homo sapiens
gagcaggcagccagcatct

SEQ ID NO: 6212002 - DNA, 16 bp, Homo sapiens
gagcaggcagggctgg

SEQ ID NO: 6212003 - DNA, 16 bp, Homo sapiens
gagcaggcccaatgct

SEQ ID NO: 6212004 - DNA, 17 bp, Homo sapiens
gagcaggcccaatgctg

SEQ ID NO: 6212005 - DNA, 18 bp, Homo sapiens
gagcaggcccgacagaga

SEQ ID NO: 6212006 - DNA, 19 bp, Homo sapiens
gagcaggcccgacagagag

SEQ ID NO: 6212007 - DNA, 22 bp, Homo sapiens
gagcaggccctgggcctccacc

SEQ ID NO: 6212008 - DNA, 19 bp, Homo sapiens
gagcaggccttgcgctgtt

SEQ ID NO: 6212009 - DNA, 19 bp, Homo sapiens
gagcaggctggcagctctc

SEQ ID NO: 6212010 - DNA, 20 bp, Homo sapiens
gagcaggcttgtggcagcct

SEQ ID NO: 6212011 - DNA, 23 bp, Homo sapiens
gagcaggcttgtggcagcctgat

SEQ ID NO: 6212012 - DNA, 17 bp, Homo sapiens
gagcagggaaggcctga

SEQ ID NO: 6212013 - DNA, 20 bp, Homo sapiens
gagcagggacagatcataga

SEQ ID NO: 6212014 - DNA, 18 bp, Homo sapiens
gagcagggatctgccccc

SEQ ID NO: 6212015 - DNA, 20 bp, Homo sapiens
gagcagggattaacctctgc

SEQ ID NO: 6212016 - DNA, 20 bp, Homo sapiens
gagcagggccaaagcacagc

SEQ ID NO: 6212017 - DNA, 21 bp, Homo sapiens
gagcagggccggggaactggc

SEQ ID NO: 6212018 - DNA, 22 bp, Homo sapiens
gagcagggccggggaactggcc

SEQ ID NO: 6212019 - DNA, 14 bp, Homo sapiens
gagcagggcggctg

SEQ ID NO: 6212020 - DNA, 16 bp, Homo sapiens
gagcagggcggctgcc

SEQ ID NO: 6212021 - DNA, 18 bp, Homo sapiens
gagcagggcggctgccga

SEQ ID NO: 6212022 - DNA, 19 bp, Homo sapiens
gagcagggctaaataaaga

SEQ ID NO: 6212023 - DNA, 14 bp, Homo sapiens
gagcagggctcagc

SEQ ID NO: 6212024 - DNA, 14 bp, Homo sapiens
gagcagggctgact

SEQ ID NO: 6212025 - DNA, 19 bp, Homo sapiens
gagcagggctgggcgcctc

SEQ ID NO: 6212026 - DNA, 15 bp, Homo sapiens
gagcaggggagcttg

SEQ ID NO: 6212027 - DNA, 17 bp, Homo sapiens
gagcaggggagcttggg

SEQ ID NO: 6212028 - DNA, 19 bp, Homo sapiens
gagcaggggagcttgggac

SEQ ID NO: 6212029 - DNA, 12 bp, Homo sapiens
gagcaggggcag

SEQ ID NO: 6212030 - DNA, 13 bp, Homo sapiens
gagcaggggcagg

SEQ ID NO: 6212031 - DNA, 18 bp, Homo sapiens
gagcaggggcaggcgcag

SEQ ID NO: 6212032 - DNA, 23 bp, Homo sapiens
gagcaggggcaggcgcagaggtc

SEQ ID NO: 6212033 - DNA, 15 bp, Homo sapiens
gagcaggggcccctg

SEQ ID NO: 6212034 - DNA, 16 bp, Homo sapiens
gagcaggggctgctgg

SEQ ID NO: 6212035 - DNA, 16 bp, Homo sapiens
gagcagggtcaagcct

SEQ ID NO: 6212036 - DNA, 20 bp, Homo sapiens
gagcagggtccacagctgga

SEQ ID NO: 6212037 - DNA, 16 bp, Homo sapiens
gagcagggtgctgtgg

SEQ ID NO: 6212038 - DNA, 17 bp, Homo sapiens
gagcagggtggggtctg

SEQ ID NO: 6212039 - DNA, 19 bp, Homo sapiens
gagcagggtggggtctggg

SEQ ID NO: 6212040 - DNA, 22 bp, Homo sapiens
gagcagggtggggtctgggagg

SEQ ID NO: 6212041 - DNA, 23 bp, Homo sapiens
gagcagggtggggtctgggaggg

SEQ ID NO: 6212042 - DNA, 12 bp, Homo sapiens
gagcaggtatca

SEQ ID NO: 6212043 - DNA, 14 bp, Homo sapiens
gagcaggtctgcag

SEQ ID NO: 6212044 - DNA, 22 bp, Homo sapiens
gagcaggtctgcaggccaccag

SEQ ID NO: 6212045 - DNA, 18 bp, Homo sapiens
gagcaggtctttgggaag

SEQ ID NO: 6212046 - DNA, 21 bp, Homo sapiens
gagcaggtgactgtgctgtgc

SEQ ID NO: 6212047 - DNA, 23 bp, Homo sapiens
gagcaggtgactgtgctgtgcag

SEQ ID NO: 6212048 - DNA, 20 bp, Homo sapiens
gagcaggttccccaagggcc

SEQ ID NO: 6212049 - DNA, 22 bp, Homo sapiens
gagcaggttccccaagggccct

SEQ ID NO: 6212050 - DNA, 18 bp, Homo sapiens
gagcagtaactgtccctg

SEQ ID NO: 6212051 - DNA, 17 bp, Homo sapiens
gagcagtaatgcagcat

SEQ ID NO: 6212052 - DNA, 20 bp, Homo sapiens
gagcagtagaaaagcaggaa

SEQ ID NO: 6212053 - DNA, 23 bp, Homo sapiens
gagcagtaggatattggcatttg

SEQ ID NO: 6212054 - DNA, 21 bp, Homo sapiens
gagcagtcagagtccagtgct

SEQ ID NO: 6212055 - DNA, 16 bp, Homo sapiens
gagcagtccctgctta

SEQ ID NO: 6212056 - DNA, 19 bp, Homo sapiens
gagcagtcgcctgcctgca

SEQ ID NO: 6212057 - DNA, 23 bp, Homo sapiens
gagcagtgattctctcttctctc

SEQ ID NO: 6212058 - DNA, 14 bp, Homo sapiens
gagcagtgcaggca

SEQ ID NO: 6212059 - DNA, 17 bp, Homo sapiens
gagcagtgcaggcacag

SEQ ID NO: 6212060 - DNA, 14 bp, Homo sapiens
gagcagtggcagag

SEQ ID NO: 6212061 - DNA, 13 bp, Homo sapiens
gagcagtgggcag

SEQ ID NO: 6212062 - DNA, 19 bp, Homo sapiens
gagcagtgggcaggtggcc

SEQ ID NO: 6212063 - DNA, 14 bp, Homo sapiens
gagcagtgggccct

SEQ ID NO: 6212064 - DNA, 21 bp, Homo sapiens
gagcagtgggccctggctctg

SEQ ID NO: 6212065 - DNA, 17 bp, Homo sapiens
gagcagtgggcctggcc

SEQ ID NO: 6212066 - DNA, 12 bp, Homo sapiens
gagcagtgggga

SEQ ID NO: 6212067 - DNA, 18 bp, Homo sapiens
gagcagtgtcttccataa

SEQ ID NO: 6212068 - DNA, 19 bp, Homo sapiens
gagcagtgtcttccataat

SEQ ID NO: 6212069 - DNA, 16 bp, Homo sapiens
gagcagtgtgtctcct

SEQ ID NO: 6212070 - DNA, 18 bp, Homo sapiens
gagcagtgtgtctcctgc

SEQ ID NO: 6212071 - DNA, 19 bp, Homo sapiens
gagcagtgtgtctcctgca

SEQ ID NO: 6212072 - DNA, 14 bp, Homo sapiens
gagcagttcaataa

SEQ ID NO: 6212073 - DNA, 17 bp, Homo sapiens
gagcagttggcctgtgc

SEQ ID NO: 6212074 - DNA, 21 bp, Homo sapiens
gagcagtttctgtcctgctgg

SEQ ID NO: 6212075 - DNA, 16 bp, Homo sapiens
gagcagtttgccaccc

SEQ ID NO: 6212076 - DNA, 17 bp, Homo sapiens
gagcagtttggggcagg

SEQ ID NO: 6212077 - DNA, 22 bp, Homo sapiens
ctttttggcattatctctttct

SEQ ID NO: 6212078 - DNA, 12 bp, Homo sapiens
ctttttggcctg

SEQ ID NO: 6212079 - DNA, 17 bp, Homo sapiens
ctttttggctgacttca

SEQ ID NO: 6212080 - DNA, 23 bp, Homo sapiens
ctttttggctgacttcatctggg

SEQ ID NO: 6212081 - DNA, 20 bp, Homo sapiens
ctttttgggagagacttgtt

SEQ ID NO: 6212082 - DNA, 19 bp, Homo sapiens
ctttttggtggatgtaaat

SEQ ID NO: 6212083 - DNA, 23 bp, Homo sapiens
ctttttggtgtatagaagtttgt

SEQ ID NO: 6212084 - DNA, 17 bp, Homo sapiens
ctttttgtaaatactgc

SEQ ID NO: 6212085 - DNA, 21 bp, Homo sapiens
ctttttgtaaatactgcttga

SEQ ID NO: 6212086 - DNA, 18 bp, Homo sapiens
ctttttgtaagtgagtgt

SEQ ID NO: 6212087 - DNA, 19 bp, Homo sapiens
ctttttgtaagtgagtgtg

SEQ ID NO: 6212088 - DNA, 13 bp, Homo sapiens
ctttttgtactgt

SEQ ID NO: 6212089 - DNA, 12 bp, Homo sapiens
ctttttgtagag

SEQ ID NO: 6212090 - DNA, 18 bp, Homo sapiens
ctttttgtaggatacttg

SEQ ID NO: 6212091 - DNA, 13 bp, Homo sapiens
ctttttgtataaa

SEQ ID NO: 6212092 - DNA, 12 bp, Homo sapiens
ctttttgtatct

SEQ ID NO: 6212093 - DNA, 23 bp, Homo sapiens
ctttttgtcgagtcaaactgtgg

SEQ ID NO: 6212094 - DNA, 22 bp, Homo sapiens
ctttttgtgaaattcaacctgt

SEQ ID NO: 6212095 - DNA, 13 bp, Homo sapiens
ctttttgtgaaga

SEQ ID NO: 6212096 - DNA, 15 bp, Homo sapiens
ctttttgtgtttttt

SEQ ID NO: 6212097 - DNA, 23 bp, Homo sapiens
ctttttgttaacagacactgtaa

SEQ ID NO: 6212098 - DNA, 17 bp, Homo sapiens
ctttttgttccagagct

SEQ ID NO: 6212099 - DNA, 16 bp, Homo sapiens
ctttttgttccctcat

SEQ ID NO: 6212100 - DNA, 21 bp, Homo sapiens
ctttttgttctggtccttttt

SEQ ID NO: 6212101 - DNA, 17 bp, Homo sapiens
ctttttgttgtaaaaca

SEQ ID NO: 6212102 - DNA, 18 bp, Homo sapiens
ctttttgtttttctttta

SEQ ID NO: 6212103 - DNA, 13 bp, Homo sapiens
cttttttaaacta

SEQ ID NO: 6212104 - DNA, 15 bp, Homo sapiens
cttttttaaactgta

SEQ ID NO: 6212105 - DNA, 13 bp, Homo sapiens
cttttttaaataa

SEQ ID NO: 6212106 - DNA, 15 bp, Homo sapiens
cttttttaaataaac

SEQ ID NO: 6212107 - DNA, 17 bp, Homo sapiens
cttttttaaatattttc

SEQ ID NO: 6212108 - DNA, 18 bp, Homo sapiens
cttttttaaatgaagaaa

SEQ ID NO: 6212109 - DNA, 15 bp, Homo sapiens
cttttttaaattaat

SEQ ID NO: 6212110 - DNA, 16 bp, Homo sapiens
cttttttaaattaata

SEQ ID NO: 6212111 - DNA, 19 bp, Homo sapiens
cttttttaaattaatcaga

SEQ ID NO: 6212112 - DNA, 21 bp, Homo sapiens
cttttttaaccaaggaggggc

SEQ ID NO: 6212113 - DNA, 20 bp, Homo sapiens
cttttttaagatttttctca

SEQ ID NO: 6212114 - DNA, 19 bp, Homo sapiens
cttttttaattcagtacaa

SEQ ID NO: 6212115 - DNA, 17 bp, Homo sapiens
cttttttaattgaaagg

SEQ ID NO: 6212116 - DNA, 13 bp, Homo sapiens
cttttttacaaag

SEQ ID NO: 6212117 - DNA, 11 bp, Homo sapiens
cttttttactc

SEQ ID NO: 6212118 - DNA, 16 bp, Homo sapiens
cttttttagagttgat

SEQ ID NO: 6212119 - DNA, 17 bp, Homo sapiens
cttttttagctctctta

SEQ ID NO: 6212120 - DNA, 15 bp, Homo sapiens
cttttttatacacat

SEQ ID NO: 6212121 - DNA, 15 bp, Homo sapiens
cttttttatacataa

SEQ ID NO: 6212122 - DNA, 13 bp, Homo sapiens
cttttttattaat

SEQ ID NO: 6212123 - DNA, 21 bp, Homo sapiens
cttttttattaatcactgtgt

SEQ ID NO: 6212124 - DNA, 15 bp, Homo sapiens
cttttttattaccag

SEQ ID NO: 6212125 - DNA, 14 bp, Homo sapiens
cttttttatttacc

SEQ ID NO: 6212126 - DNA, 18 bp, Homo sapiens
cttttttattttttatac

SEQ ID NO: 6212127 - DNA, 16 bp, Homo sapiens
cttttttcaaaagaaa

SEQ ID NO: 6212128 - DNA, 14 bp, Homo sapiens
cttttttcaaaatc

SEQ ID NO: 6212129 - DNA, 14 bp, Homo sapiens
cttttttcaaaatt

SEQ ID NO: 6212130 - DNA, 18 bp, Homo sapiens
cttttttcaaaattcaaa

SEQ ID NO: 6212131 - DNA, 16 bp, Homo sapiens
cttttttcaaatattg

SEQ ID NO: 6212132 - DNA, 19 bp, Homo sapiens
cttttttcaaatattgaat

SEQ ID NO: 6212133 - DNA, 21 bp, Homo sapiens
cttttttcaaatattgaatgc

SEQ ID NO: 6212134 - DNA, 22 bp, Homo sapiens
cttttttcaatgtactgtattg

SEQ ID NO: 6212135 - DNA, 21 bp, Homo sapiens
cttttttcacggaagttttca

SEQ ID NO: 6212136 - DNA, 12 bp, Homo sapiens
cttttttcagtt

SEQ ID NO: 6212137 - DNA, 13 bp, Homo sapiens
cttttttcagtta

SEQ ID NO: 6212138 - DNA, 22 bp, Homo sapiens
cttttttcccataagacaatga

SEQ ID NO: 6212139 - DNA, 18 bp, Homo sapiens
cttttttcctcctttctc

SEQ ID NO: 6212140 - DNA, 21 bp, Homo sapiens
cttttttcctcctttctctgt

SEQ ID NO: 6212141 - DNA, 17 bp, Homo sapiens
cttttttcctgtcaata

SEQ ID NO: 6212142 - DNA, 13 bp, Homo sapiens
cttttttctctct

SEQ ID NO: 6212143 - DNA, 20 bp, Homo sapiens
cttttttctctgatacagaa

SEQ ID NO: 6212144 - DNA, 16 bp, Homo sapiens
cttttttctcttctgt

SEQ ID NO: 6212145 - DNA, 14 bp, Homo sapiens
cttttttctgcctc

SEQ ID NO: 6212146 - DNA, 16 bp, Homo sapiens
cttttttctgcctcct

SEQ ID NO: 6212147 - DNA, 12 bp, Homo sapiens
cttttttcttcc

SEQ ID NO: 6212148 - DNA, 16 bp, Homo sapiens
cttttttctttaagat

SEQ ID NO: 6212149 - DNA, 14 bp, Homo sapiens
cttttttcttttct

SEQ ID NO: 6212150 - DNA, 17 bp, Homo sapiens
cttttttgagtcattga

SEQ ID NO: 6212151 - DNA, 16 bp, Homo sapiens
cttttttggccatctg

SEQ ID NO: 6212152 - DNA, 17 bp, Homo sapiens
cttttttggctgctgaa

SEQ ID NO: 6212153 - DNA, 16 bp, Homo sapiens
cttttttgtacagtat

SEQ ID NO: 6212154 - DNA, 19 bp, Homo sapiens
cttttttgtacttttctgg

SEQ ID NO: 6212155 - DNA, 14 bp, Homo sapiens
cttttttgtctatg

SEQ ID NO: 6212156 - DNA, 23 bp, Homo sapiens
cttttttgtctatgaagttgctg

SEQ ID NO: 6212157 - DNA, 12 bp, Homo sapiens
cttttttgtgta

SEQ ID NO: 6212158 - DNA, 13 bp, Homo sapiens
cttttttgtgtat

SEQ ID NO: 6212159 - DNA, 17 bp, Homo sapiens
cttttttgtgtatgtac

SEQ ID NO: 6212160 - DNA, 20 bp, Homo sapiens
cttttttgtgtttttaaaag

SEQ ID NO: 6212161 - DNA, 22 bp, Homo sapiens
cttttttgtttgtttctttgtg

SEQ ID NO: 6212162 - DNA, 22 bp, Homo sapiens
cttttttgttttttcaaaatag

SEQ ID NO: 6212163 - DNA, 15 bp, Homo sapiens
ctttttttaagtgct

SEQ ID NO: 6212164 - DNA, 14 bp, Homo sapiens
ctttttttaagtgt

SEQ ID NO: 6212165 - DNA, 22 bp, Homo sapiens
ctttttttaagtgttctgtggc

SEQ ID NO: 6212166 - DNA, 20 bp, Homo sapiens
ctttttttattactagtgtt

SEQ ID NO: 6212167 - DNA, 14 bp, Homo sapiens
ctttttttcaatgt

SEQ ID NO: 6212168 - DNA, 21 bp, Homo sapiens
ctttttttccttcctttttat

SEQ ID NO: 6212169 - DNA, 14 bp, Homo sapiens
ctttttttctctcc

SEQ ID NO: 6212170 - DNA, 16 bp, Homo sapiens
ctttttttctgtacca

SEQ ID NO: 6212171 - DNA, 20 bp, Homo sapiens
ctttttttctgtaccagtta

SEQ ID NO: 6212172 - DNA, 15 bp, Homo sapiens
ctttttttcttgcta

SEQ ID NO: 6212173 - DNA, 13 bp, Homo sapiens
ctttttttgaaac

SEQ ID NO: 6212174 - DNA, 16 bp, Homo sapiens
ctttttttgagaagga

SEQ ID NO: 6212175 - DNA, 22 bp, Homo sapiens
ctttttttgagcgacatctctg

SEQ ID NO: 6212176 - DNA, 17 bp, Homo sapiens
ctttttttgcatattaa

SEQ ID NO: 6212177 - DNA, 15 bp, Homo sapiens
ctttttttggggtgc

SEQ ID NO: 6212178 - DNA, 12 bp, Homo sapiens
ctttttttgtat

SEQ ID NO: 6212179 - DNA, 13 bp, Homo sapiens
ctttttttgtata

SEQ ID NO: 6212180 - DNA, 17 bp, Homo sapiens
ctttttttgtatgtgtg

SEQ ID NO: 6212181 - DNA, 14 bp, Homo sapiens
ctttttttgttata

SEQ ID NO: 6212182 - DNA, 15 bp, Homo sapiens
cttttttttaataag

SEQ ID NO: 6212183 - DNA, 18 bp, Homo sapiens
cttttttttaatgtgctg

SEQ ID NO: 6212184 - DNA, 23 bp, Homo sapiens
cttttttttacggaattccaata

SEQ ID NO: 6212185 - DNA, 19 bp, Homo sapiens
cttttttttacttatatat

SEQ ID NO: 6212186 - DNA, 19 bp, Homo sapiens
cttttttttatataaatat

SEQ ID NO: 6212187 - DNA, 15 bp, Homo sapiens
cttttttttcatcct

SEQ ID NO: 6212188 - DNA, 13 bp, Homo sapiens
cttttttttcatg

SEQ ID NO: 6212189 - DNA, 12 bp, Homo sapiens
cttttttttcct

SEQ ID NO: 6212190 - DNA, 13 bp, Homo sapiens
cttttttttccta

SEQ ID NO: 6212191 - DNA, 17 bp, Homo sapiens
cttttttttctatttca

SEQ ID NO: 6212192 - DNA, 17 bp, Homo sapiens
cttttttttctctcttt

SEQ ID NO: 6212193 - DNA, 17 bp, Homo sapiens
cttttttttcttcacct

SEQ ID NO: 6212194 - DNA, 15 bp, Homo sapiens
ctttttttttctctt

SEQ ID NO: 6212195 - DNA, 22 bp, Homo sapiens
ctttttttttctctttctctcc

SEQ ID NO: 6212196 - DNA, 19 bp, Homo sapiens
ctttttttttctttttcca

SEQ ID NO: 6212197 - DNA, 18 bp, Homo sapiens
ctttttttttgttttgtt

SEQ ID NO: 6212198 - DNA, 15 bp, Homo sapiens
cttttttttttaagt

SEQ ID NO: 6212199 - DNA, 15 bp, Homo sapiens
cttttttttttccaa

SEQ ID NO: 6212200 - DNA, 19 bp, Homo sapiens
cttttttttttctgttgaa

SEQ ID NO: 6212201 - DNA, 18 bp, Homo sapiens
ctttttttttttctgcct

SEQ ID NO: 6212202 - DNA, 19 bp, Homo sapiens
ctttttttttttctgcctg

SEQ ID NO: 6212203 - DNA, 23 bp, Homo sapiens
ctttttttttttgtttgatgcag

SEQ ID NO: 6212204 - DNA, 23 bp, Homo sapiens
ctttttttttttttaaagacaga

SEQ ID NO: 6212205 - DNA, 22 bp, Homo sapiens
ctttttttttttttataaaagc

SEQ ID NO: 6212206 - DNA, 16 bp, Homo sapiens
ctttttttttttttcc

SEQ ID NO: 6212207 - DNA, 20 bp, Homo sapiens
ctttttttttttttttaatg

SEQ ID NO: 6212208 - DNA, 21 bp, Homo sapiens
ctttttttttttttttgaaag

SEQ ID NO: 6212209 - DNA, 19 bp, Homo sapiens
ctttttttttttttttgag

SEQ ID NO: 6212210 - DNA, 21 bp, Homo sapiens
ctttttttttttttttgtgta

SEQ ID NO: 6212211 - DNA, 22 bp, Homo sapiens
ctttttttttttttttttaatt

SEQ ID NO: 6212212 - DNA, 21 bp, Homo sapiens
gaaaaaaaaaaaagaggaaaa

SEQ ID NO: 6212213 - DNA, 14 bp, Homo sapiens
gaaaaaaaaaaaca

SEQ ID NO: 6212214 - DNA, 15 bp, Homo sapiens
gaaaaaaaaaaacac

SEQ ID NO: 6212215 - DNA, 17 bp, Homo sapiens
gaaaaaaaaaaagaaaa

SEQ ID NO: 6212216 - DNA, 18 bp, Homo sapiens
gaaaaaaaaaaagaaaaa

SEQ ID NO: 6212217 - DNA, 19 bp, Homo sapiens
gaaaaaaaaaaagaaagaa

SEQ ID NO: 6212218 - DNA, 20 bp, Homo sapiens
gaaaaaaaaaaagaagaaga

SEQ ID NO: 6212219 - DNA, 15 bp, Homo sapiens
gaaaaaaaaaacact

SEQ ID NO: 6212220 - DNA, 16 bp, Homo sapiens
gaaaaaaaaaagaaga

SEQ ID NO: 6212221 - DNA, 17 bp, Homo sapiens
gaaaaaaaaaagaagaa

SEQ ID NO: 6212222 - DNA, 13 bp, Homo sapiens
gaaaaaaaaaagt

SEQ ID NO: 6212223 - DNA, 22 bp, Homo sapiens
gaaaaaaaaaataaaactctca

SEQ ID NO: 6212224 - DNA, 15 bp, Homo sapiens
gaaaaaaaaacagct

SEQ ID NO: 6212225 - DNA, 16 bp, Homo sapiens
gaaaaaaaaagaaaaa

SEQ ID NO: 6212226 - DNA, 17 bp, Homo sapiens
gaaaaaaaaagaaatct

SEQ ID NO: 6212227 - DNA, 14 bp, Homo sapiens
gaaaaaaaaagcaa

SEQ ID NO: 6212228 - DNA, 16 bp, Homo sapiens
gaaaaaaaaagcaaat

SEQ ID NO: 6212229 - DNA, 13 bp, Homo sapiens
gaaaaaaaaaggg

SEQ ID NO: 6212230 - DNA, 19 bp, Homo sapiens
gaaaaaaaaagtgaaaaaa

SEQ ID NO: 6212231 - DNA, 13 bp, Homo sapiens
gaaaaaaaaataa

SEQ ID NO: 6212232 - DNA, 15 bp, Homo sapiens
gaaaaaaaaatactt

SEQ ID NO: 6212233 - DNA, 14 bp, Homo sapiens
gaaaaaaaaatgcc

SEQ ID NO: 6212234 - DNA, 18 bp, Homo sapiens
gaaaaaaaaattcacatg

SEQ ID NO: 6212235 - DNA, 18 bp, Homo sapiens
gaaaaaaaacctgagatt

SEQ ID NO: 6212236 - DNA, 13 bp, Homo sapiens
gaaaaaaaacctt

SEQ ID NO: 6212237 - DNA, 19 bp, Homo sapiens
gaaaaaaaactgaagatga

SEQ ID NO: 6212238 - DNA, 12 bp, Homo sapiens
gaaaaaaaagaa

SEQ ID NO: 6212239 - DNA, 16 bp, Homo sapiens
gaaaaaaaagaaaaaa

SEQ ID NO: 6212240 - DNA, 15 bp, Homo sapiens
gaaaaaaaagaaagc

SEQ ID NO: 6212241 - DNA, 22 bp, Homo sapiens
gaaaaaaaagtttcagagaagt

SEQ ID NO: 6212242 - DNA, 20 bp, Homo sapiens
gaaaaaaaataacacagaga

SEQ ID NO: 6212243 - DNA, 19 bp, Homo sapiens
gaaaaaaaatagatgtttt

SEQ ID NO: 6212244 - DNA, 23 bp, Homo sapiens
gaaaaaaaatatatatatatatt

SEQ ID NO: 6212245 - DNA, 21 bp, Homo sapiens
gaaaaaaaccacacaaagaca

SEQ ID NO: 6212246 - DNA, 17 bp, Homo sapiens
gaaaaaaactgggataa

SEQ ID NO: 6212247 - DNA, 14 bp, Homo sapiens
gaaaaaaacttcat

SEQ ID NO: 6212248 - DNA, 18 bp, Homo sapiens
gaaaaaaacttggcactt

SEQ ID NO: 6212249 - DNA, 14 bp, Homo sapiens
gaaaaaaactttta

SEQ ID NO: 6212250 - DNA, 17 bp, Homo sapiens
gaaaaaaacttttataa

SEQ ID NO: 6212251 - DNA, 16 bp, Homo sapiens
gaaaaaaagaaaaaaa

SEQ ID NO: 6212252 - DNA, 13 bp, Homo sapiens
gaaaaaaagaaac

SEQ ID NO: 6212253 - DNA, 14 bp, Homo sapiens
gaaaaaaagaaacg

SEQ ID NO: 6212254 - DNA, 22 bp, Homo sapiens
gaaaaaaagaatgagtaatgtg

SEQ ID NO: 6212255 - DNA, 14 bp, Homo sapiens
gaaaaaaagcaaaa

SEQ ID NO: 6212256 - DNA, 18 bp, Homo sapiens
gaaaaaaagctgcaaaaa

SEQ ID NO: 6212257 - DNA, 17 bp, Homo sapiens
gagcagttttccaggag

SEQ ID NO: 6212258 - DNA, 21 bp, Homo sapiens
gagcagttttccaggaggccg

SEQ ID NO: 6212259 - DNA, 17 bp, Homo sapiens
gagcagttttcccctgg

SEQ ID NO: 6212260 - DNA, 18 bp, Homo sapiens
gagcagttttcccctggc

SEQ ID NO: 6212261 - DNA, 19 bp, Homo sapiens
gagcagttttcccctggcc

SEQ ID NO: 6212262 - DNA, 22 bp, Homo sapiens
gagcagttttcccctggcctca

SEQ ID NO: 6212263 - DNA, 15 bp, Homo sapiens
gagcataatgctccc

SEQ ID NO: 6212264 - DNA, 14 bp, Homo sapiens
gagcatagaagcca

SEQ ID NO: 6212265 - DNA, 15 bp, Homo sapiens
gagcatagaagccac

SEQ ID NO: 6212266 - DNA, 14 bp, Homo sapiens
gagcatagagaaca

SEQ ID NO: 6212267 - DNA, 19 bp, Homo sapiens
gagcatagcagaggggcca

SEQ ID NO: 6212268 - DNA, 23 bp, Homo sapiens
gagcatagcagaggggccaggcc

SEQ ID NO: 6212269 - DNA, 18 bp, Homo sapiens
gagcataggaggggtctg

SEQ ID NO: 6212270 - DNA, 22 bp, Homo sapiens
gagcataggtgatccatgtaac

SEQ ID NO: 6212271 - DNA, 18 bp, Homo sapiens
gagcatatgttccatgcc

SEQ ID NO: 6212272 - DNA, 21 bp, Homo sapiens
gagcatatttgccaataaagc

SEQ ID NO: 6212273 - DNA, 13 bp, Homo sapiens
gagcatcaatctt

SEQ ID NO: 6212274 - DNA, 15 bp, Homo sapiens
gagcatcaatcttgt

SEQ ID NO: 6212275 - DNA, 22 bp, Homo sapiens
gagcatcatccttagaaatcag

SEQ ID NO: 6212276 - DNA, 13 bp, Homo sapiens
gagcatcatgcct

SEQ ID NO: 6212277 - DNA, 16 bp, Homo sapiens
gagcatcatgcctctg

SEQ ID NO: 6212278 - DNA, 19 bp, Homo sapiens
gagcatcatgcctctgagg

SEQ ID NO: 6212279 - DNA, 22 bp, Homo sapiens
gagcatcatgcctctgaggcca

SEQ ID NO: 6212280 - DNA, 17 bp, Homo sapiens
gagcatccagacctgag

SEQ ID NO: 6212281 - DNA, 23 bp, Homo sapiens
gagcatccccctcctctccctgt

SEQ ID NO: 6212282 - DNA, 21 bp, Homo sapiens
gagcatccggccaaatgcaaa

SEQ ID NO: 6212283 - DNA, 14 bp, Homo sapiens
gagcatcctgagcc

SEQ ID NO: 6212284 - DNA, 14 bp, Homo sapiens
gagcatcctggcag

SEQ ID NO: 6212285 - DNA, 19 bp, Homo sapiens
gagcatcgtgacccttcag

SEQ ID NO: 6212286 - DNA, 18 bp, Homo sapiens
gagcatctcaaatgtttt

SEQ ID NO: 6212287 - DNA, 16 bp, Homo sapiens
gagcatctcaggaggg

SEQ ID NO: 6212288 - DNA, 18 bp, Homo sapiens
gagcatctcttgaggcca

SEQ ID NO: 6212289 - DNA, 23 bp, Homo sapiens
gagcatctcttgaggccaggagt

SEQ ID NO: 6212290 - DNA, 18 bp, Homo sapiens
gagcatctgccccaggta

SEQ ID NO: 6212291 - DNA, 17 bp, Homo sapiens
gagcatctgctctgaga

SEQ ID NO: 6212292 - DNA, 13 bp, Homo sapiens
gagcatctgtccc

SEQ ID NO: 6212293 - DNA, 17 bp, Homo sapiens
gagcatcttgccagcct

SEQ ID NO: 6212294 - DNA, 17 bp, Homo sapiens
gagcatgaaatttttaa

SEQ ID NO: 6212295 - DNA, 17 bp, Homo sapiens
gagcatgacagcctgca

SEQ ID NO: 6212296 - DNA, 17 bp, Homo sapiens
gagcatgagaggaggca

SEQ ID NO: 6212297 - DNA, 16 bp, Homo sapiens
gagcatgatgggaggt

SEQ ID NO: 6212298 - DNA, 22 bp, Homo sapiens
gagcatgatgggaggtgtgcca

SEQ ID NO: 6212299 - DNA, 16 bp, Homo sapiens
gagcatgcacactgag

SEQ ID NO: 6212300 - DNA, 20 bp, Homo sapiens
gagcatgcacactgagaatg

SEQ ID NO: 6212301 - DNA, 15 bp, Homo sapiens
gagcatgcacagctg

SEQ ID NO: 6212302 - DNA, 17 bp, Homo sapiens
gagcatgcacagctgct

SEQ ID NO: 6212303 - DNA, 23 bp, Homo sapiens
gagcatgcccaaatataacatga

SEQ ID NO: 6212304 - DNA, 21 bp, Homo sapiens
gagcatgcctggatggggctg

SEQ ID NO: 6212305 - DNA, 17 bp, Homo sapiens
gagcatgcttccctgca

SEQ ID NO: 6212306 - DNA, 19 bp, Homo sapiens
gagcatgcttccctgcagc

SEQ ID NO: 6212307 - DNA, 17 bp, Homo sapiens
gagcatggagacagcag

SEQ ID NO: 6212308 - DNA, 14 bp, Homo sapiens
gagcatggagctgg

SEQ ID NO: 6212309 - DNA, 17 bp, Homo sapiens
gagcatggagctggccg

SEQ ID NO: 6212310 - DNA, 21 bp, Homo sapiens
gagcatggagctgtcacctct

SEQ ID NO: 6212311 - DNA, 20 bp, Homo sapiens
gagcatggatgcatttcaaa

SEQ ID NO: 6212312 - DNA, 21 bp, Homo sapiens
gagcatggatgcatttcaaat

SEQ ID NO: 6212313 - DNA, 21 bp, Homo sapiens
gagcatggccgcaacttccca

SEQ ID NO: 6212314 - DNA, 16 bp, Homo sapiens
gagcatggctgtgagg

SEQ ID NO: 6212315 - DNA, 21 bp, Homo sapiens
gagcatggctgtgaggatggg

SEQ ID NO: 6212316 - DNA, 15 bp, Homo sapiens
gagcatgggcctggc

SEQ ID NO: 6212317 - DNA, 22 bp, Homo sapiens
gagcatggggataaaggagaag

SEQ ID NO: 6212318 - DNA, 15 bp, Homo sapiens
gagcatggggccagg

SEQ ID NO: 6212319 - DNA, 19 bp, Homo sapiens
gagcatgggggctgccagc

SEQ ID NO: 6212320 - DNA, 16 bp, Homo sapiens
gagcatggtgttttca

SEQ ID NO: 6212321 - DNA, 20 bp, Homo sapiens
gagcatgttgttttttcata

SEQ ID NO: 6212322 - DNA, 22 bp, Homo sapiens
gagcatgtttagactttaacat

SEQ ID NO: 6212323 - DNA, 20 bp, Homo sapiens
gagcattaactaaatgctca

SEQ ID NO: 6212324 - DNA, 16 bp, Homo sapiens
gagcattaagcccaat

SEQ ID NO: 6212325 - DNA, 18 bp, Homo sapiens
gagcattacgtgagccag

SEQ ID NO: 6212326 - DNA, 18 bp, Homo sapiens
gagcattagaatggagga

SEQ ID NO: 6212327 - DNA, 23 bp, Homo sapiens
gagcattataatcaccagggcca

SEQ ID NO: 6212328 - DNA, 13 bp, Homo sapiens
gagcattccagta

SEQ ID NO: 6212329 - DNA, 16 bp, Homo sapiens
gagcattctgcctgcc

SEQ ID NO: 6212330 - DNA, 20 bp, Homo sapiens
gagcattctgcctgcctggg

SEQ ID NO: 6212331 - DNA, 22 bp, Homo sapiens
gagcattctgcctgcctgggaa

SEQ ID NO: 6212332 - DNA, 19 bp, Homo sapiens
gagcattctggggtggggc

SEQ ID NO: 6212333 - DNA, 24 bp, Homo sapiens
gagcattgcagcctaagaagaagg

SEQ ID NO: 6212334 - DNA, 22 bp, Homo sapiens
gagcattgcttttgtttcttaa

SEQ ID NO: 6212335 - DNA, 15 bp, Homo sapiens
gagcattggcccctg

SEQ ID NO: 6212336 - DNA, 17 bp, Homo sapiens
gagcatttaatggcagc

SEQ ID NO: 6212337 - DNA, 17 bp, Homo sapiens
gagcatttagggcaagg

SEQ ID NO: 6212338 - DNA, 15 bp, Homo sapiens
gagcatttatgtaga

SEQ ID NO: 6212339 - DNA, 17 bp, Homo sapiens
gagcatttccctcccgg

SEQ ID NO: 6212340 - DNA, 23 bp, Homo sapiens
gagcatttccctcccgggagagg

SEQ ID NO: 6212341 - DNA, 15 bp, Homo sapiens
gagcatttctcatca

SEQ ID NO: 6212342 - DNA, 15 bp, Homo sapiens
gagcatttttaaggg

SEQ ID NO: 6212343 - DNA, 16 bp, Homo sapiens
gagcatttttaaggga

SEQ ID NO: 6212344 - DNA, 17 bp, Homo sapiens
gagcattttttatgata

SEQ ID NO: 6212345 - DNA, 19 bp, Homo sapiens
gagcatttttttattcagc

SEQ ID NO: 6212346 - DNA, 23 bp, Homo sapiens
gagccaaacacactgtaaatatc

SEQ ID NO: 6212347 - DNA, 19 bp, Homo sapiens
gagccaaaccagcagggag

SEQ ID NO: 6212348 - DNA, 14 bp, Homo sapiens
gagccaaagagaat

SEQ ID NO: 6212349 - DNA, 14 bp, Homo sapiens
gagccaaattttat

SEQ ID NO: 6212350 - DNA, 15 bp, Homo sapiens
gagccaacctggact

SEQ ID NO: 6212351 - DNA, 22 bp, Homo sapiens
gagccaaccttgctcttgggga

SEQ ID NO: 6212352 - DNA, 20 bp, Homo sapiens
gagccaactctaacaggcac

SEQ ID NO: 6212353 - DNA, 17 bp, Homo sapiens
gagccaactgattttgt

SEQ ID NO: 6212354 - DNA, 15 bp, Homo sapiens
gagccaactgctgct

SEQ ID NO: 6212355 - DNA, 13 bp, Homo sapiens
gagccaagacgga

SEQ ID NO: 6212356 - DNA, 21 bp, Homo sapiens
gagccaagatcgcgccactgc

SEQ ID NO: 6212357 - DNA, 17 bp, Homo sapiens
gagccaagcactgctca

SEQ ID NO: 6212358 - DNA, 18 bp, Homo sapiens
gagccaagcactgctcac

SEQ ID NO: 6212359 - DNA, 22 bp, Homo sapiens
gagccaagctgcacaatttaat

SEQ ID NO: 6212360 - DNA, 13 bp, Homo sapiens
gagccaaggacag

SEQ ID NO: 6212361 - DNA, 15 bp, Homo sapiens
gagccaaggacaggg

SEQ ID NO: 6212362 - DNA, 24 bp, Homo sapiens
gagccaaggacagggctggctcct

SEQ ID NO: 6212363 - DNA, 14 bp, Homo sapiens
gagccaagggaggg

SEQ ID NO: 6212364 - DNA, 16 bp, Homo sapiens
gagccaagggagggaa

SEQ ID NO: 6212365 - DNA, 17 bp, Homo sapiens
gagccaagggagggaag

SEQ ID NO: 6212366 - DNA, 19 bp, Homo sapiens
gagccaagggagggaaggg

SEQ ID NO: 6212367 - DNA, 22 bp, Homo sapiens
gagccaagggagggaagggcca

SEQ ID NO: 6212368 - DNA, 14 bp, Homo sapiens
gagccaagggatgg

SEQ ID NO: 6212369 - DNA, 18 bp, Homo sapiens
gagccaagggatggacat

SEQ ID NO: 6212370 - DNA, 22 bp, Homo sapiens
gagccaagggatggacatcttg

SEQ ID NO: 6212371 - DNA, 22 bp, Homo sapiens
gagccaaggggtctgctcctgt

SEQ ID NO: 6212372 - DNA, 16 bp, Homo sapiens
gagccaagtggtccag

SEQ ID NO: 6212373 - DNA, 18 bp, Homo sapiens
gagccaataaacctgtaa

SEQ ID NO: 6212374 - DNA, 20 bp, Homo sapiens
gagccaataaagctcacact

SEQ ID NO: 6212375 - DNA, 21 bp, Homo sapiens
gagccaataaagctcacactt

SEQ ID NO: 6212376 - DNA, 22 bp, Homo sapiens
gagccaatactgagtgcctgca

SEQ ID NO: 6212377 - DNA, 15 bp, Homo sapiens
gagccaatagactga

SEQ ID NO: 6212378 - DNA, 20 bp, Homo sapiens
gagccaatggtgagggctga

SEQ ID NO: 6212379 - DNA, 20 bp, Homo sapiens
gagccaatgttttccaccca

SEQ ID NO: 6212380 - DNA, 19 bp, Homo sapiens
gagccaatttaaagaaaac

SEQ ID NO: 6212381 - DNA, 13 bp, Homo sapiens
gagccacaagctg

SEQ ID NO: 6212382 - DNA, 16 bp, Homo sapiens
gagccacaagctgcac

SEQ ID NO: 6212383 - DNA, 20 bp, Homo sapiens
gagccacaagctgcactgtg

SEQ ID NO: 6212384 - DNA, 21 bp, Homo sapiens
gagccacaagctgcactgtga

SEQ ID NO: 6212385 - DNA, 18 bp, Homo sapiens
gagccacacatgggcatc

SEQ ID NO: 6212386 - DNA, 16 bp, Homo sapiens
gagccacagaccacct

SEQ ID NO: 6212387 - DNA, 19 bp, Homo sapiens
gagccacagaccacctgct

SEQ ID NO: 6212388 - DNA, 14 bp, Homo sapiens
gagccacagcactc

SEQ ID NO: 6212389 - DNA, 21 bp, Homo sapiens
gagccacaggaacggccctgc

SEQ ID NO: 6212390 - DNA, 22 bp, Homo sapiens
gagccacaggcaggggtgagag

SEQ ID NO: 6212391 - DNA, 18 bp, Homo sapiens
gagccacagggtctgcct

SEQ ID NO: 6212392 - DNA, 19 bp, Homo sapiens
gagccacagggtctgcctc

SEQ ID NO: 6212393 - DNA, 20 bp, Homo sapiens
gagccacagggtctgcctcc

SEQ ID NO: 6212394 - DNA, 19 bp, Homo sapiens
gagccacagtgcctggccc

SEQ ID NO: 6212395 - DNA, 18 bp, Homo sapiens
gagccacagtggggccca

SEQ ID NO: 6212396 - DNA, 24 bp, Homo sapiens
gagccacagtggggcccatggccc

SEQ ID NO: 6212397 - DNA, 22 bp, Homo sapiens
gagccaccacacccagcctctg

SEQ ID NO: 6212398 - DNA, 23 bp, Homo sapiens
gagccaccacacctggctaattt

SEQ ID NO: 6212399 - DNA, 15 bp, Homo sapiens
gagccaccactcctg

SEQ ID NO: 6212400 - DNA, 17 bp, Homo sapiens
gagccaccactcctgcc

SEQ ID NO: 6212401 - DNA, 20 bp, Homo sapiens
gagccaccactcctgcctgc

SEQ ID NO: 6212402 - DNA, 14 bp, Homo sapiens
gagccaccagcccc

SEQ ID NO: 6212403 - DNA, 12 bp, Homo sapiens
gagccaccagtt

SEQ ID NO: 6212404 - DNA, 19 bp, Homo sapiens
gagccaccatgcccagctc

SEQ ID NO: 6212405 - DNA, 18 bp, Homo sapiens
gagccacccaggccactg

SEQ ID NO: 6212406 - DNA, 13 bp, Homo sapiens
gagccaccccatg

SEQ ID NO: 6212407 - DNA, 19 bp, Homo sapiens
gagccaccgcgcccagccc

SEQ ID NO: 6212408 - DNA, 16 bp, Homo sapiens
gagccaccgcgcctgg

SEQ ID NO: 6212409 - DNA, 15 bp, Homo sapiens
gagccaccgctgcca

SEQ ID NO: 6212410 - DNA, 16 bp, Homo sapiens
gagccaccgtgcctgg

SEQ ID NO: 6212411 - DNA, 12 bp, Homo sapiens
gagccacctgca

SEQ ID NO: 6212412 - DNA, 22 bp, Homo sapiens
gagccacctgggctgggagaag

SEQ ID NO: 6212413 - DNA, 13 bp, Homo sapiens
gagccacctgtcc

SEQ ID NO: 6212414 - DNA, 19 bp, Homo sapiens
gagccacgcagtgcctgga

SEQ ID NO: 6212415 - DNA, 18 bp, Homo sapiens
gagccacgcctatgccct

SEQ ID NO: 6212416 - DNA, 14 bp, Homo sapiens
gagccactaactag

SEQ ID NO: 6212417 - DNA, 17 bp, Homo sapiens
gagccactacctttgtc

SEQ ID NO: 6212418 - DNA, 14 bp, Homo sapiens
gagccactcctctg

SEQ ID NO: 6212419 - DNA, 15 bp, Homo sapiens
gagccactcctctga

SEQ ID NO: 6212420 - DNA, 16 bp, Homo sapiens
gagccactcctgtccc

SEQ ID NO: 6212421 - DNA, 17 bp, Homo sapiens
gagccactcctgtcccg

SEQ ID NO: 6212422 - DNA, 13 bp, Homo sapiens
gagccactccttc

SEQ ID NO: 6212423 - DNA, 21 bp, Homo sapiens
gagccactccttccttcagga

SEQ ID NO: 6212424 - DNA, 13 bp, Homo sapiens
gagccactgcacc

SEQ ID NO: 6212425 - DNA, 16 bp, Homo sapiens
gagccactgcgcccag

SEQ ID NO: 6212426 - DNA, 20 bp, Homo sapiens
gagccactgcgcccggccca

SEQ ID NO: 6212427 - DNA, 14 bp, Homo sapiens
gagccactgggccc

SEQ ID NO: 6212428 - DNA, 14 bp, Homo sapiens
gagccactggggtg

SEQ ID NO: 6212429 - DNA, 16 bp, Homo sapiens
gagccactggggtggg

SEQ ID NO: 6212430 - DNA, 20 bp, Homo sapiens
gagccactttcaagctgcac

SEQ ID NO: 6212431 - DNA, 21 bp, Homo sapiens
gagccactttcaagctgcact

SEQ ID NO: 6212432 - DNA, 16 bp, Homo sapiens
gagccagaaatgggca

SEQ ID NO: 6212433 - DNA, 17 bp, Homo sapiens
gagccagaaatgggcag

SEQ ID NO: 6212434 - DNA, 19 bp, Homo sapiens
gaaaaaaagggaaaacaaa

SEQ ID NO: 6212435 - DNA, 21 bp, Homo sapiens
gaaaaaaagggaaaacaaata

SEQ ID NO: 6212436 - DNA, 17 bp, Homo sapiens
gaaaaaaagggagaata

SEQ ID NO: 6212437 - DNA, 19 bp, Homo sapiens
gaaaaaaagggcactctga

SEQ ID NO: 6212438 - DNA, 22 bp, Homo sapiens
gaaaaaaaggttaacagtaaaa

SEQ ID NO: 6212439 - DNA, 14 bp, Homo sapiens
gaaaaaaagtgctg

SEQ ID NO: 6212440 - DNA, 17 bp, Homo sapiens
gaaaaaaagtttctatt

SEQ ID NO: 6212441 - DNA, 16 bp, Homo sapiens
gaaaaaaataactatt

SEQ ID NO: 6212442 - DNA, 18 bp, Homo sapiens
gaaaaaaataactatttt

SEQ ID NO: 6212443 - DNA, 18 bp, Homo sapiens
gaaaaaaataattttaaa

SEQ ID NO: 6212444 - DNA, 23 bp, Homo sapiens
gaaaaaaataattttatgaactg

SEQ ID NO: 6212445 - DNA, 14 bp, Homo sapiens
gaaaaaaatactat

SEQ ID NO: 6212446 - DNA, 16 bp, Homo sapiens
gaaaaaaatatatttt

SEQ ID NO: 6212447 - DNA, 13 bp, Homo sapiens
gaaaaaaatcttc

SEQ ID NO: 6212448 - DNA, 22 bp, Homo sapiens
gaaaaaaatcttctccagattt

SEQ ID NO: 6212449 - DNA, 13 bp, Homo sapiens
gaaaaaaatgtat

SEQ ID NO: 6212450 - DNA, 20 bp, Homo sapiens
gaaaaaaatgtattttatgt

SEQ ID NO: 6212451 - DNA, 22 bp, Homo sapiens
gaaaaaaatgtcaaaagtagaa

SEQ ID NO: 6212452 - DNA, 22 bp, Homo sapiens
gaaaaaaattacaaagaaaata

SEQ ID NO: 6212453 - DNA, 19 bp, Homo sapiens
gaaaaaaattacaaggcaa

SEQ ID NO: 6212454 - DNA, 13 bp, Homo sapiens
gaaaaaaattatt

SEQ ID NO: 6212455 - DNA, 16 bp, Homo sapiens
gaaaaaaattgaaatg

SEQ ID NO: 6212456 - DNA, 21 bp, Homo sapiens
gaaaaaaccaccccattaaaa

SEQ ID NO: 6212457 - DNA, 10 bp, Homo sapiens
gaaaaaagaa

SEQ ID NO: 6212458 - DNA, 14 bp, Homo sapiens
gaaaaaagaaaaaa

SEQ ID NO: 6212459 - DNA, 15 bp, Homo sapiens
gaaaaaagaaagaaa

SEQ ID NO: 6212460 - DNA, 14 bp, Homo sapiens
gaaaaaagaaatcc

SEQ ID NO: 6212461 - DNA, 11 bp, Homo sapiens
gaaaaaagaag

SEQ ID NO: 6212462 - DNA, 18 bp, Homo sapiens
gaaaaaagagaaaagaaa

SEQ ID NO: 6212463 - DNA, 19 bp, Homo sapiens
gaaaaaagagtttaaacaa

SEQ ID NO: 6212464 - DNA, 13 bp, Homo sapiens
gaaaaaagcacat

SEQ ID NO: 6212465 - DNA, 10 bp, Homo sapiens
gaaaaaagct

SEQ ID NO: 6212466 - DNA, 13 bp, Homo sapiens
gaaaaaagctcat

SEQ ID NO: 6212467 - DNA, 11 bp, Homo sapiens
gaaaaaaggac

SEQ ID NO: 6212468 - DNA, 17 bp, Homo sapiens
gaaaaaagtccttcagt

SEQ ID NO: 6212469 - DNA, 14 bp, Homo sapiens
gaaaaaagttactg

SEQ ID NO: 6212470 - DNA, 22 bp, Homo sapiens
gaaaaaagttcaatgttcagtt

SEQ ID NO: 6212471 - DNA, 17 bp, Homo sapiens
gaaaaaagttccttcct

SEQ ID NO: 6212472 - DNA, 22 bp, Homo sapiens
gaaaaaagttgtaggcgaatca

SEQ ID NO: 6212473 - DNA, 17 bp, Homo sapiens
gaaaaaataacacacat

SEQ ID NO: 6212474 - DNA, 16 bp, Homo sapiens
gaaaaaataattattt

SEQ ID NO: 6212475 - DNA, 10 bp, Homo sapiens
gaaaaaatac

SEQ ID NO: 6212476 - DNA, 13 bp, Homo sapiens
gaaaaaatacatt

SEQ ID NO: 6212477 - DNA, 12 bp, Homo sapiens
gaaaaaatatat

SEQ ID NO: 6212478 - DNA, 12 bp, Homo sapiens
gaaaaaatattt

SEQ ID NO: 6212479 - DNA, 15 bp, Homo sapiens
gaaaaaatattttaa

SEQ ID NO: 6212480 - DNA, 19 bp, Homo sapiens
gaaaaaatattttcctgcc

SEQ ID NO: 6212481 - DNA, 19 bp, Homo sapiens
gaaaaaatggtagcatttt

SEQ ID NO: 6212482 - DNA, 22 bp, Homo sapiens
gaaaaaatggtagcattttaaa

SEQ ID NO: 6212483 - DNA, 17 bp, Homo sapiens
gaaaaaatgtagaatga

SEQ ID NO: 6212484 - DNA, 11 bp, Homo sapiens
gaaaaaattag

SEQ ID NO: 6212485 - DNA, 12 bp, Homo sapiens
gaaaaacaaaat

SEQ ID NO: 6212486 - DNA, 21 bp, Homo sapiens
gaaaaacaaactcgtttttta

SEQ ID NO: 6212487 - DNA, 19 bp, Homo sapiens
gaaaaacaacaaataattt

SEQ ID NO: 6212488 - DNA, 20 bp, Homo sapiens
gaaaaacaacaacacaataa

SEQ ID NO: 6212489 - DNA, 16 bp, Homo sapiens
gaaaaacaataaagat

SEQ ID NO: 6212490 - DNA, 22 bp, Homo sapiens
gaaaaacaataaagatacatga

SEQ ID NO: 6212491 - DNA, 15 bp, Homo sapiens
gaaaaacaattttct

SEQ ID NO: 6212492 - DNA, 20 bp, Homo sapiens
gaaaaacacatggggaaaaa

SEQ ID NO: 6212493 - DNA, 23 bp, Homo sapiens
gaaaaacaccgcttctgcctttt

SEQ ID NO: 6212494 - DNA, 17 bp, Homo sapiens
gaaaaacacggcagctg

SEQ ID NO: 6212495 - DNA, 23 bp, Homo sapiens
gaaaaacacggcagctgtagctc

SEQ ID NO: 6212496 - DNA, 17 bp, Homo sapiens
gaaaaacagaacatttc

SEQ ID NO: 6212497 - DNA, 20 bp, Homo sapiens
gaaaaacagaacatttctca

SEQ ID NO: 6212498 - DNA, 15 bp, Homo sapiens
gaaaaacagacaaaa

SEQ ID NO: 6212499 - DNA, 22 bp, Homo sapiens
gaaaaacagaggatgctgaagt

SEQ ID NO: 6212500 - DNA, 17 bp, Homo sapiens
gaaaaacagcagagtaa

SEQ ID NO: 6212501 - DNA, 18 bp, Homo sapiens
gaaaaacaggcacttggc

SEQ ID NO: 6212502 - DNA, 14 bp, Homo sapiens
gaaaaacatcccaa

SEQ ID NO: 6212503 - DNA, 21 bp, Homo sapiens
gaaaaacatcccaaactttaa

SEQ ID NO: 6212504 - DNA, 18 bp, Homo sapiens
gaaaaacatctgaaagcc

SEQ ID NO: 6212505 - DNA, 14 bp, Homo sapiens
gaaaaacatgtcat

SEQ ID NO: 6212506 - DNA, 17 bp, Homo sapiens
gaaaaacatgtcatgta

SEQ ID NO: 6212507 - DNA, 23 bp, Homo sapiens
gaaaaacatttaaactttttaaa

SEQ ID NO: 6212508 - DNA, 15 bp, Homo sapiens
gaaaaaccaatgatt

SEQ ID NO: 6212509 - DNA, 23 bp, Homo sapiens
gaaaaaccaatgattcataacaa

SEQ ID NO: 6212510 - DNA, 15 bp, Homo sapiens
gaaaaaccatttgaa

SEQ ID NO: 6212511 - DNA, 18 bp, Homo sapiens
gaaaaacccaaactgaga

SEQ ID NO: 6212512 - DNA, 22 bp, Homo sapiens
gaaaaaccgagataggggaggg

SEQ ID NO: 6212513 - DNA, 18 bp, Homo sapiens
gaaaaacgtgttgccttg

SEQ ID NO: 6212514 - DNA, 17 bp, Homo sapiens
gaaaaactaattgagcc

SEQ ID NO: 6212515 - DNA, 18 bp, Homo sapiens
gaaaaactcccatatcat

SEQ ID NO: 6212516 - DNA, 18 bp, Homo sapiens
gaaaaactgctgtaaaca

SEQ ID NO: 6212517 - DNA, 14 bp, Homo sapiens
gaaaaactggctct

SEQ ID NO: 6212518 - DNA, 20 bp, Homo sapiens
gaaaaactggctttttccca

SEQ ID NO: 6212519 - DNA, 13 bp, Homo sapiens
gaaaaactgttct

SEQ ID NO: 6212520 - DNA, 14 bp, Homo sapiens
gaaaaactttaaaa

SEQ ID NO: 6212521 - DNA, 22 bp, Homo sapiens
gaaaaactttggaaccagactc

SEQ ID NO: 6212522 - DNA, 14 bp, Homo sapiens
gaaaaagaaaataa

SEQ ID NO: 6212523 - DNA, 14 bp, Homo sapiens
gaaaaagaaatgca

SEQ ID NO: 6212524 - DNA, 19 bp, Homo sapiens
gaaaaagaacatgcagttt

SEQ ID NO: 6212525 - DNA, 12 bp, Homo sapiens
gaaaaagaagaa

SEQ ID NO: 6212526 - DNA, 13 bp, Homo sapiens
gaaaaagaagaaa

SEQ ID NO: 6212527 - DNA, 15 bp, Homo sapiens
gaaaaagaagaagga

SEQ ID NO: 6212528 - DNA, 14 bp, Homo sapiens
gaaaaagaagaatc

SEQ ID NO: 6212529 - DNA, 20 bp, Homo sapiens
gaaaaagaagctgaggaagc

SEQ ID NO: 6212530 - DNA, 18 bp, Homo sapiens
gaaaaagaatgaaaacaa

SEQ ID NO: 6212531 - DNA, 12 bp, Homo sapiens
gaaaaagacata

SEQ ID NO: 6212532 - DNA, 14 bp, Homo sapiens
gaaaaagacataaa

SEQ ID NO: 6212533 - DNA, 15 bp, Homo sapiens
gaaaaagacattcag

SEQ ID NO: 6212534 - DNA, 23 bp, Homo sapiens
gaaaaagacctcgtggagaattt

SEQ ID NO: 6212535 - DNA, 18 bp, Homo sapiens
gaaaaagacgatgtttat

SEQ ID NO: 6212536 - DNA, 20 bp, Homo sapiens
gaaaaagagaacagaaaaca

SEQ ID NO: 6212537 - DNA, 13 bp, Homo sapiens
gaaaaagagactc

SEQ ID NO: 6212538 - DNA, 16 bp, Homo sapiens
gaaaaagagagagcag

SEQ ID NO: 6212539 - DNA, 20 bp, Homo sapiens
gaaaaagagcatatactggt

SEQ ID NO: 6212540 - DNA, 22 bp, Homo sapiens
gaaaaagatattgtattatcat

SEQ ID NO: 6212541 - DNA, 23 bp, Homo sapiens
gaaaaagatattttatttctgat

SEQ ID NO: 6212542 - DNA, 20 bp, Homo sapiens
gaaaaagatctttcattttg

SEQ ID NO: 6212543 - DNA, 22 bp, Homo sapiens
gaaaaagatggcttatgtcatc

SEQ ID NO: 6212544 - DNA, 23 bp, Homo sapiens
gaaaaagatggcttatgtcatca

SEQ ID NO: 6212545 - DNA, 16 bp, Homo sapiens
gaaaaagcacagctct

SEQ ID NO: 6212546 - DNA, 22 bp, Homo sapiens
gaaaaagcagtaactgacaact

SEQ ID NO: 6212547 - DNA, 18 bp, Homo sapiens
gaaaaagcatgatgggaa

SEQ ID NO: 6212548 - DNA, 15 bp, Homo sapiens
gaaaaagcattaaaa

SEQ ID NO: 6212549 - DNA, 19 bp, Homo sapiens
gaaaaagccaaaattgtca

SEQ ID NO: 6212550 - DNA, 23 bp, Homo sapiens
gaaaaagcctaagaaaaaggaaa

SEQ ID NO: 6212551 - DNA, 13 bp, Homo sapiens
gaaaaagcgaaaa

SEQ ID NO: 6212552 - DNA, 11 bp, Homo sapiens
gaaaaagctcc

SEQ ID NO: 6212553 - DNA, 17 bp, Homo sapiens
gaaaaagctgcttctta

SEQ ID NO: 6212554 - DNA, 10 bp, Homo sapiens
gaaaaaggaa

SEQ ID NO: 6212555 - DNA, 21 bp, Homo sapiens
gaaaaaggacaggcagaaaga

SEQ ID NO: 6212556 - DNA, 23 bp, Homo sapiens
gaaaaaggacattggccccgcag

SEQ ID NO: 6212557 - DNA, 10 bp, Homo sapiens
gaaaaaggat

SEQ ID NO: 6212558 - DNA, 18 bp, Homo sapiens
gaaaaaggctgaaaagaa

SEQ ID NO: 6212559 - DNA, 15 bp, Homo sapiens
gaaaaaggctgtgct

SEQ ID NO: 6212560 - DNA, 23 bp, Homo sapiens
gaaaaagggattgaggagttgcc

SEQ ID NO: 6212561 - DNA, 12 bp, Homo sapiens
gaaaaagggtca

SEQ ID NO: 6212562 - DNA, 12 bp, Homo sapiens
gaaaaagtaact

SEQ ID NO: 6212563 - DNA, 19 bp, Homo sapiens
gaaaaagtcatccaatcta

SEQ ID NO: 6212564 - DNA, 13 bp, Homo sapiens
gaaaaagtgtttt

SEQ ID NO: 6212565 - DNA, 15 bp, Homo sapiens
gaaaaagtgttttta

SEQ ID NO: 6212566 - DNA, 20 bp, Homo sapiens
gaaaaagttaagatagcttt

SEQ ID NO: 6212567 - DNA, 14 bp, Homo sapiens
gaaaaagtttgttt

SEQ ID NO: 6212568 - DNA, 16 bp, Homo sapiens
gaaaaataaaatgttt

SEQ ID NO: 6212569 - DNA, 14 bp, Homo sapiens
gaaaaataaagaaa

SEQ ID NO: 6212570 - DNA, 19 bp, Homo sapiens
gaaaaataaagaaaagatg

SEQ ID NO: 6212571 - DNA, 20 bp, Homo sapiens
gaaaaataaatgtcactgcc

SEQ ID NO: 6212572 - DNA, 21 bp, Homo sapiens
gaaaaataaatgtcactgcca

SEQ ID NO: 6212573 - DNA, 16 bp, Homo sapiens
gaaaaataacaactat

SEQ ID NO: 6212574 - DNA, 19 bp, Homo sapiens
gaaaaataacttcaagcaa

SEQ ID NO: 6212575 - DNA, 12 bp, Homo sapiens
gaaaaatagagc

SEQ ID NO: 6212576 - DNA, 13 bp, Homo sapiens
gaaaaatagcata

SEQ ID NO: 6212577 - DNA, 17 bp, Homo sapiens
gaaaaatataaaattat

SEQ ID NO: 6212578 - DNA, 21 bp, Homo sapiens
gaaaaatataatgttgataat

SEQ ID NO: 6212579 - DNA, 10 bp, Homo sapiens
gaaaaatatg

SEQ ID NO: 6212580 - DNA, 16 bp, Homo sapiens
gaaaaatatgtaccaa

SEQ ID NO: 6212581 - DNA, 16 bp, Homo sapiens
gaaaaatatgtgaagg

SEQ ID NO: 6212582 - DNA, 21 bp, Homo sapiens
gaaaaatatgttgagtgttca

SEQ ID NO: 6212583 - DNA, 11 bp, Homo sapiens
gaaaaatatta

SEQ ID NO: 6212584 - DNA, 17 bp, Homo sapiens
gaaaaatattgctaaaa

SEQ ID NO: 6212585 - DNA, 23 bp, Homo sapiens
gaaaaatattgctaaaagtgcat

SEQ ID NO: 6212586 - DNA, 13 bp, Homo sapiens
gaaaaatatttaa

SEQ ID NO: 6212587 - DNA, 15 bp, Homo sapiens
gaaaaatatttaatg

SEQ ID NO: 6212588 - DNA, 16 bp, Homo sapiens
gaaaaatatttctgag

SEQ ID NO: 6212589 - DNA, 21 bp, Homo sapiens
gaaaaatcaagtattataaac

SEQ ID NO: 6212590 - DNA, 14 bp, Homo sapiens
gaaaaatcaatcat

SEQ ID NO: 6212591 - DNA, 19 bp, Homo sapiens
gaaaaatcacaatttttaa

SEQ ID NO: 6212592 - DNA, 17 bp, Homo sapiens
gaaaaatcatgggccag

SEQ ID NO: 6212593 - DNA, 13 bp, Homo sapiens
gaaaaatcctctt

SEQ ID NO: 6212594 - DNA, 16 bp, Homo sapiens
gaaaaatctaaaatgt

SEQ ID NO: 6212595 - DNA, 17 bp, Homo sapiens
gaaaaatctagtatttg

SEQ ID NO: 6212596 - DNA, 21 bp, Homo sapiens
gaaaaatctagtatttgtatc

SEQ ID NO: 6212597 - DNA, 18 bp, Homo sapiens
gaaaaatctcaattgaaa

SEQ ID NO: 6212598 - DNA, 18 bp, Homo sapiens
gaaaaatctcattatttc

SEQ ID NO: 6212599 - DNA, 19 bp, Homo sapiens
gaaaaatctcattatttca

SEQ ID NO: 6212600 - DNA, 13 bp, Homo sapiens
gaaaaatctgaat

SEQ ID NO: 6212601 - DNA, 18 bp, Homo sapiens
gaaaaatctgaatttcta

SEQ ID NO: 6212602 - DNA, 21 bp, Homo sapiens
gaaaaatcttgtgctagaata

SEQ ID NO: 6212603 - DNA, 22 bp, Homo sapiens
gaaaaatgaaaacttttgtaaa

SEQ ID NO: 6212604 - DNA, 23 bp, Homo sapiens
gaaaaatgaaaagcaatacaact

SEQ ID NO: 6212605 - DNA, 19 bp, Homo sapiens
gaaaaatgaaagatgattt

SEQ ID NO: 6212606 - DNA, 18 bp, Homo sapiens
gaaaaatgaaatttaagc

SEQ ID NO: 6212607 - DNA, 24 bp, Homo sapiens
gaaaaatgaactgtattattgcaa

SEQ ID NO: 6212608 - DNA, 22 bp, Homo sapiens
gaaaaatgacaattgtgaacat

SEQ ID NO: 6212609 - DNA, 18 bp, Homo sapiens
gaaaaatgagagaaggga

SEQ ID NO: 6212610 - DNA, 16 bp, Homo sapiens
gaaaaatgagcctggc

SEQ ID NO: 6212611 - DNA, 20 bp, Homo sapiens
gaaaaatgcccatttttgct

SEQ ID NO: 6212612 - DNA, 20 bp, Homo sapiens
gaaaaatgggagacagcctc

SEQ ID NO: 6212613 - DNA, 15 bp, Homo sapiens
gaaaaatgggagcca

SEQ ID NO: 6212614 - DNA, 23 bp, Homo sapiens
gagccagaaatgggcagttctcc

SEQ ID NO: 6212615 - DNA, 16 bp, Homo sapiens
gagccagactgtccag

SEQ ID NO: 6212616 - DNA, 17 bp, Homo sapiens
gagccagactgtccagg

SEQ ID NO: 6212617 - DNA, 13 bp, Homo sapiens
gagccagagaagt

SEQ ID NO: 6212618 - DNA, 15 bp, Homo sapiens
gagccagagagaaca

SEQ ID NO: 6212619 - DNA, 23 bp, Homo sapiens
gagccagagagaacaacaggcag

SEQ ID NO: 6212620 - DNA, 13 bp, Homo sapiens
gagccagaggcca

SEQ ID NO: 6212621 - DNA, 16 bp, Homo sapiens
gagccagaggccagga

SEQ ID NO: 6212622 - DNA, 18 bp, Homo sapiens
gagccagaggccaggatg

SEQ ID NO: 6212623 - DNA, 17 bp, Homo sapiens
gagccagatgcaggaca

SEQ ID NO: 6212624 - DNA, 19 bp, Homo sapiens
gagccagatgcaggacagg

SEQ ID NO: 6212625 - DNA, 22 bp, Homo sapiens
gagccagatgcaggacaggagg

SEQ ID NO: 6212626 - DNA, 15 bp, Homo sapiens
gagccagatggcaag

SEQ ID NO: 6212627 - DNA, 15 bp, Homo sapiens
gagccagattacagg

SEQ ID NO: 6212628 - DNA, 17 bp, Homo sapiens
gagccagattaggcctg

SEQ ID NO: 6212629 - DNA, 18 bp, Homo sapiens
gagccagatttcactctc

SEQ ID NO: 6212630 - DNA, 17 bp, Homo sapiens
gagccagcagacattgt

SEQ ID NO: 6212631 - DNA, 20 bp, Homo sapiens
gagccagcagacattgtcag

SEQ ID NO: 6212632 - DNA, 21 bp, Homo sapiens
gagccagcagcctggctctcc

SEQ ID NO: 6212633 - DNA, 21 bp, Homo sapiens
gagccagcagctgaagtctct

SEQ ID NO: 6212634 - DNA, 12 bp, Homo sapiens
gagccagcaggg

SEQ ID NO: 6212635 - DNA, 15 bp, Homo sapiens
gagccagccacactt

SEQ ID NO: 6212636 - DNA, 13 bp, Homo sapiens
gagccagccagga

SEQ ID NO: 6212637 - DNA, 14 bp, Homo sapiens
gagccagccaggcc

SEQ ID NO: 6212638 - DNA, 19 bp, Homo sapiens
gagccagccctccctgtcc

SEQ ID NO: 6212639 - DNA, 20 bp, Homo sapiens
gagccagccctccctgtcct

SEQ ID NO: 6212640 - DNA, 21 bp, Homo sapiens
gagccagccctccctgtcctc

SEQ ID NO: 6212641 - DNA, 17 bp, Homo sapiens
gagccagcctgcttccc

SEQ ID NO: 6212642 - DNA, 16 bp, Homo sapiens
gagccagcctggctct

SEQ ID NO: 6212643 - DNA, 14 bp, Homo sapiens
gagccagcctggga

SEQ ID NO: 6212644 - DNA, 17 bp, Homo sapiens
gagccagcgcctgcccg

SEQ ID NO: 6212645 - DNA, 20 bp, Homo sapiens
gagccagcggctccaactcc

SEQ ID NO: 6212646 - DNA, 21 bp, Homo sapiens
gagccagctaaggggtggggc

SEQ ID NO: 6212647 - DNA, 12 bp, Homo sapiens
gagccagctccc

SEQ ID NO: 6212648 - DNA, 12 bp, Homo sapiens
gagccagctgct

SEQ ID NO: 6212649 - DNA, 15 bp, Homo sapiens
gagccagctgctttt

SEQ ID NO: 6212650 - DNA, 14 bp, Homo sapiens
gagccagcttggtc

SEQ ID NO: 6212651 - DNA, 12 bp, Homo sapiens
gagccaggactc

SEQ ID NO: 6212652 - DNA, 17 bp, Homo sapiens
gagccaggactcccaga

SEQ ID NO: 6212653 - DNA, 12 bp, Homo sapiens
gagccaggagaa

SEQ ID NO: 6212654 - DNA, 15 bp, Homo sapiens
gagccaggagaagct

SEQ ID NO: 6212655 - DNA, 13 bp, Homo sapiens
gagccaggagacc

SEQ ID NO: 6212656 - DNA, 23 bp, Homo sapiens
gagccaggagacctgctctccgg

SEQ ID NO: 6212657 - DNA, 14 bp, Homo sapiens
gagccaggagtaag

SEQ ID NO: 6212658 - DNA, 13 bp, Homo sapiens
gagccaggcacac

SEQ ID NO: 6212659 - DNA, 22 bp, Homo sapiens
gagccaggctagctggagcctg

SEQ ID NO: 6212660 - DNA, 15 bp, Homo sapiens
gagccaggctctgcc

SEQ ID NO: 6212661 - DNA, 14 bp, Homo sapiens
gagccagggaacag

SEQ ID NO: 6212662 - DNA, 19 bp, Homo sapiens
gagccagggaacagcccca

SEQ ID NO: 6212663 - DNA, 13 bp, Homo sapiens
gagccagggcaga

SEQ ID NO: 6212664 - DNA, 14 bp, Homo sapiens
gagccagggcaggg

SEQ ID NO: 6212665 - DNA, 12 bp, Homo sapiens
gagccagggctg

SEQ ID NO: 6212666 - DNA, 16 bp, Homo sapiens
gagccagggctgtcct

SEQ ID NO: 6212667 - DNA, 18 bp, Homo sapiens
gagccagggctgtcctta

SEQ ID NO: 6212668 - DNA, 12 bp, Homo sapiens
gagccagggtct

SEQ ID NO: 6212669 - DNA, 21 bp, Homo sapiens
gagccagggttttttggccta

SEQ ID NO: 6212670 - DNA, 18 bp, Homo sapiens
gagccaggtaatgaggga

SEQ ID NO: 6212671 - DNA, 12 bp, Homo sapiens
gagccaggttca

SEQ ID NO: 6212672 - DNA, 19 bp, Homo sapiens
gagccaggttcacactcag

SEQ ID NO: 6212673 - DNA, 15 bp, Homo sapiens
gagccagtcccaggg

SEQ ID NO: 6212674 - DNA, 21 bp, Homo sapiens
gagccagtgggccagccacag

SEQ ID NO: 6212675 - DNA, 16 bp, Homo sapiens
gagccagtgtgaggct

SEQ ID NO: 6212676 - DNA, 19 bp, Homo sapiens
gagccagttgtcctatgga

SEQ ID NO: 6212677 - DNA, 14 bp, Homo sapiens
gagccatacataaa

SEQ ID NO: 6212678 - DNA, 19 bp, Homo sapiens
gagccatactgcgtccacc

SEQ ID NO: 6212679 - DNA, 19 bp, Homo sapiens
gagccatagagcctgaaat

SEQ ID NO: 6212680 - DNA, 18 bp, Homo sapiens
gagccataggaaggcact

SEQ ID NO: 6212681 - DNA, 19 bp, Homo sapiens
gagccatattaattgcctg

SEQ ID NO: 6212682 - DNA, 14 bp, Homo sapiens
gagccatcaccctc

SEQ ID NO: 6212683 - DNA, 21 bp, Homo sapiens
gagccatcactagaagaaaag

SEQ ID NO: 6212684 - DNA, 21 bp, Homo sapiens
gagccatcccactccctttcc

SEQ ID NO: 6212685 - DNA, 22 bp, Homo sapiens
gagccatcccttcggagccaac

SEQ ID NO: 6212686 - DNA, 22 bp, Homo sapiens
gagccatcggtgaaactaacag

SEQ ID NO: 6212687 - DNA, 17 bp, Homo sapiens
gagccatctgaagccac

SEQ ID NO: 6212688 - DNA, 15 bp, Homo sapiens
gagccatgaggagcg

SEQ ID NO: 6212689 - DNA, 22 bp, Homo sapiens
gagccatgatgtggagtggggc

SEQ ID NO: 6212690 - DNA, 15 bp, Homo sapiens
gagccatgccaggct

SEQ ID NO: 6212691 - DNA, 15 bp, Homo sapiens
gagccatgcctccct

SEQ ID NO: 6212692 - DNA, 16 bp, Homo sapiens
gagccatgcctccctg

SEQ ID NO: 6212693 - DNA, 20 bp, Homo sapiens
gagccatggaaggtgccaga

SEQ ID NO: 6212694 - DNA, 22 bp, Homo sapiens
gagccatggaccacgcaggaag

SEQ ID NO: 6212695 - DNA, 13 bp, Homo sapiens
gagccatggcggc

SEQ ID NO: 6212696 - DNA, 15 bp, Homo sapiens
gagccatgggcctgg

SEQ ID NO: 6212697 - DNA, 16 bp, Homo sapiens
gagccatgggcctggg

SEQ ID NO: 6212698 - DNA, 17 bp, Homo sapiens
gagccatgggcctgggc

SEQ ID NO: 6212699 - DNA, 18 bp, Homo sapiens
gagccatgggcctgggcc

SEQ ID NO: 6212700 - DNA, 16 bp, Homo sapiens
gagccatgggtctaca

SEQ ID NO: 6212701 - DNA, 15 bp, Homo sapiens
gagccatgtaccagt

SEQ ID NO: 6212702 - DNA, 16 bp, Homo sapiens
gagccattgaacagct

SEQ ID NO: 6212703 - DNA, 19 bp, Homo sapiens
gagccatttaatttttaaa

SEQ ID NO: 6212704 - DNA, 17 bp, Homo sapiens
gagccatttgtcccaag

SEQ ID NO: 6212705 - DNA, 19 bp, Homo sapiens
gagccatttgtcccaagtg

SEQ ID NO: 6212706 - DNA, 20 bp, Homo sapiens
gagccatttgtcccaagtgc

SEQ ID NO: 6212707 - DNA, 23 bp, Homo sapiens
gagccatttgtcccaagtgccaa

SEQ ID NO: 6212708 - DNA, 21 bp, Homo sapiens
gagccattttggggggccccc

SEQ ID NO: 6212709 - DNA, 23 bp, Homo sapiens
gagccattttggggggcccccct

SEQ ID NO: 6212710 - DNA, 14 bp, Homo sapiens
gagccattttgtga

SEQ ID NO: 6212711 - DNA, 21 bp, Homo sapiens
gagccattttgtgaatggatt

SEQ ID NO: 6212712 - DNA, 23 bp, Homo sapiens
gagcccaaacaccctcctggcac

SEQ ID NO: 6212713 - DNA, 20 bp, Homo sapiens
gagcccaaccaggccctgcc

SEQ ID NO: 6212714 - DNA, 16 bp, Homo sapiens
gagcccaagtgccatc

SEQ ID NO: 6212715 - DNA, 18 bp, Homo sapiens
gagcccaagtgccatccc

SEQ ID NO: 6212716 - DNA, 19 bp, Homo sapiens
gagcccaagtgccatccca

SEQ ID NO: 6212717 - DNA, 21 bp, Homo sapiens
gagcccaatgcatagagccct

SEQ ID NO: 6212718 - DNA, 13 bp, Homo sapiens
gagcccacaacct

SEQ ID NO: 6212719 - DNA, 21 bp, Homo sapiens
gagcccacaagatccaggcag

SEQ ID NO: 6212720 - DNA, 12 bp, Homo sapiens
gagcccacacca

SEQ ID NO: 6212721 - DNA, 19 bp, Homo sapiens
gagcccacaccatctggcc

SEQ ID NO: 6212722 - DNA, 21 bp, Homo sapiens
gagcccacagagtctgtgtgt

SEQ ID NO: 6212723 - DNA, 16 bp, Homo sapiens
gagcccacagcgagcc

SEQ ID NO: 6212724 - DNA, 18 bp, Homo sapiens
gagcccacagcgagcctg

SEQ ID NO: 6212725 - DNA, 22 bp, Homo sapiens
gagcccacatggccgggccctc

SEQ ID NO: 6212726 - DNA, 13 bp, Homo sapiens
gagcccaccagcc

SEQ ID NO: 6212727 - DNA, 22 bp, Homo sapiens
gagcccaccagccagccctggc

SEQ ID NO: 6212728 - DNA, 12 bp, Homo sapiens
gagcccaccctg

SEQ ID NO: 6212729 - DNA, 18 bp, Homo sapiens
gagcccacggggcaaagc

SEQ ID NO: 6212730 - DNA, 22 bp, Homo sapiens
gagcccactccatctggtagaa

SEQ ID NO: 6212731 - DNA, 20 bp, Homo sapiens
gagcccactgcccaccccct

SEQ ID NO: 6212732 - DNA, 24 bp, Homo sapiens
gagcccactgtcctgggcctgcag

SEQ ID NO: 6212733 - DNA, 17 bp, Homo sapiens
gagcccagaaaacctcc

SEQ ID NO: 6212734 - DNA, 21 bp, Homo sapiens
gagcccagacctcccctcttc

SEQ ID NO: 6212735 - DNA, 16 bp, Homo sapiens
gagcccagagaacagc

SEQ ID NO: 6212736 - DNA, 14 bp, Homo sapiens
gagcccagagggcc

SEQ ID NO: 6212737 - DNA, 17 bp, Homo sapiens
gagcccagagggccaag

SEQ ID NO: 6212738 - DNA, 18 bp, Homo sapiens
gagcccagagtcccccca

SEQ ID NO: 6212739 - DNA, 14 bp, Homo sapiens
gagcccagcacact

SEQ ID NO: 6212740 - DNA, 15 bp, Homo sapiens
gagcccagcacactg

SEQ ID NO: 6212741 - DNA, 14 bp, Homo sapiens
gagcccagccacct

SEQ ID NO: 6212742 - DNA, 22 bp, Homo sapiens
gagcccagccattaccatggag

SEQ ID NO: 6212743 - DNA, 19 bp, Homo sapiens
gagcccagcggcccaagag

SEQ ID NO: 6212744 - DNA, 19 bp, Homo sapiens
gagcccagctacattcctc

SEQ ID NO: 6212745 - DNA, 19 bp, Homo sapiens
gagcccagctcttgctctc

SEQ ID NO: 6212746 - DNA, 16 bp, Homo sapiens
gagcccagctgcctgg

SEQ ID NO: 6212747 - DNA, 22 bp, Homo sapiens
gagcccagctgcctggagaggg

SEQ ID NO: 6212748 - DNA, 11 bp, Homo sapiens
gagcccaggag

SEQ ID NO: 6212749 - DNA, 12 bp, Homo sapiens
gagcccaggagc

SEQ ID NO: 6212750 - DNA, 11 bp, Homo sapiens
gagcccaggcc

SEQ ID NO: 6212751 - DNA, 18 bp, Homo sapiens
gagcccaggccaggactc

SEQ ID NO: 6212752 - DNA, 21 bp, Homo sapiens
gagcccaggccaggactctgc

SEQ ID NO: 6212753 - DNA, 22 bp, Homo sapiens
gagcccaggccaggactctgca

SEQ ID NO: 6212754 - DNA, 23 bp, Homo sapiens
gagcccaggcctggcctcggggc

SEQ ID NO: 6212755 - DNA, 12 bp, Homo sapiens
gagcccaggctc

SEQ ID NO: 6212756 - DNA, 17 bp, Homo sapiens
gagcccagggcatccca

SEQ ID NO: 6212757 - DNA, 23 bp, Homo sapiens
gagcccaggggagaatgcagccc

SEQ ID NO: 6212758 - DNA, 12 bp, Homo sapiens
gagcccagggtg

SEQ ID NO: 6212759 - DNA, 18 bp, Homo sapiens
gagcccagtcgagacctc

SEQ ID NO: 6212760 - DNA, 16 bp, Homo sapiens
gagcccagtctgttga

SEQ ID NO: 6212761 - DNA, 15 bp, Homo sapiens
gagcccagtgggctg

SEQ ID NO: 6212762 - DNA, 17 bp, Homo sapiens
gagcccagttggaaaat

SEQ ID NO: 6212763 - DNA, 16 bp, Homo sapiens
gagcccatactcagcc

SEQ ID NO: 6212764 - DNA, 17 bp, Homo sapiens
gagcccatactcagcct

SEQ ID NO: 6212765 - DNA, 14 bp, Homo sapiens
gagcccatgctcaa

SEQ ID NO: 6212766 - DNA, 23 bp, Homo sapiens
gagcccatggtaacgaaccccta

SEQ ID NO: 6212767 - DNA, 16 bp, Homo sapiens
gagcccattaatcttg

SEQ ID NO: 6212768 - DNA, 19 bp, Homo sapiens
gagccccaaagatcccacg

SEQ ID NO: 6212769 - DNA, 19 bp, Homo sapiens
gagccccaagactctgctc

SEQ ID NO: 6212770 - DNA, 13 bp, Homo sapiens
gagccccaagcag

SEQ ID NO: 6212771 - DNA, 15 bp, Homo sapiens
gagccccaagtcctg

SEQ ID NO: 6212772 - DNA, 13 bp, Homo sapiens
gagccccacagcc

SEQ ID NO: 6212773 - DNA, 14 bp, Homo sapiens
gagccccacagccc

SEQ ID NO: 6212774 - DNA, 22 bp, Homo sapiens
gagccccacccctgaactggcc

SEQ ID NO: 6212775 - DNA, 17 bp, Homo sapiens
gagccccaccctcagat

SEQ ID NO: 6212776 - DNA, 11 bp, Homo sapiens
gagccccacct

SEQ ID NO: 6212777 - DNA, 20 bp, Homo sapiens
gagccccaccttgtctgcta

SEQ ID NO: 6212778 - DNA, 16 bp, Homo sapiens
gagccccactctcaga

SEQ ID NO: 6212779 - DNA, 14 bp, Homo sapiens
gagccccactgccc

SEQ ID NO: 6212780 - DNA, 15 bp, Homo sapiens
gagccccactgccct

SEQ ID NO: 6212781 - DNA, 16 bp, Homo sapiens
gagccccagccagccc

SEQ ID NO: 6212782 - DNA, 18 bp, Homo sapiens
gagccccagccagccctt

SEQ ID NO: 6212783 - DNA, 15 bp, Homo sapiens
gagccccagccccaa

SEQ ID NO: 6212784 - DNA, 23 bp, Homo sapiens
gagccccagccccaatccagaga

SEQ ID NO: 6212785 - DNA, 22 bp, Homo sapiens
gagccccagccccgtcccagag

SEQ ID NO: 6212786 - DNA, 23 bp, Homo sapiens
gagccccagccccgtcccagagg

SEQ ID NO: 6212787 - DNA, 17 bp, Homo sapiens
gagccccagcgggctgg

SEQ ID NO: 6212788 - DNA, 14 bp, Homo sapiens
gagccccagctgac

SEQ ID NO: 6212789 - DNA, 15 bp, Homo sapiens
gagccccaggactgg

SEQ ID NO: 6212790 - DNA, 16 bp, Homo sapiens
gagccccaggcctctg

SEQ ID NO: 6212791 - DNA, 17 bp, Homo sapiens
gagccccaggcctctgt

SEQ ID NO: 6212792 - DNA, 20 bp, Homo sapiens
gagccccaggggggcctcct

SEQ ID NO: 6212793 - DNA, 21 bp, Homo sapiens
gaaaaatggttgatggaaaat

SEQ ID NO: 6212794 - DNA, 18 bp, Homo sapiens
gaaaaatgtaaaacacat

SEQ ID NO: 6212795 - DNA, 14 bp, Homo sapiens
gaaaaatgtaaata

SEQ ID NO: 6212796 - DNA, 22 bp, Homo sapiens
gaaaaatgtcactgaagtgatt

SEQ ID NO: 6212797 - DNA, 24 bp, Homo sapiens
gaaaaatgtcactgaagtgattga

SEQ ID NO: 6212798 - DNA, 18 bp, Homo sapiens
gaaaaatgtgaaaaaaat

SEQ ID NO: 6212799 - DNA, 14 bp, Homo sapiens
gaaaaatgttagga

SEQ ID NO: 6212800 - DNA, 16 bp, Homo sapiens
gaaaaatgttaggaca

SEQ ID NO: 6212801 - DNA, 11 bp, Homo sapiens
gaaaaatgttt

SEQ ID NO: 6212802 - DNA, 13 bp, Homo sapiens
gaaaaatgtttgt

SEQ ID NO: 6212803 - DNA, 14 bp, Homo sapiens
gaaaaatgtttgtc

SEQ ID NO: 6212804 - DNA, 12 bp, Homo sapiens
gaaaaattaaat

SEQ ID NO: 6212805 - DNA, 11 bp, Homo sapiens
gaaaaattaac

SEQ ID NO: 6212806 - DNA, 15 bp, Homo sapiens
gaaaaattaactttt

SEQ ID NO: 6212807 - DNA, 16 bp, Homo sapiens
gaaaaattaacttttt

SEQ ID NO: 6212808 - DNA, 22 bp, Homo sapiens
gaaaaattaagttgttgaaagt

SEQ ID NO: 6212809 - DNA, 16 bp, Homo sapiens
gaaaaattattagaac

SEQ ID NO: 6212810 - DNA, 19 bp, Homo sapiens
gaaaaattattagaacatt

SEQ ID NO: 6212811 - DNA, 17 bp, Homo sapiens
gaaaaattattgagcca

SEQ ID NO: 6212812 - DNA, 20 bp, Homo sapiens
gaaaaattcagcaaaccatt

SEQ ID NO: 6212813 - DNA, 11 bp, Homo sapiens
gaaaaattcct

SEQ ID NO: 6212814 - DNA, 22 bp, Homo sapiens
gaaaaattcttggttattctgc

SEQ ID NO: 6212815 - DNA, 17 bp, Homo sapiens
gaaaaattgacaaaaaa

SEQ ID NO: 6212816 - DNA, 22 bp, Homo sapiens
gaaaaattgctgactgtagctt

SEQ ID NO: 6212817 - DNA, 18 bp, Homo sapiens
gaaaaattgtttccaaag

SEQ ID NO: 6212818 - DNA, 17 bp, Homo sapiens
gaaaaatttaagcattg

SEQ ID NO: 6212819 - DNA, 18 bp, Homo sapiens
gaaaaatttaagcattgt

SEQ ID NO: 6212820 - DNA, 19 bp, Homo sapiens
gaaaaatttaagcattgtt

SEQ ID NO: 6212821 - DNA, 19 bp, Homo sapiens
gaaaaatttctggcaaata

SEQ ID NO: 6212822 - DNA, 17 bp, Homo sapiens
gaaaaatttgaagtatt

SEQ ID NO: 6212823 - DNA, 16 bp, Homo sapiens
gaaaaatttttttgtt

SEQ ID NO: 6212824 - DNA, 12 bp, Homo sapiens
gaaaacaaaaaa

SEQ ID NO: 6212825 - DNA, 18 bp, Homo sapiens
gaaaacaaaaatatcttg

SEQ ID NO: 6212826 - DNA, 19 bp, Homo sapiens
gaaaacaaaaccaaaagtt

SEQ ID NO: 6212827 - DNA, 22 bp, Homo sapiens
gaaaacaaaaccaaaagttatt

SEQ ID NO: 6212828 - DNA, 15 bp, Homo sapiens
gaaaacaaaatctaa

SEQ ID NO: 6212829 - DNA, 19 bp, Homo sapiens
gaaaacaaaattttatttt

SEQ ID NO: 6212830 - DNA, 16 bp, Homo sapiens
gaaaacaaacttctcg

SEQ ID NO: 6212831 - DNA, 22 bp, Homo sapiens
gaaaacaaagccaaacaaaact

SEQ ID NO: 6212832 - DNA, 20 bp, Homo sapiens
gaaaacaaatctataaatat

SEQ ID NO: 6212833 - DNA, 14 bp, Homo sapiens
gaaaacaacaaaaa

SEQ ID NO: 6212834 - DNA, 18 bp, Homo sapiens
gaaaacaaccaaagaaaa

SEQ ID NO: 6212835 - DNA, 19 bp, Homo sapiens
gaaaacaaccaaagaaaat

SEQ ID NO: 6212836 - DNA, 18 bp, Homo sapiens
gaaaacaacttggcattt

SEQ ID NO: 6212837 - DNA, 12 bp, Homo sapiens
gaaaacaaggaa

SEQ ID NO: 6212838 - DNA, 19 bp, Homo sapiens
gaaaacaatctgcccaccg

SEQ ID NO: 6212839 - DNA, 15 bp, Homo sapiens
gaaaacaattcagtg

SEQ ID NO: 6212840 - DNA, 16 bp, Homo sapiens
gaaaacaattgttctg

SEQ ID NO: 6212841 - DNA, 12 bp, Homo sapiens
gaaaacacagat

SEQ ID NO: 6212842 - DNA, 16 bp, Homo sapiens
gaaaacacagcctccc

SEQ ID NO: 6212843 - DNA, 13 bp, Homo sapiens
gaaaacacatttt

SEQ ID NO: 6212844 - DNA, 20 bp, Homo sapiens
gaaaacacctttattttatt

SEQ ID NO: 6212845 - DNA, 16 bp, Homo sapiens
gaaaacactaacaaaa

SEQ ID NO: 6212846 - DNA, 23 bp, Homo sapiens
gaaaacactaacaaaatttgaat

SEQ ID NO: 6212847 - DNA, 21 bp, Homo sapiens
gaaaacactgtgcacatctgt

SEQ ID NO: 6212848 - DNA, 22 bp, Homo sapiens
gaaaacactgttatcatttttt

SEQ ID NO: 6212849 - DNA, 21 bp, Homo sapiens
gaaaacactgttctctgccct

SEQ ID NO: 6212850 - DNA, 24 bp, Homo sapiens
gaaaacactgttctctgccctcca

SEQ ID NO: 6212851 - DNA, 21 bp, Homo sapiens
gaaaacactttcctggataaa

SEQ ID NO: 6212852 - DNA, 9 bp, Homo sapiens
gaaaacaga

SEQ ID NO: 6212853 - DNA, 11 bp, Homo sapiens
gaaaacagaaa

SEQ ID NO: 6212854 - DNA, 14 bp, Homo sapiens
gaaaacagaaaaaa

SEQ ID NO: 6212855 - DNA, 14 bp, Homo sapiens
gaaaacagaaattg

SEQ ID NO: 6212856 - DNA, 15 bp, Homo sapiens
gaaaacagaacactt

SEQ ID NO: 6212857 - DNA, 16 bp, Homo sapiens
gaaaacagaacactta

SEQ ID NO: 6212858 - DNA, 15 bp, Homo sapiens
gaaaacagaatcagt

SEQ ID NO: 6212859 - DNA, 18 bp, Homo sapiens
gaaaacagagcctgccta

SEQ ID NO: 6212860 - DNA, 17 bp, Homo sapiens
gaaaacagagtatttct

SEQ ID NO: 6212861 - DNA, 22 bp, Homo sapiens
gaaaacagatgaccataatttt

SEQ ID NO: 6212862 - DNA, 20 bp, Homo sapiens
gaaaacagatgagaagacta

SEQ ID NO: 6212863 - DNA, 18 bp, Homo sapiens
gaaaacagtgtgtaaaca

SEQ ID NO: 6212864 - DNA, 12 bp, Homo sapiens
gaaaacataaaa

SEQ ID NO: 6212865 - DNA, 13 bp, Homo sapiens
gaaaacataaaaa

SEQ ID NO: 6212866 - DNA, 21 bp, Homo sapiens
gaaaacataatatcttgaaga

SEQ ID NO: 6212867 - DNA, 20 bp, Homo sapiens
gaaaacatatgaaatataaa

SEQ ID NO: 6212868 - DNA, 21 bp, Homo sapiens
gaaaacatatgaaatataaat

SEQ ID NO: 6212869 - DNA, 17 bp, Homo sapiens
gaaaacatatttgcaaa

SEQ ID NO: 6212870 - DNA, 22 bp, Homo sapiens
gaaaacatctagcccaaaggta

SEQ ID NO: 6212871 - DNA, 14 bp, Homo sapiens
gaaaacatctcctt

SEQ ID NO: 6212872 - DNA, 15 bp, Homo sapiens
gaaaacatctcctta

SEQ ID NO: 6212873 - DNA, 16 bp, Homo sapiens
gaaaacatggaacagt

SEQ ID NO: 6212874 - DNA, 20 bp, Homo sapiens
gaaaacatgttaatgacaat

SEQ ID NO: 6212875 - DNA, 15 bp, Homo sapiens
gaaaacattcatcca

SEQ ID NO: 6212876 - DNA, 17 bp, Homo sapiens
gaaaacattcatccagt

SEQ ID NO: 6212877 - DNA, 20 bp, Homo sapiens
gaaaacattctgatttggaa

SEQ ID NO: 6212878 - DNA, 18 bp, Homo sapiens
gaaaacattgatgaatga

SEQ ID NO: 6212879 - DNA, 18 bp, Homo sapiens
gaaaacattgttccagat

SEQ ID NO: 6212880 - DNA, 18 bp, Homo sapiens
gaaaaccaagccgtggct

SEQ ID NO: 6212881 - DNA, 22 bp, Homo sapiens
gaaaaccagcttgcgaataaca

SEQ ID NO: 6212882 - DNA, 19 bp, Homo sapiens
gaaaaccagtcttctccct

SEQ ID NO: 6212883 - DNA, 21 bp, Homo sapiens
gaaaaccagtcttctccctgt

SEQ ID NO: 6212884 - DNA, 22 bp, Homo sapiens
gaaaaccatattttattgtatt

SEQ ID NO: 6212885 - DNA, 16 bp, Homo sapiens
gaaaacccaagttttt

SEQ ID NO: 6212886 - DNA, 18 bp, Homo sapiens
gaaaacccaagtttttaa

SEQ ID NO: 6212887 - DNA, 19 bp, Homo sapiens
gaaaacccaagtttttaat

SEQ ID NO: 6212888 - DNA, 11 bp, Homo sapiens
gaaaacccacc

SEQ ID NO: 6212889 - DNA, 14 bp, Homo sapiens
gaaaacccagagag

SEQ ID NO: 6212890 - DNA, 14 bp, Homo sapiens
gaaaaccccagcat

SEQ ID NO: 6212891 - DNA, 17 bp, Homo sapiens
gaaaacccccagcatta

SEQ ID NO: 6212892 - DNA, 13 bp, Homo sapiens
gaaaacccctccc

SEQ ID NO: 6212893 - DNA, 13 bp, Homo sapiens
gaaaacccctggc

SEQ ID NO: 6212894 - DNA, 15 bp, Homo sapiens
gaaaacccctggctg

SEQ ID NO: 6212895 - DNA, 11 bp, Homo sapiens
gaaaaccctaa

SEQ ID NO: 6212896 - DNA, 15 bp, Homo sapiens
gaaaaccctaagtgt

SEQ ID NO: 6212897 - DNA, 20 bp, Homo sapiens
gaaaaccctaagtgtggatg

SEQ ID NO: 6212898 - DNA, 22 bp, Homo sapiens
gaaaacccttgggccagaagta

SEQ ID NO: 6212899 - DNA, 13 bp, Homo sapiens
gaaaaccgagaat

SEQ ID NO: 6212900 - DNA, 21 bp, Homo sapiens
gaaaacctaagtcctttatgt

SEQ ID NO: 6212901 - DNA, 20 bp, Homo sapiens
gaaaacctaattaaggaagt

SEQ ID NO: 6212902 - DNA, 13 bp, Homo sapiens
gaaaacctagaaa

SEQ ID NO: 6212903 - DNA, 14 bp, Homo sapiens
gaaaacctcaaggg

SEQ ID NO: 6212904 - DNA, 15 bp, Homo sapiens
gaaaacctcaagggc

SEQ ID NO: 6212905 - DNA, 12 bp, Homo sapiens
gaaaacctcagt

SEQ ID NO: 6212906 - DNA, 13 bp, Homo sapiens
gaaaacctggggg

SEQ ID NO: 6212907 - DNA, 23 bp, Homo sapiens
gaaaacctgggggatggtcagag

SEQ ID NO: 6212908 - DNA, 16 bp, Homo sapiens
gaaaaccttaaaagta

SEQ ID NO: 6212909 - DNA, 13 bp, Homo sapiens
gaaaacggagagg

SEQ ID NO: 6212910 - DNA, 17 bp, Homo sapiens
gaaaacgggaaagaata

SEQ ID NO: 6212911 - DNA, 20 bp, Homo sapiens
gaaaacgggcagtctgctct

SEQ ID NO: 6212912 - DNA, 21 bp, Homo sapiens
gaaaacgtatcacctttccca

SEQ ID NO: 6212913 - DNA, 16 bp, Homo sapiens
gaaaacgtggctgctt

SEQ ID NO: 6212914 - DNA, 16 bp, Homo sapiens
gaaaacgttttattgt

SEQ ID NO: 6212915 - DNA, 12 bp, Homo sapiens
gaaaactaaaaa

SEQ ID NO: 6212916 - DNA, 17 bp, Homo sapiens
gaaaactaacaaccaac

SEQ ID NO: 6212917 - DNA, 19 bp, Homo sapiens
gaaaactaactcaggtgta

SEQ ID NO: 6212918 - DNA, 12 bp, Homo sapiens
gaaaactaagtt

SEQ ID NO: 6212919 - DNA, 19 bp, Homo sapiens
gaaaactaatgtactgtac

SEQ ID NO: 6212920 - DNA, 19 bp, Homo sapiens
gaaaactacaaacgtttga

SEQ ID NO: 6212921 - DNA, 16 bp, Homo sapiens
gaaaactacattttaa

SEQ ID NO: 6212922 - DNA, 17 bp, Homo sapiens
gaaaactacattttaac

SEQ ID NO: 6212923 - DNA, 14 bp, Homo sapiens
gaaaactatacaac

SEQ ID NO: 6212924 - DNA, 20 bp, Homo sapiens
gaaaactatgtattaattta

SEQ ID NO: 6212925 - DNA, 19 bp, Homo sapiens
gaaaactattccatgtttt

SEQ ID NO: 6212926 - DNA, 18 bp, Homo sapiens
gaaaactattgagccttg

SEQ ID NO: 6212927 - DNA, 15 bp, Homo sapiens
gaaaactattttaaa

SEQ ID NO: 6212928 - DNA, 18 bp, Homo sapiens
gaaaactcaccatttcat

SEQ ID NO: 6212929 - DNA, 22 bp, Homo sapiens
gaaaactcatgatcaagatata

SEQ ID NO: 6212930 - DNA, 13 bp, Homo sapiens
gaaaactcccaat

SEQ ID NO: 6212931 - DNA, 18 bp, Homo sapiens
gaaaactcccatttacgt

SEQ ID NO: 6212932 - DNA, 13 bp, Homo sapiens
gaaaactctattt

SEQ ID NO: 6212933 - DNA, 18 bp, Homo sapiens
gaaaactcttggcctctg

SEQ ID NO: 6212934 - DNA, 13 bp, Homo sapiens
gaaaactgacatc

SEQ ID NO: 6212935 - DNA, 20 bp, Homo sapiens
gaaaactgccacaagcacaa

SEQ ID NO: 6212936 - DNA, 21 bp, Homo sapiens
gaaaactgcctgttccttgaa

SEQ ID NO: 6212937 - DNA, 14 bp, Homo sapiens
gaaaactgggtatg

SEQ ID NO: 6212938 - DNA, 21 bp, Homo sapiens
gaaaactgtaaatacaaaata

SEQ ID NO: 6212939 - DNA, 19 bp, Homo sapiens
gaaaactgtgcaacttttt

SEQ ID NO: 6212940 - DNA, 21 bp, Homo sapiens
gaaaactgtttatggtatttt

SEQ ID NO: 6212941 - DNA, 23 bp, Homo sapiens
gaaaactgtttatggtattttcg

SEQ ID NO: 6212942 - DNA, 21 bp, Homo sapiens
gaaaacttattaacaactgtg

SEQ ID NO: 6212943 - DNA, 23 bp, Homo sapiens
gaaaacttattaacaactgtgaa

SEQ ID NO: 6212944 - DNA, 22 bp, Homo sapiens
gaaaacttcaaggaaaataagt

SEQ ID NO: 6212945 - DNA, 19 bp, Homo sapiens
gaaaacttcactccaaaga

SEQ ID NO: 6212946 - DNA, 20 bp, Homo sapiens
gaaaacttcactccaaagag

SEQ ID NO: 6212947 - DNA, 22 bp, Homo sapiens
gaaaacttcactccaaagagaa

SEQ ID NO: 6212948 - DNA, 16 bp, Homo sapiens
gaaaacttcagaagca

SEQ ID NO: 6212949 - DNA, 23 bp, Homo sapiens
gaaaacttcagagaaattatgtt

SEQ ID NO: 6212950 - DNA, 20 bp, Homo sapiens
gaaaacttcgtaagaacatg

SEQ ID NO: 6212951 - DNA, 16 bp, Homo sapiens
gaaaacttcttttaaa

SEQ ID NO: 6212952 - DNA, 12 bp, Homo sapiens
gaaaacttgaat

SEQ ID NO: 6212953 - DNA, 14 bp, Homo sapiens
gaaaacttgaatct

SEQ ID NO: 6212954 - DNA, 21 bp, Homo sapiens
gaaaacttgaattcatagaaa

SEQ ID NO: 6212955 - DNA, 22 bp, Homo sapiens
gaaaacttgtgtgaaattttct

SEQ ID NO: 6212956 - DNA, 12 bp, Homo sapiens
gaaaactttaaa

SEQ ID NO: 6212957 - DNA, 20 bp, Homo sapiens
gaaaactttaaaaaatattt

SEQ ID NO: 6212958 - DNA, 22 bp, Homo sapiens
gaaaactttaaaaaatatttat

SEQ ID NO: 6212959 - DNA, 13 bp, Homo sapiens
gaaaactttgtta

SEQ ID NO: 6212960 - DNA, 20 bp, Homo sapiens
gaaaacttttacatttttct

SEQ ID NO: 6212961 - DNA, 17 bp, Homo sapiens
gaaaacttttctcagat

SEQ ID NO: 6212962 - DNA, 17 bp, Homo sapiens
gaaaacttttgtaaatt

SEQ ID NO: 6212963 - DNA, 11 bp, Homo sapiens
gaaaagaaaaa

SEQ ID NO: 6212964 - DNA, 22 bp, Homo sapiens
gaaaagaaaaaaaaaagaagaa

SEQ ID NO: 6212965 - DNA, 19 bp, Homo sapiens
gaaaagaaaaaaaaagaaa

SEQ ID NO: 6212966 - DNA, 13 bp, Homo sapiens
gaaaagaaaaaga

SEQ ID NO: 6212967 - DNA, 15 bp, Homo sapiens
gaaaagaaaaatttc

SEQ ID NO: 6212968 - DNA, 16 bp, Homo sapiens
gaaaagaaaaatttct

SEQ ID NO: 6212969 - DNA, 15 bp, Homo sapiens
gaaaagaaaacaaaa

SEQ ID NO: 6212970 - DNA, 21 bp, Homo sapiens
gaaaagaaaacatttaacata

SEQ ID NO: 6212971 - DNA, 16 bp, Homo sapiens
gaaaagaaagaaacca

SEQ ID NO: 6212972 - DNA, 12 bp, Homo sapiens
gagccccagggt

SEQ ID NO: 6212973 - DNA, 24 bp, Homo sapiens
gagccccagggtcttccctacctc

SEQ ID NO: 6212974 - DNA, 13 bp, Homo sapiens
gagccccatcttc

SEQ ID NO: 6212975 - DNA, 18 bp, Homo sapiens
gagccccatcttcaccca

SEQ ID NO: 6212976 - DNA, 20 bp, Homo sapiens
gagccccatcttcacccagg

SEQ ID NO: 6212977 - DNA, 18 bp, Homo sapiens
gagccccattcctgggaa

SEQ ID NO: 6212978 - DNA, 16 bp, Homo sapiens
gagcccccaacacagg

SEQ ID NO: 6212979 - DNA, 14 bp, Homo sapiens
gagcccccaccagc

SEQ ID NO: 6212980 - DNA, 18 bp, Homo sapiens
gagcccccaccagcagca

SEQ ID NO: 6212981 - DNA, 21 bp, Homo sapiens
gagcccccaccagcagcacaa

SEQ ID NO: 6212982 - DNA, 20 bp, Homo sapiens
gagcccccaccttgatccca

SEQ ID NO: 6212983 - DNA, 12 bp, Homo sapiens
gagcccccagat

SEQ ID NO: 6212984 - DNA, 19 bp, Homo sapiens
gagcccccagcagaggcag

SEQ ID NO: 6212985 - DNA, 23 bp, Homo sapiens
gagcccccagcagaggcaggctg

SEQ ID NO: 6212986 - DNA, 18 bp, Homo sapiens
gagcccccagccctggga

SEQ ID NO: 6212987 - DNA, 20 bp, Homo sapiens
gagcccccagccctgggaac

SEQ ID NO: 6212988 - DNA, 18 bp, Homo sapiens
gagcccccagcctgtcag

SEQ ID NO: 6212989 - DNA, 19 bp, Homo sapiens
gagcccccagctgccaaag

SEQ ID NO: 6212990 - DNA, 17 bp, Homo sapiens
gagcccccagcttccag

SEQ ID NO: 6212991 - DNA, 13 bp, Homo sapiens
gagcccccccaac

SEQ ID NO: 6212992 - DNA, 22 bp, Homo sapiens
gagcccccctagtggtatgggg

SEQ ID NO: 6212993 - DNA, 16 bp, Homo sapiens
gagcccccgcccctcc

SEQ ID NO: 6212994 - DNA, 20 bp, Homo sapiens
gagcccccgcccctccccct

SEQ ID NO: 6212995 - DNA, 22 bp, Homo sapiens
gagccccctgcacccacccctg

SEQ ID NO: 6212996 - DNA, 23 bp, Homo sapiens
gagccccctgcacccacccctgc

SEQ ID NO: 6212997 - DNA, 15 bp, Homo sapiens
gagccccctggcggc

SEQ ID NO: 6212998 - DNA, 16 bp, Homo sapiens
gagccccctggcggca

SEQ ID NO: 6212999 - DNA, 15 bp, Homo sapiens
gagccccctgtcctt

SEQ ID NO: 6213000 - DNA, 16 bp, Homo sapiens
gagccccctgtccttc

SEQ ID NO: 6213001 - DNA, 15 bp, Homo sapiens
gagccccctgtgccc

SEQ ID NO: 6213002 - DNA, 21 bp, Homo sapiens
gagccccctgtgcccacccag

SEQ ID NO: 6213003 - DNA, 23 bp, Homo sapiens
gagccccgcagacctccccagcc

SEQ ID NO: 6213004 - DNA, 18 bp, Homo sapiens
gagccccgccctcttcct

SEQ ID NO: 6213005 - DNA, 14 bp, Homo sapiens
gagccccggagcac

SEQ ID NO: 6213006 - DNA, 16 bp, Homo sapiens
gagccccggagcacca

SEQ ID NO: 6213007 - DNA, 15 bp, Homo sapiens
gagcccctaccccac

SEQ ID NO: 6213008 - DNA, 20 bp, Homo sapiens
gagcccctaccccacaccag

SEQ ID NO: 6213009 - DNA, 22 bp, Homo sapiens
gagcccctatcctgcaccctct

SEQ ID NO: 6213010 - DNA, 12 bp, Homo sapiens
gagcccctcatg

SEQ ID NO: 6213011 - DNA, 16 bp, Homo sapiens
gagcccctccccagcc

SEQ ID NO: 6213012 - DNA, 21 bp, Homo sapiens
gagcccctccccagccagccc

SEQ ID NO: 6213013 - DNA, 16 bp, Homo sapiens
gagcccctccctcctg

SEQ ID NO: 6213014 - DNA, 16 bp, Homo sapiens
gagcccctccctgcta

SEQ ID NO: 6213015 - DNA, 12 bp, Homo sapiens
gagcccctccta

SEQ ID NO: 6213016 - DNA, 12 bp, Homo sapiens
gagcccctcctc

SEQ ID NO: 6213017 - DNA, 17 bp, Homo sapiens
gagcccctcctccagcc

SEQ ID NO: 6213018 - DNA, 16 bp, Homo sapiens
gagcccctcctccccc

SEQ ID NO: 6213019 - DNA, 17 bp, Homo sapiens
gagcccctcctctcctc

SEQ ID NO: 6213020 - DNA, 23 bp, Homo sapiens
gagcccctcctctgagcagcctc

SEQ ID NO: 6213021 - DNA, 18 bp, Homo sapiens
gagcccctcggctctgga

SEQ ID NO: 6213022 - DNA, 12 bp, Homo sapiens
gagcccctgagt

SEQ ID NO: 6213023 - DNA, 12 bp, Homo sapiens
gagcccctgccc

SEQ ID NO: 6213024 - DNA, 14 bp, Homo sapiens
gagcccctggggaa

SEQ ID NO: 6213025 - DNA, 13 bp, Homo sapiens
gagcccctggtcc

SEQ ID NO: 6213026 - DNA, 13 bp, Homo sapiens
gagcccctgtttc

SEQ ID NO: 6213027 - DNA, 11 bp, Homo sapiens
gagccccttcc

SEQ ID NO: 6213028 - DNA, 19 bp, Homo sapiens
gagccccttccttgctctg

SEQ ID NO: 6213029 - DNA, 17 bp, Homo sapiens
gagccccttctgctcag

SEQ ID NO: 6213030 - DNA, 20 bp, Homo sapiens
gagcccctttgcctgtcaag

SEQ ID NO: 6213031 - DNA, 18 bp, Homo sapiens
gagcccgatattctccct

SEQ ID NO: 6213032 - DNA, 20 bp, Homo sapiens
gagcccgcacccccaccctt

SEQ ID NO: 6213033 - DNA, 23 bp, Homo sapiens
gagcccgcacccccaccctttgg

SEQ ID NO: 6213034 - DNA, 18 bp, Homo sapiens
gagcccgcagcccagacc

SEQ ID NO: 6213035 - DNA, 19 bp, Homo sapiens
gagcccgcagggccatgca

SEQ ID NO: 6213036 - DNA, 17 bp, Homo sapiens
gagcccgcccacctggg

SEQ ID NO: 6213037 - DNA, 18 bp, Homo sapiens
gagcccgccgtctgcagg

SEQ ID NO: 6213038 - DNA, 23 bp, Homo sapiens
gagcccgccgtctgcaggggcct

SEQ ID NO: 6213039 - DNA, 21 bp, Homo sapiens
gagcccgcctgcgccccccag

SEQ ID NO: 6213040 - DNA, 19 bp, Homo sapiens
gagcccgcgtgctggagaa

SEQ ID NO: 6213041 - DNA, 20 bp, Homo sapiens
gagcccgcttcaagctctct

SEQ ID NO: 6213042 - DNA, 14 bp, Homo sapiens
gagcccggagctcc

SEQ ID NO: 6213043 - DNA, 21 bp, Homo sapiens
gagcccggccctcccccagct

SEQ ID NO: 6213044 - DNA, 17 bp, Homo sapiens
gagcccgggagagactc

SEQ ID NO: 6213045 - DNA, 15 bp, Homo sapiens
gagcccgggctgcct

SEQ ID NO: 6213046 - DNA, 18 bp, Homo sapiens
gagcccgggctgcctggg

SEQ ID NO: 6213047 - DNA, 22 bp, Homo sapiens
gagcccgggctgcctgggctgt

SEQ ID NO: 6213048 - DNA, 16 bp, Homo sapiens
gagcccgtcaggccac

SEQ ID NO: 6213049 - DNA, 21 bp, Homo sapiens
gagcccgtgcagtacaggcaa

SEQ ID NO: 6213050 - DNA, 15 bp, Homo sapiens
gagcccgtgggggca

SEQ ID NO: 6213051 - DNA, 18 bp, Homo sapiens
gagccctaaacacacgcg

SEQ ID NO: 6213052 - DNA, 19 bp, Homo sapiens
gagccctactccctgcaga

SEQ ID NO: 6213053 - DNA, 17 bp, Homo sapiens
gagccctagccctgctc

SEQ ID NO: 6213054 - DNA, 20 bp, Homo sapiens
gagccctatctatgtcctgg

SEQ ID NO: 6213055 - DNA, 21 bp, Homo sapiens
gagccctatctatgtcctgga

SEQ ID NO: 6213056 - DNA, 17 bp, Homo sapiens
gagccctattgctgcta

SEQ ID NO: 6213057 - DNA, 11 bp, Homo sapiens
gagccctcaga

SEQ ID NO: 6213058 - DNA, 20 bp, Homo sapiens
gagccctcagtcggggcagg

SEQ ID NO: 6213059 - DNA, 24 bp, Homo sapiens
gagccctcagtcggggcaggccag

SEQ ID NO: 6213060 - DNA, 14 bp, Homo sapiens
gagccctccccagg

SEQ ID NO: 6213061 - DNA, 18 bp, Homo sapiens
gagccctccctcttccca

SEQ ID NO: 6213062 - DNA, 17 bp, Homo sapiens
gagccctccgccttcac

SEQ ID NO: 6213063 - DNA, 18 bp, Homo sapiens
gagccctccgccttcaca

SEQ ID NO: 6213064 - DNA, 23 bp, Homo sapiens
gagccctccgccttcacattccc

SEQ ID NO: 6213065 - DNA, 22 bp, Homo sapiens
gagccctccttcttgccctgag

SEQ ID NO: 6213066 - DNA, 20 bp, Homo sapiens
gagccctctagggcagggtg

SEQ ID NO: 6213067 - DNA, 13 bp, Homo sapiens
gagccctctcact

SEQ ID NO: 6213068 - DNA, 23 bp, Homo sapiens
gagccctctcactccagccaaag

SEQ ID NO: 6213069 - DNA, 17 bp, Homo sapiens
gagccctctgagccgcc

SEQ ID NO: 6213070 - DNA, 18 bp, Homo sapiens
gagccctctgagccgcca

SEQ ID NO: 6213071 - DNA, 22 bp, Homo sapiens
gagccctctgctgctttccaac

SEQ ID NO: 6213072 - DNA, 17 bp, Homo sapiens
gagccctgaccttggct

SEQ ID NO: 6213073 - DNA, 12 bp, Homo sapiens
gagccctgactc

SEQ ID NO: 6213074 - DNA, 13 bp, Homo sapiens
gagccctgactcc

SEQ ID NO: 6213075 - DNA, 17 bp, Homo sapiens
gagccctgactcctgga

SEQ ID NO: 6213076 - DNA, 18 bp, Homo sapiens
gagccctgactcctggac

SEQ ID NO: 6213077 - DNA, 22 bp, Homo sapiens
gagccctgactcctggactccg

SEQ ID NO: 6213078 - DNA, 11 bp, Homo sapiens
gagccctgagc

SEQ ID NO: 6213079 - DNA, 20 bp, Homo sapiens
gagccctgagcccagaaaaa

SEQ ID NO: 6213080 - DNA, 17 bp, Homo sapiens
gagccctgagctcaggc

SEQ ID NO: 6213081 - DNA, 18 bp, Homo sapiens
gagccctgagctcaggct

SEQ ID NO: 6213082 - DNA, 20 bp, Homo sapiens
gagccctgagctcaggctga

SEQ ID NO: 6213083 - DNA, 12 bp, Homo sapiens
gagccctgagga

SEQ ID NO: 6213084 - DNA, 18 bp, Homo sapiens
gagccctgaggacctctc

SEQ ID NO: 6213085 - DNA, 17 bp, Homo sapiens
gagccctgaggggctgg

SEQ ID NO: 6213086 - DNA, 9 bp, Homo sapiens
gagccctgc

SEQ ID NO: 6213087 - DNA, 12 bp, Homo sapiens
gagccctgcagc

SEQ ID NO: 6213088 - DNA, 13 bp, Homo sapiens
gagccctgcccca

SEQ ID NO: 6213089 - DNA, 15 bp, Homo sapiens
gagccctgccctgca

SEQ ID NO: 6213090 - DNA, 22 bp, Homo sapiens
gagccctgcctctccgcccctg

SEQ ID NO: 6213091 - DNA, 20 bp, Homo sapiens
gagccctgctatgaaaggaa

SEQ ID NO: 6213092 - DNA, 19 bp, Homo sapiens
gagccctgctcttctctcc

SEQ ID NO: 6213093 - DNA, 15 bp, Homo sapiens
gagccctgctgtggg

SEQ ID NO: 6213094 - DNA, 16 bp, Homo sapiens
gagccctgctgtggga

SEQ ID NO: 6213095 - DNA, 21 bp, Homo sapiens
gagccctggaccccaggctct

SEQ ID NO: 6213096 - DNA, 16 bp, Homo sapiens
gagccctggagagccc

SEQ ID NO: 6213097 - DNA, 12 bp, Homo sapiens
gagccctggcca

SEQ ID NO: 6213098 - DNA, 17 bp, Homo sapiens
gagccctggccagccct

SEQ ID NO: 6213099 - DNA, 22 bp, Homo sapiens
gagccctggccagcccttcctc

SEQ ID NO: 6213100 - DNA, 13 bp, Homo sapiens
gagccctggctcc

SEQ ID NO: 6213101 - DNA, 15 bp, Homo sapiens
gagccctggctctgc

SEQ ID NO: 6213102 - DNA, 16 bp, Homo sapiens
gagccctggctctgcc

SEQ ID NO: 6213103 - DNA, 20 bp, Homo sapiens
gagccctggctctgcccctc

SEQ ID NO: 6213104 - DNA, 13 bp, Homo sapiens
gagccctggctgg

SEQ ID NO: 6213105 - DNA, 14 bp, Homo sapiens
gagccctggctggg

SEQ ID NO: 6213106 - DNA, 19 bp, Homo sapiens
gagccctggctgggttcag

SEQ ID NO: 6213107 - DNA, 12 bp, Homo sapiens
gagccctgggac

SEQ ID NO: 6213108 - DNA, 18 bp, Homo sapiens
gagccctgggaggctctg

SEQ ID NO: 6213109 - DNA, 19 bp, Homo sapiens
gagccctgggaggctctgg

SEQ ID NO: 6213110 - DNA, 17 bp, Homo sapiens
gagccctgggccagggc

SEQ ID NO: 6213111 - DNA, 14 bp, Homo sapiens
gagccctggtggca

SEQ ID NO: 6213112 - DNA, 18 bp, Homo sapiens
gagccctggtggcagtgg

SEQ ID NO: 6213113 - DNA, 17 bp, Homo sapiens
gagccctgtacccaccc

SEQ ID NO: 6213114 - DNA, 23 bp, Homo sapiens
gagccctgtacccaccccagcac

SEQ ID NO: 6213115 - DNA, 15 bp, Homo sapiens
gagccctgtccctgc

SEQ ID NO: 6213116 - DNA, 20 bp, Homo sapiens
gagccctgttcctccctccc

SEQ ID NO: 6213117 - DNA, 20 bp, Homo sapiens
gagcccttagccttgctgta

SEQ ID NO: 6213118 - DNA, 23 bp, Homo sapiens
gagcccttagccttgctgtagag

SEQ ID NO: 6213119 - DNA, 19 bp, Homo sapiens
gagcccttatctgtgctca

SEQ ID NO: 6213120 - DNA, 15 bp, Homo sapiens
gagcccttcactgcc

SEQ ID NO: 6213121 - DNA, 16 bp, Homo sapiens
gagcccttcactgcca

SEQ ID NO: 6213122 - DNA, 18 bp, Homo sapiens
gagcccttcactgccatg

SEQ ID NO: 6213123 - DNA, 20 bp, Homo sapiens
gagcccttcactgccatgat

SEQ ID NO: 6213124 - DNA, 15 bp, Homo sapiens
gagcccttccaggag

SEQ ID NO: 6213125 - DNA, 16 bp, Homo sapiens
gagcccttcccagggc

SEQ ID NO: 6213126 - DNA, 22 bp, Homo sapiens
gagcccttctatacccacccag

SEQ ID NO: 6213127 - DNA, 23 bp, Homo sapiens
gagcccttctatacccacccaga

SEQ ID NO: 6213128 - DNA, 18 bp, Homo sapiens
gagcccttctctttgact

SEQ ID NO: 6213129 - DNA, 23 bp, Homo sapiens
gagcccttgactgtacagagact

SEQ ID NO: 6213130 - DNA, 13 bp, Homo sapiens
gagcccttgcaca

SEQ ID NO: 6213131 - DNA, 17 bp, Homo sapiens
gagcccttgcacaggcc

SEQ ID NO: 6213132 - DNA, 22 bp, Homo sapiens
gagcccttgcctccccatttcc

SEQ ID NO: 6213133 - DNA, 14 bp, Homo sapiens
gagccgaagcccag

SEQ ID NO: 6213134 - DNA, 23 bp, Homo sapiens
gagccgacaatgccctgctggcc

SEQ ID NO: 6213135 - DNA, 14 bp, Homo sapiens
gagccgacctaaaa

SEQ ID NO: 6213136 - DNA, 20 bp, Homo sapiens
gagccgagatcacgccactg

SEQ ID NO: 6213137 - DNA, 21 bp, Homo sapiens
gagccgagatcacgccactgc

SEQ ID NO: 6213138 - DNA, 15 bp, Homo sapiens
gagccgagattgcac

SEQ ID NO: 6213139 - DNA, 15 bp, Homo sapiens
gagccgagctctcct

SEQ ID NO: 6213140 - DNA, 18 bp, Homo sapiens
gagccgagctctcctggg

SEQ ID NO: 6213141 - DNA, 20 bp, Homo sapiens
gagccgagggcgtcagagag

SEQ ID NO: 6213142 - DNA, 21 bp, Homo sapiens
gagccgagggcgtcagagaga

SEQ ID NO: 6213143 - DNA, 14 bp, Homo sapiens
gagccgaggggaga

SEQ ID NO: 6213144 - DNA, 18 bp, Homo sapiens
gagccgaggggagagagg

SEQ ID NO: 6213145 - DNA, 19 bp, Homo sapiens
gagccgaggggagagaggg

SEQ ID NO: 6213146 - DNA, 15 bp, Homo sapiens
gagccgatctggtct

SEQ ID NO: 6213147 - DNA, 15 bp, Homo sapiens
gagccgcaccctggc

SEQ ID NO: 6213148 - DNA, 16 bp, Homo sapiens
gagccgcaccctggct

SEQ ID NO: 6213149 - DNA, 14 bp, Homo sapiens
gagccgcagagcct

SEQ ID NO: 6213150 - DNA, 15 bp, Homo sapiens
gaaaagaaagaagtt

SEQ ID NO: 6213151 - DNA, 12 bp, Homo sapiens
gaaaagaagaaa

SEQ ID NO: 6213152 - DNA, 16 bp, Homo sapiens
gaaaagaatacagaaa

SEQ ID NO: 6213153 - DNA, 19 bp, Homo sapiens
gaaaagaatacagaaagat

SEQ ID NO: 6213154 - DNA, 16 bp, Homo sapiens
gaaaagacaagaaaat

SEQ ID NO: 6213155 - DNA, 17 bp, Homo sapiens
gaaaagacagagcctcc

SEQ ID NO: 6213156 - DNA, 14 bp, Homo sapiens
gaaaagacatttta

SEQ ID NO: 6213157 - DNA, 15 bp, Homo sapiens
gaaaagaccagggct

SEQ ID NO: 6213158 - DNA, 14 bp, Homo sapiens
gaaaagaccctgag

SEQ ID NO: 6213159 - DNA, 22 bp, Homo sapiens
gaaaagaccctgagactccaga

SEQ ID NO: 6213160 - DNA, 16 bp, Homo sapiens
gaaaagacggatggca

SEQ ID NO: 6213161 - DNA, 19 bp, Homo sapiens
gaaaagacggatggcagga

SEQ ID NO: 6213162 - DNA, 21 bp, Homo sapiens
gaaaagactccaaagaaatgt

SEQ ID NO: 6213163 - DNA, 21 bp, Homo sapiens
gaaaagactcctcctgggggc

SEQ ID NO: 6213164 - DNA, 23 bp, Homo sapiens
gaaaagactgtgggtggggaggc

SEQ ID NO: 6213165 - DNA, 18 bp, Homo sapiens
gaaaagacttgtaatatt

SEQ ID NO: 6213166 - DNA, 17 bp, Homo sapiens
gaaaagacttttgttga

SEQ ID NO: 6213167 - DNA, 13 bp, Homo sapiens
gaaaagagaaaaa

SEQ ID NO: 6213168 - DNA, 16 bp, Homo sapiens
gaaaagagaacttttt

SEQ ID NO: 6213169 - DNA, 14 bp, Homo sapiens
gaaaagagaagaaa

SEQ ID NO: 6213170 - DNA, 13 bp, Homo sapiens
gaaaagagacagg

SEQ ID NO: 6213171 - DNA, 17 bp, Homo sapiens
gaaaagagacaggcagg

SEQ ID NO: 6213172 - DNA, 18 bp, Homo sapiens
gaaaagagacttctctgt

SEQ ID NO: 6213173 - DNA, 22 bp, Homo sapiens
gaaaagagacttctctgtaagt

SEQ ID NO: 6213174 - DNA, 20 bp, Homo sapiens
gaaaagagaggtttctggta

SEQ ID NO: 6213175 - DNA, 23 bp, Homo sapiens
gaaaagagcacttcacacagaca

SEQ ID NO: 6213176 - DNA, 13 bp, Homo sapiens
gaaaagagctggg

SEQ ID NO: 6213177 - DNA, 23 bp, Homo sapiens
gaaaagagtatcaaaggcagaaa

SEQ ID NO: 6213178 - DNA, 16 bp, Homo sapiens
gaaaagatacgacttt

SEQ ID NO: 6213179 - DNA, 22 bp, Homo sapiens
gaaaagatacgactttattttc

SEQ ID NO: 6213180 - DNA, 18 bp, Homo sapiens
gaaaagataggtttgagt

SEQ ID NO: 6213181 - DNA, 23 bp, Homo sapiens
gaaaagatggagtttacaaagat

SEQ ID NO: 6213182 - DNA, 14 bp, Homo sapiens
gaaaagatgtgctc

SEQ ID NO: 6213183 - DNA, 18 bp, Homo sapiens
gaaaagattccattttat

SEQ ID NO: 6213184 - DNA, 15 bp, Homo sapiens
gaaaagattcttctt

SEQ ID NO: 6213185 - DNA, 19 bp, Homo sapiens
gaaaagattcttcttaaaa

SEQ ID NO: 6213186 - DNA, 14 bp, Homo sapiens
gaaaagattttaac

SEQ ID NO: 6213187 - DNA, 14 bp, Homo sapiens
gaaaagattttatt

SEQ ID NO: 6213188 - DNA, 10 bp, Homo sapiens
gaaaagcaac

SEQ ID NO: 6213189 - DNA, 18 bp, Homo sapiens
gaaaagcaattgccctgt

SEQ ID NO: 6213190 - DNA, 17 bp, Homo sapiens
gaaaagcacaagaaact

SEQ ID NO: 6213191 - DNA, 18 bp, Homo sapiens
gaaaagcacacacaataa

SEQ ID NO: 6213192 - DNA, 14 bp, Homo sapiens
gaaaagcacagagg

SEQ ID NO: 6213193 - DNA, 14 bp, Homo sapiens
gaaaagcacctgcc

SEQ ID NO: 6213194 - DNA, 14 bp, Homo sapiens
gaaaagcacttaaa

SEQ ID NO: 6213195 - DNA, 21 bp, Homo sapiens
gaaaagcacttttgttattcc

SEQ ID NO: 6213196 - DNA, 15 bp, Homo sapiens
gaaaagcagacattt

SEQ ID NO: 6213197 - DNA, 16 bp, Homo sapiens
gaaaagcagacatttt

SEQ ID NO: 6213198 - DNA, 19 bp, Homo sapiens
gaaaagcagacgcagcagc

SEQ ID NO: 6213199 - DNA, 21 bp, Homo sapiens
gaaaagcagatggacttgaaa

SEQ ID NO: 6213200 - DNA, 20 bp, Homo sapiens
gaaaagcagcccttggccag

SEQ ID NO: 6213201 - DNA, 17 bp, Homo sapiens
gaaaagcataacaccaa

SEQ ID NO: 6213202 - DNA, 22 bp, Homo sapiens
gaaaagcattttcagtcttgta

SEQ ID NO: 6213203 - DNA, 16 bp, Homo sapiens
gaaaagcatttttcaa

SEQ ID NO: 6213204 - DNA, 14 bp, Homo sapiens
gaaaagccaaaggt

SEQ ID NO: 6213205 - DNA, 18 bp, Homo sapiens
gaaaagccaaaggtcaaa

SEQ ID NO: 6213206 - DNA, 12 bp, Homo sapiens
gaaaagccatat

SEQ ID NO: 6213207 - DNA, 17 bp, Homo sapiens
gaaaagcccacaggcct

SEQ ID NO: 6213208 - DNA, 23 bp, Homo sapiens
gaaaagcccacataagttttctc

SEQ ID NO: 6213209 - DNA, 14 bp, Homo sapiens
gaaaagcctcagct

SEQ ID NO: 6213210 - DNA, 20 bp, Homo sapiens
gaaaagcctccgcctgctgt

SEQ ID NO: 6213211 - DNA, 14 bp, Homo sapiens
gaaaagcctctgtg

SEQ ID NO: 6213212 - DNA, 20 bp, Homo sapiens
gaaaagccttggagaactcg

SEQ ID NO: 6213213 - DNA, 15 bp, Homo sapiens
gaaaagcgcagagaa

SEQ ID NO: 6213214 - DNA, 20 bp, Homo sapiens
gaaaagcggacatcagctgg

SEQ ID NO: 6213215 - DNA, 23 bp, Homo sapiens
gaaaagcgtctttaagagactca

SEQ ID NO: 6213216 - DNA, 19 bp, Homo sapiens
gaaaagctatcttaaaata

SEQ ID NO: 6213217 - DNA, 21 bp, Homo sapiens
gaaaagctatcttaaaatata

SEQ ID NO: 6213218 - DNA, 11 bp, Homo sapiens
gaaaagctatt

SEQ ID NO: 6213219 - DNA, 15 bp, Homo sapiens
gaaaagctgcattta

SEQ ID NO: 6213220 - DNA, 21 bp, Homo sapiens
gaaaagctgccatttcccttc

SEQ ID NO: 6213221 - DNA, 22 bp, Homo sapiens
gaaaagctgccatttcccttct

SEQ ID NO: 6213222 - DNA, 15 bp, Homo sapiens
gaaaagctgcctctg

SEQ ID NO: 6213223 - DNA, 13 bp, Homo sapiens
gaaaagctggtct

SEQ ID NO: 6213224 - DNA, 22 bp, Homo sapiens
gaaaagctgtacgcgtttgtct

SEQ ID NO: 6213225 - DNA, 19 bp, Homo sapiens
gaaaagctgtgtactttat

SEQ ID NO: 6213226 - DNA, 14 bp, Homo sapiens
gaaaagcttcttaa

SEQ ID NO: 6213227 - DNA, 14 bp, Homo sapiens
gaaaagctttgttt

SEQ ID NO: 6213228 - DNA, 14 bp, Homo sapiens
gaaaaggaaaagaa

SEQ ID NO: 6213229 - DNA, 12 bp, Homo sapiens
gaaaaggaatca

SEQ ID NO: 6213230 - DNA, 16 bp, Homo sapiens
gaaaaggaatgcaaga

SEQ ID NO: 6213231 - DNA, 19 bp, Homo sapiens
gaaaaggaatgcaagagaa

SEQ ID NO: 6213232 - DNA, 20 bp, Homo sapiens
gaaaaggactcttgagccct

SEQ ID NO: 6213233 - DNA, 12 bp, Homo sapiens
gaaaaggaggag

SEQ ID NO: 6213234 - DNA, 19 bp, Homo sapiens
gaaaaggatgatggaaaaa

SEQ ID NO: 6213235 - DNA, 21 bp, Homo sapiens
gaaaaggcaaaagactggttt

SEQ ID NO: 6213236 - DNA, 16 bp, Homo sapiens
gaaaaggcagcatttg

SEQ ID NO: 6213237 - DNA, 22 bp, Homo sapiens
gaaaaggcagcatttgaatact

SEQ ID NO: 6213238 - DNA, 14 bp, Homo sapiens
gaaaaggcagccag

SEQ ID NO: 6213239 - DNA, 15 bp, Homo sapiens
gaaaaggcagccaga

SEQ ID NO: 6213240 - DNA, 11 bp, Homo sapiens
gaaaaggcagg

SEQ ID NO: 6213241 - DNA, 12 bp, Homo sapiens
gaaaaggcctgg

SEQ ID NO: 6213242 - DNA, 13 bp, Homo sapiens
gaaaaggcctggg

SEQ ID NO: 6213243 - DNA, 18 bp, Homo sapiens
gaaaaggctaagaaaaag

SEQ ID NO: 6213244 - DNA, 19 bp, Homo sapiens
gaaaaggctaagaaaaagg

SEQ ID NO: 6213245 - DNA, 20 bp, Homo sapiens
gaaaaggctggagagagatt

SEQ ID NO: 6213246 - DNA, 20 bp, Homo sapiens
gaaaaggcttgagtctggat

SEQ ID NO: 6213247 - DNA, 16 bp, Homo sapiens
gaaaagggaaaaaaga

SEQ ID NO: 6213248 - DNA, 18 bp, Homo sapiens
gaaaagggaactgaacat

SEQ ID NO: 6213249 - DNA, 19 bp, Homo sapiens
gaaaagggaagttgtgcct

SEQ ID NO: 6213250 - DNA, 20 bp, Homo sapiens
gaaaagggactgctgggagg

SEQ ID NO: 6213251 - DNA, 16 bp, Homo sapiens
gaaaagggagaaaaag

SEQ ID NO: 6213252 - DNA, 21 bp, Homo sapiens
gaaaagggagattcagactgt

SEQ ID NO: 6213253 - DNA, 18 bp, Homo sapiens
gaaaagggatgatgggat

SEQ ID NO: 6213254 - DNA, 14 bp, Homo sapiens
gaaaagggcagagg

SEQ ID NO: 6213255 - DNA, 16 bp, Homo sapiens
gaaaagggcaggagcc

SEQ ID NO: 6213256 - DNA, 18 bp, Homo sapiens
gaaaagggcaggagccta

SEQ ID NO: 6213257 - DNA, 20 bp, Homo sapiens
gaaaagggcaggagcctaga

SEQ ID NO: 6213258 - DNA, 20 bp, Homo sapiens
gaaaaggggagcacaaggcc

SEQ ID NO: 6213259 - DNA, 23 bp, Homo sapiens
gaaaaggtagcttacctgacaca

SEQ ID NO: 6213260 - DNA, 16 bp, Homo sapiens
gaaaaggtgtaaaaca

SEQ ID NO: 6213261 - DNA, 21 bp, Homo sapiens
gaaaaggtgtccttttccttt

SEQ ID NO: 6213262 - DNA, 23 bp, Homo sapiens
gaaaaggttcttcatccctttcc

SEQ ID NO: 6213263 - DNA, 19 bp, Homo sapiens
gaaaaggttgaataatata

SEQ ID NO: 6213264 - DNA, 22 bp, Homo sapiens
gaaaaggtttatgaaaaagaag

SEQ ID NO: 6213265 - DNA, 14 bp, Homo sapiens
gaaaaggttttatt

SEQ ID NO: 6213266 - DNA, 14 bp, Homo sapiens
gaaaagtaaaaaat

SEQ ID NO: 6213267 - DNA, 21 bp, Homo sapiens
gaaaagtaaggtgcagttccc

SEQ ID NO: 6213268 - DNA, 19 bp, Homo sapiens
gaaaagtaatatttattaa

SEQ ID NO: 6213269 - DNA, 19 bp, Homo sapiens
gaaaagtaatgaagaatca

SEQ ID NO: 6213270 - DNA, 18 bp, Homo sapiens
gaaaagtaattttgtcac

SEQ ID NO: 6213271 - DNA, 15 bp, Homo sapiens
gaaaagtagaaagga

SEQ ID NO: 6213272 - DNA, 19 bp, Homo sapiens
gaaaagtatcactctaaaa

SEQ ID NO: 6213273 - DNA, 23 bp, Homo sapiens
gaaaagtatcactctaaaaaaca

SEQ ID NO: 6213274 - DNA, 21 bp, Homo sapiens
gaaaagtatggcagtgggaga

SEQ ID NO: 6213275 - DNA, 13 bp, Homo sapiens
gaaaagtatgttc

SEQ ID NO: 6213276 - DNA, 12 bp, Homo sapiens
gaaaagtattgg

SEQ ID NO: 6213277 - DNA, 15 bp, Homo sapiens
gaaaagtatttccaa

SEQ ID NO: 6213278 - DNA, 17 bp, Homo sapiens
gaaaagtattttgaagt

SEQ ID NO: 6213279 - DNA, 14 bp, Homo sapiens
gaaaagtcaaactg

SEQ ID NO: 6213280 - DNA, 15 bp, Homo sapiens
gaaaagtcacacaga

SEQ ID NO: 6213281 - DNA, 18 bp, Homo sapiens
gaaaagtcacttactatt

SEQ ID NO: 6213282 - DNA, 21 bp, Homo sapiens
gaaaagtgaaggggaaacaca

SEQ ID NO: 6213283 - DNA, 22 bp, Homo sapiens
gaaaagtgaaggggaaacacac

SEQ ID NO: 6213284 - DNA, 21 bp, Homo sapiens
gaaaagtgatgtattttcata

SEQ ID NO: 6213285 - DNA, 11 bp, Homo sapiens
gaaaagtgcct

SEQ ID NO: 6213286 - DNA, 14 bp, Homo sapiens
gaaaagtgcctgag

SEQ ID NO: 6213287 - DNA, 13 bp, Homo sapiens
gaaaagtgctgtt

SEQ ID NO: 6213288 - DNA, 21 bp, Homo sapiens
gaaaagtgcttagaaagttat

SEQ ID NO: 6213289 - DNA, 23 bp, Homo sapiens
gaaaagtgcttagaaagttattg

SEQ ID NO: 6213290 - DNA, 12 bp, Homo sapiens
gaaaagtgcttt

SEQ ID NO: 6213291 - DNA, 18 bp, Homo sapiens
gaaaagtggcaagaccaa

SEQ ID NO: 6213292 - DNA, 12 bp, Homo sapiens
gaaaagtgggct

SEQ ID NO: 6213293 - DNA, 14 bp, Homo sapiens
gaaaagtgggctgc

SEQ ID NO: 6213294 - DNA, 20 bp, Homo sapiens
gaaaagtgggctgcagcagc

SEQ ID NO: 6213295 - DNA, 13 bp, Homo sapiens
gaaaagtgttatt

SEQ ID NO: 6213296 - DNA, 14 bp, Homo sapiens
gaaaagtgttatta

SEQ ID NO: 6213297 - DNA, 15 bp, Homo sapiens
gaaaagtgttccttg

SEQ ID NO: 6213298 - DNA, 17 bp, Homo sapiens
gaaaagtgttccttgct

SEQ ID NO: 6213299 - DNA, 15 bp, Homo sapiens
gaaaagttaaactaa

SEQ ID NO: 6213300 - DNA, 19 bp, Homo sapiens
gaaaagttaaactaaaaaa

SEQ ID NO: 6213301 - DNA, 10 bp, Homo sapiens
gaaaagttat

SEQ ID NO: 6213302 - DNA, 21 bp, Homo sapiens
gaaaagttatttatgctataa

SEQ ID NO: 6213303 - DNA, 20 bp, Homo sapiens
gaaaagttgaaatgtgtaat

SEQ ID NO: 6213304 - DNA, 21 bp, Homo sapiens
gaaaagttgaaatgtgtaatt

SEQ ID NO: 6213305 - DNA, 14 bp, Homo sapiens
gaaaagttgaattt

SEQ ID NO: 6213306 - DNA, 15 bp, Homo sapiens
gaaaagttgaatttt

SEQ ID NO: 6213307 - DNA, 23 bp, Homo sapiens
gaaaagtttagcccctgaaagcc

SEQ ID NO: 6213308 - DNA, 23 bp, Homo sapiens
gaaaagtttgttttactttgttt

SEQ ID NO: 6213309 - DNA, 18 bp, Homo sapiens
gaaaagttttcaagcatt

SEQ ID NO: 6213310 - DNA, 21 bp, Homo sapiens
gaaaagttttcaagcattgct

SEQ ID NO: 6213311 - DNA, 19 bp, Homo sapiens
gaaaagttttgtaaatttc

SEQ ID NO: 6213312 - DNA, 21 bp, Homo sapiens
gaaaataaaaaaaagaaaaaa

SEQ ID NO: 6213313 - DNA, 19 bp, Homo sapiens
gaaaataaaaaaagaaaaa

SEQ ID NO: 6213314 - DNA, 16 bp, Homo sapiens
gaaaataaaaatgcta

SEQ ID NO: 6213315 - DNA, 12 bp, Homo sapiens
gaaaataaaata

SEQ ID NO: 6213316 - DNA, 17 bp, Homo sapiens
gaaaataaaataaacga

SEQ ID NO: 6213317 - DNA, 21 bp, Homo sapiens
gaaaataaaataaacgaaaca

SEQ ID NO: 6213318 - DNA, 19 bp, Homo sapiens
gaaaataaaatattcactc

SEQ ID NO: 6213319 - DNA, 12 bp, Homo sapiens
gaaaataaaatt

SEQ ID NO: 6213320 - DNA, 20 bp, Homo sapiens
gaaaataaaattaagaatgt

SEQ ID NO: 6213321 - DNA, 14 bp, Homo sapiens
gaaaataaacacca

SEQ ID NO: 6213322 - DNA, 18 bp, Homo sapiens
gaaaataaacagacaaaa

SEQ ID NO: 6213323 - DNA, 20 bp, Homo sapiens
gaaaataaacatcagtttct

SEQ ID NO: 6213324 - DNA, 22 bp, Homo sapiens
gaaaataaagacaaccatattt

SEQ ID NO: 6213325 - DNA, 18 bp, Homo sapiens
gaaaataaattttgaatg

SEQ ID NO: 6213326 - DNA, 19 bp, Homo sapiens
gaaaataacaataaaagac

SEQ ID NO: 6213327 - DNA, 12 bp, Homo sapiens
gaaaataacaga

SEQ ID NO: 6213328 - DNA, 19 bp, Homo sapiens
gaaaataacgataaaagac

SEQ ID NO: 6213329 - DNA, 13 bp, Homo sapiens
gagccgcagggcc

SEQ ID NO: 6213330 - DNA, 14 bp, Homo sapiens
gagccgcaggggcc

SEQ ID NO: 6213331 - DNA, 22 bp, Homo sapiens
gagccgcatcttctccatctgg

SEQ ID NO: 6213332 - DNA, 14 bp, Homo sapiens
gagccgccgtggct

SEQ ID NO: 6213333 - DNA, 14 bp, Homo sapiens
gagccgcctcggag

SEQ ID NO: 6213334 - DNA, 23 bp, Homo sapiens
gagccgcctcggagtgtggcctg

SEQ ID NO: 6213335 - DNA, 22 bp, Homo sapiens
gagccgcgggcgctcgctcagg

SEQ ID NO: 6213336 - DNA, 12 bp, Homo sapiens
gagccgcgggga

SEQ ID NO: 6213337 - DNA, 17 bp, Homo sapiens
gagccgcggggaagctg

SEQ ID NO: 6213338 - DNA, 16 bp, Homo sapiens
gagccgcttccccagc

SEQ ID NO: 6213339 - DNA, 23 bp, Homo sapiens
gagccggacacttctcaggaaat

SEQ ID NO: 6213340 - DNA, 22 bp, Homo sapiens
gagccggactttcggagttggg

SEQ ID NO: 6213341 - DNA, 16 bp, Homo sapiens
gagccggagcctccag

SEQ ID NO: 6213342 - DNA, 20 bp, Homo sapiens
gagccggccaccagatgctg

SEQ ID NO: 6213343 - DNA, 22 bp, Homo sapiens
gagccggccgccttctcccctc

SEQ ID NO: 6213344 - DNA, 13 bp, Homo sapiens
gagccggcggcct

SEQ ID NO: 6213345 - DNA, 15 bp, Homo sapiens
gagccgggccccgga

SEQ ID NO: 6213346 - DNA, 16 bp, Homo sapiens
gagccgggcctcccac

SEQ ID NO: 6213347 - DNA, 22 bp, Homo sapiens
gagccgggcctcccaccgcagc

SEQ ID NO: 6213348 - DNA, 20 bp, Homo sapiens
gagccgggcctggggctcct

SEQ ID NO: 6213349 - DNA, 22 bp, Homo sapiens
gagccggggtggggtggctgca

SEQ ID NO: 6213350 - DNA, 22 bp, Homo sapiens
gagccgggtctgcctcttctgg

SEQ ID NO: 6213351 - DNA, 14 bp, Homo sapiens
gagccgtgatgcct

SEQ ID NO: 6213352 - DNA, 15 bp, Homo sapiens
gagcctaaaaataaa

SEQ ID NO: 6213353 - DNA, 17 bp, Homo sapiens
gagcctaaaaataaagc

SEQ ID NO: 6213354 - DNA, 22 bp, Homo sapiens
gagcctacctctgtctgagaca

SEQ ID NO: 6213355 - DNA, 20 bp, Homo sapiens
gagcctacctgtatgtcaat

SEQ ID NO: 6213356 - DNA, 22 bp, Homo sapiens
gagcctagaacatccctgggca

SEQ ID NO: 6213357 - DNA, 14 bp, Homo sapiens
gagcctagaggagg

SEQ ID NO: 6213358 - DNA, 17 bp, Homo sapiens
gagcctagcggagccca

SEQ ID NO: 6213359 - DNA, 20 bp, Homo sapiens
gagcctagcggagcccagcc

SEQ ID NO: 6213360 - DNA, 21 bp, Homo sapiens
gagcctagcggagcccagcct

SEQ ID NO: 6213361 - DNA, 16 bp, Homo sapiens
gagcctagctcctgcc

SEQ ID NO: 6213362 - DNA, 15 bp, Homo sapiens
gagcctaggaccact

SEQ ID NO: 6213363 - DNA, 14 bp, Homo sapiens
gagcctaggccagg

SEQ ID NO: 6213364 - DNA, 16 bp, Homo sapiens
gagcctatggaaaggg

SEQ ID NO: 6213365 - DNA, 18 bp, Homo sapiens
gagcctcacagcagtgag

SEQ ID NO: 6213366 - DNA, 11 bp, Homo sapiens
gagcctcagaa

SEQ ID NO: 6213367 - DNA, 13 bp, Homo sapiens
gagcctcagaaga

SEQ ID NO: 6213368 - DNA, 15 bp, Homo sapiens
gagcctcagaagaaa

SEQ ID NO: 6213369 - DNA, 12 bp, Homo sapiens
gagcctcagact

SEQ ID NO: 6213370 - DNA, 13 bp, Homo sapiens
gagcctcagcagc

SEQ ID NO: 6213371 - DNA, 15 bp, Homo sapiens
gagcctcagcagcaa

SEQ ID NO: 6213372 - DNA, 15 bp, Homo sapiens
gagcctcagcatcct

SEQ ID NO: 6213373 - DNA, 21 bp, Homo sapiens
gagcctcagcatcctggcacc

SEQ ID NO: 6213374 - DNA, 22 bp, Homo sapiens
gagcctcccaaggagaacaaat

SEQ ID NO: 6213375 - DNA, 13 bp, Homo sapiens
gagcctcccacca

SEQ ID NO: 6213376 - DNA, 12 bp, Homo sapiens
gagcctccccca

SEQ ID NO: 6213377 - DNA, 16 bp, Homo sapiens
gagcctccccctcaga

SEQ ID NO: 6213378 - DNA, 17 bp, Homo sapiens
gagcctccccctcagat

SEQ ID NO: 6213379 - DNA, 22 bp, Homo sapiens
gagcctccctcagccacgcctc

SEQ ID NO: 6213380 - DNA, 19 bp, Homo sapiens
gagcctccgttcccacctc

SEQ ID NO: 6213381 - DNA, 13 bp, Homo sapiens
gagcctcctcagg

SEQ ID NO: 6213382 - DNA, 15 bp, Homo sapiens
gagcctcctcagggg

SEQ ID NO: 6213383 - DNA, 14 bp, Homo sapiens
gagcctcctgccca

SEQ ID NO: 6213384 - DNA, 17 bp, Homo sapiens
gagcctcctgcccagtc

SEQ ID NO: 6213385 - DNA, 23 bp, Homo sapiens
gagcctcctgggaacacatctgg

SEQ ID NO: 6213386 - DNA, 18 bp, Homo sapiens
gagcctcctttctggctt

SEQ ID NO: 6213387 - DNA, 20 bp, Homo sapiens
gagcctcgacacccccccaa

SEQ ID NO: 6213388 - DNA, 21 bp, Homo sapiens
gagcctcgacacccccccaac

SEQ ID NO: 6213389 - DNA, 14 bp, Homo sapiens
gagcctcgcccctc

SEQ ID NO: 6213390 - DNA, 16 bp, Homo sapiens
gagcctcggtggccat

SEQ ID NO: 6213391 - DNA, 19 bp, Homo sapiens
gagcctcggtggccatgct

SEQ ID NO: 6213392 - DNA, 21 bp, Homo sapiens
gagcctcgtccctccctcact

SEQ ID NO: 6213393 - DNA, 21 bp, Homo sapiens
gagcctcgtgtccagactcag

SEQ ID NO: 6213394 - DNA, 17 bp, Homo sapiens
gagcctcgtgtcctgct

SEQ ID NO: 6213395 - DNA, 13 bp, Homo sapiens
gagcctctcctgt

SEQ ID NO: 6213396 - DNA, 24 bp, Homo sapiens
gagcctctgcctgacagcatcctc

SEQ ID NO: 6213397 - DNA, 11 bp, Homo sapiens
gagcctctgcg

SEQ ID NO: 6213398 - DNA, 16 bp, Homo sapiens
gagcctctgctggaag

SEQ ID NO: 6213399 - DNA, 12 bp, Homo sapiens
gagcctctggaa

SEQ ID NO: 6213400 - DNA, 15 bp, Homo sapiens
gagcctctggaatgc

SEQ ID NO: 6213401 - DNA, 15 bp, Homo sapiens
gagcctctggcccct

SEQ ID NO: 6213402 - DNA, 17 bp, Homo sapiens
gagcctctggcccctca

SEQ ID NO: 6213403 - DNA, 13 bp, Homo sapiens
gagcctctggctt

SEQ ID NO: 6213404 - DNA, 13 bp, Homo sapiens
gagcctctgtcac

SEQ ID NO: 6213405 - DNA, 20 bp, Homo sapiens
gagcctctgtcactgcaggc

SEQ ID NO: 6213406 - DNA, 22 bp, Homo sapiens
gagcctctgtcactgcaggcac

SEQ ID NO: 6213407 - DNA, 24 bp, Homo sapiens
gagcctctgtcactgcaggcactc

SEQ ID NO: 6213408 - DNA, 20 bp, Homo sapiens
gagcctcttctgccaagaga

SEQ ID NO: 6213409 - DNA, 15 bp, Homo sapiens
gagcctcttggggaa

SEQ ID NO: 6213410 - DNA, 23 bp, Homo sapiens
gagcctctttttccttcttcagc

SEQ ID NO: 6213411 - DNA, 12 bp, Homo sapiens
gagcctgaactg

SEQ ID NO: 6213412 - DNA, 15 bp, Homo sapiens
gagcctgaactgagc

SEQ ID NO: 6213413 - DNA, 21 bp, Homo sapiens
gagcctgaactgagccccagc

SEQ ID NO: 6213414 - DNA, 22 bp, Homo sapiens
gagcctgaactgagccccagcg

SEQ ID NO: 6213415 - DNA, 21 bp, Homo sapiens
gagcctgaagctggcctggac

SEQ ID NO: 6213416 - DNA, 16 bp, Homo sapiens
gagcctgacagccaga

SEQ ID NO: 6213417 - DNA, 21 bp, Homo sapiens
gagcctgaccctcatctttct

SEQ ID NO: 6213418 - DNA, 12 bp, Homo sapiens
gagcctgacctg

SEQ ID NO: 6213419 - DNA, 16 bp, Homo sapiens
gagcctgacctgagag

SEQ ID NO: 6213420 - DNA, 19 bp, Homo sapiens
gagcctgacgctcagcccc

SEQ ID NO: 6213421 - DNA, 13 bp, Homo sapiens
gagcctgaggcag

SEQ ID NO: 6213422 - DNA, 15 bp, Homo sapiens
gagcctgaggcagga

SEQ ID NO: 6213423 - DNA, 16 bp, Homo sapiens
gagcctgaggcatgag

SEQ ID NO: 6213424 - DNA, 15 bp, Homo sapiens
gagcctgagggatct

SEQ ID NO: 6213425 - DNA, 16 bp, Homo sapiens
gagcctgagtcagggc

SEQ ID NO: 6213426 - DNA, 16 bp, Homo sapiens
gagcctgatctcttcc

SEQ ID NO: 6213427 - DNA, 18 bp, Homo sapiens
gagcctgatctcttcctg

SEQ ID NO: 6213428 - DNA, 19 bp, Homo sapiens
gagcctgatctcttcctgt

SEQ ID NO: 6213429 - DNA, 21 bp, Homo sapiens
gagcctgcaaactcactgctc

SEQ ID NO: 6213430 - DNA, 17 bp, Homo sapiens
gagcctgcacggtgaat

SEQ ID NO: 6213431 - DNA, 16 bp, Homo sapiens
gagcctgcagggaagc

SEQ ID NO: 6213432 - DNA, 16 bp, Homo sapiens
gagcctgcagggtggt

SEQ ID NO: 6213433 - DNA, 14 bp, Homo sapiens
gagcctgcatcttc

SEQ ID NO: 6213434 - DNA, 16 bp, Homo sapiens
gagcctgcatcttctt

SEQ ID NO: 6213435 - DNA, 20 bp, Homo sapiens
gagcctgccaaagtgcctgg

SEQ ID NO: 6213436 - DNA, 21 bp, Homo sapiens
gagcctgccaaagtgcctggg

SEQ ID NO: 6213437 - DNA, 22 bp, Homo sapiens
gagcctgccaaagtgcctggga

SEQ ID NO: 6213438 - DNA, 13 bp, Homo sapiens
gagcctgccaaga

SEQ ID NO: 6213439 - DNA, 13 bp, Homo sapiens
gagcctgcccagc

SEQ ID NO: 6213440 - DNA, 13 bp, Homo sapiens
gagcctgccccag

SEQ ID NO: 6213441 - DNA, 21 bp, Homo sapiens
gagcctgccgagcaaccgtgg

SEQ ID NO: 6213442 - DNA, 23 bp, Homo sapiens
gagcctgccgagcaaccgtggcc

SEQ ID NO: 6213443 - DNA, 22 bp, Homo sapiens
gagcctgccgcccccgcctggg

SEQ ID NO: 6213444 - DNA, 13 bp, Homo sapiens
gagcctgcctcct

SEQ ID NO: 6213445 - DNA, 19 bp, Homo sapiens
gagcctgcggcctgctgga

SEQ ID NO: 6213446 - DNA, 17 bp, Homo sapiens
gagcctgcgtggcctgg

SEQ ID NO: 6213447 - DNA, 15 bp, Homo sapiens
gagcctgctaaggaa

SEQ ID NO: 6213448 - DNA, 23 bp, Homo sapiens
gagcctgctaaggaacaatgccg

SEQ ID NO: 6213449 - DNA, 10 bp, Homo sapiens
gagcctgctg

SEQ ID NO: 6213450 - DNA, 23 bp, Homo sapiens
gagcctgctggtcacagcctcct

SEQ ID NO: 6213451 - DNA, 12 bp, Homo sapiens
gagcctggaagc

SEQ ID NO: 6213452 - DNA, 13 bp, Homo sapiens
gagcctggaagca

SEQ ID NO: 6213453 - DNA, 12 bp, Homo sapiens
gagcctggagaa

SEQ ID NO: 6213454 - DNA, 14 bp, Homo sapiens
gagcctggagaagc

SEQ ID NO: 6213455 - DNA, 15 bp, Homo sapiens
gagcctggagaagct

SEQ ID NO: 6213456 - DNA, 11 bp, Homo sapiens
gagcctggagc

SEQ ID NO: 6213457 - DNA, 22 bp, Homo sapiens
gagcctggagtcggatctagcc

SEQ ID NO: 6213458 - DNA, 17 bp, Homo sapiens
gagcctggcaaggcatt

SEQ ID NO: 6213459 - DNA, 20 bp, Homo sapiens
gagcctggccaacatggtga

SEQ ID NO: 6213460 - DNA, 12 bp, Homo sapiens
gagcctggctct

SEQ ID NO: 6213461 - DNA, 21 bp, Homo sapiens
gagcctggctcttgtgctgga

SEQ ID NO: 6213462 - DNA, 14 bp, Homo sapiens
gagcctggctgtcc

SEQ ID NO: 6213463 - DNA, 15 bp, Homo sapiens
gagcctggctgtcca

SEQ ID NO: 6213464 - DNA, 21 bp, Homo sapiens
gagcctggctttggtccccag

SEQ ID NO: 6213465 - DNA, 13 bp, Homo sapiens
gagcctgggcagc

SEQ ID NO: 6213466 - DNA, 15 bp, Homo sapiens
gagcctgggcagcac

SEQ ID NO: 6213467 - DNA, 12 bp, Homo sapiens
gagcctgggcca

SEQ ID NO: 6213468 - DNA, 17 bp, Homo sapiens
gagcctgggctcatagt

SEQ ID NO: 6213469 - DNA, 16 bp, Homo sapiens
gagcctggggtgggtg

SEQ ID NO: 6213470 - DNA, 22 bp, Homo sapiens
gagcctggggtgggtgtgagca

SEQ ID NO: 6213471 - DNA, 19 bp, Homo sapiens
gagcctggttcagacacag

SEQ ID NO: 6213472 - DNA, 21 bp, Homo sapiens
gagcctggttcagacacagct

SEQ ID NO: 6213473 - DNA, 11 bp, Homo sapiens
gagcctgtccc

SEQ ID NO: 6213474 - DNA, 21 bp, Homo sapiens
gagcctgtccccgccttccct

SEQ ID NO: 6213475 - DNA, 18 bp, Homo sapiens
gagcctgtcctgcctgtg

SEQ ID NO: 6213476 - DNA, 21 bp, Homo sapiens
gagcctgtcctgcctgtggcc

SEQ ID NO: 6213477 - DNA, 13 bp, Homo sapiens
gagcctgtctctc

SEQ ID NO: 6213478 - DNA, 16 bp, Homo sapiens
gagcctgtctctccct

SEQ ID NO: 6213479 - DNA, 21 bp, Homo sapiens
gagcctgtgaacccaggacaa

SEQ ID NO: 6213480 - DNA, 23 bp, Homo sapiens
gagcctgtgaacccaggacaagc

SEQ ID NO: 6213481 - DNA, 20 bp, Homo sapiens
gagcctgtgaccttgggacc

SEQ ID NO: 6213482 - DNA, 20 bp, Homo sapiens
gagcctgtggccagcagccc

SEQ ID NO: 6213483 - DNA, 13 bp, Homo sapiens
gagcctgtgtaac

SEQ ID NO: 6213484 - DNA, 16 bp, Homo sapiens
gagcctgtgtaacagc

SEQ ID NO: 6213485 - DNA, 18 bp, Homo sapiens
gagcctgtgtaacagctc

SEQ ID NO: 6213486 - DNA, 19 bp, Homo sapiens
gagcctgtgtaacagctcc

SEQ ID NO: 6213487 - DNA, 20 bp, Homo sapiens
gagcctgtgtaacagctcct

SEQ ID NO: 6213488 - DNA, 22 bp, Homo sapiens
gagcctgtgtaacagctccttg

SEQ ID NO: 6213489 - DNA, 23 bp, Homo sapiens
gagcctgtgttagtgtctgtcca

SEQ ID NO: 6213490 - DNA, 17 bp, Homo sapiens
gagcctgtttattgcca

SEQ ID NO: 6213491 - DNA, 18 bp, Homo sapiens
gagccttaatgtatttga

SEQ ID NO: 6213492 - DNA, 20 bp, Homo sapiens
gagccttaccaagactcctg

SEQ ID NO: 6213493 - DNA, 23 bp, Homo sapiens
gagccttagaggtctttaatcat

SEQ ID NO: 6213494 - DNA, 18 bp, Homo sapiens
gagccttagcagccctgg

SEQ ID NO: 6213495 - DNA, 21 bp, Homo sapiens
gagccttagcagccctggatg

SEQ ID NO: 6213496 - DNA, 17 bp, Homo sapiens
gagccttagctcccagc

SEQ ID NO: 6213497 - DNA, 22 bp, Homo sapiens
gagccttagtttcagctgacca

SEQ ID NO: 6213498 - DNA, 20 bp, Homo sapiens
gagccttatttacctagtgc

SEQ ID NO: 6213499 - DNA, 18 bp, Homo sapiens
gagccttcaagtgccaaa

SEQ ID NO: 6213500 - DNA, 17 bp, Homo sapiens
gagccttcacaaccagc

SEQ ID NO: 6213501 - DNA, 21 bp, Homo sapiens
gagccttcagaatgctcctga

SEQ ID NO: 6213502 - DNA, 16 bp, Homo sapiens
gagccttcaggccagc

SEQ ID NO: 6213503 - DNA, 19 bp, Homo sapiens
gagccttcaggccagctgg

SEQ ID NO: 6213504 - DNA, 16 bp, Homo sapiens
gagccttcagtcaggg

SEQ ID NO: 6213505 - DNA, 14 bp, Homo sapiens
gagccttccaccca

SEQ ID NO: 6213506 - DNA, 23 bp, Homo sapiens
gagccttccaccggcactcatga

SEQ ID NO: 6213507 - DNA, 12 bp, Homo sapiens
gagccttccagg

SEQ ID NO: 6213508 - DNA, 23 bp, Homo sapiens
gaaaataactgaaccaaattgca

SEQ ID NO: 6213509 - DNA, 18 bp, Homo sapiens
gaaaataactgaatttgg

SEQ ID NO: 6213510 - DNA, 17 bp, Homo sapiens
gaaaataagaaagaatt

SEQ ID NO: 6213511 - DNA, 18 bp, Homo sapiens
gaaaataagaaagaattg

SEQ ID NO: 6213512 - DNA, 18 bp, Homo sapiens
gaaaataagaatagaaat

SEQ ID NO: 6213513 - DNA, 17 bp, Homo sapiens
gaaaataagagctcagg

SEQ ID NO: 6213514 - DNA, 13 bp, Homo sapiens
gaaaataaggcac

SEQ ID NO: 6213515 - DNA, 12 bp, Homo sapiens
gaaaataagtga

SEQ ID NO: 6213516 - DNA, 16 bp, Homo sapiens
gaaaataagtgaaatt

SEQ ID NO: 6213517 - DNA, 21 bp, Homo sapiens
gaaaataagtgctctgtcaaa

SEQ ID NO: 6213518 - DNA, 20 bp, Homo sapiens
gaaaataataaaagaatcat

SEQ ID NO: 6213519 - DNA, 18 bp, Homo sapiens
gaaaataatagccatcct

SEQ ID NO: 6213520 - DNA, 20 bp, Homo sapiens
gaaaataatcaaaccaaaga

SEQ ID NO: 6213521 - DNA, 22 bp, Homo sapiens
gaaaataatcaaaccaaagagt

SEQ ID NO: 6213522 - DNA, 14 bp, Homo sapiens
gaaaataatgtttg

SEQ ID NO: 6213523 - DNA, 15 bp, Homo sapiens
gaaaataatgtttga

SEQ ID NO: 6213524 - DNA, 11 bp, Homo sapiens
gaaaataattt

SEQ ID NO: 6213525 - DNA, 15 bp, Homo sapiens
gaaaataatttctct

SEQ ID NO: 6213526 - DNA, 19 bp, Homo sapiens
gaaaataattttccaagta

SEQ ID NO: 6213527 - DNA, 13 bp, Homo sapiens
gaaaatacaataa

SEQ ID NO: 6213528 - DNA, 16 bp, Homo sapiens
gaaaatacaataaact

SEQ ID NO: 6213529 - DNA, 23 bp, Homo sapiens
gaaaataccacctcgagatgggt

SEQ ID NO: 6213530 - DNA, 22 bp, Homo sapiens
gaaaataccataggaagacata

SEQ ID NO: 6213531 - DNA, 17 bp, Homo sapiens
gaaaatactacctgtcc

SEQ ID NO: 6213532 - DNA, 15 bp, Homo sapiens
gaaaatacttaaatg

SEQ ID NO: 6213533 - DNA, 17 bp, Homo sapiens
gaaaatacttaaatgtt

SEQ ID NO: 6213534 - DNA, 21 bp, Homo sapiens
gaaaatacttaaatgttatgt

SEQ ID NO: 6213535 - DNA, 20 bp, Homo sapiens
gaaaatagaatgtggccact

SEQ ID NO: 6213536 - DNA, 13 bp, Homo sapiens
gaaaatagattag

SEQ ID NO: 6213537 - DNA, 20 bp, Homo sapiens
gaaaatagcacggggaggaa

SEQ ID NO: 6213538 - DNA, 17 bp, Homo sapiens
gaaaatagctatttttt

SEQ ID NO: 6213539 - DNA, 21 bp, Homo sapiens
gaaaatagctatttttttcct

SEQ ID NO: 6213540 - DNA, 19 bp, Homo sapiens
gaaaatagctctttcaggg

SEQ ID NO: 6213541 - DNA, 20 bp, Homo sapiens
gaaaatagggtggacagaag

SEQ ID NO: 6213542 - DNA, 14 bp, Homo sapiens
gaaaatagtgttcc

SEQ ID NO: 6213543 - DNA, 16 bp, Homo sapiens
gaaaatagttattcag

SEQ ID NO: 6213544 - DNA, 16 bp, Homo sapiens
gaaaatataaatgcat

SEQ ID NO: 6213545 - DNA, 20 bp, Homo sapiens
gaaaatataaatgcatgatt

SEQ ID NO: 6213546 - DNA, 16 bp, Homo sapiens
gaaaatataaccagcc

SEQ ID NO: 6213547 - DNA, 14 bp, Homo sapiens
gaaaatataagtaa

SEQ ID NO: 6213548 - DNA, 13 bp, Homo sapiens
gaaaatataataa

SEQ ID NO: 6213549 - DNA, 17 bp, Homo sapiens
gaaaatataataaaaga

SEQ ID NO: 6213550 - DNA, 16 bp, Homo sapiens
gaaaatatacaagtaa

SEQ ID NO: 6213551 - DNA, 15 bp, Homo sapiens
gaaaatatacatttg

SEQ ID NO: 6213552 - DNA, 14 bp, Homo sapiens
gaaaatatactgta

SEQ ID NO: 6213553 - DNA, 23 bp, Homo sapiens
gaaaatatactgtaaagaaagag

SEQ ID NO: 6213554 - DNA, 23 bp, Homo sapiens
gaaaatatatattaaaattgatt

SEQ ID NO: 6213555 - DNA, 15 bp, Homo sapiens
gaaaatatatgtatt

SEQ ID NO: 6213556 - DNA, 20 bp, Homo sapiens
gaaaatatatgtatttttat

SEQ ID NO: 6213557 - DNA, 15 bp, Homo sapiens
gaaaatatatttgca

SEQ ID NO: 6213558 - DNA, 15 bp, Homo sapiens
gaaaatatgatatat

SEQ ID NO: 6213559 - DNA, 13 bp, Homo sapiens
gaaaatatgtatt

SEQ ID NO: 6213560 - DNA, 18 bp, Homo sapiens
gaaaatatgtattaacac

SEQ ID NO: 6213561 - DNA, 19 bp, Homo sapiens
gaaaatatgtattaacact

SEQ ID NO: 6213562 - DNA, 17 bp, Homo sapiens
gaaaatattatgtgttt

SEQ ID NO: 6213563 - DNA, 18 bp, Homo sapiens
gaaaatattctaacattt

SEQ ID NO: 6213564 - DNA, 22 bp, Homo sapiens
gaaaatattgttttacaatagt

SEQ ID NO: 6213565 - DNA, 15 bp, Homo sapiens
gaaaatatttaatat

SEQ ID NO: 6213566 - DNA, 18 bp, Homo sapiens
gaaaatatttacattttg

SEQ ID NO: 6213567 - DNA, 14 bp, Homo sapiens
gaaaatatttcatt

SEQ ID NO: 6213568 - DNA, 19 bp, Homo sapiens
gaaaatatttcctgacttg

SEQ ID NO: 6213569 - DNA, 21 bp, Homo sapiens
gaaaatatttctatgtaaatt

SEQ ID NO: 6213570 - DNA, 19 bp, Homo sapiens
gaaaatattttgatcttca

SEQ ID NO: 6213571 - DNA, 23 bp, Homo sapiens
gaaaatattttgatcttcaacaa

SEQ ID NO: 6213572 - DNA, 18 bp, Homo sapiens
gaaaatattttgtctaaa

SEQ ID NO: 6213573 - DNA, 21 bp, Homo sapiens
gaaaatattttgtctaaaatg

SEQ ID NO: 6213574 - DNA, 19 bp, Homo sapiens
gaaaatatttttttccttt

SEQ ID NO: 6213575 - DNA, 15 bp, Homo sapiens
gaaaatcaaatacat

SEQ ID NO: 6213576 - DNA, 14 bp, Homo sapiens
gaaaatcaagatga

SEQ ID NO: 6213577 - DNA, 17 bp, Homo sapiens
gaaaatcactttgtcta

SEQ ID NO: 6213578 - DNA, 13 bp, Homo sapiens
gaaaatcagattt

SEQ ID NO: 6213579 - DNA, 21 bp, Homo sapiens
gaaaatcagttatattcttta

SEQ ID NO: 6213580 - DNA, 14 bp, Homo sapiens
gaaaatcagttgat

SEQ ID NO: 6213581 - DNA, 20 bp, Homo sapiens
gaaaatcatattgagaataa

SEQ ID NO: 6213582 - DNA, 15 bp, Homo sapiens
gaaaatcatcaagaa

SEQ ID NO: 6213583 - DNA, 16 bp, Homo sapiens
gaaaatcatcaagaag

SEQ ID NO: 6213584 - DNA, 21 bp, Homo sapiens
gaaaatcatcaagaagggctg

SEQ ID NO: 6213585 - DNA, 23 bp, Homo sapiens
gaaaatcctatatctgtttgtat

SEQ ID NO: 6213586 - DNA, 15 bp, Homo sapiens
gaaaatcctctggct

SEQ ID NO: 6213587 - DNA, 14 bp, Homo sapiens
gaaaatcgaggaag

SEQ ID NO: 6213588 - DNA, 19 bp, Homo sapiens
gaaaatcgagttggcaaaa

SEQ ID NO: 6213589 - DNA, 21 bp, Homo sapiens
gaaaatctagaggaaaagaaa

SEQ ID NO: 6213590 - DNA, 17 bp, Homo sapiens
gaaaatctgaattggaa

SEQ ID NO: 6213591 - DNA, 18 bp, Homo sapiens
gaaaatctgaattggaat

SEQ ID NO: 6213592 - DNA, 22 bp, Homo sapiens
gaaaatcttagtatagtagaaa

SEQ ID NO: 6213593 - DNA, 21 bp, Homo sapiens
gaaaatgaaagtgttaatttt

SEQ ID NO: 6213594 - DNA, 14 bp, Homo sapiens
gaaaatgaaatgca

SEQ ID NO: 6213595 - DNA, 17 bp, Homo sapiens
gaaaatgaaatgcatat

SEQ ID NO: 6213596 - DNA, 18 bp, Homo sapiens
gaaaatgaaatgcatatt

SEQ ID NO: 6213597 - DNA, 16 bp, Homo sapiens
gaaaatgaactgccca

SEQ ID NO: 6213598 - DNA, 12 bp, Homo sapiens
gaaaatgaattt

SEQ ID NO: 6213599 - DNA, 13 bp, Homo sapiens
gaaaatgaatttg

SEQ ID NO: 6213600 - DNA, 17 bp, Homo sapiens
gaaaatgaatttgactg

SEQ ID NO: 6213601 - DNA, 18 bp, Homo sapiens
gaaaatgagaaaggacag

SEQ ID NO: 6213602 - DNA, 22 bp, Homo sapiens
gaaaatgagaaaggacagagcc

SEQ ID NO: 6213603 - DNA, 14 bp, Homo sapiens
gaaaatgagccctg

SEQ ID NO: 6213604 - DNA, 21 bp, Homo sapiens
gaaaatgagttgtgaaagttt

SEQ ID NO: 6213605 - DNA, 20 bp, Homo sapiens
gaaaatgatacgcaacataa

SEQ ID NO: 6213606 - DNA, 12 bp, Homo sapiens
gaaaatgcaaag

SEQ ID NO: 6213607 - DNA, 13 bp, Homo sapiens
gaaaatgcaactc

SEQ ID NO: 6213608 - DNA, 16 bp, Homo sapiens
gaaaatgcaccaaata

SEQ ID NO: 6213609 - DNA, 23 bp, Homo sapiens
gaaaatgcagcagggatgccctg

SEQ ID NO: 6213610 - DNA, 19 bp, Homo sapiens
gaaaatgcagccttaaaca

SEQ ID NO: 6213611 - DNA, 20 bp, Homo sapiens
gaaaatgcattagggaaaac

SEQ ID NO: 6213612 - DNA, 21 bp, Homo sapiens
gaaaatgcattgtatcgatgt

SEQ ID NO: 6213613 - DNA, 12 bp, Homo sapiens
gaaaatgccacc

SEQ ID NO: 6213614 - DNA, 23 bp, Homo sapiens
gaaaatgccaccatccaataaaa

SEQ ID NO: 6213615 - DNA, 21 bp, Homo sapiens
gaaaatgccatgaaaattgct

SEQ ID NO: 6213616 - DNA, 15 bp, Homo sapiens
gaaaatgccctgtcc

SEQ ID NO: 6213617 - DNA, 23 bp, Homo sapiens
gaaaatgccctgtccctagctca

SEQ ID NO: 6213618 - DNA, 15 bp, Homo sapiens
gaaaatgcggttata

SEQ ID NO: 6213619 - DNA, 19 bp, Homo sapiens
gaaaatgctcttaaaatat

SEQ ID NO: 6213620 - DNA, 14 bp, Homo sapiens
gaaaatgctgccta

SEQ ID NO: 6213621 - DNA, 13 bp, Homo sapiens
gaaaatgctttct

SEQ ID NO: 6213622 - DNA, 15 bp, Homo sapiens
gaaaatgctttctca

SEQ ID NO: 6213623 - DNA, 20 bp, Homo sapiens
gaaaatgctttgaaaatgtt

SEQ ID NO: 6213624 - DNA, 14 bp, Homo sapiens
gaaaatggaaagaa

SEQ ID NO: 6213625 - DNA, 15 bp, Homo sapiens
gaaaatggaaagaag

SEQ ID NO: 6213626 - DNA, 16 bp, Homo sapiens
gaaaatggaaagaagg

SEQ ID NO: 6213627 - DNA, 19 bp, Homo sapiens
gaaaatggaaagaaggaaa

SEQ ID NO: 6213628 - DNA, 21 bp, Homo sapiens
gaaaatggaaagaaggaaaaa

SEQ ID NO: 6213629 - DNA, 21 bp, Homo sapiens
gaaaatggaagacagctctta

SEQ ID NO: 6213630 - DNA, 14 bp, Homo sapiens
gaaaatggaagacc

SEQ ID NO: 6213631 - DNA, 18 bp, Homo sapiens
gaaaatggaattactcca

SEQ ID NO: 6213632 - DNA, 19 bp, Homo sapiens
gaaaatggatgacaaagaa

SEQ ID NO: 6213633 - DNA, 22 bp, Homo sapiens
gaaaatggatgacaaagaaaat

SEQ ID NO: 6213634 - DNA, 22 bp, Homo sapiens
gaaaatggccatgcaggaggtg

SEQ ID NO: 6213635 - DNA, 15 bp, Homo sapiens
gaaaatggctgaaga

SEQ ID NO: 6213636 - DNA, 23 bp, Homo sapiens
gaaaatggggcttgccctgggtc

SEQ ID NO: 6213637 - DNA, 22 bp, Homo sapiens
gaaaatggtccaattagtttcc

SEQ ID NO: 6213638 - DNA, 23 bp, Homo sapiens
gaaaatggtccaattagtttcct

SEQ ID NO: 6213639 - DNA, 23 bp, Homo sapiens
gaaaatgtaaaataaaggctctg

SEQ ID NO: 6213640 - DNA, 15 bp, Homo sapiens
gaaaatgtaaaggag

SEQ ID NO: 6213641 - DNA, 20 bp, Homo sapiens
gaaaatgtaaaggagggaga

SEQ ID NO: 6213642 - DNA, 13 bp, Homo sapiens
gaaaatgtaaatt

SEQ ID NO: 6213643 - DNA, 16 bp, Homo sapiens
gaaaatgtaacttttc

SEQ ID NO: 6213644 - DNA, 12 bp, Homo sapiens
gaaaatgtactg

SEQ ID NO: 6213645 - DNA, 19 bp, Homo sapiens
gaaaatgtactgagatttt

SEQ ID NO: 6213646 - DNA, 15 bp, Homo sapiens
gaaaatgtatccaag

SEQ ID NO: 6213647 - DNA, 18 bp, Homo sapiens
gaaaatgtatccagagga

SEQ ID NO: 6213648 - DNA, 23 bp, Homo sapiens
gaaaatgtatggatgaattctga

SEQ ID NO: 6213649 - DNA, 15 bp, Homo sapiens
gaaaatgtatgtgta

SEQ ID NO: 6213650 - DNA, 17 bp, Homo sapiens
gaaaatgtcactgttat

SEQ ID NO: 6213651 - DNA, 22 bp, Homo sapiens
gaaaatgtcagaaaccagttat

SEQ ID NO: 6213652 - DNA, 17 bp, Homo sapiens
gaaaatgtccttgtgat

SEQ ID NO: 6213653 - DNA, 20 bp, Homo sapiens
gaaaatgtctcagtatttta

SEQ ID NO: 6213654 - DNA, 17 bp, Homo sapiens
gaaaatgtctgtaataa

SEQ ID NO: 6213655 - DNA, 14 bp, Homo sapiens
gaaaatgtgtatac

SEQ ID NO: 6213656 - DNA, 17 bp, Homo sapiens
gaaaatgtgtctctgct

SEQ ID NO: 6213657 - DNA, 19 bp, Homo sapiens
gaaaatgtgtctctgcttt

SEQ ID NO: 6213658 - DNA, 13 bp, Homo sapiens
gaaaatgtgtctg

SEQ ID NO: 6213659 - DNA, 21 bp, Homo sapiens
gaaaatgtgtctgcaacatgg

SEQ ID NO: 6213660 - DNA, 14 bp, Homo sapiens
gaaaatgtgtgttt

SEQ ID NO: 6213661 - DNA, 16 bp, Homo sapiens
gaaaatgttatttaac

SEQ ID NO: 6213662 - DNA, 15 bp, Homo sapiens
gaaaatgttcttcca

SEQ ID NO: 6213663 - DNA, 20 bp, Homo sapiens
gaaaatgttgagaatcccaa

SEQ ID NO: 6213664 - DNA, 19 bp, Homo sapiens
gaaaatgttttgtaagaaa

SEQ ID NO: 6213665 - DNA, 20 bp, Homo sapiens
gaaaatgtttttctgccagg

SEQ ID NO: 6213666 - DNA, 18 bp, Homo sapiens
gaaaattaaaataggcat

SEQ ID NO: 6213667 - DNA, 21 bp, Homo sapiens
gaaaattaaaataggcatatt

SEQ ID NO: 6213668 - DNA, 14 bp, Homo sapiens
gaaaattaaactac

SEQ ID NO: 6213669 - DNA, 17 bp, Homo sapiens
gaaaattaaattttaga

SEQ ID NO: 6213670 - DNA, 15 bp, Homo sapiens
gaaaattaacactgc

SEQ ID NO: 6213671 - DNA, 14 bp, Homo sapiens
gaaaattaatatca

SEQ ID NO: 6213672 - DNA, 11 bp, Homo sapiens
gaaaattacac

SEQ ID NO: 6213673 - DNA, 16 bp, Homo sapiens
gaaaattacgttctta

SEQ ID NO: 6213674 - DNA, 22 bp, Homo sapiens
gaaaattaggatttcatgattt

SEQ ID NO: 6213675 - DNA, 22 bp, Homo sapiens
gaaaattagtgaccattattca

SEQ ID NO: 6213676 - DNA, 17 bp, Homo sapiens
gaaaattatttgtatga

SEQ ID NO: 6213677 - DNA, 20 bp, Homo sapiens
gaaaattattttgttcatac

SEQ ID NO: 6213678 - DNA, 23 bp, Homo sapiens
gaaaattattttgttcatacata

SEQ ID NO: 6213679 - DNA, 19 bp, Homo sapiens
gaaaattcaaaaagtgttt

SEQ ID NO: 6213680 - DNA, 22 bp, Homo sapiens
gaaaattcaaaaagtgtttatt

SEQ ID NO: 6213681 - DNA, 18 bp, Homo sapiens
gaaaattcactattggct

SEQ ID NO: 6213682 - DNA, 19 bp, Homo sapiens
gaaaattcagataatggta

SEQ ID NO: 6213683 - DNA, 22 bp, Homo sapiens
gaaaattcatttcacattaatg

SEQ ID NO: 6213684 - DNA, 21 bp, Homo sapiens
gaaaattcctattgattttct

SEQ ID NO: 6213685 - DNA, 16 bp, Homo sapiens
gagccttccaggggtg

SEQ ID NO: 6213686 - DNA, 17 bp, Homo sapiens
gagccttccaggggtgg

SEQ ID NO: 6213687 - DNA, 19 bp, Homo sapiens
gagccttccatgacctccc

SEQ ID NO: 6213688 - DNA, 17 bp, Homo sapiens
gagccttcccgggcggg

SEQ ID NO: 6213689 - DNA, 21 bp, Homo sapiens
gagccttcctttctcctgccc

SEQ ID NO: 6213690 - DNA, 20 bp, Homo sapiens
gagccttcgtgccccccctt

SEQ ID NO: 6213691 - DNA, 20 bp, Homo sapiens
gagccttctcaccccaggat

SEQ ID NO: 6213692 - DNA, 17 bp, Homo sapiens
gagccttctcagaagca

SEQ ID NO: 6213693 - DNA, 15 bp, Homo sapiens
gagccttctgccacc

SEQ ID NO: 6213694 - DNA, 13 bp, Homo sapiens
gagccttgaactt

SEQ ID NO: 6213695 - DNA, 20 bp, Homo sapiens
gagccttgataatacttgac

SEQ ID NO: 6213696 - DNA, 22 bp, Homo sapiens
gagccttgcagatatctgcatg

SEQ ID NO: 6213697 - DNA, 21 bp, Homo sapiens
gagccttgcatgtacttgaag

SEQ ID NO: 6213698 - DNA, 15 bp, Homo sapiens
gagccttgctctgtt

SEQ ID NO: 6213699 - DNA, 17 bp, Homo sapiens
gagccttgctgccaagt

SEQ ID NO: 6213700 - DNA, 20 bp, Homo sapiens
gagccttgctgggccaggga

SEQ ID NO: 6213701 - DNA, 14 bp, Homo sapiens
gagccttgggagcc

SEQ ID NO: 6213702 - DNA, 19 bp, Homo sapiens
gagccttggtgtccacctg

SEQ ID NO: 6213703 - DNA, 18 bp, Homo sapiens
gagccttggttcatcagt

SEQ ID NO: 6213704 - DNA, 17 bp, Homo sapiens
gagccttgttggtggag

SEQ ID NO: 6213705 - DNA, 15 bp, Homo sapiens
gagcctttatacaat

SEQ ID NO: 6213706 - DNA, 15 bp, Homo sapiens
gagcctttgccttta

SEQ ID NO: 6213707 - DNA, 18 bp, Homo sapiens
gagcctttggtgaataac

SEQ ID NO: 6213708 - DNA, 23 bp, Homo sapiens
gagcctttggttctggccagaat

SEQ ID NO: 6213709 - DNA, 19 bp, Homo sapiens
gagccttttaactgtgcaa

SEQ ID NO: 6213710 - DNA, 18 bp, Homo sapiens
gagccttttatctgcaga

SEQ ID NO: 6213711 - DNA, 16 bp, Homo sapiens
gagccttttattaaca

SEQ ID NO: 6213712 - DNA, 15 bp, Homo sapiens
gagccttttcttata

SEQ ID NO: 6213713 - DNA, 18 bp, Homo sapiens
gagccttttgctctctgt

SEQ ID NO: 6213714 - DNA, 20 bp, Homo sapiens
gagcctttttaaaacacatg

SEQ ID NO: 6213715 - DNA, 15 bp, Homo sapiens
gagcgaaagtttctt

SEQ ID NO: 6213716 - DNA, 21 bp, Homo sapiens
gagcgaagggggtcaaaggaa

SEQ ID NO: 6213717 - DNA, 14 bp, Homo sapiens
gagcgacagagcag

SEQ ID NO: 6213718 - DNA, 20 bp, Homo sapiens
gagcgaccagcaggctcctc

SEQ ID NO: 6213719 - DNA, 21 bp, Homo sapiens
gagcgaccagcaggctcctca

SEQ ID NO: 6213720 - DNA, 14 bp, Homo sapiens
gagcgaccctggct

SEQ ID NO: 6213721 - DNA, 14 bp, Homo sapiens
gagcgacggctcct

SEQ ID NO: 6213722 - DNA, 23 bp, Homo sapiens
gagcgacgtttatttcatctctt

SEQ ID NO: 6213723 - DNA, 15 bp, Homo sapiens
gagcgagaccctgtc

SEQ ID NO: 6213724 - DNA, 17 bp, Homo sapiens
gagcgagagatcaaaga

SEQ ID NO: 6213725 - DNA, 17 bp, Homo sapiens
gagcgagagggaggcag

SEQ ID NO: 6213726 - DNA, 16 bp, Homo sapiens
gagcgagcgctaccca

SEQ ID NO: 6213727 - DNA, 13 bp, Homo sapiens
gagcgaggaaaaa

SEQ ID NO: 6213728 - DNA, 16 bp, Homo sapiens
gagcgaggaaaaacaa

SEQ ID NO: 6213729 - DNA, 21 bp, Homo sapiens
gagcgaggaaaaacaacaaat

SEQ ID NO: 6213730 - DNA, 19 bp, Homo sapiens
gagcgaggaggcgcggcct

SEQ ID NO: 6213731 - DNA, 16 bp, Homo sapiens
gagcgaggtcagagga

SEQ ID NO: 6213732 - DNA, 17 bp, Homo sapiens
gagcgaggtcagaggag

SEQ ID NO: 6213733 - DNA, 16 bp, Homo sapiens
gagcgagtggagtctg

SEQ ID NO: 6213734 - DNA, 21 bp, Homo sapiens
gagcgatcatttatttcatga

SEQ ID NO: 6213735 - DNA, 17 bp, Homo sapiens
gagcgatgtgttctttg

SEQ ID NO: 6213736 - DNA, 13 bp, Homo sapiens
gagcgcaagatag

SEQ ID NO: 6213737 - DNA, 21 bp, Homo sapiens
gagcgcaagccacagcctgtc

SEQ ID NO: 6213738 - DNA, 16 bp, Homo sapiens
gagcgcacctcgccgt

SEQ ID NO: 6213739 - DNA, 20 bp, Homo sapiens
gagcgcacctgccccctggt

SEQ ID NO: 6213740 - DNA, 17 bp, Homo sapiens
gagcgcacctgcttccc

SEQ ID NO: 6213741 - DNA, 15 bp, Homo sapiens
gagcgcagcccccac

SEQ ID NO: 6213742 - DNA, 20 bp, Homo sapiens
gagcgcagcgcctccaccct

SEQ ID NO: 6213743 - DNA, 21 bp, Homo sapiens
gagcgcagcgcctccaccctg

SEQ ID NO: 6213744 - DNA, 12 bp, Homo sapiens
gagcgcaggcag

SEQ ID NO: 6213745 - DNA, 13 bp, Homo sapiens
gagcgcaggcagc

SEQ ID NO: 6213746 - DNA, 21 bp, Homo sapiens
gagcgcaggcagcgcagggct

SEQ ID NO: 6213747 - DNA, 13 bp, Homo sapiens
gagcgccacccgc

SEQ ID NO: 6213748 - DNA, 14 bp, Homo sapiens
gagcgccacccgcc

SEQ ID NO: 6213749 - DNA, 16 bp, Homo sapiens
gagcgccacccgcccg

SEQ ID NO: 6213750 - DNA, 22 bp, Homo sapiens
gagcgccacccgcccgcccccg

SEQ ID NO: 6213751 - DNA, 23 bp, Homo sapiens
gagcgccacccgcccgcccccgc

SEQ ID NO: 6213752 - DNA, 16 bp, Homo sapiens
gagcgccaggaagcca

SEQ ID NO: 6213753 - DNA, 18 bp, Homo sapiens
gagcgccaggaagccaga

SEQ ID NO: 6213754 - DNA, 17 bp, Homo sapiens
gagcgccatcatgtctt

SEQ ID NO: 6213755 - DNA, 15 bp, Homo sapiens
gagcgcccccgagcc

SEQ ID NO: 6213756 - DNA, 18 bp, Homo sapiens
gagcgcccccgagccctg

SEQ ID NO: 6213757 - DNA, 22 bp, Homo sapiens
gagcgcccccgagccctgactc

SEQ ID NO: 6213758 - DNA, 20 bp, Homo sapiens
gagcgcccgccgtctgctcc

SEQ ID NO: 6213759 - DNA, 14 bp, Homo sapiens
gagcgccctgcaga

SEQ ID NO: 6213760 - DNA, 20 bp, Homo sapiens
gagcgccctgcagaccctgc

SEQ ID NO: 6213761 - DNA, 22 bp, Homo sapiens
gagcgccctgcagaccctgccc

SEQ ID NO: 6213762 - DNA, 23 bp, Homo sapiens
gagcgccctgcagaccctgccct

SEQ ID NO: 6213763 - DNA, 22 bp, Homo sapiens
gagcgccgtgagttctcagggc

SEQ ID NO: 6213764 - DNA, 23 bp, Homo sapiens
gagcgcctccatccaaggccagg

SEQ ID NO: 6213765 - DNA, 15 bp, Homo sapiens
gagcgcctcttcctc

SEQ ID NO: 6213766 - DNA, 16 bp, Homo sapiens
gagcgcctcttcctct

SEQ ID NO: 6213767 - DNA, 16 bp, Homo sapiens
gagcgcgcccctagcc

SEQ ID NO: 6213768 - DNA, 16 bp, Homo sapiens
gagcgcggctggctct

SEQ ID NO: 6213769 - DNA, 17 bp, Homo sapiens
gagcgcggctggctctg

SEQ ID NO: 6213770 - DNA, 17 bp, Homo sapiens
gagcgctagtgccttgc

SEQ ID NO: 6213771 - DNA, 15 bp, Homo sapiens
gagcgctcctctgcc

SEQ ID NO: 6213772 - DNA, 20 bp, Homo sapiens
gagcgctcctctgccttgga

SEQ ID NO: 6213773 - DNA, 22 bp, Homo sapiens
gagcgctcctgccgcagagctg

SEQ ID NO: 6213774 - DNA, 23 bp, Homo sapiens
gagcgctcctgccgcagagctgg

SEQ ID NO: 6213775 - DNA, 17 bp, Homo sapiens
gagcgctggcctcttcc

SEQ ID NO: 6213776 - DNA, 18 bp, Homo sapiens
gagcgctgtggactgtcc

SEQ ID NO: 6213777 - DNA, 19 bp, Homo sapiens
gagcgcttcagttcagctt

SEQ ID NO: 6213778 - DNA, 18 bp, Homo sapiens
gagcgctttctggaaaag

SEQ ID NO: 6213779 - DNA, 18 bp, Homo sapiens
gagcggactcacttgatg

SEQ ID NO: 6213780 - DNA, 17 bp, Homo sapiens
gagcggagaaaggaagg

SEQ ID NO: 6213781 - DNA, 18 bp, Homo sapiens
gagcggagaaaggaaggg

SEQ ID NO: 6213782 - DNA, 21 bp, Homo sapiens
gagcggagaaaggaagggctg

SEQ ID NO: 6213783 - DNA, 21 bp, Homo sapiens
gagcggagaggaagccagctg

SEQ ID NO: 6213784 - DNA, 14 bp, Homo sapiens
gagcggagatgagg

SEQ ID NO: 6213785 - DNA, 13 bp, Homo sapiens
gagcggagcccga

SEQ ID NO: 6213786 - DNA, 16 bp, Homo sapiens
gagcggagcttgcctg

SEQ ID NO: 6213787 - DNA, 17 bp, Homo sapiens
gagcggaggaggaagtc

SEQ ID NO: 6213788 - DNA, 16 bp, Homo sapiens
gagcggcgatgcactc

SEQ ID NO: 6213789 - DNA, 16 bp, Homo sapiens
gagcggcgcagagccc

SEQ ID NO: 6213790 - DNA, 20 bp, Homo sapiens
gagcggcgcagagccctcca

SEQ ID NO: 6213791 - DNA, 20 bp, Homo sapiens
gagcggcgccctggacttgg

SEQ ID NO: 6213792 - DNA, 14 bp, Homo sapiens
gagcggctctcctg

SEQ ID NO: 6213793 - DNA, 15 bp, Homo sapiens
gagcggctgaggacg

SEQ ID NO: 6213794 - DNA, 23 bp, Homo sapiens
gagcggctgaggacggggcagag

SEQ ID NO: 6213795 - DNA, 12 bp, Homo sapiens
gagcggctgctc

SEQ ID NO: 6213796 - DNA, 20 bp, Homo sapiens
gagcggctgctcgcccagga

SEQ ID NO: 6213797 - DNA, 21 bp, Homo sapiens
gagcggctgctcgcccaggaa

SEQ ID NO: 6213798 - DNA, 15 bp, Homo sapiens
gagcggctggagaaa

SEQ ID NO: 6213799 - DNA, 23 bp, Homo sapiens
gagcggcttccccattgccttct

SEQ ID NO: 6213800 - DNA, 17 bp, Homo sapiens
gagcgggacctgtggct

SEQ ID NO: 6213801 - DNA, 13 bp, Homo sapiens
gagcgggaggcag

SEQ ID NO: 6213802 - DNA, 20 bp, Homo sapiens
gagcgggagggagtctcagg

SEQ ID NO: 6213803 - DNA, 16 bp, Homo sapiens
gagcgggagtcaggga

SEQ ID NO: 6213804 - DNA, 15 bp, Homo sapiens
gagcgggcagggccg

SEQ ID NO: 6213805 - DNA, 13 bp, Homo sapiens
gagcggggaggtg

SEQ ID NO: 6213806 - DNA, 14 bp, Homo sapiens
gagcggggaggtgc

SEQ ID NO: 6213807 - DNA, 23 bp, Homo sapiens
gagcggtggccctgtccctccca

SEQ ID NO: 6213808 - DNA, 16 bp, Homo sapiens
gagcgtcactgcccac

SEQ ID NO: 6213809 - DNA, 23 bp, Homo sapiens
gagcgtcagggttggtgtgctga

SEQ ID NO: 6213810 - DNA, 15 bp, Homo sapiens
gagcgtccttgtccc

SEQ ID NO: 6213811 - DNA, 17 bp, Homo sapiens
gagcgtccttgtccccg

SEQ ID NO: 6213812 - DNA, 16 bp, Homo sapiens
gagcgtgaatctgtat

SEQ ID NO: 6213813 - DNA, 17 bp, Homo sapiens
gagcgtgagctgagcag

SEQ ID NO: 6213814 - DNA, 14 bp, Homo sapiens
gagcgtgattctgt

SEQ ID NO: 6213815 - DNA, 17 bp, Homo sapiens
gagcgtgcgtctgtgtg

SEQ ID NO: 6213816 - DNA, 21 bp, Homo sapiens
gagcgtggaagggggaggagt

SEQ ID NO: 6213817 - DNA, 18 bp, Homo sapiens
gagcgtggccttgggagg

SEQ ID NO: 6213818 - DNA, 19 bp, Homo sapiens
gagcgtggccttgggagga

SEQ ID NO: 6213819 - DNA, 21 bp, Homo sapiens
gagcgtggccttgggaggaca

SEQ ID NO: 6213820 - DNA, 22 bp, Homo sapiens
gagcgtgggaggcgggagtgga

SEQ ID NO: 6213821 - DNA, 21 bp, Homo sapiens
gagcgtgggctcagcagggct

SEQ ID NO: 6213822 - DNA, 16 bp, Homo sapiens
gagcgtggggaggggc

SEQ ID NO: 6213823 - DNA, 18 bp, Homo sapiens
gagcgtgtcctatccccg

SEQ ID NO: 6213824 - DNA, 23 bp, Homo sapiens
gagcgtgtcctatccccggacgc

SEQ ID NO: 6213825 - DNA, 16 bp, Homo sapiens
gagcgtgtgcggctcc

SEQ ID NO: 6213826 - DNA, 23 bp, Homo sapiens
gagcgtgtgcggctccagcccag

SEQ ID NO: 6213827 - DNA, 20 bp, Homo sapiens
gagcgttagactgacttgtt

SEQ ID NO: 6213828 - DNA, 17 bp, Homo sapiens
gagcgttcaccagtgac

SEQ ID NO: 6213829 - DNA, 19 bp, Homo sapiens
gagctaaactccttcctgg

SEQ ID NO: 6213830 - DNA, 19 bp, Homo sapiens
gagctaaattacaattgtc

SEQ ID NO: 6213831 - DNA, 15 bp, Homo sapiens
gagctaacactggcc

SEQ ID NO: 6213832 - DNA, 19 bp, Homo sapiens
gagctaaccccaagctgcc

SEQ ID NO: 6213833 - DNA, 23 bp, Homo sapiens
gagctaaccccaagctgcctctg

SEQ ID NO: 6213834 - DNA, 13 bp, Homo sapiens
gagctaaggccaa

SEQ ID NO: 6213835 - DNA, 17 bp, Homo sapiens
gagctaaggccagctag

SEQ ID NO: 6213836 - DNA, 11 bp, Homo sapiens
gagctaaggct

SEQ ID NO: 6213837 - DNA, 23 bp, Homo sapiens
gagctaagggtgggtgctcagaa

SEQ ID NO: 6213838 - DNA, 15 bp, Homo sapiens
gagctaagttctaag

SEQ ID NO: 6213839 - DNA, 14 bp, Homo sapiens
gagctaataaatct

SEQ ID NO: 6213840 - DNA, 14 bp, Homo sapiens
gagctacaaatgca

SEQ ID NO: 6213841 - DNA, 23 bp, Homo sapiens
gagctacacaggggaaaagagga

SEQ ID NO: 6213842 - DNA, 13 bp, Homo sapiens
gagctaccaggaa

SEQ ID NO: 6213843 - DNA, 18 bp, Homo sapiens
gagctaccaggaagaggg

SEQ ID NO: 6213844 - DNA, 19 bp, Homo sapiens
gagctaccaggaagagggg

SEQ ID NO: 6213845 - DNA, 13 bp, Homo sapiens
gagctacctgggg

SEQ ID NO: 6213846 - DNA, 20 bp, Homo sapiens
gagctacctgtgtggacagg

SEQ ID NO: 6213847 - DNA, 22 bp, Homo sapiens
gagctactagagatattcttat

SEQ ID NO: 6213848 - DNA, 16 bp, Homo sapiens
gagctactcccacagc

SEQ ID NO: 6213849 - DNA, 15 bp, Homo sapiens
gagctactctcttgc

SEQ ID NO: 6213850 - DNA, 20 bp, Homo sapiens
gagctactctcttgccagca

SEQ ID NO: 6213851 - DNA, 13 bp, Homo sapiens
gagctactgatga

SEQ ID NO: 6213852 - DNA, 14 bp, Homo sapiens
gagctactgatgaa

SEQ ID NO: 6213853 - DNA, 18 bp, Homo sapiens
gagctactgatgaaatct

SEQ ID NO: 6213854 - DNA, 15 bp, Homo sapiens
gagctacttcttatt

SEQ ID NO: 6213855 - DNA, 20 bp, Homo sapiens
gagctacttgggccatagct

SEQ ID NO: 6213856 - DNA, 17 bp, Homo sapiens
gagctagaacctggaga

SEQ ID NO: 6213857 - DNA, 21 bp, Homo sapiens
gagctagaacctggagggcta

SEQ ID NO: 6213858 - DNA, 19 bp, Homo sapiens
gagctagaccaaggtcaga

SEQ ID NO: 6213859 - DNA, 19 bp, Homo sapiens
gagctagagaggggcctct

SEQ ID NO: 6213860 - DNA, 23 bp, Homo sapiens
gagctagagaggggcctctggct

SEQ ID NO: 6213861 - DNA, 12 bp, Homo sapiens
gagctagaggcc

SEQ ID NO: 6213862 - DNA, 22 bp, Homo sapiens
gaaaattctaacccaggtatcc

SEQ ID NO: 6213863 - DNA, 22 bp, Homo sapiens
gaaaattctcaagtgatagtct

SEQ ID NO: 6213864 - DNA, 11 bp, Homo sapiens
gaaaattctgg

SEQ ID NO: 6213865 - DNA, 18 bp, Homo sapiens
gaaaattgaaagtattca

SEQ ID NO: 6213866 - DNA, 21 bp, Homo sapiens
gaaaattgaaagtattcagaa

SEQ ID NO: 6213867 - DNA, 13 bp, Homo sapiens
gaaaattgaattt

SEQ ID NO: 6213868 - DNA, 17 bp, Homo sapiens
gaaaattgaatttaaca

SEQ ID NO: 6213869 - DNA, 18 bp, Homo sapiens
gaaaattgaatttaacaa

SEQ ID NO: 6213870 - DNA, 24 bp, Homo sapiens
gaaaattgaggtttggaagagtga

SEQ ID NO: 6213871 - DNA, 12 bp, Homo sapiens
gaaaattgagtt

SEQ ID NO: 6213872 - DNA, 14 bp, Homo sapiens
gaaaattgccaaaa

SEQ ID NO: 6213873 - DNA, 17 bp, Homo sapiens
gaaaattgccaaaatat

SEQ ID NO: 6213874 - DNA, 17 bp, Homo sapiens
gaaaattgcctttctgt

SEQ ID NO: 6213875 - DNA, 20 bp, Homo sapiens
gaaaattgcctttctgtgtt

SEQ ID NO: 6213876 - DNA, 21 bp, Homo sapiens
gaaaattgcctttctgtgttt

SEQ ID NO: 6213877 - DNA, 15 bp, Homo sapiens
gaaaattggacatta

SEQ ID NO: 6213878 - DNA, 23 bp, Homo sapiens
gaaaatttacaaaatttattctc

SEQ ID NO: 6213879 - DNA, 22 bp, Homo sapiens
gaaaatttagccctttaaaacg

SEQ ID NO: 6213880 - DNA, 14 bp, Homo sapiens
gaaaatttatataa

SEQ ID NO: 6213881 - DNA, 16 bp, Homo sapiens
gaaaatttatataact

SEQ ID NO: 6213882 - DNA, 19 bp, Homo sapiens
gaaaatttcacttgaaatt

SEQ ID NO: 6213883 - DNA, 15 bp, Homo sapiens
gaaaatttgctttaa

SEQ ID NO: 6213884 - DNA, 17 bp, Homo sapiens
gaaaatttgttattttg

SEQ ID NO: 6213885 - DNA, 14 bp, Homo sapiens
gaaaatttgtttga

SEQ ID NO: 6213886 - DNA, 19 bp, Homo sapiens
gaaaattttaaaaatacat

SEQ ID NO: 6213887 - DNA, 20 bp, Homo sapiens
gaaaattttaccagcagaag

SEQ ID NO: 6213888 - DNA, 14 bp, Homo sapiens
gaaaattttacttc

SEQ ID NO: 6213889 - DNA, 13 bp, Homo sapiens
gaaaattttatgt

SEQ ID NO: 6213890 - DNA, 12 bp, Homo sapiens
gaaaattttctc

SEQ ID NO: 6213891 - DNA, 17 bp, Homo sapiens
gaaaattttcttcttta

SEQ ID NO: 6213892 - DNA, 18 bp, Homo sapiens
gaaaattttgatgtttta

SEQ ID NO: 6213893 - DNA, 13 bp, Homo sapiens
gaaaattttgtaa

SEQ ID NO: 6213894 - DNA, 17 bp, Homo sapiens
gaaaattttgtaaaaca

SEQ ID NO: 6213895 - DNA, 21 bp, Homo sapiens
gaaaattttgtaaaacaatgc

SEQ ID NO: 6213896 - DNA, 13 bp, Homo sapiens
gaaaatttttgta

SEQ ID NO: 6213897 - DNA, 23 bp, Homo sapiens
gaaacaaaaatgatcctcagtgc

SEQ ID NO: 6213898 - DNA, 17 bp, Homo sapiens
gaaacaaaatataaatc

SEQ ID NO: 6213899 - DNA, 23 bp, Homo sapiens
gaaacaaaatataaatcacagat

SEQ ID NO: 6213900 - DNA, 22 bp, Homo sapiens
gaaacaaaatgaaaaaaaaagg

SEQ ID NO: 6213901 - DNA, 12 bp, Homo sapiens
gaaacaaaatgt

SEQ ID NO: 6213902 - DNA, 19 bp, Homo sapiens
gaaacaaacaaaactctta

SEQ ID NO: 6213903 - DNA, 20 bp, Homo sapiens
gaaacaaacaaaactcttaa

SEQ ID NO: 6213904 - DNA, 12 bp, Homo sapiens
gaaacaaacttt

SEQ ID NO: 6213905 - DNA, 17 bp, Homo sapiens
gaaacaaagcaaatttc

SEQ ID NO: 6213906 - DNA, 15 bp, Homo sapiens
gaaacaaagggtttt

SEQ ID NO: 6213907 - DNA, 19 bp, Homo sapiens
gaaacaaagggttttcttt

SEQ ID NO: 6213908 - DNA, 18 bp, Homo sapiens
gaaacaaagtggaaggaa

SEQ ID NO: 6213909 - DNA, 23 bp, Homo sapiens
gaaacaaagtggaaggaaagatg

SEQ ID NO: 6213910 - DNA, 14 bp, Homo sapiens
gaaacaaataatca

SEQ ID NO: 6213911 - DNA, 20 bp, Homo sapiens
gaaacaaataatttgaactt

SEQ ID NO: 6213912 - DNA, 13 bp, Homo sapiens
gaaacaaatatac

SEQ ID NO: 6213913 - DNA, 18 bp, Homo sapiens
gaaacaaatgtgtataaa

SEQ ID NO: 6213914 - DNA, 17 bp, Homo sapiens
gaaacaaatttttttct

SEQ ID NO: 6213915 - DNA, 12 bp, Homo sapiens
gaaacaacaaaa

SEQ ID NO: 6213916 - DNA, 15 bp, Homo sapiens
gaaacaacaaaggaa

SEQ ID NO: 6213917 - DNA, 19 bp, Homo sapiens
gaaacaacacccaagatga

SEQ ID NO: 6213918 - DNA, 16 bp, Homo sapiens
gaaacaacactgtagt

SEQ ID NO: 6213919 - DNA, 15 bp, Homo sapiens
gaaacaacattattt

SEQ ID NO: 6213920 - DNA, 16 bp, Homo sapiens
gaaacaactcatgtct

SEQ ID NO: 6213921 - DNA, 17 bp, Homo sapiens
gaaacaagaagagtaaa

SEQ ID NO: 6213922 - DNA, 22 bp, Homo sapiens
gaaacaagaggtaccaaaaaag

SEQ ID NO: 6213923 - DNA, 15 bp, Homo sapiens
gaaacaagctgtgca

SEQ ID NO: 6213924 - DNA, 12 bp, Homo sapiens
gaaacaaggaag

SEQ ID NO: 6213925 - DNA, 15 bp, Homo sapiens
gaaacaagtattttg

SEQ ID NO: 6213926 - DNA, 17 bp, Homo sapiens
gaaacaagtgaaagcat

SEQ ID NO: 6213927 - DNA, 20 bp, Homo sapiens
gaaacaagtgaccccagggc

SEQ ID NO: 6213928 - DNA, 22 bp, Homo sapiens
gaaacaagttattctcttcact

SEQ ID NO: 6213929 - DNA, 17 bp, Homo sapiens
gaaacaataaagaaaga

SEQ ID NO: 6213930 - DNA, 16 bp, Homo sapiens
gaaacaatatgcttta

SEQ ID NO: 6213931 - DNA, 17 bp, Homo sapiens
gaaacaatatgctttac

SEQ ID NO: 6213932 - DNA, 16 bp, Homo sapiens
gaaacaatgaaatttt

SEQ ID NO: 6213933 - DNA, 22 bp, Homo sapiens
gaaacaatgtctggggacaggc

SEQ ID NO: 6213934 - DNA, 23 bp, Homo sapiens
gaaacaatgtgtctatttctgaa

SEQ ID NO: 6213935 - DNA, 22 bp, Homo sapiens
gaaacaatgttgtccaacaata

SEQ ID NO: 6213936 - DNA, 14 bp, Homo sapiens
gaaacaatttaaat

SEQ ID NO: 6213937 - DNA, 21 bp, Homo sapiens
gaaacacaatacctacaataa

SEQ ID NO: 6213938 - DNA, 14 bp, Homo sapiens
gaaacacacaagca

SEQ ID NO: 6213939 - DNA, 11 bp, Homo sapiens
gaaacacacac

SEQ ID NO: 6213940 - DNA, 13 bp, Homo sapiens
gaaacacacagtc

SEQ ID NO: 6213941 - DNA, 21 bp, Homo sapiens
gaaacacacagtgaccaaggg

SEQ ID NO: 6213942 - DNA, 11 bp, Homo sapiens
gaaacacacga

SEQ ID NO: 6213943 - DNA, 23 bp, Homo sapiens
gaaacacacgtgctgtgggcctc

SEQ ID NO: 6213944 - DNA, 19 bp, Homo sapiens
gaaacacactgaggcaggg

SEQ ID NO: 6213945 - DNA, 20 bp, Homo sapiens
gaaacacactgaggcaggga

SEQ ID NO: 6213946 - DNA, 17 bp, Homo sapiens
gaaacacacttttgcac

SEQ ID NO: 6213947 - DNA, 14 bp, Homo sapiens
gaaacacagaaacc

SEQ ID NO: 6213948 - DNA, 15 bp, Homo sapiens
gaaacacagcatgca

SEQ ID NO: 6213949 - DNA, 23 bp, Homo sapiens
gaaacacagctgttcttctgttc

SEQ ID NO: 6213950 - DNA, 22 bp, Homo sapiens
gaaacacagcttacaatcgcaa

SEQ ID NO: 6213951 - DNA, 15 bp, Homo sapiens
gaaacacataaatta

SEQ ID NO: 6213952 - DNA, 20 bp, Homo sapiens
gaaacacataattaacactt

SEQ ID NO: 6213953 - DNA, 13 bp, Homo sapiens
gaaacacatgcca

SEQ ID NO: 6213954 - DNA, 17 bp, Homo sapiens
gaaacacatgccagttt

SEQ ID NO: 6213955 - DNA, 16 bp, Homo sapiens
gaaacaccacttaatc

SEQ ID NO: 6213956 - DNA, 13 bp, Homo sapiens
gaaacaccattca

SEQ ID NO: 6213957 - DNA, 19 bp, Homo sapiens
gaaacaccctcacactggg

SEQ ID NO: 6213958 - DNA, 15 bp, Homo sapiens
gaaacacctcccagg

SEQ ID NO: 6213959 - DNA, 17 bp, Homo sapiens
gaaacacctcccagggg

SEQ ID NO: 6213960 - DNA, 17 bp, Homo sapiens
gaaacacgaaacttgtt

SEQ ID NO: 6213961 - DNA, 18 bp, Homo sapiens
gaaacacggagtttccat

SEQ ID NO: 6213962 - DNA, 23 bp, Homo sapiens
gaaacacggagtttccatttgga

SEQ ID NO: 6213963 - DNA, 19 bp, Homo sapiens
gaaacactaaggctgcttc

SEQ ID NO: 6213964 - DNA, 16 bp, Homo sapiens
gaaacactccttgcat

SEQ ID NO: 6213965 - DNA, 19 bp, Homo sapiens
gaaacactcgtgtgcatga

SEQ ID NO: 6213966 - DNA, 20 bp, Homo sapiens
gaaacactcgtgtgcatgag

SEQ ID NO: 6213967 - DNA, 11 bp, Homo sapiens
gaaacactgcc

SEQ ID NO: 6213968 - DNA, 12 bp, Homo sapiens
gaaacactgcct

SEQ ID NO: 6213969 - DNA, 22 bp, Homo sapiens
gaaacactgcttctcggccagc

SEQ ID NO: 6213970 - DNA, 12 bp, Homo sapiens
gaaacactggac

SEQ ID NO: 6213971 - DNA, 15 bp, Homo sapiens
gaaacactggacctg

SEQ ID NO: 6213972 - DNA, 13 bp, Homo sapiens
gaaacactggttt

SEQ ID NO: 6213973 - DNA, 16 bp, Homo sapiens
gaaacactttgcataa

SEQ ID NO: 6213974 - DNA, 18 bp, Homo sapiens
gaaacactttgcctcctg

SEQ ID NO: 6213975 - DNA, 22 bp, Homo sapiens
gaaacactttgcctcctgtgta

SEQ ID NO: 6213976 - DNA, 13 bp, Homo sapiens
gaaacactttttt

SEQ ID NO: 6213977 - DNA, 13 bp, Homo sapiens
gaaacagaaatag

SEQ ID NO: 6213978 - DNA, 15 bp, Homo sapiens
gaaacagaagacaaa

SEQ ID NO: 6213979 - DNA, 23 bp, Homo sapiens
gaaacagaagctttttgtttgca

SEQ ID NO: 6213980 - DNA, 22 bp, Homo sapiens
gaaacagacaagcaacccaaac

SEQ ID NO: 6213981 - DNA, 13 bp, Homo sapiens
gaaacagagaaag

SEQ ID NO: 6213982 - DNA, 22 bp, Homo sapiens
gaaacagagaaagaaaaggcaa

SEQ ID NO: 6213983 - DNA, 12 bp, Homo sapiens
gaaacagagaac

SEQ ID NO: 6213984 - DNA, 16 bp, Homo sapiens
gaaacagagagagaca

SEQ ID NO: 6213985 - DNA, 20 bp, Homo sapiens
gaaacagaggagagtcccag

SEQ ID NO: 6213986 - DNA, 22 bp, Homo sapiens
gaaacagaggcgtctcacattt

SEQ ID NO: 6213987 - DNA, 15 bp, Homo sapiens
gaaacagaggtaaaa

SEQ ID NO: 6213988 - DNA, 20 bp, Homo sapiens
gaaacagaggtaaaaaaaag

SEQ ID NO: 6213989 - DNA, 23 bp, Homo sapiens
gaaacagaggtaaaaaaaagaag

SEQ ID NO: 6213990 - DNA, 19 bp, Homo sapiens
gaaacagagtccaatttaa

SEQ ID NO: 6213991 - DNA, 22 bp, Homo sapiens
gaaacagagtccaatttaagga

SEQ ID NO: 6213992 - DNA, 20 bp, Homo sapiens
gaaacagagtggcctccctg

SEQ ID NO: 6213993 - DNA, 21 bp, Homo sapiens
gaaacagagtggcctccctgc

SEQ ID NO: 6213994 - DNA, 20 bp, Homo sapiens
gaaacagatgataaatattt

SEQ ID NO: 6213995 - DNA, 19 bp, Homo sapiens
gaaacagattcaggccagc

SEQ ID NO: 6213996 - DNA, 22 bp, Homo sapiens
gaaacagattcaggccagccca

SEQ ID NO: 6213997 - DNA, 14 bp, Homo sapiens
gaaacagatttggt

SEQ ID NO: 6213998 - DNA, 12 bp, Homo sapiens
gaaacagcaaac

SEQ ID NO: 6213999 - DNA, 19 bp, Homo sapiens
gaaacagcagctgaagcca

SEQ ID NO: 6214000 - DNA, 16 bp, Homo sapiens
gaaacagcatattagc

SEQ ID NO: 6214001 - DNA, 12 bp, Homo sapiens
gaaacagcatga

SEQ ID NO: 6214002 - DNA, 20 bp, Homo sapiens
gaaacagcatgaataaaaca

SEQ ID NO: 6214003 - DNA, 12 bp, Homo sapiens
gaaacagccagc

SEQ ID NO: 6214004 - DNA, 15 bp, Homo sapiens
gaaacagccagcaag

SEQ ID NO: 6214005 - DNA, 18 bp, Homo sapiens
gaaacagccatgtccaag

SEQ ID NO: 6214006 - DNA, 19 bp, Homo sapiens
gaaacagccatgtccaagt

SEQ ID NO: 6214007 - DNA, 16 bp, Homo sapiens
gaaacagcctgtgtct

SEQ ID NO: 6214008 - DNA, 22 bp, Homo sapiens
gaaacagctgccttagcttcag

SEQ ID NO: 6214009 - DNA, 15 bp, Homo sapiens
gaaacagctgcttct

SEQ ID NO: 6214010 - DNA, 16 bp, Homo sapiens
gaaacagctgcttctc

SEQ ID NO: 6214011 - DNA, 19 bp, Homo sapiens
gaaacagctgcttctcccc

SEQ ID NO: 6214012 - DNA, 21 bp, Homo sapiens
gaaacagctgcttctcccccc

SEQ ID NO: 6214013 - DNA, 22 bp, Homo sapiens
gaaacagcttgatgctgtttct

SEQ ID NO: 6214014 - DNA, 18 bp, Homo sapiens
gaaacagctttcaagtgc

SEQ ID NO: 6214015 - DNA, 15 bp, Homo sapiens
gaaacagctttctgg

SEQ ID NO: 6214016 - DNA, 18 bp, Homo sapiens
gaaacagggacaaagaaa

SEQ ID NO: 6214017 - DNA, 22 bp, Homo sapiens
gaaacagggagcccctaggaaa

SEQ ID NO: 6214018 - DNA, 14 bp, Homo sapiens
gaaacagggcagca

SEQ ID NO: 6214019 - DNA, 23 bp, Homo sapiens
gaaacagggcagtgacaagtgga

SEQ ID NO: 6214020 - DNA, 20 bp, Homo sapiens
gaaacaggtgtgtgtgaact

SEQ ID NO: 6214021 - DNA, 20 bp, Homo sapiens
gaaacagtgtggatgtaaat

SEQ ID NO: 6214022 - DNA, 19 bp, Homo sapiens
gaaacagttgcatgtagta

SEQ ID NO: 6214023 - DNA, 21 bp, Homo sapiens
gaaacagttgctgtgaacttt

SEQ ID NO: 6214024 - DNA, 18 bp, Homo sapiens
gaaacagttggtaacttt

SEQ ID NO: 6214025 - DNA, 19 bp, Homo sapiens
gaaacagttggtaactttt

SEQ ID NO: 6214026 - DNA, 20 bp, Homo sapiens
gaaacagttttattttccat

SEQ ID NO: 6214027 - DNA, 15 bp, Homo sapiens
gaaacataaataaaa

SEQ ID NO: 6214028 - DNA, 18 bp, Homo sapiens
gaaacataaataaaatga

SEQ ID NO: 6214029 - DNA, 12 bp, Homo sapiens
gaaacatagaaa

SEQ ID NO: 6214030 - DNA, 14 bp, Homo sapiens
gaaacatagaaaca

SEQ ID NO: 6214031 - DNA, 16 bp, Homo sapiens
gaaacatagaaacata

SEQ ID NO: 6214032 - DNA, 14 bp, Homo sapiens
gaaacatagaaaga

SEQ ID NO: 6214033 - DNA, 15 bp, Homo sapiens
gaaacatagaaagac

SEQ ID NO: 6214034 - DNA, 18 bp, Homo sapiens
gaaacatagaaagacatg

SEQ ID NO: 6214035 - DNA, 21 bp, Homo sapiens
gaaacatataactattgagtt

SEQ ID NO: 6214036 - DNA, 12 bp, Homo sapiens
gaaacatatcat

SEQ ID NO: 6214037 - DNA, 23 bp, Homo sapiens
gaaacatcagttactctgaaggg

SEQ ID NO: 6214038 - DNA, 14 bp, Homo sapiens
gaaacatctctggc

SEQ ID NO: 6214039 - DNA, 14 bp, Homo sapiens
gaaacatctgattt

SEQ ID NO: 6214040 - DNA, 18 bp, Homo sapiens
gaaacatctgatttctga

SEQ ID NO: 6214041 - DNA, 17 bp, Homo sapiens
gagctagcagcagggag

SEQ ID NO: 6214042 - DNA, 13 bp, Homo sapiens
gagctagccagag

SEQ ID NO: 6214043 - DNA, 15 bp, Homo sapiens
gagctagccagagga

SEQ ID NO: 6214044 - DNA, 13 bp, Homo sapiens
gagctagcctcca

SEQ ID NO: 6214045 - DNA, 14 bp, Homo sapiens
gagctagcctccag

SEQ ID NO: 6214046 - DNA, 16 bp, Homo sapiens
gagctagcctgaagga

SEQ ID NO: 6214047 - DNA, 14 bp, Homo sapiens
gagctagcgctgcc

SEQ ID NO: 6214048 - DNA, 18 bp, Homo sapiens
gagctagcgctgccgcac

SEQ ID NO: 6214049 - DNA, 13 bp, Homo sapiens
gagctaggaaccc

SEQ ID NO: 6214050 - DNA, 17 bp, Homo sapiens
gagctaggaagagtcta

SEQ ID NO: 6214051 - DNA, 12 bp, Homo sapiens
gagctaggagca

SEQ ID NO: 6214052 - DNA, 20 bp, Homo sapiens
gagctaggagcaaagcctgt

SEQ ID NO: 6214053 - DNA, 17 bp, Homo sapiens
gagctagttctcagctt

SEQ ID NO: 6214054 - DNA, 19 bp, Homo sapiens
gagctagttctcagcttgc

SEQ ID NO: 6214055 - DNA, 14 bp, Homo sapiens
gagctatacagttt

SEQ ID NO: 6214056 - DNA, 20 bp, Homo sapiens
gagctatacagttttcctaa

SEQ ID NO: 6214057 - DNA, 20 bp, Homo sapiens
gagctatagtgaagaatagg

SEQ ID NO: 6214058 - DNA, 17 bp, Homo sapiens
gagctatcagtgctttg

SEQ ID NO: 6214059 - DNA, 14 bp, Homo sapiens
gagctatgagccca

SEQ ID NO: 6214060 - DNA, 17 bp, Homo sapiens
gagctatgagcccagca

SEQ ID NO: 6214061 - DNA, 20 bp, Homo sapiens
gagctatgatatgtgcttgt

SEQ ID NO: 6214062 - DNA, 21 bp, Homo sapiens
gagctatgcacaccaaattgc

SEQ ID NO: 6214063 - DNA, 20 bp, Homo sapiens
gagctatggagagaattaaa

SEQ ID NO: 6214064 - DNA, 22 bp, Homo sapiens
gagctattaaaactcagcctgg

SEQ ID NO: 6214065 - DNA, 14 bp, Homo sapiens
gagctattgctaga

SEQ ID NO: 6214066 - DNA, 13 bp, Homo sapiens
gagctattgctgt

SEQ ID NO: 6214067 - DNA, 19 bp, Homo sapiens
gagctatttccattccaga

SEQ ID NO: 6214068 - DNA, 20 bp, Homo sapiens
gagctatttccattccagaa

SEQ ID NO: 6214069 - DNA, 21 bp, Homo sapiens
gagctatttccattccagaat

SEQ ID NO: 6214070 - DNA, 17 bp, Homo sapiens
gagctattttagaaagc

SEQ ID NO: 6214071 - DNA, 17 bp, Homo sapiens
gagctcaacggtctggc

SEQ ID NO: 6214072 - DNA, 19 bp, Homo sapiens
gagctcaacggtctggcag

SEQ ID NO: 6214073 - DNA, 21 bp, Homo sapiens
gagctcaacggtctggcaggg

SEQ ID NO: 6214074 - DNA, 16 bp, Homo sapiens
gagctcaactaaaagt

SEQ ID NO: 6214075 - DNA, 15 bp, Homo sapiens
gagctcaagcccttg

SEQ ID NO: 6214076 - DNA, 16 bp, Homo sapiens
gagctcaagccgtggc

SEQ ID NO: 6214077 - DNA, 17 bp, Homo sapiens
gagctcaagccgtggcc

SEQ ID NO: 6214078 - DNA, 19 bp, Homo sapiens
gagctcaagccgtggccgg

SEQ ID NO: 6214079 - DNA, 19 bp, Homo sapiens
gagctcaagggacaaggac

SEQ ID NO: 6214080 - DNA, 21 bp, Homo sapiens
gagctcacaaggcagcaaggc

SEQ ID NO: 6214081 - DNA, 23 bp, Homo sapiens
gagctcacaccgcaccgggctgg

SEQ ID NO: 6214082 - DNA, 22 bp, Homo sapiens
gagctcacactccagtggcaga

SEQ ID NO: 6214083 - DNA, 17 bp, Homo sapiens
gagctcacccatgtgca

SEQ ID NO: 6214084 - DNA, 15 bp, Homo sapiens
gagctcaccctgccc

SEQ ID NO: 6214085 - DNA, 18 bp, Homo sapiens
gagctcaccctgcccgct

SEQ ID NO: 6214086 - DNA, 14 bp, Homo sapiens
gagctcactcccac

SEQ ID NO: 6214087 - DNA, 19 bp, Homo sapiens
gagctcagaaaatatccct

SEQ ID NO: 6214088 - DNA, 14 bp, Homo sapiens
gagctcagcacagc

SEQ ID NO: 6214089 - DNA, 17 bp, Homo sapiens
gagctcagcacagcctc

SEQ ID NO: 6214090 - DNA, 18 bp, Homo sapiens
gagctcagcacagcctca

SEQ ID NO: 6214091 - DNA, 23 bp, Homo sapiens
gagctcagccccgagctgtcccc

SEQ ID NO: 6214092 - DNA, 21 bp, Homo sapiens
gagctcagcctgcctgggaga

SEQ ID NO: 6214093 - DNA, 22 bp, Homo sapiens
gagctcaggaaccgaggcaggg

SEQ ID NO: 6214094 - DNA, 17 bp, Homo sapiens
gagctcaggacactaat

SEQ ID NO: 6214095 - DNA, 13 bp, Homo sapiens
gagctcaggagaa

SEQ ID NO: 6214096 - DNA, 15 bp, Homo sapiens
gagctcaggagagag

SEQ ID NO: 6214097 - DNA, 11 bp, Homo sapiens
gagctcaggat

SEQ ID NO: 6214098 - DNA, 13 bp, Homo sapiens
gagctcaggatga

SEQ ID NO: 6214099 - DNA, 23 bp, Homo sapiens
gagctcaggatgagggaaaagaa

SEQ ID NO: 6214100 - DNA, 15 bp, Homo sapiens
gagctcaggatggct

SEQ ID NO: 6214101 - DNA, 13 bp, Homo sapiens
gagctcaggcagc

SEQ ID NO: 6214102 - DNA, 20 bp, Homo sapiens
gagctcaggccctggtgagg

SEQ ID NO: 6214103 - DNA, 12 bp, Homo sapiens
gagctcaggctg

SEQ ID NO: 6214104 - DNA, 16 bp, Homo sapiens
gagctcaggctgagcc

SEQ ID NO: 6214105 - DNA, 13 bp, Homo sapiens
gagctcagggctg

SEQ ID NO: 6214106 - DNA, 19 bp, Homo sapiens
gagctcagttgagaaacag

SEQ ID NO: 6214107 - DNA, 21 bp, Homo sapiens
gagctcagttgagaaacagtt

SEQ ID NO: 6214108 - DNA, 16 bp, Homo sapiens
gagctcatccctctca

SEQ ID NO: 6214109 - DNA, 16 bp, Homo sapiens
gagctcattaataaaa

SEQ ID NO: 6214110 - DNA, 12 bp, Homo sapiens
gagctcattctg

SEQ ID NO: 6214111 - DNA, 18 bp, Homo sapiens
gagctccaactcagaagg

SEQ ID NO: 6214112 - DNA, 13 bp, Homo sapiens
gagctccactctg

SEQ ID NO: 6214113 - DNA, 13 bp, Homo sapiens
gagctccagaccc

SEQ ID NO: 6214114 - DNA, 20 bp, Homo sapiens
gagctccagacccccagcaa

SEQ ID NO: 6214115 - DNA, 14 bp, Homo sapiens
gagctccagcctga

SEQ ID NO: 6214116 - DNA, 14 bp, Homo sapiens
gagctccagtttct

SEQ ID NO: 6214117 - DNA, 15 bp, Homo sapiens
gagctccagtttctc

SEQ ID NO: 6214118 - DNA, 22 bp, Homo sapiens
gagctccagtttctcttaagct

SEQ ID NO: 6214119 - DNA, 20 bp, Homo sapiens
gagctccatacacacgctgc

SEQ ID NO: 6214120 - DNA, 23 bp, Homo sapiens
gagctccatacacacgctgcctt

SEQ ID NO: 6214121 - DNA, 17 bp, Homo sapiens
gagctcccacaagcctg

SEQ ID NO: 6214122 - DNA, 19 bp, Homo sapiens
gagctcccacaagcctgag

SEQ ID NO: 6214123 - DNA, 13 bp, Homo sapiens
gagctcccacctc

SEQ ID NO: 6214124 - DNA, 20 bp, Homo sapiens
gagctcccacctcccttccc

SEQ ID NO: 6214125 - DNA, 19 bp, Homo sapiens
gagctcccacttctgccag

SEQ ID NO: 6214126 - DNA, 15 bp, Homo sapiens
gagctcccaggacgc

SEQ ID NO: 6214127 - DNA, 16 bp, Homo sapiens
gagctcccaggagggg

SEQ ID NO: 6214128 - DNA, 19 bp, Homo sapiens
gagctccccaatccaaccc

SEQ ID NO: 6214129 - DNA, 17 bp, Homo sapiens
gagctccccccaggtct

SEQ ID NO: 6214130 - DNA, 22 bp, Homo sapiens
gagctcccccgtggtgcctgca

SEQ ID NO: 6214131 - DNA, 13 bp, Homo sapiens
gagctcccccttc

SEQ ID NO: 6214132 - DNA, 14 bp, Homo sapiens
gagctcccccttcc

SEQ ID NO: 6214133 - DNA, 18 bp, Homo sapiens
gagctcccccttcccagt

SEQ ID NO: 6214134 - DNA, 21 bp, Homo sapiens
gagctcccctccacagctgca

SEQ ID NO: 6214135 - DNA, 22 bp, Homo sapiens
gagctcccctggagccagcagg

SEQ ID NO: 6214136 - DNA, 19 bp, Homo sapiens
gagctccctcgctgtatga

SEQ ID NO: 6214137 - DNA, 19 bp, Homo sapiens
gagctccgctaagacctcc

SEQ ID NO: 6214138 - DNA, 19 bp, Homo sapiens
gagctccgtcagcttctcc

SEQ ID NO: 6214139 - DNA, 21 bp, Homo sapiens
gagctcctccctccagctgcg

SEQ ID NO: 6214140 - DNA, 15 bp, Homo sapiens
gagctcctctgggca

SEQ ID NO: 6214141 - DNA, 14 bp, Homo sapiens
gagctcctcttcca

SEQ ID NO: 6214142 - DNA, 14 bp, Homo sapiens
gagctcctgatcag

SEQ ID NO: 6214143 - DNA, 17 bp, Homo sapiens
gagctcctgatcagagg

SEQ ID NO: 6214144 - DNA, 23 bp, Homo sapiens
gagctcctgctcattgtggccag

SEQ ID NO: 6214145 - DNA, 21 bp, Homo sapiens
gagctcctgggacccttggct

SEQ ID NO: 6214146 - DNA, 15 bp, Homo sapiens
gagctcctggggagc

SEQ ID NO: 6214147 - DNA, 17 bp, Homo sapiens
gagctcctggggagctc

SEQ ID NO: 6214148 - DNA, 20 bp, Homo sapiens
gagctcctggggagctcctg

SEQ ID NO: 6214149 - DNA, 14 bp, Homo sapiens
gagctcctgtccct

SEQ ID NO: 6214150 - DNA, 15 bp, Homo sapiens
gagctcctgtcccta

SEQ ID NO: 6214151 - DNA, 21 bp, Homo sapiens
gagctcctgtccctacccact

SEQ ID NO: 6214152 - DNA, 23 bp, Homo sapiens
gagctcctgtccctacccactct

SEQ ID NO: 6214153 - DNA, 16 bp, Homo sapiens
gagctcgcagcccccg

SEQ ID NO: 6214154 - DNA, 17 bp, Homo sapiens
gagctcgcccctcccct

SEQ ID NO: 6214155 - DNA, 17 bp, Homo sapiens
gagctcgcggggcagca

SEQ ID NO: 6214156 - DNA, 14 bp, Homo sapiens
gagctcggggacag

SEQ ID NO: 6214157 - DNA, 15 bp, Homo sapiens
gagctcggggctggg

SEQ ID NO: 6214158 - DNA, 17 bp, Homo sapiens
gagctcggggctggggg

SEQ ID NO: 6214159 - DNA, 21 bp, Homo sapiens
gagctcggggctgggggctgc

SEQ ID NO: 6214160 - DNA, 23 bp, Homo sapiens
gagctcggggctgggggctgcag

SEQ ID NO: 6214161 - DNA, 23 bp, Homo sapiens
gagctctaactgattcagggccc

SEQ ID NO: 6214162 - DNA, 16 bp, Homo sapiens
gagctctaccctgctc

SEQ ID NO: 6214163 - DNA, 19 bp, Homo sapiens
gagctctaccctgctccct

SEQ ID NO: 6214164 - DNA, 15 bp, Homo sapiens
gagctctatccccat

SEQ ID NO: 6214165 - DNA, 21 bp, Homo sapiens
gagctctcaaatccctctcca

SEQ ID NO: 6214166 - DNA, 15 bp, Homo sapiens
gagctctcaggccga

SEQ ID NO: 6214167 - DNA, 16 bp, Homo sapiens
gagctctcaggccgag

SEQ ID NO: 6214168 - DNA, 16 bp, Homo sapiens
gagctctccaggccag

SEQ ID NO: 6214169 - DNA, 19 bp, Homo sapiens
gagctctccaggccaggtg

SEQ ID NO: 6214170 - DNA, 16 bp, Homo sapiens
gagctctcctgggcca

SEQ ID NO: 6214171 - DNA, 12 bp, Homo sapiens
gagctctctgct

SEQ ID NO: 6214172 - DNA, 19 bp, Homo sapiens
gagctctgacccacagcct

SEQ ID NO: 6214173 - DNA, 21 bp, Homo sapiens
gagctctgacccttgggcctg

SEQ ID NO: 6214174 - DNA, 11 bp, Homo sapiens
gagctctgaga

SEQ ID NO: 6214175 - DNA, 14 bp, Homo sapiens
gagctctgagaggc

SEQ ID NO: 6214176 - DNA, 15 bp, Homo sapiens
gagctctgagaggcc

SEQ ID NO: 6214177 - DNA, 17 bp, Homo sapiens
gagctctgagaggccct

SEQ ID NO: 6214178 - DNA, 18 bp, Homo sapiens
gagctctgagaggccctg

SEQ ID NO: 6214179 - DNA, 15 bp, Homo sapiens
gagctctgcagccca

SEQ ID NO: 6214180 - DNA, 15 bp, Homo sapiens
gagctctgcgccagg

SEQ ID NO: 6214181 - DNA, 17 bp, Homo sapiens
gagctctgcgccaggca

SEQ ID NO: 6214182 - DNA, 19 bp, Homo sapiens
gagctctgcgccaggcaga

SEQ ID NO: 6214183 - DNA, 20 bp, Homo sapiens
gagctctggccccgctagcg

SEQ ID NO: 6214184 - DNA, 14 bp, Homo sapiens
gagctctggctttc

SEQ ID NO: 6214185 - DNA, 19 bp, Homo sapiens
gagctctggggacagcttc

SEQ ID NO: 6214186 - DNA, 22 bp, Homo sapiens
gagctctggggacagcttcctc

SEQ ID NO: 6214187 - DNA, 13 bp, Homo sapiens
gagctctggtgct

SEQ ID NO: 6214188 - DNA, 19 bp, Homo sapiens
gagctctgtagcctggtct

SEQ ID NO: 6214189 - DNA, 22 bp, Homo sapiens
gagctctgtagcctggtctgtg

SEQ ID NO: 6214190 - DNA, 23 bp, Homo sapiens
gagctctgtagcctggtctgtgc

SEQ ID NO: 6214191 - DNA, 19 bp, Homo sapiens
gagctctgtgggtctctgg

SEQ ID NO: 6214192 - DNA, 21 bp, Homo sapiens
gagctcttagtttttaaaaag

SEQ ID NO: 6214193 - DNA, 21 bp, Homo sapiens
gagctcttcaagctgtcccct

SEQ ID NO: 6214194 - DNA, 17 bp, Homo sapiens
gagctcttcaggcctcc

SEQ ID NO: 6214195 - DNA, 21 bp, Homo sapiens
gagctcttcggtttctgagca

SEQ ID NO: 6214196 - DNA, 22 bp, Homo sapiens
gagctcttcggtttctgagcat

SEQ ID NO: 6214197 - DNA, 18 bp, Homo sapiens
gagctcttcttgtgaaat

SEQ ID NO: 6214198 - DNA, 20 bp, Homo sapiens
gagctcttcttgtgaaatgt

SEQ ID NO: 6214199 - DNA, 17 bp, Homo sapiens
gagctcttgacagaaag

SEQ ID NO: 6214200 - DNA, 17 bp, Homo sapiens
gagctcttggaagagct

SEQ ID NO: 6214201 - DNA, 21 bp, Homo sapiens
gagctcttggaggtgtctgta

SEQ ID NO: 6214202 - DNA, 12 bp, Homo sapiens
gagctcttggcc

SEQ ID NO: 6214203 - DNA, 17 bp, Homo sapiens
gagctcttgggtcagag

SEQ ID NO: 6214204 - DNA, 17 bp, Homo sapiens
gagctcttgtgaggaaa

SEQ ID NO: 6214205 - DNA, 20 bp, Homo sapiens
gagctcttgttccgtgccag

SEQ ID NO: 6214206 - DNA, 21 bp, Homo sapiens
gagctcttgttccgtgccagg

SEQ ID NO: 6214207 - DNA, 22 bp, Homo sapiens
gagctgaaaaatcacatcctgg

SEQ ID NO: 6214208 - DNA, 21 bp, Homo sapiens
gagctgaaagctggtggcaga

SEQ ID NO: 6214209 - DNA, 18 bp, Homo sapiens
gagctgaaagggagcccc

SEQ ID NO: 6214210 - DNA, 17 bp, Homo sapiens
gagctgaaatgctgcat

SEQ ID NO: 6214211 - DNA, 21 bp, Homo sapiens
gagctgaacacatttgcccaa

SEQ ID NO: 6214212 - DNA, 18 bp, Homo sapiens
gagctgaaccacagaaat

SEQ ID NO: 6214213 - DNA, 22 bp, Homo sapiens
gagctgaacccattttgagtga

SEQ ID NO: 6214214 - DNA, 19 bp, Homo sapiens
gagctgaagtactgcaccc

SEQ ID NO: 6214215 - DNA, 16 bp, Homo sapiens
gagctgacaaaatttt

SEQ ID NO: 6214216 - DNA, 17 bp, Homo sapiens
gagctgacaaaattttg

SEQ ID NO: 6214217 - DNA, 22 bp, Homo sapiens
gagctgacacaaacctgcctgg

SEQ ID NO: 6214218 - DNA, 17 bp, Homo sapiens
gagctgacacaggatga

SEQ ID NO: 6214219 - DNA, 13 bp, Homo sapiens
gaaacatgaaccc

SEQ ID NO: 6214220 - DNA, 17 bp, Homo sapiens
gaaacatgacactgacc

SEQ ID NO: 6214221 - DNA, 17 bp, Homo sapiens
gaaacatggtgaaaccc

SEQ ID NO: 6214222 - DNA, 18 bp, Homo sapiens
gaaacatgtgcccctgcc

SEQ ID NO: 6214223 - DNA, 18 bp, Homo sapiens
gaaacattactttgagtg

SEQ ID NO: 6214224 - DNA, 21 bp, Homo sapiens
gaaacattagtgaaaattctg

SEQ ID NO: 6214225 - DNA, 16 bp, Homo sapiens
gaaacattattttaat

SEQ ID NO: 6214226 - DNA, 17 bp, Homo sapiens
gaaacattctttcctaa

SEQ ID NO: 6214227 - DNA, 18 bp, Homo sapiens
gaaacattctttcctaaa

SEQ ID NO: 6214228 - DNA, 18 bp, Homo sapiens
gaaacattgccatgtaac

SEQ ID NO: 6214229 - DNA, 22 bp, Homo sapiens
gaaacattgttaatataattta

SEQ ID NO: 6214230 - DNA, 11 bp, Homo sapiens
gaaacatttac

SEQ ID NO: 6214231 - DNA, 12 bp, Homo sapiens
gaaacatttata

SEQ ID NO: 6214232 - DNA, 12 bp, Homo sapiens
gaaacatttcct

SEQ ID NO: 6214233 - DNA, 11 bp, Homo sapiens
gaaacatttgg

SEQ ID NO: 6214234 - DNA, 13 bp, Homo sapiens
gaaacatttggaa

SEQ ID NO: 6214235 - DNA, 21 bp, Homo sapiens
gaaacatttttgagatattaa

SEQ ID NO: 6214236 - DNA, 20 bp, Homo sapiens
gaaacattttttcttctgaa

SEQ ID NO: 6214237 - DNA, 22 bp, Homo sapiens
gaaaccaagtcaggccaggtgg

SEQ ID NO: 6214238 - DNA, 18 bp, Homo sapiens
gaaaccaattaagcagct

SEQ ID NO: 6214239 - DNA, 22 bp, Homo sapiens
gaaaccaattcctcatcctcag

SEQ ID NO: 6214240 - DNA, 13 bp, Homo sapiens
gaaaccacacttc

SEQ ID NO: 6214241 - DNA, 14 bp, Homo sapiens
gaaaccacagctgc

SEQ ID NO: 6214242 - DNA, 13 bp, Homo sapiens
gaaaccacagtca

SEQ ID NO: 6214243 - DNA, 19 bp, Homo sapiens
gaaaccacagtcagtggag

SEQ ID NO: 6214244 - DNA, 19 bp, Homo sapiens
gaaaccacagtcttcccag

SEQ ID NO: 6214245 - DNA, 15 bp, Homo sapiens
gaaaccaccctgagg

SEQ ID NO: 6214246 - DNA, 19 bp, Homo sapiens
gaaaccaccgtgaaccaga

SEQ ID NO: 6214247 - DNA, 13 bp, Homo sapiens
gaaaccacctggg

SEQ ID NO: 6214248 - DNA, 18 bp, Homo sapiens
gaaaccaccttaaaacat

SEQ ID NO: 6214249 - DNA, 16 bp, Homo sapiens
gaaaccactgggcata

SEQ ID NO: 6214250 - DNA, 13 bp, Homo sapiens
gaaaccagaaaag

SEQ ID NO: 6214251 - DNA, 16 bp, Homo sapiens
gaaaccagaaaagcaa

SEQ ID NO: 6214252 - DNA, 22 bp, Homo sapiens
gaaaccagaatgattttgacat

SEQ ID NO: 6214253 - DNA, 15 bp, Homo sapiens
gaaaccagctcgtgg

SEQ ID NO: 6214254 - DNA, 13 bp, Homo sapiens
gaaaccagcttcc

SEQ ID NO: 6214255 - DNA, 20 bp, Homo sapiens
gaaaccagggcctgagccaa

SEQ ID NO: 6214256 - DNA, 17 bp, Homo sapiens
gaaaccagtatggaagg

SEQ ID NO: 6214257 - DNA, 22 bp, Homo sapiens
gaaaccagtatggaagggaggg

SEQ ID NO: 6214258 - DNA, 19 bp, Homo sapiens
gaaaccagtgtagccttgc

SEQ ID NO: 6214259 - DNA, 12 bp, Homo sapiens
gaaaccatgaca

SEQ ID NO: 6214260 - DNA, 15 bp, Homo sapiens
gaaaccatgacaaac

SEQ ID NO: 6214261 - DNA, 19 bp, Homo sapiens
gaaaccattccagtaggaa

SEQ ID NO: 6214262 - DNA, 19 bp, Homo sapiens
gaaaccattgttcagaaga

SEQ ID NO: 6214263 - DNA, 14 bp, Homo sapiens
gaaacccaaggaac

SEQ ID NO: 6214264 - DNA, 23 bp, Homo sapiens
gaaacccacagatgtctctgggg

SEQ ID NO: 6214265 - DNA, 21 bp, Homo sapiens
gaaacccagcgttcttcagga

SEQ ID NO: 6214266 - DNA, 23 bp, Homo sapiens
gaaacccagctctggtccataga

SEQ ID NO: 6214267 - DNA, 13 bp, Homo sapiens
gaaacccagggag

SEQ ID NO: 6214268 - DNA, 16 bp, Homo sapiens
gaaacccataggccca

SEQ ID NO: 6214269 - DNA, 16 bp, Homo sapiens
gaaaccccaagcagca

SEQ ID NO: 6214270 - DNA, 15 bp, Homo sapiens
gaaacccccacacac

SEQ ID NO: 6214271 - DNA, 16 bp, Homo sapiens
gaaacccccacacaca

SEQ ID NO: 6214272 - DNA, 17 bp, Homo sapiens
gaaacccccacacacac

SEQ ID NO: 6214273 - DNA, 14 bp, Homo sapiens
gaaacccccaggag

SEQ ID NO: 6214274 - DNA, 16 bp, Homo sapiens
gaaacccggcttcctg

SEQ ID NO: 6214275 - DNA, 17 bp, Homo sapiens
gaaacccggcttcctgt

SEQ ID NO: 6214276 - DNA, 23 bp, Homo sapiens
gaaaccctatggagaatttatcc

SEQ ID NO: 6214277 - DNA, 15 bp, Homo sapiens
gaaaccctgagcaga

SEQ ID NO: 6214278 - DNA, 14 bp, Homo sapiens
gaaaccctgtttta

SEQ ID NO: 6214279 - DNA, 19 bp, Homo sapiens
gaaacccttcacaccccag

SEQ ID NO: 6214280 - DNA, 24 bp, Homo sapiens
gaaacccttcagtgctacattttg

SEQ ID NO: 6214281 - DNA, 21 bp, Homo sapiens
gaaaccgagtagaaaatgtga

SEQ ID NO: 6214282 - DNA, 21 bp, Homo sapiens
gaaaccgcctagtttactgtt

SEQ ID NO: 6214283 - DNA, 14 bp, Homo sapiens
gaaaccgcttttgg

SEQ ID NO: 6214284 - DNA, 14 bp, Homo sapiens
gaaaccgtccctga

SEQ ID NO: 6214285 - DNA, 17 bp, Homo sapiens
gaaaccgtcctcttttt

SEQ ID NO: 6214286 - DNA, 16 bp, Homo sapiens
gaaaccgtgtgtccag

SEQ ID NO: 6214287 - DNA, 18 bp, Homo sapiens
gaaacctacaagatttcc

SEQ ID NO: 6214288 - DNA, 17 bp, Homo sapiens
gaaacctacagaatact

SEQ ID NO: 6214289 - DNA, 15 bp, Homo sapiens
gaaacctacttttta

SEQ ID NO: 6214290 - DNA, 17 bp, Homo sapiens
gaaacctagtactgccc

SEQ ID NO: 6214291 - DNA, 23 bp, Homo sapiens
gaaacctatcaatcctgccccca

SEQ ID NO: 6214292 - DNA, 23 bp, Homo sapiens
gaaacctcattgttctgtacaaa

SEQ ID NO: 6214293 - DNA, 16 bp, Homo sapiens
gaaacctctacatatt

SEQ ID NO: 6214294 - DNA, 18 bp, Homo sapiens
gaaacctcttcctaggcc

SEQ ID NO: 6214295 - DNA, 20 bp, Homo sapiens
gaaacctcttttgttgtcct

SEQ ID NO: 6214296 - DNA, 18 bp, Homo sapiens
gaaacctgaaaaaaagtt

SEQ ID NO: 6214297 - DNA, 12 bp, Homo sapiens
gaaacctgccct

SEQ ID NO: 6214298 - DNA, 15 bp, Homo sapiens
gaaacctgggagaga

SEQ ID NO: 6214299 - DNA, 16 bp, Homo sapiens
gaaacctgggattcag

SEQ ID NO: 6214300 - DNA, 18 bp, Homo sapiens
gaaacctggggtgaatac

SEQ ID NO: 6214301 - DNA, 20 bp, Homo sapiens
gaaacctgtataaccctgtt

SEQ ID NO: 6214302 - DNA, 13 bp, Homo sapiens
gaaacctgtatct

SEQ ID NO: 6214303 - DNA, 14 bp, Homo sapiens
gaaacctgtatctt

SEQ ID NO: 6214304 - DNA, 15 bp, Homo sapiens
gaaacctgtatcttt

SEQ ID NO: 6214305 - DNA, 20 bp, Homo sapiens
gaaacctgtccataaagtaa

SEQ ID NO: 6214306 - DNA, 15 bp, Homo sapiens
gaaacctgtgaaagc

SEQ ID NO: 6214307 - DNA, 15 bp, Homo sapiens
gaaaccttagtacct

SEQ ID NO: 6214308 - DNA, 19 bp, Homo sapiens
gaaaccttagtttcaagag

SEQ ID NO: 6214309 - DNA, 17 bp, Homo sapiens
gaaaccttcacccagca

SEQ ID NO: 6214310 - DNA, 14 bp, Homo sapiens
gaaaccttccagag

SEQ ID NO: 6214311 - DNA, 13 bp, Homo sapiens
gaaaccttgaagt

SEQ ID NO: 6214312 - DNA, 20 bp, Homo sapiens
gaaaccttgaagttctgaaa

SEQ ID NO: 6214313 - DNA, 23 bp, Homo sapiens
gaaaccttgaagttctgaaattt

SEQ ID NO: 6214314 - DNA, 21 bp, Homo sapiens
gaaaccttgcaaactctataa

SEQ ID NO: 6214315 - DNA, 12 bp, Homo sapiens
gaaaccttgcag

SEQ ID NO: 6214316 - DNA, 18 bp, Homo sapiens
gaaaccttgcagcatttt

SEQ ID NO: 6214317 - DNA, 22 bp, Homo sapiens
gaaaccttgcagcatttttatt

SEQ ID NO: 6214318 - DNA, 13 bp, Homo sapiens
gaaaccttggaga

SEQ ID NO: 6214319 - DNA, 15 bp, Homo sapiens
gaaaccttggagagg

SEQ ID NO: 6214320 - DNA, 18 bp, Homo sapiens
gaaaccttggagaggaga

SEQ ID NO: 6214321 - DNA, 13 bp, Homo sapiens
gaaacctttaaaa

SEQ ID NO: 6214322 - DNA, 21 bp, Homo sapiens
gaaacctttagggcagcttgc

SEQ ID NO: 6214323 - DNA, 18 bp, Homo sapiens
gaaacctttatccctgct

SEQ ID NO: 6214324 - DNA, 19 bp, Homo sapiens
gaaacctttatccctgctt

SEQ ID NO: 6214325 - DNA, 21 bp, Homo sapiens
gaaacctttctactttttctg

SEQ ID NO: 6214326 - DNA, 22 bp, Homo sapiens
gaaacctttgcttaccttgttt

SEQ ID NO: 6214327 - DNA, 20 bp, Homo sapiens
gaaaccttttaaaaaaataa

SEQ ID NO: 6214328 - DNA, 15 bp, Homo sapiens
gaaaccttttatttt

SEQ ID NO: 6214329 - DNA, 19 bp, Homo sapiens
gaaacctttttctagttat

SEQ ID NO: 6214330 - DNA, 21 bp, Homo sapiens
gaaaccttttttaagattttt

SEQ ID NO: 6214331 - DNA, 22 bp, Homo sapiens
gaaaccttttttaagatttttc

SEQ ID NO: 6214332 - DNA, 15 bp, Homo sapiens
gaaacgaatataagc

SEQ ID NO: 6214333 - DNA, 17 bp, Homo sapiens
gaaacgagaagtgccct

SEQ ID NO: 6214334 - DNA, 19 bp, Homo sapiens
gaaacgagaagtgccctta

SEQ ID NO: 6214335 - DNA, 21 bp, Homo sapiens
gaaacgagactttccattaca

SEQ ID NO: 6214336 - DNA, 16 bp, Homo sapiens
gaaacgagatttgcca

SEQ ID NO: 6214337 - DNA, 15 bp, Homo sapiens
gaaacgcacttacaa

SEQ ID NO: 6214338 - DNA, 14 bp, Homo sapiens
gaaacgcagacact

SEQ ID NO: 6214339 - DNA, 20 bp, Homo sapiens
gaaacgcagattgggctggc

SEQ ID NO: 6214340 - DNA, 23 bp, Homo sapiens
gaaacgcagattgggctggctct

SEQ ID NO: 6214341 - DNA, 22 bp, Homo sapiens
gaaacgccacaaaaatagagaa

SEQ ID NO: 6214342 - DNA, 17 bp, Homo sapiens
gaaacggatgatttcta

SEQ ID NO: 6214343 - DNA, 18 bp, Homo sapiens
gaaacggatgatttctat

SEQ ID NO: 6214344 - DNA, 16 bp, Homo sapiens
gaaacgggctccttcc

SEQ ID NO: 6214345 - DNA, 17 bp, Homo sapiens
gaaacgggctccttccc

SEQ ID NO: 6214346 - DNA, 18 bp, Homo sapiens
gaaacggtatcctccctg

SEQ ID NO: 6214347 - DNA, 21 bp, Homo sapiens
gaaacggtatcctccctgccc

SEQ ID NO: 6214348 - DNA, 22 bp, Homo sapiens
gaaacggtctttatgaattatt

SEQ ID NO: 6214349 - DNA, 22 bp, Homo sapiens
gaaacgtacttaactgtgtgaa

SEQ ID NO: 6214350 - DNA, 19 bp, Homo sapiens
gaaacgtatgtgtgcagga

SEQ ID NO: 6214351 - DNA, 13 bp, Homo sapiens
gaaacgtgttaaa

SEQ ID NO: 6214352 - DNA, 19 bp, Homo sapiens
gaaacgtgttgtatctaca

SEQ ID NO: 6214353 - DNA, 15 bp, Homo sapiens
gaaactaaaaatata

SEQ ID NO: 6214354 - DNA, 20 bp, Homo sapiens
gaaactaaaaatatagcaaa

SEQ ID NO: 6214355 - DNA, 18 bp, Homo sapiens
gaaactaaacagaaaact

SEQ ID NO: 6214356 - DNA, 13 bp, Homo sapiens
gaaactaaagcaa

SEQ ID NO: 6214357 - DNA, 17 bp, Homo sapiens
gaaactaagattctttt

SEQ ID NO: 6214358 - DNA, 13 bp, Homo sapiens
gaaactaagccag

SEQ ID NO: 6214359 - DNA, 21 bp, Homo sapiens
gaaactaagccaggcctggct

SEQ ID NO: 6214360 - DNA, 21 bp, Homo sapiens
gaaactaaggttagaaacatt

SEQ ID NO: 6214361 - DNA, 13 bp, Homo sapiens
gaaactaataaaa

SEQ ID NO: 6214362 - DNA, 15 bp, Homo sapiens
gaaactaataaaata

SEQ ID NO: 6214363 - DNA, 18 bp, Homo sapiens
gaaactaataaaatattt

SEQ ID NO: 6214364 - DNA, 21 bp, Homo sapiens
gaaactaataaaatattttct

SEQ ID NO: 6214365 - DNA, 22 bp, Homo sapiens
gaaactaataaaatattttctg

SEQ ID NO: 6214366 - DNA, 20 bp, Homo sapiens
gaaactaattgactttagaa

SEQ ID NO: 6214367 - DNA, 14 bp, Homo sapiens
gaaactacaccaca

SEQ ID NO: 6214368 - DNA, 18 bp, Homo sapiens
gaaactaccagtgggcat

SEQ ID NO: 6214369 - DNA, 23 bp, Homo sapiens
gaaactactgcctttagaaaata

SEQ ID NO: 6214370 - DNA, 18 bp, Homo sapiens
gaaactactgtatctgat

SEQ ID NO: 6214371 - DNA, 14 bp, Homo sapiens
gaaactagaaatgt

SEQ ID NO: 6214372 - DNA, 17 bp, Homo sapiens
gaaactaggcttctgta

SEQ ID NO: 6214373 - DNA, 13 bp, Homo sapiens
gaaactaggtctg

SEQ ID NO: 6214374 - DNA, 17 bp, Homo sapiens
gaaactataaagtttta

SEQ ID NO: 6214375 - DNA, 17 bp, Homo sapiens
gaaactataacatagct

SEQ ID NO: 6214376 - DNA, 22 bp, Homo sapiens
gaaactatccttctctttcaat

SEQ ID NO: 6214377 - DNA, 20 bp, Homo sapiens
gaaactatgcacctataaat

SEQ ID NO: 6214378 - DNA, 19 bp, Homo sapiens
gaaactatttacaatgtgt

SEQ ID NO: 6214379 - DNA, 13 bp, Homo sapiens
gaaactatttttg

SEQ ID NO: 6214380 - DNA, 20 bp, Homo sapiens
gaaactcaaaaccatctctc

SEQ ID NO: 6214381 - DNA, 21 bp, Homo sapiens
gaaactcacactcccctaggg

SEQ ID NO: 6214382 - DNA, 20 bp, Homo sapiens
gaaactcacctgctggcccc

SEQ ID NO: 6214383 - DNA, 22 bp, Homo sapiens
gaaactcacctgctggcccctc

SEQ ID NO: 6214384 - DNA, 13 bp, Homo sapiens
gaaactcagaaga

SEQ ID NO: 6214385 - DNA, 22 bp, Homo sapiens
gaaactcagagtcggaacggag

SEQ ID NO: 6214386 - DNA, 15 bp, Homo sapiens
gaaactcatctcatt

SEQ ID NO: 6214387 - DNA, 16 bp, Homo sapiens
gaaactccaaagtcca

SEQ ID NO: 6214388 - DNA, 20 bp, Homo sapiens
gaaactccaaagtccacaca

SEQ ID NO: 6214389 - DNA, 16 bp, Homo sapiens
gaaactccacatctgc

SEQ ID NO: 6214390 - DNA, 18 bp, Homo sapiens
gaaactccacatctgcct

SEQ ID NO: 6214391 - DNA, 20 bp, Homo sapiens
gaaactccacatctgcctta

SEQ ID NO: 6214392 - DNA, 20 bp, Homo sapiens
gaaactccaccttgcgggga

SEQ ID NO: 6214393 - DNA, 17 bp, Homo sapiens
gaaactcccttgtgttc

SEQ ID NO: 6214394 - DNA, 15 bp, Homo sapiens
gaaactccgaagaaa

SEQ ID NO: 6214395 - DNA, 20 bp, Homo sapiens
gaaactccgaagaaaagaat

SEQ ID NO: 6214396 - DNA, 15 bp, Homo sapiens
gaaactcctgtttct

SEQ ID NO: 6214397 - DNA, 18 bp, Homo sapiens
gagctgacgggaggcccc

SEQ ID NO: 6214398 - DNA, 19 bp, Homo sapiens
gagctgacgggaggcccca

SEQ ID NO: 6214399 - DNA, 15 bp, Homo sapiens
gagctgactgcatga

SEQ ID NO: 6214400 - DNA, 16 bp, Homo sapiens
gagctgactggtttct

SEQ ID NO: 6214401 - DNA, 16 bp, Homo sapiens
gagctgagaagaggag

SEQ ID NO: 6214402 - DNA, 17 bp, Homo sapiens
gagctgagatcacgcca

SEQ ID NO: 6214403 - DNA, 20 bp, Homo sapiens
gagctgagatcgcgccactg

SEQ ID NO: 6214404 - DNA, 22 bp, Homo sapiens
gagctgagatcgtgccactgca

SEQ ID NO: 6214405 - DNA, 21 bp, Homo sapiens
gagctgagatcgtgctactgc

SEQ ID NO: 6214406 - DNA, 19 bp, Homo sapiens
gagctgagatgagccccac

SEQ ID NO: 6214407 - DNA, 17 bp, Homo sapiens
gagctgagcagcctctg

SEQ ID NO: 6214408 - DNA, 20 bp, Homo sapiens
gagctgagcagcctctggac

SEQ ID NO: 6214409 - DNA, 13 bp, Homo sapiens
gagctgagcaggg

SEQ ID NO: 6214410 - DNA, 12 bp, Homo sapiens
gagctgagccag

SEQ ID NO: 6214411 - DNA, 13 bp, Homo sapiens
gagctgagccagg

SEQ ID NO: 6214412 - DNA, 15 bp, Homo sapiens
gagctgaggactctg

SEQ ID NO: 6214413 - DNA, 16 bp, Homo sapiens
gagctgaggactctgc

SEQ ID NO: 6214414 - DNA, 21 bp, Homo sapiens
gagctgaggatttcctggagt

SEQ ID NO: 6214415 - DNA, 13 bp, Homo sapiens
gagctgagggagg

SEQ ID NO: 6214416 - DNA, 15 bp, Homo sapiens
gagctgagggaggga

SEQ ID NO: 6214417 - DNA, 14 bp, Homo sapiens
gagctgaggggcag

SEQ ID NO: 6214418 - DNA, 22 bp, Homo sapiens
gagctgagtactcaggccactc

SEQ ID NO: 6214419 - DNA, 14 bp, Homo sapiens
gagctgagtcacct

SEQ ID NO: 6214420 - DNA, 16 bp, Homo sapiens
gagctgagtcacctcc

SEQ ID NO: 6214421 - DNA, 17 bp, Homo sapiens
gagctgagtcacctcct

SEQ ID NO: 6214422 - DNA, 17 bp, Homo sapiens
gagctgagtcggctggg

SEQ ID NO: 6214423 - DNA, 20 bp, Homo sapiens
gagctgagtcggctgggcag

SEQ ID NO: 6214424 - DNA, 23 bp, Homo sapiens
gagctgagtcggctgggcagggc

SEQ ID NO: 6214425 - DNA, 17 bp, Homo sapiens
gagctgagtggccagcc

SEQ ID NO: 6214426 - DNA, 19 bp, Homo sapiens
gagctgatataaattctgt

SEQ ID NO: 6214427 - DNA, 20 bp, Homo sapiens
gagctgatccagagcacaga

SEQ ID NO: 6214428 - DNA, 14 bp, Homo sapiens
gagctgatgaaact

SEQ ID NO: 6214429 - DNA, 18 bp, Homo sapiens
gagctgatgccccttctc

SEQ ID NO: 6214430 - DNA, 15 bp, Homo sapiens
gagctgatggagaag

SEQ ID NO: 6214431 - DNA, 16 bp, Homo sapiens
gagctgatggcagctg

SEQ ID NO: 6214432 - DNA, 18 bp, Homo sapiens
gagctgatggcagctggg

SEQ ID NO: 6214433 - DNA, 20 bp, Homo sapiens
gagctgatgtgagtgtgtgt

SEQ ID NO: 6214434 - DNA, 19 bp, Homo sapiens
gagctgatttccaggcccc

SEQ ID NO: 6214435 - DNA, 21 bp, Homo sapiens
gagctgatttccaggcccctg

SEQ ID NO: 6214436 - DNA, 12 bp, Homo sapiens
gagctgcacaca

SEQ ID NO: 6214437 - DNA, 17 bp, Homo sapiens
gagctgcacttggcctc

SEQ ID NO: 6214438 - DNA, 20 bp, Homo sapiens
gagctgcacttggcctcagc

SEQ ID NO: 6214439 - DNA, 11 bp, Homo sapiens
gagctgcagaa

SEQ ID NO: 6214440 - DNA, 13 bp, Homo sapiens
gagctgcagagca

SEQ ID NO: 6214441 - DNA, 21 bp, Homo sapiens
gagctgcagagcagcagcacc

SEQ ID NO: 6214442 - DNA, 13 bp, Homo sapiens
gagctgcagccag

SEQ ID NO: 6214443 - DNA, 14 bp, Homo sapiens
gagctgcagccagt

SEQ ID NO: 6214444 - DNA, 16 bp, Homo sapiens
gagctgcagcccccca

SEQ ID NO: 6214445 - DNA, 14 bp, Homo sapiens
gagctgcagcctgg

SEQ ID NO: 6214446 - DNA, 18 bp, Homo sapiens
gagctgcagcctggctgg

SEQ ID NO: 6214447 - DNA, 20 bp, Homo sapiens
gagctgcaggaatcacccct

SEQ ID NO: 6214448 - DNA, 20 bp, Homo sapiens
gagctgcagttgtgaaagca

SEQ ID NO: 6214449 - DNA, 21 bp, Homo sapiens
gagctgcatggacgcctggct

SEQ ID NO: 6214450 - DNA, 22 bp, Homo sapiens
gagctgcatggacgcctggctc

SEQ ID NO: 6214451 - DNA, 12 bp, Homo sapiens
gagctgccaaga

SEQ ID NO: 6214452 - DNA, 13 bp, Homo sapiens
gagctgccacaga

SEQ ID NO: 6214453 - DNA, 15 bp, Homo sapiens
gagctgccactgggc

SEQ ID NO: 6214454 - DNA, 17 bp, Homo sapiens
gagctgccactgggcac

SEQ ID NO: 6214455 - DNA, 21 bp, Homo sapiens
gagctgccactgggcacctgc

SEQ ID NO: 6214456 - DNA, 14 bp, Homo sapiens
gagctgccagccgg

SEQ ID NO: 6214457 - DNA, 22 bp, Homo sapiens
gagctgccagcctgaggtgccc

SEQ ID NO: 6214458 - DNA, 13 bp, Homo sapiens
gagctgccagtgg

SEQ ID NO: 6214459 - DNA, 21 bp, Homo sapiens
gagctgccagtggggcctgag

SEQ ID NO: 6214460 - DNA, 17 bp, Homo sapiens
gagctgcccctgctgct

SEQ ID NO: 6214461 - DNA, 18 bp, Homo sapiens
gagctgcccggcgcctgc

SEQ ID NO: 6214462 - DNA, 22 bp, Homo sapiens
gagctgcccggcgcctgccctg

SEQ ID NO: 6214463 - DNA, 11 bp, Homo sapiens
gagctgccctc

SEQ ID NO: 6214464 - DNA, 17 bp, Homo sapiens
gagctgccctctcctgg

SEQ ID NO: 6214465 - DNA, 19 bp, Homo sapiens
gagctgccgcaaggccctg

SEQ ID NO: 6214466 - DNA, 20 bp, Homo sapiens
gagctgccgcaaggccctgt

SEQ ID NO: 6214467 - DNA, 15 bp, Homo sapiens
gagctgcctccagcc

SEQ ID NO: 6214468 - DNA, 18 bp, Homo sapiens
gagctgcctccagcctgg

SEQ ID NO: 6214469 - DNA, 20 bp, Homo sapiens
gagctgcctccagcctggtg

SEQ ID NO: 6214470 - DNA, 14 bp, Homo sapiens
gagctgcctcccca

SEQ ID NO: 6214471 - DNA, 14 bp, Homo sapiens
gagctgcctcctgg

SEQ ID NO: 6214472 - DNA, 11 bp, Homo sapiens
gagctgcctgc

SEQ ID NO: 6214473 - DNA, 14 bp, Homo sapiens
gagctgcctgcagc

SEQ ID NO: 6214474 - DNA, 22 bp, Homo sapiens
gagctgcctgctctgcagccca

SEQ ID NO: 6214475 - DNA, 15 bp, Homo sapiens
gagctgcctgttcag

SEQ ID NO: 6214476 - DNA, 16 bp, Homo sapiens
gagctgcctgttcagc

SEQ ID NO: 6214477 - DNA, 20 bp, Homo sapiens
gagctgcctgttcagctcca

SEQ ID NO: 6214478 - DNA, 13 bp, Homo sapiens
gagctgccttccc

SEQ ID NO: 6214479 - DNA, 18 bp, Homo sapiens
gagctgcgccggacagag

SEQ ID NO: 6214480 - DNA, 12 bp, Homo sapiens
gagctgcgggct

SEQ ID NO: 6214481 - DNA, 18 bp, Homo sapiens
gagctgctaaaataaacc

SEQ ID NO: 6214482 - DNA, 18 bp, Homo sapiens
gagctgctaagctaaaga

SEQ ID NO: 6214483 - DNA, 22 bp, Homo sapiens
gagctgctcctggctgaggggc

SEQ ID NO: 6214484 - DNA, 13 bp, Homo sapiens
gagctgctctgct

SEQ ID NO: 6214485 - DNA, 16 bp, Homo sapiens
gagctgctctggaaaa

SEQ ID NO: 6214486 - DNA, 16 bp, Homo sapiens
gagctgctgagcagga

SEQ ID NO: 6214487 - DNA, 14 bp, Homo sapiens
gagctgctgaggga

SEQ ID NO: 6214488 - DNA, 13 bp, Homo sapiens
gagctgctgagtg

SEQ ID NO: 6214489 - DNA, 14 bp, Homo sapiens
gagctgctgccctg

SEQ ID NO: 6214490 - DNA, 21 bp, Homo sapiens
gagctgctggccatggctgct

SEQ ID NO: 6214491 - DNA, 12 bp, Homo sapiens
gagctgctggct

SEQ ID NO: 6214492 - DNA, 21 bp, Homo sapiens
gagctgctgggtggcaggggg

SEQ ID NO: 6214493 - DNA, 15 bp, Homo sapiens
gagctgctgtgccca

SEQ ID NO: 6214494 - DNA, 13 bp, Homo sapiens
gagctgcttcccc

SEQ ID NO: 6214495 - DNA, 17 bp, Homo sapiens
gagctggaaataaacct

SEQ ID NO: 6214496 - DNA, 20 bp, Homo sapiens
gagctggaaataaacctgga

SEQ ID NO: 6214497 - DNA, 15 bp, Homo sapiens
gagctggaaggcagg

SEQ ID NO: 6214498 - DNA, 23 bp, Homo sapiens
gagctggaattctaaatgctggt

SEQ ID NO: 6214499 - DNA, 23 bp, Homo sapiens
gagctggagatgaggccagacca

SEQ ID NO: 6214500 - DNA, 13 bp, Homo sapiens
gagctggagcccc

SEQ ID NO: 6214501 - DNA, 15 bp, Homo sapiens
gagctggagcctggt

SEQ ID NO: 6214502 - DNA, 22 bp, Homo sapiens
gagctggagcggagaggaagcc

SEQ ID NO: 6214503 - DNA, 20 bp, Homo sapiens
gagctggagctaaggccagc

SEQ ID NO: 6214504 - DNA, 20 bp, Homo sapiens
gagctggaggggtggggagc

SEQ ID NO: 6214505 - DNA, 17 bp, Homo sapiens
gagctggagtctgggct

SEQ ID NO: 6214506 - DNA, 21 bp, Homo sapiens
gagctggatttgggagctctg

SEQ ID NO: 6214507 - DNA, 20 bp, Homo sapiens
gagctggcaaaggtggctct

SEQ ID NO: 6214508 - DNA, 19 bp, Homo sapiens
gagctggcaaccagccagc

SEQ ID NO: 6214509 - DNA, 21 bp, Homo sapiens
gagctggcaaccagccagcgt

SEQ ID NO: 6214510 - DNA, 17 bp, Homo sapiens
gagctggcagcctccag

SEQ ID NO: 6214511 - DNA, 18 bp, Homo sapiens
gagctggcagcctccagt

SEQ ID NO: 6214512 - DNA, 22 bp, Homo sapiens
gagctggcagtgtgcggagctg

SEQ ID NO: 6214513 - DNA, 16 bp, Homo sapiens
gagctggcattggtct

SEQ ID NO: 6214514 - DNA, 20 bp, Homo sapiens
gagctggcattggtctgctg

SEQ ID NO: 6214515 - DNA, 22 bp, Homo sapiens
gagctggccaaagagcctttcc

SEQ ID NO: 6214516 - DNA, 23 bp, Homo sapiens
gagctggccaaagagcctttcca

SEQ ID NO: 6214517 - DNA, 13 bp, Homo sapiens
gagctggcccagg

SEQ ID NO: 6214518 - DNA, 20 bp, Homo sapiens
gagctggcccagggggcctg

SEQ ID NO: 6214519 - DNA, 23 bp, Homo sapiens
gagctggccccgcttggtggcct

SEQ ID NO: 6214520 - DNA, 17 bp, Homo sapiens
gagctggcccttgggga

SEQ ID NO: 6214521 - DNA, 19 bp, Homo sapiens
gagctggccgtgggcctgg

SEQ ID NO: 6214522 - DNA, 20 bp, Homo sapiens
gagctggccgtgggcctggg

SEQ ID NO: 6214523 - DNA, 21 bp, Homo sapiens
gagctggcctattttggacgt

SEQ ID NO: 6214524 - DNA, 15 bp, Homo sapiens
gagctggcctccccc

SEQ ID NO: 6214525 - DNA, 17 bp, Homo sapiens
gagctggcctcccccaa

SEQ ID NO: 6214526 - DNA, 15 bp, Homo sapiens
gagctggcctgtggc

SEQ ID NO: 6214527 - DNA, 16 bp, Homo sapiens
gagctggcgctcagca

SEQ ID NO: 6214528 - DNA, 18 bp, Homo sapiens
gagctggcgctcagcagc

SEQ ID NO: 6214529 - DNA, 14 bp, Homo sapiens
gagctggcgtcacc

SEQ ID NO: 6214530 - DNA, 16 bp, Homo sapiens
gagctggcgtctgtct

SEQ ID NO: 6214531 - DNA, 19 bp, Homo sapiens
gagctggctccagcctgga

SEQ ID NO: 6214532 - DNA, 13 bp, Homo sapiens
gagctggctctga

SEQ ID NO: 6214533 - DNA, 15 bp, Homo sapiens
gagctggctggcagg

SEQ ID NO: 6214534 - DNA, 18 bp, Homo sapiens
gagctggctggcaggtgt

SEQ ID NO: 6214535 - DNA, 14 bp, Homo sapiens
gagctggctgtgcc

SEQ ID NO: 6214536 - DNA, 15 bp, Homo sapiens
gagctggctgtgcct

SEQ ID NO: 6214537 - DNA, 19 bp, Homo sapiens
gagctgggaaacagggagc

SEQ ID NO: 6214538 - DNA, 21 bp, Homo sapiens
gagctgggaaacagggagccc

SEQ ID NO: 6214539 - DNA, 23 bp, Homo sapiens
gagctgggaagctgtactcagag

SEQ ID NO: 6214540 - DNA, 16 bp, Homo sapiens
gagctgggagacaaag

SEQ ID NO: 6214541 - DNA, 20 bp, Homo sapiens
gagctgggagaccctcccca

SEQ ID NO: 6214542 - DNA, 15 bp, Homo sapiens
gagctgggagccagg

SEQ ID NO: 6214543 - DNA, 16 bp, Homo sapiens
gagctgggagccaggc

SEQ ID NO: 6214544 - DNA, 18 bp, Homo sapiens
gagctgggagccaggctc

SEQ ID NO: 6214545 - DNA, 17 bp, Homo sapiens
gagctgggaggcatggc

SEQ ID NO: 6214546 - DNA, 16 bp, Homo sapiens
gagctgggatcctaag

SEQ ID NO: 6214547 - DNA, 19 bp, Homo sapiens
gagctgggatggggccaga

SEQ ID NO: 6214548 - DNA, 19 bp, Homo sapiens
gagctgggcagaaggccaa

SEQ ID NO: 6214549 - DNA, 19 bp, Homo sapiens
gagctgggcccgacatggc

SEQ ID NO: 6214550 - DNA, 16 bp, Homo sapiens
gagctgggccctgcct

SEQ ID NO: 6214551 - DNA, 17 bp, Homo sapiens
gagctgggccctgcctg

SEQ ID NO: 6214552 - DNA, 22 bp, Homo sapiens
gagctgggccctgcctgcagcc

SEQ ID NO: 6214553 - DNA, 16 bp, Homo sapiens
gagctgggccctgggt

SEQ ID NO: 6214554 - DNA, 17 bp, Homo sapiens
gagctgggcctggtctc

SEQ ID NO: 6214555 - DNA, 21 bp, Homo sapiens
gagctgggcctggtctcaccc

SEQ ID NO: 6214556 - DNA, 22 bp, Homo sapiens
gagctgggcttctgtccaaggc

SEQ ID NO: 6214557 - DNA, 20 bp, Homo sapiens
gagctggggaatcccctcgc

SEQ ID NO: 6214558 - DNA, 21 bp, Homo sapiens
gagctggggaccagcagtctg

SEQ ID NO: 6214559 - DNA, 13 bp, Homo sapiens
gagctggggacct

SEQ ID NO: 6214560 - DNA, 17 bp, Homo sapiens
gagctggggactcaggg

SEQ ID NO: 6214561 - DNA, 18 bp, Homo sapiens
gagctggggactcaggga

SEQ ID NO: 6214562 - DNA, 19 bp, Homo sapiens
gagctggggactcagggac

SEQ ID NO: 6214563 - DNA, 17 bp, Homo sapiens
gagctggggaggtggga

SEQ ID NO: 6214564 - DNA, 14 bp, Homo sapiens
gagctggggcctgg

SEQ ID NO: 6214565 - DNA, 18 bp, Homo sapiens
gagctggggcctggagag

SEQ ID NO: 6214566 - DNA, 22 bp, Homo sapiens
gagctggggcctggagaggggc

SEQ ID NO: 6214567 - DNA, 20 bp, Homo sapiens
gagctggggcttctttctgc

SEQ ID NO: 6214568 - DNA, 22 bp, Homo sapiens
gagctggggcttctttctgctg

SEQ ID NO: 6214569 - DNA, 19 bp, Homo sapiens
gagctgggggccatgagct

SEQ ID NO: 6214570 - DNA, 24 bp, Homo sapiens
gagctgggggccatgagctccaga

SEQ ID NO: 6214571 - DNA, 19 bp, Homo sapiens
gagctggggggttggcagc

SEQ ID NO: 6214572 - DNA, 22 bp, Homo sapiens
gagctggggggttggcagccca

SEQ ID NO: 6214573 - DNA, 23 bp, Homo sapiens
gagctggggggttggcagcccac

SEQ ID NO: 6214574 - DNA, 19 bp, Homo sapiens
gagctggggtctgggcagt

SEQ ID NO: 6214575 - DNA, 18 bp, Homo sapiens
gaaactccttttgctgtc

SEQ ID NO: 6214576 - DNA, 17 bp, Homo sapiens
gaaactctatggtctta

SEQ ID NO: 6214577 - DNA, 14 bp, Homo sapiens
gaaactctggagag

SEQ ID NO: 6214578 - DNA, 19 bp, Homo sapiens
gaaactctggctcagcctg

SEQ ID NO: 6214579 - DNA, 14 bp, Homo sapiens
gaaactcttatctc

SEQ ID NO: 6214580 - DNA, 15 bp, Homo sapiens
gaaactcttatctca

SEQ ID NO: 6214581 - DNA, 21 bp, Homo sapiens
gaaactcttatctcagtcatg

SEQ ID NO: 6214582 - DNA, 23 bp, Homo sapiens
gaaactcttatctcagtcatgca

SEQ ID NO: 6214583 - DNA, 13 bp, Homo sapiens
gaaactctttgga

SEQ ID NO: 6214584 - DNA, 16 bp, Homo sapiens
gaaactgaaaaatatc

SEQ ID NO: 6214585 - DNA, 18 bp, Homo sapiens
gaaactgaaaactgtaaa

SEQ ID NO: 6214586 - DNA, 13 bp, Homo sapiens
gaaactgaatgaa

SEQ ID NO: 6214587 - DNA, 15 bp, Homo sapiens
gaaactgacagtatt

SEQ ID NO: 6214588 - DNA, 18 bp, Homo sapiens
gaaactgaggaattttct

SEQ ID NO: 6214589 - DNA, 23 bp, Homo sapiens
gaaactgaggagtagctgagagg

SEQ ID NO: 6214590 - DNA, 24 bp, Homo sapiens
gaaactgaggagtagctgagagga

SEQ ID NO: 6214591 - DNA, 18 bp, Homo sapiens
gaaactgaggcccagaga

SEQ ID NO: 6214592 - DNA, 19 bp, Homo sapiens
gaaactgaggcccagagag

SEQ ID NO: 6214593 - DNA, 22 bp, Homo sapiens
gaaactgaggcccagagagctg

SEQ ID NO: 6214594 - DNA, 23 bp, Homo sapiens
gaaactgaggcccagagagctga

SEQ ID NO: 6214595 - DNA, 20 bp, Homo sapiens
gaaactgaggcccagagagg

SEQ ID NO: 6214596 - DNA, 16 bp, Homo sapiens
gaaactgagggcagag

SEQ ID NO: 6214597 - DNA, 17 bp, Homo sapiens
gaaactgagggcagaga

SEQ ID NO: 6214598 - DNA, 18 bp, Homo sapiens
gaaactgagggcagagag

SEQ ID NO: 6214599 - DNA, 22 bp, Homo sapiens
gaaactgaggtgttattttcaa

SEQ ID NO: 6214600 - DNA, 15 bp, Homo sapiens
gaaactgagtcactc

SEQ ID NO: 6214601 - DNA, 18 bp, Homo sapiens
gaaactgagtcactcaca

SEQ ID NO: 6214602 - DNA, 17 bp, Homo sapiens
gaaactgagtcctgttc

SEQ ID NO: 6214603 - DNA, 18 bp, Homo sapiens
gaaactgagtctgtggac

SEQ ID NO: 6214604 - DNA, 15 bp, Homo sapiens
gaaactgatttcttc

SEQ ID NO: 6214605 - DNA, 18 bp, Homo sapiens
gaaactgcattatttgtt

SEQ ID NO: 6214606 - DNA, 15 bp, Homo sapiens
gaaactgccaaacct

SEQ ID NO: 6214607 - DNA, 13 bp, Homo sapiens
gaaactgccacat

SEQ ID NO: 6214608 - DNA, 13 bp, Homo sapiens
gaaactgccagca

SEQ ID NO: 6214609 - DNA, 15 bp, Homo sapiens
gaaactgccagcaac

SEQ ID NO: 6214610 - DNA, 22 bp, Homo sapiens
gaaactgctcccatcattcctt

SEQ ID NO: 6214611 - DNA, 21 bp, Homo sapiens
gaaactgcttgtttcctagca

SEQ ID NO: 6214612 - DNA, 13 bp, Homo sapiens
gaaactgctttat

SEQ ID NO: 6214613 - DNA, 16 bp, Homo sapiens
gaaactggaagctgtt

SEQ ID NO: 6214614 - DNA, 14 bp, Homo sapiens
gaaactggaataag

SEQ ID NO: 6214615 - DNA, 15 bp, Homo sapiens
gaaactggaataagc

SEQ ID NO: 6214616 - DNA, 17 bp, Homo sapiens
gaaactggaataagcct

SEQ ID NO: 6214617 - DNA, 17 bp, Homo sapiens
gaaactggactcacatt

SEQ ID NO: 6214618 - DNA, 17 bp, Homo sapiens
gaaactggattaaaaca

SEQ ID NO: 6214619 - DNA, 18 bp, Homo sapiens
gaaactggccatggcctg

SEQ ID NO: 6214620 - DNA, 21 bp, Homo sapiens
gaaactggccatggcctgcaa

SEQ ID NO: 6214621 - DNA, 12 bp, Homo sapiens
gaaactggcccc

SEQ ID NO: 6214622 - DNA, 16 bp, Homo sapiens
gaaactggccccggat

SEQ ID NO: 6214623 - DNA, 12 bp, Homo sapiens
gaaactggctga

SEQ ID NO: 6214624 - DNA, 19 bp, Homo sapiens
gaaactgggaaactgggtt

SEQ ID NO: 6214625 - DNA, 17 bp, Homo sapiens
gaaactgggttcctgca

SEQ ID NO: 6214626 - DNA, 14 bp, Homo sapiens
gaaactggtttata

SEQ ID NO: 6214627 - DNA, 19 bp, Homo sapiens
gaaactggtttataataaa

SEQ ID NO: 6214628 - DNA, 20 bp, Homo sapiens
gaaactgtatcatctttgcc

SEQ ID NO: 6214629 - DNA, 21 bp, Homo sapiens
gaaactgtcggtttgctttga

SEQ ID NO: 6214630 - DNA, 18 bp, Homo sapiens
gaaactgtgaatgcttct

SEQ ID NO: 6214631 - DNA, 20 bp, Homo sapiens
gaaactgttcccacctgctg

SEQ ID NO: 6214632 - DNA, 21 bp, Homo sapiens
gaaactgttgccagagatgga

SEQ ID NO: 6214633 - DNA, 15 bp, Homo sapiens
gaaactgttggttga

SEQ ID NO: 6214634 - DNA, 14 bp, Homo sapiens
gaaacttacacaca

SEQ ID NO: 6214635 - DNA, 19 bp, Homo sapiens
gaaacttacactgtttcat

SEQ ID NO: 6214636 - DNA, 23 bp, Homo sapiens
gaaacttatagttaatattttgt

SEQ ID NO: 6214637 - DNA, 19 bp, Homo sapiens
gaaacttatcttacaaagt

SEQ ID NO: 6214638 - DNA, 11 bp, Homo sapiens
gaaacttattt

SEQ ID NO: 6214639 - DNA, 19 bp, Homo sapiens
gaaacttatttttttctga

SEQ ID NO: 6214640 - DNA, 17 bp, Homo sapiens
gaaacttcaagcaccag

SEQ ID NO: 6214641 - DNA, 22 bp, Homo sapiens
gaaacttcaagcaccagggaag

SEQ ID NO: 6214642 - DNA, 13 bp, Homo sapiens
gaaacttccaaga

SEQ ID NO: 6214643 - DNA, 13 bp, Homo sapiens
gaaacttctcagt

SEQ ID NO: 6214644 - DNA, 11 bp, Homo sapiens
gaaacttctga

SEQ ID NO: 6214645 - DNA, 18 bp, Homo sapiens
gaaacttctgatgtttat

SEQ ID NO: 6214646 - DNA, 20 bp, Homo sapiens
gaaacttgatattgaggtgt

SEQ ID NO: 6214647 - DNA, 15 bp, Homo sapiens
gaaacttggacattt

SEQ ID NO: 6214648 - DNA, 11 bp, Homo sapiens
gaaacttggat

SEQ ID NO: 6214649 - DNA, 14 bp, Homo sapiens
gaaacttggctgga

SEQ ID NO: 6214650 - DNA, 17 bp, Homo sapiens
gaaacttggctggaatt

SEQ ID NO: 6214651 - DNA, 20 bp, Homo sapiens
gaaacttgggaatcattctg

SEQ ID NO: 6214652 - DNA, 18 bp, Homo sapiens
gaaacttggttcccagaa

SEQ ID NO: 6214653 - DNA, 16 bp, Homo sapiens
gaaacttgtcacttgc

SEQ ID NO: 6214654 - DNA, 17 bp, Homo sapiens
gaaacttgttagaaatg

SEQ ID NO: 6214655 - DNA, 13 bp, Homo sapiens
gaaacttgttatt

SEQ ID NO: 6214656 - DNA, 16 bp, Homo sapiens
gaaacttgttattgtg

SEQ ID NO: 6214657 - DNA, 19 bp, Homo sapiens
gaaacttgttattgtgaat

SEQ ID NO: 6214658 - DNA, 20 bp, Homo sapiens
gaaacttgttattgtgaatg

SEQ ID NO: 6214659 - DNA, 17 bp, Homo sapiens
gaaacttgtttcactga

SEQ ID NO: 6214660 - DNA, 17 bp, Homo sapiens
gaaactttatacattag

SEQ ID NO: 6214661 - DNA, 22 bp, Homo sapiens
gaaactttattcaagtaaaaat

SEQ ID NO: 6214662 - DNA, 14 bp, Homo sapiens
gaaactttcccttt

SEQ ID NO: 6214663 - DNA, 22 bp, Homo sapiens
gaaactttgagatctaaaaata

SEQ ID NO: 6214664 - DNA, 21 bp, Homo sapiens
gaaactttgaggataactttt

SEQ ID NO: 6214665 - DNA, 19 bp, Homo sapiens
gaaactttgatctctgctt

SEQ ID NO: 6214666 - DNA, 16 bp, Homo sapiens
gaaactttgctttggg

SEQ ID NO: 6214667 - DNA, 17 bp, Homo sapiens
gaaactttgggaaaaca

SEQ ID NO: 6214668 - DNA, 13 bp, Homo sapiens
gaaactttgtgct

SEQ ID NO: 6214669 - DNA, 13 bp, Homo sapiens
gaaacttttcaag

SEQ ID NO: 6214670 - DNA, 22 bp, Homo sapiens
gaaacttttcaaggcacattga

SEQ ID NO: 6214671 - DNA, 14 bp, Homo sapiens
gaaacttttctaaa

SEQ ID NO: 6214672 - DNA, 14 bp, Homo sapiens
gaaacttttctaga

SEQ ID NO: 6214673 - DNA, 15 bp, Homo sapiens
gaaacttttctagaa

SEQ ID NO: 6214674 - DNA, 21 bp, Homo sapiens
gaaacttttcttaaaaagtta

SEQ ID NO: 6214675 - DNA, 13 bp, Homo sapiens
gaaacttttgaaa

SEQ ID NO: 6214676 - DNA, 14 bp, Homo sapiens
gaaacttttgaaaa

SEQ ID NO: 6214677 - DNA, 15 bp, Homo sapiens
gaaacttttgaaaaa

SEQ ID NO: 6214678 - DNA, 15 bp, Homo sapiens
gaaacttttgtaaag

SEQ ID NO: 6214679 - DNA, 20 bp, Homo sapiens
gaaacttttgttagggctgc

SEQ ID NO: 6214680 - DNA, 16 bp, Homo sapiens
gaaagaaaaaacaaaa

SEQ ID NO: 6214681 - DNA, 14 bp, Homo sapiens
gaaagaaaaaattt

SEQ ID NO: 6214682 - DNA, 15 bp, Homo sapiens
gaaagaaaaaatttt

SEQ ID NO: 6214683 - DNA, 24 bp, Homo sapiens
gaaagaaaaataccatgtctctaa

SEQ ID NO: 6214684 - DNA, 22 bp, Homo sapiens
gaaagaaaagaacacttgccca

SEQ ID NO: 6214685 - DNA, 13 bp, Homo sapiens
gaaagaaaaggca

SEQ ID NO: 6214686 - DNA, 14 bp, Homo sapiens
gaaagaaaaggcaa

SEQ ID NO: 6214687 - DNA, 23 bp, Homo sapiens
gaaagaaaaggcaaaagactggt

SEQ ID NO: 6214688 - DNA, 18 bp, Homo sapiens
gaaagaaaatggaaagaa

SEQ ID NO: 6214689 - DNA, 20 bp, Homo sapiens
gaaagaaaatggaaagaagg

SEQ ID NO: 6214690 - DNA, 18 bp, Homo sapiens
gaaagaaaatgtctgttt

SEQ ID NO: 6214691 - DNA, 17 bp, Homo sapiens
gaaagaaaattagtaat

SEQ ID NO: 6214692 - DNA, 14 bp, Homo sapiens
gaaagaaaattata

SEQ ID NO: 6214693 - DNA, 19 bp, Homo sapiens
gaaagaaaattatattctg

SEQ ID NO: 6214694 - DNA, 20 bp, Homo sapiens
gaaagaaaattatattctgt

SEQ ID NO: 6214695 - DNA, 17 bp, Homo sapiens
gaaagaaagaaagaaag

SEQ ID NO: 6214696 - DNA, 15 bp, Homo sapiens
gaaagaaagaaggaa

SEQ ID NO: 6214697 - DNA, 13 bp, Homo sapiens
gaaagaaagagga

SEQ ID NO: 6214698 - DNA, 16 bp, Homo sapiens
gaaagaaagctgagaa

SEQ ID NO: 6214699 - DNA, 11 bp, Homo sapiens
gaaagaaagga

SEQ ID NO: 6214700 - DNA, 13 bp, Homo sapiens
gaaagaaaggaaa

SEQ ID NO: 6214701 - DNA, 14 bp, Homo sapiens
gaaagaaaggaaag

SEQ ID NO: 6214702 - DNA, 18 bp, Homo sapiens
gaaagaaaggaaagaagg

SEQ ID NO: 6214703 - DNA, 21 bp, Homo sapiens
gaaagaaagggaaaagggaga

SEQ ID NO: 6214704 - DNA, 22 bp, Homo sapiens
gaaagaaagttgcacggctgct

SEQ ID NO: 6214705 - DNA, 16 bp, Homo sapiens
gaaagaaataattgtt

SEQ ID NO: 6214706 - DNA, 15 bp, Homo sapiens
gaaagaaatattaac

SEQ ID NO: 6214707 - DNA, 14 bp, Homo sapiens
gaaagaaatcatgt

SEQ ID NO: 6214708 - DNA, 16 bp, Homo sapiens
gaaagaaatggctttt

SEQ ID NO: 6214709 - DNA, 13 bp, Homo sapiens
gaaagaacaagtt

SEQ ID NO: 6214710 - DNA, 13 bp, Homo sapiens
gaaagaacattta

SEQ ID NO: 6214711 - DNA, 20 bp, Homo sapiens
gaaagaacgctgatttaaag

SEQ ID NO: 6214712 - DNA, 16 bp, Homo sapiens
gaaagaactatcttca

SEQ ID NO: 6214713 - DNA, 23 bp, Homo sapiens
gaaagaactttaaagctcaggag

SEQ ID NO: 6214714 - DNA, 22 bp, Homo sapiens
gaaagaagaaactccgaagaaa

SEQ ID NO: 6214715 - DNA, 14 bp, Homo sapiens
gaaagaagagaagt

SEQ ID NO: 6214716 - DNA, 11 bp, Homo sapiens
gaaagaagcaa

SEQ ID NO: 6214717 - DNA, 13 bp, Homo sapiens
gaaagaagcaaga

SEQ ID NO: 6214718 - DNA, 14 bp, Homo sapiens
gaaagaagcaagac

SEQ ID NO: 6214719 - DNA, 17 bp, Homo sapiens
gaaagaagcactctgct

SEQ ID NO: 6214720 - DNA, 15 bp, Homo sapiens
gaaagaagcagttct

SEQ ID NO: 6214721 - DNA, 20 bp, Homo sapiens
gaaagaagcattgaaaacaa

SEQ ID NO: 6214722 - DNA, 23 bp, Homo sapiens
gaaagaaggagatgaatagaaga

SEQ ID NO: 6214723 - DNA, 16 bp, Homo sapiens
gaaagaagtcaaatga

SEQ ID NO: 6214724 - DNA, 16 bp, Homo sapiens
gaaagaagtcagttaa

SEQ ID NO: 6214725 - DNA, 16 bp, Homo sapiens
gaaagaagttgctaag

SEQ ID NO: 6214726 - DNA, 13 bp, Homo sapiens
gaaagaatagaac

SEQ ID NO: 6214727 - DNA, 17 bp, Homo sapiens
gaaagaatataaagtta

SEQ ID NO: 6214728 - DNA, 16 bp, Homo sapiens
gaaagaatgaaagagt

SEQ ID NO: 6214729 - DNA, 17 bp, Homo sapiens
gaaagaatgagaaagaa

SEQ ID NO: 6214730 - DNA, 15 bp, Homo sapiens
gaaagaatgtaaagc

SEQ ID NO: 6214731 - DNA, 13 bp, Homo sapiens
gaaagaattattt

SEQ ID NO: 6214732 - DNA, 22 bp, Homo sapiens
gaaagaattcctgcagcagtta

SEQ ID NO: 6214733 - DNA, 20 bp, Homo sapiens
gaaagacaaagaaggaaaag

SEQ ID NO: 6214734 - DNA, 14 bp, Homo sapiens
gaaagacaacacaa

SEQ ID NO: 6214735 - DNA, 12 bp, Homo sapiens
gaaagacacaga

SEQ ID NO: 6214736 - DNA, 18 bp, Homo sapiens
gaaagacaccatttatct

SEQ ID NO: 6214737 - DNA, 20 bp, Homo sapiens
gaaagacactgcctgggctg

SEQ ID NO: 6214738 - DNA, 16 bp, Homo sapiens
gaaagacagagctggg

SEQ ID NO: 6214739 - DNA, 17 bp, Homo sapiens
gaaagacagcttctcat

SEQ ID NO: 6214740 - DNA, 12 bp, Homo sapiens
gaaagacaggaa

SEQ ID NO: 6214741 - DNA, 17 bp, Homo sapiens
gaaagacaggaagacca

SEQ ID NO: 6214742 - DNA, 18 bp, Homo sapiens
gaaagacaggaagaccaa

SEQ ID NO: 6214743 - DNA, 19 bp, Homo sapiens
gaaagacaggaagaccaag

SEQ ID NO: 6214744 - DNA, 17 bp, Homo sapiens
gaaagacaggctgagct

SEQ ID NO: 6214745 - DNA, 18 bp, Homo sapiens
gaaagacagtatgagaaa

SEQ ID NO: 6214746 - DNA, 15 bp, Homo sapiens
gaaagacatcaatga

SEQ ID NO: 6214747 - DNA, 16 bp, Homo sapiens
gaaagacatcaatgaa

SEQ ID NO: 6214748 - DNA, 21 bp, Homo sapiens
gaaagacatccataaagaagc

SEQ ID NO: 6214749 - DNA, 17 bp, Homo sapiens
gaaagacatctgaggaa

SEQ ID NO: 6214750 - DNA, 18 bp, Homo sapiens
gaaagacatctgaggaaa

SEQ ID NO: 6214751 - DNA, 17 bp, Homo sapiens
gaaagacatctttctct

SEQ ID NO: 6214752 - DNA, 22 bp, Homo sapiens
gaaagaccatgtggtttgctgt

SEQ ID NO: 6214753 - DNA, 15 bp, Homo sapiens
gaaagaccctaggtg

SEQ ID NO: 6214754 - DNA, 22 bp, Homo sapiens
gaaagaccctgatgcaggtcag

SEQ ID NO: 6214755 - DNA, 22 bp, Homo sapiens
gaaagacctacattccctctcc

SEQ ID NO: 6214756 - DNA, 20 bp, Homo sapiens
gagctggggtctgggcagtg

SEQ ID NO: 6214757 - DNA, 21 bp, Homo sapiens
gagctggggtgggagctcctc

SEQ ID NO: 6214758 - DNA, 20 bp, Homo sapiens
gagctgggtaccaggccacc

SEQ ID NO: 6214759 - DNA, 21 bp, Homo sapiens
gagctggtagttagtagcatg

SEQ ID NO: 6214760 - DNA, 15 bp, Homo sapiens
gagctggtgacagcc

SEQ ID NO: 6214761 - DNA, 11 bp, Homo sapiens
gagctggtgca

SEQ ID NO: 6214762 - DNA, 14 bp, Homo sapiens
gagctggtgcatta

SEQ ID NO: 6214763 - DNA, 13 bp, Homo sapiens
gagctggtgccag

SEQ ID NO: 6214764 - DNA, 23 bp, Homo sapiens
gagctggtggacccagggaacag

SEQ ID NO: 6214765 - DNA, 15 bp, Homo sapiens
gagctggttgaattg

SEQ ID NO: 6214766 - DNA, 18 bp, Homo sapiens
gagctggttgggaagaca

SEQ ID NO: 6214767 - DNA, 16 bp, Homo sapiens
gagctggttttctctg

SEQ ID NO: 6214768 - DNA, 18 bp, Homo sapiens
gagctgtaaaaatgttac

SEQ ID NO: 6214769 - DNA, 23 bp, Homo sapiens
gagctgtaatttcgccttaaact

SEQ ID NO: 6214770 - DNA, 22 bp, Homo sapiens
gagctgtataactgtgcagaga

SEQ ID NO: 6214771 - DNA, 19 bp, Homo sapiens
gagctgtatatatatatgt

SEQ ID NO: 6214772 - DNA, 21 bp, Homo sapiens
gagctgtatatatatatgtgt

SEQ ID NO: 6214773 - DNA, 22 bp, Homo sapiens
gagctgtatatatatatgtgtg

SEQ ID NO: 6214774 - DNA, 18 bp, Homo sapiens
gagctgtattaagccact

SEQ ID NO: 6214775 - DNA, 17 bp, Homo sapiens
gagctgtcaccaaggaa

SEQ ID NO: 6214776 - DNA, 19 bp, Homo sapiens
gagctgtcaccaaggaaac

SEQ ID NO: 6214777 - DNA, 14 bp, Homo sapiens
gagctgtcacctct

SEQ ID NO: 6214778 - DNA, 20 bp, Homo sapiens
gagctgtcacctctcagctg

SEQ ID NO: 6214779 - DNA, 16 bp, Homo sapiens
gagctgtccagtggag

SEQ ID NO: 6214780 - DNA, 15 bp, Homo sapiens
gagctgtcccctgga

SEQ ID NO: 6214781 - DNA, 17 bp, Homo sapiens
gagctgtcggagggctg

SEQ ID NO: 6214782 - DNA, 14 bp, Homo sapiens
gagctgtctccagg

SEQ ID NO: 6214783 - DNA, 23 bp, Homo sapiens
gagctgtctgaagcccaaagcct

SEQ ID NO: 6214784 - DNA, 20 bp, Homo sapiens
gagctgtctgcggagccagc

SEQ ID NO: 6214785 - DNA, 16 bp, Homo sapiens
gagctgtctgtctcta

SEQ ID NO: 6214786 - DNA, 16 bp, Homo sapiens
gagctgtcttcccctg

SEQ ID NO: 6214787 - DNA, 20 bp, Homo sapiens
gagctgtcttcctgtgtacc

SEQ ID NO: 6214788 - DNA, 21 bp, Homo sapiens
gagctgtgacattgctggtca

SEQ ID NO: 6214789 - DNA, 15 bp, Homo sapiens
gagctgtgacccaga

SEQ ID NO: 6214790 - DNA, 21 bp, Homo sapiens
gagctgtgagaagggtgttgt

SEQ ID NO: 6214791 - DNA, 22 bp, Homo sapiens
gagctgtgagggccaccggtgg

SEQ ID NO: 6214792 - DNA, 21 bp, Homo sapiens
gagctgtgagttctccctgta

SEQ ID NO: 6214793 - DNA, 18 bp, Homo sapiens
gagctgtgcaggtgggga

SEQ ID NO: 6214794 - DNA, 11 bp, Homo sapiens
gagctgtgccc

SEQ ID NO: 6214795 - DNA, 15 bp, Homo sapiens
gagctgtgccgaggc

SEQ ID NO: 6214796 - DNA, 21 bp, Homo sapiens
gagctgtgcctgctcagcagc

SEQ ID NO: 6214797 - DNA, 22 bp, Homo sapiens
gagctgtgcctgctcagcagcc

SEQ ID NO: 6214798 - DNA, 15 bp, Homo sapiens
gagctgtggctgggg

SEQ ID NO: 6214799 - DNA, 21 bp, Homo sapiens
gagctgtgttttgtctgagcc

SEQ ID NO: 6214800 - DNA, 13 bp, Homo sapiens
gagctgttatctt

SEQ ID NO: 6214801 - DNA, 19 bp, Homo sapiens
gagctgttcgctcctccca

SEQ ID NO: 6214802 - DNA, 18 bp, Homo sapiens
gagctgttctttttgact

SEQ ID NO: 6214803 - DNA, 15 bp, Homo sapiens
gagctgttggcctcg

SEQ ID NO: 6214804 - DNA, 17 bp, Homo sapiens
gagctgtttactaggga

SEQ ID NO: 6214805 - DNA, 17 bp, Homo sapiens
gagctgtttatggcctc

SEQ ID NO: 6214806 - DNA, 20 bp, Homo sapiens
gagctgtttatggcctcagc

SEQ ID NO: 6214807 - DNA, 22 bp, Homo sapiens
gagctgtttatggcctcagctg

SEQ ID NO: 6214808 - DNA, 15 bp, Homo sapiens
gagctgtttatgttt

SEQ ID NO: 6214809 - DNA, 19 bp, Homo sapiens
gagctgttttggatgaatg

SEQ ID NO: 6214810 - DNA, 20 bp, Homo sapiens
gagctgttttggatgaatgc

SEQ ID NO: 6214811 - DNA, 16 bp, Homo sapiens
gagcttaaaggagggt

SEQ ID NO: 6214812 - DNA, 15 bp, Homo sapiens
gagcttacccaagct

SEQ ID NO: 6214813 - DNA, 16 bp, Homo sapiens
gagcttacccaagctg

SEQ ID NO: 6214814 - DNA, 13 bp, Homo sapiens
gagcttacctccc

SEQ ID NO: 6214815 - DNA, 16 bp, Homo sapiens
gagcttacctcccacc

SEQ ID NO: 6214816 - DNA, 18 bp, Homo sapiens
gagcttagccttgtgccc

SEQ ID NO: 6214817 - DNA, 16 bp, Homo sapiens
gagcttagctctgccc

SEQ ID NO: 6214818 - DNA, 14 bp, Homo sapiens
gagcttagggatga

SEQ ID NO: 6214819 - DNA, 13 bp, Homo sapiens
gagcttagggtct

SEQ ID NO: 6214820 - DNA, 19 bp, Homo sapiens
gagcttattacagaaaaac

SEQ ID NO: 6214821 - DNA, 15 bp, Homo sapiens
gagcttattggccac

SEQ ID NO: 6214822 - DNA, 16 bp, Homo sapiens
gagcttattggccact

SEQ ID NO: 6214823 - DNA, 18 bp, Homo sapiens
gagcttcaactacttctc

SEQ ID NO: 6214824 - DNA, 22 bp, Homo sapiens
gagcttcaagtctgtgcctgga

SEQ ID NO: 6214825 - DNA, 14 bp, Homo sapiens
gagcttcagccagg

SEQ ID NO: 6214826 - DNA, 15 bp, Homo sapiens
gagcttcagccaggt

SEQ ID NO: 6214827 - DNA, 17 bp, Homo sapiens
gagcttcagccaggtct

SEQ ID NO: 6214828 - DNA, 20 bp, Homo sapiens
gagcttccaaatgtgtcaga

SEQ ID NO: 6214829 - DNA, 15 bp, Homo sapiens
gagcttccactgtca

SEQ ID NO: 6214830 - DNA, 17 bp, Homo sapiens
gagcttccagtgcatgt

SEQ ID NO: 6214831 - DNA, 20 bp, Homo sapiens
gagcttcccacacctgcctg

SEQ ID NO: 6214832 - DNA, 14 bp, Homo sapiens
gagcttcccaggat

SEQ ID NO: 6214833 - DNA, 23 bp, Homo sapiens
gagcttcctcggtagcagaggcc

SEQ ID NO: 6214834 - DNA, 18 bp, Homo sapiens
gagcttcctggctctggg

SEQ ID NO: 6214835 - DNA, 17 bp, Homo sapiens
gagcttcctggggacca

SEQ ID NO: 6214836 - DNA, 20 bp, Homo sapiens
gagcttctacagattttaga

SEQ ID NO: 6214837 - DNA, 14 bp, Homo sapiens
gagcttctccagcc

SEQ ID NO: 6214838 - DNA, 18 bp, Homo sapiens
gagcttctccagccacca

SEQ ID NO: 6214839 - DNA, 16 bp, Homo sapiens
gagcttctcccagtgt

SEQ ID NO: 6214840 - DNA, 23 bp, Homo sapiens
gagcttctcccagtgtgagaccc

SEQ ID NO: 6214841 - DNA, 11 bp, Homo sapiens
gagcttctcct

SEQ ID NO: 6214842 - DNA, 14 bp, Homo sapiens
gagcttctcctctg

SEQ ID NO: 6214843 - DNA, 19 bp, Homo sapiens
gagcttctcctctgctcca

SEQ ID NO: 6214844 - DNA, 17 bp, Homo sapiens
gagcttctctttaactc

SEQ ID NO: 6214845 - DNA, 21 bp, Homo sapiens
gagcttctctttaactcagga

SEQ ID NO: 6214846 - DNA, 22 bp, Homo sapiens
gagcttctgggaagacaactag

SEQ ID NO: 6214847 - DNA, 21 bp, Homo sapiens
gagcttctggggtccccaggg

SEQ ID NO: 6214848 - DNA, 21 bp, Homo sapiens
gagcttctgtattttcaaaga

SEQ ID NO: 6214849 - DNA, 22 bp, Homo sapiens
gagcttcttatattaaagaagt

SEQ ID NO: 6214850 - DNA, 16 bp, Homo sapiens
gagcttgagctcccct

SEQ ID NO: 6214851 - DNA, 14 bp, Homo sapiens
gagcttgagggaca

SEQ ID NO: 6214852 - DNA, 22 bp, Homo sapiens
gagcttgagggacaatgccact

SEQ ID NO: 6214853 - DNA, 23 bp, Homo sapiens
gagcttgagggacaatgccacta

SEQ ID NO: 6214854 - DNA, 20 bp, Homo sapiens
gagcttgatctgtgatttct

SEQ ID NO: 6214855 - DNA, 15 bp, Homo sapiens
gagcttgattaaatc

SEQ ID NO: 6214856 - DNA, 21 bp, Homo sapiens
gagcttgattctaaaggggac

SEQ ID NO: 6214857 - DNA, 14 bp, Homo sapiens
gagcttgcaagaag

SEQ ID NO: 6214858 - DNA, 14 bp, Homo sapiens
gagcttgcctcagg

SEQ ID NO: 6214859 - DNA, 17 bp, Homo sapiens
gagcttgcctcagggcc

SEQ ID NO: 6214860 - DNA, 15 bp, Homo sapiens
gagcttgctccagat

SEQ ID NO: 6214861 - DNA, 20 bp, Homo sapiens
gagcttgctggagagtggca

SEQ ID NO: 6214862 - DNA, 13 bp, Homo sapiens
gagcttggacagt

SEQ ID NO: 6214863 - DNA, 16 bp, Homo sapiens
gagcttggactacaca

SEQ ID NO: 6214864 - DNA, 18 bp, Homo sapiens
gagcttggagccccctgg

SEQ ID NO: 6214865 - DNA, 14 bp, Homo sapiens
gagcttggccctgc

SEQ ID NO: 6214866 - DNA, 12 bp, Homo sapiens
gagcttggcctt

SEQ ID NO: 6214867 - DNA, 23 bp, Homo sapiens
gagcttggctctcctctggctag

SEQ ID NO: 6214868 - DNA, 13 bp, Homo sapiens
gagcttgggaatg

SEQ ID NO: 6214869 - DNA, 13 bp, Homo sapiens
gagcttgggactc

SEQ ID NO: 6214870 - DNA, 18 bp, Homo sapiens
gagcttgggactcaggtc

SEQ ID NO: 6214871 - DNA, 13 bp, Homo sapiens
gagcttgggcagt

SEQ ID NO: 6214872 - DNA, 18 bp, Homo sapiens
gagcttgtaataaatact

SEQ ID NO: 6214873 - DNA, 17 bp, Homo sapiens
gagcttgtagccctgga

SEQ ID NO: 6214874 - DNA, 19 bp, Homo sapiens
gagcttgtcttttctgctg

SEQ ID NO: 6214875 - DNA, 16 bp, Homo sapiens
gagcttgtgtcctgtc

SEQ ID NO: 6214876 - DNA, 22 bp, Homo sapiens
gagcttgtgtcctgtcctttct

SEQ ID NO: 6214877 - DNA, 19 bp, Homo sapiens
gagctttattgctgcattt

SEQ ID NO: 6214878 - DNA, 20 bp, Homo sapiens
gagctttccgcgtcagcaag

SEQ ID NO: 6214879 - DNA, 22 bp, Homo sapiens
gagctttccggggaggagcctt

SEQ ID NO: 6214880 - DNA, 17 bp, Homo sapiens
gagctttccttctccag

SEQ ID NO: 6214881 - DNA, 12 bp, Homo sapiens
gagctttctctc

SEQ ID NO: 6214882 - DNA, 17 bp, Homo sapiens
gagctttctgaacagct

SEQ ID NO: 6214883 - DNA, 23 bp, Homo sapiens
gagctttctgaacagctggtgta

SEQ ID NO: 6214884 - DNA, 23 bp, Homo sapiens
gagctttctgtccttttggcact

SEQ ID NO: 6214885 - DNA, 16 bp, Homo sapiens
gagctttctgtgcatg

SEQ ID NO: 6214886 - DNA, 18 bp, Homo sapiens
gagctttctgtgcatgtg

SEQ ID NO: 6214887 - DNA, 19 bp, Homo sapiens
gagctttctgtgcatgtgc

SEQ ID NO: 6214888 - DNA, 19 bp, Homo sapiens
gagctttcttttgtattaa

SEQ ID NO: 6214889 - DNA, 20 bp, Homo sapiens
gagctttgaaaattcagtgg

SEQ ID NO: 6214890 - DNA, 15 bp, Homo sapiens
gagctttgagacagg

SEQ ID NO: 6214891 - DNA, 13 bp, Homo sapiens
gagctttgctctt

SEQ ID NO: 6214892 - DNA, 12 bp, Homo sapiens
gagctttgctta

SEQ ID NO: 6214893 - DNA, 21 bp, Homo sapiens
gagctttggacacacacagct

SEQ ID NO: 6214894 - DNA, 14 bp, Homo sapiens
gagctttgggtgac

SEQ ID NO: 6214895 - DNA, 14 bp, Homo sapiens
gagctttgtgcttg

SEQ ID NO: 6214896 - DNA, 13 bp, Homo sapiens
gagctttgtttca

SEQ ID NO: 6214897 - DNA, 16 bp, Homo sapiens
gagcttttaaaaatgt

SEQ ID NO: 6214898 - DNA, 17 bp, Homo sapiens
gagcttttaaaaatgtt

SEQ ID NO: 6214899 - DNA, 20 bp, Homo sapiens
gagcttttcgaactgtgctc

SEQ ID NO: 6214900 - DNA, 18 bp, Homo sapiens
gagcttttgcatttcctg

SEQ ID NO: 6214901 - DNA, 22 bp, Homo sapiens
gagcttttgcatttcctgtgtt

SEQ ID NO: 6214902 - DNA, 15 bp, Homo sapiens
gagcttttggtgaga

SEQ ID NO: 6214903 - DNA, 15 bp, Homo sapiens
gagctttttttaaat

SEQ ID NO: 6214904 - DNA, 13 bp, Homo sapiens
gaggaaaaaaagc

SEQ ID NO: 6214905 - DNA, 12 bp, Homo sapiens
gaggaaaaaaga

SEQ ID NO: 6214906 - DNA, 17 bp, Homo sapiens
gaggaaaaaatggtata

SEQ ID NO: 6214907 - DNA, 18 bp, Homo sapiens
gaggaaaaaatggtataa

SEQ ID NO: 6214908 - DNA, 22 bp, Homo sapiens
gaggaaaaaatggtataaaagg

SEQ ID NO: 6214909 - DNA, 18 bp, Homo sapiens
gaggaaaaacaacaaata

SEQ ID NO: 6214910 - DNA, 15 bp, Homo sapiens
gaggaaaaacagagg

SEQ ID NO: 6214911 - DNA, 14 bp, Homo sapiens
gaggaaaaaggctg

SEQ ID NO: 6214912 - DNA, 14 bp, Homo sapiens
gaggaaaaaggtca

SEQ ID NO: 6214913 - DNA, 23 bp, Homo sapiens
gaggaaaaatgggagccaggagt

SEQ ID NO: 6214914 - DNA, 18 bp, Homo sapiens
gaggaaaacacagcctcc

SEQ ID NO: 6214915 - DNA, 20 bp, Homo sapiens
gaggaaaacacagcctccct

SEQ ID NO: 6214916 - DNA, 20 bp, Homo sapiens
gaggaaaaccaagccgtggc

SEQ ID NO: 6214917 - DNA, 21 bp, Homo sapiens
gaggaaaaccaagccgtggct

SEQ ID NO: 6214918 - DNA, 17 bp, Homo sapiens
gaggaaaagacagagcc

SEQ ID NO: 6214919 - DNA, 14 bp, Homo sapiens
gaggaaaagccagt

SEQ ID NO: 6214920 - DNA, 14 bp, Homo sapiens
gaggaaaagcccag

SEQ ID NO: 6214921 - DNA, 18 bp, Homo sapiens
gaggaaaagctgcctctg

SEQ ID NO: 6214922 - DNA, 22 bp, Homo sapiens
gaggaaaatgccctgtccctag

SEQ ID NO: 6214923 - DNA, 13 bp, Homo sapiens
gaggaaaatggaa

SEQ ID NO: 6214924 - DNA, 21 bp, Homo sapiens
gaggaaaattaatatcacagc

SEQ ID NO: 6214925 - DNA, 17 bp, Homo sapiens
gaggaaactcacctgct

SEQ ID NO: 6214926 - DNA, 22 bp, Homo sapiens
gaggaaactcacctgctggccc

SEQ ID NO: 6214927 - DNA, 15 bp, Homo sapiens
gaggaaactgagtca

SEQ ID NO: 6214928 - DNA, 16 bp, Homo sapiens
gaggaaactgagtcac

SEQ ID NO: 6214929 - DNA, 22 bp, Homo sapiens
gaggaaactggcgatctcccag

SEQ ID NO: 6214930 - DNA, 21 bp, Homo sapiens
gaggaaacttggacatttatg

SEQ ID NO: 6214931 - DNA, 16 bp, Homo sapiens
gaggaaagaatgaaag

SEQ ID NO: 6214932 - DNA, 20 bp, Homo sapiens
gaggaaagagtcttcaacat

SEQ ID NO: 6214933 - DNA, 21 bp, Homo sapiens
gaggaaagagtcttcaacata

SEQ ID NO: 6214934 - DNA, 17 bp, Homo sapiens
gaaagacctgtgagggg

SEQ ID NO: 6214935 - DNA, 20 bp, Homo sapiens
gaaagacctgtgaggggaaa

SEQ ID NO: 6214936 - DNA, 19 bp, Homo sapiens
gaaagacgcactttggctt

SEQ ID NO: 6214937 - DNA, 18 bp, Homo sapiens
gaaagactatctaaatgt

SEQ ID NO: 6214938 - DNA, 20 bp, Homo sapiens
gaaagactatctaaatgttg

SEQ ID NO: 6214939 - DNA, 17 bp, Homo sapiens
gaaagactattcaaaca

SEQ ID NO: 6214940 - DNA, 18 bp, Homo sapiens
gaaagactcgagaaccaa

SEQ ID NO: 6214941 - DNA, 14 bp, Homo sapiens
gaaagactgaaaga

SEQ ID NO: 6214942 - DNA, 14 bp, Homo sapiens
gaaagactgagctc

SEQ ID NO: 6214943 - DNA, 23 bp, Homo sapiens
gaaagactggacggggaaaccta

SEQ ID NO: 6214944 - DNA, 19 bp, Homo sapiens
gaaagacttgaatttagtt

SEQ ID NO: 6214945 - DNA, 16 bp, Homo sapiens
gaaagagaaaatgctt

SEQ ID NO: 6214946 - DNA, 18 bp, Homo sapiens
gaaagagaaacagttggt

SEQ ID NO: 6214947 - DNA, 16 bp, Homo sapiens
gaaagagaatgaactg

SEQ ID NO: 6214948 - DNA, 21 bp, Homo sapiens
gaaagagaatgaactgtggaa

SEQ ID NO: 6214949 - DNA, 10 bp, Homo sapiens
gaaagagacc

SEQ ID NO: 6214950 - DNA, 18 bp, Homo sapiens
gaaagagagaaaataaaa

SEQ ID NO: 6214951 - DNA, 23 bp, Homo sapiens
gaaagagagaaaataaaaagtta

SEQ ID NO: 6214952 - DNA, 18 bp, Homo sapiens
gaaagagagaagccagcc

SEQ ID NO: 6214953 - DNA, 20 bp, Homo sapiens
gaaagagagaagccagccac

SEQ ID NO: 6214954 - DNA, 13 bp, Homo sapiens
gaaagagagagag

SEQ ID NO: 6214955 - DNA, 15 bp, Homo sapiens
gaaagagaggaacca

SEQ ID NO: 6214956 - DNA, 13 bp, Homo sapiens
gaaagagaggact

SEQ ID NO: 6214957 - DNA, 16 bp, Homo sapiens
gaaagagatacagagg

SEQ ID NO: 6214958 - DNA, 23 bp, Homo sapiens
gaaagagataccaagatgccatc

SEQ ID NO: 6214959 - DNA, 13 bp, Homo sapiens
gaaagagatgtta

SEQ ID NO: 6214960 - DNA, 18 bp, Homo sapiens
gaaagagcacttaagaga

SEQ ID NO: 6214961 - DNA, 22 bp, Homo sapiens
gaaagagcacttaagagaatat

SEQ ID NO: 6214962 - DNA, 18 bp, Homo sapiens
gaaagagcattattcctg

SEQ ID NO: 6214963 - DNA, 21 bp, Homo sapiens
gaaagagcctaacatctccat

SEQ ID NO: 6214964 - DNA, 18 bp, Homo sapiens
gaaagagccttctgggag

SEQ ID NO: 6214965 - DNA, 16 bp, Homo sapiens
gaaagagctgcctgga

SEQ ID NO: 6214966 - DNA, 17 bp, Homo sapiens
gaaagagctgcctggat

SEQ ID NO: 6214967 - DNA, 17 bp, Homo sapiens
gaaagagctgttttgga

SEQ ID NO: 6214968 - DNA, 20 bp, Homo sapiens
gaaagagctgttttggatga

SEQ ID NO: 6214969 - DNA, 21 bp, Homo sapiens
gaaagaggagaaggagaggga

SEQ ID NO: 6214970 - DNA, 21 bp, Homo sapiens
gaaagaggaggacccctgcct

SEQ ID NO: 6214971 - DNA, 24 bp, Homo sapiens
gaaagaggaggacccctgccttcc

SEQ ID NO: 6214972 - DNA, 22 bp, Homo sapiens
gaaagaggcagggacctaaagg

SEQ ID NO: 6214973 - DNA, 15 bp, Homo sapiens
gaaagaggggcctga

SEQ ID NO: 6214974 - DNA, 22 bp, Homo sapiens
gaaagaggtctccccatcccca

SEQ ID NO: 6214975 - DNA, 18 bp, Homo sapiens
gaaagaggtgaaaatgaa

SEQ ID NO: 6214976 - DNA, 21 bp, Homo sapiens
gaaagaggtgaccccagggca

SEQ ID NO: 6214977 - DNA, 23 bp, Homo sapiens
gaaagaggtgaccccagggcaca

SEQ ID NO: 6214978 - DNA, 19 bp, Homo sapiens
gaaagaggttttcacaaat

SEQ ID NO: 6214979 - DNA, 15 bp, Homo sapiens
gaaagagtaggaaga

SEQ ID NO: 6214980 - DNA, 16 bp, Homo sapiens
gaaagagtaggaagac

SEQ ID NO: 6214981 - DNA, 17 bp, Homo sapiens
gaaagagttgagcacag

SEQ ID NO: 6214982 - DNA, 17 bp, Homo sapiens
gaaagataattcactgt

SEQ ID NO: 6214983 - DNA, 15 bp, Homo sapiens
gaaagatacagggga

SEQ ID NO: 6214984 - DNA, 15 bp, Homo sapiens
gaaagatgaaactga

SEQ ID NO: 6214985 - DNA, 13 bp, Homo sapiens
gaaagatgacaaa

SEQ ID NO: 6214986 - DNA, 17 bp, Homo sapiens
gaaagatgatttgcaat

SEQ ID NO: 6214987 - DNA, 20 bp, Homo sapiens
gaaagatgcagtcctcagga

SEQ ID NO: 6214988 - DNA, 14 bp, Homo sapiens
gaaagatgcagtgg

SEQ ID NO: 6214989 - DNA, 22 bp, Homo sapiens
gaaagatgcatcatctcttcct

SEQ ID NO: 6214990 - DNA, 23 bp, Homo sapiens
gaaagatgctcaggtacagagaa

SEQ ID NO: 6214991 - DNA, 14 bp, Homo sapiens
gaaagatggagagg

SEQ ID NO: 6214992 - DNA, 13 bp, Homo sapiens
gaaagatggtaat

SEQ ID NO: 6214993 - DNA, 16 bp, Homo sapiens
gaaagatgtcccacag

SEQ ID NO: 6214994 - DNA, 22 bp, Homo sapiens
gaaagatgtcccacagggacca

SEQ ID NO: 6214995 - DNA, 22 bp, Homo sapiens
gaaagatgtgtttttgggaaga

SEQ ID NO: 6214996 - DNA, 18 bp, Homo sapiens
gaaagatgttccagtgag

SEQ ID NO: 6214997 - DNA, 23 bp, Homo sapiens
gaaagatttaatgttacagcatc

SEQ ID NO: 6214998 - DNA, 12 bp, Homo sapiens
gaaagatttgta

SEQ ID NO: 6214999 - DNA, 23 bp, Homo sapiens
gaaagatttgtgaactggaagaa

SEQ ID NO: 6215000 - DNA, 19 bp, Homo sapiens
gaaagatttgttactgtat

SEQ ID NO: 6215001 - DNA, 23 bp, Homo sapiens
gaaagatttgttactgtattttt

SEQ ID NO: 6215002 - DNA, 12 bp, Homo sapiens
gaaagattttat

SEQ ID NO: 6215003 - DNA, 13 bp, Homo sapiens
gaaagattttata

SEQ ID NO: 6215004 - DNA, 20 bp, Homo sapiens
gaaagattttatgtgcttga

SEQ ID NO: 6215005 - DNA, 15 bp, Homo sapiens
gaaagatttttacta

SEQ ID NO: 6215006 - DNA, 13 bp, Homo sapiens
gaaagcaaaatac

SEQ ID NO: 6215007 - DNA, 19 bp, Homo sapiens
gaaagcaaacaaaattgtt

SEQ ID NO: 6215008 - DNA, 12 bp, Homo sapiens
gaaagcaaagca

SEQ ID NO: 6215009 - DNA, 16 bp, Homo sapiens
gaaagcaaagcacaga

SEQ ID NO: 6215010 - DNA, 18 bp, Homo sapiens
gaaagcaaatcagacaca

SEQ ID NO: 6215011 - DNA, 21 bp, Homo sapiens
gaaagcaacttcatcccagct

SEQ ID NO: 6215012 - DNA, 22 bp, Homo sapiens
gaaagcaacttcatcccagctg

SEQ ID NO: 6215013 - DNA, 20 bp, Homo sapiens
gaaagcaagaatcagagaag

SEQ ID NO: 6215014 - DNA, 14 bp, Homo sapiens
gaaagcaataaatg

SEQ ID NO: 6215015 - DNA, 22 bp, Homo sapiens
gaaagcaatacgtttgtgcaga

SEQ ID NO: 6215016 - DNA, 11 bp, Homo sapiens
gaaagcacaca

SEQ ID NO: 6215017 - DNA, 19 bp, Homo sapiens
gaaagcaccgcagcatgtg

SEQ ID NO: 6215018 - DNA, 15 bp, Homo sapiens
gaaagcactttttgg

SEQ ID NO: 6215019 - DNA, 18 bp, Homo sapiens
gaaagcagagcctcctgg

SEQ ID NO: 6215020 - DNA, 20 bp, Homo sapiens
gaaagcagatacctcaccct

SEQ ID NO: 6215021 - DNA, 12 bp, Homo sapiens
gaaagcagcagc

SEQ ID NO: 6215022 - DNA, 19 bp, Homo sapiens
gaaagcagctcaaaggcac

SEQ ID NO: 6215023 - DNA, 20 bp, Homo sapiens
gaaagcagctcaaaggcaca

SEQ ID NO: 6215024 - DNA, 16 bp, Homo sapiens
gaaagcaggagcagct

SEQ ID NO: 6215025 - DNA, 18 bp, Homo sapiens
gaaagcaggagcagctgt

SEQ ID NO: 6215026 - DNA, 12 bp, Homo sapiens
gaaagcaggggc

SEQ ID NO: 6215027 - DNA, 23 bp, Homo sapiens
gaaagcaggggctacaagaggga

SEQ ID NO: 6215028 - DNA, 15 bp, Homo sapiens
gaaagcagttgaaat

SEQ ID NO: 6215029 - DNA, 17 bp, Homo sapiens
gaaagcatccatgtgtg

SEQ ID NO: 6215030 - DNA, 18 bp, Homo sapiens
gaaagcatgtctctgctt

SEQ ID NO: 6215031 - DNA, 19 bp, Homo sapiens
gaaagcatgtctctgcttc

SEQ ID NO: 6215032 - DNA, 21 bp, Homo sapiens
gaaagcatgtggcatgttcat

SEQ ID NO: 6215033 - DNA, 17 bp, Homo sapiens
gaaagccaaattttatt

SEQ ID NO: 6215034 - DNA, 19 bp, Homo sapiens
gaaagccacacggagaggc

SEQ ID NO: 6215035 - DNA, 13 bp, Homo sapiens
gaaagccacatct

SEQ ID NO: 6215036 - DNA, 15 bp, Homo sapiens
gaaagccacctctcc

SEQ ID NO: 6215037 - DNA, 20 bp, Homo sapiens
gaaagccacctctccctcaa

SEQ ID NO: 6215038 - DNA, 18 bp, Homo sapiens
gaaagccacgccctccct

SEQ ID NO: 6215039 - DNA, 21 bp, Homo sapiens
gaaagccacgccctccctgct

SEQ ID NO: 6215040 - DNA, 22 bp, Homo sapiens
gaaagccacgccctccctgcta

SEQ ID NO: 6215041 - DNA, 13 bp, Homo sapiens
gaaagccagcctg

SEQ ID NO: 6215042 - DNA, 23 bp, Homo sapiens
gaaagccagcctgggggctggga

SEQ ID NO: 6215043 - DNA, 14 bp, Homo sapiens
gaaagccaggcagg

SEQ ID NO: 6215044 - DNA, 23 bp, Homo sapiens
gaaagccaggcaggtagccaggg

SEQ ID NO: 6215045 - DNA, 16 bp, Homo sapiens
gaaagccagtgactcc

SEQ ID NO: 6215046 - DNA, 19 bp, Homo sapiens
gaaagccattgaccaccca

SEQ ID NO: 6215047 - DNA, 13 bp, Homo sapiens
gaaagcccaaggt

SEQ ID NO: 6215048 - DNA, 15 bp, Homo sapiens
gaaagcccacctggg

SEQ ID NO: 6215049 - DNA, 11 bp, Homo sapiens
gaaagcccaga

SEQ ID NO: 6215050 - DNA, 21 bp, Homo sapiens
gaaagcccagaaaaggacaga

SEQ ID NO: 6215051 - DNA, 16 bp, Homo sapiens
gaaagccccacccagg

SEQ ID NO: 6215052 - DNA, 14 bp, Homo sapiens
gaaagccccagcac

SEQ ID NO: 6215053 - DNA, 17 bp, Homo sapiens
gaaagccctaaaatact

SEQ ID NO: 6215054 - DNA, 18 bp, Homo sapiens
gaaagccctcccccttcc

SEQ ID NO: 6215055 - DNA, 17 bp, Homo sapiens
gaaagccctgagctttc

SEQ ID NO: 6215056 - DNA, 22 bp, Homo sapiens
gaaagccctgagctttctgcta

SEQ ID NO: 6215057 - DNA, 17 bp, Homo sapiens
gaaagccctgtgctcca

SEQ ID NO: 6215058 - DNA, 18 bp, Homo sapiens
gaaagccctgtgctttgg

SEQ ID NO: 6215059 - DNA, 16 bp, Homo sapiens
gaaagccgggggaggg

SEQ ID NO: 6215060 - DNA, 17 bp, Homo sapiens
gaaagccgtactgtcta

SEQ ID NO: 6215061 - DNA, 15 bp, Homo sapiens
gaaagcctaaaattg

SEQ ID NO: 6215062 - DNA, 16 bp, Homo sapiens
gaaagcctatcaaaga

SEQ ID NO: 6215063 - DNA, 23 bp, Homo sapiens
gaaagcctcctgccccctgccag

SEQ ID NO: 6215064 - DNA, 15 bp, Homo sapiens
gaaagcctctgctgc

SEQ ID NO: 6215065 - DNA, 14 bp, Homo sapiens
gaaagcctctggaa

SEQ ID NO: 6215066 - DNA, 15 bp, Homo sapiens
gaaagcctctggaaa

SEQ ID NO: 6215067 - DNA, 10 bp, Homo sapiens
gaaagcctga

SEQ ID NO: 6215068 - DNA, 19 bp, Homo sapiens
gaaagcctgtctctttcca

SEQ ID NO: 6215069 - DNA, 15 bp, Homo sapiens
gaaagccttaaaaat

SEQ ID NO: 6215070 - DNA, 14 bp, Homo sapiens
gaaagccttctttt

SEQ ID NO: 6215071 - DNA, 22 bp, Homo sapiens
gaaagcctttcattttgcttta

SEQ ID NO: 6215072 - DNA, 15 bp, Homo sapiens
gaaagcgaaatactt

SEQ ID NO: 6215073 - DNA, 16 bp, Homo sapiens
gaaagcggcgccacag

SEQ ID NO: 6215074 - DNA, 16 bp, Homo sapiens
gaaagcggctgcctcc

SEQ ID NO: 6215075 - DNA, 15 bp, Homo sapiens
gaaagcgggcagccc

SEQ ID NO: 6215076 - DNA, 18 bp, Homo sapiens
gaaagcgtttctgtgtag

SEQ ID NO: 6215077 - DNA, 16 bp, Homo sapiens
gaaagctaatacaaaa

SEQ ID NO: 6215078 - DNA, 17 bp, Homo sapiens
gaaagctaatactaata

SEQ ID NO: 6215079 - DNA, 19 bp, Homo sapiens
gaaagctatataagacaag

SEQ ID NO: 6215080 - DNA, 15 bp, Homo sapiens
gaaagctatatatga

SEQ ID NO: 6215081 - DNA, 16 bp, Homo sapiens
gaaagctatatatgaa

SEQ ID NO: 6215082 - DNA, 14 bp, Homo sapiens
gaaagctatatcta

SEQ ID NO: 6215083 - DNA, 22 bp, Homo sapiens
gaaagctccacggtgcgtggct

SEQ ID NO: 6215084 - DNA, 18 bp, Homo sapiens
gaaagctctgttgcaatt

SEQ ID NO: 6215085 - DNA, 20 bp, Homo sapiens
gaaagctgacttggctggtg

SEQ ID NO: 6215086 - DNA, 21 bp, Homo sapiens
gaaagctgagaactcctgact

SEQ ID NO: 6215087 - DNA, 20 bp, Homo sapiens
gaaagctgcttctgggggat

SEQ ID NO: 6215088 - DNA, 21 bp, Homo sapiens
gaaagctgctttcgaataaag

SEQ ID NO: 6215089 - DNA, 14 bp, Homo sapiens
gaaagctggactga

SEQ ID NO: 6215090 - DNA, 16 bp, Homo sapiens
gaaagctgtgaaattg

SEQ ID NO: 6215091 - DNA, 21 bp, Homo sapiens
gaaagctgtgaaattgaagtc

SEQ ID NO: 6215092 - DNA, 24 bp, Homo sapiens
gaaagctgtgaacaggctgggctg

SEQ ID NO: 6215093 - DNA, 15 bp, Homo sapiens
gaaagctgtttattt

SEQ ID NO: 6215094 - DNA, 21 bp, Homo sapiens
gaaagctgtttatttattcac

SEQ ID NO: 6215095 - DNA, 20 bp, Homo sapiens
gaaagctgtttcatttgtgt

SEQ ID NO: 6215096 - DNA, 17 bp, Homo sapiens
gaaagcttcaaactgca

SEQ ID NO: 6215097 - DNA, 16 bp, Homo sapiens
gaaagcttcttgtgat

SEQ ID NO: 6215098 - DNA, 22 bp, Homo sapiens
gaaagctttattttgagatgta

SEQ ID NO: 6215099 - DNA, 20 bp, Homo sapiens
gaaagctttggaaaaatctt

SEQ ID NO: 6215100 - DNA, 20 bp, Homo sapiens
gaaagctttgttgaaagaaa

SEQ ID NO: 6215101 - DNA, 21 bp, Homo sapiens
gaaagctttgttgaaagaaag

SEQ ID NO: 6215102 - DNA, 15 bp, Homo sapiens
gaaagcttttattcc

SEQ ID NO: 6215103 - DNA, 17 bp, Homo sapiens
gaaaggaaaaccaggga

SEQ ID NO: 6215104 - DNA, 18 bp, Homo sapiens
gaaaggaaaacctgaaga

SEQ ID NO: 6215105 - DNA, 20 bp, Homo sapiens
gaaaggaaaacctgaagact

SEQ ID NO: 6215106 - DNA, 12 bp, Homo sapiens
gaaaggaaaaga

SEQ ID NO: 6215107 - DNA, 13 bp, Homo sapiens
gaaaggaaaagaa

SEQ ID NO: 6215108 - DNA, 14 bp, Homo sapiens
gaaaggaaaagaaa

SEQ ID NO: 6215109 - DNA, 17 bp, Homo sapiens
gaaaggaaaagaggccc

SEQ ID NO: 6215110 - DNA, 14 bp, Homo sapiens
gaaaggaaaccttt

SEQ ID NO: 6215111 - DNA, 16 bp, Homo sapiens
gaaaggaaagaggctc

SEQ ID NO: 6215112 - DNA, 17 bp, Homo sapiens
gaggaaagcaaaggaga

SEQ ID NO: 6215113 - DNA, 15 bp, Homo sapiens
gaggaaagcaagtgt

SEQ ID NO: 6215114 - DNA, 20 bp, Homo sapiens
gaggaaagcacagaggcctc

SEQ ID NO: 6215115 - DNA, 22 bp, Homo sapiens
gaggaaagcacagaggcctcct

SEQ ID NO: 6215116 - DNA, 13 bp, Homo sapiens
gaggaaaggattt

SEQ ID NO: 6215117 - DNA, 14 bp, Homo sapiens
gaggaaaggatttt

SEQ ID NO: 6215118 - DNA, 14 bp, Homo sapiens
gaggaaaggccagc

SEQ ID NO: 6215119 - DNA, 19 bp, Homo sapiens
gaggaaaggccagctggca

SEQ ID NO: 6215120 - DNA, 18 bp, Homo sapiens
gaggaaaggcgcccccgc

SEQ ID NO: 6215121 - DNA, 20 bp, Homo sapiens
gaggaaaggcgcccccgccc

SEQ ID NO: 6215122 - DNA, 16 bp, Homo sapiens
gaggaaagggcctggc

SEQ ID NO: 6215123 - DNA, 18 bp, Homo sapiens
gaggaaagggcctggcca

SEQ ID NO: 6215124 - DNA, 23 bp, Homo sapiens
gaggaaaggtttggaaaactaac

SEQ ID NO: 6215125 - DNA, 21 bp, Homo sapiens
gaggaaagtgcgttctcccag

SEQ ID NO: 6215126 - DNA, 18 bp, Homo sapiens
gaggaaataatgggaaag

SEQ ID NO: 6215127 - DNA, 13 bp, Homo sapiens
gaggaaatccctt

SEQ ID NO: 6215128 - DNA, 15 bp, Homo sapiens
gaggaaatcccttca

SEQ ID NO: 6215129 - DNA, 16 bp, Homo sapiens
gaggaaatcctacctt

SEQ ID NO: 6215130 - DNA, 15 bp, Homo sapiens
gaggaaatgtggaaa

SEQ ID NO: 6215131 - DNA, 17 bp, Homo sapiens
gaggaaattctccactg

SEQ ID NO: 6215132 - DNA, 16 bp, Homo sapiens
gaggaacaaggcaagg

SEQ ID NO: 6215133 - DNA, 12 bp, Homo sapiens
gaggaacacctg

SEQ ID NO: 6215134 - DNA, 13 bp, Homo sapiens
gaggaacacctga

SEQ ID NO: 6215135 - DNA, 11 bp, Homo sapiens
gaggaacagct

SEQ ID NO: 6215136 - DNA, 23 bp, Homo sapiens
gaggaacagtgtggtttgggaaa

SEQ ID NO: 6215137 - DNA, 23 bp, Homo sapiens
gaggaacatgcataagaaatgta

SEQ ID NO: 6215138 - DNA, 17 bp, Homo sapiens
gaggaaccacatataac

SEQ ID NO: 6215139 - DNA, 20 bp, Homo sapiens
gaggaaccacatataacact

SEQ ID NO: 6215140 - DNA, 22 bp, Homo sapiens
gaggaaccgaggtgttgccagt

SEQ ID NO: 6215141 - DNA, 17 bp, Homo sapiens
gaggaacgggcagccac

SEQ ID NO: 6215142 - DNA, 20 bp, Homo sapiens
gaggaacgggcagccacagg

SEQ ID NO: 6215143 - DNA, 19 bp, Homo sapiens
gaggaacgtggttcagaga

SEQ ID NO: 6215144 - DNA, 14 bp, Homo sapiens
gaggaactccagag

SEQ ID NO: 6215145 - DNA, 15 bp, Homo sapiens
gaggaactccaggac

SEQ ID NO: 6215146 - DNA, 16 bp, Homo sapiens
gaggaactcgcctcag

SEQ ID NO: 6215147 - DNA, 17 bp, Homo sapiens
gaggaactcgcctcagc

SEQ ID NO: 6215148 - DNA, 21 bp, Homo sapiens
gaggaactgggtgactggagg

SEQ ID NO: 6215149 - DNA, 15 bp, Homo sapiens
gaggaactggtccag

SEQ ID NO: 6215150 - DNA, 17 bp, Homo sapiens
gaggaactggtccaggc

SEQ ID NO: 6215151 - DNA, 23 bp, Homo sapiens
gaggaactggtccaggccaggcc

SEQ ID NO: 6215152 - DNA, 16 bp, Homo sapiens
gaggaactgtacagaa

SEQ ID NO: 6215153 - DNA, 16 bp, Homo sapiens
gaggaactgtccagag

SEQ ID NO: 6215154 - DNA, 22 bp, Homo sapiens
gaggaacttgctgctgtgcctg

SEQ ID NO: 6215155 - DNA, 18 bp, Homo sapiens
gaggaactttcaaaagtc

SEQ ID NO: 6215156 - DNA, 19 bp, Homo sapiens
gaggaagaacggggctctt

SEQ ID NO: 6215157 - DNA, 17 bp, Homo sapiens
gaggaagaagcttaggc

SEQ ID NO: 6215158 - DNA, 12 bp, Homo sapiens
gaggaagagaga

SEQ ID NO: 6215159 - DNA, 13 bp, Homo sapiens
gaggaagagcagg

SEQ ID NO: 6215160 - DNA, 19 bp, Homo sapiens
gaggaagagcaggcacatg

SEQ ID NO: 6215161 - DNA, 21 bp, Homo sapiens
gaggaagagccacctgcaaga

SEQ ID NO: 6215162 - DNA, 14 bp, Homo sapiens
gaggaagaggctgc

SEQ ID NO: 6215163 - DNA, 13 bp, Homo sapiens
gaggaagagtctt

SEQ ID NO: 6215164 - DNA, 19 bp, Homo sapiens
gaggaagagtgcaaaacat

SEQ ID NO: 6215165 - DNA, 23 bp, Homo sapiens
gaggaagatgctcatctgagcca

SEQ ID NO: 6215166 - DNA, 12 bp, Homo sapiens
gaggaagcaaga

SEQ ID NO: 6215167 - DNA, 15 bp, Homo sapiens
gaggaagcaagacgt

SEQ ID NO: 6215168 - DNA, 21 bp, Homo sapiens
gaggaagcacaagaagtggga

SEQ ID NO: 6215169 - DNA, 12 bp, Homo sapiens
gaggaagcagaa

SEQ ID NO: 6215170 - DNA, 15 bp, Homo sapiens
gaggaagcagttggg

SEQ ID NO: 6215171 - DNA, 18 bp, Homo sapiens
gaggaagcagttggggcc

SEQ ID NO: 6215172 - DNA, 16 bp, Homo sapiens
gaggaagccacgtgct

SEQ ID NO: 6215173 - DNA, 23 bp, Homo sapiens
gaggaagccacgtgctggagagt

SEQ ID NO: 6215174 - DNA, 13 bp, Homo sapiens
gaggaagcccaca

SEQ ID NO: 6215175 - DNA, 15 bp, Homo sapiens
gaggaagcccaggct

SEQ ID NO: 6215176 - DNA, 22 bp, Homo sapiens
gaggaagcccagtagccatttt

SEQ ID NO: 6215177 - DNA, 10 bp, Homo sapiens
gaggaagccg

SEQ ID NO: 6215178 - DNA, 14 bp, Homo sapiens
gaggaagccgctgg

SEQ ID NO: 6215179 - DNA, 22 bp, Homo sapiens
gaggaagccgttgaatctggga

SEQ ID NO: 6215180 - DNA, 19 bp, Homo sapiens
gaggaagctccagtcctgc

SEQ ID NO: 6215181 - DNA, 22 bp, Homo sapiens
gaggaagctggacagcggcagt

SEQ ID NO: 6215182 - DNA, 12 bp, Homo sapiens
gaggaaggaaac

SEQ ID NO: 6215183 - DNA, 20 bp, Homo sapiens
gaggaaggaaacccagctct

SEQ ID NO: 6215184 - DNA, 22 bp, Homo sapiens
gaggaaggaaacccagctctgg

SEQ ID NO: 6215185 - DNA, 19 bp, Homo sapiens
gaggaaggaacagcaatgg

SEQ ID NO: 6215186 - DNA, 16 bp, Homo sapiens
gaggaaggagagaagg

SEQ ID NO: 6215187 - DNA, 21 bp, Homo sapiens
gaggaaggaggacccaggaca

SEQ ID NO: 6215188 - DNA, 14 bp, Homo sapiens
gaggaaggattgta

SEQ ID NO: 6215189 - DNA, 13 bp, Homo sapiens
gaggaagggactg

SEQ ID NO: 6215190 - DNA, 21 bp, Homo sapiens
gaggaagggactggtccaggc

SEQ ID NO: 6215191 - DNA, 14 bp, Homo sapiens
gaggaagggaggcc

SEQ ID NO: 6215192 - DNA, 17 bp, Homo sapiens
gaggaagggaggcctga

SEQ ID NO: 6215193 - DNA, 14 bp, Homo sapiens
gaggaagggccagg

SEQ ID NO: 6215194 - DNA, 15 bp, Homo sapiens
gaggaagggccagga

SEQ ID NO: 6215195 - DNA, 19 bp, Homo sapiens
gaggaagggccaggagaga

SEQ ID NO: 6215196 - DNA, 20 bp, Homo sapiens
gaggaagggccaggagagag

SEQ ID NO: 6215197 - DNA, 16 bp, Homo sapiens
gaggaagggcccccgg

SEQ ID NO: 6215198 - DNA, 13 bp, Homo sapiens
gaggaagggctgg

SEQ ID NO: 6215199 - DNA, 17 bp, Homo sapiens
gaggaagggctgggcca

SEQ ID NO: 6215200 - DNA, 13 bp, Homo sapiens
gaggaaggggggt

SEQ ID NO: 6215201 - DNA, 20 bp, Homo sapiens
gaggaaggggtgctgtgagg

SEQ ID NO: 6215202 - DNA, 13 bp, Homo sapiens
gaggaaggtgctg

SEQ ID NO: 6215203 - DNA, 16 bp, Homo sapiens
gaggaagtagtccagc

SEQ ID NO: 6215204 - DNA, 21 bp, Homo sapiens
gaggaagtggggtctggcctg

SEQ ID NO: 6215205 - DNA, 18 bp, Homo sapiens
gaggaagtggtctgtctg

SEQ ID NO: 6215206 - DNA, 17 bp, Homo sapiens
gaggaagtgtggaaaaa

SEQ ID NO: 6215207 - DNA, 14 bp, Homo sapiens
gaggaagttcagat

SEQ ID NO: 6215208 - DNA, 15 bp, Homo sapiens
gaggaataaagcttc

SEQ ID NO: 6215209 - DNA, 17 bp, Homo sapiens
gaggaataaagcttctc

SEQ ID NO: 6215210 - DNA, 15 bp, Homo sapiens
gaggaatacatttta

SEQ ID NO: 6215211 - DNA, 17 bp, Homo sapiens
gaggaatacattttatt

SEQ ID NO: 6215212 - DNA, 23 bp, Homo sapiens
gaggaatagcaaaattcctgtgt

SEQ ID NO: 6215213 - DNA, 20 bp, Homo sapiens
gaggaatcaacagggcagca

SEQ ID NO: 6215214 - DNA, 13 bp, Homo sapiens
gaggaatcagacc

SEQ ID NO: 6215215 - DNA, 19 bp, Homo sapiens
gaggaatccaaaagacaaa

SEQ ID NO: 6215216 - DNA, 14 bp, Homo sapiens
gaggaatccagacc

SEQ ID NO: 6215217 - DNA, 15 bp, Homo sapiens
gaggaatccagaccc

SEQ ID NO: 6215218 - DNA, 15 bp, Homo sapiens
gaggaatcctggcag

SEQ ID NO: 6215219 - DNA, 19 bp, Homo sapiens
gaggaatcgccccagactc

SEQ ID NO: 6215220 - DNA, 21 bp, Homo sapiens
gaggaatctgtgggtctggga

SEQ ID NO: 6215221 - DNA, 22 bp, Homo sapiens
gaggaatctgtgggtctgggag

SEQ ID NO: 6215222 - DNA, 21 bp, Homo sapiens
gaggaatctgtttctctgctg

SEQ ID NO: 6215223 - DNA, 22 bp, Homo sapiens
gaggaatctgtttctctgctgt

SEQ ID NO: 6215224 - DNA, 13 bp, Homo sapiens
gaggaatgctccc

SEQ ID NO: 6215225 - DNA, 17 bp, Homo sapiens
gaggaatgtagggcctg

SEQ ID NO: 6215226 - DNA, 21 bp, Homo sapiens
gaggaatgtagggcctgcatg

SEQ ID NO: 6215227 - DNA, 17 bp, Homo sapiens
gaggaatgtgggctatg

SEQ ID NO: 6215228 - DNA, 16 bp, Homo sapiens
gaggaattctgtatag

SEQ ID NO: 6215229 - DNA, 17 bp, Homo sapiens
gaggaattctgtataga

SEQ ID NO: 6215230 - DNA, 14 bp, Homo sapiens
gaggaattgggacc

SEQ ID NO: 6215231 - DNA, 22 bp, Homo sapiens
gaggaatttatacctcaaacta

SEQ ID NO: 6215232 - DNA, 14 bp, Homo sapiens
gaggacaaggtaca

SEQ ID NO: 6215233 - DNA, 12 bp, Homo sapiens
gaggacaagtga

SEQ ID NO: 6215234 - DNA, 21 bp, Homo sapiens
gaggacaagtgtaataaatca

SEQ ID NO: 6215235 - DNA, 17 bp, Homo sapiens
gaggacaatctagctct

SEQ ID NO: 6215236 - DNA, 12 bp, Homo sapiens
gaggacaattca

SEQ ID NO: 6215237 - DNA, 21 bp, Homo sapiens
gaggacaattcatgaacttcg

SEQ ID NO: 6215238 - DNA, 13 bp, Homo sapiens
gaggacacagaga

SEQ ID NO: 6215239 - DNA, 14 bp, Homo sapiens
gaggacacatgtcc

SEQ ID NO: 6215240 - DNA, 19 bp, Homo sapiens
gaggacaccagtgaaagaa

SEQ ID NO: 6215241 - DNA, 20 bp, Homo sapiens
gaggacaccagtgaaagaag

SEQ ID NO: 6215242 - DNA, 18 bp, Homo sapiens
gaggacacggaccctgtg

SEQ ID NO: 6215243 - DNA, 19 bp, Homo sapiens
gaggacacggaccctgtgt

SEQ ID NO: 6215244 - DNA, 20 bp, Homo sapiens
gaggacacggaccctgtgtg

SEQ ID NO: 6215245 - DNA, 17 bp, Homo sapiens
gaggacactaggagact

SEQ ID NO: 6215246 - DNA, 18 bp, Homo sapiens
gaggacactaggagactg

SEQ ID NO: 6215247 - DNA, 19 bp, Homo sapiens
gaggacactaggagactgg

SEQ ID NO: 6215248 - DNA, 18 bp, Homo sapiens
gaggacagaaagaccctg

SEQ ID NO: 6215249 - DNA, 12 bp, Homo sapiens
gaggacagaagg

SEQ ID NO: 6215250 - DNA, 13 bp, Homo sapiens
gaggacagaagga

SEQ ID NO: 6215251 - DNA, 20 bp, Homo sapiens
gaggacagaaggactggtgc

SEQ ID NO: 6215252 - DNA, 13 bp, Homo sapiens
gaggacagagccg

SEQ ID NO: 6215253 - DNA, 21 bp, Homo sapiens
gaggacagagtgccctggggc

SEQ ID NO: 6215254 - DNA, 16 bp, Homo sapiens
gaggacagatgcctcc

SEQ ID NO: 6215255 - DNA, 20 bp, Homo sapiens
gaggacagatgcctccttcc

SEQ ID NO: 6215256 - DNA, 21 bp, Homo sapiens
gaggacagatgcctccttcct

SEQ ID NO: 6215257 - DNA, 22 bp, Homo sapiens
gaggacagatgcctccttcctc

SEQ ID NO: 6215258 - DNA, 13 bp, Homo sapiens
gaggacagcaatg

SEQ ID NO: 6215259 - DNA, 19 bp, Homo sapiens
gaggacagcctgcctctgc

SEQ ID NO: 6215260 - DNA, 14 bp, Homo sapiens
gaggacagcttccc

SEQ ID NO: 6215261 - DNA, 15 bp, Homo sapiens
gaggacaggagaggg

SEQ ID NO: 6215262 - DNA, 21 bp, Homo sapiens
gaggacaggccagtaggggga

SEQ ID NO: 6215263 - DNA, 13 bp, Homo sapiens
gaggacagggagg

SEQ ID NO: 6215264 - DNA, 19 bp, Homo sapiens
gaggacaggtggaggcgag

SEQ ID NO: 6215265 - DNA, 15 bp, Homo sapiens
gaggacagtctggag

SEQ ID NO: 6215266 - DNA, 20 bp, Homo sapiens
gaggacagtctggagaaggt

SEQ ID NO: 6215267 - DNA, 12 bp, Homo sapiens
gaggacagtgct

SEQ ID NO: 6215268 - DNA, 18 bp, Homo sapiens
gaggacatgatggagcgc

SEQ ID NO: 6215269 - DNA, 18 bp, Homo sapiens
gaggacatgcgtgtgtca

SEQ ID NO: 6215270 - DNA, 22 bp, Homo sapiens
gaggacatgcgtgtgtcaggga

SEQ ID NO: 6215271 - DNA, 14 bp, Homo sapiens
gaggacatggggag

SEQ ID NO: 6215272 - DNA, 17 bp, Homo sapiens
gaggacatttgtgggca

SEQ ID NO: 6215273 - DNA, 19 bp, Homo sapiens
gaggaccaacatccagtcc

SEQ ID NO: 6215274 - DNA, 13 bp, Homo sapiens
gaggaccaatgct

SEQ ID NO: 6215275 - DNA, 20 bp, Homo sapiens
gaggaccaatgcttgcatgg

SEQ ID NO: 6215276 - DNA, 23 bp, Homo sapiens
gaggaccacactttgagaacctg

SEQ ID NO: 6215277 - DNA, 21 bp, Homo sapiens
gaggaccacaggtgtgagcca

SEQ ID NO: 6215278 - DNA, 23 bp, Homo sapiens
gaggaccacagtgggtggcacct

SEQ ID NO: 6215279 - DNA, 19 bp, Homo sapiens
gaggaccaccagcaggcag

SEQ ID NO: 6215280 - DNA, 22 bp, Homo sapiens
gaggaccactcctgtacactga

SEQ ID NO: 6215281 - DNA, 17 bp, Homo sapiens
gaggaccagaggagcag

SEQ ID NO: 6215282 - DNA, 22 bp, Homo sapiens
gaggaccagaggagcagaccag

SEQ ID NO: 6215283 - DNA, 19 bp, Homo sapiens
gaggaccagggcagggcca

SEQ ID NO: 6215284 - DNA, 14 bp, Homo sapiens
gaggaccagggcct

SEQ ID NO: 6215285 - DNA, 16 bp, Homo sapiens
gaggaccagggtggag

SEQ ID NO: 6215286 - DNA, 13 bp, Homo sapiens
gaggacccacctg

SEQ ID NO: 6215287 - DNA, 14 bp, Homo sapiens
gaggacccacctgg

SEQ ID NO: 6215288 - DNA, 13 bp, Homo sapiens
gaggacccagacc

SEQ ID NO: 6215289 - DNA, 14 bp, Homo sapiens
gaggacccagaccc

SEQ ID NO: 6215290 - DNA, 16 bp, Homo sapiens
gaggacccagacccag

SEQ ID NO: 6215291 - DNA, 12 bp, Homo sapiens
gaggacccagga

SEQ ID NO: 6215292 - DNA, 14 bp, Homo sapiens
gaggacccagggct

SEQ ID NO: 6215293 - DNA, 21 bp, Homo sapiens
gaggacccatgaaacagcagc

SEQ ID NO: 6215294 - DNA, 23 bp, Homo sapiens
gaggaccccagcttttcttgcca

SEQ ID NO: 6215295 - DNA, 13 bp, Homo sapiens
gaggaccccaggg

SEQ ID NO: 6215296 - DNA, 14 bp, Homo sapiens
gaggaccccagggt

SEQ ID NO: 6215297 - DNA, 15 bp, Homo sapiens
gaggaccccgagggc

SEQ ID NO: 6215298 - DNA, 13 bp, Homo sapiens
gaggacccctgcc

SEQ ID NO: 6215299 - DNA, 15 bp, Homo sapiens
gaggacccctgccct

SEQ ID NO: 6215300 - DNA, 17 bp, Homo sapiens
gaggacccctgccttcc

SEQ ID NO: 6215301 - DNA, 21 bp, Homo sapiens
gaggacccctgccttcctctg

SEQ ID NO: 6215302 - DNA, 19 bp, Homo sapiens
gaggacccggcgctgagtg

SEQ ID NO: 6215303 - DNA, 21 bp, Homo sapiens
gaggaccctcagccccaggag

SEQ ID NO: 6215304 - DNA, 13 bp, Homo sapiens
gaggaccctccca

SEQ ID NO: 6215305 - DNA, 17 bp, Homo sapiens
gaggaccctggttactc

SEQ ID NO: 6215306 - DNA, 21 bp, Homo sapiens
gaggacccttacgtgagaaat

SEQ ID NO: 6215307 - DNA, 18 bp, Homo sapiens
gaggaccgggcactcccg

SEQ ID NO: 6215308 - DNA, 23 bp, Homo sapiens
gaggaccgggcactcccgggatg

SEQ ID NO: 6215309 - DNA, 16 bp, Homo sapiens
gaggaccgttctctgt

SEQ ID NO: 6215310 - DNA, 20 bp, Homo sapiens
gaggacctatcccaaatgtg

SEQ ID NO: 6215311 - DNA, 17 bp, Homo sapiens
gaggacctccacctggg

SEQ ID NO: 6215312 - DNA, 15 bp, Homo sapiens
gaggacctccatgcc

SEQ ID NO: 6215313 - DNA, 15 bp, Homo sapiens
gaggacctctgggct

SEQ ID NO: 6215314 - DNA, 20 bp, Homo sapiens
gaggacctgaccctactccc

SEQ ID NO: 6215315 - DNA, 13 bp, Homo sapiens
gaggacctgagcc

SEQ ID NO: 6215316 - DNA, 15 bp, Homo sapiens
gaggacctgagcctg

SEQ ID NO: 6215317 - DNA, 22 bp, Homo sapiens
gaggacctgagcctgccgagca

SEQ ID NO: 6215318 - DNA, 20 bp, Homo sapiens
gaggacctgagtttgggaga

SEQ ID NO: 6215319 - DNA, 22 bp, Homo sapiens
gaggacctggcgtgctcagacc

SEQ ID NO: 6215320 - DNA, 16 bp, Homo sapiens
gaggacctggggcaca

SEQ ID NO: 6215321 - DNA, 18 bp, Homo sapiens
gaggacctgtatttaagc

SEQ ID NO: 6215322 - DNA, 20 bp, Homo sapiens
gaggacctgtatttaagcaa

SEQ ID NO: 6215323 - DNA, 19 bp, Homo sapiens
gaggacgcacgctcgctgc

SEQ ID NO: 6215324 - DNA, 22 bp, Homo sapiens
gaggacgcacgctcgctgccat

SEQ ID NO: 6215325 - DNA, 21 bp, Homo sapiens
gaggacgctctctggccttcg

SEQ ID NO: 6215326 - DNA, 17 bp, Homo sapiens
gaggacggagttcagag

SEQ ID NO: 6215327 - DNA, 19 bp, Homo sapiens
gaggacggagttcagaggg

SEQ ID NO: 6215328 - DNA, 15 bp, Homo sapiens
gaggacggccctgcc

SEQ ID NO: 6215329 - DNA, 19 bp, Homo sapiens
gaggacggccctgcctgcc

SEQ ID NO: 6215330 - DNA, 21 bp, Homo sapiens
gaggacggcttccccatcgcc

SEQ ID NO: 6215331 - DNA, 18 bp, Homo sapiens
gaggacggggcagagctg

SEQ ID NO: 6215332 - DNA, 17 bp, Homo sapiens
gaggacggtgcaaccca

SEQ ID NO: 6215333 - DNA, 20 bp, Homo sapiens
gaggacggtgcaacccaagg

SEQ ID NO: 6215334 - DNA, 23 bp, Homo sapiens
gaggacgtcatcggaggctgggc

SEQ ID NO: 6215335 - DNA, 20 bp, Homo sapiens
gaggacgtgggcggcagaga

SEQ ID NO: 6215336 - DNA, 19 bp, Homo sapiens
gaggacgtgttacccactg

SEQ ID NO: 6215337 - DNA, 16 bp, Homo sapiens
gaggactccaggggct

SEQ ID NO: 6215338 - DNA, 21 bp, Homo sapiens
gaggactcccaaccctggctt

SEQ ID NO: 6215339 - DNA, 19 bp, Homo sapiens
gaggactcgcttgtaaata

SEQ ID NO: 6215340 - DNA, 16 bp, Homo sapiens
gaggactcggccactg

SEQ ID NO: 6215341 - DNA, 20 bp, Homo sapiens
gaggactcggccactgtgtc

SEQ ID NO: 6215342 - DNA, 16 bp, Homo sapiens
gaggactctagaagct

SEQ ID NO: 6215343 - DNA, 22 bp, Homo sapiens
gaggactctgcaagtgtctgga

SEQ ID NO: 6215344 - DNA, 12 bp, Homo sapiens
gaggactgaagc

SEQ ID NO: 6215345 - DNA, 16 bp, Homo sapiens
gaggactgaagctggg

SEQ ID NO: 6215346 - DNA, 13 bp, Homo sapiens
gaggactgagccc

SEQ ID NO: 6215347 - DNA, 14 bp, Homo sapiens
gaggactgagcccc

SEQ ID NO: 6215348 - DNA, 23 bp, Homo sapiens
gaggactgatgaatgacaacatt

SEQ ID NO: 6215349 - DNA, 23 bp, Homo sapiens
gaggactgccccgtgcagactgg

SEQ ID NO: 6215350 - DNA, 19 bp, Homo sapiens
gaggactggttctgaggcc

SEQ ID NO: 6215351 - DNA, 20 bp, Homo sapiens
gaggactgtagggagggcgg

SEQ ID NO: 6215352 - DNA, 23 bp, Homo sapiens
gaggactgttggctgattggaaa

SEQ ID NO: 6215353 - DNA, 13 bp, Homo sapiens
gaggacttcaagc

SEQ ID NO: 6215354 - DNA, 20 bp, Homo sapiens
gaggacttcggggtagaggc

SEQ ID NO: 6215355 - DNA, 23 bp, Homo sapiens
gaggacttcggggtagaggctgg

SEQ ID NO: 6215356 - DNA, 18 bp, Homo sapiens
gaggacttggagggtctg

SEQ ID NO: 6215357 - DNA, 14 bp, Homo sapiens
gaggacttgtgtct

SEQ ID NO: 6215358 - DNA, 20 bp, Homo sapiens
gaggacttttctttgtggct

SEQ ID NO: 6215359 - DNA, 16 bp, Homo sapiens
gaggagaaaaaaaaag

SEQ ID NO: 6215360 - DNA, 17 bp, Homo sapiens
gaggagaaaaagaagaa

SEQ ID NO: 6215361 - DNA, 13 bp, Homo sapiens
gaggagaaacaca

SEQ ID NO: 6215362 - DNA, 22 bp, Homo sapiens
gaggagaaactctagactgcaa

SEQ ID NO: 6215363 - DNA, 12 bp, Homo sapiens
gaggagaaactg

SEQ ID NO: 6215364 - DNA, 23 bp, Homo sapiens
gaggagaaaggtgaaacacacac

SEQ ID NO: 6215365 - DNA, 15 bp, Homo sapiens
gaggagaaataaact

SEQ ID NO: 6215366 - DNA, 16 bp, Homo sapiens
gaggagaacttgctgc

SEQ ID NO: 6215367 - DNA, 20 bp, Homo sapiens
gaggagaagaattttcagac

SEQ ID NO: 6215368 - DNA, 14 bp, Homo sapiens
gaggagaaggagga

SEQ ID NO: 6215369 - DNA, 15 bp, Homo sapiens
gaggagaaggaggag

SEQ ID NO: 6215370 - DNA, 22 bp, Homo sapiens
gaggagacagagggaggacctg

SEQ ID NO: 6215371 - DNA, 14 bp, Homo sapiens
gaggagacagtcag

SEQ ID NO: 6215372 - DNA, 15 bp, Homo sapiens
gaggagacattggct

SEQ ID NO: 6215373 - DNA, 22 bp, Homo sapiens
gaggagaccagcggtccatggg

SEQ ID NO: 6215374 - DNA, 14 bp, Homo sapiens
gaggagaccagctc

SEQ ID NO: 6215375 - DNA, 13 bp, Homo sapiens
gaggagaccctcc

SEQ ID NO: 6215376 - DNA, 12 bp, Homo sapiens
gaggagaccctg

SEQ ID NO: 6215377 - DNA, 23 bp, Homo sapiens
gaggagacgaagtgaaaacaaat

SEQ ID NO: 6215378 - DNA, 16 bp, Homo sapiens
gaggagactcaggccc

SEQ ID NO: 6215379 - DNA, 23 bp, Homo sapiens
gaggagactgggcacccctgcct

SEQ ID NO: 6215380 - DNA, 16 bp, Homo sapiens
gaggagagaaaatata

SEQ ID NO: 6215381 - DNA, 12 bp, Homo sapiens
gaggagagaaga

SEQ ID NO: 6215382 - DNA, 13 bp, Homo sapiens
gaggagagaagaa

SEQ ID NO: 6215383 - DNA, 13 bp, Homo sapiens
gaggagagacggt

SEQ ID NO: 6215384 - DNA, 15 bp, Homo sapiens
gaggagagagacaga

SEQ ID NO: 6215385 - DNA, 20 bp, Homo sapiens
gaggagagagcagcttctgc

SEQ ID NO: 6215386 - DNA, 15 bp, Homo sapiens
gaggagagagccttg

SEQ ID NO: 6215387 - DNA, 14 bp, Homo sapiens
gaggagagaggacc

SEQ ID NO: 6215388 - DNA, 15 bp, Homo sapiens
gaggagagaggaccc

SEQ ID NO: 6215389 - DNA, 16 bp, Homo sapiens
gaggagagaggaggaa

SEQ ID NO: 6215390 - DNA, 14 bp, Homo sapiens
gaggagagaggcag

SEQ ID NO: 6215391 - DNA, 15 bp, Homo sapiens
gaggagagaggcaga

SEQ ID NO: 6215392 - DNA, 22 bp, Homo sapiens
gaggagagccagagaagtgaca

SEQ ID NO: 6215393 - DNA, 14 bp, Homo sapiens
gaggagagcctggt

SEQ ID NO: 6215394 - DNA, 14 bp, Homo sapiens
gaggagaggagaga

SEQ ID NO: 6215395 - DNA, 15 bp, Homo sapiens
gaggagaggctgctg

SEQ ID NO: 6215396 - DNA, 20 bp, Homo sapiens
gaggagaggggaagggccag

SEQ ID NO: 6215397 - DNA, 20 bp, Homo sapiens
gaggagagtacccccctgag

SEQ ID NO: 6215398 - DNA, 21 bp, Homo sapiens
gaggagataaggtggcttctc

SEQ ID NO: 6215399 - DNA, 18 bp, Homo sapiens
gaggagatgaccagggat

SEQ ID NO: 6215400 - DNA, 16 bp, Homo sapiens
gaggagattgctctgg

SEQ ID NO: 6215401 - DNA, 17 bp, Homo sapiens
gaggagattgctctggg

SEQ ID NO: 6215402 - DNA, 18 bp, Homo sapiens
gaggagcaacggccccag

SEQ ID NO: 6215403 - DNA, 11 bp, Homo sapiens
gaggagcaccc

SEQ ID NO: 6215404 - DNA, 18 bp, Homo sapiens
gaggagcacccccagcct

SEQ ID NO: 6215405 - DNA, 19 bp, Homo sapiens
gaggagcacccccagcctc

SEQ ID NO: 6215406 - DNA, 16 bp, Homo sapiens
gaggagcagaccagca

SEQ ID NO: 6215407 - DNA, 11 bp, Homo sapiens
gaggagcagca

SEQ ID NO: 6215408 - DNA, 18 bp, Homo sapiens
gaggagcagcagcttggg

SEQ ID NO: 6215409 - DNA, 21 bp, Homo sapiens
gaggagcagcaggagggggga

SEQ ID NO: 6215410 - DNA, 17 bp, Homo sapiens
gaggagcagccaggacc

SEQ ID NO: 6215411 - DNA, 18 bp, Homo sapiens
gaggagcagccaggaccc

SEQ ID NO: 6215412 - DNA, 14 bp, Homo sapiens
gaggagcagctggg

SEQ ID NO: 6215413 - DNA, 14 bp, Homo sapiens
gaggagcagcttcc

SEQ ID NO: 6215414 - DNA, 15 bp, Homo sapiens
gaggagcagcttcct

SEQ ID NO: 6215415 - DNA, 20 bp, Homo sapiens
gaggagcagcttccttctgg

SEQ ID NO: 6215416 - DNA, 23 bp, Homo sapiens
gaggagcagcttccttctgggac

SEQ ID NO: 6215417 - DNA, 22 bp, Homo sapiens
gaggagcaggaagcaaggccag

SEQ ID NO: 6215418 - DNA, 21 bp, Homo sapiens
gaggagcatgttttgtataca

SEQ ID NO: 6215419 - DNA, 16 bp, Homo sapiens
gaggagccaccagttc

SEQ ID NO: 6215420 - DNA, 18 bp, Homo sapiens
gaggagccaccagttctc

SEQ ID NO: 6215421 - DNA, 22 bp, Homo sapiens
gaggagccacctgggctgggag

SEQ ID NO: 6215422 - DNA, 13 bp, Homo sapiens
gaggagccaggca

SEQ ID NO: 6215423 - DNA, 14 bp, Homo sapiens
gaggagccaggccc

SEQ ID NO: 6215424 - DNA, 19 bp, Homo sapiens
gaggagccaggccccaccc

SEQ ID NO: 6215425 - DNA, 23 bp, Homo sapiens
gaggagcccacgacactgcagcc

SEQ ID NO: 6215426 - DNA, 14 bp, Homo sapiens
gaggagcccacggg

SEQ ID NO: 6215427 - DNA, 13 bp, Homo sapiens
gaggagcccagcg

SEQ ID NO: 6215428 - DNA, 18 bp, Homo sapiens
gaggagcccagcggccca

SEQ ID NO: 6215429 - DNA, 18 bp, Homo sapiens
gaggagcccaggccagga

SEQ ID NO: 6215430 - DNA, 20 bp, Homo sapiens
gaggagcccaggccaggact

SEQ ID NO: 6215431 - DNA, 12 bp, Homo sapiens
gaggagccccag

SEQ ID NO: 6215432 - DNA, 18 bp, Homo sapiens
gaggagccccagccccgt

SEQ ID NO: 6215433 - DNA, 20 bp, Homo sapiens
gaggagcccccaccctgttc

SEQ ID NO: 6215434 - DNA, 23 bp, Homo sapiens
gaggagcccccaccctgttcctg

SEQ ID NO: 6215435 - DNA, 12 bp, Homo sapiens
gaggagccctga

SEQ ID NO: 6215436 - DNA, 17 bp, Homo sapiens
gaggagcctcagaagaa

SEQ ID NO: 6215437 - DNA, 22 bp, Homo sapiens
gaggagcctgtcctgcctgtgg

SEQ ID NO: 6215438 - DNA, 21 bp, Homo sapiens
gaggagcctgtgcgtcccagc

SEQ ID NO: 6215439 - DNA, 19 bp, Homo sapiens
gaggagccttgctgggcca

SEQ ID NO: 6215440 - DNA, 20 bp, Homo sapiens
gaggagccttgctgggccag

SEQ ID NO: 6215441 - DNA, 21 bp, Homo sapiens
gaggagccttgctgggccagg

SEQ ID NO: 6215442 - DNA, 13 bp, Homo sapiens
gaggagccttttt

SEQ ID NO: 6215443 - DNA, 13 bp, Homo sapiens
gaggagcgcaggc

SEQ ID NO: 6215444 - DNA, 16 bp, Homo sapiens
gaggagcgcaggcagc

SEQ ID NO: 6215445 - DNA, 10 bp, Homo sapiens
gaggagctca

SEQ ID NO: 6215446 - DNA, 15 bp, Homo sapiens
gaggagctcagggct

SEQ ID NO: 6215447 - DNA, 16 bp, Homo sapiens
gaggagctgagggagg

SEQ ID NO: 6215448 - DNA, 17 bp, Homo sapiens
gaggagctgagggaggg

SEQ ID NO: 6215449 - DNA, 21 bp, Homo sapiens
gaggagctgccgcaaggccct

SEQ ID NO: 6215450 - DNA, 22 bp, Homo sapiens
gaggagctgccgcaaggccctg

SEQ ID NO: 6215451 - DNA, 22 bp, Homo sapiens
gaggagctgcctcttctcttga

SEQ ID NO: 6215452 - DNA, 23 bp, Homo sapiens
gaggagctgcctgcttggcccgg

SEQ ID NO: 6215453 - DNA, 13 bp, Homo sapiens
gaggagctgctgg

SEQ ID NO: 6215454 - DNA, 15 bp, Homo sapiens
gaggagctgctggct

SEQ ID NO: 6215455 - DNA, 13 bp, Homo sapiens
gaggagctggcct

SEQ ID NO: 6215456 - DNA, 16 bp, Homo sapiens
gaggagctgggcccct

SEQ ID NO: 6215457 - DNA, 19 bp, Homo sapiens
gaggagcttccagtgcatg

SEQ ID NO: 6215458 - DNA, 21 bp, Homo sapiens
gaggagcttccagtgcatgtt

SEQ ID NO: 6215459 - DNA, 20 bp, Homo sapiens
gaggagcttctcccagtgtg

SEQ ID NO: 6215460 - DNA, 18 bp, Homo sapiens
gaggaggaaatcccttca

SEQ ID NO: 6215461 - DNA, 19 bp, Homo sapiens
gaggaggaaatcccttcat

SEQ ID NO: 6215462 - DNA, 17 bp, Homo sapiens
gaggaggaacgggcagc

SEQ ID NO: 6215463 - DNA, 19 bp, Homo sapiens
gaggaggaacgggcagcca

SEQ ID NO: 6215464 - DNA, 20 bp, Homo sapiens
gaggaggaacgggcagccac

SEQ ID NO: 6215465 - DNA, 19 bp, Homo sapiens
gaggaggaagagggtagac

SEQ ID NO: 6215466 - DNA, 13 bp, Homo sapiens
gaggaggaaggca

SEQ ID NO: 6215467 - DNA, 16 bp, Homo sapiens
gaggaggaaggcaaga

SEQ ID NO: 6215468 - DNA, 14 bp, Homo sapiens
gaggaggacaagaa

SEQ ID NO: 6215469 - DNA, 13 bp, Homo sapiens
gaaaggaaataga

SEQ ID NO: 6215470 - DNA, 14 bp, Homo sapiens
gaaaggaacatttt

SEQ ID NO: 6215471 - DNA, 11 bp, Homo sapiens
gaaaggaagca

SEQ ID NO: 6215472 - DNA, 17 bp, Homo sapiens
gaaaggaagcaacagat

SEQ ID NO: 6215473 - DNA, 21 bp, Homo sapiens
gaaaggaagcattgtaaaata

SEQ ID NO: 6215474 - DNA, 23 bp, Homo sapiens
gaaaggaagcattgtaaaataat

SEQ ID NO: 6215475 - DNA, 20 bp, Homo sapiens
gaaaggaatgcaaagatgaa

SEQ ID NO: 6215476 - DNA, 14 bp, Homo sapiens
gaaaggactttgtg

SEQ ID NO: 6215477 - DNA, 13 bp, Homo sapiens
gaaaggagactag

SEQ ID NO: 6215478 - DNA, 17 bp, Homo sapiens
gaaaggagaggaaagaa

SEQ ID NO: 6215479 - DNA, 19 bp, Homo sapiens
gaaaggagcctaggccagg

SEQ ID NO: 6215480 - DNA, 21 bp, Homo sapiens
gaaaggaggccctgttccctg

SEQ ID NO: 6215481 - DNA, 15 bp, Homo sapiens
gaaaggagtagaaaa

SEQ ID NO: 6215482 - DNA, 14 bp, Homo sapiens
gaaaggagtagttt

SEQ ID NO: 6215483 - DNA, 20 bp, Homo sapiens
gaaaggagtttaaaaacatt

SEQ ID NO: 6215484 - DNA, 22 bp, Homo sapiens
gaaaggatctgtgattggctgg

SEQ ID NO: 6215485 - DNA, 22 bp, Homo sapiens
gaaaggatggcagcctcagggc

SEQ ID NO: 6215486 - DNA, 12 bp, Homo sapiens
gaaaggatttta

SEQ ID NO: 6215487 - DNA, 19 bp, Homo sapiens
gaaaggattttaccaaagc

SEQ ID NO: 6215488 - DNA, 24 bp, Homo sapiens
gaaaggattttaccaaagcatcaa

SEQ ID NO: 6215489 - DNA, 17 bp, Homo sapiens
gaaaggcaaagtacatt

SEQ ID NO: 6215490 - DNA, 17 bp, Homo sapiens
gaaaggcaaatctgact

SEQ ID NO: 6215491 - DNA, 20 bp, Homo sapiens
gaaaggcaaatctgactttt

SEQ ID NO: 6215492 - DNA, 18 bp, Homo sapiens
gaaaggcaaccaataaaa

SEQ ID NO: 6215493 - DNA, 23 bp, Homo sapiens
gaaaggcaaccaataaaagccag

SEQ ID NO: 6215494 - DNA, 18 bp, Homo sapiens
gaaaggcaagagctcaag

SEQ ID NO: 6215495 - DNA, 14 bp, Homo sapiens
gaaaggcaagcttg

SEQ ID NO: 6215496 - DNA, 21 bp, Homo sapiens
gaaaggcagccctcacctctg

SEQ ID NO: 6215497 - DNA, 19 bp, Homo sapiens
gaaaggcaggaagggaagc

SEQ ID NO: 6215498 - DNA, 14 bp, Homo sapiens
gaaaggcagggccc

SEQ ID NO: 6215499 - DNA, 17 bp, Homo sapiens
gaaaggcaggtttcatt

SEQ ID NO: 6215500 - DNA, 22 bp, Homo sapiens
gaaaggcatcagtccccctgtg

SEQ ID NO: 6215501 - DNA, 14 bp, Homo sapiens
gaaaggccagcact

SEQ ID NO: 6215502 - DNA, 20 bp, Homo sapiens
gaaaggccagcagccttcca

SEQ ID NO: 6215503 - DNA, 19 bp, Homo sapiens
gaaaggccagctggcagca

SEQ ID NO: 6215504 - DNA, 21 bp, Homo sapiens
gaaaggccagctggcagcaga

SEQ ID NO: 6215505 - DNA, 16 bp, Homo sapiens
gaaaggccccaatctt

SEQ ID NO: 6215506 - DNA, 17 bp, Homo sapiens
gaaaggccctgcacagg

SEQ ID NO: 6215507 - DNA, 18 bp, Homo sapiens
gaaaggcctcaagaacaa

SEQ ID NO: 6215508 - DNA, 15 bp, Homo sapiens
gaaaggcctctgtgg

SEQ ID NO: 6215509 - DNA, 16 bp, Homo sapiens
gaaaggcctgcacaca

SEQ ID NO: 6215510 - DNA, 18 bp, Homo sapiens
gaaaggcctgtggggagc

SEQ ID NO: 6215511 - DNA, 20 bp, Homo sapiens
gaaaggcctgtggggagccg

SEQ ID NO: 6215512 - DNA, 14 bp, Homo sapiens
gaaaggccttcaga

SEQ ID NO: 6215513 - DNA, 16 bp, Homo sapiens
gaaaggccttcagaca

SEQ ID NO: 6215514 - DNA, 20 bp, Homo sapiens
gaaaggccttcagacacatg

SEQ ID NO: 6215515 - DNA, 21 bp, Homo sapiens
gaaaggccttcagacacatgc

SEQ ID NO: 6215516 - DNA, 18 bp, Homo sapiens
gaaaggcctttaaaattt

SEQ ID NO: 6215517 - DNA, 23 bp, Homo sapiens
gaaaggcgcccccgccccaggct

SEQ ID NO: 6215518 - DNA, 22 bp, Homo sapiens
gaaaggctcaatttggtgctca

SEQ ID NO: 6215519 - DNA, 18 bp, Homo sapiens
gaaaggctcagtctcagg

SEQ ID NO: 6215520 - DNA, 17 bp, Homo sapiens
gaaaggctcatttaaaa

SEQ ID NO: 6215521 - DNA, 14 bp, Homo sapiens
gaaaggctccagga

SEQ ID NO: 6215522 - DNA, 18 bp, Homo sapiens
gaaaggctccaggagcag

SEQ ID NO: 6215523 - DNA, 19 bp, Homo sapiens
gaaaggctctgaaagccag

SEQ ID NO: 6215524 - DNA, 15 bp, Homo sapiens
gaaaggctgccgagg

SEQ ID NO: 6215525 - DNA, 14 bp, Homo sapiens
gaaaggcttttaaa

SEQ ID NO: 6215526 - DNA, 13 bp, Homo sapiens
gaaagggaaactg

SEQ ID NO: 6215527 - DNA, 12 bp, Homo sapiens
gaaagggaaagc

SEQ ID NO: 6215528 - DNA, 16 bp, Homo sapiens
gaaagggaacagaaag

SEQ ID NO: 6215529 - DNA, 11 bp, Homo sapiens
gaaagggacaa

SEQ ID NO: 6215530 - DNA, 16 bp, Homo sapiens
gaaagggacaatgata

SEQ ID NO: 6215531 - DNA, 15 bp, Homo sapiens
gaaagggacccacct

SEQ ID NO: 6215532 - DNA, 18 bp, Homo sapiens
gaaagggacccacctgct

SEQ ID NO: 6215533 - DNA, 19 bp, Homo sapiens
gaaagggacttggaagctc

SEQ ID NO: 6215534 - DNA, 14 bp, Homo sapiens
gaaagggagagggg

SEQ ID NO: 6215535 - DNA, 13 bp, Homo sapiens
gaaagggagatgt

SEQ ID NO: 6215536 - DNA, 14 bp, Homo sapiens
gaaagggaggaaga

SEQ ID NO: 6215537 - DNA, 15 bp, Homo sapiens
gaaagggagggagga

SEQ ID NO: 6215538 - DNA, 13 bp, Homo sapiens
gaaagggagggct

SEQ ID NO: 6215539 - DNA, 14 bp, Homo sapiens
gaaagggagggctc

SEQ ID NO: 6215540 - DNA, 16 bp, Homo sapiens
gaaagggagggctctg

SEQ ID NO: 6215541 - DNA, 13 bp, Homo sapiens
gaaagggatggcc

SEQ ID NO: 6215542 - DNA, 20 bp, Homo sapiens
gaaagggatggtcaggccca

SEQ ID NO: 6215543 - DNA, 20 bp, Homo sapiens
gaaagggattttcagccctc

SEQ ID NO: 6215544 - DNA, 20 bp, Homo sapiens
gaaagggcaacaataaaata

SEQ ID NO: 6215545 - DNA, 21 bp, Homo sapiens
gaaagggcacttaatttgtaa

SEQ ID NO: 6215546 - DNA, 18 bp, Homo sapiens
gaaagggcagcccctccc

SEQ ID NO: 6215547 - DNA, 23 bp, Homo sapiens
gaaagggcagtggacgtgctgcg

SEQ ID NO: 6215548 - DNA, 15 bp, Homo sapiens
gaaagggccaggaga

SEQ ID NO: 6215549 - DNA, 22 bp, Homo sapiens
gaaagggcccttcccctccccc

SEQ ID NO: 6215550 - DNA, 20 bp, Homo sapiens
gaaagggccttgacatcagt

SEQ ID NO: 6215551 - DNA, 23 bp, Homo sapiens
gaaaggggaaacgtctcccagat

SEQ ID NO: 6215552 - DNA, 15 bp, Homo sapiens
gaaaggggagcccac

SEQ ID NO: 6215553 - DNA, 15 bp, Homo sapiens
gaaaggggagtaggt

SEQ ID NO: 6215554 - DNA, 20 bp, Homo sapiens
gaaaggggagtaggtggggg

SEQ ID NO: 6215555 - DNA, 20 bp, Homo sapiens
gaaaggggctcttctgagca

SEQ ID NO: 6215556 - DNA, 21 bp, Homo sapiens
gaaagggggggaaaaaagcaa

SEQ ID NO: 6215557 - DNA, 22 bp, Homo sapiens
gaaagggggtcccagtgggagg

SEQ ID NO: 6215558 - DNA, 12 bp, Homo sapiens
gaaagggggtgg

SEQ ID NO: 6215559 - DNA, 19 bp, Homo sapiens
gaaagggtcaacggccctg

SEQ ID NO: 6215560 - DNA, 17 bp, Homo sapiens
gaaagggtcctgctttc

SEQ ID NO: 6215561 - DNA, 18 bp, Homo sapiens
gaaagggtcctgctttct

SEQ ID NO: 6215562 - DNA, 18 bp, Homo sapiens
gaaagggtgtggcttgga

SEQ ID NO: 6215563 - DNA, 14 bp, Homo sapiens
gaaaggtaaataca

SEQ ID NO: 6215564 - DNA, 17 bp, Homo sapiens
gaaaggtaaatacaagt

SEQ ID NO: 6215565 - DNA, 17 bp, Homo sapiens
gaaaggtaatctgaaac

SEQ ID NO: 6215566 - DNA, 21 bp, Homo sapiens
gaaaggtactatatttgctag

SEQ ID NO: 6215567 - DNA, 12 bp, Homo sapiens
gaaaggtagccc

SEQ ID NO: 6215568 - DNA, 19 bp, Homo sapiens
gaaaggtaggaagagaggt

SEQ ID NO: 6215569 - DNA, 15 bp, Homo sapiens
gaaaggtcacactac

SEQ ID NO: 6215570 - DNA, 16 bp, Homo sapiens
gaaaggtcacctcact

SEQ ID NO: 6215571 - DNA, 16 bp, Homo sapiens
gaaaggtcagaatttt

SEQ ID NO: 6215572 - DNA, 13 bp, Homo sapiens
gaaaggtcagccc

SEQ ID NO: 6215573 - DNA, 21 bp, Homo sapiens
gaaaggtcagcccgtttcaga

SEQ ID NO: 6215574 - DNA, 22 bp, Homo sapiens
gaaaggtctgaaatccagcatc

SEQ ID NO: 6215575 - DNA, 18 bp, Homo sapiens
gaaaggtgaaacacacac

SEQ ID NO: 6215576 - DNA, 16 bp, Homo sapiens
gaaaggtgattccagg

SEQ ID NO: 6215577 - DNA, 13 bp, Homo sapiens
gaaaggtgcagga

SEQ ID NO: 6215578 - DNA, 13 bp, Homo sapiens
gaaaggtgctata

SEQ ID NO: 6215579 - DNA, 22 bp, Homo sapiens
gaaaggtgctatataattgtga

SEQ ID NO: 6215580 - DNA, 14 bp, Homo sapiens
gaaaggtgctcaaa

SEQ ID NO: 6215581 - DNA, 18 bp, Homo sapiens
gaaaggtgctcaaagatg

SEQ ID NO: 6215582 - DNA, 14 bp, Homo sapiens
gaaaggtgctttct

SEQ ID NO: 6215583 - DNA, 17 bp, Homo sapiens
gaaaggtgctttctcca

SEQ ID NO: 6215584 - DNA, 17 bp, Homo sapiens
gaaaggtgtaggctggg

SEQ ID NO: 6215585 - DNA, 16 bp, Homo sapiens
gaaaggttaaaaaagc

SEQ ID NO: 6215586 - DNA, 13 bp, Homo sapiens
gaaaggttctgcc

SEQ ID NO: 6215587 - DNA, 15 bp, Homo sapiens
gaaaggttctgcccg

SEQ ID NO: 6215588 - DNA, 15 bp, Homo sapiens
gaaaggttgaattaa

SEQ ID NO: 6215589 - DNA, 22 bp, Homo sapiens
gaaaggttgaggggctccccag

SEQ ID NO: 6215590 - DNA, 16 bp, Homo sapiens
gaaaggtttacattgt

SEQ ID NO: 6215591 - DNA, 20 bp, Homo sapiens
gaaaggtttgagaagcactg

SEQ ID NO: 6215592 - DNA, 13 bp, Homo sapiens
gaaaggttttgga

SEQ ID NO: 6215593 - DNA, 13 bp, Homo sapiens
gaaaggttttttt

SEQ ID NO: 6215594 - DNA, 12 bp, Homo sapiens
gaaagtaaaaaa

SEQ ID NO: 6215595 - DNA, 13 bp, Homo sapiens
gaaagtaaaagtt

SEQ ID NO: 6215596 - DNA, 13 bp, Homo sapiens
gaaagtaaagtaa

SEQ ID NO: 6215597 - DNA, 14 bp, Homo sapiens
gaaagtaactgttt

SEQ ID NO: 6215598 - DNA, 14 bp, Homo sapiens
gaaagtaagtcttt

SEQ ID NO: 6215599 - DNA, 21 bp, Homo sapiens
gaaagtaatttaatttgtaaa

SEQ ID NO: 6215600 - DNA, 22 bp, Homo sapiens
gaaagtaatttaatttgtaaaa

SEQ ID NO: 6215601 - DNA, 20 bp, Homo sapiens
gaaagtaatttcaagaatgt

SEQ ID NO: 6215602 - DNA, 17 bp, Homo sapiens
gaaagtacactctgctg

SEQ ID NO: 6215603 - DNA, 20 bp, Homo sapiens
gaaagtacattttttgaaat

SEQ ID NO: 6215604 - DNA, 21 bp, Homo sapiens
gaaagtaccctcttttaccaa

SEQ ID NO: 6215605 - DNA, 22 bp, Homo sapiens
gaaagtacttctccaccctgct

SEQ ID NO: 6215606 - DNA, 18 bp, Homo sapiens
gaaagtagcagtcatcat

SEQ ID NO: 6215607 - DNA, 14 bp, Homo sapiens
gaaagtatatactg

SEQ ID NO: 6215608 - DNA, 17 bp, Homo sapiens
gaaagtatgttgtatat

SEQ ID NO: 6215609 - DNA, 20 bp, Homo sapiens
gaaagtattcagaaattaaa

SEQ ID NO: 6215610 - DNA, 21 bp, Homo sapiens
gaaagtattcagaaattaaaa

SEQ ID NO: 6215611 - DNA, 16 bp, Homo sapiens
gaaagtatttactttt

SEQ ID NO: 6215612 - DNA, 17 bp, Homo sapiens
gaaagtatttacttttt

SEQ ID NO: 6215613 - DNA, 17 bp, Homo sapiens
gaaagtcaaaaaattat

SEQ ID NO: 6215614 - DNA, 21 bp, Homo sapiens
gaaagtcaagtctacctgcct

SEQ ID NO: 6215615 - DNA, 17 bp, Homo sapiens
gaaagtcaattcagtga

SEQ ID NO: 6215616 - DNA, 19 bp, Homo sapiens
gaaagtcaattcagtgatg

SEQ ID NO: 6215617 - DNA, 16 bp, Homo sapiens
gaaagtcaccaggact

SEQ ID NO: 6215618 - DNA, 17 bp, Homo sapiens
gaaagtcacctacagga

SEQ ID NO: 6215619 - DNA, 20 bp, Homo sapiens
gaaagtcacctacaggactg

SEQ ID NO: 6215620 - DNA, 17 bp, Homo sapiens
gaaagtcagatgcccag

SEQ ID NO: 6215621 - DNA, 19 bp, Homo sapiens
gaaagtcagattcttgcat

SEQ ID NO: 6215622 - DNA, 20 bp, Homo sapiens
gaaagtcagccatatctcca

SEQ ID NO: 6215623 - DNA, 18 bp, Homo sapiens
gaaagtcagctcttgtca

SEQ ID NO: 6215624 - DNA, 19 bp, Homo sapiens
gaaagtcagctttcagagc

SEQ ID NO: 6215625 - DNA, 17 bp, Homo sapiens
gaaagtcaggctagctg

SEQ ID NO: 6215626 - DNA, 18 bp, Homo sapiens
gaaagtcattggctttat

SEQ ID NO: 6215627 - DNA, 22 bp, Homo sapiens
gaaagtccaagccgtaggaccc

SEQ ID NO: 6215628 - DNA, 22 bp, Homo sapiens
gaaagtcccccctcgccccaaa

SEQ ID NO: 6215629 - DNA, 14 bp, Homo sapiens
gaaagtcctgaact

SEQ ID NO: 6215630 - DNA, 18 bp, Homo sapiens
gaaagtccttgtttttgc

SEQ ID NO: 6215631 - DNA, 14 bp, Homo sapiens
gaaagtctatgctt

SEQ ID NO: 6215632 - DNA, 22 bp, Homo sapiens
gaaagtctgtcaggtttggttt

SEQ ID NO: 6215633 - DNA, 21 bp, Homo sapiens
gaaagtgaaaaatgtaaaaca

SEQ ID NO: 6215634 - DNA, 16 bp, Homo sapiens
gaaagtgaaagtccag

SEQ ID NO: 6215635 - DNA, 16 bp, Homo sapiens
gaaagtgaataaaaat

SEQ ID NO: 6215636 - DNA, 14 bp, Homo sapiens
gaaagtgacagaga

SEQ ID NO: 6215637 - DNA, 22 bp, Homo sapiens
gaaagtgacatttgctttcggt

SEQ ID NO: 6215638 - DNA, 14 bp, Homo sapiens
gaaagtgatgacat

SEQ ID NO: 6215639 - DNA, 15 bp, Homo sapiens
gaaagtgatgacata

SEQ ID NO: 6215640 - DNA, 18 bp, Homo sapiens
gaaagtgatttgtaatat

SEQ ID NO: 6215641 - DNA, 23 bp, Homo sapiens
gaaagtgattttatttttgcaaa

SEQ ID NO: 6215642 - DNA, 15 bp, Homo sapiens
gaaagtgcagaatca

SEQ ID NO: 6215643 - DNA, 13 bp, Homo sapiens
gaaagtgccaaaa

SEQ ID NO: 6215644 - DNA, 22 bp, Homo sapiens
gaaagtgccagcattccagact

SEQ ID NO: 6215645 - DNA, 23 bp, Homo sapiens
gaaagtgccagcattccagactt

SEQ ID NO: 6215646 - DNA, 13 bp, Homo sapiens
gaaagtgcctgac

SEQ ID NO: 6215647 - DNA, 14 bp, Homo sapiens
gaaagtgcctttat

SEQ ID NO: 6215648 - DNA, 14 bp, Homo sapiens
gaggaggacacagc

SEQ ID NO: 6215649 - DNA, 20 bp, Homo sapiens
gaggaggacccctgccttcc

SEQ ID NO: 6215650 - DNA, 22 bp, Homo sapiens
gaggaggacttggagggtctgg

SEQ ID NO: 6215651 - DNA, 15 bp, Homo sapiens
gaggaggagccttgc

SEQ ID NO: 6215652 - DNA, 12 bp, Homo sapiens
gaggaggagctg

SEQ ID NO: 6215653 - DNA, 13 bp, Homo sapiens
gaggaggaggaag

SEQ ID NO: 6215654 - DNA, 14 bp, Homo sapiens
gaggaggaggaagg

SEQ ID NO: 6215655 - DNA, 15 bp, Homo sapiens
gaggaggaggaaggc

SEQ ID NO: 6215656 - DNA, 15 bp, Homo sapiens
gaggaggaggacaca

SEQ ID NO: 6215657 - DNA, 13 bp, Homo sapiens
gaggaggaggcag

SEQ ID NO: 6215658 - DNA, 19 bp, Homo sapiens
gaggaggatgtccctgggc

SEQ ID NO: 6215659 - DNA, 16 bp, Homo sapiens
gaggaggattgtgctg

SEQ ID NO: 6215660 - DNA, 16 bp, Homo sapiens
gaggaggcagagaaga

SEQ ID NO: 6215661 - DNA, 20 bp, Homo sapiens
gaggaggcagagaagaaaga

SEQ ID NO: 6215662 - DNA, 15 bp, Homo sapiens
gaggaggcagcagga

SEQ ID NO: 6215663 - DNA, 16 bp, Homo sapiens
gaggaggcagcaggac

SEQ ID NO: 6215664 - DNA, 13 bp, Homo sapiens
gaggaggcaggag

SEQ ID NO: 6215665 - DNA, 12 bp, Homo sapiens
gaggaggccacc

SEQ ID NO: 6215666 - DNA, 19 bp, Homo sapiens
gaggaggccacctctccaa

SEQ ID NO: 6215667 - DNA, 20 bp, Homo sapiens
gaggaggccacctctccaag

SEQ ID NO: 6215668 - DNA, 18 bp, Homo sapiens
gaggaggccgactgggct

SEQ ID NO: 6215669 - DNA, 13 bp, Homo sapiens
gaggaggcctcaa

SEQ ID NO: 6215670 - DNA, 12 bp, Homo sapiens
gaggaggcctgg

SEQ ID NO: 6215671 - DNA, 13 bp, Homo sapiens
gaggaggctgccc

SEQ ID NO: 6215672 - DNA, 22 bp, Homo sapiens
gaggaggctgccctgaggggct

SEQ ID NO: 6215673 - DNA, 16 bp, Homo sapiens
gaggagggaatgattg

SEQ ID NO: 6215674 - DNA, 14 bp, Homo sapiens
gaggagggactgtc

SEQ ID NO: 6215675 - DNA, 17 bp, Homo sapiens
gaggagggagagggagg

SEQ ID NO: 6215676 - DNA, 14 bp, Homo sapiens
gaggagggatgctg

SEQ ID NO: 6215677 - DNA, 15 bp, Homo sapiens
gaggagggatgctgc

SEQ ID NO: 6215678 - DNA, 18 bp, Homo sapiens
gaggagggatgctgctcc

SEQ ID NO: 6215679 - DNA, 13 bp, Homo sapiens
gaggagggcaggc

SEQ ID NO: 6215680 - DNA, 20 bp, Homo sapiens
gaggagggcgtgactcaccc

SEQ ID NO: 6215681 - DNA, 14 bp, Homo sapiens
gaggagggctttga

SEQ ID NO: 6215682 - DNA, 15 bp, Homo sapiens
gaggaggggaagaag

SEQ ID NO: 6215683 - DNA, 15 bp, Homo sapiens
gaggaggggaagctg

SEQ ID NO: 6215684 - DNA, 16 bp, Homo sapiens
gaggaggggaaggggc

SEQ ID NO: 6215685 - DNA, 23 bp, Homo sapiens
gaggaggggaaggggctgaggac

SEQ ID NO: 6215686 - DNA, 17 bp, Homo sapiens
gaggaggggcacctgcc

SEQ ID NO: 6215687 - DNA, 19 bp, Homo sapiens
gaggaggggcccccctgcc

SEQ ID NO: 6215688 - DNA, 21 bp, Homo sapiens
gaggaggggcccccctgccct

SEQ ID NO: 6215689 - DNA, 22 bp, Homo sapiens
gaggaggggcccccctgccctg

SEQ ID NO: 6215690 - DNA, 18 bp, Homo sapiens
gaggaggggccgctgcca

SEQ ID NO: 6215691 - DNA, 16 bp, Homo sapiens
gaggaggggcgggagt

SEQ ID NO: 6215692 - DNA, 14 bp, Homo sapiens
gaggagggggcagg

SEQ ID NO: 6215693 - DNA, 19 bp, Homo sapiens
gaggaggggtaaatatatg

SEQ ID NO: 6215694 - DNA, 20 bp, Homo sapiens
gaggaggggtaaatatatgt

SEQ ID NO: 6215695 - DNA, 21 bp, Homo sapiens
gaggaggggtaaatatatgtt

SEQ ID NO: 6215696 - DNA, 23 bp, Homo sapiens
gaggaggggtgagagacctgctc

SEQ ID NO: 6215697 - DNA, 20 bp, Homo sapiens
gaggagggtcggtgccttca

SEQ ID NO: 6215698 - DNA, 12 bp, Homo sapiens
gaggagggtgcc

SEQ ID NO: 6215699 - DNA, 12 bp, Homo sapiens
gaggagggtggg

SEQ ID NO: 6215700 - DNA, 15 bp, Homo sapiens
gaggagggtggggga

SEQ ID NO: 6215701 - DNA, 19 bp, Homo sapiens
gaggaggtaatgaattaaa

SEQ ID NO: 6215702 - DNA, 18 bp, Homo sapiens
gaggaggtcccacttgca

SEQ ID NO: 6215703 - DNA, 13 bp, Homo sapiens
gaggaggtgcccg

SEQ ID NO: 6215704 - DNA, 20 bp, Homo sapiens
gaggaggtgggggctggagg

SEQ ID NO: 6215705 - DNA, 17 bp, Homo sapiens
gaggaggtgtcccaagc

SEQ ID NO: 6215706 - DNA, 19 bp, Homo sapiens
gaggaggtgtctcaggctg

SEQ ID NO: 6215707 - DNA, 23 bp, Homo sapiens
gaggaggtgtctggggtgaggga

SEQ ID NO: 6215708 - DNA, 15 bp, Homo sapiens
gaggaggtgtgagga

SEQ ID NO: 6215709 - DNA, 19 bp, Homo sapiens
gaggaggtgtggagtggag

SEQ ID NO: 6215710 - DNA, 18 bp, Homo sapiens
gaggaggttcactgagct

SEQ ID NO: 6215711 - DNA, 12 bp, Homo sapiens
gaggagtaacaa

SEQ ID NO: 6215712 - DNA, 21 bp, Homo sapiens
gaggagtaacaatacaaatgg

SEQ ID NO: 6215713 - DNA, 15 bp, Homo sapiens
gaggagtacaggtga

SEQ ID NO: 6215714 - DNA, 15 bp, Homo sapiens
gaggagtagctgaga

SEQ ID NO: 6215715 - DNA, 17 bp, Homo sapiens
gaggagtagctgagagg

SEQ ID NO: 6215716 - DNA, 18 bp, Homo sapiens
gaggagtagctgagagga

SEQ ID NO: 6215717 - DNA, 21 bp, Homo sapiens
gaggagtagctgagaggaaga

SEQ ID NO: 6215718 - DNA, 23 bp, Homo sapiens
gaggagtagctgagaggaagatg

SEQ ID NO: 6215719 - DNA, 14 bp, Homo sapiens
gaggagtcagatga

SEQ ID NO: 6215720 - DNA, 21 bp, Homo sapiens
gaggagtcagatgaggccctg

SEQ ID NO: 6215721 - DNA, 12 bp, Homo sapiens
gaggagtccaaa

SEQ ID NO: 6215722 - DNA, 19 bp, Homo sapiens
gaggagtctcaacatgtgt

SEQ ID NO: 6215723 - DNA, 16 bp, Homo sapiens
gaggagtctgaggact

SEQ ID NO: 6215724 - DNA, 17 bp, Homo sapiens
gaggagtctgaggactg

SEQ ID NO: 6215725 - DNA, 15 bp, Homo sapiens
gaggagtctgaggtc

SEQ ID NO: 6215726 - DNA, 20 bp, Homo sapiens
gaggagtctgaggtcctgag

SEQ ID NO: 6215727 - DNA, 21 bp, Homo sapiens
gaggagtctgaggtcctgagc

SEQ ID NO: 6215728 - DNA, 16 bp, Homo sapiens
gaggagtgcagccttc

SEQ ID NO: 6215729 - DNA, 19 bp, Homo sapiens
gaggagtggacgctgtcca

SEQ ID NO: 6215730 - DNA, 14 bp, Homo sapiens
gaggagtggaggtg

SEQ ID NO: 6215731 - DNA, 21 bp, Homo sapiens
gaggagtggccctgatccagg

SEQ ID NO: 6215732 - DNA, 17 bp, Homo sapiens
gaggagtgggacagaca

SEQ ID NO: 6215733 - DNA, 17 bp, Homo sapiens
gaggagtggtttttctt

SEQ ID NO: 6215734 - DNA, 21 bp, Homo sapiens
gaggagtgtcctgtctgctgg

SEQ ID NO: 6215735 - DNA, 22 bp, Homo sapiens
gaggagtgtcctgtctgctggg

SEQ ID NO: 6215736 - DNA, 19 bp, Homo sapiens
gaggagttcaatgatctag

SEQ ID NO: 6215737 - DNA, 15 bp, Homo sapiens
gaggagttctttggc

SEQ ID NO: 6215738 - DNA, 19 bp, Homo sapiens
gaggagttgtctgtcctgg

SEQ ID NO: 6215739 - DNA, 22 bp, Homo sapiens
gaggagttgtctgtcctggtca

SEQ ID NO: 6215740 - DNA, 18 bp, Homo sapiens
gaggataaaaaggaagga

SEQ ID NO: 6215741 - DNA, 16 bp, Homo sapiens
gaggataaagaaaaga

SEQ ID NO: 6215742 - DNA, 18 bp, Homo sapiens
gaggataaattgccataa

SEQ ID NO: 6215743 - DNA, 22 bp, Homo sapiens
gaggataacttccttgcccctg

SEQ ID NO: 6215744 - DNA, 16 bp, Homo sapiens
gaggataactttttaa

SEQ ID NO: 6215745 - DNA, 17 bp, Homo sapiens
gaggatacagaggagat

SEQ ID NO: 6215746 - DNA, 14 bp, Homo sapiens
gaggatacagctct

SEQ ID NO: 6215747 - DNA, 15 bp, Homo sapiens
gaggatacatttaat

SEQ ID NO: 6215748 - DNA, 21 bp, Homo sapiens
gaggatacatttaataaaact

SEQ ID NO: 6215749 - DNA, 15 bp, Homo sapiens
gaggataccccaaag

SEQ ID NO: 6215750 - DNA, 22 bp, Homo sapiens
gaggataccccaaagtccaggc

SEQ ID NO: 6215751 - DNA, 14 bp, Homo sapiens
gaggatagaaaaag

SEQ ID NO: 6215752 - DNA, 23 bp, Homo sapiens
gaggatataatgtgtgctttatt

SEQ ID NO: 6215753 - DNA, 22 bp, Homo sapiens
gaggatattcttctcttgcttt

SEQ ID NO: 6215754 - DNA, 19 bp, Homo sapiens
gaggatcacagtgctgaga

SEQ ID NO: 6215755 - DNA, 20 bp, Homo sapiens
gaggatcactggagcccagg

SEQ ID NO: 6215756 - DNA, 14 bp, Homo sapiens
gaggatcacttgag

SEQ ID NO: 6215757 - DNA, 19 bp, Homo sapiens
gaggatcacttgagcccag

SEQ ID NO: 6215758 - DNA, 14 bp, Homo sapiens
gaggatcagaaagt

SEQ ID NO: 6215759 - DNA, 14 bp, Homo sapiens
gaggatccagggca

SEQ ID NO: 6215760 - DNA, 15 bp, Homo sapiens
gaggatccagggcag

SEQ ID NO: 6215761 - DNA, 21 bp, Homo sapiens
gaggatccagggcagcaggcc

SEQ ID NO: 6215762 - DNA, 19 bp, Homo sapiens
gaggatcccctgtcccctg

SEQ ID NO: 6215763 - DNA, 17 bp, Homo sapiens
gaggatccctctctgga

SEQ ID NO: 6215764 - DNA, 18 bp, Homo sapiens
gaggatcctcacaggagc

SEQ ID NO: 6215765 - DNA, 21 bp, Homo sapiens
gaggatcctcacaggagcaga

SEQ ID NO: 6215766 - DNA, 16 bp, Homo sapiens
gaggatcctgagctgc

SEQ ID NO: 6215767 - DNA, 15 bp, Homo sapiens
gaggatctagcttca

SEQ ID NO: 6215768 - DNA, 22 bp, Homo sapiens
gaggatctagcttcatgcctca

SEQ ID NO: 6215769 - DNA, 13 bp, Homo sapiens
gaggatctcttga

SEQ ID NO: 6215770 - DNA, 18 bp, Homo sapiens
gaggatgaatagatgtga

SEQ ID NO: 6215771 - DNA, 14 bp, Homo sapiens
gaggatgagacagg

SEQ ID NO: 6215772 - DNA, 16 bp, Homo sapiens
gaggatgagagcccag

SEQ ID NO: 6215773 - DNA, 20 bp, Homo sapiens
gaggatgagagcccagaggt

SEQ ID NO: 6215774 - DNA, 14 bp, Homo sapiens
gaggatgagcagag

SEQ ID NO: 6215775 - DNA, 13 bp, Homo sapiens
gaggatgagctgg

SEQ ID NO: 6215776 - DNA, 21 bp, Homo sapiens
gaggatgatttcagaaggaga

SEQ ID NO: 6215777 - DNA, 12 bp, Homo sapiens
gaggatgcactg

SEQ ID NO: 6215778 - DNA, 15 bp, Homo sapiens
gaggatgcattcgag

SEQ ID NO: 6215779 - DNA, 16 bp, Homo sapiens
gaggatgccacagccc

SEQ ID NO: 6215780 - DNA, 19 bp, Homo sapiens
gaggatgccacagccccac

SEQ ID NO: 6215781 - DNA, 20 bp, Homo sapiens
gaggatgccacagccccaca

SEQ ID NO: 6215782 - DNA, 13 bp, Homo sapiens
gaggatgcctttt

SEQ ID NO: 6215783 - DNA, 17 bp, Homo sapiens
gaggatgccttttctgt

SEQ ID NO: 6215784 - DNA, 13 bp, Homo sapiens
gaggatgctgaag

SEQ ID NO: 6215785 - DNA, 14 bp, Homo sapiens
gaggatgctgaagt

SEQ ID NO: 6215786 - DNA, 22 bp, Homo sapiens
gaggatgctgacatcatttgta

SEQ ID NO: 6215787 - DNA, 16 bp, Homo sapiens
gaggatgctgcagtga

SEQ ID NO: 6215788 - DNA, 16 bp, Homo sapiens
gaggatgctgtcagga

SEQ ID NO: 6215789 - DNA, 16 bp, Homo sapiens
gaggatgctgtgcctc

SEQ ID NO: 6215790 - DNA, 21 bp, Homo sapiens
gaggatggacgaacaggggcc

SEQ ID NO: 6215791 - DNA, 19 bp, Homo sapiens
gaggatggacgagtgagct

SEQ ID NO: 6215792 - DNA, 14 bp, Homo sapiens
gaggatggagagag

SEQ ID NO: 6215793 - DNA, 22 bp, Homo sapiens
gaggatggagagcagccagcac

SEQ ID NO: 6215794 - DNA, 15 bp, Homo sapiens
gaggatggccagtgt

SEQ ID NO: 6215795 - DNA, 16 bp, Homo sapiens
gaggatggcttgagcc

SEQ ID NO: 6215796 - DNA, 15 bp, Homo sapiens
gaggatgggaaggag

SEQ ID NO: 6215797 - DNA, 17 bp, Homo sapiens
gaggatgggatgtattt

SEQ ID NO: 6215798 - DNA, 22 bp, Homo sapiens
gaggatggtgtcctgaggcctc

SEQ ID NO: 6215799 - DNA, 21 bp, Homo sapiens
gaggatgtaaagatcaataaa

SEQ ID NO: 6215800 - DNA, 12 bp, Homo sapiens
gaggatgtatgt

SEQ ID NO: 6215801 - DNA, 16 bp, Homo sapiens
gaggatgtatgtgtat

SEQ ID NO: 6215802 - DNA, 18 bp, Homo sapiens
gaggatgtccctgggcca

SEQ ID NO: 6215803 - DNA, 21 bp, Homo sapiens
gaggatgtctttctcctctgg

SEQ ID NO: 6215804 - DNA, 16 bp, Homo sapiens
gaggatgtgggcagct

SEQ ID NO: 6215805 - DNA, 22 bp, Homo sapiens
gaggatgtgttttgcacgtctt

SEQ ID NO: 6215806 - DNA, 21 bp, Homo sapiens
gaggatgttagacttgctccc

SEQ ID NO: 6215807 - DNA, 12 bp, Homo sapiens
gaggatgttctg

SEQ ID NO: 6215808 - DNA, 13 bp, Homo sapiens
gaggatgttctgg

SEQ ID NO: 6215809 - DNA, 22 bp, Homo sapiens
gaggatgttctggacctccccc

SEQ ID NO: 6215810 - DNA, 20 bp, Homo sapiens
gaggatgttctgggacacag

SEQ ID NO: 6215811 - DNA, 21 bp, Homo sapiens
gaggattaggggatggggagg

SEQ ID NO: 6215812 - DNA, 20 bp, Homo sapiens
gaggattagtagaaaataca

SEQ ID NO: 6215813 - DNA, 16 bp, Homo sapiens
gaggattataaatgaa

SEQ ID NO: 6215814 - DNA, 19 bp, Homo sapiens
gaggattataaatgaaatt

SEQ ID NO: 6215815 - DNA, 16 bp, Homo sapiens
gaggattcaggggctg

SEQ ID NO: 6215816 - DNA, 16 bp, Homo sapiens
gaggattctatgaggc

SEQ ID NO: 6215817 - DNA, 18 bp, Homo sapiens
gaggattctttccccaga

SEQ ID NO: 6215818 - DNA, 14 bp, Homo sapiens
gaggattgctgcca

SEQ ID NO: 6215819 - DNA, 23 bp, Homo sapiens
gaggattgcttcttgtgaaacca

SEQ ID NO: 6215820 - DNA, 20 bp, Homo sapiens
gaggattggctcccatcttt

SEQ ID NO: 6215821 - DNA, 23 bp, Homo sapiens
gaggattgtggaaaaccaggaaa

SEQ ID NO: 6215822 - DNA, 17 bp, Homo sapiens
gaggattgttgaatcta

SEQ ID NO: 6215823 - DNA, 12 bp, Homo sapiens
gaggatttagaa

SEQ ID NO: 6215824 - DNA, 21 bp, Homo sapiens
gaggatttccctgaagctatg

SEQ ID NO: 6215825 - DNA, 24 bp, Homo sapiens
gaggatttcctggagtgccctgca

SEQ ID NO: 6215826 - DNA, 15 bp, Homo sapiens
gaggatttctgggac

SEQ ID NO: 6215827 - DNA, 22 bp, Homo sapiens
gaaagtgcctttatctcagcca

SEQ ID NO: 6215828 - DNA, 15 bp, Homo sapiens
gaaagtgcctttcag

SEQ ID NO: 6215829 - DNA, 16 bp, Homo sapiens
gaaagtgcctttcagg

SEQ ID NO: 6215830 - DNA, 17 bp, Homo sapiens
gaaagtgcctttcagga

SEQ ID NO: 6215831 - DNA, 23 bp, Homo sapiens
gaaagtggctcttctaacctcag

SEQ ID NO: 6215832 - DNA, 20 bp, Homo sapiens
gaaagtgggacctggtgggc

SEQ ID NO: 6215833 - DNA, 17 bp, Homo sapiens
gaaagtgggggtggagg

SEQ ID NO: 6215834 - DNA, 16 bp, Homo sapiens
gaaagtgggtcacctg

SEQ ID NO: 6215835 - DNA, 18 bp, Homo sapiens
gaaagtgggtttcaattt

SEQ ID NO: 6215836 - DNA, 20 bp, Homo sapiens
gaaagtggtgctcagttgta

SEQ ID NO: 6215837 - DNA, 14 bp, Homo sapiens
gaaagtgtaaagca

SEQ ID NO: 6215838 - DNA, 23 bp, Homo sapiens
gaaagtgtaaagcattccaacaa

SEQ ID NO: 6215839 - DNA, 15 bp, Homo sapiens
gaaagtgtaaatgtt

SEQ ID NO: 6215840 - DNA, 19 bp, Homo sapiens
gaaagtgtataataagaaa

SEQ ID NO: 6215841 - DNA, 23 bp, Homo sapiens
gaaagtgtgaagacccaaaacag

SEQ ID NO: 6215842 - DNA, 21 bp, Homo sapiens
gaaagtgtgtgtgttctgtag

SEQ ID NO: 6215843 - DNA, 15 bp, Homo sapiens
gaaagtgttcaaatt

SEQ ID NO: 6215844 - DNA, 23 bp, Homo sapiens
gaaagtgttcaaattaaaaaagc

SEQ ID NO: 6215845 - DNA, 18 bp, Homo sapiens
gaaagtgttctgttacaa

SEQ ID NO: 6215846 - DNA, 21 bp, Homo sapiens
gaaagtgttctgttacaaaat

SEQ ID NO: 6215847 - DNA, 14 bp, Homo sapiens
gaaagtgtttcctt

SEQ ID NO: 6215848 - DNA, 17 bp, Homo sapiens
gaaagttaccttactga

SEQ ID NO: 6215849 - DNA, 18 bp, Homo sapiens
gaaagttaccttactgaa

SEQ ID NO: 6215850 - DNA, 17 bp, Homo sapiens
gaaagttactgtaaatg

SEQ ID NO: 6215851 - DNA, 14 bp, Homo sapiens
gaaagttagagatt

SEQ ID NO: 6215852 - DNA, 17 bp, Homo sapiens
gaaagttccagcagttt

SEQ ID NO: 6215853 - DNA, 22 bp, Homo sapiens
gaaagttcccccatcagttccc

SEQ ID NO: 6215854 - DNA, 13 bp, Homo sapiens
gaaagttgccatt

SEQ ID NO: 6215855 - DNA, 19 bp, Homo sapiens
gaaagttggaaaggaaaaa

SEQ ID NO: 6215856 - DNA, 19 bp, Homo sapiens
gaaagttgtgattctttga

SEQ ID NO: 6215857 - DNA, 11 bp, Homo sapiens
gaaagtttccc

SEQ ID NO: 6215858 - DNA, 14 bp, Homo sapiens
gaaagtttgccagg

SEQ ID NO: 6215859 - DNA, 17 bp, Homo sapiens
gaaagttttgttctgta

SEQ ID NO: 6215860 - DNA, 21 bp, Homo sapiens
gaaagtttttaattcatattt

SEQ ID NO: 6215861 - DNA, 11 bp, Homo sapiens
gaaagtttttt

SEQ ID NO: 6215862 - DNA, 18 bp, Homo sapiens
gaaagttttttcctccct

SEQ ID NO: 6215863 - DNA, 16 bp, Homo sapiens
gaaataaaaagatcct

SEQ ID NO: 6215864 - DNA, 23 bp, Homo sapiens
gaaataaaaagtatgttgtacat

SEQ ID NO: 6215865 - DNA, 13 bp, Homo sapiens
gaaataaaacagg

SEQ ID NO: 6215866 - DNA, 14 bp, Homo sapiens
gaaataaaaccttt

SEQ ID NO: 6215867 - DNA, 16 bp, Homo sapiens
gaaataaaacctttca

SEQ ID NO: 6215868 - DNA, 17 bp, Homo sapiens
gaaataaaagcctctgg

SEQ ID NO: 6215869 - DNA, 12 bp, Homo sapiens
gaaataaaagct

SEQ ID NO: 6215870 - DNA, 21 bp, Homo sapiens
gaaataaaatcaccctgactg

SEQ ID NO: 6215871 - DNA, 11 bp, Homo sapiens
gaaataaacac

SEQ ID NO: 6215872 - DNA, 16 bp, Homo sapiens
gaaataaacctgcact

SEQ ID NO: 6215873 - DNA, 18 bp, Homo sapiens
gaaataaacctggagatg

SEQ ID NO: 6215874 - DNA, 14 bp, Homo sapiens
gaaataaacgtctt

SEQ ID NO: 6215875 - DNA, 17 bp, Homo sapiens
gaaataaacgtcttaaa

SEQ ID NO: 6215876 - DNA, 21 bp, Homo sapiens
gaaataaacgtgcgcggactg

SEQ ID NO: 6215877 - DNA, 13 bp, Homo sapiens
gaaataaactagg

SEQ ID NO: 6215878 - DNA, 14 bp, Homo sapiens
gaaataaactgtgc

SEQ ID NO: 6215879 - DNA, 19 bp, Homo sapiens
gaaataaacttattcctcc

SEQ ID NO: 6215880 - DNA, 20 bp, Homo sapiens
gaaataaacttattcctcct

SEQ ID NO: 6215881 - DNA, 12 bp, Homo sapiens
gaaataaagaaa

SEQ ID NO: 6215882 - DNA, 13 bp, Homo sapiens
gaaataaagaaaa

SEQ ID NO: 6215883 - DNA, 20 bp, Homo sapiens
gaaataaagactcttggact

SEQ ID NO: 6215884 - DNA, 20 bp, Homo sapiens
gaaataaaggatgtgattgt

SEQ ID NO: 6215885 - DNA, 18 bp, Homo sapiens
gaaataaaggtaaaatca

SEQ ID NO: 6215886 - DNA, 20 bp, Homo sapiens
gaaataaagtaggaaagaat

SEQ ID NO: 6215887 - DNA, 19 bp, Homo sapiens
gaaataaagtcagatggaa

SEQ ID NO: 6215888 - DNA, 19 bp, Homo sapiens
gaaataaataaaaatgcat

SEQ ID NO: 6215889 - DNA, 17 bp, Homo sapiens
gaaataaatagatgtaa

SEQ ID NO: 6215890 - DNA, 15 bp, Homo sapiens
gaaataaatagctat

SEQ ID NO: 6215891 - DNA, 17 bp, Homo sapiens
gaaataaatagctatat

SEQ ID NO: 6215892 - DNA, 14 bp, Homo sapiens
gaaataaatcagag

SEQ ID NO: 6215893 - DNA, 21 bp, Homo sapiens
gaaataaatcagagagcaagg

SEQ ID NO: 6215894 - DNA, 12 bp, Homo sapiens
gaaataaatcta

SEQ ID NO: 6215895 - DNA, 12 bp, Homo sapiens
gaaataaatgaa

SEQ ID NO: 6215896 - DNA, 15 bp, Homo sapiens
gaaataaatgcccca

SEQ ID NO: 6215897 - DNA, 16 bp, Homo sapiens
gaaataaatgtttcaa

SEQ ID NO: 6215898 - DNA, 15 bp, Homo sapiens
gaaataaattcctaa

SEQ ID NO: 6215899 - DNA, 22 bp, Homo sapiens
gaaataaattggtgataagtgg

SEQ ID NO: 6215900 - DNA, 15 bp, Homo sapiens
gaaataacaaaatgg

SEQ ID NO: 6215901 - DNA, 16 bp, Homo sapiens
gaaataacaaaatgga

SEQ ID NO: 6215902 - DNA, 18 bp, Homo sapiens
gaaataacaaaatggaca

SEQ ID NO: 6215903 - DNA, 15 bp, Homo sapiens
gaaataacaatgtta

SEQ ID NO: 6215904 - DNA, 18 bp, Homo sapiens
gaaataacagaagaaaat

SEQ ID NO: 6215905 - DNA, 20 bp, Homo sapiens
gaaataacagccttaaatcc

SEQ ID NO: 6215906 - DNA, 15 bp, Homo sapiens
gaaataacattgcac

SEQ ID NO: 6215907 - DNA, 15 bp, Homo sapiens
gaaataagactttta

SEQ ID NO: 6215908 - DNA, 13 bp, Homo sapiens
gaaataagagcag

SEQ ID NO: 6215909 - DNA, 21 bp, Homo sapiens
gaaataagcaaaaaactgcat

SEQ ID NO: 6215910 - DNA, 18 bp, Homo sapiens
gaaataagctatttgatg

SEQ ID NO: 6215911 - DNA, 17 bp, Homo sapiens
gaaataaggctaaccat

SEQ ID NO: 6215912 - DNA, 20 bp, Homo sapiens
gaaataaggtataaggatct

SEQ ID NO: 6215913 - DNA, 20 bp, Homo sapiens
gaaataagtgccctctccca

SEQ ID NO: 6215914 - DNA, 11 bp, Homo sapiens
gaaataataaa

SEQ ID NO: 6215915 - DNA, 16 bp, Homo sapiens
gaaataataaaatgca

SEQ ID NO: 6215916 - DNA, 14 bp, Homo sapiens
gaaataataaatct

SEQ ID NO: 6215917 - DNA, 16 bp, Homo sapiens
gaaataataatatcca

SEQ ID NO: 6215918 - DNA, 16 bp, Homo sapiens
gaaataatagggaaaa

SEQ ID NO: 6215919 - DNA, 19 bp, Homo sapiens
gaaataatatatttcttct

SEQ ID NO: 6215920 - DNA, 17 bp, Homo sapiens
gaaataatcagtgactg

SEQ ID NO: 6215921 - DNA, 13 bp, Homo sapiens
gaaataatgcact

SEQ ID NO: 6215922 - DNA, 14 bp, Homo sapiens
gaaataatgctaca

SEQ ID NO: 6215923 - DNA, 23 bp, Homo sapiens
gaaataatgctacaattttaaga

SEQ ID NO: 6215924 - DNA, 13 bp, Homo sapiens
gaaataatgggaa

SEQ ID NO: 6215925 - DNA, 22 bp, Homo sapiens
gaaataatgtgtagttcatgta

SEQ ID NO: 6215926 - DNA, 19 bp, Homo sapiens
gaaataattacagaatata

SEQ ID NO: 6215927 - DNA, 16 bp, Homo sapiens
gaaataattacttttg

SEQ ID NO: 6215928 - DNA, 13 bp, Homo sapiens
gaaataattgttg

SEQ ID NO: 6215929 - DNA, 19 bp, Homo sapiens
gaaataattgttgattaat

SEQ ID NO: 6215930 - DNA, 15 bp, Homo sapiens
gaaataattgttgtt

SEQ ID NO: 6215931 - DNA, 17 bp, Homo sapiens
gaaataatttgaatgta

SEQ ID NO: 6215932 - DNA, 22 bp, Homo sapiens
gaaataatttgtgtctgtgttt

SEQ ID NO: 6215933 - DNA, 14 bp, Homo sapiens
gaaataatttttaa

SEQ ID NO: 6215934 - DNA, 11 bp, Homo sapiens
gaaatacaaaa

SEQ ID NO: 6215935 - DNA, 14 bp, Homo sapiens
gaaatacaaaaata

SEQ ID NO: 6215936 - DNA, 21 bp, Homo sapiens
gaaatacaattctacattgtc

SEQ ID NO: 6215937 - DNA, 19 bp, Homo sapiens
gaaatacacaagtaaacat

SEQ ID NO: 6215938 - DNA, 14 bp, Homo sapiens
gaaatacactacaa

SEQ ID NO: 6215939 - DNA, 19 bp, Homo sapiens
gaaatacagaagaaaataa

SEQ ID NO: 6215940 - DNA, 22 bp, Homo sapiens
gaaatacagataaatgattcaa

SEQ ID NO: 6215941 - DNA, 16 bp, Homo sapiens
gaaatacagtcttcca

SEQ ID NO: 6215942 - DNA, 18 bp, Homo sapiens
gaaatacatcatatgtta

SEQ ID NO: 6215943 - DNA, 17 bp, Homo sapiens
gaaatacatggacaata

SEQ ID NO: 6215944 - DNA, 14 bp, Homo sapiens
gaaatacatttaga

SEQ ID NO: 6215945 - DNA, 16 bp, Homo sapiens
gaaataccacaagcct

SEQ ID NO: 6215946 - DNA, 22 bp, Homo sapiens
gaaataccacaagcctgagaac

SEQ ID NO: 6215947 - DNA, 17 bp, Homo sapiens
gaaataccaggaccagt

SEQ ID NO: 6215948 - DNA, 19 bp, Homo sapiens
gaaataccaggaccagttt

SEQ ID NO: 6215949 - DNA, 20 bp, Homo sapiens
gaaataccaggaccagttta

SEQ ID NO: 6215950 - DNA, 14 bp, Homo sapiens
gaaatacccttctt

SEQ ID NO: 6215951 - DNA, 11 bp, Homo sapiens
gaaatacctca

SEQ ID NO: 6215952 - DNA, 14 bp, Homo sapiens
gaaatacctgtcta

SEQ ID NO: 6215953 - DNA, 19 bp, Homo sapiens
gaaataccttgagcagaat

SEQ ID NO: 6215954 - DNA, 19 bp, Homo sapiens
gaaatacgttaggaggaca

SEQ ID NO: 6215955 - DNA, 14 bp, Homo sapiens
gaaatacgtttgtg

SEQ ID NO: 6215956 - DNA, 20 bp, Homo sapiens
gaaatacgtttgtgtttcta

SEQ ID NO: 6215957 - DNA, 17 bp, Homo sapiens
gaaatactatatataca

SEQ ID NO: 6215958 - DNA, 13 bp, Homo sapiens
gaaatactcatgt

SEQ ID NO: 6215959 - DNA, 16 bp, Homo sapiens
gaaatactcgttttta

SEQ ID NO: 6215960 - DNA, 19 bp, Homo sapiens
gaaatactgagatgctggg

SEQ ID NO: 6215961 - DNA, 20 bp, Homo sapiens
gaaatactgagatgctgggc

SEQ ID NO: 6215962 - DNA, 18 bp, Homo sapiens
gaaatactgcaagaaaat

SEQ ID NO: 6215963 - DNA, 14 bp, Homo sapiens
gaaatactgctctg

SEQ ID NO: 6215964 - DNA, 16 bp, Homo sapiens
gaaatactgctctgaa

SEQ ID NO: 6215965 - DNA, 21 bp, Homo sapiens
gaaatactgtatggttttgtt

SEQ ID NO: 6215966 - DNA, 23 bp, Homo sapiens
gaaatactgtattgaatatttta

SEQ ID NO: 6215967 - DNA, 19 bp, Homo sapiens
gaaatacttcgatgatgat

SEQ ID NO: 6215968 - DNA, 23 bp, Homo sapiens
gaaatacttgaaaacttctcatt

SEQ ID NO: 6215969 - DNA, 21 bp, Homo sapiens
gaaatactttcgaaatttcat

SEQ ID NO: 6215970 - DNA, 12 bp, Homo sapiens
gaaatacttttc

SEQ ID NO: 6215971 - DNA, 12 bp, Homo sapiens
gaaatacttttt

SEQ ID NO: 6215972 - DNA, 21 bp, Homo sapiens
gaaatagaaaaaccctgcccc

SEQ ID NO: 6215973 - DNA, 15 bp, Homo sapiens
gaaatagaaaaggaa

SEQ ID NO: 6215974 - DNA, 17 bp, Homo sapiens
gaaatagaaagaagcca

SEQ ID NO: 6215975 - DNA, 20 bp, Homo sapiens
gaaatagaaatttccagaga

SEQ ID NO: 6215976 - DNA, 19 bp, Homo sapiens
gaaatagacaaaaagtata

SEQ ID NO: 6215977 - DNA, 12 bp, Homo sapiens
gaaatagacttt

SEQ ID NO: 6215978 - DNA, 18 bp, Homo sapiens
gaaatagatatcctctcc

SEQ ID NO: 6215979 - DNA, 15 bp, Homo sapiens
gaaatagcagagcct

SEQ ID NO: 6215980 - DNA, 21 bp, Homo sapiens
gaaatagcatgacaggctgtt

SEQ ID NO: 6215981 - DNA, 17 bp, Homo sapiens
gaaatagcggccctgga

SEQ ID NO: 6215982 - DNA, 20 bp, Homo sapiens
gaaatagcggccctggagga

SEQ ID NO: 6215983 - DNA, 20 bp, Homo sapiens
gaaatagctccgtggagcag

SEQ ID NO: 6215984 - DNA, 23 bp, Homo sapiens
gaaatagctggtttccaactctc

SEQ ID NO: 6215985 - DNA, 14 bp, Homo sapiens
gaaatagcttcagg

SEQ ID NO: 6215986 - DNA, 22 bp, Homo sapiens
gaaatagctttactgtttctca

SEQ ID NO: 6215987 - DNA, 20 bp, Homo sapiens
gaaataggagggaaaccttt

SEQ ID NO: 6215988 - DNA, 19 bp, Homo sapiens
gaaatagtaccttcaatac

SEQ ID NO: 6215989 - DNA, 18 bp, Homo sapiens
gaaatagtacttacaaat

SEQ ID NO: 6215990 - DNA, 17 bp, Homo sapiens
gaaatagtatacattgt

SEQ ID NO: 6215991 - DNA, 15 bp, Homo sapiens
gaaatagtctgtgtg

SEQ ID NO: 6215992 - DNA, 14 bp, Homo sapiens
gaaatagtgcactc

SEQ ID NO: 6215993 - DNA, 15 bp, Homo sapiens
gaaatagtgttcttt

SEQ ID NO: 6215994 - DNA, 20 bp, Homo sapiens
gaaatagttccattctatga

SEQ ID NO: 6215995 - DNA, 19 bp, Homo sapiens
gaaatagtttccaagaaat

SEQ ID NO: 6215996 - DNA, 16 bp, Homo sapiens
gaaatataaaaataat

SEQ ID NO: 6215997 - DNA, 16 bp, Homo sapiens
gaaatataaactgtga

SEQ ID NO: 6215998 - DNA, 17 bp, Homo sapiens
gaaatataaactgtgag

SEQ ID NO: 6215999 - DNA, 22 bp, Homo sapiens
gaaatataaactgtgagataaa

SEQ ID NO: 6216000 - DNA, 17 bp, Homo sapiens
gaaatataaattatctg

SEQ ID NO: 6216001 - DNA, 15 bp, Homo sapiens
gaaatataataaaat

SEQ ID NO: 6216002 - DNA, 13 bp, Homo sapiens
gaaatataattga

SEQ ID NO: 6216003 - DNA, 13 bp, Homo sapiens
gaaatatacagtt

SEQ ID NO: 6216004 - DNA, 18 bp, Homo sapiens
gaaatatacctacctctt

SEQ ID NO: 6216005 - DNA, 22 bp, Homo sapiens
gaaatataggatagacactgga

SEQ ID NO: 6216006 - DNA, 21 bp, Homo sapiens
gaaatatagggttttttttaa

SEQ ID NO: 6216007 - DNA, 14 bp, Homo sapiens
gaggcaaacagcaa

SEQ ID NO: 6216008 - DNA, 16 bp, Homo sapiens
gaggcaaaggcctgga

SEQ ID NO: 6216009 - DNA, 16 bp, Homo sapiens
gaggcaaattaactgt

SEQ ID NO: 6216010 - DNA, 14 bp, Homo sapiens
gaggcaacaggatt

SEQ ID NO: 6216011 - DNA, 22 bp, Homo sapiens
gaggcaacagggccatgtgctg

SEQ ID NO: 6216012 - DNA, 21 bp, Homo sapiens
gaggcaacagtgttctgagcc

SEQ ID NO: 6216013 - DNA, 20 bp, Homo sapiens
gaggcaaccccctcggagcc

SEQ ID NO: 6216014 - DNA, 13 bp, Homo sapiens
gaggcaagagaca

SEQ ID NO: 6216015 - DNA, 14 bp, Homo sapiens
gaggcaagagactg

SEQ ID NO: 6216016 - DNA, 16 bp, Homo sapiens
gaggcaagagggaggg

SEQ ID NO: 6216017 - DNA, 21 bp, Homo sapiens
gaggcaagagggaggggacag

SEQ ID NO: 6216018 - DNA, 23 bp, Homo sapiens
gaggcaagagggaggggacagag

SEQ ID NO: 6216019 - DNA, 13 bp, Homo sapiens
gaggcaaggatgg

SEQ ID NO: 6216020 - DNA, 23 bp, Homo sapiens
gaggcaaggcccagacctggcct

SEQ ID NO: 6216021 - DNA, 23 bp, Homo sapiens
gaggcaatgtcaggaacagaagg

SEQ ID NO: 6216022 - DNA, 23 bp, Homo sapiens
gaggcaattttaatcccctgcac

SEQ ID NO: 6216023 - DNA, 18 bp, Homo sapiens
gaggcacaaagggcaggc

SEQ ID NO: 6216024 - DNA, 20 bp, Homo sapiens
gaggcacaaagggcaggcct

SEQ ID NO: 6216025 - DNA, 15 bp, Homo sapiens
gaggcacactttctg

SEQ ID NO: 6216026 - DNA, 18 bp, Homo sapiens
gaggcacactttctggca

SEQ ID NO: 6216027 - DNA, 14 bp, Homo sapiens
gaggcacagcaaac

SEQ ID NO: 6216028 - DNA, 17 bp, Homo sapiens
gaggcacatgtcagcaa

SEQ ID NO: 6216029 - DNA, 23 bp, Homo sapiens
gaggcaccagctctgtggcctgt

SEQ ID NO: 6216030 - DNA, 16 bp, Homo sapiens
gaggcaccagtccagc

SEQ ID NO: 6216031 - DNA, 19 bp, Homo sapiens
gaggcaccagtccagcaaa

SEQ ID NO: 6216032 - DNA, 22 bp, Homo sapiens
gaggcaccatgcaaatgtcttc

SEQ ID NO: 6216033 - DNA, 18 bp, Homo sapiens
gaggcaccattcaggaac

SEQ ID NO: 6216034 - DNA, 21 bp, Homo sapiens
gaggcaccattcaggaacctg

SEQ ID NO: 6216035 - DNA, 16 bp, Homo sapiens
gaggcaccggcgctgc

SEQ ID NO: 6216036 - DNA, 14 bp, Homo sapiens
gaggcacctccagg

SEQ ID NO: 6216037 - DNA, 17 bp, Homo sapiens
gaggcacctccaggcag

SEQ ID NO: 6216038 - DNA, 19 bp, Homo sapiens
gaggcacctccaggcaggc

SEQ ID NO: 6216039 - DNA, 14 bp, Homo sapiens
gaggcacctgctgg

SEQ ID NO: 6216040 - DNA, 15 bp, Homo sapiens
gaggcacctgctgga

SEQ ID NO: 6216041 - DNA, 20 bp, Homo sapiens
gaggcacctggtggccatgc

SEQ ID NO: 6216042 - DNA, 15 bp, Homo sapiens
gaggcacgcaccact

SEQ ID NO: 6216043 - DNA, 21 bp, Homo sapiens
gaggcactagtcaccgacagc

SEQ ID NO: 6216044 - DNA, 14 bp, Homo sapiens
gaggcactcgctgt

SEQ ID NO: 6216045 - DNA, 12 bp, Homo sapiens
gaggcactgaag

SEQ ID NO: 6216046 - DNA, 15 bp, Homo sapiens
gaggcactgaagccc

SEQ ID NO: 6216047 - DNA, 13 bp, Homo sapiens
gaggcagaaagat

SEQ ID NO: 6216048 - DNA, 18 bp, Homo sapiens
gaggcagaaagcagaggc

SEQ ID NO: 6216049 - DNA, 23 bp, Homo sapiens
gaggcagaaccctggtgaggaag

SEQ ID NO: 6216050 - DNA, 22 bp, Homo sapiens
gaggcagaatggtgggctccag

SEQ ID NO: 6216051 - DNA, 12 bp, Homo sapiens
gaggcagacagc

SEQ ID NO: 6216052 - DNA, 21 bp, Homo sapiens
gaggcagacagcagctcaggc

SEQ ID NO: 6216053 - DNA, 19 bp, Homo sapiens
gaggcagagaaagaagaga

SEQ ID NO: 6216054 - DNA, 21 bp, Homo sapiens
gaggcagagaatctcttggga

SEQ ID NO: 6216055 - DNA, 14 bp, Homo sapiens
gaggcagagcggga

SEQ ID NO: 6216056 - DNA, 18 bp, Homo sapiens
gaggcagagcgggaggga

SEQ ID NO: 6216057 - DNA, 11 bp, Homo sapiens
gaggcagagga

SEQ ID NO: 6216058 - DNA, 18 bp, Homo sapiens
gaggcagaggcagacagg

SEQ ID NO: 6216059 - DNA, 12 bp, Homo sapiens
gaggcagagttt

SEQ ID NO: 6216060 - DNA, 17 bp, Homo sapiens
gaggcagatgcccttgc

SEQ ID NO: 6216061 - DNA, 18 bp, Homo sapiens
gaggcagatgcccttgct

SEQ ID NO: 6216062 - DNA, 18 bp, Homo sapiens
gaggcagcaacaggacca

SEQ ID NO: 6216063 - DNA, 14 bp, Homo sapiens
gaggcagcaggagc

SEQ ID NO: 6216064 - DNA, 13 bp, Homo sapiens
gaggcagcagtgt

SEQ ID NO: 6216065 - DNA, 14 bp, Homo sapiens
gaggcagccacagg

SEQ ID NO: 6216066 - DNA, 14 bp, Homo sapiens
gaggcagccagacc

SEQ ID NO: 6216067 - DNA, 12 bp, Homo sapiens
gaggcagcccag

SEQ ID NO: 6216068 - DNA, 22 bp, Homo sapiens
gaggcagccccattctgcctgc

SEQ ID NO: 6216069 - DNA, 20 bp, Homo sapiens
gaggcagcgcattgttttgc

SEQ ID NO: 6216070 - DNA, 23 bp, Homo sapiens
gaggcagcgtgaaagcagatgag

SEQ ID NO: 6216071 - DNA, 14 bp, Homo sapiens
gaggcagcgtgggc

SEQ ID NO: 6216072 - DNA, 18 bp, Homo sapiens
gaggcagcgtgggctctg

SEQ ID NO: 6216073 - DNA, 19 bp, Homo sapiens
gaggcagcgtgggctctgc

SEQ ID NO: 6216074 - DNA, 21 bp, Homo sapiens
gaggcagctccaacagcttga

SEQ ID NO: 6216075 - DNA, 19 bp, Homo sapiens
gaggcagcttcaagtgcct

SEQ ID NO: 6216076 - DNA, 19 bp, Homo sapiens
gaggcaggaatgggggtca

SEQ ID NO: 6216077 - DNA, 16 bp, Homo sapiens
gaggcaggagactggc

SEQ ID NO: 6216078 - DNA, 15 bp, Homo sapiens
gaggcaggagttgga

SEQ ID NO: 6216079 - DNA, 23 bp, Homo sapiens
gaggcaggatatccccagggaaa

SEQ ID NO: 6216080 - DNA, 24 bp, Homo sapiens
gaggcaggatatccccagggaaac

SEQ ID NO: 6216081 - DNA, 19 bp, Homo sapiens
gaggcaggcatggccctgg

SEQ ID NO: 6216082 - DNA, 22 bp, Homo sapiens
gaggcaggccgactgtactaaa

SEQ ID NO: 6216083 - DNA, 14 bp, Homo sapiens
gaggcaggctccag

SEQ ID NO: 6216084 - DNA, 17 bp, Homo sapiens
gaggcaggctccccctg

SEQ ID NO: 6216085 - DNA, 12 bp, Homo sapiens
gaggcaggctgg

SEQ ID NO: 6216086 - DNA, 14 bp, Homo sapiens
gaggcaggctggga

SEQ ID NO: 6216087 - DNA, 22 bp, Homo sapiens
gaggcagggaagtccccaggcc

SEQ ID NO: 6216088 - DNA, 23 bp, Homo sapiens
gaggcagggacaagtctttctcc

SEQ ID NO: 6216089 - DNA, 16 bp, Homo sapiens
gaggcagggaggcagc

SEQ ID NO: 6216090 - DNA, 17 bp, Homo sapiens
gaggcagggaggggact

SEQ ID NO: 6216091 - DNA, 19 bp, Homo sapiens
gaggcagggcaaatgacat

SEQ ID NO: 6216092 - DNA, 23 bp, Homo sapiens
gaggcagggcagcatggagacag

SEQ ID NO: 6216093 - DNA, 14 bp, Homo sapiens
gaggcagggcagcc

SEQ ID NO: 6216094 - DNA, 20 bp, Homo sapiens
gaggcagggccttgcccaga

SEQ ID NO: 6216095 - DNA, 17 bp, Homo sapiens
gaggcaggggagtctgc

SEQ ID NO: 6216096 - DNA, 21 bp, Homo sapiens
gaggcaggggagtctgcttgt

SEQ ID NO: 6216097 - DNA, 15 bp, Homo sapiens
gaggcaggggctctg

SEQ ID NO: 6216098 - DNA, 13 bp, Homo sapiens
gaggcaggggctg

SEQ ID NO: 6216099 - DNA, 15 bp, Homo sapiens
gaggcaggggctggg

SEQ ID NO: 6216100 - DNA, 18 bp, Homo sapiens
gaggcaggggctgggcag

SEQ ID NO: 6216101 - DNA, 16 bp, Homo sapiens
gaggcaggggcttcct

SEQ ID NO: 6216102 - DNA, 21 bp, Homo sapiens
gaggcaggggcttcctggtgc

SEQ ID NO: 6216103 - DNA, 23 bp, Homo sapiens
gaggcaggggcttcctggtgctg

SEQ ID NO: 6216104 - DNA, 17 bp, Homo sapiens
gaggcaggggtcctgca

SEQ ID NO: 6216105 - DNA, 23 bp, Homo sapiens
gaggcaggggtcctgcaggtcct

SEQ ID NO: 6216106 - DNA, 22 bp, Homo sapiens
gaggcaggtcccgagccccctg

SEQ ID NO: 6216107 - DNA, 20 bp, Homo sapiens
gaggcaggtggatcatgagg

SEQ ID NO: 6216108 - DNA, 22 bp, Homo sapiens
gaggcagtacctgggcaagctg

SEQ ID NO: 6216109 - DNA, 13 bp, Homo sapiens
gaggcagtaggaa

SEQ ID NO: 6216110 - DNA, 13 bp, Homo sapiens
gaggcagtggcag

SEQ ID NO: 6216111 - DNA, 14 bp, Homo sapiens
gaggcagtgggtcc

SEQ ID NO: 6216112 - DNA, 22 bp, Homo sapiens
gaggcagtgtggttatgttccc

SEQ ID NO: 6216113 - DNA, 22 bp, Homo sapiens
gaggcagttgacggggcagtca

SEQ ID NO: 6216114 - DNA, 15 bp, Homo sapiens
gaggcagtttgagga

SEQ ID NO: 6216115 - DNA, 16 bp, Homo sapiens
gaggcagtttgaggat

SEQ ID NO: 6216116 - DNA, 20 bp, Homo sapiens
gaggcagtttttgttccttc

SEQ ID NO: 6216117 - DNA, 14 bp, Homo sapiens
gaggcataaagact

SEQ ID NO: 6216118 - DNA, 19 bp, Homo sapiens
gaggcatacacacagcagt

SEQ ID NO: 6216119 - DNA, 18 bp, Homo sapiens
gaggcatccagcagtctc

SEQ ID NO: 6216120 - DNA, 19 bp, Homo sapiens
gaggcatcctacccttttc

SEQ ID NO: 6216121 - DNA, 17 bp, Homo sapiens
gaggcatcctctgactc

SEQ ID NO: 6216122 - DNA, 15 bp, Homo sapiens
gaggcatcctgcctg

SEQ ID NO: 6216123 - DNA, 18 bp, Homo sapiens
gaggcatcctgcctgggt

SEQ ID NO: 6216124 - DNA, 22 bp, Homo sapiens
gaggcatcctgcctgggtggga

SEQ ID NO: 6216125 - DNA, 16 bp, Homo sapiens
gaggcatctctctggg

SEQ ID NO: 6216126 - DNA, 15 bp, Homo sapiens
gaggcatctgcatgg

SEQ ID NO: 6216127 - DNA, 17 bp, Homo sapiens
gaggcatggccctgggg

SEQ ID NO: 6216128 - DNA, 15 bp, Homo sapiens
gaggcatggctgggg

SEQ ID NO: 6216129 - DNA, 20 bp, Homo sapiens
gaggcatgtgatgagaggaa

SEQ ID NO: 6216130 - DNA, 17 bp, Homo sapiens
gaggcatgtgatgtgca

SEQ ID NO: 6216131 - DNA, 22 bp, Homo sapiens
gaggcattcccagaggtgggga

SEQ ID NO: 6216132 - DNA, 14 bp, Homo sapiens
gaggcattcgggga

SEQ ID NO: 6216133 - DNA, 23 bp, Homo sapiens
gaggcattgttagtttagtgtgt

SEQ ID NO: 6216134 - DNA, 18 bp, Homo sapiens
gaggcatttgagcagctg

SEQ ID NO: 6216135 - DNA, 21 bp, Homo sapiens
gaggcatttgtttgaactgat

SEQ ID NO: 6216136 - DNA, 15 bp, Homo sapiens
gaggcattttactat

SEQ ID NO: 6216137 - DNA, 20 bp, Homo sapiens
gaggcattttactatgcctg

SEQ ID NO: 6216138 - DNA, 18 bp, Homo sapiens
gaggccaaacaggccctc

SEQ ID NO: 6216139 - DNA, 14 bp, Homo sapiens
gaggccaaatgagt

SEQ ID NO: 6216140 - DNA, 18 bp, Homo sapiens
gaggccaacactgtgggt

SEQ ID NO: 6216141 - DNA, 16 bp, Homo sapiens
gaggccaaccagcccg

SEQ ID NO: 6216142 - DNA, 17 bp, Homo sapiens
gaggccaagagtggccc

SEQ ID NO: 6216143 - DNA, 19 bp, Homo sapiens
gaggccaagagtggcccca

SEQ ID NO: 6216144 - DNA, 22 bp, Homo sapiens
gaggccaagagtggccccacct

SEQ ID NO: 6216145 - DNA, 15 bp, Homo sapiens
gaggccaaggactga

SEQ ID NO: 6216146 - DNA, 23 bp, Homo sapiens
gaggccaaggactgactttgcca

SEQ ID NO: 6216147 - DNA, 14 bp, Homo sapiens
gaggccaaggcagg

SEQ ID NO: 6216148 - DNA, 13 bp, Homo sapiens
gaggccaaggtgg

SEQ ID NO: 6216149 - DNA, 22 bp, Homo sapiens
gaggccaaggtgggaggattgc

SEQ ID NO: 6216150 - DNA, 17 bp, Homo sapiens
gaggccaaggtgggcgg

SEQ ID NO: 6216151 - DNA, 18 bp, Homo sapiens
gaggccaaggtgggcgga

SEQ ID NO: 6216152 - DNA, 20 bp, Homo sapiens
gaggccacacgcactggtgc

SEQ ID NO: 6216153 - DNA, 18 bp, Homo sapiens
gaggccacactcagcaca

SEQ ID NO: 6216154 - DNA, 22 bp, Homo sapiens
gaggccaccccaaaccccagcc

SEQ ID NO: 6216155 - DNA, 13 bp, Homo sapiens
gaggccaccggga

SEQ ID NO: 6216156 - DNA, 21 bp, Homo sapiens
gaggccaccgggacagacctg

SEQ ID NO: 6216157 - DNA, 15 bp, Homo sapiens
gaggccacctctcca

SEQ ID NO: 6216158 - DNA, 18 bp, Homo sapiens
gaggccacctctccaagg

SEQ ID NO: 6216159 - DNA, 22 bp, Homo sapiens
gaggccacggagcgggaggcag

SEQ ID NO: 6216160 - DNA, 18 bp, Homo sapiens
gaggccactcagaggccc

SEQ ID NO: 6216161 - DNA, 16 bp, Homo sapiens
gaggccacttagggaa

SEQ ID NO: 6216162 - DNA, 21 bp, Homo sapiens
gaggccagaaaggtgtgagga

SEQ ID NO: 6216163 - DNA, 18 bp, Homo sapiens
gaggccagacacaggccg

SEQ ID NO: 6216164 - DNA, 18 bp, Homo sapiens
gaggccagaccatggaca

SEQ ID NO: 6216165 - DNA, 14 bp, Homo sapiens
gaggccagagacac

SEQ ID NO: 6216166 - DNA, 19 bp, Homo sapiens
gaggccagagacacaagcc

SEQ ID NO: 6216167 - DNA, 13 bp, Homo sapiens
gaggccagaggaa

SEQ ID NO: 6216168 - DNA, 14 bp, Homo sapiens
gaggccagaggaag

SEQ ID NO: 6216169 - DNA, 16 bp, Homo sapiens
gaggccagaggaaggg

SEQ ID NO: 6216170 - DNA, 11 bp, Homo sapiens
gaggccagagt

SEQ ID NO: 6216171 - DNA, 22 bp, Homo sapiens
gaggccagagtctcccagtggg

SEQ ID NO: 6216172 - DNA, 13 bp, Homo sapiens
gaggccagcccca

SEQ ID NO: 6216173 - DNA, 20 bp, Homo sapiens
gaggccagccccacccagga

SEQ ID NO: 6216174 - DNA, 22 bp, Homo sapiens
gaggccagccccacccaggagg

SEQ ID NO: 6216175 - DNA, 23 bp, Homo sapiens
gaggccagcctgcgggaagctga

SEQ ID NO: 6216176 - DNA, 14 bp, Homo sapiens
gaggccagcctggc

SEQ ID NO: 6216177 - DNA, 19 bp, Homo sapiens
gaggccagcctggcctcct

SEQ ID NO: 6216178 - DNA, 12 bp, Homo sapiens
gaggccagcctt

SEQ ID NO: 6216179 - DNA, 13 bp, Homo sapiens
gaggccagccttg

SEQ ID NO: 6216180 - DNA, 11 bp, Homo sapiens
gaggccagcta

SEQ ID NO: 6216181 - DNA, 21 bp, Homo sapiens
gaggccagctatctgcctgac

SEQ ID NO: 6216182 - DNA, 18 bp, Homo sapiens
gaggccaggaatctgcca

SEQ ID NO: 6216183 - DNA, 19 bp, Homo sapiens
gaggccaggatgcctgagc

SEQ ID NO: 6216184 - DNA, 19 bp, Homo sapiens
gaggccaggcatggcccag

SEQ ID NO: 6216185 - DNA, 16 bp, Homo sapiens
gaaatatagttctgat

SEQ ID NO: 6216186 - DNA, 16 bp, Homo sapiens
gaaatatatacgaaca

SEQ ID NO: 6216187 - DNA, 20 bp, Homo sapiens
gaaatatatacgaacaaaac

SEQ ID NO: 6216188 - DNA, 11 bp, Homo sapiens
gaaatatatat

SEQ ID NO: 6216189 - DNA, 15 bp, Homo sapiens
gaaatatatatacat

SEQ ID NO: 6216190 - DNA, 19 bp, Homo sapiens
gaaatatatatacatatgt

SEQ ID NO: 6216191 - DNA, 14 bp, Homo sapiens
gaaatatatatgtg

SEQ ID NO: 6216192 - DNA, 17 bp, Homo sapiens
gaaatatatatgtgtgt

SEQ ID NO: 6216193 - DNA, 13 bp, Homo sapiens
gaaatatatatta

SEQ ID NO: 6216194 - DNA, 16 bp, Homo sapiens
gaaatatatcctgtgt

SEQ ID NO: 6216195 - DNA, 20 bp, Homo sapiens
gaaatatatctgtgatttta

SEQ ID NO: 6216196 - DNA, 24 bp, Homo sapiens
gaaatatatggtctaatgtttaag

SEQ ID NO: 6216197 - DNA, 21 bp, Homo sapiens
gaaatatattatgaaaattaa

SEQ ID NO: 6216198 - DNA, 12 bp, Homo sapiens
gaaatatatttg

SEQ ID NO: 6216199 - DNA, 15 bp, Homo sapiens
gaaatatatttgtaa

SEQ ID NO: 6216200 - DNA, 23 bp, Homo sapiens
gaaatatattttaccatacattt

SEQ ID NO: 6216201 - DNA, 23 bp, Homo sapiens
gaaatatcaaagtcattaaagac

SEQ ID NO: 6216202 - DNA, 15 bp, Homo sapiens
gaaatatcatcacgt

SEQ ID NO: 6216203 - DNA, 21 bp, Homo sapiens
gaaatatcatcacgtatgtta

SEQ ID NO: 6216204 - DNA, 13 bp, Homo sapiens
gaaatatcattta

SEQ ID NO: 6216205 - DNA, 14 bp, Homo sapiens
gaaatatcatttat

SEQ ID NO: 6216206 - DNA, 13 bp, Homo sapiens
gaaatatccagga

SEQ ID NO: 6216207 - DNA, 18 bp, Homo sapiens
gaaatatcccgggggtgg

SEQ ID NO: 6216208 - DNA, 18 bp, Homo sapiens
gaaatatccctcatttca

SEQ ID NO: 6216209 - DNA, 18 bp, Homo sapiens
gaaatatccttttagaag

SEQ ID NO: 6216210 - DNA, 19 bp, Homo sapiens
gaaatatctgaaaatgtat

SEQ ID NO: 6216211 - DNA, 21 bp, Homo sapiens
gaaatatctgaaaatgtatgt

SEQ ID NO: 6216212 - DNA, 15 bp, Homo sapiens
gaaatatctgtgaaa

SEQ ID NO: 6216213 - DNA, 21 bp, Homo sapiens
gaaatatctgtgaaatatcat

SEQ ID NO: 6216214 - DNA, 19 bp, Homo sapiens
gaaatatgaaattccagca

SEQ ID NO: 6216215 - DNA, 17 bp, Homo sapiens
gaaatatgcaacctgtg

SEQ ID NO: 6216216 - DNA, 12 bp, Homo sapiens
gaaatatgcata

SEQ ID NO: 6216217 - DNA, 14 bp, Homo sapiens
gaaatatgcatgta

SEQ ID NO: 6216218 - DNA, 17 bp, Homo sapiens
gaaatatgcatgtactt

SEQ ID NO: 6216219 - DNA, 18 bp, Homo sapiens
gaaatatgcatgtacttt

SEQ ID NO: 6216220 - DNA, 14 bp, Homo sapiens
gaaatatgctcttt

SEQ ID NO: 6216221 - DNA, 13 bp, Homo sapiens
gaaatatgtataa

SEQ ID NO: 6216222 - DNA, 10 bp, Homo sapiens
gaaatattaa

SEQ ID NO: 6216223 - DNA, 13 bp, Homo sapiens
gaaatattaaaat

SEQ ID NO: 6216224 - DNA, 19 bp, Homo sapiens
gaaatattaagaacatttt

SEQ ID NO: 6216225 - DNA, 20 bp, Homo sapiens
gaaatattaagaacatttta

SEQ ID NO: 6216226 - DNA, 23 bp, Homo sapiens
gaaatattaagagctattttaga

SEQ ID NO: 6216227 - DNA, 17 bp, Homo sapiens
gaaatattatgcaaatt

SEQ ID NO: 6216228 - DNA, 18 bp, Homo sapiens
gaaatattatgcaaattc

SEQ ID NO: 6216229 - DNA, 21 bp, Homo sapiens
gaaatattatgcaaattccca

SEQ ID NO: 6216230 - DNA, 23 bp, Homo sapiens
gaaatattatgcaaattcccaga

SEQ ID NO: 6216231 - DNA, 17 bp, Homo sapiens
gaaatattcacaaggtt

SEQ ID NO: 6216232 - DNA, 16 bp, Homo sapiens
gaaatattcagaaatt

SEQ ID NO: 6216233 - DNA, 18 bp, Homo sapiens
gaaatattcttattactc

SEQ ID NO: 6216234 - DNA, 21 bp, Homo sapiens
gaaatattgactcaaaccata

SEQ ID NO: 6216235 - DNA, 16 bp, Homo sapiens
gaaatattgctggggt

SEQ ID NO: 6216236 - DNA, 14 bp, Homo sapiens
gaaatattgctgta

SEQ ID NO: 6216237 - DNA, 22 bp, Homo sapiens
gaaatatttaagtatatagtat

SEQ ID NO: 6216238 - DNA, 13 bp, Homo sapiens
gaaatatttattt

SEQ ID NO: 6216239 - DNA, 19 bp, Homo sapiens
gaaatatttccattaacag

SEQ ID NO: 6216240 - DNA, 21 bp, Homo sapiens
gaaatatttgcgtaaatggtt

SEQ ID NO: 6216241 - DNA, 15 bp, Homo sapiens
gaaatatttgcttat

SEQ ID NO: 6216242 - DNA, 21 bp, Homo sapiens
gaaatatttgcttatttatat

SEQ ID NO: 6216243 - DNA, 21 bp, Homo sapiens
gaaatattttgataataaatt

SEQ ID NO: 6216244 - DNA, 13 bp, Homo sapiens
gaaatatttttca

SEQ ID NO: 6216245 - DNA, 19 bp, Homo sapiens
gaaatcaaagagagaaaat

SEQ ID NO: 6216246 - DNA, 16 bp, Homo sapiens
gaaatcaaagtgctat

SEQ ID NO: 6216247 - DNA, 17 bp, Homo sapiens
gaaatcaaagtgctatt

SEQ ID NO: 6216248 - DNA, 18 bp, Homo sapiens
gaaatcaaatatgcaaag

SEQ ID NO: 6216249 - DNA, 13 bp, Homo sapiens
gaaatcaaatgta

SEQ ID NO: 6216250 - DNA, 16 bp, Homo sapiens
gaaatcaaatgtaaag

SEQ ID NO: 6216251 - DNA, 17 bp, Homo sapiens
gaaatcaaatgtaaagt

SEQ ID NO: 6216252 - DNA, 15 bp, Homo sapiens
gaaatcaacttgctt

SEQ ID NO: 6216253 - DNA, 14 bp, Homo sapiens
gaaatcaacttgtg

SEQ ID NO: 6216254 - DNA, 20 bp, Homo sapiens
gaaatcaaggtgaaggatct

SEQ ID NO: 6216255 - DNA, 23 bp, Homo sapiens
gaaatcaataatttgtggtgatt

SEQ ID NO: 6216256 - DNA, 20 bp, Homo sapiens
gaaatcaatcagaaggtatt

SEQ ID NO: 6216257 - DNA, 21 bp, Homo sapiens
gaaatcaatcctgttaagaga

SEQ ID NO: 6216258 - DNA, 17 bp, Homo sapiens
gaaatcacaggggcggg

SEQ ID NO: 6216259 - DNA, 18 bp, Homo sapiens
gaaatcaccttttctaaa

SEQ ID NO: 6216260 - DNA, 19 bp, Homo sapiens
gaaatcaccttttctaaaa

SEQ ID NO: 6216261 - DNA, 22 bp, Homo sapiens
gaaatcagcatgacaaaaataa

SEQ ID NO: 6216262 - DNA, 20 bp, Homo sapiens
gaaatcagccaagttttata

SEQ ID NO: 6216263 - DNA, 18 bp, Homo sapiens
gaaatcagcccccagcct

SEQ ID NO: 6216264 - DNA, 19 bp, Homo sapiens
gaaatcagcccccagcctt

SEQ ID NO: 6216265 - DNA, 13 bp, Homo sapiens
gaaatcaggcctg

SEQ ID NO: 6216266 - DNA, 18 bp, Homo sapiens
gaaatcagtaatatttat

SEQ ID NO: 6216267 - DNA, 20 bp, Homo sapiens
gaaatcagtaatatttatat

SEQ ID NO: 6216268 - DNA, 16 bp, Homo sapiens
gaaatcagtgccccag

SEQ ID NO: 6216269 - DNA, 17 bp, Homo sapiens
gaaatcagttgtgaata

SEQ ID NO: 6216270 - DNA, 16 bp, Homo sapiens
gaaatcagttgtgttt

SEQ ID NO: 6216271 - DNA, 22 bp, Homo sapiens
gaaatcatatttggaataaaaa

SEQ ID NO: 6216272 - DNA, 17 bp, Homo sapiens
gaaatcatcaaaaagaa

SEQ ID NO: 6216273 - DNA, 20 bp, Homo sapiens
gaaatcatcctgttttctct

SEQ ID NO: 6216274 - DNA, 14 bp, Homo sapiens
gaaatcatgtgcat

SEQ ID NO: 6216275 - DNA, 11 bp, Homo sapiens
gaaatcatgtt

SEQ ID NO: 6216276 - DNA, 12 bp, Homo sapiens
gaaatcatgtta

SEQ ID NO: 6216277 - DNA, 14 bp, Homo sapiens
gaaatcatgttatg

SEQ ID NO: 6216278 - DNA, 20 bp, Homo sapiens
gaaatcattgtgtgtcttca

SEQ ID NO: 6216279 - DNA, 23 bp, Homo sapiens
gaaatcattgttataaagacaca

SEQ ID NO: 6216280 - DNA, 14 bp, Homo sapiens
gaaatccaaaatag

SEQ ID NO: 6216281 - DNA, 20 bp, Homo sapiens
gaaatccaaactactttctt

SEQ ID NO: 6216282 - DNA, 15 bp, Homo sapiens
gaaatccaaatttct

SEQ ID NO: 6216283 - DNA, 17 bp, Homo sapiens
gaaatccaaatttctca

SEQ ID NO: 6216284 - DNA, 18 bp, Homo sapiens
gaaatccaaatttctcat

SEQ ID NO: 6216285 - DNA, 14 bp, Homo sapiens
gaaatccaatcaga

SEQ ID NO: 6216286 - DNA, 12 bp, Homo sapiens
gaaatccagatc

SEQ ID NO: 6216287 - DNA, 24 bp, Homo sapiens
gaaatccagccccatagaaaacaa

SEQ ID NO: 6216288 - DNA, 15 bp, Homo sapiens
gaaatccaggtctcg

SEQ ID NO: 6216289 - DNA, 21 bp, Homo sapiens
gaaatccatactgtagacact

SEQ ID NO: 6216290 - DNA, 21 bp, Homo sapiens
gaaatccattgtttaaagatg

SEQ ID NO: 6216291 - DNA, 18 bp, Homo sapiens
gaaatcccatctctacaa

SEQ ID NO: 6216292 - DNA, 18 bp, Homo sapiens
gaaatccccctttctcta

SEQ ID NO: 6216293 - DNA, 22 bp, Homo sapiens
gaaatcccctaactgatttcca

SEQ ID NO: 6216294 - DNA, 15 bp, Homo sapiens
gaaatccctgctcac

SEQ ID NO: 6216295 - DNA, 19 bp, Homo sapiens
gaaatccctgtttaatatt

SEQ ID NO: 6216296 - DNA, 19 bp, Homo sapiens
gaaatcccttcatacttga

SEQ ID NO: 6216297 - DNA, 20 bp, Homo sapiens
gaaatcccttcatacttgaa

SEQ ID NO: 6216298 - DNA, 17 bp, Homo sapiens
gaaatccctttctgcta

SEQ ID NO: 6216299 - DNA, 17 bp, Homo sapiens
gaaatccggagaagctg

SEQ ID NO: 6216300 - DNA, 20 bp, Homo sapiens
gaaatcctagtttcctctcc

SEQ ID NO: 6216301 - DNA, 23 bp, Homo sapiens
gaaatcctagtttcctctccttc

SEQ ID NO: 6216302 - DNA, 14 bp, Homo sapiens
gaaatcctggttcc

SEQ ID NO: 6216303 - DNA, 19 bp, Homo sapiens
gaaatcctggtttgtaatg

SEQ ID NO: 6216304 - DNA, 23 bp, Homo sapiens
gaaatcgctgctcaaaaatgatt

SEQ ID NO: 6216305 - DNA, 17 bp, Homo sapiens
gaaatctaaatttcttt

SEQ ID NO: 6216306 - DNA, 22 bp, Homo sapiens
gaaatctaaatttcttttgcta

SEQ ID NO: 6216307 - DNA, 22 bp, Homo sapiens
gaaatctactgaattggcttcc

SEQ ID NO: 6216308 - DNA, 18 bp, Homo sapiens
gaaatctaggaaaattat

SEQ ID NO: 6216309 - DNA, 18 bp, Homo sapiens
gaaatctatgattccagg

SEQ ID NO: 6216310 - DNA, 20 bp, Homo sapiens
gaaatctcagattcttcact

SEQ ID NO: 6216311 - DNA, 20 bp, Homo sapiens
gaaatctcctttagccatca

SEQ ID NO: 6216312 - DNA, 20 bp, Homo sapiens
gaaatctgaaaaatggccat

SEQ ID NO: 6216313 - DNA, 14 bp, Homo sapiens
gaaatctggcccag

SEQ ID NO: 6216314 - DNA, 13 bp, Homo sapiens
gaaatctgtcttt

SEQ ID NO: 6216315 - DNA, 15 bp, Homo sapiens
gaaatctgtctttgc

SEQ ID NO: 6216316 - DNA, 21 bp, Homo sapiens
gaaatctgtgcaataaaataa

SEQ ID NO: 6216317 - DNA, 20 bp, Homo sapiens
gaaatctgtgcctgagaaca

SEQ ID NO: 6216318 - DNA, 14 bp, Homo sapiens
gaaatcttaaaaac

SEQ ID NO: 6216319 - DNA, 18 bp, Homo sapiens
gaaatcttaagtcataat

SEQ ID NO: 6216320 - DNA, 12 bp, Homo sapiens
gaaatctttaaa

SEQ ID NO: 6216321 - DNA, 22 bp, Homo sapiens
gaaatctttcaacttatttctg

SEQ ID NO: 6216322 - DNA, 13 bp, Homo sapiens
gaaatctttctgg

SEQ ID NO: 6216323 - DNA, 18 bp, Homo sapiens
gaaatgaaaaaaaaaaac

SEQ ID NO: 6216324 - DNA, 19 bp, Homo sapiens
gaaatgaaaacatgtaata

SEQ ID NO: 6216325 - DNA, 22 bp, Homo sapiens
gaaatgaaaatggctgaagaaa

SEQ ID NO: 6216326 - DNA, 13 bp, Homo sapiens
gaaatgaaagaaa

SEQ ID NO: 6216327 - DNA, 17 bp, Homo sapiens
gaaatgaaagcagggac

SEQ ID NO: 6216328 - DNA, 19 bp, Homo sapiens
gaaatgaaattttaccaag

SEQ ID NO: 6216329 - DNA, 17 bp, Homo sapiens
gaaatgaacacaaatta

SEQ ID NO: 6216330 - DNA, 12 bp, Homo sapiens
gaaatgaacatt

SEQ ID NO: 6216331 - DNA, 14 bp, Homo sapiens
gaaatgaacattcc

SEQ ID NO: 6216332 - DNA, 13 bp, Homo sapiens
gaaatgaagagct

SEQ ID NO: 6216333 - DNA, 24 bp, Homo sapiens
gaaatgaataagctttctctcaga

SEQ ID NO: 6216334 - DNA, 14 bp, Homo sapiens
gaaatgaataattt

SEQ ID NO: 6216335 - DNA, 18 bp, Homo sapiens
gaaatgaataatttccca

SEQ ID NO: 6216336 - DNA, 12 bp, Homo sapiens
gaaatgaatata

SEQ ID NO: 6216337 - DNA, 20 bp, Homo sapiens
gaaatgaatgtgtgtggttt

SEQ ID NO: 6216338 - DNA, 15 bp, Homo sapiens
gaaatgaattaaagt

SEQ ID NO: 6216339 - DNA, 22 bp, Homo sapiens
gaaatgaatttatctgaatata

SEQ ID NO: 6216340 - DNA, 15 bp, Homo sapiens
gaaatgacccaaaca

SEQ ID NO: 6216341 - DNA, 12 bp, Homo sapiens
gaaatgagaaat

SEQ ID NO: 6216342 - DNA, 14 bp, Homo sapiens
gaaatgagaaattg

SEQ ID NO: 6216343 - DNA, 15 bp, Homo sapiens
gaaatgagaaggcag

SEQ ID NO: 6216344 - DNA, 20 bp, Homo sapiens
gaaatgagaggcatttcccc

SEQ ID NO: 6216345 - DNA, 19 bp, Homo sapiens
gaaatgagatcccagagtt

SEQ ID NO: 6216346 - DNA, 21 bp, Homo sapiens
gaaatgagcatgcattttctt

SEQ ID NO: 6216347 - DNA, 11 bp, Homo sapiens
gaaatgagctg

SEQ ID NO: 6216348 - DNA, 14 bp, Homo sapiens
gaaatgaggaagaa

SEQ ID NO: 6216349 - DNA, 13 bp, Homo sapiens
gaaatgagtctgt

SEQ ID NO: 6216350 - DNA, 15 bp, Homo sapiens
gaaatgataaagact

SEQ ID NO: 6216351 - DNA, 16 bp, Homo sapiens
gaaatgataaagactt

SEQ ID NO: 6216352 - DNA, 16 bp, Homo sapiens
gaaatgatagatttga

SEQ ID NO: 6216353 - DNA, 18 bp, Homo sapiens
gaaatgatggaatttttc

SEQ ID NO: 6216354 - DNA, 21 bp, Homo sapiens
gaaatgatgttggtccaaagt

SEQ ID NO: 6216355 - DNA, 20 bp, Homo sapiens
gaaatgattcaaattgctgc

SEQ ID NO: 6216356 - DNA, 21 bp, Homo sapiens
gaaatgattcaaattgctgct

SEQ ID NO: 6216357 - DNA, 23 bp, Homo sapiens
gaaatgattcaaattgctgcttg

SEQ ID NO: 6216358 - DNA, 14 bp, Homo sapiens
gaaatgattcaggg

SEQ ID NO: 6216359 - DNA, 15 bp, Homo sapiens
gaaatgattcagggt

SEQ ID NO: 6216360 - DNA, 17 bp, Homo sapiens
gaaatgattgagagcag

SEQ ID NO: 6216361 - DNA, 19 bp, Homo sapiens
gaaatgattggtaggaaat

SEQ ID NO: 6216362 - DNA, 17 bp, Homo sapiens
gaaatgcacaatgtctt

SEQ ID NO: 6216363 - DNA, 17 bp, Homo sapiens
gaaatgcactaagacaa

SEQ ID NO: 6216364 - DNA, 11 bp, Homo sapiens
gaggccaggcc

SEQ ID NO: 6216365 - DNA, 18 bp, Homo sapiens
gaggccaggccctcctgc

SEQ ID NO: 6216366 - DNA, 20 bp, Homo sapiens
gaggccaggccctcctgctg

SEQ ID NO: 6216367 - DNA, 11 bp, Homo sapiens
gaggccaggcg

SEQ ID NO: 6216368 - DNA, 18 bp, Homo sapiens
gaggccaggcgagcctga

SEQ ID NO: 6216369 - DNA, 19 bp, Homo sapiens
gaggccaggctagaatgga

SEQ ID NO: 6216370 - DNA, 12 bp, Homo sapiens
gaggccagggat

SEQ ID NO: 6216371 - DNA, 15 bp, Homo sapiens
gaggccagggcagca

SEQ ID NO: 6216372 - DNA, 17 bp, Homo sapiens
gaggccagtacctttcc

SEQ ID NO: 6216373 - DNA, 17 bp, Homo sapiens
gaggccagtactttgcc

SEQ ID NO: 6216374 - DNA, 15 bp, Homo sapiens
gaggccagtgagcca

SEQ ID NO: 6216375 - DNA, 17 bp, Homo sapiens
gaggccatcagggccct

SEQ ID NO: 6216376 - DNA, 15 bp, Homo sapiens
gaggccatctcagga

SEQ ID NO: 6216377 - DNA, 16 bp, Homo sapiens
gaggccatctcaggag

SEQ ID NO: 6216378 - DNA, 18 bp, Homo sapiens
gaggccatctcaggagat

SEQ ID NO: 6216379 - DNA, 22 bp, Homo sapiens
gaggccatggactctgtcctga

SEQ ID NO: 6216380 - DNA, 20 bp, Homo sapiens
gaggccatgggcctcctgtg

SEQ ID NO: 6216381 - DNA, 13 bp, Homo sapiens
gaggccatggggg

SEQ ID NO: 6216382 - DNA, 16 bp, Homo sapiens
gaggccatttgctgcc

SEQ ID NO: 6216383 - DNA, 18 bp, Homo sapiens
gaggccatttgctgccct

SEQ ID NO: 6216384 - DNA, 15 bp, Homo sapiens
gaggcccaaggagct

SEQ ID NO: 6216385 - DNA, 21 bp, Homo sapiens
gaggcccaaggagcttaccca

SEQ ID NO: 6216386 - DNA, 12 bp, Homo sapiens
gaggcccagaga

SEQ ID NO: 6216387 - DNA, 19 bp, Homo sapiens
gaggcccagagggcctgca

SEQ ID NO: 6216388 - DNA, 19 bp, Homo sapiens
gaggcccagatccaaggcc

SEQ ID NO: 6216389 - DNA, 20 bp, Homo sapiens
gaggcccagcagagccgttc

SEQ ID NO: 6216390 - DNA, 18 bp, Homo sapiens
gaggcccagcctgtcctg

SEQ ID NO: 6216391 - DNA, 15 bp, Homo sapiens
gaggcccagcgggca

SEQ ID NO: 6216392 - DNA, 18 bp, Homo sapiens
gaggcccagcgggcagat

SEQ ID NO: 6216393 - DNA, 12 bp, Homo sapiens
gaggcccaggca

SEQ ID NO: 6216394 - DNA, 13 bp, Homo sapiens
gaggcccaggcac

SEQ ID NO: 6216395 - DNA, 14 bp, Homo sapiens
gaggcccaggcacc

SEQ ID NO: 6216396 - DNA, 17 bp, Homo sapiens
gaggcccaggcaccacc

SEQ ID NO: 6216397 - DNA, 13 bp, Homo sapiens
gaggcccaggctg

SEQ ID NO: 6216398 - DNA, 16 bp, Homo sapiens
gaggcccaggctggga

SEQ ID NO: 6216399 - DNA, 13 bp, Homo sapiens
gaggcccagggag

SEQ ID NO: 6216400 - DNA, 21 bp, Homo sapiens
gaggccccacctgaagggtgg

SEQ ID NO: 6216401 - DNA, 19 bp, Homo sapiens
gaggccccagcctccctga

SEQ ID NO: 6216402 - DNA, 13 bp, Homo sapiens
gaggccccagctc

SEQ ID NO: 6216403 - DNA, 21 bp, Homo sapiens
gaggccccagctctgagggga

SEQ ID NO: 6216404 - DNA, 14 bp, Homo sapiens
gaggccccaggccc

SEQ ID NO: 6216405 - DNA, 20 bp, Homo sapiens
gaggccccaggctgagagcc

SEQ ID NO: 6216406 - DNA, 13 bp, Homo sapiens
gaggccccaggtg

SEQ ID NO: 6216407 - DNA, 14 bp, Homo sapiens
gaggcccccagccc

SEQ ID NO: 6216408 - DNA, 19 bp, Homo sapiens
gaggcccccagcccagggc

SEQ ID NO: 6216409 - DNA, 21 bp, Homo sapiens
gaggcccccagcccagggctc

SEQ ID NO: 6216410 - DNA, 15 bp, Homo sapiens
gaggcccccagtggg

SEQ ID NO: 6216411 - DNA, 19 bp, Homo sapiens
gaggcccccagtggggaca

SEQ ID NO: 6216412 - DNA, 19 bp, Homo sapiens
gaggcccccatctccttaa

SEQ ID NO: 6216413 - DNA, 15 bp, Homo sapiens
gaggcccccctctgc

SEQ ID NO: 6216414 - DNA, 20 bp, Homo sapiens
gaggcccccgcagagactgt

SEQ ID NO: 6216415 - DNA, 19 bp, Homo sapiens
gaggcccccggaggcgccc

SEQ ID NO: 6216416 - DNA, 20 bp, Homo sapiens
gaggcccccggaggcgccca

SEQ ID NO: 6216417 - DNA, 20 bp, Homo sapiens
gaggccccgatggactcctg

SEQ ID NO: 6216418 - DNA, 21 bp, Homo sapiens
gaggccccgatggactcctga

SEQ ID NO: 6216419 - DNA, 19 bp, Homo sapiens
gaggcccctaggtgcccag

SEQ ID NO: 6216420 - DNA, 22 bp, Homo sapiens
gaggcccctatgtagtccgtgc

SEQ ID NO: 6216421 - DNA, 18 bp, Homo sapiens
gaggcccctgaggcagcc

SEQ ID NO: 6216422 - DNA, 13 bp, Homo sapiens
gaggcccctgcct

SEQ ID NO: 6216423 - DNA, 14 bp, Homo sapiens
gaggcccctgcctc

SEQ ID NO: 6216424 - DNA, 15 bp, Homo sapiens
gaggcccctggccca

SEQ ID NO: 6216425 - DNA, 20 bp, Homo sapiens
gaggcccctgggtccttcta

SEQ ID NO: 6216426 - DNA, 20 bp, Homo sapiens
gaggccccttctaggtggca

SEQ ID NO: 6216427 - DNA, 20 bp, Homo sapiens
gaggccccttgctgctggct

SEQ ID NO: 6216428 - DNA, 13 bp, Homo sapiens
gaggcccggcctc

SEQ ID NO: 6216429 - DNA, 18 bp, Homo sapiens
gaggccctcaatccacct

SEQ ID NO: 6216430 - DNA, 17 bp, Homo sapiens
gaggccctccacacctg

SEQ ID NO: 6216431 - DNA, 19 bp, Homo sapiens
gaggccctccacacctgcg

SEQ ID NO: 6216432 - DNA, 22 bp, Homo sapiens
gaggccctccacacctgcggcc

SEQ ID NO: 6216433 - DNA, 16 bp, Homo sapiens
gaggccctcctgtgct

SEQ ID NO: 6216434 - DNA, 17 bp, Homo sapiens
gaggccctcctgtgctg

SEQ ID NO: 6216435 - DNA, 19 bp, Homo sapiens
gaggccctcctgtgctggg

SEQ ID NO: 6216436 - DNA, 19 bp, Homo sapiens
gaggccctctggagtggcc

SEQ ID NO: 6216437 - DNA, 16 bp, Homo sapiens
gaggccctgaagcctc

SEQ ID NO: 6216438 - DNA, 21 bp, Homo sapiens
gaggccctgaagcctccgtgg

SEQ ID NO: 6216439 - DNA, 13 bp, Homo sapiens
gaggccctgcacc

SEQ ID NO: 6216440 - DNA, 23 bp, Homo sapiens
gaggccctgccacgtcccgctgc

SEQ ID NO: 6216441 - DNA, 13 bp, Homo sapiens
gaggccctgcccc

SEQ ID NO: 6216442 - DNA, 15 bp, Homo sapiens
gaggccctgccccca

SEQ ID NO: 6216443 - DNA, 13 bp, Homo sapiens
gaggccctgcctg

SEQ ID NO: 6216444 - DNA, 13 bp, Homo sapiens
gaggccctggagg

SEQ ID NO: 6216445 - DNA, 13 bp, Homo sapiens
gaggccctggcag

SEQ ID NO: 6216446 - DNA, 14 bp, Homo sapiens
gaggccctggccct

SEQ ID NO: 6216447 - DNA, 21 bp, Homo sapiens
gaggccctggccctttcccct

SEQ ID NO: 6216448 - DNA, 16 bp, Homo sapiens
gaggccctggtgtcag

SEQ ID NO: 6216449 - DNA, 23 bp, Homo sapiens
gaggcccttaagggaagctactg

SEQ ID NO: 6216450 - DNA, 15 bp, Homo sapiens
gaggcccttctctcc

SEQ ID NO: 6216451 - DNA, 16 bp, Homo sapiens
gaggcccttggcgggc

SEQ ID NO: 6216452 - DNA, 16 bp, Homo sapiens
gaggccctttgctgtc

SEQ ID NO: 6216453 - DNA, 17 bp, Homo sapiens
gaggccctttgctgtcc

SEQ ID NO: 6216454 - DNA, 17 bp, Homo sapiens
gaggcccttttctggct

SEQ ID NO: 6216455 - DNA, 19 bp, Homo sapiens
gaggcccttttctggctcc

SEQ ID NO: 6216456 - DNA, 18 bp, Homo sapiens
gaggccgaagctgctgtg

SEQ ID NO: 6216457 - DNA, 21 bp, Homo sapiens
gaggccgaaggtgcctcagac

SEQ ID NO: 6216458 - DNA, 16 bp, Homo sapiens
gaggccgactgggctg

SEQ ID NO: 6216459 - DNA, 18 bp, Homo sapiens
gaggccgaggaccaccag

SEQ ID NO: 6216460 - DNA, 19 bp, Homo sapiens
gaggccgaggaccaccagc

SEQ ID NO: 6216461 - DNA, 18 bp, Homo sapiens
gaggccgaggcaggtgga

SEQ ID NO: 6216462 - DNA, 14 bp, Homo sapiens
gaggccgaggcggg

SEQ ID NO: 6216463 - DNA, 18 bp, Homo sapiens
gaggccgcggcctccccg

SEQ ID NO: 6216464 - DNA, 18 bp, Homo sapiens
gaggccgcttagtgctgc

SEQ ID NO: 6216465 - DNA, 19 bp, Homo sapiens
gaggccgcttagtgctgct

SEQ ID NO: 6216466 - DNA, 17 bp, Homo sapiens
gaggccggagagctggt

SEQ ID NO: 6216467 - DNA, 17 bp, Homo sapiens
gaggccggccctgcccc

SEQ ID NO: 6216468 - DNA, 20 bp, Homo sapiens
gaggccggccctgcccctcc

SEQ ID NO: 6216469 - DNA, 16 bp, Homo sapiens
gaggccggggccgggt

SEQ ID NO: 6216470 - DNA, 19 bp, Homo sapiens
gaggccggggggagcagga

SEQ ID NO: 6216471 - DNA, 17 bp, Homo sapiens
gaggccggggtccaggc

SEQ ID NO: 6216472 - DNA, 15 bp, Homo sapiens
gaggccgtgcagtgg

SEQ ID NO: 6216473 - DNA, 19 bp, Homo sapiens
gaggcctaaaagtaaacat

SEQ ID NO: 6216474 - DNA, 18 bp, Homo sapiens
gaggcctacctgctcccc

SEQ ID NO: 6216475 - DNA, 20 bp, Homo sapiens
gaggcctcacacccagaggg

SEQ ID NO: 6216476 - DNA, 17 bp, Homo sapiens
gaggcctcaccctgctt

SEQ ID NO: 6216477 - DNA, 23 bp, Homo sapiens
gaggcctcactactcgagcccac

SEQ ID NO: 6216478 - DNA, 22 bp, Homo sapiens
gaggcctcaggtgctgtccatg

SEQ ID NO: 6216479 - DNA, 21 bp, Homo sapiens
gaggcctcagtggactttcca

SEQ ID NO: 6216480 - DNA, 13 bp, Homo sapiens
gaggcctcagttc

SEQ ID NO: 6216481 - DNA, 19 bp, Homo sapiens
gaggcctcagtttctccat

SEQ ID NO: 6216482 - DNA, 23 bp, Homo sapiens
gaggcctcagtttctccatcagc

SEQ ID NO: 6216483 - DNA, 13 bp, Homo sapiens
gaggcctcatccc

SEQ ID NO: 6216484 - DNA, 14 bp, Homo sapiens
gaggcctcatccct

SEQ ID NO: 6216485 - DNA, 17 bp, Homo sapiens
gaggcctcatgcctgct

SEQ ID NO: 6216486 - DNA, 21 bp, Homo sapiens
gaggcctcatgcctgctgaga

SEQ ID NO: 6216487 - DNA, 16 bp, Homo sapiens
gaggcctcccccagcc

SEQ ID NO: 6216488 - DNA, 21 bp, Homo sapiens
gaggcctcggctgtctcctgt

SEQ ID NO: 6216489 - DNA, 21 bp, Homo sapiens
gaggcctctctcaggagcagg

SEQ ID NO: 6216490 - DNA, 13 bp, Homo sapiens
gaggcctctggcc

SEQ ID NO: 6216491 - DNA, 17 bp, Homo sapiens
gaggcctctggccctcg

SEQ ID NO: 6216492 - DNA, 13 bp, Homo sapiens
gaggcctctgggc

SEQ ID NO: 6216493 - DNA, 19 bp, Homo sapiens
gaggcctcttggacctctg

SEQ ID NO: 6216494 - DNA, 9 bp, Homo sapiens
gaggcctga

SEQ ID NO: 6216495 - DNA, 18 bp, Homo sapiens
gaggcctgaaatcctggt

SEQ ID NO: 6216496 - DNA, 22 bp, Homo sapiens
gaggcctgaaatgtttccaggc

SEQ ID NO: 6216497 - DNA, 21 bp, Homo sapiens
gaggcctgacacaggccagcc

SEQ ID NO: 6216498 - DNA, 11 bp, Homo sapiens
gaggcctgagg

SEQ ID NO: 6216499 - DNA, 22 bp, Homo sapiens
gaggcctgaggatgagctggaa

SEQ ID NO: 6216500 - DNA, 13 bp, Homo sapiens
gaggcctgaggcc

SEQ ID NO: 6216501 - DNA, 22 bp, Homo sapiens
gaggcctgatctgcccatcgtg

SEQ ID NO: 6216502 - DNA, 17 bp, Homo sapiens
gaggcctgatgctgccc

SEQ ID NO: 6216503 - DNA, 18 bp, Homo sapiens
gaggcctgatgctgcccc

SEQ ID NO: 6216504 - DNA, 12 bp, Homo sapiens
gaggcctgcagg

SEQ ID NO: 6216505 - DNA, 15 bp, Homo sapiens
gaggcctgcagggcc

SEQ ID NO: 6216506 - DNA, 16 bp, Homo sapiens
gaggcctgcagggcct

SEQ ID NO: 6216507 - DNA, 21 bp, Homo sapiens
gaggcctgcagggcctctgtc

SEQ ID NO: 6216508 - DNA, 19 bp, Homo sapiens
gaggcctgccccctgggct

SEQ ID NO: 6216509 - DNA, 20 bp, Homo sapiens
gaggcctgcctccagggctg

SEQ ID NO: 6216510 - DNA, 19 bp, Homo sapiens
gaggcctgcgaccctgggg

SEQ ID NO: 6216511 - DNA, 20 bp, Homo sapiens
gaggcctgctgccagtgcag

SEQ ID NO: 6216512 - DNA, 21 bp, Homo sapiens
gaggcctgctgccagtgcagc

SEQ ID NO: 6216513 - DNA, 20 bp, Homo sapiens
gaggcctggaccgagatgtg

SEQ ID NO: 6216514 - DNA, 19 bp, Homo sapiens
gaggcctggactttcctgc

SEQ ID NO: 6216515 - DNA, 18 bp, Homo sapiens
gaggcctggagtaacaca

SEQ ID NO: 6216516 - DNA, 23 bp, Homo sapiens
gaggcctggccttgtcaggaccc

SEQ ID NO: 6216517 - DNA, 14 bp, Homo sapiens
gaggcctggctctg

SEQ ID NO: 6216518 - DNA, 12 bp, Homo sapiens
gaggcctgggag

SEQ ID NO: 6216519 - DNA, 20 bp, Homo sapiens
gaggcctgggccgctgccac

SEQ ID NO: 6216520 - DNA, 22 bp, Homo sapiens
gaggcctgggccgctgccacgt

SEQ ID NO: 6216521 - DNA, 13 bp, Homo sapiens
gaggcctggggcc

SEQ ID NO: 6216522 - DNA, 21 bp, Homo sapiens
gaggcctggggccggtagagg

SEQ ID NO: 6216523 - DNA, 16 bp, Homo sapiens
gaggcctggggtggga

SEQ ID NO: 6216524 - DNA, 13 bp, Homo sapiens
gaggcctgggtgt

SEQ ID NO: 6216525 - DNA, 12 bp, Homo sapiens
gaggcctggtct

SEQ ID NO: 6216526 - DNA, 12 bp, Homo sapiens
gaggcctggtgc

SEQ ID NO: 6216527 - DNA, 15 bp, Homo sapiens
gaggcctgtctgtga

SEQ ID NO: 6216528 - DNA, 14 bp, Homo sapiens
gaggcctgtgctct

SEQ ID NO: 6216529 - DNA, 16 bp, Homo sapiens
gaggccttccagctgc

SEQ ID NO: 6216530 - DNA, 20 bp, Homo sapiens
gaggccttcccatggccatt

SEQ ID NO: 6216531 - DNA, 15 bp, Homo sapiens
gaggccttgagaggc

SEQ ID NO: 6216532 - DNA, 22 bp, Homo sapiens
gaggccttgggagctcatccct

SEQ ID NO: 6216533 - DNA, 23 bp, Homo sapiens
gaggccttggggtgggggccagg

SEQ ID NO: 6216534 - DNA, 19 bp, Homo sapiens
gaggccttgtcatcctccc

SEQ ID NO: 6216535 - DNA, 19 bp, Homo sapiens
gaggcctttccccagtgtg

SEQ ID NO: 6216536 - DNA, 18 bp, Homo sapiens
gaggcgaaatataaaact

SEQ ID NO: 6216537 - DNA, 14 bp, Homo sapiens
gaggcgaataaatg

SEQ ID NO: 6216538 - DNA, 15 bp, Homo sapiens
gaggcgaataaatgt

SEQ ID NO: 6216539 - DNA, 16 bp, Homo sapiens
gaggcgaataaatgtt

SEQ ID NO: 6216540 - DNA, 20 bp, Homo sapiens
gaggcgagcagggcaggccc

SEQ ID NO: 6216541 - DNA, 12 bp, Homo sapiens
gaggcgagccag

SEQ ID NO: 6216542 - DNA, 22 bp, Homo sapiens
gaggcgagccagattaggcctg

SEQ ID NO: 6216543 - DNA, 14 bp, Homo sapiens
gaaatgcactgtat

SEQ ID NO: 6216544 - DNA, 15 bp, Homo sapiens
gaaatgcatatttgc

SEQ ID NO: 6216545 - DNA, 22 bp, Homo sapiens
gaaatgcattgctctggatctg

SEQ ID NO: 6216546 - DNA, 12 bp, Homo sapiens
gaaatgcatttt

SEQ ID NO: 6216547 - DNA, 21 bp, Homo sapiens
gaaatgcattttattctttaa

SEQ ID NO: 6216548 - DNA, 12 bp, Homo sapiens
gaaatgccaaag

SEQ ID NO: 6216549 - DNA, 19 bp, Homo sapiens
gaaatgccaagtgcctgct

SEQ ID NO: 6216550 - DNA, 18 bp, Homo sapiens
gaaatgccagacttctaa

SEQ ID NO: 6216551 - DNA, 22 bp, Homo sapiens
gaaatgcccttcactttctcct

SEQ ID NO: 6216552 - DNA, 21 bp, Homo sapiens
gaaatgccttactttgtatga

SEQ ID NO: 6216553 - DNA, 18 bp, Homo sapiens
gaaatgctatgtcatttc

SEQ ID NO: 6216554 - DNA, 17 bp, Homo sapiens
gaaatgctcaagaatgt

SEQ ID NO: 6216555 - DNA, 20 bp, Homo sapiens
gaaatgctcgtcatacagta

SEQ ID NO: 6216556 - DNA, 15 bp, Homo sapiens
gaaatgctgcctgcc

SEQ ID NO: 6216557 - DNA, 15 bp, Homo sapiens
gaaatgctgctggcc

SEQ ID NO: 6216558 - DNA, 15 bp, Homo sapiens
gaaatgctgtatttt

SEQ ID NO: 6216559 - DNA, 19 bp, Homo sapiens
gaaatgctgtatttttaca

SEQ ID NO: 6216560 - DNA, 13 bp, Homo sapiens
gaaatgcttaaaa

SEQ ID NO: 6216561 - DNA, 15 bp, Homo sapiens
gaaatgcttttatat

SEQ ID NO: 6216562 - DNA, 19 bp, Homo sapiens
gaaatgcttttatattcta

SEQ ID NO: 6216563 - DNA, 21 bp, Homo sapiens
gaaatgcttttatattctaat

SEQ ID NO: 6216564 - DNA, 11 bp, Homo sapiens
gaaatggaaac

SEQ ID NO: 6216565 - DNA, 20 bp, Homo sapiens
gaaatggaacagatttcaaa

SEQ ID NO: 6216566 - DNA, 17 bp, Homo sapiens
gaaatggaatactgaag

SEQ ID NO: 6216567 - DNA, 23 bp, Homo sapiens
gaaatggactgactgtaacgatt

SEQ ID NO: 6216568 - DNA, 21 bp, Homo sapiens
gaaatggaggatctctaaaga

SEQ ID NO: 6216569 - DNA, 24 bp, Homo sapiens
gaaatggaggatctctaaagagca

SEQ ID NO: 6216570 - DNA, 12 bp, Homo sapiens
gaaatggagggt

SEQ ID NO: 6216571 - DNA, 16 bp, Homo sapiens
gaaatggagggtgggg

SEQ ID NO: 6216572 - DNA, 19 bp, Homo sapiens
gaaatggagggtggggccg

SEQ ID NO: 6216573 - DNA, 21 bp, Homo sapiens
gaaatggatactacatcttta

SEQ ID NO: 6216574 - DNA, 18 bp, Homo sapiens
gaaatggatagattgttt

SEQ ID NO: 6216575 - DNA, 21 bp, Homo sapiens
gaaatggcaacacgtggaggt

SEQ ID NO: 6216576 - DNA, 16 bp, Homo sapiens
gaaatggcctgtccct

SEQ ID NO: 6216577 - DNA, 15 bp, Homo sapiens
gaaatggccttcccg

SEQ ID NO: 6216578 - DNA, 20 bp, Homo sapiens
gaaatggccttttttaatat

SEQ ID NO: 6216579 - DNA, 22 bp, Homo sapiens
gaaatggcgtctgctctggtgg

SEQ ID NO: 6216580 - DNA, 21 bp, Homo sapiens
gaaatgggaacaatatcaata

SEQ ID NO: 6216581 - DNA, 16 bp, Homo sapiens
gaaatgggaatcatgg

SEQ ID NO: 6216582 - DNA, 17 bp, Homo sapiens
gaaatgggaatcatggc

SEQ ID NO: 6216583 - DNA, 17 bp, Homo sapiens
gaaatgggacttaactc

SEQ ID NO: 6216584 - DNA, 19 bp, Homo sapiens
gaaatgggacttaactcct

SEQ ID NO: 6216585 - DNA, 18 bp, Homo sapiens
gaaatgggagatggtcag

SEQ ID NO: 6216586 - DNA, 14 bp, Homo sapiens
gaaatgggcagagc

SEQ ID NO: 6216587 - DNA, 19 bp, Homo sapiens
gaaatgggcagagcagaga

SEQ ID NO: 6216588 - DNA, 20 bp, Homo sapiens
gaaatgggcagttctcccag

SEQ ID NO: 6216589 - DNA, 14 bp, Homo sapiens
gaaatgggcctcag

SEQ ID NO: 6216590 - DNA, 14 bp, Homo sapiens
gaaatggggagctg

SEQ ID NO: 6216591 - DNA, 16 bp, Homo sapiens
gaaatggggcgctgga

SEQ ID NO: 6216592 - DNA, 16 bp, Homo sapiens
gaaatggtatgagctg

SEQ ID NO: 6216593 - DNA, 17 bp, Homo sapiens
gaaatggtatgagctga

SEQ ID NO: 6216594 - DNA, 21 bp, Homo sapiens
gaaatggtatgagctgagggg

SEQ ID NO: 6216595 - DNA, 15 bp, Homo sapiens
gaaatggtggaactg

SEQ ID NO: 6216596 - DNA, 19 bp, Homo sapiens
gaaatggttgtattagatg

SEQ ID NO: 6216597 - DNA, 20 bp, Homo sapiens
gaaatggtttcacttgctct

SEQ ID NO: 6216598 - DNA, 14 bp, Homo sapiens
gaaatgtaaactgc

SEQ ID NO: 6216599 - DNA, 16 bp, Homo sapiens
gaaatgtaacatgaag

SEQ ID NO: 6216600 - DNA, 19 bp, Homo sapiens
gaaatgtaacatgaagcaa

SEQ ID NO: 6216601 - DNA, 21 bp, Homo sapiens
gaaatgtaaggctgtgtaaga

SEQ ID NO: 6216602 - DNA, 22 bp, Homo sapiens
gaaatgtaagggaaactgccag

SEQ ID NO: 6216603 - DNA, 13 bp, Homo sapiens
gaaatgtaataat

SEQ ID NO: 6216604 - DNA, 16 bp, Homo sapiens
gaaatgtaataataat

SEQ ID NO: 6216605 - DNA, 18 bp, Homo sapiens
gaaatgtaatactggaat

SEQ ID NO: 6216606 - DNA, 14 bp, Homo sapiens
gaaatgtacacttt

SEQ ID NO: 6216607 - DNA, 17 bp, Homo sapiens
gaaatgtacagcaagga

SEQ ID NO: 6216608 - DNA, 20 bp, Homo sapiens
gaaatgtaccatcaaatgtt

SEQ ID NO: 6216609 - DNA, 14 bp, Homo sapiens
gaaatgtagttgat

SEQ ID NO: 6216610 - DNA, 18 bp, Homo sapiens
gaaatgtagttgatgtat

SEQ ID NO: 6216611 - DNA, 18 bp, Homo sapiens
gaaatgtattaatgtatg

SEQ ID NO: 6216612 - DNA, 22 bp, Homo sapiens
gaaatgtattcacctttctttt

SEQ ID NO: 6216613 - DNA, 22 bp, Homo sapiens
gaaatgtattttgaaaacactt

SEQ ID NO: 6216614 - DNA, 21 bp, Homo sapiens
gaaatgtcacgtactgtctga

SEQ ID NO: 6216615 - DNA, 17 bp, Homo sapiens
gaaatgtcagttctgat

SEQ ID NO: 6216616 - DNA, 18 bp, Homo sapiens
gaaatgtcccctcaaact

SEQ ID NO: 6216617 - DNA, 15 bp, Homo sapiens
gaaatgtccctttct

SEQ ID NO: 6216618 - DNA, 17 bp, Homo sapiens
gaaatgtccctttcttc

SEQ ID NO: 6216619 - DNA, 20 bp, Homo sapiens
gaaatgtccctttcttctcc

SEQ ID NO: 6216620 - DNA, 14 bp, Homo sapiens
gaaatgtcctgcat

SEQ ID NO: 6216621 - DNA, 19 bp, Homo sapiens
gaaatgtcgatcaagagaa

SEQ ID NO: 6216622 - DNA, 23 bp, Homo sapiens
gaaatgtcgatcaagagaatcaa

SEQ ID NO: 6216623 - DNA, 15 bp, Homo sapiens
gaaatgtctgctggt

SEQ ID NO: 6216624 - DNA, 18 bp, Homo sapiens
gaaatgtctggagaataa

SEQ ID NO: 6216625 - DNA, 14 bp, Homo sapiens
gaaatgtctttcta

SEQ ID NO: 6216626 - DNA, 14 bp, Homo sapiens
gaaatgtgaagagg

SEQ ID NO: 6216627 - DNA, 18 bp, Homo sapiens
gaaatgtgagaaatgtct

SEQ ID NO: 6216628 - DNA, 18 bp, Homo sapiens
gaaatgtgtgtgatgtga

SEQ ID NO: 6216629 - DNA, 23 bp, Homo sapiens
gaaatgtgtgtgatgtgacattt

SEQ ID NO: 6216630 - DNA, 22 bp, Homo sapiens
gaaatgtgtttccttttcagga

SEQ ID NO: 6216631 - DNA, 13 bp, Homo sapiens
gaaatgtgtttct

SEQ ID NO: 6216632 - DNA, 13 bp, Homo sapiens
gaaatgttaagaa

SEQ ID NO: 6216633 - DNA, 18 bp, Homo sapiens
gaaatgttcacaaggtac

SEQ ID NO: 6216634 - DNA, 22 bp, Homo sapiens
gaaatgttctcatgaactaccc

SEQ ID NO: 6216635 - DNA, 20 bp, Homo sapiens
gaaatgttctgtcaaatgtg

SEQ ID NO: 6216636 - DNA, 12 bp, Homo sapiens
gaaatgttcttt

SEQ ID NO: 6216637 - DNA, 13 bp, Homo sapiens
gaaatgttcttta

SEQ ID NO: 6216638 - DNA, 20 bp, Homo sapiens
gaaatgttgagggcaagcca

SEQ ID NO: 6216639 - DNA, 20 bp, Homo sapiens
gaaatgttgtgggggtgggg

SEQ ID NO: 6216640 - DNA, 18 bp, Homo sapiens
gaaatgtttaataaagct

SEQ ID NO: 6216641 - DNA, 20 bp, Homo sapiens
gaaatgtttatggaaatatt

SEQ ID NO: 6216642 - DNA, 14 bp, Homo sapiens
gaaatgtttcacta

SEQ ID NO: 6216643 - DNA, 18 bp, Homo sapiens
gaaatgtttgctgagtga

SEQ ID NO: 6216644 - DNA, 17 bp, Homo sapiens
gaaatgttttaatgcca

SEQ ID NO: 6216645 - DNA, 14 bp, Homo sapiens
gaaatgttttgtaa

SEQ ID NO: 6216646 - DNA, 15 bp, Homo sapiens
gaaatgtttttgatt

SEQ ID NO: 6216647 - DNA, 22 bp, Homo sapiens
gaaattaaaatattatttgata

SEQ ID NO: 6216648 - DNA, 16 bp, Homo sapiens
gaaattaaagaaatga

SEQ ID NO: 6216649 - DNA, 18 bp, Homo sapiens
gaaattaaagtatgcaaa

SEQ ID NO: 6216650 - DNA, 11 bp, Homo sapiens
gaaattaaata

SEQ ID NO: 6216651 - DNA, 15 bp, Homo sapiens
gaaattaaataattt

SEQ ID NO: 6216652 - DNA, 16 bp, Homo sapiens
gaaattaaataatttt

SEQ ID NO: 6216653 - DNA, 18 bp, Homo sapiens
gaaattaaatccaataaa

SEQ ID NO: 6216654 - DNA, 23 bp, Homo sapiens
gaaattaaattcttattggccaa

SEQ ID NO: 6216655 - DNA, 19 bp, Homo sapiens
gaaattaacacaaaggaag

SEQ ID NO: 6216656 - DNA, 21 bp, Homo sapiens
gaaattaacttttaaatgttt

SEQ ID NO: 6216657 - DNA, 15 bp, Homo sapiens
gaaattaagaactga

SEQ ID NO: 6216658 - DNA, 16 bp, Homo sapiens
gaaattaagaagaaac

SEQ ID NO: 6216659 - DNA, 18 bp, Homo sapiens
gaaattaagaaggcaaaa

SEQ ID NO: 6216660 - DNA, 22 bp, Homo sapiens
gaaattaagaaggcaaaaatgt

SEQ ID NO: 6216661 - DNA, 22 bp, Homo sapiens
gaaattaagcattttgaaacaa

SEQ ID NO: 6216662 - DNA, 15 bp, Homo sapiens
gaaattaaggaacat

SEQ ID NO: 6216663 - DNA, 15 bp, Homo sapiens
gaaattaatttgtga

SEQ ID NO: 6216664 - DNA, 19 bp, Homo sapiens
gaaattaatttgtgaattt

SEQ ID NO: 6216665 - DNA, 20 bp, Homo sapiens
gaaattaatttgtgaatttg

SEQ ID NO: 6216666 - DNA, 13 bp, Homo sapiens
gaaattacaagtt

SEQ ID NO: 6216667 - DNA, 16 bp, Homo sapiens
gaaattacaagtttca

SEQ ID NO: 6216668 - DNA, 17 bp, Homo sapiens
gaaattacaagtttcag

SEQ ID NO: 6216669 - DNA, 17 bp, Homo sapiens
gaaattacaggttcctt

SEQ ID NO: 6216670 - DNA, 16 bp, Homo sapiens
gaaattacctgtggat

SEQ ID NO: 6216671 - DNA, 19 bp, Homo sapiens
gaaattacctgtggatatt

SEQ ID NO: 6216672 - DNA, 23 bp, Homo sapiens
gaaattactggagccatgtctac

SEQ ID NO: 6216673 - DNA, 14 bp, Homo sapiens
gaaattactgtgta

SEQ ID NO: 6216674 - DNA, 17 bp, Homo sapiens
gaaattactttaacatt

SEQ ID NO: 6216675 - DNA, 17 bp, Homo sapiens
gaaattagccacatgta

SEQ ID NO: 6216676 - DNA, 23 bp, Homo sapiens
gaaattagtactcccctccttga

SEQ ID NO: 6216677 - DNA, 13 bp, Homo sapiens
gaaattagtcttt

SEQ ID NO: 6216678 - DNA, 15 bp, Homo sapiens
gaaattataactatt

SEQ ID NO: 6216679 - DNA, 20 bp, Homo sapiens
gaaattataactattacagt

SEQ ID NO: 6216680 - DNA, 21 bp, Homo sapiens
gaaattataactattacagtg

SEQ ID NO: 6216681 - DNA, 22 bp, Homo sapiens
gaaattataactattacagtgt

SEQ ID NO: 6216682 - DNA, 16 bp, Homo sapiens
gaaattatacgtacat

SEQ ID NO: 6216683 - DNA, 16 bp, Homo sapiens
gaaattatagttaggc

SEQ ID NO: 6216684 - DNA, 13 bp, Homo sapiens
gaaattatatctg

SEQ ID NO: 6216685 - DNA, 13 bp, Homo sapiens
gaaattatcttta

SEQ ID NO: 6216686 - DNA, 22 bp, Homo sapiens
gaaattatgtgacattttacat

SEQ ID NO: 6216687 - DNA, 19 bp, Homo sapiens
gaaattattggtatatttg

SEQ ID NO: 6216688 - DNA, 13 bp, Homo sapiens
gaaattcaaaatg

SEQ ID NO: 6216689 - DNA, 16 bp, Homo sapiens
gaaattcaaaatgctc

SEQ ID NO: 6216690 - DNA, 20 bp, Homo sapiens
gaaattcaacctgtgtctta

SEQ ID NO: 6216691 - DNA, 19 bp, Homo sapiens
gaaattcaacgttaataat

SEQ ID NO: 6216692 - DNA, 23 bp, Homo sapiens
gaaattcaacgttaataattctg

SEQ ID NO: 6216693 - DNA, 16 bp, Homo sapiens
gaaattcaagaagtat

SEQ ID NO: 6216694 - DNA, 16 bp, Homo sapiens
gaaattcacactgtgc

SEQ ID NO: 6216695 - DNA, 17 bp, Homo sapiens
gaaattcagattgttta

SEQ ID NO: 6216696 - DNA, 18 bp, Homo sapiens
gaaattcagattgtttaa

SEQ ID NO: 6216697 - DNA, 18 bp, Homo sapiens
gaaattcaggtacagaaa

SEQ ID NO: 6216698 - DNA, 15 bp, Homo sapiens
gaaattcatggcttt

SEQ ID NO: 6216699 - DNA, 19 bp, Homo sapiens
gaaattcattaaagaaaaa

SEQ ID NO: 6216700 - DNA, 20 bp, Homo sapiens
gaaattcattaaagaaaaac

SEQ ID NO: 6216701 - DNA, 20 bp, Homo sapiens
gaaattccagcaataagaaa

SEQ ID NO: 6216702 - DNA, 22 bp, Homo sapiens
gaaattcccccacttgggagct

SEQ ID NO: 6216703 - DNA, 22 bp, Homo sapiens
gaaattccctggaccagatgct

SEQ ID NO: 6216704 - DNA, 17 bp, Homo sapiens
gaaattcccttcatctg

SEQ ID NO: 6216705 - DNA, 18 bp, Homo sapiens
gaaattcctagtgtcttt

SEQ ID NO: 6216706 - DNA, 16 bp, Homo sapiens
gaaattcctccttccc

SEQ ID NO: 6216707 - DNA, 17 bp, Homo sapiens
gaaattcctccttcccc

SEQ ID NO: 6216708 - DNA, 16 bp, Homo sapiens
gaaattcctgtagcat

SEQ ID NO: 6216709 - DNA, 22 bp, Homo sapiens
gaaattcgccccattttcttta

SEQ ID NO: 6216710 - DNA, 16 bp, Homo sapiens
gaaattctataagaga

SEQ ID NO: 6216711 - DNA, 15 bp, Homo sapiens
gaaattctccaggat

SEQ ID NO: 6216712 - DNA, 17 bp, Homo sapiens
gaaattctcctggaggt

SEQ ID NO: 6216713 - DNA, 14 bp, Homo sapiens
gaaattctgaaaac

SEQ ID NO: 6216714 - DNA, 16 bp, Homo sapiens
gaaattctgaatttgc

SEQ ID NO: 6216715 - DNA, 19 bp, Homo sapiens
gaaattctgaatttgcaaa

SEQ ID NO: 6216716 - DNA, 21 bp, Homo sapiens
gaaattctgaatttgcaaagt

SEQ ID NO: 6216717 - DNA, 15 bp, Homo sapiens
gaaattctgctgctt

SEQ ID NO: 6216718 - DNA, 14 bp, Homo sapiens
gaaattctgctgtt

SEQ ID NO: 6216719 - DNA, 15 bp, Homo sapiens
gaaattctgttaaaa

SEQ ID NO: 6216720 - DNA, 24 bp, Homo sapiens
gaaattctgttaaaatctattctg

SEQ ID NO: 6216721 - DNA, 16 bp, Homo sapiens
gaggcgagccaggcaa

SEQ ID NO: 6216722 - DNA, 23 bp, Homo sapiens
gaggcgagcctggccaacatggt

SEQ ID NO: 6216723 - DNA, 14 bp, Homo sapiens
gaggcgaggctgcc

SEQ ID NO: 6216724 - DNA, 14 bp, Homo sapiens
gaggcgatgccagc

SEQ ID NO: 6216725 - DNA, 21 bp, Homo sapiens
gaggcgcacagtgtgagcccg

SEQ ID NO: 6216726 - DNA, 17 bp, Homo sapiens
gaggcgcagcccgaagc

SEQ ID NO: 6216727 - DNA, 15 bp, Homo sapiens
gaggcgcagggacat

SEQ ID NO: 6216728 - DNA, 13 bp, Homo sapiens
gaggcgcccacct

SEQ ID NO: 6216729 - DNA, 19 bp, Homo sapiens
gaggcgcccacctgcccag

SEQ ID NO: 6216730 - DNA, 22 bp, Homo sapiens
gaggcgccccaacccgtggagg

SEQ ID NO: 6216731 - DNA, 19 bp, Homo sapiens
gaggcgccttcctgggttg

SEQ ID NO: 6216732 - DNA, 19 bp, Homo sapiens
gaggcggacgttccagccg

SEQ ID NO: 6216733 - DNA, 14 bp, Homo sapiens
gaggcggagctcca

SEQ ID NO: 6216734 - DNA, 19 bp, Homo sapiens
gaggcggaggctgtgctcc

SEQ ID NO: 6216735 - DNA, 20 bp, Homo sapiens
gaggcggaggttgcagtgag

SEQ ID NO: 6216736 - DNA, 14 bp, Homo sapiens
gaggcggcagctgg

SEQ ID NO: 6216737 - DNA, 17 bp, Homo sapiens
gaggcggcccggccagc

SEQ ID NO: 6216738 - DNA, 18 bp, Homo sapiens
gaggcggcccggccagcg

SEQ ID NO: 6216739 - DNA, 13 bp, Homo sapiens
gaggcggctctgg

SEQ ID NO: 6216740 - DNA, 23 bp, Homo sapiens
gaggcgggaaccctctggggccc

SEQ ID NO: 6216741 - DNA, 14 bp, Homo sapiens
gaggcgggccagcc

SEQ ID NO: 6216742 - DNA, 15 bp, Homo sapiens
gaggcgggccagcca

SEQ ID NO: 6216743 - DNA, 16 bp, Homo sapiens
gaggcgggccagccag

SEQ ID NO: 6216744 - DNA, 14 bp, Homo sapiens
gaggcggggctcta

SEQ ID NO: 6216745 - DNA, 14 bp, Homo sapiens
gaggcgggggagcc

SEQ ID NO: 6216746 - DNA, 18 bp, Homo sapiens
gaggcgggggagcctgga

SEQ ID NO: 6216747 - DNA, 19 bp, Homo sapiens
gaggcgggggagcctggag

SEQ ID NO: 6216748 - DNA, 21 bp, Homo sapiens
gaggcgggtggatcacttgag

SEQ ID NO: 6216749 - DNA, 17 bp, Homo sapiens
gaggcggtatccacctg

SEQ ID NO: 6216750 - DNA, 17 bp, Homo sapiens
gaggcggtttgggagaa

SEQ ID NO: 6216751 - DNA, 22 bp, Homo sapiens
gaggcgtactacccagctctgt

SEQ ID NO: 6216752 - DNA, 22 bp, Homo sapiens
gaggcgtcttcatctccctgcc

SEQ ID NO: 6216753 - DNA, 23 bp, Homo sapiens
gaggcgtcttcatctccctgcca

SEQ ID NO: 6216754 - DNA, 14 bp, Homo sapiens
gaggcgtgcccccc

SEQ ID NO: 6216755 - DNA, 20 bp, Homo sapiens
gaggcgtgcccccctcctcc

SEQ ID NO: 6216756 - DNA, 21 bp, Homo sapiens
gaggcgtgggatccagagaga

SEQ ID NO: 6216757 - DNA, 22 bp, Homo sapiens
gaggcgtgggatccagagagaa

SEQ ID NO: 6216758 - DNA, 22 bp, Homo sapiens
gaggctaacttacagaaatgaa

SEQ ID NO: 6216759 - DNA, 19 bp, Homo sapiens
gaggctaagatgagatttg

SEQ ID NO: 6216760 - DNA, 15 bp, Homo sapiens
gaggctaagcctgga

SEQ ID NO: 6216761 - DNA, 18 bp, Homo sapiens
gaggctacccgctgtggc

SEQ ID NO: 6216762 - DNA, 20 bp, Homo sapiens
gaggctacccgctgtggccg

SEQ ID NO: 6216763 - DNA, 18 bp, Homo sapiens
gaggctactgtaaggcaa

SEQ ID NO: 6216764 - DNA, 21 bp, Homo sapiens
gaggctagaaccaagaagggc

SEQ ID NO: 6216765 - DNA, 16 bp, Homo sapiens
gaggctatagctggga

SEQ ID NO: 6216766 - DNA, 23 bp, Homo sapiens
gaggctatgaggaaactgagtca

SEQ ID NO: 6216767 - DNA, 16 bp, Homo sapiens
gaggctatgctcaggg

SEQ ID NO: 6216768 - DNA, 17 bp, Homo sapiens
gaggctatgctcagggg

SEQ ID NO: 6216769 - DNA, 20 bp, Homo sapiens
gaggctatgctcaggggccc

SEQ ID NO: 6216770 - DNA, 20 bp, Homo sapiens
gaggctattattttcactgt

SEQ ID NO: 6216771 - DNA, 21 bp, Homo sapiens
gaggctattcctaggcctcag

SEQ ID NO: 6216772 - DNA, 22 bp, Homo sapiens
gaggctattcctaggcctcagg

SEQ ID NO: 6216773 - DNA, 15 bp, Homo sapiens
gaggctcaaattttg

SEQ ID NO: 6216774 - DNA, 15 bp, Homo sapiens
gaggctcaacaataa

SEQ ID NO: 6216775 - DNA, 22 bp, Homo sapiens
gaggctcaagaggcccagggag

SEQ ID NO: 6216776 - DNA, 21 bp, Homo sapiens
gaggctcaggtgatctgtttg

SEQ ID NO: 6216777 - DNA, 15 bp, Homo sapiens
gaggctcatggccct

SEQ ID NO: 6216778 - DNA, 21 bp, Homo sapiens
gaggctcatggccctgtagtt

SEQ ID NO: 6216779 - DNA, 22 bp, Homo sapiens
gaggctcatggccctgtagtta

SEQ ID NO: 6216780 - DNA, 15 bp, Homo sapiens
gaggctccacttggt

SEQ ID NO: 6216781 - DNA, 18 bp, Homo sapiens
gaggctccacttggtctg

SEQ ID NO: 6216782 - DNA, 19 bp, Homo sapiens
gaggctccacttggtctgt

SEQ ID NO: 6216783 - DNA, 23 bp, Homo sapiens
gaggctccacttggtctgtgaga

SEQ ID NO: 6216784 - DNA, 17 bp, Homo sapiens
gaggctccagagggcac

SEQ ID NO: 6216785 - DNA, 21 bp, Homo sapiens
gaggctccagctctggcacag

SEQ ID NO: 6216786 - DNA, 14 bp, Homo sapiens
gaggctccaggact

SEQ ID NO: 6216787 - DNA, 19 bp, Homo sapiens
gaggctcccggggcctgga

SEQ ID NO: 6216788 - DNA, 22 bp, Homo sapiens
gaggctcccggggcctggacag

SEQ ID NO: 6216789 - DNA, 13 bp, Homo sapiens
gaggctccggccc

SEQ ID NO: 6216790 - DNA, 20 bp, Homo sapiens
gaggctccgtgagcccttgg

SEQ ID NO: 6216791 - DNA, 18 bp, Homo sapiens
gaggctcctccctctgcc

SEQ ID NO: 6216792 - DNA, 21 bp, Homo sapiens
gaggctcctccctctgcctca

SEQ ID NO: 6216793 - DNA, 21 bp, Homo sapiens
gaggctcctctaggccctgtg

SEQ ID NO: 6216794 - DNA, 11 bp, Homo sapiens
gaggctcctgg

SEQ ID NO: 6216795 - DNA, 22 bp, Homo sapiens
gaggctcctgtgctactttgcc

SEQ ID NO: 6216796 - DNA, 13 bp, Homo sapiens
gaggctcctgtgg

SEQ ID NO: 6216797 - DNA, 16 bp, Homo sapiens
gaggctcggggctccc

SEQ ID NO: 6216798 - DNA, 22 bp, Homo sapiens
gaggctcggggctccccacgcc

SEQ ID NO: 6216799 - DNA, 22 bp, Homo sapiens
gaggctctaattgaattttcaa

SEQ ID NO: 6216800 - DNA, 23 bp, Homo sapiens
gaggctctattgagccaagacca

SEQ ID NO: 6216801 - DNA, 21 bp, Homo sapiens
gaggctctcatgtctctttgg

SEQ ID NO: 6216802 - DNA, 13 bp, Homo sapiens
gaggctctccaaa

SEQ ID NO: 6216803 - DNA, 19 bp, Homo sapiens
gaggctctctaagaaaaga

SEQ ID NO: 6216804 - DNA, 16 bp, Homo sapiens
gaggctctctctgcct

SEQ ID NO: 6216805 - DNA, 11 bp, Homo sapiens
gaggctctgaa

SEQ ID NO: 6216806 - DNA, 12 bp, Homo sapiens
gaggctctgaag

SEQ ID NO: 6216807 - DNA, 15 bp, Homo sapiens
gaggctctgaagaga

SEQ ID NO: 6216808 - DNA, 13 bp, Homo sapiens
gaggctctgccct

SEQ ID NO: 6216809 - DNA, 15 bp, Homo sapiens
gaggctctgtcactg

SEQ ID NO: 6216810 - DNA, 16 bp, Homo sapiens
gaggctctttctgggc

SEQ ID NO: 6216811 - DNA, 20 bp, Homo sapiens
gaggctgaaagaggccaatg

SEQ ID NO: 6216812 - DNA, 14 bp, Homo sapiens
gaggctgacacaga

SEQ ID NO: 6216813 - DNA, 15 bp, Homo sapiens
gaggctgacacagcc

SEQ ID NO: 6216814 - DNA, 17 bp, Homo sapiens
gaggctgacatgctcac

SEQ ID NO: 6216815 - DNA, 15 bp, Homo sapiens
gaggctgactcctgg

SEQ ID NO: 6216816 - DNA, 14 bp, Homo sapiens
gaggctgagactgc

SEQ ID NO: 6216817 - DNA, 18 bp, Homo sapiens
gaggctgagatgggagaa

SEQ ID NO: 6216818 - DNA, 12 bp, Homo sapiens
gaggctgagccc

SEQ ID NO: 6216819 - DNA, 17 bp, Homo sapiens
gaggctgaggactttgc

SEQ ID NO: 6216820 - DNA, 12 bp, Homo sapiens
gaggctgaggca

SEQ ID NO: 6216821 - DNA, 13 bp, Homo sapiens
gaggctgaggcag

SEQ ID NO: 6216822 - DNA, 18 bp, Homo sapiens
gaggctgaggcaggagaa

SEQ ID NO: 6216823 - DNA, 17 bp, Homo sapiens
gaggctgaggcaggagg

SEQ ID NO: 6216824 - DNA, 18 bp, Homo sapiens
gaggctgaggcctggact

SEQ ID NO: 6216825 - DNA, 19 bp, Homo sapiens
gaggctgaggctggcacag

SEQ ID NO: 6216826 - DNA, 20 bp, Homo sapiens
gaggctgaggctggcacagg

SEQ ID NO: 6216827 - DNA, 18 bp, Homo sapiens
gaggctgaggtggcagaa

SEQ ID NO: 6216828 - DNA, 14 bp, Homo sapiens
gaggctgaggtggg

SEQ ID NO: 6216829 - DNA, 19 bp, Homo sapiens
gaggctgcacccctgggcc

SEQ ID NO: 6216830 - DNA, 20 bp, Homo sapiens
gaggctgcactggagccaca

SEQ ID NO: 6216831 - DNA, 14 bp, Homo sapiens
gaggctgcacttgt

SEQ ID NO: 6216832 - DNA, 14 bp, Homo sapiens
gaggctgcagcagg

SEQ ID NO: 6216833 - DNA, 14 bp, Homo sapiens
gaggctgcagccag

SEQ ID NO: 6216834 - DNA, 17 bp, Homo sapiens
gaggctgcagccaggcc

SEQ ID NO: 6216835 - DNA, 18 bp, Homo sapiens
gaggctgcagccaggcca

SEQ ID NO: 6216836 - DNA, 18 bp, Homo sapiens
gaggctgcagccaggcct

SEQ ID NO: 6216837 - DNA, 16 bp, Homo sapiens
gaggctgcagcgagct

SEQ ID NO: 6216838 - DNA, 19 bp, Homo sapiens
gaggctgcagtgagccatg

SEQ ID NO: 6216839 - DNA, 15 bp, Homo sapiens
gaggctgcatgctct

SEQ ID NO: 6216840 - DNA, 19 bp, Homo sapiens
gaggctgcatgctctggaa

SEQ ID NO: 6216841 - DNA, 22 bp, Homo sapiens
gaggctgcatgctctggaagcc

SEQ ID NO: 6216842 - DNA, 12 bp, Homo sapiens
gaggctgccccc

SEQ ID NO: 6216843 - DNA, 19 bp, Homo sapiens
gaggctgcccccatccagc

SEQ ID NO: 6216844 - DNA, 19 bp, Homo sapiens
gaggctgcccccggccccc

SEQ ID NO: 6216845 - DNA, 18 bp, Homo sapiens
gaggctgcccctctcacc

SEQ ID NO: 6216846 - DNA, 19 bp, Homo sapiens
gaggctgcccctctcacca

SEQ ID NO: 6216847 - DNA, 16 bp, Homo sapiens
gaggctgccccttgga

SEQ ID NO: 6216848 - DNA, 23 bp, Homo sapiens
gaggctgccctcctgtgctcagc

SEQ ID NO: 6216849 - DNA, 18 bp, Homo sapiens
gaggctgccctgaggggc

SEQ ID NO: 6216850 - DNA, 15 bp, Homo sapiens
gaggctgcctcagcc

SEQ ID NO: 6216851 - DNA, 24 bp, Homo sapiens
gaggctgcctcagccagtggcaca

SEQ ID NO: 6216852 - DNA, 22 bp, Homo sapiens
gaggctgcctccgcacctgacc

SEQ ID NO: 6216853 - DNA, 16 bp, Homo sapiens
gaggctgcggcaggag

SEQ ID NO: 6216854 - DNA, 15 bp, Homo sapiens
gaggctgcgtcctga

SEQ ID NO: 6216855 - DNA, 13 bp, Homo sapiens
gaggctgctgacg

SEQ ID NO: 6216856 - DNA, 23 bp, Homo sapiens
gaggctgctgacgtttgacacca

SEQ ID NO: 6216857 - DNA, 16 bp, Homo sapiens
gaggctgctgccaggc

SEQ ID NO: 6216858 - DNA, 14 bp, Homo sapiens
gaggctgctgccat

SEQ ID NO: 6216859 - DNA, 20 bp, Homo sapiens
gaggctgctgccccctggct

SEQ ID NO: 6216860 - DNA, 14 bp, Homo sapiens
gaggctgctgtcac

SEQ ID NO: 6216861 - DNA, 23 bp, Homo sapiens
gaggctgcttcccagaggagcag

SEQ ID NO: 6216862 - DNA, 12 bp, Homo sapiens
gaggctggacca

SEQ ID NO: 6216863 - DNA, 16 bp, Homo sapiens
gaggctggaccaactg

SEQ ID NO: 6216864 - DNA, 21 bp, Homo sapiens
gaggctggactccagatctgc

SEQ ID NO: 6216865 - DNA, 15 bp, Homo sapiens
gaggctggagctggc

SEQ ID NO: 6216866 - DNA, 15 bp, Homo sapiens
gaggctggaggaagg

SEQ ID NO: 6216867 - DNA, 14 bp, Homo sapiens
gaggctggaggcag

SEQ ID NO: 6216868 - DNA, 15 bp, Homo sapiens
gaggctggaggcagg

SEQ ID NO: 6216869 - DNA, 23 bp, Homo sapiens
gaggctggatcctagccttatcc

SEQ ID NO: 6216870 - DNA, 12 bp, Homo sapiens
gaggctggcaag

SEQ ID NO: 6216871 - DNA, 23 bp, Homo sapiens
gaggctggcaagaaccagttgtt

SEQ ID NO: 6216872 - DNA, 13 bp, Homo sapiens
gaggctggcactg

SEQ ID NO: 6216873 - DNA, 12 bp, Homo sapiens
gaggctggcagg

SEQ ID NO: 6216874 - DNA, 13 bp, Homo sapiens
gaggctggcaggg

SEQ ID NO: 6216875 - DNA, 12 bp, Homo sapiens
gaggctggccaa

SEQ ID NO: 6216876 - DNA, 12 bp, Homo sapiens
gaggctggctgg

SEQ ID NO: 6216877 - DNA, 15 bp, Homo sapiens
gaggctggctggggg

SEQ ID NO: 6216878 - DNA, 17 bp, Homo sapiens
gaggctggctgggggca

SEQ ID NO: 6216879 - DNA, 12 bp, Homo sapiens
gaggctgggaca

SEQ ID NO: 6216880 - DNA, 18 bp, Homo sapiens
gaggctgggacgctctgc

SEQ ID NO: 6216881 - DNA, 19 bp, Homo sapiens
gaggctgggacgctctgct

SEQ ID NO: 6216882 - DNA, 16 bp, Homo sapiens
gaggctgggaggagcc

SEQ ID NO: 6216883 - DNA, 18 bp, Homo sapiens
gaggctgggaggagcccc

SEQ ID NO: 6216884 - DNA, 19 bp, Homo sapiens
gaggctgggaggagcccct

SEQ ID NO: 6216885 - DNA, 14 bp, Homo sapiens
gaggctgggcacag

SEQ ID NO: 6216886 - DNA, 19 bp, Homo sapiens
gaggctgggcacagaggtc

SEQ ID NO: 6216887 - DNA, 17 bp, Homo sapiens
gaggctgggccagcctc

SEQ ID NO: 6216888 - DNA, 23 bp, Homo sapiens
gaggctgggccagcctcagctca

SEQ ID NO: 6216889 - DNA, 16 bp, Homo sapiens
gaggctgggcccctgg

SEQ ID NO: 6216890 - DNA, 15 bp, Homo sapiens
gaggctgggctccct

SEQ ID NO: 6216891 - DNA, 17 bp, Homo sapiens
gaggctgggctgggtgg

SEQ ID NO: 6216892 - DNA, 18 bp, Homo sapiens
gaggctggggccccatct

SEQ ID NO: 6216893 - DNA, 20 bp, Homo sapiens
gaggctggggccccatcttg

SEQ ID NO: 6216894 - DNA, 19 bp, Homo sapiens
gaggctgggtggccggccc

SEQ ID NO: 6216895 - DNA, 20 bp, Homo sapiens
gaggctgggtggccggccct

SEQ ID NO: 6216896 - DNA, 23 bp, Homo sapiens
gaggctggtaagggaccttcagg

SEQ ID NO: 6216897 - DNA, 15 bp, Homo sapiens
gaggctggtgccagg

SEQ ID NO: 6216898 - DNA, 18 bp, Homo sapiens
gaggctggtgccaggcgc

SEQ ID NO: 6216899 - DNA, 14 bp, Homo sapiens
gaaattctgttttt

SEQ ID NO: 6216900 - DNA, 15 bp, Homo sapiens
gaaattctgttttta

SEQ ID NO: 6216901 - DNA, 16 bp, Homo sapiens
gaaattctgtttttaa

SEQ ID NO: 6216902 - DNA, 23 bp, Homo sapiens
gaaattcttataactcaacattt

SEQ ID NO: 6216903 - DNA, 14 bp, Homo sapiens
gaaattcttatgtt

SEQ ID NO: 6216904 - DNA, 22 bp, Homo sapiens
gaaattcttgttatggtagaaa

SEQ ID NO: 6216905 - DNA, 15 bp, Homo sapiens
gaaattcttttcaaa

SEQ ID NO: 6216906 - DNA, 17 bp, Homo sapiens
gaaattgaaaagttatt

SEQ ID NO: 6216907 - DNA, 17 bp, Homo sapiens
gaaattgaacctttgtg

SEQ ID NO: 6216908 - DNA, 21 bp, Homo sapiens
gaaattgaacctttgtgccct

SEQ ID NO: 6216909 - DNA, 13 bp, Homo sapiens
gaaattgaatact

SEQ ID NO: 6216910 - DNA, 16 bp, Homo sapiens
gaaattgaatactttg

SEQ ID NO: 6216911 - DNA, 18 bp, Homo sapiens
gaaattgaatactttgaa

SEQ ID NO: 6216912 - DNA, 16 bp, Homo sapiens
gaaattgattttgaaa

SEQ ID NO: 6216913 - DNA, 18 bp, Homo sapiens
gaaattgcaaagaaaatt

SEQ ID NO: 6216914 - DNA, 20 bp, Homo sapiens
gaaattgcataattttctaa

SEQ ID NO: 6216915 - DNA, 21 bp, Homo sapiens
gaaattgcctatcctgctgtt

SEQ ID NO: 6216916 - DNA, 17 bp, Homo sapiens
gaaattgcctgaaaccc

SEQ ID NO: 6216917 - DNA, 13 bp, Homo sapiens
gaaattgctattt

SEQ ID NO: 6216918 - DNA, 16 bp, Homo sapiens
gaaattggaaaggact

SEQ ID NO: 6216919 - DNA, 22 bp, Homo sapiens
gaaattggaacagaatgtttta

SEQ ID NO: 6216920 - DNA, 21 bp, Homo sapiens
gaaattggcagttcctggcat

SEQ ID NO: 6216921 - DNA, 13 bp, Homo sapiens
gaaattgggtgtg

SEQ ID NO: 6216922 - DNA, 22 bp, Homo sapiens
gaaattgggtgtgccctggctc

SEQ ID NO: 6216923 - DNA, 21 bp, Homo sapiens
gaaattggtaccttgcacaca

SEQ ID NO: 6216924 - DNA, 18 bp, Homo sapiens
gaaattggtgggaagcaa

SEQ ID NO: 6216925 - DNA, 16 bp, Homo sapiens
gaaattgtattacaaa

SEQ ID NO: 6216926 - DNA, 14 bp, Homo sapiens
gaaattgtccttga

SEQ ID NO: 6216927 - DNA, 15 bp, Homo sapiens
gaaattgtgccaaag

SEQ ID NO: 6216928 - DNA, 17 bp, Homo sapiens
gaaattgtgtttgacat

SEQ ID NO: 6216929 - DNA, 18 bp, Homo sapiens
gaaatttaaaaataaagc

SEQ ID NO: 6216930 - DNA, 19 bp, Homo sapiens
gaaatttaaaaataaagct

SEQ ID NO: 6216931 - DNA, 20 bp, Homo sapiens
gaaatttaaaaataaagcta

SEQ ID NO: 6216932 - DNA, 15 bp, Homo sapiens
gaaatttaaacatta

SEQ ID NO: 6216933 - DNA, 13 bp, Homo sapiens
gaaatttaaagca

SEQ ID NO: 6216934 - DNA, 22 bp, Homo sapiens
gaaatttaaagcaggttcttgt

SEQ ID NO: 6216935 - DNA, 19 bp, Homo sapiens
gaaatttaaataatagaca

SEQ ID NO: 6216936 - DNA, 13 bp, Homo sapiens
gaaatttaagcac

SEQ ID NO: 6216937 - DNA, 19 bp, Homo sapiens
gaaatttaatacatttata

SEQ ID NO: 6216938 - DNA, 21 bp, Homo sapiens
gaaatttaatgtttctctgga

SEQ ID NO: 6216939 - DNA, 20 bp, Homo sapiens
gaaatttaattcatgtttct

SEQ ID NO: 6216940 - DNA, 14 bp, Homo sapiens
gaaatttacacagt

SEQ ID NO: 6216941 - DNA, 18 bp, Homo sapiens
gaaatttacacagtgaga

SEQ ID NO: 6216942 - DNA, 16 bp, Homo sapiens
gaaatttactgtgaga

SEQ ID NO: 6216943 - DNA, 20 bp, Homo sapiens
gaaatttactgtgagactgt

SEQ ID NO: 6216944 - DNA, 16 bp, Homo sapiens
gaaatttagagttcta

SEQ ID NO: 6216945 - DNA, 16 bp, Homo sapiens
gaaatttagcattgta

SEQ ID NO: 6216946 - DNA, 16 bp, Homo sapiens
gaaatttataaacttt

SEQ ID NO: 6216947 - DNA, 14 bp, Homo sapiens
gaaatttatacaaa

SEQ ID NO: 6216948 - DNA, 15 bp, Homo sapiens
gaaatttatacaaag

SEQ ID NO: 6216949 - DNA, 16 bp, Homo sapiens
gaaatttatacaaaga

SEQ ID NO: 6216950 - DNA, 11 bp, Homo sapiens
gaaatttatga

SEQ ID NO: 6216951 - DNA, 19 bp, Homo sapiens
gaaatttattagttaatat

SEQ ID NO: 6216952 - DNA, 23 bp, Homo sapiens
gaaatttatttcctagttctgta

SEQ ID NO: 6216953 - DNA, 16 bp, Homo sapiens
gaaatttcacgtcata

SEQ ID NO: 6216954 - DNA, 11 bp, Homo sapiens
gaaatttcaga

SEQ ID NO: 6216955 - DNA, 21 bp, Homo sapiens
gaaatttcagattcccagagc

SEQ ID NO: 6216956 - DNA, 23 bp, Homo sapiens
gaaatttcagattcccagagcaa

SEQ ID NO: 6216957 - DNA, 12 bp, Homo sapiens
gaaatttcatga

SEQ ID NO: 6216958 - DNA, 20 bp, Homo sapiens
gaaatttccactcaggtctg

SEQ ID NO: 6216959 - DNA, 19 bp, Homo sapiens
gaaatttccggaagtaaat

SEQ ID NO: 6216960 - DNA, 13 bp, Homo sapiens
gaaatttctcagc

SEQ ID NO: 6216961 - DNA, 13 bp, Homo sapiens
gaaatttgaattt

SEQ ID NO: 6216962 - DNA, 15 bp, Homo sapiens
gaaatttgatttcta

SEQ ID NO: 6216963 - DNA, 21 bp, Homo sapiens
gaaatttgatttctattcaag

SEQ ID NO: 6216964 - DNA, 20 bp, Homo sapiens
gaaatttggcattgatctta

SEQ ID NO: 6216965 - DNA, 13 bp, Homo sapiens
gaaatttgttaat

SEQ ID NO: 6216966 - DNA, 17 bp, Homo sapiens
gaaatttgttataatga

SEQ ID NO: 6216967 - DNA, 11 bp, Homo sapiens
gaaattttaaa

SEQ ID NO: 6216968 - DNA, 15 bp, Homo sapiens
gaaattttaaatgca

SEQ ID NO: 6216969 - DNA, 16 bp, Homo sapiens
gaaattttaaatgcac

SEQ ID NO: 6216970 - DNA, 18 bp, Homo sapiens
gaaattttactgacagaa

SEQ ID NO: 6216971 - DNA, 19 bp, Homo sapiens
gaaattttactgacagaaa

SEQ ID NO: 6216972 - DNA, 22 bp, Homo sapiens
gaaattttactgacagaaatgc

SEQ ID NO: 6216973 - DNA, 14 bp, Homo sapiens
gaaattttagaaat

SEQ ID NO: 6216974 - DNA, 15 bp, Homo sapiens
gaaattttatatgct

SEQ ID NO: 6216975 - DNA, 15 bp, Homo sapiens
gaaattttatctctt

SEQ ID NO: 6216976 - DNA, 16 bp, Homo sapiens
gaaattttatctcttc

SEQ ID NO: 6216977 - DNA, 14 bp, Homo sapiens
gaaattttccaatg

SEQ ID NO: 6216978 - DNA, 20 bp, Homo sapiens
gaaattttccattacatgat

SEQ ID NO: 6216979 - DNA, 13 bp, Homo sapiens
gaaattttctaca

SEQ ID NO: 6216980 - DNA, 14 bp, Homo sapiens
gaaattttctacag

SEQ ID NO: 6216981 - DNA, 15 bp, Homo sapiens
gaaattttctagaat

SEQ ID NO: 6216982 - DNA, 18 bp, Homo sapiens
gaaattttctagactttc

SEQ ID NO: 6216983 - DNA, 20 bp, Homo sapiens
gaaattttctagactttctg

SEQ ID NO: 6216984 - DNA, 20 bp, Homo sapiens
gaaattttcttgatttgagt

SEQ ID NO: 6216985 - DNA, 22 bp, Homo sapiens
gaaattttgcaaatataaacat

SEQ ID NO: 6216986 - DNA, 13 bp, Homo sapiens
gaaattttgctat

SEQ ID NO: 6216987 - DNA, 15 bp, Homo sapiens
gaaattttgtaagaa

SEQ ID NO: 6216988 - DNA, 17 bp, Homo sapiens
gaaattttgtaagaagg

SEQ ID NO: 6216989 - DNA, 20 bp, Homo sapiens
gaaattttgtaagaaggcaa

SEQ ID NO: 6216990 - DNA, 13 bp, Homo sapiens
gaaatttttaagt

SEQ ID NO: 6216991 - DNA, 19 bp, Homo sapiens
gaaatttttacctttatct

SEQ ID NO: 6216992 - DNA, 19 bp, Homo sapiens
gaaatttttattaaattat

SEQ ID NO: 6216993 - DNA, 22 bp, Homo sapiens
gaaatttttcagatgcttctgg

SEQ ID NO: 6216994 - DNA, 23 bp, Homo sapiens
gaaatttttccacactatgtgtg

SEQ ID NO: 6216995 - DNA, 23 bp, Homo sapiens
gaaatttttgatgcccagacagc

SEQ ID NO: 6216996 - DNA, 21 bp, Homo sapiens
gaaatttttgcatgtttaata

SEQ ID NO: 6216997 - DNA, 15 bp, Homo sapiens
gaaatttttgtaaat

SEQ ID NO: 6216998 - DNA, 16 bp, Homo sapiens
gaaatttttttccaga

SEQ ID NO: 6216999 - DNA, 20 bp, Homo sapiens
gaaatttttttccagaattg

SEQ ID NO: 6217000 - DNA, 14 bp, Homo sapiens
gaacaaaaaaacca

SEQ ID NO: 6217001 - DNA, 20 bp, Homo sapiens
gaacaaaaaaaccacaaagg

SEQ ID NO: 6217002 - DNA, 19 bp, Homo sapiens
gaacaaaaaaatctgcaga

SEQ ID NO: 6217003 - DNA, 17 bp, Homo sapiens
gaacaaaaattgggttt

SEQ ID NO: 6217004 - DNA, 16 bp, Homo sapiens
gaacaaaaccccagaa

SEQ ID NO: 6217005 - DNA, 15 bp, Homo sapiens
gaacaaaacctacac

SEQ ID NO: 6217006 - DNA, 23 bp, Homo sapiens
gaacaaaactgttcttttgcatt

SEQ ID NO: 6217007 - DNA, 20 bp, Homo sapiens
gaacaaaagattggagctga

SEQ ID NO: 6217008 - DNA, 23 bp, Homo sapiens
gaacaaaagattggagctgaaga

SEQ ID NO: 6217009 - DNA, 15 bp, Homo sapiens
gaacaaaataaattg

SEQ ID NO: 6217010 - DNA, 18 bp, Homo sapiens
gaacaaacaaaacttaaa

SEQ ID NO: 6217011 - DNA, 20 bp, Homo sapiens
gaacaaactcagatctcatc

SEQ ID NO: 6217012 - DNA, 13 bp, Homo sapiens
gaacaaactgatg

SEQ ID NO: 6217013 - DNA, 17 bp, Homo sapiens
gaacaaagaaaaaaata

SEQ ID NO: 6217014 - DNA, 20 bp, Homo sapiens
gaacaaagaaaaaaatatat

SEQ ID NO: 6217015 - DNA, 16 bp, Homo sapiens
gaacaaagaccaattt

SEQ ID NO: 6217016 - DNA, 16 bp, Homo sapiens
gaacaaagagtgaaat

SEQ ID NO: 6217017 - DNA, 14 bp, Homo sapiens
gaacaaagcagcca

SEQ ID NO: 6217018 - DNA, 19 bp, Homo sapiens
gaacaaagctgttaaactg

SEQ ID NO: 6217019 - DNA, 15 bp, Homo sapiens
gaacaaagtgagaca

SEQ ID NO: 6217020 - DNA, 20 bp, Homo sapiens
gaacaaatcacacctctggg

SEQ ID NO: 6217021 - DNA, 14 bp, Homo sapiens
gaacaaatcttcct

SEQ ID NO: 6217022 - DNA, 21 bp, Homo sapiens
gaacaaattctttagtactca

SEQ ID NO: 6217023 - DNA, 16 bp, Homo sapiens
gaacaaattttctggt

SEQ ID NO: 6217024 - DNA, 21 bp, Homo sapiens
gaacaacagtagtttctcagg

SEQ ID NO: 6217025 - DNA, 13 bp, Homo sapiens
gaacaacataaaa

SEQ ID NO: 6217026 - DNA, 14 bp, Homo sapiens
gaacaacataaaat

SEQ ID NO: 6217027 - DNA, 15 bp, Homo sapiens
gaacaacatgttcta

SEQ ID NO: 6217028 - DNA, 16 bp, Homo sapiens
gaacaacatgttctac

SEQ ID NO: 6217029 - DNA, 17 bp, Homo sapiens
gaacaaccctgaagcag

SEQ ID NO: 6217030 - DNA, 13 bp, Homo sapiens
gaacaacttgcta

SEQ ID NO: 6217031 - DNA, 15 bp, Homo sapiens
gaacaacttggaaga

SEQ ID NO: 6217032 - DNA, 20 bp, Homo sapiens
gaacaagaaatctttctgga

SEQ ID NO: 6217033 - DNA, 16 bp, Homo sapiens
gaacaagacagccttc

SEQ ID NO: 6217034 - DNA, 18 bp, Homo sapiens
gaacaagacagccttcac

SEQ ID NO: 6217035 - DNA, 19 bp, Homo sapiens
gaacaagacccccaggaag

SEQ ID NO: 6217036 - DNA, 20 bp, Homo sapiens
gaacaagagtgtctatggag

SEQ ID NO: 6217037 - DNA, 14 bp, Homo sapiens
gaacaagccagagc

SEQ ID NO: 6217038 - DNA, 13 bp, Homo sapiens
gaacaagctggct

SEQ ID NO: 6217039 - DNA, 19 bp, Homo sapiens
gaacaaggatgtttttaat

SEQ ID NO: 6217040 - DNA, 20 bp, Homo sapiens
gaacaagtcacagctgcagc

SEQ ID NO: 6217041 - DNA, 22 bp, Homo sapiens
gaacaagtccctgtaattgttg

SEQ ID NO: 6217042 - DNA, 17 bp, Homo sapiens
gaacaagtgtacagaag

SEQ ID NO: 6217043 - DNA, 21 bp, Homo sapiens
gaacaagtgtacagaagaatt

SEQ ID NO: 6217044 - DNA, 20 bp, Homo sapiens
gaacaagttgttaaaacatt

SEQ ID NO: 6217045 - DNA, 19 bp, Homo sapiens
gaacaataatgagagcaaa

SEQ ID NO: 6217046 - DNA, 21 bp, Homo sapiens
gaacaataatgagagcaaatg

SEQ ID NO: 6217047 - DNA, 21 bp, Homo sapiens
gaacaatagctattgcatgta

SEQ ID NO: 6217048 - DNA, 23 bp, Homo sapiens
gaacaatagctattgcatgtaaa

SEQ ID NO: 6217049 - DNA, 17 bp, Homo sapiens
gaacaataggtaaagct

SEQ ID NO: 6217050 - DNA, 16 bp, Homo sapiens
gaacaatattttatgg

SEQ ID NO: 6217051 - DNA, 14 bp, Homo sapiens
gaacaatcacaaaa

SEQ ID NO: 6217052 - DNA, 17 bp, Homo sapiens
gaacaatgccagggccc

SEQ ID NO: 6217053 - DNA, 18 bp, Homo sapiens
gaacaatggggactttgt

SEQ ID NO: 6217054 - DNA, 13 bp, Homo sapiens
gaacaatgtatac

SEQ ID NO: 6217055 - DNA, 13 bp, Homo sapiens
gaacaattgaagt

SEQ ID NO: 6217056 - DNA, 20 bp, Homo sapiens
gaacaattgctatttaaata

SEQ ID NO: 6217057 - DNA, 14 bp, Homo sapiens
gaacaatttctctg

SEQ ID NO: 6217058 - DNA, 15 bp, Homo sapiens
gaacaatttggcaat

SEQ ID NO: 6217059 - DNA, 16 bp, Homo sapiens
gaacacaaaacttgaa

SEQ ID NO: 6217060 - DNA, 20 bp, Homo sapiens
gaacacaaacacattgttat

SEQ ID NO: 6217061 - DNA, 22 bp, Homo sapiens
gaacacaaacacattgttattt

SEQ ID NO: 6217062 - DNA, 13 bp, Homo sapiens
gaacacaaagacc

SEQ ID NO: 6217063 - DNA, 20 bp, Homo sapiens
gaacacaaagaccaaaatga

SEQ ID NO: 6217064 - DNA, 21 bp, Homo sapiens
gaacacaaagaccaaaatgaa

SEQ ID NO: 6217065 - DNA, 22 bp, Homo sapiens
gaacacaaagcggggggagggt

SEQ ID NO: 6217066 - DNA, 15 bp, Homo sapiens
gaacacaaatgaaaa

SEQ ID NO: 6217067 - DNA, 16 bp, Homo sapiens
gaacacaaccagaggt

SEQ ID NO: 6217068 - DNA, 18 bp, Homo sapiens
gaacacaagggatataaa

SEQ ID NO: 6217069 - DNA, 20 bp, Homo sapiens
gaacacaagggatataaaat

SEQ ID NO: 6217070 - DNA, 22 bp, Homo sapiens
gaacacaagggatataaaatga

SEQ ID NO: 6217071 - DNA, 11 bp, Homo sapiens
gaacacacaca

SEQ ID NO: 6217072 - DNA, 14 bp, Homo sapiens
gaacacacacatat

SEQ ID NO: 6217073 - DNA, 18 bp, Homo sapiens
gaacacacaccagtttac

SEQ ID NO: 6217074 - DNA, 16 bp, Homo sapiens
gaacacacacgccagc

SEQ ID NO: 6217075 - DNA, 18 bp, Homo sapiens
gaacacacagactttctg

SEQ ID NO: 6217076 - DNA, 17 bp, Homo sapiens
gaacacactcagcagcc

SEQ ID NO: 6217077 - DNA, 20 bp, Homo sapiens
gaacacactcagcagccccc

SEQ ID NO: 6217078 - DNA, 22 bp, Homo sapiens
gaggctggtgctgtggccaggg

SEQ ID NO: 6217079 - DNA, 21 bp, Homo sapiens
gaggctggttttgatggctgg

SEQ ID NO: 6217080 - DNA, 12 bp, Homo sapiens
gaggctgtagga

SEQ ID NO: 6217081 - DNA, 17 bp, Homo sapiens
gaggctgtcacagtcct

SEQ ID NO: 6217082 - DNA, 23 bp, Homo sapiens
gaggctgtcagtgtatggggcag

SEQ ID NO: 6217083 - DNA, 12 bp, Homo sapiens
gaggctgtcctg

SEQ ID NO: 6217084 - DNA, 13 bp, Homo sapiens
gaggctgtctggg

SEQ ID NO: 6217085 - DNA, 12 bp, Homo sapiens
gaggctgtgagc

SEQ ID NO: 6217086 - DNA, 14 bp, Homo sapiens
gaggctgtgagcag

SEQ ID NO: 6217087 - DNA, 13 bp, Homo sapiens
gaggctgtgctcc

SEQ ID NO: 6217088 - DNA, 21 bp, Homo sapiens
gaggctgtggagagaagtgag

SEQ ID NO: 6217089 - DNA, 15 bp, Homo sapiens
gaggctgtggctggt

SEQ ID NO: 6217090 - DNA, 23 bp, Homo sapiens
gaggctgtggtcacagcggaggt

SEQ ID NO: 6217091 - DNA, 14 bp, Homo sapiens
gaggctgtggtcag

SEQ ID NO: 6217092 - DNA, 23 bp, Homo sapiens
gaggctgtggtggctgtctctgt

SEQ ID NO: 6217093 - DNA, 14 bp, Homo sapiens
gaggctgtgtccct

SEQ ID NO: 6217094 - DNA, 15 bp, Homo sapiens
gaggctgtgtccctg

SEQ ID NO: 6217095 - DNA, 23 bp, Homo sapiens
gaggctgtgtccctgctggggtc

SEQ ID NO: 6217096 - DNA, 12 bp, Homo sapiens
gaggctgtgtct

SEQ ID NO: 6217097 - DNA, 18 bp, Homo sapiens
gaggctgtgtctctgcca

SEQ ID NO: 6217098 - DNA, 20 bp, Homo sapiens
gaggctgtgtgcctggggga

SEQ ID NO: 6217099 - DNA, 20 bp, Homo sapiens
gaggctgtttttggctgttt

SEQ ID NO: 6217100 - DNA, 13 bp, Homo sapiens
gaggcttcacgcc

SEQ ID NO: 6217101 - DNA, 17 bp, Homo sapiens
gaggcttccaagcatta

SEQ ID NO: 6217102 - DNA, 21 bp, Homo sapiens
gaggcttccagagagtcctct

SEQ ID NO: 6217103 - DNA, 14 bp, Homo sapiens
gaggcttccagctc

SEQ ID NO: 6217104 - DNA, 17 bp, Homo sapiens
gaggcttccagctcagt

SEQ ID NO: 6217105 - DNA, 21 bp, Homo sapiens
gaggcttccaggctcttcctg

SEQ ID NO: 6217106 - DNA, 13 bp, Homo sapiens
gaggcttccagtc

SEQ ID NO: 6217107 - DNA, 18 bp, Homo sapiens
gaggcttccctacacagg

SEQ ID NO: 6217108 - DNA, 21 bp, Homo sapiens
gaggcttcctgactgacacag

SEQ ID NO: 6217109 - DNA, 19 bp, Homo sapiens
gaggcttctccgccagcct

SEQ ID NO: 6217110 - DNA, 22 bp, Homo sapiens
gaggcttctccgccagcctcct

SEQ ID NO: 6217111 - DNA, 13 bp, Homo sapiens
gaggcttctcctg

SEQ ID NO: 6217112 - DNA, 16 bp, Homo sapiens
gaggcttcttgcccag

SEQ ID NO: 6217113 - DNA, 17 bp, Homo sapiens
gaggcttcttgcccaga

SEQ ID NO: 6217114 - DNA, 15 bp, Homo sapiens
gaggcttgaaggcca

SEQ ID NO: 6217115 - DNA, 14 bp, Homo sapiens
gaggcttgctgaga

SEQ ID NO: 6217116 - DNA, 18 bp, Homo sapiens
gaggcttgtcagagctgg

SEQ ID NO: 6217117 - DNA, 19 bp, Homo sapiens
gaggcttgtcagagctggg

SEQ ID NO: 6217118 - DNA, 23 bp, Homo sapiens
gaggctttatgataatagattct

SEQ ID NO: 6217119 - DNA, 17 bp, Homo sapiens
gaggctttcaaatgtac

SEQ ID NO: 6217120 - DNA, 14 bp, Homo sapiens
gaggctttccatgg

SEQ ID NO: 6217121 - DNA, 17 bp, Homo sapiens
gaggctttctgggctct

SEQ ID NO: 6217122 - DNA, 17 bp, Homo sapiens
gaggctttgagcaacta

SEQ ID NO: 6217123 - DNA, 18 bp, Homo sapiens
gaggctttgagcaactaa

SEQ ID NO: 6217124 - DNA, 20 bp, Homo sapiens
gaggcttttatggggccctg

SEQ ID NO: 6217125 - DNA, 14 bp, Homo sapiens
gaggcttttcactg

SEQ ID NO: 6217126 - DNA, 15 bp, Homo sapiens
gaggcttttccagtg

SEQ ID NO: 6217127 - DNA, 16 bp, Homo sapiens
gaggcttttcccacca

SEQ ID NO: 6217128 - DNA, 23 bp, Homo sapiens
gaggcttttcccaccagctccca

SEQ ID NO: 6217129 - DNA, 19 bp, Homo sapiens
gagggaaaaggcaggtgct

SEQ ID NO: 6217130 - DNA, 15 bp, Homo sapiens
gagggaaaagggaag

SEQ ID NO: 6217131 - DNA, 21 bp, Homo sapiens
gagggaaacccggggaactgg

SEQ ID NO: 6217132 - DNA, 17 bp, Homo sapiens
gagggaaactgtgaatg

SEQ ID NO: 6217133 - DNA, 23 bp, Homo sapiens
gagggaaactgtgaatgcttctg

SEQ ID NO: 6217134 - DNA, 17 bp, Homo sapiens
gagggaaagccagcctg

SEQ ID NO: 6217135 - DNA, 22 bp, Homo sapiens
gagggaaagccttaagctgcag

SEQ ID NO: 6217136 - DNA, 16 bp, Homo sapiens
gagggaaaggccagca

SEQ ID NO: 6217137 - DNA, 17 bp, Homo sapiens
gagggaaaggctgaaca

SEQ ID NO: 6217138 - DNA, 15 bp, Homo sapiens
gagggaaagggagag

SEQ ID NO: 6217139 - DNA, 16 bp, Homo sapiens
gagggaaatctgtaaa

SEQ ID NO: 6217140 - DNA, 19 bp, Homo sapiens
gagggaaccaccagcgttc

SEQ ID NO: 6217141 - DNA, 16 bp, Homo sapiens
gagggaactagggcac

SEQ ID NO: 6217142 - DNA, 14 bp, Homo sapiens
gagggaagaccaga

SEQ ID NO: 6217143 - DNA, 20 bp, Homo sapiens
gagggaagacctgaaagaga

SEQ ID NO: 6217144 - DNA, 16 bp, Homo sapiens
gagggaagagggagac

SEQ ID NO: 6217145 - DNA, 19 bp, Homo sapiens
gagggaagccaggattggg

SEQ ID NO: 6217146 - DNA, 17 bp, Homo sapiens
gagggaagcccacccgc

SEQ ID NO: 6217147 - DNA, 22 bp, Homo sapiens
gagggaagcccacccgccccag

SEQ ID NO: 6217148 - DNA, 23 bp, Homo sapiens
gagggaagcccacccgccccaga

SEQ ID NO: 6217149 - DNA, 15 bp, Homo sapiens
gagggaagctgaggc

SEQ ID NO: 6217150 - DNA, 16 bp, Homo sapiens
gagggaaggagacagg

SEQ ID NO: 6217151 - DNA, 13 bp, Homo sapiens
gagggaaggagcc

SEQ ID NO: 6217152 - DNA, 14 bp, Homo sapiens
gagggaagggagcc

SEQ ID NO: 6217153 - DNA, 20 bp, Homo sapiens
gagggaagggagccaaggga

SEQ ID NO: 6217154 - DNA, 18 bp, Homo sapiens
gagggaagggccaccctg

SEQ ID NO: 6217155 - DNA, 17 bp, Homo sapiens
gagggaaggggatggag

SEQ ID NO: 6217156 - DNA, 20 bp, Homo sapiens
gagggaagtcctgggaggat

SEQ ID NO: 6217157 - DNA, 19 bp, Homo sapiens
gagggaagtgtgagcgcct

SEQ ID NO: 6217158 - DNA, 21 bp, Homo sapiens
gagggaatccccgaaggtgct

SEQ ID NO: 6217159 - DNA, 14 bp, Homo sapiens
gagggaatgtgaaa

SEQ ID NO: 6217160 - DNA, 20 bp, Homo sapiens
gagggaatgttccctgcacc

SEQ ID NO: 6217161 - DNA, 14 bp, Homo sapiens
gagggacacagagg

SEQ ID NO: 6217162 - DNA, 15 bp, Homo sapiens
gagggacagagcccg

SEQ ID NO: 6217163 - DNA, 23 bp, Homo sapiens
gagggacagcagattccacagga

SEQ ID NO: 6217164 - DNA, 16 bp, Homo sapiens
gagggacaggatctat

SEQ ID NO: 6217165 - DNA, 20 bp, Homo sapiens
gagggacaggctgaagagag

SEQ ID NO: 6217166 - DNA, 15 bp, Homo sapiens
gagggacagggcagg

SEQ ID NO: 6217167 - DNA, 13 bp, Homo sapiens
gagggacagggct

SEQ ID NO: 6217168 - DNA, 17 bp, Homo sapiens
gagggacagggcttggg

SEQ ID NO: 6217169 - DNA, 16 bp, Homo sapiens
gagggacagtctcacc

SEQ ID NO: 6217170 - DNA, 23 bp, Homo sapiens
gagggacagtctcaccatttccc

SEQ ID NO: 6217171 - DNA, 17 bp, Homo sapiens
gagggacatgctcacct

SEQ ID NO: 6217172 - DNA, 17 bp, Homo sapiens
gagggaccagctggggg

SEQ ID NO: 6217173 - DNA, 14 bp, Homo sapiens
gagggaccgagccc

SEQ ID NO: 6217174 - DNA, 21 bp, Homo sapiens
gagggacctactgaacccaga

SEQ ID NO: 6217175 - DNA, 14 bp, Homo sapiens
gagggacctctccc

SEQ ID NO: 6217176 - DNA, 21 bp, Homo sapiens
gagggacctgcatctaagcat

SEQ ID NO: 6217177 - DNA, 18 bp, Homo sapiens
gagggaccttggagagct

SEQ ID NO: 6217178 - DNA, 19 bp, Homo sapiens
gagggaccttggagagctc

SEQ ID NO: 6217179 - DNA, 14 bp, Homo sapiens
gagggacgcctggg

SEQ ID NO: 6217180 - DNA, 15 bp, Homo sapiens
gagggacgcggagga

SEQ ID NO: 6217181 - DNA, 18 bp, Homo sapiens
gagggacgcggaggagga

SEQ ID NO: 6217182 - DNA, 21 bp, Homo sapiens
gagggactccaagccctgggg

SEQ ID NO: 6217183 - DNA, 18 bp, Homo sapiens
gagggactctgaagcctc

SEQ ID NO: 6217184 - DNA, 20 bp, Homo sapiens
gagggactctgaagcctctg

SEQ ID NO: 6217185 - DNA, 21 bp, Homo sapiens
gagggactctgtctggccagg

SEQ ID NO: 6217186 - DNA, 16 bp, Homo sapiens
gagggactgagccaga

SEQ ID NO: 6217187 - DNA, 16 bp, Homo sapiens
gagggactggacagcc

SEQ ID NO: 6217188 - DNA, 18 bp, Homo sapiens
gagggactggacagccag

SEQ ID NO: 6217189 - DNA, 15 bp, Homo sapiens
gagggactgtcgctg

SEQ ID NO: 6217190 - DNA, 12 bp, Homo sapiens
gagggagaaagg

SEQ ID NO: 6217191 - DNA, 13 bp, Homo sapiens
gagggagaagaag

SEQ ID NO: 6217192 - DNA, 12 bp, Homo sapiens
gagggagaagag

SEQ ID NO: 6217193 - DNA, 22 bp, Homo sapiens
gagggagaaggagaggctctga

SEQ ID NO: 6217194 - DNA, 17 bp, Homo sapiens
gagggagacccaggggg

SEQ ID NO: 6217195 - DNA, 21 bp, Homo sapiens
gagggagacggccctgctggg

SEQ ID NO: 6217196 - DNA, 15 bp, Homo sapiens
gagggagactgaccc

SEQ ID NO: 6217197 - DNA, 14 bp, Homo sapiens
gagggagagactct

SEQ ID NO: 6217198 - DNA, 18 bp, Homo sapiens
gagggagagactctgagg

SEQ ID NO: 6217199 - DNA, 22 bp, Homo sapiens
gagggagagagagagagagagg

SEQ ID NO: 6217200 - DNA, 13 bp, Homo sapiens
gagggagcaagcc

SEQ ID NO: 6217201 - DNA, 14 bp, Homo sapiens
gagggagcaagccc

SEQ ID NO: 6217202 - DNA, 16 bp, Homo sapiens
gagggagcaagccttc

SEQ ID NO: 6217203 - DNA, 12 bp, Homo sapiens
gagggagcagac

SEQ ID NO: 6217204 - DNA, 19 bp, Homo sapiens
gagggagccatcccttccc

SEQ ID NO: 6217205 - DNA, 17 bp, Homo sapiens
gagggagccctgagcct

SEQ ID NO: 6217206 - DNA, 17 bp, Homo sapiens
gagggagccttgtgaga

SEQ ID NO: 6217207 - DNA, 21 bp, Homo sapiens
gagggagcgcccctggctgcc

SEQ ID NO: 6217208 - DNA, 12 bp, Homo sapiens
gagggagctgag

SEQ ID NO: 6217209 - DNA, 15 bp, Homo sapiens
gagggagctgaggcc

SEQ ID NO: 6217210 - DNA, 18 bp, Homo sapiens
gagggagctgaggcctcc

SEQ ID NO: 6217211 - DNA, 16 bp, Homo sapiens
gagggagctgctggct

SEQ ID NO: 6217212 - DNA, 13 bp, Homo sapiens
gagggaggaatcg

SEQ ID NO: 6217213 - DNA, 15 bp, Homo sapiens
gagggaggacatcat

SEQ ID NO: 6217214 - DNA, 13 bp, Homo sapiens
gagggaggacctg

SEQ ID NO: 6217215 - DNA, 14 bp, Homo sapiens
gagggaggcaccat

SEQ ID NO: 6217216 - DNA, 12 bp, Homo sapiens
gagggaggcccc

SEQ ID NO: 6217217 - DNA, 15 bp, Homo sapiens
gagggaggcggcctc

SEQ ID NO: 6217218 - DNA, 15 bp, Homo sapiens
gagggaggcggggag

SEQ ID NO: 6217219 - DNA, 15 bp, Homo sapiens
gagggagggagaggt

SEQ ID NO: 6217220 - DNA, 13 bp, Homo sapiens
gagggaggggagg

SEQ ID NO: 6217221 - DNA, 14 bp, Homo sapiens
gagggaggggaggt

SEQ ID NO: 6217222 - DNA, 17 bp, Homo sapiens
gagggaggggaggtggc

SEQ ID NO: 6217223 - DNA, 15 bp, Homo sapiens
gagggaggggccctg

SEQ ID NO: 6217224 - DNA, 21 bp, Homo sapiens
gagggaggggccctgtcactg

SEQ ID NO: 6217225 - DNA, 20 bp, Homo sapiens
gagggagggggaaggcaggg

SEQ ID NO: 6217226 - DNA, 21 bp, Homo sapiens
gagggagggtttctctcccaa

SEQ ID NO: 6217227 - DNA, 23 bp, Homo sapiens
gagggaggtggggcatggtttta

SEQ ID NO: 6217228 - DNA, 15 bp, Homo sapiens
gagggaggtgtttaa

SEQ ID NO: 6217229 - DNA, 18 bp, Homo sapiens
gagggaggtgtttaaaga

SEQ ID NO: 6217230 - DNA, 20 bp, Homo sapiens
gagggagtacaaagacaggg

SEQ ID NO: 6217231 - DNA, 14 bp, Homo sapiens
gagggagtcccaga

SEQ ID NO: 6217232 - DNA, 23 bp, Homo sapiens
gagggagtctcaggaggaggctg

SEQ ID NO: 6217233 - DNA, 14 bp, Homo sapiens
gagggagtgacaga

SEQ ID NO: 6217234 - DNA, 16 bp, Homo sapiens
gagggagtgacagagg

SEQ ID NO: 6217235 - DNA, 22 bp, Homo sapiens
gagggagtgacagaggcagccc

SEQ ID NO: 6217236 - DNA, 20 bp, Homo sapiens
gagggagtgagccagcagct

SEQ ID NO: 6217237 - DNA, 18 bp, Homo sapiens
gagggagtgagtggccct

SEQ ID NO: 6217238 - DNA, 16 bp, Homo sapiens
gagggagtgcagaaca

SEQ ID NO: 6217239 - DNA, 19 bp, Homo sapiens
gagggagtgcagaacacct

SEQ ID NO: 6217240 - DNA, 21 bp, Homo sapiens
gagggagtgcagaacacctgg

SEQ ID NO: 6217241 - DNA, 13 bp, Homo sapiens
gagggagtggcac

SEQ ID NO: 6217242 - DNA, 16 bp, Homo sapiens
gagggagttggctgga

SEQ ID NO: 6217243 - DNA, 21 bp, Homo sapiens
gagggagttttgtctgtctcc

SEQ ID NO: 6217244 - DNA, 15 bp, Homo sapiens
gagggatcagccccg

SEQ ID NO: 6217245 - DNA, 19 bp, Homo sapiens
gagggatcagttgcccccc

SEQ ID NO: 6217246 - DNA, 18 bp, Homo sapiens
gagggatgatgagggaag

SEQ ID NO: 6217247 - DNA, 14 bp, Homo sapiens
gagggatgcagtgc

SEQ ID NO: 6217248 - DNA, 13 bp, Homo sapiens
gagggatgccccc

SEQ ID NO: 6217249 - DNA, 20 bp, Homo sapiens
gagggatgcccccaggcagc

SEQ ID NO: 6217250 - DNA, 17 bp, Homo sapiens
gagggatgctgcctgag

SEQ ID NO: 6217251 - DNA, 20 bp, Homo sapiens
gagggatgtttggaaaaaac

SEQ ID NO: 6217252 - DNA, 19 bp, Homo sapiens
gagggattggccgcttggc

SEQ ID NO: 6217253 - DNA, 17 bp, Homo sapiens
gagggattggggtggac

SEQ ID NO: 6217254 - DNA, 21 bp, Homo sapiens
gagggatttccctgcagacct

SEQ ID NO: 6217255 - DNA, 19 bp, Homo sapiens
gagggatttctttgctgta

SEQ ID NO: 6217256 - DNA, 12 bp, Homo sapiens
gagggcaaacca

SEQ ID NO: 6217257 - DNA, 20 bp, Homo sapiens
gagggcaaaccaggctgcag

SEQ ID NO: 6217258 - DNA, 14 bp, Homo sapiens
gaacacactccatc

SEQ ID NO: 6217259 - DNA, 17 bp, Homo sapiens
gaacacagaccaggaag

SEQ ID NO: 6217260 - DNA, 18 bp, Homo sapiens
gaacacagaccaggaagc

SEQ ID NO: 6217261 - DNA, 17 bp, Homo sapiens
gaacacagagtgtgttt

SEQ ID NO: 6217262 - DNA, 18 bp, Homo sapiens
gaacacagatctcttgtt

SEQ ID NO: 6217263 - DNA, 15 bp, Homo sapiens
gaacacagcatgtgc

SEQ ID NO: 6217264 - DNA, 16 bp, Homo sapiens
gaacacagcatgtgcc

SEQ ID NO: 6217265 - DNA, 23 bp, Homo sapiens
gaacacagccaaagtaaactgtg

SEQ ID NO: 6217266 - DNA, 23 bp, Homo sapiens
gaacacagcctgggaccagggca

SEQ ID NO: 6217267 - DNA, 11 bp, Homo sapiens
gaacacaggca

SEQ ID NO: 6217268 - DNA, 16 bp, Homo sapiens
gaacacaggcaaagag

SEQ ID NO: 6217269 - DNA, 12 bp, Homo sapiens
gaacacaggcag

SEQ ID NO: 6217270 - DNA, 13 bp, Homo sapiens
gaacacaggcagc

SEQ ID NO: 6217271 - DNA, 14 bp, Homo sapiens
gaacacaggcagct

SEQ ID NO: 6217272 - DNA, 16 bp, Homo sapiens
gaacacaggcagcttt

SEQ ID NO: 6217273 - DNA, 19 bp, Homo sapiens
gaacacaggcagctttcta

SEQ ID NO: 6217274 - DNA, 13 bp, Homo sapiens
gaacacaggggcc

SEQ ID NO: 6217275 - DNA, 13 bp, Homo sapiens
gaacacagtgccc

SEQ ID NO: 6217276 - DNA, 15 bp, Homo sapiens
gaacacagtgcccca

SEQ ID NO: 6217277 - DNA, 15 bp, Homo sapiens
gaacacagttctggg

SEQ ID NO: 6217278 - DNA, 18 bp, Homo sapiens
gaacacagttgaattttt

SEQ ID NO: 6217279 - DNA, 17 bp, Homo sapiens
gaacacataattcagga

SEQ ID NO: 6217280 - DNA, 20 bp, Homo sapiens
gaacacataattcaggaagc

SEQ ID NO: 6217281 - DNA, 12 bp, Homo sapiens
gaacacatgcac

SEQ ID NO: 6217282 - DNA, 13 bp, Homo sapiens
gaacacatgcaca

SEQ ID NO: 6217283 - DNA, 14 bp, Homo sapiens
gaacacatggcaga

SEQ ID NO: 6217284 - DNA, 15 bp, Homo sapiens
gaacacatttctctg

SEQ ID NO: 6217285 - DNA, 23 bp, Homo sapiens
gaacacatttctttttaaaaaaa

SEQ ID NO: 6217286 - DNA, 12 bp, Homo sapiens
gaacacccactg

SEQ ID NO: 6217287 - DNA, 22 bp, Homo sapiens
gaacacccactggccagtccta

SEQ ID NO: 6217288 - DNA, 15 bp, Homo sapiens
gaacacccctgtgca

SEQ ID NO: 6217289 - DNA, 18 bp, Homo sapiens
gaacacccggaaagactg

SEQ ID NO: 6217290 - DNA, 16 bp, Homo sapiens
gaacaccctatatttt

SEQ ID NO: 6217291 - DNA, 23 bp, Homo sapiens
gaacacctgatcttacagaaaat

SEQ ID NO: 6217292 - DNA, 11 bp, Homo sapiens
gaacacctggc

SEQ ID NO: 6217293 - DNA, 15 bp, Homo sapiens
gaacacctggccggg

SEQ ID NO: 6217294 - DNA, 23 bp, Homo sapiens
gaacaccttggggtccctccacc

SEQ ID NO: 6217295 - DNA, 21 bp, Homo sapiens
gaacacctttgttttgcactg

SEQ ID NO: 6217296 - DNA, 16 bp, Homo sapiens
gaacacgataaaccat

SEQ ID NO: 6217297 - DNA, 20 bp, Homo sapiens
gaacacggagtggccgggcc

SEQ ID NO: 6217298 - DNA, 22 bp, Homo sapiens
gaacacgtccagaatttttcat

SEQ ID NO: 6217299 - DNA, 22 bp, Homo sapiens
gaacactaacctgaccgtgggc

SEQ ID NO: 6217300 - DNA, 22 bp, Homo sapiens
gaacactaactcaccagcccca

SEQ ID NO: 6217301 - DNA, 20 bp, Homo sapiens
gaacactactcttacatgta

SEQ ID NO: 6217302 - DNA, 23 bp, Homo sapiens
gaacactactcttacatgtataa

SEQ ID NO: 6217303 - DNA, 21 bp, Homo sapiens
gaacactactgctaaatcctc

SEQ ID NO: 6217304 - DNA, 20 bp, Homo sapiens
gaacactagacaagccagaa

SEQ ID NO: 6217305 - DNA, 16 bp, Homo sapiens
gaacactagctaagga

SEQ ID NO: 6217306 - DNA, 22 bp, Homo sapiens
gaacactcatgtctggagtccc

SEQ ID NO: 6217307 - DNA, 18 bp, Homo sapiens
gaacactccaattaagga

SEQ ID NO: 6217308 - DNA, 17 bp, Homo sapiens
gaacactccttcacaga

SEQ ID NO: 6217309 - DNA, 21 bp, Homo sapiens
gaacactctataacaaaggat

SEQ ID NO: 6217310 - DNA, 15 bp, Homo sapiens
gaacactctgagact

SEQ ID NO: 6217311 - DNA, 13 bp, Homo sapiens
gaacactcttagc

SEQ ID NO: 6217312 - DNA, 11 bp, Homo sapiens
gaacactgaca

SEQ ID NO: 6217313 - DNA, 16 bp, Homo sapiens
gaacactgcaccctcc

SEQ ID NO: 6217314 - DNA, 18 bp, Homo sapiens
gaacactgcaccctccac

SEQ ID NO: 6217315 - DNA, 23 bp, Homo sapiens
gaacactgcagtgttattttctt

SEQ ID NO: 6217316 - DNA, 13 bp, Homo sapiens
gaacactggacct

SEQ ID NO: 6217317 - DNA, 19 bp, Homo sapiens
gaacactggcagactgtgt

SEQ ID NO: 6217318 - DNA, 23 bp, Homo sapiens
gaacactggggacttggcctctc

SEQ ID NO: 6217319 - DNA, 18 bp, Homo sapiens
gaacactgggggagggga

SEQ ID NO: 6217320 - DNA, 16 bp, Homo sapiens
gaacacttattgcttt

SEQ ID NO: 6217321 - DNA, 18 bp, Homo sapiens
gaacagaaaacaacaaaa

SEQ ID NO: 6217322 - DNA, 18 bp, Homo sapiens
gaacagaactggaggcag

SEQ ID NO: 6217323 - DNA, 14 bp, Homo sapiens
gaacagaaggatga

SEQ ID NO: 6217324 - DNA, 20 bp, Homo sapiens
gaacagaaggtatacctggg

SEQ ID NO: 6217325 - DNA, 15 bp, Homo sapiens
gaacagaagtgagga

SEQ ID NO: 6217326 - DNA, 12 bp, Homo sapiens
gaacagaatgtt

SEQ ID NO: 6217327 - DNA, 15 bp, Homo sapiens
gaacagaatttatga

SEQ ID NO: 6217328 - DNA, 15 bp, Homo sapiens
gaacagacaggagaa

SEQ ID NO: 6217329 - DNA, 14 bp, Homo sapiens
gaacagaccagtga

SEQ ID NO: 6217330 - DNA, 15 bp, Homo sapiens
gaacagacctcggct

SEQ ID NO: 6217331 - DNA, 23 bp, Homo sapiens
gaacagacctgaggcttatcttt

SEQ ID NO: 6217332 - DNA, 15 bp, Homo sapiens
gaacagactggaagc

SEQ ID NO: 6217333 - DNA, 16 bp, Homo sapiens
gaacagactggaagca

SEQ ID NO: 6217334 - DNA, 22 bp, Homo sapiens
gaacagactggaagcacagctt

SEQ ID NO: 6217335 - DNA, 15 bp, Homo sapiens
gaacagagactctgg

SEQ ID NO: 6217336 - DNA, 17 bp, Homo sapiens
gaacagagcgggcctct

SEQ ID NO: 6217337 - DNA, 14 bp, Homo sapiens
gaacagaggcattt

SEQ ID NO: 6217338 - DNA, 15 bp, Homo sapiens
gaacagagggccaga

SEQ ID NO: 6217339 - DNA, 22 bp, Homo sapiens
gaacagatcttttactttggcc

SEQ ID NO: 6217340 - DNA, 22 bp, Homo sapiens
gaacagatggggtctgtgactg

SEQ ID NO: 6217341 - DNA, 15 bp, Homo sapiens
gaacagattgctaca

SEQ ID NO: 6217342 - DNA, 14 bp, Homo sapiens
gaacagatttcaaa

SEQ ID NO: 6217343 - DNA, 17 bp, Homo sapiens
gaacagatttcaaaaaa

SEQ ID NO: 6217344 - DNA, 13 bp, Homo sapiens
gaacagcaggccc

SEQ ID NO: 6217345 - DNA, 20 bp, Homo sapiens
gaacagcaggcccacctacc

SEQ ID NO: 6217346 - DNA, 19 bp, Homo sapiens
gaacagcagtaatcctggg

SEQ ID NO: 6217347 - DNA, 13 bp, Homo sapiens
gaacagcagtgtt

SEQ ID NO: 6217348 - DNA, 13 bp, Homo sapiens
gaacagcatggca

SEQ ID NO: 6217349 - DNA, 16 bp, Homo sapiens
gaacagcatggcactc

SEQ ID NO: 6217350 - DNA, 20 bp, Homo sapiens
gaacagcatggcactccctc

SEQ ID NO: 6217351 - DNA, 14 bp, Homo sapiens
gaacagcccagcac

SEQ ID NO: 6217352 - DNA, 14 bp, Homo sapiens
gaacagccccaggg

SEQ ID NO: 6217353 - DNA, 11 bp, Homo sapiens
gaacagccccg

SEQ ID NO: 6217354 - DNA, 16 bp, Homo sapiens
gaacagccctcggcct

SEQ ID NO: 6217355 - DNA, 15 bp, Homo sapiens
gaacagcctgcctgt

SEQ ID NO: 6217356 - DNA, 13 bp, Homo sapiens
gaacagccttaga

SEQ ID NO: 6217357 - DNA, 16 bp, Homo sapiens
gaacagcgggagacct

SEQ ID NO: 6217358 - DNA, 19 bp, Homo sapiens
gaacagcgggagacctgtg

SEQ ID NO: 6217359 - DNA, 14 bp, Homo sapiens
gaacagcgttttta

SEQ ID NO: 6217360 - DNA, 21 bp, Homo sapiens
gaacagcgtttttaacaagat

SEQ ID NO: 6217361 - DNA, 18 bp, Homo sapiens
gaacagctaacaataaag

SEQ ID NO: 6217362 - DNA, 22 bp, Homo sapiens
gaacagctatcacgttgaacca

SEQ ID NO: 6217363 - DNA, 21 bp, Homo sapiens
gaacagctatgggagccccag

SEQ ID NO: 6217364 - DNA, 14 bp, Homo sapiens
gaacagctcatctt

SEQ ID NO: 6217365 - DNA, 14 bp, Homo sapiens
gaacagctctgaga

SEQ ID NO: 6217366 - DNA, 22 bp, Homo sapiens
gaacagctctgagatcctggag

SEQ ID NO: 6217367 - DNA, 23 bp, Homo sapiens
gaacagctcttcactcagccaca

SEQ ID NO: 6217368 - DNA, 23 bp, Homo sapiens
gaacagctgggaccacaggtgca

SEQ ID NO: 6217369 - DNA, 19 bp, Homo sapiens
gaacagctggtgtagctac

SEQ ID NO: 6217370 - DNA, 22 bp, Homo sapiens
gaacagctggtgtagctacaga

SEQ ID NO: 6217371 - DNA, 23 bp, Homo sapiens
gaacagctgtgagccatgcctcc

SEQ ID NO: 6217372 - DNA, 13 bp, Homo sapiens
gaacagctgtgtc

SEQ ID NO: 6217373 - DNA, 14 bp, Homo sapiens
gaacagctgtgtct

SEQ ID NO: 6217374 - DNA, 17 bp, Homo sapiens
gaacagcttcaggttat

SEQ ID NO: 6217375 - DNA, 17 bp, Homo sapiens
gaacagctttgtatgtt

SEQ ID NO: 6217376 - DNA, 21 bp, Homo sapiens
gaacagctttgtatgtttatg

SEQ ID NO: 6217377 - DNA, 17 bp, Homo sapiens
gaacaggaaagagctag

SEQ ID NO: 6217378 - DNA, 11 bp, Homo sapiens
gaacaggacta

SEQ ID NO: 6217379 - DNA, 19 bp, Homo sapiens
gaacaggagacccacctga

SEQ ID NO: 6217380 - DNA, 23 bp, Homo sapiens
gaacaggagacccacctgaggct

SEQ ID NO: 6217381 - DNA, 15 bp, Homo sapiens
gaacaggaggaactg

SEQ ID NO: 6217382 - DNA, 16 bp, Homo sapiens
gaacaggaggaactgg

SEQ ID NO: 6217383 - DNA, 17 bp, Homo sapiens
gaacaggatattctcac

SEQ ID NO: 6217384 - DNA, 12 bp, Homo sapiens
gaacaggatgcc

SEQ ID NO: 6217385 - DNA, 19 bp, Homo sapiens
gaacaggcaagtgaagaaa

SEQ ID NO: 6217386 - DNA, 14 bp, Homo sapiens
gaacaggctggggc

SEQ ID NO: 6217387 - DNA, 23 bp, Homo sapiens
gaacagggaacattggagctgac

SEQ ID NO: 6217388 - DNA, 17 bp, Homo sapiens
gaacagggaccagctcc

SEQ ID NO: 6217389 - DNA, 15 bp, Homo sapiens
gaacagggacttgtt

SEQ ID NO: 6217390 - DNA, 18 bp, Homo sapiens
gaacagggcccaggcctg

SEQ ID NO: 6217391 - DNA, 21 bp, Homo sapiens
gaacagggcccaggcctggag

SEQ ID NO: 6217392 - DNA, 22 bp, Homo sapiens
gaacaggtcccacgccaggcca

SEQ ID NO: 6217393 - DNA, 16 bp, Homo sapiens
gaacaggtggatgtat

SEQ ID NO: 6217394 - DNA, 15 bp, Homo sapiens
gaacaggtgttcctc

SEQ ID NO: 6217395 - DNA, 16 bp, Homo sapiens
gaacaggttcacgtga

SEQ ID NO: 6217396 - DNA, 16 bp, Homo sapiens
gaacaggtttaaaaat

SEQ ID NO: 6217397 - DNA, 20 bp, Homo sapiens
gaacaggtttaaaaatcccc

SEQ ID NO: 6217398 - DNA, 14 bp, Homo sapiens
gaacagtaactgcc

SEQ ID NO: 6217399 - DNA, 16 bp, Homo sapiens
gaacagtacagtattt

SEQ ID NO: 6217400 - DNA, 22 bp, Homo sapiens
gaacagtactggttactttcaa

SEQ ID NO: 6217401 - DNA, 18 bp, Homo sapiens
gaacagtaggattgctgt

SEQ ID NO: 6217402 - DNA, 16 bp, Homo sapiens
gaacagtattgggcag

SEQ ID NO: 6217403 - DNA, 17 bp, Homo sapiens
gaacagtattgggcagg

SEQ ID NO: 6217404 - DNA, 18 bp, Homo sapiens
gaacagtattgggcagga

SEQ ID NO: 6217405 - DNA, 21 bp, Homo sapiens
gaacagtcacccttctgggca

SEQ ID NO: 6217406 - DNA, 16 bp, Homo sapiens
gaacagtcacgcctga

SEQ ID NO: 6217407 - DNA, 18 bp, Homo sapiens
gaacagtgaggtgcccag

SEQ ID NO: 6217408 - DNA, 19 bp, Homo sapiens
gaacagtgattttttttta

SEQ ID NO: 6217409 - DNA, 18 bp, Homo sapiens
gaacagtgcacctgggac

SEQ ID NO: 6217410 - DNA, 18 bp, Homo sapiens
gaacagtgcatgtgcatg

SEQ ID NO: 6217411 - DNA, 17 bp, Homo sapiens
gaacagtgctctgcctc

SEQ ID NO: 6217412 - DNA, 18 bp, Homo sapiens
gaacagtgctctgcctct

SEQ ID NO: 6217413 - DNA, 19 bp, Homo sapiens
gaacagtggccttgcttct

SEQ ID NO: 6217414 - DNA, 22 bp, Homo sapiens
gaacagtggctgggtgggccca

SEQ ID NO: 6217415 - DNA, 23 bp, Homo sapiens
gaacagtggctgggtgggcccag

SEQ ID NO: 6217416 - DNA, 18 bp, Homo sapiens
gaacagtggttgcctggg

SEQ ID NO: 6217417 - DNA, 19 bp, Homo sapiens
gaacagtggttgcctgggg

SEQ ID NO: 6217418 - DNA, 24 bp, Homo sapiens
gaacagtgtgcaaggcagccgtgg

SEQ ID NO: 6217419 - DNA, 19 bp, Homo sapiens
gaacagtgtttactttaaa

SEQ ID NO: 6217420 - DNA, 24 bp, Homo sapiens
gaacagtgtttactttaaatcctt

SEQ ID NO: 6217421 - DNA, 16 bp, Homo sapiens
gaacagtgtttcccat

SEQ ID NO: 6217422 - DNA, 18 bp, Homo sapiens
gaacagtgtttgattttt

SEQ ID NO: 6217423 - DNA, 24 bp, Homo sapiens
gaacagttacctctgcctcagaaa

SEQ ID NO: 6217424 - DNA, 17 bp, Homo sapiens
gaacagttgctgttctt

SEQ ID NO: 6217425 - DNA, 17 bp, Homo sapiens
gaacagtttacttggaa

SEQ ID NO: 6217426 - DNA, 22 bp, Homo sapiens
gaacataaaaaggacatcagca

SEQ ID NO: 6217427 - DNA, 16 bp, Homo sapiens
gaacataacttctcat

SEQ ID NO: 6217428 - DNA, 21 bp, Homo sapiens
gaacataatgaacagaattta

SEQ ID NO: 6217429 - DNA, 12 bp, Homo sapiens
gaacatacagac

SEQ ID NO: 6217430 - DNA, 15 bp, Homo sapiens
gaacatacagacaca

SEQ ID NO: 6217431 - DNA, 23 bp, Homo sapiens
gaacatacatgatacatttttat

SEQ ID NO: 6217432 - DNA, 13 bp, Homo sapiens
gaacatactgttc

SEQ ID NO: 6217433 - DNA, 22 bp, Homo sapiens
gaacatactgttcactcactct

SEQ ID NO: 6217434 - DNA, 21 bp, Homo sapiens
gaacatacttcaaaaataatg

SEQ ID NO: 6217435 - DNA, 13 bp, Homo sapiens
gaacatacttggt

SEQ ID NO: 6217436 - DNA, 14 bp, Homo sapiens
gagggcaaagctga

SEQ ID NO: 6217437 - DNA, 15 bp, Homo sapiens
gagggcaagaggtgc

SEQ ID NO: 6217438 - DNA, 13 bp, Homo sapiens
gagggcaagccac

SEQ ID NO: 6217439 - DNA, 15 bp, Homo sapiens
gagggcaagccacca

SEQ ID NO: 6217440 - DNA, 21 bp, Homo sapiens
gagggcaagccctgcccacag

SEQ ID NO: 6217441 - DNA, 20 bp, Homo sapiens
gagggcaaggggtttccaca

SEQ ID NO: 6217442 - DNA, 20 bp, Homo sapiens
gagggcacaccgccatcctc

SEQ ID NO: 6217443 - DNA, 14 bp, Homo sapiens
gagggcacagaaaa

SEQ ID NO: 6217444 - DNA, 22 bp, Homo sapiens
gagggcacagaaaatggaagac

SEQ ID NO: 6217445 - DNA, 13 bp, Homo sapiens
gagggcacagccc

SEQ ID NO: 6217446 - DNA, 22 bp, Homo sapiens
gagggcacattaactccctcca

SEQ ID NO: 6217447 - DNA, 22 bp, Homo sapiens
gagggcacccccaaattcaaag

SEQ ID NO: 6217448 - DNA, 15 bp, Homo sapiens
gagggcactcagaag

SEQ ID NO: 6217449 - DNA, 16 bp, Homo sapiens
gagggcactggagctg

SEQ ID NO: 6217450 - DNA, 19 bp, Homo sapiens
gagggcactggagctggga

SEQ ID NO: 6217451 - DNA, 12 bp, Homo sapiens
gagggcactggt

SEQ ID NO: 6217452 - DNA, 16 bp, Homo sapiens
gagggcactggtggcc

SEQ ID NO: 6217453 - DNA, 13 bp, Homo sapiens
gagggcacttcag

SEQ ID NO: 6217454 - DNA, 22 bp, Homo sapiens
gagggcagaaaccttgtttgtt

SEQ ID NO: 6217455 - DNA, 20 bp, Homo sapiens
gagggcagaaaggttctgcc

SEQ ID NO: 6217456 - DNA, 21 bp, Homo sapiens
gagggcagaaaggttctgccc

SEQ ID NO: 6217457 - DNA, 13 bp, Homo sapiens
gagggcagagaca

SEQ ID NO: 6217458 - DNA, 13 bp, Homo sapiens
gagggcagagcca

SEQ ID NO: 6217459 - DNA, 14 bp, Homo sapiens
gagggcagagccat

SEQ ID NO: 6217460 - DNA, 16 bp, Homo sapiens
gagggcagagccatgg

SEQ ID NO: 6217461 - DNA, 14 bp, Homo sapiens
gagggcagaggctg

SEQ ID NO: 6217462 - DNA, 16 bp, Homo sapiens
gagggcagaggctgga

SEQ ID NO: 6217463 - DNA, 15 bp, Homo sapiens
gagggcagagtgggc

SEQ ID NO: 6217464 - DNA, 17 bp, Homo sapiens
gagggcagagtgggctg

SEQ ID NO: 6217465 - DNA, 22 bp, Homo sapiens
gagggcagcactgggaagctgg

SEQ ID NO: 6217466 - DNA, 22 bp, Homo sapiens
gagggcagcagaagggggtggt

SEQ ID NO: 6217467 - DNA, 22 bp, Homo sapiens
gagggcagcagccagccctgcc

SEQ ID NO: 6217468 - DNA, 13 bp, Homo sapiens
gagggcagcccgt

SEQ ID NO: 6217469 - DNA, 23 bp, Homo sapiens
gagggcagcgggagcctccctgc

SEQ ID NO: 6217470 - DNA, 13 bp, Homo sapiens
gagggcagctgct

SEQ ID NO: 6217471 - DNA, 15 bp, Homo sapiens
gagggcaggctgagg

SEQ ID NO: 6217472 - DNA, 13 bp, Homo sapiens
gagggcaggggtg

SEQ ID NO: 6217473 - DNA, 14 bp, Homo sapiens
gagggcaggggtgc

SEQ ID NO: 6217474 - DNA, 21 bp, Homo sapiens
gagggcaggtgccctctgctc

SEQ ID NO: 6217475 - DNA, 16 bp, Homo sapiens
gagggcagtaccctcc

SEQ ID NO: 6217476 - DNA, 19 bp, Homo sapiens
gagggcagtctagtcctgg

SEQ ID NO: 6217477 - DNA, 15 bp, Homo sapiens
gagggcatataaatt

SEQ ID NO: 6217478 - DNA, 23 bp, Homo sapiens
gagggcatcagctttccctggct

SEQ ID NO: 6217479 - DNA, 18 bp, Homo sapiens
gagggcatccataccagc

SEQ ID NO: 6217480 - DNA, 18 bp, Homo sapiens
gagggcatgcgcacaagg

SEQ ID NO: 6217481 - DNA, 17 bp, Homo sapiens
gagggcatgggagggag

SEQ ID NO: 6217482 - DNA, 18 bp, Homo sapiens
gagggcatgggttggcag

SEQ ID NO: 6217483 - DNA, 22 bp, Homo sapiens
gagggcatgggttggcagggtg

SEQ ID NO: 6217484 - DNA, 17 bp, Homo sapiens
gagggcatttggcttcc

SEQ ID NO: 6217485 - DNA, 22 bp, Homo sapiens
gagggcatttggcttcctctgc

SEQ ID NO: 6217486 - DNA, 18 bp, Homo sapiens
gagggccaagacttggca

SEQ ID NO: 6217487 - DNA, 17 bp, Homo sapiens
gagggccaagagatctg

SEQ ID NO: 6217488 - DNA, 13 bp, Homo sapiens
gagggccacagcc

SEQ ID NO: 6217489 - DNA, 17 bp, Homo sapiens
gagggccaccaggaagc

SEQ ID NO: 6217490 - DNA, 18 bp, Homo sapiens
gagggccaccaggaagca

SEQ ID NO: 6217491 - DNA, 16 bp, Homo sapiens
gagggccacgggtctg

SEQ ID NO: 6217492 - DNA, 13 bp, Homo sapiens
gagggccagagct

SEQ ID NO: 6217493 - DNA, 12 bp, Homo sapiens
gagggccagcag

SEQ ID NO: 6217494 - DNA, 11 bp, Homo sapiens
gagggccaggc

SEQ ID NO: 6217495 - DNA, 13 bp, Homo sapiens
gagggccaggcag

SEQ ID NO: 6217496 - DNA, 14 bp, Homo sapiens
gagggccaggcaga

SEQ ID NO: 6217497 - DNA, 16 bp, Homo sapiens
gagggccagggaccca

SEQ ID NO: 6217498 - DNA, 14 bp, Homo sapiens
gagggccagggagg

SEQ ID NO: 6217499 - DNA, 16 bp, Homo sapiens
gagggccagggaggca

SEQ ID NO: 6217500 - DNA, 12 bp, Homo sapiens
gagggccagtga

SEQ ID NO: 6217501 - DNA, 16 bp, Homo sapiens
gagggcccagagcagg

SEQ ID NO: 6217502 - DNA, 22 bp, Homo sapiens
gagggcccagagcaggaagcat

SEQ ID NO: 6217503 - DNA, 14 bp, Homo sapiens
gagggcccagccca

SEQ ID NO: 6217504 - DNA, 18 bp, Homo sapiens
gagggcccagcccagagc

SEQ ID NO: 6217505 - DNA, 19 bp, Homo sapiens
gagggcccagcccagagcc

SEQ ID NO: 6217506 - DNA, 13 bp, Homo sapiens
gagggcccagctg

SEQ ID NO: 6217507 - DNA, 18 bp, Homo sapiens
gagggcccagctgtagcc

SEQ ID NO: 6217508 - DNA, 16 bp, Homo sapiens
gagggcccaggcaggc

SEQ ID NO: 6217509 - DNA, 15 bp, Homo sapiens
gagggcccatcaggc

SEQ ID NO: 6217510 - DNA, 17 bp, Homo sapiens
gagggcccatcaggcag

SEQ ID NO: 6217511 - DNA, 18 bp, Homo sapiens
gagggcccatcaggcagt

SEQ ID NO: 6217512 - DNA, 20 bp, Homo sapiens
gagggcccctcactggctgg

SEQ ID NO: 6217513 - DNA, 12 bp, Homo sapiens
gagggcccctct

SEQ ID NO: 6217514 - DNA, 15 bp, Homo sapiens
gagggcccctctgcc

SEQ ID NO: 6217515 - DNA, 16 bp, Homo sapiens
gagggcccctctgccc

SEQ ID NO: 6217516 - DNA, 22 bp, Homo sapiens
gagggccctggtgtttctagca

SEQ ID NO: 6217517 - DNA, 15 bp, Homo sapiens
gagggccgcctgcct

SEQ ID NO: 6217518 - DNA, 17 bp, Homo sapiens
gagggccggcggctctg

SEQ ID NO: 6217519 - DNA, 21 bp, Homo sapiens
gagggccggcggctctgagca

SEQ ID NO: 6217520 - DNA, 17 bp, Homo sapiens
gagggccgtaccccacc

SEQ ID NO: 6217521 - DNA, 18 bp, Homo sapiens
gagggcctcagagacagc

SEQ ID NO: 6217522 - DNA, 14 bp, Homo sapiens
gagggcctcagagc

SEQ ID NO: 6217523 - DNA, 18 bp, Homo sapiens
gagggcctcagagcctga

SEQ ID NO: 6217524 - DNA, 21 bp, Homo sapiens
gagggcctcagagcctgacct

SEQ ID NO: 6217525 - DNA, 15 bp, Homo sapiens
gagggcctctgcctg

SEQ ID NO: 6217526 - DNA, 16 bp, Homo sapiens
gagggcctctgcctgg

SEQ ID NO: 6217527 - DNA, 17 bp, Homo sapiens
gagggcctctgcctggg

SEQ ID NO: 6217528 - DNA, 18 bp, Homo sapiens
gagggcctctgcctggga

SEQ ID NO: 6217529 - DNA, 15 bp, Homo sapiens
gagggcctctggaca

SEQ ID NO: 6217530 - DNA, 16 bp, Homo sapiens
gagggcctctggacag

SEQ ID NO: 6217531 - DNA, 21 bp, Homo sapiens
gagggcctgcaagggagtgag

SEQ ID NO: 6217532 - DNA, 19 bp, Homo sapiens
gagggcctgtgggagcctg

SEQ ID NO: 6217533 - DNA, 12 bp, Homo sapiens
gagggccttccc

SEQ ID NO: 6217534 - DNA, 12 bp, Homo sapiens
gagggccttctt

SEQ ID NO: 6217535 - DNA, 17 bp, Homo sapiens
gagggccttgcttctct

SEQ ID NO: 6217536 - DNA, 18 bp, Homo sapiens
gagggcgcccagcagcct

SEQ ID NO: 6217537 - DNA, 15 bp, Homo sapiens
gagggcgcccagccc

SEQ ID NO: 6217538 - DNA, 18 bp, Homo sapiens
gagggcgcccagcccagg

SEQ ID NO: 6217539 - DNA, 21 bp, Homo sapiens
gagggcgcccagcccaggcct

SEQ ID NO: 6217540 - DNA, 22 bp, Homo sapiens
gagggcgcccagcccaggcctg

SEQ ID NO: 6217541 - DNA, 23 bp, Homo sapiens
gagggcgcccagcccaggcctgg

SEQ ID NO: 6217542 - DNA, 15 bp, Homo sapiens
gagggcgcctgggtc

SEQ ID NO: 6217543 - DNA, 21 bp, Homo sapiens
gagggcgcctgggtcctccca

SEQ ID NO: 6217544 - DNA, 23 bp, Homo sapiens
gagggcgcctgggtcctcccagc

SEQ ID NO: 6217545 - DNA, 13 bp, Homo sapiens
gagggcggcaggg

SEQ ID NO: 6217546 - DNA, 13 bp, Homo sapiens
gagggcggccagg

SEQ ID NO: 6217547 - DNA, 14 bp, Homo sapiens
gagggcggccaggg

SEQ ID NO: 6217548 - DNA, 15 bp, Homo sapiens
gagggcggccaggga

SEQ ID NO: 6217549 - DNA, 17 bp, Homo sapiens
gagggcggccagggaca

SEQ ID NO: 6217550 - DNA, 22 bp, Homo sapiens
gagggcgtcaggcagaggcaac

SEQ ID NO: 6217551 - DNA, 23 bp, Homo sapiens
gagggcgtcaggcagaggcaact

SEQ ID NO: 6217552 - DNA, 19 bp, Homo sapiens
gagggctactcagcagtaa

SEQ ID NO: 6217553 - DNA, 19 bp, Homo sapiens
gagggctagaacctggaga

SEQ ID NO: 6217554 - DNA, 20 bp, Homo sapiens
gagggctagaacctggcagg

SEQ ID NO: 6217555 - DNA, 19 bp, Homo sapiens
gagggctagaactggagag

SEQ ID NO: 6217556 - DNA, 20 bp, Homo sapiens
gagggctagaatctggagag

SEQ ID NO: 6217557 - DNA, 19 bp, Homo sapiens
gagggctagccctgagccc

SEQ ID NO: 6217558 - DNA, 22 bp, Homo sapiens
gagggctagccctgagcccggc

SEQ ID NO: 6217559 - DNA, 15 bp, Homo sapiens
gagggctcagaagag

SEQ ID NO: 6217560 - DNA, 18 bp, Homo sapiens
gagggctcagaagagcag

SEQ ID NO: 6217561 - DNA, 14 bp, Homo sapiens
gagggctcagggca

SEQ ID NO: 6217562 - DNA, 13 bp, Homo sapiens
gagggctccagac

SEQ ID NO: 6217563 - DNA, 14 bp, Homo sapiens
gagggctccagaca

SEQ ID NO: 6217564 - DNA, 20 bp, Homo sapiens
gagggctccctgctccctcc

SEQ ID NO: 6217565 - DNA, 23 bp, Homo sapiens
gagggctccctgctccctccctc

SEQ ID NO: 6217566 - DNA, 16 bp, Homo sapiens
gagggctcctccatgg

SEQ ID NO: 6217567 - DNA, 13 bp, Homo sapiens
gagggctcctggg

SEQ ID NO: 6217568 - DNA, 18 bp, Homo sapiens
gagggctcctggggcaga

SEQ ID NO: 6217569 - DNA, 21 bp, Homo sapiens
gagggctcgaggggtgggctg

SEQ ID NO: 6217570 - DNA, 12 bp, Homo sapiens
gagggctctgag

SEQ ID NO: 6217571 - DNA, 23 bp, Homo sapiens
gagggctctgatctaacaaaata

SEQ ID NO: 6217572 - DNA, 20 bp, Homo sapiens
gagggctctgtttgtgggac

SEQ ID NO: 6217573 - DNA, 14 bp, Homo sapiens
gagggctgacaagg

SEQ ID NO: 6217574 - DNA, 22 bp, Homo sapiens
gagggctgagagggctgtggct

SEQ ID NO: 6217575 - DNA, 15 bp, Homo sapiens
gagggctgagccatg

SEQ ID NO: 6217576 - DNA, 16 bp, Homo sapiens
gagggctgagccatgg

SEQ ID NO: 6217577 - DNA, 19 bp, Homo sapiens
gagggctgagccatggggg

SEQ ID NO: 6217578 - DNA, 12 bp, Homo sapiens
gagggctgagga

SEQ ID NO: 6217579 - DNA, 14 bp, Homo sapiens
gagggctgaggagc

SEQ ID NO: 6217580 - DNA, 20 bp, Homo sapiens
gagggctgaggagcagccag

SEQ ID NO: 6217581 - DNA, 21 bp, Homo sapiens
gagggctgaggagcagccagg

SEQ ID NO: 6217582 - DNA, 23 bp, Homo sapiens
gagggctgaggagcagccaggac

SEQ ID NO: 6217583 - DNA, 20 bp, Homo sapiens
gagggctgatggaggaaaaa

SEQ ID NO: 6217584 - DNA, 23 bp, Homo sapiens
gagggctgatggattccaaacca

SEQ ID NO: 6217585 - DNA, 12 bp, Homo sapiens
gagggctgcaga

SEQ ID NO: 6217586 - DNA, 18 bp, Homo sapiens
gagggctgccagcagccc

SEQ ID NO: 6217587 - DNA, 21 bp, Homo sapiens
gagggctgcccggctgcccac

SEQ ID NO: 6217588 - DNA, 13 bp, Homo sapiens
gagggctgccctg

SEQ ID NO: 6217589 - DNA, 13 bp, Homo sapiens
gagggctgcctga

SEQ ID NO: 6217590 - DNA, 16 bp, Homo sapiens
gagggctgcctttgga

SEQ ID NO: 6217591 - DNA, 23 bp, Homo sapiens
gagggctgcgacgcttgctctgt

SEQ ID NO: 6217592 - DNA, 15 bp, Homo sapiens
gagggctggaatctg

SEQ ID NO: 6217593 - DNA, 21 bp, Homo sapiens
gagggctggaatctggagagc

SEQ ID NO: 6217594 - DNA, 23 bp, Homo sapiens
gagggctggaggcccaggctggg

SEQ ID NO: 6217595 - DNA, 11 bp, Homo sapiens
gagggctggcc

SEQ ID NO: 6217596 - DNA, 22 bp, Homo sapiens
gagggctggccgggactgctgc

SEQ ID NO: 6217597 - DNA, 13 bp, Homo sapiens
gagggctggctgg

SEQ ID NO: 6217598 - DNA, 16 bp, Homo sapiens
gagggctggctggcct

SEQ ID NO: 6217599 - DNA, 15 bp, Homo sapiens
gagggctgggcaggg

SEQ ID NO: 6217600 - DNA, 17 bp, Homo sapiens
gagggctgggcagggcc

SEQ ID NO: 6217601 - DNA, 14 bp, Homo sapiens
gagggctgggccca

SEQ ID NO: 6217602 - DNA, 13 bp, Homo sapiens
gagggctgtggct

SEQ ID NO: 6217603 - DNA, 17 bp, Homo sapiens
gagggcttccctagatg

SEQ ID NO: 6217604 - DNA, 21 bp, Homo sapiens
gagggcttcctctagaagcca

SEQ ID NO: 6217605 - DNA, 17 bp, Homo sapiens
gagggcttggcccagcg

SEQ ID NO: 6217606 - DNA, 12 bp, Homo sapiens
gagggcttggga

SEQ ID NO: 6217607 - DNA, 15 bp, Homo sapiens
gagggctttattaca

SEQ ID NO: 6217608 - DNA, 22 bp, Homo sapiens
gagggctttctgggtgtgtcca

SEQ ID NO: 6217609 - DNA, 21 bp, Homo sapiens
gagggctttgaatctgggact

SEQ ID NO: 6217610 - DNA, 17 bp, Homo sapiens
gaggggaaaaaaatgtt

SEQ ID NO: 6217611 - DNA, 15 bp, Homo sapiens
gaggggaaaggcctg

SEQ ID NO: 6217612 - DNA, 14 bp, Homo sapiens
gaggggaaaggctg

SEQ ID NO: 6217613 - DNA, 15 bp, Homo sapiens
gaggggaaatgtaat

SEQ ID NO: 6217614 - DNA, 20 bp, Homo sapiens
gaggggaaatgtaatactgg

SEQ ID NO: 6217615 - DNA, 12 bp, Homo sapiens
gaggggaacaga

SEQ ID NO: 6217616 - DNA, 14 bp, Homo sapiens
gaacatagatgcta

SEQ ID NO: 6217617 - DNA, 22 bp, Homo sapiens
gaacatagatgctacagtattt

SEQ ID NO: 6217618 - DNA, 15 bp, Homo sapiens
gaacatagttttcac

SEQ ID NO: 6217619 - DNA, 20 bp, Homo sapiens
gaacatatcatttgtgaaga

SEQ ID NO: 6217620 - DNA, 14 bp, Homo sapiens
gaacatcacagctt

SEQ ID NO: 6217621 - DNA, 20 bp, Homo sapiens
gaacatccaaggagaaacag

SEQ ID NO: 6217622 - DNA, 20 bp, Homo sapiens
gaacatccaagtctttcttc

SEQ ID NO: 6217623 - DNA, 14 bp, Homo sapiens
gaacatccctgggc

SEQ ID NO: 6217624 - DNA, 17 bp, Homo sapiens
gaacatccctgggcaag

SEQ ID NO: 6217625 - DNA, 17 bp, Homo sapiens
gaacatccgttgaatga

SEQ ID NO: 6217626 - DNA, 19 bp, Homo sapiens
gaacatcgatatgtatatc

SEQ ID NO: 6217627 - DNA, 18 bp, Homo sapiens
gaacatcgttgttttgct

SEQ ID NO: 6217628 - DNA, 19 bp, Homo sapiens
gaacatctaacccactaga

SEQ ID NO: 6217629 - DNA, 13 bp, Homo sapiens
gaacatctcacct

SEQ ID NO: 6217630 - DNA, 14 bp, Homo sapiens
gaacatctcttgaa

SEQ ID NO: 6217631 - DNA, 15 bp, Homo sapiens
gaacatctcttgaaa

SEQ ID NO: 6217632 - DNA, 21 bp, Homo sapiens
gaacatctgagtcctggatga

SEQ ID NO: 6217633 - DNA, 21 bp, Homo sapiens
gaacatctgccttgctgcacc

SEQ ID NO: 6217634 - DNA, 19 bp, Homo sapiens
gaacatctggggactaata

SEQ ID NO: 6217635 - DNA, 14 bp, Homo sapiens
gaacatctgtgtgt

SEQ ID NO: 6217636 - DNA, 12 bp, Homo sapiens
gaacatcttcat

SEQ ID NO: 6217637 - DNA, 13 bp, Homo sapiens
gaacatcttcata

SEQ ID NO: 6217638 - DNA, 22 bp, Homo sapiens
gaacatgaatctctaacagctc

SEQ ID NO: 6217639 - DNA, 17 bp, Homo sapiens
gaacatgacccagcctg

SEQ ID NO: 6217640 - DNA, 15 bp, Homo sapiens
gaacatgacccgtac

SEQ ID NO: 6217641 - DNA, 21 bp, Homo sapiens
gaacatgacccgtacacacca

SEQ ID NO: 6217642 - DNA, 16 bp, Homo sapiens
gaacatgagtgctgat

SEQ ID NO: 6217643 - DNA, 19 bp, Homo sapiens
gaacatgatagttaaacta

SEQ ID NO: 6217644 - DNA, 21 bp, Homo sapiens
gaacatgatgggcctgaactc

SEQ ID NO: 6217645 - DNA, 15 bp, Homo sapiens
gaacatgcaagaatt

SEQ ID NO: 6217646 - DNA, 16 bp, Homo sapiens
gaacatgcacatttat

SEQ ID NO: 6217647 - DNA, 15 bp, Homo sapiens
gaacatgcagtttga

SEQ ID NO: 6217648 - DNA, 16 bp, Homo sapiens
gaacatgcagtttgaa

SEQ ID NO: 6217649 - DNA, 18 bp, Homo sapiens
gaacatgcagtttgaaat

SEQ ID NO: 6217650 - DNA, 19 bp, Homo sapiens
gaacatgcagtttgaaatt

SEQ ID NO: 6217651 - DNA, 14 bp, Homo sapiens
gaacatgccccctg

SEQ ID NO: 6217652 - DNA, 15 bp, Homo sapiens
gaacatgcctcctcc

SEQ ID NO: 6217653 - DNA, 16 bp, Homo sapiens
gaacatgcctcctcct

SEQ ID NO: 6217654 - DNA, 19 bp, Homo sapiens
gaacatgcctcctcctgcc

SEQ ID NO: 6217655 - DNA, 20 bp, Homo sapiens
gaacatgcctcctcctgccc

SEQ ID NO: 6217656 - DNA, 23 bp, Homo sapiens
gaacatgcctgattttaaaaggt

SEQ ID NO: 6217657 - DNA, 19 bp, Homo sapiens
gaacatggacttgtatatt

SEQ ID NO: 6217658 - DNA, 22 bp, Homo sapiens
gaacatggactttcttgcatga

SEQ ID NO: 6217659 - DNA, 15 bp, Homo sapiens
gaacatggagctgtc

SEQ ID NO: 6217660 - DNA, 16 bp, Homo sapiens
gaacatggctggcctg

SEQ ID NO: 6217661 - DNA, 18 bp, Homo sapiens
gaacatggctggcctggt

SEQ ID NO: 6217662 - DNA, 15 bp, Homo sapiens
gaacatggggaggag

SEQ ID NO: 6217663 - DNA, 19 bp, Homo sapiens
gaacatggtgtgtgtctct

SEQ ID NO: 6217664 - DNA, 21 bp, Homo sapiens
gaacatggtgtgtgtctctga

SEQ ID NO: 6217665 - DNA, 15 bp, Homo sapiens
gaacatgtaaaatgt

SEQ ID NO: 6217666 - DNA, 17 bp, Homo sapiens
gaacatgtaaaatgttt

SEQ ID NO: 6217667 - DNA, 20 bp, Homo sapiens
gaacatgtagaaaacaaaat

SEQ ID NO: 6217668 - DNA, 24 bp, Homo sapiens
gaacatgtcctaattcttctgtcc

SEQ ID NO: 6217669 - DNA, 18 bp, Homo sapiens
gaacatgtgccttttctg

SEQ ID NO: 6217670 - DNA, 20 bp, Homo sapiens
gaacatgtgccttttctgaa

SEQ ID NO: 6217671 - DNA, 20 bp, Homo sapiens
gaacatgtttacaggtttga

SEQ ID NO: 6217672 - DNA, 22 bp, Homo sapiens
gaacatgtttacaggtttgaat

SEQ ID NO: 6217673 - DNA, 23 bp, Homo sapiens
gaacatgttttatactgctctat

SEQ ID NO: 6217674 - DNA, 13 bp, Homo sapiens
gaacattaaaata

SEQ ID NO: 6217675 - DNA, 21 bp, Homo sapiens
gaacattaaaatatagagaca

SEQ ID NO: 6217676 - DNA, 22 bp, Homo sapiens
gaacattaaaatatagagacag

SEQ ID NO: 6217677 - DNA, 22 bp, Homo sapiens
gaacattaatgttgaaaaagaa

SEQ ID NO: 6217678 - DNA, 15 bp, Homo sapiens
gaacattaggcccca

SEQ ID NO: 6217679 - DNA, 19 bp, Homo sapiens
gaacattattaaatcagaa

SEQ ID NO: 6217680 - DNA, 22 bp, Homo sapiens
gaacattattaaatcagaatct

SEQ ID NO: 6217681 - DNA, 20 bp, Homo sapiens
gaacattattcatctctcct

SEQ ID NO: 6217682 - DNA, 22 bp, Homo sapiens
gaacattcagctctggagaaca

SEQ ID NO: 6217683 - DNA, 18 bp, Homo sapiens
gaacattcccagcccagc

SEQ ID NO: 6217684 - DNA, 22 bp, Homo sapiens
gaacattcgaatctctgcccct

SEQ ID NO: 6217685 - DNA, 21 bp, Homo sapiens
gaacattctaccaaatttttg

SEQ ID NO: 6217686 - DNA, 13 bp, Homo sapiens
gaacattgcaata

SEQ ID NO: 6217687 - DNA, 17 bp, Homo sapiens
gaacattgcaatagaaa

SEQ ID NO: 6217688 - DNA, 23 bp, Homo sapiens
gaacattgcatataacttatatt

SEQ ID NO: 6217689 - DNA, 21 bp, Homo sapiens
gaacattggaatgttctcaga

SEQ ID NO: 6217690 - DNA, 22 bp, Homo sapiens
gaacattggggattgaaaatca

SEQ ID NO: 6217691 - DNA, 15 bp, Homo sapiens
gaacattggttcttt

SEQ ID NO: 6217692 - DNA, 10 bp, Homo sapiens
gaacattgta

SEQ ID NO: 6217693 - DNA, 14 bp, Homo sapiens
gaacattgtactgt

SEQ ID NO: 6217694 - DNA, 15 bp, Homo sapiens
gaacattgtactgtt

SEQ ID NO: 6217695 - DNA, 21 bp, Homo sapiens
gaacattgtactgttgcttta

SEQ ID NO: 6217696 - DNA, 16 bp, Homo sapiens
gaacatttaaaattaa

SEQ ID NO: 6217697 - DNA, 18 bp, Homo sapiens
gaacatttaaaattaaat

SEQ ID NO: 6217698 - DNA, 19 bp, Homo sapiens
gaacatttaaaattaaata

SEQ ID NO: 6217699 - DNA, 21 bp, Homo sapiens
gaacatttaataatgtatgta

SEQ ID NO: 6217700 - DNA, 23 bp, Homo sapiens
gaacatttaataatgtatgtaca

SEQ ID NO: 6217701 - DNA, 15 bp, Homo sapiens
gaacatttacacatt

SEQ ID NO: 6217702 - DNA, 20 bp, Homo sapiens
gaacatttagtaccctgcag

SEQ ID NO: 6217703 - DNA, 21 bp, Homo sapiens
gaacatttatccaggaattga

SEQ ID NO: 6217704 - DNA, 20 bp, Homo sapiens
gaacatttctgtaaatacca

SEQ ID NO: 6217705 - DNA, 17 bp, Homo sapiens
gaacatttgatattttt

SEQ ID NO: 6217706 - DNA, 19 bp, Homo sapiens
gaacatttgatatttttcc

SEQ ID NO: 6217707 - DNA, 23 bp, Homo sapiens
gaacatttgatatttttccattt

SEQ ID NO: 6217708 - DNA, 21 bp, Homo sapiens
gaacatttgggttactatttc

SEQ ID NO: 6217709 - DNA, 15 bp, Homo sapiens
gaacatttgtgatat

SEQ ID NO: 6217710 - DNA, 14 bp, Homo sapiens
gaacattttactgt

SEQ ID NO: 6217711 - DNA, 19 bp, Homo sapiens
gaacattttataaaacata

SEQ ID NO: 6217712 - DNA, 21 bp, Homo sapiens
gaacattttttttttttcctt

SEQ ID NO: 6217713 - DNA, 19 bp, Homo sapiens
gaaccaaaaaaaaaaaagg

SEQ ID NO: 6217714 - DNA, 22 bp, Homo sapiens
gaaccaaaaaaccccagctatt

SEQ ID NO: 6217715 - DNA, 16 bp, Homo sapiens
gaaccaaaacattccg

SEQ ID NO: 6217716 - DNA, 20 bp, Homo sapiens
gaaccaaaacattccgttta

SEQ ID NO: 6217717 - DNA, 19 bp, Homo sapiens
gaaccaaaagatgccttga

SEQ ID NO: 6217718 - DNA, 16 bp, Homo sapiens
gaaccaaacaccttca

SEQ ID NO: 6217719 - DNA, 11 bp, Homo sapiens
gaaccaaagcg

SEQ ID NO: 6217720 - DNA, 22 bp, Homo sapiens
gaaccaaatacctcaatttttg

SEQ ID NO: 6217721 - DNA, 23 bp, Homo sapiens
gaaccaaatggttcttacttttc

SEQ ID NO: 6217722 - DNA, 14 bp, Homo sapiens
gaaccaaattgcac

SEQ ID NO: 6217723 - DNA, 18 bp, Homo sapiens
gaaccaacaaggaaactt

SEQ ID NO: 6217724 - DNA, 13 bp, Homo sapiens
gaaccaaccccca

SEQ ID NO: 6217725 - DNA, 18 bp, Homo sapiens
gaaccaacgggtctgtgg

SEQ ID NO: 6217726 - DNA, 16 bp, Homo sapiens
gaaccaagctattcct

SEQ ID NO: 6217727 - DNA, 13 bp, Homo sapiens
gaaccaagcttca

SEQ ID NO: 6217728 - DNA, 19 bp, Homo sapiens
gaaccaagcttcagagcct

SEQ ID NO: 6217729 - DNA, 14 bp, Homo sapiens
gaaccaaggcagcc

SEQ ID NO: 6217730 - DNA, 18 bp, Homo sapiens
gaaccaaggcagcctcca

SEQ ID NO: 6217731 - DNA, 22 bp, Homo sapiens
gaaccaaggcagcctccagagc

SEQ ID NO: 6217732 - DNA, 23 bp, Homo sapiens
gaaccaagggccctcactcagga

SEQ ID NO: 6217733 - DNA, 12 bp, Homo sapiens
gaaccaagtgac

SEQ ID NO: 6217734 - DNA, 24 bp, Homo sapiens
gaaccaagtggaccttgagaccac

SEQ ID NO: 6217735 - DNA, 16 bp, Homo sapiens
gaaccaatagaaagca

SEQ ID NO: 6217736 - DNA, 19 bp, Homo sapiens
gaaccaatagaaagcaaac

SEQ ID NO: 6217737 - DNA, 15 bp, Homo sapiens
gaaccaattcacttt

SEQ ID NO: 6217738 - DNA, 22 bp, Homo sapiens
gaaccacaaaaaaaaaggctgg

SEQ ID NO: 6217739 - DNA, 14 bp, Homo sapiens
gaaccacaactttg

SEQ ID NO: 6217740 - DNA, 13 bp, Homo sapiens
gaaccacaagtga

SEQ ID NO: 6217741 - DNA, 21 bp, Homo sapiens
gaaccacaagtgaatctttct

SEQ ID NO: 6217742 - DNA, 17 bp, Homo sapiens
gaaccacagggccagag

SEQ ID NO: 6217743 - DNA, 18 bp, Homo sapiens
gaaccacatcttgctctg

SEQ ID NO: 6217744 - DNA, 17 bp, Homo sapiens
gaaccacattcagggaa

SEQ ID NO: 6217745 - DNA, 20 bp, Homo sapiens
gaaccaccacacccagccca

SEQ ID NO: 6217746 - DNA, 21 bp, Homo sapiens
gaaccaccagcgttcccttct

SEQ ID NO: 6217747 - DNA, 14 bp, Homo sapiens
gaaccacctacccc

SEQ ID NO: 6217748 - DNA, 20 bp, Homo sapiens
gaaccacggtgaaagtgctg

SEQ ID NO: 6217749 - DNA, 22 bp, Homo sapiens
gaaccactcccaccacaggcat

SEQ ID NO: 6217750 - DNA, 20 bp, Homo sapiens
gaaccactttcttatttttt

SEQ ID NO: 6217751 - DNA, 18 bp, Homo sapiens
gaaccagcactcccaggg

SEQ ID NO: 6217752 - DNA, 20 bp, Homo sapiens
gaaccagcactcccagggcc

SEQ ID NO: 6217753 - DNA, 19 bp, Homo sapiens
gaaccagcagaaatgcccc

SEQ ID NO: 6217754 - DNA, 13 bp, Homo sapiens
gaaccagcccagc

SEQ ID NO: 6217755 - DNA, 16 bp, Homo sapiens
gaaccagcccagcctg

SEQ ID NO: 6217756 - DNA, 20 bp, Homo sapiens
gaaccagccccatcagaacc

SEQ ID NO: 6217757 - DNA, 21 bp, Homo sapiens
gaaccagccctccagagcagg

SEQ ID NO: 6217758 - DNA, 20 bp, Homo sapiens
gaaccagccgtattttacat

SEQ ID NO: 6217759 - DNA, 23 bp, Homo sapiens
gaaccagcctcaaaaacgccctc

SEQ ID NO: 6217760 - DNA, 22 bp, Homo sapiens
gaaccaggagaagggctggggc

SEQ ID NO: 6217761 - DNA, 15 bp, Homo sapiens
gaaccaggagggtaa

SEQ ID NO: 6217762 - DNA, 21 bp, Homo sapiens
gaaccaggccttctgatttca

SEQ ID NO: 6217763 - DNA, 23 bp, Homo sapiens
gaaccatagttactgtaaaatgc

SEQ ID NO: 6217764 - DNA, 22 bp, Homo sapiens
gaaccatagttgacagttccaa

SEQ ID NO: 6217765 - DNA, 17 bp, Homo sapiens
gaaccatccttcccatg

SEQ ID NO: 6217766 - DNA, 17 bp, Homo sapiens
gaaccatgaagacagga

SEQ ID NO: 6217767 - DNA, 18 bp, Homo sapiens
gaaccatgaagacaggat

SEQ ID NO: 6217768 - DNA, 19 bp, Homo sapiens
gaaccatgcaggaaggaaa

SEQ ID NO: 6217769 - DNA, 21 bp, Homo sapiens
gaaccatgcaggaaggaaaac

SEQ ID NO: 6217770 - DNA, 22 bp, Homo sapiens
gaaccatgcaggaaggaaaact

SEQ ID NO: 6217771 - DNA, 21 bp, Homo sapiens
gaaccatggaggaggaagacc

SEQ ID NO: 6217772 - DNA, 21 bp, Homo sapiens
gaaccatgtcagcaaaaagca

SEQ ID NO: 6217773 - DNA, 16 bp, Homo sapiens
gaaccattaaccagat

SEQ ID NO: 6217774 - DNA, 14 bp, Homo sapiens
gaaccattatactt

SEQ ID NO: 6217775 - DNA, 16 bp, Homo sapiens
gaaccattatacttta

SEQ ID NO: 6217776 - DNA, 15 bp, Homo sapiens
gaaccatttcaccca

SEQ ID NO: 6217777 - DNA, 15 bp, Homo sapiens
gaacccaagtgcctc

SEQ ID NO: 6217778 - DNA, 16 bp, Homo sapiens
gaacccaagtgcctca

SEQ ID NO: 6217779 - DNA, 14 bp, Homo sapiens
gaacccacactgca

SEQ ID NO: 6217780 - DNA, 22 bp, Homo sapiens
gaacccacataaaagccccagc

SEQ ID NO: 6217781 - DNA, 23 bp, Homo sapiens
gaacccacataaaagccccagct

SEQ ID NO: 6217782 - DNA, 15 bp, Homo sapiens
gaacccaccctctcc

SEQ ID NO: 6217783 - DNA, 19 bp, Homo sapiens
gaacccacctgctgagaga

SEQ ID NO: 6217784 - DNA, 16 bp, Homo sapiens
gaacccagcccacccc

SEQ ID NO: 6217785 - DNA, 17 bp, Homo sapiens
gaacccagccctggggt

SEQ ID NO: 6217786 - DNA, 14 bp, Homo sapiens
gaacccagctctca

SEQ ID NO: 6217787 - DNA, 15 bp, Homo sapiens
gaacccagctctcag

SEQ ID NO: 6217788 - DNA, 19 bp, Homo sapiens
gaacccagctctcagggct

SEQ ID NO: 6217789 - DNA, 16 bp, Homo sapiens
gaacccaggacaagca

SEQ ID NO: 6217790 - DNA, 13 bp, Homo sapiens
gaacccaggagag

SEQ ID NO: 6217791 - DNA, 14 bp, Homo sapiens
gaacccaggcagct

SEQ ID NO: 6217792 - DNA, 20 bp, Homo sapiens
gaggggaacagggtgcagga

SEQ ID NO: 6217793 - DNA, 16 bp, Homo sapiens
gaggggaactgagtca

SEQ ID NO: 6217794 - DNA, 13 bp, Homo sapiens
gaggggaagaaaa

SEQ ID NO: 6217795 - DNA, 23 bp, Homo sapiens
gaggggaagaaacactttctctt

SEQ ID NO: 6217796 - DNA, 23 bp, Homo sapiens
gaggggaagaaggaaagggaaga

SEQ ID NO: 6217797 - DNA, 12 bp, Homo sapiens
gaggggaagagg

SEQ ID NO: 6217798 - DNA, 15 bp, Homo sapiens
gaggggaagaggcct

SEQ ID NO: 6217799 - DNA, 19 bp, Homo sapiens
gaggggaagagtgtactgg

SEQ ID NO: 6217800 - DNA, 12 bp, Homo sapiens
gaggggaagctg

SEQ ID NO: 6217801 - DNA, 19 bp, Homo sapiens
gaggggaagctgcagcttg

SEQ ID NO: 6217802 - DNA, 18 bp, Homo sapiens
gaggggaagctgggccca

SEQ ID NO: 6217803 - DNA, 14 bp, Homo sapiens
gaggggaagggcca

SEQ ID NO: 6217804 - DNA, 15 bp, Homo sapiens
gaggggaaggggccg

SEQ ID NO: 6217805 - DNA, 18 bp, Homo sapiens
gaggggaataatagaaga

SEQ ID NO: 6217806 - DNA, 23 bp, Homo sapiens
gaggggaatgaaccatggcacct

SEQ ID NO: 6217807 - DNA, 19 bp, Homo sapiens
gaggggaatgagggctgag

SEQ ID NO: 6217808 - DNA, 19 bp, Homo sapiens
gaggggacaaaacccacct

SEQ ID NO: 6217809 - DNA, 16 bp, Homo sapiens
gaggggacagaggccc

SEQ ID NO: 6217810 - DNA, 14 bp, Homo sapiens
gaggggacccagcg

SEQ ID NO: 6217811 - DNA, 17 bp, Homo sapiens
gaggggacccagctcct

SEQ ID NO: 6217812 - DNA, 14 bp, Homo sapiens
gaggggacgcaggc

SEQ ID NO: 6217813 - DNA, 15 bp, Homo sapiens
gaggggacgcaggcc

SEQ ID NO: 6217814 - DNA, 22 bp, Homo sapiens
gaggggacgcaggcccctctcc

SEQ ID NO: 6217815 - DNA, 16 bp, Homo sapiens
gaggggacgggacaga

SEQ ID NO: 6217816 - DNA, 12 bp, Homo sapiens
gaggggagaagc

SEQ ID NO: 6217817 - DNA, 18 bp, Homo sapiens
gaggggagaagccaaggg

SEQ ID NO: 6217818 - DNA, 23 bp, Homo sapiens
gaggggagagacaggcagcccag

SEQ ID NO: 6217819 - DNA, 11 bp, Homo sapiens
gaggggagagg

SEQ ID NO: 6217820 - DNA, 14 bp, Homo sapiens
gaggggagaggaag

SEQ ID NO: 6217821 - DNA, 15 bp, Homo sapiens
gaggggagaggaagc

SEQ ID NO: 6217822 - DNA, 13 bp, Homo sapiens
gaggggagcaagg

SEQ ID NO: 6217823 - DNA, 12 bp, Homo sapiens
gaggggagcagc

SEQ ID NO: 6217824 - DNA, 14 bp, Homo sapiens
gaggggagccagga

SEQ ID NO: 6217825 - DNA, 11 bp, Homo sapiens
gaggggaggag

SEQ ID NO: 6217826 - DNA, 21 bp, Homo sapiens
gaggggaggatcactggagcc

SEQ ID NO: 6217827 - DNA, 17 bp, Homo sapiens
gaggggagggctcctgg

SEQ ID NO: 6217828 - DNA, 19 bp, Homo sapiens
gaggggaggggcctaggga

SEQ ID NO: 6217829 - DNA, 17 bp, Homo sapiens
gaggggaggggcctccc

SEQ ID NO: 6217830 - DNA, 14 bp, Homo sapiens
gaggggataacttt

SEQ ID NO: 6217831 - DNA, 17 bp, Homo sapiens
gaggggatggggctggg

SEQ ID NO: 6217832 - DNA, 21 bp, Homo sapiens
gaggggatgtgtgtgtgcaga

SEQ ID NO: 6217833 - DNA, 15 bp, Homo sapiens
gaggggattctctac

SEQ ID NO: 6217834 - DNA, 18 bp, Homo sapiens
gaggggattctctactgc

SEQ ID NO: 6217835 - DNA, 19 bp, Homo sapiens
gaggggattctctactgcc

SEQ ID NO: 6217836 - DNA, 23 bp, Homo sapiens
gaggggcaactgatgaacacagg

SEQ ID NO: 6217837 - DNA, 23 bp, Homo sapiens
gaggggcaagctaggccccagag

SEQ ID NO: 6217838 - DNA, 21 bp, Homo sapiens
gaggggcacctgccaccgcca

SEQ ID NO: 6217839 - DNA, 15 bp, Homo sapiens
gaggggcagaacaga

SEQ ID NO: 6217840 - DNA, 18 bp, Homo sapiens
gaggggcagaacagccgc

SEQ ID NO: 6217841 - DNA, 23 bp, Homo sapiens
gaggggcagatggaaaggagcct

SEQ ID NO: 6217842 - DNA, 13 bp, Homo sapiens
gaggggcagccct

SEQ ID NO: 6217843 - DNA, 14 bp, Homo sapiens
gaggggcagccctt

SEQ ID NO: 6217844 - DNA, 15 bp, Homo sapiens
gaggggcagcccttg

SEQ ID NO: 6217845 - DNA, 19 bp, Homo sapiens
gaggggcagcctgtgcctg

SEQ ID NO: 6217846 - DNA, 12 bp, Homo sapiens
gaggggcaggcc

SEQ ID NO: 6217847 - DNA, 23 bp, Homo sapiens
gaggggcaggccctgcactgtcc

SEQ ID NO: 6217848 - DNA, 23 bp, Homo sapiens
gaggggcaggcctttttgagcca

SEQ ID NO: 6217849 - DNA, 13 bp, Homo sapiens
gaggggcaggctg

SEQ ID NO: 6217850 - DNA, 15 bp, Homo sapiens
gaggggcagggaagg

SEQ ID NO: 6217851 - DNA, 22 bp, Homo sapiens
gaggggcagggagagcgcctct

SEQ ID NO: 6217852 - DNA, 19 bp, Homo sapiens
gaggggcatggccagcagc

SEQ ID NO: 6217853 - DNA, 15 bp, Homo sapiens
gaggggccactgacc

SEQ ID NO: 6217854 - DNA, 14 bp, Homo sapiens
gaggggccagcaga

SEQ ID NO: 6217855 - DNA, 16 bp, Homo sapiens
gaggggccagcggccc

SEQ ID NO: 6217856 - DNA, 18 bp, Homo sapiens
gaggggccaggcccaggc

SEQ ID NO: 6217857 - DNA, 19 bp, Homo sapiens
gaggggccaggcccaggca

SEQ ID NO: 6217858 - DNA, 20 bp, Homo sapiens
gaggggccaggcccaggcag

SEQ ID NO: 6217859 - DNA, 23 bp, Homo sapiens
gaggggccaggggcaggcagggc

SEQ ID NO: 6217860 - DNA, 11 bp, Homo sapiens
gaggggcccac

SEQ ID NO: 6217861 - DNA, 18 bp, Homo sapiens
gaggggcccctggcccag

SEQ ID NO: 6217862 - DNA, 17 bp, Homo sapiens
gaggggccctcaggcca

SEQ ID NO: 6217863 - DNA, 20 bp, Homo sapiens
gaggggccctccgagggtgc

SEQ ID NO: 6217864 - DNA, 22 bp, Homo sapiens
gaggggccggccctgtgtgcag

SEQ ID NO: 6217865 - DNA, 12 bp, Homo sapiens
gaggggcctagg

SEQ ID NO: 6217866 - DNA, 17 bp, Homo sapiens
gaggggcctaggcctca

SEQ ID NO: 6217867 - DNA, 22 bp, Homo sapiens
gaggggcctaggcctcagccag

SEQ ID NO: 6217868 - DNA, 15 bp, Homo sapiens
gaggggcctagggag

SEQ ID NO: 6217869 - DNA, 15 bp, Homo sapiens
gaggggcctgatgag

SEQ ID NO: 6217870 - DNA, 16 bp, Homo sapiens
gaggggcctgatgaga

SEQ ID NO: 6217871 - DNA, 15 bp, Homo sapiens
gaggggcctgccacc

SEQ ID NO: 6217872 - DNA, 20 bp, Homo sapiens
gaggggcctgccacctggac

SEQ ID NO: 6217873 - DNA, 17 bp, Homo sapiens
gaggggcctgcgcccag

SEQ ID NO: 6217874 - DNA, 19 bp, Homo sapiens
gaggggcctggcctgggtg

SEQ ID NO: 6217875 - DNA, 17 bp, Homo sapiens
gaggggcctgggaaagg

SEQ ID NO: 6217876 - DNA, 13 bp, Homo sapiens
gaggggcctgggc

SEQ ID NO: 6217877 - DNA, 18 bp, Homo sapiens
gaggggcgcaccccacag

SEQ ID NO: 6217878 - DNA, 19 bp, Homo sapiens
gaggggcgcaccccacagc

SEQ ID NO: 6217879 - DNA, 16 bp, Homo sapiens
gaggggcgcccagggt

SEQ ID NO: 6217880 - DNA, 11 bp, Homo sapiens
gaggggcgcgg

SEQ ID NO: 6217881 - DNA, 16 bp, Homo sapiens
gaggggcgcgggaggg

SEQ ID NO: 6217882 - DNA, 14 bp, Homo sapiens
gaggggcgctggcc

SEQ ID NO: 6217883 - DNA, 17 bp, Homo sapiens
gaggggcgctggcccag

SEQ ID NO: 6217884 - DNA, 18 bp, Homo sapiens
gaggggcgctggcccagc

SEQ ID NO: 6217885 - DNA, 16 bp, Homo sapiens
gaggggcgctgtcctg

SEQ ID NO: 6217886 - DNA, 18 bp, Homo sapiens
gaggggcgggctcagagc

SEQ ID NO: 6217887 - DNA, 20 bp, Homo sapiens
gaggggcggggccaggatgg

SEQ ID NO: 6217888 - DNA, 21 bp, Homo sapiens
gaggggctcatgttcaggcag

SEQ ID NO: 6217889 - DNA, 13 bp, Homo sapiens
gaggggctcctgg

SEQ ID NO: 6217890 - DNA, 14 bp, Homo sapiens
gaggggctcctgga

SEQ ID NO: 6217891 - DNA, 15 bp, Homo sapiens
gaggggctcctggaa

SEQ ID NO: 6217892 - DNA, 23 bp, Homo sapiens
gaggggctctgcgttggcttctc

SEQ ID NO: 6217893 - DNA, 16 bp, Homo sapiens
gaggggctgagtctgg

SEQ ID NO: 6217894 - DNA, 16 bp, Homo sapiens
gaggggctgcagggcc

SEQ ID NO: 6217895 - DNA, 13 bp, Homo sapiens
gaggggctgggct

SEQ ID NO: 6217896 - DNA, 14 bp, Homo sapiens
gaggggctggggag

SEQ ID NO: 6217897 - DNA, 16 bp, Homo sapiens
gaggggctgtcctcct

SEQ ID NO: 6217898 - DNA, 17 bp, Homo sapiens
gaggggcttccctctgc

SEQ ID NO: 6217899 - DNA, 22 bp, Homo sapiens
gaggggcttctgggcagactct

SEQ ID NO: 6217900 - DNA, 16 bp, Homo sapiens
gaggggcttgggcctg

SEQ ID NO: 6217901 - DNA, 13 bp, Homo sapiens
gagggggaagcaa

SEQ ID NO: 6217902 - DNA, 15 bp, Homo sapiens
gagggggaagcaaag

SEQ ID NO: 6217903 - DNA, 17 bp, Homo sapiens
gagggggaatggcagca

SEQ ID NO: 6217904 - DNA, 16 bp, Homo sapiens
gagggggacctgtccc

SEQ ID NO: 6217905 - DNA, 14 bp, Homo sapiens
gagggggagaaaag

SEQ ID NO: 6217906 - DNA, 14 bp, Homo sapiens
gagggggagagggc

SEQ ID NO: 6217907 - DNA, 15 bp, Homo sapiens
gagggggaggggaga

SEQ ID NO: 6217908 - DNA, 14 bp, Homo sapiens
gagggggcacggca

SEQ ID NO: 6217909 - DNA, 14 bp, Homo sapiens
gagggggcaggggg

SEQ ID NO: 6217910 - DNA, 18 bp, Homo sapiens
gagggggccacctcccca

SEQ ID NO: 6217911 - DNA, 18 bp, Homo sapiens
gagggggccagagggact

SEQ ID NO: 6217912 - DNA, 21 bp, Homo sapiens
gagggggctatagctacagga

SEQ ID NO: 6217913 - DNA, 19 bp, Homo sapiens
gagggggctatttctctcc

SEQ ID NO: 6217914 - DNA, 16 bp, Homo sapiens
gagggggctccatgga

SEQ ID NO: 6217915 - DNA, 13 bp, Homo sapiens
gagggggctctgc

SEQ ID NO: 6217916 - DNA, 13 bp, Homo sapiens
gagggggctggcc

SEQ ID NO: 6217917 - DNA, 14 bp, Homo sapiens
gagggggctgggaa

SEQ ID NO: 6217918 - DNA, 17 bp, Homo sapiens
gaggggggagccagagg

SEQ ID NO: 6217919 - DNA, 21 bp, Homo sapiens
gaggggggagccagaggccag

SEQ ID NO: 6217920 - DNA, 22 bp, Homo sapiens
gaggggggaggtgggatcctcc

SEQ ID NO: 6217921 - DNA, 19 bp, Homo sapiens
gaggggggatttccagcca

SEQ ID NO: 6217922 - DNA, 21 bp, Homo sapiens
gagggggtcgtggagagctag

SEQ ID NO: 6217923 - DNA, 21 bp, Homo sapiens
gagggggtgacctccggccag

SEQ ID NO: 6217924 - DNA, 22 bp, Homo sapiens
gagggggtgagaggcaggaatg

SEQ ID NO: 6217925 - DNA, 20 bp, Homo sapiens
gagggggttacaaactgcaa

SEQ ID NO: 6217926 - DNA, 23 bp, Homo sapiens
gagggggttcgcaccgtgctggg

SEQ ID NO: 6217927 - DNA, 17 bp, Homo sapiens
gagggggttcttcctca

SEQ ID NO: 6217928 - DNA, 15 bp, Homo sapiens
gaggggtaaatatat

SEQ ID NO: 6217929 - DNA, 20 bp, Homo sapiens
gaggggtaaatatatgtttt

SEQ ID NO: 6217930 - DNA, 15 bp, Homo sapiens
gaggggtaggggctg

SEQ ID NO: 6217931 - DNA, 17 bp, Homo sapiens
gaggggtaggggctggg

SEQ ID NO: 6217932 - DNA, 19 bp, Homo sapiens
gaggggtaggggctgggaa

SEQ ID NO: 6217933 - DNA, 17 bp, Homo sapiens
gaggggtcagctctggc

SEQ ID NO: 6217934 - DNA, 18 bp, Homo sapiens
gaggggtctccaggagga

SEQ ID NO: 6217935 - DNA, 13 bp, Homo sapiens
gaggggtctttta

SEQ ID NO: 6217936 - DNA, 17 bp, Homo sapiens
gaggggtgcagaggctg

SEQ ID NO: 6217937 - DNA, 18 bp, Homo sapiens
gaggggtgcagaggctgt

SEQ ID NO: 6217938 - DNA, 14 bp, Homo sapiens
gaggggtgctctgc

SEQ ID NO: 6217939 - DNA, 14 bp, Homo sapiens
gaggggtggcccag

SEQ ID NO: 6217940 - DNA, 17 bp, Homo sapiens
gaggggtggcccagagc

SEQ ID NO: 6217941 - DNA, 20 bp, Homo sapiens
gaggggtggcccagagccat

SEQ ID NO: 6217942 - DNA, 15 bp, Homo sapiens
gaggggtgggctggt

SEQ ID NO: 6217943 - DNA, 15 bp, Homo sapiens
gaggggtggggagct

SEQ ID NO: 6217944 - DNA, 18 bp, Homo sapiens
gaggggtggggagctaga

SEQ ID NO: 6217945 - DNA, 18 bp, Homo sapiens
gaggggtggtacttggca

SEQ ID NO: 6217946 - DNA, 22 bp, Homo sapiens
gaggggtggtacttggcaccaa

SEQ ID NO: 6217947 - DNA, 17 bp, Homo sapiens
gaggggtgtggcagtgg

SEQ ID NO: 6217948 - DNA, 21 bp, Homo sapiens
gaggggtgtggctccttccca

SEQ ID NO: 6217949 - DNA, 13 bp, Homo sapiens
gaggggtgttgta

SEQ ID NO: 6217950 - DNA, 17 bp, Homo sapiens
gaggggttgcgggggag

SEQ ID NO: 6217951 - DNA, 20 bp, Homo sapiens
gaggggttggtgggagggtt

SEQ ID NO: 6217952 - DNA, 13 bp, Homo sapiens
gagggtaactggg

SEQ ID NO: 6217953 - DNA, 22 bp, Homo sapiens
gagggtaactggggggccacca

SEQ ID NO: 6217954 - DNA, 19 bp, Homo sapiens
gagggtaataaccagacac

SEQ ID NO: 6217955 - DNA, 15 bp, Homo sapiens
gagggtacagctggg

SEQ ID NO: 6217956 - DNA, 21 bp, Homo sapiens
gagggtaggagggtgggaagg

SEQ ID NO: 6217957 - DNA, 17 bp, Homo sapiens
gagggtatgaagagctg

SEQ ID NO: 6217958 - DNA, 16 bp, Homo sapiens
gagggtcaagggctgg

SEQ ID NO: 6217959 - DNA, 18 bp, Homo sapiens
gagggtcaagggctgggg

SEQ ID NO: 6217960 - DNA, 16 bp, Homo sapiens
gagggtcagccagggc

SEQ ID NO: 6217961 - DNA, 19 bp, Homo sapiens
gagggtcagggcagtatct

SEQ ID NO: 6217962 - DNA, 14 bp, Homo sapiens
gagggtccacctgg

SEQ ID NO: 6217963 - DNA, 17 bp, Homo sapiens
gagggtccacctggaga

SEQ ID NO: 6217964 - DNA, 22 bp, Homo sapiens
gagggtccagaaggagggggtg

SEQ ID NO: 6217965 - DNA, 18 bp, Homo sapiens
gagggtcccaagctgggc

SEQ ID NO: 6217966 - DNA, 22 bp, Homo sapiens
gagggtcccaaggcgtgcaggg

SEQ ID NO: 6217967 - DNA, 12 bp, Homo sapiens
gagggtcccagg

SEQ ID NO: 6217968 - DNA, 13 bp, Homo sapiens
gagggtcccaggg

SEQ ID NO: 6217969 - DNA, 14 bp, Homo sapiens
gagggtcccagggc

SEQ ID NO: 6217970 - DNA, 19 bp, Homo sapiens
gagggtccccacctgggac

SEQ ID NO: 6217971 - DNA, 13 bp, Homo sapiens
gagggtccctaat

SEQ ID NO: 6217972 - DNA, 15 bp, Homo sapiens
gaacccaggcagctg

SEQ ID NO: 6217973 - DNA, 18 bp, Homo sapiens
gaacccaggcagctggca

SEQ ID NO: 6217974 - DNA, 14 bp, Homo sapiens
gaacccagggctct

SEQ ID NO: 6217975 - DNA, 20 bp, Homo sapiens
gaacccagggctctgcccca

SEQ ID NO: 6217976 - DNA, 21 bp, Homo sapiens
gaacccagggctctgccccag

SEQ ID NO: 6217977 - DNA, 19 bp, Homo sapiens
gaacccaggtctgatgcca

SEQ ID NO: 6217978 - DNA, 21 bp, Homo sapiens
gaacccaggtctgatgccaaa

SEQ ID NO: 6217979 - DNA, 22 bp, Homo sapiens
gaacccagtttttaaataccgc

SEQ ID NO: 6217980 - DNA, 16 bp, Homo sapiens
gaacccatcactgtgt

SEQ ID NO: 6217981 - DNA, 18 bp, Homo sapiens
gaacccatcactgtgtct

SEQ ID NO: 6217982 - DNA, 22 bp, Homo sapiens
gaacccatttgccatgctgcta

SEQ ID NO: 6217983 - DNA, 16 bp, Homo sapiens
gaaccccaactcccag

SEQ ID NO: 6217984 - DNA, 18 bp, Homo sapiens
gaaccccaactcccagcc

SEQ ID NO: 6217985 - DNA, 17 bp, Homo sapiens
gaaccccaaggagggag

SEQ ID NO: 6217986 - DNA, 15 bp, Homo sapiens
gaaccccagaggcag

SEQ ID NO: 6217987 - DNA, 16 bp, Homo sapiens
gaaccccatgggcttg

SEQ ID NO: 6217988 - DNA, 19 bp, Homo sapiens
gaacccccacaaccccctc

SEQ ID NO: 6217989 - DNA, 14 bp, Homo sapiens
gaacccccaccaga

SEQ ID NO: 6217990 - DNA, 20 bp, Homo sapiens
gaacccccagcccagcagac

SEQ ID NO: 6217991 - DNA, 15 bp, Homo sapiens
gaaccccccactccc

SEQ ID NO: 6217992 - DNA, 19 bp, Homo sapiens
gaaccccccactccctgcc

SEQ ID NO: 6217993 - DNA, 14 bp, Homo sapiens
gaaccccccaggcc

SEQ ID NO: 6217994 - DNA, 19 bp, Homo sapiens
gaaccccccaggccctaca

SEQ ID NO: 6217995 - DNA, 17 bp, Homo sapiens
gaaccccccccccccgc

SEQ ID NO: 6217996 - DNA, 14 bp, Homo sapiens
gaacccccctccca

SEQ ID NO: 6217997 - DNA, 17 bp, Homo sapiens
gaacccccctcccaccc

SEQ ID NO: 6217998 - DNA, 20 bp, Homo sapiens
gaaccccctcaaaagccaaa

SEQ ID NO: 6217999 - DNA, 21 bp, Homo sapiens
gaaccccctcaaaagccaaaa

SEQ ID NO: 6218000 - DNA, 19 bp, Homo sapiens
gaaccccctccctgtccca

SEQ ID NO: 6218001 - DNA, 23 bp, Homo sapiens
gaaccccctccctgtcccagggc

SEQ ID NO: 6218002 - DNA, 13 bp, Homo sapiens
gaaccccgcagcc

SEQ ID NO: 6218003 - DNA, 16 bp, Homo sapiens
gaaccccgcagcccgt

SEQ ID NO: 6218004 - DNA, 20 bp, Homo sapiens
gaaccccggggtgcccacag

SEQ ID NO: 6218005 - DNA, 19 bp, Homo sapiens
gaacccctcccctcccccc

SEQ ID NO: 6218006 - DNA, 18 bp, Homo sapiens
gaacccctggccagctct

SEQ ID NO: 6218007 - DNA, 19 bp, Homo sapiens
gaacccctgtgtccctttt

SEQ ID NO: 6218008 - DNA, 23 bp, Homo sapiens
gaacccgggaggtggagcttgca

SEQ ID NO: 6218009 - DNA, 15 bp, Homo sapiens
gaacccgggggacag

SEQ ID NO: 6218010 - DNA, 18 bp, Homo sapiens
gaacccgggggacagagg

SEQ ID NO: 6218011 - DNA, 20 bp, Homo sapiens
gaacccggtgctccctctgt

SEQ ID NO: 6218012 - DNA, 17 bp, Homo sapiens
gaaccctagctgtgtca

SEQ ID NO: 6218013 - DNA, 18 bp, Homo sapiens
gaaccctatttaaaactg

SEQ ID NO: 6218014 - DNA, 18 bp, Homo sapiens
gaaccctcagccttgact

SEQ ID NO: 6218015 - DNA, 15 bp, Homo sapiens
gaaccctcaggccac

SEQ ID NO: 6218016 - DNA, 20 bp, Homo sapiens
gaaccctcaggccaccctcc

SEQ ID NO: 6218017 - DNA, 22 bp, Homo sapiens
gaaccctcaggccaccctccac

SEQ ID NO: 6218018 - DNA, 18 bp, Homo sapiens
gaaccctccaaaggaact

SEQ ID NO: 6218019 - DNA, 15 bp, Homo sapiens
gaaccctccccacca

SEQ ID NO: 6218020 - DNA, 15 bp, Homo sapiens
gaaccctctggggcc

SEQ ID NO: 6218021 - DNA, 15 bp, Homo sapiens
gaaccctctgtccca

SEQ ID NO: 6218022 - DNA, 19 bp, Homo sapiens
gaaccctcttgccatcctg

SEQ ID NO: 6218023 - DNA, 14 bp, Homo sapiens
gaaccctgccatgg

SEQ ID NO: 6218024 - DNA, 12 bp, Homo sapiens
gaaccctgccct

SEQ ID NO: 6218025 - DNA, 14 bp, Homo sapiens
gaaccctgccctgc

SEQ ID NO: 6218026 - DNA, 18 bp, Homo sapiens
gaaccctgccctgctctg

SEQ ID NO: 6218027 - DNA, 16 bp, Homo sapiens
gaaccctggagacaga

SEQ ID NO: 6218028 - DNA, 16 bp, Homo sapiens
gaaccctggggcctga

SEQ ID NO: 6218029 - DNA, 23 bp, Homo sapiens
gaaccctgtgctggtgtcctgac

SEQ ID NO: 6218030 - DNA, 15 bp, Homo sapiens
gaacccttctgcttt

SEQ ID NO: 6218031 - DNA, 16 bp, Homo sapiens
gaacccttctgctttc

SEQ ID NO: 6218032 - DNA, 15 bp, Homo sapiens
gaacccttgtgcttg

SEQ ID NO: 6218033 - DNA, 17 bp, Homo sapiens
gaacccttgtgcttggt

SEQ ID NO: 6218034 - DNA, 13 bp, Homo sapiens
gaaccctttattt

SEQ ID NO: 6218035 - DNA, 22 bp, Homo sapiens
gaacccttttcctccagacaga

SEQ ID NO: 6218036 - DNA, 18 bp, Homo sapiens
gaacccttttggcccccg

SEQ ID NO: 6218037 - DNA, 19 bp, Homo sapiens
gaacccttttggcccccga

SEQ ID NO: 6218038 - DNA, 16 bp, Homo sapiens
gaaccgactgaccctg

SEQ ID NO: 6218039 - DNA, 17 bp, Homo sapiens
gaaccgagcaaagatca

SEQ ID NO: 6218040 - DNA, 19 bp, Homo sapiens
gaaccgagcaaagatcaaa

SEQ ID NO: 6218041 - DNA, 21 bp, Homo sapiens
gaaccgagcaaagatcaaaat

SEQ ID NO: 6218042 - DNA, 23 bp, Homo sapiens
gaaccgagcaaagatcaaaataa

SEQ ID NO: 6218043 - DNA, 13 bp, Homo sapiens
gaaccgaggactc

SEQ ID NO: 6218044 - DNA, 18 bp, Homo sapiens
gaaccgaggactccaggg

SEQ ID NO: 6218045 - DNA, 20 bp, Homo sapiens
gaaccgagggggctgctccc

SEQ ID NO: 6218046 - DNA, 13 bp, Homo sapiens
gaaccgcacagct

SEQ ID NO: 6218047 - DNA, 22 bp, Homo sapiens
gaaccgcaccccatcccaccag

SEQ ID NO: 6218048 - DNA, 19 bp, Homo sapiens
gaaccgccggttcattttg

SEQ ID NO: 6218049 - DNA, 17 bp, Homo sapiens
gaaccgctcacctagag

SEQ ID NO: 6218050 - DNA, 18 bp, Homo sapiens
gaaccgctcacctagagc

SEQ ID NO: 6218051 - DNA, 16 bp, Homo sapiens
gaaccggagagccagc

SEQ ID NO: 6218052 - DNA, 18 bp, Homo sapiens
gaaccggtcccagcctgg

SEQ ID NO: 6218053 - DNA, 22 bp, Homo sapiens
gaaccggtcccagcctgggctc

SEQ ID NO: 6218054 - DNA, 12 bp, Homo sapiens
gaaccgttgcca

SEQ ID NO: 6218055 - DNA, 14 bp, Homo sapiens
gaaccgtttacagt

SEQ ID NO: 6218056 - DNA, 18 bp, Homo sapiens
gaaccgttttgaagctac

SEQ ID NO: 6218057 - DNA, 12 bp, Homo sapiens
gaacctaactgt

SEQ ID NO: 6218058 - DNA, 14 bp, Homo sapiens
gaacctaactgtat

SEQ ID NO: 6218059 - DNA, 17 bp, Homo sapiens
gaacctaatgcactctg

SEQ ID NO: 6218060 - DNA, 20 bp, Homo sapiens
gaacctacagactccatctc

SEQ ID NO: 6218061 - DNA, 18 bp, Homo sapiens
gaacctacagttttaact

SEQ ID NO: 6218062 - DNA, 23 bp, Homo sapiens
gaacctacagttttaactgtgga

SEQ ID NO: 6218063 - DNA, 20 bp, Homo sapiens
gaacctactgttcctttcag

SEQ ID NO: 6218064 - DNA, 20 bp, Homo sapiens
gaacctagtactctctgctc

SEQ ID NO: 6218065 - DNA, 13 bp, Homo sapiens
gaacctatcttta

SEQ ID NO: 6218066 - DNA, 18 bp, Homo sapiens
gaacctattttcatttgt

SEQ ID NO: 6218067 - DNA, 23 bp, Homo sapiens
gaacctcaccccgaggccctgca

SEQ ID NO: 6218068 - DNA, 21 bp, Homo sapiens
gaacctcacgcacctcccatc

SEQ ID NO: 6218069 - DNA, 18 bp, Homo sapiens
gaacctcagattcttcat

SEQ ID NO: 6218070 - DNA, 21 bp, Homo sapiens
gaacctcagcatttccttcca

SEQ ID NO: 6218071 - DNA, 18 bp, Homo sapiens
gaacctcagcctggccag

SEQ ID NO: 6218072 - DNA, 11 bp, Homo sapiens
gaacctcaggc

SEQ ID NO: 6218073 - DNA, 18 bp, Homo sapiens
gaacctcaggcttccttg

SEQ ID NO: 6218074 - DNA, 21 bp, Homo sapiens
gaacctcattgctaccacaga

SEQ ID NO: 6218075 - DNA, 14 bp, Homo sapiens
gaacctcccagagg

SEQ ID NO: 6218076 - DNA, 16 bp, Homo sapiens
gaacctccccagcctg

SEQ ID NO: 6218077 - DNA, 12 bp, Homo sapiens
gaacctccctgg

SEQ ID NO: 6218078 - DNA, 16 bp, Homo sapiens
gaacctccctgggcct

SEQ ID NO: 6218079 - DNA, 19 bp, Homo sapiens
gaacctcgaagctgttctc

SEQ ID NO: 6218080 - DNA, 15 bp, Homo sapiens
gaacctcgagtactg

SEQ ID NO: 6218081 - DNA, 20 bp, Homo sapiens
gaacctcgagtactgtgggc

SEQ ID NO: 6218082 - DNA, 16 bp, Homo sapiens
gaacctcggggtgggg

SEQ ID NO: 6218083 - DNA, 17 bp, Homo sapiens
gaacctcggggtggggg

SEQ ID NO: 6218084 - DNA, 22 bp, Homo sapiens
gaacctcgttgacatgcacagt

SEQ ID NO: 6218085 - DNA, 21 bp, Homo sapiens
gaacctctaagtgctgctgtg

SEQ ID NO: 6218086 - DNA, 20 bp, Homo sapiens
gaacctctcgccatgatcag

SEQ ID NO: 6218087 - DNA, 14 bp, Homo sapiens
gaacctctgattta

SEQ ID NO: 6218088 - DNA, 18 bp, Homo sapiens
gaacctctgtctcatcct

SEQ ID NO: 6218089 - DNA, 18 bp, Homo sapiens
gaacctgaagaactattt

SEQ ID NO: 6218090 - DNA, 20 bp, Homo sapiens
gaacctgacatccactgttt

SEQ ID NO: 6218091 - DNA, 17 bp, Homo sapiens
gaacctgacgtagctgc

SEQ ID NO: 6218092 - DNA, 23 bp, Homo sapiens
gaacctgagttcccgggagctgg

SEQ ID NO: 6218093 - DNA, 16 bp, Homo sapiens
gaacctgatacctgcc

SEQ ID NO: 6218094 - DNA, 15 bp, Homo sapiens
gaacctgatgaaaat

SEQ ID NO: 6218095 - DNA, 16 bp, Homo sapiens
gaacctgatgaaaata

SEQ ID NO: 6218096 - DNA, 20 bp, Homo sapiens
gaacctgatgaaaataaaga

SEQ ID NO: 6218097 - DNA, 16 bp, Homo sapiens
gaacctgcacacagga

SEQ ID NO: 6218098 - DNA, 18 bp, Homo sapiens
gaacctgcacacaggaca

SEQ ID NO: 6218099 - DNA, 20 bp, Homo sapiens
gaacctgcacacaggacagc

SEQ ID NO: 6218100 - DNA, 17 bp, Homo sapiens
gaacctgcttcctggct

SEQ ID NO: 6218101 - DNA, 20 bp, Homo sapiens
gaacctggaagatcatggac

SEQ ID NO: 6218102 - DNA, 18 bp, Homo sapiens
gaacctggaccccagcct

SEQ ID NO: 6218103 - DNA, 19 bp, Homo sapiens
gaacctggaccccagcctt

SEQ ID NO: 6218104 - DNA, 16 bp, Homo sapiens
gaacctggagggctag

SEQ ID NO: 6218105 - DNA, 16 bp, Homo sapiens
gaacctggaggggcta

SEQ ID NO: 6218106 - DNA, 17 bp, Homo sapiens
gaacctggatccagcac

SEQ ID NO: 6218107 - DNA, 12 bp, Homo sapiens
gaacctggcagg

SEQ ID NO: 6218108 - DNA, 21 bp, Homo sapiens
gaacctggcaggccctgccca

SEQ ID NO: 6218109 - DNA, 12 bp, Homo sapiens
gaacctggcctt

SEQ ID NO: 6218110 - DNA, 16 bp, Homo sapiens
gaacctggccttcagt

SEQ ID NO: 6218111 - DNA, 12 bp, Homo sapiens
gaacctggctgc

SEQ ID NO: 6218112 - DNA, 21 bp, Homo sapiens
gaacctggctgcgaactgtgc

SEQ ID NO: 6218113 - DNA, 22 bp, Homo sapiens
gaacctggctgcgaactgtgca

SEQ ID NO: 6218114 - DNA, 22 bp, Homo sapiens
gaacctgggaaagagatttaaa

SEQ ID NO: 6218115 - DNA, 16 bp, Homo sapiens
gaacctgggaggcaga

SEQ ID NO: 6218116 - DNA, 17 bp, Homo sapiens
gaacctgggaggcagag

SEQ ID NO: 6218117 - DNA, 13 bp, Homo sapiens
gaacctgggcact

SEQ ID NO: 6218118 - DNA, 12 bp, Homo sapiens
gaacctgggctg

SEQ ID NO: 6218119 - DNA, 15 bp, Homo sapiens
gaacctgggctgtgc

SEQ ID NO: 6218120 - DNA, 18 bp, Homo sapiens
gaacctgggctgtgctgc

SEQ ID NO: 6218121 - DNA, 21 bp, Homo sapiens
gaacctgggctgtgctgcttt

SEQ ID NO: 6218122 - DNA, 18 bp, Homo sapiens
gaacctggtgtgtttctt

SEQ ID NO: 6218123 - DNA, 15 bp, Homo sapiens
gaacctgtactgggt

SEQ ID NO: 6218124 - DNA, 21 bp, Homo sapiens
gaacctgtactgggttatttt

SEQ ID NO: 6218125 - DNA, 19 bp, Homo sapiens
gaacctgtagaagatgacc

SEQ ID NO: 6218126 - DNA, 22 bp, Homo sapiens
gaacctgtagaagatgacctcg

SEQ ID NO: 6218127 - DNA, 16 bp, Homo sapiens
gaacctgtcctaagga

SEQ ID NO: 6218128 - DNA, 12 bp, Homo sapiens
gaacctgtcctt

SEQ ID NO: 6218129 - DNA, 15 bp, Homo sapiens
gaacctgtgaggaag

SEQ ID NO: 6218130 - DNA, 21 bp, Homo sapiens
gaacctgtgaggaagaggttg

SEQ ID NO: 6218131 - DNA, 17 bp, Homo sapiens
gaacctgtgagtaaata

SEQ ID NO: 6218132 - DNA, 14 bp, Homo sapiens
gaaccttaatgaca

SEQ ID NO: 6218133 - DNA, 19 bp, Homo sapiens
gaaccttaatgacaacact

SEQ ID NO: 6218134 - DNA, 23 bp, Homo sapiens
gaaccttacagtaaagtatagaa

SEQ ID NO: 6218135 - DNA, 18 bp, Homo sapiens
gaaccttactggcactgt

SEQ ID NO: 6218136 - DNA, 22 bp, Homo sapiens
gaaccttactggcactgtggca

SEQ ID NO: 6218137 - DNA, 10 bp, Homo sapiens
gaaccttccc

SEQ ID NO: 6218138 - DNA, 19 bp, Homo sapiens
gaaccttccttcctgcttg

SEQ ID NO: 6218139 - DNA, 19 bp, Homo sapiens
gaaccttctagaacctggg

SEQ ID NO: 6218140 - DNA, 22 bp, Homo sapiens
gaaccttctagaacctgggctg

SEQ ID NO: 6218141 - DNA, 23 bp, Homo sapiens
gaaccttctagaacctgggctgt

SEQ ID NO: 6218142 - DNA, 17 bp, Homo sapiens
gaaccttgatggggtga

SEQ ID NO: 6218143 - DNA, 15 bp, Homo sapiens
gaaccttgctgtcct

SEQ ID NO: 6218144 - DNA, 16 bp, Homo sapiens
gaaccttgtgcctggc

SEQ ID NO: 6218145 - DNA, 20 bp, Homo sapiens
gaacctttagaatatctttt

SEQ ID NO: 6218146 - DNA, 18 bp, Homo sapiens
gaacctttcaaaatggaa

SEQ ID NO: 6218147 - DNA, 14 bp, Homo sapiens
gaacctttctgtgt

SEQ ID NO: 6218148 - DNA, 17 bp, Homo sapiens
gaacctttgtgccctat

SEQ ID NO: 6218149 - DNA, 21 bp, Homo sapiens
gaaccttttgagtgccttaca

SEQ ID NO: 6218150 - DNA, 17 bp, Homo sapiens
gagggtcctcttcctca

SEQ ID NO: 6218151 - DNA, 21 bp, Homo sapiens
gagggtcctgcagcctgcagg

SEQ ID NO: 6218152 - DNA, 19 bp, Homo sapiens
gagggtcgccacacccggc

SEQ ID NO: 6218153 - DNA, 17 bp, Homo sapiens
gagggtcggggaggagg

SEQ ID NO: 6218154 - DNA, 22 bp, Homo sapiens
gagggtcgtgggaaaggggagt

SEQ ID NO: 6218155 - DNA, 17 bp, Homo sapiens
gagggtctagaggcctg

SEQ ID NO: 6218156 - DNA, 19 bp, Homo sapiens
gagggtctcccctcctgca

SEQ ID NO: 6218157 - DNA, 15 bp, Homo sapiens
gagggtctccctggg

SEQ ID NO: 6218158 - DNA, 16 bp, Homo sapiens
gagggtctccctgggc

SEQ ID NO: 6218159 - DNA, 20 bp, Homo sapiens
gagggtctcgaactcctggc

SEQ ID NO: 6218160 - DNA, 15 bp, Homo sapiens
gagggtctgcaggga

SEQ ID NO: 6218161 - DNA, 16 bp, Homo sapiens
gagggtctgcagggaa

SEQ ID NO: 6218162 - DNA, 17 bp, Homo sapiens
gagggtctgcagggaat

SEQ ID NO: 6218163 - DNA, 19 bp, Homo sapiens
gagggtctgcagggaattg

SEQ ID NO: 6218164 - DNA, 18 bp, Homo sapiens
gagggtctgggggcagct

SEQ ID NO: 6218165 - DNA, 23 bp, Homo sapiens
gagggtcttggttccagcctgcc

SEQ ID NO: 6218166 - DNA, 21 bp, Homo sapiens
gagggtcttttaccctgtgtc

SEQ ID NO: 6218167 - DNA, 22 bp, Homo sapiens
gagggtcttttaccctgtgtca

SEQ ID NO: 6218168 - DNA, 23 bp, Homo sapiens
gagggtcttttaccctgtgtcag

SEQ ID NO: 6218169 - DNA, 21 bp, Homo sapiens
gagggtgaagtgaagacaatg

SEQ ID NO: 6218170 - DNA, 16 bp, Homo sapiens
gagggtgacagaggga

SEQ ID NO: 6218171 - DNA, 17 bp, Homo sapiens
gagggtgacagagggac

SEQ ID NO: 6218172 - DNA, 21 bp, Homo sapiens
gagggtgacccacagctctgg

SEQ ID NO: 6218173 - DNA, 23 bp, Homo sapiens
gagggtgacccacagctctgggc

SEQ ID NO: 6218174 - DNA, 19 bp, Homo sapiens
gagggtgacgcccagctcc

SEQ ID NO: 6218175 - DNA, 20 bp, Homo sapiens
gagggtgagaggaagggtgg

SEQ ID NO: 6218176 - DNA, 16 bp, Homo sapiens
gagggtgagctggtgc

SEQ ID NO: 6218177 - DNA, 19 bp, Homo sapiens
gagggtgaggttgcagtga

SEQ ID NO: 6218178 - DNA, 15 bp, Homo sapiens
gagggtgataaatct

SEQ ID NO: 6218179 - DNA, 21 bp, Homo sapiens
gagggtgcagccctcttgccc

SEQ ID NO: 6218180 - DNA, 22 bp, Homo sapiens
gagggtgccgtgcgggcgaggc

SEQ ID NO: 6218181 - DNA, 18 bp, Homo sapiens
gagggtgcggggcctgca

SEQ ID NO: 6218182 - DNA, 21 bp, Homo sapiens
gagggtgcggggcctgcaggc

SEQ ID NO: 6218183 - DNA, 23 bp, Homo sapiens
gagggtgcggggcctgcaggcca

SEQ ID NO: 6218184 - DNA, 13 bp, Homo sapiens
gagggtgctgccc

SEQ ID NO: 6218185 - DNA, 14 bp, Homo sapiens
gagggtggaggaag

SEQ ID NO: 6218186 - DNA, 23 bp, Homo sapiens
gagggtggaggaaggtgctgagc

SEQ ID NO: 6218187 - DNA, 14 bp, Homo sapiens
gagggtggccagca

SEQ ID NO: 6218188 - DNA, 17 bp, Homo sapiens
gagggtgggaggggcca

SEQ ID NO: 6218189 - DNA, 13 bp, Homo sapiens
gagggtgggccag

SEQ ID NO: 6218190 - DNA, 14 bp, Homo sapiens
gagggtgggccagc

SEQ ID NO: 6218191 - DNA, 22 bp, Homo sapiens
gagggtgggggccacctgcctg

SEQ ID NO: 6218192 - DNA, 24 bp, Homo sapiens
gagggtggggtgccccagctagga

SEQ ID NO: 6218193 - DNA, 15 bp, Homo sapiens
gagggtggtgggtgg

SEQ ID NO: 6218194 - DNA, 20 bp, Homo sapiens
gagggtgtccgctgctgctt

SEQ ID NO: 6218195 - DNA, 13 bp, Homo sapiens
gagggtgtcctgc

SEQ ID NO: 6218196 - DNA, 19 bp, Homo sapiens
gagggtgtcggctgtgagg

SEQ ID NO: 6218197 - DNA, 22 bp, Homo sapiens
gagggtgtggctttccaggcac

SEQ ID NO: 6218198 - DNA, 13 bp, Homo sapiens
gagggtgtttcct

SEQ ID NO: 6218199 - DNA, 15 bp, Homo sapiens
gagggtgtttcctct

SEQ ID NO: 6218200 - DNA, 15 bp, Homo sapiens
gagggttagggaggg

SEQ ID NO: 6218201 - DNA, 18 bp, Homo sapiens
gagggttcacacagccca

SEQ ID NO: 6218202 - DNA, 19 bp, Homo sapiens
gagggttcacacagcccag

SEQ ID NO: 6218203 - DNA, 11 bp, Homo sapiens
gagggttgcca

SEQ ID NO: 6218204 - DNA, 15 bp, Homo sapiens
gagggttgctatttg

SEQ ID NO: 6218205 - DNA, 14 bp, Homo sapiens
gagggttggagaag

SEQ ID NO: 6218206 - DNA, 16 bp, Homo sapiens
gagggttggagtgctc

SEQ ID NO: 6218207 - DNA, 14 bp, Homo sapiens
gagggttgggctgg

SEQ ID NO: 6218208 - DNA, 14 bp, Homo sapiens
gagggttggggagg

SEQ ID NO: 6218209 - DNA, 17 bp, Homo sapiens
gagggttggggaggggc

SEQ ID NO: 6218210 - DNA, 21 bp, Homo sapiens
gagggttgtactattgtttaa

SEQ ID NO: 6218211 - DNA, 21 bp, Homo sapiens
gagggtttccatggggtagga

SEQ ID NO: 6218212 - DNA, 13 bp, Homo sapiens
gagggtttctgat

SEQ ID NO: 6218213 - DNA, 22 bp, Homo sapiens
gagggtttgagagagcagccag

SEQ ID NO: 6218214 - DNA, 18 bp, Homo sapiens
gagggtttgagagcccgc

SEQ ID NO: 6218215 - DNA, 16 bp, Homo sapiens
gagggtttgggcagag

SEQ ID NO: 6218216 - DNA, 14 bp, Homo sapiens
gaggtaaaaaaaag

SEQ ID NO: 6218217 - DNA, 13 bp, Homo sapiens
gaggtaaaagagc

SEQ ID NO: 6218218 - DNA, 18 bp, Homo sapiens
gaggtaaaagagccaagt

SEQ ID NO: 6218219 - DNA, 17 bp, Homo sapiens
gaggtaacagaacagct

SEQ ID NO: 6218220 - DNA, 20 bp, Homo sapiens
gaggtaacatagatgcctgg

SEQ ID NO: 6218221 - DNA, 21 bp, Homo sapiens
gaggtaacatagatgcctggg

SEQ ID NO: 6218222 - DNA, 22 bp, Homo sapiens
gaggtaacatagatgcctgggc

SEQ ID NO: 6218223 - DNA, 21 bp, Homo sapiens
gaggtaactatcaatatttaa

SEQ ID NO: 6218224 - DNA, 13 bp, Homo sapiens
gaggtaactgagg

SEQ ID NO: 6218225 - DNA, 16 bp, Homo sapiens
gaggtaagggaggagg

SEQ ID NO: 6218226 - DNA, 12 bp, Homo sapiens
gaggtaagtttt

SEQ ID NO: 6218227 - DNA, 18 bp, Homo sapiens
gaggtacacttgtgaata

SEQ ID NO: 6218228 - DNA, 13 bp, Homo sapiens
gaggtaccctggg

SEQ ID NO: 6218229 - DNA, 15 bp, Homo sapiens
gaggtactgagacag

SEQ ID NO: 6218230 - DNA, 16 bp, Homo sapiens
gaggtactgagacagg

SEQ ID NO: 6218231 - DNA, 18 bp, Homo sapiens
gaggtactgagacagggt

SEQ ID NO: 6218232 - DNA, 12 bp, Homo sapiens
gaggtactgtaa

SEQ ID NO: 6218233 - DNA, 17 bp, Homo sapiens
gaggtagaaaagattgg

SEQ ID NO: 6218234 - DNA, 20 bp, Homo sapiens
gaggtagaaatgcaaggggg

SEQ ID NO: 6218235 - DNA, 23 bp, Homo sapiens
gaggtagaaggggaggacactgg

SEQ ID NO: 6218236 - DNA, 19 bp, Homo sapiens
gaggtagaatgactccttg

SEQ ID NO: 6218237 - DNA, 14 bp, Homo sapiens
gaggtagagagggg

SEQ ID NO: 6218238 - DNA, 18 bp, Homo sapiens
gaggtagaggaaaatcaa

SEQ ID NO: 6218239 - DNA, 18 bp, Homo sapiens
gaggtagagtttgaagga

SEQ ID NO: 6218240 - DNA, 19 bp, Homo sapiens
gaggtagagtttgaaggag

SEQ ID NO: 6218241 - DNA, 19 bp, Homo sapiens
gaggtagccgagtcacacc

SEQ ID NO: 6218242 - DNA, 14 bp, Homo sapiens
gaggtagccgggct

SEQ ID NO: 6218243 - DNA, 16 bp, Homo sapiens
gaggtagcgagctgct

SEQ ID NO: 6218244 - DNA, 23 bp, Homo sapiens
gaggtagtaagcaccagctgcct

SEQ ID NO: 6218245 - DNA, 18 bp, Homo sapiens
gaggtatcttactttcct

SEQ ID NO: 6218246 - DNA, 17 bp, Homo sapiens
gaggtatgacctgggtg

SEQ ID NO: 6218247 - DNA, 13 bp, Homo sapiens
gaggtatgaggtc

SEQ ID NO: 6218248 - DNA, 16 bp, Homo sapiens
gaggtatgggctgggg

SEQ ID NO: 6218249 - DNA, 14 bp, Homo sapiens
gaggtattaaaact

SEQ ID NO: 6218250 - DNA, 16 bp, Homo sapiens
gaggtcaacagagaag

SEQ ID NO: 6218251 - DNA, 15 bp, Homo sapiens
gaggtcaagcccagg

SEQ ID NO: 6218252 - DNA, 17 bp, Homo sapiens
gaggtcaagcccaggag

SEQ ID NO: 6218253 - DNA, 22 bp, Homo sapiens
gaggtcaagcctgcagcgagct

SEQ ID NO: 6218254 - DNA, 17 bp, Homo sapiens
gaggtcaaggctgcagt

SEQ ID NO: 6218255 - DNA, 16 bp, Homo sapiens
gaggtcaagtaagaag

SEQ ID NO: 6218256 - DNA, 15 bp, Homo sapiens
gaggtcaataaagca

SEQ ID NO: 6218257 - DNA, 21 bp, Homo sapiens
gaggtcaataaagcagagcca

SEQ ID NO: 6218258 - DNA, 20 bp, Homo sapiens
gaggtcaccaggggaggagc

SEQ ID NO: 6218259 - DNA, 21 bp, Homo sapiens
gaggtcaccaggggaggagcc

SEQ ID NO: 6218260 - DNA, 21 bp, Homo sapiens
gaggtcactccaccatcccca

SEQ ID NO: 6218261 - DNA, 20 bp, Homo sapiens
gaggtcagagcctgcagtta

SEQ ID NO: 6218262 - DNA, 21 bp, Homo sapiens
gaggtcagcacatctcaacag

SEQ ID NO: 6218263 - DNA, 22 bp, Homo sapiens
gaggtcagccttgacctaatga

SEQ ID NO: 6218264 - DNA, 23 bp, Homo sapiens
gaggtcaggaagcaggggtgggg

SEQ ID NO: 6218265 - DNA, 18 bp, Homo sapiens
gaggtcaggacggctcct

SEQ ID NO: 6218266 - DNA, 14 bp, Homo sapiens
gaggtcaggcccca

SEQ ID NO: 6218267 - DNA, 23 bp, Homo sapiens
gaggtcataaaatgtctcgagtc

SEQ ID NO: 6218268 - DNA, 16 bp, Homo sapiens
gaggtcatctggcgga

SEQ ID NO: 6218269 - DNA, 22 bp, Homo sapiens
gaggtcatctggcggaggtctc

SEQ ID NO: 6218270 - DNA, 21 bp, Homo sapiens
gaggtccaaaaaaggctgccc

SEQ ID NO: 6218271 - DNA, 18 bp, Homo sapiens
gaggtccacaacacacag

SEQ ID NO: 6218272 - DNA, 13 bp, Homo sapiens
gaggtccagaccc

SEQ ID NO: 6218273 - DNA, 22 bp, Homo sapiens
gaggtccagccccccaggctgc

SEQ ID NO: 6218274 - DNA, 23 bp, Homo sapiens
gaggtccagccctggctgaagga

SEQ ID NO: 6218275 - DNA, 14 bp, Homo sapiens
gaggtccagctggg

SEQ ID NO: 6218276 - DNA, 16 bp, Homo sapiens
gaggtccagctgggcc

SEQ ID NO: 6218277 - DNA, 23 bp, Homo sapiens
gaggtcccacttgcaacttcttt

SEQ ID NO: 6218278 - DNA, 20 bp, Homo sapiens
gaggtcccagacatgctgcc

SEQ ID NO: 6218279 - DNA, 23 bp, Homo sapiens
gaggtcccagacatgctgcccac

SEQ ID NO: 6218280 - DNA, 24 bp, Homo sapiens
gaggtcccagacatgctgcccacc

SEQ ID NO: 6218281 - DNA, 22 bp, Homo sapiens
gaggtcccagccccaggcctgg

SEQ ID NO: 6218282 - DNA, 16 bp, Homo sapiens
gaggtcccagccctgg

SEQ ID NO: 6218283 - DNA, 17 bp, Homo sapiens
gaggtcccagccctggg

SEQ ID NO: 6218284 - DNA, 14 bp, Homo sapiens
gaggtcccaggaag

SEQ ID NO: 6218285 - DNA, 17 bp, Homo sapiens
gaggtcccagggcccta

SEQ ID NO: 6218286 - DNA, 17 bp, Homo sapiens
gaggtccccggttgctg

SEQ ID NO: 6218287 - DNA, 16 bp, Homo sapiens
gaggtccctgctgcca

SEQ ID NO: 6218288 - DNA, 19 bp, Homo sapiens
gaggtccctgctgccagct

SEQ ID NO: 6218289 - DNA, 20 bp, Homo sapiens
gaggtccctgcttacctgac

SEQ ID NO: 6218290 - DNA, 22 bp, Homo sapiens
gaggtcccttcaaggcctcccc

SEQ ID NO: 6218291 - DNA, 22 bp, Homo sapiens
gaggtcctcaggtcagctggga

SEQ ID NO: 6218292 - DNA, 12 bp, Homo sapiens
gaggtcctcctc

SEQ ID NO: 6218293 - DNA, 16 bp, Homo sapiens
gaggtcctcctggcct

SEQ ID NO: 6218294 - DNA, 14 bp, Homo sapiens
gaggtcctctggag

SEQ ID NO: 6218295 - DNA, 16 bp, Homo sapiens
gaggtcctctggagcc

SEQ ID NO: 6218296 - DNA, 20 bp, Homo sapiens
gaggtcctctggagccctaa

SEQ ID NO: 6218297 - DNA, 17 bp, Homo sapiens
gaggtcctgagcactgc

SEQ ID NO: 6218298 - DNA, 23 bp, Homo sapiens
gaggtcctgagcactgccaggag

SEQ ID NO: 6218299 - DNA, 13 bp, Homo sapiens
gaggtcctggggg

SEQ ID NO: 6218300 - DNA, 14 bp, Homo sapiens
gaggtcctgggggc

SEQ ID NO: 6218301 - DNA, 18 bp, Homo sapiens
gaggtcctgggggcctga

SEQ ID NO: 6218302 - DNA, 21 bp, Homo sapiens
gaggtcctgggggcctgacct

SEQ ID NO: 6218303 - DNA, 21 bp, Homo sapiens
gaggtcctgtgatcttatttt

SEQ ID NO: 6218304 - DNA, 19 bp, Homo sapiens
gaggtccttaggcctctga

SEQ ID NO: 6218305 - DNA, 21 bp, Homo sapiens
gaggtccttaggcctctgaga

SEQ ID NO: 6218306 - DNA, 23 bp, Homo sapiens
gaggtccttggagtgctgcagct

SEQ ID NO: 6218307 - DNA, 12 bp, Homo sapiens
gaggtccttggt

SEQ ID NO: 6218308 - DNA, 21 bp, Homo sapiens
gaggtcgaagcaatcagcaaa

SEQ ID NO: 6218309 - DNA, 15 bp, Homo sapiens
gaggtcgaggcagga

SEQ ID NO: 6218310 - DNA, 21 bp, Homo sapiens
gaggtcgcagctaccctcagc

SEQ ID NO: 6218311 - DNA, 16 bp, Homo sapiens
gaggtctagagagaac

SEQ ID NO: 6218312 - DNA, 12 bp, Homo sapiens
gaggtctatttt

SEQ ID NO: 6218313 - DNA, 13 bp, Homo sapiens
gaggtctcagccc

SEQ ID NO: 6218314 - DNA, 17 bp, Homo sapiens
gaggtctcatctcccag

SEQ ID NO: 6218315 - DNA, 16 bp, Homo sapiens
gaggtctccaaactga

SEQ ID NO: 6218316 - DNA, 16 bp, Homo sapiens
gaggtctccactgagg

SEQ ID NO: 6218317 - DNA, 22 bp, Homo sapiens
gaggtctccactgaggatgtga

SEQ ID NO: 6218318 - DNA, 20 bp, Homo sapiens
gaggtctccaggggcctgca

SEQ ID NO: 6218319 - DNA, 22 bp, Homo sapiens
gaggtctccaggggcctgcaga

SEQ ID NO: 6218320 - DNA, 17 bp, Homo sapiens
gaggtctccccatcccc

SEQ ID NO: 6218321 - DNA, 14 bp, Homo sapiens
gaggtctcgaccct

SEQ ID NO: 6218322 - DNA, 18 bp, Homo sapiens
gaggtctcgaccctgtcc

SEQ ID NO: 6218323 - DNA, 21 bp, Homo sapiens
gaggtctcgaccctgtcccct

SEQ ID NO: 6218324 - DNA, 17 bp, Homo sapiens
gaggtctcgctgatgct

SEQ ID NO: 6218325 - DNA, 22 bp, Homo sapiens
gaggtctcgctgatgctgggct

SEQ ID NO: 6218326 - DNA, 22 bp, Homo sapiens
gaaccttttgagtgccttacac

SEQ ID NO: 6218327 - DNA, 23 bp, Homo sapiens
gaacctttttttttgaaacagca

SEQ ID NO: 6218328 - DNA, 22 bp, Homo sapiens
gaacgaaccttggcctgggccg

SEQ ID NO: 6218329 - DNA, 17 bp, Homo sapiens
gaacgaccttacaaatg

SEQ ID NO: 6218330 - DNA, 14 bp, Homo sapiens
gaacgagcactggc

SEQ ID NO: 6218331 - DNA, 18 bp, Homo sapiens
gaacgagcactggccaga

SEQ ID NO: 6218332 - DNA, 13 bp, Homo sapiens
gaacgagcagccc

SEQ ID NO: 6218333 - DNA, 15 bp, Homo sapiens
gaacgagcagcccag

SEQ ID NO: 6218334 - DNA, 17 bp, Homo sapiens
gaacgagcagcccaggg

SEQ ID NO: 6218335 - DNA, 18 bp, Homo sapiens
gaacgagcagcccagggc

SEQ ID NO: 6218336 - DNA, 19 bp, Homo sapiens
gaacgagcagcccagggcc

SEQ ID NO: 6218337 - DNA, 17 bp, Homo sapiens
gaacgagcctggaagca

SEQ ID NO: 6218338 - DNA, 22 bp, Homo sapiens
gaacgaggattaggggatgggg

SEQ ID NO: 6218339 - DNA, 18 bp, Homo sapiens
gaacgatatgtagcagaa

SEQ ID NO: 6218340 - DNA, 21 bp, Homo sapiens
gaacgatatgtagcagaaagg

SEQ ID NO: 6218341 - DNA, 17 bp, Homo sapiens
gaacgatgcctgcaggc

SEQ ID NO: 6218342 - DNA, 16 bp, Homo sapiens
gaacgatgtgtctgta

SEQ ID NO: 6218343 - DNA, 18 bp, Homo sapiens
gaacgatttagaaagaag

SEQ ID NO: 6218344 - DNA, 16 bp, Homo sapiens
gaacgcagaagaaagg

SEQ ID NO: 6218345 - DNA, 17 bp, Homo sapiens
gaacgcagccctagagc

SEQ ID NO: 6218346 - DNA, 23 bp, Homo sapiens
gaacgcagccctagagcctgcct

SEQ ID NO: 6218347 - DNA, 14 bp, Homo sapiens
gaacgcatgcaggg

SEQ ID NO: 6218348 - DNA, 12 bp, Homo sapiens
gaacgcattttg

SEQ ID NO: 6218349 - DNA, 19 bp, Homo sapiens
gaacgcccccccccacccc

SEQ ID NO: 6218350 - DNA, 20 bp, Homo sapiens
gaacgcccccccccacccct

SEQ ID NO: 6218351 - DNA, 18 bp, Homo sapiens
gaacgccctcatgctcag

SEQ ID NO: 6218352 - DNA, 14 bp, Homo sapiens
gaacgcgtgtgtgc

SEQ ID NO: 6218353 - DNA, 16 bp, Homo sapiens
gaacgctcagcgctgg

SEQ ID NO: 6218354 - DNA, 21 bp, Homo sapiens
gaacgctctaggcagaagaag

SEQ ID NO: 6218355 - DNA, 23 bp, Homo sapiens
gaacgctctcctcgagccctccc

SEQ ID NO: 6218356 - DNA, 19 bp, Homo sapiens
gaacgctgctccatgcaca

SEQ ID NO: 6218357 - DNA, 21 bp, Homo sapiens
gaacgctgctccatgcacagg

SEQ ID NO: 6218358 - DNA, 17 bp, Homo sapiens
gaacgctgtgatgctgt

SEQ ID NO: 6218359 - DNA, 23 bp, Homo sapiens
gaacggagccccaggcctctgtg

SEQ ID NO: 6218360 - DNA, 23 bp, Homo sapiens
gaacggatgctccgaggactgga

SEQ ID NO: 6218361 - DNA, 13 bp, Homo sapiens
gaacggccctgca

SEQ ID NO: 6218362 - DNA, 12 bp, Homo sapiens
gaacgggcagcc

SEQ ID NO: 6218363 - DNA, 16 bp, Homo sapiens
gaacgggcagccacag

SEQ ID NO: 6218364 - DNA, 17 bp, Homo sapiens
gaacgggcagccacagg

SEQ ID NO: 6218365 - DNA, 20 bp, Homo sapiens
gaacgggcagccacaggact

SEQ ID NO: 6218366 - DNA, 16 bp, Homo sapiens
gaacgggcagcctggg

SEQ ID NO: 6218367 - DNA, 15 bp, Homo sapiens
gaacgggcctccccg

SEQ ID NO: 6218368 - DNA, 14 bp, Homo sapiens
gaacggggagaaaa

SEQ ID NO: 6218369 - DNA, 20 bp, Homo sapiens
gaacggggtggacgagggag

SEQ ID NO: 6218370 - DNA, 15 bp, Homo sapiens
gaacggtaaatttct

SEQ ID NO: 6218371 - DNA, 13 bp, Homo sapiens
gaacgtaaagaac

SEQ ID NO: 6218372 - DNA, 23 bp, Homo sapiens
gaacgtagtcggcacagcctggt

SEQ ID NO: 6218373 - DNA, 18 bp, Homo sapiens
gaacgtatttagccatta

SEQ ID NO: 6218374 - DNA, 20 bp, Homo sapiens
gaacgtatttagccattacc

SEQ ID NO: 6218375 - DNA, 14 bp, Homo sapiens
gaacgtatttctcc

SEQ ID NO: 6218376 - DNA, 17 bp, Homo sapiens
gaacgtatttctccaga

SEQ ID NO: 6218377 - DNA, 14 bp, Homo sapiens
gaacgtccttcctt

SEQ ID NO: 6218378 - DNA, 13 bp, Homo sapiens
gaacgtgcatcct

SEQ ID NO: 6218379 - DNA, 15 bp, Homo sapiens
gaacgtgcttctttg

SEQ ID NO: 6218380 - DNA, 16 bp, Homo sapiens
gaacgtggctctgctg

SEQ ID NO: 6218381 - DNA, 17 bp, Homo sapiens
gaacgtggctctgctgg

SEQ ID NO: 6218382 - DNA, 20 bp, Homo sapiens
gaacgtggttcagagactgg

SEQ ID NO: 6218383 - DNA, 12 bp, Homo sapiens
gaacgtgtatgt

SEQ ID NO: 6218384 - DNA, 22 bp, Homo sapiens
gaacgtgtgtccaggctctggg

SEQ ID NO: 6218385 - DNA, 14 bp, Homo sapiens
gaacgttaaactat

SEQ ID NO: 6218386 - DNA, 13 bp, Homo sapiens
gaacgttctcttt

SEQ ID NO: 6218387 - DNA, 20 bp, Homo sapiens
gaacgtttagctgacaaaat

SEQ ID NO: 6218388 - DNA, 18 bp, Homo sapiens
gaacgtttggttcaaatg

SEQ ID NO: 6218389 - DNA, 15 bp, Homo sapiens
gaacgttttctaatt

SEQ ID NO: 6218390 - DNA, 18 bp, Homo sapiens
gaacgttttcttctttcc

SEQ ID NO: 6218391 - DNA, 23 bp, Homo sapiens
gaacgttttcttctttccctgga

SEQ ID NO: 6218392 - DNA, 12 bp, Homo sapiens
gaacgtttttcc

SEQ ID NO: 6218393 - DNA, 16 bp, Homo sapiens
gaactaaaaagagact

SEQ ID NO: 6218394 - DNA, 22 bp, Homo sapiens
gaactaaaaagagactgtgcca

SEQ ID NO: 6218395 - DNA, 21 bp, Homo sapiens
gaactaaacgtcaccaaggtg

SEQ ID NO: 6218396 - DNA, 14 bp, Homo sapiens
gaactaaactttca

SEQ ID NO: 6218397 - DNA, 16 bp, Homo sapiens
gaactaaactttcaca

SEQ ID NO: 6218398 - DNA, 18 bp, Homo sapiens
gaactaaactttcacacc

SEQ ID NO: 6218399 - DNA, 13 bp, Homo sapiens
gaactaaatataa

SEQ ID NO: 6218400 - DNA, 12 bp, Homo sapiens
gaactaaatgtt

SEQ ID NO: 6218401 - DNA, 13 bp, Homo sapiens
gaactaaatgttc

SEQ ID NO: 6218402 - DNA, 18 bp, Homo sapiens
gaactaacacgtgatgtg

SEQ ID NO: 6218403 - DNA, 15 bp, Homo sapiens
gaactaacagaggag

SEQ ID NO: 6218404 - DNA, 17 bp, Homo sapiens
gaactaagttattgtta

SEQ ID NO: 6218405 - DNA, 15 bp, Homo sapiens
gaactaataaaagca

SEQ ID NO: 6218406 - DNA, 12 bp, Homo sapiens
gaactaataaat

SEQ ID NO: 6218407 - DNA, 17 bp, Homo sapiens
gaactaataaatacata

SEQ ID NO: 6218408 - DNA, 19 bp, Homo sapiens
gaactaatttcttctcctg

SEQ ID NO: 6218409 - DNA, 21 bp, Homo sapiens
gaactaatttggtttttactc

SEQ ID NO: 6218410 - DNA, 22 bp, Homo sapiens
gaactacaaacaaaatttctat

SEQ ID NO: 6218411 - DNA, 23 bp, Homo sapiens
gaactacaaacaaaatttctatt

SEQ ID NO: 6218412 - DNA, 20 bp, Homo sapiens
gaactaccttggttccccca

SEQ ID NO: 6218413 - DNA, 16 bp, Homo sapiens
gaactactaaggaaaa

SEQ ID NO: 6218414 - DNA, 14 bp, Homo sapiens
gaactactgctatt

SEQ ID NO: 6218415 - DNA, 13 bp, Homo sapiens
gaactagactttc

SEQ ID NO: 6218416 - DNA, 17 bp, Homo sapiens
gaactagactttccttt

SEQ ID NO: 6218417 - DNA, 18 bp, Homo sapiens
gaactagaggttttatga

SEQ ID NO: 6218418 - DNA, 18 bp, Homo sapiens
gaactagccaaaccagga

SEQ ID NO: 6218419 - DNA, 13 bp, Homo sapiens
gaactagctggaa

SEQ ID NO: 6218420 - DNA, 20 bp, Homo sapiens
gaactaggaaggcacttctg

SEQ ID NO: 6218421 - DNA, 20 bp, Homo sapiens
gaactagggcaagtcttaaa

SEQ ID NO: 6218422 - DNA, 12 bp, Homo sapiens
gaactagggcac

SEQ ID NO: 6218423 - DNA, 16 bp, Homo sapiens
gaactaggtgctggca

SEQ ID NO: 6218424 - DNA, 17 bp, Homo sapiens
gaactagtggtggctct

SEQ ID NO: 6218425 - DNA, 19 bp, Homo sapiens
gaactagttttactttgaa

SEQ ID NO: 6218426 - DNA, 15 bp, Homo sapiens
gaactataaagaagt

SEQ ID NO: 6218427 - DNA, 19 bp, Homo sapiens
gaactatattagtatgtat

SEQ ID NO: 6218428 - DNA, 13 bp, Homo sapiens
gaactatatttaa

SEQ ID NO: 6218429 - DNA, 14 bp, Homo sapiens
gaactatatttaat

SEQ ID NO: 6218430 - DNA, 18 bp, Homo sapiens
gaactatattttccccca

SEQ ID NO: 6218431 - DNA, 18 bp, Homo sapiens
gaactatctgcattatct

SEQ ID NO: 6218432 - DNA, 14 bp, Homo sapiens
gaactatgaaatca

SEQ ID NO: 6218433 - DNA, 17 bp, Homo sapiens
gaactatgactggagta

SEQ ID NO: 6218434 - DNA, 17 bp, Homo sapiens
gaactatggacggtgct

SEQ ID NO: 6218435 - DNA, 21 bp, Homo sapiens
gaactatggacggtgctccag

SEQ ID NO: 6218436 - DNA, 20 bp, Homo sapiens
gaactatgtcgatgcacagt

SEQ ID NO: 6218437 - DNA, 13 bp, Homo sapiens
gaactattagagc

SEQ ID NO: 6218438 - DNA, 22 bp, Homo sapiens
gaactattggagggtgggagag

SEQ ID NO: 6218439 - DNA, 13 bp, Homo sapiens
gaactattgtgtt

SEQ ID NO: 6218440 - DNA, 20 bp, Homo sapiens
gaactatttaaaataaagag

SEQ ID NO: 6218441 - DNA, 19 bp, Homo sapiens
gaactatttattaaaaaca

SEQ ID NO: 6218442 - DNA, 23 bp, Homo sapiens
gaactatttattaaaaacatgac

SEQ ID NO: 6218443 - DNA, 14 bp, Homo sapiens
gaactatttttaag

SEQ ID NO: 6218444 - DNA, 16 bp, Homo sapiens
gaactcaaatggggcc

SEQ ID NO: 6218445 - DNA, 17 bp, Homo sapiens
gaactcaagctgcgttt

SEQ ID NO: 6218446 - DNA, 21 bp, Homo sapiens
gaactcaatctaaattaaaaa

SEQ ID NO: 6218447 - DNA, 23 bp, Homo sapiens
gaactcaatctaaattaaaaaag

SEQ ID NO: 6218448 - DNA, 14 bp, Homo sapiens
gaactcaatgcatg

SEQ ID NO: 6218449 - DNA, 21 bp, Homo sapiens
gaactcaatgcatgatgactc

SEQ ID NO: 6218450 - DNA, 16 bp, Homo sapiens
gaactcacagactgct

SEQ ID NO: 6218451 - DNA, 19 bp, Homo sapiens
gaactcacagactgctgtc

SEQ ID NO: 6218452 - DNA, 13 bp, Homo sapiens
gaactcaccgctc

SEQ ID NO: 6218453 - DNA, 21 bp, Homo sapiens
gaactcacctggggctgctgg

SEQ ID NO: 6218454 - DNA, 16 bp, Homo sapiens
gaactcactcactctg

SEQ ID NO: 6218455 - DNA, 16 bp, Homo sapiens
gaactcactggggcct

SEQ ID NO: 6218456 - DNA, 13 bp, Homo sapiens
gaactcagaagag

SEQ ID NO: 6218457 - DNA, 16 bp, Homo sapiens
gaactcagaccacttg

SEQ ID NO: 6218458 - DNA, 17 bp, Homo sapiens
gaactcagagcccctcc

SEQ ID NO: 6218459 - DNA, 20 bp, Homo sapiens
gaactcagagcccctccctg

SEQ ID NO: 6218460 - DNA, 16 bp, Homo sapiens
gaactcagatccaggg

SEQ ID NO: 6218461 - DNA, 18 bp, Homo sapiens
gaactcagatccagggac

SEQ ID NO: 6218462 - DNA, 19 bp, Homo sapiens
gaactcagatccagggaca

SEQ ID NO: 6218463 - DNA, 21 bp, Homo sapiens
gaactcagatccagggacaga

SEQ ID NO: 6218464 - DNA, 18 bp, Homo sapiens
gaactcagatctgtctga

SEQ ID NO: 6218465 - DNA, 16 bp, Homo sapiens
gaactcagccaagcac

SEQ ID NO: 6218466 - DNA, 20 bp, Homo sapiens
gaactcagccaagcacagtg

SEQ ID NO: 6218467 - DNA, 14 bp, Homo sapiens
gaactcagccttaa

SEQ ID NO: 6218468 - DNA, 16 bp, Homo sapiens
gaactcagtgccacac

SEQ ID NO: 6218469 - DNA, 17 bp, Homo sapiens
gaactcatcactgtggc

SEQ ID NO: 6218470 - DNA, 18 bp, Homo sapiens
gaactcatcactgtggct

SEQ ID NO: 6218471 - DNA, 18 bp, Homo sapiens
gaactcatccctaatgct

SEQ ID NO: 6218472 - DNA, 23 bp, Homo sapiens
gaactcatcctgtgtggggaggc

SEQ ID NO: 6218473 - DNA, 12 bp, Homo sapiens
gaactcatttca

SEQ ID NO: 6218474 - DNA, 12 bp, Homo sapiens
gaactccacccc

SEQ ID NO: 6218475 - DNA, 14 bp, Homo sapiens
gaactccagagtca

SEQ ID NO: 6218476 - DNA, 19 bp, Homo sapiens
gaactccaggcatgtgtct

SEQ ID NO: 6218477 - DNA, 18 bp, Homo sapiens
gaactccaggctttctgg

SEQ ID NO: 6218478 - DNA, 23 bp, Homo sapiens
gaactccaggctttctggagttc

SEQ ID NO: 6218479 - DNA, 13 bp, Homo sapiens
gaactccagtgtt

SEQ ID NO: 6218480 - DNA, 18 bp, Homo sapiens
gaactccatacagaaaac

SEQ ID NO: 6218481 - DNA, 17 bp, Homo sapiens
gaactccatacagcctc

SEQ ID NO: 6218482 - DNA, 11 bp, Homo sapiens
gaactccattt

SEQ ID NO: 6218483 - DNA, 14 bp, Homo sapiens
gaactcccaagaac

SEQ ID NO: 6218484 - DNA, 21 bp, Homo sapiens
gaactcccaagaacagcaggc

SEQ ID NO: 6218485 - DNA, 15 bp, Homo sapiens
gaactccccagggcc

SEQ ID NO: 6218486 - DNA, 16 bp, Homo sapiens
gaactccccagggcct

SEQ ID NO: 6218487 - DNA, 22 bp, Homo sapiens
gaactccccagggcctccagga

SEQ ID NO: 6218488 - DNA, 16 bp, Homo sapiens
gaactcccccagaggt

SEQ ID NO: 6218489 - DNA, 22 bp, Homo sapiens
gaactccccttcttcctggagt

SEQ ID NO: 6218490 - DNA, 21 bp, Homo sapiens
gaactcccgacctcaagtgat

SEQ ID NO: 6218491 - DNA, 14 bp, Homo sapiens
gaactccctttcaa

SEQ ID NO: 6218492 - DNA, 16 bp, Homo sapiens
gaactccctttcaaca

SEQ ID NO: 6218493 - DNA, 15 bp, Homo sapiens
gaactcctaaatcaa

SEQ ID NO: 6218494 - DNA, 18 bp, Homo sapiens
gaactcctcaagggcaga

SEQ ID NO: 6218495 - DNA, 21 bp, Homo sapiens
gaactcctcaagggcagagaa

SEQ ID NO: 6218496 - DNA, 19 bp, Homo sapiens
gaactcctccaaagcatgt

SEQ ID NO: 6218497 - DNA, 11 bp, Homo sapiens
gaactcctgac

SEQ ID NO: 6218498 - DNA, 17 bp, Homo sapiens
gaactcctgacctcagg

SEQ ID NO: 6218499 - DNA, 13 bp, Homo sapiens
gaactcctgccag

SEQ ID NO: 6218500 - DNA, 18 bp, Homo sapiens
gaactcctgccaggcaca

SEQ ID NO: 6218501 - DNA, 11 bp, Homo sapiens
gaactcctggc

SEQ ID NO: 6218502 - DNA, 20 bp, Homo sapiens
gaactcctgtcttctttctc

SEQ ID NO: 6218503 - DNA, 15 bp, Homo sapiens
gaactccttgatttt

SEQ ID NO: 6218504 - DNA, 22 bp, Homo sapiens
gaactccttgattttagccttc

SEQ ID NO: 6218505 - DNA, 21 bp, Homo sapiens
gaactccttggcctagcccac

SEQ ID NO: 6218506 - DNA, 23 bp, Homo sapiens
gaggtctcgctgatgctgggctg

SEQ ID NO: 6218507 - DNA, 16 bp, Homo sapiens
gaggtctctccctccc

SEQ ID NO: 6218508 - DNA, 16 bp, Homo sapiens
gaggtctctgccggct

SEQ ID NO: 6218509 - DNA, 15 bp, Homo sapiens
gaggtctctgggagc

SEQ ID NO: 6218510 - DNA, 14 bp, Homo sapiens
gaggtctgaaatgg

SEQ ID NO: 6218511 - DNA, 12 bp, Homo sapiens
gaggtctgagcc

SEQ ID NO: 6218512 - DNA, 15 bp, Homo sapiens
gaggtctgagccctg

SEQ ID NO: 6218513 - DNA, 16 bp, Homo sapiens
gaggtctgagccctgg

SEQ ID NO: 6218514 - DNA, 23 bp, Homo sapiens
gaggtctgctcggccgtcttcac

SEQ ID NO: 6218515 - DNA, 21 bp, Homo sapiens
gaggtctggctgagcccctgg

SEQ ID NO: 6218516 - DNA, 23 bp, Homo sapiens
gaggtctggctgagcccctgggg

SEQ ID NO: 6218517 - DNA, 19 bp, Homo sapiens
gaggtctgtgctgaggcct

SEQ ID NO: 6218518 - DNA, 16 bp, Homo sapiens
gaggtcttcagggctc

SEQ ID NO: 6218519 - DNA, 22 bp, Homo sapiens
gaggtcttgctagaatgggaag

SEQ ID NO: 6218520 - DNA, 19 bp, Homo sapiens
gaggtctttctcctcagga

SEQ ID NO: 6218521 - DNA, 22 bp, Homo sapiens
gaggtctttctcctcaggacaa

SEQ ID NO: 6218522 - DNA, 16 bp, Homo sapiens
gaggtgaaaaggccaa

SEQ ID NO: 6218523 - DNA, 17 bp, Homo sapiens
gaggtgaaattcagtta

SEQ ID NO: 6218524 - DNA, 16 bp, Homo sapiens
gaggtgaacaaggtaa

SEQ ID NO: 6218525 - DNA, 15 bp, Homo sapiens
gaggtgaactccagg

SEQ ID NO: 6218526 - DNA, 16 bp, Homo sapiens
gaggtgaactccaggc

SEQ ID NO: 6218527 - DNA, 15 bp, Homo sapiens
gaggtgaatttcatt

SEQ ID NO: 6218528 - DNA, 15 bp, Homo sapiens
gaggtgacctgttag

SEQ ID NO: 6218529 - DNA, 21 bp, Homo sapiens
gaggtgacttgcctggggcca

SEQ ID NO: 6218530 - DNA, 13 bp, Homo sapiens
gaggtgagggggg

SEQ ID NO: 6218531 - DNA, 18 bp, Homo sapiens
gaggtgaggggggctggc

SEQ ID NO: 6218532 - DNA, 15 bp, Homo sapiens
gaggtgataggcaag

SEQ ID NO: 6218533 - DNA, 18 bp, Homo sapiens
gaggtgatgggtgcagga

SEQ ID NO: 6218534 - DNA, 21 bp, Homo sapiens
gaggtgattctcagggctgga

SEQ ID NO: 6218535 - DNA, 19 bp, Homo sapiens
gaggtgcaagacctagtcc

SEQ ID NO: 6218536 - DNA, 18 bp, Homo sapiens
gaggtgcactgggaggct

SEQ ID NO: 6218537 - DNA, 22 bp, Homo sapiens
gaggtgcaggggaagaccaaag

SEQ ID NO: 6218538 - DNA, 16 bp, Homo sapiens
gaggtgcatgcctaat

SEQ ID NO: 6218539 - DNA, 22 bp, Homo sapiens
gaggtgccagcaactgaataaa

SEQ ID NO: 6218540 - DNA, 12 bp, Homo sapiens
gaggtgccagga

SEQ ID NO: 6218541 - DNA, 22 bp, Homo sapiens
gaggtgcccactccgccagcca

SEQ ID NO: 6218542 - DNA, 15 bp, Homo sapiens
gaggtgcccaggaga

SEQ ID NO: 6218543 - DNA, 18 bp, Homo sapiens
gaggtgccggatgcagga

SEQ ID NO: 6218544 - DNA, 11 bp, Homo sapiens
gaggtgcctcc

SEQ ID NO: 6218545 - DNA, 12 bp, Homo sapiens
gaggtgcctccc

SEQ ID NO: 6218546 - DNA, 23 bp, Homo sapiens
gaggtgcctcccagtggcctggc

SEQ ID NO: 6218547 - DNA, 18 bp, Homo sapiens
gaggtgcctgaaagctgg

SEQ ID NO: 6218548 - DNA, 19 bp, Homo sapiens
gaggtgcctgagagcagaa

SEQ ID NO: 6218549 - DNA, 22 bp, Homo sapiens
gaggtgcctgagagcagaatga

SEQ ID NO: 6218550 - DNA, 17 bp, Homo sapiens
gaggtgcctgagctggg

SEQ ID NO: 6218551 - DNA, 22 bp, Homo sapiens
gaggtgcctgagctggggcctg

SEQ ID NO: 6218552 - DNA, 12 bp, Homo sapiens
gaggtgcctgga

SEQ ID NO: 6218553 - DNA, 13 bp, Homo sapiens
gaggtgcctggga

SEQ ID NO: 6218554 - DNA, 15 bp, Homo sapiens
gaggtgcctgggagg

SEQ ID NO: 6218555 - DNA, 21 bp, Homo sapiens
gaggtgcctgtcccaccccca

SEQ ID NO: 6218556 - DNA, 12 bp, Homo sapiens
gaggtgccttct

SEQ ID NO: 6218557 - DNA, 23 bp, Homo sapiens
gaggtgcgctcacctcagagcag

SEQ ID NO: 6218558 - DNA, 15 bp, Homo sapiens
gaggtgctaaattgt

SEQ ID NO: 6218559 - DNA, 23 bp, Homo sapiens
gaggtgctactgactttctcagc

SEQ ID NO: 6218560 - DNA, 17 bp, Homo sapiens
gaggtgctatgaagcca

SEQ ID NO: 6218561 - DNA, 17 bp, Homo sapiens
gaggtgctgatgagtga

SEQ ID NO: 6218562 - DNA, 21 bp, Homo sapiens
gaggtgctgggggagccctgg

SEQ ID NO: 6218563 - DNA, 20 bp, Homo sapiens
gaggtgctggtagctgaggg

SEQ ID NO: 6218564 - DNA, 20 bp, Homo sapiens
gaggtgctggttccatgcct

SEQ ID NO: 6218565 - DNA, 15 bp, Homo sapiens
gaggtgctgtcccca

SEQ ID NO: 6218566 - DNA, 12 bp, Homo sapiens
gaggtgcttcac

SEQ ID NO: 6218567 - DNA, 13 bp, Homo sapiens
gaggtggaagaag

SEQ ID NO: 6218568 - DNA, 16 bp, Homo sapiens
gaggtggaagaaggga

SEQ ID NO: 6218569 - DNA, 18 bp, Homo sapiens
gaggtggaagaagggaga

SEQ ID NO: 6218570 - DNA, 17 bp, Homo sapiens
gaggtggaagagggctg

SEQ ID NO: 6218571 - DNA, 12 bp, Homo sapiens
gaggtggagaaa

SEQ ID NO: 6218572 - DNA, 15 bp, Homo sapiens
gaggtggagaaaatt

SEQ ID NO: 6218573 - DNA, 13 bp, Homo sapiens
gaggtggagaact

SEQ ID NO: 6218574 - DNA, 22 bp, Homo sapiens
gaggtggagccaagtggtccag

SEQ ID NO: 6218575 - DNA, 18 bp, Homo sapiens
gaggtggatactgggggg

SEQ ID NO: 6218576 - DNA, 20 bp, Homo sapiens
gaggtggatcacagaggctt

SEQ ID NO: 6218577 - DNA, 21 bp, Homo sapiens
gaggtggattccgagtggtga

SEQ ID NO: 6218578 - DNA, 15 bp, Homo sapiens
gaggtggcagccctg

SEQ ID NO: 6218579 - DNA, 17 bp, Homo sapiens
gaggtggccagagctgg

SEQ ID NO: 6218580 - DNA, 22 bp, Homo sapiens
gaggtggccagagctgggaggc

SEQ ID NO: 6218581 - DNA, 23 bp, Homo sapiens
gaggtggccagcccgcagaggtg

SEQ ID NO: 6218582 - DNA, 13 bp, Homo sapiens
gaggtggcccagg

SEQ ID NO: 6218583 - DNA, 11 bp, Homo sapiens
gaggtggccct

SEQ ID NO: 6218584 - DNA, 18 bp, Homo sapiens
gaggtggccctcccaggc

SEQ ID NO: 6218585 - DNA, 21 bp, Homo sapiens
gaggtggccctcccaggctgg

SEQ ID NO: 6218586 - DNA, 18 bp, Homo sapiens
gaggtggcctccttgctt

SEQ ID NO: 6218587 - DNA, 20 bp, Homo sapiens
gaggtggctgagcccctgtc

SEQ ID NO: 6218588 - DNA, 13 bp, Homo sapiens
gaggtggctgcct

SEQ ID NO: 6218589 - DNA, 18 bp, Homo sapiens
gaggtggctgcgccccca

SEQ ID NO: 6218590 - DNA, 20 bp, Homo sapiens
gaggtggcttttgcggccag

SEQ ID NO: 6218591 - DNA, 18 bp, Homo sapiens
gaggtgggagcaggagat

SEQ ID NO: 6218592 - DNA, 13 bp, Homo sapiens
gaggtgggaggcc

SEQ ID NO: 6218593 - DNA, 14 bp, Homo sapiens
gaggtgggaggcca

SEQ ID NO: 6218594 - DNA, 16 bp, Homo sapiens
gaggtgggaggccagg

SEQ ID NO: 6218595 - DNA, 20 bp, Homo sapiens
gaggtgggaggcccctggtg

SEQ ID NO: 6218596 - DNA, 23 bp, Homo sapiens
gaggtgggaggcccctggtggca

SEQ ID NO: 6218597 - DNA, 12 bp, Homo sapiens
gaggtgggatcc

SEQ ID NO: 6218598 - DNA, 16 bp, Homo sapiens
gaggtgggatcctcca

SEQ ID NO: 6218599 - DNA, 11 bp, Homo sapiens
gaggtgggcag

SEQ ID NO: 6218600 - DNA, 17 bp, Homo sapiens
gaggtgggcagatcatt

SEQ ID NO: 6218601 - DNA, 14 bp, Homo sapiens
gaggtgggcaggtg

SEQ ID NO: 6218602 - DNA, 22 bp, Homo sapiens
gaggtgggcccaggaccagctg

SEQ ID NO: 6218603 - DNA, 21 bp, Homo sapiens
gaggtggggagggcctctgga

SEQ ID NO: 6218604 - DNA, 19 bp, Homo sapiens
gaggtggggcgaggcaggc

SEQ ID NO: 6218605 - DNA, 15 bp, Homo sapiens
gaggtgggggatgct

SEQ ID NO: 6218606 - DNA, 16 bp, Homo sapiens
gaggtgggggatgctg

SEQ ID NO: 6218607 - DNA, 13 bp, Homo sapiens
gaggtgggggcag

SEQ ID NO: 6218608 - DNA, 17 bp, Homo sapiens
gaggtgggtgggcctga

SEQ ID NO: 6218609 - DNA, 22 bp, Homo sapiens
gaggtgggtgtgggtggaaggg

SEQ ID NO: 6218610 - DNA, 19 bp, Homo sapiens
gaggtggtagctctgagcc

SEQ ID NO: 6218611 - DNA, 22 bp, Homo sapiens
gaggtggtagctctgagccctc

SEQ ID NO: 6218612 - DNA, 22 bp, Homo sapiens
gaggtggtaggatcacctgagg

SEQ ID NO: 6218613 - DNA, 22 bp, Homo sapiens
gaggtggtagtaaaacacagag

SEQ ID NO: 6218614 - DNA, 16 bp, Homo sapiens
gaggtggtctgaatgt

SEQ ID NO: 6218615 - DNA, 20 bp, Homo sapiens
gaggtggtctgaatgttctg

SEQ ID NO: 6218616 - DNA, 14 bp, Homo sapiens
gaggtggtggagga

SEQ ID NO: 6218617 - DNA, 15 bp, Homo sapiens
gaggtggtggaggag

SEQ ID NO: 6218618 - DNA, 15 bp, Homo sapiens
gaggtggtggggacc

SEQ ID NO: 6218619 - DNA, 16 bp, Homo sapiens
gaggtggttcagacaa

SEQ ID NO: 6218620 - DNA, 14 bp, Homo sapiens
gaggtgtacactaa

SEQ ID NO: 6218621 - DNA, 18 bp, Homo sapiens
gaggtgtcaccctgcaga

SEQ ID NO: 6218622 - DNA, 15 bp, Homo sapiens
gaggtgtcaggctgc

SEQ ID NO: 6218623 - DNA, 14 bp, Homo sapiens
gaggtgtcatgctt

SEQ ID NO: 6218624 - DNA, 15 bp, Homo sapiens
gaggtgtccaactgg

SEQ ID NO: 6218625 - DNA, 16 bp, Homo sapiens
gaggtgtccaactggc

SEQ ID NO: 6218626 - DNA, 15 bp, Homo sapiens
gaggtgtcccaagct

SEQ ID NO: 6218627 - DNA, 14 bp, Homo sapiens
gaggtgtctcaggc

SEQ ID NO: 6218628 - DNA, 20 bp, Homo sapiens
gaggtgtctcaggctgcctg

SEQ ID NO: 6218629 - DNA, 16 bp, Homo sapiens
gaggtgtctggcctga

SEQ ID NO: 6218630 - DNA, 20 bp, Homo sapiens
gaggtgtctggcctgaggtc

SEQ ID NO: 6218631 - DNA, 12 bp, Homo sapiens
gaggtgtgcctg

SEQ ID NO: 6218632 - DNA, 16 bp, Homo sapiens
gaggtgtgcctggcct

SEQ ID NO: 6218633 - DNA, 20 bp, Homo sapiens
gaggtgtgcctggcctctgc

SEQ ID NO: 6218634 - DNA, 14 bp, Homo sapiens
gaggtgtggagtgg

SEQ ID NO: 6218635 - DNA, 16 bp, Homo sapiens
gaggtgtgggggctgc

SEQ ID NO: 6218636 - DNA, 17 bp, Homo sapiens
gaggtgtgggggctgca

SEQ ID NO: 6218637 - DNA, 20 bp, Homo sapiens
gaggtgtgggtgtctgtttg

SEQ ID NO: 6218638 - DNA, 18 bp, Homo sapiens
gaggtgttgtggggatgg

SEQ ID NO: 6218639 - DNA, 19 bp, Homo sapiens
gaggtgttgtggggatggt

SEQ ID NO: 6218640 - DNA, 14 bp, Homo sapiens
gaggtgtttaaaga

SEQ ID NO: 6218641 - DNA, 21 bp, Homo sapiens
gaggttaaaatataaattaag

SEQ ID NO: 6218642 - DNA, 18 bp, Homo sapiens
gaggttaaacggtgccca

SEQ ID NO: 6218643 - DNA, 19 bp, Homo sapiens
gaggttaaggctgaggaaa

SEQ ID NO: 6218644 - DNA, 22 bp, Homo sapiens
gaggttaggagttcgagaccag

SEQ ID NO: 6218645 - DNA, 17 bp, Homo sapiens
gaggttatctgcctggc

SEQ ID NO: 6218646 - DNA, 20 bp, Homo sapiens
gaggttatctgcctggcctg

SEQ ID NO: 6218647 - DNA, 23 bp, Homo sapiens
gaggttattcacaacctcaccaa

SEQ ID NO: 6218648 - DNA, 23 bp, Homo sapiens
gaggttcaaaggcagcaaggcag

SEQ ID NO: 6218649 - DNA, 14 bp, Homo sapiens
gaggttccctttga

SEQ ID NO: 6218650 - DNA, 11 bp, Homo sapiens
gaggttcctcg

SEQ ID NO: 6218651 - DNA, 17 bp, Homo sapiens
gaggttcctctgcctgc

SEQ ID NO: 6218652 - DNA, 18 bp, Homo sapiens
gaggttcctctgcctgcc

SEQ ID NO: 6218653 - DNA, 14 bp, Homo sapiens
gaggttctcagagc

SEQ ID NO: 6218654 - DNA, 12 bp, Homo sapiens
gaggttctcagc

SEQ ID NO: 6218655 - DNA, 16 bp, Homo sapiens
gaggttctcagcaagt

SEQ ID NO: 6218656 - DNA, 17 bp, Homo sapiens
gaggttctcagcaagtg

SEQ ID NO: 6218657 - DNA, 16 bp, Homo sapiens
gaggttctgagaccag

SEQ ID NO: 6218658 - DNA, 13 bp, Homo sapiens
gaggttctgcctc

SEQ ID NO: 6218659 - DNA, 15 bp, Homo sapiens
gaggttctgggcctc

SEQ ID NO: 6218660 - DNA, 14 bp, Homo sapiens
gaggttctggggag

SEQ ID NO: 6218661 - DNA, 15 bp, Homo sapiens
gaggttctggggagg

SEQ ID NO: 6218662 - DNA, 22 bp, Homo sapiens
gaggttcttgtaccacttcatc

SEQ ID NO: 6218663 - DNA, 13 bp, Homo sapiens
gaggttgaagcca

SEQ ID NO: 6218664 - DNA, 19 bp, Homo sapiens
gaggttgaggatgcactgg

SEQ ID NO: 6218665 - DNA, 18 bp, Homo sapiens
gaggttgataactttgct

SEQ ID NO: 6218666 - DNA, 21 bp, Homo sapiens
gaggttgatttgctctctaaa

SEQ ID NO: 6218667 - DNA, 20 bp, Homo sapiens
gaggttgattttcatgattc

SEQ ID NO: 6218668 - DNA, 16 bp, Homo sapiens
gaggttgcagcatgag

SEQ ID NO: 6218669 - DNA, 13 bp, Homo sapiens
gaggttgcaggga

SEQ ID NO: 6218670 - DNA, 19 bp, Homo sapiens
gaggttgcagggagccgag

SEQ ID NO: 6218671 - DNA, 23 bp, Homo sapiens
gaggttgcagtgagccaaaatca

SEQ ID NO: 6218672 - DNA, 20 bp, Homo sapiens
gaggttgcagtgagccgaga

SEQ ID NO: 6218673 - DNA, 15 bp, Homo sapiens
gaggttgcattctag

SEQ ID NO: 6218674 - DNA, 20 bp, Homo sapiens
gaggttgccccttccccatc

SEQ ID NO: 6218675 - DNA, 19 bp, Homo sapiens
gaggttgctgtacaggaaa

SEQ ID NO: 6218676 - DNA, 12 bp, Homo sapiens
gaggttgggagg

SEQ ID NO: 6218677 - DNA, 16 bp, Homo sapiens
gaggttgtgcactgtt

SEQ ID NO: 6218678 - DNA, 21 bp, Homo sapiens
gaggttgtggggcctcaggct

SEQ ID NO: 6218679 - DNA, 14 bp, Homo sapiens
gaggtttagcaata

SEQ ID NO: 6218680 - DNA, 17 bp, Homo sapiens
gaggtttagctgcagga

SEQ ID NO: 6218681 - DNA, 13 bp, Homo sapiens
gaggtttcagcat

SEQ ID NO: 6218682 - DNA, 16 bp, Homo sapiens
gaggtttggaagagtg

SEQ ID NO: 6218683 - DNA, 19 bp, Homo sapiens
gaggtttggaagagtgaag

SEQ ID NO: 6218684 - DNA, 22 bp, Homo sapiens
gaggtttgtcaacaaaaagaca

SEQ ID NO: 6218685 - DNA, 16 bp, Homo sapiens
gaactcgaagcccttc

SEQ ID NO: 6218686 - DNA, 15 bp, Homo sapiens
gaactcgcacctgtg

SEQ ID NO: 6218687 - DNA, 20 bp, Homo sapiens
gaactcgcacctgtgctgga

SEQ ID NO: 6218688 - DNA, 21 bp, Homo sapiens
gaactcgcacctgtgctggag

SEQ ID NO: 6218689 - DNA, 19 bp, Homo sapiens
gaactcgcgctcagtaaac

SEQ ID NO: 6218690 - DNA, 18 bp, Homo sapiens
gaactcgttaaagcaaag

SEQ ID NO: 6218691 - DNA, 18 bp, Homo sapiens
gaactctaaaccttgtga

SEQ ID NO: 6218692 - DNA, 15 bp, Homo sapiens
gaactctaaccagtg

SEQ ID NO: 6218693 - DNA, 21 bp, Homo sapiens
gaactctaccctggtaggaaa

SEQ ID NO: 6218694 - DNA, 21 bp, Homo sapiens
gaactctatctgggcctgggc

SEQ ID NO: 6218695 - DNA, 23 bp, Homo sapiens
gaactctcccctccccatctgtg

SEQ ID NO: 6218696 - DNA, 23 bp, Homo sapiens
gaactctcctatctgaacctact

SEQ ID NO: 6218697 - DNA, 21 bp, Homo sapiens
gaactctcctgctcctcagga

SEQ ID NO: 6218698 - DNA, 17 bp, Homo sapiens
gaactctctccacccta

SEQ ID NO: 6218699 - DNA, 12 bp, Homo sapiens
gaactctgaaat

SEQ ID NO: 6218700 - DNA, 15 bp, Homo sapiens
gaactctgacaaggg

SEQ ID NO: 6218701 - DNA, 19 bp, Homo sapiens
gaactctgacaagggctga

SEQ ID NO: 6218702 - DNA, 14 bp, Homo sapiens
gaactctgcaggca

SEQ ID NO: 6218703 - DNA, 16 bp, Homo sapiens
gaactctggcttccag

SEQ ID NO: 6218704 - DNA, 13 bp, Homo sapiens
gaactctgggctc

SEQ ID NO: 6218705 - DNA, 14 bp, Homo sapiens
gaactctgggctca

SEQ ID NO: 6218706 - DNA, 19 bp, Homo sapiens
gaactctggtgctcctgca

SEQ ID NO: 6218707 - DNA, 18 bp, Homo sapiens
gaactctggtggcacagg

SEQ ID NO: 6218708 - DNA, 16 bp, Homo sapiens
gaactctgtgtgagag

SEQ ID NO: 6218709 - DNA, 17 bp, Homo sapiens
gaactctgtgtgagaga

SEQ ID NO: 6218710 - DNA, 18 bp, Homo sapiens
gaactcttaaatactttt

SEQ ID NO: 6218711 - DNA, 15 bp, Homo sapiens
gaactcttagaaatg

SEQ ID NO: 6218712 - DNA, 23 bp, Homo sapiens
gaactcttcagaacacacagact

SEQ ID NO: 6218713 - DNA, 20 bp, Homo sapiens
gaactcttcctcctcccaag

SEQ ID NO: 6218714 - DNA, 17 bp, Homo sapiens
gaactcttctcattact

SEQ ID NO: 6218715 - DNA, 22 bp, Homo sapiens
gaactctttctggcctgccttc

SEQ ID NO: 6218716 - DNA, 19 bp, Homo sapiens
gaactgaaaacataaaaag

SEQ ID NO: 6218717 - DNA, 17 bp, Homo sapiens
gaactgaaaagagagca

SEQ ID NO: 6218718 - DNA, 19 bp, Homo sapiens
gaactgaaaagagagcaga

SEQ ID NO: 6218719 - DNA, 20 bp, Homo sapiens
gaactgaaacttttctaaag

SEQ ID NO: 6218720 - DNA, 22 bp, Homo sapiens
gaactgaaaggcttttcaacca

SEQ ID NO: 6218721 - DNA, 12 bp, Homo sapiens
gaactgaacacc

SEQ ID NO: 6218722 - DNA, 23 bp, Homo sapiens
gaactgaacaccattgaaggctt

SEQ ID NO: 6218723 - DNA, 20 bp, Homo sapiens
gaactgaaccggctttacca

SEQ ID NO: 6218724 - DNA, 18 bp, Homo sapiens
gaactgaactaatccttc

SEQ ID NO: 6218725 - DNA, 12 bp, Homo sapiens
gaactgaactca

SEQ ID NO: 6218726 - DNA, 18 bp, Homo sapiens
gaactgacattaaaataa

SEQ ID NO: 6218727 - DNA, 17 bp, Homo sapiens
gaactgaccccctcccc

SEQ ID NO: 6218728 - DNA, 19 bp, Homo sapiens
gaactgagaaggcaggcct

SEQ ID NO: 6218729 - DNA, 12 bp, Homo sapiens
gaactgagactg

SEQ ID NO: 6218730 - DNA, 18 bp, Homo sapiens
gaactgagcatctccagc

SEQ ID NO: 6218731 - DNA, 14 bp, Homo sapiens
gaactgagccccag

SEQ ID NO: 6218732 - DNA, 14 bp, Homo sapiens
gaactgagcctagc

SEQ ID NO: 6218733 - DNA, 19 bp, Homo sapiens
gaactgagcctagctacct

SEQ ID NO: 6218734 - DNA, 21 bp, Homo sapiens
gaactgagctcctctgggcag

SEQ ID NO: 6218735 - DNA, 22 bp, Homo sapiens
gaactgagcttggaagcttctg

SEQ ID NO: 6218736 - DNA, 23 bp, Homo sapiens
gaactgaggagatgaccagggat

SEQ ID NO: 6218737 - DNA, 21 bp, Homo sapiens
gaactgaggagcggactcact

SEQ ID NO: 6218738 - DNA, 13 bp, Homo sapiens
gaactgaggccct

SEQ ID NO: 6218739 - DNA, 15 bp, Homo sapiens
gaactgaggccttgt

SEQ ID NO: 6218740 - DNA, 22 bp, Homo sapiens
gaactgaggccttgtgtgtcag

SEQ ID NO: 6218741 - DNA, 15 bp, Homo sapiens
gaactgagggcaagg

SEQ ID NO: 6218742 - DNA, 16 bp, Homo sapiens
gaactgagtatgtgta

SEQ ID NO: 6218743 - DNA, 16 bp, Homo sapiens
gaactgataatttttg

SEQ ID NO: 6218744 - DNA, 17 bp, Homo sapiens
gaactgatgtaagtaaa

SEQ ID NO: 6218745 - DNA, 21 bp, Homo sapiens
gaactgattgctcccaggatc

SEQ ID NO: 6218746 - DNA, 22 bp, Homo sapiens
gaactgattgctcccaggatct

SEQ ID NO: 6218747 - DNA, 23 bp, Homo sapiens
gaactgcaaagctttggctgaga

SEQ ID NO: 6218748 - DNA, 16 bp, Homo sapiens
gaactgcaacactgga

SEQ ID NO: 6218749 - DNA, 20 bp, Homo sapiens
gaactgcaatgaaagtcaaa

SEQ ID NO: 6218750 - DNA, 11 bp, Homo sapiens
gaactgcagac

SEQ ID NO: 6218751 - DNA, 17 bp, Homo sapiens
gaactgcagacctgtcc

SEQ ID NO: 6218752 - DNA, 17 bp, Homo sapiens
gaactgcagatagccca

SEQ ID NO: 6218753 - DNA, 11 bp, Homo sapiens
gaactgcagca

SEQ ID NO: 6218754 - DNA, 15 bp, Homo sapiens
gaactgcaggaagag

SEQ ID NO: 6218755 - DNA, 18 bp, Homo sapiens
gaactgcaggccctggcc

SEQ ID NO: 6218756 - DNA, 20 bp, Homo sapiens
gaactgcagtatggccatgg

SEQ ID NO: 6218757 - DNA, 17 bp, Homo sapiens
gaactgcagtcactgca

SEQ ID NO: 6218758 - DNA, 21 bp, Homo sapiens
gaactgcatatgtttcgctga

SEQ ID NO: 6218759 - DNA, 19 bp, Homo sapiens
gaactgcatgctgctggac

SEQ ID NO: 6218760 - DNA, 14 bp, Homo sapiens
gaactgcatggacc

SEQ ID NO: 6218761 - DNA, 22 bp, Homo sapiens
gaactgcatggacctaacattc

SEQ ID NO: 6218762 - DNA, 23 bp, Homo sapiens
gaactgcatggacctaacattcg

SEQ ID NO: 6218763 - DNA, 12 bp, Homo sapiens
gaactgccacct

SEQ ID NO: 6218764 - DNA, 14 bp, Homo sapiens
gaactgccaccttg

SEQ ID NO: 6218765 - DNA, 18 bp, Homo sapiens
gaactgccattattttct

SEQ ID NO: 6218766 - DNA, 23 bp, Homo sapiens
gaactgccattattttctgtcag

SEQ ID NO: 6218767 - DNA, 12 bp, Homo sapiens
gaactgccccat

SEQ ID NO: 6218768 - DNA, 13 bp, Homo sapiens
gaactgcccccac

SEQ ID NO: 6218769 - DNA, 22 bp, Homo sapiens
gaactgccctactgggagactg

SEQ ID NO: 6218770 - DNA, 19 bp, Homo sapiens
gaactgcgttatgaagagc

SEQ ID NO: 6218771 - DNA, 13 bp, Homo sapiens
gaactgctgccaa

SEQ ID NO: 6218772 - DNA, 13 bp, Homo sapiens
gaactgctgccac

SEQ ID NO: 6218773 - DNA, 16 bp, Homo sapiens
gaactgctgccactga

SEQ ID NO: 6218774 - DNA, 21 bp, Homo sapiens
gaactgctgccatgattttgg

SEQ ID NO: 6218775 - DNA, 13 bp, Homo sapiens
gaactgctgctga

SEQ ID NO: 6218776 - DNA, 19 bp, Homo sapiens
gaactgctggagtctggct

SEQ ID NO: 6218777 - DNA, 22 bp, Homo sapiens
gaactgctggagtctggcttta

SEQ ID NO: 6218778 - DNA, 20 bp, Homo sapiens
gaactgctgggcttggcagc

SEQ ID NO: 6218779 - DNA, 16 bp, Homo sapiens
gaactgctggggctgg

SEQ ID NO: 6218780 - DNA, 20 bp, Homo sapiens
gaactgcttactagccctgc

SEQ ID NO: 6218781 - DNA, 13 bp, Homo sapiens
gaactgcttcatg

SEQ ID NO: 6218782 - DNA, 19 bp, Homo sapiens
gaactgcttgcatttcttt

SEQ ID NO: 6218783 - DNA, 16 bp, Homo sapiens
gaactgcttgcccagg

SEQ ID NO: 6218784 - DNA, 14 bp, Homo sapiens
gaactgctttcaag

SEQ ID NO: 6218785 - DNA, 15 bp, Homo sapiens
gaactgctttcaagt

SEQ ID NO: 6218786 - DNA, 21 bp, Homo sapiens
gaactgcttttcctcaagcaa

SEQ ID NO: 6218787 - DNA, 17 bp, Homo sapiens
gaactggaagaaagcaa

SEQ ID NO: 6218788 - DNA, 16 bp, Homo sapiens
gaactggaataatatt

SEQ ID NO: 6218789 - DNA, 20 bp, Homo sapiens
gaactggaccctgttgctaa

SEQ ID NO: 6218790 - DNA, 22 bp, Homo sapiens
gaactggaccctgttgctaagc

SEQ ID NO: 6218791 - DNA, 14 bp, Homo sapiens
gaactggactcagg

SEQ ID NO: 6218792 - DNA, 18 bp, Homo sapiens
gaactggagccatgggca

SEQ ID NO: 6218793 - DNA, 18 bp, Homo sapiens
gaactggagctgctaagc

SEQ ID NO: 6218794 - DNA, 15 bp, Homo sapiens
gaactggaggccagg

SEQ ID NO: 6218795 - DNA, 20 bp, Homo sapiens
gaactggagggtgagaggaa

SEQ ID NO: 6218796 - DNA, 14 bp, Homo sapiens
gaactggccaagct

SEQ ID NO: 6218797 - DNA, 15 bp, Homo sapiens
gaactggccaagctg

SEQ ID NO: 6218798 - DNA, 12 bp, Homo sapiens
gaactggccact

SEQ ID NO: 6218799 - DNA, 22 bp, Homo sapiens
gaactggccactccccagtgct

SEQ ID NO: 6218800 - DNA, 12 bp, Homo sapiens
gaactggcccca

SEQ ID NO: 6218801 - DNA, 14 bp, Homo sapiens
gaactggccccagc

SEQ ID NO: 6218802 - DNA, 18 bp, Homo sapiens
gaactggccgctgggaga

SEQ ID NO: 6218803 - DNA, 14 bp, Homo sapiens
gaactggcctctgc

SEQ ID NO: 6218804 - DNA, 15 bp, Homo sapiens
gaactggctacagta

SEQ ID NO: 6218805 - DNA, 16 bp, Homo sapiens
gaactggctcctttgc

SEQ ID NO: 6218806 - DNA, 20 bp, Homo sapiens
gaactggctcctttgcctct

SEQ ID NO: 6218807 - DNA, 22 bp, Homo sapiens
gaactggctcctttgcctctgc

SEQ ID NO: 6218808 - DNA, 16 bp, Homo sapiens
gaactggctgggcccc

SEQ ID NO: 6218809 - DNA, 20 bp, Homo sapiens
gaactggctgggcccctggg

SEQ ID NO: 6218810 - DNA, 21 bp, Homo sapiens
gaactggctgggcccctgggg

SEQ ID NO: 6218811 - DNA, 22 bp, Homo sapiens
gaactggctgtgaagacccagg

SEQ ID NO: 6218812 - DNA, 15 bp, Homo sapiens
gaactggcttgtaca

SEQ ID NO: 6218813 - DNA, 16 bp, Homo sapiens
gaactggcttgtacat

SEQ ID NO: 6218814 - DNA, 17 bp, Homo sapiens
gaactgggcctgttgcc

SEQ ID NO: 6218815 - DNA, 16 bp, Homo sapiens
gaactgggctgggcct

SEQ ID NO: 6218816 - DNA, 21 bp, Homo sapiens
gaactggggttcaagcccagg

SEQ ID NO: 6218817 - DNA, 23 bp, Homo sapiens
gaactggggttcaagcccaggct

SEQ ID NO: 6218818 - DNA, 16 bp, Homo sapiens
gaactgggtaaatgca

SEQ ID NO: 6218819 - DNA, 19 bp, Homo sapiens
gaactgggtgactggaggc

SEQ ID NO: 6218820 - DNA, 13 bp, Homo sapiens
gaactggtaccat

SEQ ID NO: 6218821 - DNA, 16 bp, Homo sapiens
gaactggtagaaaaac

SEQ ID NO: 6218822 - DNA, 14 bp, Homo sapiens
gaactggttcaaga

SEQ ID NO: 6218823 - DNA, 16 bp, Homo sapiens
gaactggttcttgcct

SEQ ID NO: 6218824 - DNA, 17 bp, Homo sapiens
gaactggttcttgcctt

SEQ ID NO: 6218825 - DNA, 20 bp, Homo sapiens
gaactggttgtagtgggaag

SEQ ID NO: 6218826 - DNA, 15 bp, Homo sapiens
gaactgtacattgtg

SEQ ID NO: 6218827 - DNA, 23 bp, Homo sapiens
gaactgtactgttttctgggcca

SEQ ID NO: 6218828 - DNA, 14 bp, Homo sapiens
gaactgtatattat

SEQ ID NO: 6218829 - DNA, 20 bp, Homo sapiens
gaactgtatattattgctat

SEQ ID NO: 6218830 - DNA, 16 bp, Homo sapiens
gaactgtattattgca

SEQ ID NO: 6218831 - DNA, 19 bp, Homo sapiens
gaactgtattctagtggct

SEQ ID NO: 6218832 - DNA, 15 bp, Homo sapiens
gaactgtcaccctga

SEQ ID NO: 6218833 - DNA, 19 bp, Homo sapiens
gaactgtcagcccacagca

SEQ ID NO: 6218834 - DNA, 21 bp, Homo sapiens
gaactgtccacatctgcctcc

SEQ ID NO: 6218835 - DNA, 13 bp, Homo sapiens
gaactgtccagag

SEQ ID NO: 6218836 - DNA, 15 bp, Homo sapiens
gaactgtcccagcta

SEQ ID NO: 6218837 - DNA, 17 bp, Homo sapiens
gaactgtcccatcccca

SEQ ID NO: 6218838 - DNA, 19 bp, Homo sapiens
gaactgtcccatccccagg

SEQ ID NO: 6218839 - DNA, 20 bp, Homo sapiens
gaactgtcccatccccaggt

SEQ ID NO: 6218840 - DNA, 14 bp, Homo sapiens
gaactgtccggccc

SEQ ID NO: 6218841 - DNA, 18 bp, Homo sapiens
gaactgtcggaggaaaga

SEQ ID NO: 6218842 - DNA, 20 bp, Homo sapiens
gaactgtctagatggatgaa

SEQ ID NO: 6218843 - DNA, 21 bp, Homo sapiens
gaactgtctgaatattctaga

SEQ ID NO: 6218844 - DNA, 22 bp, Homo sapiens
gaactgtctgaatattctagaa

SEQ ID NO: 6218845 - DNA, 17 bp, Homo sapiens
gaactgtgaatatgtgt

SEQ ID NO: 6218846 - DNA, 19 bp, Homo sapiens
gaactgtgaatatgtgtaa

SEQ ID NO: 6218847 - DNA, 12 bp, Homo sapiens
gaactgtgacag

SEQ ID NO: 6218848 - DNA, 16 bp, Homo sapiens
gaactgtgacaggaag

SEQ ID NO: 6218849 - DNA, 16 bp, Homo sapiens
gaactgtgataaaaag

SEQ ID NO: 6218850 - DNA, 18 bp, Homo sapiens
gaactgtgcatagtgctg

SEQ ID NO: 6218851 - DNA, 19 bp, Homo sapiens
gaactgtgcatagtgctgg

SEQ ID NO: 6218852 - DNA, 14 bp, Homo sapiens
gaactgtgcctagt

SEQ ID NO: 6218853 - DNA, 16 bp, Homo sapiens
gaactgtgctcccacg

SEQ ID NO: 6218854 - DNA, 14 bp, Homo sapiens
gaactgtggaattt

SEQ ID NO: 6218855 - DNA, 14 bp, Homo sapiens
gaactgtgtttcaa

SEQ ID NO: 6218856 - DNA, 15 bp, Homo sapiens
gaactgttagaatgt

SEQ ID NO: 6218857 - DNA, 16 bp, Homo sapiens
gaactgttagatgctg

SEQ ID NO: 6218858 - DNA, 16 bp, Homo sapiens
gaactgttcatttcca

SEQ ID NO: 6218859 - DNA, 22 bp, Homo sapiens
gaactgttctggcctcagacca

SEQ ID NO: 6218860 - DNA, 22 bp, Homo sapiens
gaactgttgcccttctgtccaa

SEQ ID NO: 6218861 - DNA, 15 bp, Homo sapiens
gaactgttggagccc

SEQ ID NO: 6218862 - DNA, 13 bp, Homo sapiens
gaactgttgtata

SEQ ID NO: 6218863 - DNA, 22 bp, Homo sapiens
gaggtttgtttagaagaagtgt

SEQ ID NO: 6218864 - DNA, 15 bp, Homo sapiens
gaggtttgtttgtgt

SEQ ID NO: 6218865 - DNA, 16 bp, Homo sapiens
gaggtttttcttggga

SEQ ID NO: 6218866 - DNA, 17 bp, Homo sapiens
gagtaaaaagacatttt

SEQ ID NO: 6218867 - DNA, 21 bp, Homo sapiens
gagtaaaacattttatttctt

SEQ ID NO: 6218868 - DNA, 16 bp, Homo sapiens
gagtaaaaccaaaggt

SEQ ID NO: 6218869 - DNA, 12 bp, Homo sapiens
gagtaaaatcac

SEQ ID NO: 6218870 - DNA, 16 bp, Homo sapiens
gagtaaacggcccagg

SEQ ID NO: 6218871 - DNA, 16 bp, Homo sapiens
gagtaaactgaggccc

SEQ ID NO: 6218872 - DNA, 18 bp, Homo sapiens
gagtaaactgtttctcag

SEQ ID NO: 6218873 - DNA, 10 bp, Homo sapiens
gagtaaagct

SEQ ID NO: 6218874 - DNA, 12 bp, Homo sapiens
gagtaaaggaaa

SEQ ID NO: 6218875 - DNA, 15 bp, Homo sapiens
gagtaaagtctgggc

SEQ ID NO: 6218876 - DNA, 14 bp, Homo sapiens
gagtaaataaaagc

SEQ ID NO: 6218877 - DNA, 20 bp, Homo sapiens
gagtaaataaactgtttata

SEQ ID NO: 6218878 - DNA, 18 bp, Homo sapiens
gagtaaatatatatgtca

SEQ ID NO: 6218879 - DNA, 20 bp, Homo sapiens
gagtaaatcagatgttgaat

SEQ ID NO: 6218880 - DNA, 15 bp, Homo sapiens
gagtaacaatacaaa

SEQ ID NO: 6218881 - DNA, 20 bp, Homo sapiens
gagtaacaatacaaatggat

SEQ ID NO: 6218882 - DNA, 19 bp, Homo sapiens
gagtaacacataacattgt

SEQ ID NO: 6218883 - DNA, 18 bp, Homo sapiens
gagtaagaaatgggcctc

SEQ ID NO: 6218884 - DNA, 20 bp, Homo sapiens
gagtaagaaatgggcctcag

SEQ ID NO: 6218885 - DNA, 20 bp, Homo sapiens
gagtaagaatgtgtgtgcag

SEQ ID NO: 6218886 - DNA, 21 bp, Homo sapiens
gagtaagaatgtgtgtgcaga

SEQ ID NO: 6218887 - DNA, 12 bp, Homo sapiens
gagtaagagctg

SEQ ID NO: 6218888 - DNA, 16 bp, Homo sapiens
gagtaagatattattt

SEQ ID NO: 6218889 - DNA, 13 bp, Homo sapiens
gagtaagcagtgt

SEQ ID NO: 6218890 - DNA, 15 bp, Homo sapiens
gagtaagctgctttt

SEQ ID NO: 6218891 - DNA, 12 bp, Homo sapiens
gagtaagtatta

SEQ ID NO: 6218892 - DNA, 22 bp, Homo sapiens
gagtaataagcatggtgtcagt

SEQ ID NO: 6218893 - DNA, 20 bp, Homo sapiens
gagtaatactttttaaatta

SEQ ID NO: 6218894 - DNA, 17 bp, Homo sapiens
gagtaatagtaaacaca

SEQ ID NO: 6218895 - DNA, 16 bp, Homo sapiens
gagtaatatgcctgct

SEQ ID NO: 6218896 - DNA, 15 bp, Homo sapiens
gagtaatcaggcagc

SEQ ID NO: 6218897 - DNA, 22 bp, Homo sapiens
gagtaatctgtgtacaaagaaa

SEQ ID NO: 6218898 - DNA, 13 bp, Homo sapiens
gagtaatgatgta

SEQ ID NO: 6218899 - DNA, 23 bp, Homo sapiens
gagtaatgcatacagaaatataa

SEQ ID NO: 6218900 - DNA, 13 bp, Homo sapiens
gagtaatggtatt

SEQ ID NO: 6218901 - DNA, 20 bp, Homo sapiens
gagtaatgtgactaaaggaa

SEQ ID NO: 6218902 - DNA, 16 bp, Homo sapiens
gagtaattaataaaga

SEQ ID NO: 6218903 - DNA, 18 bp, Homo sapiens
gagtaattcatctgtgaa

SEQ ID NO: 6218904 - DNA, 15 bp, Homo sapiens
gagtaattctagaca

SEQ ID NO: 6218905 - DNA, 18 bp, Homo sapiens
gagtaattgcacattttt

SEQ ID NO: 6218906 - DNA, 16 bp, Homo sapiens
gagtaatttattgttt

SEQ ID NO: 6218907 - DNA, 15 bp, Homo sapiens
gagtaattttctgat

SEQ ID NO: 6218908 - DNA, 17 bp, Homo sapiens
gagtacaaagacaggga

SEQ ID NO: 6218909 - DNA, 14 bp, Homo sapiens
gagtacaaatgtgt

SEQ ID NO: 6218910 - DNA, 21 bp, Homo sapiens
gagtacaagctcttgtttctg

SEQ ID NO: 6218911 - DNA, 15 bp, Homo sapiens
gagtacactcagcca

SEQ ID NO: 6218912 - DNA, 17 bp, Homo sapiens
gagtacactcagccact

SEQ ID NO: 6218913 - DNA, 13 bp, Homo sapiens
gagtacactgtgt

SEQ ID NO: 6218914 - DNA, 17 bp, Homo sapiens
gagtacactgtgtctct

SEQ ID NO: 6218915 - DNA, 14 bp, Homo sapiens
gagtacagactgca

SEQ ID NO: 6218916 - DNA, 20 bp, Homo sapiens
gagtacagactgcagacatt

SEQ ID NO: 6218917 - DNA, 18 bp, Homo sapiens
gagtacatggaagaagta

SEQ ID NO: 6218918 - DNA, 15 bp, Homo sapiens
gagtacattcatctg

SEQ ID NO: 6218919 - DNA, 18 bp, Homo sapiens
gagtacattgtgcccttg

SEQ ID NO: 6218920 - DNA, 22 bp, Homo sapiens
gagtacattgtgcccttgattt

SEQ ID NO: 6218921 - DNA, 16 bp, Homo sapiens
gagtacccccctgaga

SEQ ID NO: 6218922 - DNA, 22 bp, Homo sapiens
gagtacctccagtcacactccc

SEQ ID NO: 6218923 - DNA, 19 bp, Homo sapiens
gagtacctgcaaaaatgag

SEQ ID NO: 6218924 - DNA, 23 bp, Homo sapiens
gagtacctgcaaaaatgagttgt

SEQ ID NO: 6218925 - DNA, 17 bp, Homo sapiens
gagtacctgctgcccca

SEQ ID NO: 6218926 - DNA, 20 bp, Homo sapiens
gagtacgtcctgcctggcac

SEQ ID NO: 6218927 - DNA, 16 bp, Homo sapiens
gagtacgttgtgcatt

SEQ ID NO: 6218928 - DNA, 18 bp, Homo sapiens
gagtacgttgtgcatttg

SEQ ID NO: 6218929 - DNA, 18 bp, Homo sapiens
gagtactacagtcctccc

SEQ ID NO: 6218930 - DNA, 20 bp, Homo sapiens
gagtactagaatttgtattt

SEQ ID NO: 6218931 - DNA, 14 bp, Homo sapiens
gagtactggaataa

SEQ ID NO: 6218932 - DNA, 14 bp, Homo sapiens
gagtactgtgggca

SEQ ID NO: 6218933 - DNA, 22 bp, Homo sapiens
gagtactgtgggcaatttagaa

SEQ ID NO: 6218934 - DNA, 16 bp, Homo sapiens
gagtagaaaatgtgac

SEQ ID NO: 6218935 - DNA, 22 bp, Homo sapiens
gagtagaaagacagagctggga

SEQ ID NO: 6218936 - DNA, 13 bp, Homo sapiens
gagtagaaagctt

SEQ ID NO: 6218937 - DNA, 17 bp, Homo sapiens
gagtagaaaggccttta

SEQ ID NO: 6218938 - DNA, 17 bp, Homo sapiens
gagtagaaataaaagtg

SEQ ID NO: 6218939 - DNA, 16 bp, Homo sapiens
gagtagaacccaggtc

SEQ ID NO: 6218940 - DNA, 15 bp, Homo sapiens
gagtagaatgtagtt

SEQ ID NO: 6218941 - DNA, 14 bp, Homo sapiens
gagtagaattgcat

SEQ ID NO: 6218942 - DNA, 17 bp, Homo sapiens
gagtagaattgcattga

SEQ ID NO: 6218943 - DNA, 18 bp, Homo sapiens
gagtagacacatttaagg

SEQ ID NO: 6218944 - DNA, 18 bp, Homo sapiens
gagtagacccctggctgg

SEQ ID NO: 6218945 - DNA, 19 bp, Homo sapiens
gagtagagcatgacttatt

SEQ ID NO: 6218946 - DNA, 14 bp, Homo sapiens
gagtagagccaggt

SEQ ID NO: 6218947 - DNA, 18 bp, Homo sapiens
gagtagcaaggaaggaca

SEQ ID NO: 6218948 - DNA, 22 bp, Homo sapiens
gagtagcaagttctagagaaga

SEQ ID NO: 6218949 - DNA, 13 bp, Homo sapiens
gagtagccaagct

SEQ ID NO: 6218950 - DNA, 21 bp, Homo sapiens
gagtagccaggttctgccggt

SEQ ID NO: 6218951 - DNA, 18 bp, Homo sapiens
gagtagccgagagcctgc

SEQ ID NO: 6218952 - DNA, 19 bp, Homo sapiens
gagtagccgattttagagt

SEQ ID NO: 6218953 - DNA, 13 bp, Homo sapiens
gagtagctcgtcc

SEQ ID NO: 6218954 - DNA, 12 bp, Homo sapiens
gagtagctgaga

SEQ ID NO: 6218955 - DNA, 16 bp, Homo sapiens
gagtagctgagactac

SEQ ID NO: 6218956 - DNA, 15 bp, Homo sapiens
gagtagctgagagga

SEQ ID NO: 6218957 - DNA, 14 bp, Homo sapiens
gagtagctgagctc

SEQ ID NO: 6218958 - DNA, 15 bp, Homo sapiens
gagtagctgagctca

SEQ ID NO: 6218959 - DNA, 14 bp, Homo sapiens
gagtagctgggact

SEQ ID NO: 6218960 - DNA, 13 bp, Homo sapiens
gagtagctgggat

SEQ ID NO: 6218961 - DNA, 12 bp, Homo sapiens
gagtaggaagac

SEQ ID NO: 6218962 - DNA, 19 bp, Homo sapiens
gagtaggaagactttggaa

SEQ ID NO: 6218963 - DNA, 17 bp, Homo sapiens
gagtagggtagaaggaa

SEQ ID NO: 6218964 - DNA, 22 bp, Homo sapiens
gagtagggtagaaggaaagcat

SEQ ID NO: 6218965 - DNA, 18 bp, Homo sapiens
gagtaggtctgggatgga

SEQ ID NO: 6218966 - DNA, 16 bp, Homo sapiens
gagtagtggccactgg

SEQ ID NO: 6218967 - DNA, 14 bp, Homo sapiens
gagtagtgtggaat

SEQ ID NO: 6218968 - DNA, 21 bp, Homo sapiens
gagtagttgatgttgcatttt

SEQ ID NO: 6218969 - DNA, 13 bp, Homo sapiens
gagtagttttcta

SEQ ID NO: 6218970 - DNA, 23 bp, Homo sapiens
gagtataaataaccctgggctgt

SEQ ID NO: 6218971 - DNA, 13 bp, Homo sapiens
gagtataattttg

SEQ ID NO: 6218972 - DNA, 17 bp, Homo sapiens
gagtatacaagtgtttc

SEQ ID NO: 6218973 - DNA, 20 bp, Homo sapiens
gagtatacaagtgtttctag

SEQ ID NO: 6218974 - DNA, 17 bp, Homo sapiens
gagtataccatgagatg

SEQ ID NO: 6218975 - DNA, 15 bp, Homo sapiens
gagtatacggaaaca

SEQ ID NO: 6218976 - DNA, 13 bp, Homo sapiens
gagtatactaaaa

SEQ ID NO: 6218977 - DNA, 15 bp, Homo sapiens
gagtatatatgtaca

SEQ ID NO: 6218978 - DNA, 11 bp, Homo sapiens
gagtatatgtc

SEQ ID NO: 6218979 - DNA, 15 bp, Homo sapiens
gagtatattataata

SEQ ID NO: 6218980 - DNA, 18 bp, Homo sapiens
gagtatattgaaaagaaa

SEQ ID NO: 6218981 - DNA, 22 bp, Homo sapiens
gagtatatttaagaagccaagg

SEQ ID NO: 6218982 - DNA, 22 bp, Homo sapiens
gagtatatttttgtctgcagct

SEQ ID NO: 6218983 - DNA, 16 bp, Homo sapiens
gagtatcaaaggcaga

SEQ ID NO: 6218984 - DNA, 22 bp, Homo sapiens
gagtatcagaattgaaacactt

SEQ ID NO: 6218985 - DNA, 17 bp, Homo sapiens
gagtatctgaagggaat

SEQ ID NO: 6218986 - DNA, 20 bp, Homo sapiens
gagtatgatccaggattggc

SEQ ID NO: 6218987 - DNA, 13 bp, Homo sapiens
gagtatgttcttg

SEQ ID NO: 6218988 - DNA, 18 bp, Homo sapiens
gagtattccatgagctgc

SEQ ID NO: 6218989 - DNA, 17 bp, Homo sapiens
gagtattggaagacttg

SEQ ID NO: 6218990 - DNA, 20 bp, Homo sapiens
gagtatttaggcagattgaa

SEQ ID NO: 6218991 - DNA, 16 bp, Homo sapiens
gagtatttattgtcag

SEQ ID NO: 6218992 - DNA, 13 bp, Homo sapiens
gagtatttgctgt

SEQ ID NO: 6218993 - DNA, 21 bp, Homo sapiens
gagtatttggaagcaacgtgt

SEQ ID NO: 6218994 - DNA, 15 bp, Homo sapiens
gagtatttttataat

SEQ ID NO: 6218995 - DNA, 17 bp, Homo sapiens
gagtatttttataattt

SEQ ID NO: 6218996 - DNA, 14 bp, Homo sapiens
gagtatttttgaca

SEQ ID NO: 6218997 - DNA, 16 bp, Homo sapiens
gagtatttttgacaga

SEQ ID NO: 6218998 - DNA, 14 bp, Homo sapiens
gagtcaaaaagaac

SEQ ID NO: 6218999 - DNA, 14 bp, Homo sapiens
gagtcaaaacaaag

SEQ ID NO: 6219000 - DNA, 19 bp, Homo sapiens
gagtcaaaactcaaatgct

SEQ ID NO: 6219001 - DNA, 15 bp, Homo sapiens
gagtcaaaagcctgg

SEQ ID NO: 6219002 - DNA, 21 bp, Homo sapiens
gagtcaaagctgaccatggat

SEQ ID NO: 6219003 - DNA, 13 bp, Homo sapiens
gagtcaaatccag

SEQ ID NO: 6219004 - DNA, 21 bp, Homo sapiens
gagtcaaatccagtggtgggt

SEQ ID NO: 6219005 - DNA, 21 bp, Homo sapiens
gagtcaaatgggaaaaaaaca

SEQ ID NO: 6219006 - DNA, 19 bp, Homo sapiens
gagtcaaatggtaggcatt

SEQ ID NO: 6219007 - DNA, 20 bp, Homo sapiens
gagtcaacaaattaaataaa

SEQ ID NO: 6219008 - DNA, 15 bp, Homo sapiens
gagtcaactggagca

SEQ ID NO: 6219009 - DNA, 15 bp, Homo sapiens
gagtcaatcagcctt

SEQ ID NO: 6219010 - DNA, 18 bp, Homo sapiens
gagtcaattggaaagact

SEQ ID NO: 6219011 - DNA, 12 bp, Homo sapiens
gagtcaatttgc

SEQ ID NO: 6219012 - DNA, 13 bp, Homo sapiens
gagtcaatttgct

SEQ ID NO: 6219013 - DNA, 17 bp, Homo sapiens
gagtcacatcagtgagg

SEQ ID NO: 6219014 - DNA, 21 bp, Homo sapiens
gagtcacatcagtgaggaggg

SEQ ID NO: 6219015 - DNA, 23 bp, Homo sapiens
gagtcacatcagtgaggagggat

SEQ ID NO: 6219016 - DNA, 14 bp, Homo sapiens
gagtcacattctgc

SEQ ID NO: 6219017 - DNA, 15 bp, Homo sapiens
gagtcacattctgct

SEQ ID NO: 6219018 - DNA, 17 bp, Homo sapiens
gagtcacattctgctta

SEQ ID NO: 6219019 - DNA, 22 bp, Homo sapiens
gagtcacattctgcttaaagtt

SEQ ID NO: 6219020 - DNA, 13 bp, Homo sapiens
gagtcaccatgca

SEQ ID NO: 6219021 - DNA, 14 bp, Homo sapiens
gagtcaccatgcaa

SEQ ID NO: 6219022 - DNA, 16 bp, Homo sapiens
gagtcaccatgcaagg

SEQ ID NO: 6219023 - DNA, 18 bp, Homo sapiens
gagtcaccatgcaagggt

SEQ ID NO: 6219024 - DNA, 17 bp, Homo sapiens
gagtcacccagttggtg

SEQ ID NO: 6219025 - DNA, 23 bp, Homo sapiens
gagtcacccccccaggcctccag

SEQ ID NO: 6219026 - DNA, 19 bp, Homo sapiens
gagtcaccctcctcacaga

SEQ ID NO: 6219027 - DNA, 13 bp, Homo sapiens
gagtcacctcctc

SEQ ID NO: 6219028 - DNA, 14 bp, Homo sapiens
gagtcacctcctcc

SEQ ID NO: 6219029 - DNA, 23 bp, Homo sapiens
gagtcacctcctccactcactcc

SEQ ID NO: 6219030 - DNA, 11 bp, Homo sapiens
gagtcacctgc

SEQ ID NO: 6219031 - DNA, 17 bp, Homo sapiens
gagtcacctgcaagccc

SEQ ID NO: 6219032 - DNA, 23 bp, Homo sapiens
gagtcacctgcaagccccagggc

SEQ ID NO: 6219033 - DNA, 15 bp, Homo sapiens
gagtcacctgctcca

SEQ ID NO: 6219034 - DNA, 18 bp, Homo sapiens
gagtcacctgctccagaa

SEQ ID NO: 6219035 - DNA, 18 bp, Homo sapiens
gagtcaccttccaggacc

SEQ ID NO: 6219036 - DNA, 14 bp, Homo sapiens
gagtcaccttccct

SEQ ID NO: 6219037 - DNA, 15 bp, Homo sapiens
gagtcaccttccctt

SEQ ID NO: 6219038 - DNA, 22 bp, Homo sapiens
gagtcaccttcccttgccactt

SEQ ID NO: 6219039 - DNA, 22 bp, Homo sapiens
gagtcaccttttctgtggctgg

SEQ ID NO: 6219040 - DNA, 20 bp, Homo sapiens
gagtcacgctggggctctct

SEQ ID NO: 6219041 - DNA, 17 bp, Homo sapiens
gagtcactacgcctggc

SEQ ID NO: 6219042 - DNA, 14 bp, Homo sapiens
gagtcactgagacc

SEQ ID NO: 6219043 - DNA, 15 bp, Homo sapiens
gagtcactgcctctc

SEQ ID NO: 6219044 - DNA, 16 bp, Homo sapiens
gaactgttgtataaat

SEQ ID NO: 6219045 - DNA, 12 bp, Homo sapiens
gaacttaaaaca

SEQ ID NO: 6219046 - DNA, 13 bp, Homo sapiens
gaacttaaaacat

SEQ ID NO: 6219047 - DNA, 13 bp, Homo sapiens
gaacttaaaatga

SEQ ID NO: 6219048 - DNA, 15 bp, Homo sapiens
gaacttaaataaatg

SEQ ID NO: 6219049 - DNA, 18 bp, Homo sapiens
gaacttaaataaatgtca

SEQ ID NO: 6219050 - DNA, 13 bp, Homo sapiens
gaacttacaaagg

SEQ ID NO: 6219051 - DNA, 23 bp, Homo sapiens
gaacttacacttggagcccgtgc

SEQ ID NO: 6219052 - DNA, 23 bp, Homo sapiens
gaacttacatactaggtgccttt

SEQ ID NO: 6219053 - DNA, 20 bp, Homo sapiens
gaacttactgtagcctcaga

SEQ ID NO: 6219054 - DNA, 13 bp, Homo sapiens
gaacttatgtaca

SEQ ID NO: 6219055 - DNA, 16 bp, Homo sapiens
gaacttatttgtacat

SEQ ID NO: 6219056 - DNA, 19 bp, Homo sapiens
gaacttcaagatgagcctg

SEQ ID NO: 6219057 - DNA, 21 bp, Homo sapiens
gaacttcaagatgagcctggg

SEQ ID NO: 6219058 - DNA, 18 bp, Homo sapiens
gaacttcacaagaatggt

SEQ ID NO: 6219059 - DNA, 19 bp, Homo sapiens
gaacttcacctgcaaagct

SEQ ID NO: 6219060 - DNA, 20 bp, Homo sapiens
gaacttcacctgcaaagctc

SEQ ID NO: 6219061 - DNA, 14 bp, Homo sapiens
gaacttcagaaaga

SEQ ID NO: 6219062 - DNA, 20 bp, Homo sapiens
gaacttcagcattgtaatta

SEQ ID NO: 6219063 - DNA, 16 bp, Homo sapiens
gaacttcatctgccac

SEQ ID NO: 6219064 - DNA, 19 bp, Homo sapiens
gaacttcatctgccactgg

SEQ ID NO: 6219065 - DNA, 13 bp, Homo sapiens
gaacttcattttt

SEQ ID NO: 6219066 - DNA, 18 bp, Homo sapiens
gaacttccaggaaagtgt

SEQ ID NO: 6219067 - DNA, 23 bp, Homo sapiens
gaacttccaggtgttactgtaat

SEQ ID NO: 6219068 - DNA, 21 bp, Homo sapiens
gaacttccctccatccacccc

SEQ ID NO: 6219069 - DNA, 14 bp, Homo sapiens
gaacttccctcccc

SEQ ID NO: 6219070 - DNA, 13 bp, Homo sapiens
gaacttctaatat

SEQ ID NO: 6219071 - DNA, 14 bp, Homo sapiens
gaacttctagctca

SEQ ID NO: 6219072 - DNA, 19 bp, Homo sapiens
gaacttctccgtcctcgat

SEQ ID NO: 6219073 - DNA, 21 bp, Homo sapiens
gaacttctcgtagatgctgcc

SEQ ID NO: 6219074 - DNA, 16 bp, Homo sapiens
gaacttctgactactt

SEQ ID NO: 6219075 - DNA, 15 bp, Homo sapiens
gaacttctgcctcta

SEQ ID NO: 6219076 - DNA, 21 bp, Homo sapiens
gaacttgaaaaaaaaaaacac

SEQ ID NO: 6219077 - DNA, 15 bp, Homo sapiens
gaacttgaaatttga

SEQ ID NO: 6219078 - DNA, 17 bp, Homo sapiens
gaacttgaacaaagtct

SEQ ID NO: 6219079 - DNA, 19 bp, Homo sapiens
gaacttgaacaaagtctct

SEQ ID NO: 6219080 - DNA, 16 bp, Homo sapiens
gaacttgaactgattc

SEQ ID NO: 6219081 - DNA, 18 bp, Homo sapiens
gaacttgaagcctgctcc

SEQ ID NO: 6219082 - DNA, 23 bp, Homo sapiens
gaacttgaatactttgagtaaac

SEQ ID NO: 6219083 - DNA, 17 bp, Homo sapiens
gaacttgagctctgtaa

SEQ ID NO: 6219084 - DNA, 21 bp, Homo sapiens
gaacttgagctctgtaactta

SEQ ID NO: 6219085 - DNA, 22 bp, Homo sapiens
gaacttgagctctgtaacttac

SEQ ID NO: 6219086 - DNA, 18 bp, Homo sapiens
gaacttgaggacacatgt

SEQ ID NO: 6219087 - DNA, 15 bp, Homo sapiens
gaacttgatgttcct

SEQ ID NO: 6219088 - DNA, 19 bp, Homo sapiens
gaacttgatgttcctggga

SEQ ID NO: 6219089 - DNA, 13 bp, Homo sapiens
gaacttgatttgc

SEQ ID NO: 6219090 - DNA, 15 bp, Homo sapiens
gaacttgatttgcat

SEQ ID NO: 6219091 - DNA, 16 bp, Homo sapiens
gaacttgatttgcatg

SEQ ID NO: 6219092 - DNA, 15 bp, Homo sapiens
gaacttgattttaaa

SEQ ID NO: 6219093 - DNA, 12 bp, Homo sapiens
gaacttgcatgg

SEQ ID NO: 6219094 - DNA, 23 bp, Homo sapiens
gaacttgcattgtgattggcctg

SEQ ID NO: 6219095 - DNA, 23 bp, Homo sapiens
gaacttgccctgagcactcctgg

SEQ ID NO: 6219096 - DNA, 11 bp, Homo sapiens
gaacttgcctg

SEQ ID NO: 6219097 - DNA, 19 bp, Homo sapiens
gaacttgcctgcctttcca

SEQ ID NO: 6219098 - DNA, 24 bp, Homo sapiens
gaacttgcgagaaattcgtgtgtt

SEQ ID NO: 6219099 - DNA, 16 bp, Homo sapiens
gaacttgcgagtccaa

SEQ ID NO: 6219100 - DNA, 22 bp, Homo sapiens
gaacttgctgctgagtgcacca

SEQ ID NO: 6219101 - DNA, 15 bp, Homo sapiens
gaacttgctgctgcc

SEQ ID NO: 6219102 - DNA, 16 bp, Homo sapiens
gaacttgctgctgcct

SEQ ID NO: 6219103 - DNA, 19 bp, Homo sapiens
gaacttgctgctgccttca

SEQ ID NO: 6219104 - DNA, 21 bp, Homo sapiens
gaacttgctgggtggttctct

SEQ ID NO: 6219105 - DNA, 17 bp, Homo sapiens
gaacttggaggcaccat

SEQ ID NO: 6219106 - DNA, 16 bp, Homo sapiens
gaacttggcgctgccc

SEQ ID NO: 6219107 - DNA, 12 bp, Homo sapiens
gaacttggttcc

SEQ ID NO: 6219108 - DNA, 15 bp, Homo sapiens
gaacttgtaactaaa

SEQ ID NO: 6219109 - DNA, 18 bp, Homo sapiens
gaacttgtctggctttgg

SEQ ID NO: 6219110 - DNA, 23 bp, Homo sapiens
gaacttgtctggctttggcactc

SEQ ID NO: 6219111 - DNA, 18 bp, Homo sapiens
gaacttgttacttgcagc

SEQ ID NO: 6219112 - DNA, 22 bp, Homo sapiens
gaacttgttgctgattttgacc

SEQ ID NO: 6219113 - DNA, 14 bp, Homo sapiens
gaacttgtttacaa

SEQ ID NO: 6219114 - DNA, 14 bp, Homo sapiens
gaactttaaaagaa

SEQ ID NO: 6219115 - DNA, 21 bp, Homo sapiens
gaactttaaagctcaggaggg

SEQ ID NO: 6219116 - DNA, 16 bp, Homo sapiens
gaactttattaagtaa

SEQ ID NO: 6219117 - DNA, 19 bp, Homo sapiens
gaactttcatagcactgca

SEQ ID NO: 6219118 - DNA, 13 bp, Homo sapiens
gaactttcatttt

SEQ ID NO: 6219119 - DNA, 14 bp, Homo sapiens
gaactttcattttt

SEQ ID NO: 6219120 - DNA, 17 bp, Homo sapiens
gaactttccaggaaggc

SEQ ID NO: 6219121 - DNA, 15 bp, Homo sapiens
gaactttccattttg

SEQ ID NO: 6219122 - DNA, 20 bp, Homo sapiens
gaactttcctggatgtctga

SEQ ID NO: 6219123 - DNA, 21 bp, Homo sapiens
gaactttctcttcatactttt

SEQ ID NO: 6219124 - DNA, 15 bp, Homo sapiens
gaactttctggtccc

SEQ ID NO: 6219125 - DNA, 22 bp, Homo sapiens
gaactttgacctctgcagcaat

SEQ ID NO: 6219126 - DNA, 19 bp, Homo sapiens
gaactttgcatagcagctg

SEQ ID NO: 6219127 - DNA, 19 bp, Homo sapiens
gaactttgctgagcctgta

SEQ ID NO: 6219128 - DNA, 15 bp, Homo sapiens
gaactttgtatagtt

SEQ ID NO: 6219129 - DNA, 20 bp, Homo sapiens
gaactttgtttccagaaatt

SEQ ID NO: 6219130 - DNA, 15 bp, Homo sapiens
gaacttttacagaat

SEQ ID NO: 6219131 - DNA, 13 bp, Homo sapiens
gaacttttcaaaa

SEQ ID NO: 6219132 - DNA, 20 bp, Homo sapiens
gaacttttcaaaataaagct

SEQ ID NO: 6219133 - DNA, 22 bp, Homo sapiens
gaacttttcctctgtatcactg

SEQ ID NO: 6219134 - DNA, 16 bp, Homo sapiens
gaacttttgtactgaa

SEQ ID NO: 6219135 - DNA, 20 bp, Homo sapiens
gaacttttgtactgaatttt

SEQ ID NO: 6219136 - DNA, 20 bp, Homo sapiens
gaactttttaaagaagtgca

SEQ ID NO: 6219137 - DNA, 14 bp, Homo sapiens
gaactttttatttg

SEQ ID NO: 6219138 - DNA, 24 bp, Homo sapiens
gaactttttatttgaggagacgaa

SEQ ID NO: 6219139 - DNA, 13 bp, Homo sapiens
gaactttttcctc

SEQ ID NO: 6219140 - DNA, 14 bp, Homo sapiens
gaactttttgtagg

SEQ ID NO: 6219141 - DNA, 16 bp, Homo sapiens
gaacttttttaaataa

SEQ ID NO: 6219142 - DNA, 20 bp, Homo sapiens
gaacttttttaaataaactt

SEQ ID NO: 6219143 - DNA, 23 bp, Homo sapiens
gaacttttttaaataaacttttt

SEQ ID NO: 6219144 - DNA, 13 bp, Homo sapiens
gaacttttttcaa

SEQ ID NO: 6219145 - DNA, 22 bp, Homo sapiens
gaacttttttttttaatgtttt

SEQ ID NO: 6219146 - DNA, 20 bp, Homo sapiens
gaagaaaaaaacgaaaacag

SEQ ID NO: 6219147 - DNA, 23 bp, Homo sapiens
gaagaaaaaaatcttctccagat

SEQ ID NO: 6219148 - DNA, 18 bp, Homo sapiens
gaagaaaaaatacatttt

SEQ ID NO: 6219149 - DNA, 20 bp, Homo sapiens
gaagaaaaaatggcaagaga

SEQ ID NO: 6219150 - DNA, 13 bp, Homo sapiens
gaagaaaaactct

SEQ ID NO: 6219151 - DNA, 13 bp, Homo sapiens
gaagaaaaagaag

SEQ ID NO: 6219152 - DNA, 16 bp, Homo sapiens
gaagaaaaagaagctg

SEQ ID NO: 6219153 - DNA, 17 bp, Homo sapiens
gaagaaaaagcaagtgt

SEQ ID NO: 6219154 - DNA, 18 bp, Homo sapiens
gaagaaaaataaaatttc

SEQ ID NO: 6219155 - DNA, 19 bp, Homo sapiens
gaagaaaacatatatttta

SEQ ID NO: 6219156 - DNA, 22 bp, Homo sapiens
gaagaaaacatctattctctcc

SEQ ID NO: 6219157 - DNA, 14 bp, Homo sapiens
gaagaaaactatcc

SEQ ID NO: 6219158 - DNA, 21 bp, Homo sapiens
gaagaaaactatcctgcgggt

SEQ ID NO: 6219159 - DNA, 22 bp, Homo sapiens
gaagaaaactatcctgcgggtt

SEQ ID NO: 6219160 - DNA, 13 bp, Homo sapiens
gaagaaaagaaaa

SEQ ID NO: 6219161 - DNA, 11 bp, Homo sapiens
gaagaaaagag

SEQ ID NO: 6219162 - DNA, 14 bp, Homo sapiens
gaagaaaagattct

SEQ ID NO: 6219163 - DNA, 14 bp, Homo sapiens
gaagaaaagttatt

SEQ ID NO: 6219164 - DNA, 18 bp, Homo sapiens
gaagaaaataattctcta

SEQ ID NO: 6219165 - DNA, 20 bp, Homo sapiens
gaagaaaatatttttaaatg

SEQ ID NO: 6219166 - DNA, 16 bp, Homo sapiens
gaagaaaatgagatgg

SEQ ID NO: 6219167 - DNA, 14 bp, Homo sapiens
gaagaaaatggaat

SEQ ID NO: 6219168 - DNA, 22 bp, Homo sapiens
gaagaaaatggatgacaaagaa

SEQ ID NO: 6219169 - DNA, 16 bp, Homo sapiens
gaagaaaatggtttat

SEQ ID NO: 6219170 - DNA, 13 bp, Homo sapiens
gaagaaaatgtca

SEQ ID NO: 6219171 - DNA, 21 bp, Homo sapiens
gaagaaaatgttcttccagtt

SEQ ID NO: 6219172 - DNA, 17 bp, Homo sapiens
gaagaaaattgctgtgc

SEQ ID NO: 6219173 - DNA, 12 bp, Homo sapiens
gaagaaacaaaa

SEQ ID NO: 6219174 - DNA, 15 bp, Homo sapiens
gaagaaacacagcat

SEQ ID NO: 6219175 - DNA, 21 bp, Homo sapiens
gaagaaacacagcatgcattt

SEQ ID NO: 6219176 - DNA, 18 bp, Homo sapiens
gaagaaacactttctctt

SEQ ID NO: 6219177 - DNA, 14 bp, Homo sapiens
gaagaaacagaaga

SEQ ID NO: 6219178 - DNA, 16 bp, Homo sapiens
gaagaaacagctatga

SEQ ID NO: 6219179 - DNA, 16 bp, Homo sapiens
gaagaaacaggggatc

SEQ ID NO: 6219180 - DNA, 16 bp, Homo sapiens
gaagaaacatttatct

SEQ ID NO: 6219181 - DNA, 14 bp, Homo sapiens
gaagaaactcctgg

SEQ ID NO: 6219182 - DNA, 13 bp, Homo sapiens
gaagaaagaaaat

SEQ ID NO: 6219183 - DNA, 20 bp, Homo sapiens
gaagaaagaactatcttcat

SEQ ID NO: 6219184 - DNA, 11 bp, Homo sapiens
gaagaaagaga

SEQ ID NO: 6219185 - DNA, 13 bp, Homo sapiens
gaagaaagagact

SEQ ID NO: 6219186 - DNA, 22 bp, Homo sapiens
gaagaaagagactgtggggagg

SEQ ID NO: 6219187 - DNA, 15 bp, Homo sapiens
gaagaaagatttaaa

SEQ ID NO: 6219188 - DNA, 18 bp, Homo sapiens
gaagaaagccagacaact

SEQ ID NO: 6219189 - DNA, 13 bp, Homo sapiens
gaagaaagccctg

SEQ ID NO: 6219190 - DNA, 21 bp, Homo sapiens
gaagaaagcctcagtgaaaca

SEQ ID NO: 6219191 - DNA, 15 bp, Homo sapiens
gaagaaagctgattt

SEQ ID NO: 6219192 - DNA, 22 bp, Homo sapiens
gaagaaaggccaaggtgctgga

SEQ ID NO: 6219193 - DNA, 12 bp, Homo sapiens
gaagaaagggag

SEQ ID NO: 6219194 - DNA, 20 bp, Homo sapiens
gaagaaagtaaaaagaacaa

SEQ ID NO: 6219195 - DNA, 22 bp, Homo sapiens
gaagaaagtcaaaaaattattt

SEQ ID NO: 6219196 - DNA, 15 bp, Homo sapiens
gaagaaagtggaaaa

SEQ ID NO: 6219197 - DNA, 15 bp, Homo sapiens
gaagaaataaataat

SEQ ID NO: 6219198 - DNA, 13 bp, Homo sapiens
gaagaaatatgaa

SEQ ID NO: 6219199 - DNA, 18 bp, Homo sapiens
gaagaaatcacagaatca

SEQ ID NO: 6219200 - DNA, 22 bp, Homo sapiens
gaagaaatcacagaatcatatg

SEQ ID NO: 6219201 - DNA, 16 bp, Homo sapiens
gaagaaatctttccag

SEQ ID NO: 6219202 - DNA, 20 bp, Homo sapiens
gaagaaatctttctccctca

SEQ ID NO: 6219203 - DNA, 14 bp, Homo sapiens
gaagaaatgaaatt

SEQ ID NO: 6219204 - DNA, 15 bp, Homo sapiens
gaagaaatgaaattt

SEQ ID NO: 6219205 - DNA, 16 bp, Homo sapiens
gaagaaatgaaatttt

SEQ ID NO: 6219206 - DNA, 22 bp, Homo sapiens
gaagaaattaatatattagtga

SEQ ID NO: 6219207 - DNA, 22 bp, Homo sapiens
gaagaaattataaagataaagc

SEQ ID NO: 6219208 - DNA, 15 bp, Homo sapiens
gaagaaattatttaa

SEQ ID NO: 6219209 - DNA, 17 bp, Homo sapiens
gaagaaattcaggtaca

SEQ ID NO: 6219210 - DNA, 22 bp, Homo sapiens
gaagaaattcaggtacagaaaa

SEQ ID NO: 6219211 - DNA, 15 bp, Homo sapiens
gaagaaattcctgta

SEQ ID NO: 6219212 - DNA, 18 bp, Homo sapiens
gaagaacaacaaagacat

SEQ ID NO: 6219213 - DNA, 19 bp, Homo sapiens
gaagaacacagcatgtgcc

SEQ ID NO: 6219214 - DNA, 14 bp, Homo sapiens
gaagaacagccccg

SEQ ID NO: 6219215 - DNA, 21 bp, Homo sapiens
gaagaacagctgttcctgtgt

SEQ ID NO: 6219216 - DNA, 13 bp, Homo sapiens
gaagaacaggcct

SEQ ID NO: 6219217 - DNA, 14 bp, Homo sapiens
gaagaacatcaaga

SEQ ID NO: 6219218 - DNA, 16 bp, Homo sapiens
gaagaacatccaagga

SEQ ID NO: 6219219 - DNA, 17 bp, Homo sapiens
gaagaacatccaaggag

SEQ ID NO: 6219220 - DNA, 20 bp, Homo sapiens
gaagaaccaaatacctcaat

SEQ ID NO: 6219221 - DNA, 13 bp, Homo sapiens
gaagaaccatctt

SEQ ID NO: 6219222 - DNA, 21 bp, Homo sapiens
gaagaacgcggtgtgtaacac

SEQ ID NO: 6219223 - DNA, 21 bp, Homo sapiens
gagtcactgcctctccctggc

SEQ ID NO: 6219224 - DNA, 23 bp, Homo sapiens
gagtcactgcctctccctggccc

SEQ ID NO: 6219225 - DNA, 14 bp, Homo sapiens
gagtcactggaaca

SEQ ID NO: 6219226 - DNA, 16 bp, Homo sapiens
gagtcacttgaaactt

SEQ ID NO: 6219227 - DNA, 22 bp, Homo sapiens
gagtcagaagtttctgccgcag

SEQ ID NO: 6219228 - DNA, 22 bp, Homo sapiens
gagtcagaatgtgaaaaaggaa

SEQ ID NO: 6219229 - DNA, 12 bp, Homo sapiens
gagtcagactga

SEQ ID NO: 6219230 - DNA, 14 bp, Homo sapiens
gagtcagagccctg

SEQ ID NO: 6219231 - DNA, 14 bp, Homo sapiens
gagtcagaggacac

SEQ ID NO: 6219232 - DNA, 16 bp, Homo sapiens
gagtcagaggagaaga

SEQ ID NO: 6219233 - DNA, 21 bp, Homo sapiens
gagtcagatgagcaaggacat

SEQ ID NO: 6219234 - DNA, 13 bp, Homo sapiens
gagtcagcacctt

SEQ ID NO: 6219235 - DNA, 21 bp, Homo sapiens
gagtcagcaccttggcccagg

SEQ ID NO: 6219236 - DNA, 21 bp, Homo sapiens
gagtcagccatgtctgtgctg

SEQ ID NO: 6219237 - DNA, 15 bp, Homo sapiens
gagtcagccattcct

SEQ ID NO: 6219238 - DNA, 21 bp, Homo sapiens
gagtcagccccgacttcctga

SEQ ID NO: 6219239 - DNA, 22 bp, Homo sapiens
gagtcagcccttggcttctgct

SEQ ID NO: 6219240 - DNA, 20 bp, Homo sapiens
gagtcagcctcgcaggcctc

SEQ ID NO: 6219241 - DNA, 15 bp, Homo sapiens
gagtcagctgtttct

SEQ ID NO: 6219242 - DNA, 17 bp, Homo sapiens
gagtcaggacctccggg

SEQ ID NO: 6219243 - DNA, 23 bp, Homo sapiens
gagtcaggacttgaacccaggtc

SEQ ID NO: 6219244 - DNA, 12 bp, Homo sapiens
gagtcaggcccg

SEQ ID NO: 6219245 - DNA, 17 bp, Homo sapiens
gagtcagggacctgctg

SEQ ID NO: 6219246 - DNA, 14 bp, Homo sapiens
gagtcagggagccc

SEQ ID NO: 6219247 - DNA, 19 bp, Homo sapiens
gagtcagggagccctgggg

SEQ ID NO: 6219248 - DNA, 15 bp, Homo sapiens
gagtcagggcccaga

SEQ ID NO: 6219249 - DNA, 22 bp, Homo sapiens
gagtcagggcccagaggctgag

SEQ ID NO: 6219250 - DNA, 14 bp, Homo sapiens
gagtcaggggctct

SEQ ID NO: 6219251 - DNA, 21 bp, Homo sapiens
gagtcaggtgtcgaggccaca

SEQ ID NO: 6219252 - DNA, 14 bp, Homo sapiens
gagtcagtagccag

SEQ ID NO: 6219253 - DNA, 18 bp, Homo sapiens
gagtcagtctctctctcc

SEQ ID NO: 6219254 - DNA, 14 bp, Homo sapiens
gagtcagtctcttg

SEQ ID NO: 6219255 - DNA, 23 bp, Homo sapiens
gagtcagtgaagtctagaatcat

SEQ ID NO: 6219256 - DNA, 16 bp, Homo sapiens
gagtcagtgtctggct

SEQ ID NO: 6219257 - DNA, 16 bp, Homo sapiens
gagtcataaaccttaa

SEQ ID NO: 6219258 - DNA, 15 bp, Homo sapiens
gagtcatcaaaaaga

SEQ ID NO: 6219259 - DNA, 11 bp, Homo sapiens
gagtcatcatg

SEQ ID NO: 6219260 - DNA, 13 bp, Homo sapiens
gagtcatctcaaa

SEQ ID NO: 6219261 - DNA, 13 bp, Homo sapiens
gagtcatctccat

SEQ ID NO: 6219262 - DNA, 22 bp, Homo sapiens
gagtcatgagtttatgagctga

SEQ ID NO: 6219263 - DNA, 14 bp, Homo sapiens
gagtcatggctaat

SEQ ID NO: 6219264 - DNA, 13 bp, Homo sapiens
gagtcatggtcag

SEQ ID NO: 6219265 - DNA, 20 bp, Homo sapiens
gagtcatgtgagcctcgtgt

SEQ ID NO: 6219266 - DNA, 13 bp, Homo sapiens
gagtcatgtgcct

SEQ ID NO: 6219267 - DNA, 22 bp, Homo sapiens
gagtcatgtgcctctgtcctta

SEQ ID NO: 6219268 - DNA, 20 bp, Homo sapiens
gagtcattatgtagctgtcg

SEQ ID NO: 6219269 - DNA, 19 bp, Homo sapiens
gagtcattcaggtgacctc

SEQ ID NO: 6219270 - DNA, 22 bp, Homo sapiens
gagtcattcaggtgacctcctg

SEQ ID NO: 6219271 - DNA, 18 bp, Homo sapiens
gagtcattcgttctgtgg

SEQ ID NO: 6219272 - DNA, 14 bp, Homo sapiens
gagtcattgctgta

SEQ ID NO: 6219273 - DNA, 20 bp, Homo sapiens
gagtcatttaaatgtgtaca

SEQ ID NO: 6219274 - DNA, 14 bp, Homo sapiens
gagtcatttctgat

SEQ ID NO: 6219275 - DNA, 15 bp, Homo sapiens
gagtcatttctgatt

SEQ ID NO: 6219276 - DNA, 18 bp, Homo sapiens
gagtcatttgagtctctt

SEQ ID NO: 6219277 - DNA, 20 bp, Homo sapiens
gagtcatttgtttaaacaat

SEQ ID NO: 6219278 - DNA, 20 bp, Homo sapiens
gagtcattttcacttttaaa

SEQ ID NO: 6219279 - DNA, 15 bp, Homo sapiens
gagtccaaaccttct

SEQ ID NO: 6219280 - DNA, 16 bp, Homo sapiens
gagtccaaactggaat

SEQ ID NO: 6219281 - DNA, 13 bp, Homo sapiens
gagtccacgccca

SEQ ID NO: 6219282 - DNA, 19 bp, Homo sapiens
gagtccacgcccaccagcc

SEQ ID NO: 6219283 - DNA, 15 bp, Homo sapiens
gagtccactgcctcc

SEQ ID NO: 6219284 - DNA, 16 bp, Homo sapiens
gagtccactttcctct

SEQ ID NO: 6219285 - DNA, 17 bp, Homo sapiens
gagtccactttcctctc

SEQ ID NO: 6219286 - DNA, 11 bp, Homo sapiens
gagtccagacc

SEQ ID NO: 6219287 - DNA, 13 bp, Homo sapiens
gagtccagacctg

SEQ ID NO: 6219288 - DNA, 18 bp, Homo sapiens
gagtccagacctgggccc

SEQ ID NO: 6219289 - DNA, 21 bp, Homo sapiens
gagtccagacctgggccctgg

SEQ ID NO: 6219290 - DNA, 16 bp, Homo sapiens
gagtccagctttcctt

SEQ ID NO: 6219291 - DNA, 14 bp, Homo sapiens
gagtccaggaaggg

SEQ ID NO: 6219292 - DNA, 17 bp, Homo sapiens
gagtccaggagccccag

SEQ ID NO: 6219293 - DNA, 15 bp, Homo sapiens
gagtccaggcacagg

SEQ ID NO: 6219294 - DNA, 18 bp, Homo sapiens
gagtccaggcccccagcc

SEQ ID NO: 6219295 - DNA, 23 bp, Homo sapiens
gagtccaggcccccagcccctcc

SEQ ID NO: 6219296 - DNA, 13 bp, Homo sapiens
gagtccaggcctg

SEQ ID NO: 6219297 - DNA, 14 bp, Homo sapiens
gagtccaggcctgg

SEQ ID NO: 6219298 - DNA, 15 bp, Homo sapiens
gagtccagggcggga

SEQ ID NO: 6219299 - DNA, 18 bp, Homo sapiens
gagtccagtgtgggacac

SEQ ID NO: 6219300 - DNA, 13 bp, Homo sapiens
gagtccatcagcc

SEQ ID NO: 6219301 - DNA, 18 bp, Homo sapiens
gagtccattatttgagtt

SEQ ID NO: 6219302 - DNA, 17 bp, Homo sapiens
gagtccattgcaaaagg

SEQ ID NO: 6219303 - DNA, 19 bp, Homo sapiens
gagtccattgcaaaaggtt

SEQ ID NO: 6219304 - DNA, 14 bp, Homo sapiens
gagtcccaaggaaa

SEQ ID NO: 6219305 - DNA, 18 bp, Homo sapiens
gagtcccaaggaaagccc

SEQ ID NO: 6219306 - DNA, 21 bp, Homo sapiens
gagtcccaccttggctgcagg

SEQ ID NO: 6219307 - DNA, 13 bp, Homo sapiens
gagtcccactgcc

SEQ ID NO: 6219308 - DNA, 14 bp, Homo sapiens
gagtcccactgcct

SEQ ID NO: 6219309 - DNA, 19 bp, Homo sapiens
gagtcccactgcctcaggt

SEQ ID NO: 6219310 - DNA, 20 bp, Homo sapiens
gagtcccactgcctcaggtt

SEQ ID NO: 6219311 - DNA, 17 bp, Homo sapiens
gagtcccaggcccctgg

SEQ ID NO: 6219312 - DNA, 17 bp, Homo sapiens
gagtcccaggggcagcc

SEQ ID NO: 6219313 - DNA, 20 bp, Homo sapiens
gagtcccaggggcagccaca

SEQ ID NO: 6219314 - DNA, 21 bp, Homo sapiens
gagtcccaggggcagccacac

SEQ ID NO: 6219315 - DNA, 18 bp, Homo sapiens
gagtcccaggttggctct

SEQ ID NO: 6219316 - DNA, 23 bp, Homo sapiens
gagtcccaggttggctctgccag

SEQ ID NO: 6219317 - DNA, 14 bp, Homo sapiens
gagtcccagtggga

SEQ ID NO: 6219318 - DNA, 18 bp, Homo sapiens
gagtcccagtgggaggcg

SEQ ID NO: 6219319 - DNA, 15 bp, Homo sapiens
gagtccccacctgcg

SEQ ID NO: 6219320 - DNA, 21 bp, Homo sapiens
gagtccccatgattccctcct

SEQ ID NO: 6219321 - DNA, 15 bp, Homo sapiens
gagtccccccacccc

SEQ ID NO: 6219322 - DNA, 17 bp, Homo sapiens
gagtccccccacccctc

SEQ ID NO: 6219323 - DNA, 18 bp, Homo sapiens
gagtccccccacccctcc

SEQ ID NO: 6219324 - DNA, 22 bp, Homo sapiens
gagtccccccactcccagcatc

SEQ ID NO: 6219325 - DNA, 21 bp, Homo sapiens
gagtccccgtgtgccccaaga

SEQ ID NO: 6219326 - DNA, 18 bp, Homo sapiens
gagtcccctcacctcctc

SEQ ID NO: 6219327 - DNA, 18 bp, Homo sapiens
gagtcccctccccggccc

SEQ ID NO: 6219328 - DNA, 23 bp, Homo sapiens
gagtcccctcctccagccgctgg

SEQ ID NO: 6219329 - DNA, 22 bp, Homo sapiens
gagtcccgtggggccccggctc

SEQ ID NO: 6219330 - DNA, 20 bp, Homo sapiens
gagtccctacctgcttcacg

SEQ ID NO: 6219331 - DNA, 11 bp, Homo sapiens
gagtccctcca

SEQ ID NO: 6219332 - DNA, 17 bp, Homo sapiens
gagtccctcctccccca

SEQ ID NO: 6219333 - DNA, 19 bp, Homo sapiens
gagtccctcgtctcttgtg

SEQ ID NO: 6219334 - DNA, 14 bp, Homo sapiens
gagtccctgccatc

SEQ ID NO: 6219335 - DNA, 14 bp, Homo sapiens
gagtccctgcctgg

SEQ ID NO: 6219336 - DNA, 19 bp, Homo sapiens
gagtccctgcctggaccag

SEQ ID NO: 6219337 - DNA, 24 bp, Homo sapiens
gagtccctgtgatggccaggccag

SEQ ID NO: 6219338 - DNA, 19 bp, Homo sapiens
gagtccgaaagggacttgg

SEQ ID NO: 6219339 - DNA, 16 bp, Homo sapiens
gagtccgcccatccct

SEQ ID NO: 6219340 - DNA, 14 bp, Homo sapiens
gagtccggaggcag

SEQ ID NO: 6219341 - DNA, 17 bp, Homo sapiens
gagtccggatttctaac

SEQ ID NO: 6219342 - DNA, 20 bp, Homo sapiens
gagtccgtggttgccctaga

SEQ ID NO: 6219343 - DNA, 17 bp, Homo sapiens
gagtcctcactcccagt

SEQ ID NO: 6219344 - DNA, 22 bp, Homo sapiens
gagtcctccagaactcttcctc

SEQ ID NO: 6219345 - DNA, 15 bp, Homo sapiens
gagtcctccttccca

SEQ ID NO: 6219346 - DNA, 18 bp, Homo sapiens
gagtcctccttcccagct

SEQ ID NO: 6219347 - DNA, 23 bp, Homo sapiens
gagtcctccttcccagctctaca

SEQ ID NO: 6219348 - DNA, 13 bp, Homo sapiens
gagtcctctccag

SEQ ID NO: 6219349 - DNA, 18 bp, Homo sapiens
gagtcctgaggcagaacc

SEQ ID NO: 6219350 - DNA, 12 bp, Homo sapiens
gagtcctgcctt

SEQ ID NO: 6219351 - DNA, 13 bp, Homo sapiens
gagtcctggccct

SEQ ID NO: 6219352 - DNA, 14 bp, Homo sapiens
gagtcctgggaggt

SEQ ID NO: 6219353 - DNA, 12 bp, Homo sapiens
gagtcctggggt

SEQ ID NO: 6219354 - DNA, 17 bp, Homo sapiens
gagtcctggtccctctg

SEQ ID NO: 6219355 - DNA, 18 bp, Homo sapiens
gagtcctggtccctctga

SEQ ID NO: 6219356 - DNA, 20 bp, Homo sapiens
gagtcctggtccctctgagg

SEQ ID NO: 6219357 - DNA, 20 bp, Homo sapiens
gagtcctgttctcagagctc

SEQ ID NO: 6219358 - DNA, 16 bp, Homo sapiens
gagtcctgttcttcct

SEQ ID NO: 6219359 - DNA, 16 bp, Homo sapiens
gagtcctgttgaagac

SEQ ID NO: 6219360 - DNA, 17 bp, Homo sapiens
gagtcctgttgaagact

SEQ ID NO: 6219361 - DNA, 18 bp, Homo sapiens
gagtccttacctcgggga

SEQ ID NO: 6219362 - DNA, 22 bp, Homo sapiens
gagtccttacctcggggagagg

SEQ ID NO: 6219363 - DNA, 15 bp, Homo sapiens
gagtccttagcctgg

SEQ ID NO: 6219364 - DNA, 18 bp, Homo sapiens
gagtccttattcttctca

SEQ ID NO: 6219365 - DNA, 18 bp, Homo sapiens
gagtcctttccaggggcc

SEQ ID NO: 6219366 - DNA, 16 bp, Homo sapiens
gagtcctttcttttga

SEQ ID NO: 6219367 - DNA, 17 bp, Homo sapiens
gagtcgaggacagggag

SEQ ID NO: 6219368 - DNA, 20 bp, Homo sapiens
gagtcgctctcatgaagccc

SEQ ID NO: 6219369 - DNA, 22 bp, Homo sapiens
gagtcgctctcatgaagccctt

SEQ ID NO: 6219370 - DNA, 12 bp, Homo sapiens
gagtcggctggg

SEQ ID NO: 6219371 - DNA, 14 bp, Homo sapiens
gagtcggctgggca

SEQ ID NO: 6219372 - DNA, 17 bp, Homo sapiens
gagtcggctgggcaggg

SEQ ID NO: 6219373 - DNA, 20 bp, Homo sapiens
gagtcggctgggcagggccg

SEQ ID NO: 6219374 - DNA, 16 bp, Homo sapiens
gagtcggtctgctttg

SEQ ID NO: 6219375 - DNA, 17 bp, Homo sapiens
gagtcgtacagaaagct

SEQ ID NO: 6219376 - DNA, 17 bp, Homo sapiens
gagtcgtggggtgtgct

SEQ ID NO: 6219377 - DNA, 20 bp, Homo sapiens
gagtcgtggggtgtgctggg

SEQ ID NO: 6219378 - DNA, 21 bp, Homo sapiens
gagtcgtggggtgtgctggga

SEQ ID NO: 6219379 - DNA, 22 bp, Homo sapiens
gagtcgtggggtgtgctgggag

SEQ ID NO: 6219380 - DNA, 16 bp, Homo sapiens
gagtcgttggagactg

SEQ ID NO: 6219381 - DNA, 19 bp, Homo sapiens
gagtcgttggagactgaag

SEQ ID NO: 6219382 - DNA, 22 bp, Homo sapiens
gagtctaaagatggagtttcta

SEQ ID NO: 6219383 - DNA, 18 bp, Homo sapiens
gagtctaatagtctttgc

SEQ ID NO: 6219384 - DNA, 18 bp, Homo sapiens
gagtctacctcttcagta

SEQ ID NO: 6219385 - DNA, 19 bp, Homo sapiens
gagtctacctgagcattca

SEQ ID NO: 6219386 - DNA, 16 bp, Homo sapiens
gagtctagatgtttat

SEQ ID NO: 6219387 - DNA, 11 bp, Homo sapiens
gagtctagatt

SEQ ID NO: 6219388 - DNA, 13 bp, Homo sapiens
gagtctagattca

SEQ ID NO: 6219389 - DNA, 13 bp, Homo sapiens
gagtctagattct

SEQ ID NO: 6219390 - DNA, 16 bp, Homo sapiens
gagtctagtcagtgta

SEQ ID NO: 6219391 - DNA, 16 bp, Homo sapiens
gagtctcaaaatcaac

SEQ ID NO: 6219392 - DNA, 19 bp, Homo sapiens
gagtctcaaaatcaactct

SEQ ID NO: 6219393 - DNA, 22 bp, Homo sapiens
gagtctcaataaactgaatttt

SEQ ID NO: 6219394 - DNA, 12 bp, Homo sapiens
gagtctcactgt

SEQ ID NO: 6219395 - DNA, 19 bp, Homo sapiens
gagtctcactgttgcccag

SEQ ID NO: 6219396 - DNA, 20 bp, Homo sapiens
gagtctcactgttgcccagg

SEQ ID NO: 6219397 - DNA, 21 bp, Homo sapiens
gagtctcactgttgcccaggc

SEQ ID NO: 6219398 - DNA, 12 bp, Homo sapiens
gagtctcagagc

SEQ ID NO: 6219399 - DNA, 18 bp, Homo sapiens
gagtctcagagcacagag

SEQ ID NO: 6219400 - DNA, 22 bp, Homo sapiens
gagtctcattctgttgcccagg

SEQ ID NO: 6219401 - DNA, 23 bp, Homo sapiens
gagtctccagggccccccaactg

SEQ ID NO: 6219402 - DNA, 19 bp, Homo sapiens
gaagaactagccatgtgct

SEQ ID NO: 6219403 - DNA, 12 bp, Homo sapiens
gaagaactgaaa

SEQ ID NO: 6219404 - DNA, 15 bp, Homo sapiens
gaagaactgcacttt

SEQ ID NO: 6219405 - DNA, 21 bp, Homo sapiens
gaagaactgcatggggagtac

SEQ ID NO: 6219406 - DNA, 14 bp, Homo sapiens
gaagaactgttgcc

SEQ ID NO: 6219407 - DNA, 9 bp, Homo sapiens
gaagaagaa

SEQ ID NO: 6219408 - DNA, 15 bp, Homo sapiens
gaagaagaaaagaga

SEQ ID NO: 6219409 - DNA, 22 bp, Homo sapiens
gaagaagaaccagcccagcctg

SEQ ID NO: 6219410 - DNA, 13 bp, Homo sapiens
gaagaagaagaaa

SEQ ID NO: 6219411 - DNA, 16 bp, Homo sapiens
gaagaagacacctcta

SEQ ID NO: 6219412 - DNA, 16 bp, Homo sapiens
gaagaagagaagctgc

SEQ ID NO: 6219413 - DNA, 13 bp, Homo sapiens
gaagaagagaggc

SEQ ID NO: 6219414 - DNA, 15 bp, Homo sapiens
gaagaagagggagag

SEQ ID NO: 6219415 - DNA, 13 bp, Homo sapiens
gaagaagatgctc

SEQ ID NO: 6219416 - DNA, 17 bp, Homo sapiens
gaagaagccctgttctc

SEQ ID NO: 6219417 - DNA, 18 bp, Homo sapiens
gaagaagctcctgaatcc

SEQ ID NO: 6219418 - DNA, 15 bp, Homo sapiens
gaagaagctgaggat

SEQ ID NO: 6219419 - DNA, 12 bp, Homo sapiens
gaagaagctggg

SEQ ID NO: 6219420 - DNA, 17 bp, Homo sapiens
gaagaagctgggaggga

SEQ ID NO: 6219421 - DNA, 23 bp, Homo sapiens
gaagaagctgggagggaggggga

SEQ ID NO: 6219422 - DNA, 15 bp, Homo sapiens
gaagaagctttgccg

SEQ ID NO: 6219423 - DNA, 15 bp, Homo sapiens
gaagaaggacttcct

SEQ ID NO: 6219424 - DNA, 19 bp, Homo sapiens
gaagaaggacttgtttccc

SEQ ID NO: 6219425 - DNA, 20 bp, Homo sapiens
gaagaaggccagagagggaa

SEQ ID NO: 6219426 - DNA, 16 bp, Homo sapiens
gaagaaggcccgggag

SEQ ID NO: 6219427 - DNA, 21 bp, Homo sapiens
gaagaaggcccgggaggagga

SEQ ID NO: 6219428 - DNA, 14 bp, Homo sapiens
gaagaagggaaatt

SEQ ID NO: 6219429 - DNA, 19 bp, Homo sapiens
gaagaagggagaagaaagg

SEQ ID NO: 6219430 - DNA, 16 bp, Homo sapiens
gaagaagggcacccta

SEQ ID NO: 6219431 - DNA, 20 bp, Homo sapiens
gaagaaggggctgttcttcc

SEQ ID NO: 6219432 - DNA, 20 bp, Homo sapiens
gaagaaggtggaccttttaa

SEQ ID NO: 6219433 - DNA, 15 bp, Homo sapiens
gaagaagtatatttt

SEQ ID NO: 6219434 - DNA, 14 bp, Homo sapiens
gaagaagtcagaga

SEQ ID NO: 6219435 - DNA, 13 bp, Homo sapiens
gaagaagtgtgtc

SEQ ID NO: 6219436 - DNA, 19 bp, Homo sapiens
gaagaagtttcatcatttt

SEQ ID NO: 6219437 - DNA, 15 bp, Homo sapiens
gaagaataaattcta

SEQ ID NO: 6219438 - DNA, 23 bp, Homo sapiens
gaagaataagtcatggagcctga

SEQ ID NO: 6219439 - DNA, 15 bp, Homo sapiens
gaagaatagggccca

SEQ ID NO: 6219440 - DNA, 23 bp, Homo sapiens
gaagaatagggcccatgggaggg

SEQ ID NO: 6219441 - DNA, 14 bp, Homo sapiens
gaagaatattcagg

SEQ ID NO: 6219442 - DNA, 19 bp, Homo sapiens
gaagaatattcaggactta

SEQ ID NO: 6219443 - DNA, 15 bp, Homo sapiens
gaagaatattgtatt

SEQ ID NO: 6219444 - DNA, 19 bp, Homo sapiens
gaagaatattgttcctaag

SEQ ID NO: 6219445 - DNA, 15 bp, Homo sapiens
gaagaatatttaaga

SEQ ID NO: 6219446 - DNA, 16 bp, Homo sapiens
gaagaatcaggagagg

SEQ ID NO: 6219447 - DNA, 19 bp, Homo sapiens
gaagaatctctatgccctg

SEQ ID NO: 6219448 - DNA, 20 bp, Homo sapiens
gaagaatcttcctggcacaa

SEQ ID NO: 6219449 - DNA, 16 bp, Homo sapiens
gaagaatctttcttct

SEQ ID NO: 6219450 - DNA, 14 bp, Homo sapiens
gaagaatgaacaaa

SEQ ID NO: 6219451 - DNA, 15 bp, Homo sapiens
gaagaatgaagacca

SEQ ID NO: 6219452 - DNA, 20 bp, Homo sapiens
gaagaatgcatgctttccat

SEQ ID NO: 6219453 - DNA, 16 bp, Homo sapiens
gaagaatgcattcaaa

SEQ ID NO: 6219454 - DNA, 24 bp, Homo sapiens
gaagaatgcttaatcagatagata

SEQ ID NO: 6219455 - DNA, 17 bp, Homo sapiens
gaagaatggagaggaac

SEQ ID NO: 6219456 - DNA, 12 bp, Homo sapiens
gaagaatggctt

SEQ ID NO: 6219457 - DNA, 23 bp, Homo sapiens
gaagaatgtagccctctccaaat

SEQ ID NO: 6219458 - DNA, 23 bp, Homo sapiens
gaagaatgtctcctgccactcct

SEQ ID NO: 6219459 - DNA, 22 bp, Homo sapiens
gaagaatgttaagacttgacag

SEQ ID NO: 6219460 - DNA, 16 bp, Homo sapiens
gaagaattaagataca

SEQ ID NO: 6219461 - DNA, 21 bp, Homo sapiens
gaagaattacaatttctttaa

SEQ ID NO: 6219462 - DNA, 13 bp, Homo sapiens
gaagaattatgta

SEQ ID NO: 6219463 - DNA, 14 bp, Homo sapiens
gaagaattcatgat

SEQ ID NO: 6219464 - DNA, 23 bp, Homo sapiens
gaagaattgaacccaggaggtgg

SEQ ID NO: 6219465 - DNA, 12 bp, Homo sapiens
gaagaatttaaa

SEQ ID NO: 6219466 - DNA, 17 bp, Homo sapiens
gaagaatttgagaagaa

SEQ ID NO: 6219467 - DNA, 14 bp, Homo sapiens
gaagaatttgttat

SEQ ID NO: 6219468 - DNA, 16 bp, Homo sapiens
gaagaatttgttcttg

SEQ ID NO: 6219469 - DNA, 12 bp, Homo sapiens
gaagaattttaa

SEQ ID NO: 6219470 - DNA, 14 bp, Homo sapiens
gaagaattttaaaa

SEQ ID NO: 6219471 - DNA, 13 bp, Homo sapiens
gaagaattttatt

SEQ ID NO: 6219472 - DNA, 20 bp, Homo sapiens
gaagaattttatttttctgt

SEQ ID NO: 6219473 - DNA, 17 bp, Homo sapiens
gaagaattttcagaccc

SEQ ID NO: 6219474 - DNA, 19 bp, Homo sapiens
gaagaattttttttttaag

SEQ ID NO: 6219475 - DNA, 15 bp, Homo sapiens
gaagacaaaaatact

SEQ ID NO: 6219476 - DNA, 19 bp, Homo sapiens
gaagacaaaacatacattt

SEQ ID NO: 6219477 - DNA, 23 bp, Homo sapiens
gaagacaaaacatacattttgta

SEQ ID NO: 6219478 - DNA, 21 bp, Homo sapiens
gaagacaaactccggcactgg

SEQ ID NO: 6219479 - DNA, 18 bp, Homo sapiens
gaagacaaagtctaagga

SEQ ID NO: 6219480 - DNA, 14 bp, Homo sapiens
gaagacaaatacac

SEQ ID NO: 6219481 - DNA, 14 bp, Homo sapiens
gaagacaaatgaca

SEQ ID NO: 6219482 - DNA, 13 bp, Homo sapiens
gaagacaagcatt

SEQ ID NO: 6219483 - DNA, 23 bp, Homo sapiens
gaagacaatactccctttaaaga

SEQ ID NO: 6219484 - DNA, 22 bp, Homo sapiens
gaagacaatgacttactgtaca

SEQ ID NO: 6219485 - DNA, 18 bp, Homo sapiens
gaagacaattgacaacag

SEQ ID NO: 6219486 - DNA, 19 bp, Homo sapiens
gaagacacagcccagacaa

SEQ ID NO: 6219487 - DNA, 21 bp, Homo sapiens
gaagacacagcccagacaaga

SEQ ID NO: 6219488 - DNA, 18 bp, Homo sapiens
gaagacacagcctccccc

SEQ ID NO: 6219489 - DNA, 23 bp, Homo sapiens
gaagacaccagagcagatgcaga

SEQ ID NO: 6219490 - DNA, 21 bp, Homo sapiens
gaagacaccagagtgtatgca

SEQ ID NO: 6219491 - DNA, 23 bp, Homo sapiens
gaagacactaattccttaaatga

SEQ ID NO: 6219492 - DNA, 17 bp, Homo sapiens
gaagacactccttcccc

SEQ ID NO: 6219493 - DNA, 16 bp, Homo sapiens
gaagacactgcagtga

SEQ ID NO: 6219494 - DNA, 15 bp, Homo sapiens
gaagacactgtgcag

SEQ ID NO: 6219495 - DNA, 17 bp, Homo sapiens
gaagacactgtgcaggc

SEQ ID NO: 6219496 - DNA, 15 bp, Homo sapiens
gaagacacttgctga

SEQ ID NO: 6219497 - DNA, 14 bp, Homo sapiens
gaagacagaaaccc

SEQ ID NO: 6219498 - DNA, 16 bp, Homo sapiens
gaagacagaaccacag

SEQ ID NO: 6219499 - DNA, 18 bp, Homo sapiens
gaagacagaaccacaggg

SEQ ID NO: 6219500 - DNA, 17 bp, Homo sapiens
gaagacagaagtttgca

SEQ ID NO: 6219501 - DNA, 19 bp, Homo sapiens
gaagacagagatggcagag

SEQ ID NO: 6219502 - DNA, 20 bp, Homo sapiens
gaagacagagcaaagcgccc

SEQ ID NO: 6219503 - DNA, 13 bp, Homo sapiens
gaagacagagcag

SEQ ID NO: 6219504 - DNA, 14 bp, Homo sapiens
gaagacagagcagg

SEQ ID NO: 6219505 - DNA, 15 bp, Homo sapiens
gaagacagagcaggc

SEQ ID NO: 6219506 - DNA, 13 bp, Homo sapiens
gaagacagagcta

SEQ ID NO: 6219507 - DNA, 15 bp, Homo sapiens
gaagacagagctaca

SEQ ID NO: 6219508 - DNA, 13 bp, Homo sapiens
gaagacagaggca

SEQ ID NO: 6219509 - DNA, 20 bp, Homo sapiens
gaagacagcagcaagtgtgc

SEQ ID NO: 6219510 - DNA, 17 bp, Homo sapiens
gaagacagcatttaaag

SEQ ID NO: 6219511 - DNA, 13 bp, Homo sapiens
gaagacagctctt

SEQ ID NO: 6219512 - DNA, 15 bp, Homo sapiens
gaagacagctcttat

SEQ ID NO: 6219513 - DNA, 22 bp, Homo sapiens
gaagacagcttaatagtagtta

SEQ ID NO: 6219514 - DNA, 14 bp, Homo sapiens
gaagacaggcacaa

SEQ ID NO: 6219515 - DNA, 19 bp, Homo sapiens
gaagacaggcacaaaatgt

SEQ ID NO: 6219516 - DNA, 12 bp, Homo sapiens
gaagacagtggc

SEQ ID NO: 6219517 - DNA, 22 bp, Homo sapiens
gaagacagtgtggggataaaga

SEQ ID NO: 6219518 - DNA, 16 bp, Homo sapiens
gaagacataaaacttt

SEQ ID NO: 6219519 - DNA, 13 bp, Homo sapiens
gaagacatatatt

SEQ ID NO: 6219520 - DNA, 18 bp, Homo sapiens
gaagacatgaaccaagtg

SEQ ID NO: 6219521 - DNA, 18 bp, Homo sapiens
gaagacatgttttagaca

SEQ ID NO: 6219522 - DNA, 17 bp, Homo sapiens
gaagacatttcttttct

SEQ ID NO: 6219523 - DNA, 14 bp, Homo sapiens
gaagacattttctc

SEQ ID NO: 6219524 - DNA, 12 bp, Homo sapiens
gaagacattttg

SEQ ID NO: 6219525 - DNA, 20 bp, Homo sapiens
gaagacattttgttacataa

SEQ ID NO: 6219526 - DNA, 19 bp, Homo sapiens
gaagaccaaagtttgcaac

SEQ ID NO: 6219527 - DNA, 22 bp, Homo sapiens
gaagaccaaggcctcggcagaa

SEQ ID NO: 6219528 - DNA, 23 bp, Homo sapiens
gaagaccaatctcttgaatccca

SEQ ID NO: 6219529 - DNA, 21 bp, Homo sapiens
gaagaccacatccacacacgc

SEQ ID NO: 6219530 - DNA, 22 bp, Homo sapiens
gaagaccagaattcccttgaat

SEQ ID NO: 6219531 - DNA, 17 bp, Homo sapiens
gaagaccagagcagttt

SEQ ID NO: 6219532 - DNA, 14 bp, Homo sapiens
gaagaccagtcaca

SEQ ID NO: 6219533 - DNA, 16 bp, Homo sapiens
gaagacccaaaacagc

SEQ ID NO: 6219534 - DNA, 21 bp, Homo sapiens
gaagacccaaaacagctttgt

SEQ ID NO: 6219535 - DNA, 23 bp, Homo sapiens
gaagacccaaaacagctttgtct

SEQ ID NO: 6219536 - DNA, 15 bp, Homo sapiens
gaagacccagcagat

SEQ ID NO: 6219537 - DNA, 15 bp, Homo sapiens
gaagacccagcagga

SEQ ID NO: 6219538 - DNA, 13 bp, Homo sapiens
gaagacccctgcc

SEQ ID NO: 6219539 - DNA, 14 bp, Homo sapiens
gaagacccctgccc

SEQ ID NO: 6219540 - DNA, 15 bp, Homo sapiens
gaagacccctgccca

SEQ ID NO: 6219541 - DNA, 17 bp, Homo sapiens
gaagacccctgcccaag

SEQ ID NO: 6219542 - DNA, 19 bp, Homo sapiens
gaagacccctgcccaagtg

SEQ ID NO: 6219543 - DNA, 15 bp, Homo sapiens
gaagaccctatctcc

SEQ ID NO: 6219544 - DNA, 16 bp, Homo sapiens
gaagaccctcagttat

SEQ ID NO: 6219545 - DNA, 17 bp, Homo sapiens
gaagaccgaattttatt

SEQ ID NO: 6219546 - DNA, 20 bp, Homo sapiens
gaagaccgactaacagctga

SEQ ID NO: 6219547 - DNA, 20 bp, Homo sapiens
gaagacctaaatgacctcag

SEQ ID NO: 6219548 - DNA, 13 bp, Homo sapiens
gaagacctaacca

SEQ ID NO: 6219549 - DNA, 20 bp, Homo sapiens
gaagacctaaccagggccag

SEQ ID NO: 6219550 - DNA, 20 bp, Homo sapiens
gaagacctaaggcagacagg

SEQ ID NO: 6219551 - DNA, 21 bp, Homo sapiens
gaagacctaaggcagacagga

SEQ ID NO: 6219552 - DNA, 22 bp, Homo sapiens
gaagacctaaggcagacaggaa

SEQ ID NO: 6219553 - DNA, 20 bp, Homo sapiens
gaagacctcacctagaaatt

SEQ ID NO: 6219554 - DNA, 15 bp, Homo sapiens
gaagacctgaaagag

SEQ ID NO: 6219555 - DNA, 22 bp, Homo sapiens
gaagacctgctgagggaccagc

SEQ ID NO: 6219556 - DNA, 22 bp, Homo sapiens
gaagaccttctagtgagcctgg

SEQ ID NO: 6219557 - DNA, 16 bp, Homo sapiens
gaagaccttctgaaga

SEQ ID NO: 6219558 - DNA, 14 bp, Homo sapiens
gaagacctttttct

SEQ ID NO: 6219559 - DNA, 17 bp, Homo sapiens
gaagacctttttctgca

SEQ ID NO: 6219560 - DNA, 14 bp, Homo sapiens
gaagacgaggccct

SEQ ID NO: 6219561 - DNA, 23 bp, Homo sapiens
gaagacgaggccctcgggcccag

SEQ ID NO: 6219562 - DNA, 23 bp, Homo sapiens
gaagacgatttggggggggaggg

SEQ ID NO: 6219563 - DNA, 15 bp, Homo sapiens
gaagacgcctgagct

SEQ ID NO: 6219564 - DNA, 21 bp, Homo sapiens
gaagacgtgatgccaggacca

SEQ ID NO: 6219565 - DNA, 14 bp, Homo sapiens
gaagacgttttctt

SEQ ID NO: 6219566 - DNA, 16 bp, Homo sapiens
gaagactagaggccag

SEQ ID NO: 6219567 - DNA, 18 bp, Homo sapiens
gaagactagaggccaggg

SEQ ID NO: 6219568 - DNA, 23 bp, Homo sapiens
gaagactagaggccagggcagca

SEQ ID NO: 6219569 - DNA, 19 bp, Homo sapiens
gaagactatttaccaggga

SEQ ID NO: 6219570 - DNA, 19 bp, Homo sapiens
gaagactcaggagtctgcc

SEQ ID NO: 6219571 - DNA, 20 bp, Homo sapiens
gaagactcaggagtctgcca

SEQ ID NO: 6219572 - DNA, 21 bp, Homo sapiens
gaagactcaggagtctgccac

SEQ ID NO: 6219573 - DNA, 20 bp, Homo sapiens
gaagactccctgatcccaga

SEQ ID NO: 6219574 - DNA, 22 bp, Homo sapiens
gaagactccctgatcccagacc

SEQ ID NO: 6219575 - DNA, 15 bp, Homo sapiens
gaagactcctagctg

SEQ ID NO: 6219576 - DNA, 15 bp, Homo sapiens
gaagactctaccaga

SEQ ID NO: 6219577 - DNA, 18 bp, Homo sapiens
gaagactctgcagccctc

SEQ ID NO: 6219578 - DNA, 15 bp, Homo sapiens
gaagactctggagcc

SEQ ID NO: 6219579 - DNA, 16 bp, Homo sapiens
gaagactctggagcca

SEQ ID NO: 6219580 - DNA, 21 bp, Homo sapiens
gaagactgacaaagtcatcct

SEQ ID NO: 6219581 - DNA, 20 bp, Homo sapiens
gagtctccagtggttgctgt

SEQ ID NO: 6219582 - DNA, 13 bp, Homo sapiens
gagtctcccaagg

SEQ ID NO: 6219583 - DNA, 13 bp, Homo sapiens
gagtctcccaggg

SEQ ID NO: 6219584 - DNA, 14 bp, Homo sapiens
gagtctccctctga

SEQ ID NO: 6219585 - DNA, 19 bp, Homo sapiens
gagtctcctcactgccact

SEQ ID NO: 6219586 - DNA, 19 bp, Homo sapiens
gagtctcctctctgagact

SEQ ID NO: 6219587 - DNA, 12 bp, Homo sapiens
gagtctccttct

SEQ ID NO: 6219588 - DNA, 14 bp, Homo sapiens
gagtctccttctct

SEQ ID NO: 6219589 - DNA, 16 bp, Homo sapiens
gagtctccttctcttc

SEQ ID NO: 6219590 - DNA, 23 bp, Homo sapiens
gagtctcgctattgtcaccaggg

SEQ ID NO: 6219591 - DNA, 16 bp, Homo sapiens
gagtctcgctctgctg

SEQ ID NO: 6219592 - DNA, 22 bp, Homo sapiens
gagtctcgctctgctgcccagg

SEQ ID NO: 6219593 - DNA, 14 bp, Homo sapiens
gagtctcgctctgt

SEQ ID NO: 6219594 - DNA, 20 bp, Homo sapiens
gagtctcgctctgtcgccca

SEQ ID NO: 6219595 - DNA, 21 bp, Homo sapiens
gagtctcgctctgtcgcccag

SEQ ID NO: 6219596 - DNA, 23 bp, Homo sapiens
gagtctcgctctgtcgcccaggc

SEQ ID NO: 6219597 - DNA, 18 bp, Homo sapiens
gagtctctacccctttct

SEQ ID NO: 6219598 - DNA, 16 bp, Homo sapiens
gagtctctccagcctc

SEQ ID NO: 6219599 - DNA, 20 bp, Homo sapiens
gagtctctccagcctcacag

SEQ ID NO: 6219600 - DNA, 17 bp, Homo sapiens
gagtctctctctctcca

SEQ ID NO: 6219601 - DNA, 23 bp, Homo sapiens
gagtctctctctctccatccctc

SEQ ID NO: 6219602 - DNA, 11 bp, Homo sapiens
gagtctctctt

SEQ ID NO: 6219603 - DNA, 16 bp, Homo sapiens
gagtctctgaacatcc

SEQ ID NO: 6219604 - DNA, 15 bp, Homo sapiens
gagtctctgaatttg

SEQ ID NO: 6219605 - DNA, 18 bp, Homo sapiens
gagtctctgccacccact

SEQ ID NO: 6219606 - DNA, 20 bp, Homo sapiens
gagtctctgccacccactca

SEQ ID NO: 6219607 - DNA, 11 bp, Homo sapiens
gagtctctggc

SEQ ID NO: 6219608 - DNA, 21 bp, Homo sapiens
gagtctctggctcagctgtgg

SEQ ID NO: 6219609 - DNA, 22 bp, Homo sapiens
gagtctctggctcagctgtggt

SEQ ID NO: 6219610 - DNA, 14 bp, Homo sapiens
gagtctcttctcca

SEQ ID NO: 6219611 - DNA, 23 bp, Homo sapiens
gagtctcttggtgatggagtgtg

SEQ ID NO: 6219612 - DNA, 22 bp, Homo sapiens
gagtctgaaagacagaatgtca

SEQ ID NO: 6219613 - DNA, 12 bp, Homo sapiens
gagtctgaaatg

SEQ ID NO: 6219614 - DNA, 18 bp, Homo sapiens
gagtctgaaatggggcta

SEQ ID NO: 6219615 - DNA, 12 bp, Homo sapiens
gagtctgaagcc

SEQ ID NO: 6219616 - DNA, 16 bp, Homo sapiens
gagtctgaaggagagg

SEQ ID NO: 6219617 - DNA, 18 bp, Homo sapiens
gagtctgaaggagaggag

SEQ ID NO: 6219618 - DNA, 13 bp, Homo sapiens
gagtctgaaggct

SEQ ID NO: 6219619 - DNA, 14 bp, Homo sapiens
gagtctgaaggctg

SEQ ID NO: 6219620 - DNA, 12 bp, Homo sapiens
gagtctgagccc

SEQ ID NO: 6219621 - DNA, 12 bp, Homo sapiens
gagtctgaggac

SEQ ID NO: 6219622 - DNA, 14 bp, Homo sapiens
gagtctgaggactg

SEQ ID NO: 6219623 - DNA, 18 bp, Homo sapiens
gagtctgaggactgtcct

SEQ ID NO: 6219624 - DNA, 14 bp, Homo sapiens
gagtctgaggtcct

SEQ ID NO: 6219625 - DNA, 23 bp, Homo sapiens
gagtctgaggtcctgagcactgc

SEQ ID NO: 6219626 - DNA, 19 bp, Homo sapiens
gagtctgcataaacttcat

SEQ ID NO: 6219627 - DNA, 21 bp, Homo sapiens
gagtctgcataaacttcatct

SEQ ID NO: 6219628 - DNA, 12 bp, Homo sapiens
gagtctgccagg

SEQ ID NO: 6219629 - DNA, 18 bp, Homo sapiens
gagtctgctatattttca

SEQ ID NO: 6219630 - DNA, 22 bp, Homo sapiens
gagtctggacctccatccctgc

SEQ ID NO: 6219631 - DNA, 12 bp, Homo sapiens
gagtctggactt

SEQ ID NO: 6219632 - DNA, 15 bp, Homo sapiens
gagtctggactttgc

SEQ ID NO: 6219633 - DNA, 18 bp, Homo sapiens
gagtctggagaccaggac

SEQ ID NO: 6219634 - DNA, 22 bp, Homo sapiens
gagtctggagaccaggactctg

SEQ ID NO: 6219635 - DNA, 12 bp, Homo sapiens
gagtctggagct

SEQ ID NO: 6219636 - DNA, 13 bp, Homo sapiens
gagtctggagctg

SEQ ID NO: 6219637 - DNA, 17 bp, Homo sapiens
gagtctggcaaacatgt

SEQ ID NO: 6219638 - DNA, 20 bp, Homo sapiens
gagtctggcaaacatgtgca

SEQ ID NO: 6219639 - DNA, 11 bp, Homo sapiens
gagtctgggat

SEQ ID NO: 6219640 - DNA, 16 bp, Homo sapiens
gagtctgggcctctga

SEQ ID NO: 6219641 - DNA, 18 bp, Homo sapiens
gagtctgggcctctgact

SEQ ID NO: 6219642 - DNA, 12 bp, Homo sapiens
gagtctgggctc

SEQ ID NO: 6219643 - DNA, 23 bp, Homo sapiens
gagtctggtgaagctcacttctg

SEQ ID NO: 6219644 - DNA, 15 bp, Homo sapiens
gagtctggtggagga

SEQ ID NO: 6219645 - DNA, 19 bp, Homo sapiens
gagtctggtggaggagctg

SEQ ID NO: 6219646 - DNA, 17 bp, Homo sapiens
gagtctgtaggagcaag

SEQ ID NO: 6219647 - DNA, 12 bp, Homo sapiens
gagtctgtcctt

SEQ ID NO: 6219648 - DNA, 17 bp, Homo sapiens
gagtctgtcctttccca

SEQ ID NO: 6219649 - DNA, 12 bp, Homo sapiens
gagtctgtctca

SEQ ID NO: 6219650 - DNA, 17 bp, Homo sapiens
gagtctgtctcttggct

SEQ ID NO: 6219651 - DNA, 16 bp, Homo sapiens
gagtctgtttcccaag

SEQ ID NO: 6219652 - DNA, 19 bp, Homo sapiens
gagtctgtttcccaagcta

SEQ ID NO: 6219653 - DNA, 19 bp, Homo sapiens
gagtcttaattttctaaaa

SEQ ID NO: 6219654 - DNA, 22 bp, Homo sapiens
gagtcttatatcccaggtgagg

SEQ ID NO: 6219655 - DNA, 18 bp, Homo sapiens
gagtcttcacatttagaa

SEQ ID NO: 6219656 - DNA, 19 bp, Homo sapiens
gagtcttcactgctctgcc

SEQ ID NO: 6219657 - DNA, 16 bp, Homo sapiens
gagtcttcagacccag

SEQ ID NO: 6219658 - DNA, 17 bp, Homo sapiens
gagtcttcagacccaga

SEQ ID NO: 6219659 - DNA, 17 bp, Homo sapiens
gagtcttcctgtagtgg

SEQ ID NO: 6219660 - DNA, 16 bp, Homo sapiens
gagtcttgcagtgatt

SEQ ID NO: 6219661 - DNA, 20 bp, Homo sapiens
gagtcttgctacctcagtca

SEQ ID NO: 6219662 - DNA, 20 bp, Homo sapiens
gagtcttgctctgtcgccca

SEQ ID NO: 6219663 - DNA, 20 bp, Homo sapiens
gagtcttgctctgttgccca

SEQ ID NO: 6219664 - DNA, 22 bp, Homo sapiens
gagtcttgctctgttgcccaag

SEQ ID NO: 6219665 - DNA, 23 bp, Homo sapiens
gagtcttggcctgcctcccagcc

SEQ ID NO: 6219666 - DNA, 14 bp, Homo sapiens
gagtcttgggcctg

SEQ ID NO: 6219667 - DNA, 17 bp, Homo sapiens
gagtcttgggcctggcc

SEQ ID NO: 6219668 - DNA, 14 bp, Homo sapiens
gagtcttgggtggc

SEQ ID NO: 6219669 - DNA, 14 bp, Homo sapiens
gagtcttggtgcta

SEQ ID NO: 6219670 - DNA, 17 bp, Homo sapiens
gagtcttgtgaaagtgt

SEQ ID NO: 6219671 - DNA, 17 bp, Homo sapiens
gagtctttaatcccagt

SEQ ID NO: 6219672 - DNA, 17 bp, Homo sapiens
gagtctttctcactgcc

SEQ ID NO: 6219673 - DNA, 22 bp, Homo sapiens
gagtctttgaagctgaaaatat

SEQ ID NO: 6219674 - DNA, 15 bp, Homo sapiens
gagtctttggttcta

SEQ ID NO: 6219675 - DNA, 22 bp, Homo sapiens
gagtctttggttctaaggacct

SEQ ID NO: 6219676 - DNA, 11 bp, Homo sapiens
gagtgaaacag

SEQ ID NO: 6219677 - DNA, 20 bp, Homo sapiens
gagtgaaacctttagggcag

SEQ ID NO: 6219678 - DNA, 19 bp, Homo sapiens
gagtgaaactcccacccta

SEQ ID NO: 6219679 - DNA, 14 bp, Homo sapiens
gagtgaaagggcta

SEQ ID NO: 6219680 - DNA, 19 bp, Homo sapiens
gagtgaaagggctatggca

SEQ ID NO: 6219681 - DNA, 22 bp, Homo sapiens
gagtgaaataccctcaagtctc

SEQ ID NO: 6219682 - DNA, 16 bp, Homo sapiens
gagtgaaatattgtaa

SEQ ID NO: 6219683 - DNA, 19 bp, Homo sapiens
gagtgaaatattgtaaatg

SEQ ID NO: 6219684 - DNA, 19 bp, Homo sapiens
gagtgaacaaatttacaga

SEQ ID NO: 6219685 - DNA, 19 bp, Homo sapiens
gagtgaacaactatttata

SEQ ID NO: 6219686 - DNA, 15 bp, Homo sapiens
gagtgaacatttcta

SEQ ID NO: 6219687 - DNA, 15 bp, Homo sapiens
gagtgaagaggggca

SEQ ID NO: 6219688 - DNA, 16 bp, Homo sapiens
gagtgaagaggggcag

SEQ ID NO: 6219689 - DNA, 19 bp, Homo sapiens
gagtgaagaggggcagccc

SEQ ID NO: 6219690 - DNA, 20 bp, Homo sapiens
gagtgaagaggggcagccct

SEQ ID NO: 6219691 - DNA, 15 bp, Homo sapiens
gagtgaagagtgaag

SEQ ID NO: 6219692 - DNA, 18 bp, Homo sapiens
gagtgaagagtgaagagc

SEQ ID NO: 6219693 - DNA, 20 bp, Homo sapiens
gagtgaagagtgaagagcat

SEQ ID NO: 6219694 - DNA, 16 bp, Homo sapiens
gagtgaagtccagtga

SEQ ID NO: 6219695 - DNA, 18 bp, Homo sapiens
gagtgaagtccagtgacc

SEQ ID NO: 6219696 - DNA, 22 bp, Homo sapiens
gagtgacacccaagagggctgc

SEQ ID NO: 6219697 - DNA, 12 bp, Homo sapiens
gagtgacagctt

SEQ ID NO: 6219698 - DNA, 22 bp, Homo sapiens
gagtgacatgggtgtgccaggc

SEQ ID NO: 6219699 - DNA, 19 bp, Homo sapiens
gagtgaccagcacactgga

SEQ ID NO: 6219700 - DNA, 24 bp, Homo sapiens
gagtgacctcacttctggcactgt

SEQ ID NO: 6219701 - DNA, 20 bp, Homo sapiens
gagtgacctcggacagagcc

SEQ ID NO: 6219702 - DNA, 20 bp, Homo sapiens
gagtgacgggagcctcctct

SEQ ID NO: 6219703 - DNA, 15 bp, Homo sapiens
gagtgacggtcccac

SEQ ID NO: 6219704 - DNA, 14 bp, Homo sapiens
gagtgactagacgt

SEQ ID NO: 6219705 - DNA, 23 bp, Homo sapiens
gagtgactcaagaagtgaagaat

SEQ ID NO: 6219706 - DNA, 15 bp, Homo sapiens
gagtgactcggtgta

SEQ ID NO: 6219707 - DNA, 16 bp, Homo sapiens
gagtgactctggctgc

SEQ ID NO: 6219708 - DNA, 21 bp, Homo sapiens
gagtgagaataattgtgtaca

SEQ ID NO: 6219709 - DNA, 23 bp, Homo sapiens
gagtgagaataattgtgtacaaa

SEQ ID NO: 6219710 - DNA, 15 bp, Homo sapiens
gagtgagacccagga

SEQ ID NO: 6219711 - DNA, 13 bp, Homo sapiens
gagtgagaccctg

SEQ ID NO: 6219712 - DNA, 18 bp, Homo sapiens
gagtgagaccctgtctca

SEQ ID NO: 6219713 - DNA, 13 bp, Homo sapiens
gagtgagactcca

SEQ ID NO: 6219714 - DNA, 19 bp, Homo sapiens
gagtgagactccacctcaa

SEQ ID NO: 6219715 - DNA, 17 bp, Homo sapiens
gagtgagactcctgatt

SEQ ID NO: 6219716 - DNA, 14 bp, Homo sapiens
gagtgagactctgt

SEQ ID NO: 6219717 - DNA, 18 bp, Homo sapiens
gagtgagagcacaaagat

SEQ ID NO: 6219718 - DNA, 18 bp, Homo sapiens
gagtgagaggggaggcca

SEQ ID NO: 6219719 - DNA, 20 bp, Homo sapiens
gagtgagaggggaggccaag

SEQ ID NO: 6219720 - DNA, 17 bp, Homo sapiens
gagtgagcaagggggcc

SEQ ID NO: 6219721 - DNA, 17 bp, Homo sapiens
gagtgagcagctactgt

SEQ ID NO: 6219722 - DNA, 21 bp, Homo sapiens
gagtgagccacagaccacctg

SEQ ID NO: 6219723 - DNA, 20 bp, Homo sapiens
gagtgagctaccaggaagag

SEQ ID NO: 6219724 - DNA, 14 bp, Homo sapiens
gagtgagctctggt

SEQ ID NO: 6219725 - DNA, 20 bp, Homo sapiens
gagtgagctctggtggagac

SEQ ID NO: 6219726 - DNA, 23 bp, Homo sapiens
gagtgagctctggtggagacaaa

SEQ ID NO: 6219727 - DNA, 12 bp, Homo sapiens
gagtgagctggt

SEQ ID NO: 6219728 - DNA, 23 bp, Homo sapiens
gagtgaggagtggacgctgtcca

SEQ ID NO: 6219729 - DNA, 20 bp, Homo sapiens
gagtgaggatatgagtagcc

SEQ ID NO: 6219730 - DNA, 13 bp, Homo sapiens
gagtgaggccccc

SEQ ID NO: 6219731 - DNA, 16 bp, Homo sapiens
gagtgagggaggaggg

SEQ ID NO: 6219732 - DNA, 21 bp, Homo sapiens
gagtgagggcctcagagcctg

SEQ ID NO: 6219733 - DNA, 19 bp, Homo sapiens
gagtgagggggtaaagcag

SEQ ID NO: 6219734 - DNA, 19 bp, Homo sapiens
gagtgaggggtaaaagctg

SEQ ID NO: 6219735 - DNA, 16 bp, Homo sapiens
gagtgaggtgcaggga

SEQ ID NO: 6219736 - DNA, 18 bp, Homo sapiens
gagtgagtcacctgctcc

SEQ ID NO: 6219737 - DNA, 20 bp, Homo sapiens
gagtgagtcacctgctccag

SEQ ID NO: 6219738 - DNA, 21 bp, Homo sapiens
gagtgagtcacctgctccaga

SEQ ID NO: 6219739 - DNA, 15 bp, Homo sapiens
gagtgagtgtgtgtg

SEQ ID NO: 6219740 - DNA, 21 bp, Homo sapiens
gagtgataatattgtttccct

SEQ ID NO: 6219741 - DNA, 17 bp, Homo sapiens
gagtgatactttaagtt

SEQ ID NO: 6219742 - DNA, 14 bp, Homo sapiens
gagtgatgatttgg

SEQ ID NO: 6219743 - DNA, 24 bp, Homo sapiens
gagtgatggcagaacgatgcctgc

SEQ ID NO: 6219744 - DNA, 14 bp, Homo sapiens
gagtgatgggcaag

SEQ ID NO: 6219745 - DNA, 20 bp, Homo sapiens
gagtgatgggcaaggggcca

SEQ ID NO: 6219746 - DNA, 23 bp, Homo sapiens
gagtgatgggcaaggggccagga

SEQ ID NO: 6219747 - DNA, 18 bp, Homo sapiens
gagtgatggtgtccttcc

SEQ ID NO: 6219748 - DNA, 20 bp, Homo sapiens
gagtgatggtgtccttccct

SEQ ID NO: 6219749 - DNA, 15 bp, Homo sapiens
gagtgattgcagctt

SEQ ID NO: 6219750 - DNA, 18 bp, Homo sapiens
gagtgatttccatctctg

SEQ ID NO: 6219751 - DNA, 23 bp, Homo sapiens
gagtgcaaaaggcttgcagaact

SEQ ID NO: 6219752 - DNA, 21 bp, Homo sapiens
gagtgcaagcccctgctccag

SEQ ID NO: 6219753 - DNA, 12 bp, Homo sapiens
gagtgcacagct

SEQ ID NO: 6219754 - DNA, 13 bp, Homo sapiens
gagtgcacagctg

SEQ ID NO: 6219755 - DNA, 13 bp, Homo sapiens
gagtgcacatgcc

SEQ ID NO: 6219756 - DNA, 15 bp, Homo sapiens
gagtgcaccaaagag

SEQ ID NO: 6219757 - DNA, 16 bp, Homo sapiens
gagtgcacctgcctcc

SEQ ID NO: 6219758 - DNA, 23 bp, Homo sapiens
gagtgcacctgcctccaccagca

SEQ ID NO: 6219759 - DNA, 22 bp, Homo sapiens
gaagactgattttaaaactttt

SEQ ID NO: 6219760 - DNA, 22 bp, Homo sapiens
gaagactgcacaggtgacaagc

SEQ ID NO: 6219761 - DNA, 17 bp, Homo sapiens
gaagactgcattatatt

SEQ ID NO: 6219762 - DNA, 14 bp, Homo sapiens
gaagactgctaaat

SEQ ID NO: 6219763 - DNA, 17 bp, Homo sapiens
gaagactggaagctaat

SEQ ID NO: 6219764 - DNA, 15 bp, Homo sapiens
gaagactgtgacatc

SEQ ID NO: 6219765 - DNA, 22 bp, Homo sapiens
gaagactgtgcggcacaggaaa

SEQ ID NO: 6219766 - DNA, 11 bp, Homo sapiens
gaagactgtgg

SEQ ID NO: 6219767 - DNA, 20 bp, Homo sapiens
gaagacttagatctgagccc

SEQ ID NO: 6219768 - DNA, 18 bp, Homo sapiens
gaagacttcaatattaaa

SEQ ID NO: 6219769 - DNA, 19 bp, Homo sapiens
gaagacttcaatattaaat

SEQ ID NO: 6219770 - DNA, 17 bp, Homo sapiens
gaagacttcatccctct

SEQ ID NO: 6219771 - DNA, 20 bp, Homo sapiens
gaagacttccagctttctct

SEQ ID NO: 6219772 - DNA, 21 bp, Homo sapiens
gaagacttccagctttctctt

SEQ ID NO: 6219773 - DNA, 22 bp, Homo sapiens
gaagacttccagctttctcttt

SEQ ID NO: 6219774 - DNA, 23 bp, Homo sapiens
gaagacttccagctttctctttg

SEQ ID NO: 6219775 - DNA, 15 bp, Homo sapiens
gaagacttcccagct

SEQ ID NO: 6219776 - DNA, 22 bp, Homo sapiens
gaagacttccccaagcctggca

SEQ ID NO: 6219777 - DNA, 12 bp, Homo sapiens
gaagacttcctc

SEQ ID NO: 6219778 - DNA, 14 bp, Homo sapiens
gaagacttcttggg

SEQ ID NO: 6219779 - DNA, 20 bp, Homo sapiens
gaagacttggcccaggaaaa

SEQ ID NO: 6219780 - DNA, 19 bp, Homo sapiens
gaagactttaattatatat

SEQ ID NO: 6219781 - DNA, 20 bp, Homo sapiens
gaagacttttctttcagcca

SEQ ID NO: 6219782 - DNA, 17 bp, Homo sapiens
gaagagaaaaaaaggaa

SEQ ID NO: 6219783 - DNA, 13 bp, Homo sapiens
gaagagaaaagac

SEQ ID NO: 6219784 - DNA, 22 bp, Homo sapiens
gaagagaaaatgtaaaggaggg

SEQ ID NO: 6219785 - DNA, 12 bp, Homo sapiens
gaagagaaacca

SEQ ID NO: 6219786 - DNA, 23 bp, Homo sapiens
gaagagaaatacagctggctatc

SEQ ID NO: 6219787 - DNA, 12 bp, Homo sapiens
gaagagaaattt

SEQ ID NO: 6219788 - DNA, 14 bp, Homo sapiens
gaagagaagacaaa

SEQ ID NO: 6219789 - DNA, 16 bp, Homo sapiens
gaagagaagctgctga

SEQ ID NO: 6219790 - DNA, 20 bp, Homo sapiens
gaagagaagctgctgaccaa

SEQ ID NO: 6219791 - DNA, 12 bp, Homo sapiens
gaagagaaggaa

SEQ ID NO: 6219792 - DNA, 13 bp, Homo sapiens
gaagagaaggagc

SEQ ID NO: 6219793 - DNA, 14 bp, Homo sapiens
gaagagaaggagca

SEQ ID NO: 6219794 - DNA, 17 bp, Homo sapiens
gaagagaagggcagggc

SEQ ID NO: 6219795 - DNA, 24 bp, Homo sapiens
gaagagaagtgaccgagagaacct

SEQ ID NO: 6219796 - DNA, 19 bp, Homo sapiens
gaagagacaaagatttctt

SEQ ID NO: 6219797 - DNA, 18 bp, Homo sapiens
gaagagacaaagtgggtg

SEQ ID NO: 6219798 - DNA, 15 bp, Homo sapiens
gaagagacagcccag

SEQ ID NO: 6219799 - DNA, 16 bp, Homo sapiens
gaagagactgggaaga

SEQ ID NO: 6219800 - DNA, 22 bp, Homo sapiens
gaagagagaaggggcgggaata

SEQ ID NO: 6219801 - DNA, 18 bp, Homo sapiens
gaagagagagagagaggt

SEQ ID NO: 6219802 - DNA, 19 bp, Homo sapiens
gaagagagatcaaatggaa

SEQ ID NO: 6219803 - DNA, 16 bp, Homo sapiens
gaagagagcatgagag

SEQ ID NO: 6219804 - DNA, 12 bp, Homo sapiens
gaagagagcctg

SEQ ID NO: 6219805 - DNA, 20 bp, Homo sapiens
gaagagagcctgcaggatct

SEQ ID NO: 6219806 - DNA, 14 bp, Homo sapiens
gaagagagcctgcc

SEQ ID NO: 6219807 - DNA, 15 bp, Homo sapiens
gaagagagcctgccc

SEQ ID NO: 6219808 - DNA, 17 bp, Homo sapiens
gaagagaggagttcaat

SEQ ID NO: 6219809 - DNA, 20 bp, Homo sapiens
gaagagaggagttcaatgat

SEQ ID NO: 6219810 - DNA, 22 bp, Homo sapiens
gaagagaggagttcaatgatct

SEQ ID NO: 6219811 - DNA, 12 bp, Homo sapiens
gaagagaggcac

SEQ ID NO: 6219812 - DNA, 17 bp, Homo sapiens
gaagagaggcacctgct

SEQ ID NO: 6219813 - DNA, 22 bp, Homo sapiens
gaagagagggacaggcactcca

SEQ ID NO: 6219814 - DNA, 20 bp, Homo sapiens
gaagagagggctgagccatg

SEQ ID NO: 6219815 - DNA, 14 bp, Homo sapiens
gaagagaggggaag

SEQ ID NO: 6219816 - DNA, 21 bp, Homo sapiens
gaagagagtggggcctgccct

SEQ ID NO: 6219817 - DNA, 22 bp, Homo sapiens
gaagagagttctggatgtctgg

SEQ ID NO: 6219818 - DNA, 16 bp, Homo sapiens
gaagagatcccaggag

SEQ ID NO: 6219819 - DNA, 19 bp, Homo sapiens
gaagagatcccaggaggtg

SEQ ID NO: 6219820 - DNA, 14 bp, Homo sapiens
gaagagatgctcta

SEQ ID NO: 6219821 - DNA, 21 bp, Homo sapiens
gaagagattagcatgaaaggt

SEQ ID NO: 6219822 - DNA, 17 bp, Homo sapiens
gaagagcaaaaatatcc

SEQ ID NO: 6219823 - DNA, 14 bp, Homo sapiens
gaagagcaaaagct

SEQ ID NO: 6219824 - DNA, 13 bp, Homo sapiens
gaagagcacagcc

SEQ ID NO: 6219825 - DNA, 22 bp, Homo sapiens
gaagagcacggtcccccaggag

SEQ ID NO: 6219826 - DNA, 14 bp, Homo sapiens
gaagagcagcacct

SEQ ID NO: 6219827 - DNA, 23 bp, Homo sapiens
gaagagcagcacctcctcagcct

SEQ ID NO: 6219828 - DNA, 12 bp, Homo sapiens
gaagagcagccc

SEQ ID NO: 6219829 - DNA, 18 bp, Homo sapiens
gaagagcagcctgatggc

SEQ ID NO: 6219830 - DNA, 22 bp, Homo sapiens
gaagagcaggactccaggccca

SEQ ID NO: 6219831 - DNA, 23 bp, Homo sapiens
gaagagcaggcacatggaggagc

SEQ ID NO: 6219832 - DNA, 21 bp, Homo sapiens
gaagagcaggtgactgtgctg

SEQ ID NO: 6219833 - DNA, 13 bp, Homo sapiens
gaagagccacagt

SEQ ID NO: 6219834 - DNA, 15 bp, Homo sapiens
gaagagccacctgca

SEQ ID NO: 6219835 - DNA, 18 bp, Homo sapiens
gaagagccacctgcaaga

SEQ ID NO: 6219836 - DNA, 20 bp, Homo sapiens
gaagagccacctgcaagatg

SEQ ID NO: 6219837 - DNA, 23 bp, Homo sapiens
gaagagccacctgcaagatggac

SEQ ID NO: 6219838 - DNA, 13 bp, Homo sapiens
gaagagccagccg

SEQ ID NO: 6219839 - DNA, 18 bp, Homo sapiens
gaagagccatcttggcag

SEQ ID NO: 6219840 - DNA, 16 bp, Homo sapiens
gaagagcccagtctgt

SEQ ID NO: 6219841 - DNA, 15 bp, Homo sapiens
gaagagccccactct

SEQ ID NO: 6219842 - DNA, 16 bp, Homo sapiens
gaagagccccactctc

SEQ ID NO: 6219843 - DNA, 20 bp, Homo sapiens
gaagagccccactctcagag

SEQ ID NO: 6219844 - DNA, 17 bp, Homo sapiens
gaagagcccgcagggcc

SEQ ID NO: 6219845 - DNA, 22 bp, Homo sapiens
gaagagcccgcagggccatgca

SEQ ID NO: 6219846 - DNA, 23 bp, Homo sapiens
gaagagcccgcagggccatgcag

SEQ ID NO: 6219847 - DNA, 20 bp, Homo sapiens
gaagagcccgtcgcgctgga

SEQ ID NO: 6219848 - DNA, 13 bp, Homo sapiens
gaagagccctgag

SEQ ID NO: 6219849 - DNA, 16 bp, Homo sapiens
gaagagccctgagctc

SEQ ID NO: 6219850 - DNA, 17 bp, Homo sapiens
gaagagccctgagctca

SEQ ID NO: 6219851 - DNA, 15 bp, Homo sapiens
gaagagccctggaca

SEQ ID NO: 6219852 - DNA, 16 bp, Homo sapiens
gaagagccggtggtgc

SEQ ID NO: 6219853 - DNA, 13 bp, Homo sapiens
gaagagcctgaag

SEQ ID NO: 6219854 - DNA, 21 bp, Homo sapiens
gaagagcctgaagctggcctg

SEQ ID NO: 6219855 - DNA, 17 bp, Homo sapiens
gaagagcctgactgtgt

SEQ ID NO: 6219856 - DNA, 21 bp, Homo sapiens
gaagagcgcagtgttttgcaa

SEQ ID NO: 6219857 - DNA, 17 bp, Homo sapiens
gaagagcgctcctctgc

SEQ ID NO: 6219858 - DNA, 18 bp, Homo sapiens
gaagagcgctcctctgcc

SEQ ID NO: 6219859 - DNA, 19 bp, Homo sapiens
gaagagcgctcctctgcct

SEQ ID NO: 6219860 - DNA, 16 bp, Homo sapiens
gaagagctagagaaat

SEQ ID NO: 6219861 - DNA, 17 bp, Homo sapiens
gaagagctattatataa

SEQ ID NO: 6219862 - DNA, 23 bp, Homo sapiens
gaagagctcaagggacaaggaca

SEQ ID NO: 6219863 - DNA, 22 bp, Homo sapiens
gaagagctcccctacggaccag

SEQ ID NO: 6219864 - DNA, 12 bp, Homo sapiens
gaagagctcttg

SEQ ID NO: 6219865 - DNA, 13 bp, Homo sapiens
gaagagctcttgg

SEQ ID NO: 6219866 - DNA, 10 bp, Homo sapiens
gaagagctga

SEQ ID NO: 6219867 - DNA, 15 bp, Homo sapiens
gaagagctgagacct

SEQ ID NO: 6219868 - DNA, 17 bp, Homo sapiens
gaagagctgagtactca

SEQ ID NO: 6219869 - DNA, 14 bp, Homo sapiens
gaagagcttagaaa

SEQ ID NO: 6219870 - DNA, 14 bp, Homo sapiens
gaagagcttgcttt

SEQ ID NO: 6219871 - DNA, 20 bp, Homo sapiens
gaagagcttgctttgattta

SEQ ID NO: 6219872 - DNA, 11 bp, Homo sapiens
gaagaggaagt

SEQ ID NO: 6219873 - DNA, 22 bp, Homo sapiens
gaagaggaagttagagataatt

SEQ ID NO: 6219874 - DNA, 17 bp, Homo sapiens
gaagaggaccagaggag

SEQ ID NO: 6219875 - DNA, 19 bp, Homo sapiens
gaagaggaccagaggagca

SEQ ID NO: 6219876 - DNA, 10 bp, Homo sapiens
gaagaggact

SEQ ID NO: 6219877 - DNA, 17 bp, Homo sapiens
gaagaggacttttttga

SEQ ID NO: 6219878 - DNA, 15 bp, Homo sapiens
gaagaggagaaaaag

SEQ ID NO: 6219879 - DNA, 22 bp, Homo sapiens
gaagaggagattggccagtgag

SEQ ID NO: 6219880 - DNA, 15 bp, Homo sapiens
gaagaggagcctcag

SEQ ID NO: 6219881 - DNA, 19 bp, Homo sapiens
gaagaggagcctcagaaga

SEQ ID NO: 6219882 - DNA, 22 bp, Homo sapiens
gaagaggagcctcagaagaaaa

SEQ ID NO: 6219883 - DNA, 14 bp, Homo sapiens
gaagaggaggagga

SEQ ID NO: 6219884 - DNA, 13 bp, Homo sapiens
gaagaggagtcaa

SEQ ID NO: 6219885 - DNA, 21 bp, Homo sapiens
gaagaggcccactagagggcc

SEQ ID NO: 6219886 - DNA, 20 bp, Homo sapiens
gaagaggccgctgcagggtg

SEQ ID NO: 6219887 - DNA, 18 bp, Homo sapiens
gaagaggcctagcctgag

SEQ ID NO: 6219888 - DNA, 20 bp, Homo sapiens
gaagaggcctgtttggcctc

SEQ ID NO: 6219889 - DNA, 14 bp, Homo sapiens
gaagaggccttggg

SEQ ID NO: 6219890 - DNA, 15 bp, Homo sapiens
gaagaggcctttcta

SEQ ID NO: 6219891 - DNA, 15 bp, Homo sapiens
gaagaggcctttgga

SEQ ID NO: 6219892 - DNA, 16 bp, Homo sapiens
gaagaggcgggccagc

SEQ ID NO: 6219893 - DNA, 17 bp, Homo sapiens
gaagaggcgggccagcc

SEQ ID NO: 6219894 - DNA, 19 bp, Homo sapiens
gaagaggcgggccagccag

SEQ ID NO: 6219895 - DNA, 11 bp, Homo sapiens
gaagaggcttc

SEQ ID NO: 6219896 - DNA, 16 bp, Homo sapiens
gaagaggcttctcctg

SEQ ID NO: 6219897 - DNA, 19 bp, Homo sapiens
gaagagggaaaacagaaaa

SEQ ID NO: 6219898 - DNA, 14 bp, Homo sapiens
gaagagggagaagg

SEQ ID NO: 6219899 - DNA, 19 bp, Homo sapiens
gaagagggaggcttcctga

SEQ ID NO: 6219900 - DNA, 18 bp, Homo sapiens
gaagagggcccagcccag

SEQ ID NO: 6219901 - DNA, 22 bp, Homo sapiens
gaagagggcccagcccagagcc

SEQ ID NO: 6219902 - DNA, 13 bp, Homo sapiens
gaagagggcctgt

SEQ ID NO: 6219903 - DNA, 21 bp, Homo sapiens
gaagagggctgagctgagctt

SEQ ID NO: 6219904 - DNA, 14 bp, Homo sapiens
gaagaggggacagg

SEQ ID NO: 6219905 - DNA, 13 bp, Homo sapiens
gaagaggggcagc

SEQ ID NO: 6219906 - DNA, 14 bp, Homo sapiens
gaagaggggccaga

SEQ ID NO: 6219907 - DNA, 19 bp, Homo sapiens
gaagaggggcgctgccccc

SEQ ID NO: 6219908 - DNA, 23 bp, Homo sapiens
gaagaggggtggtggggggcagg

SEQ ID NO: 6219909 - DNA, 18 bp, Homo sapiens
gaagagggtgtgtttgaa

SEQ ID NO: 6219910 - DNA, 20 bp, Homo sapiens
gaagaggtggccccatatta

SEQ ID NO: 6219911 - DNA, 20 bp, Homo sapiens
gaagaggttctcagcaagtg

SEQ ID NO: 6219912 - DNA, 23 bp, Homo sapiens
gaagaggttctcagcaagtgtac

SEQ ID NO: 6219913 - DNA, 23 bp, Homo sapiens
gaagaggttgcagtgagctgaga

SEQ ID NO: 6219914 - DNA, 19 bp, Homo sapiens
gaagagtagaacccaggtc

SEQ ID NO: 6219915 - DNA, 20 bp, Homo sapiens
gaagagtatttttgacagaa

SEQ ID NO: 6219916 - DNA, 15 bp, Homo sapiens
gaagagtcatgtggg

SEQ ID NO: 6219917 - DNA, 13 bp, Homo sapiens
gaagagtcatttt

SEQ ID NO: 6219918 - DNA, 15 bp, Homo sapiens
gaagagtccaggaag

SEQ ID NO: 6219919 - DNA, 14 bp, Homo sapiens
gaagagtgaaatac

SEQ ID NO: 6219920 - DNA, 13 bp, Homo sapiens
gaagagtgaaccc

SEQ ID NO: 6219921 - DNA, 17 bp, Homo sapiens
gaagagtgaagagcatt

SEQ ID NO: 6219922 - DNA, 14 bp, Homo sapiens
gaagagtgagaggg

SEQ ID NO: 6219923 - DNA, 22 bp, Homo sapiens
gaagagtggcagctataggaaa

SEQ ID NO: 6219924 - DNA, 21 bp, Homo sapiens
gaagagtgtggagtcattctc

SEQ ID NO: 6219925 - DNA, 13 bp, Homo sapiens
gaagagtgtgtgt

SEQ ID NO: 6219926 - DNA, 20 bp, Homo sapiens
gaagagttcccttgaaactt

SEQ ID NO: 6219927 - DNA, 21 bp, Homo sapiens
gaagagttcccttgaaacttt

SEQ ID NO: 6219928 - DNA, 23 bp, Homo sapiens
gaagagttgaggaactgtacaga

SEQ ID NO: 6219929 - DNA, 22 bp, Homo sapiens
gaagagttgccccgtctctgtt

SEQ ID NO: 6219930 - DNA, 20 bp, Homo sapiens
gaagagtttaaagagaaaag

SEQ ID NO: 6219931 - DNA, 20 bp, Homo sapiens
gaagagtttgtaaatgactt

SEQ ID NO: 6219932 - DNA, 15 bp, Homo sapiens
gaagataaatgcttt

SEQ ID NO: 6219933 - DNA, 14 bp, Homo sapiens
gaagataagttgga

SEQ ID NO: 6219934 - DNA, 18 bp, Homo sapiens
gaagataagttggaaaca

SEQ ID NO: 6219935 - DNA, 17 bp, Homo sapiens
gaagataattgttgaaa

SEQ ID NO: 6219936 - DNA, 15 bp, Homo sapiens
gaagataatttgcat

SEQ ID NO: 6219937 - DNA, 14 bp, Homo sapiens
gagtgcactgacct

SEQ ID NO: 6219938 - DNA, 18 bp, Homo sapiens
gagtgcagaacacctggc

SEQ ID NO: 6219939 - DNA, 20 bp, Homo sapiens
gagtgcagaacacctggccg

SEQ ID NO: 6219940 - DNA, 15 bp, Homo sapiens
gagtgcagacaccta

SEQ ID NO: 6219941 - DNA, 13 bp, Homo sapiens
gagtgcagaggcg

SEQ ID NO: 6219942 - DNA, 16 bp, Homo sapiens
gagtgcagccaaaggg

SEQ ID NO: 6219943 - DNA, 15 bp, Homo sapiens
gagtgcaggcccacc

SEQ ID NO: 6219944 - DNA, 17 bp, Homo sapiens
gagtgcaggcctgctca

SEQ ID NO: 6219945 - DNA, 17 bp, Homo sapiens
gagtgcaggtgcagttt

SEQ ID NO: 6219946 - DNA, 18 bp, Homo sapiens
gagtgcagtgagccgaga

SEQ ID NO: 6219947 - DNA, 22 bp, Homo sapiens
gagtgcagtggcgcaatcttaa

SEQ ID NO: 6219948 - DNA, 14 bp, Homo sapiens
gagtgcataaataa

SEQ ID NO: 6219949 - DNA, 14 bp, Homo sapiens
gagtgcatggccac

SEQ ID NO: 6219950 - DNA, 15 bp, Homo sapiens
gagtgccacgtggcc

SEQ ID NO: 6219951 - DNA, 18 bp, Homo sapiens
gagtgccacgtggccgct

SEQ ID NO: 6219952 - DNA, 23 bp, Homo sapiens
gagtgccacgtggccgctgccca

SEQ ID NO: 6219953 - DNA, 13 bp, Homo sapiens
gagtgccaggacc

SEQ ID NO: 6219954 - DNA, 20 bp, Homo sapiens
gagtgccaggaccagcctgt

SEQ ID NO: 6219955 - DNA, 14 bp, Homo sapiens
gagtgccaggactc

SEQ ID NO: 6219956 - DNA, 23 bp, Homo sapiens
gagtgccataccttctcccaggc

SEQ ID NO: 6219957 - DNA, 23 bp, Homo sapiens
gagtgcccaccctgggagacaga

SEQ ID NO: 6219958 - DNA, 14 bp, Homo sapiens
gagtgcccagcaga

SEQ ID NO: 6219959 - DNA, 18 bp, Homo sapiens
gagtgcccagcagaggtt

SEQ ID NO: 6219960 - DNA, 15 bp, Homo sapiens
gagtgcccatggggt

SEQ ID NO: 6219961 - DNA, 14 bp, Homo sapiens
gagtgccccacctg

SEQ ID NO: 6219962 - DNA, 19 bp, Homo sapiens
gagtgccccacctgccact

SEQ ID NO: 6219963 - DNA, 19 bp, Homo sapiens
gagtgccccactgcactcc

SEQ ID NO: 6219964 - DNA, 13 bp, Homo sapiens
gagtgccccagaa

SEQ ID NO: 6219965 - DNA, 13 bp, Homo sapiens
gagtgcccctgca

SEQ ID NO: 6219966 - DNA, 14 bp, Homo sapiens
gagtgccctgcagg

SEQ ID NO: 6219967 - DNA, 14 bp, Homo sapiens
gagtgcctggagtc

SEQ ID NO: 6219968 - DNA, 18 bp, Homo sapiens
gagtgccttacacaatgg

SEQ ID NO: 6219969 - DNA, 21 bp, Homo sapiens
gagtgccttatttcctttcca

SEQ ID NO: 6219970 - DNA, 16 bp, Homo sapiens
gagtgccttctgtggg

SEQ ID NO: 6219971 - DNA, 15 bp, Homo sapiens
gagtgcgaccaccac

SEQ ID NO: 6219972 - DNA, 16 bp, Homo sapiens
gagtgcgaccaccact

SEQ ID NO: 6219973 - DNA, 23 bp, Homo sapiens
gagtgcggcgtggagactggcag

SEQ ID NO: 6219974 - DNA, 15 bp, Homo sapiens
gagtgcggtggtgtg

SEQ ID NO: 6219975 - DNA, 13 bp, Homo sapiens
gagtgcgtctgag

SEQ ID NO: 6219976 - DNA, 15 bp, Homo sapiens
gagtgcgtggtgcga

SEQ ID NO: 6219977 - DNA, 15 bp, Homo sapiens
gagtgcgtgtgtgtg

SEQ ID NO: 6219978 - DNA, 14 bp, Homo sapiens
gagtgctatgtgtg

SEQ ID NO: 6219979 - DNA, 24 bp, Homo sapiens
gagtgctcaacctacagtggaggg

SEQ ID NO: 6219980 - DNA, 21 bp, Homo sapiens
gagtgctcagtagtcagactg

SEQ ID NO: 6219981 - DNA, 19 bp, Homo sapiens
gagtgctgaaggaatggaa

SEQ ID NO: 6219982 - DNA, 22 bp, Homo sapiens
gagtgctgattcaaaccaaagc

SEQ ID NO: 6219983 - DNA, 13 bp, Homo sapiens
gagtgctgcagct

SEQ ID NO: 6219984 - DNA, 20 bp, Homo sapiens
gagtgctgcttgtgcctccc

SEQ ID NO: 6219985 - DNA, 22 bp, Homo sapiens
gagtgctggaatggggacctgg

SEQ ID NO: 6219986 - DNA, 13 bp, Homo sapiens
gagtgctggcact

SEQ ID NO: 6219987 - DNA, 22 bp, Homo sapiens
gagtgctggctcacagtacagc

SEQ ID NO: 6219988 - DNA, 13 bp, Homo sapiens
gagtgctgtgaga

SEQ ID NO: 6219989 - DNA, 18 bp, Homo sapiens
gagtgcttgcttttcatg

SEQ ID NO: 6219990 - DNA, 18 bp, Homo sapiens
gagtgcttgttagagaga

SEQ ID NO: 6219991 - DNA, 13 bp, Homo sapiens
gagtgctttaaaa

SEQ ID NO: 6219992 - DNA, 16 bp, Homo sapiens
gagtggaaagtcacct

SEQ ID NO: 6219993 - DNA, 19 bp, Homo sapiens
gagtggaaattacccactg

SEQ ID NO: 6219994 - DNA, 19 bp, Homo sapiens
gagtggaatagtatcctcc

SEQ ID NO: 6219995 - DNA, 23 bp, Homo sapiens
gagtggaatagtatcctccaggt

SEQ ID NO: 6219996 - DNA, 17 bp, Homo sapiens
gagtggaatcaagttct

SEQ ID NO: 6219997 - DNA, 13 bp, Homo sapiens
gagtggacagcag

SEQ ID NO: 6219998 - DNA, 15 bp, Homo sapiens
gagtggacagcagct

SEQ ID NO: 6219999 - DNA, 17 bp, Homo sapiens
gagtggacagcagctgg

SEQ ID NO: 6220000 - DNA, 16 bp, Homo sapiens
gagtggacgctgtcca

SEQ ID NO: 6220001 - DNA, 18 bp, Homo sapiens
gagtggactcttccctct

SEQ ID NO: 6220002 - DNA, 14 bp, Homo sapiens
gagtggactgcatt

SEQ ID NO: 6220003 - DNA, 19 bp, Homo sapiens
gagtggagagaagctcttc

SEQ ID NO: 6220004 - DNA, 17 bp, Homo sapiens
gagtggagcccagggtg

SEQ ID NO: 6220005 - DNA, 21 bp, Homo sapiens
gagtggagcccagggtgctgg

SEQ ID NO: 6220006 - DNA, 13 bp, Homo sapiens
gagtggaggaagc

SEQ ID NO: 6220007 - DNA, 20 bp, Homo sapiens
gagtggaggtttatagttaa

SEQ ID NO: 6220008 - DNA, 18 bp, Homo sapiens
gagtggagtggaagaaga

SEQ ID NO: 6220009 - DNA, 16 bp, Homo sapiens
gagtggatctccaagg

SEQ ID NO: 6220010 - DNA, 17 bp, Homo sapiens
gagtggatctccaagga

SEQ ID NO: 6220011 - DNA, 22 bp, Homo sapiens
gagtggatctccaaggaccagg

SEQ ID NO: 6220012 - DNA, 18 bp, Homo sapiens
gagtggatgatgtttcgt

SEQ ID NO: 6220013 - DNA, 16 bp, Homo sapiens
gagtggatgctgtgct

SEQ ID NO: 6220014 - DNA, 12 bp, Homo sapiens
gagtggatggat

SEQ ID NO: 6220015 - DNA, 14 bp, Homo sapiens
gagtggatggatgg

SEQ ID NO: 6220016 - DNA, 18 bp, Homo sapiens
gagtggatggatggacag

SEQ ID NO: 6220017 - DNA, 16 bp, Homo sapiens
gagtggcacttctgcc

SEQ ID NO: 6220018 - DNA, 18 bp, Homo sapiens
gagtggcacttctgcctt

SEQ ID NO: 6220019 - DNA, 15 bp, Homo sapiens
gagtggcagcagccc

SEQ ID NO: 6220020 - DNA, 19 bp, Homo sapiens
gagtggcagccaagagcca

SEQ ID NO: 6220021 - DNA, 22 bp, Homo sapiens
gagtggcagcccagccagcgtc

SEQ ID NO: 6220022 - DNA, 21 bp, Homo sapiens
gagtggcagctgtcccctctc

SEQ ID NO: 6220023 - DNA, 16 bp, Homo sapiens
gagtggcaggggacag

SEQ ID NO: 6220024 - DNA, 23 bp, Homo sapiens
gagtggcaggggacaggagtcca

SEQ ID NO: 6220025 - DNA, 20 bp, Homo sapiens
gagtggcatggccaccacca

SEQ ID NO: 6220026 - DNA, 23 bp, Homo sapiens
gagtggcattggcagcaggtgct

SEQ ID NO: 6220027 - DNA, 17 bp, Homo sapiens
gagtggccacggcccag

SEQ ID NO: 6220028 - DNA, 23 bp, Homo sapiens
gagtggccacggcccagggaggg

SEQ ID NO: 6220029 - DNA, 11 bp, Homo sapiens
gagtggccact

SEQ ID NO: 6220030 - DNA, 17 bp, Homo sapiens
gagtggccagccagtgc

SEQ ID NO: 6220031 - DNA, 17 bp, Homo sapiens
gagtggccagcgccagg

SEQ ID NO: 6220032 - DNA, 10 bp, Homo sapiens
gagtggccca

SEQ ID NO: 6220033 - DNA, 20 bp, Homo sapiens
gagtggccccggctgcatga

SEQ ID NO: 6220034 - DNA, 21 bp, Homo sapiens
gagtggcccctcacctgggcc

SEQ ID NO: 6220035 - DNA, 12 bp, Homo sapiens
gagtggccctga

SEQ ID NO: 6220036 - DNA, 14 bp, Homo sapiens
gagtggcctagagc

SEQ ID NO: 6220037 - DNA, 18 bp, Homo sapiens
gagtggcctcatttcact

SEQ ID NO: 6220038 - DNA, 14 bp, Homo sapiens
gagtggcctccctg

SEQ ID NO: 6220039 - DNA, 15 bp, Homo sapiens
gagtggcctccctgc

SEQ ID NO: 6220040 - DNA, 13 bp, Homo sapiens
gagtggcctggcc

SEQ ID NO: 6220041 - DNA, 18 bp, Homo sapiens
gagtggcctggccaggag

SEQ ID NO: 6220042 - DNA, 17 bp, Homo sapiens
gagtggcctgggtccca

SEQ ID NO: 6220043 - DNA, 16 bp, Homo sapiens
gagtggcctgtagtcc

SEQ ID NO: 6220044 - DNA, 13 bp, Homo sapiens
gagtggcctgtga

SEQ ID NO: 6220045 - DNA, 13 bp, Homo sapiens
gagtggcggggcc

SEQ ID NO: 6220046 - DNA, 17 bp, Homo sapiens
gagtggcgtgagctgcc

SEQ ID NO: 6220047 - DNA, 19 bp, Homo sapiens
gagtggcgtggcctcccca

SEQ ID NO: 6220048 - DNA, 15 bp, Homo sapiens
gagtggctcactggc

SEQ ID NO: 6220049 - DNA, 16 bp, Homo sapiens
gagtggctcgccaggc

SEQ ID NO: 6220050 - DNA, 19 bp, Homo sapiens
gagtggctgaccaggccct

SEQ ID NO: 6220051 - DNA, 19 bp, Homo sapiens
gagtggctgccggaggagc

SEQ ID NO: 6220052 - DNA, 17 bp, Homo sapiens
gagtggctggggcatgg

SEQ ID NO: 6220053 - DNA, 12 bp, Homo sapiens
gagtgggaagcc

SEQ ID NO: 6220054 - DNA, 21 bp, Homo sapiens
gagtgggaagggagcattgca

SEQ ID NO: 6220055 - DNA, 23 bp, Homo sapiens
gagtgggacaccattctgaattt

SEQ ID NO: 6220056 - DNA, 15 bp, Homo sapiens
gagtgggacagacag

SEQ ID NO: 6220057 - DNA, 21 bp, Homo sapiens
gagtgggacagacagcagctg

SEQ ID NO: 6220058 - DNA, 15 bp, Homo sapiens
gagtgggagaggaag

SEQ ID NO: 6220059 - DNA, 18 bp, Homo sapiens
gagtgggagaggctggga

SEQ ID NO: 6220060 - DNA, 21 bp, Homo sapiens
gagtgggaggcgtgcccccct

SEQ ID NO: 6220061 - DNA, 17 bp, Homo sapiens
gagtgggcgcagtggct

SEQ ID NO: 6220062 - DNA, 13 bp, Homo sapiens
gagtggggaggag

SEQ ID NO: 6220063 - DNA, 16 bp, Homo sapiens
gagtggggaggagaga

SEQ ID NO: 6220064 - DNA, 19 bp, Homo sapiens
gagtggggaggagagaggg

SEQ ID NO: 6220065 - DNA, 14 bp, Homo sapiens
gagtggggcagtag

SEQ ID NO: 6220066 - DNA, 21 bp, Homo sapiens
gagtggggcctttgccagcag

SEQ ID NO: 6220067 - DNA, 23 bp, Homo sapiens
gagtggggcctttgccagcagag

SEQ ID NO: 6220068 - DNA, 15 bp, Homo sapiens
gagtggggcttcctg

SEQ ID NO: 6220069 - DNA, 18 bp, Homo sapiens
gagtggggcttcctgggc

SEQ ID NO: 6220070 - DNA, 22 bp, Homo sapiens
gagtgggggagagcaggctggc

SEQ ID NO: 6220071 - DNA, 16 bp, Homo sapiens
gagtggggggacagag

SEQ ID NO: 6220072 - DNA, 18 bp, Homo sapiens
gagtggggggaggaagca

SEQ ID NO: 6220073 - DNA, 24 bp, Homo sapiens
gagtggggtagaggaagacgagac

SEQ ID NO: 6220074 - DNA, 22 bp, Homo sapiens
gagtggggttgggggacagcct

SEQ ID NO: 6220075 - DNA, 18 bp, Homo sapiens
gagtgggtaaatcaggga

SEQ ID NO: 6220076 - DNA, 19 bp, Homo sapiens
gagtgggtgacaagagcct

SEQ ID NO: 6220077 - DNA, 20 bp, Homo sapiens
gagtgggtgacaagagcctg

SEQ ID NO: 6220078 - DNA, 21 bp, Homo sapiens
gagtgggtgacaagagcctga

SEQ ID NO: 6220079 - DNA, 18 bp, Homo sapiens
gagtgggtgcgtggtata

SEQ ID NO: 6220080 - DNA, 15 bp, Homo sapiens
gagtgggttgatttc

SEQ ID NO: 6220081 - DNA, 23 bp, Homo sapiens
gagtgggttttgtccattattaa

SEQ ID NO: 6220082 - DNA, 20 bp, Homo sapiens
gagtggtaaaaaagaaatga

SEQ ID NO: 6220083 - DNA, 21 bp, Homo sapiens
gagtggtcactggtcagggca

SEQ ID NO: 6220084 - DNA, 23 bp, Homo sapiens
gagtggtccacattctgctgccc

SEQ ID NO: 6220085 - DNA, 19 bp, Homo sapiens
gagtggtggctcatgcctg

SEQ ID NO: 6220086 - DNA, 11 bp, Homo sapiens
gagtggtggtt

SEQ ID NO: 6220087 - DNA, 13 bp, Homo sapiens
gagtggtggttcc

SEQ ID NO: 6220088 - DNA, 13 bp, Homo sapiens
gagtggttaggca

SEQ ID NO: 6220089 - DNA, 14 bp, Homo sapiens
gagtggttctcatt

SEQ ID NO: 6220090 - DNA, 21 bp, Homo sapiens
gagtggttgggctgtgcctgg

SEQ ID NO: 6220091 - DNA, 21 bp, Homo sapiens
gagtggtttaggctatttgta

SEQ ID NO: 6220092 - DNA, 14 bp, Homo sapiens
gagtgtaacatcca

SEQ ID NO: 6220093 - DNA, 13 bp, Homo sapiens
gagtgtacaagta

SEQ ID NO: 6220094 - DNA, 15 bp, Homo sapiens
gagtgtacagagtgg

SEQ ID NO: 6220095 - DNA, 18 bp, Homo sapiens
gagtgtactagtagttaa

SEQ ID NO: 6220096 - DNA, 18 bp, Homo sapiens
gagtgtactgtgcctggt

SEQ ID NO: 6220097 - DNA, 16 bp, Homo sapiens
gagtgtagaagcattc

SEQ ID NO: 6220098 - DNA, 22 bp, Homo sapiens
gagtgtagcctaaagggcaggg

SEQ ID NO: 6220099 - DNA, 20 bp, Homo sapiens
gagtgtagctgtaagggcag

SEQ ID NO: 6220100 - DNA, 13 bp, Homo sapiens
gagtgtagctgtg

SEQ ID NO: 6220101 - DNA, 14 bp, Homo sapiens
gagtgtagctgtga

SEQ ID NO: 6220102 - DNA, 15 bp, Homo sapiens
gagtgtagctgtgaa

SEQ ID NO: 6220103 - DNA, 14 bp, Homo sapiens
gagtgtatgcatac

SEQ ID NO: 6220104 - DNA, 16 bp, Homo sapiens
gagtgtatgtatacac

SEQ ID NO: 6220105 - DNA, 21 bp, Homo sapiens
gagtgtatgtatacacacaca

SEQ ID NO: 6220106 - DNA, 17 bp, Homo sapiens
gagtgtatgtgccagta

SEQ ID NO: 6220107 - DNA, 14 bp, Homo sapiens
gagtgtattctatt

SEQ ID NO: 6220108 - DNA, 23 bp, Homo sapiens
gagtgtatttttgtaattcctct

SEQ ID NO: 6220109 - DNA, 17 bp, Homo sapiens
gagtgtcaaccagacag

SEQ ID NO: 6220110 - DNA, 13 bp, Homo sapiens
gagtgtcaggctc

SEQ ID NO: 6220111 - DNA, 15 bp, Homo sapiens
gagtgtccatagata

SEQ ID NO: 6220112 - DNA, 23 bp, Homo sapiens
gagtgtcctaggagtatcctcat

SEQ ID NO: 6220113 - DNA, 14 bp, Homo sapiens
gagtgtcctgctac

SEQ ID NO: 6220114 - DNA, 19 bp, Homo sapiens
gagtgtccttagtgtataa

SEQ ID NO: 6220115 - DNA, 17 bp, Homo sapiens
gagtgtctctgataaaa

SEQ ID NO: 6220116 - DNA, 16 bp, Homo sapiens
gaagataattttatgt

SEQ ID NO: 6220117 - DNA, 22 bp, Homo sapiens
gaagatacacattacagccagg

SEQ ID NO: 6220118 - DNA, 15 bp, Homo sapiens
gaagatactgaaata

SEQ ID NO: 6220119 - DNA, 15 bp, Homo sapiens
gaagatagctctctg

SEQ ID NO: 6220120 - DNA, 19 bp, Homo sapiens
gaagataggacgtatttat

SEQ ID NO: 6220121 - DNA, 18 bp, Homo sapiens
gaagataggctctgcaca

SEQ ID NO: 6220122 - DNA, 19 bp, Homo sapiens
gaagatataacattcagtt

SEQ ID NO: 6220123 - DNA, 22 bp, Homo sapiens
gaagatataactattgcccagg

SEQ ID NO: 6220124 - DNA, 17 bp, Homo sapiens
gaagatatatttcactt

SEQ ID NO: 6220125 - DNA, 14 bp, Homo sapiens
gaagatatcttgaa

SEQ ID NO: 6220126 - DNA, 17 bp, Homo sapiens
gaagatatgccactaac

SEQ ID NO: 6220127 - DNA, 22 bp, Homo sapiens
gaagatatgccactaacttcta

SEQ ID NO: 6220128 - DNA, 21 bp, Homo sapiens
gaagatattatttgtcttaaa

SEQ ID NO: 6220129 - DNA, 23 bp, Homo sapiens
gaagatattgggaaggaaatata

SEQ ID NO: 6220130 - DNA, 16 bp, Homo sapiens
gaagatcacgctcccc

SEQ ID NO: 6220131 - DNA, 14 bp, Homo sapiens
gaagatcactgtag

SEQ ID NO: 6220132 - DNA, 18 bp, Homo sapiens
gaagatcagagctgcagc

SEQ ID NO: 6220133 - DNA, 14 bp, Homo sapiens
gaagatcagatgca

SEQ ID NO: 6220134 - DNA, 15 bp, Homo sapiens
gaagatcatggacct

SEQ ID NO: 6220135 - DNA, 17 bp, Homo sapiens
gaagatcattgccatca

SEQ ID NO: 6220136 - DNA, 19 bp, Homo sapiens
gaagatcattttgaaattg

SEQ ID NO: 6220137 - DNA, 20 bp, Homo sapiens
gaagatccccaactgctcca

SEQ ID NO: 6220138 - DNA, 15 bp, Homo sapiens
gaagatcccctcagg

SEQ ID NO: 6220139 - DNA, 13 bp, Homo sapiens
gaagatcctaccc

SEQ ID NO: 6220140 - DNA, 20 bp, Homo sapiens
gaagatcctgtgaggagccc

SEQ ID NO: 6220141 - DNA, 15 bp, Homo sapiens
gaagatcgcatggca

SEQ ID NO: 6220142 - DNA, 18 bp, Homo sapiens
gaagatcgttagtatcta

SEQ ID NO: 6220143 - DNA, 20 bp, Homo sapiens
gaagatctaccccagggaga

SEQ ID NO: 6220144 - DNA, 21 bp, Homo sapiens
gaagatctaccccagggagaa

SEQ ID NO: 6220145 - DNA, 20 bp, Homo sapiens
gaagatctacctgcaacaca

SEQ ID NO: 6220146 - DNA, 19 bp, Homo sapiens
gaagatctctgcagggccg

SEQ ID NO: 6220147 - DNA, 22 bp, Homo sapiens
gaagatctctgcagggccgcca

SEQ ID NO: 6220148 - DNA, 13 bp, Homo sapiens
gaagatctgtaat

SEQ ID NO: 6220149 - DNA, 20 bp, Homo sapiens
gaagatgaaagattcagtga

SEQ ID NO: 6220150 - DNA, 14 bp, Homo sapiens
gaagatgaaatata

SEQ ID NO: 6220151 - DNA, 12 bp, Homo sapiens
gaagatgaaatt

SEQ ID NO: 6220152 - DNA, 13 bp, Homo sapiens
gaagatgaaattt

SEQ ID NO: 6220153 - DNA, 13 bp, Homo sapiens
gaagatgaagaga

SEQ ID NO: 6220154 - DNA, 14 bp, Homo sapiens
gaagatgaagagaa

SEQ ID NO: 6220155 - DNA, 18 bp, Homo sapiens
gaagatgaatcagtatga

SEQ ID NO: 6220156 - DNA, 15 bp, Homo sapiens
gaagatgaatggcgt

SEQ ID NO: 6220157 - DNA, 15 bp, Homo sapiens
gaagatgaatggtct

SEQ ID NO: 6220158 - DNA, 18 bp, Homo sapiens
gaagatgaccggtttgga

SEQ ID NO: 6220159 - DNA, 12 bp, Homo sapiens
gaagatgacctg

SEQ ID NO: 6220160 - DNA, 18 bp, Homo sapiens
gaagatgacctgccccaa

SEQ ID NO: 6220161 - DNA, 14 bp, Homo sapiens
gaagatgactgagg

SEQ ID NO: 6220162 - DNA, 12 bp, Homo sapiens
gaagatgagcct

SEQ ID NO: 6220163 - DNA, 13 bp, Homo sapiens
gaagatgcagctc

SEQ ID NO: 6220164 - DNA, 18 bp, Homo sapiens
gaagatgcagttcaaaaa

SEQ ID NO: 6220165 - DNA, 15 bp, Homo sapiens
gaagatgcattttaa

SEQ ID NO: 6220166 - DNA, 19 bp, Homo sapiens
gaagatgcattttaaatgt

SEQ ID NO: 6220167 - DNA, 13 bp, Homo sapiens
gaagatgccaagg

SEQ ID NO: 6220168 - DNA, 12 bp, Homo sapiens
gaagatgccctc

SEQ ID NO: 6220169 - DNA, 17 bp, Homo sapiens
gaagatgcctgttaatt

SEQ ID NO: 6220170 - DNA, 20 bp, Homo sapiens
gaagatgctcatctgagcca

SEQ ID NO: 6220171 - DNA, 16 bp, Homo sapiens
gaagatgctggcccca

SEQ ID NO: 6220172 - DNA, 15 bp, Homo sapiens
gaagatgctgtaaat

SEQ ID NO: 6220173 - DNA, 21 bp, Homo sapiens
gaagatggagacaccctctgg

SEQ ID NO: 6220174 - DNA, 18 bp, Homo sapiens
gaagatggatatgaccag

SEQ ID NO: 6220175 - DNA, 16 bp, Homo sapiens
gaagatggatgtaatt

SEQ ID NO: 6220176 - DNA, 23 bp, Homo sapiens
gaagatggcactgtccagggccc

SEQ ID NO: 6220177 - DNA, 20 bp, Homo sapiens
gaagatggcatcctgtgaag

SEQ ID NO: 6220178 - DNA, 19 bp, Homo sapiens
gaagatgggaggtggaagc

SEQ ID NO: 6220179 - DNA, 12 bp, Homo sapiens
gaagatgggggc

SEQ ID NO: 6220180 - DNA, 18 bp, Homo sapiens
gaagatgggggctggagg

SEQ ID NO: 6220181 - DNA, 17 bp, Homo sapiens
gaagatggtagcagata

SEQ ID NO: 6220182 - DNA, 17 bp, Homo sapiens
gaagatggtttcaattc

SEQ ID NO: 6220183 - DNA, 22 bp, Homo sapiens
gaagatggtttcaattcagatt

SEQ ID NO: 6220184 - DNA, 12 bp, Homo sapiens
gaagatgtaagg

SEQ ID NO: 6220185 - DNA, 18 bp, Homo sapiens
gaagatgtagaggagaaa

SEQ ID NO: 6220186 - DNA, 18 bp, Homo sapiens
gaagatgtatgctttgaa

SEQ ID NO: 6220187 - DNA, 18 bp, Homo sapiens
gaagatgtattcagagcc

SEQ ID NO: 6220188 - DNA, 16 bp, Homo sapiens
gaagatgtctcctcaa

SEQ ID NO: 6220189 - DNA, 23 bp, Homo sapiens
gaagatgtctcctcaagcctgtg

SEQ ID NO: 6220190 - DNA, 15 bp, Homo sapiens
gaagatgtgatttat

SEQ ID NO: 6220191 - DNA, 15 bp, Homo sapiens
gaagatgtgtaaaca

SEQ ID NO: 6220192 - DNA, 21 bp, Homo sapiens
gaagatgttaattacttttga

SEQ ID NO: 6220193 - DNA, 21 bp, Homo sapiens
gaagatgttcaatagaacatg

SEQ ID NO: 6220194 - DNA, 13 bp, Homo sapiens
gaagatgtttaac

SEQ ID NO: 6220195 - DNA, 13 bp, Homo sapiens
gaagatgtttact

SEQ ID NO: 6220196 - DNA, 11 bp, Homo sapiens
gaagattaaaa

SEQ ID NO: 6220197 - DNA, 17 bp, Homo sapiens
gaagattaagacagaga

SEQ ID NO: 6220198 - DNA, 20 bp, Homo sapiens
gaagattaggagaaacacat

SEQ ID NO: 6220199 - DNA, 18 bp, Homo sapiens
gaagattataaaagccaa

SEQ ID NO: 6220200 - DNA, 13 bp, Homo sapiens
gaagattatatga

SEQ ID NO: 6220201 - DNA, 18 bp, Homo sapiens
gaagattcagcagtgtct

SEQ ID NO: 6220202 - DNA, 16 bp, Homo sapiens
gaagattcccacccct

SEQ ID NO: 6220203 - DNA, 16 bp, Homo sapiens
gaagattctcgcccct

SEQ ID NO: 6220204 - DNA, 19 bp, Homo sapiens
gaagattctcgccccttcc

SEQ ID NO: 6220205 - DNA, 22 bp, Homo sapiens
gaagattctcgccccttccctc

SEQ ID NO: 6220206 - DNA, 18 bp, Homo sapiens
gaagattctctattggct

SEQ ID NO: 6220207 - DNA, 20 bp, Homo sapiens
gaagattcttgtatttatta

SEQ ID NO: 6220208 - DNA, 13 bp, Homo sapiens
gaagattgtgaat

SEQ ID NO: 6220209 - DNA, 12 bp, Homo sapiens
gaagatttaatt

SEQ ID NO: 6220210 - DNA, 17 bp, Homo sapiens
gaagatttgaaaacaaa

SEQ ID NO: 6220211 - DNA, 20 bp, Homo sapiens
gaagatttgatgctggagag

SEQ ID NO: 6220212 - DNA, 19 bp, Homo sapiens
gaagcaaaaacgaaagctg

SEQ ID NO: 6220213 - DNA, 20 bp, Homo sapiens
gaagcaaaattataagaaga

SEQ ID NO: 6220214 - DNA, 15 bp, Homo sapiens
gaagcaaacacatta

SEQ ID NO: 6220215 - DNA, 15 bp, Homo sapiens
gaagcaaagacaaaa

SEQ ID NO: 6220216 - DNA, 22 bp, Homo sapiens
gaagcaaagacaaaagaaactt

SEQ ID NO: 6220217 - DNA, 22 bp, Homo sapiens
gaagcaaagtgcccatggtggc

SEQ ID NO: 6220218 - DNA, 16 bp, Homo sapiens
gaagcaaagtgctgga

SEQ ID NO: 6220219 - DNA, 20 bp, Homo sapiens
gaagcaaagttcaacttatt

SEQ ID NO: 6220220 - DNA, 23 bp, Homo sapiens
gaagcaaagttcaacttatttca

SEQ ID NO: 6220221 - DNA, 14 bp, Homo sapiens
gaagcaaataaata

SEQ ID NO: 6220222 - DNA, 20 bp, Homo sapiens
gaagcaaatacaattcacag

SEQ ID NO: 6220223 - DNA, 16 bp, Homo sapiens
gaagcaaataccaaag

SEQ ID NO: 6220224 - DNA, 17 bp, Homo sapiens
gaagcaaatcgaatgaa

SEQ ID NO: 6220225 - DNA, 12 bp, Homo sapiens
gaagcaaatgtg

SEQ ID NO: 6220226 - DNA, 23 bp, Homo sapiens
gaagcaacagcttcagaaagagc

SEQ ID NO: 6220227 - DNA, 15 bp, Homo sapiens
gaagcaaccaccaca

SEQ ID NO: 6220228 - DNA, 17 bp, Homo sapiens
gaagcaacgtgttaatt

SEQ ID NO: 6220229 - DNA, 21 bp, Homo sapiens
gaagcaactccgtgtgcctgg

SEQ ID NO: 6220230 - DNA, 22 bp, Homo sapiens
gaagcaactgaagatccacaaa

SEQ ID NO: 6220231 - DNA, 14 bp, Homo sapiens
gaagcaagaaagcc

SEQ ID NO: 6220232 - DNA, 13 bp, Homo sapiens
gaagcaagaagaa

SEQ ID NO: 6220233 - DNA, 18 bp, Homo sapiens
gaagcaagaatggaggaa

SEQ ID NO: 6220234 - DNA, 13 bp, Homo sapiens
gaagcaagcaggg

SEQ ID NO: 6220235 - DNA, 15 bp, Homo sapiens
gaagcaagcaggggt

SEQ ID NO: 6220236 - DNA, 13 bp, Homo sapiens
gaagcaagccaga

SEQ ID NO: 6220237 - DNA, 14 bp, Homo sapiens
gaagcaagccagac

SEQ ID NO: 6220238 - DNA, 18 bp, Homo sapiens
gaagcaagccggcagaaa

SEQ ID NO: 6220239 - DNA, 21 bp, Homo sapiens
gaagcaagctggatgcagtgg

SEQ ID NO: 6220240 - DNA, 22 bp, Homo sapiens
gaagcaagctgtgttacttgaa

SEQ ID NO: 6220241 - DNA, 16 bp, Homo sapiens
gaagcaagcttaatgg

SEQ ID NO: 6220242 - DNA, 13 bp, Homo sapiens
gaagcaaggaaga

SEQ ID NO: 6220243 - DNA, 18 bp, Homo sapiens
gaagcaaggaagatatac

SEQ ID NO: 6220244 - DNA, 13 bp, Homo sapiens
gaagcaaggaagt

SEQ ID NO: 6220245 - DNA, 20 bp, Homo sapiens
gaagcaagtaaaaaggctaa

SEQ ID NO: 6220246 - DNA, 19 bp, Homo sapiens
gaagcaataaagaagagtg

SEQ ID NO: 6220247 - DNA, 21 bp, Homo sapiens
gaagcaataactccaagcaga

SEQ ID NO: 6220248 - DNA, 17 bp, Homo sapiens
gaagcaataataaagta

SEQ ID NO: 6220249 - DNA, 14 bp, Homo sapiens
gaagcaatcagcaa

SEQ ID NO: 6220250 - DNA, 16 bp, Homo sapiens
gaagcaatcagcaaac

SEQ ID NO: 6220251 - DNA, 22 bp, Homo sapiens
gaagcaatcagcaaacacaata

SEQ ID NO: 6220252 - DNA, 18 bp, Homo sapiens
gaagcaatctttgaaata

SEQ ID NO: 6220253 - DNA, 19 bp, Homo sapiens
gaagcaatctttgaaataa

SEQ ID NO: 6220254 - DNA, 20 bp, Homo sapiens
gaagcaatgcttcatccctt

SEQ ID NO: 6220255 - DNA, 16 bp, Homo sapiens
gaagcacaaaagacaa

SEQ ID NO: 6220256 - DNA, 14 bp, Homo sapiens
gaagcacaaaggaa

SEQ ID NO: 6220257 - DNA, 15 bp, Homo sapiens
gaagcacaagaagtg

SEQ ID NO: 6220258 - DNA, 19 bp, Homo sapiens
gaagcacaagaagtgggag

SEQ ID NO: 6220259 - DNA, 20 bp, Homo sapiens
gaagcacaagttcctggttt

SEQ ID NO: 6220260 - DNA, 14 bp, Homo sapiens
gaagcacacctaca

SEQ ID NO: 6220261 - DNA, 22 bp, Homo sapiens
gaagcacactgcagggctgctg

SEQ ID NO: 6220262 - DNA, 17 bp, Homo sapiens
gaagcacagaatatttt

SEQ ID NO: 6220263 - DNA, 12 bp, Homo sapiens
gaagcacaggcc

SEQ ID NO: 6220264 - DNA, 18 bp, Homo sapiens
gaagcacaggccagggga

SEQ ID NO: 6220265 - DNA, 14 bp, Homo sapiens
gaagcacatgcctc

SEQ ID NO: 6220266 - DNA, 21 bp, Homo sapiens
gaagcacatgcctctctcagg

SEQ ID NO: 6220267 - DNA, 16 bp, Homo sapiens
gaagcaccataacttt

SEQ ID NO: 6220268 - DNA, 20 bp, Homo sapiens
gaagcacctatgaaagcaac

SEQ ID NO: 6220269 - DNA, 16 bp, Homo sapiens
gaagcacgttcactag

SEQ ID NO: 6220270 - DNA, 14 bp, Homo sapiens
gaagcactctgctg

SEQ ID NO: 6220271 - DNA, 18 bp, Homo sapiens
gaagcactgggatcacag

SEQ ID NO: 6220272 - DNA, 16 bp, Homo sapiens
gaagcactttttctgc

SEQ ID NO: 6220273 - DNA, 13 bp, Homo sapiens
gaagcagaaacaa

SEQ ID NO: 6220274 - DNA, 22 bp, Homo sapiens
gaagcagaaatatagtgcaata

SEQ ID NO: 6220275 - DNA, 12 bp, Homo sapiens
gaagcagaacct

SEQ ID NO: 6220276 - DNA, 16 bp, Homo sapiens
gaagcagaagacggga

SEQ ID NO: 6220277 - DNA, 13 bp, Homo sapiens
gaagcagaataaa

SEQ ID NO: 6220278 - DNA, 15 bp, Homo sapiens
gaagcagaataaagc

SEQ ID NO: 6220279 - DNA, 12 bp, Homo sapiens
gaagcagaatga

SEQ ID NO: 6220280 - DNA, 15 bp, Homo sapiens
gaagcagagagcaca

SEQ ID NO: 6220281 - DNA, 14 bp, Homo sapiens
gaagcagagcaaaa

SEQ ID NO: 6220282 - DNA, 12 bp, Homo sapiens
gaagcagagcac

SEQ ID NO: 6220283 - DNA, 14 bp, Homo sapiens
gaagcagaggaagg

SEQ ID NO: 6220284 - DNA, 14 bp, Homo sapiens
gaagcagaggccct

SEQ ID NO: 6220285 - DNA, 14 bp, Homo sapiens
gaagcagagggaca

SEQ ID NO: 6220286 - DNA, 11 bp, Homo sapiens
gaagcagagtg

SEQ ID NO: 6220287 - DNA, 14 bp, Homo sapiens
gaagcagccagctc

SEQ ID NO: 6220288 - DNA, 18 bp, Homo sapiens
gaagcagccccctgtggc

SEQ ID NO: 6220289 - DNA, 22 bp, Homo sapiens
gaagcagcctctccccaggtcc

SEQ ID NO: 6220290 - DNA, 12 bp, Homo sapiens
gaagcagctctt

SEQ ID NO: 6220291 - DNA, 16 bp, Homo sapiens
gaagcaggatggagct

SEQ ID NO: 6220292 - DNA, 14 bp, Homo sapiens
gaagcaggcagagc

SEQ ID NO: 6220293 - DNA, 16 bp, Homo sapiens
gaagcaggcagagcgg

SEQ ID NO: 6220294 - DNA, 19 bp, Homo sapiens
gaagcaggcagagcgggga

SEQ ID NO: 6220295 - DNA, 20 bp, Homo sapiens
gaagcaggcagagcggggag

SEQ ID NO: 6220296 - DNA, 19 bp, Homo sapiens
gaagcaggctacactgaca

SEQ ID NO: 6220297 - DNA, 15 bp, Homo sapiens
gagtgtctctgcctg

SEQ ID NO: 6220298 - DNA, 13 bp, Homo sapiens
gagtgtctgcagt

SEQ ID NO: 6220299 - DNA, 15 bp, Homo sapiens
gagtgtctttccacg

SEQ ID NO: 6220300 - DNA, 21 bp, Homo sapiens
gagtgtctttccacggagcca

SEQ ID NO: 6220301 - DNA, 14 bp, Homo sapiens
gagtgtgaaatctc

SEQ ID NO: 6220302 - DNA, 20 bp, Homo sapiens
gagtgtgaagctttgcacac

SEQ ID NO: 6220303 - DNA, 11 bp, Homo sapiens
gagtgtgaatg

SEQ ID NO: 6220304 - DNA, 21 bp, Homo sapiens
gagtgtgaccaaaagttacat

SEQ ID NO: 6220305 - DNA, 15 bp, Homo sapiens
gagtgtgagagatgg

SEQ ID NO: 6220306 - DNA, 17 bp, Homo sapiens
gagtgtgaggagagggt

SEQ ID NO: 6220307 - DNA, 13 bp, Homo sapiens
gagtgtgagggca

SEQ ID NO: 6220308 - DNA, 17 bp, Homo sapiens
gagtgtgagggcagcac

SEQ ID NO: 6220309 - DNA, 16 bp, Homo sapiens
gagtgtgcagacagcc

SEQ ID NO: 6220310 - DNA, 20 bp, Homo sapiens
gagtgtgcatggaggccctc

SEQ ID NO: 6220311 - DNA, 12 bp, Homo sapiens
gagtgtgccaga

SEQ ID NO: 6220312 - DNA, 17 bp, Homo sapiens
gagtgtgcctgaagtcc

SEQ ID NO: 6220313 - DNA, 20 bp, Homo sapiens
gagtgtgcctgaagtcccag

SEQ ID NO: 6220314 - DNA, 20 bp, Homo sapiens
gagtgtgctcaggccgggct

SEQ ID NO: 6220315 - DNA, 15 bp, Homo sapiens
gagtgtgctgctgta

SEQ ID NO: 6220316 - DNA, 23 bp, Homo sapiens
gagtgtgctgctgtaagaaatct

SEQ ID NO: 6220317 - DNA, 14 bp, Homo sapiens
gagtgtgctggagg

SEQ ID NO: 6220318 - DNA, 18 bp, Homo sapiens
gagtgtgctggaggactg

SEQ ID NO: 6220319 - DNA, 17 bp, Homo sapiens
gagtgtggaagccggag

SEQ ID NO: 6220320 - DNA, 13 bp, Homo sapiens
gagtgtggcctgg

SEQ ID NO: 6220321 - DNA, 15 bp, Homo sapiens
gagtgtggcctggat

SEQ ID NO: 6220322 - DNA, 17 bp, Homo sapiens
gagtgtgggctgccctt

SEQ ID NO: 6220323 - DNA, 17 bp, Homo sapiens
gagtgtgggtgatcaga

SEQ ID NO: 6220324 - DNA, 15 bp, Homo sapiens
gagtgtggtttcttt

SEQ ID NO: 6220325 - DNA, 19 bp, Homo sapiens
gagtgtggtttctttttga

SEQ ID NO: 6220326 - DNA, 19 bp, Homo sapiens
gagtgtgtagaaacacagc

SEQ ID NO: 6220327 - DNA, 17 bp, Homo sapiens
gagtgtgtatgccaaga

SEQ ID NO: 6220328 - DNA, 14 bp, Homo sapiens
gagtgtgtatgtca

SEQ ID NO: 6220329 - DNA, 18 bp, Homo sapiens
gagtgtgtatgtcagtgg

SEQ ID NO: 6220330 - DNA, 16 bp, Homo sapiens
gagtgtgtcagagccc

SEQ ID NO: 6220331 - DNA, 19 bp, Homo sapiens
gagtgtgtcagagcccagg

SEQ ID NO: 6220332 - DNA, 10 bp, Homo sapiens
gagtgtgtga

SEQ ID NO: 6220333 - DNA, 19 bp, Homo sapiens
gagtgtgtgcatgtgtgtg

SEQ ID NO: 6220334 - DNA, 14 bp, Homo sapiens
gagtgtgtgggcag

SEQ ID NO: 6220335 - DNA, 17 bp, Homo sapiens
gagtgtgtgggcagggt

SEQ ID NO: 6220336 - DNA, 13 bp, Homo sapiens
gagtgtgtgtgct

SEQ ID NO: 6220337 - DNA, 22 bp, Homo sapiens
gagtgtgtttgtgtgcatgaaa

SEQ ID NO: 6220338 - DNA, 23 bp, Homo sapiens
gagtgttcaaactactgtacatt

SEQ ID NO: 6220339 - DNA, 21 bp, Homo sapiens
gagtgttcattttagtgactg

SEQ ID NO: 6220340 - DNA, 18 bp, Homo sapiens
gagtgttcccgtgcctgg

SEQ ID NO: 6220341 - DNA, 13 bp, Homo sapiens
gagtgttcctgtt

SEQ ID NO: 6220342 - DNA, 19 bp, Homo sapiens
gagtgttctagttcctgga

SEQ ID NO: 6220343 - DNA, 16 bp, Homo sapiens
gagtgttgaaacggat

SEQ ID NO: 6220344 - DNA, 16 bp, Homo sapiens
gagtgttggggctggg

SEQ ID NO: 6220345 - DNA, 22 bp, Homo sapiens
gagtgtttaaatgctgtgtaca

SEQ ID NO: 6220346 - DNA, 19 bp, Homo sapiens
gagtgtttgtgtctgactc

SEQ ID NO: 6220347 - DNA, 20 bp, Homo sapiens
gagttaaaacaatgaagtgt

SEQ ID NO: 6220348 - DNA, 13 bp, Homo sapiens
gagttaaaagtta

SEQ ID NO: 6220349 - DNA, 13 bp, Homo sapiens
gagttaaaatata

SEQ ID NO: 6220350 - DNA, 17 bp, Homo sapiens
gagttaaaatgtttact

SEQ ID NO: 6220351 - DNA, 19 bp, Homo sapiens
gagttaaaatgtttactgt

SEQ ID NO: 6220352 - DNA, 12 bp, Homo sapiens
gagttaaataaa

SEQ ID NO: 6220353 - DNA, 14 bp, Homo sapiens
gagttaagaagctg

SEQ ID NO: 6220354 - DNA, 16 bp, Homo sapiens
gagttaagaagctgtt

SEQ ID NO: 6220355 - DNA, 19 bp, Homo sapiens
gagttaatgatggcagagg

SEQ ID NO: 6220356 - DNA, 16 bp, Homo sapiens
gagttacaatttggag

SEQ ID NO: 6220357 - DNA, 15 bp, Homo sapiens
gagttacagacaaag

SEQ ID NO: 6220358 - DNA, 19 bp, Homo sapiens
gagttacagcgagaggcag

SEQ ID NO: 6220359 - DNA, 20 bp, Homo sapiens
gagttacagcgagaggcaga

SEQ ID NO: 6220360 - DNA, 13 bp, Homo sapiens
gagttacagttct

SEQ ID NO: 6220361 - DNA, 19 bp, Homo sapiens
gagttacttgtctgaggcc

SEQ ID NO: 6220362 - DNA, 19 bp, Homo sapiens
gagttagaaccacagcaga

SEQ ID NO: 6220363 - DNA, 14 bp, Homo sapiens
gagttagactgttg

SEQ ID NO: 6220364 - DNA, 22 bp, Homo sapiens
gagttagcactgaactgctttt

SEQ ID NO: 6220365 - DNA, 21 bp, Homo sapiens
gagttagcatgtatgaatgta

SEQ ID NO: 6220366 - DNA, 13 bp, Homo sapiens
gagttagccaaac

SEQ ID NO: 6220367 - DNA, 13 bp, Homo sapiens
gagttagccatcc

SEQ ID NO: 6220368 - DNA, 15 bp, Homo sapiens
gagttaggtcctcac

SEQ ID NO: 6220369 - DNA, 14 bp, Homo sapiens
gagttatatgttca

SEQ ID NO: 6220370 - DNA, 18 bp, Homo sapiens
gagttatatgttcactgt

SEQ ID NO: 6220371 - DNA, 14 bp, Homo sapiens
gagttatcaggtgc

SEQ ID NO: 6220372 - DNA, 18 bp, Homo sapiens
gagttatcatgaatttta

SEQ ID NO: 6220373 - DNA, 19 bp, Homo sapiens
gagttatcatgaattttaa

SEQ ID NO: 6220374 - DNA, 18 bp, Homo sapiens
gagttatctaaaagaaat

SEQ ID NO: 6220375 - DNA, 22 bp, Homo sapiens
gagttatctaagaatacagctt

SEQ ID NO: 6220376 - DNA, 18 bp, Homo sapiens
gagttatcttctttatta

SEQ ID NO: 6220377 - DNA, 23 bp, Homo sapiens
gagttatcttctttattattcct

SEQ ID NO: 6220378 - DNA, 22 bp, Homo sapiens
gagttattatctatggaaatgt

SEQ ID NO: 6220379 - DNA, 20 bp, Homo sapiens
gagttattcataaagagaaa

SEQ ID NO: 6220380 - DNA, 17 bp, Homo sapiens
gagttattgaagcagag

SEQ ID NO: 6220381 - DNA, 18 bp, Homo sapiens
gagttattgaagcagagt

SEQ ID NO: 6220382 - DNA, 19 bp, Homo sapiens
gagttattgaagcagagtg

SEQ ID NO: 6220383 - DNA, 20 bp, Homo sapiens
gagttattgaagcagagtgg

SEQ ID NO: 6220384 - DNA, 21 bp, Homo sapiens
gagttattgaatcttaatttt

SEQ ID NO: 6220385 - DNA, 17 bp, Homo sapiens
gagttattttttgtatt

SEQ ID NO: 6220386 - DNA, 15 bp, Homo sapiens
gagttcaagaccagc

SEQ ID NO: 6220387 - DNA, 18 bp, Homo sapiens
gagttcaagaccagcctg

SEQ ID NO: 6220388 - DNA, 20 bp, Homo sapiens
gagttcaagaccagcctggc

SEQ ID NO: 6220389 - DNA, 13 bp, Homo sapiens
gagttcaatgatc

SEQ ID NO: 6220390 - DNA, 14 bp, Homo sapiens
gagttcaatgatct

SEQ ID NO: 6220391 - DNA, 12 bp, Homo sapiens
gagttcacagga

SEQ ID NO: 6220392 - DNA, 18 bp, Homo sapiens
gagttcacaggaggccag

SEQ ID NO: 6220393 - DNA, 16 bp, Homo sapiens
gagttcaccatctctt

SEQ ID NO: 6220394 - DNA, 20 bp, Homo sapiens
gagttcaccttggaagggcg

SEQ ID NO: 6220395 - DNA, 23 bp, Homo sapiens
gagttcactgttgtacacagtct

SEQ ID NO: 6220396 - DNA, 13 bp, Homo sapiens
gagttcagagggt

SEQ ID NO: 6220397 - DNA, 22 bp, Homo sapiens
gagttcagcctttaagatacct

SEQ ID NO: 6220398 - DNA, 14 bp, Homo sapiens
gagttcagttttac

SEQ ID NO: 6220399 - DNA, 21 bp, Homo sapiens
gagttcatggggatctggggg

SEQ ID NO: 6220400 - DNA, 16 bp, Homo sapiens
gagttcattcatatta

SEQ ID NO: 6220401 - DNA, 18 bp, Homo sapiens
gagttcattcatattaca

SEQ ID NO: 6220402 - DNA, 23 bp, Homo sapiens
gagttccaaataaggatttgttc

SEQ ID NO: 6220403 - DNA, 12 bp, Homo sapiens
gagttccagtca

SEQ ID NO: 6220404 - DNA, 18 bp, Homo sapiens
gagttcccaaagggaggg

SEQ ID NO: 6220405 - DNA, 23 bp, Homo sapiens
gagttcccaaagggagggtggca

SEQ ID NO: 6220406 - DNA, 17 bp, Homo sapiens
gagttcccgggagctgg

SEQ ID NO: 6220407 - DNA, 21 bp, Homo sapiens
gagttccctcttctaacccaa

SEQ ID NO: 6220408 - DNA, 18 bp, Homo sapiens
gagttccggcctgggcac

SEQ ID NO: 6220409 - DNA, 21 bp, Homo sapiens
gagttccgggaaacatagcct

SEQ ID NO: 6220410 - DNA, 12 bp, Homo sapiens
gagttcctctgc

SEQ ID NO: 6220411 - DNA, 13 bp, Homo sapiens
gagttcctctgca

SEQ ID NO: 6220412 - DNA, 16 bp, Homo sapiens
gagttcctctttgccc

SEQ ID NO: 6220413 - DNA, 23 bp, Homo sapiens
gagttcctgcggagtgaagaggg

SEQ ID NO: 6220414 - DNA, 13 bp, Homo sapiens
gagttcctgctcc

SEQ ID NO: 6220415 - DNA, 23 bp, Homo sapiens
gagttcctgtgggtgtgtctctc

SEQ ID NO: 6220416 - DNA, 13 bp, Homo sapiens
gagttcctttccc

SEQ ID NO: 6220417 - DNA, 17 bp, Homo sapiens
gagttcgagaccaacct

SEQ ID NO: 6220418 - DNA, 19 bp, Homo sapiens
gagttcgaggcgagcctgg

SEQ ID NO: 6220419 - DNA, 18 bp, Homo sapiens
gagttcggctctgggtgg

SEQ ID NO: 6220420 - DNA, 19 bp, Homo sapiens
gagttcgtaccgcttcctt

SEQ ID NO: 6220421 - DNA, 15 bp, Homo sapiens
gagttcgtgaagagg

SEQ ID NO: 6220422 - DNA, 15 bp, Homo sapiens
gagttctcagggctc

SEQ ID NO: 6220423 - DNA, 22 bp, Homo sapiens
gagttctccctgtacagtgtta

SEQ ID NO: 6220424 - DNA, 21 bp, Homo sapiens
gagttctctcatcggaggccc

SEQ ID NO: 6220425 - DNA, 17 bp, Homo sapiens
gagttctctgatgcaga

SEQ ID NO: 6220426 - DNA, 18 bp, Homo sapiens
gagttctctgatgcagaa

SEQ ID NO: 6220427 - DNA, 18 bp, Homo sapiens
gagttctcttccgcagcc

SEQ ID NO: 6220428 - DNA, 16 bp, Homo sapiens
gagttctgacattcat

SEQ ID NO: 6220429 - DNA, 12 bp, Homo sapiens
gagttctgctga

SEQ ID NO: 6220430 - DNA, 23 bp, Homo sapiens
gagttctgggtttctagaggtca

SEQ ID NO: 6220431 - DNA, 13 bp, Homo sapiens
gagttctggttcc

SEQ ID NO: 6220432 - DNA, 17 bp, Homo sapiens
gagttctttttgaagta

SEQ ID NO: 6220433 - DNA, 19 bp, Homo sapiens
gagttctttttgaagtatt

SEQ ID NO: 6220434 - DNA, 20 bp, Homo sapiens
gagttgaagacagcttccca

SEQ ID NO: 6220435 - DNA, 15 bp, Homo sapiens
gagttgaggaactgt

SEQ ID NO: 6220436 - DNA, 21 bp, Homo sapiens
gagttgaggggcttccctctg

SEQ ID NO: 6220437 - DNA, 15 bp, Homo sapiens
gagttgaggttgtta

SEQ ID NO: 6220438 - DNA, 22 bp, Homo sapiens
gagttgagtctcctctctgaga

SEQ ID NO: 6220439 - DNA, 21 bp, Homo sapiens
gagttgatagcacagaccctg

SEQ ID NO: 6220440 - DNA, 14 bp, Homo sapiens
gagttgatctggaa

SEQ ID NO: 6220441 - DNA, 16 bp, Homo sapiens
gagttgatctggaacc

SEQ ID NO: 6220442 - DNA, 19 bp, Homo sapiens
gagttgatctggaacccag

SEQ ID NO: 6220443 - DNA, 18 bp, Homo sapiens
gagttgattcagctctgc

SEQ ID NO: 6220444 - DNA, 16 bp, Homo sapiens
gagttgcatatccaaa

SEQ ID NO: 6220445 - DNA, 21 bp, Homo sapiens
gagttgcatttgtaaaaatga

SEQ ID NO: 6220446 - DNA, 16 bp, Homo sapiens
gagttgccaagacaaa

SEQ ID NO: 6220447 - DNA, 20 bp, Homo sapiens
gagttgccaagacaaatcaa

SEQ ID NO: 6220448 - DNA, 15 bp, Homo sapiens
gagttgctcactcag

SEQ ID NO: 6220449 - DNA, 23 bp, Homo sapiens
gagttgctcctacccctgtcctg

SEQ ID NO: 6220450 - DNA, 18 bp, Homo sapiens
gagttgctgccacaaaca

SEQ ID NO: 6220451 - DNA, 14 bp, Homo sapiens
gagttgctgtgccg

SEQ ID NO: 6220452 - DNA, 20 bp, Homo sapiens
gagttgctttgccagagcag

SEQ ID NO: 6220453 - DNA, 12 bp, Homo sapiens
gagttggagaga

SEQ ID NO: 6220454 - DNA, 17 bp, Homo sapiens
gagttggagtactatat

SEQ ID NO: 6220455 - DNA, 23 bp, Homo sapiens
gagttggattaaattctgggtga

SEQ ID NO: 6220456 - DNA, 17 bp, Homo sapiens
gagttggctcaggcaga

SEQ ID NO: 6220457 - DNA, 13 bp, Homo sapiens
gagttggctggga

SEQ ID NO: 6220458 - DNA, 15 bp, Homo sapiens
gagttgggattggac

SEQ ID NO: 6220459 - DNA, 12 bp, Homo sapiens
gagttgggctgg

SEQ ID NO: 6220460 - DNA, 22 bp, Homo sapiens
gagttgggctggtttggtggcc

SEQ ID NO: 6220461 - DNA, 16 bp, Homo sapiens
gagttggggaaggcaa

SEQ ID NO: 6220462 - DNA, 23 bp, Homo sapiens
gagttgggggagggaagaccaga

SEQ ID NO: 6220463 - DNA, 12 bp, Homo sapiens
gagttgggggta

SEQ ID NO: 6220464 - DNA, 18 bp, Homo sapiens
gagttgggggtattttct

SEQ ID NO: 6220465 - DNA, 20 bp, Homo sapiens
gagttgggggtgtggctctg

SEQ ID NO: 6220466 - DNA, 12 bp, Homo sapiens
gagttgtataaa

SEQ ID NO: 6220467 - DNA, 17 bp, Homo sapiens
gagttgtcgtttttagc

SEQ ID NO: 6220468 - DNA, 22 bp, Homo sapiens
gagttgtcgtttttagctttgt

SEQ ID NO: 6220469 - DNA, 18 bp, Homo sapiens
gagttgtgagccctctag

SEQ ID NO: 6220470 - DNA, 19 bp, Homo sapiens
gagttgtgagccctctagg

SEQ ID NO: 6220471 - DNA, 15 bp, Homo sapiens
gagttgtgatacaga

SEQ ID NO: 6220472 - DNA, 18 bp, Homo sapiens
gagttgtgatggagggga

SEQ ID NO: 6220473 - DNA, 22 bp, Homo sapiens
gagttgtgatggaggggagagg

SEQ ID NO: 6220474 - DNA, 20 bp, Homo sapiens
gagttgtggaaagcctctgc

SEQ ID NO: 6220475 - DNA, 16 bp, Homo sapiens
gagttgttacattttt

SEQ ID NO: 6220476 - DNA, 23 bp, Homo sapiens
gaagcaggctacactgacactgg

SEQ ID NO: 6220477 - DNA, 12 bp, Homo sapiens
gaagcaggctgg

SEQ ID NO: 6220478 - DNA, 15 bp, Homo sapiens
gaagcaggctggagg

SEQ ID NO: 6220479 - DNA, 16 bp, Homo sapiens
gaagcagggagagttg

SEQ ID NO: 6220480 - DNA, 23 bp, Homo sapiens
gaagcagggagagttggggaagg

SEQ ID NO: 6220481 - DNA, 17 bp, Homo sapiens
gaagcagggtttctttt

SEQ ID NO: 6220482 - DNA, 15 bp, Homo sapiens
gaagcaggttaaatg

SEQ ID NO: 6220483 - DNA, 18 bp, Homo sapiens
gaagcaggttaaatgttt

SEQ ID NO: 6220484 - DNA, 19 bp, Homo sapiens
gaagcaggttcccaagctc

SEQ ID NO: 6220485 - DNA, 18 bp, Homo sapiens
gaagcaggttgaggggct

SEQ ID NO: 6220486 - DNA, 19 bp, Homo sapiens
gaagcaggttgcttcaaga

SEQ ID NO: 6220487 - DNA, 15 bp, Homo sapiens
gaagcagtcagccct

SEQ ID NO: 6220488 - DNA, 23 bp, Homo sapiens
gaagcagtcgtggctttggcagt

SEQ ID NO: 6220489 - DNA, 15 bp, Homo sapiens
gaagcagtgagccgc

SEQ ID NO: 6220490 - DNA, 12 bp, Homo sapiens
gaagcagtgccc

SEQ ID NO: 6220491 - DNA, 19 bp, Homo sapiens
gaagcagtgccttccataa

SEQ ID NO: 6220492 - DNA, 16 bp, Homo sapiens
gaagcagtggggtagg

SEQ ID NO: 6220493 - DNA, 18 bp, Homo sapiens
gaagcagtgtgagcaggg

SEQ ID NO: 6220494 - DNA, 14 bp, Homo sapiens
gaagcagtttcaga

SEQ ID NO: 6220495 - DNA, 17 bp, Homo sapiens
gaagcatacactatgaa

SEQ ID NO: 6220496 - DNA, 18 bp, Homo sapiens
gaagcatccaaagattgc

SEQ ID NO: 6220497 - DNA, 11 bp, Homo sapiens
gaagcatccag

SEQ ID NO: 6220498 - DNA, 14 bp, Homo sapiens
gaagcatccaggca

SEQ ID NO: 6220499 - DNA, 13 bp, Homo sapiens
gaagcatcctccc

SEQ ID NO: 6220500 - DNA, 16 bp, Homo sapiens
gaagcatcctccccac

SEQ ID NO: 6220501 - DNA, 13 bp, Homo sapiens
gaagcatgaggtg

SEQ ID NO: 6220502 - DNA, 22 bp, Homo sapiens
gaagcatgagttatctgatttt

SEQ ID NO: 6220503 - DNA, 14 bp, Homo sapiens
gaagcatggctgtc

SEQ ID NO: 6220504 - DNA, 16 bp, Homo sapiens
gaagcatgtaggagaa

SEQ ID NO: 6220505 - DNA, 17 bp, Homo sapiens
gaagcatgtaggagaat

SEQ ID NO: 6220506 - DNA, 18 bp, Homo sapiens
gaagcatgtgacacccac

SEQ ID NO: 6220507 - DNA, 20 bp, Homo sapiens
gaagcattaaaatgcatggt

SEQ ID NO: 6220508 - DNA, 17 bp, Homo sapiens
gaagcattaacttctct

SEQ ID NO: 6220509 - DNA, 20 bp, Homo sapiens
gaagcattaacttctctgga

SEQ ID NO: 6220510 - DNA, 14 bp, Homo sapiens
gaagcattcacaaa

SEQ ID NO: 6220511 - DNA, 17 bp, Homo sapiens
gaagcattctccccagt

SEQ ID NO: 6220512 - DNA, 16 bp, Homo sapiens
gaagcattgaaaacaa

SEQ ID NO: 6220513 - DNA, 20 bp, Homo sapiens
gaagcattgcctggactgac

SEQ ID NO: 6220514 - DNA, 22 bp, Homo sapiens
gaagcattgcctggactgacca

SEQ ID NO: 6220515 - DNA, 13 bp, Homo sapiens
gaagcattgtaaa

SEQ ID NO: 6220516 - DNA, 13 bp, Homo sapiens
gaagcatttaaaa

SEQ ID NO: 6220517 - DNA, 17 bp, Homo sapiens
gaagcatttactttgtg

SEQ ID NO: 6220518 - DNA, 19 bp, Homo sapiens
gaagcatttcaaagccctg

SEQ ID NO: 6220519 - DNA, 21 bp, Homo sapiens
gaagcatttcaaagccctgcc

SEQ ID NO: 6220520 - DNA, 13 bp, Homo sapiens
gaagcattttata

SEQ ID NO: 6220521 - DNA, 23 bp, Homo sapiens
gaagcattttttataattttcta

SEQ ID NO: 6220522 - DNA, 18 bp, Homo sapiens
gaagccaaacctctgtga

SEQ ID NO: 6220523 - DNA, 10 bp, Homo sapiens
gaagccaaag

SEQ ID NO: 6220524 - DNA, 13 bp, Homo sapiens
gaagccaaagagt

SEQ ID NO: 6220525 - DNA, 22 bp, Homo sapiens
gaagccaaagttttcaaactgc

SEQ ID NO: 6220526 - DNA, 21 bp, Homo sapiens
gaagccaactgacaaagatgc

SEQ ID NO: 6220527 - DNA, 17 bp, Homo sapiens
gaagccaacttggcttt

SEQ ID NO: 6220528 - DNA, 12 bp, Homo sapiens
gaagccaagcct

SEQ ID NO: 6220529 - DNA, 14 bp, Homo sapiens
gaagccaagctccc

SEQ ID NO: 6220530 - DNA, 14 bp, Homo sapiens
gaagccaagggaag

SEQ ID NO: 6220531 - DNA, 14 bp, Homo sapiens
gaagccaagggaca

SEQ ID NO: 6220532 - DNA, 19 bp, Homo sapiens
gaagccaagtggggtgctg

SEQ ID NO: 6220533 - DNA, 18 bp, Homo sapiens
gaagccaattcagacagg

SEQ ID NO: 6220534 - DNA, 13 bp, Homo sapiens
gaagccacagaaa

SEQ ID NO: 6220535 - DNA, 15 bp, Homo sapiens
gaagccacaggcctg

SEQ ID NO: 6220536 - DNA, 17 bp, Homo sapiens
gaagccacaggcctggc

SEQ ID NO: 6220537 - DNA, 18 bp, Homo sapiens
gaagccacaggcctggcc

SEQ ID NO: 6220538 - DNA, 13 bp, Homo sapiens
gaagccacatcac

SEQ ID NO: 6220539 - DNA, 12 bp, Homo sapiens
gaagccaccctc

SEQ ID NO: 6220540 - DNA, 19 bp, Homo sapiens
gaagccaccctcccagctc

SEQ ID NO: 6220541 - DNA, 13 bp, Homo sapiens
gaagccaccctgg

SEQ ID NO: 6220542 - DNA, 17 bp, Homo sapiens
gaagccacccttccctg

SEQ ID NO: 6220543 - DNA, 19 bp, Homo sapiens
gaagccacccttccctgcc

SEQ ID NO: 6220544 - DNA, 22 bp, Homo sapiens
gaagccacctctctgcctgttc

SEQ ID NO: 6220545 - DNA, 17 bp, Homo sapiens
gaagccacgctgtcctc

SEQ ID NO: 6220546 - DNA, 15 bp, Homo sapiens
gaagccactgaagct

SEQ ID NO: 6220547 - DNA, 19 bp, Homo sapiens
gaagccagaaggtgcaggg

SEQ ID NO: 6220548 - DNA, 21 bp, Homo sapiens
gaagccagagccccaagcagg

SEQ ID NO: 6220549 - DNA, 16 bp, Homo sapiens
gaagccagcaggctct

SEQ ID NO: 6220550 - DNA, 20 bp, Homo sapiens
gaagccagcaggctctcagg

SEQ ID NO: 6220551 - DNA, 23 bp, Homo sapiens
gaagccagcaggctctcaggcca

SEQ ID NO: 6220552 - DNA, 10 bp, Homo sapiens
gaagccagcc

SEQ ID NO: 6220553 - DNA, 11 bp, Homo sapiens
gaagccagcca

SEQ ID NO: 6220554 - DNA, 12 bp, Homo sapiens
gaagccagccac

SEQ ID NO: 6220555 - DNA, 16 bp, Homo sapiens
gaagccagccacagac

SEQ ID NO: 6220556 - DNA, 10 bp, Homo sapiens
gaagccagct

SEQ ID NO: 6220557 - DNA, 16 bp, Homo sapiens
gaagccagctccctga

SEQ ID NO: 6220558 - DNA, 12 bp, Homo sapiens
gaagccaggagc

SEQ ID NO: 6220559 - DNA, 18 bp, Homo sapiens
gaagccaggtacaggaga

SEQ ID NO: 6220560 - DNA, 22 bp, Homo sapiens
gaagccaggtacaggagaggca

SEQ ID NO: 6220561 - DNA, 10 bp, Homo sapiens
gaagccatag

SEQ ID NO: 6220562 - DNA, 16 bp, Homo sapiens
gaagccatagggggct

SEQ ID NO: 6220563 - DNA, 18 bp, Homo sapiens
gaagccatagtgtcactt

SEQ ID NO: 6220564 - DNA, 18 bp, Homo sapiens
gaagccatcacctcagat

SEQ ID NO: 6220565 - DNA, 17 bp, Homo sapiens
gaagccatcacttctcc

SEQ ID NO: 6220566 - DNA, 19 bp, Homo sapiens
gaagccatctaaagtaaaa

SEQ ID NO: 6220567 - DNA, 18 bp, Homo sapiens
gaagccatctgacagcag

SEQ ID NO: 6220568 - DNA, 23 bp, Homo sapiens
gaagccatgagttccagaaagta

SEQ ID NO: 6220569 - DNA, 12 bp, Homo sapiens
gaagccatggga

SEQ ID NO: 6220570 - DNA, 15 bp, Homo sapiens
gaagccatgggacct

SEQ ID NO: 6220571 - DNA, 14 bp, Homo sapiens
gaagccatggtccc

SEQ ID NO: 6220572 - DNA, 12 bp, Homo sapiens
gaagccattgtc

SEQ ID NO: 6220573 - DNA, 16 bp, Homo sapiens
gaagccattttccagt

SEQ ID NO: 6220574 - DNA, 18 bp, Homo sapiens
gaagcccaaagcctgagg

SEQ ID NO: 6220575 - DNA, 19 bp, Homo sapiens
gaagcccaataaacctctt

SEQ ID NO: 6220576 - DNA, 16 bp, Homo sapiens
gaagcccacactatgc

SEQ ID NO: 6220577 - DNA, 18 bp, Homo sapiens
gaagcccaccactggcca

SEQ ID NO: 6220578 - DNA, 13 bp, Homo sapiens
gaagcccacccgc

SEQ ID NO: 6220579 - DNA, 14 bp, Homo sapiens
gaagcccacccgcc

SEQ ID NO: 6220580 - DNA, 17 bp, Homo sapiens
gaagcccacccgcccca

SEQ ID NO: 6220581 - DNA, 20 bp, Homo sapiens
gaagcccactgcctcctccc

SEQ ID NO: 6220582 - DNA, 10 bp, Homo sapiens
gaagcccaga

SEQ ID NO: 6220583 - DNA, 12 bp, Homo sapiens
gaagcccagaat

SEQ ID NO: 6220584 - DNA, 14 bp, Homo sapiens
gaagcccagacctc

SEQ ID NO: 6220585 - DNA, 19 bp, Homo sapiens
gaagcccagcccctactgc

SEQ ID NO: 6220586 - DNA, 22 bp, Homo sapiens
gaagcccagcccctactgctgt

SEQ ID NO: 6220587 - DNA, 13 bp, Homo sapiens
gaagcccagcctg

SEQ ID NO: 6220588 - DNA, 20 bp, Homo sapiens
gaagcccagcgacacagaag

SEQ ID NO: 6220589 - DNA, 17 bp, Homo sapiens
gaagcccagctccaggg

SEQ ID NO: 6220590 - DNA, 20 bp, Homo sapiens
gaagcccagctccagggcca

SEQ ID NO: 6220591 - DNA, 21 bp, Homo sapiens
gaagcccaggaaaggctccag

SEQ ID NO: 6220592 - DNA, 14 bp, Homo sapiens
gaagcccaggagga

SEQ ID NO: 6220593 - DNA, 23 bp, Homo sapiens
gaagcccaggccccttttcactc

SEQ ID NO: 6220594 - DNA, 14 bp, Homo sapiens
gaagcccaggctga

SEQ ID NO: 6220595 - DNA, 19 bp, Homo sapiens
gaagcccaggctgaagagt

SEQ ID NO: 6220596 - DNA, 16 bp, Homo sapiens
gaagcccaggggccgg

SEQ ID NO: 6220597 - DNA, 17 bp, Homo sapiens
gaagcccagtagccatt

SEQ ID NO: 6220598 - DNA, 19 bp, Homo sapiens
gaagcccatcctgaccagc

SEQ ID NO: 6220599 - DNA, 16 bp, Homo sapiens
gaagcccatgctttcc

SEQ ID NO: 6220600 - DNA, 21 bp, Homo sapiens
gaagcccatgtcttctgctgt

SEQ ID NO: 6220601 - DNA, 23 bp, Homo sapiens
gaagccccaacgggaaaggaaac

SEQ ID NO: 6220602 - DNA, 20 bp, Homo sapiens
gaagcccctgagtcctgagc

SEQ ID NO: 6220603 - DNA, 20 bp, Homo sapiens
gaagcccctgggggctccct

SEQ ID NO: 6220604 - DNA, 13 bp, Homo sapiens
gaagcccctgtcg

SEQ ID NO: 6220605 - DNA, 21 bp, Homo sapiens
gaagcccctgtcgcccaccca

SEQ ID NO: 6220606 - DNA, 17 bp, Homo sapiens
gaagccccttccccatg

SEQ ID NO: 6220607 - DNA, 19 bp, Homo sapiens
gaagccccttccccatggg

SEQ ID NO: 6220608 - DNA, 13 bp, Homo sapiens
gaagccccttgga

SEQ ID NO: 6220609 - DNA, 14 bp, Homo sapiens
gaagccccttggag

SEQ ID NO: 6220610 - DNA, 18 bp, Homo sapiens
gaagccccttggagagag

SEQ ID NO: 6220611 - DNA, 17 bp, Homo sapiens
gaagcccggactgacca

SEQ ID NO: 6220612 - DNA, 18 bp, Homo sapiens
gaagcccggctcctggtc

SEQ ID NO: 6220613 - DNA, 19 bp, Homo sapiens
gaagcccggtggcgtggca

SEQ ID NO: 6220614 - DNA, 19 bp, Homo sapiens
gaagccctaagtaaatcta

SEQ ID NO: 6220615 - DNA, 14 bp, Homo sapiens
gaagccctccttcc

SEQ ID NO: 6220616 - DNA, 19 bp, Homo sapiens
gaagccctccttgccaccc

SEQ ID NO: 6220617 - DNA, 17 bp, Homo sapiens
gaagccctcggcctcca

SEQ ID NO: 6220618 - DNA, 17 bp, Homo sapiens
gaagccctctcagatca

SEQ ID NO: 6220619 - DNA, 20 bp, Homo sapiens
gaagccctgcagagcacaaa

SEQ ID NO: 6220620 - DNA, 13 bp, Homo sapiens
gaagccctggaga

SEQ ID NO: 6220621 - DNA, 22 bp, Homo sapiens
gaagccctggatttcagaaaga

SEQ ID NO: 6220622 - DNA, 16 bp, Homo sapiens
gaagccctgtctgttt

SEQ ID NO: 6220623 - DNA, 15 bp, Homo sapiens
gaagcccttagggag

SEQ ID NO: 6220624 - DNA, 23 bp, Homo sapiens
gaagcccttccagtggtaccagc

SEQ ID NO: 6220625 - DNA, 23 bp, Homo sapiens
gaagcccttctaccttcctgcaa

SEQ ID NO: 6220626 - DNA, 13 bp, Homo sapiens
gaagccgactctg

SEQ ID NO: 6220627 - DNA, 23 bp, Homo sapiens
gaagccgctcccggttccctccc

SEQ ID NO: 6220628 - DNA, 21 bp, Homo sapiens
gaagccgctggggccagttgg

SEQ ID NO: 6220629 - DNA, 23 bp, Homo sapiens
gaagccggacacggcttcactga

SEQ ID NO: 6220630 - DNA, 16 bp, Homo sapiens
gaagccggacagctgc

SEQ ID NO: 6220631 - DNA, 16 bp, Homo sapiens
gaagccggagggtgtt

SEQ ID NO: 6220632 - DNA, 23 bp, Homo sapiens
gaagccggcggagctctggcttt

SEQ ID NO: 6220633 - DNA, 18 bp, Homo sapiens
gaagccggcggcccaagc

SEQ ID NO: 6220634 - DNA, 23 bp, Homo sapiens
gaagccggtgcctgggtggccat

SEQ ID NO: 6220635 - DNA, 17 bp, Homo sapiens
gaagccggtgtccctgg

SEQ ID NO: 6220636 - DNA, 18 bp, Homo sapiens
gaagccggtgtccctgga

SEQ ID NO: 6220637 - DNA, 17 bp, Homo sapiens
gaagccgtgccctgccc

SEQ ID NO: 6220638 - DNA, 19 bp, Homo sapiens
gaagccgtgccctgccccc

SEQ ID NO: 6220639 - DNA, 23 bp, Homo sapiens
gaagccgttgaatctgggaggga

SEQ ID NO: 6220640 - DNA, 16 bp, Homo sapiens
gaagcctaccagaaga

SEQ ID NO: 6220641 - DNA, 22 bp, Homo sapiens
gaagcctaggaggactggggta

SEQ ID NO: 6220642 - DNA, 16 bp, Homo sapiens
gaagcctattgtaaat

SEQ ID NO: 6220643 - DNA, 19 bp, Homo sapiens
gaagcctatttttatattt

SEQ ID NO: 6220644 - DNA, 20 bp, Homo sapiens
gaagcctcagattccttccc

SEQ ID NO: 6220645 - DNA, 18 bp, Homo sapiens
gaagcctccaagcacaga

SEQ ID NO: 6220646 - DNA, 21 bp, Homo sapiens
gaagcctccaagcacagagcc

SEQ ID NO: 6220647 - DNA, 20 bp, Homo sapiens
gaagcctccaagcctgcctc

SEQ ID NO: 6220648 - DNA, 21 bp, Homo sapiens
gaagcctccaagcctgcctcc

SEQ ID NO: 6220649 - DNA, 22 bp, Homo sapiens
gaagcctccaagcctgcctccc

SEQ ID NO: 6220650 - DNA, 21 bp, Homo sapiens
gaagcctccacaccagctgct

SEQ ID NO: 6220651 - DNA, 15 bp, Homo sapiens
gaagcctccacctgc

SEQ ID NO: 6220652 - DNA, 18 bp, Homo sapiens
gaagcctccacctgcagc

SEQ ID NO: 6220653 - DNA, 19 bp, Homo sapiens
gaagcctccacctgcagcc

SEQ ID NO: 6220654 - DNA, 16 bp, Homo sapiens
gaagcctccccagctc

SEQ ID NO: 6220655 - DNA, 21 bp, Homo sapiens
gaagcctccgtggaacattct

SEQ ID NO: 6220656 - DNA, 18 bp, Homo sapiens
gagttgttctcaggggtg

SEQ ID NO: 6220657 - DNA, 21 bp, Homo sapiens
gagttgttctcaggggtgctg

SEQ ID NO: 6220658 - DNA, 15 bp, Homo sapiens
gagttgttgccctgg

SEQ ID NO: 6220659 - DNA, 18 bp, Homo sapiens
gagttgttgtttgccaag

SEQ ID NO: 6220660 - DNA, 21 bp, Homo sapiens
gagttgttttggtgcctgcct

SEQ ID NO: 6220661 - DNA, 13 bp, Homo sapiens
gagttgtttttgt

SEQ ID NO: 6220662 - DNA, 14 bp, Homo sapiens
gagttgtttttgta

SEQ ID NO: 6220663 - DNA, 18 bp, Homo sapiens
gagttgtttttgtatatt

SEQ ID NO: 6220664 - DNA, 19 bp, Homo sapiens
gagtttaaaaaaataacat

SEQ ID NO: 6220665 - DNA, 14 bp, Homo sapiens
gagtttaaaatcat

SEQ ID NO: 6220666 - DNA, 20 bp, Homo sapiens
gagtttaaagagaaaaggga

SEQ ID NO: 6220667 - DNA, 22 bp, Homo sapiens
gagtttaacagatatttaaatt

SEQ ID NO: 6220668 - DNA, 21 bp, Homo sapiens
gagtttaactttgggcccaga

SEQ ID NO: 6220669 - DNA, 18 bp, Homo sapiens
gagtttaatacaggaaat

SEQ ID NO: 6220670 - DNA, 20 bp, Homo sapiens
gagtttacaagaaataaatc

SEQ ID NO: 6220671 - DNA, 17 bp, Homo sapiens
gagtttacagtttgtgt

SEQ ID NO: 6220672 - DNA, 19 bp, Homo sapiens
gagtttacagtttgtgttt

SEQ ID NO: 6220673 - DNA, 23 bp, Homo sapiens
gagtttaccatttgtaataaagt

SEQ ID NO: 6220674 - DNA, 18 bp, Homo sapiens
gagtttagccctgaacat

SEQ ID NO: 6220675 - DNA, 17 bp, Homo sapiens
gagtttaggcagcttct

SEQ ID NO: 6220676 - DNA, 20 bp, Homo sapiens
gagtttagggaacaatttgg

SEQ ID NO: 6220677 - DNA, 15 bp, Homo sapiens
gagtttagggtgggg

SEQ ID NO: 6220678 - DNA, 16 bp, Homo sapiens
gagtttatacagtgta

SEQ ID NO: 6220679 - DNA, 15 bp, Homo sapiens
gagtttattctgatt

SEQ ID NO: 6220680 - DNA, 18 bp, Homo sapiens
gagtttcacagtgtgatt

SEQ ID NO: 6220681 - DNA, 14 bp, Homo sapiens
gagtttcagctgga

SEQ ID NO: 6220682 - DNA, 18 bp, Homo sapiens
gagtttcatgtacaagat

SEQ ID NO: 6220683 - DNA, 16 bp, Homo sapiens
gagtttccatttggat

SEQ ID NO: 6220684 - DNA, 22 bp, Homo sapiens
gagtttccccactaataaagtg

SEQ ID NO: 6220685 - DNA, 17 bp, Homo sapiens
gagtttcctatgggaac

SEQ ID NO: 6220686 - DNA, 15 bp, Homo sapiens
gagtttcctcaggct

SEQ ID NO: 6220687 - DNA, 21 bp, Homo sapiens
gagtttcctcaggctgctgga

SEQ ID NO: 6220688 - DNA, 23 bp, Homo sapiens
gagtttcctcaggctgctggagg

SEQ ID NO: 6220689 - DNA, 11 bp, Homo sapiens
gagtttccttt

SEQ ID NO: 6220690 - DNA, 14 bp, Homo sapiens
gagtttccttttct

SEQ ID NO: 6220691 - DNA, 16 bp, Homo sapiens
gagtttctaaggtccg

SEQ ID NO: 6220692 - DNA, 13 bp, Homo sapiens
gagtttctatgga

SEQ ID NO: 6220693 - DNA, 18 bp, Homo sapiens
gagtttctctagaagctc

SEQ ID NO: 6220694 - DNA, 19 bp, Homo sapiens
gagtttctggctgaaaatg

SEQ ID NO: 6220695 - DNA, 23 bp, Homo sapiens
gagtttctggtaagactgctggt

SEQ ID NO: 6220696 - DNA, 13 bp, Homo sapiens
gagtttctgtttg

SEQ ID NO: 6220697 - DNA, 15 bp, Homo sapiens
gagtttctgtttgat

SEQ ID NO: 6220698 - DNA, 15 bp, Homo sapiens
gagtttctttcagat

SEQ ID NO: 6220699 - DNA, 21 bp, Homo sapiens
gagtttgagacaagccctggc

SEQ ID NO: 6220700 - DNA, 12 bp, Homo sapiens
gagtttgagacc

SEQ ID NO: 6220701 - DNA, 17 bp, Homo sapiens
gagtttgcaatgtcaca

SEQ ID NO: 6220702 - DNA, 23 bp, Homo sapiens
gagtttgccccgttctgtttgta

SEQ ID NO: 6220703 - DNA, 13 bp, Homo sapiens
gagtttgcctccc

SEQ ID NO: 6220704 - DNA, 20 bp, Homo sapiens
gagtttggatgttgtaaata

SEQ ID NO: 6220705 - DNA, 14 bp, Homo sapiens
gagtttgggctgga

SEQ ID NO: 6220706 - DNA, 20 bp, Homo sapiens
gagtttggggtatgggagag

SEQ ID NO: 6220707 - DNA, 16 bp, Homo sapiens
gagtttggttaatcag

SEQ ID NO: 6220708 - DNA, 17 bp, Homo sapiens
gagtttgtaaatgactt

SEQ ID NO: 6220709 - DNA, 13 bp, Homo sapiens
gagtttgtagtaa

SEQ ID NO: 6220710 - DNA, 15 bp, Homo sapiens
gagtttgtattatta

SEQ ID NO: 6220711 - DNA, 20 bp, Homo sapiens
gagtttgtggtaacttgaga

SEQ ID NO: 6220712 - DNA, 15 bp, Homo sapiens
gagtttgtgtctgtt

SEQ ID NO: 6220713 - DNA, 18 bp, Homo sapiens
gagtttgtgtgttgtctt

SEQ ID NO: 6220714 - DNA, 23 bp, Homo sapiens
gagtttgtgttgttgttgctgct

SEQ ID NO: 6220715 - DNA, 20 bp, Homo sapiens
gagtttgtttcttgtgtgtt

SEQ ID NO: 6220716 - DNA, 23 bp, Homo sapiens
gagttttaaattatgtataaaca

SEQ ID NO: 6220717 - DNA, 23 bp, Homo sapiens
gagttttcacctggtatccatta

SEQ ID NO: 6220718 - DNA, 21 bp, Homo sapiens
gagttttccatggcaggaagg

SEQ ID NO: 6220719 - DNA, 22 bp, Homo sapiens
gagttttcctctatacatctct

SEQ ID NO: 6220720 - DNA, 18 bp, Homo sapiens
gagttttctatgaatcta

SEQ ID NO: 6220721 - DNA, 21 bp, Homo sapiens
gagttttctgtgtggtctcca

SEQ ID NO: 6220722 - DNA, 18 bp, Homo sapiens
gagttttgatttggtgga

SEQ ID NO: 6220723 - DNA, 13 bp, Homo sapiens
gagttttgtttta

SEQ ID NO: 6220724 - DNA, 18 bp, Homo sapiens
gagtttttaaagccttct

SEQ ID NO: 6220725 - DNA, 23 bp, Homo sapiens
gagtttttcattatttggaaatt

SEQ ID NO: 6220726 - DNA, 13 bp, Homo sapiens
gagtttttcctcc

SEQ ID NO: 6220727 - DNA, 14 bp, Homo sapiens
gagtttttcctccc

SEQ ID NO: 6220728 - DNA, 15 bp, Homo sapiens
gagtttttctgaaaa

SEQ ID NO: 6220729 - DNA, 19 bp, Homo sapiens
gagtttttttctgtttata

SEQ ID NO: 6220730 - DNA, 15 bp, Homo sapiens
gagttttttttaacc

SEQ ID NO: 6220731 - DNA, 18 bp, Homo sapiens
gataaaaaagaaaacatt

SEQ ID NO: 6220732 - DNA, 13 bp, Homo sapiens
gataaaaaatttt

SEQ ID NO: 6220733 - DNA, 14 bp, Homo sapiens
gataaaaaattttg

SEQ ID NO: 6220734 - DNA, 18 bp, Homo sapiens
gataaaaaattttgtaat

SEQ ID NO: 6220735 - DNA, 14 bp, Homo sapiens
gataaaaacaatat

SEQ ID NO: 6220736 - DNA, 22 bp, Homo sapiens
gataaaaacctgaactttcatt

SEQ ID NO: 6220737 - DNA, 15 bp, Homo sapiens
gataaaaaggaagga

SEQ ID NO: 6220738 - DNA, 12 bp, Homo sapiens
gataaaaatcag

SEQ ID NO: 6220739 - DNA, 20 bp, Homo sapiens
gataaaacattagaagaaaa

SEQ ID NO: 6220740 - DNA, 18 bp, Homo sapiens
gataaaaccttttttgaa

SEQ ID NO: 6220741 - DNA, 17 bp, Homo sapiens
gataaaacgatctaaag

SEQ ID NO: 6220742 - DNA, 20 bp, Homo sapiens
gataaaactaaatatatgtc

SEQ ID NO: 6220743 - DNA, 18 bp, Homo sapiens
gataaaagaaccccagac

SEQ ID NO: 6220744 - DNA, 16 bp, Homo sapiens
gataaaaggataggaa

SEQ ID NO: 6220745 - DNA, 22 bp, Homo sapiens
gataaaaggtggagtttctctg

SEQ ID NO: 6220746 - DNA, 16 bp, Homo sapiens
gataaaaggtttcttt

SEQ ID NO: 6220747 - DNA, 17 bp, Homo sapiens
gataaaataaaatttta

SEQ ID NO: 6220748 - DNA, 18 bp, Homo sapiens
gataaaataaataatttt

SEQ ID NO: 6220749 - DNA, 14 bp, Homo sapiens
gataaaataaatga

SEQ ID NO: 6220750 - DNA, 13 bp, Homo sapiens
gataaaataagta

SEQ ID NO: 6220751 - DNA, 19 bp, Homo sapiens
gataaaataagtaacatat

SEQ ID NO: 6220752 - DNA, 18 bp, Homo sapiens
gataaaataatgctttga

SEQ ID NO: 6220753 - DNA, 17 bp, Homo sapiens
gataaaatactaaacta

SEQ ID NO: 6220754 - DNA, 13 bp, Homo sapiens
gataaaatcataa

SEQ ID NO: 6220755 - DNA, 19 bp, Homo sapiens
gataaaatcccattgtatt

SEQ ID NO: 6220756 - DNA, 19 bp, Homo sapiens
gataaaatctactccaaat

SEQ ID NO: 6220757 - DNA, 18 bp, Homo sapiens
gataaaatgactacttag

SEQ ID NO: 6220758 - DNA, 13 bp, Homo sapiens
gataaaattacaa

SEQ ID NO: 6220759 - DNA, 22 bp, Homo sapiens
gataaaattatagatgggaatg

SEQ ID NO: 6220760 - DNA, 11 bp, Homo sapiens
gataaacaaac

SEQ ID NO: 6220761 - DNA, 15 bp, Homo sapiens
gataaacacaagatt

SEQ ID NO: 6220762 - DNA, 15 bp, Homo sapiens
gataaacattaaaca

SEQ ID NO: 6220763 - DNA, 14 bp, Homo sapiens
gataaaccaccctc

SEQ ID NO: 6220764 - DNA, 19 bp, Homo sapiens
gataaaccaccctctgggg

SEQ ID NO: 6220765 - DNA, 15 bp, Homo sapiens
gataaactaaaagca

SEQ ID NO: 6220766 - DNA, 16 bp, Homo sapiens
gataaacttgcttcag

SEQ ID NO: 6220767 - DNA, 18 bp, Homo sapiens
gataaacttttagaaact

SEQ ID NO: 6220768 - DNA, 17 bp, Homo sapiens
gataaagaaaaaaatac

SEQ ID NO: 6220769 - DNA, 17 bp, Homo sapiens
gataaagaactaaatca

SEQ ID NO: 6220770 - DNA, 21 bp, Homo sapiens
gataaagacagctgacagata

SEQ ID NO: 6220771 - DNA, 12 bp, Homo sapiens
gataaagacttt

SEQ ID NO: 6220772 - DNA, 11 bp, Homo sapiens
gataaagatga

SEQ ID NO: 6220773 - DNA, 13 bp, Homo sapiens
gataaagatgatc

SEQ ID NO: 6220774 - DNA, 21 bp, Homo sapiens
gataaagatgtcaaatatctc

SEQ ID NO: 6220775 - DNA, 16 bp, Homo sapiens
gataaagattgtgtgg

SEQ ID NO: 6220776 - DNA, 17 bp, Homo sapiens
gataaagccactgaaaa

SEQ ID NO: 6220777 - DNA, 21 bp, Homo sapiens
gataaagccacttctggcttc

SEQ ID NO: 6220778 - DNA, 11 bp, Homo sapiens
gataaaggaaa

SEQ ID NO: 6220779 - DNA, 11 bp, Homo sapiens
gataaaggtga

SEQ ID NO: 6220780 - DNA, 13 bp, Homo sapiens
gataaagtaaaaa

SEQ ID NO: 6220781 - DNA, 17 bp, Homo sapiens
gataaagtagtaaaaat

SEQ ID NO: 6220782 - DNA, 20 bp, Homo sapiens
gataaagtcctgaacctttc

SEQ ID NO: 6220783 - DNA, 23 bp, Homo sapiens
gataaagtcctgaacctttcaaa

SEQ ID NO: 6220784 - DNA, 14 bp, Homo sapiens
gataaagttcctta

SEQ ID NO: 6220785 - DNA, 18 bp, Homo sapiens
gataaagttgagagacag

SEQ ID NO: 6220786 - DNA, 19 bp, Homo sapiens
gataaagttggtaaacctt

SEQ ID NO: 6220787 - DNA, 13 bp, Homo sapiens
gataaataaagtc

SEQ ID NO: 6220788 - DNA, 21 bp, Homo sapiens
gataaataataaaggttctat

SEQ ID NO: 6220789 - DNA, 18 bp, Homo sapiens
gataaataatcggcccac

SEQ ID NO: 6220790 - DNA, 17 bp, Homo sapiens
gataaatagtgttattg

SEQ ID NO: 6220791 - DNA, 15 bp, Homo sapiens
gataaatatatatga

SEQ ID NO: 6220792 - DNA, 19 bp, Homo sapiens
gataaatatcattatagca

SEQ ID NO: 6220793 - DNA, 14 bp, Homo sapiens
gataaatatcttac

SEQ ID NO: 6220794 - DNA, 15 bp, Homo sapiens
gataaatattatatt

SEQ ID NO: 6220795 - DNA, 22 bp, Homo sapiens
gataaatattatattatatata

SEQ ID NO: 6220796 - DNA, 12 bp, Homo sapiens
gataaatattca

SEQ ID NO: 6220797 - DNA, 20 bp, Homo sapiens
gataaatattcacacttgaa

SEQ ID NO: 6220798 - DNA, 12 bp, Homo sapiens
gataaatattta

SEQ ID NO: 6220799 - DNA, 13 bp, Homo sapiens
gataaatatttga

SEQ ID NO: 6220800 - DNA, 16 bp, Homo sapiens
gataaatatttgactt

SEQ ID NO: 6220801 - DNA, 17 bp, Homo sapiens
gataaatcataaagtca

SEQ ID NO: 6220802 - DNA, 18 bp, Homo sapiens
gataaatcataaagtcag

SEQ ID NO: 6220803 - DNA, 16 bp, Homo sapiens
gataaatcatgggcat

SEQ ID NO: 6220804 - DNA, 17 bp, Homo sapiens
gataaatcatgggcatt

SEQ ID NO: 6220805 - DNA, 23 bp, Homo sapiens
gataaatcatttcagtatcatct

SEQ ID NO: 6220806 - DNA, 13 bp, Homo sapiens
gataaatcatttt

SEQ ID NO: 6220807 - DNA, 18 bp, Homo sapiens
gataaatgaaataaacgt

SEQ ID NO: 6220808 - DNA, 19 bp, Homo sapiens
gataaatgaacatttaact

SEQ ID NO: 6220809 - DNA, 18 bp, Homo sapiens
gataaatgatgattcgtg

SEQ ID NO: 6220810 - DNA, 16 bp, Homo sapiens
gataaatgctttaaat

SEQ ID NO: 6220811 - DNA, 13 bp, Homo sapiens
gataaattacatt

SEQ ID NO: 6220812 - DNA, 14 bp, Homo sapiens
gataaattacatta

SEQ ID NO: 6220813 - DNA, 12 bp, Homo sapiens
gataaattataa

SEQ ID NO: 6220814 - DNA, 24 bp, Homo sapiens
gataaattgccataatatgatgca

SEQ ID NO: 6220815 - DNA, 19 bp, Homo sapiens
gataaattgtatgaagatc

SEQ ID NO: 6220816 - DNA, 17 bp, Homo sapiens
gataaatttaaaacaca

SEQ ID NO: 6220817 - DNA, 21 bp, Homo sapiens
gataaatttaaaacacagtat

SEQ ID NO: 6220818 - DNA, 15 bp, Homo sapiens
gataaatttgttgaa

SEQ ID NO: 6220819 - DNA, 14 bp, Homo sapiens
gataacaaaaaata

SEQ ID NO: 6220820 - DNA, 18 bp, Homo sapiens
gataacaaaaaataaatt

SEQ ID NO: 6220821 - DNA, 15 bp, Homo sapiens
gataacaaaatcaca

SEQ ID NO: 6220822 - DNA, 16 bp, Homo sapiens
gataacaaaatcacaa

SEQ ID NO: 6220823 - DNA, 18 bp, Homo sapiens
gataacaaaatcacaagc

SEQ ID NO: 6220824 - DNA, 22 bp, Homo sapiens
gataacaaagatatcttttctt

SEQ ID NO: 6220825 - DNA, 17 bp, Homo sapiens
gataacaacctggagac

SEQ ID NO: 6220826 - DNA, 22 bp, Homo sapiens
gataacaaccttttacattgtg

SEQ ID NO: 6220827 - DNA, 23 bp, Homo sapiens
gataacaaccttttacattgtga

SEQ ID NO: 6220828 - DNA, 15 bp, Homo sapiens
gataacaagatcttt

SEQ ID NO: 6220829 - DNA, 20 bp, Homo sapiens
gataacaatgcagcaaggcc

SEQ ID NO: 6220830 - DNA, 22 bp, Homo sapiens
gataacaatgttttaacaagaa

SEQ ID NO: 6220831 - DNA, 15 bp, Homo sapiens
gataacaccagtggg

SEQ ID NO: 6220832 - DNA, 14 bp, Homo sapiens
gataacacttaaaa

SEQ ID NO: 6220833 - DNA, 15 bp, Homo sapiens
gataacagagtgatt

SEQ ID NO: 6220834 - DNA, 17 bp, Homo sapiens
gataacagcctcttgcc

SEQ ID NO: 6220835 - DNA, 15 bp, Homo sapiens
gataacagctaccat

SEQ ID NO: 6220836 - DNA, 12 bp, Homo sapiens
gaagcctctcat

SEQ ID NO: 6220837 - DNA, 19 bp, Homo sapiens
gaagcctctctccttggcc

SEQ ID NO: 6220838 - DNA, 15 bp, Homo sapiens
gaagcctctgcctcc

SEQ ID NO: 6220839 - DNA, 17 bp, Homo sapiens
gaagcctctggctagag

SEQ ID NO: 6220840 - DNA, 13 bp, Homo sapiens
gaagcctctggga

SEQ ID NO: 6220841 - DNA, 21 bp, Homo sapiens
gaagcctctgggtcagtggtc

SEQ ID NO: 6220842 - DNA, 22 bp, Homo sapiens
gaagcctgaactgaggccttgt

SEQ ID NO: 6220843 - DNA, 14 bp, Homo sapiens
gaagcctgactgct

SEQ ID NO: 6220844 - DNA, 14 bp, Homo sapiens
gaagcctgagcagg

SEQ ID NO: 6220845 - DNA, 17 bp, Homo sapiens
gaagcctggactctgcc

SEQ ID NO: 6220846 - DNA, 13 bp, Homo sapiens
gaagcctgggggc

SEQ ID NO: 6220847 - DNA, 18 bp, Homo sapiens
gaagcctgggggcctggc

SEQ ID NO: 6220848 - DNA, 20 bp, Homo sapiens
gaagcctgggggcctggctg

SEQ ID NO: 6220849 - DNA, 16 bp, Homo sapiens
gaagcctgtgccacct

SEQ ID NO: 6220850 - DNA, 21 bp, Homo sapiens
gaagcctgtgccacctgcaag

SEQ ID NO: 6220851 - DNA, 15 bp, Homo sapiens
gaagcctgtgccagc

SEQ ID NO: 6220852 - DNA, 17 bp, Homo sapiens
gaagcctgtgcctccca

SEQ ID NO: 6220853 - DNA, 20 bp, Homo sapiens
gaagcctgttttgttggaag

SEQ ID NO: 6220854 - DNA, 22 bp, Homo sapiens
gaagcctgttttgttggaaggt

SEQ ID NO: 6220855 - DNA, 19 bp, Homo sapiens
gaagccttcaagctctgag

SEQ ID NO: 6220856 - DNA, 15 bp, Homo sapiens
gaagccttcccccag

SEQ ID NO: 6220857 - DNA, 23 bp, Homo sapiens
gaagccttccccttatcctccct

SEQ ID NO: 6220858 - DNA, 14 bp, Homo sapiens
gaagccttctgcag

SEQ ID NO: 6220859 - DNA, 16 bp, Homo sapiens
gaagccttcttctgcc

SEQ ID NO: 6220860 - DNA, 15 bp, Homo sapiens
gaagccttcttgctg

SEQ ID NO: 6220861 - DNA, 22 bp, Homo sapiens
gaagccttgcctaaatttaatg

SEQ ID NO: 6220862 - DNA, 14 bp, Homo sapiens
gaagccttgctcat

SEQ ID NO: 6220863 - DNA, 12 bp, Homo sapiens
gaagccttgctg

SEQ ID NO: 6220864 - DNA, 13 bp, Homo sapiens
gaagccttgctga

SEQ ID NO: 6220865 - DNA, 20 bp, Homo sapiens
gaagccttggaaccagcccc

SEQ ID NO: 6220866 - DNA, 19 bp, Homo sapiens
gaagcctttactgaccctg

SEQ ID NO: 6220867 - DNA, 15 bp, Homo sapiens
gaagcctttcctgta

SEQ ID NO: 6220868 - DNA, 16 bp, Homo sapiens
gaagccttttgcaaat

SEQ ID NO: 6220869 - DNA, 15 bp, Homo sapiens
gaagcgaacatcttc

SEQ ID NO: 6220870 - DNA, 20 bp, Homo sapiens
gaagcgaacatcttcatata

SEQ ID NO: 6220871 - DNA, 13 bp, Homo sapiens
gaagcgactctcc

SEQ ID NO: 6220872 - DNA, 16 bp, Homo sapiens
gaagcgagcactgacc

SEQ ID NO: 6220873 - DNA, 14 bp, Homo sapiens
gaagcgccaggctg

SEQ ID NO: 6220874 - DNA, 22 bp, Homo sapiens
gaagcgcgccactcgcttcccc

SEQ ID NO: 6220875 - DNA, 15 bp, Homo sapiens
gaagcgctcatctgg

SEQ ID NO: 6220876 - DNA, 13 bp, Homo sapiens
gaagcgctgccct

SEQ ID NO: 6220877 - DNA, 17 bp, Homo sapiens
gaagcgctgccctgtga

SEQ ID NO: 6220878 - DNA, 24 bp, Homo sapiens
gaagcgctgttgcccgccctccac

SEQ ID NO: 6220879 - DNA, 18 bp, Homo sapiens
gaagcggagagagccaag

SEQ ID NO: 6220880 - DNA, 19 bp, Homo sapiens
gaagcggagagagccaaga

SEQ ID NO: 6220881 - DNA, 20 bp, Homo sapiens
gaagcggagagagccaagac

SEQ ID NO: 6220882 - DNA, 16 bp, Homo sapiens
gaagcggatttccagg

SEQ ID NO: 6220883 - DNA, 23 bp, Homo sapiens
gaagcgggctgggggtagcctgg

SEQ ID NO: 6220884 - DNA, 16 bp, Homo sapiens
gaagcggtcagactgg

SEQ ID NO: 6220885 - DNA, 20 bp, Homo sapiens
gaagcggtcagactggaggt

SEQ ID NO: 6220886 - DNA, 18 bp, Homo sapiens
gaagcggtcgtgttgtga

SEQ ID NO: 6220887 - DNA, 15 bp, Homo sapiens
gaagcggtttgcatt

SEQ ID NO: 6220888 - DNA, 13 bp, Homo sapiens
gaagcgtatgttt

SEQ ID NO: 6220889 - DNA, 17 bp, Homo sapiens
gaagcgtcgccccagtg

SEQ ID NO: 6220890 - DNA, 18 bp, Homo sapiens
gaagcgttatgtgcagta

SEQ ID NO: 6220891 - DNA, 13 bp, Homo sapiens
gaagcgtttttaa

SEQ ID NO: 6220892 - DNA, 13 bp, Homo sapiens
gaagctaaaacac

SEQ ID NO: 6220893 - DNA, 14 bp, Homo sapiens
gaagctaacaggga

SEQ ID NO: 6220894 - DNA, 16 bp, Homo sapiens
gaagctaacagggaag

SEQ ID NO: 6220895 - DNA, 20 bp, Homo sapiens
gaagctaacagggaaggcag

SEQ ID NO: 6220896 - DNA, 15 bp, Homo sapiens
gaagctaatgaccaa

SEQ ID NO: 6220897 - DNA, 17 bp, Homo sapiens
gaagctaatgaccaacc

SEQ ID NO: 6220898 - DNA, 14 bp, Homo sapiens
gaagctaatgtgaa

SEQ ID NO: 6220899 - DNA, 22 bp, Homo sapiens
gaagctacagattgtcatagtt

SEQ ID NO: 6220900 - DNA, 22 bp, Homo sapiens
gaagctacaggttacaacagat

SEQ ID NO: 6220901 - DNA, 21 bp, Homo sapiens
gaagctacccctcaaactgca

SEQ ID NO: 6220902 - DNA, 22 bp, Homo sapiens
gaagctactgtgtgtgtgaatg

SEQ ID NO: 6220903 - DNA, 15 bp, Homo sapiens
gaagctactttgttt

SEQ ID NO: 6220904 - DNA, 18 bp, Homo sapiens
gaagctagacacatgaag

SEQ ID NO: 6220905 - DNA, 14 bp, Homo sapiens
gaagctagctcccc

SEQ ID NO: 6220906 - DNA, 15 bp, Homo sapiens
gaagctagctcccct

SEQ ID NO: 6220907 - DNA, 17 bp, Homo sapiens
gaagctagctcccctcc

SEQ ID NO: 6220908 - DNA, 19 bp, Homo sapiens
gaagctagctcccctcctc

SEQ ID NO: 6220909 - DNA, 22 bp, Homo sapiens
gaagctagctcccctcctctcc

SEQ ID NO: 6220910 - DNA, 20 bp, Homo sapiens
gaagctatcgtaaaattaag

SEQ ID NO: 6220911 - DNA, 17 bp, Homo sapiens
gaagctattgagaaaga

SEQ ID NO: 6220912 - DNA, 18 bp, Homo sapiens
gaagctattgatgtttcc

SEQ ID NO: 6220913 - DNA, 19 bp, Homo sapiens
gaagctattgatgtttcca

SEQ ID NO: 6220914 - DNA, 12 bp, Homo sapiens
gaagctattttt

SEQ ID NO: 6220915 - DNA, 19 bp, Homo sapiens
gaagctcacacatcctgtc

SEQ ID NO: 6220916 - DNA, 23 bp, Homo sapiens
gaagctcacacatcctgtcagtg

SEQ ID NO: 6220917 - DNA, 19 bp, Homo sapiens
gaagctcacactgatgggc

SEQ ID NO: 6220918 - DNA, 22 bp, Homo sapiens
gaagctcacctgttgcttacaa

SEQ ID NO: 6220919 - DNA, 12 bp, Homo sapiens
gaagctcagccc

SEQ ID NO: 6220920 - DNA, 13 bp, Homo sapiens
gaagctcagccca

SEQ ID NO: 6220921 - DNA, 15 bp, Homo sapiens
gaagctcagcccacc

SEQ ID NO: 6220922 - DNA, 18 bp, Homo sapiens
gaagctcagcccaccccc

SEQ ID NO: 6220923 - DNA, 12 bp, Homo sapiens
gaagctcagcct

SEQ ID NO: 6220924 - DNA, 14 bp, Homo sapiens
gaagctcagccttc

SEQ ID NO: 6220925 - DNA, 21 bp, Homo sapiens
gaagctcagctgcattccgca

SEQ ID NO: 6220926 - DNA, 14 bp, Homo sapiens
gaagctcagctgcc

SEQ ID NO: 6220927 - DNA, 15 bp, Homo sapiens
gaagctcagggcctg

SEQ ID NO: 6220928 - DNA, 17 bp, Homo sapiens
gaagctcagggcctggc

SEQ ID NO: 6220929 - DNA, 23 bp, Homo sapiens
gaagctcagggcctggctcaggt

SEQ ID NO: 6220930 - DNA, 19 bp, Homo sapiens
gaagctcaggttccctgcc

SEQ ID NO: 6220931 - DNA, 22 bp, Homo sapiens
gaagctcaggttccctgccaca

SEQ ID NO: 6220932 - DNA, 19 bp, Homo sapiens
gaagctcagtttggctgta

SEQ ID NO: 6220933 - DNA, 13 bp, Homo sapiens
gaagctccactgt

SEQ ID NO: 6220934 - DNA, 15 bp, Homo sapiens
gaagctccactgtca

SEQ ID NO: 6220935 - DNA, 22 bp, Homo sapiens
gaagctccagatccagtatctt

SEQ ID NO: 6220936 - DNA, 13 bp, Homo sapiens
gaagctccatgga

SEQ ID NO: 6220937 - DNA, 14 bp, Homo sapiens
gaagctcccacacc

SEQ ID NO: 6220938 - DNA, 14 bp, Homo sapiens
gaagctcccacccc

SEQ ID NO: 6220939 - DNA, 20 bp, Homo sapiens
gaagctcccaccccactcag

SEQ ID NO: 6220940 - DNA, 21 bp, Homo sapiens
gaagctcccagatgctgggga

SEQ ID NO: 6220941 - DNA, 15 bp, Homo sapiens
gaagctcccaggaac

SEQ ID NO: 6220942 - DNA, 15 bp, Homo sapiens
gaagctcccccagca

SEQ ID NO: 6220943 - DNA, 12 bp, Homo sapiens
gaagctcctgct

SEQ ID NO: 6220944 - DNA, 21 bp, Homo sapiens
gaagctcctgctacttcccca

SEQ ID NO: 6220945 - DNA, 12 bp, Homo sapiens
gaagctcctggt

SEQ ID NO: 6220946 - DNA, 13 bp, Homo sapiens
gaagctcctggta

SEQ ID NO: 6220947 - DNA, 20 bp, Homo sapiens
gaagctcgcatccagacagt

SEQ ID NO: 6220948 - DNA, 20 bp, Homo sapiens
gaagctcgccccacctccac

SEQ ID NO: 6220949 - DNA, 16 bp, Homo sapiens
gaagctcggtgagtga

SEQ ID NO: 6220950 - DNA, 20 bp, Homo sapiens
gaagctctccgagctctggt

SEQ ID NO: 6220951 - DNA, 15 bp, Homo sapiens
gaagctctgaagtca

SEQ ID NO: 6220952 - DNA, 16 bp, Homo sapiens
gaagctctgaagtcac

SEQ ID NO: 6220953 - DNA, 12 bp, Homo sapiens
gaagctctggct

SEQ ID NO: 6220954 - DNA, 20 bp, Homo sapiens
gaagctctggctgaaccctg

SEQ ID NO: 6220955 - DNA, 23 bp, Homo sapiens
gaagctctggctgaaccctgtgc

SEQ ID NO: 6220956 - DNA, 22 bp, Homo sapiens
gaagctctgtttataaaaacaa

SEQ ID NO: 6220957 - DNA, 20 bp, Homo sapiens
gaagctcttactctttccta

SEQ ID NO: 6220958 - DNA, 13 bp, Homo sapiens
gaagctcttggac

SEQ ID NO: 6220959 - DNA, 22 bp, Homo sapiens
gaagctgaaaacctaagtcctt

SEQ ID NO: 6220960 - DNA, 14 bp, Homo sapiens
gaagctgaaaatat

SEQ ID NO: 6220961 - DNA, 15 bp, Homo sapiens
gaagctgaaaatata

SEQ ID NO: 6220962 - DNA, 15 bp, Homo sapiens
gaagctgaagatccc

SEQ ID NO: 6220963 - DNA, 16 bp, Homo sapiens
gaagctgaagcccccc

SEQ ID NO: 6220964 - DNA, 15 bp, Homo sapiens
gaagctgacctttaa

SEQ ID NO: 6220965 - DNA, 14 bp, Homo sapiens
gaagctgagaagaa

SEQ ID NO: 6220966 - DNA, 15 bp, Homo sapiens
gaagctgagaagaag

SEQ ID NO: 6220967 - DNA, 14 bp, Homo sapiens
gaagctgagcacca

SEQ ID NO: 6220968 - DNA, 14 bp, Homo sapiens
gaagctgagctttt

SEQ ID NO: 6220969 - DNA, 12 bp, Homo sapiens
gaagctgaggaa

SEQ ID NO: 6220970 - DNA, 14 bp, Homo sapiens
gaagctgaggatcc

SEQ ID NO: 6220971 - DNA, 19 bp, Homo sapiens
gaagctgaggatcctcaca

SEQ ID NO: 6220972 - DNA, 14 bp, Homo sapiens
gaagctgaggccca

SEQ ID NO: 6220973 - DNA, 17 bp, Homo sapiens
gaagctgaggcccatgg

SEQ ID NO: 6220974 - DNA, 20 bp, Homo sapiens
gaagctgaggcccatggcca

SEQ ID NO: 6220975 - DNA, 19 bp, Homo sapiens
gaagctgaggctgctgcca

SEQ ID NO: 6220976 - DNA, 20 bp, Homo sapiens
gaagctgatccagtttccgg

SEQ ID NO: 6220977 - DNA, 14 bp, Homo sapiens
gaagctgatgagga

SEQ ID NO: 6220978 - DNA, 21 bp, Homo sapiens
gaagctgatgctttgcttcaa

SEQ ID NO: 6220979 - DNA, 18 bp, Homo sapiens
gaagctgattttcatgaa

SEQ ID NO: 6220980 - DNA, 18 bp, Homo sapiens
gaagctgcagctggtctg

SEQ ID NO: 6220981 - DNA, 18 bp, Homo sapiens
gaagctgcagcttgggag

SEQ ID NO: 6220982 - DNA, 20 bp, Homo sapiens
gaagctgccacccctcttct

SEQ ID NO: 6220983 - DNA, 17 bp, Homo sapiens
gaagctgccagcccaga

SEQ ID NO: 6220984 - DNA, 16 bp, Homo sapiens
gaagctgccctgccca

SEQ ID NO: 6220985 - DNA, 18 bp, Homo sapiens
gaagctgccgtagcttca

SEQ ID NO: 6220986 - DNA, 13 bp, Homo sapiens
gaagctgctcact

SEQ ID NO: 6220987 - DNA, 22 bp, Homo sapiens
gaagctgctgaccaattgtgct

SEQ ID NO: 6220988 - DNA, 17 bp, Homo sapiens
gaagctgctgaggcccc

SEQ ID NO: 6220989 - DNA, 12 bp, Homo sapiens
gaagctgctgca

SEQ ID NO: 6220990 - DNA, 15 bp, Homo sapiens
gaagctgctgcagcc

SEQ ID NO: 6220991 - DNA, 19 bp, Homo sapiens
gaagctgctgcagccctgc

SEQ ID NO: 6220992 - DNA, 16 bp, Homo sapiens
gaagctgctgtctcta

SEQ ID NO: 6220993 - DNA, 17 bp, Homo sapiens
gaagctgcttctgccca

SEQ ID NO: 6220994 - DNA, 18 bp, Homo sapiens
gaagctgcttctgcccac

SEQ ID NO: 6220995 - DNA, 21 bp, Homo sapiens
gaagctggacttctgtgggcc

SEQ ID NO: 6220996 - DNA, 21 bp, Homo sapiens
gaagctggagcccagcgtcag

SEQ ID NO: 6220997 - DNA, 19 bp, Homo sapiens
gaagctggagtgctgcttg

SEQ ID NO: 6220998 - DNA, 22 bp, Homo sapiens
gaagctgggactcattcacatt

SEQ ID NO: 6220999 - DNA, 13 bp, Homo sapiens
gaagctgggaggg

SEQ ID NO: 6221000 - DNA, 14 bp, Homo sapiens
gaagctgggaggga

SEQ ID NO: 6221001 - DNA, 18 bp, Homo sapiens
gaagctgggcccaaaggc

SEQ ID NO: 6221002 - DNA, 23 bp, Homo sapiens
gaagctgggtgagccaaggacag

SEQ ID NO: 6221003 - DNA, 22 bp, Homo sapiens
gaagctgtacccaatttaattc

SEQ ID NO: 6221004 - DNA, 22 bp, Homo sapiens
gaagctgtactcagagcagagc

SEQ ID NO: 6221005 - DNA, 14 bp, Homo sapiens
gaagctgtactttt

SEQ ID NO: 6221006 - DNA, 14 bp, Homo sapiens
gaagctgtcaggct

SEQ ID NO: 6221007 - DNA, 23 bp, Homo sapiens
gaagctgtgtccttgcacctgca

SEQ ID NO: 6221008 - DNA, 20 bp, Homo sapiens
gaagctgtgttgaaacagaa

SEQ ID NO: 6221009 - DNA, 21 bp, Homo sapiens
gaagctgtgttgaaacagaaa

SEQ ID NO: 6221010 - DNA, 16 bp, Homo sapiens
gaagctgttggtgttc

SEQ ID NO: 6221011 - DNA, 21 bp, Homo sapiens
gaagctgttgtacatttatga

SEQ ID NO: 6221012 - DNA, 15 bp, Homo sapiens
gaagctgtttggaaa

SEQ ID NO: 6221013 - DNA, 18 bp, Homo sapiens
gaagcttaaaataaagtt

SEQ ID NO: 6221014 - DNA, 18 bp, Homo sapiens
gaagcttactctctgctt

SEQ ID NO: 6221015 - DNA, 19 bp, Homo sapiens
gaagcttactctctgcttc

SEQ ID NO: 6221016 - DNA, 15 bp, Homo sapiens
gataacatacttctt

SEQ ID NO: 6221017 - DNA, 12 bp, Homo sapiens
gataacattttc

SEQ ID NO: 6221018 - DNA, 17 bp, Homo sapiens
gataaccatagcatagg

SEQ ID NO: 6221019 - DNA, 22 bp, Homo sapiens
gataaccccaggcactgtttgg

SEQ ID NO: 6221020 - DNA, 23 bp, Homo sapiens
gataacctatatgatttatagtt

SEQ ID NO: 6221021 - DNA, 21 bp, Homo sapiens
gataacctgtacttcaagtta

SEQ ID NO: 6221022 - DNA, 20 bp, Homo sapiens
gataaccttgtttattagca

SEQ ID NO: 6221023 - DNA, 19 bp, Homo sapiens
gataacgcaggagagagag

SEQ ID NO: 6221024 - DNA, 21 bp, Homo sapiens
gataacgcttaaaggaagtca

SEQ ID NO: 6221025 - DNA, 15 bp, Homo sapiens
gataacggctctcca

SEQ ID NO: 6221026 - DNA, 11 bp, Homo sapiens
gataactaaaa

SEQ ID NO: 6221027 - DNA, 17 bp, Homo sapiens
gataactactgacgaaa

SEQ ID NO: 6221028 - DNA, 13 bp, Homo sapiens
gataactagatgg

SEQ ID NO: 6221029 - DNA, 17 bp, Homo sapiens
gataactagatggtgct

SEQ ID NO: 6221030 - DNA, 19 bp, Homo sapiens
gataactagatggtgctga

SEQ ID NO: 6221031 - DNA, 21 bp, Homo sapiens
gataactatttacatataata

SEQ ID NO: 6221032 - DNA, 18 bp, Homo sapiens
gataactcaccatcttga

SEQ ID NO: 6221033 - DNA, 19 bp, Homo sapiens
gataactcaccatcttgaa

SEQ ID NO: 6221034 - DNA, 19 bp, Homo sapiens
gataactctctttccttga

SEQ ID NO: 6221035 - DNA, 21 bp, Homo sapiens
gataactctgcaaaggcctgg

SEQ ID NO: 6221036 - DNA, 13 bp, Homo sapiens
gataactctgtac

SEQ ID NO: 6221037 - DNA, 21 bp, Homo sapiens
gataactgaaaattatttaaa

SEQ ID NO: 6221038 - DNA, 15 bp, Homo sapiens
gataactgatggcaa

SEQ ID NO: 6221039 - DNA, 14 bp, Homo sapiens
gataactgatttct

SEQ ID NO: 6221040 - DNA, 22 bp, Homo sapiens
gataactgatttctatggcttt

SEQ ID NO: 6221041 - DNA, 17 bp, Homo sapiens
gataactgctgtattca

SEQ ID NO: 6221042 - DNA, 17 bp, Homo sapiens
gataactgttatttata

SEQ ID NO: 6221043 - DNA, 14 bp, Homo sapiens
gataacttaaataa

SEQ ID NO: 6221044 - DNA, 21 bp, Homo sapiens
gataacttaggtggcaagctg

SEQ ID NO: 6221045 - DNA, 21 bp, Homo sapiens
gataacttccttgcccctgct

SEQ ID NO: 6221046 - DNA, 16 bp, Homo sapiens
gataacttcttgaaaa

SEQ ID NO: 6221047 - DNA, 18 bp, Homo sapiens
gataacttcttgaaaaag

SEQ ID NO: 6221048 - DNA, 19 bp, Homo sapiens
gataacttgcatactattg

SEQ ID NO: 6221049 - DNA, 19 bp, Homo sapiens
gataacttttttgagtcat

SEQ ID NO: 6221050 - DNA, 23 bp, Homo sapiens
gataagacattttgtttttactg

SEQ ID NO: 6221051 - DNA, 20 bp, Homo sapiens
gataagacttgtttctttct

SEQ ID NO: 6221052 - DNA, 20 bp, Homo sapiens
gataagagggcacacactgt

SEQ ID NO: 6221053 - DNA, 13 bp, Homo sapiens
gataagattgaaa

SEQ ID NO: 6221054 - DNA, 20 bp, Homo sapiens
gataagcagttatgtgacct

SEQ ID NO: 6221055 - DNA, 15 bp, Homo sapiens
gataagcctgaaaca

SEQ ID NO: 6221056 - DNA, 14 bp, Homo sapiens
gataagcctgagcc

SEQ ID NO: 6221057 - DNA, 18 bp, Homo sapiens
gataagcctgagccttag

SEQ ID NO: 6221058 - DNA, 21 bp, Homo sapiens
gataaggaaactgaggcccag

SEQ ID NO: 6221059 - DNA, 15 bp, Homo sapiens
gataaggaagaaaca

SEQ ID NO: 6221060 - DNA, 14 bp, Homo sapiens
gataaggacatgat

SEQ ID NO: 6221061 - DNA, 20 bp, Homo sapiens
gataaggacatgatgctttt

SEQ ID NO: 6221062 - DNA, 20 bp, Homo sapiens
gataaggactagatactact

SEQ ID NO: 6221063 - DNA, 20 bp, Homo sapiens
gataaggatgatacagtctc

SEQ ID NO: 6221064 - DNA, 16 bp, Homo sapiens
gataaggcaacaaaat

SEQ ID NO: 6221065 - DNA, 19 bp, Homo sapiens
gataaggcagttgaacctg

SEQ ID NO: 6221066 - DNA, 21 bp, Homo sapiens
gataaggccgagcccacacca

SEQ ID NO: 6221067 - DNA, 17 bp, Homo sapiens
gataagggagagggaaa

SEQ ID NO: 6221068 - DNA, 13 bp, Homo sapiens
gataaggggcctt

SEQ ID NO: 6221069 - DNA, 20 bp, Homo sapiens
gataaggggccttgctctga

SEQ ID NO: 6221070 - DNA, 22 bp, Homo sapiens
gataaggggccttgctctgagc

SEQ ID NO: 6221071 - DNA, 15 bp, Homo sapiens
gataaggggtggggg

SEQ ID NO: 6221072 - DNA, 22 bp, Homo sapiens
gataaggggtgggggagaaaaa

SEQ ID NO: 6221073 - DNA, 20 bp, Homo sapiens
gataaggtaaaatgccatga

SEQ ID NO: 6221074 - DNA, 16 bp, Homo sapiens
gataaggtctgtagta

SEQ ID NO: 6221075 - DNA, 14 bp, Homo sapiens
gataaggtggcttc

SEQ ID NO: 6221076 - DNA, 15 bp, Homo sapiens
gataaggtttcctgc

SEQ ID NO: 6221077 - DNA, 16 bp, Homo sapiens
gataagtaatgaaagt

SEQ ID NO: 6221078 - DNA, 13 bp, Homo sapiens
gataagtggaaaa

SEQ ID NO: 6221079 - DNA, 19 bp, Homo sapiens
gataagtggaaaaaagaga

SEQ ID NO: 6221080 - DNA, 22 bp, Homo sapiens
gataagtgttctgtctgacttt

SEQ ID NO: 6221081 - DNA, 19 bp, Homo sapiens
gataagtgttcttcagtgt

SEQ ID NO: 6221082 - DNA, 16 bp, Homo sapiens
gataagttcatacatt

SEQ ID NO: 6221083 - DNA, 22 bp, Homo sapiens
gataagttggaaacactaaatg

SEQ ID NO: 6221084 - DNA, 16 bp, Homo sapiens
gataagttggagcagg

SEQ ID NO: 6221085 - DNA, 16 bp, Homo sapiens
gataataaaattcatt

SEQ ID NO: 6221086 - DNA, 17 bp, Homo sapiens
gataataaaatttagac

SEQ ID NO: 6221087 - DNA, 18 bp, Homo sapiens
gataataactagatctcc

SEQ ID NO: 6221088 - DNA, 14 bp, Homo sapiens
gataataagattag

SEQ ID NO: 6221089 - DNA, 11 bp, Homo sapiens
gataataataa

SEQ ID NO: 6221090 - DNA, 13 bp, Homo sapiens
gataataataata

SEQ ID NO: 6221091 - DNA, 16 bp, Homo sapiens
gataataatatatgtt

SEQ ID NO: 6221092 - DNA, 19 bp, Homo sapiens
gataataatattgtttttc

SEQ ID NO: 6221093 - DNA, 14 bp, Homo sapiens
gataataatcttgg

SEQ ID NO: 6221094 - DNA, 18 bp, Homo sapiens
gataataatgcttaataa

SEQ ID NO: 6221095 - DNA, 18 bp, Homo sapiens
gataataattttatagaa

SEQ ID NO: 6221096 - DNA, 18 bp, Homo sapiens
gataatacaccactacat

SEQ ID NO: 6221097 - DNA, 24 bp, Homo sapiens
gataatacaccactacattctgtt

SEQ ID NO: 6221098 - DNA, 13 bp, Homo sapiens
gataatacttgac

SEQ ID NO: 6221099 - DNA, 17 bp, Homo sapiens
gataatacttgacctct

SEQ ID NO: 6221100 - DNA, 21 bp, Homo sapiens
gataatagctcacagcacatt

SEQ ID NO: 6221101 - DNA, 20 bp, Homo sapiens
gataataggggattttaaaa

SEQ ID NO: 6221102 - DNA, 12 bp, Homo sapiens
gataatatataa

SEQ ID NO: 6221103 - DNA, 17 bp, Homo sapiens
gataatatattttcaag

SEQ ID NO: 6221104 - DNA, 17 bp, Homo sapiens
gataatatgagatttct

SEQ ID NO: 6221105 - DNA, 20 bp, Homo sapiens
gataatatgtttgaggttaa

SEQ ID NO: 6221106 - DNA, 15 bp, Homo sapiens
gataatattagtgat

SEQ ID NO: 6221107 - DNA, 21 bp, Homo sapiens
gataatattagtgattctgat

SEQ ID NO: 6221108 - DNA, 16 bp, Homo sapiens
gataatatttaaaata

SEQ ID NO: 6221109 - DNA, 15 bp, Homo sapiens
gataatcagcctctt

SEQ ID NO: 6221110 - DNA, 13 bp, Homo sapiens
gataatcaggaaa

SEQ ID NO: 6221111 - DNA, 15 bp, Homo sapiens
gataatcattttgag

SEQ ID NO: 6221112 - DNA, 23 bp, Homo sapiens
gataatccaaagcgatcatgtca

SEQ ID NO: 6221113 - DNA, 16 bp, Homo sapiens
gataatcccaccaccc

SEQ ID NO: 6221114 - DNA, 13 bp, Homo sapiens
gataatctgagca

SEQ ID NO: 6221115 - DNA, 20 bp, Homo sapiens
gataatctgagcaggtacat

SEQ ID NO: 6221116 - DNA, 18 bp, Homo sapiens
gataatcttagctgccaa

SEQ ID NO: 6221117 - DNA, 13 bp, Homo sapiens
gataatcttcagg

SEQ ID NO: 6221118 - DNA, 17 bp, Homo sapiens
gataatctttatggttc

SEQ ID NO: 6221119 - DNA, 13 bp, Homo sapiens
gataatgaacaga

SEQ ID NO: 6221120 - DNA, 18 bp, Homo sapiens
gataatgagatgtaatac

SEQ ID NO: 6221121 - DNA, 22 bp, Homo sapiens
gataatgagatgtaatacacca

SEQ ID NO: 6221122 - DNA, 22 bp, Homo sapiens
gataatgaggcaactcagcagg

SEQ ID NO: 6221123 - DNA, 20 bp, Homo sapiens
gataatgagttttacattac

SEQ ID NO: 6221124 - DNA, 16 bp, Homo sapiens
gataatgataacttgt

SEQ ID NO: 6221125 - DNA, 16 bp, Homo sapiens
gataatgcagataaat

SEQ ID NO: 6221126 - DNA, 20 bp, Homo sapiens
gataatgcatatttttgcac

SEQ ID NO: 6221127 - DNA, 15 bp, Homo sapiens
gataatgctgttgcc

SEQ ID NO: 6221128 - DNA, 17 bp, Homo sapiens
gataatgcttttactaa

SEQ ID NO: 6221129 - DNA, 16 bp, Homo sapiens
gataatggagaatgta

SEQ ID NO: 6221130 - DNA, 17 bp, Homo sapiens
gataatggtaatttagt

SEQ ID NO: 6221131 - DNA, 13 bp, Homo sapiens
gataatgtattgc

SEQ ID NO: 6221132 - DNA, 16 bp, Homo sapiens
gataatgtcaaaatca

SEQ ID NO: 6221133 - DNA, 18 bp, Homo sapiens
gataatgtccccactccc

SEQ ID NO: 6221134 - DNA, 19 bp, Homo sapiens
gataatgtggattaaaacc

SEQ ID NO: 6221135 - DNA, 11 bp, Homo sapiens
gataatgttaa

SEQ ID NO: 6221136 - DNA, 19 bp, Homo sapiens
gataatgttaaatttgtaa

SEQ ID NO: 6221137 - DNA, 17 bp, Homo sapiens
gataatgttctgggaag

SEQ ID NO: 6221138 - DNA, 14 bp, Homo sapiens
gataattaaatgaa

SEQ ID NO: 6221139 - DNA, 17 bp, Homo sapiens
gataattacaatacaaa

SEQ ID NO: 6221140 - DNA, 19 bp, Homo sapiens
gataattacaatacaaagg

SEQ ID NO: 6221141 - DNA, 14 bp, Homo sapiens
gataattataatat

SEQ ID NO: 6221142 - DNA, 22 bp, Homo sapiens
gataattcatttgtattgctta

SEQ ID NO: 6221143 - DNA, 17 bp, Homo sapiens
gataattccagtggtcc

SEQ ID NO: 6221144 - DNA, 13 bp, Homo sapiens
gataattcttact

SEQ ID NO: 6221145 - DNA, 12 bp, Homo sapiens
gataattgtaaa

SEQ ID NO: 6221146 - DNA, 17 bp, Homo sapiens
gataattgtgtagtaat

SEQ ID NO: 6221147 - DNA, 14 bp, Homo sapiens
gataattgttgaaa

SEQ ID NO: 6221148 - DNA, 16 bp, Homo sapiens
gataattgttgaaatt

SEQ ID NO: 6221149 - DNA, 12 bp, Homo sapiens
gataatttaaga

SEQ ID NO: 6221150 - DNA, 23 bp, Homo sapiens
gataatttattgtaccaaagctg

SEQ ID NO: 6221151 - DNA, 22 bp, Homo sapiens
gataatttatttcaataaatct

SEQ ID NO: 6221152 - DNA, 14 bp, Homo sapiens
gataatttcaggga

SEQ ID NO: 6221153 - DNA, 22 bp, Homo sapiens
gataatttcagggaaattaatc

SEQ ID NO: 6221154 - DNA, 21 bp, Homo sapiens
gataatttgcatattctattg

SEQ ID NO: 6221155 - DNA, 18 bp, Homo sapiens
gataattttaaattctct

SEQ ID NO: 6221156 - DNA, 22 bp, Homo sapiens
gataattttcctttaatatgaa

SEQ ID NO: 6221157 - DNA, 18 bp, Homo sapiens
gataattttgaaatgatt

SEQ ID NO: 6221158 - DNA, 16 bp, Homo sapiens
gataatttttaaaaga

SEQ ID NO: 6221159 - DNA, 11 bp, Homo sapiens
gataatttttt

SEQ ID NO: 6221160 - DNA, 12 bp, Homo sapiens
gatacaaaatgc

SEQ ID NO: 6221161 - DNA, 13 bp, Homo sapiens
gatacaaagtgtt

SEQ ID NO: 6221162 - DNA, 20 bp, Homo sapiens
gatacaacttcaagtgcatg

SEQ ID NO: 6221163 - DNA, 22 bp, Homo sapiens
gatacaagaaaaagtagaaaaa

SEQ ID NO: 6221164 - DNA, 14 bp, Homo sapiens
gatacaaggatcag

SEQ ID NO: 6221165 - DNA, 14 bp, Homo sapiens
gatacaataaaaca

SEQ ID NO: 6221166 - DNA, 12 bp, Homo sapiens
gatacaataaat

SEQ ID NO: 6221167 - DNA, 17 bp, Homo sapiens
gatacaatcagctgctt

SEQ ID NO: 6221168 - DNA, 13 bp, Homo sapiens
gatacaatctggg

SEQ ID NO: 6221169 - DNA, 19 bp, Homo sapiens
gatacaatctgggatagtt

SEQ ID NO: 6221170 - DNA, 22 bp, Homo sapiens
gatacacaagagggactgtatt

SEQ ID NO: 6221171 - DNA, 18 bp, Homo sapiens
gatacactcaagcatgaa

SEQ ID NO: 6221172 - DNA, 23 bp, Homo sapiens
gatacactcaagcatgaagataa

SEQ ID NO: 6221173 - DNA, 16 bp, Homo sapiens
gatacactgcactttg

SEQ ID NO: 6221174 - DNA, 12 bp, Homo sapiens
gatacagacatt

SEQ ID NO: 6221175 - DNA, 17 bp, Homo sapiens
gatacagacattcaatg

SEQ ID NO: 6221176 - DNA, 17 bp, Homo sapiens
gatacagagtatatttc

SEQ ID NO: 6221177 - DNA, 22 bp, Homo sapiens
gatacagatccgcatgtgtctg

SEQ ID NO: 6221178 - DNA, 22 bp, Homo sapiens
gatacaggactggttccttcct

SEQ ID NO: 6221179 - DNA, 21 bp, Homo sapiens
gatacaggcccctgggtttct

SEQ ID NO: 6221180 - DNA, 23 bp, Homo sapiens
gatacagggagccggcggcctct

SEQ ID NO: 6221181 - DNA, 17 bp, Homo sapiens
gatacagtcaacaagcc

SEQ ID NO: 6221182 - DNA, 23 bp, Homo sapiens
gatacagtggagaatgggggtga

SEQ ID NO: 6221183 - DNA, 18 bp, Homo sapiens
gatacagtgtaggcattt

SEQ ID NO: 6221184 - DNA, 16 bp, Homo sapiens
gatacagtgtttttta

SEQ ID NO: 6221185 - DNA, 19 bp, Homo sapiens
gatacagttactcagaatt

SEQ ID NO: 6221186 - DNA, 23 bp, Homo sapiens
gatacagttactcagaattctct

SEQ ID NO: 6221187 - DNA, 16 bp, Homo sapiens
gatacataaaaattaa

SEQ ID NO: 6221188 - DNA, 21 bp, Homo sapiens
gatacatacaccagcattcct

SEQ ID NO: 6221189 - DNA, 14 bp, Homo sapiens
gatacatacagaat

SEQ ID NO: 6221190 - DNA, 14 bp, Homo sapiens
gatacatagatgga

SEQ ID NO: 6221191 - DNA, 16 bp, Homo sapiens
gatacatatactgatt

SEQ ID NO: 6221192 - DNA, 20 bp, Homo sapiens
gatacatatgagtgtggaag

SEQ ID NO: 6221193 - DNA, 17 bp, Homo sapiens
gatacatcactgcttga

SEQ ID NO: 6221194 - DNA, 23 bp, Homo sapiens
gatacatccaaagcagacagctc

SEQ ID NO: 6221195 - DNA, 17 bp, Homo sapiens
gatacatctgctgtgtg

SEQ ID NO: 6221196 - DNA, 21 bp, Homo sapiens
gatacatgctaagaaagcaaa

SEQ ID NO: 6221197 - DNA, 13 bp, Homo sapiens
gatacatggggaa

SEQ ID NO: 6221198 - DNA, 18 bp, Homo sapiens
gatacatggggaactgca

SEQ ID NO: 6221199 - DNA, 16 bp, Homo sapiens
gatacattagcagcta

SEQ ID NO: 6221200 - DNA, 18 bp, Homo sapiens
gatacatttatcttctgt

SEQ ID NO: 6221201 - DNA, 23 bp, Homo sapiens
gatacatttatcttctgtttttc

SEQ ID NO: 6221202 - DNA, 11 bp, Homo sapiens
gatacattttt

SEQ ID NO: 6221203 - DNA, 13 bp, Homo sapiens
gataccaaagaga

SEQ ID NO: 6221204 - DNA, 20 bp, Homo sapiens
gataccaaagagacagggcc

SEQ ID NO: 6221205 - DNA, 17 bp, Homo sapiens
gataccacctttactgt

SEQ ID NO: 6221206 - DNA, 23 bp, Homo sapiens
gataccacttttcattgcaaagt

SEQ ID NO: 6221207 - DNA, 22 bp, Homo sapiens
gataccagcgaggaggctccag

SEQ ID NO: 6221208 - DNA, 16 bp, Homo sapiens
gataccagctcagggg

SEQ ID NO: 6221209 - DNA, 13 bp, Homo sapiens
gataccagctgga

SEQ ID NO: 6221210 - DNA, 17 bp, Homo sapiens
gataccaggttgaaaga

SEQ ID NO: 6221211 - DNA, 18 bp, Homo sapiens
gataccatatacagctca

SEQ ID NO: 6221212 - DNA, 20 bp, Homo sapiens
gataccatgatgctgagccc

SEQ ID NO: 6221213 - DNA, 19 bp, Homo sapiens
gataccatgctgtaaggat

SEQ ID NO: 6221214 - DNA, 17 bp, Homo sapiens
gataccatgtataattt

SEQ ID NO: 6221215 - DNA, 16 bp, Homo sapiens
gatacccaacagttta

SEQ ID NO: 6221216 - DNA, 23 bp, Homo sapiens
gatacccaacagtttatttttat

SEQ ID NO: 6221217 - DNA, 21 bp, Homo sapiens
gatacccagagagaaaaagag

SEQ ID NO: 6221218 - DNA, 15 bp, Homo sapiens
gatacccagtggaat

SEQ ID NO: 6221219 - DNA, 13 bp, Homo sapiens
gatacccccctct

SEQ ID NO: 6221220 - DNA, 19 bp, Homo sapiens
gataccctgtttctggagt

SEQ ID NO: 6221221 - DNA, 21 bp, Homo sapiens
gataccgccacgggtttccct

SEQ ID NO: 6221222 - DNA, 21 bp, Homo sapiens
gatacctaaaacataagatca

SEQ ID NO: 6221223 - DNA, 20 bp, Homo sapiens
gatacctataaagaggatcg

SEQ ID NO: 6221224 - DNA, 14 bp, Homo sapiens
gatacctcagccct

SEQ ID NO: 6221225 - DNA, 15 bp, Homo sapiens
gatacctcagccctg

SEQ ID NO: 6221226 - DNA, 22 bp, Homo sapiens
gatacctcagccctggccctgc

SEQ ID NO: 6221227 - DNA, 15 bp, Homo sapiens
gatacctcatcatcc

SEQ ID NO: 6221228 - DNA, 18 bp, Homo sapiens
gatacctccaaccctgcc

SEQ ID NO: 6221229 - DNA, 20 bp, Homo sapiens
gatacctccaaccctgccgt

SEQ ID NO: 6221230 - DNA, 18 bp, Homo sapiens
gatacctgctttggaagc

SEQ ID NO: 6221231 - DNA, 17 bp, Homo sapiens
gataccttaaaatttga

SEQ ID NO: 6221232 - DNA, 21 bp, Homo sapiens
gataccttaaaatttgaaaca

SEQ ID NO: 6221233 - DNA, 11 bp, Homo sapiens
gataccttcaa

SEQ ID NO: 6221234 - DNA, 18 bp, Homo sapiens
gataccttccatctcaac

SEQ ID NO: 6221235 - DNA, 13 bp, Homo sapiens
gataccttgaaaa

SEQ ID NO: 6221236 - DNA, 22 bp, Homo sapiens
gatacctttccccaaatagcct

SEQ ID NO: 6221237 - DNA, 14 bp, Homo sapiens
gatacgaaatcagt

SEQ ID NO: 6221238 - DNA, 16 bp, Homo sapiens
gatacgcatcagacag

SEQ ID NO: 6221239 - DNA, 15 bp, Homo sapiens
gatacgctggtctgg

SEQ ID NO: 6221240 - DNA, 20 bp, Homo sapiens
gatacggggtcttgctctgt

SEQ ID NO: 6221241 - DNA, 19 bp, Homo sapiens
gatacgtagttgtgctttt

SEQ ID NO: 6221242 - DNA, 17 bp, Homo sapiens
gatacgtatatttttaa

SEQ ID NO: 6221243 - DNA, 21 bp, Homo sapiens
gatacgtccgtgtgtcccaga

SEQ ID NO: 6221244 - DNA, 13 bp, Homo sapiens
gatacgtgtatga

SEQ ID NO: 6221245 - DNA, 14 bp, Homo sapiens
gatactaaagcaaa

SEQ ID NO: 6221246 - DNA, 18 bp, Homo sapiens
gatactacaacttttgtt

SEQ ID NO: 6221247 - DNA, 11 bp, Homo sapiens
gatactacagt

SEQ ID NO: 6221248 - DNA, 13 bp, Homo sapiens
gatactacatctt

SEQ ID NO: 6221249 - DNA, 16 bp, Homo sapiens
gatactaccagggtct

SEQ ID NO: 6221250 - DNA, 15 bp, Homo sapiens
gatactactttctct

SEQ ID NO: 6221251 - DNA, 21 bp, Homo sapiens
gatactgaattgttatgtaaa

SEQ ID NO: 6221252 - DNA, 20 bp, Homo sapiens
gatactgagattgtctgttc

SEQ ID NO: 6221253 - DNA, 17 bp, Homo sapiens
gatactgattatgaaat

SEQ ID NO: 6221254 - DNA, 18 bp, Homo sapiens
gatactgattatgaaatg

SEQ ID NO: 6221255 - DNA, 15 bp, Homo sapiens
gatactgcaaaggct

SEQ ID NO: 6221256 - DNA, 15 bp, Homo sapiens
gatactgcccggggc

SEQ ID NO: 6221257 - DNA, 17 bp, Homo sapiens
gatactgcctcccccag

SEQ ID NO: 6221258 - DNA, 20 bp, Homo sapiens
gatactgcgactttctgcct

SEQ ID NO: 6221259 - DNA, 19 bp, Homo sapiens
gatactgctgcttgtcaaa

SEQ ID NO: 6221260 - DNA, 15 bp, Homo sapiens
gatactgctgtgtaa

SEQ ID NO: 6221261 - DNA, 17 bp, Homo sapiens
gatactggggggcaggc

SEQ ID NO: 6221262 - DNA, 20 bp, Homo sapiens
gatactgggtacaagagcca

SEQ ID NO: 6221263 - DNA, 22 bp, Homo sapiens
gatactgtaacactttacaatg

SEQ ID NO: 6221264 - DNA, 13 bp, Homo sapiens
gatactgtactga

SEQ ID NO: 6221265 - DNA, 22 bp, Homo sapiens
gatactgtctctccagtgaaat

SEQ ID NO: 6221266 - DNA, 17 bp, Homo sapiens
gatactgtctctttcat

SEQ ID NO: 6221267 - DNA, 23 bp, Homo sapiens
gatactgtgagcttacattgaaa

SEQ ID NO: 6221268 - DNA, 13 bp, Homo sapiens
gatactgttgcac

SEQ ID NO: 6221269 - DNA, 13 bp, Homo sapiens
gatactgtttctt

SEQ ID NO: 6221270 - DNA, 14 bp, Homo sapiens
gatactgtttcttg

SEQ ID NO: 6221271 - DNA, 17 bp, Homo sapiens
gatactgtttcttgcac

SEQ ID NO: 6221272 - DNA, 22 bp, Homo sapiens
gatactgtttcttgcactgaat

SEQ ID NO: 6221273 - DNA, 18 bp, Homo sapiens
gatacttaacaaatacat

SEQ ID NO: 6221274 - DNA, 22 bp, Homo sapiens
gatacttagtggtatgtctctt

SEQ ID NO: 6221275 - DNA, 22 bp, Homo sapiens
gatacttatattttcgtatgaa

SEQ ID NO: 6221276 - DNA, 19 bp, Homo sapiens
gatacttatttaaatagat

SEQ ID NO: 6221277 - DNA, 22 bp, Homo sapiens
gatacttcgacactgttcttag

SEQ ID NO: 6221278 - DNA, 23 bp, Homo sapiens
gatacttcgacactgttcttagc

SEQ ID NO: 6221279 - DNA, 16 bp, Homo sapiens
gatacttgaaaattaa

SEQ ID NO: 6221280 - DNA, 17 bp, Homo sapiens
gatacttgaaaattaac

SEQ ID NO: 6221281 - DNA, 15 bp, Homo sapiens
gatacttgaattttt

SEQ ID NO: 6221282 - DNA, 13 bp, Homo sapiens
gatacttggattt

SEQ ID NO: 6221283 - DNA, 14 bp, Homo sapiens
gatacttggtcctt

SEQ ID NO: 6221284 - DNA, 17 bp, Homo sapiens
gatacttgttccagatg

SEQ ID NO: 6221285 - DNA, 20 bp, Homo sapiens
gatactttagtacaatttca

SEQ ID NO: 6221286 - DNA, 16 bp, Homo sapiens
gatactttgtattgtc

SEQ ID NO: 6221287 - DNA, 15 bp, Homo sapiens
gatacttttattgtt

SEQ ID NO: 6221288 - DNA, 21 bp, Homo sapiens
gatactttttcttttgtaagt

SEQ ID NO: 6221289 - DNA, 18 bp, Homo sapiens
gatagaaaaaaactaaag

SEQ ID NO: 6221290 - DNA, 17 bp, Homo sapiens
gatagaaaaaggatgga

SEQ ID NO: 6221291 - DNA, 20 bp, Homo sapiens
gatagaaaaaggatggaaga

SEQ ID NO: 6221292 - DNA, 21 bp, Homo sapiens
gatagaaaaaggatggaagaa

SEQ ID NO: 6221293 - DNA, 23 bp, Homo sapiens
gatagaaaaaggatggaagaaag

SEQ ID NO: 6221294 - DNA, 17 bp, Homo sapiens
gatagaaaatccttcag

SEQ ID NO: 6221295 - DNA, 16 bp, Homo sapiens
gatagaaagcattaca

SEQ ID NO: 6221296 - DNA, 14 bp, Homo sapiens
gatagaaagctgga

SEQ ID NO: 6221297 - DNA, 16 bp, Homo sapiens
gatagaaagctggact

SEQ ID NO: 6221298 - DNA, 13 bp, Homo sapiens
gatagaaatgcca

SEQ ID NO: 6221299 - DNA, 19 bp, Homo sapiens
gatagaaatgccaagcact

SEQ ID NO: 6221300 - DNA, 21 bp, Homo sapiens
gatagaacacaaaacttgaaa

SEQ ID NO: 6221301 - DNA, 23 bp, Homo sapiens
gatagaacacaaaacttgaaaga

SEQ ID NO: 6221302 - DNA, 13 bp, Homo sapiens
gatagaactactt

SEQ ID NO: 6221303 - DNA, 15 bp, Homo sapiens
gatagaactgtactg

SEQ ID NO: 6221304 - DNA, 15 bp, Homo sapiens
gatagaactgtggca

SEQ ID NO: 6221305 - DNA, 14 bp, Homo sapiens
gatagaagaactgc

SEQ ID NO: 6221306 - DNA, 21 bp, Homo sapiens
gatagaagaaggactgaagaa

SEQ ID NO: 6221307 - DNA, 16 bp, Homo sapiens
gatagaagatgtttgc

SEQ ID NO: 6221308 - DNA, 20 bp, Homo sapiens
gatagacacatatgaggggg

SEQ ID NO: 6221309 - DNA, 12 bp, Homo sapiens
gatagacactgg

SEQ ID NO: 6221310 - DNA, 19 bp, Homo sapiens
gatagacactggacatggc

SEQ ID NO: 6221311 - DNA, 16 bp, Homo sapiens
gatagacgggttgaaa

SEQ ID NO: 6221312 - DNA, 21 bp, Homo sapiens
gatagacgggttgaaagacat

SEQ ID NO: 6221313 - DNA, 19 bp, Homo sapiens
gatagacttactaataaaa

SEQ ID NO: 6221314 - DNA, 13 bp, Homo sapiens
gatagacttggga

SEQ ID NO: 6221315 - DNA, 15 bp, Homo sapiens
gatagagaatgccct

SEQ ID NO: 6221316 - DNA, 19 bp, Homo sapiens
gatagagattcccctggac

SEQ ID NO: 6221317 - DNA, 15 bp, Homo sapiens
gatagagcaaagcat

SEQ ID NO: 6221318 - DNA, 14 bp, Homo sapiens
gatagagctgggtg

SEQ ID NO: 6221319 - DNA, 15 bp, Homo sapiens
gatagagctgggtgg

SEQ ID NO: 6221320 - DNA, 15 bp, Homo sapiens
gatagaggaaaggga

SEQ ID NO: 6221321 - DNA, 22 bp, Homo sapiens
gatagaggaaagggatggtaag

SEQ ID NO: 6221322 - DNA, 14 bp, Homo sapiens
gatagaggggctgc

SEQ ID NO: 6221323 - DNA, 15 bp, Homo sapiens
gatagagtaaaaaga

SEQ ID NO: 6221324 - DNA, 20 bp, Homo sapiens
gatagagtaaaaagaaaaca

SEQ ID NO: 6221325 - DNA, 13 bp, Homo sapiens
gatagagttccat

SEQ ID NO: 6221326 - DNA, 15 bp, Homo sapiens
gatagagtttaacag

SEQ ID NO: 6221327 - DNA, 17 bp, Homo sapiens
gatagatgactttgcag

SEQ ID NO: 6221328 - DNA, 17 bp, Homo sapiens
gatagatgctggcccag

SEQ ID NO: 6221329 - DNA, 15 bp, Homo sapiens
gatagatgtttgact

SEQ ID NO: 6221330 - DNA, 15 bp, Homo sapiens
gatagatttgacctc

SEQ ID NO: 6221331 - DNA, 20 bp, Homo sapiens
gatagcaagtcccatcagcc

SEQ ID NO: 6221332 - DNA, 18 bp, Homo sapiens
gatagcacagaccctgcc

SEQ ID NO: 6221333 - DNA, 23 bp, Homo sapiens
gatagcacctaaacttacattta

SEQ ID NO: 6221334 - DNA, 19 bp, Homo sapiens
gatagcactgagcaaagca

SEQ ID NO: 6221335 - DNA, 12 bp, Homo sapiens
gatagcactttc

SEQ ID NO: 6221336 - DNA, 22 bp, Homo sapiens
gatagcagaggaaaaagaaaaa

SEQ ID NO: 6221337 - DNA, 15 bp, Homo sapiens
gatagcagcctggct

SEQ ID NO: 6221338 - DNA, 13 bp, Homo sapiens
gatagcagggcat

SEQ ID NO: 6221339 - DNA, 22 bp, Homo sapiens
gatagcatggggcccctggccc

SEQ ID NO: 6221340 - DNA, 23 bp, Homo sapiens
gatagcatggggcccctggccca

SEQ ID NO: 6221341 - DNA, 14 bp, Homo sapiens
gatagcatgtcttt

SEQ ID NO: 6221342 - DNA, 22 bp, Homo sapiens
gatagcattgttttcttttaca

SEQ ID NO: 6221343 - DNA, 22 bp, Homo sapiens
gatagcatttttgatttatgca

SEQ ID NO: 6221344 - DNA, 16 bp, Homo sapiens
gatagccagacacatg

SEQ ID NO: 6221345 - DNA, 23 bp, Homo sapiens
gatagccatttccatggctctgt

SEQ ID NO: 6221346 - DNA, 14 bp, Homo sapiens
gatagcccagaaca

SEQ ID NO: 6221347 - DNA, 15 bp, Homo sapiens
gatagcccaggagca

SEQ ID NO: 6221348 - DNA, 23 bp, Homo sapiens
gatagccctgggtaccctgagcc

SEQ ID NO: 6221349 - DNA, 15 bp, Homo sapiens
gatagccctgtcctg

SEQ ID NO: 6221350 - DNA, 16 bp, Homo sapiens
gatagcctagggtgag

SEQ ID NO: 6221351 - DNA, 20 bp, Homo sapiens
gatagccttccgtaacccaa

SEQ ID NO: 6221352 - DNA, 16 bp, Homo sapiens
gatagccttgaaaaca

SEQ ID NO: 6221353 - DNA, 14 bp, Homo sapiens
gatagcctttgtag

SEQ ID NO: 6221354 - DNA, 15 bp, Homo sapiens
gatagcctttgtagg

SEQ ID NO: 6221355 - DNA, 16 bp, Homo sapiens
gatagctaacatttta

SEQ ID NO: 6221356 - DNA, 20 bp, Homo sapiens
gatagctaacattttaaata

SEQ ID NO: 6221357 - DNA, 22 bp, Homo sapiens
gatagctatattttatttctga

SEQ ID NO: 6221358 - DNA, 19 bp, Homo sapiens
gatagctctctgactgctt

SEQ ID NO: 6221359 - DNA, 13 bp, Homo sapiens
gatagctgcatgt

SEQ ID NO: 6221360 - DNA, 19 bp, Homo sapiens
gatagctgcatgtggcttt

SEQ ID NO: 6221361 - DNA, 13 bp, Homo sapiens
gatagctgtgact

SEQ ID NO: 6221362 - DNA, 18 bp, Homo sapiens
gatagcttacactgagga

SEQ ID NO: 6221363 - DNA, 19 bp, Homo sapiens
gatagcttacactgaggac

SEQ ID NO: 6221364 - DNA, 20 bp, Homo sapiens
gatagcttacactgaggact

SEQ ID NO: 6221365 - DNA, 22 bp, Homo sapiens
gataggaactgtctcaaaagga

SEQ ID NO: 6221366 - DNA, 21 bp, Homo sapiens
gataggaaggtcatttccatg

SEQ ID NO: 6221367 - DNA, 15 bp, Homo sapiens
gataggaccttgggc

SEQ ID NO: 6221368 - DNA, 21 bp, Homo sapiens
gataggactccatttctttct

SEQ ID NO: 6221369 - DNA, 15 bp, Homo sapiens
gataggagacttgta

SEQ ID NO: 6221370 - DNA, 14 bp, Homo sapiens
gataggaggaacca

SEQ ID NO: 6221371 - DNA, 14 bp, Homo sapiens
gataggagggggcg

SEQ ID NO: 6221372 - DNA, 15 bp, Homo sapiens
gataggagggtgccc

SEQ ID NO: 6221373 - DNA, 23 bp, Homo sapiens
gataggagttctctgatgcagaa

SEQ ID NO: 6221374 - DNA, 15 bp, Homo sapiens
gaagcttatgtttct

SEQ ID NO: 6221375 - DNA, 17 bp, Homo sapiens
gaagcttatgtttctta

SEQ ID NO: 6221376 - DNA, 22 bp, Homo sapiens
gaagcttattaatgctaagggc

SEQ ID NO: 6221377 - DNA, 12 bp, Homo sapiens
gaagcttcagca

SEQ ID NO: 6221378 - DNA, 21 bp, Homo sapiens
gaagcttcagcaggaggcaag

SEQ ID NO: 6221379 - DNA, 21 bp, Homo sapiens
gaagcttccatgatgcacagt

SEQ ID NO: 6221380 - DNA, 13 bp, Homo sapiens
gaagcttctaatt

SEQ ID NO: 6221381 - DNA, 15 bp, Homo sapiens
gaagcttgagcctcc

SEQ ID NO: 6221382 - DNA, 16 bp, Homo sapiens
gaagcttgagcctccc

SEQ ID NO: 6221383 - DNA, 18 bp, Homo sapiens
gaagcttgagcctccccc

SEQ ID NO: 6221384 - DNA, 16 bp, Homo sapiens
gaagcttgatttgctt

SEQ ID NO: 6221385 - DNA, 15 bp, Homo sapiens
gaagcttggaggagg

SEQ ID NO: 6221386 - DNA, 16 bp, Homo sapiens
gaagcttggaggaggg

SEQ ID NO: 6221387 - DNA, 22 bp, Homo sapiens
gaagcttgtgtatccattatca

SEQ ID NO: 6221388 - DNA, 23 bp, Homo sapiens
gaagcttgtgtatccattatcat

SEQ ID NO: 6221389 - DNA, 15 bp, Homo sapiens
gaagctttaagcaaa

SEQ ID NO: 6221390 - DNA, 18 bp, Homo sapiens
gaagctttaccagctgaa

SEQ ID NO: 6221391 - DNA, 20 bp, Homo sapiens
gaagctttactttagaattt

SEQ ID NO: 6221392 - DNA, 17 bp, Homo sapiens
gaagctttcaggggaag

SEQ ID NO: 6221393 - DNA, 15 bp, Homo sapiens
gaagctttctctgct

SEQ ID NO: 6221394 - DNA, 21 bp, Homo sapiens
gaagctttctctgcttcagct

SEQ ID NO: 6221395 - DNA, 21 bp, Homo sapiens
gaagctttggaagcagcaagg

SEQ ID NO: 6221396 - DNA, 20 bp, Homo sapiens
gaagctttggtgagaacctg

SEQ ID NO: 6221397 - DNA, 18 bp, Homo sapiens
gaagctttggttatgaaa

SEQ ID NO: 6221398 - DNA, 23 bp, Homo sapiens
gaagctttgtaggtgagatgcaa

SEQ ID NO: 6221399 - DNA, 20 bp, Homo sapiens
gaagctttgtcccctgcttc

SEQ ID NO: 6221400 - DNA, 19 bp, Homo sapiens
gaagctttttgtttgcatc

SEQ ID NO: 6221401 - DNA, 15 bp, Homo sapiens
gaaggaaaaacatgc

SEQ ID NO: 6221402 - DNA, 11 bp, Homo sapiens
gaaggaaaaat

SEQ ID NO: 6221403 - DNA, 18 bp, Homo sapiens
gaaggaaaagaaagaaga

SEQ ID NO: 6221404 - DNA, 14 bp, Homo sapiens
gaaggaaaatgata

SEQ ID NO: 6221405 - DNA, 15 bp, Homo sapiens
gaaggaaacaaatgt

SEQ ID NO: 6221406 - DNA, 19 bp, Homo sapiens
gaaggaaacatagaaagac

SEQ ID NO: 6221407 - DNA, 17 bp, Homo sapiens
gaaggaaacccagctct

SEQ ID NO: 6221408 - DNA, 21 bp, Homo sapiens
gaaggaaacccagctctggtc

SEQ ID NO: 6221409 - DNA, 21 bp, Homo sapiens
gaaggaaagaagggggccctg

SEQ ID NO: 6221410 - DNA, 22 bp, Homo sapiens
gaaggaaagaagggggccctgc

SEQ ID NO: 6221411 - DNA, 15 bp, Homo sapiens
gaaggaaagatgctc

SEQ ID NO: 6221412 - DNA, 23 bp, Homo sapiens
gaaggaaagcatgtctctgcttc

SEQ ID NO: 6221413 - DNA, 15 bp, Homo sapiens
gaaggaaagggaaga

SEQ ID NO: 6221414 - DNA, 15 bp, Homo sapiens
gaaggaaatgatgga

SEQ ID NO: 6221415 - DNA, 18 bp, Homo sapiens
gaaggaaatgatggaatt

SEQ ID NO: 6221416 - DNA, 15 bp, Homo sapiens
gaaggaacgtcccct

SEQ ID NO: 6221417 - DNA, 22 bp, Homo sapiens
gaaggaactcaaggtggctgga

SEQ ID NO: 6221418 - DNA, 12 bp, Homo sapiens
gaaggaagaggg

SEQ ID NO: 6221419 - DNA, 21 bp, Homo sapiens
gaaggaagatcttgagagctg

SEQ ID NO: 6221420 - DNA, 23 bp, Homo sapiens
gaaggaagatcttgagagctgct

SEQ ID NO: 6221421 - DNA, 20 bp, Homo sapiens
gaaggaagccggggaagaga

SEQ ID NO: 6221422 - DNA, 19 bp, Homo sapiens
gaaggaagctgtgttgaaa

SEQ ID NO: 6221423 - DNA, 20 bp, Homo sapiens
gaaggaaggcagggaggagg

SEQ ID NO: 6221424 - DNA, 21 bp, Homo sapiens
gaaggaaggcctgagcccctt

SEQ ID NO: 6221425 - DNA, 15 bp, Homo sapiens
gaaggaagggcagag

SEQ ID NO: 6221426 - DNA, 22 bp, Homo sapiens
gaaggaataaattgctccttga

SEQ ID NO: 6221427 - DNA, 16 bp, Homo sapiens
gaaggaatctgtgcag

SEQ ID NO: 6221428 - DNA, 16 bp, Homo sapiens
gaaggaatgcaataaa

SEQ ID NO: 6221429 - DNA, 16 bp, Homo sapiens
gaaggaatgtctttgg

SEQ ID NO: 6221430 - DNA, 23 bp, Homo sapiens
gaaggaatttgattgctttgctg

SEQ ID NO: 6221431 - DNA, 15 bp, Homo sapiens
gaaggacacttcctg

SEQ ID NO: 6221432 - DNA, 17 bp, Homo sapiens
gaaggacagactggccg

SEQ ID NO: 6221433 - DNA, 18 bp, Homo sapiens
gaaggacagactggccgg

SEQ ID NO: 6221434 - DNA, 19 bp, Homo sapiens
gaaggacaggaccctcagg

SEQ ID NO: 6221435 - DNA, 18 bp, Homo sapiens
gaaggacagtccctgctg

SEQ ID NO: 6221436 - DNA, 18 bp, Homo sapiens
gaaggacatgagatcagg

SEQ ID NO: 6221437 - DNA, 21 bp, Homo sapiens
gaaggacattttctctttaaa

SEQ ID NO: 6221438 - DNA, 20 bp, Homo sapiens
gaaggaccaacccatgccct

SEQ ID NO: 6221439 - DNA, 22 bp, Homo sapiens
gaaggaccaacccatgccctgc

SEQ ID NO: 6221440 - DNA, 22 bp, Homo sapiens
gaaggaccacattttatattta

SEQ ID NO: 6221441 - DNA, 15 bp, Homo sapiens
gaaggacccaagaaa

SEQ ID NO: 6221442 - DNA, 13 bp, Homo sapiens
gaaggaccccagg

SEQ ID NO: 6221443 - DNA, 16 bp, Homo sapiens
gaaggacccctcacca

SEQ ID NO: 6221444 - DNA, 22 bp, Homo sapiens
gaaggacccggaggggcctggc

SEQ ID NO: 6221445 - DNA, 19 bp, Homo sapiens
gaaggaccctgtgccctcc

SEQ ID NO: 6221446 - DNA, 17 bp, Homo sapiens
gaaggacctccccctgt

SEQ ID NO: 6221447 - DNA, 15 bp, Homo sapiens
gaaggacctcctgag

SEQ ID NO: 6221448 - DNA, 20 bp, Homo sapiens
gaaggacgggttggggccgg

SEQ ID NO: 6221449 - DNA, 17 bp, Homo sapiens
gaaggacggtgccaagg

SEQ ID NO: 6221450 - DNA, 19 bp, Homo sapiens
gaaggactaatagaaaagt

SEQ ID NO: 6221451 - DNA, 16 bp, Homo sapiens
gaaggactattaattc

SEQ ID NO: 6221452 - DNA, 20 bp, Homo sapiens
gaaggactgcagccactgat

SEQ ID NO: 6221453 - DNA, 21 bp, Homo sapiens
gaaggactgtgacaggcagca

SEQ ID NO: 6221454 - DNA, 14 bp, Homo sapiens
gaaggactgtggct

SEQ ID NO: 6221455 - DNA, 16 bp, Homo sapiens
gaaggagaaaggagcc

SEQ ID NO: 6221456 - DNA, 16 bp, Homo sapiens
gaaggagaaggctgga

SEQ ID NO: 6221457 - DNA, 19 bp, Homo sapiens
gaaggagaaggctggagaa

SEQ ID NO: 6221458 - DNA, 19 bp, Homo sapiens
gaaggagaatggcatggca

SEQ ID NO: 6221459 - DNA, 15 bp, Homo sapiens
gaaggagacacagat

SEQ ID NO: 6221460 - DNA, 16 bp, Homo sapiens
gaaggagacacagatg

SEQ ID NO: 6221461 - DNA, 18 bp, Homo sapiens
gaaggagacagagctggt

SEQ ID NO: 6221462 - DNA, 14 bp, Homo sapiens
gaaggagacagcag

SEQ ID NO: 6221463 - DNA, 16 bp, Homo sapiens
gaaggagacagcagca

SEQ ID NO: 6221464 - DNA, 17 bp, Homo sapiens
gaaggagacaggatgag

SEQ ID NO: 6221465 - DNA, 18 bp, Homo sapiens
gaaggagacaggatgagg

SEQ ID NO: 6221466 - DNA, 12 bp, Homo sapiens
gaaggagagaaa

SEQ ID NO: 6221467 - DNA, 20 bp, Homo sapiens
gaaggagagaaagtgggtga

SEQ ID NO: 6221468 - DNA, 15 bp, Homo sapiens
gaaggagagatgacc

SEQ ID NO: 6221469 - DNA, 12 bp, Homo sapiens
gaaggagagccc

SEQ ID NO: 6221470 - DNA, 15 bp, Homo sapiens
gaaggagagcccagg

SEQ ID NO: 6221471 - DNA, 16 bp, Homo sapiens
gaaggagaggagtgcg

SEQ ID NO: 6221472 - DNA, 21 bp, Homo sapiens
gaaggagatgagtgggcttcg

SEQ ID NO: 6221473 - DNA, 22 bp, Homo sapiens
gaaggagattgtggggagagaa

SEQ ID NO: 6221474 - DNA, 14 bp, Homo sapiens
gaaggagcaggccc

SEQ ID NO: 6221475 - DNA, 17 bp, Homo sapiens
gaaggagccagccagga

SEQ ID NO: 6221476 - DNA, 23 bp, Homo sapiens
gaaggagccagccaggactcctt

SEQ ID NO: 6221477 - DNA, 19 bp, Homo sapiens
gaaggagcccagccagaaa

SEQ ID NO: 6221478 - DNA, 20 bp, Homo sapiens
gaaggagccccattcctggg

SEQ ID NO: 6221479 - DNA, 12 bp, Homo sapiens
gaaggagcctgc

SEQ ID NO: 6221480 - DNA, 17 bp, Homo sapiens
gaaggagctgcctggac

SEQ ID NO: 6221481 - DNA, 19 bp, Homo sapiens
gaaggagctgcctggaccc

SEQ ID NO: 6221482 - DNA, 13 bp, Homo sapiens
gaaggaggaaggg

SEQ ID NO: 6221483 - DNA, 15 bp, Homo sapiens
gaaggaggacccagg

SEQ ID NO: 6221484 - DNA, 16 bp, Homo sapiens
gaaggaggacccagga

SEQ ID NO: 6221485 - DNA, 17 bp, Homo sapiens
gaaggaggacccaggac

SEQ ID NO: 6221486 - DNA, 11 bp, Homo sapiens
gaaggaggaga

SEQ ID NO: 6221487 - DNA, 15 bp, Homo sapiens
gaaggaggaggagga

SEQ ID NO: 6221488 - DNA, 18 bp, Homo sapiens
gaaggaggaggaggaggt

SEQ ID NO: 6221489 - DNA, 17 bp, Homo sapiens
gaaggaggcagactgat

SEQ ID NO: 6221490 - DNA, 19 bp, Homo sapiens
gaaggaggccaaccagccc

SEQ ID NO: 6221491 - DNA, 14 bp, Homo sapiens
gaaggaggccactt

SEQ ID NO: 6221492 - DNA, 14 bp, Homo sapiens
gaaggaggcctcca

SEQ ID NO: 6221493 - DNA, 19 bp, Homo sapiens
gaaggaggctccaggcagc

SEQ ID NO: 6221494 - DNA, 20 bp, Homo sapiens
gaaggaggctccaggcagca

SEQ ID NO: 6221495 - DNA, 14 bp, Homo sapiens
gaaggaggctggct

SEQ ID NO: 6221496 - DNA, 16 bp, Homo sapiens
gaaggagggagctgct

SEQ ID NO: 6221497 - DNA, 21 bp, Homo sapiens
gaaggagggcagagccatggg

SEQ ID NO: 6221498 - DNA, 16 bp, Homo sapiens
gaaggaggggaagctg

SEQ ID NO: 6221499 - DNA, 20 bp, Homo sapiens
gaaggaggggaagctgcagc

SEQ ID NO: 6221500 - DNA, 19 bp, Homo sapiens
gaaggaggggagcctttgg

SEQ ID NO: 6221501 - DNA, 23 bp, Homo sapiens
gaaggagggggtgacctccggcc

SEQ ID NO: 6221502 - DNA, 24 bp, Homo sapiens
gaaggagggggttcttcctcacct

SEQ ID NO: 6221503 - DNA, 12 bp, Homo sapiens
gaaggatacaaa

SEQ ID NO: 6221504 - DNA, 19 bp, Homo sapiens
gaaggatacaaaagcatgt

SEQ ID NO: 6221505 - DNA, 15 bp, Homo sapiens
gaaggatagcctcag

SEQ ID NO: 6221506 - DNA, 18 bp, Homo sapiens
gaaggatagcctcagcca

SEQ ID NO: 6221507 - DNA, 19 bp, Homo sapiens
gaaggatattttcaacaat

SEQ ID NO: 6221508 - DNA, 16 bp, Homo sapiens
gaaggatccaggaata

SEQ ID NO: 6221509 - DNA, 14 bp, Homo sapiens
gaaggatcctggaa

SEQ ID NO: 6221510 - DNA, 14 bp, Homo sapiens
gaaggatgagcatt

SEQ ID NO: 6221511 - DNA, 18 bp, Homo sapiens
gaaggatggcatctccat

SEQ ID NO: 6221512 - DNA, 18 bp, Homo sapiens
gaaggatgggtcccctcc

SEQ ID NO: 6221513 - DNA, 15 bp, Homo sapiens
gaaggatgtacattt

SEQ ID NO: 6221514 - DNA, 20 bp, Homo sapiens
gaaggatgtacatttccaaa

SEQ ID NO: 6221515 - DNA, 21 bp, Homo sapiens
gaaggatgtccgttccaggag

SEQ ID NO: 6221516 - DNA, 16 bp, Homo sapiens
gaaggattaatgaaaa

SEQ ID NO: 6221517 - DNA, 18 bp, Homo sapiens
gaaggattatatgtatta

SEQ ID NO: 6221518 - DNA, 22 bp, Homo sapiens
gaaggattcttttttcaatgta

SEQ ID NO: 6221519 - DNA, 14 bp, Homo sapiens
gaaggattgtaaaa

SEQ ID NO: 6221520 - DNA, 18 bp, Homo sapiens
gaaggcaaactgaggcag

SEQ ID NO: 6221521 - DNA, 24 bp, Homo sapiens
gaaggcaaactgaggcagcatgca

SEQ ID NO: 6221522 - DNA, 19 bp, Homo sapiens
gaaggcaaagcccctggaa

SEQ ID NO: 6221523 - DNA, 17 bp, Homo sapiens
gaaggcaaaggcagagg

SEQ ID NO: 6221524 - DNA, 15 bp, Homo sapiens
gaaggcaaatataag

SEQ ID NO: 6221525 - DNA, 14 bp, Homo sapiens
gaaggcaaatctcc

SEQ ID NO: 6221526 - DNA, 15 bp, Homo sapiens
gaaggcaaatgactt

SEQ ID NO: 6221527 - DNA, 16 bp, Homo sapiens
gaaggcaaatgacttt

SEQ ID NO: 6221528 - DNA, 16 bp, Homo sapiens
gaaggcaacctggaag

SEQ ID NO: 6221529 - DNA, 17 bp, Homo sapiens
gaaggcaacttgaagaa

SEQ ID NO: 6221530 - DNA, 14 bp, Homo sapiens
gaaggcaagagggg

SEQ ID NO: 6221531 - DNA, 16 bp, Homo sapiens
gaaggcaagagggggt

SEQ ID NO: 6221532 - DNA, 17 bp, Homo sapiens
gaaggcaagagggggtg

SEQ ID NO: 6221533 - DNA, 22 bp, Homo sapiens
gaaggcaagagggggtggaggg

SEQ ID NO: 6221534 - DNA, 21 bp, Homo sapiens
gaaggcaagctggcaggaggg

SEQ ID NO: 6221535 - DNA, 13 bp, Homo sapiens
gaaggcaatgcca

SEQ ID NO: 6221536 - DNA, 21 bp, Homo sapiens
gaaggcaatgctcacctcttc

SEQ ID NO: 6221537 - DNA, 21 bp, Homo sapiens
gaaggcaatttctctgcacac

SEQ ID NO: 6221538 - DNA, 12 bp, Homo sapiens
gaaggcacagct

SEQ ID NO: 6221539 - DNA, 18 bp, Homo sapiens
gaaggcacaggtgtaaat

SEQ ID NO: 6221540 - DNA, 21 bp, Homo sapiens
gaaggcacccgccctttcctt

SEQ ID NO: 6221541 - DNA, 12 bp, Homo sapiens
gaaggcactggg

SEQ ID NO: 6221542 - DNA, 12 bp, Homo sapiens
gaaggcagaata

SEQ ID NO: 6221543 - DNA, 16 bp, Homo sapiens
gaaggcagacagcagg

SEQ ID NO: 6221544 - DNA, 19 bp, Homo sapiens
gaaggcagacagcaggcag

SEQ ID NO: 6221545 - DNA, 21 bp, Homo sapiens
gaaggcagacagcaggcagcg

SEQ ID NO: 6221546 - DNA, 14 bp, Homo sapiens
gaaggcagagaaaa

SEQ ID NO: 6221547 - DNA, 15 bp, Homo sapiens
gaaggcagaggctgg

SEQ ID NO: 6221548 - DNA, 14 bp, Homo sapiens
gaaggcagcaaaga

SEQ ID NO: 6221549 - DNA, 17 bp, Homo sapiens
gaaggcagcaggtggca

SEQ ID NO: 6221550 - DNA, 19 bp, Homo sapiens
gaaggcaggcagggctctc

SEQ ID NO: 6221551 - DNA, 21 bp, Homo sapiens
gaaggcaggcagggctctcct

SEQ ID NO: 6221552 - DNA, 20 bp, Homo sapiens
gataggcacatagagaggga

SEQ ID NO: 6221553 - DNA, 15 bp, Homo sapiens
gataggcccctgggg

SEQ ID NO: 6221554 - DNA, 12 bp, Homo sapiens
gataggctctgc

SEQ ID NO: 6221555 - DNA, 13 bp, Homo sapiens
gataggctctgca

SEQ ID NO: 6221556 - DNA, 17 bp, Homo sapiens
gataggctctgcacaga

SEQ ID NO: 6221557 - DNA, 12 bp, Homo sapiens
gatagggaaagg

SEQ ID NO: 6221558 - DNA, 20 bp, Homo sapiens
gatagggagggaagggggaa

SEQ ID NO: 6221559 - DNA, 22 bp, Homo sapiens
gatagggcggcaaatgccaaag

SEQ ID NO: 6221560 - DNA, 15 bp, Homo sapiens
gatagggctgggcaa

SEQ ID NO: 6221561 - DNA, 23 bp, Homo sapiens
gataggggaactcctcaacactc

SEQ ID NO: 6221562 - DNA, 17 bp, Homo sapiens
gataggtcagtgcaaat

SEQ ID NO: 6221563 - DNA, 19 bp, Homo sapiens
gataggttctgctttctga

SEQ ID NO: 6221564 - DNA, 14 bp, Homo sapiens
gatagtaagcatag

SEQ ID NO: 6221565 - DNA, 19 bp, Homo sapiens
gatagtagatctgtggcga

SEQ ID NO: 6221566 - DNA, 14 bp, Homo sapiens
gatagtagcttcct

SEQ ID NO: 6221567 - DNA, 13 bp, Homo sapiens
gatagtagtaaaa

SEQ ID NO: 6221568 - DNA, 16 bp, Homo sapiens
gatagtcaccttttaa

SEQ ID NO: 6221569 - DNA, 19 bp, Homo sapiens
gatagtccttcctggcatc

SEQ ID NO: 6221570 - DNA, 22 bp, Homo sapiens
gatagtcctttttccaatgttt

SEQ ID NO: 6221571 - DNA, 23 bp, Homo sapiens
gatagtcttggaagctgtttgga

SEQ ID NO: 6221572 - DNA, 22 bp, Homo sapiens
gatagtctttcagttaaggaga

SEQ ID NO: 6221573 - DNA, 16 bp, Homo sapiens
gatagtgatgtatttt

SEQ ID NO: 6221574 - DNA, 14 bp, Homo sapiens
gatagtgcctctgc

SEQ ID NO: 6221575 - DNA, 17 bp, Homo sapiens
gatagtgcttcttgtaa

SEQ ID NO: 6221576 - DNA, 13 bp, Homo sapiens
gatagtgtgattt

SEQ ID NO: 6221577 - DNA, 15 bp, Homo sapiens
gatagtgttctgctc

SEQ ID NO: 6221578 - DNA, 17 bp, Homo sapiens
gatagtgttctgctcct

SEQ ID NO: 6221579 - DNA, 22 bp, Homo sapiens
gatagtgttctgctcctgcttt

SEQ ID NO: 6221580 - DNA, 22 bp, Homo sapiens
gatagttaaactaccacttttt

SEQ ID NO: 6221581 - DNA, 21 bp, Homo sapiens
gatagttatctgttcttttga

SEQ ID NO: 6221582 - DNA, 16 bp, Homo sapiens
gatagttgatgcatgt

SEQ ID NO: 6221583 - DNA, 13 bp, Homo sapiens
gatagtttacaaa

SEQ ID NO: 6221584 - DNA, 14 bp, Homo sapiens
gatagtttcattta

SEQ ID NO: 6221585 - DNA, 23 bp, Homo sapiens
gatagttttcatccataactgaa

SEQ ID NO: 6221586 - DNA, 14 bp, Homo sapiens
gatagttttctaga

SEQ ID NO: 6221587 - DNA, 19 bp, Homo sapiens
gatataaaaacagattctg

SEQ ID NO: 6221588 - DNA, 15 bp, Homo sapiens
gatataaaatgaaag

SEQ ID NO: 6221589 - DNA, 16 bp, Homo sapiens
gatataaaatgaaaga

SEQ ID NO: 6221590 - DNA, 11 bp, Homo sapiens
gatataaagcc

SEQ ID NO: 6221591 - DNA, 21 bp, Homo sapiens
gatataaaggaccctgtttct

SEQ ID NO: 6221592 - DNA, 23 bp, Homo sapiens
gatataaaggaccctgtttctgt

SEQ ID NO: 6221593 - DNA, 13 bp, Homo sapiens
gatataaataaaa

SEQ ID NO: 6221594 - DNA, 14 bp, Homo sapiens
gatataaatgaagt

SEQ ID NO: 6221595 - DNA, 21 bp, Homo sapiens
gatataaattaattgtgcctg

SEQ ID NO: 6221596 - DNA, 21 bp, Homo sapiens
gatataacaactggatgcatc

SEQ ID NO: 6221597 - DNA, 16 bp, Homo sapiens
gatataactgtcttgt

SEQ ID NO: 6221598 - DNA, 16 bp, Homo sapiens
gatataagagaagtct

SEQ ID NO: 6221599 - DNA, 22 bp, Homo sapiens
gatataagagaagtctcattcg

SEQ ID NO: 6221600 - DNA, 20 bp, Homo sapiens
gatataagagggctttttaa

SEQ ID NO: 6221601 - DNA, 17 bp, Homo sapiens
gatataagatttgtaca

SEQ ID NO: 6221602 - DNA, 16 bp, Homo sapiens
gatataataattactt

SEQ ID NO: 6221603 - DNA, 19 bp, Homo sapiens
gatataatatcagatttca

SEQ ID NO: 6221604 - DNA, 18 bp, Homo sapiens
gatataatcttggcttct

SEQ ID NO: 6221605 - DNA, 14 bp, Homo sapiens
gatataatgaacaa

SEQ ID NO: 6221606 - DNA, 13 bp, Homo sapiens
gatataattactt

SEQ ID NO: 6221607 - DNA, 14 bp, Homo sapiens
gatataattactta

SEQ ID NO: 6221608 - DNA, 20 bp, Homo sapiens
gatatacaattagagatatt

SEQ ID NO: 6221609 - DNA, 16 bp, Homo sapiens
gatatacagatgaaaa

SEQ ID NO: 6221610 - DNA, 15 bp, Homo sapiens
gatatacattgtgtg

SEQ ID NO: 6221611 - DNA, 24 bp, Homo sapiens
gatatacgccctctttcatctgta

SEQ ID NO: 6221612 - DNA, 17 bp, Homo sapiens
gatatactctagatgaa

SEQ ID NO: 6221613 - DNA, 22 bp, Homo sapiens
gatatacttgtttttgtaaaga

SEQ ID NO: 6221614 - DNA, 14 bp, Homo sapiens
gatatactttgtgg

SEQ ID NO: 6221615 - DNA, 16 bp, Homo sapiens
gatatactttgtggac

SEQ ID NO: 6221616 - DNA, 16 bp, Homo sapiens
gatatagaacagtgct

SEQ ID NO: 6221617 - DNA, 19 bp, Homo sapiens
gatatagaagtataaagaa

SEQ ID NO: 6221618 - DNA, 15 bp, Homo sapiens
gatatagaattgcaa

SEQ ID NO: 6221619 - DNA, 14 bp, Homo sapiens
gatatagagtcatt

SEQ ID NO: 6221620 - DNA, 22 bp, Homo sapiens
gatatagcttttggtgtttgag

SEQ ID NO: 6221621 - DNA, 20 bp, Homo sapiens
gatatagtgatggggctcag

SEQ ID NO: 6221622 - DNA, 20 bp, Homo sapiens
gatatataatggtaatagaa

SEQ ID NO: 6221623 - DNA, 20 bp, Homo sapiens
gatatatatgtataatttca

SEQ ID NO: 6221624 - DNA, 23 bp, Homo sapiens
gatatatattataaatatatata

SEQ ID NO: 6221625 - DNA, 12 bp, Homo sapiens
gatatatatttc

SEQ ID NO: 6221626 - DNA, 21 bp, Homo sapiens
gatatatatttccaaatattc

SEQ ID NO: 6221627 - DNA, 21 bp, Homo sapiens
gatatatcagtgttgtctcat

SEQ ID NO: 6221628 - DNA, 20 bp, Homo sapiens
gatatatcatgagtgaataa

SEQ ID NO: 6221629 - DNA, 16 bp, Homo sapiens
gatatatctttatact

SEQ ID NO: 6221630 - DNA, 11 bp, Homo sapiens
gatatatgtat

SEQ ID NO: 6221631 - DNA, 15 bp, Homo sapiens
gatatatgtatttat

SEQ ID NO: 6221632 - DNA, 16 bp, Homo sapiens
gatatatgtgtataca

SEQ ID NO: 6221633 - DNA, 13 bp, Homo sapiens
gatatattaaaaa

SEQ ID NO: 6221634 - DNA, 14 bp, Homo sapiens
gatatattaaaaat

SEQ ID NO: 6221635 - DNA, 17 bp, Homo sapiens
gatatattaaaaatata

SEQ ID NO: 6221636 - DNA, 21 bp, Homo sapiens
gatatattaaaaatataaaac

SEQ ID NO: 6221637 - DNA, 17 bp, Homo sapiens
gatatattattgtaagt

SEQ ID NO: 6221638 - DNA, 19 bp, Homo sapiens
gatatattctctaataaaa

SEQ ID NO: 6221639 - DNA, 19 bp, Homo sapiens
gatatatttctatgtgtat

SEQ ID NO: 6221640 - DNA, 18 bp, Homo sapiens
gatatatttgaaatagta

SEQ ID NO: 6221641 - DNA, 23 bp, Homo sapiens
gatatattttacaattttttatc

SEQ ID NO: 6221642 - DNA, 15 bp, Homo sapiens
gatatattttctttc

SEQ ID NO: 6221643 - DNA, 15 bp, Homo sapiens
gatatatttttcaca

SEQ ID NO: 6221644 - DNA, 17 bp, Homo sapiens
gatatatttttcacagt

SEQ ID NO: 6221645 - DNA, 17 bp, Homo sapiens
gatatcaaaattctagc

SEQ ID NO: 6221646 - DNA, 18 bp, Homo sapiens
gatatcaatactaagtga

SEQ ID NO: 6221647 - DNA, 18 bp, Homo sapiens
gatatcacagtctaattt

SEQ ID NO: 6221648 - DNA, 16 bp, Homo sapiens
gatatcacctgaatta

SEQ ID NO: 6221649 - DNA, 22 bp, Homo sapiens
gatatcacctgaattattaatg

SEQ ID NO: 6221650 - DNA, 15 bp, Homo sapiens
gatatcacgggcccg

SEQ ID NO: 6221651 - DNA, 13 bp, Homo sapiens
gatatcagaattt

SEQ ID NO: 6221652 - DNA, 22 bp, Homo sapiens
gatatcagcactggattgtaga

SEQ ID NO: 6221653 - DNA, 12 bp, Homo sapiens
gatatcatttta

SEQ ID NO: 6221654 - DNA, 13 bp, Homo sapiens
gatatcattttaa

SEQ ID NO: 6221655 - DNA, 14 bp, Homo sapiens
gatatccacataaa

SEQ ID NO: 6221656 - DNA, 15 bp, Homo sapiens
gatatccattctttc

SEQ ID NO: 6221657 - DNA, 17 bp, Homo sapiens
gatatccctatgctgcc

SEQ ID NO: 6221658 - DNA, 11 bp, Homo sapiens
gatatcctctc

SEQ ID NO: 6221659 - DNA, 15 bp, Homo sapiens
gatatcctgatctcg

SEQ ID NO: 6221660 - DNA, 20 bp, Homo sapiens
gatatcgtgaaatcctcagc

SEQ ID NO: 6221661 - DNA, 17 bp, Homo sapiens
gatatctagacaatttc

SEQ ID NO: 6221662 - DNA, 17 bp, Homo sapiens
gatatctatatatgtat

SEQ ID NO: 6221663 - DNA, 15 bp, Homo sapiens
gatatctatattcta

SEQ ID NO: 6221664 - DNA, 23 bp, Homo sapiens
gatatctatatttttatttctac

SEQ ID NO: 6221665 - DNA, 16 bp, Homo sapiens
gatatctcaatctgca

SEQ ID NO: 6221666 - DNA, 20 bp, Homo sapiens
gatatctgagggaggaggcc

SEQ ID NO: 6221667 - DNA, 23 bp, Homo sapiens
gatatctgagggaggaggccacc

SEQ ID NO: 6221668 - DNA, 14 bp, Homo sapiens
gatatcttcagttt

SEQ ID NO: 6221669 - DNA, 15 bp, Homo sapiens
gatatcttcagttta

SEQ ID NO: 6221670 - DNA, 21 bp, Homo sapiens
gatatctttgagggctgacaa

SEQ ID NO: 6221671 - DNA, 14 bp, Homo sapiens
gatatcttttcttt

SEQ ID NO: 6221672 - DNA, 15 bp, Homo sapiens
gatatctttttattg

SEQ ID NO: 6221673 - DNA, 17 bp, Homo sapiens
gatatgaaaaataaata

SEQ ID NO: 6221674 - DNA, 15 bp, Homo sapiens
gatatgaaaaatatg

SEQ ID NO: 6221675 - DNA, 15 bp, Homo sapiens
gatatgaaaaatgag

SEQ ID NO: 6221676 - DNA, 17 bp, Homo sapiens
gatatgaaagagaaaat

SEQ ID NO: 6221677 - DNA, 23 bp, Homo sapiens
gatatgaagaactattatattga

SEQ ID NO: 6221678 - DNA, 16 bp, Homo sapiens
gatatgaccaaaattt

SEQ ID NO: 6221679 - DNA, 20 bp, Homo sapiens
gatatgagaaatataaaaat

SEQ ID NO: 6221680 - DNA, 20 bp, Homo sapiens
gatatgagggtggtttatga

SEQ ID NO: 6221681 - DNA, 21 bp, Homo sapiens
gatatgagttgttttcagact

SEQ ID NO: 6221682 - DNA, 24 bp, Homo sapiens
gatatgattcaaatgtctataaac

SEQ ID NO: 6221683 - DNA, 19 bp, Homo sapiens
gatatgattgtaacatatt

SEQ ID NO: 6221684 - DNA, 23 bp, Homo sapiens
gatatgattgtttctcaaatctt

SEQ ID NO: 6221685 - DNA, 14 bp, Homo sapiens
gatatgatttaaaa

SEQ ID NO: 6221686 - DNA, 20 bp, Homo sapiens
gatatgatttaaaacatgta

SEQ ID NO: 6221687 - DNA, 20 bp, Homo sapiens
gatatgcaccaggtctcaag

SEQ ID NO: 6221688 - DNA, 18 bp, Homo sapiens
gatatgcatgtagcatat

SEQ ID NO: 6221689 - DNA, 22 bp, Homo sapiens
gatatgcatgtagcatataaat

SEQ ID NO: 6221690 - DNA, 18 bp, Homo sapiens
gatatgcattcaagagag

SEQ ID NO: 6221691 - DNA, 16 bp, Homo sapiens
gatatgccctcctggt

SEQ ID NO: 6221692 - DNA, 16 bp, Homo sapiens
gatatgcctgctcttt

SEQ ID NO: 6221693 - DNA, 18 bp, Homo sapiens
gatatgcctgctctttgg

SEQ ID NO: 6221694 - DNA, 15 bp, Homo sapiens
gatatgctagaaaag

SEQ ID NO: 6221695 - DNA, 20 bp, Homo sapiens
gatatgctgaacgcagaaga

SEQ ID NO: 6221696 - DNA, 17 bp, Homo sapiens
gatatgctgagaaatta

SEQ ID NO: 6221697 - DNA, 16 bp, Homo sapiens
gatatgcttagtaatg

SEQ ID NO: 6221698 - DNA, 14 bp, Homo sapiens
gatatggaaacaga

SEQ ID NO: 6221699 - DNA, 17 bp, Homo sapiens
gatatggaaacagaaga

SEQ ID NO: 6221700 - DNA, 19 bp, Homo sapiens
gatatggagaattgctgaa

SEQ ID NO: 6221701 - DNA, 21 bp, Homo sapiens
gatatggagtgagtcacctgc

SEQ ID NO: 6221702 - DNA, 22 bp, Homo sapiens
gatatggagtgagtcacctgct

SEQ ID NO: 6221703 - DNA, 23 bp, Homo sapiens
gatatggagtgagtcacctgctc

SEQ ID NO: 6221704 - DNA, 14 bp, Homo sapiens
gatatggcagaaga

SEQ ID NO: 6221705 - DNA, 17 bp, Homo sapiens
gatatggcagaagacac

SEQ ID NO: 6221706 - DNA, 18 bp, Homo sapiens
gatatggcttaggaatga

SEQ ID NO: 6221707 - DNA, 21 bp, Homo sapiens
gatatggcttaggaatgactt

SEQ ID NO: 6221708 - DNA, 16 bp, Homo sapiens
gatatgggacattttt

SEQ ID NO: 6221709 - DNA, 17 bp, Homo sapiens
gatatgggacatttttg

SEQ ID NO: 6221710 - DNA, 21 bp, Homo sapiens
gatatgggctttctctttggt

SEQ ID NO: 6221711 - DNA, 21 bp, Homo sapiens
gatatggggttacttcagcca

SEQ ID NO: 6221712 - DNA, 17 bp, Homo sapiens
gatatgggtagtatttt

SEQ ID NO: 6221713 - DNA, 18 bp, Homo sapiens
gatatgggtcctctgggg

SEQ ID NO: 6221714 - DNA, 16 bp, Homo sapiens
gatatggtgcagagaa

SEQ ID NO: 6221715 - DNA, 24 bp, Homo sapiens
gatatggtgcagagaagctggact

SEQ ID NO: 6221716 - DNA, 21 bp, Homo sapiens
gatatggtgggtggacagggg

SEQ ID NO: 6221717 - DNA, 17 bp, Homo sapiens
gatatgtaaaacattta

SEQ ID NO: 6221718 - DNA, 19 bp, Homo sapiens
gatatgtaaacataattct

SEQ ID NO: 6221719 - DNA, 17 bp, Homo sapiens
gatatgtatgggtaggg

SEQ ID NO: 6221720 - DNA, 18 bp, Homo sapiens
gatatgtatgggtagggt

SEQ ID NO: 6221721 - DNA, 22 bp, Homo sapiens
gatatgtctgctgagttggcct

SEQ ID NO: 6221722 - DNA, 13 bp, Homo sapiens
gatatgtctttaa

SEQ ID NO: 6221723 - DNA, 14 bp, Homo sapiens
gatatgtggtgtat

SEQ ID NO: 6221724 - DNA, 19 bp, Homo sapiens
gatatgtggtgtatatcct

SEQ ID NO: 6221725 - DNA, 22 bp, Homo sapiens
gatatgtgtaaatgttatgact

SEQ ID NO: 6221726 - DNA, 15 bp, Homo sapiens
gatatgtgtgtgttt

SEQ ID NO: 6221727 - DNA, 18 bp, Homo sapiens
gatatgttgtattaactg

SEQ ID NO: 6221728 - DNA, 17 bp, Homo sapiens
gatatgttgttaaacac

SEQ ID NO: 6221729 - DNA, 15 bp, Homo sapiens
gatatgtttttattt

SEQ ID NO: 6221730 - DNA, 23 bp, Homo sapiens
gaaggcaggcagggctctcctgg

SEQ ID NO: 6221731 - DNA, 13 bp, Homo sapiens
gaaggcagggaat

SEQ ID NO: 6221732 - DNA, 19 bp, Homo sapiens
gaaggcagggaatgcctgg

SEQ ID NO: 6221733 - DNA, 21 bp, Homo sapiens
gaaggcagggaatgcctggag

SEQ ID NO: 6221734 - DNA, 23 bp, Homo sapiens
gaaggcagggacagagatggagg

SEQ ID NO: 6221735 - DNA, 13 bp, Homo sapiens
gaaggcagggagg

SEQ ID NO: 6221736 - DNA, 14 bp, Homo sapiens
gaaggcagggcaga

SEQ ID NO: 6221737 - DNA, 20 bp, Homo sapiens
gaaggcagggctcctccctg

SEQ ID NO: 6221738 - DNA, 21 bp, Homo sapiens
gaaggcagggggaaggtgggg

SEQ ID NO: 6221739 - DNA, 21 bp, Homo sapiens
gaaggcagtagttttcaaaac

SEQ ID NO: 6221740 - DNA, 16 bp, Homo sapiens
gaaggcagtctgaacc

SEQ ID NO: 6221741 - DNA, 17 bp, Homo sapiens
gaaggcagtctgaaccc

SEQ ID NO: 6221742 - DNA, 22 bp, Homo sapiens
gaaggcagtgcctgctctgctg

SEQ ID NO: 6221743 - DNA, 22 bp, Homo sapiens
gaaggcagtggcaggggagcag

SEQ ID NO: 6221744 - DNA, 15 bp, Homo sapiens
gaaggcatgagaaag

SEQ ID NO: 6221745 - DNA, 16 bp, Homo sapiens
gaaggcatttgcagga

SEQ ID NO: 6221746 - DNA, 17 bp, Homo sapiens
gaaggcatttgcagggt

SEQ ID NO: 6221747 - DNA, 14 bp, Homo sapiens
gaaggccacagcaa

SEQ ID NO: 6221748 - DNA, 15 bp, Homo sapiens
gaaggccacaggcca

SEQ ID NO: 6221749 - DNA, 22 bp, Homo sapiens
gaaggccacctcccactcctgc

SEQ ID NO: 6221750 - DNA, 23 bp, Homo sapiens
gaaggccacctcccactcctgct

SEQ ID NO: 6221751 - DNA, 22 bp, Homo sapiens
gaaggccagaaaaggcagccag

SEQ ID NO: 6221752 - DNA, 14 bp, Homo sapiens
gaaggccagagagg

SEQ ID NO: 6221753 - DNA, 16 bp, Homo sapiens
gaaggccagagaggga

SEQ ID NO: 6221754 - DNA, 23 bp, Homo sapiens
gaaggccagcccactgggccctg

SEQ ID NO: 6221755 - DNA, 22 bp, Homo sapiens
gaaggccaggagtaagcccaag

SEQ ID NO: 6221756 - DNA, 13 bp, Homo sapiens
gaaggccaggcct

SEQ ID NO: 6221757 - DNA, 17 bp, Homo sapiens
gaaggccatcatctctg

SEQ ID NO: 6221758 - DNA, 17 bp, Homo sapiens
gaaggccatggggcagc

SEQ ID NO: 6221759 - DNA, 18 bp, Homo sapiens
gaaggccatggggcagcc

SEQ ID NO: 6221760 - DNA, 20 bp, Homo sapiens
gaaggccatggggcagcctc

SEQ ID NO: 6221761 - DNA, 22 bp, Homo sapiens
gaaggccatggggcagcctcca

SEQ ID NO: 6221762 - DNA, 23 bp, Homo sapiens
gaaggccattgggtttggggcca

SEQ ID NO: 6221763 - DNA, 17 bp, Homo sapiens
gaaggcccaactggttc

SEQ ID NO: 6221764 - DNA, 23 bp, Homo sapiens
gaaggcccaactggttcaggctc

SEQ ID NO: 6221765 - DNA, 23 bp, Homo sapiens
gaaggcccagcaccaccctcctt

SEQ ID NO: 6221766 - DNA, 13 bp, Homo sapiens
gaaggcccagggg

SEQ ID NO: 6221767 - DNA, 14 bp, Homo sapiens
gaaggcccatgaag

SEQ ID NO: 6221768 - DNA, 17 bp, Homo sapiens
gaaggcccatgaaggaa

SEQ ID NO: 6221769 - DNA, 21 bp, Homo sapiens
gaaggccccagagagaccctg

SEQ ID NO: 6221770 - DNA, 16 bp, Homo sapiens
gaaggccccagggcag

SEQ ID NO: 6221771 - DNA, 14 bp, Homo sapiens
gaaggccccgccca

SEQ ID NO: 6221772 - DNA, 16 bp, Homo sapiens
gaaggccccgcccagg

SEQ ID NO: 6221773 - DNA, 18 bp, Homo sapiens
gaaggccccgcccaggct

SEQ ID NO: 6221774 - DNA, 23 bp, Homo sapiens
gaaggcccctctccgcaaggtgg

SEQ ID NO: 6221775 - DNA, 16 bp, Homo sapiens
gaaggccccttccctg

SEQ ID NO: 6221776 - DNA, 18 bp, Homo sapiens
gaaggcccgggaggagga

SEQ ID NO: 6221777 - DNA, 22 bp, Homo sapiens
gaaggccgacaccactcctgcc

SEQ ID NO: 6221778 - DNA, 20 bp, Homo sapiens
gaaggccgctgccccagccc

SEQ ID NO: 6221779 - DNA, 13 bp, Homo sapiens
gaaggcctgactt

SEQ ID NO: 6221780 - DNA, 15 bp, Homo sapiens
gaaggcctgagcccc

SEQ ID NO: 6221781 - DNA, 14 bp, Homo sapiens
gaaggcctgaggga

SEQ ID NO: 6221782 - DNA, 23 bp, Homo sapiens
gaaggcctgagggaagcccaccc

SEQ ID NO: 6221783 - DNA, 15 bp, Homo sapiens
gaaggcctgcccccc

SEQ ID NO: 6221784 - DNA, 17 bp, Homo sapiens
gaaggcctgcccccctt

SEQ ID NO: 6221785 - DNA, 16 bp, Homo sapiens
gaaggcctggctggaa

SEQ ID NO: 6221786 - DNA, 15 bp, Homo sapiens
gaaggccttgttaaa

SEQ ID NO: 6221787 - DNA, 13 bp, Homo sapiens
gaaggcctttctt

SEQ ID NO: 6221788 - DNA, 12 bp, Homo sapiens
gaaggcgaggag

SEQ ID NO: 6221789 - DNA, 19 bp, Homo sapiens
gaaggcgatgtggtgaccc

SEQ ID NO: 6221790 - DNA, 16 bp, Homo sapiens
gaaggcgctgggtgcc

SEQ ID NO: 6221791 - DNA, 17 bp, Homo sapiens
gaaggcgggctgaggag

SEQ ID NO: 6221792 - DNA, 18 bp, Homo sapiens
gaaggcgtgcaaggggct

SEQ ID NO: 6221793 - DNA, 20 bp, Homo sapiens
gaaggcgtgcaaggggctca

SEQ ID NO: 6221794 - DNA, 14 bp, Homo sapiens
gaaggctaaaaagc

SEQ ID NO: 6221795 - DNA, 17 bp, Homo sapiens
gaaggctaaaaagcaac

SEQ ID NO: 6221796 - DNA, 22 bp, Homo sapiens
gaaggctacttcggggctggga

SEQ ID NO: 6221797 - DNA, 16 bp, Homo sapiens
gaaggctcgagcatgc

SEQ ID NO: 6221798 - DNA, 17 bp, Homo sapiens
gaaggctctcaccccca

SEQ ID NO: 6221799 - DNA, 16 bp, Homo sapiens
gaaggctctctggtct

SEQ ID NO: 6221800 - DNA, 21 bp, Homo sapiens
gaaggctctctggtctacctg

SEQ ID NO: 6221801 - DNA, 13 bp, Homo sapiens
gaaggctctgtca

SEQ ID NO: 6221802 - DNA, 18 bp, Homo sapiens
gaaggctctgtcactcca

SEQ ID NO: 6221803 - DNA, 18 bp, Homo sapiens
gaaggctcttctccccag

SEQ ID NO: 6221804 - DNA, 20 bp, Homo sapiens
gaaggctggaaggcagcagg

SEQ ID NO: 6221805 - DNA, 19 bp, Homo sapiens
gaaggctggggccagtgta

SEQ ID NO: 6221806 - DNA, 20 bp, Homo sapiens
gaaggctgggttctgatcct

SEQ ID NO: 6221807 - DNA, 12 bp, Homo sapiens
gaaggctgtacg

SEQ ID NO: 6221808 - DNA, 21 bp, Homo sapiens
gaaggctgtgtgtcttctgcc

SEQ ID NO: 6221809 - DNA, 18 bp, Homo sapiens
gaaggcttaagaactgct

SEQ ID NO: 6221810 - DNA, 14 bp, Homo sapiens
gaaggcttcctcca

SEQ ID NO: 6221811 - DNA, 20 bp, Homo sapiens
gaaggcttcctccagcggct

SEQ ID NO: 6221812 - DNA, 22 bp, Homo sapiens
gaaggcttctctccacagtgtt

SEQ ID NO: 6221813 - DNA, 16 bp, Homo sapiens
gaaggcttctctctgt

SEQ ID NO: 6221814 - DNA, 17 bp, Homo sapiens
gaaggcttgttgtgctt

SEQ ID NO: 6221815 - DNA, 14 bp, Homo sapiens
gaaggctttattct

SEQ ID NO: 6221816 - DNA, 23 bp, Homo sapiens
gaaggctttgccatgggcctgct

SEQ ID NO: 6221817 - DNA, 23 bp, Homo sapiens
gaaggcttttatatatgaagttg

SEQ ID NO: 6221818 - DNA, 19 bp, Homo sapiens
gaaggcttttggtctccct

SEQ ID NO: 6221819 - DNA, 15 bp, Homo sapiens
gaagggaaaacagtc

SEQ ID NO: 6221820 - DNA, 18 bp, Homo sapiens
gaagggaaaagggatgat

SEQ ID NO: 6221821 - DNA, 18 bp, Homo sapiens
gaagggaaacaaagaagt

SEQ ID NO: 6221822 - DNA, 16 bp, Homo sapiens
gaagggaaagcgggca

SEQ ID NO: 6221823 - DNA, 14 bp, Homo sapiens
gaagggaaatctta

SEQ ID NO: 6221824 - DNA, 11 bp, Homo sapiens
gaagggaaatt

SEQ ID NO: 6221825 - DNA, 20 bp, Homo sapiens
gaagggaacagcctgagccg

SEQ ID NO: 6221826 - DNA, 21 bp, Homo sapiens
gaagggaacccccaaatttaa

SEQ ID NO: 6221827 - DNA, 17 bp, Homo sapiens
gaagggaagcctcttca

SEQ ID NO: 6221828 - DNA, 16 bp, Homo sapiens
gaagggaagtggggag

SEQ ID NO: 6221829 - DNA, 19 bp, Homo sapiens
gaagggaatcctcctccag

SEQ ID NO: 6221830 - DNA, 18 bp, Homo sapiens
gaagggaattaggcttta

SEQ ID NO: 6221831 - DNA, 23 bp, Homo sapiens
gaagggaattgctcagagaagga

SEQ ID NO: 6221832 - DNA, 20 bp, Homo sapiens
gaagggacaaaaggtactgg

SEQ ID NO: 6221833 - DNA, 18 bp, Homo sapiens
gaagggacagctgctggg

SEQ ID NO: 6221834 - DNA, 13 bp, Homo sapiens
gaagggacatggg

SEQ ID NO: 6221835 - DNA, 23 bp, Homo sapiens
gaagggaccaagcgaccaaggat

SEQ ID NO: 6221836 - DNA, 21 bp, Homo sapiens
gaagggaccgggagcctgcgt

SEQ ID NO: 6221837 - DNA, 24 bp, Homo sapiens
gaagggaccgggagcctgcgtggc

SEQ ID NO: 6221838 - DNA, 17 bp, Homo sapiens
gaagggaccttgaaggg

SEQ ID NO: 6221839 - DNA, 20 bp, Homo sapiens
gaagggaccttgaagggtaa

SEQ ID NO: 6221840 - DNA, 13 bp, Homo sapiens
gaagggactctgg

SEQ ID NO: 6221841 - DNA, 19 bp, Homo sapiens
gaagggactctgggctgtg

SEQ ID NO: 6221842 - DNA, 11 bp, Homo sapiens
gaagggagaaa

SEQ ID NO: 6221843 - DNA, 16 bp, Homo sapiens
gaagggagagccagct

SEQ ID NO: 6221844 - DNA, 19 bp, Homo sapiens
gaagggagcattgcagcct

SEQ ID NO: 6221845 - DNA, 13 bp, Homo sapiens
gaagggagccaag

SEQ ID NO: 6221846 - DNA, 17 bp, Homo sapiens
gaagggagctagccaga

SEQ ID NO: 6221847 - DNA, 17 bp, Homo sapiens
gaagggaggcctgaggg

SEQ ID NO: 6221848 - DNA, 19 bp, Homo sapiens
gaagggaggcctgaggggc

SEQ ID NO: 6221849 - DNA, 13 bp, Homo sapiens
gaagggaggctgg

SEQ ID NO: 6221850 - DNA, 23 bp, Homo sapiens
gaagggagggcagagctggtgcg

SEQ ID NO: 6221851 - DNA, 13 bp, Homo sapiens
gaagggaggggaa

SEQ ID NO: 6221852 - DNA, 16 bp, Homo sapiens
gaagggagggggctgg

SEQ ID NO: 6221853 - DNA, 16 bp, Homo sapiens
gaagggaggggtcctg

SEQ ID NO: 6221854 - DNA, 14 bp, Homo sapiens
gaagggaggtgggg

SEQ ID NO: 6221855 - DNA, 17 bp, Homo sapiens
gaagggagtctctcttc

SEQ ID NO: 6221856 - DNA, 19 bp, Homo sapiens
gaagggagtctctcttcca

SEQ ID NO: 6221857 - DNA, 19 bp, Homo sapiens
gaagggagtgaggggctgt

SEQ ID NO: 6221858 - DNA, 20 bp, Homo sapiens
gaagggagtgaggggctgtg

SEQ ID NO: 6221859 - DNA, 22 bp, Homo sapiens
gaagggagttgctcactcagga

SEQ ID NO: 6221860 - DNA, 13 bp, Homo sapiens
gaagggatggggg

SEQ ID NO: 6221861 - DNA, 22 bp, Homo sapiens
gaagggcaggaaggagagcctg

SEQ ID NO: 6221862 - DNA, 14 bp, Homo sapiens
gaagggcaggagct

SEQ ID NO: 6221863 - DNA, 16 bp, Homo sapiens
gaagggcaggagctca

SEQ ID NO: 6221864 - DNA, 19 bp, Homo sapiens
gaagggcatccttctgcct

SEQ ID NO: 6221865 - DNA, 16 bp, Homo sapiens
gaagggcattctttcc

SEQ ID NO: 6221866 - DNA, 23 bp, Homo sapiens
gaagggccaatggagaaaatgaa

SEQ ID NO: 6221867 - DNA, 17 bp, Homo sapiens
gaagggccaccctgagc

SEQ ID NO: 6221868 - DNA, 19 bp, Homo sapiens
gaagggccaccctgagcag

SEQ ID NO: 6221869 - DNA, 17 bp, Homo sapiens
gaagggccagagccagg

SEQ ID NO: 6221870 - DNA, 15 bp, Homo sapiens
gaagggccagagcct

SEQ ID NO: 6221871 - DNA, 17 bp, Homo sapiens
gaagggccagagcctgg

SEQ ID NO: 6221872 - DNA, 12 bp, Homo sapiens
gaagggccagca

SEQ ID NO: 6221873 - DNA, 15 bp, Homo sapiens
gaagggccagcccta

SEQ ID NO: 6221874 - DNA, 16 bp, Homo sapiens
gaagggccagccctac

SEQ ID NO: 6221875 - DNA, 17 bp, Homo sapiens
gaagggccagccctaca

SEQ ID NO: 6221876 - DNA, 13 bp, Homo sapiens
gaagggccaggag

SEQ ID NO: 6221877 - DNA, 17 bp, Homo sapiens
gaagggccaggagagag

SEQ ID NO: 6221878 - DNA, 16 bp, Homo sapiens
gaagggccagtcctgc

SEQ ID NO: 6221879 - DNA, 14 bp, Homo sapiens
gaagggccagtctg

SEQ ID NO: 6221880 - DNA, 13 bp, Homo sapiens
gaagggcccagga

SEQ ID NO: 6221881 - DNA, 22 bp, Homo sapiens
gaagggccggcttctgcctggg

SEQ ID NO: 6221882 - DNA, 20 bp, Homo sapiens
gaagggcgctgagggcaggg

SEQ ID NO: 6221883 - DNA, 20 bp, Homo sapiens
gaagggctagaacctggaga

SEQ ID NO: 6221884 - DNA, 22 bp, Homo sapiens
gaagggctagaacctggagagc

SEQ ID NO: 6221885 - DNA, 21 bp, Homo sapiens
gaagggctgaaccctcagcct

SEQ ID NO: 6221886 - DNA, 14 bp, Homo sapiens
gaagggctgcatga

SEQ ID NO: 6221887 - DNA, 18 bp, Homo sapiens
gaagggctgcatgatgtt

SEQ ID NO: 6221888 - DNA, 15 bp, Homo sapiens
gaagggcttgaattg

SEQ ID NO: 6221889 - DNA, 21 bp, Homo sapiens
gaagggcttggactcaagcaa

SEQ ID NO: 6221890 - DNA, 19 bp, Homo sapiens
gaaggggaaaaatgggaaa

SEQ ID NO: 6221891 - DNA, 13 bp, Homo sapiens
gaaggggacagga

SEQ ID NO: 6221892 - DNA, 18 bp, Homo sapiens
gaaggggacccccgcccc

SEQ ID NO: 6221893 - DNA, 15 bp, Homo sapiens
gaaggggaccctccg

SEQ ID NO: 6221894 - DNA, 19 bp, Homo sapiens
gaaggggacgcgggctgtg

SEQ ID NO: 6221895 - DNA, 20 bp, Homo sapiens
gaaggggacgcgggctgtgc

SEQ ID NO: 6221896 - DNA, 15 bp, Homo sapiens
gaaggggagagaggg

SEQ ID NO: 6221897 - DNA, 14 bp, Homo sapiens
gaaggggagctttt

SEQ ID NO: 6221898 - DNA, 18 bp, Homo sapiens
gaaggggaggacactggt

SEQ ID NO: 6221899 - DNA, 23 bp, Homo sapiens
gaaggggaggcagccggcaccca

SEQ ID NO: 6221900 - DNA, 13 bp, Homo sapiens
gaaggggatggag

SEQ ID NO: 6221901 - DNA, 15 bp, Homo sapiens
gaaggggatggaggc

SEQ ID NO: 6221902 - DNA, 22 bp, Homo sapiens
gaaggggatgggaaataaagaa

SEQ ID NO: 6221903 - DNA, 23 bp, Homo sapiens
gaaggggcacaccactgccctgc

SEQ ID NO: 6221904 - DNA, 14 bp, Homo sapiens
gaaggggccagagg

SEQ ID NO: 6221905 - DNA, 23 bp, Homo sapiens
gaaggggccccggggctggcaag

SEQ ID NO: 6221906 - DNA, 19 bp, Homo sapiens
gaaggggcgtgtccctcct

SEQ ID NO: 6221907 - DNA, 13 bp, Homo sapiens
gatattaaaatgc

SEQ ID NO: 6221908 - DNA, 16 bp, Homo sapiens
gatattaaaatttggt

SEQ ID NO: 6221909 - DNA, 21 bp, Homo sapiens
gatattaaacctctttcccca

SEQ ID NO: 6221910 - DNA, 21 bp, Homo sapiens
gatattaaacgtgtaaattgc

SEQ ID NO: 6221911 - DNA, 13 bp, Homo sapiens
gatattaaagatt

SEQ ID NO: 6221912 - DNA, 23 bp, Homo sapiens
gatattaaagattggaatgtgtt

SEQ ID NO: 6221913 - DNA, 18 bp, Homo sapiens
gatattaagaatcttaga

SEQ ID NO: 6221914 - DNA, 14 bp, Homo sapiens
gatattaatcaaaa

SEQ ID NO: 6221915 - DNA, 13 bp, Homo sapiens
gatattaccctca

SEQ ID NO: 6221916 - DNA, 19 bp, Homo sapiens
gatattactttatcacttt

SEQ ID NO: 6221917 - DNA, 20 bp, Homo sapiens
gatattaggccagttgaagt

SEQ ID NO: 6221918 - DNA, 14 bp, Homo sapiens
gatattatagaaaa

SEQ ID NO: 6221919 - DNA, 22 bp, Homo sapiens
gatattatctacctgttctgta

SEQ ID NO: 6221920 - DNA, 24 bp, Homo sapiens
gatattatctacctgttctgtagc

SEQ ID NO: 6221921 - DNA, 18 bp, Homo sapiens
gatattattaatttttat

SEQ ID NO: 6221922 - DNA, 23 bp, Homo sapiens
gatattattcaccatgtaaaaca

SEQ ID NO: 6221923 - DNA, 17 bp, Homo sapiens
gatattatttaaatgtt

SEQ ID NO: 6221924 - DNA, 20 bp, Homo sapiens
gatattatttaaatgttgaa

SEQ ID NO: 6221925 - DNA, 16 bp, Homo sapiens
gatattattttaaatt

SEQ ID NO: 6221926 - DNA, 17 bp, Homo sapiens
gatattcaaacacacag

SEQ ID NO: 6221927 - DNA, 17 bp, Homo sapiens
gatattcagaattatga

SEQ ID NO: 6221928 - DNA, 17 bp, Homo sapiens
gatattcagatgtatgt

SEQ ID NO: 6221929 - DNA, 12 bp, Homo sapiens
gatattccatag

SEQ ID NO: 6221930 - DNA, 13 bp, Homo sapiens
gatattcccaggg

SEQ ID NO: 6221931 - DNA, 13 bp, Homo sapiens
gatattctaagac

SEQ ID NO: 6221932 - DNA, 18 bp, Homo sapiens
gatattctcattatttca

SEQ ID NO: 6221933 - DNA, 14 bp, Homo sapiens
gatattctcctcgg

SEQ ID NO: 6221934 - DNA, 16 bp, Homo sapiens
gatattctcctcggac

SEQ ID NO: 6221935 - DNA, 19 bp, Homo sapiens
gatattcttctcttgcttt

SEQ ID NO: 6221936 - DNA, 24 bp, Homo sapiens
gatattctttaaacaaatatgaaa

SEQ ID NO: 6221937 - DNA, 13 bp, Homo sapiens
gatattctttaca

SEQ ID NO: 6221938 - DNA, 21 bp, Homo sapiens
gatattgaaggagaaaataga

SEQ ID NO: 6221939 - DNA, 18 bp, Homo sapiens
gatattgaggccaagaat

SEQ ID NO: 6221940 - DNA, 14 bp, Homo sapiens
gatattgatattga

SEQ ID NO: 6221941 - DNA, 21 bp, Homo sapiens
gatattgccttatttgtctgt

SEQ ID NO: 6221942 - DNA, 22 bp, Homo sapiens
gatattgccttatttgtctgta

SEQ ID NO: 6221943 - DNA, 16 bp, Homo sapiens
gatattgctaattgtg

SEQ ID NO: 6221944 - DNA, 12 bp, Homo sapiens
gatattggaaga

SEQ ID NO: 6221945 - DNA, 17 bp, Homo sapiens
gatattgggaaggaaat

SEQ ID NO: 6221946 - DNA, 23 bp, Homo sapiens
gatattggtggccggtggttttg

SEQ ID NO: 6221947 - DNA, 18 bp, Homo sapiens
gatattggttcttcccct

SEQ ID NO: 6221948 - DNA, 13 bp, Homo sapiens
gatattgtacata

SEQ ID NO: 6221949 - DNA, 17 bp, Homo sapiens
gatattgtacataaaag

SEQ ID NO: 6221950 - DNA, 18 bp, Homo sapiens
gatattgtacataaaaga

SEQ ID NO: 6221951 - DNA, 15 bp, Homo sapiens
gatattgtgtaggaa

SEQ ID NO: 6221952 - DNA, 20 bp, Homo sapiens
gatattgttataaataaaat

SEQ ID NO: 6221953 - DNA, 22 bp, Homo sapiens
gatattgttcaaacaatatcat

SEQ ID NO: 6221954 - DNA, 14 bp, Homo sapiens
gatattgttctcca

SEQ ID NO: 6221955 - DNA, 18 bp, Homo sapiens
gatattgttgttttccat

SEQ ID NO: 6221956 - DNA, 13 bp, Homo sapiens
gatattgtttaaa

SEQ ID NO: 6221957 - DNA, 11 bp, Homo sapiens
gatattgtttg

SEQ ID NO: 6221958 - DNA, 16 bp, Homo sapiens
gatattgttttctgta

SEQ ID NO: 6221959 - DNA, 17 bp, Homo sapiens
gatattgttttctgtaa

SEQ ID NO: 6221960 - DNA, 17 bp, Homo sapiens
gatattgttttgtgact

SEQ ID NO: 6221961 - DNA, 19 bp, Homo sapiens
gatatttaaatttagtgct

SEQ ID NO: 6221962 - DNA, 13 bp, Homo sapiens
gatatttaagaaa

SEQ ID NO: 6221963 - DNA, 19 bp, Homo sapiens
gatatttaggtttttggct

SEQ ID NO: 6221964 - DNA, 17 bp, Homo sapiens
gatatttatatgttatt

SEQ ID NO: 6221965 - DNA, 19 bp, Homo sapiens
gatatttatggggggagaa

SEQ ID NO: 6221966 - DNA, 12 bp, Homo sapiens
gatatttattga

SEQ ID NO: 6221967 - DNA, 18 bp, Homo sapiens
gatatttattgatgtttt

SEQ ID NO: 6221968 - DNA, 20 bp, Homo sapiens
gatatttattgatgttttca

SEQ ID NO: 6221969 - DNA, 18 bp, Homo sapiens
gatatttatttaaacaaa

SEQ ID NO: 6221970 - DNA, 17 bp, Homo sapiens
gatatttcaatctttta

SEQ ID NO: 6221971 - DNA, 16 bp, Homo sapiens
gatatttccatcatta

SEQ ID NO: 6221972 - DNA, 19 bp, Homo sapiens
gatatttccatttcttcct

SEQ ID NO: 6221973 - DNA, 17 bp, Homo sapiens
gatatttcgaccctggg

SEQ ID NO: 6221974 - DNA, 18 bp, Homo sapiens
gatatttcgaccctgggg

SEQ ID NO: 6221975 - DNA, 20 bp, Homo sapiens
gatatttcgtttggtcttag

SEQ ID NO: 6221976 - DNA, 14 bp, Homo sapiens
gatatttgaaatag

SEQ ID NO: 6221977 - DNA, 21 bp, Homo sapiens
gatatttgacagacatccttg

SEQ ID NO: 6221978 - DNA, 21 bp, Homo sapiens
gatatttgcacttatgtactt

SEQ ID NO: 6221979 - DNA, 22 bp, Homo sapiens
gatatttgcattgaggaaatat

SEQ ID NO: 6221980 - DNA, 19 bp, Homo sapiens
gatatttgcctgtctgttt

SEQ ID NO: 6221981 - DNA, 20 bp, Homo sapiens
gatatttgctggagtgctgg

SEQ ID NO: 6221982 - DNA, 13 bp, Homo sapiens
gatatttggctta

SEQ ID NO: 6221983 - DNA, 17 bp, Homo sapiens
gatattttatttctgat

SEQ ID NO: 6221984 - DNA, 19 bp, Homo sapiens
gatattttcaaattgtatc

SEQ ID NO: 6221985 - DNA, 20 bp, Homo sapiens
gatattttcaaattgtatct

SEQ ID NO: 6221986 - DNA, 22 bp, Homo sapiens
gatattttcatatttaaagcca

SEQ ID NO: 6221987 - DNA, 16 bp, Homo sapiens
gatattttcccttttt

SEQ ID NO: 6221988 - DNA, 20 bp, Homo sapiens
gatattttccctttttaaaa

SEQ ID NO: 6221989 - DNA, 15 bp, Homo sapiens
gatattttctgtgcc

SEQ ID NO: 6221990 - DNA, 21 bp, Homo sapiens
gatattttctgtgcctgaata

SEQ ID NO: 6221991 - DNA, 17 bp, Homo sapiens
gatattttcttaaaacc

SEQ ID NO: 6221992 - DNA, 20 bp, Homo sapiens
gatattttcttccaagcaaa

SEQ ID NO: 6221993 - DNA, 16 bp, Homo sapiens
gatattttgaaatgaa

SEQ ID NO: 6221994 - DNA, 21 bp, Homo sapiens
gatatttttaacttaatggca

SEQ ID NO: 6221995 - DNA, 14 bp, Homo sapiens
gatatttttatagg

SEQ ID NO: 6221996 - DNA, 15 bp, Homo sapiens
gatatttttattcaa

SEQ ID NO: 6221997 - DNA, 14 bp, Homo sapiens
gatatttttctcca

SEQ ID NO: 6221998 - DNA, 15 bp, Homo sapiens
gatatttttttaagt

SEQ ID NO: 6221999 - DNA, 15 bp, Homo sapiens
gatatttttttcttt

SEQ ID NO: 6222000 - DNA, 20 bp, Homo sapiens
gatcaaaaagaaactttgtt

SEQ ID NO: 6222001 - DNA, 23 bp, Homo sapiens
gatcaaaaaggcttataaaacag

SEQ ID NO: 6222002 - DNA, 17 bp, Homo sapiens
gatcaaaaataaactag

SEQ ID NO: 6222003 - DNA, 21 bp, Homo sapiens
gatcaaaacctgtgccaggct

SEQ ID NO: 6222004 - DNA, 23 bp, Homo sapiens
gatcaaaacctgtgccaggctga

SEQ ID NO: 6222005 - DNA, 20 bp, Homo sapiens
gatcaaaaccttccttccct

SEQ ID NO: 6222006 - DNA, 21 bp, Homo sapiens
gatcaaaaccttccttccctg

SEQ ID NO: 6222007 - DNA, 20 bp, Homo sapiens
gatcaaaaggttaataaagt

SEQ ID NO: 6222008 - DNA, 14 bp, Homo sapiens
gatcaaaatcaaaa

SEQ ID NO: 6222009 - DNA, 22 bp, Homo sapiens
gatcaaaatcaaaaggtaatgc

SEQ ID NO: 6222010 - DNA, 21 bp, Homo sapiens
gatcaaaatctgtagagcagg

SEQ ID NO: 6222011 - DNA, 13 bp, Homo sapiens
gatcaaaatgcat

SEQ ID NO: 6222012 - DNA, 22 bp, Homo sapiens
gatcaaaccccgaccacctgcc

SEQ ID NO: 6222013 - DNA, 15 bp, Homo sapiens
gatcaaacctttctg

SEQ ID NO: 6222014 - DNA, 16 bp, Homo sapiens
gatcaaacctttctgg

SEQ ID NO: 6222015 - DNA, 19 bp, Homo sapiens
gatcaaacctttctggcct

SEQ ID NO: 6222016 - DNA, 12 bp, Homo sapiens
gatcaaagatga

SEQ ID NO: 6222017 - DNA, 20 bp, Homo sapiens
gatcaaagctaggaaaggca

SEQ ID NO: 6222018 - DNA, 22 bp, Homo sapiens
gatcaaagctaggaaaggcaga

SEQ ID NO: 6222019 - DNA, 12 bp, Homo sapiens
gatcaaagttcc

SEQ ID NO: 6222020 - DNA, 14 bp, Homo sapiens
gatcaaatacttta

SEQ ID NO: 6222021 - DNA, 16 bp, Homo sapiens
gatcaaatagttgcat

SEQ ID NO: 6222022 - DNA, 22 bp, Homo sapiens
gatcaaattttgagcaaagaaa

SEQ ID NO: 6222023 - DNA, 14 bp, Homo sapiens
gatcaacatctttt

SEQ ID NO: 6222024 - DNA, 15 bp, Homo sapiens
gatcaaccaggcaga

SEQ ID NO: 6222025 - DNA, 23 bp, Homo sapiens
gatcaaccccttcgctcctgtgt

SEQ ID NO: 6222026 - DNA, 14 bp, Homo sapiens
gatcaagaaagtgt

SEQ ID NO: 6222027 - DNA, 14 bp, Homo sapiens
gatcaagagaatca

SEQ ID NO: 6222028 - DNA, 15 bp, Homo sapiens
gatcaagcagaaaac

SEQ ID NO: 6222029 - DNA, 17 bp, Homo sapiens
gatcaagccaaaaaaga

SEQ ID NO: 6222030 - DNA, 20 bp, Homo sapiens
gatcaagcttgtgtacttga

SEQ ID NO: 6222031 - DNA, 23 bp, Homo sapiens
gatcaaggccttattggaaagca

SEQ ID NO: 6222032 - DNA, 15 bp, Homo sapiens
gatcaaggtgaaata

SEQ ID NO: 6222033 - DNA, 13 bp, Homo sapiens
gatcaagtattac

SEQ ID NO: 6222034 - DNA, 17 bp, Homo sapiens
gatcaagtcctttgtga

SEQ ID NO: 6222035 - DNA, 19 bp, Homo sapiens
gatcaataaaatgtgattt

SEQ ID NO: 6222036 - DNA, 21 bp, Homo sapiens
gatcaatagattgtaatacac

SEQ ID NO: 6222037 - DNA, 15 bp, Homo sapiens
gatcaatcctttatt

SEQ ID NO: 6222038 - DNA, 17 bp, Homo sapiens
gatcaatctgcagtttg

SEQ ID NO: 6222039 - DNA, 21 bp, Homo sapiens
gatcaatctgcagtttgtgaa

SEQ ID NO: 6222040 - DNA, 23 bp, Homo sapiens
gatcaatggcgcagtgcctctgg

SEQ ID NO: 6222041 - DNA, 20 bp, Homo sapiens
gatcaattatagtttctgag

SEQ ID NO: 6222042 - DNA, 14 bp, Homo sapiens
gatcaatttctccc

SEQ ID NO: 6222043 - DNA, 11 bp, Homo sapiens
gatcaatttgt

SEQ ID NO: 6222044 - DNA, 13 bp, Homo sapiens
gatcacaaaaaca

SEQ ID NO: 6222045 - DNA, 21 bp, Homo sapiens
gatcacaacgtgcattgtgct

SEQ ID NO: 6222046 - DNA, 23 bp, Homo sapiens
gatcacaacgtgcattgtgcttc

SEQ ID NO: 6222047 - DNA, 17 bp, Homo sapiens
gatcacaagatggaatt

SEQ ID NO: 6222048 - DNA, 20 bp, Homo sapiens
gatcacacagccacttagca

SEQ ID NO: 6222049 - DNA, 12 bp, Homo sapiens
gatcacacagtg

SEQ ID NO: 6222050 - DNA, 23 bp, Homo sapiens
gatcacaccactacactccagcc

SEQ ID NO: 6222051 - DNA, 24 bp, Homo sapiens
gatcacaccactacactccagcct

SEQ ID NO: 6222052 - DNA, 19 bp, Homo sapiens
gatcacacctcagtgggaa

SEQ ID NO: 6222053 - DNA, 15 bp, Homo sapiens
gatcacactatttta

SEQ ID NO: 6222054 - DNA, 17 bp, Homo sapiens
gatcacagaccacagga

SEQ ID NO: 6222055 - DNA, 19 bp, Homo sapiens
gatcacagaccacaggaag

SEQ ID NO: 6222056 - DNA, 15 bp, Homo sapiens
gatcacagagcagca

SEQ ID NO: 6222057 - DNA, 16 bp, Homo sapiens
gatcacagagcagcaa

SEQ ID NO: 6222058 - DNA, 21 bp, Homo sapiens
gatcacagagcagcaagttca

SEQ ID NO: 6222059 - DNA, 13 bp, Homo sapiens
gatcacagaggct

SEQ ID NO: 6222060 - DNA, 15 bp, Homo sapiens
gatcacagcagggcc

SEQ ID NO: 6222061 - DNA, 16 bp, Homo sapiens
gatcacagcagggcct

SEQ ID NO: 6222062 - DNA, 14 bp, Homo sapiens
gatcacagccccac

SEQ ID NO: 6222063 - DNA, 16 bp, Homo sapiens
gatcacagcctcaccc

SEQ ID NO: 6222064 - DNA, 13 bp, Homo sapiens
gatcacagcctcc

SEQ ID NO: 6222065 - DNA, 16 bp, Homo sapiens
gatcacagcctccagg

SEQ ID NO: 6222066 - DNA, 18 bp, Homo sapiens
gatcacagcgtttcagga

SEQ ID NO: 6222067 - DNA, 14 bp, Homo sapiens
gatcacagctcacg

SEQ ID NO: 6222068 - DNA, 21 bp, Homo sapiens
gatcacagcttcagccaggag

SEQ ID NO: 6222069 - DNA, 11 bp, Homo sapiens
gatcacaggag

SEQ ID NO: 6222070 - DNA, 13 bp, Homo sapiens
gatcacatctaaa

SEQ ID NO: 6222071 - DNA, 21 bp, Homo sapiens
gatcacatgcccctcttagaa

SEQ ID NO: 6222072 - DNA, 15 bp, Homo sapiens
gatcaccagaataaa

SEQ ID NO: 6222073 - DNA, 18 bp, Homo sapiens
gatcaccagcccggcctg

SEQ ID NO: 6222074 - DNA, 20 bp, Homo sapiens
gatcaccagcccggcctgct

SEQ ID NO: 6222075 - DNA, 22 bp, Homo sapiens
gatcaccagcccggcctgctcc

SEQ ID NO: 6222076 - DNA, 13 bp, Homo sapiens
gatcaccagtgca

SEQ ID NO: 6222077 - DNA, 17 bp, Homo sapiens
gatcaccatgttagcct

SEQ ID NO: 6222078 - DNA, 18 bp, Homo sapiens
gatcaccatgttagcctt

SEQ ID NO: 6222079 - DNA, 22 bp, Homo sapiens
gatcacccattccgggttcact

SEQ ID NO: 6222080 - DNA, 14 bp, Homo sapiens
gatcacctgaggtc

SEQ ID NO: 6222081 - DNA, 15 bp, Homo sapiens
gatcacgaggtcagg

SEQ ID NO: 6222082 - DNA, 18 bp, Homo sapiens
gatcacgatgtaaattat

SEQ ID NO: 6222083 - DNA, 13 bp, Homo sapiens
gatcacgccactg

SEQ ID NO: 6222084 - DNA, 15 bp, Homo sapiens
gatcacgccactgca

SEQ ID NO: 6222085 - DNA, 16 bp, Homo sapiens
gatcacgccactgcac

SEQ ID NO: 6222086 - DNA, 18 bp, Homo sapiens
gaaggggctatcctggga

SEQ ID NO: 6222087 - DNA, 19 bp, Homo sapiens
gaaggggctatcctgggac

SEQ ID NO: 6222088 - DNA, 20 bp, Homo sapiens
gaaggggctatcctgggacc

SEQ ID NO: 6222089 - DNA, 21 bp, Homo sapiens
gaaggggctgaggacgagacc

SEQ ID NO: 6222090 - DNA, 18 bp, Homo sapiens
gaaggggctgcttgcttt

SEQ ID NO: 6222091 - DNA, 12 bp, Homo sapiens
gaaggggctgga

SEQ ID NO: 6222092 - DNA, 14 bp, Homo sapiens
gaaggggctggtgg

SEQ ID NO: 6222093 - DNA, 19 bp, Homo sapiens
gaaggggctggtggagatg

SEQ ID NO: 6222094 - DNA, 23 bp, Homo sapiens
gaaggggcttctaatgacccaga

SEQ ID NO: 6222095 - DNA, 14 bp, Homo sapiens
gaagggggcaggcc

SEQ ID NO: 6222096 - DNA, 22 bp, Homo sapiens
gaagggggcaggcccctttgga

SEQ ID NO: 6222097 - DNA, 16 bp, Homo sapiens
gaagggggccctgcta

SEQ ID NO: 6222098 - DNA, 19 bp, Homo sapiens
gaagggggctctgccccag

SEQ ID NO: 6222099 - DNA, 19 bp, Homo sapiens
gaagggggctgggacatgg

SEQ ID NO: 6222100 - DNA, 18 bp, Homo sapiens
gaagggggtctctgttaa

SEQ ID NO: 6222101 - DNA, 19 bp, Homo sapiens
gaagggggtgacagtcctc

SEQ ID NO: 6222102 - DNA, 23 bp, Homo sapiens
gaagggggtgcaaagactctgag

SEQ ID NO: 6222103 - DNA, 12 bp, Homo sapiens
gaagggggtggt

SEQ ID NO: 6222104 - DNA, 21 bp, Homo sapiens
gaagggggtgtgcgtgcgtgt

SEQ ID NO: 6222105 - DNA, 14 bp, Homo sapiens
gaaggggttcctca

SEQ ID NO: 6222106 - DNA, 14 bp, Homo sapiens
gaagggtaaacaat

SEQ ID NO: 6222107 - DNA, 13 bp, Homo sapiens
gaagggtcctgcc

SEQ ID NO: 6222108 - DNA, 15 bp, Homo sapiens
gaagggtcctgccgg

SEQ ID NO: 6222109 - DNA, 21 bp, Homo sapiens
gaagggtccttccctctcccc

SEQ ID NO: 6222110 - DNA, 19 bp, Homo sapiens
gaagggtgcctggctgggc

SEQ ID NO: 6222111 - DNA, 14 bp, Homo sapiens
gaagggtggcctgt

SEQ ID NO: 6222112 - DNA, 21 bp, Homo sapiens
gaagggtggcctgttccctag

SEQ ID NO: 6222113 - DNA, 22 bp, Homo sapiens
gaagggtggcctgttccctaga

SEQ ID NO: 6222114 - DNA, 22 bp, Homo sapiens
gaagggtggctttgcatttctt

SEQ ID NO: 6222115 - DNA, 16 bp, Homo sapiens
gaagggtgggccctgg

SEQ ID NO: 6222116 - DNA, 17 bp, Homo sapiens
gaagggtggtggagcca

SEQ ID NO: 6222117 - DNA, 21 bp, Homo sapiens
gaagggttagacaagcctgga

SEQ ID NO: 6222118 - DNA, 13 bp, Homo sapiens
gaagggttctgcc

SEQ ID NO: 6222119 - DNA, 21 bp, Homo sapiens
gaagggttctgccctgcctga

SEQ ID NO: 6222120 - DNA, 22 bp, Homo sapiens
gaagggttggtgggctggccca

SEQ ID NO: 6222121 - DNA, 14 bp, Homo sapiens
gaagggtttctcta

SEQ ID NO: 6222122 - DNA, 19 bp, Homo sapiens
gaagggtttttagagaatg

SEQ ID NO: 6222123 - DNA, 16 bp, Homo sapiens
gaaggtaaagggacac

SEQ ID NO: 6222124 - DNA, 17 bp, Homo sapiens
gaaggtaaataaaaaga

SEQ ID NO: 6222125 - DNA, 18 bp, Homo sapiens
gaaggtaactaagaagtg

SEQ ID NO: 6222126 - DNA, 23 bp, Homo sapiens
gaaggtaatactataaatatatt

SEQ ID NO: 6222127 - DNA, 13 bp, Homo sapiens
gaaggtactgtat

SEQ ID NO: 6222128 - DNA, 20 bp, Homo sapiens
gaaggtactgtcatgggcta

SEQ ID NO: 6222129 - DNA, 19 bp, Homo sapiens
gaaggtatacctgggaaga

SEQ ID NO: 6222130 - DNA, 19 bp, Homo sapiens
gaaggtatatcaggagggg

SEQ ID NO: 6222131 - DNA, 16 bp, Homo sapiens
gaaggtatcacacact

SEQ ID NO: 6222132 - DNA, 19 bp, Homo sapiens
gaaggtatcagttatatga

SEQ ID NO: 6222133 - DNA, 18 bp, Homo sapiens
gaaggtattaagattata

SEQ ID NO: 6222134 - DNA, 23 bp, Homo sapiens
gaaggtcaataaattattagaga

SEQ ID NO: 6222135 - DNA, 15 bp, Homo sapiens
gaaggtcacagaagt

SEQ ID NO: 6222136 - DNA, 14 bp, Homo sapiens
gaaggtcaccagca

SEQ ID NO: 6222137 - DNA, 23 bp, Homo sapiens
gaaggtcactcttcctgcaagga

SEQ ID NO: 6222138 - DNA, 14 bp, Homo sapiens
gaaggtcatttcca

SEQ ID NO: 6222139 - DNA, 17 bp, Homo sapiens
gaaggtcccacagccct

SEQ ID NO: 6222140 - DNA, 17 bp, Homo sapiens
gaaggtcccatggcctg

SEQ ID NO: 6222141 - DNA, 21 bp, Homo sapiens
gaaggtccttgcctgaactcc

SEQ ID NO: 6222142 - DNA, 14 bp, Homo sapiens
gaaggtcggaggct

SEQ ID NO: 6222143 - DNA, 15 bp, Homo sapiens
gaaggtcggaggctt

SEQ ID NO: 6222144 - DNA, 17 bp, Homo sapiens
gaaggtctattggccaa

SEQ ID NO: 6222145 - DNA, 18 bp, Homo sapiens
gaaggtctccaagggagg

SEQ ID NO: 6222146 - DNA, 20 bp, Homo sapiens
gaaggtctgtggtgcagtgt

SEQ ID NO: 6222147 - DNA, 17 bp, Homo sapiens
gaaggtcttgatttgtt

SEQ ID NO: 6222148 - DNA, 23 bp, Homo sapiens
gaaggtcttgatttgttttagaa

SEQ ID NO: 6222149 - DNA, 12 bp, Homo sapiens
gaaggtgaaaca

SEQ ID NO: 6222150 - DNA, 13 bp, Homo sapiens
gaaggtgaacttt

SEQ ID NO: 6222151 - DNA, 19 bp, Homo sapiens
gaaggtgaactttgtgctt

SEQ ID NO: 6222152 - DNA, 11 bp, Homo sapiens
gaaggtgacag

SEQ ID NO: 6222153 - DNA, 19 bp, Homo sapiens
gaaggtgaccgcccagctc

SEQ ID NO: 6222154 - DNA, 17 bp, Homo sapiens
gaaggtgataagggaaa

SEQ ID NO: 6222155 - DNA, 23 bp, Homo sapiens
gaaggtgataagggaaaagataa

SEQ ID NO: 6222156 - DNA, 19 bp, Homo sapiens
gaaggtgatgttgccatcc

SEQ ID NO: 6222157 - DNA, 16 bp, Homo sapiens
gaaggtgatttattct

SEQ ID NO: 6222158 - DNA, 22 bp, Homo sapiens
gaaggtgccccaaaatgcaaga

SEQ ID NO: 6222159 - DNA, 19 bp, Homo sapiens
gaaggtgccgtgagcaggc

SEQ ID NO: 6222160 - DNA, 14 bp, Homo sapiens
gaaggtgcctgcca

SEQ ID NO: 6222161 - DNA, 13 bp, Homo sapiens
gaaggtgcctggc

SEQ ID NO: 6222162 - DNA, 15 bp, Homo sapiens
gaaggtgctgagctt

SEQ ID NO: 6222163 - DNA, 14 bp, Homo sapiens
gaaggtgctgccac

SEQ ID NO: 6222164 - DNA, 18 bp, Homo sapiens
gaaggtgctgccacccct

SEQ ID NO: 6222165 - DNA, 14 bp, Homo sapiens
gaaggtgctggagg

SEQ ID NO: 6222166 - DNA, 18 bp, Homo sapiens
gaaggtgctggaggtggg

SEQ ID NO: 6222167 - DNA, 18 bp, Homo sapiens
gaaggtggacctggcagt

SEQ ID NO: 6222168 - DNA, 18 bp, Homo sapiens
gaaggtggcttaccaaga

SEQ ID NO: 6222169 - DNA, 14 bp, Homo sapiens
gaaggtggggccct

SEQ ID NO: 6222170 - DNA, 19 bp, Homo sapiens
gaaggtggggccctgcccc

SEQ ID NO: 6222171 - DNA, 18 bp, Homo sapiens
gaaggtgtctctggtctt

SEQ ID NO: 6222172 - DNA, 15 bp, Homo sapiens
gaaggtgtgctacag

SEQ ID NO: 6222173 - DNA, 15 bp, Homo sapiens
gaaggtgtttaaaga

SEQ ID NO: 6222174 - DNA, 14 bp, Homo sapiens
gaaggtgtttcaaa

SEQ ID NO: 6222175 - DNA, 15 bp, Homo sapiens
gaaggtgtttcaaag

SEQ ID NO: 6222176 - DNA, 18 bp, Homo sapiens
gaaggttagaaaggcagc

SEQ ID NO: 6222177 - DNA, 20 bp, Homo sapiens
gaaggttaggatttaacagt

SEQ ID NO: 6222178 - DNA, 15 bp, Homo sapiens
gaaggttcccaagga

SEQ ID NO: 6222179 - DNA, 15 bp, Homo sapiens
gaaggttggcggggg

SEQ ID NO: 6222180 - DNA, 22 bp, Homo sapiens
gaaggttggtgaatttcacaag

SEQ ID NO: 6222181 - DNA, 22 bp, Homo sapiens
gaaggttgtatgtgtcatttat

SEQ ID NO: 6222182 - DNA, 20 bp, Homo sapiens
gaaggtttacaatttacaaa

SEQ ID NO: 6222183 - DNA, 13 bp, Homo sapiens
gaaggtttattgt

SEQ ID NO: 6222184 - DNA, 20 bp, Homo sapiens
gaaggtttggtgtgtggaga

SEQ ID NO: 6222185 - DNA, 15 bp, Homo sapiens
gaaggtttgtatatt

SEQ ID NO: 6222186 - DNA, 16 bp, Homo sapiens
gaaggtttgtgttttt

SEQ ID NO: 6222187 - DNA, 17 bp, Homo sapiens
gaagtaaaacatttaaa

SEQ ID NO: 6222188 - DNA, 18 bp, Homo sapiens
gaagtaaaagttaagatc

SEQ ID NO: 6222189 - DNA, 18 bp, Homo sapiens
gaagtaaaatgtggcagg

SEQ ID NO: 6222190 - DNA, 18 bp, Homo sapiens
gaagtaaacctgaacaaa

SEQ ID NO: 6222191 - DNA, 15 bp, Homo sapiens
gaagtaaagcctcaa

SEQ ID NO: 6222192 - DNA, 18 bp, Homo sapiens
gaagtaaattaggcagtg

SEQ ID NO: 6222193 - DNA, 12 bp, Homo sapiens
gaagtaaattat

SEQ ID NO: 6222194 - DNA, 13 bp, Homo sapiens
gaagtaaattatg

SEQ ID NO: 6222195 - DNA, 18 bp, Homo sapiens
gaagtaacccctcctggc

SEQ ID NO: 6222196 - DNA, 20 bp, Homo sapiens
gaagtaacccctcctggctg

SEQ ID NO: 6222197 - DNA, 14 bp, Homo sapiens
gaagtaactacagt

SEQ ID NO: 6222198 - DNA, 15 bp, Homo sapiens
gaagtaactcccact

SEQ ID NO: 6222199 - DNA, 17 bp, Homo sapiens
gaagtaacttgtcttaa

SEQ ID NO: 6222200 - DNA, 20 bp, Homo sapiens
gaagtaacttgtcttaaata

SEQ ID NO: 6222201 - DNA, 18 bp, Homo sapiens
gaagtaacttttacaaaa

SEQ ID NO: 6222202 - DNA, 14 bp, Homo sapiens
gaagtaagttcatc

SEQ ID NO: 6222203 - DNA, 16 bp, Homo sapiens
gaagtaagttcatcaa

SEQ ID NO: 6222204 - DNA, 23 bp, Homo sapiens
gaagtaagttctgaaaactgttt

SEQ ID NO: 6222205 - DNA, 22 bp, Homo sapiens
gaagtaagtttatccaaatctt

SEQ ID NO: 6222206 - DNA, 20 bp, Homo sapiens
gaagtaatatgcacacattt

SEQ ID NO: 6222207 - DNA, 21 bp, Homo sapiens
gaagtaatatgcacacatttt

SEQ ID NO: 6222208 - DNA, 21 bp, Homo sapiens
gaagtaattaaggtacatcat

SEQ ID NO: 6222209 - DNA, 20 bp, Homo sapiens
gaagtaattttcttctcatt

SEQ ID NO: 6222210 - DNA, 13 bp, Homo sapiens
gaagtacaaacat

SEQ ID NO: 6222211 - DNA, 15 bp, Homo sapiens
gaagtacaaacatga

SEQ ID NO: 6222212 - DNA, 18 bp, Homo sapiens
gaagtacaaacatgaaaa

SEQ ID NO: 6222213 - DNA, 20 bp, Homo sapiens
gaagtacaggtcatctgctg

SEQ ID NO: 6222214 - DNA, 13 bp, Homo sapiens
gaagtaccagact

SEQ ID NO: 6222215 - DNA, 20 bp, Homo sapiens
gaagtacgtcccagcggcct

SEQ ID NO: 6222216 - DNA, 23 bp, Homo sapiens
gaagtacttggcccccttcagga

SEQ ID NO: 6222217 - DNA, 14 bp, Homo sapiens
gaagtactttgtgc

SEQ ID NO: 6222218 - DNA, 22 bp, Homo sapiens
gaagtagcaataggctgtaatc

SEQ ID NO: 6222219 - DNA, 15 bp, Homo sapiens
gaagtagcacaggct

SEQ ID NO: 6222220 - DNA, 14 bp, Homo sapiens
gaagtagctagtag

SEQ ID NO: 6222221 - DNA, 15 bp, Homo sapiens
gaagtagctagtagc

SEQ ID NO: 6222222 - DNA, 18 bp, Homo sapiens
gaagtagcttgctccctg

SEQ ID NO: 6222223 - DNA, 21 bp, Homo sapiens
gaagtagtatgttattcctgg

SEQ ID NO: 6222224 - DNA, 15 bp, Homo sapiens
gaagtagtccagcct

SEQ ID NO: 6222225 - DNA, 15 bp, Homo sapiens
gaagtagttatcatg

SEQ ID NO: 6222226 - DNA, 19 bp, Homo sapiens
gaagtagttatcatgttag

SEQ ID NO: 6222227 - DNA, 20 bp, Homo sapiens
gaagtagttctgtttggtgt

SEQ ID NO: 6222228 - DNA, 17 bp, Homo sapiens
gaagtagttttgttcat

SEQ ID NO: 6222229 - DNA, 15 bp, Homo sapiens
gaagtataaggtgct

SEQ ID NO: 6222230 - DNA, 23 bp, Homo sapiens
gaagtatacctggctttttaaaa

SEQ ID NO: 6222231 - DNA, 20 bp, Homo sapiens
gaagtatagatggtagaaac

SEQ ID NO: 6222232 - DNA, 22 bp, Homo sapiens
gaagtatagatggtagaaactt

SEQ ID NO: 6222233 - DNA, 14 bp, Homo sapiens
gaagtatcagcact

SEQ ID NO: 6222234 - DNA, 14 bp, Homo sapiens
gaagtatccttcag

SEQ ID NO: 6222235 - DNA, 19 bp, Homo sapiens
gaagtatctaaaagtgtca

SEQ ID NO: 6222236 - DNA, 16 bp, Homo sapiens
gaagtatctgtacctg

SEQ ID NO: 6222237 - DNA, 17 bp, Homo sapiens
gaagtatggtgtgttca

SEQ ID NO: 6222238 - DNA, 22 bp, Homo sapiens
gaagtattaaaatgcatatttc

SEQ ID NO: 6222239 - DNA, 21 bp, Homo sapiens
gaagtattatctgtaaaaatt

SEQ ID NO: 6222240 - DNA, 14 bp, Homo sapiens
gaagtattcacaaa

SEQ ID NO: 6222241 - DNA, 13 bp, Homo sapiens
gaagtattcctgt

SEQ ID NO: 6222242 - DNA, 14 bp, Homo sapiens
gaagtattcctgtt

SEQ ID NO: 6222243 - DNA, 15 bp, Homo sapiens
gaagtatttgagaga

SEQ ID NO: 6222244 - DNA, 11 bp, Homo sapiens
gaagtatttta

SEQ ID NO: 6222245 - DNA, 20 bp, Homo sapiens
gaagtattttcctccaaagt

SEQ ID NO: 6222246 - DNA, 17 bp, Homo sapiens
gaagtatttttagaata

SEQ ID NO: 6222247 - DNA, 15 bp, Homo sapiens
gaagtatttttttaa

SEQ ID NO: 6222248 - DNA, 20 bp, Homo sapiens
gaagtcaaaatatgtaagaa

SEQ ID NO: 6222249 - DNA, 15 bp, Homo sapiens
gaagtcaaagcaagg

SEQ ID NO: 6222250 - DNA, 16 bp, Homo sapiens
gaagtcaaagcaagga

SEQ ID NO: 6222251 - DNA, 17 bp, Homo sapiens
gaagtcaaataaatgtt

SEQ ID NO: 6222252 - DNA, 23 bp, Homo sapiens
gaagtcaaataaatgtttccccc

SEQ ID NO: 6222253 - DNA, 20 bp, Homo sapiens
gaagtcaagcccagccacgt

SEQ ID NO: 6222254 - DNA, 18 bp, Homo sapiens
gaagtcaaggcttagacc

SEQ ID NO: 6222255 - DNA, 19 bp, Homo sapiens
gaagtcaattactctataa

SEQ ID NO: 6222256 - DNA, 21 bp, Homo sapiens
gaagtcaatttgggggacatg

SEQ ID NO: 6222257 - DNA, 21 bp, Homo sapiens
gaagtcacattcctgaacagg

SEQ ID NO: 6222258 - DNA, 18 bp, Homo sapiens
gaagtcacctttctgggc

SEQ ID NO: 6222259 - DNA, 18 bp, Homo sapiens
gaagtcactcaattgttt

SEQ ID NO: 6222260 - DNA, 20 bp, Homo sapiens
gaagtcactcaattgttttt

SEQ ID NO: 6222261 - DNA, 18 bp, Homo sapiens
gaagtcactcacactggc

SEQ ID NO: 6222262 - DNA, 16 bp, Homo sapiens
gaagtcactgaacaaa

SEQ ID NO: 6222263 - DNA, 17 bp, Homo sapiens
gaagtcagaatttttaa

SEQ ID NO: 6222264 - DNA, 18 bp, Homo sapiens
gatcacgccactgcacta

SEQ ID NO: 6222265 - DNA, 23 bp, Homo sapiens
gatcacgccattgcactccagcc

SEQ ID NO: 6222266 - DNA, 22 bp, Homo sapiens
gatcacgccattgtactccagc

SEQ ID NO: 6222267 - DNA, 23 bp, Homo sapiens
gatcacgccattgtactccagcc

SEQ ID NO: 6222268 - DNA, 15 bp, Homo sapiens
gatcacggctcactg

SEQ ID NO: 6222269 - DNA, 18 bp, Homo sapiens
gatcacggctcactgcag

SEQ ID NO: 6222270 - DNA, 14 bp, Homo sapiens
gatcactactgcag

SEQ ID NO: 6222271 - DNA, 14 bp, Homo sapiens
gatcactcccagca

SEQ ID NO: 6222272 - DNA, 15 bp, Homo sapiens
gatcactcccagcac

SEQ ID NO: 6222273 - DNA, 13 bp, Homo sapiens
gatcactcctgga

SEQ ID NO: 6222274 - DNA, 14 bp, Homo sapiens
gatcactgaacttt

SEQ ID NO: 6222275 - DNA, 13 bp, Homo sapiens
gatcactgaattt

SEQ ID NO: 6222276 - DNA, 15 bp, Homo sapiens
gatcactgccacact

SEQ ID NO: 6222277 - DNA, 23 bp, Homo sapiens
gatcactgccctttttgaaatca

SEQ ID NO: 6222278 - DNA, 17 bp, Homo sapiens
gatcactggagcccagg

SEQ ID NO: 6222279 - DNA, 19 bp, Homo sapiens
gatcactggctggcctgag

SEQ ID NO: 6222280 - DNA, 16 bp, Homo sapiens
gatcacttgagcccag

SEQ ID NO: 6222281 - DNA, 19 bp, Homo sapiens
gatcacttgggcccaggag

SEQ ID NO: 6222282 - DNA, 20 bp, Homo sapiens
gatcacttgggcccaggagg

SEQ ID NO: 6222283 - DNA, 23 bp, Homo sapiens
gatcacttgtcctcttgccagct

SEQ ID NO: 6222284 - DNA, 12 bp, Homo sapiens
gatcagaaagta

SEQ ID NO: 6222285 - DNA, 14 bp, Homo sapiens
gatcagaaatacag

SEQ ID NO: 6222286 - DNA, 15 bp, Homo sapiens
gatcagaacagcaga

SEQ ID NO: 6222287 - DNA, 21 bp, Homo sapiens
gatcagaacattcagctctgg

SEQ ID NO: 6222288 - DNA, 14 bp, Homo sapiens
gatcagaagaacat

SEQ ID NO: 6222289 - DNA, 17 bp, Homo sapiens
gatcagaagtaggaagg

SEQ ID NO: 6222290 - DNA, 13 bp, Homo sapiens
gatcagaatccca

SEQ ID NO: 6222291 - DNA, 22 bp, Homo sapiens
gatcagaccttggatcagatga

SEQ ID NO: 6222292 - DNA, 14 bp, Homo sapiens
gatcagagagcaag

SEQ ID NO: 6222293 - DNA, 16 bp, Homo sapiens
gatcagagcaggacct

SEQ ID NO: 6222294 - DNA, 14 bp, Homo sapiens
gatcagagcattta

SEQ ID NO: 6222295 - DNA, 23 bp, Homo sapiens
gatcagagccgtggtcctttggg

SEQ ID NO: 6222296 - DNA, 13 bp, Homo sapiens
gatcagagctgca

SEQ ID NO: 6222297 - DNA, 14 bp, Homo sapiens
gatcagagctgcag

SEQ ID NO: 6222298 - DNA, 16 bp, Homo sapiens
gatcagagctgcagcc

SEQ ID NO: 6222299 - DNA, 19 bp, Homo sapiens
gatcagagctgcagccagt

SEQ ID NO: 6222300 - DNA, 16 bp, Homo sapiens
gatcagaggagtaaat

SEQ ID NO: 6222301 - DNA, 24 bp, Homo sapiens
gatcagaggcatttgagcagctga

SEQ ID NO: 6222302 - DNA, 15 bp, Homo sapiens
gatcagaggtcatcc

SEQ ID NO: 6222303 - DNA, 14 bp, Homo sapiens
gatcagaggtgtac

SEQ ID NO: 6222304 - DNA, 19 bp, Homo sapiens
gatcagaggtgtacactaa

SEQ ID NO: 6222305 - DNA, 22 bp, Homo sapiens
gatcagaggtgtacactaacat

SEQ ID NO: 6222306 - DNA, 16 bp, Homo sapiens
gatcagatagcaggag

SEQ ID NO: 6222307 - DNA, 21 bp, Homo sapiens
gatcagatgctccaagattct

SEQ ID NO: 6222308 - DNA, 22 bp, Homo sapiens
gatcagatgctccaagattcta

SEQ ID NO: 6222309 - DNA, 15 bp, Homo sapiens
gatcagatgctgaat

SEQ ID NO: 6222310 - DNA, 15 bp, Homo sapiens
gatcagattaaaaac

SEQ ID NO: 6222311 - DNA, 22 bp, Homo sapiens
gatcagatttggtgatggaaaa

SEQ ID NO: 6222312 - DNA, 16 bp, Homo sapiens
gatcagcaaaaagact

SEQ ID NO: 6222313 - DNA, 21 bp, Homo sapiens
gatcagcagcgtgcacatctg

SEQ ID NO: 6222314 - DNA, 21 bp, Homo sapiens
gatcagcatccaaaagcagga

SEQ ID NO: 6222315 - DNA, 15 bp, Homo sapiens
gatcagcatgcctgt

SEQ ID NO: 6222316 - DNA, 15 bp, Homo sapiens
gatcagcattgtgac

SEQ ID NO: 6222317 - DNA, 17 bp, Homo sapiens
gatcagcattgtgactt

SEQ ID NO: 6222318 - DNA, 20 bp, Homo sapiens
gatcagcattttagaaacta

SEQ ID NO: 6222319 - DNA, 18 bp, Homo sapiens
gatcagccagtgaccaac

SEQ ID NO: 6222320 - DNA, 19 bp, Homo sapiens
gatcagccattaaaataaa

SEQ ID NO: 6222321 - DNA, 22 bp, Homo sapiens
gatcagccattaaaataaaaca

SEQ ID NO: 6222322 - DNA, 22 bp, Homo sapiens
gatcagccccaccctggcctag

SEQ ID NO: 6222323 - DNA, 20 bp, Homo sapiens
gatcagccccgcctgtcaca

SEQ ID NO: 6222324 - DNA, 17 bp, Homo sapiens
gatcagcgtggccttgt

SEQ ID NO: 6222325 - DNA, 16 bp, Homo sapiens
gatcagctgtttgtca

SEQ ID NO: 6222326 - DNA, 23 bp, Homo sapiens
gatcagcttattgtctagtgaaa

SEQ ID NO: 6222327 - DNA, 20 bp, Homo sapiens
gatcagctttcaaagcattt

SEQ ID NO: 6222328 - DNA, 15 bp, Homo sapiens
gatcaggaaccaggg

SEQ ID NO: 6222329 - DNA, 20 bp, Homo sapiens
gatcaggaaccagggcctcc

SEQ ID NO: 6222330 - DNA, 23 bp, Homo sapiens
gatcaggaaccagggcctccctg

SEQ ID NO: 6222331 - DNA, 16 bp, Homo sapiens
gatcaggaagagaagg

SEQ ID NO: 6222332 - DNA, 17 bp, Homo sapiens
gatcaggagagcaaggt

SEQ ID NO: 6222333 - DNA, 12 bp, Homo sapiens
gatcaggagccc

SEQ ID NO: 6222334 - DNA, 22 bp, Homo sapiens
gatcaggcacccggggccagag

SEQ ID NO: 6222335 - DNA, 16 bp, Homo sapiens
gatcaggcagtgttta

SEQ ID NO: 6222336 - DNA, 15 bp, Homo sapiens
gatcaggccccaccc

SEQ ID NO: 6222337 - DNA, 15 bp, Homo sapiens
gatcaggctagccct

SEQ ID NO: 6222338 - DNA, 13 bp, Homo sapiens
gatcaggcttcct

SEQ ID NO: 6222339 - DNA, 17 bp, Homo sapiens
gatcaggcttcctggtg

SEQ ID NO: 6222340 - DNA, 19 bp, Homo sapiens
gatcaggcttcctggtgag

SEQ ID NO: 6222341 - DNA, 17 bp, Homo sapiens
gatcagggcctgccccc

SEQ ID NO: 6222342 - DNA, 20 bp, Homo sapiens
gatcagggcctgccccctgg

SEQ ID NO: 6222343 - DNA, 22 bp, Homo sapiens
gatcagggcctgccccctgggg

SEQ ID NO: 6222344 - DNA, 11 bp, Homo sapiens
gatcaggtcat

SEQ ID NO: 6222345 - DNA, 13 bp, Homo sapiens
gatcaggtttgcc

SEQ ID NO: 6222346 - DNA, 16 bp, Homo sapiens
gatcagtagtttgcat

SEQ ID NO: 6222347 - DNA, 22 bp, Homo sapiens
gatcagtagtttgcatttcaga

SEQ ID NO: 6222348 - DNA, 17 bp, Homo sapiens
gatcagtatttaactaa

SEQ ID NO: 6222349 - DNA, 14 bp, Homo sapiens
gatcagtctttgtc

SEQ ID NO: 6222350 - DNA, 20 bp, Homo sapiens
gatcagtgtaccatttgcct

SEQ ID NO: 6222351 - DNA, 14 bp, Homo sapiens
gatcagttaactat

SEQ ID NO: 6222352 - DNA, 11 bp, Homo sapiens
gatcagttttc

SEQ ID NO: 6222353 - DNA, 14 bp, Homo sapiens
gatcagttttccta

SEQ ID NO: 6222354 - DNA, 21 bp, Homo sapiens
gatcagttttcctagtctttg

SEQ ID NO: 6222355 - DNA, 19 bp, Homo sapiens
gatcataaagagcacgttt

SEQ ID NO: 6222356 - DNA, 15 bp, Homo sapiens
gatcataagtgaatt

SEQ ID NO: 6222357 - DNA, 22 bp, Homo sapiens
gatcatagatttctgattttat

SEQ ID NO: 6222358 - DNA, 15 bp, Homo sapiens
gatcatagctcactg

SEQ ID NO: 6222359 - DNA, 21 bp, Homo sapiens
gatcatagctcactgcagcct

SEQ ID NO: 6222360 - DNA, 16 bp, Homo sapiens
gatcataggaagtggc

SEQ ID NO: 6222361 - DNA, 19 bp, Homo sapiens
gatcataggaagtggctgg

SEQ ID NO: 6222362 - DNA, 21 bp, Homo sapiens
gatcataggaagtggctggtc

SEQ ID NO: 6222363 - DNA, 22 bp, Homo sapiens
gatcataggaagtggctggtct

SEQ ID NO: 6222364 - DNA, 20 bp, Homo sapiens
gatcatataagcaagacagt

SEQ ID NO: 6222365 - DNA, 13 bp, Homo sapiens
gatcatccactgt

SEQ ID NO: 6222366 - DNA, 16 bp, Homo sapiens
gatcatccaggcctca

SEQ ID NO: 6222367 - DNA, 15 bp, Homo sapiens
gatcatccctttggt

SEQ ID NO: 6222368 - DNA, 15 bp, Homo sapiens
gatcatctctgtgac

SEQ ID NO: 6222369 - DNA, 17 bp, Homo sapiens
gatcatgcatagagtgt

SEQ ID NO: 6222370 - DNA, 12 bp, Homo sapiens
gatcatgcattg

SEQ ID NO: 6222371 - DNA, 14 bp, Homo sapiens
gatcatggctcact

SEQ ID NO: 6222372 - DNA, 20 bp, Homo sapiens
gatcatggctcactgcagcc

SEQ ID NO: 6222373 - DNA, 21 bp, Homo sapiens
gatcatggctcactgcagcct

SEQ ID NO: 6222374 - DNA, 18 bp, Homo sapiens
gatcatggtgtaataaga

SEQ ID NO: 6222375 - DNA, 16 bp, Homo sapiens
gatcatgtaaatgatt

SEQ ID NO: 6222376 - DNA, 19 bp, Homo sapiens
gatcatgtactttttagta

SEQ ID NO: 6222377 - DNA, 13 bp, Homo sapiens
gatcattaaaaaa

SEQ ID NO: 6222378 - DNA, 14 bp, Homo sapiens
gatcattcttttat

SEQ ID NO: 6222379 - DNA, 20 bp, Homo sapiens
gatcattgaaagtaaaaaat

SEQ ID NO: 6222380 - DNA, 14 bp, Homo sapiens
gatcattgcatttc

SEQ ID NO: 6222381 - DNA, 16 bp, Homo sapiens
gatcattgcatttcca

SEQ ID NO: 6222382 - DNA, 18 bp, Homo sapiens
gatcattgcatttccaga

SEQ ID NO: 6222383 - DNA, 17 bp, Homo sapiens
gatcatttaaaaagctc

SEQ ID NO: 6222384 - DNA, 16 bp, Homo sapiens
gatcatttatttcatg

SEQ ID NO: 6222385 - DNA, 22 bp, Homo sapiens
gatcatttattttaagcactct

SEQ ID NO: 6222386 - DNA, 21 bp, Homo sapiens
gatcatttgcccttaaggaca

SEQ ID NO: 6222387 - DNA, 18 bp, Homo sapiens
gatcatttggagctcttg

SEQ ID NO: 6222388 - DNA, 23 bp, Homo sapiens
gatcattttagacactgggagaa

SEQ ID NO: 6222389 - DNA, 20 bp, Homo sapiens
gatcattttttgtctatttt

SEQ ID NO: 6222390 - DNA, 13 bp, Homo sapiens
gatccaaaagaag

SEQ ID NO: 6222391 - DNA, 23 bp, Homo sapiens
gatccaaaagaagcccccagcta

SEQ ID NO: 6222392 - DNA, 15 bp, Homo sapiens
gatccaaatgctgtg

SEQ ID NO: 6222393 - DNA, 13 bp, Homo sapiens
gatccaagacaaa

SEQ ID NO: 6222394 - DNA, 17 bp, Homo sapiens
gatccaagctaagcact

SEQ ID NO: 6222395 - DNA, 12 bp, Homo sapiens
gatccaagctgg

SEQ ID NO: 6222396 - DNA, 16 bp, Homo sapiens
gatccaagctggtccc

SEQ ID NO: 6222397 - DNA, 21 bp, Homo sapiens
gatccaagctggtcccactca

SEQ ID NO: 6222398 - DNA, 19 bp, Homo sapiens
gatccaaggggctagctgg

SEQ ID NO: 6222399 - DNA, 22 bp, Homo sapiens
gatccaataattttcctgtgac

SEQ ID NO: 6222400 - DNA, 16 bp, Homo sapiens
gatccacacacagagg

SEQ ID NO: 6222401 - DNA, 17 bp, Homo sapiens
gatccacacacagagga

SEQ ID NO: 6222402 - DNA, 18 bp, Homo sapiens
gatccacacacagaggaa

SEQ ID NO: 6222403 - DNA, 19 bp, Homo sapiens
gatccacacacagaggaag

SEQ ID NO: 6222404 - DNA, 23 bp, Homo sapiens
gatccacactttgggcttagtat

SEQ ID NO: 6222405 - DNA, 16 bp, Homo sapiens
gatccacccaacccta

SEQ ID NO: 6222406 - DNA, 17 bp, Homo sapiens
gatccacccaaccctat

SEQ ID NO: 6222407 - DNA, 21 bp, Homo sapiens
gatccacccacctcagcctcc

SEQ ID NO: 6222408 - DNA, 15 bp, Homo sapiens
gatccacccacctgg

SEQ ID NO: 6222409 - DNA, 19 bp, Homo sapiens
gatccacccacctgggcct

SEQ ID NO: 6222410 - DNA, 17 bp, Homo sapiens
gatccaccccctgccca

SEQ ID NO: 6222411 - DNA, 12 bp, Homo sapiens
gatccacccgcc

SEQ ID NO: 6222412 - DNA, 16 bp, Homo sapiens
gatccacctgcacaaa

SEQ ID NO: 6222413 - DNA, 17 bp, Homo sapiens
gatccacctgcacaaac

SEQ ID NO: 6222414 - DNA, 19 bp, Homo sapiens
gatccacctgcacaaacat

SEQ ID NO: 6222415 - DNA, 16 bp, Homo sapiens
gatccacgctgggcct

SEQ ID NO: 6222416 - DNA, 13 bp, Homo sapiens
gatccactggctg

SEQ ID NO: 6222417 - DNA, 17 bp, Homo sapiens
gatccacttcttggttc

SEQ ID NO: 6222418 - DNA, 21 bp, Homo sapiens
gatccagaatggagtcttttc

SEQ ID NO: 6222419 - DNA, 20 bp, Homo sapiens
gatccagagacctgctccag

SEQ ID NO: 6222420 - DNA, 21 bp, Homo sapiens
gatccagagacctgctccaga

SEQ ID NO: 6222421 - DNA, 23 bp, Homo sapiens
gatccagagacttggggaccaga

SEQ ID NO: 6222422 - DNA, 14 bp, Homo sapiens
gatccagagagaag

SEQ ID NO: 6222423 - DNA, 14 bp, Homo sapiens
gatccagagcacag

SEQ ID NO: 6222424 - DNA, 18 bp, Homo sapiens
gatccagatagcctaggg

SEQ ID NO: 6222425 - DNA, 23 bp, Homo sapiens
gatccagatagcctagggtgagg

SEQ ID NO: 6222426 - DNA, 18 bp, Homo sapiens
gatccagatccagactgt

SEQ ID NO: 6222427 - DNA, 15 bp, Homo sapiens
gatccagattcccag

SEQ ID NO: 6222428 - DNA, 17 bp, Homo sapiens
gatccagattcccaggc

SEQ ID NO: 6222429 - DNA, 18 bp, Homo sapiens
gatccagattcccaggcc

SEQ ID NO: 6222430 - DNA, 19 bp, Homo sapiens
gatccagattcccaggcca

SEQ ID NO: 6222431 - DNA, 18 bp, Homo sapiens
gatccagcagattattca

SEQ ID NO: 6222432 - DNA, 11 bp, Homo sapiens
gatccagccac

SEQ ID NO: 6222433 - DNA, 12 bp, Homo sapiens
gatccagccact

SEQ ID NO: 6222434 - DNA, 10 bp, Homo sapiens
gatccagccc

SEQ ID NO: 6222435 - DNA, 23 bp, Homo sapiens
gatccagccctgagttcctagcc

SEQ ID NO: 6222436 - DNA, 21 bp, Homo sapiens
gatccagccctggttctggct

SEQ ID NO: 6222437 - DNA, 23 bp, Homo sapiens
gatccagccctggttctggctgt

SEQ ID NO: 6222438 - DNA, 13 bp, Homo sapiens
gatccagctcaag

SEQ ID NO: 6222439 - DNA, 13 bp, Homo sapiens
gatccaggaaaga

SEQ ID NO: 6222440 - DNA, 20 bp, Homo sapiens
gatccaggaaagatgtccca

SEQ ID NO: 6222441 - DNA, 15 bp, Homo sapiens
gatccaggaacacat

SEQ ID NO: 6222442 - DNA, 16 bp, Homo sapiens
gatccaggagctccag

SEQ ID NO: 6222443 - DNA, 19 bp, Homo sapiens
gaagtcagagaaaacactt

SEQ ID NO: 6222444 - DNA, 13 bp, Homo sapiens
gaagtcagagagg

SEQ ID NO: 6222445 - DNA, 14 bp, Homo sapiens
gaagtcagatctgc

SEQ ID NO: 6222446 - DNA, 23 bp, Homo sapiens
gaagtcagatctgcctaaggact

SEQ ID NO: 6222447 - DNA, 20 bp, Homo sapiens
gaagtcagccacactgggcc

SEQ ID NO: 6222448 - DNA, 22 bp, Homo sapiens
gaagtcagcgggcccaggccta

SEQ ID NO: 6222449 - DNA, 20 bp, Homo sapiens
gaagtcaggagccagcaggg

SEQ ID NO: 6222450 - DNA, 19 bp, Homo sapiens
gaagtcagtacgatcaagt

SEQ ID NO: 6222451 - DNA, 19 bp, Homo sapiens
gaagtcataaacagcattt

SEQ ID NO: 6222452 - DNA, 15 bp, Homo sapiens
gaagtcatcataaaa

SEQ ID NO: 6222453 - DNA, 18 bp, Homo sapiens
gaagtcatcttgctacca

SEQ ID NO: 6222454 - DNA, 15 bp, Homo sapiens
gaagtcattaaactg

SEQ ID NO: 6222455 - DNA, 17 bp, Homo sapiens
gaagtcattaaactggt

SEQ ID NO: 6222456 - DNA, 12 bp, Homo sapiens
gaagtccaagca

SEQ ID NO: 6222457 - DNA, 17 bp, Homo sapiens
gaagtccaatgtggcaa

SEQ ID NO: 6222458 - DNA, 14 bp, Homo sapiens
gaagtccacaggac

SEQ ID NO: 6222459 - DNA, 15 bp, Homo sapiens
gaagtccacaggacg

SEQ ID NO: 6222460 - DNA, 15 bp, Homo sapiens
gaagtccaggcagag

SEQ ID NO: 6222461 - DNA, 17 bp, Homo sapiens
gaagtccagtgaccctg

SEQ ID NO: 6222462 - DNA, 15 bp, Homo sapiens
gaagtcccaccaggg

SEQ ID NO: 6222463 - DNA, 17 bp, Homo sapiens
gaagtccccaggcccca

SEQ ID NO: 6222464 - DNA, 18 bp, Homo sapiens
gaagtcccctctcctcca

SEQ ID NO: 6222465 - DNA, 21 bp, Homo sapiens
gaagtccctaggagggaagga

SEQ ID NO: 6222466 - DNA, 12 bp, Homo sapiens
gaagtccctcag

SEQ ID NO: 6222467 - DNA, 14 bp, Homo sapiens
gaagtccctcagag

SEQ ID NO: 6222468 - DNA, 15 bp, Homo sapiens
gaagtccctgttctc

SEQ ID NO: 6222469 - DNA, 16 bp, Homo sapiens
gaagtccctgttctca

SEQ ID NO: 6222470 - DNA, 19 bp, Homo sapiens
gaagtccctgttctcagct

SEQ ID NO: 6222471 - DNA, 17 bp, Homo sapiens
gaagtcccttcctgtcc

SEQ ID NO: 6222472 - DNA, 19 bp, Homo sapiens
gaagtcccttcctgtcctg

SEQ ID NO: 6222473 - DNA, 14 bp, Homo sapiens
gaagtccgaggcct

SEQ ID NO: 6222474 - DNA, 15 bp, Homo sapiens
gaagtccggccccag

SEQ ID NO: 6222475 - DNA, 21 bp, Homo sapiens
gaagtcctccctcctgcaggc

SEQ ID NO: 6222476 - DNA, 23 bp, Homo sapiens
gaagtcctccctcctgcaggctg

SEQ ID NO: 6222477 - DNA, 23 bp, Homo sapiens
gaagtccttcagtgagcccctcc

SEQ ID NO: 6222478 - DNA, 14 bp, Homo sapiens
gaagtcgaaggatg

SEQ ID NO: 6222479 - DNA, 24 bp, Homo sapiens
gaagtcgtccttactcctgtggga

SEQ ID NO: 6222480 - DNA, 18 bp, Homo sapiens
gaagtcgtcttaactcac

SEQ ID NO: 6222481 - DNA, 21 bp, Homo sapiens
gaagtctcaaagatctttcgt

SEQ ID NO: 6222482 - DNA, 14 bp, Homo sapiens
gaagtctcagcctg

SEQ ID NO: 6222483 - DNA, 15 bp, Homo sapiens
gaagtctcagcctgg

SEQ ID NO: 6222484 - DNA, 13 bp, Homo sapiens
gaagtctcagcta

SEQ ID NO: 6222485 - DNA, 17 bp, Homo sapiens
gaagtctcatgggaagc

SEQ ID NO: 6222486 - DNA, 21 bp, Homo sapiens
gaagtctccccgcagccctct

SEQ ID NO: 6222487 - DNA, 21 bp, Homo sapiens
gaagtctccctgcacagcctc

SEQ ID NO: 6222488 - DNA, 21 bp, Homo sapiens
gaagtctctgaagtgaaactg

SEQ ID NO: 6222489 - DNA, 12 bp, Homo sapiens
gaagtctctgat

SEQ ID NO: 6222490 - DNA, 14 bp, Homo sapiens
gaagtctcttcctg

SEQ ID NO: 6222491 - DNA, 23 bp, Homo sapiens
gaagtctctttttttggcccagg

SEQ ID NO: 6222492 - DNA, 13 bp, Homo sapiens
gaagtctgagccc

SEQ ID NO: 6222493 - DNA, 18 bp, Homo sapiens
gaagtctgagcccatttc

SEQ ID NO: 6222494 - DNA, 19 bp, Homo sapiens
gaagtctgagcccatttct

SEQ ID NO: 6222495 - DNA, 11 bp, Homo sapiens
gaagtctgata

SEQ ID NO: 6222496 - DNA, 20 bp, Homo sapiens
gaagtctgatggtgagcagt

SEQ ID NO: 6222497 - DNA, 17 bp, Homo sapiens
gaagtctggtcagagcc

SEQ ID NO: 6222498 - DNA, 19 bp, Homo sapiens
gaagtctggtcagagccac

SEQ ID NO: 6222499 - DNA, 19 bp, Homo sapiens
gaagtcttactacagaaat

SEQ ID NO: 6222500 - DNA, 18 bp, Homo sapiens
gaagtcttacttaaaaaa

SEQ ID NO: 6222501 - DNA, 16 bp, Homo sapiens
gaagtcttcaaatttg

SEQ ID NO: 6222502 - DNA, 19 bp, Homo sapiens
gaagtcttcaaatttgatt

SEQ ID NO: 6222503 - DNA, 20 bp, Homo sapiens
gaagtcttcaaatttgattc

SEQ ID NO: 6222504 - DNA, 16 bp, Homo sapiens
gaagtcttccatcagc

SEQ ID NO: 6222505 - DNA, 14 bp, Homo sapiens
gaagtcttccctca

SEQ ID NO: 6222506 - DNA, 17 bp, Homo sapiens
gaagtcttcttatctaa

SEQ ID NO: 6222507 - DNA, 9 bp, Homo sapiens
gaagtcttg

SEQ ID NO: 6222508 - DNA, 13 bp, Homo sapiens
gaagtcttgaagt

SEQ ID NO: 6222509 - DNA, 19 bp, Homo sapiens
gaagtcttgaagttgggtg

SEQ ID NO: 6222510 - DNA, 11 bp, Homo sapiens
gaagtcttgta

SEQ ID NO: 6222511 - DNA, 12 bp, Homo sapiens
gaagtctttaat

SEQ ID NO: 6222512 - DNA, 18 bp, Homo sapiens
gaagtctttcaagaatga

SEQ ID NO: 6222513 - DNA, 18 bp, Homo sapiens
gaagtctttgccttctct

SEQ ID NO: 6222514 - DNA, 18 bp, Homo sapiens
gaagtctttgtacagaca

SEQ ID NO: 6222515 - DNA, 20 bp, Homo sapiens
gaagtctttttcattttgca

SEQ ID NO: 6222516 - DNA, 12 bp, Homo sapiens
gaagtgaaatta

SEQ ID NO: 6222517 - DNA, 13 bp, Homo sapiens
gaagtgaaggaga

SEQ ID NO: 6222518 - DNA, 17 bp, Homo sapiens
gaagtgaaggagaaagg

SEQ ID NO: 6222519 - DNA, 16 bp, Homo sapiens
gaagtgaatacatggt

SEQ ID NO: 6222520 - DNA, 18 bp, Homo sapiens
gaagtgaatctgattgca

SEQ ID NO: 6222521 - DNA, 19 bp, Homo sapiens
gaagtgaatgggaaagggt

SEQ ID NO: 6222522 - DNA, 21 bp, Homo sapiens
gaagtgacaaggccccagaga

SEQ ID NO: 6222523 - DNA, 12 bp, Homo sapiens
gaagtgacaggg

SEQ ID NO: 6222524 - DNA, 15 bp, Homo sapiens
gaagtgacagggaag

SEQ ID NO: 6222525 - DNA, 11 bp, Homo sapiens
gaagtgaccaa

SEQ ID NO: 6222526 - DNA, 12 bp, Homo sapiens
gaagtgaccaag

SEQ ID NO: 6222527 - DNA, 13 bp, Homo sapiens
gaagtgaccaagg

SEQ ID NO: 6222528 - DNA, 16 bp, Homo sapiens
gaagtgaccaaggagg

SEQ ID NO: 6222529 - DNA, 17 bp, Homo sapiens
gaagtgaccaaggtgaa

SEQ ID NO: 6222530 - DNA, 13 bp, Homo sapiens
gaagtgaccccag

SEQ ID NO: 6222531 - DNA, 15 bp, Homo sapiens
gaagtgaccccagct

SEQ ID NO: 6222532 - DNA, 20 bp, Homo sapiens
gaagtgaccccagctccagg

SEQ ID NO: 6222533 - DNA, 22 bp, Homo sapiens
gaagtgaccccagctccaggca

SEQ ID NO: 6222534 - DNA, 16 bp, Homo sapiens
gaagtgactgttgtac

SEQ ID NO: 6222535 - DNA, 21 bp, Homo sapiens
gaagtgactttggctgcatgc

SEQ ID NO: 6222536 - DNA, 13 bp, Homo sapiens
gaagtgagaagat

SEQ ID NO: 6222537 - DNA, 12 bp, Homo sapiens
gaagtgagacct

SEQ ID NO: 6222538 - DNA, 13 bp, Homo sapiens
gaagtgagagaaa

SEQ ID NO: 6222539 - DNA, 16 bp, Homo sapiens
gaagtgagcacagcct

SEQ ID NO: 6222540 - DNA, 14 bp, Homo sapiens
gaagtgagccagca

SEQ ID NO: 6222541 - DNA, 21 bp, Homo sapiens
gaagtgaggatgagacccagc

SEQ ID NO: 6222542 - DNA, 19 bp, Homo sapiens
gaagtgaggcccaaggagc

SEQ ID NO: 6222543 - DNA, 14 bp, Homo sapiens
gaagtgaggcctgg

SEQ ID NO: 6222544 - DNA, 15 bp, Homo sapiens
gaagtgaggcctggg

SEQ ID NO: 6222545 - DNA, 16 bp, Homo sapiens
gaagtgagggctgggc

SEQ ID NO: 6222546 - DNA, 18 bp, Homo sapiens
gaagtgatatggtgaagg

SEQ ID NO: 6222547 - DNA, 22 bp, Homo sapiens
gaagtgatatggtgaagggaag

SEQ ID NO: 6222548 - DNA, 15 bp, Homo sapiens
gaagtgattctaaga

SEQ ID NO: 6222549 - DNA, 18 bp, Homo sapiens
gaagtgcaaatttgatac

SEQ ID NO: 6222550 - DNA, 16 bp, Homo sapiens
gaagtgcacaggagcc

SEQ ID NO: 6222551 - DNA, 13 bp, Homo sapiens
gaagtgcagatga

SEQ ID NO: 6222552 - DNA, 12 bp, Homo sapiens
gaagtgcagccc

SEQ ID NO: 6222553 - DNA, 21 bp, Homo sapiens
gaagtgcagcgggccaggcag

SEQ ID NO: 6222554 - DNA, 16 bp, Homo sapiens
gaagtgcagctcagga

SEQ ID NO: 6222555 - DNA, 15 bp, Homo sapiens
gaagtgcagctcatg

SEQ ID NO: 6222556 - DNA, 18 bp, Homo sapiens
gaagtgcagtcagcagat

SEQ ID NO: 6222557 - DNA, 16 bp, Homo sapiens
gaagtgcatctacttg

SEQ ID NO: 6222558 - DNA, 18 bp, Homo sapiens
gaagtgcatgaacagggt

SEQ ID NO: 6222559 - DNA, 18 bp, Homo sapiens
gaagtgcatgttaaaata

SEQ ID NO: 6222560 - DNA, 14 bp, Homo sapiens
gaagtgcccagccc

SEQ ID NO: 6222561 - DNA, 21 bp, Homo sapiens
gaagtgcccagcccctgcccc

SEQ ID NO: 6222562 - DNA, 23 bp, Homo sapiens
gaagtgcccctgctgcctcccca

SEQ ID NO: 6222563 - DNA, 22 bp, Homo sapiens
gaagtgcggggtaggggaagaa

SEQ ID NO: 6222564 - DNA, 15 bp, Homo sapiens
gaagtgcgtgaatgt

SEQ ID NO: 6222565 - DNA, 18 bp, Homo sapiens
gaagtgctccctggaggc

SEQ ID NO: 6222566 - DNA, 20 bp, Homo sapiens
gaagtgctgctccatgtttc

SEQ ID NO: 6222567 - DNA, 15 bp, Homo sapiens
gaagtgctgttttat

SEQ ID NO: 6222568 - DNA, 18 bp, Homo sapiens
gaagtgcttattctctca

SEQ ID NO: 6222569 - DNA, 19 bp, Homo sapiens
gaagtggaaaaagaaattc

SEQ ID NO: 6222570 - DNA, 16 bp, Homo sapiens
gaagtggaaggaagaa

SEQ ID NO: 6222571 - DNA, 19 bp, Homo sapiens
gaagtggaaggaagaacag

SEQ ID NO: 6222572 - DNA, 19 bp, Homo sapiens
gaagtggaatccagtgtgg

SEQ ID NO: 6222573 - DNA, 18 bp, Homo sapiens
gaagtggaccaggacagg

SEQ ID NO: 6222574 - DNA, 14 bp, Homo sapiens
gaagtggcagttct

SEQ ID NO: 6222575 - DNA, 11 bp, Homo sapiens
gaagtggcccc

SEQ ID NO: 6222576 - DNA, 14 bp, Homo sapiens
gaagtggccctccc

SEQ ID NO: 6222577 - DNA, 17 bp, Homo sapiens
gaagtggccctccctca

SEQ ID NO: 6222578 - DNA, 15 bp, Homo sapiens
gaagtggcctgagaa

SEQ ID NO: 6222579 - DNA, 14 bp, Homo sapiens
gaagtggctcagac

SEQ ID NO: 6222580 - DNA, 15 bp, Homo sapiens
gaagtggctctcagg

SEQ ID NO: 6222581 - DNA, 23 bp, Homo sapiens
gaagtggctgccacacccagggg

SEQ ID NO: 6222582 - DNA, 16 bp, Homo sapiens
gaagtggctgtccctg

SEQ ID NO: 6222583 - DNA, 19 bp, Homo sapiens
gaagtgggagaagtggccc

SEQ ID NO: 6222584 - DNA, 12 bp, Homo sapiens
gaagtgggagca

SEQ ID NO: 6222585 - DNA, 16 bp, Homo sapiens
gaagtgggagtgggag

SEQ ID NO: 6222586 - DNA, 23 bp, Homo sapiens
gaagtgggagtgggagaggaagc

SEQ ID NO: 6222587 - DNA, 20 bp, Homo sapiens
gaagtgggattcaggaatgg

SEQ ID NO: 6222588 - DNA, 22 bp, Homo sapiens
gaagtgggattcaggaatgggc

SEQ ID NO: 6222589 - DNA, 18 bp, Homo sapiens
gaagtgggccaggacagg

SEQ ID NO: 6222590 - DNA, 21 bp, Homo sapiens
gaagtgggccaggacaggccc

SEQ ID NO: 6222591 - DNA, 19 bp, Homo sapiens
gaagtgggccagtcctggt

SEQ ID NO: 6222592 - DNA, 18 bp, Homo sapiens
gaagtggggaccccaccc

SEQ ID NO: 6222593 - DNA, 17 bp, Homo sapiens
gaagtgggggccgctgg

SEQ ID NO: 6222594 - DNA, 18 bp, Homo sapiens
gaagtggggtctggcctg

SEQ ID NO: 6222595 - DNA, 16 bp, Homo sapiens
gaagtgggtggggaca

SEQ ID NO: 6222596 - DNA, 20 bp, Homo sapiens
gaagtggtacaatctggctc

SEQ ID NO: 6222597 - DNA, 16 bp, Homo sapiens
gaagtggtactagtgt

SEQ ID NO: 6222598 - DNA, 21 bp, Homo sapiens
gaagtggtgtgatcccagctc

SEQ ID NO: 6222599 - DNA, 18 bp, Homo sapiens
gaagtgtaacagctgagg

SEQ ID NO: 6222600 - DNA, 23 bp, Homo sapiens
gaagtgtaacagctgaggtctct

SEQ ID NO: 6222601 - DNA, 16 bp, Homo sapiens
gaagtgtaggcagaca

SEQ ID NO: 6222602 - DNA, 17 bp, Homo sapiens
gaagtgtaggcagacac

SEQ ID NO: 6222603 - DNA, 15 bp, Homo sapiens
gaagtgtatttattt

SEQ ID NO: 6222604 - DNA, 18 bp, Homo sapiens
gaagtgtcgagtccagtc

SEQ ID NO: 6222605 - DNA, 22 bp, Homo sapiens
gaagtgtctaatgcattaactt

SEQ ID NO: 6222606 - DNA, 21 bp, Homo sapiens
gaagtgtctgccagctgggcc

SEQ ID NO: 6222607 - DNA, 21 bp, Homo sapiens
gaagtgtcttctgttcccaag

SEQ ID NO: 6222608 - DNA, 15 bp, Homo sapiens
gaagtgtgactggct

SEQ ID NO: 6222609 - DNA, 16 bp, Homo sapiens
gaagtgtgacttctta

SEQ ID NO: 6222610 - DNA, 18 bp, Homo sapiens
gaagtgtgagcgccttgg

SEQ ID NO: 6222611 - DNA, 20 bp, Homo sapiens
gaagtgtgattgggaataaa

SEQ ID NO: 6222612 - DNA, 20 bp, Homo sapiens
gaagtgtgctgaggtgggcc

SEQ ID NO: 6222613 - DNA, 15 bp, Homo sapiens
gaagtgtggaaaaat

SEQ ID NO: 6222614 - DNA, 13 bp, Homo sapiens
gaagtgtggctgg

SEQ ID NO: 6222615 - DNA, 17 bp, Homo sapiens
gaagtgtggctggtgtc

SEQ ID NO: 6222616 - DNA, 21 bp, Homo sapiens
gaagtgtgggataaagattat

SEQ ID NO: 6222617 - DNA, 24 bp, Homo sapiens
gaagtgtgggtctgtgtgtgtgta

SEQ ID NO: 6222618 - DNA, 17 bp, Homo sapiens
gaagtgtgtggaaggca

SEQ ID NO: 6222619 - DNA, 12 bp, Homo sapiens
gaagtgtgttct

SEQ ID NO: 6222620 - DNA, 15 bp, Homo sapiens
gaagtgtgtttcctt

SEQ ID NO: 6222621 - DNA, 17 bp, Homo sapiens
gaagtgttaatacatca

SEQ ID NO: 6222622 - DNA, 10 bp, Homo sapiens
gaagtgttca

SEQ ID NO: 6222623 - DNA, 23 bp, Homo sapiens
gatccaggagctccagtgtcctg

SEQ ID NO: 6222624 - DNA, 17 bp, Homo sapiens
gatccaggattggcctg

SEQ ID NO: 6222625 - DNA, 14 bp, Homo sapiens
gatccaggcttctc

SEQ ID NO: 6222626 - DNA, 15 bp, Homo sapiens
gatccaggcttctcc

SEQ ID NO: 6222627 - DNA, 14 bp, Homo sapiens
gatccagggacaga

SEQ ID NO: 6222628 - DNA, 15 bp, Homo sapiens
gatccagggacagag

SEQ ID NO: 6222629 - DNA, 16 bp, Homo sapiens
gatccagggcagcagg

SEQ ID NO: 6222630 - DNA, 20 bp, Homo sapiens
gatccagggcagcaggccag

SEQ ID NO: 6222631 - DNA, 14 bp, Homo sapiens
gatccaggggaagc

SEQ ID NO: 6222632 - DNA, 12 bp, Homo sapiens
gatccagtctgc

SEQ ID NO: 6222633 - DNA, 22 bp, Homo sapiens
gatccagtgacatgattctgaa

SEQ ID NO: 6222634 - DNA, 22 bp, Homo sapiens
gatccagtgtaaacttccgttc

SEQ ID NO: 6222635 - DNA, 14 bp, Homo sapiens
gatccagtgtataa

SEQ ID NO: 6222636 - DNA, 22 bp, Homo sapiens
gatccagttccagttcccatgg

SEQ ID NO: 6222637 - DNA, 21 bp, Homo sapiens
gatccagtttccggaaacaaa

SEQ ID NO: 6222638 - DNA, 17 bp, Homo sapiens
gatccagttttgtttgg

SEQ ID NO: 6222639 - DNA, 22 bp, Homo sapiens
gatccataggactaccgcaggc

SEQ ID NO: 6222640 - DNA, 24 bp, Homo sapiens
gatccatagtgctacctgcacctc

SEQ ID NO: 6222641 - DNA, 18 bp, Homo sapiens
gatccatccgtccagcca

SEQ ID NO: 6222642 - DNA, 13 bp, Homo sapiens
gatccatctcagt

SEQ ID NO: 6222643 - DNA, 19 bp, Homo sapiens
gatccatcttgagccacag

SEQ ID NO: 6222644 - DNA, 21 bp, Homo sapiens
gatccatggggggagaagtga

SEQ ID NO: 6222645 - DNA, 14 bp, Homo sapiens
gatccatgtaactg

SEQ ID NO: 6222646 - DNA, 16 bp, Homo sapiens
gatccatgtagcagga

SEQ ID NO: 6222647 - DNA, 23 bp, Homo sapiens
gatccatttaaaacaagctgata

SEQ ID NO: 6222648 - DNA, 12 bp, Homo sapiens
gatccatttgcc

SEQ ID NO: 6222649 - DNA, 16 bp, Homo sapiens
gatccatttgcctttc

SEQ ID NO: 6222650 - DNA, 14 bp, Homo sapiens
gatcccaaagcaag

SEQ ID NO: 6222651 - DNA, 15 bp, Homo sapiens
gatcccaaagcaagg

SEQ ID NO: 6222652 - DNA, 16 bp, Homo sapiens
gatcccaaagcaagga

SEQ ID NO: 6222653 - DNA, 18 bp, Homo sapiens
gatcccaacactgccagc

SEQ ID NO: 6222654 - DNA, 23 bp, Homo sapiens
gatcccaattcatttcatctact

SEQ ID NO: 6222655 - DNA, 11 bp, Homo sapiens
gatcccacccc

SEQ ID NO: 6222656 - DNA, 22 bp, Homo sapiens
gatcccaccccattttctgtgg

SEQ ID NO: 6222657 - DNA, 13 bp, Homo sapiens
gatcccaccccct

SEQ ID NO: 6222658 - DNA, 15 bp, Homo sapiens
gatcccaccccctcc

SEQ ID NO: 6222659 - DNA, 17 bp, Homo sapiens
gatcccaccccctcctc

SEQ ID NO: 6222660 - DNA, 23 bp, Homo sapiens
gatcccaccccctcctcccccag

SEQ ID NO: 6222661 - DNA, 20 bp, Homo sapiens
gatcccaccctggggacccc

SEQ ID NO: 6222662 - DNA, 20 bp, Homo sapiens
gatcccaccgacccttcctg

SEQ ID NO: 6222663 - DNA, 15 bp, Homo sapiens
gatcccactggaaga

SEQ ID NO: 6222664 - DNA, 13 bp, Homo sapiens
gatcccactggcg

SEQ ID NO: 6222665 - DNA, 13 bp, Homo sapiens
gatcccagaaagt

SEQ ID NO: 6222666 - DNA, 20 bp, Homo sapiens
gatcccagcccaccctgccc

SEQ ID NO: 6222667 - DNA, 21 bp, Homo sapiens
gatcccagctcactgcagcct

SEQ ID NO: 6222668 - DNA, 12 bp, Homo sapiens
gatcccaggagg

SEQ ID NO: 6222669 - DNA, 16 bp, Homo sapiens
gatcccaggccaggga

SEQ ID NO: 6222670 - DNA, 19 bp, Homo sapiens
gatcccaggcccctggagg

SEQ ID NO: 6222671 - DNA, 14 bp, Homo sapiens
gatcccagtttctg

SEQ ID NO: 6222672 - DNA, 15 bp, Homo sapiens
gatcccataaagaaa

SEQ ID NO: 6222673 - DNA, 18 bp, Homo sapiens
gatcccatccatcagctc

SEQ ID NO: 6222674 - DNA, 24 bp, Homo sapiens
gatcccatcttgataagaccacca

SEQ ID NO: 6222675 - DNA, 18 bp, Homo sapiens
gatcccatgtcacctcag

SEQ ID NO: 6222676 - DNA, 13 bp, Homo sapiens
gatccccaactgc

SEQ ID NO: 6222677 - DNA, 22 bp, Homo sapiens
gatccccaactgctccagcctc

SEQ ID NO: 6222678 - DNA, 18 bp, Homo sapiens
gatccccaagtgtgaaca

SEQ ID NO: 6222679 - DNA, 20 bp, Homo sapiens
gatccccaagtgtgaacaaa

SEQ ID NO: 6222680 - DNA, 15 bp, Homo sapiens
gatccccagcccctc

SEQ ID NO: 6222681 - DNA, 16 bp, Homo sapiens
gatccccagcccctcc

SEQ ID NO: 6222682 - DNA, 19 bp, Homo sapiens
gatccccagcccctcctcc

SEQ ID NO: 6222683 - DNA, 20 bp, Homo sapiens
gatccccagcccctcctccc

SEQ ID NO: 6222684 - DNA, 16 bp, Homo sapiens
gatccccagctttctc

SEQ ID NO: 6222685 - DNA, 17 bp, Homo sapiens
gatccccagctttctcc

SEQ ID NO: 6222686 - DNA, 13 bp, Homo sapiens
gatccccagggca

SEQ ID NO: 6222687 - DNA, 17 bp, Homo sapiens
gatccccatgcctagca

SEQ ID NO: 6222688 - DNA, 21 bp, Homo sapiens
gatccccatggaacagccctg

SEQ ID NO: 6222689 - DNA, 21 bp, Homo sapiens
gatcccccaagtgtcctggac

SEQ ID NO: 6222690 - DNA, 23 bp, Homo sapiens
gatccccccattttctctattct

SEQ ID NO: 6222691 - DNA, 18 bp, Homo sapiens
gatcccccgccccatcct

SEQ ID NO: 6222692 - DNA, 19 bp, Homo sapiens
gatcccccgccccatcctc

SEQ ID NO: 6222693 - DNA, 12 bp, Homo sapiens
gatcccccttct

SEQ ID NO: 6222694 - DNA, 13 bp, Homo sapiens
gatccccgccacc

SEQ ID NO: 6222695 - DNA, 17 bp, Homo sapiens
gatccccgcctggccag

SEQ ID NO: 6222696 - DNA, 18 bp, Homo sapiens
gatccccgcctggccagg

SEQ ID NO: 6222697 - DNA, 21 bp, Homo sapiens
gatccccgcctggccaggagc

SEQ ID NO: 6222698 - DNA, 15 bp, Homo sapiens
gatcccctctctgtg

SEQ ID NO: 6222699 - DNA, 13 bp, Homo sapiens
gatcccctgagcc

SEQ ID NO: 6222700 - DNA, 16 bp, Homo sapiens
gatccccttcctacca

SEQ ID NO: 6222701 - DNA, 18 bp, Homo sapiens
gatccccttcctaccacc

SEQ ID NO: 6222702 - DNA, 16 bp, Homo sapiens
gatccccttgatagat

SEQ ID NO: 6222703 - DNA, 21 bp, Homo sapiens
gatcccgtgaaattgatgcca

SEQ ID NO: 6222704 - DNA, 18 bp, Homo sapiens
gatccctaatgtgtttct

SEQ ID NO: 6222705 - DNA, 15 bp, Homo sapiens
gatccctagctgtga

SEQ ID NO: 6222706 - DNA, 15 bp, Homo sapiens
gatccctcatcctca

SEQ ID NO: 6222707 - DNA, 11 bp, Homo sapiens
gatccctccac

SEQ ID NO: 6222708 - DNA, 14 bp, Homo sapiens
gatccctcctgagc

SEQ ID NO: 6222709 - DNA, 23 bp, Homo sapiens
gatccctctacagagcttccctg

SEQ ID NO: 6222710 - DNA, 17 bp, Homo sapiens
gatccctgaacccctgg

SEQ ID NO: 6222711 - DNA, 19 bp, Homo sapiens
gatccctgaacccctggcc

SEQ ID NO: 6222712 - DNA, 15 bp, Homo sapiens
gatccctgctctctg

SEQ ID NO: 6222713 - DNA, 20 bp, Homo sapiens
gatccctgtgttgtctctag

SEQ ID NO: 6222714 - DNA, 13 bp, Homo sapiens
gatcccttccacc

SEQ ID NO: 6222715 - DNA, 19 bp, Homo sapiens
gatcccttccacctgctct

SEQ ID NO: 6222716 - DNA, 20 bp, Homo sapiens
gatcccttccacctgctctg

SEQ ID NO: 6222717 - DNA, 23 bp, Homo sapiens
gatccgacttgaattttcccact

SEQ ID NO: 6222718 - DNA, 16 bp, Homo sapiens
gatccgagggcccctc

SEQ ID NO: 6222719 - DNA, 17 bp, Homo sapiens
gatccgagggcccctct

SEQ ID NO: 6222720 - DNA, 23 bp, Homo sapiens
gatccgagtgtgatttgaattct

SEQ ID NO: 6222721 - DNA, 14 bp, Homo sapiens
gatccgcaacccat

SEQ ID NO: 6222722 - DNA, 18 bp, Homo sapiens
gatccgcaatgtggagca

SEQ ID NO: 6222723 - DNA, 13 bp, Homo sapiens
gatccgcatgtgt

SEQ ID NO: 6222724 - DNA, 14 bp, Homo sapiens
gatccgcatgtgtc

SEQ ID NO: 6222725 - DNA, 16 bp, Homo sapiens
gatccgcatgtgtctg

SEQ ID NO: 6222726 - DNA, 19 bp, Homo sapiens
gatccgcatgtgtctgtat

SEQ ID NO: 6222727 - DNA, 18 bp, Homo sapiens
gatccgcccacctcagcc

SEQ ID NO: 6222728 - DNA, 13 bp, Homo sapiens
gatccgccctggg

SEQ ID NO: 6222729 - DNA, 16 bp, Homo sapiens
gatccgccctgggctc

SEQ ID NO: 6222730 - DNA, 14 bp, Homo sapiens
gatccgctgccacc

SEQ ID NO: 6222731 - DNA, 15 bp, Homo sapiens
gatccgctgccacca

SEQ ID NO: 6222732 - DNA, 14 bp, Homo sapiens
gatccggaaagaag

SEQ ID NO: 6222733 - DNA, 16 bp, Homo sapiens
gatccggctgctcctc

SEQ ID NO: 6222734 - DNA, 19 bp, Homo sapiens
gatccggctgctcctccag

SEQ ID NO: 6222735 - DNA, 20 bp, Homo sapiens
gatccggctgctcctccagc

SEQ ID NO: 6222736 - DNA, 23 bp, Homo sapiens
gatccggggccctctctgcaccg

SEQ ID NO: 6222737 - DNA, 14 bp, Homo sapiens
gatccgtgaattct

SEQ ID NO: 6222738 - DNA, 17 bp, Homo sapiens
gatccgtttgaccaatt

SEQ ID NO: 6222739 - DNA, 19 bp, Homo sapiens
gatcctaaaataagcttca

SEQ ID NO: 6222740 - DNA, 20 bp, Homo sapiens
gatcctaaactctctagctt

SEQ ID NO: 6222741 - DNA, 12 bp, Homo sapiens
gatcctaaatat

SEQ ID NO: 6222742 - DNA, 22 bp, Homo sapiens
gatcctaaccctgggctccctg

SEQ ID NO: 6222743 - DNA, 20 bp, Homo sapiens
gatcctaactgaagagacag

SEQ ID NO: 6222744 - DNA, 23 bp, Homo sapiens
gatcctaatcccttcctctccca

SEQ ID NO: 6222745 - DNA, 23 bp, Homo sapiens
gatcctaatgaatgcataaaatg

SEQ ID NO: 6222746 - DNA, 19 bp, Homo sapiens
gatcctacaatattttatt

SEQ ID NO: 6222747 - DNA, 19 bp, Homo sapiens
gatcctactcttcctttct

SEQ ID NO: 6222748 - DNA, 15 bp, Homo sapiens
gatcctagatcctaa

SEQ ID NO: 6222749 - DNA, 20 bp, Homo sapiens
gatcctagccttatcctctg

SEQ ID NO: 6222750 - DNA, 22 bp, Homo sapiens
gatcctagccttatcctctgat

SEQ ID NO: 6222751 - DNA, 18 bp, Homo sapiens
gatcctaggcatttgctg

SEQ ID NO: 6222752 - DNA, 20 bp, Homo sapiens
gatcctagggcacttctagt

SEQ ID NO: 6222753 - DNA, 18 bp, Homo sapiens
gatcctattctcaccagg

SEQ ID NO: 6222754 - DNA, 16 bp, Homo sapiens
gatcctcaaaaatcat

SEQ ID NO: 6222755 - DNA, 19 bp, Homo sapiens
gatcctcacaaccacctaa

SEQ ID NO: 6222756 - DNA, 18 bp, Homo sapiens
gatcctcacaggagcaga

SEQ ID NO: 6222757 - DNA, 15 bp, Homo sapiens
gatcctcagttctca

SEQ ID NO: 6222758 - DNA, 16 bp, Homo sapiens
gatcctccacagagag

SEQ ID NO: 6222759 - DNA, 12 bp, Homo sapiens
gatcctccaggt

SEQ ID NO: 6222760 - DNA, 16 bp, Homo sapiens
gatcctcccacctcag

SEQ ID NO: 6222761 - DNA, 17 bp, Homo sapiens
gatcctcccacctcagc

SEQ ID NO: 6222762 - DNA, 19 bp, Homo sapiens
gatcctcccacctcagcct

SEQ ID NO: 6222763 - DNA, 15 bp, Homo sapiens
gatcctcccctggac

SEQ ID NO: 6222764 - DNA, 18 bp, Homo sapiens
gatcctcccgccccagcc

SEQ ID NO: 6222765 - DNA, 19 bp, Homo sapiens
gatcctcccgccccagcct

SEQ ID NO: 6222766 - DNA, 20 bp, Homo sapiens
gatcctcccgccccagcctc

SEQ ID NO: 6222767 - DNA, 21 bp, Homo sapiens
gatcctcccgccccagcctcc

SEQ ID NO: 6222768 - DNA, 24 bp, Homo sapiens
gatcctcccgccccagcctcctga

SEQ ID NO: 6222769 - DNA, 21 bp, Homo sapiens
gatcctccgcggaggcccctg

SEQ ID NO: 6222770 - DNA, 22 bp, Homo sapiens
gatcctccgcggaggcccctga

SEQ ID NO: 6222771 - DNA, 16 bp, Homo sapiens
gatcctcctgcagacc

SEQ ID NO: 6222772 - DNA, 20 bp, Homo sapiens
gatcctcctgtcttggcctc

SEQ ID NO: 6222773 - DNA, 17 bp, Homo sapiens
gatcctccttccaggcc

SEQ ID NO: 6222774 - DNA, 19 bp, Homo sapiens
gatcctccttcctcatcct

SEQ ID NO: 6222775 - DNA, 16 bp, Homo sapiens
gatcctctccaccctc

SEQ ID NO: 6222776 - DNA, 22 bp, Homo sapiens
gatcctctccaccctcctctag

SEQ ID NO: 6222777 - DNA, 19 bp, Homo sapiens
gatcctctccactccatgt

SEQ ID NO: 6222778 - DNA, 17 bp, Homo sapiens
gatcctctcctttgaaa

SEQ ID NO: 6222779 - DNA, 18 bp, Homo sapiens
gatcctcttgccacatct

SEQ ID NO: 6222780 - DNA, 20 bp, Homo sapiens
gatcctctttccccactgaa

SEQ ID NO: 6222781 - DNA, 16 bp, Homo sapiens
gatcctgaaaaaatga

SEQ ID NO: 6222782 - DNA, 22 bp, Homo sapiens
gatcctgaatctgtgcaaacag

SEQ ID NO: 6222783 - DNA, 16 bp, Homo sapiens
gatcctgactaagcct

SEQ ID NO: 6222784 - DNA, 15 bp, Homo sapiens
gatcctgagccagat

SEQ ID NO: 6222785 - DNA, 21 bp, Homo sapiens
gatcctgagccagatttcact

SEQ ID NO: 6222786 - DNA, 12 bp, Homo sapiens
gatcctgagctc

SEQ ID NO: 6222787 - DNA, 13 bp, Homo sapiens
gatcctgagctgc

SEQ ID NO: 6222788 - DNA, 16 bp, Homo sapiens
gatcctgatagcctgt

SEQ ID NO: 6222789 - DNA, 17 bp, Homo sapiens
gatcctgcaccccagca

SEQ ID NO: 6222790 - DNA, 11 bp, Homo sapiens
gatcctgcagg

SEQ ID NO: 6222791 - DNA, 12 bp, Homo sapiens
gatcctgcagga

SEQ ID NO: 6222792 - DNA, 20 bp, Homo sapiens
gatcctgcaggaacgagcac

SEQ ID NO: 6222793 - DNA, 23 bp, Homo sapiens
gatcctgcaggaacgagcactgg

SEQ ID NO: 6222794 - DNA, 14 bp, Homo sapiens
gatcctgccaccct

SEQ ID NO: 6222795 - DNA, 15 bp, Homo sapiens
gatcctgccaccctg

SEQ ID NO: 6222796 - DNA, 17 bp, Homo sapiens
gatcctgcgggtggggc

SEQ ID NO: 6222797 - DNA, 18 bp, Homo sapiens
gatcctgcgggtggggct

SEQ ID NO: 6222798 - DNA, 13 bp, Homo sapiens
gatcctgctgccg

SEQ ID NO: 6222799 - DNA, 15 bp, Homo sapiens
gatcctgctgctttg

SEQ ID NO: 6222800 - DNA, 21 bp, Homo sapiens
gatcctgctgctttgggctgg

SEQ ID NO: 6222801 - DNA, 13 bp, Homo sapiens
gaagtgttcctgt

SEQ ID NO: 6222802 - DNA, 21 bp, Homo sapiens
gaagtgttgcatggatgtttt

SEQ ID NO: 6222803 - DNA, 22 bp, Homo sapiens
gaagtgttgcatggatgtttta

SEQ ID NO: 6222804 - DNA, 17 bp, Homo sapiens
gaagtgttgtggagaaa

SEQ ID NO: 6222805 - DNA, 16 bp, Homo sapiens
gaagtgtttatgttgt

SEQ ID NO: 6222806 - DNA, 15 bp, Homo sapiens
gaagtgttttacaat

SEQ ID NO: 6222807 - DNA, 20 bp, Homo sapiens
gaagttaaaggttactgttt

SEQ ID NO: 6222808 - DNA, 22 bp, Homo sapiens
gaagttaactgttccccttggt

SEQ ID NO: 6222809 - DNA, 23 bp, Homo sapiens
gaagttaactgttccccttggta

SEQ ID NO: 6222810 - DNA, 21 bp, Homo sapiens
gaagttaagcagcctttctgt

SEQ ID NO: 6222811 - DNA, 19 bp, Homo sapiens
gaagttacacaattaattg

SEQ ID NO: 6222812 - DNA, 13 bp, Homo sapiens
gaagttacctttt

SEQ ID NO: 6222813 - DNA, 14 bp, Homo sapiens
gaagttactgaatg

SEQ ID NO: 6222814 - DNA, 16 bp, Homo sapiens
gaagttactgaatgca

SEQ ID NO: 6222815 - DNA, 20 bp, Homo sapiens
gaagttactttatgtttgtc

SEQ ID NO: 6222816 - DNA, 16 bp, Homo sapiens
gaagttactttcttaa

SEQ ID NO: 6222817 - DNA, 20 bp, Homo sapiens
gaagttactttcttaatgtg

SEQ ID NO: 6222818 - DNA, 13 bp, Homo sapiens
gaagttactttgt

SEQ ID NO: 6222819 - DNA, 17 bp, Homo sapiens
gaagttactttgtaatt

SEQ ID NO: 6222820 - DNA, 20 bp, Homo sapiens
gaagttactttttgtagaga

SEQ ID NO: 6222821 - DNA, 16 bp, Homo sapiens
gaagttagtttgtata

SEQ ID NO: 6222822 - DNA, 13 bp, Homo sapiens
gaagttatatttc

SEQ ID NO: 6222823 - DNA, 21 bp, Homo sapiens
gaagttatatttcctatacca

SEQ ID NO: 6222824 - DNA, 16 bp, Homo sapiens
gaagttatgtgtatgt

SEQ ID NO: 6222825 - DNA, 12 bp, Homo sapiens
gaagttatttat

SEQ ID NO: 6222826 - DNA, 13 bp, Homo sapiens
gaagttcaagtga

SEQ ID NO: 6222827 - DNA, 17 bp, Homo sapiens
gaagttcaccagccctg

SEQ ID NO: 6222828 - DNA, 22 bp, Homo sapiens
gaagttcaccagccctgagcca

SEQ ID NO: 6222829 - DNA, 18 bp, Homo sapiens
gaagttctagaattctag

SEQ ID NO: 6222830 - DNA, 16 bp, Homo sapiens
gaagttctatttattt

SEQ ID NO: 6222831 - DNA, 12 bp, Homo sapiens
gaagttctgaaa

SEQ ID NO: 6222832 - DNA, 17 bp, Homo sapiens
gaagttctgcctctgat

SEQ ID NO: 6222833 - DNA, 17 bp, Homo sapiens
gaagttcttcaagagga

SEQ ID NO: 6222834 - DNA, 23 bp, Homo sapiens
gaagttgaactatgactggagta

SEQ ID NO: 6222835 - DNA, 21 bp, Homo sapiens
gaagttgactctgctcttgca

SEQ ID NO: 6222836 - DNA, 21 bp, Homo sapiens
gaagttgacttatagtacatg

SEQ ID NO: 6222837 - DNA, 23 bp, Homo sapiens
gaagttgacttatagtacatgat

SEQ ID NO: 6222838 - DNA, 21 bp, Homo sapiens
gaagttgaggggagcatgctt

SEQ ID NO: 6222839 - DNA, 17 bp, Homo sapiens
gaagttgcagtgagctg

SEQ ID NO: 6222840 - DNA, 13 bp, Homo sapiens
gaagttggacagc

SEQ ID NO: 6222841 - DNA, 23 bp, Homo sapiens
gaagttggacagcaaaaccattg

SEQ ID NO: 6222842 - DNA, 14 bp, Homo sapiens
gaagttggctgagc

SEQ ID NO: 6222843 - DNA, 12 bp, Homo sapiens
gaagttggggaa

SEQ ID NO: 6222844 - DNA, 22 bp, Homo sapiens
gaagttggtcttactttgtgca

SEQ ID NO: 6222845 - DNA, 19 bp, Homo sapiens
gaagttgtctccttccatt

SEQ ID NO: 6222846 - DNA, 20 bp, Homo sapiens
gaagttgtgaaactaaaatt

SEQ ID NO: 6222847 - DNA, 22 bp, Homo sapiens
gaagttgtgaaactaaaatttt

SEQ ID NO: 6222848 - DNA, 21 bp, Homo sapiens
gaagttgttactaactaaact

SEQ ID NO: 6222849 - DNA, 15 bp, Homo sapiens
gaagttgttagtgat

SEQ ID NO: 6222850 - DNA, 14 bp, Homo sapiens
gaagttgtttatca

SEQ ID NO: 6222851 - DNA, 17 bp, Homo sapiens
gaagttgtttatcaact

SEQ ID NO: 6222852 - DNA, 14 bp, Homo sapiens
gaagttgttttttt

SEQ ID NO: 6222853 - DNA, 19 bp, Homo sapiens
gaagtttaaaacagtattt

SEQ ID NO: 6222854 - DNA, 14 bp, Homo sapiens
gaagtttaaaaccc

SEQ ID NO: 6222855 - DNA, 14 bp, Homo sapiens
gaagtttaaatatt

SEQ ID NO: 6222856 - DNA, 13 bp, Homo sapiens
gaagtttaaatct

SEQ ID NO: 6222857 - DNA, 19 bp, Homo sapiens
gaagtttaacaagtattta

SEQ ID NO: 6222858 - DNA, 18 bp, Homo sapiens
gaagtttaattgacttat

SEQ ID NO: 6222859 - DNA, 14 bp, Homo sapiens
gaagtttacatttt

SEQ ID NO: 6222860 - DNA, 20 bp, Homo sapiens
gaagtttattattttcaaag

SEQ ID NO: 6222861 - DNA, 14 bp, Homo sapiens
gaagtttcacatga

SEQ ID NO: 6222862 - DNA, 17 bp, Homo sapiens
gaagtttcagtttctgt

SEQ ID NO: 6222863 - DNA, 21 bp, Homo sapiens
gaagtttcatttatgatacaa

SEQ ID NO: 6222864 - DNA, 21 bp, Homo sapiens
gaagtttccttggctggtgca

SEQ ID NO: 6222865 - DNA, 21 bp, Homo sapiens
gaagtttctgccgcagccctg

SEQ ID NO: 6222866 - DNA, 14 bp, Homo sapiens
gaagtttgaatgtt

SEQ ID NO: 6222867 - DNA, 17 bp, Homo sapiens
gaagtttgaatgttaaa

SEQ ID NO: 6222868 - DNA, 19 bp, Homo sapiens
gaagtttgaatgttaaata

SEQ ID NO: 6222869 - DNA, 20 bp, Homo sapiens
gaagtttgaatgttaaataa

SEQ ID NO: 6222870 - DNA, 19 bp, Homo sapiens
gaagtttgataaatagtgt

SEQ ID NO: 6222871 - DNA, 12 bp, Homo sapiens
gaagtttgcaac

SEQ ID NO: 6222872 - DNA, 12 bp, Homo sapiens
gaagtttgcatc

SEQ ID NO: 6222873 - DNA, 14 bp, Homo sapiens
gaagtttgctgtgc

SEQ ID NO: 6222874 - DNA, 17 bp, Homo sapiens
gaagtttgctgtgcttt

SEQ ID NO: 6222875 - DNA, 17 bp, Homo sapiens
gaagtttggagattttt

SEQ ID NO: 6222876 - DNA, 15 bp, Homo sapiens
gaagtttggataacc

SEQ ID NO: 6222877 - DNA, 14 bp, Homo sapiens
gaagtttgtagcca

SEQ ID NO: 6222878 - DNA, 15 bp, Homo sapiens
gaagtttgtagccag

SEQ ID NO: 6222879 - DNA, 16 bp, Homo sapiens
gaagtttgtccatttg

SEQ ID NO: 6222880 - DNA, 21 bp, Homo sapiens
gaagtttgtgttctgtttgtt

SEQ ID NO: 6222881 - DNA, 22 bp, Homo sapiens
gaagtttgttatagatttagct

SEQ ID NO: 6222882 - DNA, 16 bp, Homo sapiens
gaagttttaactatgc

SEQ ID NO: 6222883 - DNA, 22 bp, Homo sapiens
gaagttttaactttaatacagc

SEQ ID NO: 6222884 - DNA, 13 bp, Homo sapiens
gaagttttacatt

SEQ ID NO: 6222885 - DNA, 22 bp, Homo sapiens
gaagttttacttgattaaggac

SEQ ID NO: 6222886 - DNA, 23 bp, Homo sapiens
gaagttttcaatgatgggcgagc

SEQ ID NO: 6222887 - DNA, 11 bp, Homo sapiens
gaagttttcct

SEQ ID NO: 6222888 - DNA, 22 bp, Homo sapiens
gaagttttcttttactatcttt

SEQ ID NO: 6222889 - DNA, 15 bp, Homo sapiens
gaagttttgtacaga

SEQ ID NO: 6222890 - DNA, 18 bp, Homo sapiens
gaagtttttaaaaataaa

SEQ ID NO: 6222891 - DNA, 16 bp, Homo sapiens
gaagtttttgaaatac

SEQ ID NO: 6222892 - DNA, 17 bp, Homo sapiens
gaagtttttgaaatacc

SEQ ID NO: 6222893 - DNA, 19 bp, Homo sapiens
gaagtttttgtactgtaaa

SEQ ID NO: 6222894 - DNA, 16 bp, Homo sapiens
gaagttttttactttg

SEQ ID NO: 6222895 - DNA, 20 bp, Homo sapiens
gaataaaaaacatttgtaca

SEQ ID NO: 6222896 - DNA, 21 bp, Homo sapiens
gaataaaaaacatttgtacat

SEQ ID NO: 6222897 - DNA, 14 bp, Homo sapiens
gaataaaaaataaa

SEQ ID NO: 6222898 - DNA, 23 bp, Homo sapiens
gaataaaaagtgaacttttgtaa

SEQ ID NO: 6222899 - DNA, 16 bp, Homo sapiens
gaataaaaataaagtt

SEQ ID NO: 6222900 - DNA, 13 bp, Homo sapiens
gaataaaaattaa

SEQ ID NO: 6222901 - DNA, 16 bp, Homo sapiens
gaataaaacatttctc

SEQ ID NO: 6222902 - DNA, 11 bp, Homo sapiens
gaataaaagaa

SEQ ID NO: 6222903 - DNA, 13 bp, Homo sapiens
gaataaaagaatt

SEQ ID NO: 6222904 - DNA, 14 bp, Homo sapiens
gaataaaagctata

SEQ ID NO: 6222905 - DNA, 21 bp, Homo sapiens
gaataaaatactatttttact

SEQ ID NO: 6222906 - DNA, 22 bp, Homo sapiens
gaataaaatataaaactgaaat

SEQ ID NO: 6222907 - DNA, 23 bp, Homo sapiens
gaataaaatcctaagacacaaat

SEQ ID NO: 6222908 - DNA, 18 bp, Homo sapiens
gaataaaatctgctgcac

SEQ ID NO: 6222909 - DNA, 17 bp, Homo sapiens
gaataaaatgttgaaaa

SEQ ID NO: 6222910 - DNA, 17 bp, Homo sapiens
gaataaaattattttgg

SEQ ID NO: 6222911 - DNA, 14 bp, Homo sapiens
gaataaaattccta

SEQ ID NO: 6222912 - DNA, 19 bp, Homo sapiens
gaataaaattcctatctca

SEQ ID NO: 6222913 - DNA, 22 bp, Homo sapiens
gaataaaattgtaaaattgtat

SEQ ID NO: 6222914 - DNA, 13 bp, Homo sapiens
gaataaaattgtt

SEQ ID NO: 6222915 - DNA, 15 bp, Homo sapiens
gaataaacacacaga

SEQ ID NO: 6222916 - DNA, 19 bp, Homo sapiens
gaataaacagtgagcatat

SEQ ID NO: 6222917 - DNA, 22 bp, Homo sapiens
gaataaacagtgagcatatctg

SEQ ID NO: 6222918 - DNA, 21 bp, Homo sapiens
gaataaacatctgtgtctgtg

SEQ ID NO: 6222919 - DNA, 22 bp, Homo sapiens
gaataaacatctgtgtctgtgt

SEQ ID NO: 6222920 - DNA, 16 bp, Homo sapiens
gaataaacatttgtta

SEQ ID NO: 6222921 - DNA, 20 bp, Homo sapiens
gaataaacattttttgatcc

SEQ ID NO: 6222922 - DNA, 16 bp, Homo sapiens
gaataaaccggatcct

SEQ ID NO: 6222923 - DNA, 18 bp, Homo sapiens
gaataaaccggatcctgt

SEQ ID NO: 6222924 - DNA, 22 bp, Homo sapiens
gaataaacgcagaagaggggga

SEQ ID NO: 6222925 - DNA, 19 bp, Homo sapiens
gaataaactagattacatt

SEQ ID NO: 6222926 - DNA, 22 bp, Homo sapiens
gaataaactgaatattttggaa

SEQ ID NO: 6222927 - DNA, 15 bp, Homo sapiens
gaataaacttcagca

SEQ ID NO: 6222928 - DNA, 14 bp, Homo sapiens
gaataaagaaaaac

SEQ ID NO: 6222929 - DNA, 17 bp, Homo sapiens
gaataaagaatacttga

SEQ ID NO: 6222930 - DNA, 17 bp, Homo sapiens
gaataaagaatgccatt

SEQ ID NO: 6222931 - DNA, 12 bp, Homo sapiens
gaataaagcaat

SEQ ID NO: 6222932 - DNA, 14 bp, Homo sapiens
gaataaagcaattt

SEQ ID NO: 6222933 - DNA, 16 bp, Homo sapiens
gaataaagcaattttc

SEQ ID NO: 6222934 - DNA, 17 bp, Homo sapiens
gaataaagcaattttcc

SEQ ID NO: 6222935 - DNA, 22 bp, Homo sapiens
gaataaagcaattttccttgaa

SEQ ID NO: 6222936 - DNA, 12 bp, Homo sapiens
gaataaagcagc

SEQ ID NO: 6222937 - DNA, 13 bp, Homo sapiens
gaataaagcaggg

SEQ ID NO: 6222938 - DNA, 14 bp, Homo sapiens
gaataaagcaggga

SEQ ID NO: 6222939 - DNA, 17 bp, Homo sapiens
gaataaagcctgctttt

SEQ ID NO: 6222940 - DNA, 16 bp, Homo sapiens
gaataaagctgtgagc

SEQ ID NO: 6222941 - DNA, 13 bp, Homo sapiens
gaataaagcttct

SEQ ID NO: 6222942 - DNA, 18 bp, Homo sapiens
gaataaagcttctctctg

SEQ ID NO: 6222943 - DNA, 20 bp, Homo sapiens
gaataaagcttctctctgag

SEQ ID NO: 6222944 - DNA, 19 bp, Homo sapiens
gaataaaggcagttttcta

SEQ ID NO: 6222945 - DNA, 13 bp, Homo sapiens
gaataaaggctga

SEQ ID NO: 6222946 - DNA, 15 bp, Homo sapiens
gaataaagtattcta

SEQ ID NO: 6222947 - DNA, 13 bp, Homo sapiens
gaataaagtattg

SEQ ID NO: 6222948 - DNA, 18 bp, Homo sapiens
gaataaagtctgagtggg

SEQ ID NO: 6222949 - DNA, 20 bp, Homo sapiens
gaataaataagtaaatacat

SEQ ID NO: 6222950 - DNA, 15 bp, Homo sapiens
gaataaatacccatt

SEQ ID NO: 6222951 - DNA, 16 bp, Homo sapiens
gaataaatatgcctct

SEQ ID NO: 6222952 - DNA, 12 bp, Homo sapiens
gaataaatattt

SEQ ID NO: 6222953 - DNA, 15 bp, Homo sapiens
gaataaatgagcatt

SEQ ID NO: 6222954 - DNA, 15 bp, Homo sapiens
gaataaatgccttta

SEQ ID NO: 6222955 - DNA, 14 bp, Homo sapiens
gaataaatgtatct

SEQ ID NO: 6222956 - DNA, 18 bp, Homo sapiens
gaataaatgtatctgaat

SEQ ID NO: 6222957 - DNA, 21 bp, Homo sapiens
gaataaatgtatctgaatatc

SEQ ID NO: 6222958 - DNA, 15 bp, Homo sapiens
gaataaatgtcactt

SEQ ID NO: 6222959 - DNA, 14 bp, Homo sapiens
gaataaatgtcttt

SEQ ID NO: 6222960 - DNA, 11 bp, Homo sapiens
gaataaatgtt

SEQ ID NO: 6222961 - DNA, 12 bp, Homo sapiens
gaataaatgttc

SEQ ID NO: 6222962 - DNA, 18 bp, Homo sapiens
gaataaatgttttacaac

SEQ ID NO: 6222963 - DNA, 20 bp, Homo sapiens
gaataaattatggcatttct

SEQ ID NO: 6222964 - DNA, 23 bp, Homo sapiens
gaataaattatggcatttctatt

SEQ ID NO: 6222965 - DNA, 16 bp, Homo sapiens
gaataaattgattttt

SEQ ID NO: 6222966 - DNA, 22 bp, Homo sapiens
gaataacactcaagactatgtt

SEQ ID NO: 6222967 - DNA, 13 bp, Homo sapiens
gaataacactgca

SEQ ID NO: 6222968 - DNA, 19 bp, Homo sapiens
gaataacatatcaaatgaa

SEQ ID NO: 6222969 - DNA, 18 bp, Homo sapiens
gaataacatgtaattaag

SEQ ID NO: 6222970 - DNA, 17 bp, Homo sapiens
gaataacatttaaattc

SEQ ID NO: 6222971 - DNA, 22 bp, Homo sapiens
gaataaccacttaaaaaatgtc

SEQ ID NO: 6222972 - DNA, 13 bp, Homo sapiens
gaataacctgcac

SEQ ID NO: 6222973 - DNA, 21 bp, Homo sapiens
gaataactaatacaattcatt

SEQ ID NO: 6222974 - DNA, 13 bp, Homo sapiens
gaataactacctc

SEQ ID NO: 6222975 - DNA, 15 bp, Homo sapiens
gaataactacctcct

SEQ ID NO: 6222976 - DNA, 17 bp, Homo sapiens
gaataactacctcctca

SEQ ID NO: 6222977 - DNA, 22 bp, Homo sapiens
gaataactctttttcagagctt

SEQ ID NO: 6222978 - DNA, 12 bp, Homo sapiens
gaataacttgaa

SEQ ID NO: 6222979 - DNA, 23 bp, Homo sapiens
gaataagaaaacaatcacactca

SEQ ID NO: 6222980 - DNA, 11 bp, Homo sapiens
gatcctgctgg

SEQ ID NO: 6222981 - DNA, 14 bp, Homo sapiens
gatcctgctgtggc

SEQ ID NO: 6222982 - DNA, 21 bp, Homo sapiens
gatcctgctgtggcctcactt

SEQ ID NO: 6222983 - DNA, 15 bp, Homo sapiens
gatcctggaggccca

SEQ ID NO: 6222984 - DNA, 17 bp, Homo sapiens
gatcctggaggcccagt

SEQ ID NO: 6222985 - DNA, 19 bp, Homo sapiens
gatcctggattcactcact

SEQ ID NO: 6222986 - DNA, 23 bp, Homo sapiens
gatcctgggtggtctgcaggcag

SEQ ID NO: 6222987 - DNA, 20 bp, Homo sapiens
gatcctggtctgcacctcta

SEQ ID NO: 6222988 - DNA, 22 bp, Homo sapiens
gatcctgtaggctaaaaggctt

SEQ ID NO: 6222989 - DNA, 20 bp, Homo sapiens
gatcctgtattcagacagat

SEQ ID NO: 6222990 - DNA, 21 bp, Homo sapiens
gatcctgtcccatgggctctg

SEQ ID NO: 6222991 - DNA, 23 bp, Homo sapiens
gatcctgtcccatgggctctggc

SEQ ID NO: 6222992 - DNA, 16 bp, Homo sapiens
gatcctgtctttaagg

SEQ ID NO: 6222993 - DNA, 12 bp, Homo sapiens
gatcctgtgaag

SEQ ID NO: 6222994 - DNA, 12 bp, Homo sapiens
gatcctgttctg

SEQ ID NO: 6222995 - DNA, 15 bp, Homo sapiens
gatcctgtttcagct

SEQ ID NO: 6222996 - DNA, 17 bp, Homo sapiens
gatccttagagaagttt

SEQ ID NO: 6222997 - DNA, 22 bp, Homo sapiens
gatccttagaggtcctctggag

SEQ ID NO: 6222998 - DNA, 23 bp, Homo sapiens
gatccttcaaagtctcaatgaaa

SEQ ID NO: 6222999 - DNA, 22 bp, Homo sapiens
gatccttcacaggcagtgcatg

SEQ ID NO: 6223000 - DNA, 16 bp, Homo sapiens
gatccttccacctcag

SEQ ID NO: 6223001 - DNA, 17 bp, Homo sapiens
gatccttccacctcagt

SEQ ID NO: 6223002 - DNA, 21 bp, Homo sapiens
gatccttccatcttgtggggc

SEQ ID NO: 6223003 - DNA, 20 bp, Homo sapiens
gatccttcccaaggtacagc

SEQ ID NO: 6223004 - DNA, 17 bp, Homo sapiens
gatccttctgagctcca

SEQ ID NO: 6223005 - DNA, 14 bp, Homo sapiens
gatccttggtgctg

SEQ ID NO: 6223006 - DNA, 15 bp, Homo sapiens
gatccttggtgctgt

SEQ ID NO: 6223007 - DNA, 22 bp, Homo sapiens
gatccttgtctttactgacaag

SEQ ID NO: 6223008 - DNA, 19 bp, Homo sapiens
gatcctttggggcttctgt

SEQ ID NO: 6223009 - DNA, 20 bp, Homo sapiens
gatcctttggggcttctgtg

SEQ ID NO: 6223010 - DNA, 19 bp, Homo sapiens
gatccttttccatcccact

SEQ ID NO: 6223011 - DNA, 22 bp, Homo sapiens
gatccttttcctaattcacaca

SEQ ID NO: 6223012 - DNA, 15 bp, Homo sapiens
gatccttttggagtc

SEQ ID NO: 6223013 - DNA, 21 bp, Homo sapiens
gatcctttttccatcatttta

SEQ ID NO: 6223014 - DNA, 20 bp, Homo sapiens
gatccttttttgtcatttta

SEQ ID NO: 6223015 - DNA, 13 bp, Homo sapiens
gatcgacagacag

SEQ ID NO: 6223016 - DNA, 14 bp, Homo sapiens
gatcgacagacagc

SEQ ID NO: 6223017 - DNA, 17 bp, Homo sapiens
gatcgagaccatcctgg

SEQ ID NO: 6223018 - DNA, 18 bp, Homo sapiens
gatcgagaccatcctggc

SEQ ID NO: 6223019 - DNA, 20 bp, Homo sapiens
gatcgagaccatcctggcca

SEQ ID NO: 6223020 - DNA, 16 bp, Homo sapiens
gatcgaggcatggggc

SEQ ID NO: 6223021 - DNA, 23 bp, Homo sapiens
gatcgaggcatggggcatgtcct

SEQ ID NO: 6223022 - DNA, 13 bp, Homo sapiens
gatcgatgtgctc

SEQ ID NO: 6223023 - DNA, 20 bp, Homo sapiens
gatcgcaagagccatgtaga

SEQ ID NO: 6223024 - DNA, 20 bp, Homo sapiens
gatcgcacaaggacatttgg

SEQ ID NO: 6223025 - DNA, 18 bp, Homo sapiens
gatcgcaccactgcactc

SEQ ID NO: 6223026 - DNA, 23 bp, Homo sapiens
gatcgcaccactgcactccagcc

SEQ ID NO: 6223027 - DNA, 16 bp, Homo sapiens
gatcgccttccccacc

SEQ ID NO: 6223028 - DNA, 21 bp, Homo sapiens
gatcgcggcggagctggcccc

SEQ ID NO: 6223029 - DNA, 16 bp, Homo sapiens
gatcgctaagctggct

SEQ ID NO: 6223030 - DNA, 17 bp, Homo sapiens
gatcgctcccttggctt

SEQ ID NO: 6223031 - DNA, 19 bp, Homo sapiens
gatcgctgcacatggcctg

SEQ ID NO: 6223032 - DNA, 21 bp, Homo sapiens
gatcgctgcacatggcctgag

SEQ ID NO: 6223033 - DNA, 16 bp, Homo sapiens
gatcgctggcagagaa

SEQ ID NO: 6223034 - DNA, 14 bp, Homo sapiens
gatcgcttgagccc

SEQ ID NO: 6223035 - DNA, 15 bp, Homo sapiens
gatcgcttgagccca

SEQ ID NO: 6223036 - DNA, 17 bp, Homo sapiens
gatcgcttgagcccagg

SEQ ID NO: 6223037 - DNA, 19 bp, Homo sapiens
gatcgctttgtactttgtg

SEQ ID NO: 6223038 - DNA, 19 bp, Homo sapiens
gatcggactctgcccctgg

SEQ ID NO: 6223039 - DNA, 18 bp, Homo sapiens
gatcgtctcggcccctct

SEQ ID NO: 6223040 - DNA, 18 bp, Homo sapiens
gatcgtctgactggtgtt

SEQ ID NO: 6223041 - DNA, 16 bp, Homo sapiens
gatcgtgacgctgaat

SEQ ID NO: 6223042 - DNA, 19 bp, Homo sapiens
gatcgtgacgctgaataaa

SEQ ID NO: 6223043 - DNA, 22 bp, Homo sapiens
gatcgtgccattacactccagc

SEQ ID NO: 6223044 - DNA, 23 bp, Homo sapiens
gatcgtgccattacactccagcc

SEQ ID NO: 6223045 - DNA, 18 bp, Homo sapiens
gatcgtgctaaattttca

SEQ ID NO: 6223046 - DNA, 16 bp, Homo sapiens
gatcgttcattgcctt

SEQ ID NO: 6223047 - DNA, 22 bp, Homo sapiens
gatcgtttcacatctgtatatc

SEQ ID NO: 6223048 - DNA, 16 bp, Homo sapiens
gatctaaaccagtcct

SEQ ID NO: 6223049 - DNA, 17 bp, Homo sapiens
gatctaaataaaatgct

SEQ ID NO: 6223050 - DNA, 18 bp, Homo sapiens
gatctaactgttgttact

SEQ ID NO: 6223051 - DNA, 18 bp, Homo sapiens
gatctaagaaatcatgtg

SEQ ID NO: 6223052 - DNA, 21 bp, Homo sapiens
gatctaaggatgtcacagggc

SEQ ID NO: 6223053 - DNA, 13 bp, Homo sapiens
gatctaataaact

SEQ ID NO: 6223054 - DNA, 21 bp, Homo sapiens
gatctacacatgttgccttgc

SEQ ID NO: 6223055 - DNA, 14 bp, Homo sapiens
gatctacctggagg

SEQ ID NO: 6223056 - DNA, 16 bp, Homo sapiens
gatctactacatccca

SEQ ID NO: 6223057 - DNA, 21 bp, Homo sapiens
gatctacttgcctcatttccc

SEQ ID NO: 6223058 - DNA, 21 bp, Homo sapiens
gatctagcactcctcaagact

SEQ ID NO: 6223059 - DNA, 15 bp, Homo sapiens
gatctagccatggct

SEQ ID NO: 6223060 - DNA, 13 bp, Homo sapiens
gatctaggaagac

SEQ ID NO: 6223061 - DNA, 14 bp, Homo sapiens
gatctaggaagact

SEQ ID NO: 6223062 - DNA, 21 bp, Homo sapiens
gatctaggagaggagaaccag

SEQ ID NO: 6223063 - DNA, 19 bp, Homo sapiens
gatctaggtttaactcaga

SEQ ID NO: 6223064 - DNA, 15 bp, Homo sapiens
gatctagtccttgtc

SEQ ID NO: 6223065 - DNA, 17 bp, Homo sapiens
gatctagttcactctcc

SEQ ID NO: 6223066 - DNA, 22 bp, Homo sapiens
gatctagttctcaatcactgct

SEQ ID NO: 6223067 - DNA, 15 bp, Homo sapiens
gatctataggcagct

SEQ ID NO: 6223068 - DNA, 15 bp, Homo sapiens
gatctatcacctgtc

SEQ ID NO: 6223069 - DNA, 13 bp, Homo sapiens
gatctatgcaatt

SEQ ID NO: 6223070 - DNA, 15 bp, Homo sapiens
gatctatgcctttca

SEQ ID NO: 6223071 - DNA, 13 bp, Homo sapiens
gatctatgggaaa

SEQ ID NO: 6223072 - DNA, 15 bp, Homo sapiens
gatctatgtttcatc

SEQ ID NO: 6223073 - DNA, 19 bp, Homo sapiens
gatctatgtttgtgtgatt

SEQ ID NO: 6223074 - DNA, 13 bp, Homo sapiens
gatctatttgtag

SEQ ID NO: 6223075 - DNA, 13 bp, Homo sapiens
gatctcaaatcca

SEQ ID NO: 6223076 - DNA, 15 bp, Homo sapiens
gatctcaaatccact

SEQ ID NO: 6223077 - DNA, 19 bp, Homo sapiens
gatctcaaatccactgaca

SEQ ID NO: 6223078 - DNA, 15 bp, Homo sapiens
gatctcaccaggcag

SEQ ID NO: 6223079 - DNA, 19 bp, Homo sapiens
gatctcaccaggcagcctc

SEQ ID NO: 6223080 - DNA, 21 bp, Homo sapiens
gatctcagaggctcagagact

SEQ ID NO: 6223081 - DNA, 15 bp, Homo sapiens
gatctcagcagccag

SEQ ID NO: 6223082 - DNA, 20 bp, Homo sapiens
gatctcagcagccagctcct

SEQ ID NO: 6223083 - DNA, 21 bp, Homo sapiens
gatctcagcatcctggaaatt

SEQ ID NO: 6223084 - DNA, 13 bp, Homo sapiens
gatctcaggagcc

SEQ ID NO: 6223085 - DNA, 17 bp, Homo sapiens
gatctcaggcttctgca

SEQ ID NO: 6223086 - DNA, 13 bp, Homo sapiens
gatctcaggttct

SEQ ID NO: 6223087 - DNA, 23 bp, Homo sapiens
gatctcagtggttaagattccta

SEQ ID NO: 6223088 - DNA, 16 bp, Homo sapiens
gatctcatagatgacc

SEQ ID NO: 6223089 - DNA, 23 bp, Homo sapiens
gatctcatgacattatatttgag

SEQ ID NO: 6223090 - DNA, 20 bp, Homo sapiens
gatctcatggaaactggcca

SEQ ID NO: 6223091 - DNA, 21 bp, Homo sapiens
gatctcatggaaactggccag

SEQ ID NO: 6223092 - DNA, 15 bp, Homo sapiens
gatctcatgtcctct

SEQ ID NO: 6223093 - DNA, 15 bp, Homo sapiens
gatctcattcagtat

SEQ ID NO: 6223094 - DNA, 21 bp, Homo sapiens
gatctcattcagtattaaagg

SEQ ID NO: 6223095 - DNA, 12 bp, Homo sapiens
gatctccaaagc

SEQ ID NO: 6223096 - DNA, 14 bp, Homo sapiens
gatctccaaagctt

SEQ ID NO: 6223097 - DNA, 19 bp, Homo sapiens
gatctccaaggaccaggtt

SEQ ID NO: 6223098 - DNA, 20 bp, Homo sapiens
gatctccaaggaccaggtta

SEQ ID NO: 6223099 - DNA, 12 bp, Homo sapiens
gatctccactga

SEQ ID NO: 6223100 - DNA, 12 bp, Homo sapiens
gatctccaggcc

SEQ ID NO: 6223101 - DNA, 14 bp, Homo sapiens
gatctccaggccca

SEQ ID NO: 6223102 - DNA, 19 bp, Homo sapiens
gatctccaggcccagcctg

SEQ ID NO: 6223103 - DNA, 23 bp, Homo sapiens
gatctccaggcccagcctggccc

SEQ ID NO: 6223104 - DNA, 15 bp, Homo sapiens
gatctccagttgtat

SEQ ID NO: 6223105 - DNA, 21 bp, Homo sapiens
gatctccatgctttgctctca

SEQ ID NO: 6223106 - DNA, 12 bp, Homo sapiens
gatctcccaggg

SEQ ID NO: 6223107 - DNA, 16 bp, Homo sapiens
gatctcccagggctct

SEQ ID NO: 6223108 - DNA, 19 bp, Homo sapiens
gatctcccagggctctctg

SEQ ID NO: 6223109 - DNA, 22 bp, Homo sapiens
gatctcccagggctctctggac

SEQ ID NO: 6223110 - DNA, 15 bp, Homo sapiens
gatctccctgagatg

SEQ ID NO: 6223111 - DNA, 16 bp, Homo sapiens
gatctccctgagatgg

SEQ ID NO: 6223112 - DNA, 15 bp, Homo sapiens
gatctccctgccgcc

SEQ ID NO: 6223113 - DNA, 17 bp, Homo sapiens
gatctcctgacctcatg

SEQ ID NO: 6223114 - DNA, 11 bp, Homo sapiens
gatctcctgag

SEQ ID NO: 6223115 - DNA, 13 bp, Homo sapiens
gatctcctgagct

SEQ ID NO: 6223116 - DNA, 21 bp, Homo sapiens
gatctcctgccagcccagctg

SEQ ID NO: 6223117 - DNA, 15 bp, Homo sapiens
gatctcctgctgcct

SEQ ID NO: 6223118 - DNA, 13 bp, Homo sapiens
gatctcctgtaat

SEQ ID NO: 6223119 - DNA, 20 bp, Homo sapiens
gatctcctgtaattttgtag

SEQ ID NO: 6223120 - DNA, 14 bp, Homo sapiens
gatctcctgtggct

SEQ ID NO: 6223121 - DNA, 20 bp, Homo sapiens
gatctcctgtttttttcagg

SEQ ID NO: 6223122 - DNA, 19 bp, Homo sapiens
gatctccttcccttctctt

SEQ ID NO: 6223123 - DNA, 14 bp, Homo sapiens
gatctccttgccct

SEQ ID NO: 6223124 - DNA, 17 bp, Homo sapiens
gatctcgactcccccct

SEQ ID NO: 6223125 - DNA, 22 bp, Homo sapiens
gatctcgccaacccctctctca

SEQ ID NO: 6223126 - DNA, 13 bp, Homo sapiens
gatctcgcctgga

SEQ ID NO: 6223127 - DNA, 19 bp, Homo sapiens
gatctcgcctggaaacaga

SEQ ID NO: 6223128 - DNA, 18 bp, Homo sapiens
gatctcggctcagcctcc

SEQ ID NO: 6223129 - DNA, 15 bp, Homo sapiens
gatctctaacttcac

SEQ ID NO: 6223130 - DNA, 20 bp, Homo sapiens
gatctctacattaatgtcct

SEQ ID NO: 6223131 - DNA, 16 bp, Homo sapiens
gatctctcaggagcac

SEQ ID NO: 6223132 - DNA, 21 bp, Homo sapiens
gatctctcaggagcacaggca

SEQ ID NO: 6223133 - DNA, 24 bp, Homo sapiens
gatctctcaggagcacaggcagct

SEQ ID NO: 6223134 - DNA, 14 bp, Homo sapiens
gatctctcctggcc

SEQ ID NO: 6223135 - DNA, 18 bp, Homo sapiens
gatctctctagctttgtc

SEQ ID NO: 6223136 - DNA, 18 bp, Homo sapiens
gatctctcttgtcctctt

SEQ ID NO: 6223137 - DNA, 11 bp, Homo sapiens
gatctctgaag

SEQ ID NO: 6223138 - DNA, 14 bp, Homo sapiens
gatctctgaagcca

SEQ ID NO: 6223139 - DNA, 16 bp, Homo sapiens
gatctctgacctctgc

SEQ ID NO: 6223140 - DNA, 19 bp, Homo sapiens
gatctctgagaccacagag

SEQ ID NO: 6223141 - DNA, 14 bp, Homo sapiens
gatctctgctccct

SEQ ID NO: 6223142 - DNA, 20 bp, Homo sapiens
gatctctgctccctgcaagc

SEQ ID NO: 6223143 - DNA, 12 bp, Homo sapiens
gatctctgctgg

SEQ ID NO: 6223144 - DNA, 19 bp, Homo sapiens
gatctcttagaagccatgg

SEQ ID NO: 6223145 - DNA, 12 bp, Homo sapiens
gatctcttcctg

SEQ ID NO: 6223146 - DNA, 16 bp, Homo sapiens
gatctcttgagcctgg

SEQ ID NO: 6223147 - DNA, 18 bp, Homo sapiens
gatctcttgagcctggga

SEQ ID NO: 6223148 - DNA, 19 bp, Homo sapiens
gatctgaaatccataaact

SEQ ID NO: 6223149 - DNA, 22 bp, Homo sapiens
gatctgaaattggtgggaagca

SEQ ID NO: 6223150 - DNA, 20 bp, Homo sapiens
gatctgaccctcccagtctc

SEQ ID NO: 6223151 - DNA, 14 bp, Homo sapiens
gatctgactgcacg

SEQ ID NO: 6223152 - DNA, 22 bp, Homo sapiens
gatctgagaacacgttgccagg

SEQ ID NO: 6223153 - DNA, 18 bp, Homo sapiens
gatctgagaatctttatt

SEQ ID NO: 6223154 - DNA, 12 bp, Homo sapiens
gatctgagccct

SEQ ID NO: 6223155 - DNA, 21 bp, Homo sapiens
gatctgagccctccctcttcc

SEQ ID NO: 6223156 - DNA, 13 bp, Homo sapiens
gatctgagctccc

SEQ ID NO: 6223157 - DNA, 17 bp, Homo sapiens
gatctgagctcccacct

SEQ ID NO: 6223158 - DNA, 13 bp, Homo sapiens
gatctgagggaga

SEQ ID NO: 6223159 - DNA, 17 bp, Homo sapiens
gaataagaaagtttcac

SEQ ID NO: 6223160 - DNA, 16 bp, Homo sapiens
gaataagaatggagca

SEQ ID NO: 6223161 - DNA, 14 bp, Homo sapiens
gaataagaatttgc

SEQ ID NO: 6223162 - DNA, 17 bp, Homo sapiens
gaataagattatatgga

SEQ ID NO: 6223163 - DNA, 15 bp, Homo sapiens
gaataagcacttgaa

SEQ ID NO: 6223164 - DNA, 16 bp, Homo sapiens
gaataagcacttttta

SEQ ID NO: 6223165 - DNA, 20 bp, Homo sapiens
gaataagccattctgactca

SEQ ID NO: 6223166 - DNA, 22 bp, Homo sapiens
gaataagccattctgactcata

SEQ ID NO: 6223167 - DNA, 13 bp, Homo sapiens
gaataagctttct

SEQ ID NO: 6223168 - DNA, 21 bp, Homo sapiens
gaataaggaggaggagggaga

SEQ ID NO: 6223169 - DNA, 23 bp, Homo sapiens
gaataaggtacaagaagcatttt

SEQ ID NO: 6223170 - DNA, 17 bp, Homo sapiens
gaataagtattcttcat

SEQ ID NO: 6223171 - DNA, 21 bp, Homo sapiens
gaataagtgctgtttgagatg

SEQ ID NO: 6223172 - DNA, 15 bp, Homo sapiens
gaataagtgtacata

SEQ ID NO: 6223173 - DNA, 14 bp, Homo sapiens
gaataagttattgc

SEQ ID NO: 6223174 - DNA, 16 bp, Homo sapiens
gaataagttattgcag

SEQ ID NO: 6223175 - DNA, 18 bp, Homo sapiens
gaataagttattgcagtt

SEQ ID NO: 6223176 - DNA, 13 bp, Homo sapiens
gaataagttgatt

SEQ ID NO: 6223177 - DNA, 13 bp, Homo sapiens
gaataagttttat

SEQ ID NO: 6223178 - DNA, 19 bp, Homo sapiens
gaataataaaagtatatat

SEQ ID NO: 6223179 - DNA, 21 bp, Homo sapiens
gaataataaaagtatatatat

SEQ ID NO: 6223180 - DNA, 14 bp, Homo sapiens
gaataataaatatt

SEQ ID NO: 6223181 - DNA, 21 bp, Homo sapiens
gaataataaatcgatccatgt

SEQ ID NO: 6223182 - DNA, 16 bp, Homo sapiens
gaataataagcaggat

SEQ ID NO: 6223183 - DNA, 19 bp, Homo sapiens
gaataatagcacatgattt

SEQ ID NO: 6223184 - DNA, 20 bp, Homo sapiens
gaataatatcaaataaaata

SEQ ID NO: 6223185 - DNA, 16 bp, Homo sapiens
gaataatatgatgcca

SEQ ID NO: 6223186 - DNA, 19 bp, Homo sapiens
gaataatcacgctttcctg

SEQ ID NO: 6223187 - DNA, 20 bp, Homo sapiens
gaataatcacgctttcctga

SEQ ID NO: 6223188 - DNA, 20 bp, Homo sapiens
gaataatctattatttggag

SEQ ID NO: 6223189 - DNA, 15 bp, Homo sapiens
gaataatctttgggt

SEQ ID NO: 6223190 - DNA, 15 bp, Homo sapiens
gaataatgaaaataa

SEQ ID NO: 6223191 - DNA, 20 bp, Homo sapiens
gaataatgaaaataaaacac

SEQ ID NO: 6223192 - DNA, 23 bp, Homo sapiens
gaataatgagtctgcataaactt

SEQ ID NO: 6223193 - DNA, 21 bp, Homo sapiens
gaataatggtaccagataaaa

SEQ ID NO: 6223194 - DNA, 13 bp, Homo sapiens
gaataatgtagtg

SEQ ID NO: 6223195 - DNA, 21 bp, Homo sapiens
gaataatgtctagattttgaa

SEQ ID NO: 6223196 - DNA, 20 bp, Homo sapiens
gaataatgttttttgaagtt

SEQ ID NO: 6223197 - DNA, 13 bp, Homo sapiens
gaataattattta

SEQ ID NO: 6223198 - DNA, 12 bp, Homo sapiens
gaataattgcat

SEQ ID NO: 6223199 - DNA, 14 bp, Homo sapiens
gaataattgtgtac

SEQ ID NO: 6223200 - DNA, 19 bp, Homo sapiens
gaataattgtgtacaaagt

SEQ ID NO: 6223201 - DNA, 22 bp, Homo sapiens
gaataatttatagtaatgagtt

SEQ ID NO: 6223202 - DNA, 21 bp, Homo sapiens
gaataatttcccaattaggaa

SEQ ID NO: 6223203 - DNA, 13 bp, Homo sapiens
gaataatttgtaa

SEQ ID NO: 6223204 - DNA, 15 bp, Homo sapiens
gaataatttgtaaat

SEQ ID NO: 6223205 - DNA, 19 bp, Homo sapiens
gaataatttttaattgctt

SEQ ID NO: 6223206 - DNA, 14 bp, Homo sapiens
gaatacaaacattt

SEQ ID NO: 6223207 - DNA, 18 bp, Homo sapiens
gaatacaaacatttcact

SEQ ID NO: 6223208 - DNA, 13 bp, Homo sapiens
gaatacaacttga

SEQ ID NO: 6223209 - DNA, 22 bp, Homo sapiens
gaatacaatatatagctggcaa

SEQ ID NO: 6223210 - DNA, 17 bp, Homo sapiens
gaatacaattaaaggtc

SEQ ID NO: 6223211 - DNA, 20 bp, Homo sapiens
gaatacacatataaaaacaa

SEQ ID NO: 6223212 - DNA, 14 bp, Homo sapiens
gaatacagaaaatg

SEQ ID NO: 6223213 - DNA, 14 bp, Homo sapiens
gaatacagaaagat

SEQ ID NO: 6223214 - DNA, 21 bp, Homo sapiens
gaatacagaggcaactgcatt

SEQ ID NO: 6223215 - DNA, 18 bp, Homo sapiens
gaatacagcagcaagaaa

SEQ ID NO: 6223216 - DNA, 19 bp, Homo sapiens
gaatacagtcattccaaga

SEQ ID NO: 6223217 - DNA, 20 bp, Homo sapiens
gaatacagtgagtcctcctc

SEQ ID NO: 6223218 - DNA, 13 bp, Homo sapiens
gaatacatcagaa

SEQ ID NO: 6223219 - DNA, 16 bp, Homo sapiens
gaatacatcagaaaat

SEQ ID NO: 6223220 - DNA, 20 bp, Homo sapiens
gaatacatcagaaaataaaa

SEQ ID NO: 6223221 - DNA, 15 bp, Homo sapiens
gaatacattgataca

SEQ ID NO: 6223222 - DNA, 19 bp, Homo sapiens
gaatacattgatacaaagt

SEQ ID NO: 6223223 - DNA, 16 bp, Homo sapiens
gaatacatttgtattt

SEQ ID NO: 6223224 - DNA, 12 bp, Homo sapiens
gaatacatttta

SEQ ID NO: 6223225 - DNA, 17 bp, Homo sapiens
gaatacattttattctg

SEQ ID NO: 6223226 - DNA, 22 bp, Homo sapiens
gaataccacatcaaataagaaa

SEQ ID NO: 6223227 - DNA, 18 bp, Homo sapiens
gaataccacttacctcaa

SEQ ID NO: 6223228 - DNA, 22 bp, Homo sapiens
gaataccattaaaactgctttt

SEQ ID NO: 6223229 - DNA, 16 bp, Homo sapiens
gaataccccaccagca

SEQ ID NO: 6223230 - DNA, 19 bp, Homo sapiens
gaataccccaccagcagaa

SEQ ID NO: 6223231 - DNA, 14 bp, Homo sapiens
gaatacccccagag

SEQ ID NO: 6223232 - DNA, 14 bp, Homo sapiens
gaataccccttctc

SEQ ID NO: 6223233 - DNA, 13 bp, Homo sapiens
gaatacctgtccc

SEQ ID NO: 6223234 - DNA, 20 bp, Homo sapiens
gaataccttagtgcagttat

SEQ ID NO: 6223235 - DNA, 14 bp, Homo sapiens
gaatacggaagagc

SEQ ID NO: 6223236 - DNA, 15 bp, Homo sapiens
gaatactaataaaat

SEQ ID NO: 6223237 - DNA, 23 bp, Homo sapiens
gaatactaataaaatacatacta

SEQ ID NO: 6223238 - DNA, 22 bp, Homo sapiens
gaatactgaaaaagaatgaaaa

SEQ ID NO: 6223239 - DNA, 22 bp, Homo sapiens
gaatactgaacatctgagtcct

SEQ ID NO: 6223240 - DNA, 17 bp, Homo sapiens
gaatactgcatttacag

SEQ ID NO: 6223241 - DNA, 13 bp, Homo sapiens
gaatactgctaca

SEQ ID NO: 6223242 - DNA, 17 bp, Homo sapiens
gaatactgcttgaataa

SEQ ID NO: 6223243 - DNA, 16 bp, Homo sapiens
gaatactgcttgctta

SEQ ID NO: 6223244 - DNA, 20 bp, Homo sapiens
gaatactgttaaaggaaaaa

SEQ ID NO: 6223245 - DNA, 12 bp, Homo sapiens
gaatacttattt

SEQ ID NO: 6223246 - DNA, 12 bp, Homo sapiens
gaatacttgaac

SEQ ID NO: 6223247 - DNA, 14 bp, Homo sapiens
gaatacttgaacca

SEQ ID NO: 6223248 - DNA, 22 bp, Homo sapiens
gaatacttgaaccataaaatgt

SEQ ID NO: 6223249 - DNA, 15 bp, Homo sapiens
gaatacttgaacttg

SEQ ID NO: 6223250 - DNA, 14 bp, Homo sapiens
gaatactttataaa

SEQ ID NO: 6223251 - DNA, 13 bp, Homo sapiens
gaatactttgctt

SEQ ID NO: 6223252 - DNA, 14 bp, Homo sapiens
gaatactttgcttc

SEQ ID NO: 6223253 - DNA, 15 bp, Homo sapiens
gaatactttttaaaa

SEQ ID NO: 6223254 - DNA, 16 bp, Homo sapiens
gaatagaagaaagaaa

SEQ ID NO: 6223255 - DNA, 16 bp, Homo sapiens
gaatagaagcaaatta

SEQ ID NO: 6223256 - DNA, 18 bp, Homo sapiens
gaatagaagctaaggttt

SEQ ID NO: 6223257 - DNA, 20 bp, Homo sapiens
gaatagaaggaaactagctt

SEQ ID NO: 6223258 - DNA, 19 bp, Homo sapiens
gaatagaagttttcctgat

SEQ ID NO: 6223259 - DNA, 22 bp, Homo sapiens
gaatagacagaggtttcatttt

SEQ ID NO: 6223260 - DNA, 20 bp, Homo sapiens
gaatagacataaattgtaat

SEQ ID NO: 6223261 - DNA, 22 bp, Homo sapiens
gaatagacataaattgtaattt

SEQ ID NO: 6223262 - DNA, 16 bp, Homo sapiens
gaatagagctgccact

SEQ ID NO: 6223263 - DNA, 15 bp, Homo sapiens
gaatagagttttcct

SEQ ID NO: 6223264 - DNA, 15 bp, Homo sapiens
gaatagatgctgact

SEQ ID NO: 6223265 - DNA, 19 bp, Homo sapiens
gaatagatggaatttggaa

SEQ ID NO: 6223266 - DNA, 15 bp, Homo sapiens
gaatagatgtgatca

SEQ ID NO: 6223267 - DNA, 19 bp, Homo sapiens
gaatagatgtgatcactga

SEQ ID NO: 6223268 - DNA, 19 bp, Homo sapiens
gaatagattttctctggaa

SEQ ID NO: 6223269 - DNA, 21 bp, Homo sapiens
gaatagcaaaattcctgtgtt

SEQ ID NO: 6223270 - DNA, 16 bp, Homo sapiens
gaatagcagagagcca

SEQ ID NO: 6223271 - DNA, 20 bp, Homo sapiens
gaatagcagtggcaaaatat

SEQ ID NO: 6223272 - DNA, 16 bp, Homo sapiens
gaatagcatctgtaca

SEQ ID NO: 6223273 - DNA, 15 bp, Homo sapiens
gaatagccagagagg

SEQ ID NO: 6223274 - DNA, 18 bp, Homo sapiens
gaatagccatatttgtaa

SEQ ID NO: 6223275 - DNA, 12 bp, Homo sapiens
gaatagcctggc

SEQ ID NO: 6223276 - DNA, 22 bp, Homo sapiens
gaatagcctggccaccagccat

SEQ ID NO: 6223277 - DNA, 14 bp, Homo sapiens
gaatagctgggact

SEQ ID NO: 6223278 - DNA, 22 bp, Homo sapiens
gaatagctgggactacaggtgt

SEQ ID NO: 6223279 - DNA, 19 bp, Homo sapiens
gaatagcttgtttctgtca

SEQ ID NO: 6223280 - DNA, 22 bp, Homo sapiens
gaatagctttaatgatatgctt

SEQ ID NO: 6223281 - DNA, 16 bp, Homo sapiens
gaatagctttatcttg

SEQ ID NO: 6223282 - DNA, 20 bp, Homo sapiens
gaatagctttatcttggttt

SEQ ID NO: 6223283 - DNA, 18 bp, Homo sapiens
gaataggaaaatgtacat

SEQ ID NO: 6223284 - DNA, 18 bp, Homo sapiens
gaataggacttgtttttg

SEQ ID NO: 6223285 - DNA, 21 bp, Homo sapiens
gaataggagaaaatgaaaggt

SEQ ID NO: 6223286 - DNA, 20 bp, Homo sapiens
gaataggagttctcctggag

SEQ ID NO: 6223287 - DNA, 14 bp, Homo sapiens
gaataggcattaaa

SEQ ID NO: 6223288 - DNA, 20 bp, Homo sapiens
gaataggctgatgggcaaaa

SEQ ID NO: 6223289 - DNA, 19 bp, Homo sapiens
gaatagggctaggaatata

SEQ ID NO: 6223290 - DNA, 15 bp, Homo sapiens
gaataggttactttg

SEQ ID NO: 6223291 - DNA, 16 bp, Homo sapiens
gaatagtaaactaaag

SEQ ID NO: 6223292 - DNA, 20 bp, Homo sapiens
gaatagtatcctccaggttt

SEQ ID NO: 6223293 - DNA, 14 bp, Homo sapiens
gaatagtcctaaaa

SEQ ID NO: 6223294 - DNA, 23 bp, Homo sapiens
gaatagtctagatggctcctctc

SEQ ID NO: 6223295 - DNA, 16 bp, Homo sapiens
gaatagtctctgggtt

SEQ ID NO: 6223296 - DNA, 20 bp, Homo sapiens
gaatagtggacatggtcaca

SEQ ID NO: 6223297 - DNA, 22 bp, Homo sapiens
gaatagtggttaacagagctaa

SEQ ID NO: 6223298 - DNA, 17 bp, Homo sapiens
gaatagttaaaaattaa

SEQ ID NO: 6223299 - DNA, 14 bp, Homo sapiens
gaatagttctgtat

SEQ ID NO: 6223300 - DNA, 16 bp, Homo sapiens
gaatagttgagcccca

SEQ ID NO: 6223301 - DNA, 14 bp, Homo sapiens
gaatagtttatttc

SEQ ID NO: 6223302 - DNA, 21 bp, Homo sapiens
gaatagtttatttctgtgaaa

SEQ ID NO: 6223303 - DNA, 15 bp, Homo sapiens
gaatataaaaaatgt

SEQ ID NO: 6223304 - DNA, 17 bp, Homo sapiens
gaatataaaaacatttg

SEQ ID NO: 6223305 - DNA, 13 bp, Homo sapiens
gaatataaagctt

SEQ ID NO: 6223306 - DNA, 19 bp, Homo sapiens
gaatataaatagctgaaaa

SEQ ID NO: 6223307 - DNA, 17 bp, Homo sapiens
gaatataaatgtgtgta

SEQ ID NO: 6223308 - DNA, 13 bp, Homo sapiens
gaatataacatga

SEQ ID NO: 6223309 - DNA, 15 bp, Homo sapiens
gaatataacatgtaa

SEQ ID NO: 6223310 - DNA, 11 bp, Homo sapiens
gaatataagaa

SEQ ID NO: 6223311 - DNA, 18 bp, Homo sapiens
gaatataagcttaaaata

SEQ ID NO: 6223312 - DNA, 19 bp, Homo sapiens
gaatataagcttaaaataa

SEQ ID NO: 6223313 - DNA, 23 bp, Homo sapiens
gaatataagcttaaaataagtga

SEQ ID NO: 6223314 - DNA, 16 bp, Homo sapiens
gaatataatagattga

SEQ ID NO: 6223315 - DNA, 20 bp, Homo sapiens
gaatatacatgtaaaaatgt

SEQ ID NO: 6223316 - DNA, 18 bp, Homo sapiens
gaatataccttatttatt

SEQ ID NO: 6223317 - DNA, 20 bp, Homo sapiens
gaatatactcattagaatta

SEQ ID NO: 6223318 - DNA, 14 bp, Homo sapiens
gaatatactgtctt

SEQ ID NO: 6223319 - DNA, 17 bp, Homo sapiens
gaatatagattaaatca

SEQ ID NO: 6223320 - DNA, 22 bp, Homo sapiens
gaatatagcctgcctcagtggc

SEQ ID NO: 6223321 - DNA, 14 bp, Homo sapiens
gaatataggtctct

SEQ ID NO: 6223322 - DNA, 23 bp, Homo sapiens
gaatataggtctcttctcccaga

SEQ ID NO: 6223323 - DNA, 12 bp, Homo sapiens
gaatatatatgg

SEQ ID NO: 6223324 - DNA, 21 bp, Homo sapiens
gaatatatatggaataagtgt

SEQ ID NO: 6223325 - DNA, 18 bp, Homo sapiens
gaatatatcagaatctgt

SEQ ID NO: 6223326 - DNA, 23 bp, Homo sapiens
gaatatatcagaatctgtgtgaa

SEQ ID NO: 6223327 - DNA, 21 bp, Homo sapiens
gaatatatcagtacctctcaa

SEQ ID NO: 6223328 - DNA, 16 bp, Homo sapiens
gaatatatgcttttgg

SEQ ID NO: 6223329 - DNA, 14 bp, Homo sapiens
gaatatatggcatt

SEQ ID NO: 6223330 - DNA, 17 bp, Homo sapiens
gaatatattactgattt

SEQ ID NO: 6223331 - DNA, 13 bp, Homo sapiens
gaatatatttatt

SEQ ID NO: 6223332 - DNA, 16 bp, Homo sapiens
gaatatatttatttaa

SEQ ID NO: 6223333 - DNA, 21 bp, Homo sapiens
gaatatcaagaatagttgtca

SEQ ID NO: 6223334 - DNA, 13 bp, Homo sapiens
gaatatcaatata

SEQ ID NO: 6223335 - DNA, 19 bp, Homo sapiens
gaatatcatctgtcattat

SEQ ID NO: 6223336 - DNA, 13 bp, Homo sapiens
gaatatcatgcaa

SEQ ID NO: 6223337 - DNA, 16 bp, Homo sapiens
gaatatcattgatttt

SEQ ID NO: 6223338 - DNA, 16 bp, Homo sapiens
gatctgagtaggtctg

SEQ ID NO: 6223339 - DNA, 20 bp, Homo sapiens
gatctgagtaggtctgggat

SEQ ID NO: 6223340 - DNA, 17 bp, Homo sapiens
gatctgagtcagagcca

SEQ ID NO: 6223341 - DNA, 17 bp, Homo sapiens
gatctgatgcaagcaag

SEQ ID NO: 6223342 - DNA, 15 bp, Homo sapiens
gatctgatggtgagc

SEQ ID NO: 6223343 - DNA, 13 bp, Homo sapiens
gatctgcaggctg

SEQ ID NO: 6223344 - DNA, 14 bp, Homo sapiens
gatctgcaggctgc

SEQ ID NO: 6223345 - DNA, 14 bp, Homo sapiens
gatctgcaggggtc

SEQ ID NO: 6223346 - DNA, 23 bp, Homo sapiens
gatctgcaggggtctgggagtca

SEQ ID NO: 6223347 - DNA, 16 bp, Homo sapiens
gatctgcatatttctg

SEQ ID NO: 6223348 - DNA, 13 bp, Homo sapiens
gatctgccagacc

SEQ ID NO: 6223349 - DNA, 17 bp, Homo sapiens
gatctgccagacctgca

SEQ ID NO: 6223350 - DNA, 11 bp, Homo sapiens
gatctgcccat

SEQ ID NO: 6223351 - DNA, 13 bp, Homo sapiens
gatctgcccatcg

SEQ ID NO: 6223352 - DNA, 18 bp, Homo sapiens
gatctgcccatcgtgaag

SEQ ID NO: 6223353 - DNA, 23 bp, Homo sapiens
gatctgcctgggcctgtgcagca

SEQ ID NO: 6223354 - DNA, 18 bp, Homo sapiens
gatctgcggatctcagct

SEQ ID NO: 6223355 - DNA, 19 bp, Homo sapiens
gatctgcggatctcagctt

SEQ ID NO: 6223356 - DNA, 18 bp, Homo sapiens
gatctgctagtgctgtaa

SEQ ID NO: 6223357 - DNA, 13 bp, Homo sapiens
gatctgctcagcc

SEQ ID NO: 6223358 - DNA, 11 bp, Homo sapiens
gatctgctcct

SEQ ID NO: 6223359 - DNA, 16 bp, Homo sapiens
gatctgctctgtttta

SEQ ID NO: 6223360 - DNA, 17 bp, Homo sapiens
gatctgctgaggcccag

SEQ ID NO: 6223361 - DNA, 12 bp, Homo sapiens
gatctgctgcag

SEQ ID NO: 6223362 - DNA, 18 bp, Homo sapiens
gatctgcttccctggggc

SEQ ID NO: 6223363 - DNA, 19 bp, Homo sapiens
gatctgcttccctggggcc

SEQ ID NO: 6223364 - DNA, 16 bp, Homo sapiens
gatctggaacccagac

SEQ ID NO: 6223365 - DNA, 21 bp, Homo sapiens
gatctggaacctcagcctggc

SEQ ID NO: 6223366 - DNA, 23 bp, Homo sapiens
gatctggaacctcagcctggcca

SEQ ID NO: 6223367 - DNA, 13 bp, Homo sapiens
gatctggagtctg

SEQ ID NO: 6223368 - DNA, 19 bp, Homo sapiens
gatctggagtctgaaggag

SEQ ID NO: 6223369 - DNA, 16 bp, Homo sapiens
gatctggcacactccc

SEQ ID NO: 6223370 - DNA, 22 bp, Homo sapiens
gatctggcacactccctctcct

SEQ ID NO: 6223371 - DNA, 18 bp, Homo sapiens
gatctggcccaagctggg

SEQ ID NO: 6223372 - DNA, 19 bp, Homo sapiens
gatctggcccaagctgggc

SEQ ID NO: 6223373 - DNA, 13 bp, Homo sapiens
gatctggctgcag

SEQ ID NO: 6223374 - DNA, 24 bp, Homo sapiens
gatctggcttacaggggggtcgga

SEQ ID NO: 6223375 - DNA, 22 bp, Homo sapiens
gatctgggaccctttccttcct

SEQ ID NO: 6223376 - DNA, 23 bp, Homo sapiens
gatctgggaggtctccactgagg

SEQ ID NO: 6223377 - DNA, 22 bp, Homo sapiens
gatctgggcattttcctcctct

SEQ ID NO: 6223378 - DNA, 14 bp, Homo sapiens
gatctgggctgtgg

SEQ ID NO: 6223379 - DNA, 13 bp, Homo sapiens
gatctggggaagg

SEQ ID NO: 6223380 - DNA, 18 bp, Homo sapiens
gatctggggaaggaccaa

SEQ ID NO: 6223381 - DNA, 21 bp, Homo sapiens
gatctggggactgagtgtggg

SEQ ID NO: 6223382 - DNA, 21 bp, Homo sapiens
gatctggggagagcggctgga

SEQ ID NO: 6223383 - DNA, 14 bp, Homo sapiens
gatctggggaggca

SEQ ID NO: 6223384 - DNA, 17 bp, Homo sapiens
gatctggggctctggga

SEQ ID NO: 6223385 - DNA, 17 bp, Homo sapiens
gatctggggggtgggga

SEQ ID NO: 6223386 - DNA, 20 bp, Homo sapiens
gatctggggggtggggagga

SEQ ID NO: 6223387 - DNA, 21 bp, Homo sapiens
gatctgggttaggtggccgct

SEQ ID NO: 6223388 - DNA, 22 bp, Homo sapiens
gatctgggttttgcctctgccc

SEQ ID NO: 6223389 - DNA, 16 bp, Homo sapiens
gatctggtgcgtgtgg

SEQ ID NO: 6223390 - DNA, 17 bp, Homo sapiens
gatctggtgcgtgtggc

SEQ ID NO: 6223391 - DNA, 18 bp, Homo sapiens
gatctggtgcgtgtggcc

SEQ ID NO: 6223392 - DNA, 24 bp, Homo sapiens
gatctggttttgctattagactgt

SEQ ID NO: 6223393 - DNA, 14 bp, Homo sapiens
gatctgtaccatga

SEQ ID NO: 6223394 - DNA, 18 bp, Homo sapiens
gatctgtactgtaatttt

SEQ ID NO: 6223395 - DNA, 16 bp, Homo sapiens
gatctgtactttgtgt

SEQ ID NO: 6223396 - DNA, 21 bp, Homo sapiens
gatctgtagacttctggttgt

SEQ ID NO: 6223397 - DNA, 17 bp, Homo sapiens
gatctgtataaaaatgt

SEQ ID NO: 6223398 - DNA, 23 bp, Homo sapiens
gatctgtataaaaatgtaaatta

SEQ ID NO: 6223399 - DNA, 14 bp, Homo sapiens
gatctgtataaata

SEQ ID NO: 6223400 - DNA, 16 bp, Homo sapiens
gatctgtataaataag

SEQ ID NO: 6223401 - DNA, 23 bp, Homo sapiens
gatctgtatatttttttctaaga

SEQ ID NO: 6223402 - DNA, 12 bp, Homo sapiens
gatctgtattaa

SEQ ID NO: 6223403 - DNA, 20 bp, Homo sapiens
gatctgtatttaatggtttt

SEQ ID NO: 6223404 - DNA, 15 bp, Homo sapiens
gatctgtccaaggaa

SEQ ID NO: 6223405 - DNA, 17 bp, Homo sapiens
gatctgtcctcagcctt

SEQ ID NO: 6223406 - DNA, 15 bp, Homo sapiens
gatctgtcctggggg

SEQ ID NO: 6223407 - DNA, 16 bp, Homo sapiens
gatctgtctgtgcaca

SEQ ID NO: 6223408 - DNA, 20 bp, Homo sapiens
gatctgtctgtgcacatgcc

SEQ ID NO: 6223409 - DNA, 12 bp, Homo sapiens
gatctgtcttgt

SEQ ID NO: 6223410 - DNA, 22 bp, Homo sapiens
gatctgtcttgtaatattttgt

SEQ ID NO: 6223411 - DNA, 13 bp, Homo sapiens
gatctgtgattgg

SEQ ID NO: 6223412 - DNA, 18 bp, Homo sapiens
gatctgtgccccatgcct

SEQ ID NO: 6223413 - DNA, 15 bp, Homo sapiens
gatctgtgcctggga

SEQ ID NO: 6223414 - DNA, 16 bp, Homo sapiens
gatctgtgcctgggat

SEQ ID NO: 6223415 - DNA, 20 bp, Homo sapiens
gatctgtgtacaattttagt

SEQ ID NO: 6223416 - DNA, 15 bp, Homo sapiens
gatctgtgtggctcc

SEQ ID NO: 6223417 - DNA, 16 bp, Homo sapiens
gatctgtgtggctcct

SEQ ID NO: 6223418 - DNA, 14 bp, Homo sapiens
gatctgttgcaaac

SEQ ID NO: 6223419 - DNA, 17 bp, Homo sapiens
gatctgttgtaatatca

SEQ ID NO: 6223420 - DNA, 14 bp, Homo sapiens
gatctgtttccaaa

SEQ ID NO: 6223421 - DNA, 14 bp, Homo sapiens
gatctgttttctgg

SEQ ID NO: 6223422 - DNA, 17 bp, Homo sapiens
gatctgttttctggaag

SEQ ID NO: 6223423 - DNA, 17 bp, Homo sapiens
gatctgttttgaaggca

SEQ ID NO: 6223424 - DNA, 19 bp, Homo sapiens
gatctgttttgaaggcaaa

SEQ ID NO: 6223425 - DNA, 14 bp, Homo sapiens
gatctgttttggat

SEQ ID NO: 6223426 - DNA, 12 bp, Homo sapiens
gatcttaaaata

SEQ ID NO: 6223427 - DNA, 13 bp, Homo sapiens
gatcttaaatttt

SEQ ID NO: 6223428 - DNA, 19 bp, Homo sapiens
gatcttaaattttgtgata

SEQ ID NO: 6223429 - DNA, 16 bp, Homo sapiens
gatcttaatataaatt

SEQ ID NO: 6223430 - DNA, 15 bp, Homo sapiens
gatcttactctactg

SEQ ID NO: 6223431 - DNA, 17 bp, Homo sapiens
gatcttaggcatgtgct

SEQ ID NO: 6223432 - DNA, 23 bp, Homo sapiens
gatcttagggatgattaaaggca

SEQ ID NO: 6223433 - DNA, 19 bp, Homo sapiens
gatcttcaaaagtaatgcc

SEQ ID NO: 6223434 - DNA, 24 bp, Homo sapiens
gatcttcaaaagtaatgcctctgt

SEQ ID NO: 6223435 - DNA, 15 bp, Homo sapiens
gatcttcaacaaatt

SEQ ID NO: 6223436 - DNA, 16 bp, Homo sapiens
gatcttcaatggcttt

SEQ ID NO: 6223437 - DNA, 16 bp, Homo sapiens
gatcttcaatttggat

SEQ ID NO: 6223438 - DNA, 19 bp, Homo sapiens
gatcttcagaactgccctt

SEQ ID NO: 6223439 - DNA, 18 bp, Homo sapiens
gatcttcattaccaatag

SEQ ID NO: 6223440 - DNA, 15 bp, Homo sapiens
gatcttccaaatatt

SEQ ID NO: 6223441 - DNA, 21 bp, Homo sapiens
gatcttccagaagctgtactt

SEQ ID NO: 6223442 - DNA, 12 bp, Homo sapiens
gatcttccccct

SEQ ID NO: 6223443 - DNA, 16 bp, Homo sapiens
gatcttcccccttccc

SEQ ID NO: 6223444 - DNA, 20 bp, Homo sapiens
gatcttcctcaaacttcaga

SEQ ID NO: 6223445 - DNA, 19 bp, Homo sapiens
gatcttcctgctgagtcct

SEQ ID NO: 6223446 - DNA, 15 bp, Homo sapiens
gatcttccttccgct

SEQ ID NO: 6223447 - DNA, 18 bp, Homo sapiens
gatcttccttccgctctg

SEQ ID NO: 6223448 - DNA, 22 bp, Homo sapiens
gatcttcttcatccaacttcca

SEQ ID NO: 6223449 - DNA, 22 bp, Homo sapiens
gatcttgaatgtggtctcagga

SEQ ID NO: 6223450 - DNA, 23 bp, Homo sapiens
gatcttgaatgtggtctcaggat

SEQ ID NO: 6223451 - DNA, 22 bp, Homo sapiens
gatcttgagcaaggcaagaagt

SEQ ID NO: 6223452 - DNA, 19 bp, Homo sapiens
gatcttgagcaagttcctt

SEQ ID NO: 6223453 - DNA, 15 bp, Homo sapiens
gatcttgatggtgtt

SEQ ID NO: 6223454 - DNA, 18 bp, Homo sapiens
gatcttgcattcattttc

SEQ ID NO: 6223455 - DNA, 19 bp, Homo sapiens
gatcttgcattcattttct

SEQ ID NO: 6223456 - DNA, 16 bp, Homo sapiens
gatcttgccacatttc

SEQ ID NO: 6223457 - DNA, 21 bp, Homo sapiens
gatcttgcctaaatcccaaga

SEQ ID NO: 6223458 - DNA, 17 bp, Homo sapiens
gatcttgcctctttcct

SEQ ID NO: 6223459 - DNA, 16 bp, Homo sapiens
gatcttggagacaatt

SEQ ID NO: 6223460 - DNA, 18 bp, Homo sapiens
gatcttggctcactacaa

SEQ ID NO: 6223461 - DNA, 19 bp, Homo sapiens
gatcttggctcactgcaac

SEQ ID NO: 6223462 - DNA, 16 bp, Homo sapiens
gatcttgtctccacta

SEQ ID NO: 6223463 - DNA, 13 bp, Homo sapiens
gatcttgtgctca

SEQ ID NO: 6223464 - DNA, 17 bp, Homo sapiens
gatcttgtgctcagcat

SEQ ID NO: 6223465 - DNA, 13 bp, Homo sapiens
gatctttaaaata

SEQ ID NO: 6223466 - DNA, 15 bp, Homo sapiens
gatctttaaatacag

SEQ ID NO: 6223467 - DNA, 19 bp, Homo sapiens
gatctttaaatacagtcaa

SEQ ID NO: 6223468 - DNA, 22 bp, Homo sapiens
gatctttaactggaaggctgct

SEQ ID NO: 6223469 - DNA, 15 bp, Homo sapiens
gatctttactcttga

SEQ ID NO: 6223470 - DNA, 20 bp, Homo sapiens
gatctttattatggaaaaca

SEQ ID NO: 6223471 - DNA, 23 bp, Homo sapiens
gatctttattatggaaaacattt

SEQ ID NO: 6223472 - DNA, 16 bp, Homo sapiens
gatctttcaatatcat

SEQ ID NO: 6223473 - DNA, 21 bp, Homo sapiens
gatctttcacccacagaaaga

SEQ ID NO: 6223474 - DNA, 16 bp, Homo sapiens
gatctttcagaaatat

SEQ ID NO: 6223475 - DNA, 18 bp, Homo sapiens
gatctttcagaaatataa

SEQ ID NO: 6223476 - DNA, 19 bp, Homo sapiens
gatctttccattggaaata

SEQ ID NO: 6223477 - DNA, 21 bp, Homo sapiens
gatctttcgttggttgtttct

SEQ ID NO: 6223478 - DNA, 12 bp, Homo sapiens
gatctttctctt

SEQ ID NO: 6223479 - DNA, 14 bp, Homo sapiens
gatctttctcttcc

SEQ ID NO: 6223480 - DNA, 18 bp, Homo sapiens
gatctttctttcctttct

SEQ ID NO: 6223481 - DNA, 16 bp, Homo sapiens
gatctttgactgaaaa

SEQ ID NO: 6223482 - DNA, 13 bp, Homo sapiens
gatctttgagccc

SEQ ID NO: 6223483 - DNA, 20 bp, Homo sapiens
gatctttgagtgtattctat

SEQ ID NO: 6223484 - DNA, 17 bp, Homo sapiens
gatctttgcagacaggc

SEQ ID NO: 6223485 - DNA, 18 bp, Homo sapiens
gatctttgcagacaggca

SEQ ID NO: 6223486 - DNA, 11 bp, Homo sapiens
gatctttgtgg

SEQ ID NO: 6223487 - DNA, 15 bp, Homo sapiens
gatctttgtggccaa

SEQ ID NO: 6223488 - DNA, 16 bp, Homo sapiens
gatctttgtggccaag

SEQ ID NO: 6223489 - DNA, 14 bp, Homo sapiens
gatctttgttcctc

SEQ ID NO: 6223490 - DNA, 18 bp, Homo sapiens
gatctttgtttaaatgcc

SEQ ID NO: 6223491 - DNA, 19 bp, Homo sapiens
gatctttgtttaaatgcca

SEQ ID NO: 6223492 - DNA, 20 bp, Homo sapiens
gatcttttaaaaaggcagta

SEQ ID NO: 6223493 - DNA, 16 bp, Homo sapiens
gatcttttaaaatcat

SEQ ID NO: 6223494 - DNA, 17 bp, Homo sapiens
gatcttttaaagtgtta

SEQ ID NO: 6223495 - DNA, 15 bp, Homo sapiens
gatcttttgttccca

SEQ ID NO: 6223496 - DNA, 16 bp, Homo sapiens
gatgaaaaagcatgta

SEQ ID NO: 6223497 - DNA, 18 bp, Homo sapiens
gatgaaaaagcatgtaca

SEQ ID NO: 6223498 - DNA, 20 bp, Homo sapiens
gatgaaaaattgctgactgt

SEQ ID NO: 6223499 - DNA, 22 bp, Homo sapiens
gatgaaaacaaaatcacagcac

SEQ ID NO: 6223500 - DNA, 14 bp, Homo sapiens
gatgaaaacatagc

SEQ ID NO: 6223501 - DNA, 13 bp, Homo sapiens
gatgaaaagattt

SEQ ID NO: 6223502 - DNA, 17 bp, Homo sapiens
gatgaaaagctttgttt

SEQ ID NO: 6223503 - DNA, 12 bp, Homo sapiens
gatgaaaataaa

SEQ ID NO: 6223504 - DNA, 13 bp, Homo sapiens
gatgaaaataaaa

SEQ ID NO: 6223505 - DNA, 16 bp, Homo sapiens
gatgaaaataaaataa

SEQ ID NO: 6223506 - DNA, 15 bp, Homo sapiens
gatgaaaataaagaa

SEQ ID NO: 6223507 - DNA, 19 bp, Homo sapiens
gatgaaaataattttccaa

SEQ ID NO: 6223508 - DNA, 16 bp, Homo sapiens
gatgaaaatatttaaa

SEQ ID NO: 6223509 - DNA, 16 bp, Homo sapiens
gatgaaacatcatttc

SEQ ID NO: 6223510 - DNA, 17 bp, Homo sapiens
gatgaaactaaagcaat

SEQ ID NO: 6223511 - DNA, 20 bp, Homo sapiens
gatgaaactggttcctacat

SEQ ID NO: 6223512 - DNA, 21 bp, Homo sapiens
gatgaaactttgaaaaagata

SEQ ID NO: 6223513 - DNA, 22 bp, Homo sapiens
gatgaaactttgaaaaagatat

SEQ ID NO: 6223514 - DNA, 15 bp, Homo sapiens
gatgaaagacaaaga

SEQ ID NO: 6223515 - DNA, 20 bp, Homo sapiens
gatgaaagacaaagaaggaa

SEQ ID NO: 6223516 - DNA, 23 bp, Homo sapiens
gatgaaagtgcaaagtgccctca

SEQ ID NO: 6223517 - DNA, 17 bp, Homo sapiens
gaatatcattgatttta

SEQ ID NO: 6223518 - DNA, 18 bp, Homo sapiens
gaatatccagtcaaagac

SEQ ID NO: 6223519 - DNA, 16 bp, Homo sapiens
gaatatccatgaccta

SEQ ID NO: 6223520 - DNA, 16 bp, Homo sapiens
gaatatccatgtactt

SEQ ID NO: 6223521 - DNA, 19 bp, Homo sapiens
gaatatcgatataaattgg

SEQ ID NO: 6223522 - DNA, 23 bp, Homo sapiens
gaatatcgtaaccagttttttca

SEQ ID NO: 6223523 - DNA, 17 bp, Homo sapiens
gaatatctattaatata

SEQ ID NO: 6223524 - DNA, 15 bp, Homo sapiens
gaatatctgtaatgg

SEQ ID NO: 6223525 - DNA, 19 bp, Homo sapiens
gaatatctgttcccagccc

SEQ ID NO: 6223526 - DNA, 20 bp, Homo sapiens
gaatatctgttcccagcccc

SEQ ID NO: 6223527 - DNA, 14 bp, Homo sapiens
gaatatgaaacata

SEQ ID NO: 6223528 - DNA, 17 bp, Homo sapiens
gaatatgacggaagaac

SEQ ID NO: 6223529 - DNA, 17 bp, Homo sapiens
gaatatgactgttttta

SEQ ID NO: 6223530 - DNA, 19 bp, Homo sapiens
gaatatgagctttatgtaa

SEQ ID NO: 6223531 - DNA, 19 bp, Homo sapiens
gaatatgattaaaaatatc

SEQ ID NO: 6223532 - DNA, 21 bp, Homo sapiens
gaatatgccttaatttagaaa

SEQ ID NO: 6223533 - DNA, 23 bp, Homo sapiens
gaatatgccttaatttagaaact

SEQ ID NO: 6223534 - DNA, 22 bp, Homo sapiens
gaatatggaacatatgcacagg

SEQ ID NO: 6223535 - DNA, 21 bp, Homo sapiens
gaatatggacagttagcattt

SEQ ID NO: 6223536 - DNA, 22 bp, Homo sapiens
gaatatggacagttagcattta

SEQ ID NO: 6223537 - DNA, 16 bp, Homo sapiens
gaatatggaggctgga

SEQ ID NO: 6223538 - DNA, 23 bp, Homo sapiens
gaatatggttggagagccctgga

SEQ ID NO: 6223539 - DNA, 15 bp, Homo sapiens
gaatattaaaaatta

SEQ ID NO: 6223540 - DNA, 20 bp, Homo sapiens
gaatattaaagtctgagaaa

SEQ ID NO: 6223541 - DNA, 15 bp, Homo sapiens
gaatattaagaaaca

SEQ ID NO: 6223542 - DNA, 17 bp, Homo sapiens
gaatattaatggaaaca

SEQ ID NO: 6223543 - DNA, 21 bp, Homo sapiens
gaatattacatgtaaagctgt

SEQ ID NO: 6223544 - DNA, 22 bp, Homo sapiens
gaatattagatgctctgagaaa

SEQ ID NO: 6223545 - DNA, 12 bp, Homo sapiens
gaatattagctt

SEQ ID NO: 6223546 - DNA, 19 bp, Homo sapiens
gaatattataaaaatatca

SEQ ID NO: 6223547 - DNA, 15 bp, Homo sapiens
gaatattcaggactt

SEQ ID NO: 6223548 - DNA, 23 bp, Homo sapiens
gaatattccactatttgcagagg

SEQ ID NO: 6223549 - DNA, 22 bp, Homo sapiens
gaatattctttttatattctgt

SEQ ID NO: 6223550 - DNA, 12 bp, Homo sapiens
gaatattgagca

SEQ ID NO: 6223551 - DNA, 13 bp, Homo sapiens
gaatattgcaaaa

SEQ ID NO: 6223552 - DNA, 19 bp, Homo sapiens
gaatattgctgatggtgca

SEQ ID NO: 6223553 - DNA, 19 bp, Homo sapiens
gaatattggtaattaaaag

SEQ ID NO: 6223554 - DNA, 13 bp, Homo sapiens
gaatattgtgatt

SEQ ID NO: 6223555 - DNA, 17 bp, Homo sapiens
gaatattgtgattctgt

SEQ ID NO: 6223556 - DNA, 16 bp, Homo sapiens
gaatattgtggctccc

SEQ ID NO: 6223557 - DNA, 21 bp, Homo sapiens
gaatattgttcctaagttctt

SEQ ID NO: 6223558 - DNA, 19 bp, Homo sapiens
gaatatttaagcaataaaa

SEQ ID NO: 6223559 - DNA, 22 bp, Homo sapiens
gaatatttagcataaatttaat

SEQ ID NO: 6223560 - DNA, 19 bp, Homo sapiens
gaatatttataggccaggg

SEQ ID NO: 6223561 - DNA, 12 bp, Homo sapiens
gaatatttatta

SEQ ID NO: 6223562 - DNA, 18 bp, Homo sapiens
gaatatttattacctctg

SEQ ID NO: 6223563 - DNA, 21 bp, Homo sapiens
gaatatttattacctctgata

SEQ ID NO: 6223564 - DNA, 19 bp, Homo sapiens
gaatatttattcagtgact

SEQ ID NO: 6223565 - DNA, 11 bp, Homo sapiens
gaatatttgaa

SEQ ID NO: 6223566 - DNA, 12 bp, Homo sapiens
gaatatttgaat

SEQ ID NO: 6223567 - DNA, 13 bp, Homo sapiens
gaatatttgaata

SEQ ID NO: 6223568 - DNA, 16 bp, Homo sapiens
gaatatttgaatcttg

SEQ ID NO: 6223569 - DNA, 18 bp, Homo sapiens
gaatatttgaatcttgtc

SEQ ID NO: 6223570 - DNA, 22 bp, Homo sapiens
gaatatttgaatcttgtctcaa

SEQ ID NO: 6223571 - DNA, 17 bp, Homo sapiens
gaatatttgaatgtatg

SEQ ID NO: 6223572 - DNA, 18 bp, Homo sapiens
gaatatttgttttaatac

SEQ ID NO: 6223573 - DNA, 16 bp, Homo sapiens
gaatattttaacttcc

SEQ ID NO: 6223574 - DNA, 18 bp, Homo sapiens
gaatattttaagtattgc

SEQ ID NO: 6223575 - DNA, 12 bp, Homo sapiens
gaatattttata

SEQ ID NO: 6223576 - DNA, 19 bp, Homo sapiens
gaatattttatattaaaat

SEQ ID NO: 6223577 - DNA, 12 bp, Homo sapiens
gaatattttatc

SEQ ID NO: 6223578 - DNA, 14 bp, Homo sapiens
gaatattttatcct

SEQ ID NO: 6223579 - DNA, 14 bp, Homo sapiens
gaatattttatctt

SEQ ID NO: 6223580 - DNA, 15 bp, Homo sapiens
gaatattttattcaa

SEQ ID NO: 6223581 - DNA, 20 bp, Homo sapiens
gaatattttattcaaggtaa

SEQ ID NO: 6223582 - DNA, 23 bp, Homo sapiens
gaatattttcaagtttttcatac

SEQ ID NO: 6223583 - DNA, 19 bp, Homo sapiens
gaatattttggaaactgct

SEQ ID NO: 6223584 - DNA, 22 bp, Homo sapiens
gaatatttttatatttccttta

SEQ ID NO: 6223585 - DNA, 12 bp, Homo sapiens
gaatatttttgt

SEQ ID NO: 6223586 - DNA, 22 bp, Homo sapiens
gaatattttttgaggctaaaga

SEQ ID NO: 6223587 - DNA, 18 bp, Homo sapiens
gaatcaaaagctgaaatt

SEQ ID NO: 6223588 - DNA, 14 bp, Homo sapiens
gaatcaaaagtgcc

SEQ ID NO: 6223589 - DNA, 14 bp, Homo sapiens
gaatcaaacatttt

SEQ ID NO: 6223590 - DNA, 21 bp, Homo sapiens
gaatcaaagtgattttagcaa

SEQ ID NO: 6223591 - DNA, 18 bp, Homo sapiens
gaatcaaatctgagcctt

SEQ ID NO: 6223592 - DNA, 17 bp, Homo sapiens
gaatcaaatctgtgctc

SEQ ID NO: 6223593 - DNA, 13 bp, Homo sapiens
gaatcaacagatg

SEQ ID NO: 6223594 - DNA, 16 bp, Homo sapiens
gaatcaagagctgccc

SEQ ID NO: 6223595 - DNA, 23 bp, Homo sapiens
gaatcaagagggcagcccccact

SEQ ID NO: 6223596 - DNA, 23 bp, Homo sapiens
gaatcaagcaatccagcctcatg

SEQ ID NO: 6223597 - DNA, 20 bp, Homo sapiens
gaatcaagctagaaggccac

SEQ ID NO: 6223598 - DNA, 18 bp, Homo sapiens
gaatcaaggtaagctcag

SEQ ID NO: 6223599 - DNA, 14 bp, Homo sapiens
gaatcaatgaaaaa

SEQ ID NO: 6223600 - DNA, 14 bp, Homo sapiens
gaatcaattattta

SEQ ID NO: 6223601 - DNA, 20 bp, Homo sapiens
gaatcaattgtctatatgga

SEQ ID NO: 6223602 - DNA, 22 bp, Homo sapiens
gaatcaatttcccagaagggag

SEQ ID NO: 6223603 - DNA, 18 bp, Homo sapiens
gaatcacaggctgggctg

SEQ ID NO: 6223604 - DNA, 22 bp, Homo sapiens
gaatcacaggctgggctgggca

SEQ ID NO: 6223605 - DNA, 20 bp, Homo sapiens
gaatcacctgaaccccagag

SEQ ID NO: 6223606 - DNA, 12 bp, Homo sapiens
gaatcacctggc

SEQ ID NO: 6223607 - DNA, 21 bp, Homo sapiens
gaatcacggtggtaaagaaag

SEQ ID NO: 6223608 - DNA, 22 bp, Homo sapiens
gaatcacggtggtaaagaaagt

SEQ ID NO: 6223609 - DNA, 14 bp, Homo sapiens
gaatcactgctcca

SEQ ID NO: 6223610 - DNA, 23 bp, Homo sapiens
gaatcactgtattttcattttaa

SEQ ID NO: 6223611 - DNA, 18 bp, Homo sapiens
gaatcactgtgctcagcc

SEQ ID NO: 6223612 - DNA, 20 bp, Homo sapiens
gaatcactgtttagaacaca

SEQ ID NO: 6223613 - DNA, 15 bp, Homo sapiens
gaatcactgttttta

SEQ ID NO: 6223614 - DNA, 17 bp, Homo sapiens
gaatcactgtttttaga

SEQ ID NO: 6223615 - DNA, 23 bp, Homo sapiens
gaatcactgtttttagacacctt

SEQ ID NO: 6223616 - DNA, 18 bp, Homo sapiens
gaatcacttttctagaca

SEQ ID NO: 6223617 - DNA, 13 bp, Homo sapiens
gaatcagaactca

SEQ ID NO: 6223618 - DNA, 16 bp, Homo sapiens
gaatcagaagaaaggc

SEQ ID NO: 6223619 - DNA, 23 bp, Homo sapiens
gaatcagaatcatggagaaaatg

SEQ ID NO: 6223620 - DNA, 15 bp, Homo sapiens
gaatcagacagcagg

SEQ ID NO: 6223621 - DNA, 22 bp, Homo sapiens
gaatcagaccctaccccaccac

SEQ ID NO: 6223622 - DNA, 16 bp, Homo sapiens
gaatcagacctgggtg

SEQ ID NO: 6223623 - DNA, 23 bp, Homo sapiens
gaatcagagaccttccagaaata

SEQ ID NO: 6223624 - DNA, 16 bp, Homo sapiens
gaatcagaggcagaga

SEQ ID NO: 6223625 - DNA, 17 bp, Homo sapiens
gaatcagagtagaaata

SEQ ID NO: 6223626 - DNA, 18 bp, Homo sapiens
gaatcagatggtgtcatt

SEQ ID NO: 6223627 - DNA, 20 bp, Homo sapiens
gaatcagctgctacaagaat

SEQ ID NO: 6223628 - DNA, 16 bp, Homo sapiens
gaatcagctggacata

SEQ ID NO: 6223629 - DNA, 21 bp, Homo sapiens
gaatcaggaaagagattagaa

SEQ ID NO: 6223630 - DNA, 20 bp, Homo sapiens
gaatcagggaccagctttac

SEQ ID NO: 6223631 - DNA, 16 bp, Homo sapiens
gaatcagggagcactg

SEQ ID NO: 6223632 - DNA, 17 bp, Homo sapiens
gaatcagggagcactgg

SEQ ID NO: 6223633 - DNA, 18 bp, Homo sapiens
gaatcagggagcactgga

SEQ ID NO: 6223634 - DNA, 21 bp, Homo sapiens
gaatcagggagcactggaggc

SEQ ID NO: 6223635 - DNA, 17 bp, Homo sapiens
gaatcagggtggagaag

SEQ ID NO: 6223636 - DNA, 19 bp, Homo sapiens
gaatcagggtggagaagtt

SEQ ID NO: 6223637 - DNA, 16 bp, Homo sapiens
gaatcaggttgacagt

SEQ ID NO: 6223638 - DNA, 20 bp, Homo sapiens
gaatcagtaggaccaggcca

SEQ ID NO: 6223639 - DNA, 20 bp, Homo sapiens
gaatcagtattgggagccgg

SEQ ID NO: 6223640 - DNA, 19 bp, Homo sapiens
gaatcagtatttccttcca

SEQ ID NO: 6223641 - DNA, 18 bp, Homo sapiens
gaatcagtcctagaatgt

SEQ ID NO: 6223642 - DNA, 19 bp, Homo sapiens
gaatcagtttccaattatt

SEQ ID NO: 6223643 - DNA, 15 bp, Homo sapiens
gaatcagttttggaa

SEQ ID NO: 6223644 - DNA, 13 bp, Homo sapiens
gaatcagttttta

SEQ ID NO: 6223645 - DNA, 10 bp, Homo sapiens
gaatcataat

SEQ ID NO: 6223646 - DNA, 16 bp, Homo sapiens
gaatcataattttcaa

SEQ ID NO: 6223647 - DNA, 23 bp, Homo sapiens
gaatcataattttcaagagaaga

SEQ ID NO: 6223648 - DNA, 20 bp, Homo sapiens
gaatcatacttaacatttca

SEQ ID NO: 6223649 - DNA, 17 bp, Homo sapiens
gaatcatcaggaccctg

SEQ ID NO: 6223650 - DNA, 20 bp, Homo sapiens
gaatcatgagcctgctggaa

SEQ ID NO: 6223651 - DNA, 23 bp, Homo sapiens
gaatcatgcaaaaaaaaaaatgt

SEQ ID NO: 6223652 - DNA, 21 bp, Homo sapiens
gaatcatgggcagaggatgag

SEQ ID NO: 6223653 - DNA, 22 bp, Homo sapiens
gaatcatggggtggaataaagg

SEQ ID NO: 6223654 - DNA, 17 bp, Homo sapiens
gaatcatgtcaggcctg

SEQ ID NO: 6223655 - DNA, 19 bp, Homo sapiens
gaatcatgtcgatcctggg

SEQ ID NO: 6223656 - DNA, 21 bp, Homo sapiens
gaatcatgtctgtatccccag

SEQ ID NO: 6223657 - DNA, 17 bp, Homo sapiens
gaatcatgtttctttga

SEQ ID NO: 6223658 - DNA, 22 bp, Homo sapiens
gaatcattaatttcaaaattta

SEQ ID NO: 6223659 - DNA, 13 bp, Homo sapiens
gaatcattattta

SEQ ID NO: 6223660 - DNA, 18 bp, Homo sapiens
gaatcattcagaaatgtt

SEQ ID NO: 6223661 - DNA, 12 bp, Homo sapiens
gaatcattccac

SEQ ID NO: 6223662 - DNA, 21 bp, Homo sapiens
gaatcattccagtgctagaaa

SEQ ID NO: 6223663 - DNA, 14 bp, Homo sapiens
gaatcattctggct

SEQ ID NO: 6223664 - DNA, 20 bp, Homo sapiens
gaatcattgtatgtggtcat

SEQ ID NO: 6223665 - DNA, 17 bp, Homo sapiens
gaatcattgtggtggtt

SEQ ID NO: 6223666 - DNA, 22 bp, Homo sapiens
gaatcattgttaaccacagctg

SEQ ID NO: 6223667 - DNA, 13 bp, Homo sapiens
gaatcatttagca

SEQ ID NO: 6223668 - DNA, 22 bp, Homo sapiens
gaatcatttctatttctcctcc

SEQ ID NO: 6223669 - DNA, 14 bp, Homo sapiens
gaatcatttgttca

SEQ ID NO: 6223670 - DNA, 14 bp, Homo sapiens
gaatcatttttgta

SEQ ID NO: 6223671 - DNA, 12 bp, Homo sapiens
gaatccaaactt

SEQ ID NO: 6223672 - DNA, 18 bp, Homo sapiens
gaatccaaatctgtcctc

SEQ ID NO: 6223673 - DNA, 20 bp, Homo sapiens
gaatccaaatctgtcctctg

SEQ ID NO: 6223674 - DNA, 20 bp, Homo sapiens
gaatccaaatgtgaaagatg

SEQ ID NO: 6223675 - DNA, 19 bp, Homo sapiens
gaatccaagacaaactaaa

SEQ ID NO: 6223676 - DNA, 20 bp, Homo sapiens
gaatccaagacaaactaaac

SEQ ID NO: 6223677 - DNA, 23 bp, Homo sapiens
gaatccaagacaaactaaacttt

SEQ ID NO: 6223678 - DNA, 17 bp, Homo sapiens
gaatccaagctccctgc

SEQ ID NO: 6223679 - DNA, 20 bp, Homo sapiens
gaatccaagctccctgcccc

SEQ ID NO: 6223680 - DNA, 21 bp, Homo sapiens
gaatccaagggttgagagcca

SEQ ID NO: 6223681 - DNA, 20 bp, Homo sapiens
gaatccaatactgcccaagg

SEQ ID NO: 6223682 - DNA, 23 bp, Homo sapiens
gaatccaattaatgattcaatta

SEQ ID NO: 6223683 - DNA, 18 bp, Homo sapiens
gaatccacaaggacctct

SEQ ID NO: 6223684 - DNA, 20 bp, Homo sapiens
gaatccacatcatattggag

SEQ ID NO: 6223685 - DNA, 16 bp, Homo sapiens
gaatccacatttctaa

SEQ ID NO: 6223686 - DNA, 15 bp, Homo sapiens
gaatccacccatcct

SEQ ID NO: 6223687 - DNA, 16 bp, Homo sapiens
gaatccacctgcagtt

SEQ ID NO: 6223688 - DNA, 17 bp, Homo sapiens
gaatccactcccaggca

SEQ ID NO: 6223689 - DNA, 20 bp, Homo sapiens
gaatccagacccggctgcgt

SEQ ID NO: 6223690 - DNA, 17 bp, Homo sapiens
gaatccagcaggtcaca

SEQ ID NO: 6223691 - DNA, 18 bp, Homo sapiens
gaatccagctccctagac

SEQ ID NO: 6223692 - DNA, 22 bp, Homo sapiens
gaatccagctccctagactgca

SEQ ID NO: 6223693 - DNA, 13 bp, Homo sapiens
gatgaaataaaat

SEQ ID NO: 6223694 - DNA, 10 bp, Homo sapiens
gatgaaatca

SEQ ID NO: 6223695 - DNA, 20 bp, Homo sapiens
gatgaaatctgctagaaagt

SEQ ID NO: 6223696 - DNA, 15 bp, Homo sapiens
gatgaaatgcactgt

SEQ ID NO: 6223697 - DNA, 17 bp, Homo sapiens
gatgaaattgaacctgg

SEQ ID NO: 6223698 - DNA, 20 bp, Homo sapiens
gatgaaatttatttccatct

SEQ ID NO: 6223699 - DNA, 19 bp, Homo sapiens
gatgaaatttgataaactg

SEQ ID NO: 6223700 - DNA, 14 bp, Homo sapiens
gatgaacaatgtat

SEQ ID NO: 6223701 - DNA, 16 bp, Homo sapiens
gatgaacaatgtatac

SEQ ID NO: 6223702 - DNA, 17 bp, Homo sapiens
gatgaacatattcatga

SEQ ID NO: 6223703 - DNA, 13 bp, Homo sapiens
gatgaacatttca

SEQ ID NO: 6223704 - DNA, 13 bp, Homo sapiens
gatgaacccagga

SEQ ID NO: 6223705 - DNA, 16 bp, Homo sapiens
gatgaactcaatgcat

SEQ ID NO: 6223706 - DNA, 18 bp, Homo sapiens
gatgaactcttagaaatg

SEQ ID NO: 6223707 - DNA, 22 bp, Homo sapiens
gatgaactcttagaaatgaagg

SEQ ID NO: 6223708 - DNA, 16 bp, Homo sapiens
gatgaactgactgaag

SEQ ID NO: 6223709 - DNA, 12 bp, Homo sapiens
gatgaagaaaga

SEQ ID NO: 6223710 - DNA, 14 bp, Homo sapiens
gatgaagaaagaga

SEQ ID NO: 6223711 - DNA, 19 bp, Homo sapiens
gatgaagaacacagcatgt

SEQ ID NO: 6223712 - DNA, 20 bp, Homo sapiens
gatgaagaacacagcatgtg

SEQ ID NO: 6223713 - DNA, 23 bp, Homo sapiens
gatgaagaccctatctcccacaa

SEQ ID NO: 6223714 - DNA, 22 bp, Homo sapiens
gatgaagagctatttaatgaca

SEQ ID NO: 6223715 - DNA, 14 bp, Homo sapiens
gatgaagagtgaga

SEQ ID NO: 6223716 - DNA, 15 bp, Homo sapiens
gatgaagcccgtgtc

SEQ ID NO: 6223717 - DNA, 14 bp, Homo sapiens
gatgaagcctgtgc

SEQ ID NO: 6223718 - DNA, 17 bp, Homo sapiens
gatgaagcctgtgccac

SEQ ID NO: 6223719 - DNA, 21 bp, Homo sapiens
gatgaagcctgtgccacctgc

SEQ ID NO: 6223720 - DNA, 15 bp, Homo sapiens
gatgaagctgaggct

SEQ ID NO: 6223721 - DNA, 20 bp, Homo sapiens
gatgaagctttggccctcag

SEQ ID NO: 6223722 - DNA, 16 bp, Homo sapiens
gatgaagggcccgaga

SEQ ID NO: 6223723 - DNA, 22 bp, Homo sapiens
gatgaagtttgtagttgtttta

SEQ ID NO: 6223724 - DNA, 16 bp, Homo sapiens
gatgaagttttacatt

SEQ ID NO: 6223725 - DNA, 13 bp, Homo sapiens
gatgaataaaata

SEQ ID NO: 6223726 - DNA, 14 bp, Homo sapiens
gatgaatagaagaa

SEQ ID NO: 6223727 - DNA, 15 bp, Homo sapiens
gatgaatagaagaaa

SEQ ID NO: 6223728 - DNA, 18 bp, Homo sapiens
gatgaatagaagaaagaa

SEQ ID NO: 6223729 - DNA, 21 bp, Homo sapiens
gatgaatagaagttttaaatt

SEQ ID NO: 6223730 - DNA, 13 bp, Homo sapiens
gatgaatcttgcg

SEQ ID NO: 6223731 - DNA, 13 bp, Homo sapiens
gatgaatgagaat

SEQ ID NO: 6223732 - DNA, 14 bp, Homo sapiens
gatgaatgcagtat

SEQ ID NO: 6223733 - DNA, 16 bp, Homo sapiens
gatgaatgcagtataa

SEQ ID NO: 6223734 - DNA, 16 bp, Homo sapiens
gatgaatgccgtggat

SEQ ID NO: 6223735 - DNA, 18 bp, Homo sapiens
gatgaatgtaaactcggg

SEQ ID NO: 6223736 - DNA, 16 bp, Homo sapiens
gatgaatgtactatgt

SEQ ID NO: 6223737 - DNA, 14 bp, Homo sapiens
gatgaatgtatgtg

SEQ ID NO: 6223738 - DNA, 16 bp, Homo sapiens
gatgaattcttcctct

SEQ ID NO: 6223739 - DNA, 21 bp, Homo sapiens
gatgaattcttcctctccttc

SEQ ID NO: 6223740 - DNA, 22 bp, Homo sapiens
gatgaattcttcctctccttcc

SEQ ID NO: 6223741 - DNA, 22 bp, Homo sapiens
gatgaattgtaaaagcaacatc

SEQ ID NO: 6223742 - DNA, 21 bp, Homo sapiens
gatgaatttggtctgcctctg

SEQ ID NO: 6223743 - DNA, 13 bp, Homo sapiens
gatgaattttctg

SEQ ID NO: 6223744 - DNA, 20 bp, Homo sapiens
gatgacaaaaattcaactca

SEQ ID NO: 6223745 - DNA, 21 bp, Homo sapiens
gatgacaaagaaaatgagaat

SEQ ID NO: 6223746 - DNA, 15 bp, Homo sapiens
gatgacacataaatc

SEQ ID NO: 6223747 - DNA, 18 bp, Homo sapiens
gatgacacataaatctgt

SEQ ID NO: 6223748 - DNA, 12 bp, Homo sapiens
gatgacagctct

SEQ ID NO: 6223749 - DNA, 13 bp, Homo sapiens
gatgacagctctt

SEQ ID NO: 6223750 - DNA, 20 bp, Homo sapiens
gatgacaggctctcctggct

SEQ ID NO: 6223751 - DNA, 17 bp, Homo sapiens
gatgacaggtcagcagt

SEQ ID NO: 6223752 - DNA, 18 bp, Homo sapiens
gatgacagtgacacccag

SEQ ID NO: 6223753 - DNA, 12 bp, Homo sapiens
gatgacagtgct

SEQ ID NO: 6223754 - DNA, 21 bp, Homo sapiens
gatgacatagcagttacagag

SEQ ID NO: 6223755 - DNA, 16 bp, Homo sapiens
gatgacattccaccat

SEQ ID NO: 6223756 - DNA, 23 bp, Homo sapiens
gatgacattctggtctcgtcttc

SEQ ID NO: 6223757 - DNA, 19 bp, Homo sapiens
gatgaccaaagtcccttcc

SEQ ID NO: 6223758 - DNA, 17 bp, Homo sapiens
gatgaccaatctctgtg

SEQ ID NO: 6223759 - DNA, 15 bp, Homo sapiens
gatgaccaatgggat

SEQ ID NO: 6223760 - DNA, 18 bp, Homo sapiens
gatgaccagggatgctgg

SEQ ID NO: 6223761 - DNA, 17 bp, Homo sapiens
gatgaccatactcagac

SEQ ID NO: 6223762 - DNA, 16 bp, Homo sapiens
gatgaccccggcctgt

SEQ ID NO: 6223763 - DNA, 11 bp, Homo sapiens
gatgaccccta

SEQ ID NO: 6223764 - DNA, 14 bp, Homo sapiens
gatgacccctgccc

SEQ ID NO: 6223765 - DNA, 15 bp, Homo sapiens
gatgacccctgccca

SEQ ID NO: 6223766 - DNA, 18 bp, Homo sapiens
gatgacccggggcagctg

SEQ ID NO: 6223767 - DNA, 17 bp, Homo sapiens
gatgacccttttcatga

SEQ ID NO: 6223768 - DNA, 19 bp, Homo sapiens
gatgacctaacctaagcaa

SEQ ID NO: 6223769 - DNA, 12 bp, Homo sapiens
gatgacctccag

SEQ ID NO: 6223770 - DNA, 13 bp, Homo sapiens
gatgacctccaga

SEQ ID NO: 6223771 - DNA, 16 bp, Homo sapiens
gatgacctccagaagt

SEQ ID NO: 6223772 - DNA, 15 bp, Homo sapiens
gatgaccttcccagg

SEQ ID NO: 6223773 - DNA, 18 bp, Homo sapiens
gatgaccttgaatgatgc

SEQ ID NO: 6223774 - DNA, 19 bp, Homo sapiens
gatgacctttttgcagtgt

SEQ ID NO: 6223775 - DNA, 14 bp, Homo sapiens
gatgacgcctctgg

SEQ ID NO: 6223776 - DNA, 16 bp, Homo sapiens
gatgacgcctctggac

SEQ ID NO: 6223777 - DNA, 21 bp, Homo sapiens
gatgacgcctctggacctcgg

SEQ ID NO: 6223778 - DNA, 13 bp, Homo sapiens
gatgacggccagg

SEQ ID NO: 6223779 - DNA, 14 bp, Homo sapiens
gatgacggccaggc

SEQ ID NO: 6223780 - DNA, 15 bp, Homo sapiens
gatgacggccaggct

SEQ ID NO: 6223781 - DNA, 23 bp, Homo sapiens
gatgacggccaggctccctgacc

SEQ ID NO: 6223782 - DNA, 21 bp, Homo sapiens
gatgacggtattatgcttctt

SEQ ID NO: 6223783 - DNA, 18 bp, Homo sapiens
gatgactaaaatatttat

SEQ ID NO: 6223784 - DNA, 18 bp, Homo sapiens
gatgactaacaagatttg

SEQ ID NO: 6223785 - DNA, 15 bp, Homo sapiens
gatgactagaggcag

SEQ ID NO: 6223786 - DNA, 19 bp, Homo sapiens
gatgactgccttgcctcct

SEQ ID NO: 6223787 - DNA, 13 bp, Homo sapiens
gatgactggaaac

SEQ ID NO: 6223788 - DNA, 17 bp, Homo sapiens
gatgactggaattttta

SEQ ID NO: 6223789 - DNA, 14 bp, Homo sapiens
gatgactggcattt

SEQ ID NO: 6223790 - DNA, 17 bp, Homo sapiens
gatgactggcattttat

SEQ ID NO: 6223791 - DNA, 20 bp, Homo sapiens
gatgactggcattttataga

SEQ ID NO: 6223792 - DNA, 11 bp, Homo sapiens
gatgactggtc

SEQ ID NO: 6223793 - DNA, 18 bp, Homo sapiens
gatgactggttgttcaaa

SEQ ID NO: 6223794 - DNA, 22 bp, Homo sapiens
gatgacttagcgtcaagacatt

SEQ ID NO: 6223795 - DNA, 18 bp, Homo sapiens
gatgacttagtacaaagt

SEQ ID NO: 6223796 - DNA, 21 bp, Homo sapiens
gatgacttcccaactgcaagt

SEQ ID NO: 6223797 - DNA, 23 bp, Homo sapiens
gatgacttgttcatttttctctc

SEQ ID NO: 6223798 - DNA, 20 bp, Homo sapiens
gatgactttgcagatggaaa

SEQ ID NO: 6223799 - DNA, 18 bp, Homo sapiens
gatgactttttttctgat

SEQ ID NO: 6223800 - DNA, 17 bp, Homo sapiens
gatgagaaacagctcag

SEQ ID NO: 6223801 - DNA, 13 bp, Homo sapiens
gatgagaaagctt

SEQ ID NO: 6223802 - DNA, 22 bp, Homo sapiens
gatgagaacaaagctgttaaac

SEQ ID NO: 6223803 - DNA, 13 bp, Homo sapiens
gatgagaagacta

SEQ ID NO: 6223804 - DNA, 13 bp, Homo sapiens
gatgagaagccag

SEQ ID NO: 6223805 - DNA, 18 bp, Homo sapiens
gatgagaagttaagcagc

SEQ ID NO: 6223806 - DNA, 22 bp, Homo sapiens
gatgagaatttctaaaaagatt

SEQ ID NO: 6223807 - DNA, 21 bp, Homo sapiens
gatgagacagacattcacctg

SEQ ID NO: 6223808 - DNA, 17 bp, Homo sapiens
gatgagacagggttttt

SEQ ID NO: 6223809 - DNA, 15 bp, Homo sapiens
gatgagacccagccc

SEQ ID NO: 6223810 - DNA, 13 bp, Homo sapiens
gatgagacctggg

SEQ ID NO: 6223811 - DNA, 23 bp, Homo sapiens
gatgagacttccaaacctgacag

SEQ ID NO: 6223812 - DNA, 15 bp, Homo sapiens
gatgagagcccagag

SEQ ID NO: 6223813 - DNA, 17 bp, Homo sapiens
gatgagagcccagaggt

SEQ ID NO: 6223814 - DNA, 15 bp, Homo sapiens
gatgagagtggctta

SEQ ID NO: 6223815 - DNA, 13 bp, Homo sapiens
gatgagagttttg

SEQ ID NO: 6223816 - DNA, 18 bp, Homo sapiens
gatgagagttttggatgc

SEQ ID NO: 6223817 - DNA, 19 bp, Homo sapiens
gatgagataatatgagatt

SEQ ID NO: 6223818 - DNA, 15 bp, Homo sapiens
gatgagatccgggag

SEQ ID NO: 6223819 - DNA, 21 bp, Homo sapiens
gatgagatcctcaaaaatcat

SEQ ID NO: 6223820 - DNA, 20 bp, Homo sapiens
gatgagatttgccagcacag

SEQ ID NO: 6223821 - DNA, 18 bp, Homo sapiens
gatgagcaaccacattta

SEQ ID NO: 6223822 - DNA, 17 bp, Homo sapiens
gatgagcactcctgatt

SEQ ID NO: 6223823 - DNA, 20 bp, Homo sapiens
gatgagcagtcacactgtta

SEQ ID NO: 6223824 - DNA, 12 bp, Homo sapiens
gatgagcattta

SEQ ID NO: 6223825 - DNA, 18 bp, Homo sapiens
gatgagcatttagggcaa

SEQ ID NO: 6223826 - DNA, 21 bp, Homo sapiens
gatgagcatttagggcaagga

SEQ ID NO: 6223827 - DNA, 20 bp, Homo sapiens
gatgagcccagccctgttct

SEQ ID NO: 6223828 - DNA, 16 bp, Homo sapiens
gatgagccccacgtgg

SEQ ID NO: 6223829 - DNA, 23 bp, Homo sapiens
gatgagccgctgtgagcccctgg

SEQ ID NO: 6223830 - DNA, 22 bp, Homo sapiens
gatgagcctctccttgccccag

SEQ ID NO: 6223831 - DNA, 16 bp, Homo sapiens
gatgagcgccacctct

SEQ ID NO: 6223832 - DNA, 20 bp, Homo sapiens
gatgagctcccacaagcctg

SEQ ID NO: 6223833 - DNA, 23 bp, Homo sapiens
gatgagctcccacaagcctgagg

SEQ ID NO: 6223834 - DNA, 11 bp, Homo sapiens
gatgagctcta

SEQ ID NO: 6223835 - DNA, 14 bp, Homo sapiens
gatgagctggtttg

SEQ ID NO: 6223836 - DNA, 21 bp, Homo sapiens
gatgaggaaacaggcctcaag

SEQ ID NO: 6223837 - DNA, 13 bp, Homo sapiens
gatgaggacagag

SEQ ID NO: 6223838 - DNA, 13 bp, Homo sapiens
gatgaggagcagc

SEQ ID NO: 6223839 - DNA, 22 bp, Homo sapiens
gatgaggagtaaaattcagttt

SEQ ID NO: 6223840 - DNA, 14 bp, Homo sapiens
gatgaggcatttta

SEQ ID NO: 6223841 - DNA, 15 bp, Homo sapiens
gatgaggccagacca

SEQ ID NO: 6223842 - DNA, 21 bp, Homo sapiens
gatgaggccctccacacctgc

SEQ ID NO: 6223843 - DNA, 22 bp, Homo sapiens
gatgaggccctccacacctgcg

SEQ ID NO: 6223844 - DNA, 21 bp, Homo sapiens
gatgaggccgcggcctccccg

SEQ ID NO: 6223845 - DNA, 23 bp, Homo sapiens
gatgaggcctcttggacctctgc

SEQ ID NO: 6223846 - DNA, 21 bp, Homo sapiens
gatgaggctggataggagagg

SEQ ID NO: 6223847 - DNA, 17 bp, Homo sapiens
gatgaggctggtgacgt

SEQ ID NO: 6223848 - DNA, 13 bp, Homo sapiens
gatgaggcttctt

SEQ ID NO: 6223849 - DNA, 21 bp, Homo sapiens
gatgaggcttcttcctggatg

SEQ ID NO: 6223850 - DNA, 21 bp, Homo sapiens
gatgagggaaaagaaaaagat

SEQ ID NO: 6223851 - DNA, 16 bp, Homo sapiens
gatgagggatgggcct

SEQ ID NO: 6223852 - DNA, 13 bp, Homo sapiens
gatgagggcagca

SEQ ID NO: 6223853 - DNA, 14 bp, Homo sapiens
gatgagggcagcag

SEQ ID NO: 6223854 - DNA, 18 bp, Homo sapiens
gatgagggcagcagccag

SEQ ID NO: 6223855 - DNA, 14 bp, Homo sapiens
gatgagggcatgtg

SEQ ID NO: 6223856 - DNA, 17 bp, Homo sapiens
gatgaggggccactgac

SEQ ID NO: 6223857 - DNA, 21 bp, Homo sapiens
gatgagggggaattcctggaa

SEQ ID NO: 6223858 - DNA, 23 bp, Homo sapiens
gatgagggttcatcatccctccc

SEQ ID NO: 6223859 - DNA, 18 bp, Homo sapiens
gatgaggtcaccagggga

SEQ ID NO: 6223860 - DNA, 14 bp, Homo sapiens
gatgaggttgagct

SEQ ID NO: 6223861 - DNA, 21 bp, Homo sapiens
gatgaggttgagctatgatat

SEQ ID NO: 6223862 - DNA, 19 bp, Homo sapiens
gatgagtaaactgaggccc

SEQ ID NO: 6223863 - DNA, 17 bp, Homo sapiens
gatgagtgtaacaagaa

SEQ ID NO: 6223864 - DNA, 18 bp, Homo sapiens
gatgagtgtaacaagaaa

SEQ ID NO: 6223865 - DNA, 20 bp, Homo sapiens
gatgagtgtaacaagaaagg

SEQ ID NO: 6223866 - DNA, 13 bp, Homo sapiens
gatgagttattat

SEQ ID NO: 6223867 - DNA, 18 bp, Homo sapiens
gatgagttgcagttttta

SEQ ID NO: 6223868 - DNA, 24 bp, Homo sapiens
gatgagtttcactgtactgcatgt

SEQ ID NO: 6223869 - DNA, 20 bp, Homo sapiens
gatgataaaaggagaataag

SEQ ID NO: 6223870 - DNA, 19 bp, Homo sapiens
gatgataacctaacactat

SEQ ID NO: 6223871 - DNA, 20 bp, Homo sapiens
gatgataagttcctttcctt

SEQ ID NO: 6223872 - DNA, 18 bp, Homo sapiens
gaatccagctgggctaga

SEQ ID NO: 6223873 - DNA, 16 bp, Homo sapiens
gaatccagtttctttc

SEQ ID NO: 6223874 - DNA, 17 bp, Homo sapiens
gaatccagtttctttcc

SEQ ID NO: 6223875 - DNA, 20 bp, Homo sapiens
gaatccataaatgtgttcct

SEQ ID NO: 6223876 - DNA, 15 bp, Homo sapiens
gaatccatatcagct

SEQ ID NO: 6223877 - DNA, 19 bp, Homo sapiens
gaatccatatttcaacaga

SEQ ID NO: 6223878 - DNA, 14 bp, Homo sapiens
gaatccattgaaag

SEQ ID NO: 6223879 - DNA, 20 bp, Homo sapiens
gaatccattgaactggaaga

SEQ ID NO: 6223880 - DNA, 19 bp, Homo sapiens
gaatcccagccccctgacc

SEQ ID NO: 6223881 - DNA, 22 bp, Homo sapiens
gaatcccagccccctgaccact

SEQ ID NO: 6223882 - DNA, 13 bp, Homo sapiens
gaatcccagccgg

SEQ ID NO: 6223883 - DNA, 15 bp, Homo sapiens
gaatcccagccggcc

SEQ ID NO: 6223884 - DNA, 13 bp, Homo sapiens
gaatcccccaggg

SEQ ID NO: 6223885 - DNA, 16 bp, Homo sapiens
gaatcccctccctgtc

SEQ ID NO: 6223886 - DNA, 15 bp, Homo sapiens
gaatcccctggggag

SEQ ID NO: 6223887 - DNA, 18 bp, Homo sapiens
gaatcccggcggaaagcc

SEQ ID NO: 6223888 - DNA, 18 bp, Homo sapiens
gaatcccggctccagagc

SEQ ID NO: 6223889 - DNA, 20 bp, Homo sapiens
gaatccctagactttaggct

SEQ ID NO: 6223890 - DNA, 12 bp, Homo sapiens
gaatccctgcag

SEQ ID NO: 6223891 - DNA, 18 bp, Homo sapiens
gaatccctgttcattgta

SEQ ID NO: 6223892 - DNA, 15 bp, Homo sapiens
gaatcccttaaaatt

SEQ ID NO: 6223893 - DNA, 16 bp, Homo sapiens
gaatcccttaaaatta

SEQ ID NO: 6223894 - DNA, 16 bp, Homo sapiens
gaatcccttaacagtt

SEQ ID NO: 6223895 - DNA, 21 bp, Homo sapiens
gaatcccttaacagttgtatt

SEQ ID NO: 6223896 - DNA, 14 bp, Homo sapiens
gaatcctcagagag

SEQ ID NO: 6223897 - DNA, 18 bp, Homo sapiens
gaatcctcagttggaatc

SEQ ID NO: 6223898 - DNA, 19 bp, Homo sapiens
gaatcctcagttggaatca

SEQ ID NO: 6223899 - DNA, 13 bp, Homo sapiens
gaatcctgctgcc

SEQ ID NO: 6223900 - DNA, 17 bp, Homo sapiens
gaatcctgctgccagag

SEQ ID NO: 6223901 - DNA, 18 bp, Homo sapiens
gaatcctgctttacagga

SEQ ID NO: 6223902 - DNA, 12 bp, Homo sapiens
gaatcctggcag

SEQ ID NO: 6223903 - DNA, 13 bp, Homo sapiens
gaatcctggcagc

SEQ ID NO: 6223904 - DNA, 16 bp, Homo sapiens
gaatcctggcagccca

SEQ ID NO: 6223905 - DNA, 13 bp, Homo sapiens
gaatcctgggccc

SEQ ID NO: 6223906 - DNA, 14 bp, Homo sapiens
gaatcctgggcccc

SEQ ID NO: 6223907 - DNA, 16 bp, Homo sapiens
gaatcctgggccccca

SEQ ID NO: 6223908 - DNA, 21 bp, Homo sapiens
gaatcctgggcccccagagac

SEQ ID NO: 6223909 - DNA, 14 bp, Homo sapiens
gaatcctgtcgatt

SEQ ID NO: 6223910 - DNA, 17 bp, Homo sapiens
gaatccttactgatatt

SEQ ID NO: 6223911 - DNA, 13 bp, Homo sapiens
gaatccttagaat

SEQ ID NO: 6223912 - DNA, 14 bp, Homo sapiens
gaatcctttacatt

SEQ ID NO: 6223913 - DNA, 12 bp, Homo sapiens
gaatcctttcag

SEQ ID NO: 6223914 - DNA, 13 bp, Homo sapiens
gaatcctttgtac

SEQ ID NO: 6223915 - DNA, 18 bp, Homo sapiens
gaatcgacctcactgtca

SEQ ID NO: 6223916 - DNA, 18 bp, Homo sapiens
gaatcgatctgtactgta

SEQ ID NO: 6223917 - DNA, 16 bp, Homo sapiens
gaatcgcaagttaact

SEQ ID NO: 6223918 - DNA, 16 bp, Homo sapiens
gaatcgcagctgtggg

SEQ ID NO: 6223919 - DNA, 20 bp, Homo sapiens
gaatcgctcctgcagcccca

SEQ ID NO: 6223920 - DNA, 15 bp, Homo sapiens
gaatcggaatctctg

SEQ ID NO: 6223921 - DNA, 19 bp, Homo sapiens
gaatcggcagtattttctg

SEQ ID NO: 6223922 - DNA, 21 bp, Homo sapiens
gaatcgtccctatatcagggc

SEQ ID NO: 6223923 - DNA, 19 bp, Homo sapiens
gaatcgtttttgctgcaga

SEQ ID NO: 6223924 - DNA, 20 bp, Homo sapiens
gaatcgtttttgctgcagag

SEQ ID NO: 6223925 - DNA, 21 bp, Homo sapiens
gaatcgtttttgctgcagaga

SEQ ID NO: 6223926 - DNA, 13 bp, Homo sapiens
gaatctaaaataa

SEQ ID NO: 6223927 - DNA, 21 bp, Homo sapiens
gaatctaaacgtggtcacctt

SEQ ID NO: 6223928 - DNA, 17 bp, Homo sapiens
gaatctaagctgtttgc

SEQ ID NO: 6223929 - DNA, 18 bp, Homo sapiens
gaatctaagctgtttgcc

SEQ ID NO: 6223930 - DNA, 18 bp, Homo sapiens
gaatctaaggataatgaa

SEQ ID NO: 6223931 - DNA, 15 bp, Homo sapiens
gaatctacctgtggt

SEQ ID NO: 6223932 - DNA, 12 bp, Homo sapiens
gaatctagaaat

SEQ ID NO: 6223933 - DNA, 14 bp, Homo sapiens
gaatctagaaatgt

SEQ ID NO: 6223934 - DNA, 14 bp, Homo sapiens
gaatctagaagaaa

SEQ ID NO: 6223935 - DNA, 18 bp, Homo sapiens
gaatctagaagaaatgaa

SEQ ID NO: 6223936 - DNA, 15 bp, Homo sapiens
gaatctagaagatgt

SEQ ID NO: 6223937 - DNA, 16 bp, Homo sapiens
gaatctagaagatgtg

SEQ ID NO: 6223938 - DNA, 14 bp, Homo sapiens
gaatctagaggagg

SEQ ID NO: 6223939 - DNA, 18 bp, Homo sapiens
gaatctagccagtgaaca

SEQ ID NO: 6223940 - DNA, 17 bp, Homo sapiens
gaatctagcccaaccta

SEQ ID NO: 6223941 - DNA, 21 bp, Homo sapiens
gaatctaggccaccccaacct

SEQ ID NO: 6223942 - DNA, 18 bp, Homo sapiens
gaatctagggagggggaa

SEQ ID NO: 6223943 - DNA, 21 bp, Homo sapiens
gaatctataagtagtaaatca

SEQ ID NO: 6223944 - DNA, 21 bp, Homo sapiens
gaatctatctgcttatgcagt

SEQ ID NO: 6223945 - DNA, 19 bp, Homo sapiens
gaatctatgccaaagatca

SEQ ID NO: 6223946 - DNA, 15 bp, Homo sapiens
gaatctatttaagta

SEQ ID NO: 6223947 - DNA, 16 bp, Homo sapiens
gaatctcaatgtacat

SEQ ID NO: 6223948 - DNA, 12 bp, Homo sapiens
gaatctcagcac

SEQ ID NO: 6223949 - DNA, 23 bp, Homo sapiens
gaatctcagttgattttctggat

SEQ ID NO: 6223950 - DNA, 16 bp, Homo sapiens
gaatctcataattgga

SEQ ID NO: 6223951 - DNA, 18 bp, Homo sapiens
gaatctcataattggaat

SEQ ID NO: 6223952 - DNA, 19 bp, Homo sapiens
gaatctcataatttataca

SEQ ID NO: 6223953 - DNA, 14 bp, Homo sapiens
gaatctcatccctc

SEQ ID NO: 6223954 - DNA, 15 bp, Homo sapiens
gaatctcatccctca

SEQ ID NO: 6223955 - DNA, 15 bp, Homo sapiens
gaatctcattactgc

SEQ ID NO: 6223956 - DNA, 15 bp, Homo sapiens
gaatctcccaaggag

SEQ ID NO: 6223957 - DNA, 19 bp, Homo sapiens
gaatctcccaaggagggca

SEQ ID NO: 6223958 - DNA, 20 bp, Homo sapiens
gaatctcccagacttgtttc

SEQ ID NO: 6223959 - DNA, 12 bp, Homo sapiens
gaatctcccctc

SEQ ID NO: 6223960 - DNA, 19 bp, Homo sapiens
gaatctcccctcctcacag

SEQ ID NO: 6223961 - DNA, 14 bp, Homo sapiens
gaatctccttgttg

SEQ ID NO: 6223962 - DNA, 18 bp, Homo sapiens
gaatctctaaaatgctgt

SEQ ID NO: 6223963 - DNA, 19 bp, Homo sapiens
gaatctctatgtatattct

SEQ ID NO: 6223964 - DNA, 16 bp, Homo sapiens
gaatctctcaaaatgt

SEQ ID NO: 6223965 - DNA, 20 bp, Homo sapiens
gaatctctctactcagatga

SEQ ID NO: 6223966 - DNA, 18 bp, Homo sapiens
gaatctctgaatttgaga

SEQ ID NO: 6223967 - DNA, 13 bp, Homo sapiens
gaatctctgcccc

SEQ ID NO: 6223968 - DNA, 15 bp, Homo sapiens
gaatctctgcccctc

SEQ ID NO: 6223969 - DNA, 14 bp, Homo sapiens
gaatctctgcctct

SEQ ID NO: 6223970 - DNA, 13 bp, Homo sapiens
gaatctctgtgcc

SEQ ID NO: 6223971 - DNA, 13 bp, Homo sapiens
gaatctcttcact

SEQ ID NO: 6223972 - DNA, 17 bp, Homo sapiens
gaatctcttcatgcttg

SEQ ID NO: 6223973 - DNA, 21 bp, Homo sapiens
gaatctcttcatgcttgacat

SEQ ID NO: 6223974 - DNA, 14 bp, Homo sapiens
gaatctcttttctg

SEQ ID NO: 6223975 - DNA, 18 bp, Homo sapiens
gaatctctttttgctttc

SEQ ID NO: 6223976 - DNA, 13 bp, Homo sapiens
gaatctgaatgta

SEQ ID NO: 6223977 - DNA, 15 bp, Homo sapiens
gaatctgaccacaga

SEQ ID NO: 6223978 - DNA, 12 bp, Homo sapiens
gaatctgaggca

SEQ ID NO: 6223979 - DNA, 23 bp, Homo sapiens
gaatctgatctttttatacacaa

SEQ ID NO: 6223980 - DNA, 19 bp, Homo sapiens
gaatctgcctgtggccttg

SEQ ID NO: 6223981 - DNA, 12 bp, Homo sapiens
gaatctgccttc

SEQ ID NO: 6223982 - DNA, 18 bp, Homo sapiens
gaatctgccttccagccc

SEQ ID NO: 6223983 - DNA, 13 bp, Homo sapiens
gaatctgctcact

SEQ ID NO: 6223984 - DNA, 15 bp, Homo sapiens
gaatctgctcacttt

SEQ ID NO: 6223985 - DNA, 13 bp, Homo sapiens
gaatctgctccaa

SEQ ID NO: 6223986 - DNA, 17 bp, Homo sapiens
gaatctgctgagaggca

SEQ ID NO: 6223987 - DNA, 22 bp, Homo sapiens
gaatctgctgagaggcaccagt

SEQ ID NO: 6223988 - DNA, 22 bp, Homo sapiens
gaatctggaccccatctgtgaa

SEQ ID NO: 6223989 - DNA, 16 bp, Homo sapiens
gaatctgggggtgagg

SEQ ID NO: 6223990 - DNA, 17 bp, Homo sapiens
gaatctgggggtgagga

SEQ ID NO: 6223991 - DNA, 17 bp, Homo sapiens
gaatctgtatgattcta

SEQ ID NO: 6223992 - DNA, 23 bp, Homo sapiens
gaatctgtctcccagttatgaat

SEQ ID NO: 6223993 - DNA, 16 bp, Homo sapiens
gaatctgtgcagatga

SEQ ID NO: 6223994 - DNA, 23 bp, Homo sapiens
gaatctgtgcagatgagcagtca

SEQ ID NO: 6223995 - DNA, 20 bp, Homo sapiens
gaatctgtgcagtcatcaac

SEQ ID NO: 6223996 - DNA, 20 bp, Homo sapiens
gaatctgtgggtctgggagt

SEQ ID NO: 6223997 - DNA, 23 bp, Homo sapiens
gaatctgtgtggtacaaacctgc

SEQ ID NO: 6223998 - DNA, 12 bp, Homo sapiens
gaatctgttact

SEQ ID NO: 6223999 - DNA, 15 bp, Homo sapiens
gaatctgttactgaa

SEQ ID NO: 6224000 - DNA, 13 bp, Homo sapiens
gaatctgtttctc

SEQ ID NO: 6224001 - DNA, 14 bp, Homo sapiens
gaatctgtttctct

SEQ ID NO: 6224002 - DNA, 18 bp, Homo sapiens
gaatctgtttctctgctg

SEQ ID NO: 6224003 - DNA, 20 bp, Homo sapiens
gaatcttaaggtctaactgt

SEQ ID NO: 6224004 - DNA, 22 bp, Homo sapiens
gaatcttaaggtgtagccacac

SEQ ID NO: 6224005 - DNA, 18 bp, Homo sapiens
gaatcttaatgcttgtaa

SEQ ID NO: 6224006 - DNA, 20 bp, Homo sapiens
gaatcttatttttcctgtcc

SEQ ID NO: 6224007 - DNA, 21 bp, Homo sapiens
gaatcttatttttcctgtcct

SEQ ID NO: 6224008 - DNA, 16 bp, Homo sapiens
gaatcttcacctcaga

SEQ ID NO: 6224009 - DNA, 17 bp, Homo sapiens
gaatcttcacctcagag

SEQ ID NO: 6224010 - DNA, 22 bp, Homo sapiens
gaatcttcacgacaatgttgag

SEQ ID NO: 6224011 - DNA, 15 bp, Homo sapiens
gaatcttcactagaa

SEQ ID NO: 6224012 - DNA, 17 bp, Homo sapiens
gaatcttccatctgcat

SEQ ID NO: 6224013 - DNA, 22 bp, Homo sapiens
gaatcttctcatcttttatcta

SEQ ID NO: 6224014 - DNA, 16 bp, Homo sapiens
gaatcttctccagtat

SEQ ID NO: 6224015 - DNA, 14 bp, Homo sapiens
gaatcttctgggta

SEQ ID NO: 6224016 - DNA, 20 bp, Homo sapiens
gaatcttgaggaataaatgc

SEQ ID NO: 6224017 - DNA, 20 bp, Homo sapiens
gaatcttggtttgccttcca

SEQ ID NO: 6224018 - DNA, 23 bp, Homo sapiens
gaatcttggtttgccttccagaa

SEQ ID NO: 6224019 - DNA, 13 bp, Homo sapiens
gaatcttgtctca

SEQ ID NO: 6224020 - DNA, 15 bp, Homo sapiens
gaatcttgtctcaat

SEQ ID NO: 6224021 - DNA, 21 bp, Homo sapiens
gaatcttgtctcaatgctcat

SEQ ID NO: 6224022 - DNA, 19 bp, Homo sapiens
gaatctttaaaagatgctt

SEQ ID NO: 6224023 - DNA, 22 bp, Homo sapiens
gaatctttattgagaaagagca

SEQ ID NO: 6224024 - DNA, 18 bp, Homo sapiens
gaatctttcatacatata

SEQ ID NO: 6224025 - DNA, 11 bp, Homo sapiens
gaatctttctc

SEQ ID NO: 6224026 - DNA, 14 bp, Homo sapiens
gaatctttctcctg

SEQ ID NO: 6224027 - DNA, 17 bp, Homo sapiens
gaatctttctcctggtg

SEQ ID NO: 6224028 - DNA, 15 bp, Homo sapiens
gaatctttggtcttc

SEQ ID NO: 6224029 - DNA, 15 bp, Homo sapiens
gaatcttttataatg

SEQ ID NO: 6224030 - DNA, 19 bp, Homo sapiens
gaatcttttttttatataa

SEQ ID NO: 6224031 - DNA, 14 bp, Homo sapiens
gaatgaaaaatgaa

SEQ ID NO: 6224032 - DNA, 20 bp, Homo sapiens
gaatgaaaaatttaagcatt

SEQ ID NO: 6224033 - DNA, 15 bp, Homo sapiens
gaatgaaaactcatt

SEQ ID NO: 6224034 - DNA, 13 bp, Homo sapiens
gaatgaaaagaca

SEQ ID NO: 6224035 - DNA, 20 bp, Homo sapiens
gaatgaaaagacaagaaaat

SEQ ID NO: 6224036 - DNA, 13 bp, Homo sapiens
gaatgaaaataac

SEQ ID NO: 6224037 - DNA, 15 bp, Homo sapiens
gaatgaaaattagat

SEQ ID NO: 6224038 - DNA, 16 bp, Homo sapiens
gaatgaaacccccaca

SEQ ID NO: 6224039 - DNA, 19 bp, Homo sapiens
gaatgaaacccccacacac

SEQ ID NO: 6224040 - DNA, 22 bp, Homo sapiens
gaatgaaagagtaaaggaaatg

SEQ ID NO: 6224041 - DNA, 19 bp, Homo sapiens
gaatgaaagggcccagaga

SEQ ID NO: 6224042 - DNA, 15 bp, Homo sapiens
gaatgaaatactgtt

SEQ ID NO: 6224043 - DNA, 19 bp, Homo sapiens
gaatgaaatataaactgtg

SEQ ID NO: 6224044 - DNA, 21 bp, Homo sapiens
gaatgaaatataaactgtgag

SEQ ID NO: 6224045 - DNA, 24 bp, Homo sapiens
gaatgaaatataaactgtgagata

SEQ ID NO: 6224046 - DNA, 21 bp, Homo sapiens
gaatgaaattcctccttcccc

SEQ ID NO: 6224047 - DNA, 16 bp, Homo sapiens
gaatgaacaaagacca

SEQ ID NO: 6224048 - DNA, 13 bp, Homo sapiens
gaatgaacaacct

SEQ ID NO: 6224049 - DNA, 18 bp, Homo sapiens
gaatgaacaacctcggct

SEQ ID NO: 6224050 - DNA, 20 bp, Homo sapiens
gaatgaacactcttttgctt

SEQ ID NO: 6224051 - DNA, 15 bp, Homo sapiens
gaatgaaccactgcc

SEQ ID NO: 6224052 - DNA, 15 bp, Homo sapiens
gaatgaaccatggca

SEQ ID NO: 6224053 - DNA, 17 bp, Homo sapiens
gatgatacagtgttttt

SEQ ID NO: 6224054 - DNA, 20 bp, Homo sapiens
gatgatacagtgttttttag

SEQ ID NO: 6224055 - DNA, 22 bp, Homo sapiens
gatgatactgactttttaaatt

SEQ ID NO: 6224056 - DNA, 18 bp, Homo sapiens
gatgatagaggattttat

SEQ ID NO: 6224057 - DNA, 14 bp, Homo sapiens
gatgatatacacag

SEQ ID NO: 6224058 - DNA, 17 bp, Homo sapiens
gatgatatacacagtgg

SEQ ID NO: 6224059 - DNA, 19 bp, Homo sapiens
gatgatcaatcctttatta

SEQ ID NO: 6224060 - DNA, 13 bp, Homo sapiens
gatgatcaattat

SEQ ID NO: 6224061 - DNA, 20 bp, Homo sapiens
gatgatcagctgtttgtcat

SEQ ID NO: 6224062 - DNA, 22 bp, Homo sapiens
gatgatccatgagtttgccctg

SEQ ID NO: 6224063 - DNA, 22 bp, Homo sapiens
gatgatcccagtcactcctctc

SEQ ID NO: 6224064 - DNA, 21 bp, Homo sapiens
gatgatccccacgccacagcc

SEQ ID NO: 6224065 - DNA, 11 bp, Homo sapiens
gatgatccttg

SEQ ID NO: 6224066 - DNA, 15 bp, Homo sapiens
gatgatctaggaaga

SEQ ID NO: 6224067 - DNA, 21 bp, Homo sapiens
gatgatctaggaagactttgg

SEQ ID NO: 6224068 - DNA, 22 bp, Homo sapiens
gatgatgattttaacagtttta

SEQ ID NO: 6224069 - DNA, 14 bp, Homo sapiens
gatgatgctgccag

SEQ ID NO: 6224070 - DNA, 16 bp, Homo sapiens
gatgatgctttggaag

SEQ ID NO: 6224071 - DNA, 15 bp, Homo sapiens
gatgatggaaacgca

SEQ ID NO: 6224072 - DNA, 19 bp, Homo sapiens
gatgatggaaacgcactta

SEQ ID NO: 6224073 - DNA, 17 bp, Homo sapiens
gatgatggcagagccag

SEQ ID NO: 6224074 - DNA, 17 bp, Homo sapiens
gatgatgggaattgtgt

SEQ ID NO: 6224075 - DNA, 12 bp, Homo sapiens
gatgatgggatt

SEQ ID NO: 6224076 - DNA, 21 bp, Homo sapiens
gatgatggggtcagcaggccc

SEQ ID NO: 6224077 - DNA, 15 bp, Homo sapiens
gatgatggtgttggt

SEQ ID NO: 6224078 - DNA, 17 bp, Homo sapiens
gatgatggtgttggtga

SEQ ID NO: 6224079 - DNA, 20 bp, Homo sapiens
gatgatgtctcttgtagaag

SEQ ID NO: 6224080 - DNA, 13 bp, Homo sapiens
gatgatgttctga

SEQ ID NO: 6224081 - DNA, 17 bp, Homo sapiens
gatgatgttttgatatt

SEQ ID NO: 6224082 - DNA, 16 bp, Homo sapiens
gatgattaaaggcagc

SEQ ID NO: 6224083 - DNA, 23 bp, Homo sapiens
gatgattaaataagattctaacg

SEQ ID NO: 6224084 - DNA, 20 bp, Homo sapiens
gatgattaatacaatattaa

SEQ ID NO: 6224085 - DNA, 23 bp, Homo sapiens
gatgattcaaatatcaaaaggaa

SEQ ID NO: 6224086 - DNA, 13 bp, Homo sapiens
gatgattcaagcc

SEQ ID NO: 6224087 - DNA, 15 bp, Homo sapiens
gatgattcaggtgca

SEQ ID NO: 6224088 - DNA, 22 bp, Homo sapiens
gatgattcttaacacagccttc

SEQ ID NO: 6224089 - DNA, 19 bp, Homo sapiens
gatgattgaagaaacagct

SEQ ID NO: 6224090 - DNA, 17 bp, Homo sapiens
gatgattgttcataata

SEQ ID NO: 6224091 - DNA, 19 bp, Homo sapiens
gatgatttcatcttctgga

SEQ ID NO: 6224092 - DNA, 19 bp, Homo sapiens
gatgatttccgtcatgctc

SEQ ID NO: 6224093 - DNA, 18 bp, Homo sapiens
gatgatttggtcagattg

SEQ ID NO: 6224094 - DNA, 14 bp, Homo sapiens
gatgattttaatat

SEQ ID NO: 6224095 - DNA, 19 bp, Homo sapiens
gatgattttcatttcatga

SEQ ID NO: 6224096 - DNA, 15 bp, Homo sapiens
gatgattttgtaatt

SEQ ID NO: 6224097 - DNA, 20 bp, Homo sapiens
gatgatttttaagtacaaaa

SEQ ID NO: 6224098 - DNA, 14 bp, Homo sapiens
gatgatttttgtca

SEQ ID NO: 6224099 - DNA, 19 bp, Homo sapiens
gatgattttttaagcagac

SEQ ID NO: 6224100 - DNA, 20 bp, Homo sapiens
gatgattttttaaggagctg

SEQ ID NO: 6224101 - DNA, 14 bp, Homo sapiens
gatgcaaagaggca

SEQ ID NO: 6224102 - DNA, 16 bp, Homo sapiens
gatgcaaagaggcaag

SEQ ID NO: 6224103 - DNA, 18 bp, Homo sapiens
gatgcaaagtacaatgtg

SEQ ID NO: 6224104 - DNA, 22 bp, Homo sapiens
gatgcaaatagattcagagaaa

SEQ ID NO: 6224105 - DNA, 23 bp, Homo sapiens
gatgcaaatagattcagagaaat

SEQ ID NO: 6224106 - DNA, 17 bp, Homo sapiens
gatgcaagatatttata

SEQ ID NO: 6224107 - DNA, 14 bp, Homo sapiens
gatgcaagccagct

SEQ ID NO: 6224108 - DNA, 14 bp, Homo sapiens
gatgcaaggaccag

SEQ ID NO: 6224109 - DNA, 18 bp, Homo sapiens
gatgcaaggattacagaa

SEQ ID NO: 6224110 - DNA, 15 bp, Homo sapiens
gatgcaaggtgctgg

SEQ ID NO: 6224111 - DNA, 18 bp, Homo sapiens
gatgcaagttattttatt

SEQ ID NO: 6224112 - DNA, 19 bp, Homo sapiens
gatgcaatccttacaaatg

SEQ ID NO: 6224113 - DNA, 20 bp, Homo sapiens
gatgcaatccttacaaatga

SEQ ID NO: 6224114 - DNA, 13 bp, Homo sapiens
gatgcaatgaaca

SEQ ID NO: 6224115 - DNA, 18 bp, Homo sapiens
gatgcaatgtgctactga

SEQ ID NO: 6224116 - DNA, 16 bp, Homo sapiens
gatgcacacacagata

SEQ ID NO: 6224117 - DNA, 22 bp, Homo sapiens
gatgcacagagttgttacattt

SEQ ID NO: 6224118 - DNA, 15 bp, Homo sapiens
gatgcacagatgcca

SEQ ID NO: 6224119 - DNA, 19 bp, Homo sapiens
gatgcacagatgccatggc

SEQ ID NO: 6224120 - DNA, 20 bp, Homo sapiens
gatgcacagtatctgctgtt

SEQ ID NO: 6224121 - DNA, 22 bp, Homo sapiens
gatgcacagtatctgctgttct

SEQ ID NO: 6224122 - DNA, 22 bp, Homo sapiens
gatgcacagtgcctgatgggag

SEQ ID NO: 6224123 - DNA, 17 bp, Homo sapiens
gatgcacatttctggat

SEQ ID NO: 6224124 - DNA, 19 bp, Homo sapiens
gatgcacatttctggattg

SEQ ID NO: 6224125 - DNA, 20 bp, Homo sapiens
gatgcacatttctggattgt

SEQ ID NO: 6224126 - DNA, 13 bp, Homo sapiens
gatgcaccagccc

SEQ ID NO: 6224127 - DNA, 14 bp, Homo sapiens
gatgcaccagccct

SEQ ID NO: 6224128 - DNA, 23 bp, Homo sapiens
gatgcacggcggcagggtggggg

SEQ ID NO: 6224129 - DNA, 21 bp, Homo sapiens
gatgcacgtggggcccactgc

SEQ ID NO: 6224130 - DNA, 20 bp, Homo sapiens
gatgcactatatgtttacac

SEQ ID NO: 6224131 - DNA, 15 bp, Homo sapiens
gatgcactggcctgt

SEQ ID NO: 6224132 - DNA, 23 bp, Homo sapiens
gatgcacttattttttaatgtga

SEQ ID NO: 6224133 - DNA, 17 bp, Homo sapiens
gatgcagaggcctgcag

SEQ ID NO: 6224134 - DNA, 11 bp, Homo sapiens
gatgcagaggg

SEQ ID NO: 6224135 - DNA, 18 bp, Homo sapiens
gatgcagataaaatattt

SEQ ID NO: 6224136 - DNA, 17 bp, Homo sapiens
gatgcagcaaaatgtga

SEQ ID NO: 6224137 - DNA, 14 bp, Homo sapiens
gatgcagccgcctt

SEQ ID NO: 6224138 - DNA, 14 bp, Homo sapiens
gatgcagcctcaca

SEQ ID NO: 6224139 - DNA, 14 bp, Homo sapiens
gatgcaggacagga

SEQ ID NO: 6224140 - DNA, 16 bp, Homo sapiens
gatgcaggctcccctg

SEQ ID NO: 6224141 - DNA, 19 bp, Homo sapiens
gatgcaggctcccctgagg

SEQ ID NO: 6224142 - DNA, 14 bp, Homo sapiens
gatgcagggctgca

SEQ ID NO: 6224143 - DNA, 22 bp, Homo sapiens
gatgcaggtgagcccatggccc

SEQ ID NO: 6224144 - DNA, 23 bp, Homo sapiens
gatgcaggtggatctccttgaga

SEQ ID NO: 6224145 - DNA, 21 bp, Homo sapiens
gatgcaggttggaaggggcct

SEQ ID NO: 6224146 - DNA, 19 bp, Homo sapiens
gatgcaggtttgaccagga

SEQ ID NO: 6224147 - DNA, 21 bp, Homo sapiens
gatgcagtattgagtgttcta

SEQ ID NO: 6224148 - DNA, 20 bp, Homo sapiens
gatgcagtcctcaggaaggg

SEQ ID NO: 6224149 - DNA, 17 bp, Homo sapiens
gatgcagtctcctcttt

SEQ ID NO: 6224150 - DNA, 18 bp, Homo sapiens
gatgcagtgccctagaag

SEQ ID NO: 6224151 - DNA, 22 bp, Homo sapiens
gatgcagtgctcgctgttgctg

SEQ ID NO: 6224152 - DNA, 18 bp, Homo sapiens
gatgcagttctgaagaag

SEQ ID NO: 6224153 - DNA, 14 bp, Homo sapiens
gatgcatatagaca

SEQ ID NO: 6224154 - DNA, 14 bp, Homo sapiens
gatgcatattaaag

SEQ ID NO: 6224155 - DNA, 15 bp, Homo sapiens
gatgcatattaaaga

SEQ ID NO: 6224156 - DNA, 20 bp, Homo sapiens
gatgcatcacactcaaggac

SEQ ID NO: 6224157 - DNA, 24 bp, Homo sapiens
gatgcatcacactcaaggacagga

SEQ ID NO: 6224158 - DNA, 22 bp, Homo sapiens
gatgcatcactgggtgttgatc

SEQ ID NO: 6224159 - DNA, 19 bp, Homo sapiens
gatgcatcatctcttcctc

SEQ ID NO: 6224160 - DNA, 17 bp, Homo sapiens
gatgcatcgggaaagaa

SEQ ID NO: 6224161 - DNA, 21 bp, Homo sapiens
gatgcatcgttttctttgctg

SEQ ID NO: 6224162 - DNA, 17 bp, Homo sapiens
gatgcatctgtggcctg

SEQ ID NO: 6224163 - DNA, 20 bp, Homo sapiens
gatgcatctgtggcctgggg

SEQ ID NO: 6224164 - DNA, 17 bp, Homo sapiens
gatgcatgagctccctc

SEQ ID NO: 6224165 - DNA, 15 bp, Homo sapiens
gatgcatgatgccct

SEQ ID NO: 6224166 - DNA, 17 bp, Homo sapiens
gatgcatgatgccctcc

SEQ ID NO: 6224167 - DNA, 13 bp, Homo sapiens
gatgcatgcgcag

SEQ ID NO: 6224168 - DNA, 14 bp, Homo sapiens
gatgcatggaggac

SEQ ID NO: 6224169 - DNA, 22 bp, Homo sapiens
gatgcatgtctgccaaaatgca

SEQ ID NO: 6224170 - DNA, 17 bp, Homo sapiens
gatgcatgtcttttaaa

SEQ ID NO: 6224171 - DNA, 22 bp, Homo sapiens
gatgcatgtcttttaaaatgca

SEQ ID NO: 6224172 - DNA, 23 bp, Homo sapiens
gatgcatgtggtttggttcctct

SEQ ID NO: 6224173 - DNA, 20 bp, Homo sapiens
gatgcatgttgattaaactc

SEQ ID NO: 6224174 - DNA, 20 bp, Homo sapiens
gatgcatgttttccagctcc

SEQ ID NO: 6224175 - DNA, 17 bp, Homo sapiens
gatgcattaaaagaaaa

SEQ ID NO: 6224176 - DNA, 14 bp, Homo sapiens
gatgcatttaataa

SEQ ID NO: 6224177 - DNA, 13 bp, Homo sapiens
gatgcatttccat

SEQ ID NO: 6224178 - DNA, 21 bp, Homo sapiens
gatgcatttgggtccaggagg

SEQ ID NO: 6224179 - DNA, 10 bp, Homo sapiens
gatgcatttt

SEQ ID NO: 6224180 - DNA, 18 bp, Homo sapiens
gatgccaaaatgacttta

SEQ ID NO: 6224181 - DNA, 19 bp, Homo sapiens
gatgccaaaccacaagact

SEQ ID NO: 6224182 - DNA, 13 bp, Homo sapiens
gatgccaaagcag

SEQ ID NO: 6224183 - DNA, 20 bp, Homo sapiens
gatgccaaggaggtcccagg

SEQ ID NO: 6224184 - DNA, 16 bp, Homo sapiens
gatgccaagtggccct

SEQ ID NO: 6224185 - DNA, 22 bp, Homo sapiens
gatgccaatactagtcacccca

SEQ ID NO: 6224186 - DNA, 19 bp, Homo sapiens
gatgccaatattaaatctg

SEQ ID NO: 6224187 - DNA, 17 bp, Homo sapiens
gatgccaatttcctctc

SEQ ID NO: 6224188 - DNA, 18 bp, Homo sapiens
gatgccaatttcctctcc

SEQ ID NO: 6224189 - DNA, 15 bp, Homo sapiens
gatgccacacaagga

SEQ ID NO: 6224190 - DNA, 15 bp, Homo sapiens
gatgccacaccaagc

SEQ ID NO: 6224191 - DNA, 16 bp, Homo sapiens
gatgccacaccaagct

SEQ ID NO: 6224192 - DNA, 19 bp, Homo sapiens
gatgccacaccaagctgtg

SEQ ID NO: 6224193 - DNA, 12 bp, Homo sapiens
gatgccacagcc

SEQ ID NO: 6224194 - DNA, 15 bp, Homo sapiens
gatgccacagcccca

SEQ ID NO: 6224195 - DNA, 19 bp, Homo sapiens
gatgccacagccccacagc

SEQ ID NO: 6224196 - DNA, 22 bp, Homo sapiens
gatgccacccagcaacacagag

SEQ ID NO: 6224197 - DNA, 12 bp, Homo sapiens
gatgccacccta

SEQ ID NO: 6224198 - DNA, 16 bp, Homo sapiens
gatgccaccctagcca

SEQ ID NO: 6224199 - DNA, 18 bp, Homo sapiens
gatgccacgcctggaagg

SEQ ID NO: 6224200 - DNA, 18 bp, Homo sapiens
gatgccacttctcactca

SEQ ID NO: 6224201 - DNA, 16 bp, Homo sapiens
gatgccactttgcagc

SEQ ID NO: 6224202 - DNA, 11 bp, Homo sapiens
gatgccagagg

SEQ ID NO: 6224203 - DNA, 12 bp, Homo sapiens
gatgccagaggg

SEQ ID NO: 6224204 - DNA, 14 bp, Homo sapiens
gatgccagagggcc

SEQ ID NO: 6224205 - DNA, 15 bp, Homo sapiens
gatgccagccaagct

SEQ ID NO: 6224206 - DNA, 18 bp, Homo sapiens
gatgccagccaagctctg

SEQ ID NO: 6224207 - DNA, 16 bp, Homo sapiens
gatgccagcccctgcc

SEQ ID NO: 6224208 - DNA, 18 bp, Homo sapiens
gatgccagcccctgcctg

SEQ ID NO: 6224209 - DNA, 19 bp, Homo sapiens
gatgccagcccctgcctgg

SEQ ID NO: 6224210 - DNA, 14 bp, Homo sapiens
gatgccagcccttc

SEQ ID NO: 6224211 - DNA, 15 bp, Homo sapiens
gatgccagcccttca

SEQ ID NO: 6224212 - DNA, 23 bp, Homo sapiens
gatgccagccgggtacctcagtt

SEQ ID NO: 6224213 - DNA, 16 bp, Homo sapiens
gatgccagctgtctcc

SEQ ID NO: 6224214 - DNA, 14 bp, Homo sapiens
gatgccagctgtgt

SEQ ID NO: 6224215 - DNA, 14 bp, Homo sapiens
gatgccagcttctc

SEQ ID NO: 6224216 - DNA, 13 bp, Homo sapiens
gatgccaggtgca

SEQ ID NO: 6224217 - DNA, 13 bp, Homo sapiens
gatgccagtgaag

SEQ ID NO: 6224218 - DNA, 18 bp, Homo sapiens
gatgccataatcagaaca

SEQ ID NO: 6224219 - DNA, 15 bp, Homo sapiens
gatgccatcctcttt

SEQ ID NO: 6224220 - DNA, 18 bp, Homo sapiens
gatgccatctgtgggcac

SEQ ID NO: 6224221 - DNA, 20 bp, Homo sapiens
gatgccatctgtgtcctggt

SEQ ID NO: 6224222 - DNA, 21 bp, Homo sapiens
gatgccatctgtgtcctggtt

SEQ ID NO: 6224223 - DNA, 22 bp, Homo sapiens
gatgccatgagccgcccaaggc

SEQ ID NO: 6224224 - DNA, 12 bp, Homo sapiens
gatgccatgttt

SEQ ID NO: 6224225 - DNA, 20 bp, Homo sapiens
gatgccattcttccttgcaa

SEQ ID NO: 6224226 - DNA, 13 bp, Homo sapiens
gatgcccacccct

SEQ ID NO: 6224227 - DNA, 17 bp, Homo sapiens
gatgcccactgaggaat

SEQ ID NO: 6224228 - DNA, 11 bp, Homo sapiens
gatgcccagag

SEQ ID NO: 6224229 - DNA, 18 bp, Homo sapiens
gatgcccagagggcccag

SEQ ID NO: 6224230 - DNA, 22 bp, Homo sapiens
gatgcccagggccactctgcct

SEQ ID NO: 6224231 - DNA, 23 bp, Homo sapiens
gaatgaacccaagagcaagggct

SEQ ID NO: 6224232 - DNA, 20 bp, Homo sapiens
gaatgaacccatagggagct

SEQ ID NO: 6224233 - DNA, 19 bp, Homo sapiens
gaatgaaccctcctccttt

SEQ ID NO: 6224234 - DNA, 20 bp, Homo sapiens
gaatgaaccctcctcctttt

SEQ ID NO: 6224235 - DNA, 17 bp, Homo sapiens
gaatgaaccttctggcc

SEQ ID NO: 6224236 - DNA, 21 bp, Homo sapiens
gaatgaactgtggaatttatt

SEQ ID NO: 6224237 - DNA, 12 bp, Homo sapiens
gaatgaagacca

SEQ ID NO: 6224238 - DNA, 18 bp, Homo sapiens
gaatgaagatactgaaat

SEQ ID NO: 6224239 - DNA, 21 bp, Homo sapiens
gaatgaagatactgaaataaa

SEQ ID NO: 6224240 - DNA, 16 bp, Homo sapiens
gaatgaagcagtattt

SEQ ID NO: 6224241 - DNA, 14 bp, Homo sapiens
gaatgaagggccag

SEQ ID NO: 6224242 - DNA, 17 bp, Homo sapiens
gaatgaaggtgtcagaa

SEQ ID NO: 6224243 - DNA, 15 bp, Homo sapiens
gaatgaataaaacaa

SEQ ID NO: 6224244 - DNA, 18 bp, Homo sapiens
gaatgaatgtcagtgtga

SEQ ID NO: 6224245 - DNA, 14 bp, Homo sapiens
gaatgaattaaata

SEQ ID NO: 6224246 - DNA, 16 bp, Homo sapiens
gaatgaattaaataaa

SEQ ID NO: 6224247 - DNA, 21 bp, Homo sapiens
gaatgaccacgggcctcagtt

SEQ ID NO: 6224248 - DNA, 17 bp, Homo sapiens
gaatgaccgctctccct

SEQ ID NO: 6224249 - DNA, 21 bp, Homo sapiens
gaatgacctgcagtcagggcc

SEQ ID NO: 6224250 - DNA, 15 bp, Homo sapiens
gaatgaccttgtaat

SEQ ID NO: 6224251 - DNA, 16 bp, Homo sapiens
gaatgaccttgtaatg

SEQ ID NO: 6224252 - DNA, 21 bp, Homo sapiens
gaatgaccttgtaatgtaact

SEQ ID NO: 6224253 - DNA, 19 bp, Homo sapiens
gaatgacggtaagtgttct

SEQ ID NO: 6224254 - DNA, 20 bp, Homo sapiens
gaatgacggtaagtgttctc

SEQ ID NO: 6224255 - DNA, 21 bp, Homo sapiens
gaatgactatgtccagattgg

SEQ ID NO: 6224256 - DNA, 21 bp, Homo sapiens
gaatgactcatgcctctgagc

SEQ ID NO: 6224257 - DNA, 13 bp, Homo sapiens
gaatgactcgttt

SEQ ID NO: 6224258 - DNA, 17 bp, Homo sapiens
gaatgactgaagacagg

SEQ ID NO: 6224259 - DNA, 13 bp, Homo sapiens
gaatgacttactt

SEQ ID NO: 6224260 - DNA, 11 bp, Homo sapiens
gaatgactttt

SEQ ID NO: 6224261 - DNA, 21 bp, Homo sapiens
gaatgagacctggaacaaatc

SEQ ID NO: 6224262 - DNA, 16 bp, Homo sapiens
gaatgagactggcttg

SEQ ID NO: 6224263 - DNA, 20 bp, Homo sapiens
gaatgagagacacactgaag

SEQ ID NO: 6224264 - DNA, 11 bp, Homo sapiens
gaatgagagag

SEQ ID NO: 6224265 - DNA, 13 bp, Homo sapiens
gaatgagagagtg

SEQ ID NO: 6224266 - DNA, 16 bp, Homo sapiens
gaatgagaggttgagg

SEQ ID NO: 6224267 - DNA, 14 bp, Homo sapiens
gaatgagagtgtga

SEQ ID NO: 6224268 - DNA, 16 bp, Homo sapiens
gaatgagcattctgca

SEQ ID NO: 6224269 - DNA, 16 bp, Homo sapiens
gaatgagcccagagaa

SEQ ID NO: 6224270 - DNA, 20 bp, Homo sapiens
gaatgagcccagagaacagc

SEQ ID NO: 6224271 - DNA, 20 bp, Homo sapiens
gaatgagcctacgctgaaga

SEQ ID NO: 6224272 - DNA, 15 bp, Homo sapiens
gaatgagcctttgtg

SEQ ID NO: 6224273 - DNA, 17 bp, Homo sapiens
gaatgagcctttgtgct

SEQ ID NO: 6224274 - DNA, 12 bp, Homo sapiens
gaatgagctggg

SEQ ID NO: 6224275 - DNA, 15 bp, Homo sapiens
gaatgagctgggccc

SEQ ID NO: 6224276 - DNA, 22 bp, Homo sapiens
gaatgaggaagcaaagagtgag

SEQ ID NO: 6224277 - DNA, 20 bp, Homo sapiens
gaatgaggaggaaggagaga

SEQ ID NO: 6224278 - DNA, 20 bp, Homo sapiens
gaatgaggcacttatcagca

SEQ ID NO: 6224279 - DNA, 18 bp, Homo sapiens
gaatgagggcgtgaaaca

SEQ ID NO: 6224280 - DNA, 21 bp, Homo sapiens
gaatgagggcgtgaaacacaa

SEQ ID NO: 6224281 - DNA, 22 bp, Homo sapiens
gaatgagggcgtgaaacacaat

SEQ ID NO: 6224282 - DNA, 23 bp, Homo sapiens
gaatgagggcgtgaaacacaata

SEQ ID NO: 6224283 - DNA, 13 bp, Homo sapiens
gaatgaggggaag

SEQ ID NO: 6224284 - DNA, 16 bp, Homo sapiens
gaatgagggggctcag

SEQ ID NO: 6224285 - DNA, 15 bp, Homo sapiens
gaatgagggtttgag

SEQ ID NO: 6224286 - DNA, 17 bp, Homo sapiens
gaatgaggtcccaggca

SEQ ID NO: 6224287 - DNA, 15 bp, Homo sapiens
gaatgaggtgggagg

SEQ ID NO: 6224288 - DNA, 18 bp, Homo sapiens
gaatgagtaaataaactc

SEQ ID NO: 6224289 - DNA, 22 bp, Homo sapiens
gaatgagtaaataaactcttca

SEQ ID NO: 6224290 - DNA, 23 bp, Homo sapiens
gaatgagtaaataaactcttcaa

SEQ ID NO: 6224291 - DNA, 18 bp, Homo sapiens
gaatgagtcaatcagcct

SEQ ID NO: 6224292 - DNA, 20 bp, Homo sapiens
gaatgagtcaatcagccttt

SEQ ID NO: 6224293 - DNA, 21 bp, Homo sapiens
gaatgagtgaagtattgctga

SEQ ID NO: 6224294 - DNA, 14 bp, Homo sapiens
gaatgagtgggaat

SEQ ID NO: 6224295 - DNA, 14 bp, Homo sapiens
gaatgagtgtgcat

SEQ ID NO: 6224296 - DNA, 18 bp, Homo sapiens
gaatgagtttcttagact

SEQ ID NO: 6224297 - DNA, 12 bp, Homo sapiens
gaatgatagaac

SEQ ID NO: 6224298 - DNA, 21 bp, Homo sapiens
gaatgatagaactttgccagt

SEQ ID NO: 6224299 - DNA, 20 bp, Homo sapiens
gaatgatagcccagaacaaa

SEQ ID NO: 6224300 - DNA, 21 bp, Homo sapiens
gaatgatagtaataggataca

SEQ ID NO: 6224301 - DNA, 15 bp, Homo sapiens
gaatgatatgcattt

SEQ ID NO: 6224302 - DNA, 16 bp, Homo sapiens
gaatgatatgctagaa

SEQ ID NO: 6224303 - DNA, 16 bp, Homo sapiens
gaatgatctgattgac

SEQ ID NO: 6224304 - DNA, 13 bp, Homo sapiens
gaatgatgaagct

SEQ ID NO: 6224305 - DNA, 20 bp, Homo sapiens
gaatgatgatcctaggcatt

SEQ ID NO: 6224306 - DNA, 23 bp, Homo sapiens
gaatgatggacttttgggggttg

SEQ ID NO: 6224307 - DNA, 14 bp, Homo sapiens
gaatgattaattaa

SEQ ID NO: 6224308 - DNA, 21 bp, Homo sapiens
gaatgattcaattttttaatg

SEQ ID NO: 6224309 - DNA, 22 bp, Homo sapiens
gaatgattccctcttgctattg

SEQ ID NO: 6224310 - DNA, 23 bp, Homo sapiens
gaatgattctaatttttaagcaa

SEQ ID NO: 6224311 - DNA, 19 bp, Homo sapiens
gaatgattggttaaaatgt

SEQ ID NO: 6224312 - DNA, 20 bp, Homo sapiens
gaatgatttccaaagagaaa

SEQ ID NO: 6224313 - DNA, 21 bp, Homo sapiens
gaatgatttctatgaacttgt

SEQ ID NO: 6224314 - DNA, 15 bp, Homo sapiens
gaatgattttgacat

SEQ ID NO: 6224315 - DNA, 14 bp, Homo sapiens
gaatgatttttaga

SEQ ID NO: 6224316 - DNA, 18 bp, Homo sapiens
gaatgatttttcattggc

SEQ ID NO: 6224317 - DNA, 16 bp, Homo sapiens
gaatgatttttcttta

SEQ ID NO: 6224318 - DNA, 19 bp, Homo sapiens
gaatgcaaccaagtcacac

SEQ ID NO: 6224319 - DNA, 10 bp, Homo sapiens
gaatgcaaga

SEQ ID NO: 6224320 - DNA, 16 bp, Homo sapiens
gaatgcaagagaagga

SEQ ID NO: 6224321 - DNA, 19 bp, Homo sapiens
gaatgcaatgtttctaaat

SEQ ID NO: 6224322 - DNA, 18 bp, Homo sapiens
gaatgcacaaacagaggc

SEQ ID NO: 6224323 - DNA, 21 bp, Homo sapiens
gaatgcacacagcggctgcct

SEQ ID NO: 6224324 - DNA, 15 bp, Homo sapiens
gaatgcacagatata

SEQ ID NO: 6224325 - DNA, 17 bp, Homo sapiens
gaatgcacagatatact

SEQ ID NO: 6224326 - DNA, 18 bp, Homo sapiens
gaatgcaccatggagacg

SEQ ID NO: 6224327 - DNA, 13 bp, Homo sapiens
gaatgcacctccc

SEQ ID NO: 6224328 - DNA, 18 bp, Homo sapiens
gaatgcacctccccaaag

SEQ ID NO: 6224329 - DNA, 19 bp, Homo sapiens
gaatgcagacttttcagac

SEQ ID NO: 6224330 - DNA, 15 bp, Homo sapiens
gaatgcagagatgtg

SEQ ID NO: 6224331 - DNA, 18 bp, Homo sapiens
gaatgcagattcctgggc

SEQ ID NO: 6224332 - DNA, 19 bp, Homo sapiens
gaatgcagcccaccaggag

SEQ ID NO: 6224333 - DNA, 20 bp, Homo sapiens
gaatgcagcccaccaggagc

SEQ ID NO: 6224334 - DNA, 14 bp, Homo sapiens
gaatgcagtacaga

SEQ ID NO: 6224335 - DNA, 16 bp, Homo sapiens
gaatgcagtgggtggg

SEQ ID NO: 6224336 - DNA, 14 bp, Homo sapiens
gaatgcataaataa

SEQ ID NO: 6224337 - DNA, 16 bp, Homo sapiens
gaatgcataaataaat

SEQ ID NO: 6224338 - DNA, 21 bp, Homo sapiens
gaatgcatattcaacacactg

SEQ ID NO: 6224339 - DNA, 14 bp, Homo sapiens
gaatgcatgttctg

SEQ ID NO: 6224340 - DNA, 13 bp, Homo sapiens
gaatgcattcaaa

SEQ ID NO: 6224341 - DNA, 20 bp, Homo sapiens
gaatgcattgatattgtgaa

SEQ ID NO: 6224342 - DNA, 17 bp, Homo sapiens
gaatgccacccacatct

SEQ ID NO: 6224343 - DNA, 21 bp, Homo sapiens
gaatgccactgccttcgcttc

SEQ ID NO: 6224344 - DNA, 22 bp, Homo sapiens
gaatgccactgccttcgcttct

SEQ ID NO: 6224345 - DNA, 16 bp, Homo sapiens
gaatgccagcccaaag

SEQ ID NO: 6224346 - DNA, 16 bp, Homo sapiens
gaatgccatttctcac

SEQ ID NO: 6224347 - DNA, 23 bp, Homo sapiens
gaatgccatttctcacgccctct

SEQ ID NO: 6224348 - DNA, 19 bp, Homo sapiens
gaatgccgaatttggtaca

SEQ ID NO: 6224349 - DNA, 23 bp, Homo sapiens
gaatgccgaatttggtacacatg

SEQ ID NO: 6224350 - DNA, 21 bp, Homo sapiens
gaatgccgcgaactgggttct

SEQ ID NO: 6224351 - DNA, 16 bp, Homo sapiens
gaatgccgggcccctc

SEQ ID NO: 6224352 - DNA, 14 bp, Homo sapiens
gaatgccgtggatt

SEQ ID NO: 6224353 - DNA, 18 bp, Homo sapiens
gaatgcctaggccagctc

SEQ ID NO: 6224354 - DNA, 20 bp, Homo sapiens
gaatgcctaggccagctcct

SEQ ID NO: 6224355 - DNA, 22 bp, Homo sapiens
gaatgcctcaatgtgaccaggg

SEQ ID NO: 6224356 - DNA, 13 bp, Homo sapiens
gaatgcctcctcc

SEQ ID NO: 6224357 - DNA, 18 bp, Homo sapiens
gaatgcctcctgtgggga

SEQ ID NO: 6224358 - DNA, 12 bp, Homo sapiens
gaatgcctcgct

SEQ ID NO: 6224359 - DNA, 21 bp, Homo sapiens
gaatgcctcgctcccttcaag

SEQ ID NO: 6224360 - DNA, 19 bp, Homo sapiens
gaatgcctgagtgcctggc

SEQ ID NO: 6224361 - DNA, 11 bp, Homo sapiens
gaatgcctgga

SEQ ID NO: 6224362 - DNA, 13 bp, Homo sapiens
gaatgcctggagg

SEQ ID NO: 6224363 - DNA, 22 bp, Homo sapiens
gaatgcctgtcccagtccaaat

SEQ ID NO: 6224364 - DNA, 13 bp, Homo sapiens
gaatgcctgtgcc

SEQ ID NO: 6224365 - DNA, 19 bp, Homo sapiens
gaatgccttatttttgaat

SEQ ID NO: 6224366 - DNA, 19 bp, Homo sapiens
gaatgccttccgggccggg

SEQ ID NO: 6224367 - DNA, 22 bp, Homo sapiens
gaatgccttggaaatagaaaga

SEQ ID NO: 6224368 - DNA, 13 bp, Homo sapiens
gaatgcctttcaa

SEQ ID NO: 6224369 - DNA, 22 bp, Homo sapiens
gaatgcgctcttcaccaggaag

SEQ ID NO: 6224370 - DNA, 15 bp, Homo sapiens
gaatgcgctttattg

SEQ ID NO: 6224371 - DNA, 16 bp, Homo sapiens
gaatgcgggggagcag

SEQ ID NO: 6224372 - DNA, 19 bp, Homo sapiens
gaatgcgggggagcaggca

SEQ ID NO: 6224373 - DNA, 15 bp, Homo sapiens
gaatgcggttcaggg

SEQ ID NO: 6224374 - DNA, 20 bp, Homo sapiens
gaatgcggttgggaggcagg

SEQ ID NO: 6224375 - DNA, 16 bp, Homo sapiens
gaatgctaacagttca

SEQ ID NO: 6224376 - DNA, 19 bp, Homo sapiens
gaatgctaagccagttctt

SEQ ID NO: 6224377 - DNA, 14 bp, Homo sapiens
gaatgctagacaga

SEQ ID NO: 6224378 - DNA, 15 bp, Homo sapiens
gaatgctcaatgtgc

SEQ ID NO: 6224379 - DNA, 18 bp, Homo sapiens
gaatgctcaatgtgctgt

SEQ ID NO: 6224380 - DNA, 23 bp, Homo sapiens
gaatgctcagggtcactgaacca

SEQ ID NO: 6224381 - DNA, 19 bp, Homo sapiens
gaatgctcccagctgtgct

SEQ ID NO: 6224382 - DNA, 11 bp, Homo sapiens
gaatgctcccc

SEQ ID NO: 6224383 - DNA, 13 bp, Homo sapiens
gaatgctccccca

SEQ ID NO: 6224384 - DNA, 19 bp, Homo sapiens
gaatgctcccccatcctcc

SEQ ID NO: 6224385 - DNA, 16 bp, Homo sapiens
gaatgctctgtgccag

SEQ ID NO: 6224386 - DNA, 20 bp, Homo sapiens
gaatgctgacaatgctgcca

SEQ ID NO: 6224387 - DNA, 13 bp, Homo sapiens
gaatgctgagacc

SEQ ID NO: 6224388 - DNA, 18 bp, Homo sapiens
gaatgctgagctgaagaa

SEQ ID NO: 6224389 - DNA, 20 bp, Homo sapiens
gaatgctgagctgaagaaat

SEQ ID NO: 6224390 - DNA, 16 bp, Homo sapiens
gaatgctgaggcctcg

SEQ ID NO: 6224391 - DNA, 21 bp, Homo sapiens
gaatgctgcaggacttgagaa

SEQ ID NO: 6224392 - DNA, 21 bp, Homo sapiens
gaatgctgcccgctctgcaga

SEQ ID NO: 6224393 - DNA, 23 bp, Homo sapiens
gaatgctggactggaggcccctg

SEQ ID NO: 6224394 - DNA, 13 bp, Homo sapiens
gaatgctgggact

SEQ ID NO: 6224395 - DNA, 14 bp, Homo sapiens
gaatgctgggactc

SEQ ID NO: 6224396 - DNA, 18 bp, Homo sapiens
gaatgctgggactcagcc

SEQ ID NO: 6224397 - DNA, 22 bp, Homo sapiens
gaatgctgggcccccagcctgg

SEQ ID NO: 6224398 - DNA, 19 bp, Homo sapiens
gaatgctgggtatgctctg

SEQ ID NO: 6224399 - DNA, 14 bp, Homo sapiens
gaatgctgtacatc

SEQ ID NO: 6224400 - DNA, 15 bp, Homo sapiens
gaatgctgtacatct

SEQ ID NO: 6224401 - DNA, 21 bp, Homo sapiens
gaatgcttaaagaattcaaat

SEQ ID NO: 6224402 - DNA, 16 bp, Homo sapiens
gaatgcttcctagaag

SEQ ID NO: 6224403 - DNA, 16 bp, Homo sapiens
gaatgcttctgagagc

SEQ ID NO: 6224404 - DNA, 22 bp, Homo sapiens
gaatgcttctgcatcaaaggag

SEQ ID NO: 6224405 - DNA, 18 bp, Homo sapiens
gaatgctttttgaatgtt

SEQ ID NO: 6224406 - DNA, 12 bp, Homo sapiens
gaatggaaaaat

SEQ ID NO: 6224407 - DNA, 16 bp, Homo sapiens
gaatggaaagcggagt

SEQ ID NO: 6224408 - DNA, 19 bp, Homo sapiens
gaatggaaatttataatat

SEQ ID NO: 6224409 - DNA, 16 bp, Homo sapiens
gaatggaactactgta

SEQ ID NO: 6224410 - DNA, 17 bp, Homo sapiens
gaatggaactactgtac

SEQ ID NO: 6224411 - DNA, 22 bp, Homo sapiens
gaatggaagcctccacctgcag

SEQ ID NO: 6224412 - DNA, 21 bp, Homo sapiens
gaatggaatcgatttcctccc

SEQ ID NO: 6224413 - DNA, 16 bp, Homo sapiens
gaatggaatcttctcc

SEQ ID NO: 6224414 - DNA, 23 bp, Homo sapiens
gaatggaccctctcctggactcg

SEQ ID NO: 6224415 - DNA, 16 bp, Homo sapiens
gaatggactttggaag

SEQ ID NO: 6224416 - DNA, 19 bp, Homo sapiens
gaatggactttggaagcag

SEQ ID NO: 6224417 - DNA, 21 bp, Homo sapiens
gaatggactttggaagcaggg

SEQ ID NO: 6224418 - DNA, 16 bp, Homo sapiens
gaatggagaatacatc

SEQ ID NO: 6224419 - DNA, 13 bp, Homo sapiens
gaatggagacaga

SEQ ID NO: 6224420 - DNA, 13 bp, Homo sapiens
gaatggaggcaga

SEQ ID NO: 6224421 - DNA, 17 bp, Homo sapiens
gaatggaggcagagacc

SEQ ID NO: 6224422 - DNA, 22 bp, Homo sapiens
gaatggaggggcagagccagga

SEQ ID NO: 6224423 - DNA, 18 bp, Homo sapiens
gaatggagtccagacctg

SEQ ID NO: 6224424 - DNA, 22 bp, Homo sapiens
gaatggataagatgatgttaaa

SEQ ID NO: 6224425 - DNA, 15 bp, Homo sapiens
gaatggatataatct

SEQ ID NO: 6224426 - DNA, 14 bp, Homo sapiens
gaatggatcacaag

SEQ ID NO: 6224427 - DNA, 17 bp, Homo sapiens
gaatggatcacaagatg

SEQ ID NO: 6224428 - DNA, 14 bp, Homo sapiens
gaatggatgaggtg

SEQ ID NO: 6224429 - DNA, 14 bp, Homo sapiens
gaatggatggggag

SEQ ID NO: 6224430 - DNA, 20 bp, Homo sapiens
gaatggatggggagaatggt

SEQ ID NO: 6224431 - DNA, 14 bp, Homo sapiens
gaatggattaaatg

SEQ ID NO: 6224432 - DNA, 19 bp, Homo sapiens
gaatggattggattattta

SEQ ID NO: 6224433 - DNA, 22 bp, Homo sapiens
gaatggcacagcccaaagaagg

SEQ ID NO: 6224434 - DNA, 18 bp, Homo sapiens
gaatggcagtcctggagg

SEQ ID NO: 6224435 - DNA, 19 bp, Homo sapiens
gaatggcagtcctggaggc

SEQ ID NO: 6224436 - DNA, 21 bp, Homo sapiens
gaatggcagtcctggaggcag

SEQ ID NO: 6224437 - DNA, 19 bp, Homo sapiens
gaatggcatggcaggagtc

SEQ ID NO: 6224438 - DNA, 13 bp, Homo sapiens
gaatggcatttgc

SEQ ID NO: 6224439 - DNA, 13 bp, Homo sapiens
gaatggccacaaa

SEQ ID NO: 6224440 - DNA, 18 bp, Homo sapiens
gaatggccctcattcagt

SEQ ID NO: 6224441 - DNA, 15 bp, Homo sapiens
gaatggcctgagaca

SEQ ID NO: 6224442 - DNA, 16 bp, Homo sapiens
gaatggcctggagcag

SEQ ID NO: 6224443 - DNA, 14 bp, Homo sapiens
gaatggcgtccgtg

SEQ ID NO: 6224444 - DNA, 19 bp, Homo sapiens
gaatggctatgtttttaat

SEQ ID NO: 6224445 - DNA, 13 bp, Homo sapiens
gaatggctttcaa

SEQ ID NO: 6224446 - DNA, 16 bp, Homo sapiens
gaatggctttgtcttg

SEQ ID NO: 6224447 - DNA, 17 bp, Homo sapiens
gaatggctttgtcttga

SEQ ID NO: 6224448 - DNA, 18 bp, Homo sapiens
gaatggctttgtcttgaa

SEQ ID NO: 6224449 - DNA, 13 bp, Homo sapiens
gaatgggaaaaga

SEQ ID NO: 6224450 - DNA, 22 bp, Homo sapiens
gaatgggaaagtatttttgaaa

SEQ ID NO: 6224451 - DNA, 20 bp, Homo sapiens
gaatgggatattttgaaatg

SEQ ID NO: 6224452 - DNA, 23 bp, Homo sapiens
gaatgggcaattccagaaatctt

SEQ ID NO: 6224453 - DNA, 16 bp, Homo sapiens
gaatgggcagttacat

SEQ ID NO: 6224454 - DNA, 20 bp, Homo sapiens
gaatgggcatgaatggagat

SEQ ID NO: 6224455 - DNA, 17 bp, Homo sapiens
gaatgggctgcagaaga

SEQ ID NO: 6224456 - DNA, 22 bp, Homo sapiens
gaatggggaactctccctctgg

SEQ ID NO: 6224457 - DNA, 14 bp, Homo sapiens
gaatggggacctgg

SEQ ID NO: 6224458 - DNA, 17 bp, Homo sapiens
gaatggggatccagtta

SEQ ID NO: 6224459 - DNA, 21 bp, Homo sapiens
gaatggggcgatcaagtccag

SEQ ID NO: 6224460 - DNA, 22 bp, Homo sapiens
gaatgggggccaggctgagccg

SEQ ID NO: 6224461 - DNA, 20 bp, Homo sapiens
gaatgggggtatcctgtgca

SEQ ID NO: 6224462 - DNA, 16 bp, Homo sapiens
gaatggggttcctgct

SEQ ID NO: 6224463 - DNA, 14 bp, Homo sapiens
gaatgggtttactc

SEQ ID NO: 6224464 - DNA, 19 bp, Homo sapiens
gaatggtagtctaaccaaa

SEQ ID NO: 6224465 - DNA, 23 bp, Homo sapiens
gaatggtccgtgctaaggacttg

SEQ ID NO: 6224466 - DNA, 14 bp, Homo sapiens
gaatggtctcagtg

SEQ ID NO: 6224467 - DNA, 15 bp, Homo sapiens
gaatggtctttgctc

SEQ ID NO: 6224468 - DNA, 19 bp, Homo sapiens
gaatggtgattttaaatgt

SEQ ID NO: 6224469 - DNA, 21 bp, Homo sapiens
gaatggtgattttaaatgtgt

SEQ ID NO: 6224470 - DNA, 15 bp, Homo sapiens
gaatggtgggctcca

SEQ ID NO: 6224471 - DNA, 13 bp, Homo sapiens
gaatggtggtgga

SEQ ID NO: 6224472 - DNA, 19 bp, Homo sapiens
gaatggttaataaaactgc

SEQ ID NO: 6224473 - DNA, 19 bp, Homo sapiens
gaatggttccatgcctgag

SEQ ID NO: 6224474 - DNA, 22 bp, Homo sapiens
gaatggttttcaaaataaaaat

SEQ ID NO: 6224475 - DNA, 13 bp, Homo sapiens
gaatgtaaaagaa

SEQ ID NO: 6224476 - DNA, 20 bp, Homo sapiens
gaatgtaaagcttgtctgat

SEQ ID NO: 6224477 - DNA, 14 bp, Homo sapiens
gaatgtaaatgtct

SEQ ID NO: 6224478 - DNA, 11 bp, Homo sapiens
gaatgtaacca

SEQ ID NO: 6224479 - DNA, 15 bp, Homo sapiens
gaatgtaactgctga

SEQ ID NO: 6224480 - DNA, 14 bp, Homo sapiens
gaatgtaagaaaac

SEQ ID NO: 6224481 - DNA, 20 bp, Homo sapiens
gaatgtaatttgtgtaataa

SEQ ID NO: 6224482 - DNA, 23 bp, Homo sapiens
gaatgtaatttgtgtaataaagt

SEQ ID NO: 6224483 - DNA, 14 bp, Homo sapiens
gaatgtacaaagat

SEQ ID NO: 6224484 - DNA, 22 bp, Homo sapiens
gaatgtacagaaaatagctttt

SEQ ID NO: 6224485 - DNA, 19 bp, Homo sapiens
gaatgtacatactgaaaaa

SEQ ID NO: 6224486 - DNA, 20 bp, Homo sapiens
gaatgtacatgaagcaatta

SEQ ID NO: 6224487 - DNA, 13 bp, Homo sapiens
gaatgtacattac

SEQ ID NO: 6224488 - DNA, 14 bp, Homo sapiens
gaatgtacgtccag

SEQ ID NO: 6224489 - DNA, 20 bp, Homo sapiens
gaatgtactatgtctgaaca

SEQ ID NO: 6224490 - DNA, 14 bp, Homo sapiens
gaatgtactctgtt

SEQ ID NO: 6224491 - DNA, 15 bp, Homo sapiens
gaatgtagccagccc

SEQ ID NO: 6224492 - DNA, 23 bp, Homo sapiens
gaatgtagccctctccaaatcaa

SEQ ID NO: 6224493 - DNA, 15 bp, Homo sapiens
gaatgtagctggttt

SEQ ID NO: 6224494 - DNA, 18 bp, Homo sapiens
gaatgtagcttccacctc

SEQ ID NO: 6224495 - DNA, 20 bp, Homo sapiens
gaatgtagcttccacctcat

SEQ ID NO: 6224496 - DNA, 22 bp, Homo sapiens
gaatgtaggctggctttcagag

SEQ ID NO: 6224497 - DNA, 16 bp, Homo sapiens
gaatgtagtttgagga

SEQ ID NO: 6224498 - DNA, 22 bp, Homo sapiens
gaatgtagtttgaggaaatttg

SEQ ID NO: 6224499 - DNA, 16 bp, Homo sapiens
gaatgtatcaggaaat

SEQ ID NO: 6224500 - DNA, 22 bp, Homo sapiens
gaatgtatctagtggtctgatt

SEQ ID NO: 6224501 - DNA, 15 bp, Homo sapiens
gaatgtatctcctcc

SEQ ID NO: 6224502 - DNA, 14 bp, Homo sapiens
gaatgtatctgtga

SEQ ID NO: 6224503 - DNA, 17 bp, Homo sapiens
gaatgtatctgtgaagt

SEQ ID NO: 6224504 - DNA, 18 bp, Homo sapiens
gaatgtatgctaattgaa

SEQ ID NO: 6224505 - DNA, 17 bp, Homo sapiens
gaatgtattattctgca

SEQ ID NO: 6224506 - DNA, 12 bp, Homo sapiens
gaatgtattgta

SEQ ID NO: 6224507 - DNA, 22 bp, Homo sapiens
gaatgtattgtaccttttaaca

SEQ ID NO: 6224508 - DNA, 16 bp, Homo sapiens
gaatgtatttatttgg

SEQ ID NO: 6224509 - DNA, 14 bp, Homo sapiens
gaatgtatttgatt

SEQ ID NO: 6224510 - DNA, 17 bp, Homo sapiens
gaatgtcaatatttgag

SEQ ID NO: 6224511 - DNA, 22 bp, Homo sapiens
gaatgtcaatgccaggatttct

SEQ ID NO: 6224512 - DNA, 14 bp, Homo sapiens
gaatgtcagattcc

SEQ ID NO: 6224513 - DNA, 15 bp, Homo sapiens
gaatgtcagattcct

SEQ ID NO: 6224514 - DNA, 19 bp, Homo sapiens
gaatgtcagattcctttcc

SEQ ID NO: 6224515 - DNA, 18 bp, Homo sapiens
gaatgtcagtatgtggaa

SEQ ID NO: 6224516 - DNA, 20 bp, Homo sapiens
gaatgtcagtgtgactgatc

SEQ ID NO: 6224517 - DNA, 15 bp, Homo sapiens
gaatgtcatttgcta

SEQ ID NO: 6224518 - DNA, 22 bp, Homo sapiens
gaatgtcatttgctaatgaatt

SEQ ID NO: 6224519 - DNA, 23 bp, Homo sapiens
gaatgtcatttgctaatgaattt

SEQ ID NO: 6224520 - DNA, 22 bp, Homo sapiens
gaatgtccaaaatttatatttt

SEQ ID NO: 6224521 - DNA, 15 bp, Homo sapiens
gaatgtcccagaggc

SEQ ID NO: 6224522 - DNA, 17 bp, Homo sapiens
gaatgtcctgtagagag

SEQ ID NO: 6224523 - DNA, 20 bp, Homo sapiens
gaatgtcctgtagagagaga

SEQ ID NO: 6224524 - DNA, 22 bp, Homo sapiens
gaatgtccttattcttgtggtt

SEQ ID NO: 6224525 - DNA, 16 bp, Homo sapiens
gaatgtctaacttaaa

SEQ ID NO: 6224526 - DNA, 11 bp, Homo sapiens
gaatgtctcag

SEQ ID NO: 6224527 - DNA, 18 bp, Homo sapiens
gaatgtctgaagtacaaa

SEQ ID NO: 6224528 - DNA, 18 bp, Homo sapiens
gaatgtctgccttactgg

SEQ ID NO: 6224529 - DNA, 18 bp, Homo sapiens
gaatgtcttgttcctgtg

SEQ ID NO: 6224530 - DNA, 16 bp, Homo sapiens
gaatgtcttttgaata

SEQ ID NO: 6224531 - DNA, 22 bp, Homo sapiens
gaatgtgaaaaaaaaaagtaat

SEQ ID NO: 6224532 - DNA, 14 bp, Homo sapiens
gaatgtgaaagcac

SEQ ID NO: 6224533 - DNA, 17 bp, Homo sapiens
gaatgtgaaatttaaat

SEQ ID NO: 6224534 - DNA, 14 bp, Homo sapiens
gaatgtgaagcctt

SEQ ID NO: 6224535 - DNA, 16 bp, Homo sapiens
gaatgtgaagccttcc

SEQ ID NO: 6224536 - DNA, 22 bp, Homo sapiens
gaatgtgagctaagcattttct

SEQ ID NO: 6224537 - DNA, 22 bp, Homo sapiens
gaatgtgagtgtgtttgtgtgc

SEQ ID NO: 6224538 - DNA, 19 bp, Homo sapiens
gaatgtgataaggaaatca

SEQ ID NO: 6224539 - DNA, 18 bp, Homo sapiens
gaatgtgcaaagcagtat

SEQ ID NO: 6224540 - DNA, 15 bp, Homo sapiens
gaatgtgcaggtttg

SEQ ID NO: 6224541 - DNA, 16 bp, Homo sapiens
gaatgtgcatttcttg

SEQ ID NO: 6224542 - DNA, 15 bp, Homo sapiens
gaatgtgccacagag

SEQ ID NO: 6224543 - DNA, 15 bp, Homo sapiens
gaatgtgccacctgt

SEQ ID NO: 6224544 - DNA, 21 bp, Homo sapiens
gaatgtgctagagttaaaagt

SEQ ID NO: 6224545 - DNA, 18 bp, Homo sapiens
gaatgtgctgaagcaaag

SEQ ID NO: 6224546 - DNA, 19 bp, Homo sapiens
gaatgtgctggtgaacact

SEQ ID NO: 6224547 - DNA, 22 bp, Homo sapiens
gaatgtggataaaactgtgtaa

SEQ ID NO: 6224548 - DNA, 20 bp, Homo sapiens
gaatgtggatttgattcatt

SEQ ID NO: 6224549 - DNA, 18 bp, Homo sapiens
gaatgtggccacttattt

SEQ ID NO: 6224550 - DNA, 22 bp, Homo sapiens
gaatgtggcccctgaacaagaa

SEQ ID NO: 6224551 - DNA, 18 bp, Homo sapiens
gaatgtggcttgagaaat

SEQ ID NO: 6224552 - DNA, 13 bp, Homo sapiens
gaatgtgggctat

SEQ ID NO: 6224553 - DNA, 20 bp, Homo sapiens
gaatgtgggctatgtagtca

SEQ ID NO: 6224554 - DNA, 12 bp, Homo sapiens
gaatgtgtcagg

SEQ ID NO: 6224555 - DNA, 16 bp, Homo sapiens
gaatgtgtcctcctgc

SEQ ID NO: 6224556 - DNA, 19 bp, Homo sapiens
gaatgtgtcctcctgctct

SEQ ID NO: 6224557 - DNA, 13 bp, Homo sapiens
gaatgtgtcttta

SEQ ID NO: 6224558 - DNA, 13 bp, Homo sapiens
gaatgtgttcttt

SEQ ID NO: 6224559 - DNA, 13 bp, Homo sapiens
gaatgtgtttcaa

SEQ ID NO: 6224560 - DNA, 19 bp, Homo sapiens
gaatgtgtttcaaactgta

SEQ ID NO: 6224561 - DNA, 13 bp, Homo sapiens
gaatgtgtttcac

SEQ ID NO: 6224562 - DNA, 13 bp, Homo sapiens
gaatgttaaaggg

SEQ ID NO: 6224563 - DNA, 18 bp, Homo sapiens
gaatgttaaataaattgt

SEQ ID NO: 6224564 - DNA, 21 bp, Homo sapiens
gaatgttaaataaattgtata

SEQ ID NO: 6224565 - DNA, 22 bp, Homo sapiens
gaatgttaatttattttgctcc

SEQ ID NO: 6224566 - DNA, 19 bp, Homo sapiens
gaatgttaccagacttcaa

SEQ ID NO: 6224567 - DNA, 14 bp, Homo sapiens
gaatgttagagcac

SEQ ID NO: 6224568 - DNA, 23 bp, Homo sapiens
gaatgttagagtaatgaaatgga

SEQ ID NO: 6224569 - DNA, 17 bp, Homo sapiens
gaatgttatatcatcaa

SEQ ID NO: 6224570 - DNA, 17 bp, Homo sapiens
gaatgttatcagtatta

SEQ ID NO: 6224571 - DNA, 20 bp, Homo sapiens
gaatgttcccaagtaggcat

SEQ ID NO: 6224572 - DNA, 14 bp, Homo sapiens
gaatgttctcagat

SEQ ID NO: 6224573 - DNA, 11 bp, Homo sapiens
gaatgttctga

SEQ ID NO: 6224574 - DNA, 15 bp, Homo sapiens
gaatgttctgacatt

SEQ ID NO: 6224575 - DNA, 20 bp, Homo sapiens
gaatgttctgacattaacag

SEQ ID NO: 6224576 - DNA, 20 bp, Homo sapiens
gaatgttgcaatgtgaaaaa

SEQ ID NO: 6224577 - DNA, 18 bp, Homo sapiens
gaatgttggcaaatcact

SEQ ID NO: 6224578 - DNA, 23 bp, Homo sapiens
gaatgttgtgttggtatttactg

SEQ ID NO: 6224579 - DNA, 16 bp, Homo sapiens
gaatgttgttaaatgc

SEQ ID NO: 6224580 - DNA, 20 bp, Homo sapiens
gaatgttgttgtctatttgt

SEQ ID NO: 6224581 - DNA, 21 bp, Homo sapiens
gaatgtttaatagaaaattaa

SEQ ID NO: 6224582 - DNA, 20 bp, Homo sapiens
gaatgtttacactctttgta

SEQ ID NO: 6224583 - DNA, 15 bp, Homo sapiens
gaatgtttatgttct

SEQ ID NO: 6224584 - DNA, 17 bp, Homo sapiens
gaatgtttatgttctca

SEQ ID NO: 6224585 - DNA, 22 bp, Homo sapiens
gaatgtttcctgtggaaatatg

SEQ ID NO: 6224586 - DNA, 22 bp, Homo sapiens
gaatgtttgaactgccaagaaa

SEQ ID NO: 6224587 - DNA, 19 bp, Homo sapiens
aacacatacaaaagaatta

SEQ ID NO: 6224588 - DNA, 21 bp, Homo sapiens
aacacatacaggaaggtagaa

SEQ ID NO: 6224589 - DNA, 17 bp, Homo sapiens
aacacatcaaataaact

SEQ ID NO: 6224590 - DNA, 12 bp, Homo sapiens
aacacatcagct

SEQ ID NO: 6224591 - DNA, 20 bp, Homo sapiens
aacacatcataaggttttat

SEQ ID NO: 6224592 - DNA, 14 bp, Homo sapiens
aacacatctggctg

SEQ ID NO: 6224593 - DNA, 15 bp, Homo sapiens
aacacatctggctgc

SEQ ID NO: 6224594 - DNA, 11 bp, Homo sapiens
aacacatgata

SEQ ID NO: 6224595 - DNA, 12 bp, Homo sapiens
aacacatgcaca

SEQ ID NO: 6224596 - DNA, 14 bp, Homo sapiens
aacacatgcacaca

SEQ ID NO: 6224597 - DNA, 13 bp, Homo sapiens
aacacatggcaga

SEQ ID NO: 6224598 - DNA, 20 bp, Homo sapiens
aacacatgggggagagagac

SEQ ID NO: 6224599 - DNA, 17 bp, Homo sapiens
aacacattaaaagacaa

SEQ ID NO: 6224600 - DNA, 20 bp, Homo sapiens
aacacattaaaggtactttg

SEQ ID NO: 6224601 - DNA, 13 bp, Homo sapiens
aacacattataaa

SEQ ID NO: 6224602 - DNA, 13 bp, Homo sapiens
aacacattccttt

SEQ ID NO: 6224603 - DNA, 22 bp, Homo sapiens
aacacattgaaactgtatttac

SEQ ID NO: 6224604 - DNA, 18 bp, Homo sapiens
aacacattgaatgcgctt

SEQ ID NO: 6224605 - DNA, 14 bp, Homo sapiens
aacacattgcctaa

SEQ ID NO: 6224606 - DNA, 16 bp, Homo sapiens
aacacattgttatttt

SEQ ID NO: 6224607 - DNA, 20 bp, Homo sapiens
aacacatttaaaattttaaa

SEQ ID NO: 6224608 - DNA, 16 bp, Homo sapiens
aacacatttcaaatga

SEQ ID NO: 6224609 - DNA, 13 bp, Homo sapiens
aacacatttctct

SEQ ID NO: 6224610 - DNA, 22 bp, Homo sapiens
aacacattttccatatttggat

SEQ ID NO: 6224611 - DNA, 16 bp, Homo sapiens
aacacattttgtataa

SEQ ID NO: 6224612 - DNA, 22 bp, Homo sapiens
aacacattttgtataattgtat

SEQ ID NO: 6224613 - DNA, 23 bp, Homo sapiens
aacacatttttaaagctttcccc

SEQ ID NO: 6224614 - DNA, 17 bp, Homo sapiens
aacaccaagcacagcag

SEQ ID NO: 6224615 - DNA, 19 bp, Homo sapiens
aacaccaagcacagcagcc

SEQ ID NO: 6224616 - DNA, 14 bp, Homo sapiens
aacaccaagtaaat

SEQ ID NO: 6224617 - DNA, 14 bp, Homo sapiens
aacaccacagaaat

SEQ ID NO: 6224618 - DNA, 13 bp, Homo sapiens
aacaccacagaca

SEQ ID NO: 6224619 - DNA, 17 bp, Homo sapiens
aacaccacagacacaca

SEQ ID NO: 6224620 - DNA, 18 bp, Homo sapiens
aacaccacagacacacac

SEQ ID NO: 6224621 - DNA, 19 bp, Homo sapiens
aacaccagaggggaaaaaa

SEQ ID NO: 6224622 - DNA, 14 bp, Homo sapiens
aacaccagccccac

SEQ ID NO: 6224623 - DNA, 13 bp, Homo sapiens
aacaccagcccct

SEQ ID NO: 6224624 - DNA, 18 bp, Homo sapiens
aacaccagcccctgcccc

SEQ ID NO: 6224625 - DNA, 19 bp, Homo sapiens
aacaccagcccctgcccca

SEQ ID NO: 6224626 - DNA, 22 bp, Homo sapiens
aacaccagcccctgccccagcc

SEQ ID NO: 6224627 - DNA, 23 bp, Homo sapiens
aacaccagcccctgccccagccc

SEQ ID NO: 6224628 - DNA, 21 bp, Homo sapiens
aacaccaggtttatggaaaat

SEQ ID NO: 6224629 - DNA, 13 bp, Homo sapiens
aacaccagtgtta

SEQ ID NO: 6224630 - DNA, 19 bp, Homo sapiens
aacaccatgattcctttaa

SEQ ID NO: 6224631 - DNA, 23 bp, Homo sapiens
aacaccatggagatgaaatgcct

SEQ ID NO: 6224632 - DNA, 15 bp, Homo sapiens
aacaccattattcca

SEQ ID NO: 6224633 - DNA, 19 bp, Homo sapiens
aacacccaaaggtggcctg

SEQ ID NO: 6224634 - DNA, 13 bp, Homo sapiens
aacacccactggc

SEQ ID NO: 6224635 - DNA, 17 bp, Homo sapiens
aacacccactggccagt

SEQ ID NO: 6224636 - DNA, 13 bp, Homo sapiens
aacacccagcccc

SEQ ID NO: 6224637 - DNA, 15 bp, Homo sapiens
aacacccagccccag

SEQ ID NO: 6224638 - DNA, 19 bp, Homo sapiens
aacacccccatccctcggg

SEQ ID NO: 6224639 - DNA, 21 bp, Homo sapiens
aacaccccgcctgcctcctgg

SEQ ID NO: 6224640 - DNA, 16 bp, Homo sapiens
aacacccggaaagact

SEQ ID NO: 6224641 - DNA, 14 bp, Homo sapiens
aacacccttagaaa

SEQ ID NO: 6224642 - DNA, 12 bp, Homo sapiens
aacacccttcct

SEQ ID NO: 6224643 - DNA, 18 bp, Homo sapiens
aacacctagatcagaaca

SEQ ID NO: 6224644 - DNA, 14 bp, Homo sapiens
aacacctcctagca

SEQ ID NO: 6224645 - DNA, 16 bp, Homo sapiens
aacacctcctcatgta

SEQ ID NO: 6224646 - DNA, 22 bp, Homo sapiens
aacacctcctcccgaaaaatgt

SEQ ID NO: 6224647 - DNA, 12 bp, Homo sapiens
aacacctgctgc

SEQ ID NO: 6224648 - DNA, 17 bp, Homo sapiens
aacaccttccagctcct

SEQ ID NO: 6224649 - DNA, 15 bp, Homo sapiens
aacaccttcctcctg

SEQ ID NO: 6224650 - DNA, 17 bp, Homo sapiens
aacaccttcctcctgca

SEQ ID NO: 6224651 - DNA, 20 bp, Homo sapiens
aacaccttcttattatatat

SEQ ID NO: 6224652 - DNA, 20 bp, Homo sapiens
aacaccttcttggcttctgg

SEQ ID NO: 6224653 - DNA, 16 bp, Homo sapiens
aacacctttattttat

SEQ ID NO: 6224654 - DNA, 22 bp, Homo sapiens
aacacctttgttttgcactgac

SEQ ID NO: 6224655 - DNA, 12 bp, Homo sapiens
aacacgaaactt

SEQ ID NO: 6224656 - DNA, 20 bp, Homo sapiens
aacacgaaacttgttattgt

SEQ ID NO: 6224657 - DNA, 17 bp, Homo sapiens
aacacgattttcaagat

SEQ ID NO: 6224658 - DNA, 14 bp, Homo sapiens
aacacgcacagaag

SEQ ID NO: 6224659 - DNA, 15 bp, Homo sapiens
aacacgcacctgcct

SEQ ID NO: 6224660 - DNA, 19 bp, Homo sapiens
aacacgcacctgcctcagg

SEQ ID NO: 6224661 - DNA, 14 bp, Homo sapiens
aacacgcaggagca

SEQ ID NO: 6224662 - DNA, 21 bp, Homo sapiens
aacacgcatgcctcagccagc

SEQ ID NO: 6224663 - DNA, 22 bp, Homo sapiens
aacacgccttgttcctgctctt

SEQ ID NO: 6224664 - DNA, 21 bp, Homo sapiens
aacacggacccatagacagcc

SEQ ID NO: 6224665 - DNA, 20 bp, Homo sapiens
aacacggagcagggagagct

SEQ ID NO: 6224666 - DNA, 19 bp, Homo sapiens
aacacggagtttccatttg

SEQ ID NO: 6224667 - DNA, 16 bp, Homo sapiens
aacacggccctcctgg

SEQ ID NO: 6224668 - DNA, 18 bp, Homo sapiens
aacacggccctcctggga

SEQ ID NO: 6224669 - DNA, 21 bp, Homo sapiens
aacacgtccagaatttttcat

SEQ ID NO: 6224670 - DNA, 13 bp, Homo sapiens
aacacgtttagaa

SEQ ID NO: 6224671 - DNA, 17 bp, Homo sapiens
aacacgtttagaaatga

SEQ ID NO: 6224672 - DNA, 13 bp, Homo sapiens
aacacgttttaag

SEQ ID NO: 6224673 - DNA, 13 bp, Homo sapiens
aacactaaaattt

SEQ ID NO: 6224674 - DNA, 22 bp, Homo sapiens
aacactaaatgttaaagatgta

SEQ ID NO: 6224675 - DNA, 20 bp, Homo sapiens
aacactaaattagtttaaaa

SEQ ID NO: 6224676 - DNA, 23 bp, Homo sapiens
aacactaaattgcagtttacagt

SEQ ID NO: 6224677 - DNA, 20 bp, Homo sapiens
aacactaacaaaatttgaat

SEQ ID NO: 6224678 - DNA, 18 bp, Homo sapiens
aacactaacatataatgt

SEQ ID NO: 6224679 - DNA, 18 bp, Homo sapiens
aacactaactatgcatgg

SEQ ID NO: 6224680 - DNA, 22 bp, Homo sapiens
aacactaatatatttaaaaata

SEQ ID NO: 6224681 - DNA, 19 bp, Homo sapiens
aacactaatcacaaactga

SEQ ID NO: 6224682 - DNA, 22 bp, Homo sapiens
aacactaatcacaaactgaatg

SEQ ID NO: 6224683 - DNA, 14 bp, Homo sapiens
aacactaatggcca

SEQ ID NO: 6224684 - DNA, 14 bp, Homo sapiens
aacactaattcata

SEQ ID NO: 6224685 - DNA, 23 bp, Homo sapiens
aacactagggccttggaaattcc

SEQ ID NO: 6224686 - DNA, 15 bp, Homo sapiens
aacactagtctgtgt

SEQ ID NO: 6224687 - DNA, 18 bp, Homo sapiens
aacactagtctgtgtaac

SEQ ID NO: 6224688 - DNA, 14 bp, Homo sapiens
aacactatatggca

SEQ ID NO: 6224689 - DNA, 18 bp, Homo sapiens
aacactatcatagttatt

SEQ ID NO: 6224690 - DNA, 13 bp, Homo sapiens
aacactattctcc

SEQ ID NO: 6224691 - DNA, 16 bp, Homo sapiens
aacactattctccaga

SEQ ID NO: 6224692 - DNA, 19 bp, Homo sapiens
aacactattttcagaatct

SEQ ID NO: 6224693 - DNA, 21 bp, Homo sapiens
aacactcacatttattctgct

SEQ ID NO: 6224694 - DNA, 19 bp, Homo sapiens
aacactcactgcctgcagc

SEQ ID NO: 6224695 - DNA, 18 bp, Homo sapiens
aacactcacttaattctc

SEQ ID NO: 6224696 - DNA, 24 bp, Homo sapiens
aacactcagtggcccatggcattt

SEQ ID NO: 6224697 - DNA, 20 bp, Homo sapiens
aacactcattcttttttcta

SEQ ID NO: 6224698 - DNA, 21 bp, Homo sapiens
aacactcattgacctgaggcc

SEQ ID NO: 6224699 - DNA, 19 bp, Homo sapiens
aacactccaccccctccag

SEQ ID NO: 6224700 - DNA, 14 bp, Homo sapiens
aacactccaggccc

SEQ ID NO: 6224701 - DNA, 19 bp, Homo sapiens
aacactccattattcctct

SEQ ID NO: 6224702 - DNA, 22 bp, Homo sapiens
aacactcctctactcttacaga

SEQ ID NO: 6224703 - DNA, 17 bp, Homo sapiens
aacactcgtgtgcatga

SEQ ID NO: 6224704 - DNA, 13 bp, Homo sapiens
aacactctatatt

SEQ ID NO: 6224705 - DNA, 11 bp, Homo sapiens
aacactctgag

SEQ ID NO: 6224706 - DNA, 14 bp, Homo sapiens
aacactctgagact

SEQ ID NO: 6224707 - DNA, 20 bp, Homo sapiens
aacactcttcttgagcagac

SEQ ID NO: 6224708 - DNA, 19 bp, Homo sapiens
aacactcttttgctttatt

SEQ ID NO: 6224709 - DNA, 15 bp, Homo sapiens
aacactgaaaaaata

SEQ ID NO: 6224710 - DNA, 15 bp, Homo sapiens
aacactgaaaaatta

SEQ ID NO: 6224711 - DNA, 14 bp, Homo sapiens
aacactgaaatgaa

SEQ ID NO: 6224712 - DNA, 19 bp, Homo sapiens
aacactgaaattgcctgaa

SEQ ID NO: 6224713 - DNA, 14 bp, Homo sapiens
aacactgaatcatg

SEQ ID NO: 6224714 - DNA, 17 bp, Homo sapiens
aacactgaatcatgtta

SEQ ID NO: 6224715 - DNA, 19 bp, Homo sapiens
aacactgagaaagaggcag

SEQ ID NO: 6224716 - DNA, 14 bp, Homo sapiens
aacactgagtgaaa

SEQ ID NO: 6224717 - DNA, 19 bp, Homo sapiens
aacactgagtgaaatatta

SEQ ID NO: 6224718 - DNA, 13 bp, Homo sapiens
aacactgatgata

SEQ ID NO: 6224719 - DNA, 18 bp, Homo sapiens
aacactgattcctggaga

SEQ ID NO: 6224720 - DNA, 14 bp, Homo sapiens
aacactgatttccc

SEQ ID NO: 6224721 - DNA, 23 bp, Homo sapiens
aacactgatttccccttttgcat

SEQ ID NO: 6224722 - DNA, 18 bp, Homo sapiens
aacactgcagccctctcc

SEQ ID NO: 6224723 - DNA, 14 bp, Homo sapiens
aacactgcaggcat

SEQ ID NO: 6224724 - DNA, 15 bp, Homo sapiens
aacactgccaaacat

SEQ ID NO: 6224725 - DNA, 22 bp, Homo sapiens
aacactgccagcatttcccttc

SEQ ID NO: 6224726 - DNA, 20 bp, Homo sapiens
aacactgccatattgtgtaa

SEQ ID NO: 6224727 - DNA, 22 bp, Homo sapiens
aacactgccatcttagtttgga

SEQ ID NO: 6224728 - DNA, 12 bp, Homo sapiens
aacactgccctc

SEQ ID NO: 6224729 - DNA, 15 bp, Homo sapiens
aacactgcctctgag

SEQ ID NO: 6224730 - DNA, 20 bp, Homo sapiens
aacactgcttaaggaaaaga

SEQ ID NO: 6224731 - DNA, 13 bp, Homo sapiens
aacactggacctg

SEQ ID NO: 6224732 - DNA, 14 bp, Homo sapiens
aacactggacctgg

SEQ ID NO: 6224733 - DNA, 15 bp, Homo sapiens
aacactggcagactg

SEQ ID NO: 6224734 - DNA, 12 bp, Homo sapiens
aacactggcccc

SEQ ID NO: 6224735 - DNA, 13 bp, Homo sapiens
aacactggcccct

SEQ ID NO: 6224736 - DNA, 15 bp, Homo sapiens
aacactggctctggg

SEQ ID NO: 6224737 - DNA, 18 bp, Homo sapiens
aacactggctctgggact

SEQ ID NO: 6224738 - DNA, 21 bp, Homo sapiens
aacactgggggcaccttaaga

SEQ ID NO: 6224739 - DNA, 23 bp, Homo sapiens
aacactggtctgctgttccagtg

SEQ ID NO: 6224740 - DNA, 13 bp, Homo sapiens
aacactggtgcca

SEQ ID NO: 6224741 - DNA, 16 bp, Homo sapiens
aacactggttaaatta

SEQ ID NO: 6224742 - DNA, 17 bp, Homo sapiens
aacactggttgtagtca

SEQ ID NO: 6224743 - DNA, 16 bp, Homo sapiens
aacactggttttaaat

SEQ ID NO: 6224744 - DNA, 22 bp, Homo sapiens
aacactggttttaaatattttg

SEQ ID NO: 6224745 - DNA, 15 bp, Homo sapiens
aacactgtaatatct

SEQ ID NO: 6224746 - DNA, 23 bp, Homo sapiens
aacactgtagctacattttcaga

SEQ ID NO: 6224747 - DNA, 19 bp, Homo sapiens
aacactgtagtaaataatg

SEQ ID NO: 6224748 - DNA, 14 bp, Homo sapiens
aacactgtattgta

SEQ ID NO: 6224749 - DNA, 17 bp, Homo sapiens
aacactgtcatcaatgt

SEQ ID NO: 6224750 - DNA, 18 bp, Homo sapiens
aacactgtccttccctgc

SEQ ID NO: 6224751 - DNA, 20 bp, Homo sapiens
aacactgtccttccctgcca

SEQ ID NO: 6224752 - DNA, 20 bp, Homo sapiens
aacactgtgcacatctgtgt

SEQ ID NO: 6224753 - DNA, 13 bp, Homo sapiens
aacactgtgccct

SEQ ID NO: 6224754 - DNA, 18 bp, Homo sapiens
aacactgtgggtgtgtga

SEQ ID NO: 6224755 - DNA, 21 bp, Homo sapiens
aacactgttatcattttttcc

SEQ ID NO: 6224756 - DNA, 18 bp, Homo sapiens
aacactgttctctgccct

SEQ ID NO: 6224757 - DNA, 19 bp, Homo sapiens
aacactgttctctgccctc

SEQ ID NO: 6224758 - DNA, 20 bp, Homo sapiens
aacactgttctctgccctcc

SEQ ID NO: 6224759 - DNA, 13 bp, Homo sapiens
aacactgttggca

SEQ ID NO: 6224760 - DNA, 22 bp, Homo sapiens
aacactgttggcacttataggt

SEQ ID NO: 6224761 - DNA, 17 bp, Homo sapiens
aacactgttttatagaa

SEQ ID NO: 6224762 - DNA, 22 bp, Homo sapiens
aacacttaagggttttagaaaa

SEQ ID NO: 6224763 - DNA, 20 bp, Homo sapiens
aacacttaatcattttatgg

SEQ ID NO: 6224764 - DNA, 17 bp, Homo sapiens
aacacttaggaagaaat

SEQ ID NO: 6224765 - DNA, 18 bp, Homo sapiens
aacacttaggaagaaatc

SEQ ID NO: 6224766 - DNA, 20 bp, Homo sapiens
gatgcccattcctgcctggt

SEQ ID NO: 6224767 - DNA, 14 bp, Homo sapiens
gatgccccagggat

SEQ ID NO: 6224768 - DNA, 17 bp, Homo sapiens
gatgccccagggatggg

SEQ ID NO: 6224769 - DNA, 14 bp, Homo sapiens
gatgcccccaggca

SEQ ID NO: 6224770 - DNA, 16 bp, Homo sapiens
gatgcccccaggcagc

SEQ ID NO: 6224771 - DNA, 14 bp, Homo sapiens
gatgcccccctaga

SEQ ID NO: 6224772 - DNA, 18 bp, Homo sapiens
gatgccccctccaggaga

SEQ ID NO: 6224773 - DNA, 13 bp, Homo sapiens
gatgcccctgaca

SEQ ID NO: 6224774 - DNA, 21 bp, Homo sapiens
gatgcccctgcagtttggccc

SEQ ID NO: 6224775 - DNA, 16 bp, Homo sapiens
gatgcccctgctccct

SEQ ID NO: 6224776 - DNA, 13 bp, Homo sapiens
gatgcccctggcc

SEQ ID NO: 6224777 - DNA, 13 bp, Homo sapiens
gatgccccttccc

SEQ ID NO: 6224778 - DNA, 23 bp, Homo sapiens
gatgcccgcccggggagtttccg

SEQ ID NO: 6224779 - DNA, 17 bp, Homo sapiens
gatgccctaagtgttga

SEQ ID NO: 6224780 - DNA, 16 bp, Homo sapiens
gatgccctcttctcct

SEQ ID NO: 6224781 - DNA, 15 bp, Homo sapiens
gatgccctggaggtg

SEQ ID NO: 6224782 - DNA, 14 bp, Homo sapiens
gatgccctgggggc

SEQ ID NO: 6224783 - DNA, 22 bp, Homo sapiens
gatgccctgttggtttcacaga

SEQ ID NO: 6224784 - DNA, 15 bp, Homo sapiens
gatgcccttgctggg

SEQ ID NO: 6224785 - DNA, 18 bp, Homo sapiens
gatgcccttgctgggcct

SEQ ID NO: 6224786 - DNA, 19 bp, Homo sapiens
gatgcccttgctgggcctg

SEQ ID NO: 6224787 - DNA, 17 bp, Homo sapiens
gatgccgagacctcaag

SEQ ID NO: 6224788 - DNA, 15 bp, Homo sapiens
gatgccgctcttctg

SEQ ID NO: 6224789 - DNA, 16 bp, Homo sapiens
gatgccggagccccaa

SEQ ID NO: 6224790 - DNA, 17 bp, Homo sapiens
gatgccgggcgccagga

SEQ ID NO: 6224791 - DNA, 19 bp, Homo sapiens
gatgccgggcgccaggaca

SEQ ID NO: 6224792 - DNA, 20 bp, Homo sapiens
gatgccgggcgccaggacag

SEQ ID NO: 6224793 - DNA, 23 bp, Homo sapiens
gatgccgggcgccaggacagcag

SEQ ID NO: 6224794 - DNA, 21 bp, Homo sapiens
gatgccgttctgttccaacct

SEQ ID NO: 6224795 - DNA, 22 bp, Homo sapiens
gatgcctaaaaattcccttcct

SEQ ID NO: 6224796 - DNA, 20 bp, Homo sapiens
gatgcctacaaccatccctg

SEQ ID NO: 6224797 - DNA, 15 bp, Homo sapiens
gatgcctaccgggtt

SEQ ID NO: 6224798 - DNA, 11 bp, Homo sapiens
gatgcctcacc

SEQ ID NO: 6224799 - DNA, 16 bp, Homo sapiens
gatgcctcaccacacc

SEQ ID NO: 6224800 - DNA, 23 bp, Homo sapiens
gatgcctcatgatatgtcagggc

SEQ ID NO: 6224801 - DNA, 15 bp, Homo sapiens
gatgcctcccggctt

SEQ ID NO: 6224802 - DNA, 16 bp, Homo sapiens
gatgcctcctgtcaga

SEQ ID NO: 6224803 - DNA, 16 bp, Homo sapiens
gatgcctccttcctct

SEQ ID NO: 6224804 - DNA, 20 bp, Homo sapiens
gatgcctccttggccaccag

SEQ ID NO: 6224805 - DNA, 22 bp, Homo sapiens
gatgcctctccccagagcattt

SEQ ID NO: 6224806 - DNA, 14 bp, Homo sapiens
gatgcctgacacag

SEQ ID NO: 6224807 - DNA, 15 bp, Homo sapiens
gatgcctgacacagg

SEQ ID NO: 6224808 - DNA, 21 bp, Homo sapiens
gatgcctgattcggacggcca

SEQ ID NO: 6224809 - DNA, 17 bp, Homo sapiens
gatgcctgcatgctgaa

SEQ ID NO: 6224810 - DNA, 15 bp, Homo sapiens
gatgcctgcccgcac

SEQ ID NO: 6224811 - DNA, 21 bp, Homo sapiens
gatgcctggcggggtggggtg

SEQ ID NO: 6224812 - DNA, 12 bp, Homo sapiens
gatgcctgggcc

SEQ ID NO: 6224813 - DNA, 15 bp, Homo sapiens
gatgcctgggcctga

SEQ ID NO: 6224814 - DNA, 14 bp, Homo sapiens
gatgcctggtggca

SEQ ID NO: 6224815 - DNA, 16 bp, Homo sapiens
gatgcctggtggcagc

SEQ ID NO: 6224816 - DNA, 17 bp, Homo sapiens
gatgcctggtggcagct

SEQ ID NO: 6224817 - DNA, 18 bp, Homo sapiens
gatgcctggtggcagctg

SEQ ID NO: 6224818 - DNA, 19 bp, Homo sapiens
gatgcctggtggcagctgc

SEQ ID NO: 6224819 - DNA, 20 bp, Homo sapiens
gatgcctgtgaactgaactc

SEQ ID NO: 6224820 - DNA, 22 bp, Homo sapiens
gatgccttccgacaccactggg

SEQ ID NO: 6224821 - DNA, 22 bp, Homo sapiens
gatgccttgagtctttaatccc

SEQ ID NO: 6224822 - DNA, 23 bp, Homo sapiens
gatgccttgagtctttaatccca

SEQ ID NO: 6224823 - DNA, 16 bp, Homo sapiens
gatgcctttgagtctg

SEQ ID NO: 6224824 - DNA, 14 bp, Homo sapiens
gatgcctttgctgt

SEQ ID NO: 6224825 - DNA, 15 bp, Homo sapiens
gatgcctttgctgtt

SEQ ID NO: 6224826 - DNA, 15 bp, Homo sapiens
gatgccttttctgtg

SEQ ID NO: 6224827 - DNA, 18 bp, Homo sapiens
gatgccttttttgtagtt

SEQ ID NO: 6224828 - DNA, 22 bp, Homo sapiens
gatgccttttttgtagtttttt

SEQ ID NO: 6224829 - DNA, 16 bp, Homo sapiens
gatgcgaaaacttgaa

SEQ ID NO: 6224830 - DNA, 15 bp, Homo sapiens
gatgcgagcttggcc

SEQ ID NO: 6224831 - DNA, 14 bp, Homo sapiens
gatgcgcactgcat

SEQ ID NO: 6224832 - DNA, 16 bp, Homo sapiens
gatgcgcagccccatc

SEQ ID NO: 6224833 - DNA, 17 bp, Homo sapiens
gatgcgcctgatcacca

SEQ ID NO: 6224834 - DNA, 17 bp, Homo sapiens
gatgcggatcctgctgg

SEQ ID NO: 6224835 - DNA, 22 bp, Homo sapiens
gatgcggctttctctgcctctg

SEQ ID NO: 6224836 - DNA, 22 bp, Homo sapiens
gatgcgggccagtgctccagcc

SEQ ID NO: 6224837 - DNA, 19 bp, Homo sapiens
gatgcggggacaggctgga

SEQ ID NO: 6224838 - DNA, 19 bp, Homo sapiens
gatgcgtattctgtggccg

SEQ ID NO: 6224839 - DNA, 13 bp, Homo sapiens
gatgcgtgggcag

SEQ ID NO: 6224840 - DNA, 14 bp, Homo sapiens
gatgcgtgggcaga

SEQ ID NO: 6224841 - DNA, 19 bp, Homo sapiens
gatgcgtttgcctcctgga

SEQ ID NO: 6224842 - DNA, 16 bp, Homo sapiens
gatgctaaagatgatg

SEQ ID NO: 6224843 - DNA, 16 bp, Homo sapiens
gatgctaataaactgt

SEQ ID NO: 6224844 - DNA, 14 bp, Homo sapiens
gatgctaattttca

SEQ ID NO: 6224845 - DNA, 21 bp, Homo sapiens
gatgctacaaaacaccttgtc

SEQ ID NO: 6224846 - DNA, 15 bp, Homo sapiens
gatgctactaagaaa

SEQ ID NO: 6224847 - DNA, 21 bp, Homo sapiens
gatgctactactgcagtcttt

SEQ ID NO: 6224848 - DNA, 20 bp, Homo sapiens
gatgctagaaaaatgttctt

SEQ ID NO: 6224849 - DNA, 16 bp, Homo sapiens
gatgctagaactccct

SEQ ID NO: 6224850 - DNA, 18 bp, Homo sapiens
gatgctagaactcccttt

SEQ ID NO: 6224851 - DNA, 18 bp, Homo sapiens
gatgctattaagaaggca

SEQ ID NO: 6224852 - DNA, 13 bp, Homo sapiens
gatgctatttgca

SEQ ID NO: 6224853 - DNA, 20 bp, Homo sapiens
gatgctcaaaatctttccaa

SEQ ID NO: 6224854 - DNA, 20 bp, Homo sapiens
gatgctcactgcttctgctt

SEQ ID NO: 6224855 - DNA, 19 bp, Homo sapiens
gatgctcaggtacagagaa

SEQ ID NO: 6224856 - DNA, 22 bp, Homo sapiens
gatgctcagttgctaaacactg

SEQ ID NO: 6224857 - DNA, 19 bp, Homo sapiens
gatgctcatctgagccagc

SEQ ID NO: 6224858 - DNA, 17 bp, Homo sapiens
gatgctccaagattcta

SEQ ID NO: 6224859 - DNA, 22 bp, Homo sapiens
gatgctccaagattctagatga

SEQ ID NO: 6224860 - DNA, 12 bp, Homo sapiens
gatgctccagcc

SEQ ID NO: 6224861 - DNA, 22 bp, Homo sapiens
gatgctccagccaacccctgtg

SEQ ID NO: 6224862 - DNA, 23 bp, Homo sapiens
gatgctccagccaacccctgtgg

SEQ ID NO: 6224863 - DNA, 19 bp, Homo sapiens
gatgctccagggcagcctc

SEQ ID NO: 6224864 - DNA, 14 bp, Homo sapiens
gatgctccctcagc

SEQ ID NO: 6224865 - DNA, 21 bp, Homo sapiens
gatgctccctcagcctcagag

SEQ ID NO: 6224866 - DNA, 13 bp, Homo sapiens
gatgctccctccc

SEQ ID NO: 6224867 - DNA, 21 bp, Homo sapiens
gatgctccgaggactggactg

SEQ ID NO: 6224868 - DNA, 12 bp, Homo sapiens
gatgctctctga

SEQ ID NO: 6224869 - DNA, 22 bp, Homo sapiens
gatgctctctgaggcaaggccc

SEQ ID NO: 6224870 - DNA, 19 bp, Homo sapiens
gatgctctttaaataataa

SEQ ID NO: 6224871 - DNA, 12 bp, Homo sapiens
gatgctctttcc

SEQ ID NO: 6224872 - DNA, 13 bp, Homo sapiens
gatgctctttccc

SEQ ID NO: 6224873 - DNA, 17 bp, Homo sapiens
gatgctctttcccagga

SEQ ID NO: 6224874 - DNA, 15 bp, Homo sapiens
gatgctctttccctt

SEQ ID NO: 6224875 - DNA, 18 bp, Homo sapiens
gatgctctttcccttttc

SEQ ID NO: 6224876 - DNA, 13 bp, Homo sapiens
gatgctgaaataa

SEQ ID NO: 6224877 - DNA, 10 bp, Homo sapiens
gatgctgaag

SEQ ID NO: 6224878 - DNA, 12 bp, Homo sapiens
gatgctgacacc

SEQ ID NO: 6224879 - DNA, 13 bp, Homo sapiens
gatgctgacacca

SEQ ID NO: 6224880 - DNA, 16 bp, Homo sapiens
gatgctgacccaggaa

SEQ ID NO: 6224881 - DNA, 20 bp, Homo sapiens
gatgctgactgtactcctcc

SEQ ID NO: 6224882 - DNA, 15 bp, Homo sapiens
gatgctgagcccgga

SEQ ID NO: 6224883 - DNA, 14 bp, Homo sapiens
gatgctgatggagc

SEQ ID NO: 6224884 - DNA, 15 bp, Homo sapiens
gatgctgatgttcag

SEQ ID NO: 6224885 - DNA, 16 bp, Homo sapiens
gatgctgatgttcagt

SEQ ID NO: 6224886 - DNA, 17 bp, Homo sapiens
gatgctgatgttcagtg

SEQ ID NO: 6224887 - DNA, 18 bp, Homo sapiens
gatgctgccggcacagct

SEQ ID NO: 6224888 - DNA, 19 bp, Homo sapiens
gatgctgccggcacagctg

SEQ ID NO: 6224889 - DNA, 12 bp, Homo sapiens
gatgctgcctga

SEQ ID NO: 6224890 - DNA, 14 bp, Homo sapiens
gatgctgcctgagt

SEQ ID NO: 6224891 - DNA, 15 bp, Homo sapiens
gatgctgctccgccc

SEQ ID NO: 6224892 - DNA, 11 bp, Homo sapiens
gatgctgctga

SEQ ID NO: 6224893 - DNA, 20 bp, Homo sapiens
gatgctgctggaggaatcag

SEQ ID NO: 6224894 - DNA, 13 bp, Homo sapiens
gatgctgctggcc

SEQ ID NO: 6224895 - DNA, 14 bp, Homo sapiens
gatgctgctggcct

SEQ ID NO: 6224896 - DNA, 12 bp, Homo sapiens
gatgctgctttc

SEQ ID NO: 6224897 - DNA, 15 bp, Homo sapiens
gatgctgctttcccc

SEQ ID NO: 6224898 - DNA, 14 bp, Homo sapiens
gatgctggagaaga

SEQ ID NO: 6224899 - DNA, 19 bp, Homo sapiens
gatgctggagaagagagga

SEQ ID NO: 6224900 - DNA, 15 bp, Homo sapiens
gatgctggagaggtt

SEQ ID NO: 6224901 - DNA, 17 bp, Homo sapiens
gatgctggatgtctgcc

SEQ ID NO: 6224902 - DNA, 22 bp, Homo sapiens
gatgctggatgtctgccaattt

SEQ ID NO: 6224903 - DNA, 16 bp, Homo sapiens
gatgctggccacagaa

SEQ ID NO: 6224904 - DNA, 12 bp, Homo sapiens
gatgctggccca

SEQ ID NO: 6224905 - DNA, 16 bp, Homo sapiens
gatgctggcccagggc

SEQ ID NO: 6224906 - DNA, 17 bp, Homo sapiens
gatgctggcccagggcc

SEQ ID NO: 6224907 - DNA, 13 bp, Homo sapiens
gatgctggcccca

SEQ ID NO: 6224908 - DNA, 23 bp, Homo sapiens
gatgctggccccaaaagccttac

SEQ ID NO: 6224909 - DNA, 23 bp, Homo sapiens
gatgctgggcacttcatctgatc

SEQ ID NO: 6224910 - DNA, 15 bp, Homo sapiens
gatgctgggctgggt

SEQ ID NO: 6224911 - DNA, 17 bp, Homo sapiens
gatgctgggctgggtgc

SEQ ID NO: 6224912 - DNA, 11 bp, Homo sapiens
gatgctgggga

SEQ ID NO: 6224913 - DNA, 23 bp, Homo sapiens
gatgctgggttggtgcacagtga

SEQ ID NO: 6224914 - DNA, 20 bp, Homo sapiens
gatgctggtaatggccatgg

SEQ ID NO: 6224915 - DNA, 15 bp, Homo sapiens
gatgctggtggagga

SEQ ID NO: 6224916 - DNA, 20 bp, Homo sapiens
gatgctggtggctggtgaga

SEQ ID NO: 6224917 - DNA, 12 bp, Homo sapiens
gatgctgtaaat

SEQ ID NO: 6224918 - DNA, 19 bp, Homo sapiens
gatgctgtaacttaaaata

SEQ ID NO: 6224919 - DNA, 18 bp, Homo sapiens
gatgctgtagacatctgt

SEQ ID NO: 6224920 - DNA, 21 bp, Homo sapiens
gatgctgtcttcgtactggga

SEQ ID NO: 6224921 - DNA, 13 bp, Homo sapiens
gatgctgtgaaat

SEQ ID NO: 6224922 - DNA, 19 bp, Homo sapiens
gatgctgtgaaattcccaa

SEQ ID NO: 6224923 - DNA, 16 bp, Homo sapiens
gatgctgtgctatgaa

SEQ ID NO: 6224924 - DNA, 13 bp, Homo sapiens
gatgctgtttgac

SEQ ID NO: 6224925 - DNA, 14 bp, Homo sapiens
gatgctgtttgaca

SEQ ID NO: 6224926 - DNA, 13 bp, Homo sapiens
gatgcttaataaa

SEQ ID NO: 6224927 - DNA, 18 bp, Homo sapiens
gatgcttacatctggaat

SEQ ID NO: 6224928 - DNA, 21 bp, Homo sapiens
gatgcttacatctggaatctg

SEQ ID NO: 6224929 - DNA, 20 bp, Homo sapiens
gatgcttagagggatttctt

SEQ ID NO: 6224930 - DNA, 14 bp, Homo sapiens
gatgcttataataa

SEQ ID NO: 6224931 - DNA, 17 bp, Homo sapiens
gatgcttataataaaga

SEQ ID NO: 6224932 - DNA, 19 bp, Homo sapiens
gatgcttataataaagaaa

SEQ ID NO: 6224933 - DNA, 14 bp, Homo sapiens
gatgcttctctcct

SEQ ID NO: 6224934 - DNA, 15 bp, Homo sapiens
gatgcttctgggaga

SEQ ID NO: 6224935 - DNA, 20 bp, Homo sapiens
gatgcttcttcagagactcc

SEQ ID NO: 6224936 - DNA, 24 bp, Homo sapiens
gatgcttgcctagggcctggtcca

SEQ ID NO: 6224937 - DNA, 20 bp, Homo sapiens
gatgcttggagcaatcagaa

SEQ ID NO: 6224938 - DNA, 16 bp, Homo sapiens
gatgcttgggaagact

SEQ ID NO: 6224939 - DNA, 18 bp, Homo sapiens
gatgcttgtaacaagaaa

SEQ ID NO: 6224940 - DNA, 20 bp, Homo sapiens
gatgcttgtaacaagaaaac

SEQ ID NO: 6224941 - DNA, 14 bp, Homo sapiens
gatgctttaccaaa

SEQ ID NO: 6224942 - DNA, 21 bp, Homo sapiens
gatgctttatgcaactaactg

SEQ ID NO: 6224943 - DNA, 14 bp, Homo sapiens
gatgctttggaaga

SEQ ID NO: 6224944 - DNA, 15 bp, Homo sapiens
gatgcttttaacaga

SEQ ID NO: 6224945 - DNA, 17 bp, Homo sapiens
gatgcttttagctcaaa

SEQ ID NO: 6224946 - DNA, 12 bp, Homo sapiens
aacacttagtat

SEQ ID NO: 6224947 - DNA, 15 bp, Homo sapiens
aacacttattgcttt

SEQ ID NO: 6224948 - DNA, 15 bp, Homo sapiens
aacacttattttctg

SEQ ID NO: 6224949 - DNA, 21 bp, Homo sapiens
aacacttattttctgaattca

SEQ ID NO: 6224950 - DNA, 15 bp, Homo sapiens
aacacttcagacaca

SEQ ID NO: 6224951 - DNA, 21 bp, Homo sapiens
aacacttcattctttatatat

SEQ ID NO: 6224952 - DNA, 23 bp, Homo sapiens
aacacttcattctttatatatgg

SEQ ID NO: 6224953 - DNA, 15 bp, Homo sapiens
aacacttcattttca

SEQ ID NO: 6224954 - DNA, 11 bp, Homo sapiens
aacacttccag

SEQ ID NO: 6224955 - DNA, 15 bp, Homo sapiens
aacacttctccttaa

SEQ ID NO: 6224956 - DNA, 13 bp, Homo sapiens
aacacttctgctt

SEQ ID NO: 6224957 - DNA, 14 bp, Homo sapiens
aacacttctgcttt

SEQ ID NO: 6224958 - DNA, 13 bp, Homo sapiens
aacacttctgtat

SEQ ID NO: 6224959 - DNA, 18 bp, Homo sapiens
aacacttctgtatgcatc

SEQ ID NO: 6224960 - DNA, 23 bp, Homo sapiens
aacacttctgtatgcatcagata

SEQ ID NO: 6224961 - DNA, 14 bp, Homo sapiens
aacacttctgtcct

SEQ ID NO: 6224962 - DNA, 17 bp, Homo sapiens
aacacttgaaaagtgtg

SEQ ID NO: 6224963 - DNA, 22 bp, Homo sapiens
aacacttgcaggggtccctgct

SEQ ID NO: 6224964 - DNA, 19 bp, Homo sapiens
aacacttggaacagtgttt

SEQ ID NO: 6224965 - DNA, 18 bp, Homo sapiens
aacacttggcatacaaaa

SEQ ID NO: 6224966 - DNA, 23 bp, Homo sapiens
aacacttgtgacttttgctttaa

SEQ ID NO: 6224967 - DNA, 22 bp, Homo sapiens
aacactttccctctctggacct

SEQ ID NO: 6224968 - DNA, 18 bp, Homo sapiens
aacactttcctggataaa

SEQ ID NO: 6224969 - DNA, 23 bp, Homo sapiens
aacactttggtattcaatttgat

SEQ ID NO: 6224970 - DNA, 13 bp, Homo sapiens
aacactttgtatt

SEQ ID NO: 6224971 - DNA, 19 bp, Homo sapiens
aacactttttatgacaaaa

SEQ ID NO: 6224972 - DNA, 17 bp, Homo sapiens
aacagaaaaaaaacaca

SEQ ID NO: 6224973 - DNA, 14 bp, Homo sapiens
aacagaaaaacaaa

SEQ ID NO: 6224974 - DNA, 14 bp, Homo sapiens
aacagaaaaacaat

SEQ ID NO: 6224975 - DNA, 23 bp, Homo sapiens
aacagaaaaatatgtaccaagaa

SEQ ID NO: 6224976 - DNA, 20 bp, Homo sapiens
aacagaaaaatgaaatttaa

SEQ ID NO: 6224977 - DNA, 13 bp, Homo sapiens
aacagaaaacaac

SEQ ID NO: 6224978 - DNA, 14 bp, Homo sapiens
aacagaaaacaaca

SEQ ID NO: 6224979 - DNA, 20 bp, Homo sapiens
aacagaaaacaacaaaaaat

SEQ ID NO: 6224980 - DNA, 15 bp, Homo sapiens
aacagaaaacaagaa

SEQ ID NO: 6224981 - DNA, 20 bp, Homo sapiens
aacagaaaagagaagaaaga

SEQ ID NO: 6224982 - DNA, 18 bp, Homo sapiens
aacagaaaaggttctgaa

SEQ ID NO: 6224983 - DNA, 16 bp, Homo sapiens
aacagaaacaaaaaca

SEQ ID NO: 6224984 - DNA, 22 bp, Homo sapiens
aacagaaagcctgggtgacatt

SEQ ID NO: 6224985 - DNA, 18 bp, Homo sapiens
aacagaaagggcaacaat

SEQ ID NO: 6224986 - DNA, 19 bp, Homo sapiens
aacagaaagtcattccttc

SEQ ID NO: 6224987 - DNA, 18 bp, Homo sapiens
aacagaaagtttgtaaaa

SEQ ID NO: 6224988 - DNA, 10 bp, Homo sapiens
aacagaaatg

SEQ ID NO: 6224989 - DNA, 19 bp, Homo sapiens
aacagaaatgctctgatta

SEQ ID NO: 6224990 - DNA, 12 bp, Homo sapiens
aacagaaatgta

SEQ ID NO: 6224991 - DNA, 13 bp, Homo sapiens
aacagaaatgtac

SEQ ID NO: 6224992 - DNA, 22 bp, Homo sapiens
aacagaaattggtaccttgcac

SEQ ID NO: 6224993 - DNA, 21 bp, Homo sapiens
aacagaaattgtatattgtaa

SEQ ID NO: 6224994 - DNA, 11 bp, Homo sapiens
aacagaacagg

SEQ ID NO: 6224995 - DNA, 17 bp, Homo sapiens
aacagaacagggtcatg

SEQ ID NO: 6224996 - DNA, 12 bp, Homo sapiens
aacagaaccaga

SEQ ID NO: 6224997 - DNA, 15 bp, Homo sapiens
aacagaactcccttc

SEQ ID NO: 6224998 - DNA, 23 bp, Homo sapiens
aacagaactcggtgtccccacca

SEQ ID NO: 6224999 - DNA, 20 bp, Homo sapiens
aacagaagaaaatagaattg

SEQ ID NO: 6225000 - DNA, 21 bp, Homo sapiens
aacagaagacaaaattgtaag

SEQ ID NO: 6225001 - DNA, 24 bp, Homo sapiens
aacagaagaggagggacctactga

SEQ ID NO: 6225002 - DNA, 14 bp, Homo sapiens
aacagaagcagcaa

SEQ ID NO: 6225003 - DNA, 19 bp, Homo sapiens
aacagaagcagcaaatgaa

SEQ ID NO: 6225004 - DNA, 22 bp, Homo sapiens
aacagaagctcttactctttcc

SEQ ID NO: 6225005 - DNA, 13 bp, Homo sapiens
aacagaaggatga

SEQ ID NO: 6225006 - DNA, 18 bp, Homo sapiens
aacagaagggagggcaga

SEQ ID NO: 6225007 - DNA, 21 bp, Homo sapiens
aacagaagtatcaagccatgt

SEQ ID NO: 6225008 - DNA, 14 bp, Homo sapiens
aacagaagtgcatc

SEQ ID NO: 6225009 - DNA, 13 bp, Homo sapiens
aacagaataaagc

SEQ ID NO: 6225010 - DNA, 15 bp, Homo sapiens
aacagaatattctgt

SEQ ID NO: 6225011 - DNA, 16 bp, Homo sapiens
aacagaatcagtgtta

SEQ ID NO: 6225012 - DNA, 21 bp, Homo sapiens
aacagaatcagtgttaaattc

SEQ ID NO: 6225013 - DNA, 14 bp, Homo sapiens
aacagaatgtttta

SEQ ID NO: 6225014 - DNA, 13 bp, Homo sapiens
aacagaatttatg

SEQ ID NO: 6225015 - DNA, 18 bp, Homo sapiens
aacagaattttccattta

SEQ ID NO: 6225016 - DNA, 15 bp, Homo sapiens
aacagacaaaaacaa

SEQ ID NO: 6225017 - DNA, 13 bp, Homo sapiens
aacagacaagcaa

SEQ ID NO: 6225018 - DNA, 21 bp, Homo sapiens
aacagacaagcaacccaaact

SEQ ID NO: 6225019 - DNA, 12 bp, Homo sapiens
aacagacactgt

SEQ ID NO: 6225020 - DNA, 13 bp, Homo sapiens
aacagacactgta

SEQ ID NO: 6225021 - DNA, 19 bp, Homo sapiens
aacagacagaaagagacac

SEQ ID NO: 6225022 - DNA, 12 bp, Homo sapiens
aacagacattgt

SEQ ID NO: 6225023 - DNA, 14 bp, Homo sapiens
aacagaccagcata

SEQ ID NO: 6225024 - DNA, 19 bp, Homo sapiens
aacagaccagcatagttct

SEQ ID NO: 6225025 - DNA, 18 bp, Homo sapiens
aacagaccccctctagaa

SEQ ID NO: 6225026 - DNA, 18 bp, Homo sapiens
aacagacctcggctgtgt

SEQ ID NO: 6225027 - DNA, 15 bp, Homo sapiens
aacagactagaagta

SEQ ID NO: 6225028 - DNA, 21 bp, Homo sapiens
aacagactcaatgtccccctc

SEQ ID NO: 6225029 - DNA, 19 bp, Homo sapiens
aacagactcgattcatatt

SEQ ID NO: 6225030 - DNA, 19 bp, Homo sapiens
aacagactgccttatatta

SEQ ID NO: 6225031 - DNA, 21 bp, Homo sapiens
aacagactgccttatattatt

SEQ ID NO: 6225032 - DNA, 17 bp, Homo sapiens
aacagactgttgagtta

SEQ ID NO: 6225033 - DNA, 20 bp, Homo sapiens
aacagagaaagaaaaggcaa

SEQ ID NO: 6225034 - DNA, 16 bp, Homo sapiens
aacagagaaggcagga

SEQ ID NO: 6225035 - DNA, 16 bp, Homo sapiens
aacagagactctggaa

SEQ ID NO: 6225036 - DNA, 13 bp, Homo sapiens
aacagagactgga

SEQ ID NO: 6225037 - DNA, 20 bp, Homo sapiens
aacagagccattcccttgga

SEQ ID NO: 6225038 - DNA, 15 bp, Homo sapiens
aacagagccttcaca

SEQ ID NO: 6225039 - DNA, 19 bp, Homo sapiens
aacagagccttcacaacca

SEQ ID NO: 6225040 - DNA, 17 bp, Homo sapiens
aacagagcgggcctctt

SEQ ID NO: 6225041 - DNA, 20 bp, Homo sapiens
aacagaggaagaatttgtta

SEQ ID NO: 6225042 - DNA, 16 bp, Homo sapiens
aacagaggaggccagc

SEQ ID NO: 6225043 - DNA, 17 bp, Homo sapiens
aacagaggcctccccca

SEQ ID NO: 6225044 - DNA, 23 bp, Homo sapiens
aacagagggagtttaatacagga

SEQ ID NO: 6225045 - DNA, 12 bp, Homo sapiens
aacagagggcca

SEQ ID NO: 6225046 - DNA, 19 bp, Homo sapiens
aacagagggctgcattcga

SEQ ID NO: 6225047 - DNA, 14 bp, Homo sapiens
aacagaggtaaaaa

SEQ ID NO: 6225048 - DNA, 21 bp, Homo sapiens
aacagaggtaaaaaaaagaag

SEQ ID NO: 6225049 - DNA, 22 bp, Homo sapiens
aacagaggtaaaaaaaagaagt

SEQ ID NO: 6225050 - DNA, 16 bp, Homo sapiens
aacagagtaatcttgt

SEQ ID NO: 6225051 - DNA, 23 bp, Homo sapiens
aacagagtccgggagaatgctgg

SEQ ID NO: 6225052 - DNA, 17 bp, Homo sapiens
aacagagtgaaaaatct

SEQ ID NO: 6225053 - DNA, 14 bp, Homo sapiens
aacagagtgcctgc

SEQ ID NO: 6225054 - DNA, 20 bp, Homo sapiens
aacagagtggattgggctgc

SEQ ID NO: 6225055 - DNA, 13 bp, Homo sapiens
aacagagttttct

SEQ ID NO: 6225056 - DNA, 17 bp, Homo sapiens
aacagataaagaaactg

SEQ ID NO: 6225057 - DNA, 18 bp, Homo sapiens
aacagataagcaagagag

SEQ ID NO: 6225058 - DNA, 19 bp, Homo sapiens
aacagataagcaagagaga

SEQ ID NO: 6225059 - DNA, 13 bp, Homo sapiens
aacagataatcag

SEQ ID NO: 6225060 - DNA, 22 bp, Homo sapiens
aacagataccatactcatttct

SEQ ID NO: 6225061 - DNA, 23 bp, Homo sapiens
aacagatagatgttgctctttca

SEQ ID NO: 6225062 - DNA, 20 bp, Homo sapiens
aacagatataaatggctggt

SEQ ID NO: 6225063 - DNA, 15 bp, Homo sapiens
aacagatatgttttt

SEQ ID NO: 6225064 - DNA, 11 bp, Homo sapiens
aacagatattt

SEQ ID NO: 6225065 - DNA, 16 bp, Homo sapiens
aacagatcaatttgta

SEQ ID NO: 6225066 - DNA, 20 bp, Homo sapiens
aacagatctccaaagctttc

SEQ ID NO: 6225067 - DNA, 13 bp, Homo sapiens
aacagatctggaa

SEQ ID NO: 6225068 - DNA, 22 bp, Homo sapiens
aacagatctggaacctcagcct

SEQ ID NO: 6225069 - DNA, 14 bp, Homo sapiens
aacagatgaaaagc

SEQ ID NO: 6225070 - DNA, 20 bp, Homo sapiens
aacagatgaaaagcctctgt

SEQ ID NO: 6225071 - DNA, 16 bp, Homo sapiens
aacagatgaataaact

SEQ ID NO: 6225072 - DNA, 21 bp, Homo sapiens
aacagatgatgagaatttcta

SEQ ID NO: 6225073 - DNA, 21 bp, Homo sapiens
aacagatgcaatgtgctactg

SEQ ID NO: 6225074 - DNA, 15 bp, Homo sapiens
aacagatgctaggaa

SEQ ID NO: 6225075 - DNA, 14 bp, Homo sapiens
aacagatgcttttc

SEQ ID NO: 6225076 - DNA, 13 bp, Homo sapiens
aacagatgtaaat

SEQ ID NO: 6225077 - DNA, 13 bp, Homo sapiens
aacagatgtgaaa

SEQ ID NO: 6225078 - DNA, 17 bp, Homo sapiens
aacagatgtttcttttg

SEQ ID NO: 6225079 - DNA, 20 bp, Homo sapiens
aacagatgtttcttttgtat

SEQ ID NO: 6225080 - DNA, 16 bp, Homo sapiens
aacagattataataaa

SEQ ID NO: 6225081 - DNA, 15 bp, Homo sapiens
aacagattcacactg

SEQ ID NO: 6225082 - DNA, 16 bp, Homo sapiens
aacagattcacactgt

SEQ ID NO: 6225083 - DNA, 18 bp, Homo sapiens
aacagattcacactgtct

SEQ ID NO: 6225084 - DNA, 20 bp, Homo sapiens
aacagattcaggccagccca

SEQ ID NO: 6225085 - DNA, 13 bp, Homo sapiens
aacagattctgat

SEQ ID NO: 6225086 - DNA, 18 bp, Homo sapiens
aacagattctgattccct

SEQ ID NO: 6225087 - DNA, 20 bp, Homo sapiens
aacagattctgattcccttc

SEQ ID NO: 6225088 - DNA, 16 bp, Homo sapiens
aacagattgtttgcaa

SEQ ID NO: 6225089 - DNA, 19 bp, Homo sapiens
aacagatttaagcaagacc

SEQ ID NO: 6225090 - DNA, 20 bp, Homo sapiens
aacagatttaagcaagacca

SEQ ID NO: 6225091 - DNA, 19 bp, Homo sapiens
aacagatttctaagttaaa

SEQ ID NO: 6225092 - DNA, 14 bp, Homo sapiens
aacagatttggaaa

SEQ ID NO: 6225093 - DNA, 18 bp, Homo sapiens
aacagatttggtgaattt

SEQ ID NO: 6225094 - DNA, 21 bp, Homo sapiens
aacagatttgtgaactcagcc

SEQ ID NO: 6225095 - DNA, 19 bp, Homo sapiens
aacagcaaaccaagagatt

SEQ ID NO: 6225096 - DNA, 20 bp, Homo sapiens
aacagcaaatgcaaaaactc

SEQ ID NO: 6225097 - DNA, 13 bp, Homo sapiens
aacagcaaattaa

SEQ ID NO: 6225098 - DNA, 14 bp, Homo sapiens
aacagcaaattaat

SEQ ID NO: 6225099 - DNA, 18 bp, Homo sapiens
aacagcaaattaatgtgt

SEQ ID NO: 6225100 - DNA, 13 bp, Homo sapiens
aacagcaactaca

SEQ ID NO: 6225101 - DNA, 13 bp, Homo sapiens
aacagcaagaaat

SEQ ID NO: 6225102 - DNA, 14 bp, Homo sapiens
aacagcaagaaata

SEQ ID NO: 6225103 - DNA, 17 bp, Homo sapiens
aacagcaagaaataaat

SEQ ID NO: 6225104 - DNA, 14 bp, Homo sapiens
aacagcaagggaga

SEQ ID NO: 6225105 - DNA, 15 bp, Homo sapiens
aacagcaagtatgaa

SEQ ID NO: 6225106 - DNA, 15 bp, Homo sapiens
aacagcaagtgtgaa

SEQ ID NO: 6225107 - DNA, 20 bp, Homo sapiens
aacagcaagtgtttgtggga

SEQ ID NO: 6225108 - DNA, 17 bp, Homo sapiens
aacagcacacaggcagc

SEQ ID NO: 6225109 - DNA, 19 bp, Homo sapiens
aacagcacacaggcagcca

SEQ ID NO: 6225110 - DNA, 14 bp, Homo sapiens
aacagcacacctgt

SEQ ID NO: 6225111 - DNA, 18 bp, Homo sapiens
aacagcacacctgtgtcc

SEQ ID NO: 6225112 - DNA, 21 bp, Homo sapiens
aacagcacagggaagcaaata

SEQ ID NO: 6225113 - DNA, 23 bp, Homo sapiens
aacagcactggctctctccagga

SEQ ID NO: 6225114 - DNA, 16 bp, Homo sapiens
aacagcactttctgta

SEQ ID NO: 6225115 - DNA, 23 bp, Homo sapiens
aacagcactttctgtagtaataa

SEQ ID NO: 6225116 - DNA, 17 bp, Homo sapiens
aacagcacttttcctct

SEQ ID NO: 6225117 - DNA, 15 bp, Homo sapiens
aacagcagaaagact

SEQ ID NO: 6225118 - DNA, 18 bp, Homo sapiens
aacagcagctgaagccag

SEQ ID NO: 6225119 - DNA, 14 bp, Homo sapiens
aacagcaggaggca

SEQ ID NO: 6225120 - DNA, 13 bp, Homo sapiens
aacagcaggccca

SEQ ID NO: 6225121 - DNA, 17 bp, Homo sapiens
aacagcaggcccaccta

SEQ ID NO: 6225122 - DNA, 20 bp, Homo sapiens
aacagcagtctccttcagca

SEQ ID NO: 6225123 - DNA, 11 bp, Homo sapiens
aacagcagtgt

SEQ ID NO: 6225124 - DNA, 15 bp, Homo sapiens
aacagcagtgttccc

SEQ ID NO: 6225125 - DNA, 16 bp, Homo sapiens
aacagcagtgttctca

SEQ ID NO: 6225126 - DNA, 16 bp, Homo sapiens
gatgcttttatagctg

SEQ ID NO: 6225127 - DNA, 16 bp, Homo sapiens
gatgcttttctgtctc

SEQ ID NO: 6225128 - DNA, 14 bp, Homo sapiens
gatgcttttgctgc

SEQ ID NO: 6225129 - DNA, 15 bp, Homo sapiens
gatgcttttgctgct

SEQ ID NO: 6225130 - DNA, 16 bp, Homo sapiens
gatgcttttgctgctg

SEQ ID NO: 6225131 - DNA, 21 bp, Homo sapiens
gatgcttttgtgagaaaggga

SEQ ID NO: 6225132 - DNA, 14 bp, Homo sapiens
gatggaaaaaaaaa

SEQ ID NO: 6225133 - DNA, 22 bp, Homo sapiens
gatggaaaaaccacccccaaat

SEQ ID NO: 6225134 - DNA, 18 bp, Homo sapiens
gatggaaaaactgaggct

SEQ ID NO: 6225135 - DNA, 17 bp, Homo sapiens
gatggaaaaagaatata

SEQ ID NO: 6225136 - DNA, 14 bp, Homo sapiens
gatggaaaaatcac

SEQ ID NO: 6225137 - DNA, 18 bp, Homo sapiens
gatggaaaaatcacccag

SEQ ID NO: 6225138 - DNA, 18 bp, Homo sapiens
gatggaaaagtgtccttc

SEQ ID NO: 6225139 - DNA, 13 bp, Homo sapiens
gatggaaaataaa

SEQ ID NO: 6225140 - DNA, 15 bp, Homo sapiens
gatggaaacaaagtg

SEQ ID NO: 6225141 - DNA, 16 bp, Homo sapiens
gatggaaacaatgtgg

SEQ ID NO: 6225142 - DNA, 17 bp, Homo sapiens
gatggaaactgccaaac

SEQ ID NO: 6225143 - DNA, 20 bp, Homo sapiens
gatggaaatacagttatttc

SEQ ID NO: 6225144 - DNA, 17 bp, Homo sapiens
gatggaaatatgttcta

SEQ ID NO: 6225145 - DNA, 21 bp, Homo sapiens
gatggaacaggctcagatctc

SEQ ID NO: 6225146 - DNA, 13 bp, Homo sapiens
gatggaacagtga

SEQ ID NO: 6225147 - DNA, 17 bp, Homo sapiens
gatggaacgggcatggg

SEQ ID NO: 6225148 - DNA, 16 bp, Homo sapiens
gatggaactgtgtatt

SEQ ID NO: 6225149 - DNA, 17 bp, Homo sapiens
gatggaagaaagaagca

SEQ ID NO: 6225150 - DNA, 13 bp, Homo sapiens
gatggaaggcgtg

SEQ ID NO: 6225151 - DNA, 17 bp, Homo sapiens
gatggaagtaaagcctc

SEQ ID NO: 6225152 - DNA, 19 bp, Homo sapiens
gatggaagtcacctttctg

SEQ ID NO: 6225153 - DNA, 21 bp, Homo sapiens
gatggaagtgggccagtcctg

SEQ ID NO: 6225154 - DNA, 21 bp, Homo sapiens
gatggaagttgcagtgagctg

SEQ ID NO: 6225155 - DNA, 16 bp, Homo sapiens
gatggaatagaaaaga

SEQ ID NO: 6225156 - DNA, 23 bp, Homo sapiens
gatggaatggaaaagcaacttca

SEQ ID NO: 6225157 - DNA, 16 bp, Homo sapiens
gatggaatgtaaaata

SEQ ID NO: 6225158 - DNA, 17 bp, Homo sapiens
gatggaattaaatgtgg

SEQ ID NO: 6225159 - DNA, 20 bp, Homo sapiens
gatggaatttttctgtactt

SEQ ID NO: 6225160 - DNA, 13 bp, Homo sapiens
gatggaatttttt

SEQ ID NO: 6225161 - DNA, 20 bp, Homo sapiens
gatggaatttttttgtacga

SEQ ID NO: 6225162 - DNA, 15 bp, Homo sapiens
gatggacacccccag

SEQ ID NO: 6225163 - DNA, 12 bp, Homo sapiens
gatggacagaat

SEQ ID NO: 6225164 - DNA, 16 bp, Homo sapiens
gatggacagacacctc

SEQ ID NO: 6225165 - DNA, 22 bp, Homo sapiens
gatggacagttcacaccctgca

SEQ ID NO: 6225166 - DNA, 12 bp, Homo sapiens
gatggaccaaag

SEQ ID NO: 6225167 - DNA, 14 bp, Homo sapiens
gatggaccagtaga

SEQ ID NO: 6225168 - DNA, 16 bp, Homo sapiens
gatggaccagtagaca

SEQ ID NO: 6225169 - DNA, 14 bp, Homo sapiens
gatggacccctccc

SEQ ID NO: 6225170 - DNA, 20 bp, Homo sapiens
gatggaccctcgcagcaggt

SEQ ID NO: 6225171 - DNA, 20 bp, Homo sapiens
gatggaccgggtgggcctgg

SEQ ID NO: 6225172 - DNA, 14 bp, Homo sapiens
gatggacgcaggcc

SEQ ID NO: 6225173 - DNA, 14 bp, Homo sapiens
gatggacgctgccg

SEQ ID NO: 6225174 - DNA, 16 bp, Homo sapiens
gatggacgctgccggg

SEQ ID NO: 6225175 - DNA, 18 bp, Homo sapiens
gatggacgctgccgggag

SEQ ID NO: 6225176 - DNA, 14 bp, Homo sapiens
gatggactctgaaa

SEQ ID NO: 6225177 - DNA, 16 bp, Homo sapiens
gatggactggggagca

SEQ ID NO: 6225178 - DNA, 22 bp, Homo sapiens
gatggacttgtgattggctgca

SEQ ID NO: 6225179 - DNA, 19 bp, Homo sapiens
gatggacttttgggggttg

SEQ ID NO: 6225180 - DNA, 21 bp, Homo sapiens
gatggacttttgggggttgga

SEQ ID NO: 6225181 - DNA, 16 bp, Homo sapiens
gatggagaaggaaaag

SEQ ID NO: 6225182 - DNA, 14 bp, Homo sapiens
gatggagaaggaag

SEQ ID NO: 6225183 - DNA, 19 bp, Homo sapiens
gatggagacaccctctggg

SEQ ID NO: 6225184 - DNA, 20 bp, Homo sapiens
gatggagacaccctctgggg

SEQ ID NO: 6225185 - DNA, 22 bp, Homo sapiens
gatggagactggtcctgtgtgc

SEQ ID NO: 6225186 - DNA, 23 bp, Homo sapiens
gatggagactggtcctgtgtgca

SEQ ID NO: 6225187 - DNA, 13 bp, Homo sapiens
gatggagagaata

SEQ ID NO: 6225188 - DNA, 14 bp, Homo sapiens
gatggagaggacag

SEQ ID NO: 6225189 - DNA, 14 bp, Homo sapiens
gatggagaggagaa

SEQ ID NO: 6225190 - DNA, 14 bp, Homo sapiens
gatggagagggatg

SEQ ID NO: 6225191 - DNA, 16 bp, Homo sapiens
gatggagagggatgga

SEQ ID NO: 6225192 - DNA, 17 bp, Homo sapiens
gatggagagggatggaa

SEQ ID NO: 6225193 - DNA, 15 bp, Homo sapiens
gatggagcaagctct

SEQ ID NO: 6225194 - DNA, 20 bp, Homo sapiens
gatggagcccagttggaaaa

SEQ ID NO: 6225195 - DNA, 18 bp, Homo sapiens
gatggagccccaccttgt

SEQ ID NO: 6225196 - DNA, 12 bp, Homo sapiens
gatggagctgac

SEQ ID NO: 6225197 - DNA, 12 bp, Homo sapiens
gatggagctttg

SEQ ID NO: 6225198 - DNA, 12 bp, Homo sapiens
gatggaggaaaa

SEQ ID NO: 6225199 - DNA, 14 bp, Homo sapiens
gatggaggagaaat

SEQ ID NO: 6225200 - DNA, 16 bp, Homo sapiens
gatggaggagaaataa

SEQ ID NO: 6225201 - DNA, 11 bp, Homo sapiens
gatggaggagg

SEQ ID NO: 6225202 - DNA, 15 bp, Homo sapiens
gatggaggccagagt

SEQ ID NO: 6225203 - DNA, 12 bp, Homo sapiens
gatggagggaag

SEQ ID NO: 6225204 - DNA, 13 bp, Homo sapiens
gatggagggaaga

SEQ ID NO: 6225205 - DNA, 15 bp, Homo sapiens
gatggagggggctgg

SEQ ID NO: 6225206 - DNA, 18 bp, Homo sapiens
gatggagggggctggggt

SEQ ID NO: 6225207 - DNA, 13 bp, Homo sapiens
gatggagggtcca

SEQ ID NO: 6225208 - DNA, 17 bp, Homo sapiens
gatggagggtggaaata

SEQ ID NO: 6225209 - DNA, 18 bp, Homo sapiens
gatggaggtagggctggc

SEQ ID NO: 6225210 - DNA, 16 bp, Homo sapiens
gatggaggtatttgaa

SEQ ID NO: 6225211 - DNA, 23 bp, Homo sapiens
gatggaggttctcagagccaagt

SEQ ID NO: 6225212 - DNA, 21 bp, Homo sapiens
gatggagtctcactcttgtca

SEQ ID NO: 6225213 - DNA, 18 bp, Homo sapiens
gatggagtgtgcagacag

SEQ ID NO: 6225214 - DNA, 18 bp, Homo sapiens
gatggagttcttgtgcca

SEQ ID NO: 6225215 - DNA, 15 bp, Homo sapiens
gatggagtttcactt

SEQ ID NO: 6225216 - DNA, 22 bp, Homo sapiens
gatggagtttctctagaagctc

SEQ ID NO: 6225217 - DNA, 16 bp, Homo sapiens
gatggagtttctctct

SEQ ID NO: 6225218 - DNA, 17 bp, Homo sapiens
gatggatattagatgcc

SEQ ID NO: 6225219 - DNA, 22 bp, Homo sapiens
gatggatctgctccatgcagat

SEQ ID NO: 6225220 - DNA, 17 bp, Homo sapiens
gatggatggcaccctgg

SEQ ID NO: 6225221 - DNA, 12 bp, Homo sapiens
gatggattccaa

SEQ ID NO: 6225222 - DNA, 22 bp, Homo sapiens
gatggattcccccccctttcct

SEQ ID NO: 6225223 - DNA, 17 bp, Homo sapiens
gatggattctccactca

SEQ ID NO: 6225224 - DNA, 22 bp, Homo sapiens
gatggatttccagccaaagcct

SEQ ID NO: 6225225 - DNA, 18 bp, Homo sapiens
gatggatttgacacactc

SEQ ID NO: 6225226 - DNA, 19 bp, Homo sapiens
gatggatttgcctgtgcca

SEQ ID NO: 6225227 - DNA, 12 bp, Homo sapiens
gatggattttat

SEQ ID NO: 6225228 - DNA, 19 bp, Homo sapiens
gatggcaaaaaaaaaaaag

SEQ ID NO: 6225229 - DNA, 20 bp, Homo sapiens
gatggcaaagaaggagagca

SEQ ID NO: 6225230 - DNA, 16 bp, Homo sapiens
gatggcaacagatctg

SEQ ID NO: 6225231 - DNA, 19 bp, Homo sapiens
gatggcaacattggacaga

SEQ ID NO: 6225232 - DNA, 18 bp, Homo sapiens
gatggcaaccagaccatt

SEQ ID NO: 6225233 - DNA, 21 bp, Homo sapiens
gatggcaactgtattaaagaa

SEQ ID NO: 6225234 - DNA, 23 bp, Homo sapiens
gatggcaactgtattaaagaaaa

SEQ ID NO: 6225235 - DNA, 13 bp, Homo sapiens
gatggcacaatga

SEQ ID NO: 6225236 - DNA, 17 bp, Homo sapiens
gatggcaccctggaacc

SEQ ID NO: 6225237 - DNA, 23 bp, Homo sapiens
gatggcacctgtggccagagcac

SEQ ID NO: 6225238 - DNA, 15 bp, Homo sapiens
gatggcactgtccag

SEQ ID NO: 6225239 - DNA, 18 bp, Homo sapiens
gatggcactgtccagggc

SEQ ID NO: 6225240 - DNA, 21 bp, Homo sapiens
gatggcactgtccagggccca

SEQ ID NO: 6225241 - DNA, 13 bp, Homo sapiens
gatggcagactct

SEQ ID NO: 6225242 - DNA, 18 bp, Homo sapiens
gatggcagactctttaat

SEQ ID NO: 6225243 - DNA, 14 bp, Homo sapiens
gatggcagagccag

SEQ ID NO: 6225244 - DNA, 23 bp, Homo sapiens
gatggcagcctcagggcttcctt

SEQ ID NO: 6225245 - DNA, 17 bp, Homo sapiens
gatggcagcttttaaaa

SEQ ID NO: 6225246 - DNA, 20 bp, Homo sapiens
gatggcaggacgtgggctgg

SEQ ID NO: 6225247 - DNA, 13 bp, Homo sapiens
gatggcaggagag

SEQ ID NO: 6225248 - DNA, 13 bp, Homo sapiens
gatggcaggatgg

SEQ ID NO: 6225249 - DNA, 15 bp, Homo sapiens
gatggcaggatggcc

SEQ ID NO: 6225250 - DNA, 18 bp, Homo sapiens
gatggcaggatggcctgg

SEQ ID NO: 6225251 - DNA, 13 bp, Homo sapiens
gatggcaggcctg

SEQ ID NO: 6225252 - DNA, 17 bp, Homo sapiens
gatggcagtggctgtga

SEQ ID NO: 6225253 - DNA, 21 bp, Homo sapiens
gatggcatcctgtgaagtcct

SEQ ID NO: 6225254 - DNA, 15 bp, Homo sapiens
gatggcatctagcca

SEQ ID NO: 6225255 - DNA, 15 bp, Homo sapiens
gatggccaagagcat

SEQ ID NO: 6225256 - DNA, 17 bp, Homo sapiens
gatggccactgctcttg

SEQ ID NO: 6225257 - DNA, 19 bp, Homo sapiens
gatggccactgctcttgtg

SEQ ID NO: 6225258 - DNA, 13 bp, Homo sapiens
gatggccagagga

SEQ ID NO: 6225259 - DNA, 14 bp, Homo sapiens
gatggccagcccct

SEQ ID NO: 6225260 - DNA, 22 bp, Homo sapiens
gatggccagcccctggggccca

SEQ ID NO: 6225261 - DNA, 19 bp, Homo sapiens
gatggccagccccttagac

SEQ ID NO: 6225262 - DNA, 13 bp, Homo sapiens
gatggccaggctg

SEQ ID NO: 6225263 - DNA, 12 bp, Homo sapiens
gatggccagtgt

SEQ ID NO: 6225264 - DNA, 17 bp, Homo sapiens
gatggcccaagggatgg

SEQ ID NO: 6225265 - DNA, 19 bp, Homo sapiens
gatggcccagcaggcaggc

SEQ ID NO: 6225266 - DNA, 20 bp, Homo sapiens
gatggcccattctacttgct

SEQ ID NO: 6225267 - DNA, 21 bp, Homo sapiens
gatggccccaacaagcacccc

SEQ ID NO: 6225268 - DNA, 22 bp, Homo sapiens
gatggccccaacaagcaccccg

SEQ ID NO: 6225269 - DNA, 15 bp, Homo sapiens
gatggccccagcaca

SEQ ID NO: 6225270 - DNA, 14 bp, Homo sapiens
gatggcccctccag

SEQ ID NO: 6225271 - DNA, 18 bp, Homo sapiens
gatggcccctccagcaca

SEQ ID NO: 6225272 - DNA, 19 bp, Homo sapiens
gatggcccctccagcacac

SEQ ID NO: 6225273 - DNA, 14 bp, Homo sapiens
gatggcccctcctt

SEQ ID NO: 6225274 - DNA, 18 bp, Homo sapiens
gatggcccctccttgcaa

SEQ ID NO: 6225275 - DNA, 23 bp, Homo sapiens
gatggcccctccttgcaaccagg

SEQ ID NO: 6225276 - DNA, 15 bp, Homo sapiens
gatggcccgagagct

SEQ ID NO: 6225277 - DNA, 19 bp, Homo sapiens
gatggcccgagagctggga

SEQ ID NO: 6225278 - DNA, 13 bp, Homo sapiens
gatggccggctgg

SEQ ID NO: 6225279 - DNA, 22 bp, Homo sapiens
gatggccgggcgcggtggctca

SEQ ID NO: 6225280 - DNA, 18 bp, Homo sapiens
gatggccgggctgctgct

SEQ ID NO: 6225281 - DNA, 12 bp, Homo sapiens
gatggcctctgg

SEQ ID NO: 6225282 - DNA, 21 bp, Homo sapiens
gatggcctctggggcaggacc

SEQ ID NO: 6225283 - DNA, 13 bp, Homo sapiens
gatggcctgagaa

SEQ ID NO: 6225284 - DNA, 12 bp, Homo sapiens
gatggcctggcc

SEQ ID NO: 6225285 - DNA, 14 bp, Homo sapiens
gatggccttaattt

SEQ ID NO: 6225286 - DNA, 20 bp, Homo sapiens
gatggcctttccttccctct

SEQ ID NO: 6225287 - DNA, 16 bp, Homo sapiens
gatggcctttggaccc

SEQ ID NO: 6225288 - DNA, 21 bp, Homo sapiens
gatggcctttggacccagggc

SEQ ID NO: 6225289 - DNA, 22 bp, Homo sapiens
gatggcctttggacccagggcc

SEQ ID NO: 6225290 - DNA, 18 bp, Homo sapiens
gatggcgaccaccaaagt

SEQ ID NO: 6225291 - DNA, 19 bp, Homo sapiens
gatggcgaccaccaaagtc

SEQ ID NO: 6225292 - DNA, 21 bp, Homo sapiens
gatggcgcacccggcagcccc

SEQ ID NO: 6225293 - DNA, 14 bp, Homo sapiens
gatggcgcaggaac

SEQ ID NO: 6225294 - DNA, 13 bp, Homo sapiens
gatggcgcgggag

SEQ ID NO: 6225295 - DNA, 17 bp, Homo sapiens
gatggcgcgggaggcac

SEQ ID NO: 6225296 - DNA, 19 bp, Homo sapiens
gatggcgctattgcactcc

SEQ ID NO: 6225297 - DNA, 15 bp, Homo sapiens
gatggcgggcactgg

SEQ ID NO: 6225298 - DNA, 21 bp, Homo sapiens
gatggcggggatctgggaggg

SEQ ID NO: 6225299 - DNA, 14 bp, Homo sapiens
gatggcgggtgggg

SEQ ID NO: 6225300 - DNA, 20 bp, Homo sapiens
gatggcgtgtcccctgcctg

SEQ ID NO: 6225301 - DNA, 21 bp, Homo sapiens
gatggctaaaaccatcatagt

SEQ ID NO: 6225302 - DNA, 19 bp, Homo sapiens
gatggctatattaggcatg

SEQ ID NO: 6225303 - DNA, 17 bp, Homo sapiens
gatggctcaagacaagg

SEQ ID NO: 6225304 - DNA, 13 bp, Homo sapiens
gatggctcccagg

SEQ ID NO: 6225305 - DNA, 23 bp, Homo sapiens
gatggctccctgggctggcatgg

SEQ ID NO: 6225306 - DNA, 20 bp, Homo sapiens
aacagcagtgttctcacagt

SEQ ID NO: 6225307 - DNA, 18 bp, Homo sapiens
aacagcagtttcaggtag

SEQ ID NO: 6225308 - DNA, 18 bp, Homo sapiens
aacagcatcaaaatacaa

SEQ ID NO: 6225309 - DNA, 15 bp, Homo sapiens
aacagcatctccaag

SEQ ID NO: 6225310 - DNA, 22 bp, Homo sapiens
aacagcatctgcctctattcaa

SEQ ID NO: 6225311 - DNA, 13 bp, Homo sapiens
aacagcatggaaa

SEQ ID NO: 6225312 - DNA, 17 bp, Homo sapiens
aacagcatgtctactgc

SEQ ID NO: 6225313 - DNA, 15 bp, Homo sapiens
aacagcattagatag

SEQ ID NO: 6225314 - DNA, 16 bp, Homo sapiens
aacagccaacaggtgg

SEQ ID NO: 6225315 - DNA, 13 bp, Homo sapiens
aacagccaagctg

SEQ ID NO: 6225316 - DNA, 18 bp, Homo sapiens
aacagccaagctggcaca

SEQ ID NO: 6225317 - DNA, 15 bp, Homo sapiens
aacagccaagtgtga

SEQ ID NO: 6225318 - DNA, 15 bp, Homo sapiens
aacagccatatctga

SEQ ID NO: 6225319 - DNA, 11 bp, Homo sapiens
aacagccatgc

SEQ ID NO: 6225320 - DNA, 16 bp, Homo sapiens
aacagccatgcccgca

SEQ ID NO: 6225321 - DNA, 22 bp, Homo sapiens
aacagccatgtccaagttcttc

SEQ ID NO: 6225322 - DNA, 24 bp, Homo sapiens
aacagccattgcggccccaggagg

SEQ ID NO: 6225323 - DNA, 16 bp, Homo sapiens
aacagccatttaggca

SEQ ID NO: 6225324 - DNA, 20 bp, Homo sapiens
aacagcccagcaagaaggag

SEQ ID NO: 6225325 - DNA, 14 bp, Homo sapiens
aacagcccatttta

SEQ ID NO: 6225326 - DNA, 21 bp, Homo sapiens
aacagcccattttatctttga

SEQ ID NO: 6225327 - DNA, 19 bp, Homo sapiens
aacagccccccccttgaat

SEQ ID NO: 6225328 - DNA, 19 bp, Homo sapiens
aacagcccccctgctgctg

SEQ ID NO: 6225329 - DNA, 19 bp, Homo sapiens
aacagccctcctctgcact

SEQ ID NO: 6225330 - DNA, 12 bp, Homo sapiens
aacagcccttcc

SEQ ID NO: 6225331 - DNA, 20 bp, Homo sapiens
aacagcccttccttggggaa

SEQ ID NO: 6225332 - DNA, 20 bp, Homo sapiens
aacagccgctcctgtctgcc

SEQ ID NO: 6225333 - DNA, 14 bp, Homo sapiens
aacagcctcacaga

SEQ ID NO: 6225334 - DNA, 13 bp, Homo sapiens
aacagcctcactt

SEQ ID NO: 6225335 - DNA, 13 bp, Homo sapiens
aacagcctgagaa

SEQ ID NO: 6225336 - DNA, 22 bp, Homo sapiens
aacagcctgtttgggaggctgg

SEQ ID NO: 6225337 - DNA, 11 bp, Homo sapiens
aacagccttag

SEQ ID NO: 6225338 - DNA, 16 bp, Homo sapiens
aacagccttagctgcc

SEQ ID NO: 6225339 - DNA, 14 bp, Homo sapiens
aacagcctttgaat

SEQ ID NO: 6225340 - DNA, 18 bp, Homo sapiens
aacagcctttgaatgtaa

SEQ ID NO: 6225341 - DNA, 19 bp, Homo sapiens
aacagcctttgaatgtaac

SEQ ID NO: 6225342 - DNA, 21 bp, Homo sapiens
aacagcctttttgtaatttat

SEQ ID NO: 6225343 - DNA, 23 bp, Homo sapiens
aacagcgtttaagactgtaatga

SEQ ID NO: 6225344 - DNA, 16 bp, Homo sapiens
aacagctaaatttgga

SEQ ID NO: 6225345 - DNA, 19 bp, Homo sapiens
aacagctacaaacttttaa

SEQ ID NO: 6225346 - DNA, 21 bp, Homo sapiens
aacagctacaacagcctcact

SEQ ID NO: 6225347 - DNA, 22 bp, Homo sapiens
aacagctacaacagcctcactt

SEQ ID NO: 6225348 - DNA, 24 bp, Homo sapiens
aacagctaggttaataggaggaca

SEQ ID NO: 6225349 - DNA, 18 bp, Homo sapiens
aacagctatgggagcccc

SEQ ID NO: 6225350 - DNA, 21 bp, Homo sapiens
aacagctattatatcagcttt

SEQ ID NO: 6225351 - DNA, 18 bp, Homo sapiens
aacagctatttaaggggg

SEQ ID NO: 6225352 - DNA, 22 bp, Homo sapiens
aacagctatttcccttttctgt

SEQ ID NO: 6225353 - DNA, 11 bp, Homo sapiens
aacagctcagc

SEQ ID NO: 6225354 - DNA, 12 bp, Homo sapiens
aacagctcccag

SEQ ID NO: 6225355 - DNA, 13 bp, Homo sapiens
aacagctccttgg

SEQ ID NO: 6225356 - DNA, 22 bp, Homo sapiens
aacagctccttgggaggaagca

SEQ ID NO: 6225357 - DNA, 23 bp, Homo sapiens
aacagctccttgggaggaagcag

SEQ ID NO: 6225358 - DNA, 19 bp, Homo sapiens
aacagctcgatccaaattg

SEQ ID NO: 6225359 - DNA, 14 bp, Homo sapiens
aacagctctgagat

SEQ ID NO: 6225360 - DNA, 15 bp, Homo sapiens
aacagctctgagatc

SEQ ID NO: 6225361 - DNA, 16 bp, Homo sapiens
aacagctctgagatcc

SEQ ID NO: 6225362 - DNA, 23 bp, Homo sapiens
aacagctctgagatcctggagtg

SEQ ID NO: 6225363 - DNA, 19 bp, Homo sapiens
aacagctgaggtctcttga

SEQ ID NO: 6225364 - DNA, 20 bp, Homo sapiens
aacagctgccttagcttcag

SEQ ID NO: 6225365 - DNA, 22 bp, Homo sapiens
aacagctgccttagcttcagga

SEQ ID NO: 6225366 - DNA, 23 bp, Homo sapiens
aacagctgccttagcttcaggaa

SEQ ID NO: 6225367 - DNA, 11 bp, Homo sapiens
aacagctgctt

SEQ ID NO: 6225368 - DNA, 20 bp, Homo sapiens
aacagctgcttctcccccca

SEQ ID NO: 6225369 - DNA, 21 bp, Homo sapiens
aacagctggacacccccttgg

SEQ ID NO: 6225370 - DNA, 23 bp, Homo sapiens
aacagctggacacccccttggtg

SEQ ID NO: 6225371 - DNA, 19 bp, Homo sapiens
aacagctggaggaatacat

SEQ ID NO: 6225372 - DNA, 20 bp, Homo sapiens
aacagctggaggaatacatt

SEQ ID NO: 6225373 - DNA, 22 bp, Homo sapiens
aacagctggaggaatacatttt

SEQ ID NO: 6225374 - DNA, 13 bp, Homo sapiens
aacagctggtact

SEQ ID NO: 6225375 - DNA, 16 bp, Homo sapiens
aacagctggtgtagct

SEQ ID NO: 6225376 - DNA, 22 bp, Homo sapiens
aacagctggtgtagctacagag

SEQ ID NO: 6225377 - DNA, 14 bp, Homo sapiens
aacagctgtattat

SEQ ID NO: 6225378 - DNA, 15 bp, Homo sapiens
aacagctgtattatc

SEQ ID NO: 6225379 - DNA, 21 bp, Homo sapiens
aacagctgtgagccatgcctc

SEQ ID NO: 6225380 - DNA, 14 bp, Homo sapiens
aacagctgtgtctg

SEQ ID NO: 6225381 - DNA, 20 bp, Homo sapiens
aacagcttcagaaagagctc

SEQ ID NO: 6225382 - DNA, 14 bp, Homo sapiens
aacagcttcaggtt

SEQ ID NO: 6225383 - DNA, 22 bp, Homo sapiens
aacagcttcatgttcccaaaat

SEQ ID NO: 6225384 - DNA, 21 bp, Homo sapiens
aacagcttcttgcttgtaaaa

SEQ ID NO: 6225385 - DNA, 22 bp, Homo sapiens
aacagcttcttgcttgtaaaaa

SEQ ID NO: 6225386 - DNA, 20 bp, Homo sapiens
aacagcttgaaaactggatt

SEQ ID NO: 6225387 - DNA, 16 bp, Homo sapiens
aacagctttcaagtgc

SEQ ID NO: 6225388 - DNA, 17 bp, Homo sapiens
aacagctttctccagaa

SEQ ID NO: 6225389 - DNA, 21 bp, Homo sapiens
aacagctttgtctccaaagaa

SEQ ID NO: 6225390 - DNA, 22 bp, Homo sapiens
aacagctttgtctccaaagaag

SEQ ID NO: 6225391 - DNA, 21 bp, Homo sapiens
aacagcttttcccaggagacc

SEQ ID NO: 6225392 - DNA, 17 bp, Homo sapiens
aacaggaaaaaaacttt

SEQ ID NO: 6225393 - DNA, 11 bp, Homo sapiens
aacaggaaaag

SEQ ID NO: 6225394 - DNA, 14 bp, Homo sapiens
aacaggaaaagaaa

SEQ ID NO: 6225395 - DNA, 17 bp, Homo sapiens
aacaggaaagagctagg

SEQ ID NO: 6225396 - DNA, 12 bp, Homo sapiens
aacaggaatcct

SEQ ID NO: 6225397 - DNA, 16 bp, Homo sapiens
aacaggaatccttact

SEQ ID NO: 6225398 - DNA, 16 bp, Homo sapiens
aacaggaatgtctgga

SEQ ID NO: 6225399 - DNA, 17 bp, Homo sapiens
aacaggagacaggtcag

SEQ ID NO: 6225400 - DNA, 14 bp, Homo sapiens
aacaggagagacag

SEQ ID NO: 6225401 - DNA, 15 bp, Homo sapiens
aacaggagagacagg

SEQ ID NO: 6225402 - DNA, 22 bp, Homo sapiens
aacaggaggaactggtccaggc

SEQ ID NO: 6225403 - DNA, 20 bp, Homo sapiens
aacaggattacagtgtagct

SEQ ID NO: 6225404 - DNA, 19 bp, Homo sapiens
aacaggattagacagtcaa

SEQ ID NO: 6225405 - DNA, 16 bp, Homo sapiens
aacaggattgatcatt

SEQ ID NO: 6225406 - DNA, 15 bp, Homo sapiens
aacaggattttcaag

SEQ ID NO: 6225407 - DNA, 14 bp, Homo sapiens
aacaggcaagtgaa

SEQ ID NO: 6225408 - DNA, 16 bp, Homo sapiens
aacaggcactgccctg

SEQ ID NO: 6225409 - DNA, 18 bp, Homo sapiens
aacaggcacttggcagcc

SEQ ID NO: 6225410 - DNA, 14 bp, Homo sapiens
aacaggcactttga

SEQ ID NO: 6225411 - DNA, 11 bp, Homo sapiens
aacaggcagat

SEQ ID NO: 6225412 - DNA, 18 bp, Homo sapiens
aacaggcaggggcccact

SEQ ID NO: 6225413 - DNA, 22 bp, Homo sapiens
aacaggcattgcactaaaagtg

SEQ ID NO: 6225414 - DNA, 17 bp, Homo sapiens
aacaggccattgtgaac

SEQ ID NO: 6225415 - DNA, 23 bp, Homo sapiens
aacaggccattgtgaaccaatgc

SEQ ID NO: 6225416 - DNA, 12 bp, Homo sapiens
aacaggcccagc

SEQ ID NO: 6225417 - DNA, 20 bp, Homo sapiens
aacaggccctctgtggcctg

SEQ ID NO: 6225418 - DNA, 13 bp, Homo sapiens
aacaggcgtggga

SEQ ID NO: 6225419 - DNA, 14 bp, Homo sapiens
aacaggctggttct

SEQ ID NO: 6225420 - DNA, 19 bp, Homo sapiens
aacaggcttggagggaagg

SEQ ID NO: 6225421 - DNA, 14 bp, Homo sapiens
aacagggaaaacag

SEQ ID NO: 6225422 - DNA, 13 bp, Homo sapiens
aacagggaaggca

SEQ ID NO: 6225423 - DNA, 20 bp, Homo sapiens
aacagggaaggcaggcaggg

SEQ ID NO: 6225424 - DNA, 20 bp, Homo sapiens
aacagggacactacaaacat

SEQ ID NO: 6225425 - DNA, 16 bp, Homo sapiens
aacagggaccagctcc

SEQ ID NO: 6225426 - DNA, 16 bp, Homo sapiens
aacagggattgatttt

SEQ ID NO: 6225427 - DNA, 21 bp, Homo sapiens
aacagggattgattttaaaat

SEQ ID NO: 6225428 - DNA, 13 bp, Homo sapiens
aacagggcaaaat

SEQ ID NO: 6225429 - DNA, 19 bp, Homo sapiens
aacagggcagcagtggggt

SEQ ID NO: 6225430 - DNA, 22 bp, Homo sapiens
aacagggcagtgacaagtggag

SEQ ID NO: 6225431 - DNA, 24 bp, Homo sapiens
aacagggcagtgacaagtggaggg

SEQ ID NO: 6225432 - DNA, 16 bp, Homo sapiens
aacagggcccaggcct

SEQ ID NO: 6225433 - DNA, 19 bp, Homo sapiens
aacagggctatttgaagaa

SEQ ID NO: 6225434 - DNA, 14 bp, Homo sapiens
aacagggctgcctt

SEQ ID NO: 6225435 - DNA, 16 bp, Homo sapiens
aacaggggaggaaaaa

SEQ ID NO: 6225436 - DNA, 18 bp, Homo sapiens
aacaggggaggaaaaaag

SEQ ID NO: 6225437 - DNA, 19 bp, Homo sapiens
aacaggggaggaaaaaaga

SEQ ID NO: 6225438 - DNA, 18 bp, Homo sapiens
aacagggggaaaatgttt

SEQ ID NO: 6225439 - DNA, 15 bp, Homo sapiens
aacagggtaaattat

SEQ ID NO: 6225440 - DNA, 23 bp, Homo sapiens
aacagggtctctagtgctgtgaa

SEQ ID NO: 6225441 - DNA, 22 bp, Homo sapiens
aacagggtgttgtcagcatctt

SEQ ID NO: 6225442 - DNA, 15 bp, Homo sapiens
aacagggtttctcag

SEQ ID NO: 6225443 - DNA, 14 bp, Homo sapiens
aacaggtaaacaga

SEQ ID NO: 6225444 - DNA, 23 bp, Homo sapiens
aacaggtagtattacaccaccgg

SEQ ID NO: 6225445 - DNA, 15 bp, Homo sapiens
aacaggtatatactt

SEQ ID NO: 6225446 - DNA, 13 bp, Homo sapiens
aacaggtattttg

SEQ ID NO: 6225447 - DNA, 15 bp, Homo sapiens
aacaggtctcctctt

SEQ ID NO: 6225448 - DNA, 19 bp, Homo sapiens
aacaggtctcctcttaaaa

SEQ ID NO: 6225449 - DNA, 17 bp, Homo sapiens
aacaggtgctggcccag

SEQ ID NO: 6225450 - DNA, 16 bp, Homo sapiens
aacaggtggcaggacc

SEQ ID NO: 6225451 - DNA, 19 bp, Homo sapiens
aacaggtggcaggaccagg

SEQ ID NO: 6225452 - DNA, 17 bp, Homo sapiens
aacaggtgttcctcctc

SEQ ID NO: 6225453 - DNA, 17 bp, Homo sapiens
aacaggttcctgtggag

SEQ ID NO: 6225454 - DNA, 22 bp, Homo sapiens
aacaggttcttaaaaaggaaca

SEQ ID NO: 6225455 - DNA, 23 bp, Homo sapiens
aacaggttgaggctaaaacaaat

SEQ ID NO: 6225456 - DNA, 13 bp, Homo sapiens
aacaggttgggat

SEQ ID NO: 6225457 - DNA, 17 bp, Homo sapiens
aacaggttgggatggga

SEQ ID NO: 6225458 - DNA, 19 bp, Homo sapiens
aacaggttgttttctactt

SEQ ID NO: 6225459 - DNA, 19 bp, Homo sapiens
aacaggttttcctgaagaa

SEQ ID NO: 6225460 - DNA, 18 bp, Homo sapiens
aacagtaaaacaggctgc

SEQ ID NO: 6225461 - DNA, 12 bp, Homo sapiens
aacagtaaaatc

SEQ ID NO: 6225462 - DNA, 13 bp, Homo sapiens
aacagtaaaccac

SEQ ID NO: 6225463 - DNA, 23 bp, Homo sapiens
aacagtaaaccactgaaaaaata

SEQ ID NO: 6225464 - DNA, 14 bp, Homo sapiens
aacagtaaagttaa

SEQ ID NO: 6225465 - DNA, 14 bp, Homo sapiens
aacagtaaatatac

SEQ ID NO: 6225466 - DNA, 22 bp, Homo sapiens
aacagtaaatatacactttaca

SEQ ID NO: 6225467 - DNA, 12 bp, Homo sapiens
aacagtaactgc

SEQ ID NO: 6225468 - DNA, 17 bp, Homo sapiens
aacagtaatctatgtgt

SEQ ID NO: 6225469 - DNA, 20 bp, Homo sapiens
aacagtaattactttcagaa

SEQ ID NO: 6225470 - DNA, 13 bp, Homo sapiens
aacagtacatttt

SEQ ID NO: 6225471 - DNA, 16 bp, Homo sapiens
aacagtacctgtgcct

SEQ ID NO: 6225472 - DNA, 12 bp, Homo sapiens
aacagtagcata

SEQ ID NO: 6225473 - DNA, 16 bp, Homo sapiens
aacagtagttgtattc

SEQ ID NO: 6225474 - DNA, 11 bp, Homo sapiens
aacagtatctc

SEQ ID NO: 6225475 - DNA, 18 bp, Homo sapiens
aacagtatctcaaacaat

SEQ ID NO: 6225476 - DNA, 13 bp, Homo sapiens
aacagtatctctt

SEQ ID NO: 6225477 - DNA, 14 bp, Homo sapiens
aacagtatgatgga

SEQ ID NO: 6225478 - DNA, 14 bp, Homo sapiens
aacagtatgtcaga

SEQ ID NO: 6225479 - DNA, 22 bp, Homo sapiens
aacagtatttgtacaaatactg

SEQ ID NO: 6225480 - DNA, 14 bp, Homo sapiens
aacagtattttaag

SEQ ID NO: 6225481 - DNA, 18 bp, Homo sapiens
aacagtattttaagaagt

SEQ ID NO: 6225482 - DNA, 23 bp, Homo sapiens
aacagtattttaagaagttgctg

SEQ ID NO: 6225483 - DNA, 19 bp, Homo sapiens
aacagtcacccttctgggc

SEQ ID NO: 6225484 - DNA, 16 bp, Homo sapiens
aacagtcacgcctgaa

SEQ ID NO: 6225485 - DNA, 18 bp, Homo sapiens
aacagtcacgcctgaaac

SEQ ID NO: 6225486 - DNA, 12 bp, Homo sapiens
aacagtcagcca

SEQ ID NO: 6225487 - DNA, 23 bp, Homo sapiens
aacagtcagccagcttggtggtt

SEQ ID NO: 6225488 - DNA, 15 bp, Homo sapiens
aacagtcatcattta

SEQ ID NO: 6225489 - DNA, 19 bp, Homo sapiens
aacagtcatctagaattca

SEQ ID NO: 6225490 - DNA, 19 bp, Homo sapiens
aacagtcatgtatgcaagt

SEQ ID NO: 6225491 - DNA, 14 bp, Homo sapiens
aacagtccttgctt

SEQ ID NO: 6225492 - DNA, 17 bp, Homo sapiens
aacagtctcaggaaatc

SEQ ID NO: 6225493 - DNA, 14 bp, Homo sapiens
aacagtgaacttgt

SEQ ID NO: 6225494 - DNA, 17 bp, Homo sapiens
aacagtgaacttgtctg

SEQ ID NO: 6225495 - DNA, 17 bp, Homo sapiens
aacagtgaagacagaag

SEQ ID NO: 6225496 - DNA, 20 bp, Homo sapiens
aacagtgaatttaagcatga

SEQ ID NO: 6225497 - DNA, 12 bp, Homo sapiens
aacagtgacttc

SEQ ID NO: 6225498 - DNA, 15 bp, Homo sapiens
aacagtgagaaaaga

SEQ ID NO: 6225499 - DNA, 22 bp, Homo sapiens
aacagtgagaaaagaaaggcta

SEQ ID NO: 6225500 - DNA, 15 bp, Homo sapiens
aacagtgatgatgca

SEQ ID NO: 6225501 - DNA, 23 bp, Homo sapiens
aacagtgcacctgggacagggag

SEQ ID NO: 6225502 - DNA, 22 bp, Homo sapiens
aacagtgcatattcctttctat

SEQ ID NO: 6225503 - DNA, 19 bp, Homo sapiens
aacagtgccaaatgctggg

SEQ ID NO: 6225504 - DNA, 19 bp, Homo sapiens
aacagtgccattgtcttta

SEQ ID NO: 6225505 - DNA, 13 bp, Homo sapiens
aacagtgcctgct

SEQ ID NO: 6225506 - DNA, 15 bp, Homo sapiens
aacagtgctaaaaat

SEQ ID NO: 6225507 - DNA, 16 bp, Homo sapiens
aacagtgctaaaaatg

SEQ ID NO: 6225508 - DNA, 14 bp, Homo sapiens
aacagtgctctgcc

SEQ ID NO: 6225509 - DNA, 15 bp, Homo sapiens
aacagtgctctgcct

SEQ ID NO: 6225510 - DNA, 15 bp, Homo sapiens
aacagtgctgttctg

SEQ ID NO: 6225511 - DNA, 12 bp, Homo sapiens
aacagtggagct

SEQ ID NO: 6225512 - DNA, 14 bp, Homo sapiens
aacagtggctgggt

SEQ ID NO: 6225513 - DNA, 19 bp, Homo sapiens
aacagtgggagccctgacc

SEQ ID NO: 6225514 - DNA, 19 bp, Homo sapiens
aacagtggttgcctggggg

SEQ ID NO: 6225515 - DNA, 20 bp, Homo sapiens
aacagtgtcttgagctctaa

SEQ ID NO: 6225516 - DNA, 17 bp, Homo sapiens
aacagtgtctttctagc

SEQ ID NO: 6225517 - DNA, 14 bp, Homo sapiens
aacagtgtgaagtt

SEQ ID NO: 6225518 - DNA, 16 bp, Homo sapiens
aacagtgtgaagttag

SEQ ID NO: 6225519 - DNA, 21 bp, Homo sapiens
aacagtgtgtaaacaaaatga

SEQ ID NO: 6225520 - DNA, 17 bp, Homo sapiens
aacagtgttctgagccc

SEQ ID NO: 6225521 - DNA, 15 bp, Homo sapiens
aacagtgtttcccat

SEQ ID NO: 6225522 - DNA, 19 bp, Homo sapiens
aacagtgtttcccataatt

SEQ ID NO: 6225523 - DNA, 13 bp, Homo sapiens
aacagtgttttca

SEQ ID NO: 6225524 - DNA, 13 bp, Homo sapiens
aacagttaacttt

SEQ ID NO: 6225525 - DNA, 20 bp, Homo sapiens
aacagttacttaagattcag

SEQ ID NO: 6225526 - DNA, 21 bp, Homo sapiens
aacagttattgggcttaaaaa

SEQ ID NO: 6225527 - DNA, 17 bp, Homo sapiens
aacagttccataccaag

SEQ ID NO: 6225528 - DNA, 12 bp, Homo sapiens
aacagttccatt

SEQ ID NO: 6225529 - DNA, 13 bp, Homo sapiens
aacagttccattt

SEQ ID NO: 6225530 - DNA, 14 bp, Homo sapiens
aacagttccttcag

SEQ ID NO: 6225531 - DNA, 16 bp, Homo sapiens
aacagttctcactggg

SEQ ID NO: 6225532 - DNA, 13 bp, Homo sapiens
aacagttctcaga

SEQ ID NO: 6225533 - DNA, 14 bp, Homo sapiens
aacagttctgcact

SEQ ID NO: 6225534 - DNA, 18 bp, Homo sapiens
aacagttgagtttcttct

SEQ ID NO: 6225535 - DNA, 14 bp, Homo sapiens
aacagttgcacagc

SEQ ID NO: 6225536 - DNA, 15 bp, Homo sapiens
aacagttgcacagca

SEQ ID NO: 6225537 - DNA, 20 bp, Homo sapiens
aacagttgcacagcatctca

SEQ ID NO: 6225538 - DNA, 22 bp, Homo sapiens
aacagttgcatgtagtaacact

SEQ ID NO: 6225539 - DNA, 16 bp, Homo sapiens
aacagttgctgttctt

SEQ ID NO: 6225540 - DNA, 13 bp, Homo sapiens
aacagttgctttg

SEQ ID NO: 6225541 - DNA, 14 bp, Homo sapiens
aacagttggcactg

SEQ ID NO: 6225542 - DNA, 17 bp, Homo sapiens
aacagttggtgatttta

SEQ ID NO: 6225543 - DNA, 22 bp, Homo sapiens
aacagttgtaccactgctaata

SEQ ID NO: 6225544 - DNA, 13 bp, Homo sapiens
aacagttgtattt

SEQ ID NO: 6225545 - DNA, 20 bp, Homo sapiens
aacagttgtatttaacagaa

SEQ ID NO: 6225546 - DNA, 22 bp, Homo sapiens
aacagttgtgaaccaagatcta

SEQ ID NO: 6225547 - DNA, 15 bp, Homo sapiens
aacagttgttactta

SEQ ID NO: 6225548 - DNA, 20 bp, Homo sapiens
aacagtttaatgaagatcta

SEQ ID NO: 6225549 - DNA, 22 bp, Homo sapiens
aacagtttatgcagtgctgctt

SEQ ID NO: 6225550 - DNA, 17 bp, Homo sapiens
aacagtttctcaagttt

SEQ ID NO: 6225551 - DNA, 16 bp, Homo sapiens
aacagtttcttgcttg

SEQ ID NO: 6225552 - DNA, 17 bp, Homo sapiens
aacagtttcttgcttgg

SEQ ID NO: 6225553 - DNA, 22 bp, Homo sapiens
aacagtttcttgcttggaagcc

SEQ ID NO: 6225554 - DNA, 23 bp, Homo sapiens
aacagtttgatgctgagtcatgc

SEQ ID NO: 6225555 - DNA, 13 bp, Homo sapiens
aacagtttgtaca

SEQ ID NO: 6225556 - DNA, 20 bp, Homo sapiens
aacagttttacttctggcct

SEQ ID NO: 6225557 - DNA, 11 bp, Homo sapiens
aacagttttag

SEQ ID NO: 6225558 - DNA, 16 bp, Homo sapiens
aacagttttccatgaa

SEQ ID NO: 6225559 - DNA, 17 bp, Homo sapiens
aacagttttccatgaaa

SEQ ID NO: 6225560 - DNA, 18 bp, Homo sapiens
aacagttttcctatgctt

SEQ ID NO: 6225561 - DNA, 20 bp, Homo sapiens
aacagttttcctatgctttg

SEQ ID NO: 6225562 - DNA, 21 bp, Homo sapiens
aacagttttggagaaaaatta

SEQ ID NO: 6225563 - DNA, 12 bp, Homo sapiens
aacagttttgtg

SEQ ID NO: 6225564 - DNA, 21 bp, Homo sapiens
aacagttttttatgctaatca

SEQ ID NO: 6225565 - DNA, 22 bp, Homo sapiens
aacataaaaactactgaataaa

SEQ ID NO: 6225566 - DNA, 16 bp, Homo sapiens
aacataaaaactgatt

SEQ ID NO: 6225567 - DNA, 17 bp, Homo sapiens
aacataaaaactgattt

SEQ ID NO: 6225568 - DNA, 13 bp, Homo sapiens
aacataaaaagtt

SEQ ID NO: 6225569 - DNA, 22 bp, Homo sapiens
aacataaaaagttaaaaaaaat

SEQ ID NO: 6225570 - DNA, 15 bp, Homo sapiens
aacataaaagtgcta

SEQ ID NO: 6225571 - DNA, 14 bp, Homo sapiens
aacataaaatgagg

SEQ ID NO: 6225572 - DNA, 18 bp, Homo sapiens
aacataaaatgaggcagt

SEQ ID NO: 6225573 - DNA, 14 bp, Homo sapiens
aacataaagcaaat

SEQ ID NO: 6225574 - DNA, 19 bp, Homo sapiens
aacataaaggtaaaacaaa

SEQ ID NO: 6225575 - DNA, 12 bp, Homo sapiens
aacataaatgca

SEQ ID NO: 6225576 - DNA, 21 bp, Homo sapiens
aacataaccattacagggagc

SEQ ID NO: 6225577 - DNA, 20 bp, Homo sapiens
aacataacccacttgtcact

SEQ ID NO: 6225578 - DNA, 14 bp, Homo sapiens
aacataactgcttc

SEQ ID NO: 6225579 - DNA, 12 bp, Homo sapiens
aacataactgta

SEQ ID NO: 6225580 - DNA, 21 bp, Homo sapiens
aacataacttctcatgtatat

SEQ ID NO: 6225581 - DNA, 19 bp, Homo sapiens
aacataagctaaatcatat

SEQ ID NO: 6225582 - DNA, 16 bp, Homo sapiens
aacataagttgcattt

SEQ ID NO: 6225583 - DNA, 15 bp, Homo sapiens
aacataataataatg

SEQ ID NO: 6225584 - DNA, 15 bp, Homo sapiens
aacataatagaattt

SEQ ID NO: 6225585 - DNA, 19 bp, Homo sapiens
aacataatataagaatcat

SEQ ID NO: 6225586 - DNA, 16 bp, Homo sapiens
aacataatctagttta

SEQ ID NO: 6225587 - DNA, 17 bp, Homo sapiens
aacataatgaacagaat

SEQ ID NO: 6225588 - DNA, 17 bp, Homo sapiens
aacataatggttgtgaa

SEQ ID NO: 6225589 - DNA, 23 bp, Homo sapiens
aacataatggttgtgaaatgtaa

SEQ ID NO: 6225590 - DNA, 12 bp, Homo sapiens
aacataattaaa

SEQ ID NO: 6225591 - DNA, 19 bp, Homo sapiens
aacataattttttttttct

SEQ ID NO: 6225592 - DNA, 20 bp, Homo sapiens
aacataattttttttttctc

SEQ ID NO: 6225593 - DNA, 21 bp, Homo sapiens
aacataattttttttttctca

SEQ ID NO: 6225594 - DNA, 17 bp, Homo sapiens
aacatacaagaaaatgt

SEQ ID NO: 6225595 - DNA, 18 bp, Homo sapiens
aacatacaaggacattca

SEQ ID NO: 6225596 - DNA, 18 bp, Homo sapiens
aacatacagaggatgcct

SEQ ID NO: 6225597 - DNA, 16 bp, Homo sapiens
aacatacataatacaa

SEQ ID NO: 6225598 - DNA, 15 bp, Homo sapiens
aacataccaacatgt

SEQ ID NO: 6225599 - DNA, 21 bp, Homo sapiens
aacataccccttacaaatgaa

SEQ ID NO: 6225600 - DNA, 20 bp, Homo sapiens
aacatacgggaagtttattt

SEQ ID NO: 6225601 - DNA, 23 bp, Homo sapiens
aacatacgggaagtttatttcct

SEQ ID NO: 6225602 - DNA, 18 bp, Homo sapiens
aacatacttacatttcag

SEQ ID NO: 6225603 - DNA, 14 bp, Homo sapiens
aacatacttcaaaa

SEQ ID NO: 6225604 - DNA, 19 bp, Homo sapiens
aacatacttcaaaaataat

SEQ ID NO: 6225605 - DNA, 20 bp, Homo sapiens
aacatacttcaaaaataatg

SEQ ID NO: 6225606 - DNA, 15 bp, Homo sapiens
aacatactttctaaa

SEQ ID NO: 6225607 - DNA, 19 bp, Homo sapiens
aacatagaaacatacacaa

SEQ ID NO: 6225608 - DNA, 23 bp, Homo sapiens
aacatagaaatggaaattttgct

SEQ ID NO: 6225609 - DNA, 19 bp, Homo sapiens
aacatagactgaagattta

SEQ ID NO: 6225610 - DNA, 21 bp, Homo sapiens
aacatagactgaagatttatt

SEQ ID NO: 6225611 - DNA, 18 bp, Homo sapiens
aacatagagtagacctga

SEQ ID NO: 6225612 - DNA, 16 bp, Homo sapiens
aacatagatgcctggg

SEQ ID NO: 6225613 - DNA, 20 bp, Homo sapiens
aacatagccagatgtagtct

SEQ ID NO: 6225614 - DNA, 16 bp, Homo sapiens
aacataggtgctcttc

SEQ ID NO: 6225615 - DNA, 20 bp, Homo sapiens
aacatagtaagttcagcact

SEQ ID NO: 6225616 - DNA, 13 bp, Homo sapiens
aacatagtgagac

SEQ ID NO: 6225617 - DNA, 16 bp, Homo sapiens
aacatagtggtatttt

SEQ ID NO: 6225618 - DNA, 21 bp, Homo sapiens
aacatagtggtattttaacat

SEQ ID NO: 6225619 - DNA, 15 bp, Homo sapiens
aacatagttgaaaaa

SEQ ID NO: 6225620 - DNA, 18 bp, Homo sapiens
aacatagtttaagttgat

SEQ ID NO: 6225621 - DNA, 19 bp, Homo sapiens
aacatagtttaagttgatt

SEQ ID NO: 6225622 - DNA, 15 bp, Homo sapiens
aacatataaaataat

SEQ ID NO: 6225623 - DNA, 15 bp, Homo sapiens
aacatataaagcact

SEQ ID NO: 6225624 - DNA, 14 bp, Homo sapiens
aacatataaagtag

SEQ ID NO: 6225625 - DNA, 22 bp, Homo sapiens
aacatatacattttgttgcagg

SEQ ID NO: 6225626 - DNA, 21 bp, Homo sapiens
aacatatactatttagtctca

SEQ ID NO: 6225627 - DNA, 12 bp, Homo sapiens
aacatatataac

SEQ ID NO: 6225628 - DNA, 13 bp, Homo sapiens
aacatatatattt

SEQ ID NO: 6225629 - DNA, 24 bp, Homo sapiens
aacatatatgtatatacacatcca

SEQ ID NO: 6225630 - DNA, 18 bp, Homo sapiens
aacatatatttattgagt

SEQ ID NO: 6225631 - DNA, 13 bp, Homo sapiens
aacatatatttta

SEQ ID NO: 6225632 - DNA, 20 bp, Homo sapiens
aacatatcatttgtgaagaa

SEQ ID NO: 6225633 - DNA, 20 bp, Homo sapiens
aacatatctgtaaatagtga

SEQ ID NO: 6225634 - DNA, 16 bp, Homo sapiens
aacatatgaaatataa

SEQ ID NO: 6225635 - DNA, 19 bp, Homo sapiens
aacatatgaaatataaatt

SEQ ID NO: 6225636 - DNA, 18 bp, Homo sapiens
aacatatgggtgtgaagt

SEQ ID NO: 6225637 - DNA, 16 bp, Homo sapiens
aacatatgtacataaa

SEQ ID NO: 6225638 - DNA, 13 bp, Homo sapiens
aacatatgtatta

SEQ ID NO: 6225639 - DNA, 22 bp, Homo sapiens
aacatatgtattaagccaaaca

SEQ ID NO: 6225640 - DNA, 22 bp, Homo sapiens
aacatatgtcacgaacttgaaa

SEQ ID NO: 6225641 - DNA, 22 bp, Homo sapiens
aacatatgtctgtctttgcaaa

SEQ ID NO: 6225642 - DNA, 16 bp, Homo sapiens
aacatattatttcatt

SEQ ID NO: 6225643 - DNA, 15 bp, Homo sapiens
aacatattcatgaaa

SEQ ID NO: 6225644 - DNA, 19 bp, Homo sapiens
aacatattcatgaaatgtg

SEQ ID NO: 6225645 - DNA, 22 bp, Homo sapiens
aacatattcatgaaatgtggaa

SEQ ID NO: 6225646 - DNA, 21 bp, Homo sapiens
aacatattcttgctttcacaa

SEQ ID NO: 6225647 - DNA, 15 bp, Homo sapiens
aacatatttaagaaa

SEQ ID NO: 6225648 - DNA, 14 bp, Homo sapiens
aacatatttcattt

SEQ ID NO: 6225649 - DNA, 18 bp, Homo sapiens
aacatatttcattttaac

SEQ ID NO: 6225650 - DNA, 22 bp, Homo sapiens
aacatatttcattttaacatga

SEQ ID NO: 6225651 - DNA, 20 bp, Homo sapiens
aacatatttcttgagtaatt

SEQ ID NO: 6225652 - DNA, 20 bp, Homo sapiens
aacatatttgttaaatattt

SEQ ID NO: 6225653 - DNA, 15 bp, Homo sapiens
aacatattttacatc

SEQ ID NO: 6225654 - DNA, 15 bp, Homo sapiens
aacatcaaataaatt

SEQ ID NO: 6225655 - DNA, 20 bp, Homo sapiens
aacatcaaataaatttctgg

SEQ ID NO: 6225656 - DNA, 14 bp, Homo sapiens
aacatcaacatctt

SEQ ID NO: 6225657 - DNA, 17 bp, Homo sapiens
aacatcaagataccttt

SEQ ID NO: 6225658 - DNA, 12 bp, Homo sapiens
aacatcaatgtt

SEQ ID NO: 6225659 - DNA, 14 bp, Homo sapiens
aacatcaatgttca

SEQ ID NO: 6225660 - DNA, 18 bp, Homo sapiens
aacatcaatgttcattgt

SEQ ID NO: 6225661 - DNA, 19 bp, Homo sapiens
aacatcaatgttcattgta

SEQ ID NO: 6225662 - DNA, 22 bp, Homo sapiens
aacatcaattgggttttgatct

SEQ ID NO: 6225663 - DNA, 18 bp, Homo sapiens
aacatcacacctgcccta

SEQ ID NO: 6225664 - DNA, 21 bp, Homo sapiens
gatggctgctagattttaatt

SEQ ID NO: 6225665 - DNA, 15 bp, Homo sapiens
gatggctgctgctca

SEQ ID NO: 6225666 - DNA, 12 bp, Homo sapiens
gatggctgctgg

SEQ ID NO: 6225667 - DNA, 17 bp, Homo sapiens
gatggctgtgcctctgc

SEQ ID NO: 6225668 - DNA, 20 bp, Homo sapiens
gatggctgtgcctctgcctg

SEQ ID NO: 6225669 - DNA, 20 bp, Homo sapiens
gatggctgtggcatttccaa

SEQ ID NO: 6225670 - DNA, 16 bp, Homo sapiens
gatggcttacaaaaag

SEQ ID NO: 6225671 - DNA, 16 bp, Homo sapiens
gatggcttatttttta

SEQ ID NO: 6225672 - DNA, 23 bp, Homo sapiens
gatggcttattttttaaaatatt

SEQ ID NO: 6225673 - DNA, 22 bp, Homo sapiens
gatggcttccgtgagacacaag

SEQ ID NO: 6225674 - DNA, 20 bp, Homo sapiens
gatggcttcggagggccgca

SEQ ID NO: 6225675 - DNA, 21 bp, Homo sapiens
gatggctttgaatgcggccca

SEQ ID NO: 6225676 - DNA, 16 bp, Homo sapiens
gatggcttttgtttct

SEQ ID NO: 6225677 - DNA, 12 bp, Homo sapiens
gatgggaaaata

SEQ ID NO: 6225678 - DNA, 16 bp, Homo sapiens
gatgggaaactgcttt

SEQ ID NO: 6225679 - DNA, 16 bp, Homo sapiens
gatgggaaagcattgt

SEQ ID NO: 6225680 - DNA, 19 bp, Homo sapiens
gatgggaaataaagaaaat

SEQ ID NO: 6225681 - DNA, 17 bp, Homo sapiens
gatgggaaatctgccta

SEQ ID NO: 6225682 - DNA, 23 bp, Homo sapiens
gatgggaaggttagaaaggcagc

SEQ ID NO: 6225683 - DNA, 23 bp, Homo sapiens
gatgggaatgaggtgggaggtgg

SEQ ID NO: 6225684 - DNA, 15 bp, Homo sapiens
gatgggacagggagg

SEQ ID NO: 6225685 - DNA, 13 bp, Homo sapiens
gatgggacatcaa

SEQ ID NO: 6225686 - DNA, 18 bp, Homo sapiens
gatgggactcattgtaga

SEQ ID NO: 6225687 - DNA, 21 bp, Homo sapiens
gatgggagagctagaaagttg

SEQ ID NO: 6225688 - DNA, 14 bp, Homo sapiens
gatgggaggagagc

SEQ ID NO: 6225689 - DNA, 18 bp, Homo sapiens
gatgggaggctcctggtg

SEQ ID NO: 6225690 - DNA, 20 bp, Homo sapiens
gatgggagggaggctcaggt

SEQ ID NO: 6225691 - DNA, 15 bp, Homo sapiens
gatgggaggtggaag

SEQ ID NO: 6225692 - DNA, 18 bp, Homo sapiens
gatgggaggtggaagcag

SEQ ID NO: 6225693 - DNA, 22 bp, Homo sapiens
gatgggaggtggaagcagaggc

SEQ ID NO: 6225694 - DNA, 17 bp, Homo sapiens
gatgggagtctccctcc

SEQ ID NO: 6225695 - DNA, 14 bp, Homo sapiens
gatgggagtgggca

SEQ ID NO: 6225696 - DNA, 15 bp, Homo sapiens
gatgggagtgggcac

SEQ ID NO: 6225697 - DNA, 20 bp, Homo sapiens
gatgggatcccaggccaggg

SEQ ID NO: 6225698 - DNA, 11 bp, Homo sapiens
gatgggatggc

SEQ ID NO: 6225699 - DNA, 19 bp, Homo sapiens
gatgggatggtggagggcc

SEQ ID NO: 6225700 - DNA, 17 bp, Homo sapiens
gatgggattctggacag

SEQ ID NO: 6225701 - DNA, 23 bp, Homo sapiens
gatgggatttcaccgtattagcc

SEQ ID NO: 6225702 - DNA, 22 bp, Homo sapiens
gatgggcaaagcttgtcaaaga

SEQ ID NO: 6225703 - DNA, 16 bp, Homo sapiens
gatgggcaaggggcca

SEQ ID NO: 6225704 - DNA, 19 bp, Homo sapiens
gatgggcaaggggccagga

SEQ ID NO: 6225705 - DNA, 20 bp, Homo sapiens
gatgggcaaggggccaggaa

SEQ ID NO: 6225706 - DNA, 21 bp, Homo sapiens
gatgggcaatcctgggctggc

SEQ ID NO: 6225707 - DNA, 14 bp, Homo sapiens
gatgggcacaggct

SEQ ID NO: 6225708 - DNA, 20 bp, Homo sapiens
gatgggcactggaaaacata

SEQ ID NO: 6225709 - DNA, 20 bp, Homo sapiens
gatgggcatatgtgtcagtg

SEQ ID NO: 6225710 - DNA, 23 bp, Homo sapiens
gatgggcatatgtgtcagtgggg

SEQ ID NO: 6225711 - DNA, 21 bp, Homo sapiens
gatgggcatggggtgggcctc

SEQ ID NO: 6225712 - DNA, 16 bp, Homo sapiens
gatgggcattgggctg

SEQ ID NO: 6225713 - DNA, 18 bp, Homo sapiens
gatgggccacccaccagg

SEQ ID NO: 6225714 - DNA, 13 bp, Homo sapiens
gatgggccaccgc

SEQ ID NO: 6225715 - DNA, 14 bp, Homo sapiens
gatgggccaccgcc

SEQ ID NO: 6225716 - DNA, 18 bp, Homo sapiens
gatgggccaccgccttgc

SEQ ID NO: 6225717 - DNA, 18 bp, Homo sapiens
gatgggccaggcagagaa

SEQ ID NO: 6225718 - DNA, 13 bp, Homo sapiens
gatgggcctgagt

SEQ ID NO: 6225719 - DNA, 18 bp, Homo sapiens
gatgggcctttgagcctg

SEQ ID NO: 6225720 - DNA, 19 bp, Homo sapiens
gatgggcggacggctgtgg

SEQ ID NO: 6225721 - DNA, 17 bp, Homo sapiens
gatgggctcccaccctc

SEQ ID NO: 6225722 - DNA, 15 bp, Homo sapiens
gatgggctctacctc

SEQ ID NO: 6225723 - DNA, 18 bp, Homo sapiens
gatgggctctacctctct

SEQ ID NO: 6225724 - DNA, 17 bp, Homo sapiens
gatgggctgagctagcc

SEQ ID NO: 6225725 - DNA, 19 bp, Homo sapiens
gatgggctgagctagcctc

SEQ ID NO: 6225726 - DNA, 20 bp, Homo sapiens
gatgggctgagctagcctcc

SEQ ID NO: 6225727 - DNA, 15 bp, Homo sapiens
gatgggctggagcag

SEQ ID NO: 6225728 - DNA, 13 bp, Homo sapiens
gatgggcttccca

SEQ ID NO: 6225729 - DNA, 19 bp, Homo sapiens
gatgggcttctgttctctg

SEQ ID NO: 6225730 - DNA, 18 bp, Homo sapiens
gatgggcttgttttcttg

SEQ ID NO: 6225731 - DNA, 21 bp, Homo sapiens
gatgggctttctcagtgtcag

SEQ ID NO: 6225732 - DNA, 23 bp, Homo sapiens
gatgggcttttgttctgaggggt

SEQ ID NO: 6225733 - DNA, 17 bp, Homo sapiens
gatggggaatccgtgtg

SEQ ID NO: 6225734 - DNA, 14 bp, Homo sapiens
gatggggacaaaga

SEQ ID NO: 6225735 - DNA, 18 bp, Homo sapiens
gatggggacactaatgaa

SEQ ID NO: 6225736 - DNA, 16 bp, Homo sapiens
gatggggaccagcagc

SEQ ID NO: 6225737 - DNA, 18 bp, Homo sapiens
gatggggaccagcagccc

SEQ ID NO: 6225738 - DNA, 17 bp, Homo sapiens
gatggggactctgccgc

SEQ ID NO: 6225739 - DNA, 11 bp, Homo sapiens
gatggggagaa

SEQ ID NO: 6225740 - DNA, 12 bp, Homo sapiens
gatggggagaaa

SEQ ID NO: 6225741 - DNA, 13 bp, Homo sapiens
gatggggagaaag

SEQ ID NO: 6225742 - DNA, 17 bp, Homo sapiens
gatggggagcagctggg

SEQ ID NO: 6225743 - DNA, 18 bp, Homo sapiens
gatggggagcagctgggc

SEQ ID NO: 6225744 - DNA, 15 bp, Homo sapiens
gatggggagctctgg

SEQ ID NO: 6225745 - DNA, 14 bp, Homo sapiens
gatggggaggaaga

SEQ ID NO: 6225746 - DNA, 21 bp, Homo sapiens
gatggggaggaagagagagac

SEQ ID NO: 6225747 - DNA, 12 bp, Homo sapiens
gatggggagggg

SEQ ID NO: 6225748 - DNA, 17 bp, Homo sapiens
gatggggaggggctctg

SEQ ID NO: 6225749 - DNA, 16 bp, Homo sapiens
gatggggcaagacaga

SEQ ID NO: 6225750 - DNA, 17 bp, Homo sapiens
gatggggcacggctctg

SEQ ID NO: 6225751 - DNA, 19 bp, Homo sapiens
gatggggcagagcttctcc

SEQ ID NO: 6225752 - DNA, 20 bp, Homo sapiens
gatggggcagagcttctcct

SEQ ID NO: 6225753 - DNA, 21 bp, Homo sapiens
gatggggcagagcttctcctg

SEQ ID NO: 6225754 - DNA, 22 bp, Homo sapiens
gatggggccctgcctcctttgt

SEQ ID NO: 6225755 - DNA, 21 bp, Homo sapiens
gatggggcctccctccttggg

SEQ ID NO: 6225756 - DNA, 13 bp, Homo sapiens
gatggggcctctg

SEQ ID NO: 6225757 - DNA, 21 bp, Homo sapiens
gatggggcgggggtgtgtctg

SEQ ID NO: 6225758 - DNA, 22 bp, Homo sapiens
gatggggctcagatggactggg

SEQ ID NO: 6225759 - DNA, 21 bp, Homo sapiens
gatggggctcccagctccttt

SEQ ID NO: 6225760 - DNA, 23 bp, Homo sapiens
gatggggctgcaccggctggcct

SEQ ID NO: 6225761 - DNA, 17 bp, Homo sapiens
gatgggggaaagcacag

SEQ ID NO: 6225762 - DNA, 22 bp, Homo sapiens
gatgggggaactcagatccagg

SEQ ID NO: 6225763 - DNA, 16 bp, Homo sapiens
gatgggggaactgtga

SEQ ID NO: 6225764 - DNA, 20 bp, Homo sapiens
gatgggggcagggctgtgct

SEQ ID NO: 6225765 - DNA, 14 bp, Homo sapiens
gatgggggctctgc

SEQ ID NO: 6225766 - DNA, 22 bp, Homo sapiens
gatgggggcttcttcctcacac

SEQ ID NO: 6225767 - DNA, 23 bp, Homo sapiens
gatggggggggatgtggatcagg

SEQ ID NO: 6225768 - DNA, 20 bp, Homo sapiens
gatgggggtgcaggcagcct

SEQ ID NO: 6225769 - DNA, 12 bp, Homo sapiens
gatgggggtggc

SEQ ID NO: 6225770 - DNA, 15 bp, Homo sapiens
gatgggggtggctgg

SEQ ID NO: 6225771 - DNA, 16 bp, Homo sapiens
gatggggtcagcaggc

SEQ ID NO: 6225772 - DNA, 21 bp, Homo sapiens
gatggggtcagcaggcccagg

SEQ ID NO: 6225773 - DNA, 19 bp, Homo sapiens
gatggggtctgtgactgga

SEQ ID NO: 6225774 - DNA, 17 bp, Homo sapiens
gatggggtgagaagtac

SEQ ID NO: 6225775 - DNA, 21 bp, Homo sapiens
gatggggtgagaagtacaggg

SEQ ID NO: 6225776 - DNA, 18 bp, Homo sapiens
gatggggtgggcagggct

SEQ ID NO: 6225777 - DNA, 19 bp, Homo sapiens
gatggggtgggcagggctg

SEQ ID NO: 6225778 - DNA, 15 bp, Homo sapiens
gatgggtattaaact

SEQ ID NO: 6225779 - DNA, 20 bp, Homo sapiens
gatgggtcaggtagggggga

SEQ ID NO: 6225780 - DNA, 15 bp, Homo sapiens
gatgggtcagttgta

SEQ ID NO: 6225781 - DNA, 22 bp, Homo sapiens
gatgggtcctggccttgtgtca

SEQ ID NO: 6225782 - DNA, 14 bp, Homo sapiens
gatgggtctgatat

SEQ ID NO: 6225783 - DNA, 21 bp, Homo sapiens
gatgggtctgatattaatcaa

SEQ ID NO: 6225784 - DNA, 23 bp, Homo sapiens
gatgggtctggtttgcagagctt

SEQ ID NO: 6225785 - DNA, 21 bp, Homo sapiens
gatgggtgattatgaaatgcc

SEQ ID NO: 6225786 - DNA, 21 bp, Homo sapiens
gatgggtgattccttcaattc

SEQ ID NO: 6225787 - DNA, 13 bp, Homo sapiens
gatgggtgcagga

SEQ ID NO: 6225788 - DNA, 16 bp, Homo sapiens
gatgggtgccctttcc

SEQ ID NO: 6225789 - DNA, 23 bp, Homo sapiens
gatgggtgccctttcctggcagt

SEQ ID NO: 6225790 - DNA, 19 bp, Homo sapiens
gatgggtgctggtcctgtt

SEQ ID NO: 6225791 - DNA, 19 bp, Homo sapiens
gatgggtgcttggaggaag

SEQ ID NO: 6225792 - DNA, 11 bp, Homo sapiens
gatgggtgggc

SEQ ID NO: 6225793 - DNA, 12 bp, Homo sapiens
gatgggtggggg

SEQ ID NO: 6225794 - DNA, 13 bp, Homo sapiens
gatgggtgggggc

SEQ ID NO: 6225795 - DNA, 20 bp, Homo sapiens
gatgggtgggggctcctggt

SEQ ID NO: 6225796 - DNA, 15 bp, Homo sapiens
gatgggtgtcccctg

SEQ ID NO: 6225797 - DNA, 19 bp, Homo sapiens
gatgggtgtgggagtgagg

SEQ ID NO: 6225798 - DNA, 16 bp, Homo sapiens
gatgggtgttgctgtt

SEQ ID NO: 6225799 - DNA, 14 bp, Homo sapiens
gatgggttccagag

SEQ ID NO: 6225800 - DNA, 13 bp, Homo sapiens
gatgggttcttag

SEQ ID NO: 6225801 - DNA, 18 bp, Homo sapiens
gatgggtttgacaaggtt

SEQ ID NO: 6225802 - DNA, 21 bp, Homo sapiens
gatgggtttggggctggcccc

SEQ ID NO: 6225803 - DNA, 21 bp, Homo sapiens
gatgggttttgttaggggtgg

SEQ ID NO: 6225804 - DNA, 22 bp, Homo sapiens
gatgggttttgttaggggtggg

SEQ ID NO: 6225805 - DNA, 23 bp, Homo sapiens
gatggtaaagccatgttaaatga

SEQ ID NO: 6225806 - DNA, 14 bp, Homo sapiens
gatggtaataatct

SEQ ID NO: 6225807 - DNA, 16 bp, Homo sapiens
gatggtaatcttttct

SEQ ID NO: 6225808 - DNA, 16 bp, Homo sapiens
gatggtacgtgaccct

SEQ ID NO: 6225809 - DNA, 19 bp, Homo sapiens
gatggtacgtgaccctctg

SEQ ID NO: 6225810 - DNA, 14 bp, Homo sapiens
gatggtactgctga

SEQ ID NO: 6225811 - DNA, 17 bp, Homo sapiens
gatggtagcagataaag

SEQ ID NO: 6225812 - DNA, 23 bp, Homo sapiens
gatggtagcagataaagacagct

SEQ ID NO: 6225813 - DNA, 22 bp, Homo sapiens
gatggtatctgggtaagaagaa

SEQ ID NO: 6225814 - DNA, 14 bp, Homo sapiens
gatggtattaatct

SEQ ID NO: 6225815 - DNA, 17 bp, Homo sapiens
gatggtattaatcttgt

SEQ ID NO: 6225816 - DNA, 20 bp, Homo sapiens
gatggtattaatcttgtgta

SEQ ID NO: 6225817 - DNA, 13 bp, Homo sapiens
gatggtatttctt

SEQ ID NO: 6225818 - DNA, 22 bp, Homo sapiens
gatggtcaggcccagttctcgt

SEQ ID NO: 6225819 - DNA, 21 bp, Homo sapiens
gatggtcatcgagatggagct

SEQ ID NO: 6225820 - DNA, 11 bp, Homo sapiens
gatggtcccag

SEQ ID NO: 6225821 - DNA, 20 bp, Homo sapiens
gatggtccgccacgaggagc

SEQ ID NO: 6225822 - DNA, 17 bp, Homo sapiens
gatggtcctcacaagcc

SEQ ID NO: 6225823 - DNA, 13 bp, Homo sapiens
gatggtcctgggg

SEQ ID NO: 6225824 - DNA, 15 bp, Homo sapiens
gatggtcctggggct

SEQ ID NO: 6225825 - DNA, 15 bp, Homo sapiens
gatggtctcacagag

SEQ ID NO: 6225826 - DNA, 15 bp, Homo sapiens
gatggtctccacctg

SEQ ID NO: 6225827 - DNA, 24 bp, Homo sapiens
gatggtctccatatcagctctctg

SEQ ID NO: 6225828 - DNA, 18 bp, Homo sapiens
gatggtctctctccctct

SEQ ID NO: 6225829 - DNA, 19 bp, Homo sapiens
gatggtctctctccctctg

SEQ ID NO: 6225830 - DNA, 17 bp, Homo sapiens
gatggtcttacagcagg

SEQ ID NO: 6225831 - DNA, 20 bp, Homo sapiens
gatggtcttgatctcctgag

SEQ ID NO: 6225832 - DNA, 17 bp, Homo sapiens
gatggtgacagctgcaa

SEQ ID NO: 6225833 - DNA, 23 bp, Homo sapiens
gatggtgacagctgcaagccagg

SEQ ID NO: 6225834 - DNA, 13 bp, Homo sapiens
gatggtgagctgg

SEQ ID NO: 6225835 - DNA, 16 bp, Homo sapiens
gatggtgagctgggaa

SEQ ID NO: 6225836 - DNA, 16 bp, Homo sapiens
gatggtgcaatgacct

SEQ ID NO: 6225837 - DNA, 20 bp, Homo sapiens
gatggtgcaatgacctttca

SEQ ID NO: 6225838 - DNA, 14 bp, Homo sapiens
gatggtgcagacgc

SEQ ID NO: 6225839 - DNA, 23 bp, Homo sapiens
gatggtgcagatgcctgcagtgc

SEQ ID NO: 6225840 - DNA, 15 bp, Homo sapiens
gatggtgccccctgg

SEQ ID NO: 6225841 - DNA, 15 bp, Homo sapiens
gatggtgcccctagg

SEQ ID NO: 6225842 - DNA, 14 bp, Homo sapiens
gatggtgctcccct

SEQ ID NO: 6225843 - DNA, 18 bp, Homo sapiens
gatggtgctgggtaataa

SEQ ID NO: 6225844 - DNA, 17 bp, Homo sapiens
gatggtggcacattcct

SEQ ID NO: 6225845 - DNA, 20 bp, Homo sapiens
gatggtggccgcccacccgc

SEQ ID NO: 6225846 - DNA, 17 bp, Homo sapiens
gatggtggctgtgtctc

SEQ ID NO: 6225847 - DNA, 13 bp, Homo sapiens
gatggtgggatgt

SEQ ID NO: 6225848 - DNA, 17 bp, Homo sapiens
gatggtgggatgtggtt

SEQ ID NO: 6225849 - DNA, 13 bp, Homo sapiens
gatggtgggcttc

SEQ ID NO: 6225850 - DNA, 17 bp, Homo sapiens
gatggtggggcccccag

SEQ ID NO: 6225851 - DNA, 20 bp, Homo sapiens
gatggtgggtggggctgcag

SEQ ID NO: 6225852 - DNA, 14 bp, Homo sapiens
gatggtgtcctgag

SEQ ID NO: 6225853 - DNA, 18 bp, Homo sapiens
gatggtgtcctgaggcct

SEQ ID NO: 6225854 - DNA, 17 bp, Homo sapiens
gatggtgtcctgcatgt

SEQ ID NO: 6225855 - DNA, 21 bp, Homo sapiens
gatggtgtctcttctttagaa

SEQ ID NO: 6225856 - DNA, 20 bp, Homo sapiens
gatggtgttaaagctgtaca

SEQ ID NO: 6225857 - DNA, 21 bp, Homo sapiens
gatggtgttaaagctgtacac

SEQ ID NO: 6225858 - DNA, 24 bp, Homo sapiens
gatggtgttcaaaaaacttgtaaa

SEQ ID NO: 6225859 - DNA, 13 bp, Homo sapiens
gatggtgttgtca

SEQ ID NO: 6225860 - DNA, 22 bp, Homo sapiens
gatggttattagacaattccat

SEQ ID NO: 6225861 - DNA, 13 bp, Homo sapiens
gatggttcccctg

SEQ ID NO: 6225862 - DNA, 22 bp, Homo sapiens
gatggttctcaattgtatagtt

SEQ ID NO: 6225863 - DNA, 14 bp, Homo sapiens
gatggtttcttgca

SEQ ID NO: 6225864 - DNA, 17 bp, Homo sapiens
gatggtttgaaattttt

SEQ ID NO: 6225865 - DNA, 15 bp, Homo sapiens
gatggtttggaaaat

SEQ ID NO: 6225866 - DNA, 16 bp, Homo sapiens
gatggtttggaaaata

SEQ ID NO: 6225867 - DNA, 17 bp, Homo sapiens
gatggttttaaactttc

SEQ ID NO: 6225868 - DNA, 16 bp, Homo sapiens
gatgtaaaaaatacaa

SEQ ID NO: 6225869 - DNA, 14 bp, Homo sapiens
gatgtaaaacagaa

SEQ ID NO: 6225870 - DNA, 15 bp, Homo sapiens
gatgtaaaatcttgt

SEQ ID NO: 6225871 - DNA, 24 bp, Homo sapiens
gatgtaaaatgagtttgtattatt

SEQ ID NO: 6225872 - DNA, 13 bp, Homo sapiens
gatgtaaacaatg

SEQ ID NO: 6225873 - DNA, 13 bp, Homo sapiens
gatgtaaagatgt

SEQ ID NO: 6225874 - DNA, 12 bp, Homo sapiens
gatgtaaagtga

SEQ ID NO: 6225875 - DNA, 18 bp, Homo sapiens
gatgtaaatcgggaagga

SEQ ID NO: 6225876 - DNA, 20 bp, Homo sapiens
gatgtaaatcgggaaggatg

SEQ ID NO: 6225877 - DNA, 13 bp, Homo sapiens
gatgtaaatgaag

SEQ ID NO: 6225878 - DNA, 22 bp, Homo sapiens
gatgtaacagtgcaagattttt

SEQ ID NO: 6225879 - DNA, 16 bp, Homo sapiens
gatgtaactattgaat

SEQ ID NO: 6225880 - DNA, 21 bp, Homo sapiens
gatgtaaggaattgaagatag

SEQ ID NO: 6225881 - DNA, 17 bp, Homo sapiens
gatgtaaggatgggcat

SEQ ID NO: 6225882 - DNA, 14 bp, Homo sapiens
gatgtaaggcctta

SEQ ID NO: 6225883 - DNA, 22 bp, Homo sapiens
gatgtaaggccttagccatgat

SEQ ID NO: 6225884 - DNA, 23 bp, Homo sapiens
gatgtaaggtaatttctgtgtat

SEQ ID NO: 6225885 - DNA, 13 bp, Homo sapiens
gatgtaatacttc

SEQ ID NO: 6225886 - DNA, 14 bp, Homo sapiens
gatgtaatacttct

SEQ ID NO: 6225887 - DNA, 15 bp, Homo sapiens
gatgtaatacttctt

SEQ ID NO: 6225888 - DNA, 23 bp, Homo sapiens
gatgtaatctctctgcagctgcc

SEQ ID NO: 6225889 - DNA, 17 bp, Homo sapiens
gatgtaatgacagagag

SEQ ID NO: 6225890 - DNA, 19 bp, Homo sapiens
gatgtaatgacagagagtt

SEQ ID NO: 6225891 - DNA, 12 bp, Homo sapiens
gatgtaatttag

SEQ ID NO: 6225892 - DNA, 20 bp, Homo sapiens
gatgtacagaacacaaatgt

SEQ ID NO: 6225893 - DNA, 16 bp, Homo sapiens
gatgtacagtctgtca

SEQ ID NO: 6225894 - DNA, 23 bp, Homo sapiens
gatgtacagttgggaaaatatgt

SEQ ID NO: 6225895 - DNA, 22 bp, Homo sapiens
gatgtacataactcctgtccct

SEQ ID NO: 6225896 - DNA, 13 bp, Homo sapiens
gatgtacattaca

SEQ ID NO: 6225897 - DNA, 18 bp, Homo sapiens
gatgtacattacagatta

SEQ ID NO: 6225898 - DNA, 21 bp, Homo sapiens
gatgtaccaattgtcaaatta

SEQ ID NO: 6225899 - DNA, 19 bp, Homo sapiens
gatgtaccagtttgtccat

SEQ ID NO: 6225900 - DNA, 22 bp, Homo sapiens
gatgtacttctctgtgtgcaca

SEQ ID NO: 6225901 - DNA, 13 bp, Homo sapiens
gatgtagaaacaa

SEQ ID NO: 6225902 - DNA, 17 bp, Homo sapiens
gatgtagagagaacagg

SEQ ID NO: 6225903 - DNA, 19 bp, Homo sapiens
gatgtagagagaacaggtg

SEQ ID NO: 6225904 - DNA, 18 bp, Homo sapiens
gatgtagatataaatata

SEQ ID NO: 6225905 - DNA, 20 bp, Homo sapiens
gatgtaggggaagagatgtt

SEQ ID NO: 6225906 - DNA, 14 bp, Homo sapiens
gatgtataaaactt

SEQ ID NO: 6225907 - DNA, 15 bp, Homo sapiens
gatgtataatatgca

SEQ ID NO: 6225908 - DNA, 14 bp, Homo sapiens
gatgtataatgtaa

SEQ ID NO: 6225909 - DNA, 15 bp, Homo sapiens
gatgtataatgtaat

SEQ ID NO: 6225910 - DNA, 18 bp, Homo sapiens
gatgtatataaaatgtgc

SEQ ID NO: 6225911 - DNA, 15 bp, Homo sapiens
gatgtatatgtttat

SEQ ID NO: 6225912 - DNA, 21 bp, Homo sapiens
gatgtatatttaattaaagca

SEQ ID NO: 6225913 - DNA, 20 bp, Homo sapiens
gatgtatcgggaagatttct

SEQ ID NO: 6225914 - DNA, 22 bp, Homo sapiens
gatgtatcgggaagatttctaa

SEQ ID NO: 6225915 - DNA, 21 bp, Homo sapiens
gatgtatctgagttgccaaga

SEQ ID NO: 6225916 - DNA, 22 bp, Homo sapiens
gatgtatgaaggcttttggtct

SEQ ID NO: 6225917 - DNA, 20 bp, Homo sapiens
gatgtatgaatacagcagca

SEQ ID NO: 6225918 - DNA, 19 bp, Homo sapiens
gatgtatgcagctatctgg

SEQ ID NO: 6225919 - DNA, 22 bp, Homo sapiens
gatgtatgtgaataaaaattat

SEQ ID NO: 6225920 - DNA, 20 bp, Homo sapiens
gatgtatgtgtgaaacaatg

SEQ ID NO: 6225921 - DNA, 21 bp, Homo sapiens
gatgtatgtgtgaaacaatgt

SEQ ID NO: 6225922 - DNA, 14 bp, Homo sapiens
gatgtatgtgtgac

SEQ ID NO: 6225923 - DNA, 23 bp, Homo sapiens
gatgtattacatgactgtttctt

SEQ ID NO: 6225924 - DNA, 17 bp, Homo sapiens
gatgtattatgcaaagt

SEQ ID NO: 6225925 - DNA, 18 bp, Homo sapiens
gatgtatttctaaatgtt

SEQ ID NO: 6225926 - DNA, 15 bp, Homo sapiens
gatgtattttgtgag

SEQ ID NO: 6225927 - DNA, 16 bp, Homo sapiens
gatgtattttgtgagt

SEQ ID NO: 6225928 - DNA, 14 bp, Homo sapiens
gatgtatttttctt

SEQ ID NO: 6225929 - DNA, 16 bp, Homo sapiens
gatgtatttttgatgt

SEQ ID NO: 6225930 - DNA, 18 bp, Homo sapiens
gatgtatttttgtaccct

SEQ ID NO: 6225931 - DNA, 14 bp, Homo sapiens
gatgtcaaccttgt

SEQ ID NO: 6225932 - DNA, 20 bp, Homo sapiens
gatgtcaaccttgtgtgagt

SEQ ID NO: 6225933 - DNA, 22 bp, Homo sapiens
gatgtcaagctggccgtggagt

SEQ ID NO: 6225934 - DNA, 20 bp, Homo sapiens
gatgtcacagtccaaccaga

SEQ ID NO: 6225935 - DNA, 18 bp, Homo sapiens
gatgtcacagtttgttca

SEQ ID NO: 6225936 - DNA, 20 bp, Homo sapiens
gatgtcacagtttgttcagt

SEQ ID NO: 6225937 - DNA, 18 bp, Homo sapiens
gatgtcactcagcccctt

SEQ ID NO: 6225938 - DNA, 13 bp, Homo sapiens
gatgtcagcagac

SEQ ID NO: 6225939 - DNA, 23 bp, Homo sapiens
gatgtcagctgctgttgaacttt

SEQ ID NO: 6225940 - DNA, 15 bp, Homo sapiens
gatgtcagcttccca

SEQ ID NO: 6225941 - DNA, 22 bp, Homo sapiens
gatgtcagcttcccagccatgc

SEQ ID NO: 6225942 - DNA, 23 bp, Homo sapiens
gatgtcataataaagttgtttta

SEQ ID NO: 6225943 - DNA, 15 bp, Homo sapiens
gatgtcatacagaga

SEQ ID NO: 6225944 - DNA, 17 bp, Homo sapiens
gatgtcatacagagaag

SEQ ID NO: 6225945 - DNA, 20 bp, Homo sapiens
gatgtcatagccaaagccag

SEQ ID NO: 6225946 - DNA, 14 bp, Homo sapiens
gatgtcatatcatt

SEQ ID NO: 6225947 - DNA, 21 bp, Homo sapiens
gatgtcatcccattgtcttct

SEQ ID NO: 6225948 - DNA, 20 bp, Homo sapiens
gatgtcatccccttgtgtca

SEQ ID NO: 6225949 - DNA, 23 bp, Homo sapiens
gatgtcatccccttgtgtcagag

SEQ ID NO: 6225950 - DNA, 20 bp, Homo sapiens
gatgtcatgtacttcctgtg

SEQ ID NO: 6225951 - DNA, 14 bp, Homo sapiens
gatgtcatttccac

SEQ ID NO: 6225952 - DNA, 17 bp, Homo sapiens
gatgtccaaaagatacc

SEQ ID NO: 6225953 - DNA, 14 bp, Homo sapiens
gatgtccaacaagg

SEQ ID NO: 6225954 - DNA, 12 bp, Homo sapiens
gatgtccagaag

SEQ ID NO: 6225955 - DNA, 12 bp, Homo sapiens
gatgtccagggc

SEQ ID NO: 6225956 - DNA, 17 bp, Homo sapiens
gatgtccagggggagaa

SEQ ID NO: 6225957 - DNA, 23 bp, Homo sapiens
gatgtccagggggagaaggaaga

SEQ ID NO: 6225958 - DNA, 15 bp, Homo sapiens
gatgtcccacaggga

SEQ ID NO: 6225959 - DNA, 18 bp, Homo sapiens
gatgtcccacagggacca

SEQ ID NO: 6225960 - DNA, 18 bp, Homo sapiens
gatgtcccagtgctcacc

SEQ ID NO: 6225961 - DNA, 18 bp, Homo sapiens
gatgtcccatctgctcct

SEQ ID NO: 6225962 - DNA, 11 bp, Homo sapiens
gatgtccccag

SEQ ID NO: 6225963 - DNA, 21 bp, Homo sapiens
gatgtcccccaggggcccagg

SEQ ID NO: 6225964 - DNA, 19 bp, Homo sapiens
gatgtccctattctgccat

SEQ ID NO: 6225965 - DNA, 15 bp, Homo sapiens
gatgtccctcctttt

SEQ ID NO: 6225966 - DNA, 19 bp, Homo sapiens
gatgtccctgggccagggt

SEQ ID NO: 6225967 - DNA, 21 bp, Homo sapiens
gatgtcccttgatgcacagag

SEQ ID NO: 6225968 - DNA, 15 bp, Homo sapiens
gatgtccgttccagg

SEQ ID NO: 6225969 - DNA, 18 bp, Homo sapiens
gatgtcctcctctgtgaa

SEQ ID NO: 6225970 - DNA, 20 bp, Homo sapiens
gatgtcctcctctgtgaaac

SEQ ID NO: 6225971 - DNA, 18 bp, Homo sapiens
gatgtccttaaaatgtgg

SEQ ID NO: 6225972 - DNA, 21 bp, Homo sapiens
gatgtcgctgggtcctctgca

SEQ ID NO: 6225973 - DNA, 14 bp, Homo sapiens
gatgtctaatagtt

SEQ ID NO: 6225974 - DNA, 17 bp, Homo sapiens
gatgtctacagaaaatg

SEQ ID NO: 6225975 - DNA, 14 bp, Homo sapiens
gatgtctcagagcc

SEQ ID NO: 6225976 - DNA, 15 bp, Homo sapiens
gatgtctcctcaagc

SEQ ID NO: 6225977 - DNA, 16 bp, Homo sapiens
gatgtctctaaagcac

SEQ ID NO: 6225978 - DNA, 13 bp, Homo sapiens
gatgtctgagaga

SEQ ID NO: 6225979 - DNA, 13 bp, Homo sapiens
gatgtctgtagca

SEQ ID NO: 6225980 - DNA, 19 bp, Homo sapiens
gatgtcttaacctcaggga

SEQ ID NO: 6225981 - DNA, 20 bp, Homo sapiens
gatgtcttaacgaataaagg

SEQ ID NO: 6225982 - DNA, 19 bp, Homo sapiens
gatgtcttagtgacttagt

SEQ ID NO: 6225983 - DNA, 16 bp, Homo sapiens
gatgtcttatttttag

SEQ ID NO: 6225984 - DNA, 14 bp, Homo sapiens
gatgtcttcatacc

SEQ ID NO: 6225985 - DNA, 18 bp, Homo sapiens
gatgtcttcatacctaca

SEQ ID NO: 6225986 - DNA, 12 bp, Homo sapiens
gatgtcttccct

SEQ ID NO: 6225987 - DNA, 15 bp, Homo sapiens
gatgtcttccctggg

SEQ ID NO: 6225988 - DNA, 17 bp, Homo sapiens
gatgtcttccctgggct

SEQ ID NO: 6225989 - DNA, 18 bp, Homo sapiens
gatgtcttctgcctgtta

SEQ ID NO: 6225990 - DNA, 20 bp, Homo sapiens
gatgtcttctgcctgttata

SEQ ID NO: 6225991 - DNA, 18 bp, Homo sapiens
gatgtcttgagatgtatt

SEQ ID NO: 6225992 - DNA, 13 bp, Homo sapiens
gatgtcttggaac

SEQ ID NO: 6225993 - DNA, 22 bp, Homo sapiens
gatgtcttggaacattggaatg

SEQ ID NO: 6225994 - DNA, 16 bp, Homo sapiens
gatgtctttgttaaga

SEQ ID NO: 6225995 - DNA, 13 bp, Homo sapiens
gatgtcttttata

SEQ ID NO: 6225996 - DNA, 24 bp, Homo sapiens
gatgtcttttttaaggctctgtgc

SEQ ID NO: 6225997 - DNA, 12 bp, Homo sapiens
gatgtgaagaaa

SEQ ID NO: 6225998 - DNA, 14 bp, Homo sapiens
gatgtgaagaaata

SEQ ID NO: 6225999 - DNA, 15 bp, Homo sapiens
gatgtgaagaaataa

SEQ ID NO: 6226000 - DNA, 23 bp, Homo sapiens
gatgtgaagccaattcagacagg

SEQ ID NO: 6226001 - DNA, 18 bp, Homo sapiens
gatgtgaattattgacac

SEQ ID NO: 6226002 - DNA, 21 bp, Homo sapiens
gatgtgaattgcctgcagaga

SEQ ID NO: 6226003 - DNA, 19 bp, Homo sapiens
gatgtgacccaccagtgcc

SEQ ID NO: 6226004 - DNA, 20 bp, Homo sapiens
gatgtgacccaccagtgcct

SEQ ID NO: 6226005 - DNA, 14 bp, Homo sapiens
gatgtgactgtata

SEQ ID NO: 6226006 - DNA, 14 bp, Homo sapiens
gatgtgagaaaacc

SEQ ID NO: 6226007 - DNA, 22 bp, Homo sapiens
gatgtgagaaaaccccttccca

SEQ ID NO: 6226008 - DNA, 14 bp, Homo sapiens
gatgtgagcagaag

SEQ ID NO: 6226009 - DNA, 10 bp, Homo sapiens
gatgtgagcc

SEQ ID NO: 6226010 - DNA, 21 bp, Homo sapiens
gatgtgagccaccgtgcctgg

SEQ ID NO: 6226011 - DNA, 14 bp, Homo sapiens
gatgtgagccttgt

SEQ ID NO: 6226012 - DNA, 18 bp, Homo sapiens
gatgtgagggcaccacca

SEQ ID NO: 6226013 - DNA, 21 bp, Homo sapiens
gatgtgagtcctgttgaagac

SEQ ID NO: 6226014 - DNA, 17 bp, Homo sapiens
gatgtgagtgtgtgtga

SEQ ID NO: 6226015 - DNA, 11 bp, Homo sapiens
gatgtgatata

SEQ ID NO: 6226016 - DNA, 16 bp, Homo sapiens
gatgtgatggaacaca

SEQ ID NO: 6226017 - DNA, 24 bp, Homo sapiens
gatgtgatttaatagtgttaatca

SEQ ID NO: 6226018 - DNA, 17 bp, Homo sapiens
gatgtgatttatgcatt

SEQ ID NO: 6226019 - DNA, 16 bp, Homo sapiens
gatgtgcaaaaccttt

SEQ ID NO: 6226020 - DNA, 17 bp, Homo sapiens
gatgtgcaacctgtggc

SEQ ID NO: 6226021 - DNA, 19 bp, Homo sapiens
gatgtgcaagcgacgacag

SEQ ID NO: 6226022 - DNA, 18 bp, Homo sapiens
gatgtgcagcatttcact

SEQ ID NO: 6226023 - DNA, 15 bp, Homo sapiens
gatgtgcatgggagc

SEQ ID NO: 6226024 - DNA, 16 bp, Homo sapiens
gatgtgccagaacttc

SEQ ID NO: 6226025 - DNA, 12 bp, Homo sapiens
gatgtgcctaaa

SEQ ID NO: 6226026 - DNA, 15 bp, Homo sapiens
gatgtgcctgggtgg

SEQ ID NO: 6226027 - DNA, 14 bp, Homo sapiens
gatgtgccttaaat

SEQ ID NO: 6226028 - DNA, 21 bp, Homo sapiens
gatgtgcggagcgggaggcgg

SEQ ID NO: 6226029 - DNA, 19 bp, Homo sapiens
gatgtgctataatctgttt

SEQ ID NO: 6226030 - DNA, 12 bp, Homo sapiens
gatgtgctcagc

SEQ ID NO: 6226031 - DNA, 13 bp, Homo sapiens
gatgtgctcagcc

SEQ ID NO: 6226032 - DNA, 20 bp, Homo sapiens
gatgtgctcccaccaggcag

SEQ ID NO: 6226033 - DNA, 15 bp, Homo sapiens
gatgtgctgcagtgc

SEQ ID NO: 6226034 - DNA, 18 bp, Homo sapiens
gatgtgctggagctggct

SEQ ID NO: 6226035 - DNA, 18 bp, Homo sapiens
gatgtgctttgtggcttc

SEQ ID NO: 6226036 - DNA, 11 bp, Homo sapiens
gatgtgctttt

SEQ ID NO: 6226037 - DNA, 19 bp, Homo sapiens
gatgtggaactgctgccac

SEQ ID NO: 6226038 - DNA, 21 bp, Homo sapiens
gatgtggaactgctgccactg

SEQ ID NO: 6226039 - DNA, 19 bp, Homo sapiens
gatgtggaatgcagtcctc

SEQ ID NO: 6226040 - DNA, 16 bp, Homo sapiens
gatgtggacatgcacc

SEQ ID NO: 6226041 - DNA, 18 bp, Homo sapiens
gatgtggacatgcacccg

SEQ ID NO: 6226042 - DNA, 22 bp, Homo sapiens
gatgtggacttgtatgctgccc

SEQ ID NO: 6226043 - DNA, 19 bp, Homo sapiens
gatgtggatccctttagaa

SEQ ID NO: 6226044 - DNA, 18 bp, Homo sapiens
gatgtggcaggagggcag

SEQ ID NO: 6226045 - DNA, 19 bp, Homo sapiens
gatgtggcaggggcagtgg

SEQ ID NO: 6226046 - DNA, 23 bp, Homo sapiens
gatgtggccctggctgccggcac

SEQ ID NO: 6226047 - DNA, 21 bp, Homo sapiens
gatgtggctactgacatatct

SEQ ID NO: 6226048 - DNA, 13 bp, Homo sapiens
gatgtgggcagct

SEQ ID NO: 6226049 - DNA, 16 bp, Homo sapiens
gatgtgggccaccatg

SEQ ID NO: 6226050 - DNA, 19 bp, Homo sapiens
gatgtgggccaccattgca

SEQ ID NO: 6226051 - DNA, 12 bp, Homo sapiens
gatgtgggctca

SEQ ID NO: 6226052 - DNA, 19 bp, Homo sapiens
gatgtgggtaagaggagca

SEQ ID NO: 6226053 - DNA, 17 bp, Homo sapiens
gatgtgggtcaaggaat

SEQ ID NO: 6226054 - DNA, 22 bp, Homo sapiens
gatgtggtattggtgctttgtg

SEQ ID NO: 6226055 - DNA, 18 bp, Homo sapiens
gatgtggtcacagctgta

SEQ ID NO: 6226056 - DNA, 23 bp, Homo sapiens
gatgtggtccttaggagacgctg

SEQ ID NO: 6226057 - DNA, 20 bp, Homo sapiens
gatgtggtgcctgaggtctg

SEQ ID NO: 6226058 - DNA, 16 bp, Homo sapiens
gatgtggtgcttttct

SEQ ID NO: 6226059 - DNA, 13 bp, Homo sapiens
gatgtgtaatttt

SEQ ID NO: 6226060 - DNA, 15 bp, Homo sapiens
gatgtgtatgtgttt

SEQ ID NO: 6226061 - DNA, 21 bp, Homo sapiens
gatgtgtccgtgaaagttgtg

SEQ ID NO: 6226062 - DNA, 13 bp, Homo sapiens
gatgtgtcctcag

SEQ ID NO: 6226063 - DNA, 17 bp, Homo sapiens
gatgtgtcctgacactg

SEQ ID NO: 6226064 - DNA, 18 bp, Homo sapiens
gatgtgtctcccagaact

SEQ ID NO: 6226065 - DNA, 15 bp, Homo sapiens
gatgtgtctgggaga

SEQ ID NO: 6226066 - DNA, 21 bp, Homo sapiens
gatgtgtctgggagagcctgg

SEQ ID NO: 6226067 - DNA, 22 bp, Homo sapiens
gatgtgtctgggagagcctggc

SEQ ID NO: 6226068 - DNA, 14 bp, Homo sapiens
gatgtgtgctttcc

SEQ ID NO: 6226069 - DNA, 16 bp, Homo sapiens
gatgtgtggggcatgg

SEQ ID NO: 6226070 - DNA, 17 bp, Homo sapiens
gatgtgtgttgatactg

SEQ ID NO: 6226071 - DNA, 21 bp, Homo sapiens
gatgtgtgttgatactgttgc

SEQ ID NO: 6226072 - DNA, 24 bp, Homo sapiens
gatgtgtgttgtcagcctgtgctg

SEQ ID NO: 6226073 - DNA, 18 bp, Homo sapiens
gatgtgttcattcaagct

SEQ ID NO: 6226074 - DNA, 17 bp, Homo sapiens
gatgtgttcctcctgct

SEQ ID NO: 6226075 - DNA, 14 bp, Homo sapiens
gatgtgttcttatt

SEQ ID NO: 6226076 - DNA, 12 bp, Homo sapiens
gatgtgttcttt

SEQ ID NO: 6226077 - DNA, 20 bp, Homo sapiens
gatgtgttgaccggctgccg

SEQ ID NO: 6226078 - DNA, 21 bp, Homo sapiens
gatgtgttgaccggctgccgt

SEQ ID NO: 6226079 - DNA, 16 bp, Homo sapiens
gatgtgttttgcacgt

SEQ ID NO: 6226080 - DNA, 21 bp, Homo sapiens
gatgtgttttgttttggactc

SEQ ID NO: 6226081 - DNA, 21 bp, Homo sapiens
gatgttaaatgttattattac

SEQ ID NO: 6226082 - DNA, 21 bp, Homo sapiens
gatgttaacacattttgtata

SEQ ID NO: 6226083 - DNA, 22 bp, Homo sapiens
gatgttaacacattttgtataa

SEQ ID NO: 6226084 - DNA, 13 bp, Homo sapiens
gatgttaacagta

SEQ ID NO: 6226085 - DNA, 19 bp, Homo sapiens
gatgttaacagtattttaa

SEQ ID NO: 6226086 - DNA, 21 bp, Homo sapiens
gatgttaacagtattttaaga

SEQ ID NO: 6226087 - DNA, 21 bp, Homo sapiens
gatgttaacttggttctcaga

SEQ ID NO: 6226088 - DNA, 23 bp, Homo sapiens
gatgttaacttggttctcagact

SEQ ID NO: 6226089 - DNA, 14 bp, Homo sapiens
gatgttaactttgt

SEQ ID NO: 6226090 - DNA, 23 bp, Homo sapiens
gatgttaatctcccagcccacct

SEQ ID NO: 6226091 - DNA, 18 bp, Homo sapiens
gatgttacaagtttgcta

SEQ ID NO: 6226092 - DNA, 19 bp, Homo sapiens
gatgttacaagtttgctaa

SEQ ID NO: 6226093 - DNA, 22 bp, Homo sapiens
gatgttacaagtttgctaaaag

SEQ ID NO: 6226094 - DNA, 20 bp, Homo sapiens
gatgttacatcacagtgttt

SEQ ID NO: 6226095 - DNA, 17 bp, Homo sapiens
gatgttactaccttatt

SEQ ID NO: 6226096 - DNA, 17 bp, Homo sapiens
gatgttactccaaaact

SEQ ID NO: 6226097 - DNA, 19 bp, Homo sapiens
gatgttagaaagtgctgat

SEQ ID NO: 6226098 - DNA, 15 bp, Homo sapiens
gatgttagacttgct

SEQ ID NO: 6226099 - DNA, 22 bp, Homo sapiens
gatgttatattaaagaaaaact

SEQ ID NO: 6226100 - DNA, 13 bp, Homo sapiens
gatgttatatttt

SEQ ID NO: 6226101 - DNA, 21 bp, Homo sapiens
gatgttatatttttcttaaaa

SEQ ID NO: 6226102 - DNA, 15 bp, Homo sapiens
gatgttatcttaaca

SEQ ID NO: 6226103 - DNA, 14 bp, Homo sapiens
gatgttatgaacag

SEQ ID NO: 6226104 - DNA, 15 bp, Homo sapiens
gatgttatgaacagc

SEQ ID NO: 6226105 - DNA, 17 bp, Homo sapiens
gatgttatgaacagctg

SEQ ID NO: 6226106 - DNA, 18 bp, Homo sapiens
gatgttatgaacagctgt

SEQ ID NO: 6226107 - DNA, 20 bp, Homo sapiens
gatgttatgtaaaaggccaa

SEQ ID NO: 6226108 - DNA, 15 bp, Homo sapiens
gatgttattactgtt

SEQ ID NO: 6226109 - DNA, 23 bp, Homo sapiens
gatgttattactgttttgggcct

SEQ ID NO: 6226110 - DNA, 21 bp, Homo sapiens
gatgttcaacttaatgaagaa

SEQ ID NO: 6226111 - DNA, 15 bp, Homo sapiens
gatgttcaatagaac

SEQ ID NO: 6226112 - DNA, 17 bp, Homo sapiens
gatgttcaatagaacat

SEQ ID NO: 6226113 - DNA, 20 bp, Homo sapiens
gatgttcagaattttggaaa

SEQ ID NO: 6226114 - DNA, 13 bp, Homo sapiens
gatgttcagagtg

SEQ ID NO: 6226115 - DNA, 17 bp, Homo sapiens
gatgttcagagtggctc

SEQ ID NO: 6226116 - DNA, 20 bp, Homo sapiens
gatgttcagcactgtccctt

SEQ ID NO: 6226117 - DNA, 14 bp, Homo sapiens
gatgttcagtgtaa

SEQ ID NO: 6226118 - DNA, 15 bp, Homo sapiens
gatgttcagtgtaat

SEQ ID NO: 6226119 - DNA, 23 bp, Homo sapiens
gatgttcagtgtaatttctttgc

SEQ ID NO: 6226120 - DNA, 14 bp, Homo sapiens
gatgttcatttaga

SEQ ID NO: 6226121 - DNA, 18 bp, Homo sapiens
gatgttccacctgccaca

SEQ ID NO: 6226122 - DNA, 13 bp, Homo sapiens
gatgttctaaggc

SEQ ID NO: 6226123 - DNA, 21 bp, Homo sapiens
gatgttctactttgttctgct

SEQ ID NO: 6226124 - DNA, 22 bp, Homo sapiens
gatgttctattttttgttttgt

SEQ ID NO: 6226125 - DNA, 15 bp, Homo sapiens
gatgttctctatcat

SEQ ID NO: 6226126 - DNA, 19 bp, Homo sapiens
gatgttctctatcatttaa

SEQ ID NO: 6226127 - DNA, 21 bp, Homo sapiens
gatgttctctatcatttaata

SEQ ID NO: 6226128 - DNA, 22 bp, Homo sapiens
gatgttctgcctctccctgggt

SEQ ID NO: 6226129 - DNA, 18 bp, Homo sapiens
gatgttctggacctcccc

SEQ ID NO: 6226130 - DNA, 18 bp, Homo sapiens
gatgttctggataccatt

SEQ ID NO: 6226131 - DNA, 14 bp, Homo sapiens
gatgttctggccct

SEQ ID NO: 6226132 - DNA, 21 bp, Homo sapiens
gatgttgaaatatgcatacta

SEQ ID NO: 6226133 - DNA, 19 bp, Homo sapiens
gatgttgaactttttttaa

SEQ ID NO: 6226134 - DNA, 20 bp, Homo sapiens
gatgttgaagaatacagtta

SEQ ID NO: 6226135 - DNA, 14 bp, Homo sapiens
gatgttgagctgag

SEQ ID NO: 6226136 - DNA, 13 bp, Homo sapiens
gatgttgataatt

SEQ ID NO: 6226137 - DNA, 21 bp, Homo sapiens
gatgttgatgcaatccttaca

SEQ ID NO: 6226138 - DNA, 19 bp, Homo sapiens
gatgttgccatgtgtttta

SEQ ID NO: 6226139 - DNA, 19 bp, Homo sapiens
gatgttgctccatcctttg

SEQ ID NO: 6226140 - DNA, 19 bp, Homo sapiens
gatgttgctgttcacagct

SEQ ID NO: 6226141 - DNA, 13 bp, Homo sapiens
gatgttgcttctg

SEQ ID NO: 6226142 - DNA, 15 bp, Homo sapiens
gatgttggctgggaa

SEQ ID NO: 6226143 - DNA, 17 bp, Homo sapiens
gatgttggtccaaagtg

SEQ ID NO: 6226144 - DNA, 15 bp, Homo sapiens
gatgttgtaaataaa

SEQ ID NO: 6226145 - DNA, 15 bp, Homo sapiens
gatgtttaatcaaga

SEQ ID NO: 6226146 - DNA, 14 bp, Homo sapiens
gatgtttaatgaag

SEQ ID NO: 6226147 - DNA, 16 bp, Homo sapiens
gatgtttacatggcgc

SEQ ID NO: 6226148 - DNA, 17 bp, Homo sapiens
gatgtttacctggtgct

SEQ ID NO: 6226149 - DNA, 15 bp, Homo sapiens
gatgtttagtagctg

SEQ ID NO: 6226150 - DNA, 14 bp, Homo sapiens
gatgtttataaact

SEQ ID NO: 6226151 - DNA, 14 bp, Homo sapiens
gatgtttatgttct

SEQ ID NO: 6226152 - DNA, 13 bp, Homo sapiens
gatgtttcatttt

SEQ ID NO: 6226153 - DNA, 14 bp, Homo sapiens
gatgtttccagaaa

SEQ ID NO: 6226154 - DNA, 16 bp, Homo sapiens
gatgtttccagaaaat

SEQ ID NO: 6226155 - DNA, 22 bp, Homo sapiens
gatgtttccagaaaatataaat

SEQ ID NO: 6226156 - DNA, 13 bp, Homo sapiens
gatgtttccagac

SEQ ID NO: 6226157 - DNA, 19 bp, Homo sapiens
gatgtttccagacttcctt

SEQ ID NO: 6226158 - DNA, 15 bp, Homo sapiens
gatgtttccagctgc

SEQ ID NO: 6226159 - DNA, 19 bp, Homo sapiens
gatgtttccagctgccaag

SEQ ID NO: 6226160 - DNA, 21 bp, Homo sapiens
gatgtttccctctccttccaa

SEQ ID NO: 6226161 - DNA, 14 bp, Homo sapiens
gatgtttcctggaa

SEQ ID NO: 6226162 - DNA, 20 bp, Homo sapiens
gatgtttcctggaagcagag

SEQ ID NO: 6226163 - DNA, 20 bp, Homo sapiens
gatgtttctatatgtaactt

SEQ ID NO: 6226164 - DNA, 15 bp, Homo sapiens
gatgtttctgtgaaa

SEQ ID NO: 6226165 - DNA, 23 bp, Homo sapiens
gatgtttctgtgaaattctcaga

SEQ ID NO: 6226166 - DNA, 12 bp, Homo sapiens
gatgtttcttct

SEQ ID NO: 6226167 - DNA, 19 bp, Homo sapiens
gatgtttcttttgtatgta

SEQ ID NO: 6226168 - DNA, 13 bp, Homo sapiens
gatgtttgcccaa

SEQ ID NO: 6226169 - DNA, 14 bp, Homo sapiens
gatgtttgcccaaa

SEQ ID NO: 6226170 - DNA, 18 bp, Homo sapiens
gatgtttgcccaaaattt

SEQ ID NO: 6226171 - DNA, 16 bp, Homo sapiens
gatgtttgctcagagg

SEQ ID NO: 6226172 - DNA, 22 bp, Homo sapiens
gatgtttgtgatggtctctggt

SEQ ID NO: 6226173 - DNA, 13 bp, Homo sapiens
gatgtttgtgtca

SEQ ID NO: 6226174 - DNA, 13 bp, Homo sapiens
gatgttttaactt

SEQ ID NO: 6226175 - DNA, 15 bp, Homo sapiens
gatgttttaacttat

SEQ ID NO: 6226176 - DNA, 18 bp, Homo sapiens
gatgttttaattccatga

SEQ ID NO: 6226177 - DNA, 21 bp, Homo sapiens
gatgttttacgtctgggagaa

SEQ ID NO: 6226178 - DNA, 19 bp, Homo sapiens
gatgttttagagataaata

SEQ ID NO: 6226179 - DNA, 22 bp, Homo sapiens
gatgttttagagataaatattt

SEQ ID NO: 6226180 - DNA, 13 bp, Homo sapiens
gatgttttagcat

SEQ ID NO: 6226181 - DNA, 23 bp, Homo sapiens
gatgttttagccattgttggctt

SEQ ID NO: 6226182 - DNA, 14 bp, Homo sapiens
gatgttttccactg

SEQ ID NO: 6226183 - DNA, 13 bp, Homo sapiens
gatgttttctaag

SEQ ID NO: 6226184 - DNA, 15 bp, Homo sapiens
gatgttttgggggaa

SEQ ID NO: 6226185 - DNA, 22 bp, Homo sapiens
gatgttttggtagattaaatat

SEQ ID NO: 6226186 - DNA, 16 bp, Homo sapiens
gatgttttgtataaaa

SEQ ID NO: 6226187 - DNA, 18 bp, Homo sapiens
gatgttttgtataaaatc

SEQ ID NO: 6226188 - DNA, 20 bp, Homo sapiens
gatgttttgtcccatttcct

SEQ ID NO: 6226189 - DNA, 15 bp, Homo sapiens
gatgtttttaaaatc

SEQ ID NO: 6226190 - DNA, 17 bp, Homo sapiens
gatgtttttaaaatctt

SEQ ID NO: 6226191 - DNA, 20 bp, Homo sapiens
gatgtttttagttctgactt

SEQ ID NO: 6226192 - DNA, 22 bp, Homo sapiens
gatgtttttagttctgactttg

SEQ ID NO: 6226193 - DNA, 13 bp, Homo sapiens
gattaaaaatacc

SEQ ID NO: 6226194 - DNA, 22 bp, Homo sapiens
gattaaaaggtatactttagta

SEQ ID NO: 6226195 - DNA, 18 bp, Homo sapiens
gattaaaatatcctttca

SEQ ID NO: 6226196 - DNA, 16 bp, Homo sapiens
gattaaaatatttgcc

SEQ ID NO: 6226197 - DNA, 18 bp, Homo sapiens
aacatcactacaaaaaga

SEQ ID NO: 6226198 - DNA, 21 bp, Homo sapiens
aacatcactacaaaaagaaga

SEQ ID NO: 6226199 - DNA, 20 bp, Homo sapiens
aacatcactatcaattttaa

SEQ ID NO: 6226200 - DNA, 19 bp, Homo sapiens
aacatcagaactgaaataa

SEQ ID NO: 6226201 - DNA, 17 bp, Homo sapiens
aacatcagacctgtctt

SEQ ID NO: 6226202 - DNA, 21 bp, Homo sapiens
aacatcaggttaggcagtata

SEQ ID NO: 6226203 - DNA, 22 bp, Homo sapiens
aacatcaggttaggcagtataa

SEQ ID NO: 6226204 - DNA, 13 bp, Homo sapiens
aacatcagtggat

SEQ ID NO: 6226205 - DNA, 21 bp, Homo sapiens
aacatcagttactctgaaggg

SEQ ID NO: 6226206 - DNA, 16 bp, Homo sapiens
aacatcatcaaggcac

SEQ ID NO: 6226207 - DNA, 21 bp, Homo sapiens
aacatcatcaggaagcctgtg

SEQ ID NO: 6226208 - DNA, 12 bp, Homo sapiens
aacatcattcta

SEQ ID NO: 6226209 - DNA, 16 bp, Homo sapiens
aacatcattctacata

SEQ ID NO: 6226210 - DNA, 21 bp, Homo sapiens
aacatcattctacataatgga

SEQ ID NO: 6226211 - DNA, 15 bp, Homo sapiens
aacatcattgcataa

SEQ ID NO: 6226212 - DNA, 17 bp, Homo sapiens
aacatcattttgttttc

SEQ ID NO: 6226213 - DNA, 11 bp, Homo sapiens
aacatccaaaa

SEQ ID NO: 6226214 - DNA, 16 bp, Homo sapiens
aacatccaagccagag

SEQ ID NO: 6226215 - DNA, 15 bp, Homo sapiens
aacatccaagtcttt

SEQ ID NO: 6226216 - DNA, 22 bp, Homo sapiens
aacatccaagtctttcttcttt

SEQ ID NO: 6226217 - DNA, 15 bp, Homo sapiens
aacatccaataggaa

SEQ ID NO: 6226218 - DNA, 21 bp, Homo sapiens
aacatccaataggaatgctaa

SEQ ID NO: 6226219 - DNA, 16 bp, Homo sapiens
aacatccacttaagtt

SEQ ID NO: 6226220 - DNA, 19 bp, Homo sapiens
aacatccacttaagttctt

SEQ ID NO: 6226221 - DNA, 15 bp, Homo sapiens
aacatcccaaacttt

SEQ ID NO: 6226222 - DNA, 24 bp, Homo sapiens
aacatcccaaactttaaaatgcga

SEQ ID NO: 6226223 - DNA, 17 bp, Homo sapiens
aacatcccaataaagtc

SEQ ID NO: 6226224 - DNA, 18 bp, Homo sapiens
aacatcccattgccctgg

SEQ ID NO: 6226225 - DNA, 17 bp, Homo sapiens
aacatcctgctttgatt

SEQ ID NO: 6226226 - DNA, 15 bp, Homo sapiens
aacatccttccttcc

SEQ ID NO: 6226227 - DNA, 17 bp, Homo sapiens
aacatcgatatgtatat

SEQ ID NO: 6226228 - DNA, 19 bp, Homo sapiens
aacatcgatatgtatatca

SEQ ID NO: 6226229 - DNA, 15 bp, Homo sapiens
aacatcgtggatgta

SEQ ID NO: 6226230 - DNA, 16 bp, Homo sapiens
aacatctacaggatct

SEQ ID NO: 6226231 - DNA, 23 bp, Homo sapiens
aacatctcaataaagtgctttaa

SEQ ID NO: 6226232 - DNA, 18 bp, Homo sapiens
aacatctcatcatgtcta

SEQ ID NO: 6226233 - DNA, 17 bp, Homo sapiens
aacatctcatgtgtgct

SEQ ID NO: 6226234 - DNA, 16 bp, Homo sapiens
aacatctcctccaata

SEQ ID NO: 6226235 - DNA, 12 bp, Homo sapiens
aacatctgaaaa

SEQ ID NO: 6226236 - DNA, 18 bp, Homo sapiens
aacatctgaaaagaaatg

SEQ ID NO: 6226237 - DNA, 22 bp, Homo sapiens
aacatctgaaaagaaatgctaa

SEQ ID NO: 6226238 - DNA, 14 bp, Homo sapiens
aacatctgaagagc

SEQ ID NO: 6226239 - DNA, 21 bp, Homo sapiens
aacatctgatctgtataaaaa

SEQ ID NO: 6226240 - DNA, 21 bp, Homo sapiens
aacatctgcagtgttctgtga

SEQ ID NO: 6226241 - DNA, 16 bp, Homo sapiens
aacatctgccttgctg

SEQ ID NO: 6226242 - DNA, 13 bp, Homo sapiens
aacatctgtgtct

SEQ ID NO: 6226243 - DNA, 19 bp, Homo sapiens
aacatctgtgtctgtgtct

SEQ ID NO: 6226244 - DNA, 16 bp, Homo sapiens
aacatcttcatataaa

SEQ ID NO: 6226245 - DNA, 21 bp, Homo sapiens
aacatcttgaatactctgccc

SEQ ID NO: 6226246 - DNA, 21 bp, Homo sapiens
aacatcttggctgttctagac

SEQ ID NO: 6226247 - DNA, 19 bp, Homo sapiens
aacatctttacgtactgta

SEQ ID NO: 6226248 - DNA, 18 bp, Homo sapiens
aacatctttattgaaatt

SEQ ID NO: 6226249 - DNA, 21 bp, Homo sapiens
aacatctttgaaattatgtaa

SEQ ID NO: 6226250 - DNA, 15 bp, Homo sapiens
aacatctttgcgaaa

SEQ ID NO: 6226251 - DNA, 16 bp, Homo sapiens
aacatctttgttttta

SEQ ID NO: 6226252 - DNA, 11 bp, Homo sapiens
aacatcttttc

SEQ ID NO: 6226253 - DNA, 22 bp, Homo sapiens
aacatcttttcctgatggctgg

SEQ ID NO: 6226254 - DNA, 21 bp, Homo sapiens
aacatctttttcctccctttc

SEQ ID NO: 6226255 - DNA, 21 bp, Homo sapiens
aacatgaaaaacaaacaaaaa

SEQ ID NO: 6226256 - DNA, 23 bp, Homo sapiens
aacatgaaaaacacggcagctgt

SEQ ID NO: 6226257 - DNA, 18 bp, Homo sapiens
aacatgaaagctgatgcc

SEQ ID NO: 6226258 - DNA, 14 bp, Homo sapiens
aacatgaaatgata

SEQ ID NO: 6226259 - DNA, 14 bp, Homo sapiens
aacatgaaatgccc

SEQ ID NO: 6226260 - DNA, 16 bp, Homo sapiens
aacatgaacccaaaaa

SEQ ID NO: 6226261 - DNA, 14 bp, Homo sapiens
aacatgaagaatgc

SEQ ID NO: 6226262 - DNA, 18 bp, Homo sapiens
aacatgaagacctttttc

SEQ ID NO: 6226263 - DNA, 22 bp, Homo sapiens
aacatgaagacctttttctgca

SEQ ID NO: 6226264 - DNA, 18 bp, Homo sapiens
aacatgaagcataatttg

SEQ ID NO: 6226265 - DNA, 13 bp, Homo sapiens
aacatgaatcaaa

SEQ ID NO: 6226266 - DNA, 20 bp, Homo sapiens
aacatgaatcaaaagtgcct

SEQ ID NO: 6226267 - DNA, 14 bp, Homo sapiens
aacatgacactgac

SEQ ID NO: 6226268 - DNA, 19 bp, Homo sapiens
aacatgacatttaccagca

SEQ ID NO: 6226269 - DNA, 22 bp, Homo sapiens
aacatgacatttaccagcaact

SEQ ID NO: 6226270 - DNA, 16 bp, Homo sapiens
aacatgaccaaaaacc

SEQ ID NO: 6226271 - DNA, 24 bp, Homo sapiens
aacatgacttccttatttctgaac

SEQ ID NO: 6226272 - DNA, 13 bp, Homo sapiens
aacatgagaaatg

SEQ ID NO: 6226273 - DNA, 23 bp, Homo sapiens
aacatgagaaatgtgaactgtga

SEQ ID NO: 6226274 - DNA, 18 bp, Homo sapiens
aacatgaggacagaagga

SEQ ID NO: 6226275 - DNA, 18 bp, Homo sapiens
aacatgaggggacatttt

SEQ ID NO: 6226276 - DNA, 13 bp, Homo sapiens
aacatgagttatt

SEQ ID NO: 6226277 - DNA, 14 bp, Homo sapiens
aacatgagtttatg

SEQ ID NO: 6226278 - DNA, 22 bp, Homo sapiens
aacatgatccccgtctctgccc

SEQ ID NO: 6226279 - DNA, 17 bp, Homo sapiens
aacatgatgaggtagta

SEQ ID NO: 6226280 - DNA, 13 bp, Homo sapiens
aacatgatgggcc

SEQ ID NO: 6226281 - DNA, 17 bp, Homo sapiens
aacatgatgtcaacttc

SEQ ID NO: 6226282 - DNA, 14 bp, Homo sapiens
aacatgatgtgaga

SEQ ID NO: 6226283 - DNA, 15 bp, Homo sapiens
aacatgattatcttg

SEQ ID NO: 6226284 - DNA, 16 bp, Homo sapiens
aacatgatttatttgt

SEQ ID NO: 6226285 - DNA, 13 bp, Homo sapiens
aacatgatttggg

SEQ ID NO: 6226286 - DNA, 24 bp, Homo sapiens
aacatgattttacaagtataacag

SEQ ID NO: 6226287 - DNA, 22 bp, Homo sapiens
aacatgcaagatacaggaaaaa

SEQ ID NO: 6226288 - DNA, 12 bp, Homo sapiens
aacatgcaataa

SEQ ID NO: 6226289 - DNA, 15 bp, Homo sapiens
aacatgcaataacaa

SEQ ID NO: 6226290 - DNA, 22 bp, Homo sapiens
aacatgcaattggggaagaaaa

SEQ ID NO: 6226291 - DNA, 22 bp, Homo sapiens
aacatgcaattttgcatttgaa

SEQ ID NO: 6226292 - DNA, 17 bp, Homo sapiens
aacatgcacattcatcc

SEQ ID NO: 6226293 - DNA, 18 bp, Homo sapiens
aacatgcacattcatcct

SEQ ID NO: 6226294 - DNA, 20 bp, Homo sapiens
aacatgcacatttatatata

SEQ ID NO: 6226295 - DNA, 18 bp, Homo sapiens
aacatgcacattttgtac

SEQ ID NO: 6226296 - DNA, 16 bp, Homo sapiens
aacatgcactgatgtt

SEQ ID NO: 6226297 - DNA, 18 bp, Homo sapiens
aacatgcagctctgcagc

SEQ ID NO: 6226298 - DNA, 11 bp, Homo sapiens
aacatgcagtt

SEQ ID NO: 6226299 - DNA, 15 bp, Homo sapiens
aacatgcagtttgaa

SEQ ID NO: 6226300 - DNA, 22 bp, Homo sapiens
aacatgcagtttgaaattctga

SEQ ID NO: 6226301 - DNA, 12 bp, Homo sapiens
aacatgcatatg

SEQ ID NO: 6226302 - DNA, 12 bp, Homo sapiens
aacatgccccag

SEQ ID NO: 6226303 - DNA, 22 bp, Homo sapiens
aacatgccccctgcagacacgt

SEQ ID NO: 6226304 - DNA, 18 bp, Homo sapiens
aacatgcctcctcctgcc

SEQ ID NO: 6226305 - DNA, 14 bp, Homo sapiens
aacatgcctgattt

SEQ ID NO: 6226306 - DNA, 15 bp, Homo sapiens
aacatgcctgatttt

SEQ ID NO: 6226307 - DNA, 21 bp, Homo sapiens
aacatgcctgccccaaacaaa

SEQ ID NO: 6226308 - DNA, 22 bp, Homo sapiens
aacatgcctgccccaaacaaat

SEQ ID NO: 6226309 - DNA, 20 bp, Homo sapiens
aacatgctgctctggtgcac

SEQ ID NO: 6226310 - DNA, 22 bp, Homo sapiens
aacatgctggtgaatattttca

SEQ ID NO: 6226311 - DNA, 19 bp, Homo sapiens
aacatgcttataacattaa

SEQ ID NO: 6226312 - DNA, 16 bp, Homo sapiens
aacatgcttgatgttt

SEQ ID NO: 6226313 - DNA, 20 bp, Homo sapiens
aacatgcttttactttattg

SEQ ID NO: 6226314 - DNA, 17 bp, Homo sapiens
aacatggaaaacagagt

SEQ ID NO: 6226315 - DNA, 16 bp, Homo sapiens
aacatggaagatattc

SEQ ID NO: 6226316 - DNA, 20 bp, Homo sapiens
aacatggaatttaatttatg

SEQ ID NO: 6226317 - DNA, 19 bp, Homo sapiens
aacatggacttgtatattt

SEQ ID NO: 6226318 - DNA, 16 bp, Homo sapiens
aacatggagaaatcta

SEQ ID NO: 6226319 - DNA, 23 bp, Homo sapiens
aacatggaggatggtgtcctgag

SEQ ID NO: 6226320 - DNA, 12 bp, Homo sapiens
aacatggccaca

SEQ ID NO: 6226321 - DNA, 20 bp, Homo sapiens
aacatggccagactcccttg

SEQ ID NO: 6226322 - DNA, 22 bp, Homo sapiens
aacatggcctttgcttgaaaga

SEQ ID NO: 6226323 - DNA, 21 bp, Homo sapiens
aacatgggagcttattgctaa

SEQ ID NO: 6226324 - DNA, 11 bp, Homo sapiens
aacatgggagg

SEQ ID NO: 6226325 - DNA, 17 bp, Homo sapiens
aacatgggagggatcag

SEQ ID NO: 6226326 - DNA, 21 bp, Homo sapiens
aacatgggagggatcagcccc

SEQ ID NO: 6226327 - DNA, 21 bp, Homo sapiens
aacatgggcattgggttctaa

SEQ ID NO: 6226328 - DNA, 17 bp, Homo sapiens
aacatgggctgtgatta

SEQ ID NO: 6226329 - DNA, 22 bp, Homo sapiens
aacatgggctgtgattactgca

SEQ ID NO: 6226330 - DNA, 14 bp, Homo sapiens
aacatgggtttcct

SEQ ID NO: 6226331 - DNA, 16 bp, Homo sapiens
aacatgggtttcctta

SEQ ID NO: 6226332 - DNA, 22 bp, Homo sapiens
aacatggtaaacgctgtcccta

SEQ ID NO: 6226333 - DNA, 23 bp, Homo sapiens
aacatggttaccatgtctttctc

SEQ ID NO: 6226334 - DNA, 16 bp, Homo sapiens
aacatggtttaaaaga

SEQ ID NO: 6226335 - DNA, 23 bp, Homo sapiens
aacatggtttgactcatcttata

SEQ ID NO: 6226336 - DNA, 19 bp, Homo sapiens
aacatgtaatataaagatg

SEQ ID NO: 6226337 - DNA, 19 bp, Homo sapiens
aacatgtactacagctata

SEQ ID NO: 6226338 - DNA, 15 bp, Homo sapiens
aacatgtaggaagta

SEQ ID NO: 6226339 - DNA, 17 bp, Homo sapiens
aacatgtataatatttt

SEQ ID NO: 6226340 - DNA, 16 bp, Homo sapiens
aacatgtatctgtcta

SEQ ID NO: 6226341 - DNA, 11 bp, Homo sapiens
aacatgtcatg

SEQ ID NO: 6226342 - DNA, 16 bp, Homo sapiens
aacatgtccccttccc

SEQ ID NO: 6226343 - DNA, 20 bp, Homo sapiens
aacatgtcctgcctattatc

SEQ ID NO: 6226344 - DNA, 20 bp, Homo sapiens
aacatgtcttgactgttagt

SEQ ID NO: 6226345 - DNA, 15 bp, Homo sapiens
aacatgtgcccctgc

SEQ ID NO: 6226346 - DNA, 16 bp, Homo sapiens
aacatgtggaagaaaa

SEQ ID NO: 6226347 - DNA, 12 bp, Homo sapiens
aacatgtgtgac

SEQ ID NO: 6226348 - DNA, 13 bp, Homo sapiens
aacatgtgtttct

SEQ ID NO: 6226349 - DNA, 21 bp, Homo sapiens
aacatgttacgtgtgcaacag

SEQ ID NO: 6226350 - DNA, 20 bp, Homo sapiens
aacatgttcccaaggcccca

SEQ ID NO: 6226351 - DNA, 13 bp, Homo sapiens
aacatgttcctga

SEQ ID NO: 6226352 - DNA, 15 bp, Homo sapiens
aacatgttggtattt

SEQ ID NO: 6226353 - DNA, 22 bp, Homo sapiens
aacatgtttaaatagcctaaat

SEQ ID NO: 6226354 - DNA, 20 bp, Homo sapiens
aacatgtttacttttcaggg

SEQ ID NO: 6226355 - DNA, 11 bp, Homo sapiens
aacatgtttcc

SEQ ID NO: 6226356 - DNA, 15 bp, Homo sapiens
aacatgtttccagca

SEQ ID NO: 6226357 - DNA, 16 bp, Homo sapiens
aacatgtttccagcat

SEQ ID NO: 6226358 - DNA, 17 bp, Homo sapiens
aacatgtttccagcatt

SEQ ID NO: 6226359 - DNA, 18 bp, Homo sapiens
aacatgtttccagcattc

SEQ ID NO: 6226360 - DNA, 21 bp, Homo sapiens
aacatgtttccagcattccca

SEQ ID NO: 6226361 - DNA, 21 bp, Homo sapiens
aacatgttttatgtacacaaa

SEQ ID NO: 6226362 - DNA, 22 bp, Homo sapiens
aacatgtttttcttctccctca

SEQ ID NO: 6226363 - DNA, 21 bp, Homo sapiens
aacattaaaaatggaactgtg

SEQ ID NO: 6226364 - DNA, 23 bp, Homo sapiens
aacattaaaacaatattgtttct

SEQ ID NO: 6226365 - DNA, 11 bp, Homo sapiens
aacattaaaca

SEQ ID NO: 6226366 - DNA, 13 bp, Homo sapiens
aacattaaacact

SEQ ID NO: 6226367 - DNA, 18 bp, Homo sapiens
aacattaaatgtcttata

SEQ ID NO: 6226368 - DNA, 18 bp, Homo sapiens
aacattaagaaaatattt

SEQ ID NO: 6226369 - DNA, 17 bp, Homo sapiens
aacattaagtaaatgct

SEQ ID NO: 6226370 - DNA, 18 bp, Homo sapiens
aacattaagtaaatgctg

SEQ ID NO: 6226371 - DNA, 16 bp, Homo sapiens
aacattaatgttgaaa

SEQ ID NO: 6226372 - DNA, 15 bp, Homo sapiens
aacattaatgttgat

SEQ ID NO: 6226373 - DNA, 17 bp, Homo sapiens
aacattaatgttgattt

SEQ ID NO: 6226374 - DNA, 13 bp, Homo sapiens
aacattaatttta

SEQ ID NO: 6226375 - DNA, 20 bp, Homo sapiens
gattaaaattcaggaagcag

SEQ ID NO: 6226376 - DNA, 16 bp, Homo sapiens
gattaaacacctgaca

SEQ ID NO: 6226377 - DNA, 19 bp, Homo sapiens
gattaaacagcaaagccat

SEQ ID NO: 6226378 - DNA, 19 bp, Homo sapiens
gattaaacctttttataaa

SEQ ID NO: 6226379 - DNA, 15 bp, Homo sapiens
gattaaactgagtga

SEQ ID NO: 6226380 - DNA, 14 bp, Homo sapiens
gattaaactgggaa

SEQ ID NO: 6226381 - DNA, 12 bp, Homo sapiens
gattaaactgta

SEQ ID NO: 6226382 - DNA, 14 bp, Homo sapiens
gattaaacttatga

SEQ ID NO: 6226383 - DNA, 17 bp, Homo sapiens
gattaaacttatgaatg

SEQ ID NO: 6226384 - DNA, 15 bp, Homo sapiens
gattaaacttcacct

SEQ ID NO: 6226385 - DNA, 14 bp, Homo sapiens
gattaaagagattg

SEQ ID NO: 6226386 - DNA, 14 bp, Homo sapiens
gattaaagtgcctt

SEQ ID NO: 6226387 - DNA, 17 bp, Homo sapiens
gattaaagtgccttcag

SEQ ID NO: 6226388 - DNA, 19 bp, Homo sapiens
gattaaataacttgaagag

SEQ ID NO: 6226389 - DNA, 23 bp, Homo sapiens
gattaaatatagattagaaaaat

SEQ ID NO: 6226390 - DNA, 22 bp, Homo sapiens
gattaaatatatctttgtaaat

SEQ ID NO: 6226391 - DNA, 11 bp, Homo sapiens
gattaaatctc

SEQ ID NO: 6226392 - DNA, 13 bp, Homo sapiens
gattaaatggcac

SEQ ID NO: 6226393 - DNA, 17 bp, Homo sapiens
gattaaatggcacctgt

SEQ ID NO: 6226394 - DNA, 17 bp, Homo sapiens
gattaaattacagcttt

SEQ ID NO: 6226395 - DNA, 19 bp, Homo sapiens
gattaaattacagctttta

SEQ ID NO: 6226396 - DNA, 12 bp, Homo sapiens
gattaaattctt

SEQ ID NO: 6226397 - DNA, 10 bp, Homo sapiens
gattaaattt

SEQ ID NO: 6226398 - DNA, 13 bp, Homo sapiens
gattaacacactg

SEQ ID NO: 6226399 - DNA, 19 bp, Homo sapiens
gattaaccacttcagctga

SEQ ID NO: 6226400 - DNA, 17 bp, Homo sapiens
gattaacctctgcacta

SEQ ID NO: 6226401 - DNA, 15 bp, Homo sapiens
gattaaccttttcaa

SEQ ID NO: 6226402 - DNA, 15 bp, Homo sapiens
gattaactaaagaag

SEQ ID NO: 6226403 - DNA, 24 bp, Homo sapiens
gattaactcttagaagtgttgtaa

SEQ ID NO: 6226404 - DNA, 19 bp, Homo sapiens
gattaacttatttagagat

SEQ ID NO: 6226405 - DNA, 11 bp, Homo sapiens
gattaagaaac

SEQ ID NO: 6226406 - DNA, 20 bp, Homo sapiens
gattaagacagagaaacaga

SEQ ID NO: 6226407 - DNA, 13 bp, Homo sapiens
gattaagagccat

SEQ ID NO: 6226408 - DNA, 20 bp, Homo sapiens
gattaagatacactcctgct

SEQ ID NO: 6226409 - DNA, 18 bp, Homo sapiens
gattaagatgccttgaat

SEQ ID NO: 6226410 - DNA, 19 bp, Homo sapiens
gattaaggactacagaatt

SEQ ID NO: 6226411 - DNA, 20 bp, Homo sapiens
gattaaggcgtgagccactg

SEQ ID NO: 6226412 - DNA, 14 bp, Homo sapiens
gattaaggcgtggc

SEQ ID NO: 6226413 - DNA, 18 bp, Homo sapiens
gattaaggcgtggcttct

SEQ ID NO: 6226414 - DNA, 15 bp, Homo sapiens
gattaagggacattt

SEQ ID NO: 6226415 - DNA, 19 bp, Homo sapiens
gattaagggacgggggtgg

SEQ ID NO: 6226416 - DNA, 17 bp, Homo sapiens
gattaaggtctctcttt

SEQ ID NO: 6226417 - DNA, 20 bp, Homo sapiens
gattaaggtctctctttgga

SEQ ID NO: 6226418 - DNA, 19 bp, Homo sapiens
gattaagttataccagcaa

SEQ ID NO: 6226419 - DNA, 15 bp, Homo sapiens
gattaataaaatatc

SEQ ID NO: 6226420 - DNA, 18 bp, Homo sapiens
gattaataacagaaatac

SEQ ID NO: 6226421 - DNA, 18 bp, Homo sapiens
gattaatatattgaacac

SEQ ID NO: 6226422 - DNA, 14 bp, Homo sapiens
gattaatatgaaaa

SEQ ID NO: 6226423 - DNA, 10 bp, Homo sapiens
gattaatcaa

SEQ ID NO: 6226424 - DNA, 20 bp, Homo sapiens
gattaatcaaaggcatatct

SEQ ID NO: 6226425 - DNA, 15 bp, Homo sapiens
gattaatccagaata

SEQ ID NO: 6226426 - DNA, 12 bp, Homo sapiens
gattaatgtgta

SEQ ID NO: 6226427 - DNA, 22 bp, Homo sapiens
gattaattagttgattgctgtt

SEQ ID NO: 6226428 - DNA, 14 bp, Homo sapiens
gattaattgctgca

SEQ ID NO: 6226429 - DNA, 14 bp, Homo sapiens
gattaatttatggt

SEQ ID NO: 6226430 - DNA, 16 bp, Homo sapiens
gattaatttatggttt

SEQ ID NO: 6226431 - DNA, 14 bp, Homo sapiens
gattaatttcatca

SEQ ID NO: 6226432 - DNA, 21 bp, Homo sapiens
gattaatttgtgaaaatgtaa

SEQ ID NO: 6226433 - DNA, 14 bp, Homo sapiens
gattaatttgtgta

SEQ ID NO: 6226434 - DNA, 16 bp, Homo sapiens
gattacaaataaacag

SEQ ID NO: 6226435 - DNA, 12 bp, Homo sapiens
gattacaaatag

SEQ ID NO: 6226436 - DNA, 17 bp, Homo sapiens
gattacaaatcagaagt

SEQ ID NO: 6226437 - DNA, 19 bp, Homo sapiens
gattacaaatcagaagtca

SEQ ID NO: 6226438 - DNA, 21 bp, Homo sapiens
gattacaaatcagaagtcatc

SEQ ID NO: 6226439 - DNA, 13 bp, Homo sapiens
gattacaataaat

SEQ ID NO: 6226440 - DNA, 14 bp, Homo sapiens
gattacacacgtga

SEQ ID NO: 6226441 - DNA, 13 bp, Homo sapiens
gattacagaaaca

SEQ ID NO: 6226442 - DNA, 14 bp, Homo sapiens
gattacagaaacac

SEQ ID NO: 6226443 - DNA, 16 bp, Homo sapiens
gattacagaaactgat

SEQ ID NO: 6226444 - DNA, 17 bp, Homo sapiens
gattacaggaatgaaga

SEQ ID NO: 6226445 - DNA, 18 bp, Homo sapiens
gattacaggaatgaagaa

SEQ ID NO: 6226446 - DNA, 23 bp, Homo sapiens
gattacaggcacctaccaccagg

SEQ ID NO: 6226447 - DNA, 19 bp, Homo sapiens
gattacaggcatgagccac

SEQ ID NO: 6226448 - DNA, 23 bp, Homo sapiens
gattacaggcatgggccaccacg

SEQ ID NO: 6226449 - DNA, 23 bp, Homo sapiens
gattacaggccttttgactcttt

SEQ ID NO: 6226450 - DNA, 17 bp, Homo sapiens
gattacaggctcctgcc

SEQ ID NO: 6226451 - DNA, 15 bp, Homo sapiens
gattacaggtgactg

SEQ ID NO: 6226452 - DNA, 13 bp, Homo sapiens
gattacaggtgtg

SEQ ID NO: 6226453 - DNA, 20 bp, Homo sapiens
gattacaggtgtgagccacc

SEQ ID NO: 6226454 - DNA, 13 bp, Homo sapiens
gattacatagatc

SEQ ID NO: 6226455 - DNA, 18 bp, Homo sapiens
gattacatagatcagcca

SEQ ID NO: 6226456 - DNA, 20 bp, Homo sapiens
gattacatagatcagccatt

SEQ ID NO: 6226457 - DNA, 23 bp, Homo sapiens
gattacatccgtaggacaagttt

SEQ ID NO: 6226458 - DNA, 16 bp, Homo sapiens
gattacatctgcctta

SEQ ID NO: 6226459 - DNA, 14 bp, Homo sapiens
gattaccagggact

SEQ ID NO: 6226460 - DNA, 16 bp, Homo sapiens
gattaccagtctgatt

SEQ ID NO: 6226461 - DNA, 14 bp, Homo sapiens
gattaccggcattt

SEQ ID NO: 6226462 - DNA, 13 bp, Homo sapiens
gattacctcctga

SEQ ID NO: 6226463 - DNA, 11 bp, Homo sapiens
gattacctctc

SEQ ID NO: 6226464 - DNA, 14 bp, Homo sapiens
gattacctgaaagc

SEQ ID NO: 6226465 - DNA, 21 bp, Homo sapiens
gattacgtgtatgtttcttct

SEQ ID NO: 6226466 - DNA, 19 bp, Homo sapiens
gattactactttgcctctt

SEQ ID NO: 6226467 - DNA, 23 bp, Homo sapiens
gattactactttgcctcttcagc

SEQ ID NO: 6226468 - DNA, 15 bp, Homo sapiens
gattactccttcctt

SEQ ID NO: 6226469 - DNA, 19 bp, Homo sapiens
gattactctttgctttgta

SEQ ID NO: 6226470 - DNA, 15 bp, Homo sapiens
gattactgatgtgat

SEQ ID NO: 6226471 - DNA, 14 bp, Homo sapiens
gattactgcaatca

SEQ ID NO: 6226472 - DNA, 22 bp, Homo sapiens
gattacttcttatttttcttac

SEQ ID NO: 6226473 - DNA, 12 bp, Homo sapiens
gattagaaacta

SEQ ID NO: 6226474 - DNA, 17 bp, Homo sapiens
gattagaagctgaaaac

SEQ ID NO: 6226475 - DNA, 14 bp, Homo sapiens
gattagaaggcaag

SEQ ID NO: 6226476 - DNA, 22 bp, Homo sapiens
gattagaatgaaaattgtatgt

SEQ ID NO: 6226477 - DNA, 23 bp, Homo sapiens
gattagaattctgtatagattag

SEQ ID NO: 6226478 - DNA, 16 bp, Homo sapiens
gattagacagaacacc

SEQ ID NO: 6226479 - DNA, 14 bp, Homo sapiens
gattagagggaggt

SEQ ID NO: 6226480 - DNA, 23 bp, Homo sapiens
gattagatgtgccaataaccaag

SEQ ID NO: 6226481 - DNA, 19 bp, Homo sapiens
gattagcaaggtcatttct

SEQ ID NO: 6226482 - DNA, 20 bp, Homo sapiens
gattagcaaggtcatttctt

SEQ ID NO: 6226483 - DNA, 19 bp, Homo sapiens
gattagcaagttacagtga

SEQ ID NO: 6226484 - DNA, 23 bp, Homo sapiens
gattagcctttgacattgatgtg

SEQ ID NO: 6226485 - DNA, 14 bp, Homo sapiens
gattagctctggac

SEQ ID NO: 6226486 - DNA, 15 bp, Homo sapiens
gattagctttgtgtt

SEQ ID NO: 6226487 - DNA, 20 bp, Homo sapiens
gattaggaatcattctgtaa

SEQ ID NO: 6226488 - DNA, 22 bp, Homo sapiens
gattaggcaaaaataatttatt

SEQ ID NO: 6226489 - DNA, 14 bp, Homo sapiens
gattaggcacacag

SEQ ID NO: 6226490 - DNA, 21 bp, Homo sapiens
gattaggctcttttaggtaac

SEQ ID NO: 6226491 - DNA, 20 bp, Homo sapiens
gattagggaaaatggatata

SEQ ID NO: 6226492 - DNA, 17 bp, Homo sapiens
gattaggtcacattaca

SEQ ID NO: 6226493 - DNA, 21 bp, Homo sapiens
gattaggtgaagggatggggg

SEQ ID NO: 6226494 - DNA, 19 bp, Homo sapiens
gattaggtttcagcagagc

SEQ ID NO: 6226495 - DNA, 18 bp, Homo sapiens
gattagtaaatatgtgaa

SEQ ID NO: 6226496 - DNA, 15 bp, Homo sapiens
gattagtaagatctc

SEQ ID NO: 6226497 - DNA, 14 bp, Homo sapiens
gattagtaagtctt

SEQ ID NO: 6226498 - DNA, 18 bp, Homo sapiens
gattagtataatatttct

SEQ ID NO: 6226499 - DNA, 15 bp, Homo sapiens
gattagtttagaaca

SEQ ID NO: 6226500 - DNA, 16 bp, Homo sapiens
gattagttttcttgtt

SEQ ID NO: 6226501 - DNA, 19 bp, Homo sapiens
gattataaaattaatcaca

SEQ ID NO: 6226502 - DNA, 21 bp, Homo sapiens
gattataaatgaaatttgcaa

SEQ ID NO: 6226503 - DNA, 13 bp, Homo sapiens
gattataagacaa

SEQ ID NO: 6226504 - DNA, 12 bp, Homo sapiens
gattataataaa

SEQ ID NO: 6226505 - DNA, 14 bp, Homo sapiens
gattatagatactt

SEQ ID NO: 6226506 - DNA, 18 bp, Homo sapiens
gattatagattctaaaga

SEQ ID NO: 6226507 - DNA, 20 bp, Homo sapiens
gattataggagtgagccacc

SEQ ID NO: 6226508 - DNA, 20 bp, Homo sapiens
gattataggcacctaccacc

SEQ ID NO: 6226509 - DNA, 16 bp, Homo sapiens
gattatagtaactata

SEQ ID NO: 6226510 - DNA, 14 bp, Homo sapiens
gattatataaaata

SEQ ID NO: 6226511 - DNA, 21 bp, Homo sapiens
gattatataaagacctataaa

SEQ ID NO: 6226512 - DNA, 22 bp, Homo sapiens
gattatatatcataaagtatgc

SEQ ID NO: 6226513 - DNA, 18 bp, Homo sapiens
gattatatatccctgata

SEQ ID NO: 6226514 - DNA, 18 bp, Homo sapiens
gattatatcaaagtattt

SEQ ID NO: 6226515 - DNA, 14 bp, Homo sapiens
gattatattatgaa

SEQ ID NO: 6226516 - DNA, 10 bp, Homo sapiens
gattatcagg

SEQ ID NO: 6226517 - DNA, 15 bp, Homo sapiens
gattatcagtagaaa

SEQ ID NO: 6226518 - DNA, 17 bp, Homo sapiens
gattatcagtagaaaga

SEQ ID NO: 6226519 - DNA, 23 bp, Homo sapiens
gattatcatttatttttaaaata

SEQ ID NO: 6226520 - DNA, 13 bp, Homo sapiens
gattatcttcagc

SEQ ID NO: 6226521 - DNA, 17 bp, Homo sapiens
gattatcttcagcccag

SEQ ID NO: 6226522 - DNA, 12 bp, Homo sapiens
gattatcttgaa

SEQ ID NO: 6226523 - DNA, 20 bp, Homo sapiens
gattatgagttccctaaaca

SEQ ID NO: 6226524 - DNA, 19 bp, Homo sapiens
gattatgatgcatacagtt

SEQ ID NO: 6226525 - DNA, 22 bp, Homo sapiens
gattatgatgcatacagttttc

SEQ ID NO: 6226526 - DNA, 20 bp, Homo sapiens
gattatggaaaaataaaact

SEQ ID NO: 6226527 - DNA, 14 bp, Homo sapiens
gattatggagcttt

SEQ ID NO: 6226528 - DNA, 13 bp, Homo sapiens
gattatgggtcac

SEQ ID NO: 6226529 - DNA, 14 bp, Homo sapiens
gattatgggtcaca

SEQ ID NO: 6226530 - DNA, 19 bp, Homo sapiens
gattatgggtcctgcaatt

SEQ ID NO: 6226531 - DNA, 15 bp, Homo sapiens
gattatggttttgtg

SEQ ID NO: 6226532 - DNA, 19 bp, Homo sapiens
gattatgtagcaaaataca

SEQ ID NO: 6226533 - DNA, 22 bp, Homo sapiens
gattatgtatggatatatttga

SEQ ID NO: 6226534 - DNA, 13 bp, Homo sapiens
gattatgtgactt

SEQ ID NO: 6226535 - DNA, 21 bp, Homo sapiens
gattatgttatacaaggcaag

SEQ ID NO: 6226536 - DNA, 16 bp, Homo sapiens
gattatgttcctgctg

SEQ ID NO: 6226537 - DNA, 21 bp, Homo sapiens
gattatgttcctgctgtattt

SEQ ID NO: 6226538 - DNA, 16 bp, Homo sapiens
gattattaaatcgttt

SEQ ID NO: 6226539 - DNA, 19 bp, Homo sapiens
gattattaacgatgtccaa

SEQ ID NO: 6226540 - DNA, 16 bp, Homo sapiens
gattattactaattct

SEQ ID NO: 6226541 - DNA, 19 bp, Homo sapiens
gattattactaattctatt

SEQ ID NO: 6226542 - DNA, 22 bp, Homo sapiens
gattattactacaaaaccgttt

SEQ ID NO: 6226543 - DNA, 14 bp, Homo sapiens
gattattacttctg

SEQ ID NO: 6226544 - DNA, 12 bp, Homo sapiens
gattattataaa

SEQ ID NO: 6226545 - DNA, 13 bp, Homo sapiens
gattattataaac

SEQ ID NO: 6226546 - DNA, 14 bp, Homo sapiens
gattattataaact

SEQ ID NO: 6226547 - DNA, 17 bp, Homo sapiens
gattattataaactata

SEQ ID NO: 6226548 - DNA, 22 bp, Homo sapiens
gattattataaactataaactt

SEQ ID NO: 6226549 - DNA, 22 bp, Homo sapiens
gattattatgtttattacaatt

SEQ ID NO: 6226550 - DNA, 14 bp, Homo sapiens
gattattattttag

SEQ ID NO: 6226551 - DNA, 13 bp, Homo sapiens
gattattcactga

SEQ ID NO: 6226552 - DNA, 16 bp, Homo sapiens
gattattcactgattt

SEQ ID NO: 6226553 - DNA, 14 bp, Homo sapiens
gattattcagtgtc

SEQ ID NO: 6226554 - DNA, 21 bp, Homo sapiens
gattattcatttaaaatgatt

SEQ ID NO: 6226555 - DNA, 17 bp, Homo sapiens
gattattctgattccac

SEQ ID NO: 6226556 - DNA, 13 bp, Homo sapiens
gattattgaatgt

SEQ ID NO: 6226557 - DNA, 20 bp, Homo sapiens
gattattgaatgttatatca

SEQ ID NO: 6226558 - DNA, 17 bp, Homo sapiens
gattattgatcaaaatc

SEQ ID NO: 6226559 - DNA, 19 bp, Homo sapiens
gattattgatcaaaatcaa

SEQ ID NO: 6226560 - DNA, 12 bp, Homo sapiens
gattattggaaa

SEQ ID NO: 6226561 - DNA, 14 bp, Homo sapiens
gattattgtattta

SEQ ID NO: 6226562 - DNA, 22 bp, Homo sapiens
gattattgtgacttcactgtat

SEQ ID NO: 6226563 - DNA, 18 bp, Homo sapiens
gattatttaaatgctttt

SEQ ID NO: 6226564 - DNA, 17 bp, Homo sapiens
gattatttaagactaaa

SEQ ID NO: 6226565 - DNA, 14 bp, Homo sapiens
gattatttaataac

SEQ ID NO: 6226566 - DNA, 16 bp, Homo sapiens
gattatttaataacat

SEQ ID NO: 6226567 - DNA, 18 bp, Homo sapiens
gattatttaataacatta

SEQ ID NO: 6226568 - DNA, 23 bp, Homo sapiens
gattatttaataacattacctta

SEQ ID NO: 6226569 - DNA, 18 bp, Homo sapiens
gattatttacaagaagaa

SEQ ID NO: 6226570 - DNA, 21 bp, Homo sapiens
gattatttacaagaagaactc

SEQ ID NO: 6226571 - DNA, 16 bp, Homo sapiens
gattatttctgtattt

SEQ ID NO: 6226572 - DNA, 12 bp, Homo sapiens
gattatttgcat

SEQ ID NO: 6226573 - DNA, 21 bp, Homo sapiens
gattatttgggagggaaaagg

SEQ ID NO: 6226574 - DNA, 18 bp, Homo sapiens
gattatttgtatttacag

SEQ ID NO: 6226575 - DNA, 22 bp, Homo sapiens
gattatttgttatttgtacagt

SEQ ID NO: 6226576 - DNA, 23 bp, Homo sapiens
gattatttgttatttgtacagtt

SEQ ID NO: 6226577 - DNA, 12 bp, Homo sapiens
gattattttatc

SEQ ID NO: 6226578 - DNA, 21 bp, Homo sapiens
gattattttctacacatacat

SEQ ID NO: 6226579 - DNA, 22 bp, Homo sapiens
gattattttttaaaaaggtaaa

SEQ ID NO: 6226580 - DNA, 15 bp, Homo sapiens
gattattttttatga

SEQ ID NO: 6226581 - DNA, 17 bp, Homo sapiens
gattattttttcagacc

SEQ ID NO: 6226582 - DNA, 15 bp, Homo sapiens
gattcaaaatattta

SEQ ID NO: 6226583 - DNA, 16 bp, Homo sapiens
gattcaaaatatttaa

SEQ ID NO: 6226584 - DNA, 16 bp, Homo sapiens
gattcaaactgctcca

SEQ ID NO: 6226585 - DNA, 15 bp, Homo sapiens
gattcaaagtgttgt

SEQ ID NO: 6226586 - DNA, 20 bp, Homo sapiens
gattcaaatatcaaaaggaa

SEQ ID NO: 6226587 - DNA, 13 bp, Homo sapiens
gattcaaatgcat

SEQ ID NO: 6226588 - DNA, 15 bp, Homo sapiens
gattcaaatgcatga

SEQ ID NO: 6226589 - DNA, 17 bp, Homo sapiens
gattcaaatgttacaaa

SEQ ID NO: 6226590 - DNA, 15 bp, Homo sapiens
gattcaaatgtttta

SEQ ID NO: 6226591 - DNA, 13 bp, Homo sapiens
gattcaaattgct

SEQ ID NO: 6226592 - DNA, 14 bp, Homo sapiens
gattcaaatttatt

SEQ ID NO: 6226593 - DNA, 15 bp, Homo sapiens
gattcaacagggaag

SEQ ID NO: 6226594 - DNA, 13 bp, Homo sapiens
gattcaagacaag

SEQ ID NO: 6226595 - DNA, 16 bp, Homo sapiens
gattcaagacaagagc

SEQ ID NO: 6226596 - DNA, 13 bp, Homo sapiens
gattcaagccatt

SEQ ID NO: 6226597 - DNA, 14 bp, Homo sapiens
gattcaaggctcag

SEQ ID NO: 6226598 - DNA, 18 bp, Homo sapiens
gattcaataaaatgcact

SEQ ID NO: 6226599 - DNA, 20 bp, Homo sapiens
gattcaatcattttgggaaa

SEQ ID NO: 6226600 - DNA, 16 bp, Homo sapiens
gattcaatctgtaaac

SEQ ID NO: 6226601 - DNA, 19 bp, Homo sapiens
gattcaatgcccctgaatt

SEQ ID NO: 6226602 - DNA, 21 bp, Homo sapiens
gattcaatgcccctgaattta

SEQ ID NO: 6226603 - DNA, 16 bp, Homo sapiens
gattcaatttgatgtg

SEQ ID NO: 6226604 - DNA, 16 bp, Homo sapiens
gattcacaccccacct

SEQ ID NO: 6226605 - DNA, 18 bp, Homo sapiens
gattcacaccccacctgc

SEQ ID NO: 6226606 - DNA, 21 bp, Homo sapiens
gattcacacctgactctgaaa

SEQ ID NO: 6226607 - DNA, 12 bp, Homo sapiens
gattcacactgt

SEQ ID NO: 6226608 - DNA, 13 bp, Homo sapiens
gattcacagacca

SEQ ID NO: 6226609 - DNA, 12 bp, Homo sapiens
gattcacagcct

SEQ ID NO: 6226610 - DNA, 22 bp, Homo sapiens
gattcacagcctccgcggactg

SEQ ID NO: 6226611 - DNA, 15 bp, Homo sapiens
gattcacatctcatt

SEQ ID NO: 6226612 - DNA, 14 bp, Homo sapiens
gattcacatctgca

SEQ ID NO: 6226613 - DNA, 19 bp, Homo sapiens
gattcacatgctggctcct

SEQ ID NO: 6226614 - DNA, 13 bp, Homo sapiens
gattcacatgttt

SEQ ID NO: 6226615 - DNA, 16 bp, Homo sapiens
gattcacatgttttca

SEQ ID NO: 6226616 - DNA, 22 bp, Homo sapiens
gattcacatgttttcaaatgga

SEQ ID NO: 6226617 - DNA, 21 bp, Homo sapiens
gattcacccccctctgctgcc

SEQ ID NO: 6226618 - DNA, 22 bp, Homo sapiens
gattcacccccctctgctgccg

SEQ ID NO: 6226619 - DNA, 16 bp, Homo sapiens
gattcacctcttcctc

SEQ ID NO: 6226620 - DNA, 18 bp, Homo sapiens
gattcacctcttcctctg

SEQ ID NO: 6226621 - DNA, 20 bp, Homo sapiens
gattcacctcttcctctggt

SEQ ID NO: 6226622 - DNA, 19 bp, Homo sapiens
gattcacctgtaaaacttt

SEQ ID NO: 6226623 - DNA, 20 bp, Homo sapiens
gattcacctgtaaaacttta

SEQ ID NO: 6226624 - DNA, 21 bp, Homo sapiens
gattcacgtttttctggacca

SEQ ID NO: 6226625 - DNA, 18 bp, Homo sapiens
gattcactgccttcctct

SEQ ID NO: 6226626 - DNA, 16 bp, Homo sapiens
gattcacttcacgctt

SEQ ID NO: 6226627 - DNA, 21 bp, Homo sapiens
gattcactttgtttatgcata

SEQ ID NO: 6226628 - DNA, 21 bp, Homo sapiens
gattcagaaaatgttctgttt

SEQ ID NO: 6226629 - DNA, 14 bp, Homo sapiens
gattcagaagggga

SEQ ID NO: 6226630 - DNA, 14 bp, Homo sapiens
gattcagaatgaga

SEQ ID NO: 6226631 - DNA, 12 bp, Homo sapiens
gattcagacagc

SEQ ID NO: 6226632 - DNA, 12 bp, Homo sapiens
gattcagagaaa

SEQ ID NO: 6226633 - DNA, 13 bp, Homo sapiens
gattcagagaaat

SEQ ID NO: 6226634 - DNA, 17 bp, Homo sapiens
gattcagagacttagaa

SEQ ID NO: 6226635 - DNA, 14 bp, Homo sapiens
gattcagatttctc

SEQ ID NO: 6226636 - DNA, 12 bp, Homo sapiens
gattcagcaaaa

SEQ ID NO: 6226637 - DNA, 21 bp, Homo sapiens
gattcagcagtgtctgttctt

SEQ ID NO: 6226638 - DNA, 22 bp, Homo sapiens
gattcagcatttgttctttgcc

SEQ ID NO: 6226639 - DNA, 23 bp, Homo sapiens
gattcagcatttgttctttgcca

SEQ ID NO: 6226640 - DNA, 15 bp, Homo sapiens
gattcagctcattat

SEQ ID NO: 6226641 - DNA, 17 bp, Homo sapiens
gattcaggaaaaggcct

SEQ ID NO: 6226642 - DNA, 22 bp, Homo sapiens
gattcaggaaaaggcctggggt

SEQ ID NO: 6226643 - DNA, 15 bp, Homo sapiens
gattcaggaatgggc

SEQ ID NO: 6226644 - DNA, 19 bp, Homo sapiens
gattcaggacgtccttcca

SEQ ID NO: 6226645 - DNA, 17 bp, Homo sapiens
gattcaggcagactggt

SEQ ID NO: 6226646 - DNA, 15 bp, Homo sapiens
gattcaggcagcagt

SEQ ID NO: 6226647 - DNA, 18 bp, Homo sapiens
gattcaggcagcagtgtc

SEQ ID NO: 6226648 - DNA, 20 bp, Homo sapiens
gattcaggcattttccccct

SEQ ID NO: 6226649 - DNA, 13 bp, Homo sapiens
gattcaggccagc

SEQ ID NO: 6226650 - DNA, 16 bp, Homo sapiens
gattcaggccagccca

SEQ ID NO: 6226651 - DNA, 20 bp, Homo sapiens
gattcaggccagcccagcca

SEQ ID NO: 6226652 - DNA, 22 bp, Homo sapiens
gattcaggccagcccagccagg

SEQ ID NO: 6226653 - DNA, 16 bp, Homo sapiens
gattcaggctgcttgg

SEQ ID NO: 6226654 - DNA, 15 bp, Homo sapiens
gattcagggaaagtg

SEQ ID NO: 6226655 - DNA, 22 bp, Homo sapiens
gattcagggaaagtgggacagc

SEQ ID NO: 6226656 - DNA, 14 bp, Homo sapiens
gattcaggggaagg

SEQ ID NO: 6226657 - DNA, 15 bp, Homo sapiens
gattcaggggaaggg

SEQ ID NO: 6226658 - DNA, 20 bp, Homo sapiens
gattcaggggaagggcaggc

SEQ ID NO: 6226659 - DNA, 16 bp, Homo sapiens
gattcaggggctcccc

SEQ ID NO: 6226660 - DNA, 18 bp, Homo sapiens
gattcaggggctgggggt

SEQ ID NO: 6226661 - DNA, 21 bp, Homo sapiens
gattcaggggctttgggccca

SEQ ID NO: 6226662 - DNA, 18 bp, Homo sapiens
gattcagggttatttgag

SEQ ID NO: 6226663 - DNA, 13 bp, Homo sapiens
gattcagtcacat

SEQ ID NO: 6226664 - DNA, 11 bp, Homo sapiens
gattcagtctt

SEQ ID NO: 6226665 - DNA, 15 bp, Homo sapiens
gattcagtcttctgg

SEQ ID NO: 6226666 - DNA, 18 bp, Homo sapiens
gattcagtggaggctggc

SEQ ID NO: 6226667 - DNA, 19 bp, Homo sapiens
gattcagtttctaaaattg

SEQ ID NO: 6226668 - DNA, 19 bp, Homo sapiens
gattcagttttcccacttt

SEQ ID NO: 6226669 - DNA, 20 bp, Homo sapiens
gattcataaagtaatgatga

SEQ ID NO: 6226670 - DNA, 22 bp, Homo sapiens
gattcataaatacaaaaatgaa

SEQ ID NO: 6226671 - DNA, 15 bp, Homo sapiens
gattcataacaatgt

SEQ ID NO: 6226672 - DNA, 13 bp, Homo sapiens
gattcatatttaa

SEQ ID NO: 6226673 - DNA, 15 bp, Homo sapiens
gattcatatttaatt

SEQ ID NO: 6226674 - DNA, 17 bp, Homo sapiens
gattcatatttacttct

SEQ ID NO: 6226675 - DNA, 22 bp, Homo sapiens
gattcatctaccctgctgacct

SEQ ID NO: 6226676 - DNA, 19 bp, Homo sapiens
gattcatctatggagggca

SEQ ID NO: 6226677 - DNA, 21 bp, Homo sapiens
gattcatctatggagggcaga

SEQ ID NO: 6226678 - DNA, 13 bp, Homo sapiens
gattcatctctgg

SEQ ID NO: 6226679 - DNA, 12 bp, Homo sapiens
gattcatgattt

SEQ ID NO: 6226680 - DNA, 22 bp, Homo sapiens
gattcatgcaagtggagctgtc

SEQ ID NO: 6226681 - DNA, 13 bp, Homo sapiens
gattcatgtgctt

SEQ ID NO: 6226682 - DNA, 18 bp, Homo sapiens
gattcatgttatatttaa

SEQ ID NO: 6226683 - DNA, 20 bp, Homo sapiens
gattcattctcataattcct

SEQ ID NO: 6226684 - DNA, 21 bp, Homo sapiens
gattcattcttaacaagatat

SEQ ID NO: 6226685 - DNA, 23 bp, Homo sapiens
gattcatttcctgcccttcctca

SEQ ID NO: 6226686 - DNA, 19 bp, Homo sapiens
gattcattttaacatctga

SEQ ID NO: 6226687 - DNA, 13 bp, Homo sapiens
gattcattttcct

SEQ ID NO: 6226688 - DNA, 16 bp, Homo sapiens
gattcattttcctgtt

SEQ ID NO: 6226689 - DNA, 14 bp, Homo sapiens
gattccaaaaacat

SEQ ID NO: 6226690 - DNA, 18 bp, Homo sapiens
gattccaaagagtagaat

SEQ ID NO: 6226691 - DNA, 21 bp, Homo sapiens
gattccaacccaggtctgctt

SEQ ID NO: 6226692 - DNA, 22 bp, Homo sapiens
gattccaaccccaactccagta

SEQ ID NO: 6226693 - DNA, 20 bp, Homo sapiens
gattccaagggcccagaggg

SEQ ID NO: 6226694 - DNA, 21 bp, Homo sapiens
gattccacacaaaatgtcaca

SEQ ID NO: 6226695 - DNA, 21 bp, Homo sapiens
gattccactacacctggctga

SEQ ID NO: 6226696 - DNA, 20 bp, Homo sapiens
gattccactgaaacctctgt

SEQ ID NO: 6226697 - DNA, 17 bp, Homo sapiens
gattccagaacgccctg

SEQ ID NO: 6226698 - DNA, 19 bp, Homo sapiens
gattccagcaagaccaaat

SEQ ID NO: 6226699 - DNA, 18 bp, Homo sapiens
gattccagccatcacctt

SEQ ID NO: 6226700 - DNA, 15 bp, Homo sapiens
gattccagcccacat

SEQ ID NO: 6226701 - DNA, 18 bp, Homo sapiens
gattccagcccacattgg

SEQ ID NO: 6226702 - DNA, 19 bp, Homo sapiens
gattccatctccttgtctt

SEQ ID NO: 6226703 - DNA, 22 bp, Homo sapiens
gattccatttggcagagcttct

SEQ ID NO: 6226704 - DNA, 18 bp, Homo sapiens
gattccattttggaaaat

SEQ ID NO: 6226705 - DNA, 18 bp, Homo sapiens
gattcccaagctcccttc

SEQ ID NO: 6226706 - DNA, 21 bp, Homo sapiens
gattcccaagctctgctcctc

SEQ ID NO: 6226707 - DNA, 22 bp, Homo sapiens
gattcccaagctctgctcctct

SEQ ID NO: 6226708 - DNA, 19 bp, Homo sapiens
gattcccagagacaggaaa

SEQ ID NO: 6226709 - DNA, 19 bp, Homo sapiens
gattcccagagcaaaataa

SEQ ID NO: 6226710 - DNA, 12 bp, Homo sapiens
gattcccaggag

SEQ ID NO: 6226711 - DNA, 14 bp, Homo sapiens
gattcccaggccag

SEQ ID NO: 6226712 - DNA, 20 bp, Homo sapiens
gattcccaggccagggctgg

SEQ ID NO: 6226713 - DNA, 23 bp, Homo sapiens
gattcccaggccagggctgggtc

SEQ ID NO: 6226714 - DNA, 14 bp, Homo sapiens
gattcccattgaaa

SEQ ID NO: 6226715 - DNA, 21 bp, Homo sapiens
gattcccccccctttcctaaa

SEQ ID NO: 6226716 - DNA, 18 bp, Homo sapiens
gattccccggagctggga

SEQ ID NO: 6226717 - DNA, 21 bp, Homo sapiens
gattccccggagctgggaagg

SEQ ID NO: 6226718 - DNA, 19 bp, Homo sapiens
gattcccgcatggttttta

SEQ ID NO: 6226719 - DNA, 21 bp, Homo sapiens
gattcccggagggaaactgtg

SEQ ID NO: 6226720 - DNA, 17 bp, Homo sapiens
gattcccggctggactt

SEQ ID NO: 6226721 - DNA, 14 bp, Homo sapiens
gattccctctccca

SEQ ID NO: 6226722 - DNA, 19 bp, Homo sapiens
gattccctgtccccaacag

SEQ ID NO: 6226723 - DNA, 13 bp, Homo sapiens
gattcccttctgg

SEQ ID NO: 6226724 - DNA, 18 bp, Homo sapiens
gattcccttctgggcttc

SEQ ID NO: 6226725 - DNA, 19 bp, Homo sapiens
gattcccttgaaatttaga

SEQ ID NO: 6226726 - DNA, 16 bp, Homo sapiens
gattcccttgcactgt

SEQ ID NO: 6226727 - DNA, 15 bp, Homo sapiens
gattccggatcctaa

SEQ ID NO: 6226728 - DNA, 22 bp, Homo sapiens
gattccggatcctaagcatcta

SEQ ID NO: 6226729 - DNA, 16 bp, Homo sapiens
gattccggccctggct

SEQ ID NO: 6226730 - DNA, 18 bp, Homo sapiens
gattcctaaaactctgcc

SEQ ID NO: 6226731 - DNA, 19 bp, Homo sapiens
gattcctaaaactctgcca

SEQ ID NO: 6226732 - DNA, 22 bp, Homo sapiens
gattcctaagccacttgaaatg

SEQ ID NO: 6226733 - DNA, 19 bp, Homo sapiens
gattcctaaggcccagctg

SEQ ID NO: 6226734 - DNA, 19 bp, Homo sapiens
aacattaattttgtgcatt

SEQ ID NO: 6226735 - DNA, 20 bp, Homo sapiens
aacattacagggaatgcctg

SEQ ID NO: 6226736 - DNA, 20 bp, Homo sapiens
aacattacagttcataatag

SEQ ID NO: 6226737 - DNA, 16 bp, Homo sapiens
aacattaccttactgt

SEQ ID NO: 6226738 - DNA, 19 bp, Homo sapiens
aacattaccttactgtgga

SEQ ID NO: 6226739 - DNA, 20 bp, Homo sapiens
aacattaccttgtctttcaa

SEQ ID NO: 6226740 - DNA, 21 bp, Homo sapiens
aacattaccttgtctttcaaa

SEQ ID NO: 6226741 - DNA, 18 bp, Homo sapiens
aacattacttatttaact

SEQ ID NO: 6226742 - DNA, 16 bp, Homo sapiens
aacattagaagaaaac

SEQ ID NO: 6226743 - DNA, 14 bp, Homo sapiens
aacattagaatatt

SEQ ID NO: 6226744 - DNA, 18 bp, Homo sapiens
aacattaggaattgttta

SEQ ID NO: 6226745 - DNA, 20 bp, Homo sapiens
aacattaggaattgtttata

SEQ ID NO: 6226746 - DNA, 16 bp, Homo sapiens
aacattagtactttat

SEQ ID NO: 6226747 - DNA, 19 bp, Homo sapiens
aacattagttttaaaaagg

SEQ ID NO: 6226748 - DNA, 15 bp, Homo sapiens
aacattataaatgac

SEQ ID NO: 6226749 - DNA, 18 bp, Homo sapiens
aacattatataacaaaaa

SEQ ID NO: 6226750 - DNA, 13 bp, Homo sapiens
aacattatgatct

SEQ ID NO: 6226751 - DNA, 17 bp, Homo sapiens
aacattatgatctaata

SEQ ID NO: 6226752 - DNA, 18 bp, Homo sapiens
aacattatgatctaataa

SEQ ID NO: 6226753 - DNA, 23 bp, Homo sapiens
aacattatgatctaataaacttt

SEQ ID NO: 6226754 - DNA, 23 bp, Homo sapiens
aacattattcctgcactcacagg

SEQ ID NO: 6226755 - DNA, 18 bp, Homo sapiens
aacattattttaaaatca

SEQ ID NO: 6226756 - DNA, 12 bp, Homo sapiens
aacattattttt

SEQ ID NO: 6226757 - DNA, 15 bp, Homo sapiens
aacattatttttaga

SEQ ID NO: 6226758 - DNA, 16 bp, Homo sapiens
aacattcaatttgcta

SEQ ID NO: 6226759 - DNA, 20 bp, Homo sapiens
aacattcacacagggctctt

SEQ ID NO: 6226760 - DNA, 18 bp, Homo sapiens
aacattcacttttgttaa

SEQ ID NO: 6226761 - DNA, 14 bp, Homo sapiens
aacattcagctctg

SEQ ID NO: 6226762 - DNA, 18 bp, Homo sapiens
aacattcagctctggaga

SEQ ID NO: 6226763 - DNA, 14 bp, Homo sapiens
aacattcaggagct

SEQ ID NO: 6226764 - DNA, 17 bp, Homo sapiens
aacattcagtactttat

SEQ ID NO: 6226765 - DNA, 18 bp, Homo sapiens
aacattcagtactttatg

SEQ ID NO: 6226766 - DNA, 20 bp, Homo sapiens
aacattcatccagttgcaat

SEQ ID NO: 6226767 - DNA, 18 bp, Homo sapiens
aacattcattcaacagct

SEQ ID NO: 6226768 - DNA, 17 bp, Homo sapiens
aacattccaagactcta

SEQ ID NO: 6226769 - DNA, 10 bp, Homo sapiens
aacattccat

SEQ ID NO: 6226770 - DNA, 13 bp, Homo sapiens
aacattccatcct

SEQ ID NO: 6226771 - DNA, 14 bp, Homo sapiens
aacattccatcctt

SEQ ID NO: 6226772 - DNA, 16 bp, Homo sapiens
aacattccatttgctt

SEQ ID NO: 6226773 - DNA, 12 bp, Homo sapiens
aacattcccact

SEQ ID NO: 6226774 - DNA, 14 bp, Homo sapiens
aacattcccagccc

SEQ ID NO: 6226775 - DNA, 17 bp, Homo sapiens
aacattccctggaattg

SEQ ID NO: 6226776 - DNA, 22 bp, Homo sapiens
aacattccgtttacattttaga

SEQ ID NO: 6226777 - DNA, 19 bp, Homo sapiens
aacattcctcatgaatgta

SEQ ID NO: 6226778 - DNA, 21 bp, Homo sapiens
aacattcctcatgaatgtaaa

SEQ ID NO: 6226779 - DNA, 22 bp, Homo sapiens
aacattcctcatgaatgtaaat

SEQ ID NO: 6226780 - DNA, 16 bp, Homo sapiens
aacattcctccagcct

SEQ ID NO: 6226781 - DNA, 19 bp, Homo sapiens
aacattcctccagcctccc

SEQ ID NO: 6226782 - DNA, 21 bp, Homo sapiens
aacattcctccagcctcccct

SEQ ID NO: 6226783 - DNA, 18 bp, Homo sapiens
aacattcgtgagctgggg

SEQ ID NO: 6226784 - DNA, 17 bp, Homo sapiens
aacattctacttgctta

SEQ ID NO: 6226785 - DNA, 21 bp, Homo sapiens
aacattctattgactttctta

SEQ ID NO: 6226786 - DNA, 14 bp, Homo sapiens
aacattctatttca

SEQ ID NO: 6226787 - DNA, 16 bp, Homo sapiens
aacattctgatttgga

SEQ ID NO: 6226788 - DNA, 12 bp, Homo sapiens
aacattctgcaa

SEQ ID NO: 6226789 - DNA, 15 bp, Homo sapiens
aacattctgcaatgg

SEQ ID NO: 6226790 - DNA, 12 bp, Homo sapiens
aacattctgtac

SEQ ID NO: 6226791 - DNA, 18 bp, Homo sapiens
aacattctttaacataca

SEQ ID NO: 6226792 - DNA, 19 bp, Homo sapiens
aacattctttttctgttga

SEQ ID NO: 6226793 - DNA, 23 bp, Homo sapiens
aacattctttttctgttgaaact

SEQ ID NO: 6226794 - DNA, 17 bp, Homo sapiens
aacattgaaatattagt

SEQ ID NO: 6226795 - DNA, 18 bp, Homo sapiens
aacattgaagtaatgaat

SEQ ID NO: 6226796 - DNA, 19 bp, Homo sapiens
aacattgaagtaatgaatt

SEQ ID NO: 6226797 - DNA, 18 bp, Homo sapiens
aacattgaccaagaactg

SEQ ID NO: 6226798 - DNA, 21 bp, Homo sapiens
aacattgatccagtcatttta

SEQ ID NO: 6226799 - DNA, 16 bp, Homo sapiens
aacattgatctgtttt

SEQ ID NO: 6226800 - DNA, 22 bp, Homo sapiens
aacattgatctgttttacagga

SEQ ID NO: 6226801 - DNA, 17 bp, Homo sapiens
aacattgattggataaa

SEQ ID NO: 6226802 - DNA, 17 bp, Homo sapiens
aacattgcaatagaaat

SEQ ID NO: 6226803 - DNA, 19 bp, Homo sapiens
aacattgcataaacacttt

SEQ ID NO: 6226804 - DNA, 11 bp, Homo sapiens
aacattgcatg

SEQ ID NO: 6226805 - DNA, 17 bp, Homo sapiens
aacattgccttgcattt

SEQ ID NO: 6226806 - DNA, 16 bp, Homo sapiens
aacattgctgatgtag

SEQ ID NO: 6226807 - DNA, 23 bp, Homo sapiens
aacattggaagcaggttaaatgt

SEQ ID NO: 6226808 - DNA, 15 bp, Homo sapiens
aacattggaatgttc

SEQ ID NO: 6226809 - DNA, 17 bp, Homo sapiens
aacattggacagaaaat

SEQ ID NO: 6226810 - DNA, 22 bp, Homo sapiens
aacattggacagaaaatgcaat

SEQ ID NO: 6226811 - DNA, 17 bp, Homo sapiens
aacattggagacatcac

SEQ ID NO: 6226812 - DNA, 19 bp, Homo sapiens
aacattggagctgactgtt

SEQ ID NO: 6226813 - DNA, 16 bp, Homo sapiens
aacattggttcttgta

SEQ ID NO: 6226814 - DNA, 18 bp, Homo sapiens
aacattggttcttgtatt

SEQ ID NO: 6226815 - DNA, 13 bp, Homo sapiens
aacattgtactgt

SEQ ID NO: 6226816 - DNA, 20 bp, Homo sapiens
aacattgtactgttgcttta

SEQ ID NO: 6226817 - DNA, 14 bp, Homo sapiens
aacattgtagcctc

SEQ ID NO: 6226818 - DNA, 15 bp, Homo sapiens
aacattgtgatgtat

SEQ ID NO: 6226819 - DNA, 22 bp, Homo sapiens
aacattgtgatgtatattcctt

SEQ ID NO: 6226820 - DNA, 15 bp, Homo sapiens
aacattgttccagat

SEQ ID NO: 6226821 - DNA, 17 bp, Homo sapiens
aacattgttccagattc

SEQ ID NO: 6226822 - DNA, 19 bp, Homo sapiens
aacattgttccagattcaa

SEQ ID NO: 6226823 - DNA, 14 bp, Homo sapiens
aacattgttctgaa

SEQ ID NO: 6226824 - DNA, 15 bp, Homo sapiens
aacattgttttgtgt

SEQ ID NO: 6226825 - DNA, 16 bp, Homo sapiens
aacatttaaaattaaa

SEQ ID NO: 6226826 - DNA, 18 bp, Homo sapiens
aacatttaaagagatttc

SEQ ID NO: 6226827 - DNA, 15 bp, Homo sapiens
aacatttaacataat

SEQ ID NO: 6226828 - DNA, 16 bp, Homo sapiens
aacatttaacataatg

SEQ ID NO: 6226829 - DNA, 17 bp, Homo sapiens
aacatttaactagcctt

SEQ ID NO: 6226830 - DNA, 21 bp, Homo sapiens
aacatttaatattatatagga

SEQ ID NO: 6226831 - DNA, 22 bp, Homo sapiens
aacatttacaataaatattctg

SEQ ID NO: 6226832 - DNA, 21 bp, Homo sapiens
aacatttacacattctcacaa

SEQ ID NO: 6226833 - DNA, 18 bp, Homo sapiens
aacatttaggagaagttg

SEQ ID NO: 6226834 - DNA, 19 bp, Homo sapiens
aacatttaggagaagttgg

SEQ ID NO: 6226835 - DNA, 15 bp, Homo sapiens
aacatttagtttaaa

SEQ ID NO: 6226836 - DNA, 22 bp, Homo sapiens
aacatttatatattgtctgtaa

SEQ ID NO: 6226837 - DNA, 15 bp, Homo sapiens
aacatttatatgtag

SEQ ID NO: 6226838 - DNA, 18 bp, Homo sapiens
aacatttatctaaaagaa

SEQ ID NO: 6226839 - DNA, 15 bp, Homo sapiens
aacatttatctttgt

SEQ ID NO: 6226840 - DNA, 13 bp, Homo sapiens
aacatttatgacc

SEQ ID NO: 6226841 - DNA, 13 bp, Homo sapiens
aacatttatgtga

SEQ ID NO: 6226842 - DNA, 14 bp, Homo sapiens
aacatttattttga

SEQ ID NO: 6226843 - DNA, 22 bp, Homo sapiens
aacatttattttttttaaagaa

SEQ ID NO: 6226844 - DNA, 19 bp, Homo sapiens
aacatttcaaattgaattt

SEQ ID NO: 6226845 - DNA, 14 bp, Homo sapiens
aacatttcaagttt

SEQ ID NO: 6226846 - DNA, 23 bp, Homo sapiens
aacatttcaatgtcagcctttgt

SEQ ID NO: 6226847 - DNA, 17 bp, Homo sapiens
aacatttcacagtattt

SEQ ID NO: 6226848 - DNA, 21 bp, Homo sapiens
aacatttcagaaggtatcagt

SEQ ID NO: 6226849 - DNA, 22 bp, Homo sapiens
aacatttcatgtagtaagattt

SEQ ID NO: 6226850 - DNA, 15 bp, Homo sapiens
aacatttcatgtatt

SEQ ID NO: 6226851 - DNA, 23 bp, Homo sapiens
aacatttcatgtatttctttaga

SEQ ID NO: 6226852 - DNA, 20 bp, Homo sapiens
aacatttctaactaaggaca

SEQ ID NO: 6226853 - DNA, 23 bp, Homo sapiens
aacatttctaactctattaatga

SEQ ID NO: 6226854 - DNA, 22 bp, Homo sapiens
aacatttctatagccaaaaata

SEQ ID NO: 6226855 - DNA, 13 bp, Homo sapiens
aacatttctcatg

SEQ ID NO: 6226856 - DNA, 16 bp, Homo sapiens
aacatttctcatgtgc

SEQ ID NO: 6226857 - DNA, 16 bp, Homo sapiens
aacatttctgtaaata

SEQ ID NO: 6226858 - DNA, 21 bp, Homo sapiens
aacatttctgtatactgtaaa

SEQ ID NO: 6226859 - DNA, 23 bp, Homo sapiens
aacatttctgtatactgtaaaag

SEQ ID NO: 6226860 - DNA, 24 bp, Homo sapiens
aacatttctgtatactgtaaaagt

SEQ ID NO: 6226861 - DNA, 19 bp, Homo sapiens
aacatttctgtgaaactat

SEQ ID NO: 6226862 - DNA, 19 bp, Homo sapiens
aacatttcttaaaatgttt

SEQ ID NO: 6226863 - DNA, 17 bp, Homo sapiens
aacatttgacacataaa

SEQ ID NO: 6226864 - DNA, 16 bp, Homo sapiens
aacatttgatattttt

SEQ ID NO: 6226865 - DNA, 22 bp, Homo sapiens
aacatttgatatttttccattt

SEQ ID NO: 6226866 - DNA, 23 bp, Homo sapiens
aacatttgatgtctagataacat

SEQ ID NO: 6226867 - DNA, 21 bp, Homo sapiens
aacatttgattaataaaatat

SEQ ID NO: 6226868 - DNA, 22 bp, Homo sapiens
aacatttgccaagtgagttgaa

SEQ ID NO: 6226869 - DNA, 14 bp, Homo sapiens
aacatttgccttgc

SEQ ID NO: 6226870 - DNA, 13 bp, Homo sapiens
aacatttgctgcc

SEQ ID NO: 6226871 - DNA, 16 bp, Homo sapiens
aacatttgctgtttta

SEQ ID NO: 6226872 - DNA, 21 bp, Homo sapiens
aacatttgctttgttttctaa

SEQ ID NO: 6226873 - DNA, 20 bp, Homo sapiens
aacatttggaaaccatgcac

SEQ ID NO: 6226874 - DNA, 21 bp, Homo sapiens
aacatttgtaaaaatactgtt

SEQ ID NO: 6226875 - DNA, 23 bp, Homo sapiens
aacatttgtaatttttttctagt

SEQ ID NO: 6226876 - DNA, 15 bp, Homo sapiens
aacatttgtgtgtta

SEQ ID NO: 6226877 - DNA, 22 bp, Homo sapiens
aacatttgttctatagcttttc

SEQ ID NO: 6226878 - DNA, 22 bp, Homo sapiens
aacatttgttgaataggggaaa

SEQ ID NO: 6226879 - DNA, 14 bp, Homo sapiens
aacatttgtttatc

SEQ ID NO: 6226880 - DNA, 17 bp, Homo sapiens
aacatttgtttccccca

SEQ ID NO: 6226881 - DNA, 13 bp, Homo sapiens
aacattttaaaat

SEQ ID NO: 6226882 - DNA, 19 bp, Homo sapiens
aacattttaaataaaagaa

SEQ ID NO: 6226883 - DNA, 20 bp, Homo sapiens
aacattttaaataaaagaaa

SEQ ID NO: 6226884 - DNA, 13 bp, Homo sapiens
aacattttaaatg

SEQ ID NO: 6226885 - DNA, 15 bp, Homo sapiens
aacattttaaatgga

SEQ ID NO: 6226886 - DNA, 17 bp, Homo sapiens
aacattttaaatggaca

SEQ ID NO: 6226887 - DNA, 17 bp, Homo sapiens
aacattttaagttttac

SEQ ID NO: 6226888 - DNA, 14 bp, Homo sapiens
aacattttaattca

SEQ ID NO: 6226889 - DNA, 18 bp, Homo sapiens
aacattttacagatttta

SEQ ID NO: 6226890 - DNA, 21 bp, Homo sapiens
aacattttacagtaaatgtta

SEQ ID NO: 6226891 - DNA, 17 bp, Homo sapiens
aacattttacccacaca

SEQ ID NO: 6226892 - DNA, 16 bp, Homo sapiens
aacattttactgttgt

SEQ ID NO: 6226893 - DNA, 14 bp, Homo sapiens
aacattttatttat

SEQ ID NO: 6226894 - DNA, 14 bp, Homo sapiens
aacattttctctta

SEQ ID NO: 6226895 - DNA, 17 bp, Homo sapiens
aacattttcttgaattt

SEQ ID NO: 6226896 - DNA, 21 bp, Homo sapiens
aacattttgaaaacccctggc

SEQ ID NO: 6226897 - DNA, 14 bp, Homo sapiens
aacattttggaaat

SEQ ID NO: 6226898 - DNA, 16 bp, Homo sapiens
aacattttggaaattg

SEQ ID NO: 6226899 - DNA, 22 bp, Homo sapiens
aacattttgtatgctgcatgaa

SEQ ID NO: 6226900 - DNA, 21 bp, Homo sapiens
aacattttgttcttacacata

SEQ ID NO: 6226901 - DNA, 20 bp, Homo sapiens
aacatttttaatttaacaaa

SEQ ID NO: 6226902 - DNA, 22 bp, Homo sapiens
aacatttttcaacaaatatctt

SEQ ID NO: 6226903 - DNA, 19 bp, Homo sapiens
aacatttttgagatattaa

SEQ ID NO: 6226904 - DNA, 13 bp, Homo sapiens
aacatttttggta

SEQ ID NO: 6226905 - DNA, 22 bp, Homo sapiens
aacattttttaaacaataaact

SEQ ID NO: 6226906 - DNA, 13 bp, Homo sapiens
aacattttttata

SEQ ID NO: 6226907 - DNA, 21 bp, Homo sapiens
aacattttttgtttcttggtg

SEQ ID NO: 6226908 - DNA, 16 bp, Homo sapiens
aacatttttttaagca

SEQ ID NO: 6226909 - DNA, 21 bp, Homo sapiens
aacattttttttaaaaattag

SEQ ID NO: 6226910 - DNA, 21 bp, Homo sapiens
aacatttttttttctccataa

SEQ ID NO: 6226911 - DNA, 18 bp, Homo sapiens
gattcctacccctcttcc

SEQ ID NO: 6226912 - DNA, 23 bp, Homo sapiens
gattcctagattacatctgcctt

SEQ ID NO: 6226913 - DNA, 21 bp, Homo sapiens
gattcctcacatctttaactt

SEQ ID NO: 6226914 - DNA, 13 bp, Homo sapiens
gattcctcccagg

SEQ ID NO: 6226915 - DNA, 12 bp, Homo sapiens
gattcctcccca

SEQ ID NO: 6226916 - DNA, 18 bp, Homo sapiens
gattcctccccaccctgt

SEQ ID NO: 6226917 - DNA, 22 bp, Homo sapiens
gattcctccccaccctgtccca

SEQ ID NO: 6226918 - DNA, 24 bp, Homo sapiens
gattcctccccaccctgtcccagg

SEQ ID NO: 6226919 - DNA, 18 bp, Homo sapiens
gattcctcccccagagcc

SEQ ID NO: 6226920 - DNA, 20 bp, Homo sapiens
gattcctctcatttccagct

SEQ ID NO: 6226921 - DNA, 19 bp, Homo sapiens
gattcctcttgcctctctc

SEQ ID NO: 6226922 - DNA, 17 bp, Homo sapiens
gattcctgacccaggcc

SEQ ID NO: 6226923 - DNA, 18 bp, Homo sapiens
gattcctgagctggcctg

SEQ ID NO: 6226924 - DNA, 16 bp, Homo sapiens
gattcctgccaagtag

SEQ ID NO: 6226925 - DNA, 16 bp, Homo sapiens
gattcctgctgcctgt

SEQ ID NO: 6226926 - DNA, 12 bp, Homo sapiens
gattcctgggcc

SEQ ID NO: 6226927 - DNA, 13 bp, Homo sapiens
gattcctgggcct

SEQ ID NO: 6226928 - DNA, 21 bp, Homo sapiens
gattcctggttatcctatttt

SEQ ID NO: 6226929 - DNA, 20 bp, Homo sapiens
gattcctggtttgactcagt

SEQ ID NO: 6226930 - DNA, 18 bp, Homo sapiens
gattcctgtaaatgtgac

SEQ ID NO: 6226931 - DNA, 20 bp, Homo sapiens
gattcctgtaaatgtgacaa

SEQ ID NO: 6226932 - DNA, 16 bp, Homo sapiens
gattcctgtttcaagt

SEQ ID NO: 6226933 - DNA, 22 bp, Homo sapiens
gattccttctaagtgtacttca

SEQ ID NO: 6226934 - DNA, 15 bp, Homo sapiens
gattccttggcagcc

SEQ ID NO: 6226935 - DNA, 13 bp, Homo sapiens
gattcctttaaaa

SEQ ID NO: 6226936 - DNA, 17 bp, Homo sapiens
gattcctttaaaatata

SEQ ID NO: 6226937 - DNA, 13 bp, Homo sapiens
gattcctttccct

SEQ ID NO: 6226938 - DNA, 21 bp, Homo sapiens
gattccttttgatggggagaa

SEQ ID NO: 6226939 - DNA, 16 bp, Homo sapiens
gattccttttttcaaa

SEQ ID NO: 6226940 - DNA, 13 bp, Homo sapiens
gattcgaggtcct

SEQ ID NO: 6226941 - DNA, 17 bp, Homo sapiens
gattcgaggtcctcctg

SEQ ID NO: 6226942 - DNA, 22 bp, Homo sapiens
gattcgaggtcctcctggcctg

SEQ ID NO: 6226943 - DNA, 23 bp, Homo sapiens
gattcgtggtcttttcctcgctt

SEQ ID NO: 6226944 - DNA, 19 bp, Homo sapiens
gattctaaaacattcttta

SEQ ID NO: 6226945 - DNA, 11 bp, Homo sapiens
gattctaaaat

SEQ ID NO: 6226946 - DNA, 11 bp, Homo sapiens
gattctaaaga

SEQ ID NO: 6226947 - DNA, 12 bp, Homo sapiens
gattctaaagat

SEQ ID NO: 6226948 - DNA, 14 bp, Homo sapiens
gattctaaagattc

SEQ ID NO: 6226949 - DNA, 17 bp, Homo sapiens
gattctaaagattctat

SEQ ID NO: 6226950 - DNA, 13 bp, Homo sapiens
gattctaaagctc

SEQ ID NO: 6226951 - DNA, 19 bp, Homo sapiens
gattctaacatattgccat

SEQ ID NO: 6226952 - DNA, 19 bp, Homo sapiens
gattctaatttttaagcaa

SEQ ID NO: 6226953 - DNA, 21 bp, Homo sapiens
gattctacaaaaaaccaggat

SEQ ID NO: 6226954 - DNA, 22 bp, Homo sapiens
gattctacaaaaaaccaggatg

SEQ ID NO: 6226955 - DNA, 17 bp, Homo sapiens
gattctactcttgtcat

SEQ ID NO: 6226956 - DNA, 18 bp, Homo sapiens
gattctactcttgtcatt

SEQ ID NO: 6226957 - DNA, 18 bp, Homo sapiens
gattctactttaagcact

SEQ ID NO: 6226958 - DNA, 22 bp, Homo sapiens
gattctactttaagcactacat

SEQ ID NO: 6226959 - DNA, 19 bp, Homo sapiens
gattctagatcagatgctc

SEQ ID NO: 6226960 - DNA, 16 bp, Homo sapiens
gattctagtacataat

SEQ ID NO: 6226961 - DNA, 17 bp, Homo sapiens
gattctatagttctaga

SEQ ID NO: 6226962 - DNA, 18 bp, Homo sapiens
gattctatagttctagac

SEQ ID NO: 6226963 - DNA, 22 bp, Homo sapiens
gattctatattattatatatat

SEQ ID NO: 6226964 - DNA, 14 bp, Homo sapiens
gattctatgtaact

SEQ ID NO: 6226965 - DNA, 16 bp, Homo sapiens
gattctatgtaacttg

SEQ ID NO: 6226966 - DNA, 17 bp, Homo sapiens
gattctatgttaatatt

SEQ ID NO: 6226967 - DNA, 15 bp, Homo sapiens
gattctattatatat

SEQ ID NO: 6226968 - DNA, 18 bp, Homo sapiens
gattctatttaattgaaa

SEQ ID NO: 6226969 - DNA, 20 bp, Homo sapiens
gattctatttaattgaaact

SEQ ID NO: 6226970 - DNA, 20 bp, Homo sapiens
gattctatttatatgtacat

SEQ ID NO: 6226971 - DNA, 20 bp, Homo sapiens
gattctatttcccctcttct

SEQ ID NO: 6226972 - DNA, 18 bp, Homo sapiens
gattctcaaaggagcgag

SEQ ID NO: 6226973 - DNA, 15 bp, Homo sapiens
gattctcaccagctg

SEQ ID NO: 6226974 - DNA, 15 bp, Homo sapiens
gattctcacctgcct

SEQ ID NO: 6226975 - DNA, 19 bp, Homo sapiens
gattctcagggtctctgct

SEQ ID NO: 6226976 - DNA, 22 bp, Homo sapiens
gattctcagggtctctgctgcc

SEQ ID NO: 6226977 - DNA, 11 bp, Homo sapiens
gattctcatgt

SEQ ID NO: 6226978 - DNA, 19 bp, Homo sapiens
gattctcccgcctcagcct

SEQ ID NO: 6226979 - DNA, 16 bp, Homo sapiens
gattctcctgtgctag

SEQ ID NO: 6226980 - DNA, 11 bp, Homo sapiens
gattctccttc

SEQ ID NO: 6226981 - DNA, 18 bp, Homo sapiens
gattctccttcagccctc

SEQ ID NO: 6226982 - DNA, 13 bp, Homo sapiens
gattctctactgc

SEQ ID NO: 6226983 - DNA, 16 bp, Homo sapiens
gattctctgcccagcc

SEQ ID NO: 6226984 - DNA, 21 bp, Homo sapiens
gattctctgcgagcaacagtg

SEQ ID NO: 6226985 - DNA, 23 bp, Homo sapiens
gattctctggctgtaaggctcta

SEQ ID NO: 6226986 - DNA, 15 bp, Homo sapiens
gattctctgtgtcta

SEQ ID NO: 6226987 - DNA, 23 bp, Homo sapiens
gattctctgtgtctaagattcta

SEQ ID NO: 6226988 - DNA, 19 bp, Homo sapiens
gattctcttagctactgta

SEQ ID NO: 6226989 - DNA, 21 bp, Homo sapiens
gattctcttgagataaggttt

SEQ ID NO: 6226990 - DNA, 13 bp, Homo sapiens
gattctgagagct

SEQ ID NO: 6226991 - DNA, 16 bp, Homo sapiens
gattctgagcaaaggc

SEQ ID NO: 6226992 - DNA, 18 bp, Homo sapiens
gattctgagcaaaggccc

SEQ ID NO: 6226993 - DNA, 15 bp, Homo sapiens
gattctgatgcatac

SEQ ID NO: 6226994 - DNA, 15 bp, Homo sapiens
gattctgatttgtat

SEQ ID NO: 6226995 - DNA, 18 bp, Homo sapiens
gattctgcagtaaatctt

SEQ ID NO: 6226996 - DNA, 16 bp, Homo sapiens
gattctgcctaataaa

SEQ ID NO: 6226997 - DNA, 17 bp, Homo sapiens
gattctgcctaataaaa

SEQ ID NO: 6226998 - DNA, 17 bp, Homo sapiens
gattctgcctttgccag

SEQ ID NO: 6226999 - DNA, 11 bp, Homo sapiens
gattctgctgg

SEQ ID NO: 6227000 - DNA, 18 bp, Homo sapiens
gattctggatctcctgct

SEQ ID NO: 6227001 - DNA, 19 bp, Homo sapiens
gattctggatctcctgctg

SEQ ID NO: 6227002 - DNA, 17 bp, Homo sapiens
gattctgggaaaggtgc

SEQ ID NO: 6227003 - DNA, 23 bp, Homo sapiens
gattctgggatggaccctcgcag

SEQ ID NO: 6227004 - DNA, 17 bp, Homo sapiens
gattctgggtttgccca

SEQ ID NO: 6227005 - DNA, 19 bp, Homo sapiens
gattctgtcccccacgtgg

SEQ ID NO: 6227006 - DNA, 18 bp, Homo sapiens
gattctgtccctccaaag

SEQ ID NO: 6227007 - DNA, 20 bp, Homo sapiens
gattctgtgggcagctggct

SEQ ID NO: 6227008 - DNA, 21 bp, Homo sapiens
gattctgtgtcagagcccagc

SEQ ID NO: 6227009 - DNA, 19 bp, Homo sapiens
gattctgtgtgttttcata

SEQ ID NO: 6227010 - DNA, 16 bp, Homo sapiens
gattcttaaagttgaa

SEQ ID NO: 6227011 - DNA, 17 bp, Homo sapiens
gattcttaaagttgaat

SEQ ID NO: 6227012 - DNA, 14 bp, Homo sapiens
gattcttaccaaga

SEQ ID NO: 6227013 - DNA, 16 bp, Homo sapiens
gattcttactgttctt

SEQ ID NO: 6227014 - DNA, 17 bp, Homo sapiens
gattcttactgttcttc

SEQ ID NO: 6227015 - DNA, 23 bp, Homo sapiens
gattcttatggacaatgacccag

SEQ ID NO: 6227016 - DNA, 16 bp, Homo sapiens
gattcttcaaaagcat

SEQ ID NO: 6227017 - DNA, 23 bp, Homo sapiens
gattcttcagcaaaaatatttta

SEQ ID NO: 6227018 - DNA, 14 bp, Homo sapiens
gattcttccatctg

SEQ ID NO: 6227019 - DNA, 21 bp, Homo sapiens
gattcttcccgctccccacct

SEQ ID NO: 6227020 - DNA, 22 bp, Homo sapiens
gattcttccttgccacaatcac

SEQ ID NO: 6227021 - DNA, 16 bp, Homo sapiens
gattcttctgtgttta

SEQ ID NO: 6227022 - DNA, 18 bp, Homo sapiens
gattcttcttaaaagttt

SEQ ID NO: 6227023 - DNA, 13 bp, Homo sapiens
gattcttgtaaat

SEQ ID NO: 6227024 - DNA, 15 bp, Homo sapiens
gattcttgtaaatct

SEQ ID NO: 6227025 - DNA, 16 bp, Homo sapiens
gattcttgtgcctcag

SEQ ID NO: 6227026 - DNA, 15 bp, Homo sapiens
gattcttgttttgct

SEQ ID NO: 6227027 - DNA, 16 bp, Homo sapiens
gattcttgttttgctt

SEQ ID NO: 6227028 - DNA, 15 bp, Homo sapiens
gattctttagagaag

SEQ ID NO: 6227029 - DNA, 17 bp, Homo sapiens
gattctttcagattgct

SEQ ID NO: 6227030 - DNA, 20 bp, Homo sapiens
gattctttcagttctttgga

SEQ ID NO: 6227031 - DNA, 19 bp, Homo sapiens
gattctttccatttgcatt

SEQ ID NO: 6227032 - DNA, 13 bp, Homo sapiens
gattctttcccca

SEQ ID NO: 6227033 - DNA, 19 bp, Homo sapiens
gattctttcctgaggctgg

SEQ ID NO: 6227034 - DNA, 23 bp, Homo sapiens
gattctttgatatgttgatgaaa

SEQ ID NO: 6227035 - DNA, 22 bp, Homo sapiens
gattcttttttcaatgtactgt

SEQ ID NO: 6227036 - DNA, 20 bp, Homo sapiens
gattgaaaacttttctcaga

SEQ ID NO: 6227037 - DNA, 22 bp, Homo sapiens
gattgaaaagaagaaagtctat

SEQ ID NO: 6227038 - DNA, 14 bp, Homo sapiens
gattgaaaaggaag

SEQ ID NO: 6227039 - DNA, 15 bp, Homo sapiens
gattgaaaagtaaac

SEQ ID NO: 6227040 - DNA, 19 bp, Homo sapiens
gattgaaaatgtccaggaa

SEQ ID NO: 6227041 - DNA, 11 bp, Homo sapiens
gattgaaagaa

SEQ ID NO: 6227042 - DNA, 17 bp, Homo sapiens
gattgaaatttatgact

SEQ ID NO: 6227043 - DNA, 14 bp, Homo sapiens
gattgaacacaggc

SEQ ID NO: 6227044 - DNA, 17 bp, Homo sapiens
gattgaagaaacagcta

SEQ ID NO: 6227045 - DNA, 20 bp, Homo sapiens
gattgaaggggcttctaatg

SEQ ID NO: 6227046 - DNA, 23 bp, Homo sapiens
gattgaagtattttgctggaata

SEQ ID NO: 6227047 - DNA, 15 bp, Homo sapiens
gattgaagtctgata

SEQ ID NO: 6227048 - DNA, 17 bp, Homo sapiens
gattgaagtttattatt

SEQ ID NO: 6227049 - DNA, 23 bp, Homo sapiens
gattgaagtttattattttcaaa

SEQ ID NO: 6227050 - DNA, 14 bp, Homo sapiens
gattgaatgctgcc

SEQ ID NO: 6227051 - DNA, 15 bp, Homo sapiens
gattgaattccatta

SEQ ID NO: 6227052 - DNA, 19 bp, Homo sapiens
gattgaatttttaagcaaa

SEQ ID NO: 6227053 - DNA, 20 bp, Homo sapiens
gattgaatttttaagcaaat

SEQ ID NO: 6227054 - DNA, 17 bp, Homo sapiens
gattgacagctttgctg

SEQ ID NO: 6227055 - DNA, 19 bp, Homo sapiens
gattgacagtaacttggtt

SEQ ID NO: 6227056 - DNA, 12 bp, Homo sapiens
gattgacatttt

SEQ ID NO: 6227057 - DNA, 18 bp, Homo sapiens
gattgacattttgtagct

SEQ ID NO: 6227058 - DNA, 19 bp, Homo sapiens
gattgacctataaaacaaa

SEQ ID NO: 6227059 - DNA, 16 bp, Homo sapiens
gattgagaagaggaca

SEQ ID NO: 6227060 - DNA, 16 bp, Homo sapiens
gattgagagttggctg

SEQ ID NO: 6227061 - DNA, 16 bp, Homo sapiens
gattgaggagttgcct

SEQ ID NO: 6227062 - DNA, 22 bp, Homo sapiens
gattgaggataaaaaggaagga

SEQ ID NO: 6227063 - DNA, 17 bp, Homo sapiens
gattgatatcgtgaaat

SEQ ID NO: 6227064 - DNA, 17 bp, Homo sapiens
gattgatcacacagtgt

SEQ ID NO: 6227065 - DNA, 21 bp, Homo sapiens
gattgatcacacagtgttagt

SEQ ID NO: 6227066 - DNA, 13 bp, Homo sapiens
gattgatcattct

SEQ ID NO: 6227067 - DNA, 19 bp, Homo sapiens
gattgattcagctaagcaa

SEQ ID NO: 6227068 - DNA, 23 bp, Homo sapiens
gattgattcagtatcttagagtt

SEQ ID NO: 6227069 - DNA, 20 bp, Homo sapiens
gattgatttacctttggaat

SEQ ID NO: 6227070 - DNA, 22 bp, Homo sapiens
gattgatttacctttggaattg

SEQ ID NO: 6227071 - DNA, 18 bp, Homo sapiens
gattgattttaaaatgta

SEQ ID NO: 6227072 - DNA, 20 bp, Homo sapiens
gattgattttaaaatgtaca

SEQ ID NO: 6227073 - DNA, 23 bp, Homo sapiens
gattgatttttaaagtttaaata

SEQ ID NO: 6227074 - DNA, 18 bp, Homo sapiens
gattgcaaagggacattg

SEQ ID NO: 6227075 - DNA, 22 bp, Homo sapiens
gattgcaaatattggttagtat

SEQ ID NO: 6227076 - DNA, 17 bp, Homo sapiens
gattgcaacccagggca

SEQ ID NO: 6227077 - DNA, 16 bp, Homo sapiens
gattgcaaggaaggaa

SEQ ID NO: 6227078 - DNA, 18 bp, Homo sapiens
gattgcaatatctgaagc

SEQ ID NO: 6227079 - DNA, 21 bp, Homo sapiens
gattgcaatttgcacaagttt

SEQ ID NO: 6227080 - DNA, 22 bp, Homo sapiens
gattgcaatttgcacaagtttt

SEQ ID NO: 6227081 - DNA, 11 bp, Homo sapiens
gattgcacaga

SEQ ID NO: 6227082 - DNA, 16 bp, Homo sapiens
gattgcaccactgcac

SEQ ID NO: 6227083 - DNA, 16 bp, Homo sapiens
gattgcacgtgcctgt

SEQ ID NO: 6227084 - DNA, 23 bp, Homo sapiens
gattgcacgtggcctcttgagca

SEQ ID NO: 6227085 - DNA, 14 bp, Homo sapiens
gattgcactaaata

SEQ ID NO: 6227086 - DNA, 12 bp, Homo sapiens
gattgcactgct

SEQ ID NO: 6227087 - DNA, 18 bp, Homo sapiens
gattgcagaaaggagaga

SEQ ID NO: 6227088 - DNA, 13 bp, Homo sapiens
gattgcagaattg

SEQ ID NO: 6227089 - DNA, 15 bp, Homo sapiens
gattgcagaattgtt

SEQ ID NO: 6227090 - DNA, 15 bp, Homo sapiens
gattgcagtccccag

SEQ ID NO: 6227091 - DNA, 14 bp, Homo sapiens
gattgcatcctgct

SEQ ID NO: 6227092 - DNA, 12 bp, Homo sapiens
gattgccacagc

SEQ ID NO: 6227093 - DNA, 20 bp, Homo sapiens
gattgccatttcttcccaag

SEQ ID NO: 6227094 - DNA, 21 bp, Homo sapiens
gattgcccctggctttgcctc

SEQ ID NO: 6227095 - DNA, 19 bp, Homo sapiens
gattgccggtcttgacagc

SEQ ID NO: 6227096 - DNA, 14 bp, Homo sapiens
gattgcctctgaaa

SEQ ID NO: 6227097 - DNA, 16 bp, Homo sapiens
gattgcctttaatatt

SEQ ID NO: 6227098 - DNA, 22 bp, Homo sapiens
gattgcctttgtagttaatgta

SEQ ID NO: 6227099 - DNA, 15 bp, Homo sapiens
gattgcctttttata

SEQ ID NO: 6227100 - DNA, 21 bp, Homo sapiens
gattgcctttttataactttt

SEQ ID NO: 6227101 - DNA, 22 bp, Homo sapiens
gattgcctttttataacttttt

SEQ ID NO: 6227102 - DNA, 20 bp, Homo sapiens
gattgcgagagatgtgtgtt

SEQ ID NO: 6227103 - DNA, 21 bp, Homo sapiens
gattgcgagagatgtgtgttg

SEQ ID NO: 6227104 - DNA, 14 bp, Homo sapiens
gattgcgccactgc

SEQ ID NO: 6227105 - DNA, 19 bp, Homo sapiens
gattgcgcctttgtattat

SEQ ID NO: 6227106 - DNA, 13 bp, Homo sapiens
gattgctaaatgt

SEQ ID NO: 6227107 - DNA, 13 bp, Homo sapiens
gattgctaattgc

SEQ ID NO: 6227108 - DNA, 21 bp, Homo sapiens
gattgctaattgctgttgaaa

SEQ ID NO: 6227109 - DNA, 15 bp, Homo sapiens
gattgctcccaggat

SEQ ID NO: 6227110 - DNA, 17 bp, Homo sapiens
gattgctctggagcagc

SEQ ID NO: 6227111 - DNA, 18 bp, Homo sapiens
gattgctctggagcagcc

SEQ ID NO: 6227112 - DNA, 20 bp, Homo sapiens
gattgctctggagcagccaa

SEQ ID NO: 6227113 - DNA, 23 bp, Homo sapiens
gattgctctggagcagccaaggc

SEQ ID NO: 6227114 - DNA, 20 bp, Homo sapiens
gattgctgaatcccatcagg

SEQ ID NO: 6227115 - DNA, 11 bp, Homo sapiens
gattgctgcca

SEQ ID NO: 6227116 - DNA, 13 bp, Homo sapiens
gattgctgccaga

SEQ ID NO: 6227117 - DNA, 14 bp, Homo sapiens
gattgctgccaggc

SEQ ID NO: 6227118 - DNA, 16 bp, Homo sapiens
gattgctgccccatca

SEQ ID NO: 6227119 - DNA, 16 bp, Homo sapiens
gattgctggggccagg

SEQ ID NO: 6227120 - DNA, 18 bp, Homo sapiens
gattgcttaaaagcattt

SEQ ID NO: 6227121 - DNA, 18 bp, Homo sapiens
gattgcttcaattaaaat

SEQ ID NO: 6227122 - DNA, 17 bp, Homo sapiens
gattgcttgagcccaga

SEQ ID NO: 6227123 - DNA, 17 bp, Homo sapiens
gattgcttgagctcagg

SEQ ID NO: 6227124 - DNA, 11 bp, Homo sapiens
gattgctttgc

SEQ ID NO: 6227125 - DNA, 23 bp, Homo sapiens
gattgctttgctgcacagcagga

SEQ ID NO: 6227126 - DNA, 15 bp, Homo sapiens
gattggaaaataata

SEQ ID NO: 6227127 - DNA, 19 bp, Homo sapiens
gattggaaaataataaaag

SEQ ID NO: 6227128 - DNA, 16 bp, Homo sapiens
gattggaaagacagga

SEQ ID NO: 6227129 - DNA, 20 bp, Homo sapiens
gattggaaagacaggaagac

SEQ ID NO: 6227130 - DNA, 18 bp, Homo sapiens
gattggaagaaacacgtg

SEQ ID NO: 6227131 - DNA, 18 bp, Homo sapiens
gattggaaggagacacag

SEQ ID NO: 6227132 - DNA, 22 bp, Homo sapiens
gattggaaggagacacagatgt

SEQ ID NO: 6227133 - DNA, 14 bp, Homo sapiens
gattggacattttc

SEQ ID NO: 6227134 - DNA, 18 bp, Homo sapiens
gattggagctgaagacct

SEQ ID NO: 6227135 - DNA, 19 bp, Homo sapiens
gattggatattctcctcgg

SEQ ID NO: 6227136 - DNA, 15 bp, Homo sapiens
gattggattattcat

SEQ ID NO: 6227137 - DNA, 17 bp, Homo sapiens
gattggattattcattt

SEQ ID NO: 6227138 - DNA, 15 bp, Homo sapiens
gattggatttgctgt

SEQ ID NO: 6227139 - DNA, 18 bp, Homo sapiens
gattggatttgctgtgac

SEQ ID NO: 6227140 - DNA, 19 bp, Homo sapiens
gattggattttatgttgac

SEQ ID NO: 6227141 - DNA, 22 bp, Homo sapiens
gattggattttatgttgacatt

SEQ ID NO: 6227142 - DNA, 15 bp, Homo sapiens
gattggccctgcccc

SEQ ID NO: 6227143 - DNA, 18 bp, Homo sapiens
gattggccctgcccctcc

SEQ ID NO: 6227144 - DNA, 21 bp, Homo sapiens
gattggccctgcccctccccc

SEQ ID NO: 6227145 - DNA, 15 bp, Homo sapiens
gattggcctccaggg

SEQ ID NO: 6227146 - DNA, 17 bp, Homo sapiens
gattggctcacactgag

SEQ ID NO: 6227147 - DNA, 18 bp, Homo sapiens
gattggctcacactgaga

SEQ ID NO: 6227148 - DNA, 20 bp, Homo sapiens
gattggctcacactgagaat

SEQ ID NO: 6227149 - DNA, 17 bp, Homo sapiens
gattggctgcaggaaga

SEQ ID NO: 6227150 - DNA, 9 bp, Homo sapiens
gattggctt

SEQ ID NO: 6227151 - DNA, 17 bp, Homo sapiens
gattggcttaaagtgaa

SEQ ID NO: 6227152 - DNA, 18 bp, Homo sapiens
gattggcttgtgtgtttc

SEQ ID NO: 6227153 - DNA, 15 bp, Homo sapiens
gattgggaataaata

SEQ ID NO: 6227154 - DNA, 16 bp, Homo sapiens
gattgggaatccgccc

SEQ ID NO: 6227155 - DNA, 22 bp, Homo sapiens
gattgggacgcacagtgcagtt

SEQ ID NO: 6227156 - DNA, 14 bp, Homo sapiens
gattgggagggaca

SEQ ID NO: 6227157 - DNA, 18 bp, Homo sapiens
gattggggcctcacccag

SEQ ID NO: 6227158 - DNA, 16 bp, Homo sapiens
gattggggggaaagag

SEQ ID NO: 6227159 - DNA, 22 bp, Homo sapiens
gattggggggaaagagggagca

SEQ ID NO: 6227160 - DNA, 16 bp, Homo sapiens
gattgggggggcttgg

SEQ ID NO: 6227161 - DNA, 12 bp, Homo sapiens
gattgggtgcca

SEQ ID NO: 6227162 - DNA, 18 bp, Homo sapiens
gattgggttatgaatatt

SEQ ID NO: 6227163 - DNA, 14 bp, Homo sapiens
gattggtaccagag

SEQ ID NO: 6227164 - DNA, 19 bp, Homo sapiens
gattggtatgatgctgccg

SEQ ID NO: 6227165 - DNA, 20 bp, Homo sapiens
gattggtgattcaaagtgtt

SEQ ID NO: 6227166 - DNA, 14 bp, Homo sapiens
gattggtgggctga

SEQ ID NO: 6227167 - DNA, 20 bp, Homo sapiens
gattggttaaaatgtgattt

SEQ ID NO: 6227168 - DNA, 20 bp, Homo sapiens
gattggttcatgcctggggt

SEQ ID NO: 6227169 - DNA, 14 bp, Homo sapiens
gattggttctgttt

SEQ ID NO: 6227170 - DNA, 15 bp, Homo sapiens
gattggttgtgcctt

SEQ ID NO: 6227171 - DNA, 18 bp, Homo sapiens
gattggttgtgccttccc

SEQ ID NO: 6227172 - DNA, 20 bp, Homo sapiens
gattggttttaattgaagga

SEQ ID NO: 6227173 - DNA, 23 bp, Homo sapiens
gattggttttaattgaaggaaag

SEQ ID NO: 6227174 - DNA, 18 bp, Homo sapiens
gattggttttattttatg

SEQ ID NO: 6227175 - DNA, 22 bp, Homo sapiens
gattggttttggggaaatgtgg

SEQ ID NO: 6227176 - DNA, 14 bp, Homo sapiens
gattgtaaaaacaa

SEQ ID NO: 6227177 - DNA, 18 bp, Homo sapiens
gattgtaacgttgctgtg

SEQ ID NO: 6227178 - DNA, 23 bp, Homo sapiens
gattgtaacgttgctgtgggaac

SEQ ID NO: 6227179 - DNA, 23 bp, Homo sapiens
gattgtaatatgtaaatggtatg

SEQ ID NO: 6227180 - DNA, 20 bp, Homo sapiens
gattgtacatatggaaatcc

SEQ ID NO: 6227181 - DNA, 13 bp, Homo sapiens
gattgtacatttt

SEQ ID NO: 6227182 - DNA, 17 bp, Homo sapiens
gattgtagaacttgttg

SEQ ID NO: 6227183 - DNA, 12 bp, Homo sapiens
gattgtagtatt

SEQ ID NO: 6227184 - DNA, 21 bp, Homo sapiens
gattgtataagcatgctttct

SEQ ID NO: 6227185 - DNA, 19 bp, Homo sapiens
gattgtataatgtgatttt

SEQ ID NO: 6227186 - DNA, 20 bp, Homo sapiens
gattgtatctgaactcacag

SEQ ID NO: 6227187 - DNA, 16 bp, Homo sapiens
gattgtatgttgagga

SEQ ID NO: 6227188 - DNA, 16 bp, Homo sapiens
gattgtattactttaa

SEQ ID NO: 6227189 - DNA, 20 bp, Homo sapiens
gattgtattgttgaaaaagt

SEQ ID NO: 6227190 - DNA, 16 bp, Homo sapiens
gattgtatttaaaggt

SEQ ID NO: 6227191 - DNA, 20 bp, Homo sapiens
gattgtcaatgctggagaaa

SEQ ID NO: 6227192 - DNA, 21 bp, Homo sapiens
gattgtcaatgctggagaaaa

SEQ ID NO: 6227193 - DNA, 22 bp, Homo sapiens
gattgtcagccacctccctctg

SEQ ID NO: 6227194 - DNA, 22 bp, Homo sapiens
gattgtcattcttacaaaacat

SEQ ID NO: 6227195 - DNA, 18 bp, Homo sapiens
gattgtccacaaatgtcc

SEQ ID NO: 6227196 - DNA, 12 bp, Homo sapiens
gattgtccctgt

SEQ ID NO: 6227197 - DNA, 16 bp, Homo sapiens
gattgtctcagggccg

SEQ ID NO: 6227198 - DNA, 12 bp, Homo sapiens
gattgtcttgca

SEQ ID NO: 6227199 - DNA, 11 bp, Homo sapiens
gattgtgaagg

SEQ ID NO: 6227200 - DNA, 21 bp, Homo sapiens
gattgtgaatatttccatatg

SEQ ID NO: 6227201 - DNA, 13 bp, Homo sapiens
gattgtgcccctg

SEQ ID NO: 6227202 - DNA, 18 bp, Homo sapiens
gattgtgcctaatgtgtt

SEQ ID NO: 6227203 - DNA, 19 bp, Homo sapiens
gattgtgggcatgagctgc

SEQ ID NO: 6227204 - DNA, 20 bp, Homo sapiens
gattgtgtcccattccccca

SEQ ID NO: 6227205 - DNA, 21 bp, Homo sapiens
gattgtgtggtgttttggatt

SEQ ID NO: 6227206 - DNA, 23 bp, Homo sapiens
gattgtgtttgttcataataaaa

SEQ ID NO: 6227207 - DNA, 15 bp, Homo sapiens
gattgttaatttcag

SEQ ID NO: 6227208 - DNA, 23 bp, Homo sapiens
gattgttaggagtggttctcatt

SEQ ID NO: 6227209 - DNA, 14 bp, Homo sapiens
gattgttcctcccc

SEQ ID NO: 6227210 - DNA, 13 bp, Homo sapiens
gattgttggcagt

SEQ ID NO: 6227211 - DNA, 11 bp, Homo sapiens
gattgtttaca

SEQ ID NO: 6227212 - DNA, 21 bp, Homo sapiens
gattgtttacaggatattcca

SEQ ID NO: 6227213 - DNA, 11 bp, Homo sapiens
gattgtttgca

SEQ ID NO: 6227214 - DNA, 22 bp, Homo sapiens
gattgttttttaaaaatggata

SEQ ID NO: 6227215 - DNA, 22 bp, Homo sapiens
gattgttttttcctaaggaaac

SEQ ID NO: 6227216 - DNA, 12 bp, Homo sapiens
gatttaaaaaat

SEQ ID NO: 6227217 - DNA, 16 bp, Homo sapiens
gatttaaaaactggaa

SEQ ID NO: 6227218 - DNA, 15 bp, Homo sapiens
gatttaaaacatgta

SEQ ID NO: 6227219 - DNA, 16 bp, Homo sapiens
gatttaaaagcctgct

SEQ ID NO: 6227220 - DNA, 18 bp, Homo sapiens
gatttaaaagtgtatttt

SEQ ID NO: 6227221 - DNA, 16 bp, Homo sapiens
gatttaaacacacaga

SEQ ID NO: 6227222 - DNA, 17 bp, Homo sapiens
gatttaaacacacagat

SEQ ID NO: 6227223 - DNA, 20 bp, Homo sapiens
gatttaaacacattaaaggt

SEQ ID NO: 6227224 - DNA, 14 bp, Homo sapiens
gatttaaactctta

SEQ ID NO: 6227225 - DNA, 19 bp, Homo sapiens
gatttaaaggcagacagtt

SEQ ID NO: 6227226 - DNA, 20 bp, Homo sapiens
gatttaaagggacaccccta

SEQ ID NO: 6227227 - DNA, 12 bp, Homo sapiens
gatttaaatgcc

SEQ ID NO: 6227228 - DNA, 16 bp, Homo sapiens
gatttaacaaatacat

SEQ ID NO: 6227229 - DNA, 21 bp, Homo sapiens
gatttaacaaatacattcata

SEQ ID NO: 6227230 - DNA, 14 bp, Homo sapiens
gatttaacagaaat

SEQ ID NO: 6227231 - DNA, 16 bp, Homo sapiens
gatttaacagaaatgt

SEQ ID NO: 6227232 - DNA, 14 bp, Homo sapiens
gatttaacagcatg

SEQ ID NO: 6227233 - DNA, 18 bp, Homo sapiens
gatttaacagcatgacaa

SEQ ID NO: 6227234 - DNA, 19 bp, Homo sapiens
gatttaacagcatgacaaa

SEQ ID NO: 6227235 - DNA, 18 bp, Homo sapiens
gatttaagccttacaaag

SEQ ID NO: 6227236 - DNA, 20 bp, Homo sapiens
gatttaagccttacaaaggg

SEQ ID NO: 6227237 - DNA, 22 bp, Homo sapiens
gatttaagccttgacacactgt

SEQ ID NO: 6227238 - DNA, 17 bp, Homo sapiens
gatttaagttacaatgt

SEQ ID NO: 6227239 - DNA, 16 bp, Homo sapiens
gatttaagttcctgct

SEQ ID NO: 6227240 - DNA, 21 bp, Homo sapiens
gatttaagttcctgctgcctg

SEQ ID NO: 6227241 - DNA, 15 bp, Homo sapiens
gatttaataaaataa

SEQ ID NO: 6227242 - DNA, 19 bp, Homo sapiens
gatttaatagtgttaatca

SEQ ID NO: 6227243 - DNA, 22 bp, Homo sapiens
gatttaatagtgttaatcaatt

SEQ ID NO: 6227244 - DNA, 14 bp, Homo sapiens
gatttaatatggat

SEQ ID NO: 6227245 - DNA, 15 bp, Homo sapiens
gatttaatgttttct

SEQ ID NO: 6227246 - DNA, 12 bp, Homo sapiens
gatttaattctc

SEQ ID NO: 6227247 - DNA, 15 bp, Homo sapiens
gatttaattctcttg

SEQ ID NO: 6227248 - DNA, 15 bp, Homo sapiens
gatttaattcttacc

SEQ ID NO: 6227249 - DNA, 14 bp, Homo sapiens
gatttaatttccag

SEQ ID NO: 6227250 - DNA, 23 bp, Homo sapiens
gatttaatttgatatcacagtct

SEQ ID NO: 6227251 - DNA, 20 bp, Homo sapiens
gatttaatttgccaaaataa

SEQ ID NO: 6227252 - DNA, 19 bp, Homo sapiens
gatttacagcctcacttga

SEQ ID NO: 6227253 - DNA, 16 bp, Homo sapiens
gatttacagtttcaaa

SEQ ID NO: 6227254 - DNA, 19 bp, Homo sapiens
gatttacatgtatggttac

SEQ ID NO: 6227255 - DNA, 15 bp, Homo sapiens
gatttaccacttgtg

SEQ ID NO: 6227256 - DNA, 16 bp, Homo sapiens
gatttaccacttgtgt

SEQ ID NO: 6227257 - DNA, 16 bp, Homo sapiens
gatttaccttttctgt

SEQ ID NO: 6227258 - DNA, 17 bp, Homo sapiens
gatttaccttttctgtt

SEQ ID NO: 6227259 - DNA, 17 bp, Homo sapiens
gatttactgagagaagg

SEQ ID NO: 6227260 - DNA, 17 bp, Homo sapiens
gatttactgtcccagga

SEQ ID NO: 6227261 - DNA, 23 bp, Homo sapiens
gatttagaagcaaagatttcagt

SEQ ID NO: 6227262 - DNA, 15 bp, Homo sapiens
gatttagaagtgtca

SEQ ID NO: 6227263 - DNA, 12 bp, Homo sapiens
gatttagattta

SEQ ID NO: 6227264 - DNA, 14 bp, Homo sapiens
gatttagcaagcaa

SEQ ID NO: 6227265 - DNA, 14 bp, Homo sapiens
gatttagctattta

SEQ ID NO: 6227266 - DNA, 20 bp, Homo sapiens
gatttagctatttattgttc

SEQ ID NO: 6227267 - DNA, 15 bp, Homo sapiens
gatttaggtagcctt

SEQ ID NO: 6227268 - DNA, 14 bp, Homo sapiens
gaatgtttgtctca

SEQ ID NO: 6227269 - DNA, 18 bp, Homo sapiens
gaatgtttgtgtctgtgg

SEQ ID NO: 6227270 - DNA, 19 bp, Homo sapiens
gaatgtttgtgtctgtggt

SEQ ID NO: 6227271 - DNA, 17 bp, Homo sapiens
gaatgtttgtttcagtg

SEQ ID NO: 6227272 - DNA, 21 bp, Homo sapiens
gaatgtttgtttcagtgccat

SEQ ID NO: 6227273 - DNA, 22 bp, Homo sapiens
gaatgtttttccctccccagaa

SEQ ID NO: 6227274 - DNA, 13 bp, Homo sapiens
gaattaaaactga

SEQ ID NO: 6227275 - DNA, 18 bp, Homo sapiens
gaattaaaacttcttaaa

SEQ ID NO: 6227276 - DNA, 19 bp, Homo sapiens
gaattaaaaggatagtatt

SEQ ID NO: 6227277 - DNA, 20 bp, Homo sapiens
gaattaaaaggatagtattt

SEQ ID NO: 6227278 - DNA, 15 bp, Homo sapiens
gaattaaaatggttt

SEQ ID NO: 6227279 - DNA, 22 bp, Homo sapiens
gaattaaacccacaagctgcct

SEQ ID NO: 6227280 - DNA, 23 bp, Homo sapiens
gaattaaacccacaagctgcctc

SEQ ID NO: 6227281 - DNA, 14 bp, Homo sapiens
gaattaaagtactt

SEQ ID NO: 6227282 - DNA, 12 bp, Homo sapiens
gaattaaagtct

SEQ ID NO: 6227283 - DNA, 20 bp, Homo sapiens
gaattaaataaacccttcct

SEQ ID NO: 6227284 - DNA, 15 bp, Homo sapiens
gaattaaatagtgtg

SEQ ID NO: 6227285 - DNA, 18 bp, Homo sapiens
gaattaaatattgaaaca

SEQ ID NO: 6227286 - DNA, 23 bp, Homo sapiens
gaattaaatcatcccttaataaa

SEQ ID NO: 6227287 - DNA, 20 bp, Homo sapiens
gaattaaattaggaataaat

SEQ ID NO: 6227288 - DNA, 17 bp, Homo sapiens
gaattaacacagtgttt

SEQ ID NO: 6227289 - DNA, 16 bp, Homo sapiens
gaattaaccatttaat

SEQ ID NO: 6227290 - DNA, 23 bp, Homo sapiens
gaattaaccatttaataaagaaa

SEQ ID NO: 6227291 - DNA, 15 bp, Homo sapiens
gaattaacctggtgc

SEQ ID NO: 6227292 - DNA, 18 bp, Homo sapiens
gaattaacctggtgctgg

SEQ ID NO: 6227293 - DNA, 16 bp, Homo sapiens
gaattaactataacaa

SEQ ID NO: 6227294 - DNA, 22 bp, Homo sapiens
gaattaactgcatacgttttgg

SEQ ID NO: 6227295 - DNA, 17 bp, Homo sapiens
gaattaagatacaaatt

SEQ ID NO: 6227296 - DNA, 16 bp, Homo sapiens
gaattaagctgtgcaa

SEQ ID NO: 6227297 - DNA, 15 bp, Homo sapiens
gaattaagttatctt

SEQ ID NO: 6227298 - DNA, 20 bp, Homo sapiens
gaattaagttatctttaaaa

SEQ ID NO: 6227299 - DNA, 13 bp, Homo sapiens
gaattaagtttta

SEQ ID NO: 6227300 - DNA, 15 bp, Homo sapiens
gaattaatgacagaa

SEQ ID NO: 6227301 - DNA, 17 bp, Homo sapiens
gaattaatgagaagata

SEQ ID NO: 6227302 - DNA, 17 bp, Homo sapiens
gaattaatgatgaggat

SEQ ID NO: 6227303 - DNA, 17 bp, Homo sapiens
gaattaattaatttgga

SEQ ID NO: 6227304 - DNA, 21 bp, Homo sapiens
gaattacaaccattgtatttt

SEQ ID NO: 6227305 - DNA, 14 bp, Homo sapiens
gaattacagagata

SEQ ID NO: 6227306 - DNA, 20 bp, Homo sapiens
gaattacagagatataaatg

SEQ ID NO: 6227307 - DNA, 14 bp, Homo sapiens
gaattacataacag

SEQ ID NO: 6227308 - DNA, 14 bp, Homo sapiens
gaattacatatgaa

SEQ ID NO: 6227309 - DNA, 21 bp, Homo sapiens
gaattacatgtaaaacattat

SEQ ID NO: 6227310 - DNA, 15 bp, Homo sapiens
gaattacatttgtat

SEQ ID NO: 6227311 - DNA, 18 bp, Homo sapiens
gaattacatttgtataaa

SEQ ID NO: 6227312 - DNA, 19 bp, Homo sapiens
gaattaccattaattacat

SEQ ID NO: 6227313 - DNA, 14 bp, Homo sapiens
gaattaccatttgt

SEQ ID NO: 6227314 - DNA, 18 bp, Homo sapiens
gaattaccatttgttaat

SEQ ID NO: 6227315 - DNA, 14 bp, Homo sapiens
gaattacccttcct

SEQ ID NO: 6227316 - DNA, 16 bp, Homo sapiens
gaattacccttcctca

SEQ ID NO: 6227317 - DNA, 20 bp, Homo sapiens
gaattacctgataagggaga

SEQ ID NO: 6227318 - DNA, 22 bp, Homo sapiens
gaattaccttagattagctctg

SEQ ID NO: 6227319 - DNA, 15 bp, Homo sapiens
gaattactaacttct

SEQ ID NO: 6227320 - DNA, 18 bp, Homo sapiens
gaattactaacttctaaa

SEQ ID NO: 6227321 - DNA, 16 bp, Homo sapiens
gaattactccaaaaag

SEQ ID NO: 6227322 - DNA, 21 bp, Homo sapiens
gaattactgaaaaaggtgatt

SEQ ID NO: 6227323 - DNA, 18 bp, Homo sapiens
gaattactgtatataaac

SEQ ID NO: 6227324 - DNA, 24 bp, Homo sapiens
gaattactgtttgaaacttttcaa

SEQ ID NO: 6227325 - DNA, 16 bp, Homo sapiens
gaattacttatattca

SEQ ID NO: 6227326 - DNA, 16 bp, Homo sapiens
gaattacttttttcca

SEQ ID NO: 6227327 - DNA, 13 bp, Homo sapiens
gaattagaagaaa

SEQ ID NO: 6227328 - DNA, 15 bp, Homo sapiens
gaattagaagaaaat

SEQ ID NO: 6227329 - DNA, 16 bp, Homo sapiens
gaattagagaagctga

SEQ ID NO: 6227330 - DNA, 17 bp, Homo sapiens
gaattagagtggaataa

SEQ ID NO: 6227331 - DNA, 22 bp, Homo sapiens
gaattagccaaccaggctacag

SEQ ID NO: 6227332 - DNA, 19 bp, Homo sapiens
gaattaggctttagatttt

SEQ ID NO: 6227333 - DNA, 16 bp, Homo sapiens
gaattagtaaagttag

SEQ ID NO: 6227334 - DNA, 18 bp, Homo sapiens
gaattagtccttgcttgg

SEQ ID NO: 6227335 - DNA, 22 bp, Homo sapiens
gaattagttggcagagaaaatg

SEQ ID NO: 6227336 - DNA, 11 bp, Homo sapiens
gaattagtttt

SEQ ID NO: 6227337 - DNA, 17 bp, Homo sapiens
gaattagttttaaaatg

SEQ ID NO: 6227338 - DNA, 19 bp, Homo sapiens
gaattataactggaaagaa

SEQ ID NO: 6227339 - DNA, 23 bp, Homo sapiens
gaattatactttgttgtttttaa

SEQ ID NO: 6227340 - DNA, 22 bp, Homo sapiens
gaattatatctaatttatacaa

SEQ ID NO: 6227341 - DNA, 15 bp, Homo sapiens
gaattatcagcaaag

SEQ ID NO: 6227342 - DNA, 16 bp, Homo sapiens
gaattatcagcaaaga

SEQ ID NO: 6227343 - DNA, 22 bp, Homo sapiens
gaattatcatcccaacagccaa

SEQ ID NO: 6227344 - DNA, 16 bp, Homo sapiens
gaattatccattacgt

SEQ ID NO: 6227345 - DNA, 18 bp, Homo sapiens
gaattatctcaagtaaaa

SEQ ID NO: 6227346 - DNA, 12 bp, Homo sapiens
gaattatgaaac

SEQ ID NO: 6227347 - DNA, 18 bp, Homo sapiens
gaattatgataaaggctt

SEQ ID NO: 6227348 - DNA, 13 bp, Homo sapiens
gaattatgcttcc

SEQ ID NO: 6227349 - DNA, 21 bp, Homo sapiens
gaattatgctttgtagagttt

SEQ ID NO: 6227350 - DNA, 16 bp, Homo sapiens
gaattatgtaatatat

SEQ ID NO: 6227351 - DNA, 22 bp, Homo sapiens
gaattattacactgtaagaaat

SEQ ID NO: 6227352 - DNA, 17 bp, Homo sapiens
gaattattacatcttta

SEQ ID NO: 6227353 - DNA, 17 bp, Homo sapiens
gaattattatgtctcaa

SEQ ID NO: 6227354 - DNA, 16 bp, Homo sapiens
gaattattcaatttat

SEQ ID NO: 6227355 - DNA, 17 bp, Homo sapiens
gaattattcagtgaatt

SEQ ID NO: 6227356 - DNA, 15 bp, Homo sapiens
gaattattgacactg

SEQ ID NO: 6227357 - DNA, 18 bp, Homo sapiens
gaattattttaaaagata

SEQ ID NO: 6227358 - DNA, 20 bp, Homo sapiens
gaattattttgaatgtcaca

SEQ ID NO: 6227359 - DNA, 12 bp, Homo sapiens
gaattattttgt

SEQ ID NO: 6227360 - DNA, 15 bp, Homo sapiens
gaattatttttcact

SEQ ID NO: 6227361 - DNA, 14 bp, Homo sapiens
gaattatttttgtg

SEQ ID NO: 6227362 - DNA, 22 bp, Homo sapiens
gaattatttttgtgtttctaaa

SEQ ID NO: 6227363 - DNA, 16 bp, Homo sapiens
gaattattttttttct

SEQ ID NO: 6227364 - DNA, 16 bp, Homo sapiens
gaattcaaactggggc

SEQ ID NO: 6227365 - DNA, 17 bp, Homo sapiens
gaattcaaatcctcttt

SEQ ID NO: 6227366 - DNA, 17 bp, Homo sapiens
gaattcaatttggcaaa

SEQ ID NO: 6227367 - DNA, 20 bp, Homo sapiens
gaattcacacaactactttc

SEQ ID NO: 6227368 - DNA, 15 bp, Homo sapiens
gaattcacccctccc

SEQ ID NO: 6227369 - DNA, 21 bp, Homo sapiens
gaattcactccacttggacat

SEQ ID NO: 6227370 - DNA, 13 bp, Homo sapiens
gaattcagacatc

SEQ ID NO: 6227371 - DNA, 16 bp, Homo sapiens
gaattcagcaccctgg

SEQ ID NO: 6227372 - DNA, 17 bp, Homo sapiens
gaattcagcagttttat

SEQ ID NO: 6227373 - DNA, 14 bp, Homo sapiens
gaattcagctgccc

SEQ ID NO: 6227374 - DNA, 11 bp, Homo sapiens
gaattcagtaa

SEQ ID NO: 6227375 - DNA, 18 bp, Homo sapiens
gaattcataaaaataacc

SEQ ID NO: 6227376 - DNA, 22 bp, Homo sapiens
gaattcataataaattttctaa

SEQ ID NO: 6227377 - DNA, 15 bp, Homo sapiens
gaattcatactctgt

SEQ ID NO: 6227378 - DNA, 20 bp, Homo sapiens
gaattcatactctgttgcct

SEQ ID NO: 6227379 - DNA, 16 bp, Homo sapiens
gaattcattataattt

SEQ ID NO: 6227380 - DNA, 16 bp, Homo sapiens
gaattcattctggtct

SEQ ID NO: 6227381 - DNA, 22 bp, Homo sapiens
gaattcattctggtctctctat

SEQ ID NO: 6227382 - DNA, 17 bp, Homo sapiens
gaattcattgtctcagt

SEQ ID NO: 6227383 - DNA, 20 bp, Homo sapiens
gaattcattgtctcagtgaa

SEQ ID NO: 6227384 - DNA, 14 bp, Homo sapiens
gaattcatttgctg

SEQ ID NO: 6227385 - DNA, 15 bp, Homo sapiens
gaattccaaagcaaa

SEQ ID NO: 6227386 - DNA, 15 bp, Homo sapiens
gaattccaacttgaa

SEQ ID NO: 6227387 - DNA, 18 bp, Homo sapiens
gaattccaacttgaagga

SEQ ID NO: 6227388 - DNA, 16 bp, Homo sapiens
gaattccaaggagttc

SEQ ID NO: 6227389 - DNA, 21 bp, Homo sapiens
gaattccaagtgtattttaaa

SEQ ID NO: 6227390 - DNA, 15 bp, Homo sapiens
gaattccaattaaat

SEQ ID NO: 6227391 - DNA, 17 bp, Homo sapiens
gaattccaattaaattt

SEQ ID NO: 6227392 - DNA, 17 bp, Homo sapiens
gaattccacagggacca

SEQ ID NO: 6227393 - DNA, 22 bp, Homo sapiens
gaattccacctggaaagccagg

SEQ ID NO: 6227394 - DNA, 14 bp, Homo sapiens
gaattccatcttgt

SEQ ID NO: 6227395 - DNA, 22 bp, Homo sapiens
gaattcccagatagtcccagca

SEQ ID NO: 6227396 - DNA, 12 bp, Homo sapiens
gaattccctcac

SEQ ID NO: 6227397 - DNA, 20 bp, Homo sapiens
gaattccctcactcgtctcc

SEQ ID NO: 6227398 - DNA, 20 bp, Homo sapiens
gaattcctaaaattatggaa

SEQ ID NO: 6227399 - DNA, 14 bp, Homo sapiens
gaattcctaaagct

SEQ ID NO: 6227400 - DNA, 18 bp, Homo sapiens
gaattcctcctctattta

SEQ ID NO: 6227401 - DNA, 14 bp, Homo sapiens
gaattcctctttaa

SEQ ID NO: 6227402 - DNA, 18 bp, Homo sapiens
gaattcctctttaacaag

SEQ ID NO: 6227403 - DNA, 15 bp, Homo sapiens
gaattcctgaagcca

SEQ ID NO: 6227404 - DNA, 18 bp, Homo sapiens
gaattcctgaagccagat

SEQ ID NO: 6227405 - DNA, 17 bp, Homo sapiens
gaattcctgcagcagtt

SEQ ID NO: 6227406 - DNA, 23 bp, Homo sapiens
gaattcctgctatgacagctggc

SEQ ID NO: 6227407 - DNA, 15 bp, Homo sapiens
gaattccttcgaaag

SEQ ID NO: 6227408 - DNA, 17 bp, Homo sapiens
gaattcgggtggcatcc

SEQ ID NO: 6227409 - DNA, 19 bp, Homo sapiens
gaattcgtgttatgaatct

SEQ ID NO: 6227410 - DNA, 17 bp, Homo sapiens
gaattctaaatgctggt

SEQ ID NO: 6227411 - DNA, 19 bp, Homo sapiens
gaattctaattgtcagtga

SEQ ID NO: 6227412 - DNA, 13 bp, Homo sapiens
gaattctaccctg

SEQ ID NO: 6227413 - DNA, 18 bp, Homo sapiens
gaattctaccctggaaaa

SEQ ID NO: 6227414 - DNA, 21 bp, Homo sapiens
gaattctaccctggaaaagtg

SEQ ID NO: 6227415 - DNA, 14 bp, Homo sapiens
gaattctagaaaat

SEQ ID NO: 6227416 - DNA, 14 bp, Homo sapiens
gaattctagctttt

SEQ ID NO: 6227417 - DNA, 14 bp, Homo sapiens
gaattctagtgctg

SEQ ID NO: 6227418 - DNA, 16 bp, Homo sapiens
gaattctatttgaagc

SEQ ID NO: 6227419 - DNA, 15 bp, Homo sapiens
gaattctatttgctg

SEQ ID NO: 6227420 - DNA, 20 bp, Homo sapiens
gaattctcaggtaggaagca

SEQ ID NO: 6227421 - DNA, 18 bp, Homo sapiens
gaattctcagtgccaact

SEQ ID NO: 6227422 - DNA, 15 bp, Homo sapiens
gaattctgattgatt

SEQ ID NO: 6227423 - DNA, 19 bp, Homo sapiens
gaattctgccttggttctg

SEQ ID NO: 6227424 - DNA, 21 bp, Homo sapiens
gaattctgctctaaataaaga

SEQ ID NO: 6227425 - DNA, 19 bp, Homo sapiens
gaattctggacaacccaag

SEQ ID NO: 6227426 - DNA, 13 bp, Homo sapiens
gaattctgtatag

SEQ ID NO: 6227427 - DNA, 14 bp, Homo sapiens
gaattctgtataga

SEQ ID NO: 6227428 - DNA, 13 bp, Homo sapiens
gaattctgttcta

SEQ ID NO: 6227429 - DNA, 22 bp, Homo sapiens
gaattctgttctaaaactccaa

SEQ ID NO: 6227430 - DNA, 18 bp, Homo sapiens
gaattcttcacatgtaac

SEQ ID NO: 6227431 - DNA, 16 bp, Homo sapiens
gaattcttcctcctct

SEQ ID NO: 6227432 - DNA, 22 bp, Homo sapiens
gaattcttcctctccttcccac

SEQ ID NO: 6227433 - DNA, 23 bp, Homo sapiens
gaattcttcctctccttcccaca

SEQ ID NO: 6227434 - DNA, 12 bp, Homo sapiens
gaattcttctgg

SEQ ID NO: 6227435 - DNA, 13 bp, Homo sapiens
gaattcttgatct

SEQ ID NO: 6227436 - DNA, 14 bp, Homo sapiens
gaattcttgctgtt

SEQ ID NO: 6227437 - DNA, 20 bp, Homo sapiens
gaattcttggttgaggaaac

SEQ ID NO: 6227438 - DNA, 19 bp, Homo sapiens
gaattctttaaaattacaa

SEQ ID NO: 6227439 - DNA, 18 bp, Homo sapiens
gaattctttagattttta

SEQ ID NO: 6227440 - DNA, 17 bp, Homo sapiens
gaattctttctgttgaa

SEQ ID NO: 6227441 - DNA, 13 bp, Homo sapiens
gaattctttgcat

SEQ ID NO: 6227442 - DNA, 15 bp, Homo sapiens
gaattctttgcattc

SEQ ID NO: 6227443 - DNA, 16 bp, Homo sapiens
gaattctttgcattcc

SEQ ID NO: 6227444 - DNA, 18 bp, Homo sapiens
gaattctttgcattcctt

SEQ ID NO: 6227445 - DNA, 16 bp, Homo sapiens
gaattcttttggggaa

SEQ ID NO: 6227446 - DNA, 16 bp, Homo sapiens
gaattgaaaaggactc

SEQ ID NO: 6227447 - DNA, 20 bp, Homo sapiens
gatttagtaatagtccaata

SEQ ID NO: 6227448 - DNA, 13 bp, Homo sapiens
gatttagtagtgt

SEQ ID NO: 6227449 - DNA, 18 bp, Homo sapiens
gatttagtgtaataagac

SEQ ID NO: 6227450 - DNA, 15 bp, Homo sapiens
gatttagtttcagta

SEQ ID NO: 6227451 - DNA, 16 bp, Homo sapiens
gatttagtttcagtag

SEQ ID NO: 6227452 - DNA, 23 bp, Homo sapiens
gatttataaagatttttgttaag

SEQ ID NO: 6227453 - DNA, 21 bp, Homo sapiens
gatttataaatgcactgtaat

SEQ ID NO: 6227454 - DNA, 19 bp, Homo sapiens
gatttatagtatgtgactt

SEQ ID NO: 6227455 - DNA, 21 bp, Homo sapiens
gatttatagtatgtgactttt

SEQ ID NO: 6227456 - DNA, 17 bp, Homo sapiens
gatttatagtttgtaca

SEQ ID NO: 6227457 - DNA, 21 bp, Homo sapiens
gatttatagtttgtacatgca

SEQ ID NO: 6227458 - DNA, 16 bp, Homo sapiens
gatttatataaatgta

SEQ ID NO: 6227459 - DNA, 19 bp, Homo sapiens
gatttatataaatgtaaaa

SEQ ID NO: 6227460 - DNA, 18 bp, Homo sapiens
gatttatatgtgtaattt

SEQ ID NO: 6227461 - DNA, 15 bp, Homo sapiens
gatttatcaaatcag

SEQ ID NO: 6227462 - DNA, 15 bp, Homo sapiens
gatttatctttatac

SEQ ID NO: 6227463 - DNA, 12 bp, Homo sapiens
gatttatctttc

SEQ ID NO: 6227464 - DNA, 13 bp, Homo sapiens
gatttatgcattt

SEQ ID NO: 6227465 - DNA, 16 bp, Homo sapiens
gatttatgctttaact

SEQ ID NO: 6227466 - DNA, 17 bp, Homo sapiens
gatttatgtattttgaa

SEQ ID NO: 6227467 - DNA, 14 bp, Homo sapiens
gatttattaaagaa

SEQ ID NO: 6227468 - DNA, 16 bp, Homo sapiens
gatttattaaagaaaa

SEQ ID NO: 6227469 - DNA, 17 bp, Homo sapiens
gatttattaaagaaaaa

SEQ ID NO: 6227470 - DNA, 20 bp, Homo sapiens
gatttattaacttaataatc

SEQ ID NO: 6227471 - DNA, 17 bp, Homo sapiens
gatttattctcagaaca

SEQ ID NO: 6227472 - DNA, 20 bp, Homo sapiens
gatttattctcagaacacca

SEQ ID NO: 6227473 - DNA, 12 bp, Homo sapiens
gatttatttaaa

SEQ ID NO: 6227474 - DNA, 18 bp, Homo sapiens
gatttatttaaaatagca

SEQ ID NO: 6227475 - DNA, 12 bp, Homo sapiens
gatttatttcta

SEQ ID NO: 6227476 - DNA, 16 bp, Homo sapiens
gatttatttgcttctt

SEQ ID NO: 6227477 - DNA, 16 bp, Homo sapiens
gatttatttggagtgg

SEQ ID NO: 6227478 - DNA, 20 bp, Homo sapiens
gatttatttggagtggaggc

SEQ ID NO: 6227479 - DNA, 15 bp, Homo sapiens
gatttatttgtttga

SEQ ID NO: 6227480 - DNA, 17 bp, Homo sapiens
gatttattttacattta

SEQ ID NO: 6227481 - DNA, 22 bp, Homo sapiens
gatttattttacatttagagta

SEQ ID NO: 6227482 - DNA, 14 bp, Homo sapiens
gatttattttgtta

SEQ ID NO: 6227483 - DNA, 17 bp, Homo sapiens
gatttatttttcagttc

SEQ ID NO: 6227484 - DNA, 22 bp, Homo sapiens
gatttattttttgtaactcttt

SEQ ID NO: 6227485 - DNA, 14 bp, Homo sapiens
gatttcaaaatcag

SEQ ID NO: 6227486 - DNA, 12 bp, Homo sapiens
gatttcaacata

SEQ ID NO: 6227487 - DNA, 21 bp, Homo sapiens
gatttcaacatgagtgtattt

SEQ ID NO: 6227488 - DNA, 22 bp, Homo sapiens
gatttcaacatggatacatatt

SEQ ID NO: 6227489 - DNA, 15 bp, Homo sapiens
gatttcaagggactg

SEQ ID NO: 6227490 - DNA, 23 bp, Homo sapiens
gatttcaaggtccgagctctgtc

SEQ ID NO: 6227491 - DNA, 15 bp, Homo sapiens
gatttcacaaatatt

SEQ ID NO: 6227492 - DNA, 21 bp, Homo sapiens
gatttcacaggtcttgcccaa

SEQ ID NO: 6227493 - DNA, 12 bp, Homo sapiens
gatttcacattt

SEQ ID NO: 6227494 - DNA, 16 bp, Homo sapiens
gatttcacatttctac

SEQ ID NO: 6227495 - DNA, 22 bp, Homo sapiens
gatttcaccgtattagccagga

SEQ ID NO: 6227496 - DNA, 18 bp, Homo sapiens
gatttcactctccttggt

SEQ ID NO: 6227497 - DNA, 22 bp, Homo sapiens
gatttcagacctagcagggaag

SEQ ID NO: 6227498 - DNA, 13 bp, Homo sapiens
gatttcagatgta

SEQ ID NO: 6227499 - DNA, 15 bp, Homo sapiens
gatttcagctcactg

SEQ ID NO: 6227500 - DNA, 17 bp, Homo sapiens
gatttcagctcactgca

SEQ ID NO: 6227501 - DNA, 19 bp, Homo sapiens
gatttcagggaaatggagg

SEQ ID NO: 6227502 - DNA, 20 bp, Homo sapiens
gatttcagggaaatggaggg

SEQ ID NO: 6227503 - DNA, 23 bp, Homo sapiens
gatttcagtagaattttagtcct

SEQ ID NO: 6227504 - DNA, 17 bp, Homo sapiens
gatttcagtcttttcct

SEQ ID NO: 6227505 - DNA, 16 bp, Homo sapiens
gatttcatacctcaga

SEQ ID NO: 6227506 - DNA, 15 bp, Homo sapiens
gatttcatactgtaa

SEQ ID NO: 6227507 - DNA, 14 bp, Homo sapiens
gatttcatattgat

SEQ ID NO: 6227508 - DNA, 16 bp, Homo sapiens
gatttcatccttgaat

SEQ ID NO: 6227509 - DNA, 17 bp, Homo sapiens
gatttcatcttctggaa

SEQ ID NO: 6227510 - DNA, 15 bp, Homo sapiens
gatttcatgattaga

SEQ ID NO: 6227511 - DNA, 20 bp, Homo sapiens
gatttcatgctatctctgtg

SEQ ID NO: 6227512 - DNA, 19 bp, Homo sapiens
gatttcatggtgattccag

SEQ ID NO: 6227513 - DNA, 16 bp, Homo sapiens
gatttcatgtactgca

SEQ ID NO: 6227514 - DNA, 12 bp, Homo sapiens
gatttcattaca

SEQ ID NO: 6227515 - DNA, 21 bp, Homo sapiens
gatttcatttcaactgtttgc

SEQ ID NO: 6227516 - DNA, 18 bp, Homo sapiens
gatttccaagaatcggca

SEQ ID NO: 6227517 - DNA, 22 bp, Homo sapiens
gatttccagaaccacacttgaa

SEQ ID NO: 6227518 - DNA, 17 bp, Homo sapiens
gatttccaggcccctga

SEQ ID NO: 6227519 - DNA, 18 bp, Homo sapiens
gatttccaggcccctgag

SEQ ID NO: 6227520 - DNA, 22 bp, Homo sapiens
gatttccagtttttctttactt

SEQ ID NO: 6227521 - DNA, 15 bp, Homo sapiens
gatttccatccaaac

SEQ ID NO: 6227522 - DNA, 23 bp, Homo sapiens
gatttccatccaaacctacctta

SEQ ID NO: 6227523 - DNA, 15 bp, Homo sapiens
gatttccatttgcaa

SEQ ID NO: 6227524 - DNA, 20 bp, Homo sapiens
gatttcccactgcactccag

SEQ ID NO: 6227525 - DNA, 21 bp, Homo sapiens
gatttcccccctccgcctcca

SEQ ID NO: 6227526 - DNA, 19 bp, Homo sapiens
gatttccccttttgcattc

SEQ ID NO: 6227527 - DNA, 11 bp, Homo sapiens
gatttccctgc

SEQ ID NO: 6227528 - DNA, 19 bp, Homo sapiens
gatttcccttcatttaaac

SEQ ID NO: 6227529 - DNA, 22 bp, Homo sapiens
gatttcccttcatttaaactaa

SEQ ID NO: 6227530 - DNA, 22 bp, Homo sapiens
gatttcccttcttctgtcatct

SEQ ID NO: 6227531 - DNA, 20 bp, Homo sapiens
gatttcccttttttcttccc

SEQ ID NO: 6227532 - DNA, 15 bp, Homo sapiens
gatttccgttaaaat

SEQ ID NO: 6227533 - DNA, 14 bp, Homo sapiens
gatttcctaaacat

SEQ ID NO: 6227534 - DNA, 15 bp, Homo sapiens
gatttcctaaacata

SEQ ID NO: 6227535 - DNA, 12 bp, Homo sapiens
gatttcctaagc

SEQ ID NO: 6227536 - DNA, 22 bp, Homo sapiens
gatttcctacagaaatactgct

SEQ ID NO: 6227537 - DNA, 16 bp, Homo sapiens
gatttcctattttaaa

SEQ ID NO: 6227538 - DNA, 19 bp, Homo sapiens
gatttcctattttaaaacc

SEQ ID NO: 6227539 - DNA, 20 bp, Homo sapiens
gatttcctattttaaaacca

SEQ ID NO: 6227540 - DNA, 13 bp, Homo sapiens
gatttcctggagt

SEQ ID NO: 6227541 - DNA, 21 bp, Homo sapiens
gatttcctggagtgccctgca

SEQ ID NO: 6227542 - DNA, 13 bp, Homo sapiens
gatttcctgtgtc

SEQ ID NO: 6227543 - DNA, 13 bp, Homo sapiens
gatttccttgaat

SEQ ID NO: 6227544 - DNA, 17 bp, Homo sapiens
gatttccttgaatgtgg

SEQ ID NO: 6227545 - DNA, 18 bp, Homo sapiens
gatttcctttatactgtg

SEQ ID NO: 6227546 - DNA, 22 bp, Homo sapiens
gatttcctttatactgtgaagt

SEQ ID NO: 6227547 - DNA, 22 bp, Homo sapiens
gatttctaacagtccttgcttt

SEQ ID NO: 6227548 - DNA, 20 bp, Homo sapiens
gatttctaagttaaatcatt

SEQ ID NO: 6227549 - DNA, 22 bp, Homo sapiens
gatttctaagttaaatcatttt

SEQ ID NO: 6227550 - DNA, 10 bp, Homo sapiens
gatttctaat

SEQ ID NO: 6227551 - DNA, 22 bp, Homo sapiens
gatttctaattgtaagtgaaat

SEQ ID NO: 6227552 - DNA, 17 bp, Homo sapiens
gatttctagaaaagctt

SEQ ID NO: 6227553 - DNA, 20 bp, Homo sapiens
gatttctagaaaagcttcct

SEQ ID NO: 6227554 - DNA, 18 bp, Homo sapiens
gatttctagaatggtttt

SEQ ID NO: 6227555 - DNA, 17 bp, Homo sapiens
gatttctagcaggcagg

SEQ ID NO: 6227556 - DNA, 17 bp, Homo sapiens
gatttctagtgtatact

SEQ ID NO: 6227557 - DNA, 20 bp, Homo sapiens
gatttctagttatttattct

SEQ ID NO: 6227558 - DNA, 17 bp, Homo sapiens
gatttctatggctttca

SEQ ID NO: 6227559 - DNA, 23 bp, Homo sapiens
gatttctatggctttcaaagcta

SEQ ID NO: 6227560 - DNA, 16 bp, Homo sapiens
gatttctcattgactt

SEQ ID NO: 6227561 - DNA, 17 bp, Homo sapiens
gatttctccagaaattt

SEQ ID NO: 6227562 - DNA, 14 bp, Homo sapiens
gatttctctgaaca

SEQ ID NO: 6227563 - DNA, 18 bp, Homo sapiens
gatttctcttgggcaggc

SEQ ID NO: 6227564 - DNA, 17 bp, Homo sapiens
gatttctgcaggttctt

SEQ ID NO: 6227565 - DNA, 16 bp, Homo sapiens
gatttctgccttcctt

SEQ ID NO: 6227566 - DNA, 17 bp, Homo sapiens
gatttctgctccaaatt

SEQ ID NO: 6227567 - DNA, 16 bp, Homo sapiens
gatttctggttctgat

SEQ ID NO: 6227568 - DNA, 20 bp, Homo sapiens
gatttctgtgaagttgaata

SEQ ID NO: 6227569 - DNA, 23 bp, Homo sapiens
gatttctgtgccattttctgtaa

SEQ ID NO: 6227570 - DNA, 22 bp, Homo sapiens
gatttctgtttagataatacac

SEQ ID NO: 6227571 - DNA, 15 bp, Homo sapiens
gatttcttaatgtct

SEQ ID NO: 6227572 - DNA, 15 bp, Homo sapiens
gatttcttagagatt

SEQ ID NO: 6227573 - DNA, 20 bp, Homo sapiens
gatttcttattttcttggaa

SEQ ID NO: 6227574 - DNA, 19 bp, Homo sapiens
gatttcttcgctgctctag

SEQ ID NO: 6227575 - DNA, 13 bp, Homo sapiens
gatttcttgcttt

SEQ ID NO: 6227576 - DNA, 17 bp, Homo sapiens
gatttctttgaaaaaaa

SEQ ID NO: 6227577 - DNA, 16 bp, Homo sapiens
gatttctttgaatgta

SEQ ID NO: 6227578 - DNA, 19 bp, Homo sapiens
gatttctttgctgtaagat

SEQ ID NO: 6227579 - DNA, 18 bp, Homo sapiens
gatttgaaaagaatttgt

SEQ ID NO: 6227580 - DNA, 12 bp, Homo sapiens
gatttgaaaatt

SEQ ID NO: 6227581 - DNA, 19 bp, Homo sapiens
gatttgaaacttggtgtgt

SEQ ID NO: 6227582 - DNA, 20 bp, Homo sapiens
gatttgaacacttggtgctg

SEQ ID NO: 6227583 - DNA, 22 bp, Homo sapiens
gatttgaactcagatctgtctg

SEQ ID NO: 6227584 - DNA, 13 bp, Homo sapiens
gatttgaactgag

SEQ ID NO: 6227585 - DNA, 19 bp, Homo sapiens
gatttgaagaacatgtgag

SEQ ID NO: 6227586 - DNA, 20 bp, Homo sapiens
gatttgaagaacatgtgaga

SEQ ID NO: 6227587 - DNA, 13 bp, Homo sapiens
gatttgaatccag

SEQ ID NO: 6227588 - DNA, 14 bp, Homo sapiens
gatttgactgtttt

SEQ ID NO: 6227589 - DNA, 21 bp, Homo sapiens
gatttgactgtttttacccat

SEQ ID NO: 6227590 - DNA, 16 bp, Homo sapiens
gatttgagctcagccc

SEQ ID NO: 6227591 - DNA, 18 bp, Homo sapiens
gatttgagtccattgcaa

SEQ ID NO: 6227592 - DNA, 19 bp, Homo sapiens
gatttgagtttcctttaaa

SEQ ID NO: 6227593 - DNA, 20 bp, Homo sapiens
gatttgatatacagacctcc

SEQ ID NO: 6227594 - DNA, 22 bp, Homo sapiens
gatttgatatacagacctccag

SEQ ID NO: 6227595 - DNA, 17 bp, Homo sapiens
gatttgatatatgtatc

SEQ ID NO: 6227596 - DNA, 17 bp, Homo sapiens
gatttgatatttgcatt

SEQ ID NO: 6227597 - DNA, 13 bp, Homo sapiens
gatttgatctttg

SEQ ID NO: 6227598 - DNA, 14 bp, Homo sapiens
gatttgatctttgt

SEQ ID NO: 6227599 - DNA, 22 bp, Homo sapiens
gatttgatctttgtttaaatgc

SEQ ID NO: 6227600 - DNA, 19 bp, Homo sapiens
gatttgatgagttaactgt

SEQ ID NO: 6227601 - DNA, 23 bp, Homo sapiens
gatttgatgagttaactgtgaaa

SEQ ID NO: 6227602 - DNA, 21 bp, Homo sapiens
gatttgatgctggagaggtta

SEQ ID NO: 6227603 - DNA, 15 bp, Homo sapiens
gatttgatgcttttc

SEQ ID NO: 6227604 - DNA, 16 bp, Homo sapiens
gatttgattcattttc

SEQ ID NO: 6227605 - DNA, 23 bp, Homo sapiens
gatttgcaaataaaggctctgga

SEQ ID NO: 6227606 - DNA, 17 bp, Homo sapiens
gatttgcaacactgcca

SEQ ID NO: 6227607 - DNA, 12 bp, Homo sapiens
gatttgcaactt

SEQ ID NO: 6227608 - DNA, 11 bp, Homo sapiens
gatttgcaata

SEQ ID NO: 6227609 - DNA, 20 bp, Homo sapiens
gatttgcaggattcccttct

SEQ ID NO: 6227610 - DNA, 20 bp, Homo sapiens
gatttgcatttcagaatatt

SEQ ID NO: 6227611 - DNA, 15 bp, Homo sapiens
gatttgccaaaaact

SEQ ID NO: 6227612 - DNA, 23 bp, Homo sapiens
gatttgccaaaaactaaaattca

SEQ ID NO: 6227613 - DNA, 18 bp, Homo sapiens
gatttgccacatcttaaa

SEQ ID NO: 6227614 - DNA, 17 bp, Homo sapiens
gatttgccatagagtac

SEQ ID NO: 6227615 - DNA, 21 bp, Homo sapiens
gatttgctaataatgttcacg

SEQ ID NO: 6227616 - DNA, 18 bp, Homo sapiens
gatttgctatcaaaataa

SEQ ID NO: 6227617 - DNA, 21 bp, Homo sapiens
gatttgctgggcagtttttct

SEQ ID NO: 6227618 - DNA, 12 bp, Homo sapiens
gatttggaaaat

SEQ ID NO: 6227619 - DNA, 23 bp, Homo sapiens
gatttggaagagaggcacctgct

SEQ ID NO: 6227620 - DNA, 15 bp, Homo sapiens
gatttggaattgaac

SEQ ID NO: 6227621 - DNA, 15 bp, Homo sapiens
gatttggactcgaaa

SEQ ID NO: 6227622 - DNA, 20 bp, Homo sapiens
gatttggagactttgttcct

SEQ ID NO: 6227623 - DNA, 18 bp, Homo sapiens
gatttggagatgtctctg

SEQ ID NO: 6227624 - DNA, 19 bp, Homo sapiens
gatttggatcaaaaggaga

SEQ ID NO: 6227625 - DNA, 15 bp, Homo sapiens
gaattgaaagagaat

SEQ ID NO: 6227626 - DNA, 21 bp, Homo sapiens
gaattgaaataaggagggaca

SEQ ID NO: 6227627 - DNA, 16 bp, Homo sapiens
gaattgaacccaggag

SEQ ID NO: 6227628 - DNA, 16 bp, Homo sapiens
gaattgaactctctgc

SEQ ID NO: 6227629 - DNA, 15 bp, Homo sapiens
gaattgaagatgtaa

SEQ ID NO: 6227630 - DNA, 19 bp, Homo sapiens
gaattgaaggagaaaatgc

SEQ ID NO: 6227631 - DNA, 19 bp, Homo sapiens
gaattgaagtcatcataaa

SEQ ID NO: 6227632 - DNA, 24 bp, Homo sapiens
gaattgacagttgaacagagctag

SEQ ID NO: 6227633 - DNA, 15 bp, Homo sapiens
gaattgacattctct

SEQ ID NO: 6227634 - DNA, 16 bp, Homo sapiens
gaattgacattgaaat

SEQ ID NO: 6227635 - DNA, 16 bp, Homo sapiens
gaattgacccacaaga

SEQ ID NO: 6227636 - DNA, 21 bp, Homo sapiens
gaattgacccacaagaaatga

SEQ ID NO: 6227637 - DNA, 15 bp, Homo sapiens
gaattgactgcagtt

SEQ ID NO: 6227638 - DNA, 15 bp, Homo sapiens
gaattgagaaaagag

SEQ ID NO: 6227639 - DNA, 19 bp, Homo sapiens
gaattgagaataagaattt

SEQ ID NO: 6227640 - DNA, 19 bp, Homo sapiens
gaattgagaggtgggggat

SEQ ID NO: 6227641 - DNA, 23 bp, Homo sapiens
gaattgagaggtgggggatgctg

SEQ ID NO: 6227642 - DNA, 17 bp, Homo sapiens
gaattgagatgattaaa

SEQ ID NO: 6227643 - DNA, 19 bp, Homo sapiens
gaattgagcctaaaaataa

SEQ ID NO: 6227644 - DNA, 20 bp, Homo sapiens
gaattgaggggaggtggcca

SEQ ID NO: 6227645 - DNA, 21 bp, Homo sapiens
gaattgaggggaggtggccag

SEQ ID NO: 6227646 - DNA, 23 bp, Homo sapiens
gaattgataataaactgtcctct

SEQ ID NO: 6227647 - DNA, 20 bp, Homo sapiens
gaattgatcattttcccccc

SEQ ID NO: 6227648 - DNA, 17 bp, Homo sapiens
gaattgatgatgcagtt

SEQ ID NO: 6227649 - DNA, 15 bp, Homo sapiens
gaattgattcatgtt

SEQ ID NO: 6227650 - DNA, 21 bp, Homo sapiens
gaattgattcatgttcatcaa

SEQ ID NO: 6227651 - DNA, 18 bp, Homo sapiens
gaattgatttgcattgaa

SEQ ID NO: 6227652 - DNA, 23 bp, Homo sapiens
gaattgattttgaggagtggttt

SEQ ID NO: 6227653 - DNA, 16 bp, Homo sapiens
gaattgcattagtcca

SEQ ID NO: 6227654 - DNA, 21 bp, Homo sapiens
gaattgcattttttaaaacaa

SEQ ID NO: 6227655 - DNA, 18 bp, Homo sapiens
gaattgccagtcttttgt

SEQ ID NO: 6227656 - DNA, 21 bp, Homo sapiens
gaattgcccattgtttttctg

SEQ ID NO: 6227657 - DNA, 16 bp, Homo sapiens
gaattgcctgcagaga

SEQ ID NO: 6227658 - DNA, 21 bp, Homo sapiens
gaattgcctgcagagagaagc

SEQ ID NO: 6227659 - DNA, 15 bp, Homo sapiens
gaattgcctgccatg

SEQ ID NO: 6227660 - DNA, 14 bp, Homo sapiens
gaattgcgctcagg

SEQ ID NO: 6227661 - DNA, 15 bp, Homo sapiens
gaattgcgttggtct

SEQ ID NO: 6227662 - DNA, 15 bp, Homo sapiens
gaattgctgctctct

SEQ ID NO: 6227663 - DNA, 16 bp, Homo sapiens
gaattgcttctgtgta

SEQ ID NO: 6227664 - DNA, 24 bp, Homo sapiens
gaattgcttgtttgcttcaactgt

SEQ ID NO: 6227665 - DNA, 17 bp, Homo sapiens
gaattgctttctgctct

SEQ ID NO: 6227666 - DNA, 15 bp, Homo sapiens
gaattgcttttatca

SEQ ID NO: 6227667 - DNA, 21 bp, Homo sapiens
gaattggaaagacttctcaaa

SEQ ID NO: 6227668 - DNA, 17 bp, Homo sapiens
gaattggaagggaaaaa

SEQ ID NO: 6227669 - DNA, 21 bp, Homo sapiens
gaattggaggtaggaagggga

SEQ ID NO: 6227670 - DNA, 22 bp, Homo sapiens
gaattggcaaacccactgcagc

SEQ ID NO: 6227671 - DNA, 15 bp, Homo sapiens
gaattggcataattt

SEQ ID NO: 6227672 - DNA, 17 bp, Homo sapiens
gaattggcataatttgt

SEQ ID NO: 6227673 - DNA, 16 bp, Homo sapiens
gaattggccatcttaa

SEQ ID NO: 6227674 - DNA, 20 bp, Homo sapiens
gaattggcttccagatttta

SEQ ID NO: 6227675 - DNA, 15 bp, Homo sapiens
gaattggcttccttg

SEQ ID NO: 6227676 - DNA, 17 bp, Homo sapiens
gaattgggagcttggga

SEQ ID NO: 6227677 - DNA, 16 bp, Homo sapiens
gaattgggcggctctg

SEQ ID NO: 6227678 - DNA, 20 bp, Homo sapiens
gaattgggcggctctgaagc

SEQ ID NO: 6227679 - DNA, 17 bp, Homo sapiens
gaattggggagggagaa

SEQ ID NO: 6227680 - DNA, 22 bp, Homo sapiens
gaattggggattgagttgtaaa

SEQ ID NO: 6227681 - DNA, 13 bp, Homo sapiens
gaattggtgaata

SEQ ID NO: 6227682 - DNA, 15 bp, Homo sapiens
gaattggtgaataaa

SEQ ID NO: 6227683 - DNA, 19 bp, Homo sapiens
gaattggtttaaactttta

SEQ ID NO: 6227684 - DNA, 16 bp, Homo sapiens
gaattgtaactgttct

SEQ ID NO: 6227685 - DNA, 12 bp, Homo sapiens
gaattgtacaga

SEQ ID NO: 6227686 - DNA, 22 bp, Homo sapiens
gaattgtacctatttctgatga

SEQ ID NO: 6227687 - DNA, 23 bp, Homo sapiens
gaattgtacctatttctgatgat

SEQ ID NO: 6227688 - DNA, 16 bp, Homo sapiens
gaattgtagaattgtt

SEQ ID NO: 6227689 - DNA, 21 bp, Homo sapiens
gaattgtagttcttagtccca

SEQ ID NO: 6227690 - DNA, 14 bp, Homo sapiens
gaattgtatcattt

SEQ ID NO: 6227691 - DNA, 16 bp, Homo sapiens
gaattgtcaaatgatg

SEQ ID NO: 6227692 - DNA, 15 bp, Homo sapiens
gaattgtccttttct

SEQ ID NO: 6227693 - DNA, 14 bp, Homo sapiens
gaattgtctctggg

SEQ ID NO: 6227694 - DNA, 13 bp, Homo sapiens
gaattgtctttta

SEQ ID NO: 6227695 - DNA, 18 bp, Homo sapiens
gaattgtgaccaagttat

SEQ ID NO: 6227696 - DNA, 12 bp, Homo sapiens
gaattgtgcaaa

SEQ ID NO: 6227697 - DNA, 22 bp, Homo sapiens
gaattgtggaaggattgtaaca

SEQ ID NO: 6227698 - DNA, 12 bp, Homo sapiens
gaattgtggcta

SEQ ID NO: 6227699 - DNA, 23 bp, Homo sapiens
gaattgtgtttataattttaaat

SEQ ID NO: 6227700 - DNA, 16 bp, Homo sapiens
gaattgttatgaaaat

SEQ ID NO: 6227701 - DNA, 19 bp, Homo sapiens
gaattgttgaatgtattct

SEQ ID NO: 6227702 - DNA, 22 bp, Homo sapiens
gaattgttgacaaatgtaaaca

SEQ ID NO: 6227703 - DNA, 22 bp, Homo sapiens
gaattgtttttagaaatttatt

SEQ ID NO: 6227704 - DNA, 16 bp, Homo sapiens
gaattgtttttataaa

SEQ ID NO: 6227705 - DNA, 17 bp, Homo sapiens
gaattgtttttataaaa

SEQ ID NO: 6227706 - DNA, 17 bp, Homo sapiens
gaattgtttttgtacag

SEQ ID NO: 6227707 - DNA, 18 bp, Homo sapiens
gaatttaaaaataagaaa

SEQ ID NO: 6227708 - DNA, 20 bp, Homo sapiens
gaatttaaaattaagtagaa

SEQ ID NO: 6227709 - DNA, 18 bp, Homo sapiens
gaatttaaagacaaaaat

SEQ ID NO: 6227710 - DNA, 12 bp, Homo sapiens
gaatttaaataa

SEQ ID NO: 6227711 - DNA, 13 bp, Homo sapiens
gaatttaaataaa

SEQ ID NO: 6227712 - DNA, 20 bp, Homo sapiens
gaatttaaatataattctgt

SEQ ID NO: 6227713 - DNA, 22 bp, Homo sapiens
gaatttaaatataattctgtaa

SEQ ID NO: 6227714 - DNA, 16 bp, Homo sapiens
gaatttaaatcactca

SEQ ID NO: 6227715 - DNA, 22 bp, Homo sapiens
gaatttaacaatgcgaatggta

SEQ ID NO: 6227716 - DNA, 16 bp, Homo sapiens
gaatttaagaatttgt

SEQ ID NO: 6227717 - DNA, 16 bp, Homo sapiens
gaatttaagctgtaaa

SEQ ID NO: 6227718 - DNA, 13 bp, Homo sapiens
gaatttaaggcaa

SEQ ID NO: 6227719 - DNA, 16 bp, Homo sapiens
gaatttaataatctgt

SEQ ID NO: 6227720 - DNA, 15 bp, Homo sapiens
gaatttaatatatat

SEQ ID NO: 6227721 - DNA, 19 bp, Homo sapiens
gaatttaatggactgtgaa

SEQ ID NO: 6227722 - DNA, 22 bp, Homo sapiens
gaatttaatggactgtgaattt

SEQ ID NO: 6227723 - DNA, 14 bp, Homo sapiens
gaatttaattaatc

SEQ ID NO: 6227724 - DNA, 17 bp, Homo sapiens
gaatttaatttttaaaa

SEQ ID NO: 6227725 - DNA, 17 bp, Homo sapiens
gaatttaccagaaatat

SEQ ID NO: 6227726 - DNA, 18 bp, Homo sapiens
gaatttaccagaaatatt

SEQ ID NO: 6227727 - DNA, 20 bp, Homo sapiens
gaatttaccagaaatatttg

SEQ ID NO: 6227728 - DNA, 22 bp, Homo sapiens
gaatttaccagaaatatttgct

SEQ ID NO: 6227729 - DNA, 16 bp, Homo sapiens
gaatttactggacata

SEQ ID NO: 6227730 - DNA, 20 bp, Homo sapiens
gaatttagccctggtttgaa

SEQ ID NO: 6227731 - DNA, 16 bp, Homo sapiens
gaatttaggtttttat

SEQ ID NO: 6227732 - DNA, 19 bp, Homo sapiens
gaatttagtcacaccatct

SEQ ID NO: 6227733 - DNA, 14 bp, Homo sapiens
gaatttagtcatta

SEQ ID NO: 6227734 - DNA, 13 bp, Homo sapiens
gaatttataacaa

SEQ ID NO: 6227735 - DNA, 15 bp, Homo sapiens
gaatttataacaaat

SEQ ID NO: 6227736 - DNA, 18 bp, Homo sapiens
gaatttataattcagtat

SEQ ID NO: 6227737 - DNA, 13 bp, Homo sapiens
gaatttatacctc

SEQ ID NO: 6227738 - DNA, 20 bp, Homo sapiens
gaatttatataaagtatttt

SEQ ID NO: 6227739 - DNA, 22 bp, Homo sapiens
gaatttatatacaacctgcttg

SEQ ID NO: 6227740 - DNA, 22 bp, Homo sapiens
gaatttatcacacttctgtgag

SEQ ID NO: 6227741 - DNA, 19 bp, Homo sapiens
gaatttatctttaccaaaa

SEQ ID NO: 6227742 - DNA, 23 bp, Homo sapiens
gaatttatgtgaaatgctttctg

SEQ ID NO: 6227743 - DNA, 22 bp, Homo sapiens
gaatttattagtttaaaatgca

SEQ ID NO: 6227744 - DNA, 11 bp, Homo sapiens
gaatttattat

SEQ ID NO: 6227745 - DNA, 19 bp, Homo sapiens
gaatttattgcacattgtt

SEQ ID NO: 6227746 - DNA, 22 bp, Homo sapiens
gaatttattggcttttctgatc

SEQ ID NO: 6227747 - DNA, 14 bp, Homo sapiens
gaatttatttatgt

SEQ ID NO: 6227748 - DNA, 15 bp, Homo sapiens
gaatttatttatgtt

SEQ ID NO: 6227749 - DNA, 19 bp, Homo sapiens
gaatttatttatgttctca

SEQ ID NO: 6227750 - DNA, 12 bp, Homo sapiens
gaatttcacaag

SEQ ID NO: 6227751 - DNA, 12 bp, Homo sapiens
gaatttcactgt

SEQ ID NO: 6227752 - DNA, 15 bp, Homo sapiens
gaatttcactgtctt

SEQ ID NO: 6227753 - DNA, 17 bp, Homo sapiens
gaatttcagtataaaga

SEQ ID NO: 6227754 - DNA, 17 bp, Homo sapiens
gaatttccattgacatt

SEQ ID NO: 6227755 - DNA, 16 bp, Homo sapiens
gaatttcccaggaccc

SEQ ID NO: 6227756 - DNA, 19 bp, Homo sapiens
gaatttcctcccaattcat

SEQ ID NO: 6227757 - DNA, 17 bp, Homo sapiens
gaatttctaaaaaacag

SEQ ID NO: 6227758 - DNA, 15 bp, Homo sapiens
gaatttctaaagtaa

SEQ ID NO: 6227759 - DNA, 19 bp, Homo sapiens
gaatttctaaagtaaaatt

SEQ ID NO: 6227760 - DNA, 23 bp, Homo sapiens
gaatttctaaagtaaaattgaag

SEQ ID NO: 6227761 - DNA, 19 bp, Homo sapiens
gaatttctaggactgaatt

SEQ ID NO: 6227762 - DNA, 20 bp, Homo sapiens
gaatttctatagactgactt

SEQ ID NO: 6227763 - DNA, 17 bp, Homo sapiens
gaatttctgatttcact

SEQ ID NO: 6227764 - DNA, 18 bp, Homo sapiens
gaatttctggaagaaagg

SEQ ID NO: 6227765 - DNA, 16 bp, Homo sapiens
gaatttctggcctcct

SEQ ID NO: 6227766 - DNA, 13 bp, Homo sapiens
gaatttctggttt

SEQ ID NO: 6227767 - DNA, 15 bp, Homo sapiens
gaatttcttaacttc

SEQ ID NO: 6227768 - DNA, 16 bp, Homo sapiens
gaatttcttaacttct

SEQ ID NO: 6227769 - DNA, 17 bp, Homo sapiens
gaatttcttaacttctt

SEQ ID NO: 6227770 - DNA, 21 bp, Homo sapiens
gaatttcttaacttcttgctt

SEQ ID NO: 6227771 - DNA, 21 bp, Homo sapiens
gaatttcttcaactccctgcc

SEQ ID NO: 6227772 - DNA, 19 bp, Homo sapiens
gaatttcttcactgttgaa

SEQ ID NO: 6227773 - DNA, 17 bp, Homo sapiens
gaatttcttcttttcct

SEQ ID NO: 6227774 - DNA, 22 bp, Homo sapiens
gaatttcttttccttcattcat

SEQ ID NO: 6227775 - DNA, 15 bp, Homo sapiens
gaatttgaaaggaaa

SEQ ID NO: 6227776 - DNA, 22 bp, Homo sapiens
gaatttgaaatggttgtcacct

SEQ ID NO: 6227777 - DNA, 14 bp, Homo sapiens
gaatttgaagaatt

SEQ ID NO: 6227778 - DNA, 14 bp, Homo sapiens
gaatttgaagagat

SEQ ID NO: 6227779 - DNA, 14 bp, Homo sapiens
gaatttgaatctca

SEQ ID NO: 6227780 - DNA, 16 bp, Homo sapiens
gaatttgaatctcaat

SEQ ID NO: 6227781 - DNA, 16 bp, Homo sapiens
gaatttgaatgaaaaa

SEQ ID NO: 6227782 - DNA, 17 bp, Homo sapiens
gaatttgaatgaaaaat

SEQ ID NO: 6227783 - DNA, 22 bp, Homo sapiens
gaatttgacctaggcaagtttg

SEQ ID NO: 6227784 - DNA, 14 bp, Homo sapiens
gaatttgactggtt

SEQ ID NO: 6227785 - DNA, 16 bp, Homo sapiens
gaatttgattgctttg

SEQ ID NO: 6227786 - DNA, 17 bp, Homo sapiens
gaatttgattgctttgc

SEQ ID NO: 6227787 - DNA, 16 bp, Homo sapiens
gaatttgcaacagtaa

SEQ ID NO: 6227788 - DNA, 18 bp, Homo sapiens
gaatttgcatccagcagc

SEQ ID NO: 6227789 - DNA, 13 bp, Homo sapiens
gaatttgccagag

SEQ ID NO: 6227790 - DNA, 12 bp, Homo sapiens
gaatttgctaaa

SEQ ID NO: 6227791 - DNA, 19 bp, Homo sapiens
gaatttggagactctgtgg

SEQ ID NO: 6227792 - DNA, 18 bp, Homo sapiens
gaatttggatacactctc

SEQ ID NO: 6227793 - DNA, 14 bp, Homo sapiens
gaatttggcccaga

SEQ ID NO: 6227794 - DNA, 19 bp, Homo sapiens
gaatttgggaccctgcttt

SEQ ID NO: 6227795 - DNA, 20 bp, Homo sapiens
gaatttgggaccctgcttta

SEQ ID NO: 6227796 - DNA, 23 bp, Homo sapiens
gaatttgggaccctgctttagag

SEQ ID NO: 6227797 - DNA, 23 bp, Homo sapiens
gaatttgggagaagcaaatatag

SEQ ID NO: 6227798 - DNA, 21 bp, Homo sapiens
gaatttggggctacttatatt

SEQ ID NO: 6227799 - DNA, 17 bp, Homo sapiens
gaatttggtacacatgt

SEQ ID NO: 6227800 - DNA, 17 bp, Homo sapiens
gaatttgtaacctcagc

SEQ ID NO: 6227801 - DNA, 22 bp, Homo sapiens
gaatttgtaagtttatgtctaa

SEQ ID NO: 6227802 - DNA, 12 bp, Homo sapiens
gaatttgtactt

SEQ ID NO: 6227803 - DNA, 23 bp, Homo sapiens
gatttggcaggatcggcttcctc

SEQ ID NO: 6227804 - DNA, 20 bp, Homo sapiens
gatttggccacactggggct

SEQ ID NO: 6227805 - DNA, 22 bp, Homo sapiens
gatttggccacactggggctga

SEQ ID NO: 6227806 - DNA, 15 bp, Homo sapiens
gatttggccaggcct

SEQ ID NO: 6227807 - DNA, 16 bp, Homo sapiens
gatttggccaggccta

SEQ ID NO: 6227808 - DNA, 13 bp, Homo sapiens
gatttggctggtg

SEQ ID NO: 6227809 - DNA, 20 bp, Homo sapiens
gatttggcttgacaaaggca

SEQ ID NO: 6227810 - DNA, 15 bp, Homo sapiens
gatttgggagaaggg

SEQ ID NO: 6227811 - DNA, 17 bp, Homo sapiens
gatttgggagctctgct

SEQ ID NO: 6227812 - DNA, 20 bp, Homo sapiens
gatttgggctctagaattcc

SEQ ID NO: 6227813 - DNA, 19 bp, Homo sapiens
gatttgggctgaatgtatg

SEQ ID NO: 6227814 - DNA, 12 bp, Homo sapiens
gatttgggctgg

SEQ ID NO: 6227815 - DNA, 18 bp, Homo sapiens
gatttgggggctcgggga

SEQ ID NO: 6227816 - DNA, 20 bp, Homo sapiens
gatttgggggctcggggagg

SEQ ID NO: 6227817 - DNA, 16 bp, Homo sapiens
gatttggggggggagg

SEQ ID NO: 6227818 - DNA, 16 bp, Homo sapiens
gatttggggtgatttc

SEQ ID NO: 6227819 - DNA, 17 bp, Homo sapiens
gatttggggtgttacag

SEQ ID NO: 6227820 - DNA, 17 bp, Homo sapiens
gatttgggtttttttgt

SEQ ID NO: 6227821 - DNA, 22 bp, Homo sapiens
gatttggtacttttgagtgtgt

SEQ ID NO: 6227822 - DNA, 22 bp, Homo sapiens
gatttggtcaacactaacatga

SEQ ID NO: 6227823 - DNA, 23 bp, Homo sapiens
gatttggtcagaatgcagttgtt

SEQ ID NO: 6227824 - DNA, 18 bp, Homo sapiens
gatttggtgaatttgaat

SEQ ID NO: 6227825 - DNA, 15 bp, Homo sapiens
gatttggttgcactt

SEQ ID NO: 6227826 - DNA, 12 bp, Homo sapiens
gatttggttttt

SEQ ID NO: 6227827 - DNA, 14 bp, Homo sapiens
gatttgtaacatta

SEQ ID NO: 6227828 - DNA, 16 bp, Homo sapiens
gatttgtaccattcct

SEQ ID NO: 6227829 - DNA, 19 bp, Homo sapiens
gatttgtactacagttctt

SEQ ID NO: 6227830 - DNA, 16 bp, Homo sapiens
gatttgtagcactgag

SEQ ID NO: 6227831 - DNA, 22 bp, Homo sapiens
gatttgtagcataactgtagct

SEQ ID NO: 6227832 - DNA, 21 bp, Homo sapiens
gatttgtaggaaggtctcatt

SEQ ID NO: 6227833 - DNA, 15 bp, Homo sapiens
gatttgtatttatat

SEQ ID NO: 6227834 - DNA, 16 bp, Homo sapiens
gatttgtatttatatt

SEQ ID NO: 6227835 - DNA, 22 bp, Homo sapiens
gatttgtatttatattagagtg

SEQ ID NO: 6227836 - DNA, 16 bp, Homo sapiens
gatttgtccaaacagg

SEQ ID NO: 6227837 - DNA, 17 bp, Homo sapiens
gatttgtcccagaattt

SEQ ID NO: 6227838 - DNA, 16 bp, Homo sapiens
gatttgtcccagcctg

SEQ ID NO: 6227839 - DNA, 21 bp, Homo sapiens
gatttgtcccagcctggggct

SEQ ID NO: 6227840 - DNA, 21 bp, Homo sapiens
gatttgtccttggggacatct

SEQ ID NO: 6227841 - DNA, 14 bp, Homo sapiens
gatttgtcttccct

SEQ ID NO: 6227842 - DNA, 18 bp, Homo sapiens
gatttgtcttcccttctt

SEQ ID NO: 6227843 - DNA, 21 bp, Homo sapiens
gatttgtcttcccttctttgc

SEQ ID NO: 6227844 - DNA, 18 bp, Homo sapiens
gatttgtgaaataaaaca

SEQ ID NO: 6227845 - DNA, 22 bp, Homo sapiens
gatttgtgaactggaagaaagc

SEQ ID NO: 6227846 - DNA, 17 bp, Homo sapiens
gatttgtgcccattcct

SEQ ID NO: 6227847 - DNA, 18 bp, Homo sapiens
gatttgtgtttctttata

SEQ ID NO: 6227848 - DNA, 18 bp, Homo sapiens
gatttgtgttttacagta

SEQ ID NO: 6227849 - DNA, 19 bp, Homo sapiens
gatttgtgttttacagtat

SEQ ID NO: 6227850 - DNA, 14 bp, Homo sapiens
gatttgttttagaa

SEQ ID NO: 6227851 - DNA, 23 bp, Homo sapiens
gatttgttttcttcaacatgtgt

SEQ ID NO: 6227852 - DNA, 16 bp, Homo sapiens
gatttgtttttaaact

SEQ ID NO: 6227853 - DNA, 21 bp, Homo sapiens
gattttaaaaaatcaatcaat

SEQ ID NO: 6227854 - DNA, 24 bp, Homo sapiens
gattttaaaaaccagtcaagagca

SEQ ID NO: 6227855 - DNA, 20 bp, Homo sapiens
gattttaaaaatacattttt

SEQ ID NO: 6227856 - DNA, 21 bp, Homo sapiens
gattttaaaagttttgttctt

SEQ ID NO: 6227857 - DNA, 12 bp, Homo sapiens
gattttaaaatg

SEQ ID NO: 6227858 - DNA, 21 bp, Homo sapiens
gattttaaaatgacttttatt

SEQ ID NO: 6227859 - DNA, 23 bp, Homo sapiens
gattttaaaccataaaaagctga

SEQ ID NO: 6227860 - DNA, 13 bp, Homo sapiens
gattttaaactag

SEQ ID NO: 6227861 - DNA, 23 bp, Homo sapiens
gattttaaactagatgacctcat

SEQ ID NO: 6227862 - DNA, 21 bp, Homo sapiens
gattttaaatgcaaattaaag

SEQ ID NO: 6227863 - DNA, 21 bp, Homo sapiens
gattttaaattcacaatagaa

SEQ ID NO: 6227864 - DNA, 23 bp, Homo sapiens
gattttaacaataactactgtgt

SEQ ID NO: 6227865 - DNA, 14 bp, Homo sapiens
gattttaagaatgg

SEQ ID NO: 6227866 - DNA, 24 bp, Homo sapiens
gattttaagaatggtctcagtgtt

SEQ ID NO: 6227867 - DNA, 18 bp, Homo sapiens
gattttaatcaagttgaa

SEQ ID NO: 6227868 - DNA, 19 bp, Homo sapiens
gattttaatttatttgttt

SEQ ID NO: 6227869 - DNA, 13 bp, Homo sapiens
gattttaattttg

SEQ ID NO: 6227870 - DNA, 21 bp, Homo sapiens
gattttacagagaatctgaag

SEQ ID NO: 6227871 - DNA, 16 bp, Homo sapiens
gattttacatgaagta

SEQ ID NO: 6227872 - DNA, 18 bp, Homo sapiens
gattttacatgtggccca

SEQ ID NO: 6227873 - DNA, 14 bp, Homo sapiens
gattttagataaag

SEQ ID NO: 6227874 - DNA, 15 bp, Homo sapiens
gattttagttttatt

SEQ ID NO: 6227875 - DNA, 19 bp, Homo sapiens
gattttagttttattttct

SEQ ID NO: 6227876 - DNA, 13 bp, Homo sapiens
gattttatacata

SEQ ID NO: 6227877 - DNA, 21 bp, Homo sapiens
gattttatacatagtcacaaa

SEQ ID NO: 6227878 - DNA, 15 bp, Homo sapiens
gattttatattttct

SEQ ID NO: 6227879 - DNA, 19 bp, Homo sapiens
gattttatattttctattt

SEQ ID NO: 6227880 - DNA, 20 bp, Homo sapiens
gattttatctgtgaattcag

SEQ ID NO: 6227881 - DNA, 13 bp, Homo sapiens
gattttatctgtt

SEQ ID NO: 6227882 - DNA, 17 bp, Homo sapiens
gattttatctgttaacc

SEQ ID NO: 6227883 - DNA, 17 bp, Homo sapiens
gattttatgcacagcct

SEQ ID NO: 6227884 - DNA, 18 bp, Homo sapiens
gattttatgcacagccta

SEQ ID NO: 6227885 - DNA, 19 bp, Homo sapiens
gattttatgctttaaacat

SEQ ID NO: 6227886 - DNA, 13 bp, Homo sapiens
gattttatgttga

SEQ ID NO: 6227887 - DNA, 18 bp, Homo sapiens
gattttatgttgacattt

SEQ ID NO: 6227888 - DNA, 16 bp, Homo sapiens
gattttatgtttaaaa

SEQ ID NO: 6227889 - DNA, 20 bp, Homo sapiens
gattttattatgtaaatccc

SEQ ID NO: 6227890 - DNA, 17 bp, Homo sapiens
gattttatttaaactat

SEQ ID NO: 6227891 - DNA, 15 bp, Homo sapiens
gattttatttgacaa

SEQ ID NO: 6227892 - DNA, 18 bp, Homo sapiens
gattttattttcaagcaa

SEQ ID NO: 6227893 - DNA, 17 bp, Homo sapiens
gattttcaaaagataat

SEQ ID NO: 6227894 - DNA, 21 bp, Homo sapiens
gattttcaaatatgtaaactt

SEQ ID NO: 6227895 - DNA, 21 bp, Homo sapiens
gattttcaaccagataacata

SEQ ID NO: 6227896 - DNA, 19 bp, Homo sapiens
gattttcaagattctaaag

SEQ ID NO: 6227897 - DNA, 16 bp, Homo sapiens
gattttcaataataga

SEQ ID NO: 6227898 - DNA, 18 bp, Homo sapiens
gattttcacacattcacg

SEQ ID NO: 6227899 - DNA, 19 bp, Homo sapiens
gattttcagccctcagaat

SEQ ID NO: 6227900 - DNA, 14 bp, Homo sapiens
gattttcataactt

SEQ ID NO: 6227901 - DNA, 16 bp, Homo sapiens
gattttcataacttat

SEQ ID NO: 6227902 - DNA, 16 bp, Homo sapiens
gattttccatctaaaa

SEQ ID NO: 6227903 - DNA, 15 bp, Homo sapiens
gattttcctaaggcc

SEQ ID NO: 6227904 - DNA, 17 bp, Homo sapiens
gattttcctcctttcct

SEQ ID NO: 6227905 - DNA, 21 bp, Homo sapiens
gattttcctgaaacactaaag

SEQ ID NO: 6227906 - DNA, 13 bp, Homo sapiens
gattttcctgtgg

SEQ ID NO: 6227907 - DNA, 18 bp, Homo sapiens
gattttccttttttatac

SEQ ID NO: 6227908 - DNA, 17 bp, Homo sapiens
gattttctactgtaaga

SEQ ID NO: 6227909 - DNA, 22 bp, Homo sapiens
gattttctattgttactctggt

SEQ ID NO: 6227910 - DNA, 13 bp, Homo sapiens
gattttctccagc

SEQ ID NO: 6227911 - DNA, 15 bp, Homo sapiens
gattttctccagctc

SEQ ID NO: 6227912 - DNA, 16 bp, Homo sapiens
gattttctccagctca

SEQ ID NO: 6227913 - DNA, 16 bp, Homo sapiens
gattttctggttctaa

SEQ ID NO: 6227914 - DNA, 21 bp, Homo sapiens
gattttcttaaggaattttgt

SEQ ID NO: 6227915 - DNA, 13 bp, Homo sapiens
gattttcttcttt

SEQ ID NO: 6227916 - DNA, 20 bp, Homo sapiens
gattttctttaaaagaatgg

SEQ ID NO: 6227917 - DNA, 24 bp, Homo sapiens
gattttctttaaaagaatgggcag

SEQ ID NO: 6227918 - DNA, 15 bp, Homo sapiens
gattttcttttgcct

SEQ ID NO: 6227919 - DNA, 14 bp, Homo sapiens
gattttcttttgtt

SEQ ID NO: 6227920 - DNA, 20 bp, Homo sapiens
gattttgaaaaagtaggctg

SEQ ID NO: 6227921 - DNA, 22 bp, Homo sapiens
gattttgaaaaagtaggctgcc

SEQ ID NO: 6227922 - DNA, 13 bp, Homo sapiens
gattttgaaaaat

SEQ ID NO: 6227923 - DNA, 16 bp, Homo sapiens
gattttgaaaactaca

SEQ ID NO: 6227924 - DNA, 21 bp, Homo sapiens
gattttgaaaccatgaagaga

SEQ ID NO: 6227925 - DNA, 21 bp, Homo sapiens
gattttgaaatttttattaaa

SEQ ID NO: 6227926 - DNA, 14 bp, Homo sapiens
gattttgaattaga

SEQ ID NO: 6227927 - DNA, 20 bp, Homo sapiens
gattttgaccttgtattgaa

SEQ ID NO: 6227928 - DNA, 14 bp, Homo sapiens
gattttgagggtgg

SEQ ID NO: 6227929 - DNA, 12 bp, Homo sapiens
gattttgaggtt

SEQ ID NO: 6227930 - DNA, 20 bp, Homo sapiens
gattttgatattttcacaga

SEQ ID NO: 6227931 - DNA, 11 bp, Homo sapiens
gattttgcaaa

SEQ ID NO: 6227932 - DNA, 11 bp, Homo sapiens
gattttgcaca

SEQ ID NO: 6227933 - DNA, 15 bp, Homo sapiens
gattttgccctcctg

SEQ ID NO: 6227934 - DNA, 16 bp, Homo sapiens
gattttggcagggcgg

SEQ ID NO: 6227935 - DNA, 21 bp, Homo sapiens
gattttggggttgtgttgtca

SEQ ID NO: 6227936 - DNA, 18 bp, Homo sapiens
gattttggtttattccct

SEQ ID NO: 6227937 - DNA, 22 bp, Homo sapiens
gattttggttttgttcccctcc

SEQ ID NO: 6227938 - DNA, 15 bp, Homo sapiens
gattttgtaaatgtt

SEQ ID NO: 6227939 - DNA, 18 bp, Homo sapiens
gattttgtaattcttatg

SEQ ID NO: 6227940 - DNA, 13 bp, Homo sapiens
gattttgtacaga

SEQ ID NO: 6227941 - DNA, 16 bp, Homo sapiens
gattttgtacagaatt

SEQ ID NO: 6227942 - DNA, 20 bp, Homo sapiens
gattttgtatatgaaaacaa

SEQ ID NO: 6227943 - DNA, 14 bp, Homo sapiens
gattttgtgaaatt

SEQ ID NO: 6227944 - DNA, 21 bp, Homo sapiens
gattttgtgtttattcttgat

SEQ ID NO: 6227945 - DNA, 15 bp, Homo sapiens
gattttgttttgctt

SEQ ID NO: 6227946 - DNA, 22 bp, Homo sapiens
gattttgttttgctttttctga

SEQ ID NO: 6227947 - DNA, 14 bp, Homo sapiens
gatttttaaaaggt

SEQ ID NO: 6227948 - DNA, 19 bp, Homo sapiens
gatttttaaagtttaaata

SEQ ID NO: 6227949 - DNA, 13 bp, Homo sapiens
gatttttaaatta

SEQ ID NO: 6227950 - DNA, 19 bp, Homo sapiens
gatttttaaattggagaaa

SEQ ID NO: 6227951 - DNA, 18 bp, Homo sapiens
gatttttaagaaagtaat

SEQ ID NO: 6227952 - DNA, 15 bp, Homo sapiens
gatttttaagaactt

SEQ ID NO: 6227953 - DNA, 16 bp, Homo sapiens
gatttttaagaacttc

SEQ ID NO: 6227954 - DNA, 20 bp, Homo sapiens
gatttttaagagaattagac

SEQ ID NO: 6227955 - DNA, 19 bp, Homo sapiens
gatttttaatggttaagaa

SEQ ID NO: 6227956 - DNA, 14 bp, Homo sapiens
gatttttaattaaa

SEQ ID NO: 6227957 - DNA, 20 bp, Homo sapiens
gatttttaccgtttcttccc

SEQ ID NO: 6227958 - DNA, 16 bp, Homo sapiens
gatttttactaatata

SEQ ID NO: 6227959 - DNA, 15 bp, Homo sapiens
gatttttagaattaa

SEQ ID NO: 6227960 - DNA, 12 bp, Homo sapiens
gatttttatcac

SEQ ID NO: 6227961 - DNA, 13 bp, Homo sapiens
gatttttatccaa

SEQ ID NO: 6227962 - DNA, 15 bp, Homo sapiens
gatttttatgtctgg

SEQ ID NO: 6227963 - DNA, 15 bp, Homo sapiens
gatttttatgtgttt

SEQ ID NO: 6227964 - DNA, 14 bp, Homo sapiens
gatttttatgtttt

SEQ ID NO: 6227965 - DNA, 15 bp, Homo sapiens
gatttttatttgcat

SEQ ID NO: 6227966 - DNA, 17 bp, Homo sapiens
gatttttcaaagacttc

SEQ ID NO: 6227967 - DNA, 13 bp, Homo sapiens
gatttttccatgt

SEQ ID NO: 6227968 - DNA, 12 bp, Homo sapiens
gatttttccttt

SEQ ID NO: 6227969 - DNA, 16 bp, Homo sapiens
gatttttctaaccttg

SEQ ID NO: 6227970 - DNA, 11 bp, Homo sapiens
gatttttctct

SEQ ID NO: 6227971 - DNA, 15 bp, Homo sapiens
gatttttctcttcat

SEQ ID NO: 6227972 - DNA, 23 bp, Homo sapiens
gatttttctggaggttgataact

SEQ ID NO: 6227973 - DNA, 14 bp, Homo sapiens
gatttttcttattt

SEQ ID NO: 6227974 - DNA, 15 bp, Homo sapiens
gatttttctttacaa

SEQ ID NO: 6227975 - DNA, 23 bp, Homo sapiens
gatttttcttttaagccctgctc

SEQ ID NO: 6227976 - DNA, 22 bp, Homo sapiens
gatttttgaaaatcctgaataa

SEQ ID NO: 6227977 - DNA, 21 bp, Homo sapiens
gatttttgctcttctgtatgt

SEQ ID NO: 6227978 - DNA, 15 bp, Homo sapiens
gatttttgtcttgtg

SEQ ID NO: 6227979 - DNA, 18 bp, Homo sapiens
gatttttgttaagctcag

SEQ ID NO: 6227980 - DNA, 13 bp, Homo sapiens
gatttttgttaat

SEQ ID NO: 6227981 - DNA, 14 bp, Homo sapiens
gatttttgttgatt

SEQ ID NO: 6227982 - DNA, 15 bp, Homo sapiens
gaatttgtatcatgt

SEQ ID NO: 6227983 - DNA, 20 bp, Homo sapiens
gaatttgtgaaggtggaaat

SEQ ID NO: 6227984 - DNA, 17 bp, Homo sapiens
gaatttgtgaatatatt

SEQ ID NO: 6227985 - DNA, 18 bp, Homo sapiens
gaatttgtgaatatattt

SEQ ID NO: 6227986 - DNA, 13 bp, Homo sapiens
gaatttgttatca

SEQ ID NO: 6227987 - DNA, 15 bp, Homo sapiens
gaatttgttctcttt

SEQ ID NO: 6227988 - DNA, 15 bp, Homo sapiens
gaatttgttcttaaa

SEQ ID NO: 6227989 - DNA, 12 bp, Homo sapiens
gaattttaaaag

SEQ ID NO: 6227990 - DNA, 13 bp, Homo sapiens
gaattttaaagta

SEQ ID NO: 6227991 - DNA, 15 bp, Homo sapiens
gaattttaaataatg

SEQ ID NO: 6227992 - DNA, 22 bp, Homo sapiens
gaattttaacttttgggatttg

SEQ ID NO: 6227993 - DNA, 13 bp, Homo sapiens
gaattttaatgtg

SEQ ID NO: 6227994 - DNA, 16 bp, Homo sapiens
gaattttaatgtgaag

SEQ ID NO: 6227995 - DNA, 15 bp, Homo sapiens
gaattttagaagaga

SEQ ID NO: 6227996 - DNA, 14 bp, Homo sapiens
gaattttaggaact

SEQ ID NO: 6227997 - DNA, 18 bp, Homo sapiens
gaattttatactttccct

SEQ ID NO: 6227998 - DNA, 20 bp, Homo sapiens
gaattttatactttccctac

SEQ ID NO: 6227999 - DNA, 21 bp, Homo sapiens
gaattttatactttccctacc

SEQ ID NO: 6228000 - DNA, 22 bp, Homo sapiens
gaattttatactttccctaccc

SEQ ID NO: 6228001 - DNA, 15 bp, Homo sapiens
gaattttatctgtgg

SEQ ID NO: 6228002 - DNA, 18 bp, Homo sapiens
gaattttattgacacagt

SEQ ID NO: 6228003 - DNA, 18 bp, Homo sapiens
gaattttatttctctcag

SEQ ID NO: 6228004 - DNA, 22 bp, Homo sapiens
gaattttattttacagagcttg

SEQ ID NO: 6228005 - DNA, 17 bp, Homo sapiens
gaattttcaagcatctc

SEQ ID NO: 6228006 - DNA, 20 bp, Homo sapiens
gaattttcaaggccttcagt

SEQ ID NO: 6228007 - DNA, 22 bp, Homo sapiens
gaattttcacatgaacatactg

SEQ ID NO: 6228008 - DNA, 12 bp, Homo sapiens
gaattttcatcc

SEQ ID NO: 6228009 - DNA, 21 bp, Homo sapiens
gaattttcatcccgtatcaca

SEQ ID NO: 6228010 - DNA, 13 bp, Homo sapiens
gaattttcatttt

SEQ ID NO: 6228011 - DNA, 18 bp, Homo sapiens
gaattttcattttcatta

SEQ ID NO: 6228012 - DNA, 20 bp, Homo sapiens
gaattttccacgcagttctt

SEQ ID NO: 6228013 - DNA, 14 bp, Homo sapiens
gaattttcccactg

SEQ ID NO: 6228014 - DNA, 15 bp, Homo sapiens
gaattttctaaaagc

SEQ ID NO: 6228015 - DNA, 20 bp, Homo sapiens
gaattttctggaaaatgctt

SEQ ID NO: 6228016 - DNA, 23 bp, Homo sapiens
gaattttctggaaaatgcttctt

SEQ ID NO: 6228017 - DNA, 16 bp, Homo sapiens
gaattttctttcatac

SEQ ID NO: 6228018 - DNA, 22 bp, Homo sapiens
gaattttctttttaataaaaag

SEQ ID NO: 6228019 - DNA, 17 bp, Homo sapiens
gaattttgcaatgtatt

SEQ ID NO: 6228020 - DNA, 18 bp, Homo sapiens
gaattttggaaaaatgtc

SEQ ID NO: 6228021 - DNA, 23 bp, Homo sapiens
gaattttggctgtgtctcccttc

SEQ ID NO: 6228022 - DNA, 20 bp, Homo sapiens
gaattttggtgatgtaaaac

SEQ ID NO: 6228023 - DNA, 16 bp, Homo sapiens
gaattttgtaagtata

SEQ ID NO: 6228024 - DNA, 22 bp, Homo sapiens
gaattttgtaagtataagaaat

SEQ ID NO: 6228025 - DNA, 21 bp, Homo sapiens
gaattttgtgcccccatgtaa

SEQ ID NO: 6228026 - DNA, 16 bp, Homo sapiens
gaattttgttctctgg

SEQ ID NO: 6228027 - DNA, 17 bp, Homo sapiens
gaattttgttctctggg

SEQ ID NO: 6228028 - DNA, 20 bp, Homo sapiens
gaattttgttctctgggaga

SEQ ID NO: 6228029 - DNA, 16 bp, Homo sapiens
gaattttgttttactt

SEQ ID NO: 6228030 - DNA, 19 bp, Homo sapiens
gaattttgttttacttttt

SEQ ID NO: 6228031 - DNA, 18 bp, Homo sapiens
gaatttttaaaataaact

SEQ ID NO: 6228032 - DNA, 20 bp, Homo sapiens
gaatttttaaaataaactgt

SEQ ID NO: 6228033 - DNA, 17 bp, Homo sapiens
gaatttttaaacaagta

SEQ ID NO: 6228034 - DNA, 15 bp, Homo sapiens
gaatttttaatgact

SEQ ID NO: 6228035 - DNA, 15 bp, Homo sapiens
gaatttttatgtgtg

SEQ ID NO: 6228036 - DNA, 16 bp, Homo sapiens
gaatttttattatgca

SEQ ID NO: 6228037 - DNA, 21 bp, Homo sapiens
gaatttttcagcacttaacta

SEQ ID NO: 6228038 - DNA, 14 bp, Homo sapiens
gaatttttctctaa

SEQ ID NO: 6228039 - DNA, 11 bp, Homo sapiens
gaatttttgcc

SEQ ID NO: 6228040 - DNA, 14 bp, Homo sapiens
gaatttttgcctat

SEQ ID NO: 6228041 - DNA, 21 bp, Homo sapiens
gaatttttgcctatctttaaa

SEQ ID NO: 6228042 - DNA, 23 bp, Homo sapiens
gaatttttgcttgacttcagtta

SEQ ID NO: 6228043 - DNA, 18 bp, Homo sapiens
gaattttttattcttgtg

SEQ ID NO: 6228044 - DNA, 13 bp, Homo sapiens
gaattttttctca

SEQ ID NO: 6228045 - DNA, 18 bp, Homo sapiens
gaatttttttctgcacag

SEQ ID NO: 6228046 - DNA, 19 bp, Homo sapiens
gaatttttttctgcacagc

SEQ ID NO: 6228047 - DNA, 14 bp, Homo sapiens
gaatttttttgtaa

SEQ ID NO: 6228048 - DNA, 16 bp, Homo sapiens
gaattttttttaacat

SEQ ID NO: 6228049 - DNA, 18 bp, Homo sapiens
gaattttttttaatgctt

SEQ ID NO: 6228050 - DNA, 20 bp, Homo sapiens
gaattttttttaatgcttaa

SEQ ID NO: 6228051 - DNA, 22 bp, Homo sapiens
gaattttttttgttgtttcagt

SEQ ID NO: 6228052 - DNA, 17 bp, Homo sapiens
gacaaaaaaatttaaaa

SEQ ID NO: 6228053 - DNA, 19 bp, Homo sapiens
gacaaaaaaatttaaaatt

SEQ ID NO: 6228054 - DNA, 20 bp, Homo sapiens
gacaaaaaaatttaaaatta

SEQ ID NO: 6228055 - DNA, 17 bp, Homo sapiens
gacaaaaacagcctcac

SEQ ID NO: 6228056 - DNA, 18 bp, Homo sapiens
gacaaaaacagcctcaca

SEQ ID NO: 6228057 - DNA, 12 bp, Homo sapiens
gacaaaaaccaa

SEQ ID NO: 6228058 - DNA, 17 bp, Homo sapiens
gacaaaaagaacaaaaa

SEQ ID NO: 6228059 - DNA, 15 bp, Homo sapiens
gacaaaaagccttga

SEQ ID NO: 6228060 - DNA, 13 bp, Homo sapiens
gacaaaaaggaaa

SEQ ID NO: 6228061 - DNA, 16 bp, Homo sapiens
gacaaaaagtatatta

SEQ ID NO: 6228062 - DNA, 12 bp, Homo sapiens
gacaaaaataac

SEQ ID NO: 6228063 - DNA, 13 bp, Homo sapiens
gacaaaaatactc

SEQ ID NO: 6228064 - DNA, 17 bp, Homo sapiens
gacaaaaattatttttt

SEQ ID NO: 6228065 - DNA, 19 bp, Homo sapiens
gacaaaacaatccccatca

SEQ ID NO: 6228066 - DNA, 12 bp, Homo sapiens
gacaaaacattt

SEQ ID NO: 6228067 - DNA, 17 bp, Homo sapiens
gacaaaacctaacttgc

SEQ ID NO: 6228068 - DNA, 13 bp, Homo sapiens
gacaaaacttctt

SEQ ID NO: 6228069 - DNA, 14 bp, Homo sapiens
gacaaaagaaactt

SEQ ID NO: 6228070 - DNA, 20 bp, Homo sapiens
gacaaaagcagcacaaggaa

SEQ ID NO: 6228071 - DNA, 13 bp, Homo sapiens
gacaaaagggcca

SEQ ID NO: 6228072 - DNA, 16 bp, Homo sapiens
gacaaaagggccaggt

SEQ ID NO: 6228073 - DNA, 15 bp, Homo sapiens
gacaaaagtaaatgg

SEQ ID NO: 6228074 - DNA, 13 bp, Homo sapiens
gacaaaataaagt

SEQ ID NO: 6228075 - DNA, 22 bp, Homo sapiens
gacaaaatacttgtctgtttta

SEQ ID NO: 6228076 - DNA, 14 bp, Homo sapiens
gacaaaatgactgg

SEQ ID NO: 6228077 - DNA, 19 bp, Homo sapiens
gacaaaatgactggctcct

SEQ ID NO: 6228078 - DNA, 24 bp, Homo sapiens
gacaaaatgactggctcctgactt

SEQ ID NO: 6228079 - DNA, 21 bp, Homo sapiens
gacaaaatgggaggaggaaag

SEQ ID NO: 6228080 - DNA, 12 bp, Homo sapiens
gacaaaatgtga

SEQ ID NO: 6228081 - DNA, 12 bp, Homo sapiens
gacaaaatgtta

SEQ ID NO: 6228082 - DNA, 16 bp, Homo sapiens
gacaaaatgttatttc

SEQ ID NO: 6228083 - DNA, 20 bp, Homo sapiens
gacaaaattaatacattcta

SEQ ID NO: 6228084 - DNA, 20 bp, Homo sapiens
gacaaaattgctgaggagct

SEQ ID NO: 6228085 - DNA, 21 bp, Homo sapiens
gacaaaattgtaagccagagt

SEQ ID NO: 6228086 - DNA, 13 bp, Homo sapiens
gacaaaatttaga

SEQ ID NO: 6228087 - DNA, 22 bp, Homo sapiens
gacaaaatttgagaatacataa

SEQ ID NO: 6228088 - DNA, 12 bp, Homo sapiens
gacaaacactgc

SEQ ID NO: 6228089 - DNA, 13 bp, Homo sapiens
gacaaacactgcc

SEQ ID NO: 6228090 - DNA, 16 bp, Homo sapiens
gacaaaccactgtaca

SEQ ID NO: 6228091 - DNA, 17 bp, Homo sapiens
gacaaaccactgtacat

SEQ ID NO: 6228092 - DNA, 21 bp, Homo sapiens
gacaaaccactgtacatatat

SEQ ID NO: 6228093 - DNA, 22 bp, Homo sapiens
gacaaaccataactgacaagag

SEQ ID NO: 6228094 - DNA, 20 bp, Homo sapiens
gacaaacccggaagatcaga

SEQ ID NO: 6228095 - DNA, 12 bp, Homo sapiens
gacaaacccttc

SEQ ID NO: 6228096 - DNA, 18 bp, Homo sapiens
gacaaaccttaaaacagc

SEQ ID NO: 6228097 - DNA, 19 bp, Homo sapiens
gacaaagaaaactgcacaa

SEQ ID NO: 6228098 - DNA, 20 bp, Homo sapiens
gacaaagaaatagcaagaga

SEQ ID NO: 6228099 - DNA, 16 bp, Homo sapiens
gacaaagaaggaaaag

SEQ ID NO: 6228100 - DNA, 16 bp, Homo sapiens
gacaaagaattccaaa

SEQ ID NO: 6228101 - DNA, 18 bp, Homo sapiens
gacaaagactcctctggg

SEQ ID NO: 6228102 - DNA, 22 bp, Homo sapiens
gacaaagagaataaagacttca

SEQ ID NO: 6228103 - DNA, 20 bp, Homo sapiens
gacaaagaggcctttaacca

SEQ ID NO: 6228104 - DNA, 17 bp, Homo sapiens
gacaaagatggctcaga

SEQ ID NO: 6228105 - DNA, 14 bp, Homo sapiens
gacaaagcaggagt

SEQ ID NO: 6228106 - DNA, 17 bp, Homo sapiens
gacaaagcattctaaat

SEQ ID NO: 6228107 - DNA, 20 bp, Homo sapiens
gacaaagccttaagcaaatt

SEQ ID NO: 6228108 - DNA, 18 bp, Homo sapiens
gacaaagctgctaaatct

SEQ ID NO: 6228109 - DNA, 19 bp, Homo sapiens
gacaaagctgctaaatctc

SEQ ID NO: 6228110 - DNA, 14 bp, Homo sapiens
gacaaaggagcctg

SEQ ID NO: 6228111 - DNA, 15 bp, Homo sapiens
gacaaaggagcctgt

SEQ ID NO: 6228112 - DNA, 18 bp, Homo sapiens
gacaaaggagcctgtgaa

SEQ ID NO: 6228113 - DNA, 17 bp, Homo sapiens
gacaaaggcccagaaat

SEQ ID NO: 6228114 - DNA, 12 bp, Homo sapiens
gacaaaggcctg

SEQ ID NO: 6228115 - DNA, 14 bp, Homo sapiens
gacaaaggccttaa

SEQ ID NO: 6228116 - DNA, 21 bp, Homo sapiens
gacaaagggaaggctgctgtg

SEQ ID NO: 6228117 - DNA, 15 bp, Homo sapiens
gacaaagggagggag

SEQ ID NO: 6228118 - DNA, 15 bp, Homo sapiens
gacaaagtcaagcca

SEQ ID NO: 6228119 - DNA, 18 bp, Homo sapiens
gacaaagtcatcccctct

SEQ ID NO: 6228120 - DNA, 22 bp, Homo sapiens
gacaaagtcatcccctctcagg

SEQ ID NO: 6228121 - DNA, 14 bp, Homo sapiens
gacaaagtctccag

SEQ ID NO: 6228122 - DNA, 16 bp, Homo sapiens
gacaaagtctccagcc

SEQ ID NO: 6228123 - DNA, 17 bp, Homo sapiens
gacaaagtctccagccc

SEQ ID NO: 6228124 - DNA, 16 bp, Homo sapiens
gacaaagtgccaaaga

SEQ ID NO: 6228125 - DNA, 11 bp, Homo sapiens
gacaaagtgtg

SEQ ID NO: 6228126 - DNA, 18 bp, Homo sapiens
gacaaagtgtgtaattat

SEQ ID NO: 6228127 - DNA, 22 bp, Homo sapiens
gacaaagtgtgtctcaaaaata

SEQ ID NO: 6228128 - DNA, 19 bp, Homo sapiens
gacaaagtgttgaaaatgt

SEQ ID NO: 6228129 - DNA, 23 bp, Homo sapiens
gacaaagttactgattcactgca

SEQ ID NO: 6228130 - DNA, 21 bp, Homo sapiens
gacaaagttatatatttataa

SEQ ID NO: 6228131 - DNA, 18 bp, Homo sapiens
gacaaagttccaaaatgc

SEQ ID NO: 6228132 - DNA, 14 bp, Homo sapiens
gacaaagttctgta

SEQ ID NO: 6228133 - DNA, 15 bp, Homo sapiens
gacaaagttctgtat

SEQ ID NO: 6228134 - DNA, 15 bp, Homo sapiens
gacaaataaggaagg

SEQ ID NO: 6228135 - DNA, 13 bp, Homo sapiens
gacaaataagttt

SEQ ID NO: 6228136 - DNA, 13 bp, Homo sapiens
gacaaatacacat

SEQ ID NO: 6228137 - DNA, 18 bp, Homo sapiens
gacaaatactcatgtgta

SEQ ID NO: 6228138 - DNA, 19 bp, Homo sapiens
gacaaatactcatgtgtat

SEQ ID NO: 6228139 - DNA, 14 bp, Homo sapiens
gacaaataggagtg

SEQ ID NO: 6228140 - DNA, 15 bp, Homo sapiens
gacaaatagtaggca

SEQ ID NO: 6228141 - DNA, 23 bp, Homo sapiens
gacaaatagtaggctaaaaacat

SEQ ID NO: 6228142 - DNA, 12 bp, Homo sapiens
gacaaatatgta

SEQ ID NO: 6228143 - DNA, 11 bp, Homo sapiens
gacaaatattc

SEQ ID NO: 6228144 - DNA, 22 bp, Homo sapiens
gacaaatattcctttgcatatt

SEQ ID NO: 6228145 - DNA, 13 bp, Homo sapiens
gacaaatattctg

SEQ ID NO: 6228146 - DNA, 17 bp, Homo sapiens
gacaaatatttctttct

SEQ ID NO: 6228147 - DNA, 23 bp, Homo sapiens
gacaaatcaacagaagcatttgt

SEQ ID NO: 6228148 - DNA, 17 bp, Homo sapiens
gacaaatcaagcttcag

SEQ ID NO: 6228149 - DNA, 19 bp, Homo sapiens
gacaaatcaagtttccaag

SEQ ID NO: 6228150 - DNA, 21 bp, Homo sapiens
gacaaatcctaggctcctggg

SEQ ID NO: 6228151 - DNA, 23 bp, Homo sapiens
gacaaatcctaggctcctgggag

SEQ ID NO: 6228152 - DNA, 15 bp, Homo sapiens
gacaaatcctttctg

SEQ ID NO: 6228153 - DNA, 19 bp, Homo sapiens
gacaaatcctttctgcccc

SEQ ID NO: 6228154 - DNA, 19 bp, Homo sapiens
gacaaatctaaaatgcaaa

SEQ ID NO: 6228155 - DNA, 22 bp, Homo sapiens
gacaaatctaaaatgcaaagaa

SEQ ID NO: 6228156 - DNA, 14 bp, Homo sapiens
gacaaatctgtgta

SEQ ID NO: 6228157 - DNA, 20 bp, Homo sapiens
gacaaatgaaagagaaaata

SEQ ID NO: 6228158 - DNA, 14 bp, Homo sapiens
gacaaatgacagat

SEQ ID NO: 6228159 - DNA, 20 bp, Homo sapiens
gacaaatgggactgatgtca

SEQ ID NO: 6228160 - DNA, 22 bp, Homo sapiens
gacaaatgggactgatgtcatc

SEQ ID NO: 6228161 - DNA, 23 bp, Homo sapiens
gattttttaaaaaaaatgtgaaa

SEQ ID NO: 6228162 - DNA, 16 bp, Homo sapiens
gattttttaaaagaaa

SEQ ID NO: 6228163 - DNA, 17 bp, Homo sapiens
gattttttaaaagaaat

SEQ ID NO: 6228164 - DNA, 16 bp, Homo sapiens
gattttttaataattt

SEQ ID NO: 6228165 - DNA, 17 bp, Homo sapiens
gattttttaataattta

SEQ ID NO: 6228166 - DNA, 20 bp, Homo sapiens
gattttttacaaattatgtt

SEQ ID NO: 6228167 - DNA, 18 bp, Homo sapiens
gattttttattattattc

SEQ ID NO: 6228168 - DNA, 16 bp, Homo sapiens
gattttttattgctag

SEQ ID NO: 6228169 - DNA, 18 bp, Homo sapiens
gattttttattgctagta

SEQ ID NO: 6228170 - DNA, 13 bp, Homo sapiens
gattttttccctt

SEQ ID NO: 6228171 - DNA, 16 bp, Homo sapiens
gattttttcccttttt

SEQ ID NO: 6228172 - DNA, 21 bp, Homo sapiens
gattttttccttcaaagttta

SEQ ID NO: 6228173 - DNA, 17 bp, Homo sapiens
gattttttgttcttgtt

SEQ ID NO: 6228174 - DNA, 21 bp, Homo sapiens
gatttttttcccaattgagaa

SEQ ID NO: 6228175 - DNA, 16 bp, Homo sapiens
gatttttttcctcccc

SEQ ID NO: 6228176 - DNA, 17 bp, Homo sapiens
gatttttttgttcttgt

SEQ ID NO: 6228177 - DNA, 16 bp, Homo sapiens
gatttttttgttgttg

SEQ ID NO: 6228178 - DNA, 16 bp, Homo sapiens
gattttttttctctct

SEQ ID NO: 6228179 - DNA, 19 bp, Homo sapiens
gatttttttttccactttt

SEQ ID NO: 6228180 - DNA, 17 bp, Homo sapiens
gatttttttttccttca

SEQ ID NO: 6228181 - DNA, 22 bp, Homo sapiens
gatttttttttccttcagtgcc

SEQ ID NO: 6228182 - DNA, 17 bp, Homo sapiens
gattttttttttaagtg

SEQ ID NO: 6228183 - DNA, 19 bp, Homo sapiens
gattttttttttaagtgac

SEQ ID NO: 6228184 - DNA, 20 bp, Homo sapiens
gattttttttttttcctctt

SEQ ID NO: 6228185 - DNA, 23 bp, Homo sapiens
gattttttttttttggtaattat

SEQ ID NO: 6228186 - DNA, 21 bp, Homo sapiens
gatttttttttttttcctgtc

SEQ ID NO: 6228187 - DNA, 18 bp, Homo sapiens
gcaaaaaaaaaaaaaagc

SEQ ID NO: 6228188 - DNA, 16 bp, Homo sapiens
gcaaaaaaaaaaatgt

SEQ ID NO: 6228189 - DNA, 20 bp, Homo sapiens
gcaaaaaaaaacttaaagca

SEQ ID NO: 6228190 - DNA, 16 bp, Homo sapiens
gcaaaaaaagcctcca

SEQ ID NO: 6228191 - DNA, 17 bp, Homo sapiens
gcaaaaaaagcctccaa

SEQ ID NO: 6228192 - DNA, 22 bp, Homo sapiens
gcaaaaaaagcctccaagggtt

SEQ ID NO: 6228193 - DNA, 17 bp, Homo sapiens
gcaaaaaaagttgtatg

SEQ ID NO: 6228194 - DNA, 18 bp, Homo sapiens
gcaaaaaaagttgtatga

SEQ ID NO: 6228195 - DNA, 23 bp, Homo sapiens
gcaaaaaacatacttacatttca

SEQ ID NO: 6228196 - DNA, 21 bp, Homo sapiens
gcaaaaaagaacagtgttgaa

SEQ ID NO: 6228197 - DNA, 21 bp, Homo sapiens
gcaaaaaagtccaattttaat

SEQ ID NO: 6228198 - DNA, 15 bp, Homo sapiens
gcaaaaaataaaata

SEQ ID NO: 6228199 - DNA, 16 bp, Homo sapiens
gcaaaaaataaaataa

SEQ ID NO: 6228200 - DNA, 18 bp, Homo sapiens
gcaaaaaataaaataagt

SEQ ID NO: 6228201 - DNA, 15 bp, Homo sapiens
gcaaaaaataatgac

SEQ ID NO: 6228202 - DNA, 15 bp, Homo sapiens
gcaaaaacaaaaaga

SEQ ID NO: 6228203 - DNA, 21 bp, Homo sapiens
gcaaaaacaaaaagaaaagaa

SEQ ID NO: 6228204 - DNA, 21 bp, Homo sapiens
gcaaaaacatagtttgtaaag

SEQ ID NO: 6228205 - DNA, 18 bp, Homo sapiens
gcaaaaacatatgtctgt

SEQ ID NO: 6228206 - DNA, 13 bp, Homo sapiens
gcaaaaacccttg

SEQ ID NO: 6228207 - DNA, 18 bp, Homo sapiens
gcaaaaactgtactgtgt

SEQ ID NO: 6228208 - DNA, 20 bp, Homo sapiens
gcaaaaagaacaaagctgga

SEQ ID NO: 6228209 - DNA, 16 bp, Homo sapiens
gcaaaaagagtcagac

SEQ ID NO: 6228210 - DNA, 13 bp, Homo sapiens
gcaaaaagcaaaa

SEQ ID NO: 6228211 - DNA, 20 bp, Homo sapiens
gcaaaaagcaagggagaaaa

SEQ ID NO: 6228212 - DNA, 20 bp, Homo sapiens
gcaaaaaggagccttttgct

SEQ ID NO: 6228213 - DNA, 16 bp, Homo sapiens
gcaaaaataatttatt

SEQ ID NO: 6228214 - DNA, 17 bp, Homo sapiens
gcaaaaataatttattt

SEQ ID NO: 6228215 - DNA, 13 bp, Homo sapiens
gcaaaaatataaa

SEQ ID NO: 6228216 - DNA, 13 bp, Homo sapiens
gcaaaaatatttt

SEQ ID NO: 6228217 - DNA, 22 bp, Homo sapiens
gcaaaaatattttatgatccag

SEQ ID NO: 6228218 - DNA, 18 bp, Homo sapiens
gcaaaaatccgaggtgct

SEQ ID NO: 6228219 - DNA, 21 bp, Homo sapiens
gcaaaaatgacaacagaaaaa

SEQ ID NO: 6228220 - DNA, 19 bp, Homo sapiens
gcaaaaatgcaacaaatga

SEQ ID NO: 6228221 - DNA, 17 bp, Homo sapiens
gcaaaaatgccaggcag

SEQ ID NO: 6228222 - DNA, 12 bp, Homo sapiens
gcaaaaatgcta

SEQ ID NO: 6228223 - DNA, 16 bp, Homo sapiens
gcaaaaatgtaaaaaa

SEQ ID NO: 6228224 - DNA, 18 bp, Homo sapiens
gcaaaaatgtaaaaaaca

SEQ ID NO: 6228225 - DNA, 14 bp, Homo sapiens
gcaaaaatgttttc

SEQ ID NO: 6228226 - DNA, 14 bp, Homo sapiens
gcaaaaatttttgg

SEQ ID NO: 6228227 - DNA, 18 bp, Homo sapiens
gcaaaacaaaagtacatt

SEQ ID NO: 6228228 - DNA, 18 bp, Homo sapiens
gcaaaacacgcaagggca

SEQ ID NO: 6228229 - DNA, 16 bp, Homo sapiens
gcaaaacagccctcag

SEQ ID NO: 6228230 - DNA, 12 bp, Homo sapiens
gcaaaaccagaa

SEQ ID NO: 6228231 - DNA, 15 bp, Homo sapiens
gcaaaaccattgctt

SEQ ID NO: 6228232 - DNA, 18 bp, Homo sapiens
gcaaaaccggcaacctgt

SEQ ID NO: 6228233 - DNA, 20 bp, Homo sapiens
gcaaaaccggcaacctgtaa

SEQ ID NO: 6228234 - DNA, 15 bp, Homo sapiens
gcaaaaccttttact

SEQ ID NO: 6228235 - DNA, 19 bp, Homo sapiens
gcaaaactcccaatggata

SEQ ID NO: 6228236 - DNA, 23 bp, Homo sapiens
gcaaaactctacttaatccaatg

SEQ ID NO: 6228237 - DNA, 12 bp, Homo sapiens
gcaaaactgaat

SEQ ID NO: 6228238 - DNA, 13 bp, Homo sapiens
gcaaaactgcaaa

SEQ ID NO: 6228239 - DNA, 21 bp, Homo sapiens
gcaaaactgcaaattgtagcc

SEQ ID NO: 6228240 - DNA, 12 bp, Homo sapiens
gcaaaagaaaaa

SEQ ID NO: 6228241 - DNA, 18 bp, Homo sapiens
gcaaaagaagttgatctg

SEQ ID NO: 6228242 - DNA, 19 bp, Homo sapiens
gcaaaagaatggcagaaaa

SEQ ID NO: 6228243 - DNA, 16 bp, Homo sapiens
gcaaaagacttgagcc

SEQ ID NO: 6228244 - DNA, 17 bp, Homo sapiens
gcaaaagagaaaaagaa

SEQ ID NO: 6228245 - DNA, 17 bp, Homo sapiens
gcaaaagatgcttctca

SEQ ID NO: 6228246 - DNA, 22 bp, Homo sapiens
gcaaaagatgcttctcactgcc

SEQ ID NO: 6228247 - DNA, 20 bp, Homo sapiens
gcaaaagatgtgcaaaatca

SEQ ID NO: 6228248 - DNA, 23 bp, Homo sapiens
gcaaaagatgtgcaaaatcactg

SEQ ID NO: 6228249 - DNA, 18 bp, Homo sapiens
gcaaaagcagctaaatgt

SEQ ID NO: 6228250 - DNA, 21 bp, Homo sapiens
gcaaaagcccattgaagaaga

SEQ ID NO: 6228251 - DNA, 21 bp, Homo sapiens
gcaaaaggagagactcccatg

SEQ ID NO: 6228252 - DNA, 13 bp, Homo sapiens
gcaaaaggcagct

SEQ ID NO: 6228253 - DNA, 14 bp, Homo sapiens
gcaaaaggcagctc

SEQ ID NO: 6228254 - DNA, 23 bp, Homo sapiens
gcaaaaggcctcttgtaaagact

SEQ ID NO: 6228255 - DNA, 15 bp, Homo sapiens
gcaaaaggctgagaa

SEQ ID NO: 6228256 - DNA, 16 bp, Homo sapiens
gcaaaaggctgagaag

SEQ ID NO: 6228257 - DNA, 19 bp, Homo sapiens
gcaaaaggctgattactga

SEQ ID NO: 6228258 - DNA, 20 bp, Homo sapiens
gcaaaaggttcactaaagca

SEQ ID NO: 6228259 - DNA, 21 bp, Homo sapiens
gcaaaaggttcactaaagcag

SEQ ID NO: 6228260 - DNA, 15 bp, Homo sapiens
gcaaaagtgagaaaa

SEQ ID NO: 6228261 - DNA, 21 bp, Homo sapiens
gcaaaagtggggctaaatgaa

SEQ ID NO: 6228262 - DNA, 18 bp, Homo sapiens
gcaaaagttctgacttga

SEQ ID NO: 6228263 - DNA, 21 bp, Homo sapiens
gcaaaataaaacatagcaaat

SEQ ID NO: 6228264 - DNA, 19 bp, Homo sapiens
gcaaaatacacgtttatct

SEQ ID NO: 6228265 - DNA, 21 bp, Homo sapiens
gcaaaatacatgatgatttca

SEQ ID NO: 6228266 - DNA, 19 bp, Homo sapiens
gcaaaatagaagaagagga

SEQ ID NO: 6228267 - DNA, 15 bp, Homo sapiens
gcaaaatagtattgc

SEQ ID NO: 6228268 - DNA, 17 bp, Homo sapiens
gcaaaatagtattgctg

SEQ ID NO: 6228269 - DNA, 20 bp, Homo sapiens
gcaaaatccaaactgctgtc

SEQ ID NO: 6228270 - DNA, 23 bp, Homo sapiens
gcaaaatccaaactgctgtctct

SEQ ID NO: 6228271 - DNA, 18 bp, Homo sapiens
gcaaaatccttacttcca

SEQ ID NO: 6228272 - DNA, 19 bp, Homo sapiens
gcaaaatccttacttccag

SEQ ID NO: 6228273 - DNA, 22 bp, Homo sapiens
gcaaaatgaactaactgccatg

SEQ ID NO: 6228274 - DNA, 12 bp, Homo sapiens
gcaaaatgagtt

SEQ ID NO: 6228275 - DNA, 13 bp, Homo sapiens
gcaaaatgctctt

SEQ ID NO: 6228276 - DNA, 21 bp, Homo sapiens
gcaaaatggaaatgtaataat

SEQ ID NO: 6228277 - DNA, 16 bp, Homo sapiens
gcaaaatggaagcaaa

SEQ ID NO: 6228278 - DNA, 20 bp, Homo sapiens
gcaaaatgggatgatatgga

SEQ ID NO: 6228279 - DNA, 19 bp, Homo sapiens
gcaaaatgttacagaatct

SEQ ID NO: 6228280 - DNA, 20 bp, Homo sapiens
gcaaaattacagttcacact

SEQ ID NO: 6228281 - DNA, 23 bp, Homo sapiens
gcaaaattagtacctcaaagtaa

SEQ ID NO: 6228282 - DNA, 17 bp, Homo sapiens
gcaaaattataagaaga

SEQ ID NO: 6228283 - DNA, 13 bp, Homo sapiens
gcaaaattgcaaa

SEQ ID NO: 6228284 - DNA, 16 bp, Homo sapiens
gcaaaattgttttcac

SEQ ID NO: 6228285 - DNA, 17 bp, Homo sapiens
gcaaaattgttttcact

SEQ ID NO: 6228286 - DNA, 21 bp, Homo sapiens
gcaaaattgtttttggttgga

SEQ ID NO: 6228287 - DNA, 22 bp, Homo sapiens
gcaaaatttgatgccaggacac

SEQ ID NO: 6228288 - DNA, 16 bp, Homo sapiens
gcaaacaaaatgatgg

SEQ ID NO: 6228289 - DNA, 19 bp, Homo sapiens
gcaaacaaaatgatgggaa

SEQ ID NO: 6228290 - DNA, 18 bp, Homo sapiens
gcaaacaaaattgttctt

SEQ ID NO: 6228291 - DNA, 14 bp, Homo sapiens
gcaaacaacctgaa

SEQ ID NO: 6228292 - DNA, 20 bp, Homo sapiens
gcaaacaacctgaatctttt

SEQ ID NO: 6228293 - DNA, 17 bp, Homo sapiens
gcaaacaactgaaatgt

SEQ ID NO: 6228294 - DNA, 18 bp, Homo sapiens
gcaaacaactttctggaa

SEQ ID NO: 6228295 - DNA, 12 bp, Homo sapiens
gcaaacaataaa

SEQ ID NO: 6228296 - DNA, 21 bp, Homo sapiens
gcaaacaatcccaatctttct

SEQ ID NO: 6228297 - DNA, 17 bp, Homo sapiens
gcaaacacacaaaggta

SEQ ID NO: 6228298 - DNA, 19 bp, Homo sapiens
gcaaacacacagactctgt

SEQ ID NO: 6228299 - DNA, 21 bp, Homo sapiens
gcaaacacacagactctgtga

SEQ ID NO: 6228300 - DNA, 13 bp, Homo sapiens
gcaaacacacctt

SEQ ID NO: 6228301 - DNA, 17 bp, Homo sapiens
gcaaacactccaccctc

SEQ ID NO: 6228302 - DNA, 14 bp, Homo sapiens
gcaaacactgtgta

SEQ ID NO: 6228303 - DNA, 17 bp, Homo sapiens
gcaaacagaaatcaggt

SEQ ID NO: 6228304 - DNA, 14 bp, Homo sapiens
gcaaacagaacagg

SEQ ID NO: 6228305 - DNA, 13 bp, Homo sapiens
gcaaacagcaaga

SEQ ID NO: 6228306 - DNA, 12 bp, Homo sapiens
gcaaacagctga

SEQ ID NO: 6228307 - DNA, 13 bp, Homo sapiens
gcaaacagggcct

SEQ ID NO: 6228308 - DNA, 18 bp, Homo sapiens
gcaaacagggtggcccag

SEQ ID NO: 6228309 - DNA, 23 bp, Homo sapiens
gcaaacagggtggcccaggtggc

SEQ ID NO: 6228310 - DNA, 13 bp, Homo sapiens
gcaaacatcaaat

SEQ ID NO: 6228311 - DNA, 19 bp, Homo sapiens
gcaaacatggagaaatcta

SEQ ID NO: 6228312 - DNA, 11 bp, Homo sapiens
gcaaacattta

SEQ ID NO: 6228313 - DNA, 21 bp, Homo sapiens
gcaaacattttctcttagaaa

SEQ ID NO: 6228314 - DNA, 17 bp, Homo sapiens
gcaaaccaacctttctg

SEQ ID NO: 6228315 - DNA, 18 bp, Homo sapiens
gcaaaccaacctttctga

SEQ ID NO: 6228316 - DNA, 23 bp, Homo sapiens
gcaaaccaacctttctgacatca

SEQ ID NO: 6228317 - DNA, 16 bp, Homo sapiens
gcaaaccaagagattg

SEQ ID NO: 6228318 - DNA, 21 bp, Homo sapiens
gcaaaccaatacagaattgac

SEQ ID NO: 6228319 - DNA, 16 bp, Homo sapiens
gcaaaccaatggtgat

SEQ ID NO: 6228320 - DNA, 21 bp, Homo sapiens
gcaaaccaatggtgatcctct

SEQ ID NO: 6228321 - DNA, 15 bp, Homo sapiens
gcaaaccaatttgtt

SEQ ID NO: 6228322 - DNA, 18 bp, Homo sapiens
gcaaaccaatttgttctg

SEQ ID NO: 6228323 - DNA, 19 bp, Homo sapiens
gcaaaccaatttgttctgt

SEQ ID NO: 6228324 - DNA, 22 bp, Homo sapiens
gcaaaccacactggactccggc

SEQ ID NO: 6228325 - DNA, 14 bp, Homo sapiens
gcaaaccacttctc

SEQ ID NO: 6228326 - DNA, 16 bp, Homo sapiens
gcaaaccatcattgaa

SEQ ID NO: 6228327 - DNA, 17 bp, Homo sapiens
gcaaaccatttcaaatg

SEQ ID NO: 6228328 - DNA, 23 bp, Homo sapiens
gcaaaccatttcaaatggcagca

SEQ ID NO: 6228329 - DNA, 14 bp, Homo sapiens
gcaaacccaaagat

SEQ ID NO: 6228330 - DNA, 15 bp, Homo sapiens
gcaaacccagacggc

SEQ ID NO: 6228331 - DNA, 20 bp, Homo sapiens
gcaaacccagaggtggatgt

SEQ ID NO: 6228332 - DNA, 19 bp, Homo sapiens
gcaaacccatcaacaaaaa

SEQ ID NO: 6228333 - DNA, 17 bp, Homo sapiens
gcaaacccatgaagctg

SEQ ID NO: 6228334 - DNA, 16 bp, Homo sapiens
gcaaacccattaaggg

SEQ ID NO: 6228335 - DNA, 14 bp, Homo sapiens
gcaaaccccaaaga

SEQ ID NO: 6228336 - DNA, 17 bp, Homo sapiens
gcaaaccctggtgcttt

SEQ ID NO: 6228337 - DNA, 23 bp, Homo sapiens
gcaaaccctggtggtattttatt

SEQ ID NO: 6228338 - DNA, 11 bp, Homo sapiens
gacaaatgtga

SEQ ID NO: 6228339 - DNA, 16 bp, Homo sapiens
gacaaatgtgaagatg

SEQ ID NO: 6228340 - DNA, 18 bp, Homo sapiens
gacaaatgtgaagatgca

SEQ ID NO: 6228341 - DNA, 22 bp, Homo sapiens
gacaaatgtgtatcggatgctt

SEQ ID NO: 6228342 - DNA, 21 bp, Homo sapiens
gacaaatgttgtcctgttaat

SEQ ID NO: 6228343 - DNA, 14 bp, Homo sapiens
gacaaatgtttcta

SEQ ID NO: 6228344 - DNA, 22 bp, Homo sapiens
gacaaattactgataaaaatga

SEQ ID NO: 6228345 - DNA, 21 bp, Homo sapiens
gacaaattagcatgcaagctt

SEQ ID NO: 6228346 - DNA, 22 bp, Homo sapiens
gacaaattagcatgcaagcttg

SEQ ID NO: 6228347 - DNA, 16 bp, Homo sapiens
gacaaattatatttga

SEQ ID NO: 6228348 - DNA, 19 bp, Homo sapiens
gacaaattcatattctttt

SEQ ID NO: 6228349 - DNA, 19 bp, Homo sapiens
gacaaattcggatgtatga

SEQ ID NO: 6228350 - DNA, 17 bp, Homo sapiens
gacaaattctgtttctt

SEQ ID NO: 6228351 - DNA, 16 bp, Homo sapiens
gacaaattgcacagaa

SEQ ID NO: 6228352 - DNA, 20 bp, Homo sapiens
gacaaattgttaagagtatc

SEQ ID NO: 6228353 - DNA, 21 bp, Homo sapiens
gacaaatttagccaataaaga

SEQ ID NO: 6228354 - DNA, 22 bp, Homo sapiens
gacaaatttgcaaaactgtgct

SEQ ID NO: 6228355 - DNA, 12 bp, Homo sapiens
gacaaattttgc

SEQ ID NO: 6228356 - DNA, 13 bp, Homo sapiens
gacaacaaaagaa

SEQ ID NO: 6228357 - DNA, 18 bp, Homo sapiens
gacaacaaagaggacacc

SEQ ID NO: 6228358 - DNA, 23 bp, Homo sapiens
gacaacaaattaggttttgtaca

SEQ ID NO: 6228359 - DNA, 22 bp, Homo sapiens
gacaacaaggccctttaacttg

SEQ ID NO: 6228360 - DNA, 12 bp, Homo sapiens
gacaacacacac

SEQ ID NO: 6228361 - DNA, 13 bp, Homo sapiens
gacaacacacaca

SEQ ID NO: 6228362 - DNA, 16 bp, Homo sapiens
gacaacacagcctata

SEQ ID NO: 6228363 - DNA, 21 bp, Homo sapiens
gacaacaccttcctcctgcag

SEQ ID NO: 6228364 - DNA, 14 bp, Homo sapiens
gacaacactaattg

SEQ ID NO: 6228365 - DNA, 22 bp, Homo sapiens
gacaacactaattgtccacagc

SEQ ID NO: 6228366 - DNA, 22 bp, Homo sapiens
gacaacactcattgacctgagg

SEQ ID NO: 6228367 - DNA, 21 bp, Homo sapiens
gacaacacttaatagcaacag

SEQ ID NO: 6228368 - DNA, 17 bp, Homo sapiens
gacaacagaaaaacaat

SEQ ID NO: 6228369 - DNA, 12 bp, Homo sapiens
gacaacagaagc

SEQ ID NO: 6228370 - DNA, 12 bp, Homo sapiens
gacaacagaagt

SEQ ID NO: 6228371 - DNA, 16 bp, Homo sapiens
gacaacagacttctga

SEQ ID NO: 6228372 - DNA, 13 bp, Homo sapiens
gacaacagcacac

SEQ ID NO: 6228373 - DNA, 15 bp, Homo sapiens
gacaacagcacacag

SEQ ID NO: 6228374 - DNA, 15 bp, Homo sapiens
gacaacagcctgaga

SEQ ID NO: 6228375 - DNA, 18 bp, Homo sapiens
gacaacagcctgagaaat

SEQ ID NO: 6228376 - DNA, 21 bp, Homo sapiens
gacaacaggttttcaccatag

SEQ ID NO: 6228377 - DNA, 14 bp, Homo sapiens
gacaacagttctga

SEQ ID NO: 6228378 - DNA, 20 bp, Homo sapiens
gacaacagttctgagctgta

SEQ ID NO: 6228379 - DNA, 20 bp, Homo sapiens
gacaacatggcttctccttt

SEQ ID NO: 6228380 - DNA, 21 bp, Homo sapiens
gacaacatggcttctcctttg

SEQ ID NO: 6228381 - DNA, 12 bp, Homo sapiens
gacaacattaaa

SEQ ID NO: 6228382 - DNA, 18 bp, Homo sapiens
gacaacattatgatctaa

SEQ ID NO: 6228383 - DNA, 19 bp, Homo sapiens
gacaacattatgatctaat

SEQ ID NO: 6228384 - DNA, 20 bp, Homo sapiens
gacaacattatgatctaata

SEQ ID NO: 6228385 - DNA, 22 bp, Homo sapiens
gacaacattatgatctaataaa

SEQ ID NO: 6228386 - DNA, 19 bp, Homo sapiens
gacaacatttttgtacatt

SEQ ID NO: 6228387 - DNA, 20 bp, Homo sapiens
gacaacatttttgtacatta

SEQ ID NO: 6228388 - DNA, 22 bp, Homo sapiens
gacaacatttttgtacattatg

SEQ ID NO: 6228389 - DNA, 14 bp, Homo sapiens
gacaaccaaaacat

SEQ ID NO: 6228390 - DNA, 19 bp, Homo sapiens
gacaaccaccgctccccag

SEQ ID NO: 6228391 - DNA, 15 bp, Homo sapiens
gacaaccactggtct

SEQ ID NO: 6228392 - DNA, 19 bp, Homo sapiens
gacaaccactggtctgtag

SEQ ID NO: 6228393 - DNA, 12 bp, Homo sapiens
gacaaccatgac

SEQ ID NO: 6228394 - DNA, 16 bp, Homo sapiens
gacaaccattaaagtc

SEQ ID NO: 6228395 - DNA, 15 bp, Homo sapiens
gacaacccaggcagt

SEQ ID NO: 6228396 - DNA, 24 bp, Homo sapiens
gacaaccccatcatatgacatgcc

SEQ ID NO: 6228397 - DNA, 20 bp, Homo sapiens
gacaaccgatgctccagcca

SEQ ID NO: 6228398 - DNA, 21 bp, Homo sapiens
gacaaccgatgctccagccaa

SEQ ID NO: 6228399 - DNA, 14 bp, Homo sapiens
gacaacctgtgcag

SEQ ID NO: 6228400 - DNA, 20 bp, Homo sapiens
gacaaccttggcttggccct

SEQ ID NO: 6228401 - DNA, 22 bp, Homo sapiens
gacaaccttggcttggccctgg

SEQ ID NO: 6228402 - DNA, 19 bp, Homo sapiens
gacaaccttgtcccaagga

SEQ ID NO: 6228403 - DNA, 13 bp, Homo sapiens
gacaacctttgtg

SEQ ID NO: 6228404 - DNA, 19 bp, Homo sapiens
gacaacgaacatggcatgt

SEQ ID NO: 6228405 - DNA, 23 bp, Homo sapiens
gacaacgaacatggcatgtgaaa

SEQ ID NO: 6228406 - DNA, 14 bp, Homo sapiens
gacaacgaggaagc

SEQ ID NO: 6228407 - DNA, 16 bp, Homo sapiens
gacaacgaggaagccc

SEQ ID NO: 6228408 - DNA, 15 bp, Homo sapiens
gacaacgtgctgctt

SEQ ID NO: 6228409 - DNA, 17 bp, Homo sapiens
gacaacgtttcagcgac

SEQ ID NO: 6228410 - DNA, 15 bp, Homo sapiens
gacaactagatttgt

SEQ ID NO: 6228411 - DNA, 18 bp, Homo sapiens
gacaactagatttgtcct

SEQ ID NO: 6228412 - DNA, 21 bp, Homo sapiens
gacaactcattttcatattgt

SEQ ID NO: 6228413 - DNA, 19 bp, Homo sapiens
gacaactgaagagacacgt

SEQ ID NO: 6228414 - DNA, 15 bp, Homo sapiens
gacaactggcaggca

SEQ ID NO: 6228415 - DNA, 19 bp, Homo sapiens
gacaactggtccactcagg

SEQ ID NO: 6228416 - DNA, 12 bp, Homo sapiens
gacaactgtgac

SEQ ID NO: 6228417 - DNA, 21 bp, Homo sapiens
gacaactgttttaataaaaga

SEQ ID NO: 6228418 - DNA, 16 bp, Homo sapiens
gacaacttagctcagg

SEQ ID NO: 6228419 - DNA, 21 bp, Homo sapiens
gacaacttctaattgccatgt

SEQ ID NO: 6228420 - DNA, 16 bp, Homo sapiens
gacaacttgctccttt

SEQ ID NO: 6228421 - DNA, 19 bp, Homo sapiens
gacaacttgctcctttcca

SEQ ID NO: 6228422 - DNA, 15 bp, Homo sapiens
gacaacttgtatctt

SEQ ID NO: 6228423 - DNA, 13 bp, Homo sapiens
gacaactttatgt

SEQ ID NO: 6228424 - DNA, 21 bp, Homo sapiens
gacaagaagctcccagatgct

SEQ ID NO: 6228425 - DNA, 12 bp, Homo sapiens
gacaagaagctg

SEQ ID NO: 6228426 - DNA, 13 bp, Homo sapiens
gacaagaagctgc

SEQ ID NO: 6228427 - DNA, 14 bp, Homo sapiens
gacaagaagctgct

SEQ ID NO: 6228428 - DNA, 17 bp, Homo sapiens
gacaagacagaggggag

SEQ ID NO: 6228429 - DNA, 16 bp, Homo sapiens
gacaagacttcagtat

SEQ ID NO: 6228430 - DNA, 16 bp, Homo sapiens
gacaagagagatgaaa

SEQ ID NO: 6228431 - DNA, 20 bp, Homo sapiens
gacaagagatctacacatgt

SEQ ID NO: 6228432 - DNA, 18 bp, Homo sapiens
gacaagagatgggaatga

SEQ ID NO: 6228433 - DNA, 22 bp, Homo sapiens
gacaagagcctgatctcttcct

SEQ ID NO: 6228434 - DNA, 19 bp, Homo sapiens
gacaagagctgttatgctg

SEQ ID NO: 6228435 - DNA, 20 bp, Homo sapiens
gacaagagctgttatgctgt

SEQ ID NO: 6228436 - DNA, 22 bp, Homo sapiens
gacaagagctgttatgctgttt

SEQ ID NO: 6228437 - DNA, 22 bp, Homo sapiens
gacaagagttggggacagaact

SEQ ID NO: 6228438 - DNA, 21 bp, Homo sapiens
gacaagataccggtgcttctg

SEQ ID NO: 6228439 - DNA, 19 bp, Homo sapiens
gacaagatattgtacataa

SEQ ID NO: 6228440 - DNA, 20 bp, Homo sapiens
gacaagattttttaattgtt

SEQ ID NO: 6228441 - DNA, 17 bp, Homo sapiens
gacaagcaacccaaact

SEQ ID NO: 6228442 - DNA, 19 bp, Homo sapiens
gacaagcaattagacaaga

SEQ ID NO: 6228443 - DNA, 15 bp, Homo sapiens
gacaagcacagtcag

SEQ ID NO: 6228444 - DNA, 12 bp, Homo sapiens
gacaagcagagg

SEQ ID NO: 6228445 - DNA, 14 bp, Homo sapiens
gacaagcaggccgc

SEQ ID NO: 6228446 - DNA, 18 bp, Homo sapiens
gacaagcagtgtctgtca

SEQ ID NO: 6228447 - DNA, 20 bp, Homo sapiens
gacaagcagtgtctgtcagc

SEQ ID NO: 6228448 - DNA, 13 bp, Homo sapiens
gacaagcatggaa

SEQ ID NO: 6228449 - DNA, 22 bp, Homo sapiens
gacaagccaacttgtaaataca

SEQ ID NO: 6228450 - DNA, 23 bp, Homo sapiens
gacaagccaacttgtaaatacac

SEQ ID NO: 6228451 - DNA, 15 bp, Homo sapiens
gacaagccccaggca

SEQ ID NO: 6228452 - DNA, 16 bp, Homo sapiens
gacaagccccaggcag

SEQ ID NO: 6228453 - DNA, 12 bp, Homo sapiens
gacaagccctgg

SEQ ID NO: 6228454 - DNA, 12 bp, Homo sapiens
gacaagcctgga

SEQ ID NO: 6228455 - DNA, 14 bp, Homo sapiens
gacaagctaggaaa

SEQ ID NO: 6228456 - DNA, 19 bp, Homo sapiens
gacaagctaggaaagagga

SEQ ID NO: 6228457 - DNA, 15 bp, Homo sapiens
gacaagctcacagac

SEQ ID NO: 6228458 - DNA, 14 bp, Homo sapiens
gacaagctcctccc

SEQ ID NO: 6228459 - DNA, 19 bp, Homo sapiens
gacaagctcctcccttgag

SEQ ID NO: 6228460 - DNA, 14 bp, Homo sapiens
gacaagctggccaa

SEQ ID NO: 6228461 - DNA, 19 bp, Homo sapiens
gacaagctggccaaagtca

SEQ ID NO: 6228462 - DNA, 22 bp, Homo sapiens
gacaagctggccaaagtcactt

SEQ ID NO: 6228463 - DNA, 13 bp, Homo sapiens
gacaaggaagtgg

SEQ ID NO: 6228464 - DNA, 15 bp, Homo sapiens
gacaaggaggtagag

SEQ ID NO: 6228465 - DNA, 18 bp, Homo sapiens
gacaaggattgctactgt

SEQ ID NO: 6228466 - DNA, 19 bp, Homo sapiens
gacaaggattgctactgtc

SEQ ID NO: 6228467 - DNA, 16 bp, Homo sapiens
gacaaggcaggcctga

SEQ ID NO: 6228468 - DNA, 12 bp, Homo sapiens
gacaaggccagc

SEQ ID NO: 6228469 - DNA, 15 bp, Homo sapiens
gacaaggccagcacc

SEQ ID NO: 6228470 - DNA, 16 bp, Homo sapiens
gacaaggctgtgccag

SEQ ID NO: 6228471 - DNA, 20 bp, Homo sapiens
gacaaggctgtgccaggctg

SEQ ID NO: 6228472 - DNA, 17 bp, Homo sapiens
gacaagggaggcagtgg

SEQ ID NO: 6228473 - DNA, 13 bp, Homo sapiens
gacaagggattct

SEQ ID NO: 6228474 - DNA, 16 bp, Homo sapiens
gacaagggattctggg

SEQ ID NO: 6228475 - DNA, 21 bp, Homo sapiens
gacaagggctgacctgcctct

SEQ ID NO: 6228476 - DNA, 16 bp, Homo sapiens
gacaaggggtggaagg

SEQ ID NO: 6228477 - DNA, 21 bp, Homo sapiens
gacaaggtagacatggatttg

SEQ ID NO: 6228478 - DNA, 14 bp, Homo sapiens
gacaaggtcacctg

SEQ ID NO: 6228479 - DNA, 17 bp, Homo sapiens
gacaaggtgcaggcagg

SEQ ID NO: 6228480 - DNA, 18 bp, Homo sapiens
gacaaggtgtttctctgt

SEQ ID NO: 6228481 - DNA, 12 bp, Homo sapiens
gacaagtagttc

SEQ ID NO: 6228482 - DNA, 23 bp, Homo sapiens
gacaagtatgaatattactctca

SEQ ID NO: 6228483 - DNA, 23 bp, Homo sapiens
gacaagtctgagtagttatgaat

SEQ ID NO: 6228484 - DNA, 15 bp, Homo sapiens
gacaagtcttgctgt

SEQ ID NO: 6228485 - DNA, 17 bp, Homo sapiens
gacaagtcttgctgtgc

SEQ ID NO: 6228486 - DNA, 20 bp, Homo sapiens
gacaagtcttgctgtgcttt

SEQ ID NO: 6228487 - DNA, 14 bp, Homo sapiens
gacaagtgctgttg

SEQ ID NO: 6228488 - DNA, 20 bp, Homo sapiens
gacaagtggactcagggcag

SEQ ID NO: 6228489 - DNA, 15 bp, Homo sapiens
gacaagtggaggggg

SEQ ID NO: 6228490 - DNA, 17 bp, Homo sapiens
gacaagtggagggggtg

SEQ ID NO: 6228491 - DNA, 13 bp, Homo sapiens
gacaagtgtcttt

SEQ ID NO: 6228492 - DNA, 14 bp, Homo sapiens
gacaagtgtctttt

SEQ ID NO: 6228493 - DNA, 23 bp, Homo sapiens
gacaagttacacctccactcagc

SEQ ID NO: 6228494 - DNA, 22 bp, Homo sapiens
gacaagttttagttaaaactca

SEQ ID NO: 6228495 - DNA, 20 bp, Homo sapiens
gacaataaacatctgagcag

SEQ ID NO: 6228496 - DNA, 15 bp, Homo sapiens
gacaataacttctta

SEQ ID NO: 6228497 - DNA, 15 bp, Homo sapiens
gacaataatctcact

SEQ ID NO: 6228498 - DNA, 22 bp, Homo sapiens
gacaataattacattggcacaa

SEQ ID NO: 6228499 - DNA, 19 bp, Homo sapiens
gacaataatttcaggtttt

SEQ ID NO: 6228500 - DNA, 18 bp, Homo sapiens
gacaatacagtaagcata

SEQ ID NO: 6228501 - DNA, 19 bp, Homo sapiens
gacaatactgtatcagatg

SEQ ID NO: 6228502 - DNA, 14 bp, Homo sapiens
gacaatagaacatt

SEQ ID NO: 6228503 - DNA, 22 bp, Homo sapiens
gacaatagagggccacggggag

SEQ ID NO: 6228504 - DNA, 17 bp, Homo sapiens
gacaatagcattagaaa

SEQ ID NO: 6228505 - DNA, 15 bp, Homo sapiens
gacaatatacaagct

SEQ ID NO: 6228506 - DNA, 13 bp, Homo sapiens
gacaatatatcat

SEQ ID NO: 6228507 - DNA, 18 bp, Homo sapiens
gacaatatcaatcacatt

SEQ ID NO: 6228508 - DNA, 19 bp, Homo sapiens
gacaatatgtgagtgcctt

SEQ ID NO: 6228509 - DNA, 22 bp, Homo sapiens
gacaatcacagctcctcgctgc

SEQ ID NO: 6228510 - DNA, 22 bp, Homo sapiens
gacaatcacgggcggtcctgca

SEQ ID NO: 6228511 - DNA, 19 bp, Homo sapiens
gacaatcagtcccctccca

SEQ ID NO: 6228512 - DNA, 23 bp, Homo sapiens
gacaatcatctccaatggaaagc

SEQ ID NO: 6228513 - DNA, 19 bp, Homo sapiens
gacaatcatgaaatatgca

SEQ ID NO: 6228514 - DNA, 13 bp, Homo sapiens
gacaatcatgtgt

SEQ ID NO: 6228515 - DNA, 14 bp, Homo sapiens
gacaatccactctc

SEQ ID NO: 6228516 - DNA, 19 bp, Homo sapiens
gcaaaccctgtcaaacatt

SEQ ID NO: 6228517 - DNA, 14 bp, Homo sapiens
gcaaaccctttgta

SEQ ID NO: 6228518 - DNA, 15 bp, Homo sapiens
gcaaaccctttgtat

SEQ ID NO: 6228519 - DNA, 16 bp, Homo sapiens
gcaaacctctccttcc

SEQ ID NO: 6228520 - DNA, 21 bp, Homo sapiens
gcaaacctgacccctgctcag

SEQ ID NO: 6228521 - DNA, 22 bp, Homo sapiens
gcaaacctgcagtttttaattt

SEQ ID NO: 6228522 - DNA, 13 bp, Homo sapiens
gcaaacctgctgg

SEQ ID NO: 6228523 - DNA, 15 bp, Homo sapiens
gcaaacctgctggtg

SEQ ID NO: 6228524 - DNA, 14 bp, Homo sapiens
gcaaaccttcctgg

SEQ ID NO: 6228525 - DNA, 17 bp, Homo sapiens
gcaaactatttgcgact

SEQ ID NO: 6228526 - DNA, 16 bp, Homo sapiens
gcaaactcaagcttct

SEQ ID NO: 6228527 - DNA, 21 bp, Homo sapiens
gcaaactcaagcttcttcact

SEQ ID NO: 6228528 - DNA, 19 bp, Homo sapiens
gcaaactcactgctcaaga

SEQ ID NO: 6228529 - DNA, 13 bp, Homo sapiens
gcaaactccaggt

SEQ ID NO: 6228530 - DNA, 17 bp, Homo sapiens
gcaaactctataaagaa

SEQ ID NO: 6228531 - DNA, 18 bp, Homo sapiens
gcaaactctataaagaaa

SEQ ID NO: 6228532 - DNA, 13 bp, Homo sapiens
gcaaactctgctg

SEQ ID NO: 6228533 - DNA, 14 bp, Homo sapiens
gcaaactctgctgt

SEQ ID NO: 6228534 - DNA, 22 bp, Homo sapiens
gcaaactgaaattagtgttttc

SEQ ID NO: 6228535 - DNA, 18 bp, Homo sapiens
gcaaactgaagcccacag

SEQ ID NO: 6228536 - DNA, 17 bp, Homo sapiens
gcaaactgaggcagcat

SEQ ID NO: 6228537 - DNA, 17 bp, Homo sapiens
gcaaactgatgctgagg

SEQ ID NO: 6228538 - DNA, 17 bp, Homo sapiens
gcaaactgggaacccct

SEQ ID NO: 6228539 - DNA, 19 bp, Homo sapiens
gcaaactgtgcttctctat

SEQ ID NO: 6228540 - DNA, 16 bp, Homo sapiens
gcaaacttgtatctga

SEQ ID NO: 6228541 - DNA, 12 bp, Homo sapiens
gcaaactttaac

SEQ ID NO: 6228542 - DNA, 18 bp, Homo sapiens
gcaaactttagtgtctct

SEQ ID NO: 6228543 - DNA, 18 bp, Homo sapiens
gcaaactttattttgtgt

SEQ ID NO: 6228544 - DNA, 16 bp, Homo sapiens
gcaaacttttatgcag

SEQ ID NO: 6228545 - DNA, 23 bp, Homo sapiens
gcaaagaaaagaactgcttgcat

SEQ ID NO: 6228546 - DNA, 12 bp, Homo sapiens
gcaaagaaaatg

SEQ ID NO: 6228547 - DNA, 18 bp, Homo sapiens
gcaaagaaaattctcaag

SEQ ID NO: 6228548 - DNA, 16 bp, Homo sapiens
gcaaagaactgcccca

SEQ ID NO: 6228549 - DNA, 14 bp, Homo sapiens
gcaaagaatcaaca

SEQ ID NO: 6228550 - DNA, 18 bp, Homo sapiens
gcaaagacaaaagaaact

SEQ ID NO: 6228551 - DNA, 19 bp, Homo sapiens
gcaaagacaaaagaaactt

SEQ ID NO: 6228552 - DNA, 12 bp, Homo sapiens
gcaaagaccacc

SEQ ID NO: 6228553 - DNA, 21 bp, Homo sapiens
gcaaagactattcccttctaa

SEQ ID NO: 6228554 - DNA, 22 bp, Homo sapiens
gcaaagactattcccttctaac

SEQ ID NO: 6228555 - DNA, 13 bp, Homo sapiens
gcaaagactctga

SEQ ID NO: 6228556 - DNA, 20 bp, Homo sapiens
gcaaagactctgagccaagg

SEQ ID NO: 6228557 - DNA, 22 bp, Homo sapiens
gcaaagactctgagccaaggga

SEQ ID NO: 6228558 - DNA, 16 bp, Homo sapiens
gcaaagagacatttca

SEQ ID NO: 6228559 - DNA, 14 bp, Homo sapiens
gcaaagagagattt

SEQ ID NO: 6228560 - DNA, 12 bp, Homo sapiens
gcaaagagaggt

SEQ ID NO: 6228561 - DNA, 16 bp, Homo sapiens
gcaaagaggactcgct

SEQ ID NO: 6228562 - DNA, 12 bp, Homo sapiens
gcaaagaggggc

SEQ ID NO: 6228563 - DNA, 20 bp, Homo sapiens
gcaaagaggggcgctgtcct

SEQ ID NO: 6228564 - DNA, 18 bp, Homo sapiens
gcaaagaggtgctgcttt

SEQ ID NO: 6228565 - DNA, 19 bp, Homo sapiens
gcaaagaggtgctgctttg

SEQ ID NO: 6228566 - DNA, 22 bp, Homo sapiens
gcaaagataatttatttcaata

SEQ ID NO: 6228567 - DNA, 13 bp, Homo sapiens
gcaaagatccagc

SEQ ID NO: 6228568 - DNA, 19 bp, Homo sapiens
gcaaagatccagcggggct

SEQ ID NO: 6228569 - DNA, 20 bp, Homo sapiens
gcaaagatctgtcctcagcc

SEQ ID NO: 6228570 - DNA, 15 bp, Homo sapiens
gcaaagatggcttcc

SEQ ID NO: 6228571 - DNA, 14 bp, Homo sapiens
gcaaagatttcagt

SEQ ID NO: 6228572 - DNA, 15 bp, Homo sapiens
gcaaagatttcagta

SEQ ID NO: 6228573 - DNA, 13 bp, Homo sapiens
gcaaagcaccagc

SEQ ID NO: 6228574 - DNA, 21 bp, Homo sapiens
gcaaagcaccagcttctccag

SEQ ID NO: 6228575 - DNA, 22 bp, Homo sapiens
gcaaagcaccagcttctccagg

SEQ ID NO: 6228576 - DNA, 23 bp, Homo sapiens
gcaaagcaccagcttctccaggc

SEQ ID NO: 6228577 - DNA, 16 bp, Homo sapiens
gcaaagcactctctgc

SEQ ID NO: 6228578 - DNA, 12 bp, Homo sapiens
gcaaagcattga

SEQ ID NO: 6228579 - DNA, 18 bp, Homo sapiens
gcaaagccaaggcagcga

SEQ ID NO: 6228580 - DNA, 12 bp, Homo sapiens
gcaaagccatat

SEQ ID NO: 6228581 - DNA, 15 bp, Homo sapiens
gcaaagcccccagag

SEQ ID NO: 6228582 - DNA, 16 bp, Homo sapiens
gcaaagcccctcacac

SEQ ID NO: 6228583 - DNA, 23 bp, Homo sapiens
gcaaagcccctcacactgcaagg

SEQ ID NO: 6228584 - DNA, 12 bp, Homo sapiens
gcaaagcctcct

SEQ ID NO: 6228585 - DNA, 13 bp, Homo sapiens
gcaaagcctcctt

SEQ ID NO: 6228586 - DNA, 19 bp, Homo sapiens
gcaaagcctgttcatggca

SEQ ID NO: 6228587 - DNA, 14 bp, Homo sapiens
gcaaagcctttaaa

SEQ ID NO: 6228588 - DNA, 17 bp, Homo sapiens
gcaaagcgcccacccag

SEQ ID NO: 6228589 - DNA, 21 bp, Homo sapiens
gcaaagcgcccacccaggtcc

SEQ ID NO: 6228590 - DNA, 17 bp, Homo sapiens
gcaaagctaaaataaaa

SEQ ID NO: 6228591 - DNA, 16 bp, Homo sapiens
gcaaagctacaggact

SEQ ID NO: 6228592 - DNA, 19 bp, Homo sapiens
gcaaagctctgtggccaca

SEQ ID NO: 6228593 - DNA, 21 bp, Homo sapiens
gcaaagctgatgacaacttcc

SEQ ID NO: 6228594 - DNA, 15 bp, Homo sapiens
gcaaagctgctgggc

SEQ ID NO: 6228595 - DNA, 16 bp, Homo sapiens
gcaaagctgctgggcc

SEQ ID NO: 6228596 - DNA, 18 bp, Homo sapiens
gcaaagctgctgggccag

SEQ ID NO: 6228597 - DNA, 11 bp, Homo sapiens
gcaaagcttgt

SEQ ID NO: 6228598 - DNA, 17 bp, Homo sapiens
gcaaagctttggctgag

SEQ ID NO: 6228599 - DNA, 12 bp, Homo sapiens
gcaaaggaaaat

SEQ ID NO: 6228600 - DNA, 16 bp, Homo sapiens
gcaaaggaaaccaaag

SEQ ID NO: 6228601 - DNA, 15 bp, Homo sapiens
gcaaaggaaggtgga

SEQ ID NO: 6228602 - DNA, 20 bp, Homo sapiens
gcaaaggaaggtggatggcc

SEQ ID NO: 6228603 - DNA, 19 bp, Homo sapiens
gcaaaggacccttgagtaa

SEQ ID NO: 6228604 - DNA, 20 bp, Homo sapiens
gcaaaggactgttttttcct

SEQ ID NO: 6228605 - DNA, 18 bp, Homo sapiens
gcaaaggagaaatctggc

SEQ ID NO: 6228606 - DNA, 12 bp, Homo sapiens
gcaaaggagaag

SEQ ID NO: 6228607 - DNA, 20 bp, Homo sapiens
gcaaaggagaagcacagctc

SEQ ID NO: 6228608 - DNA, 18 bp, Homo sapiens
gcaaaggagacaaagcag

SEQ ID NO: 6228609 - DNA, 19 bp, Homo sapiens
gcaaaggagacaaagcagg

SEQ ID NO: 6228610 - DNA, 20 bp, Homo sapiens
gcaaaggagacaaagcagga

SEQ ID NO: 6228611 - DNA, 22 bp, Homo sapiens
gcaaaggagacaaagcaggagt

SEQ ID NO: 6228612 - DNA, 15 bp, Homo sapiens
gcaaaggagggcctc

SEQ ID NO: 6228613 - DNA, 19 bp, Homo sapiens
gcaaaggagggcctcagag

SEQ ID NO: 6228614 - DNA, 17 bp, Homo sapiens
gcaaaggcaggaggtgg

SEQ ID NO: 6228615 - DNA, 14 bp, Homo sapiens
gcaaaggcagggcc

SEQ ID NO: 6228616 - DNA, 18 bp, Homo sapiens
gcaaaggcagtcccggga

SEQ ID NO: 6228617 - DNA, 14 bp, Homo sapiens
gcaaaggccctggg

SEQ ID NO: 6228618 - DNA, 13 bp, Homo sapiens
gcaaaggcccttg

SEQ ID NO: 6228619 - DNA, 11 bp, Homo sapiens
gcaaaggcctg

SEQ ID NO: 6228620 - DNA, 13 bp, Homo sapiens
gcaaaggctggga

SEQ ID NO: 6228621 - DNA, 17 bp, Homo sapiens
gcaaagggagcagaact

SEQ ID NO: 6228622 - DNA, 22 bp, Homo sapiens
gcaaagggattactagagaaag

SEQ ID NO: 6228623 - DNA, 14 bp, Homo sapiens
gcaaagggcatggg

SEQ ID NO: 6228624 - DNA, 23 bp, Homo sapiens
gcaaagggcatgggtcgggagag

SEQ ID NO: 6228625 - DNA, 22 bp, Homo sapiens
gcaaagggcctgcccagacaag

SEQ ID NO: 6228626 - DNA, 15 bp, Homo sapiens
gcaaagggcgggcct

SEQ ID NO: 6228627 - DNA, 15 bp, Homo sapiens
gcaaagggctgaaag

SEQ ID NO: 6228628 - DNA, 15 bp, Homo sapiens
gcaaaggggcaatgg

SEQ ID NO: 6228629 - DNA, 23 bp, Homo sapiens
gcaaagggggaggagaagaaaat

SEQ ID NO: 6228630 - DNA, 13 bp, Homo sapiens
gcaaaggggggag

SEQ ID NO: 6228631 - DNA, 17 bp, Homo sapiens
gcaaaggggggaggtca

SEQ ID NO: 6228632 - DNA, 17 bp, Homo sapiens
gcaaaggtgcactccag

SEQ ID NO: 6228633 - DNA, 23 bp, Homo sapiens
gcaaaggtgcactccagactctg

SEQ ID NO: 6228634 - DNA, 22 bp, Homo sapiens
gcaaaggtgggaggatcatttg

SEQ ID NO: 6228635 - DNA, 12 bp, Homo sapiens
gcaaagtacaat

SEQ ID NO: 6228636 - DNA, 19 bp, Homo sapiens
gcaaagtacaggtactttg

SEQ ID NO: 6228637 - DNA, 20 bp, Homo sapiens
gcaaagtaccaactgagcca

SEQ ID NO: 6228638 - DNA, 22 bp, Homo sapiens
gcaaagtactgtaagaataatt

SEQ ID NO: 6228639 - DNA, 21 bp, Homo sapiens
gcaaagtattgtaaattatat

SEQ ID NO: 6228640 - DNA, 20 bp, Homo sapiens
gcaaagtcatgtcagaagga

SEQ ID NO: 6228641 - DNA, 16 bp, Homo sapiens
gcaaagtctaaagttt

SEQ ID NO: 6228642 - DNA, 21 bp, Homo sapiens
gcaaagtctaaagtttacagt

SEQ ID NO: 6228643 - DNA, 20 bp, Homo sapiens
gcaaagtgaagacactggct

SEQ ID NO: 6228644 - DNA, 20 bp, Homo sapiens
gcaaagtgattcactgtgct

SEQ ID NO: 6228645 - DNA, 17 bp, Homo sapiens
gcaaagtgattccctgc

SEQ ID NO: 6228646 - DNA, 19 bp, Homo sapiens
gcaaagtgcccatggtggc

SEQ ID NO: 6228647 - DNA, 23 bp, Homo sapiens
gcaaagtgctgtacccttccacc

SEQ ID NO: 6228648 - DNA, 17 bp, Homo sapiens
gcaaagtggcagggacc

SEQ ID NO: 6228649 - DNA, 14 bp, Homo sapiens
gcaaagtgttttgt

SEQ ID NO: 6228650 - DNA, 18 bp, Homo sapiens
gcaaagttacagatgcac

SEQ ID NO: 6228651 - DNA, 22 bp, Homo sapiens
gcaaagttacagatgcacccca

SEQ ID NO: 6228652 - DNA, 20 bp, Homo sapiens
gcaaagttatcttaaatatg

SEQ ID NO: 6228653 - DNA, 20 bp, Homo sapiens
gcaaagttttacagagagga

SEQ ID NO: 6228654 - DNA, 14 bp, Homo sapiens
gcaaataaagcagt

SEQ ID NO: 6228655 - DNA, 15 bp, Homo sapiens
gcaaataaagccttt

SEQ ID NO: 6228656 - DNA, 19 bp, Homo sapiens
gcaaataaagccttttaaa

SEQ ID NO: 6228657 - DNA, 19 bp, Homo sapiens
gcaaataaatacgtgtcaa

SEQ ID NO: 6228658 - DNA, 17 bp, Homo sapiens
gcaaataacaaatgcca

SEQ ID NO: 6228659 - DNA, 21 bp, Homo sapiens
gcaaataagcactcctttaaa

SEQ ID NO: 6228660 - DNA, 20 bp, Homo sapiens
gcaaataagtcatctgatga

SEQ ID NO: 6228661 - DNA, 19 bp, Homo sapiens
gcaaataatttcctggtgt

SEQ ID NO: 6228662 - DNA, 22 bp, Homo sapiens
gcaaataatttcctggtgtgaa

SEQ ID NO: 6228663 - DNA, 16 bp, Homo sapiens
gcaaatacaaaatgat

SEQ ID NO: 6228664 - DNA, 16 bp, Homo sapiens
gcaaatacaatcagcc

SEQ ID NO: 6228665 - DNA, 20 bp, Homo sapiens
gcaaatactccaagcttcaa

SEQ ID NO: 6228666 - DNA, 22 bp, Homo sapiens
gcaaatactccaagcttcaagt

SEQ ID NO: 6228667 - DNA, 18 bp, Homo sapiens
gcaaatagattcagagaa

SEQ ID NO: 6228668 - DNA, 19 bp, Homo sapiens
gcaaatagattcagagaaa

SEQ ID NO: 6228669 - DNA, 20 bp, Homo sapiens
gcaaatagattcagagaaat

SEQ ID NO: 6228670 - DNA, 22 bp, Homo sapiens
gcaaatagattcagagaaattt

SEQ ID NO: 6228671 - DNA, 23 bp, Homo sapiens
gcaaatagccacaattatataaa

SEQ ID NO: 6228672 - DNA, 14 bp, Homo sapiens
gcaaatagtagagt

SEQ ID NO: 6228673 - DNA, 16 bp, Homo sapiens
gcaaatagtttcaaat

SEQ ID NO: 6228674 - DNA, 11 bp, Homo sapiens
gcaaatataaa

SEQ ID NO: 6228675 - DNA, 14 bp, Homo sapiens
gcaaatataaacat

SEQ ID NO: 6228676 - DNA, 15 bp, Homo sapiens
gcaaatataaacatc

SEQ ID NO: 6228677 - DNA, 17 bp, Homo sapiens
gcaaatataagctggga

SEQ ID NO: 6228678 - DNA, 19 bp, Homo sapiens
gcaaatatactttactttt

SEQ ID NO: 6228679 - DNA, 13 bp, Homo sapiens
gcaaatatagaaa

SEQ ID NO: 6228680 - DNA, 20 bp, Homo sapiens
gcaaatatcatactgttcaa

SEQ ID NO: 6228681 - DNA, 18 bp, Homo sapiens
gcaaatattagcaaagaa

SEQ ID NO: 6228682 - DNA, 19 bp, Homo sapiens
gcaaatatttatgacctca

SEQ ID NO: 6228683 - DNA, 21 bp, Homo sapiens
gcaaatattttgtcactgctg

SEQ ID NO: 6228684 - DNA, 15 bp, Homo sapiens
gcaaatcaaccccag

SEQ ID NO: 6228685 - DNA, 12 bp, Homo sapiens
gcaaatcaatgc

SEQ ID NO: 6228686 - DNA, 17 bp, Homo sapiens
gcaaatcaggcttttgt

SEQ ID NO: 6228687 - DNA, 18 bp, Homo sapiens
gcaaatcaggggccagag

SEQ ID NO: 6228688 - DNA, 19 bp, Homo sapiens
gcaaatcaggggccagaga

SEQ ID NO: 6228689 - DNA, 22 bp, Homo sapiens
gcaaatccataccccctgcccc

SEQ ID NO: 6228690 - DNA, 19 bp, Homo sapiens
gcaaatcctatgtgatttt

SEQ ID NO: 6228691 - DNA, 19 bp, Homo sapiens
gcaaatcctcttctaactc

SEQ ID NO: 6228692 - DNA, 20 bp, Homo sapiens
gcaaatccttgtgggaaaag

SEQ ID NO: 6228693 - DNA, 22 bp, Homo sapiens
gcaaatccttgtgggaaaagaa

SEQ ID NO: 6228694 - DNA, 18 bp, Homo sapiens
gcaaatctcctttgtcca

SEQ ID NO: 6228695 - DNA, 15 bp, Homo sapiens
gacaatcctgaagaa

SEQ ID NO: 6228696 - DNA, 17 bp, Homo sapiens
gacaatcgtgatagtta

SEQ ID NO: 6228697 - DNA, 19 bp, Homo sapiens
gacaatctaaaaaatatct

SEQ ID NO: 6228698 - DNA, 20 bp, Homo sapiens
gacaatctaccaactgtccc

SEQ ID NO: 6228699 - DNA, 19 bp, Homo sapiens
gacaatgaaacaacagaga

SEQ ID NO: 6228700 - DNA, 16 bp, Homo sapiens
gacaatgacccagtgg

SEQ ID NO: 6228701 - DNA, 15 bp, Homo sapiens
gacaatgactaagcc

SEQ ID NO: 6228702 - DNA, 20 bp, Homo sapiens
gacaatgactaagccaagct

SEQ ID NO: 6228703 - DNA, 23 bp, Homo sapiens
gacaatgatattgacactgtccc

SEQ ID NO: 6228704 - DNA, 20 bp, Homo sapiens
gacaatgatgatgataatga

SEQ ID NO: 6228705 - DNA, 16 bp, Homo sapiens
gacaatgcaaaccatc

SEQ ID NO: 6228706 - DNA, 22 bp, Homo sapiens
gacaatgcaaaccatcattgaa

SEQ ID NO: 6228707 - DNA, 16 bp, Homo sapiens
gacaatgcagatgcca

SEQ ID NO: 6228708 - DNA, 16 bp, Homo sapiens
gacaatgccaataggt

SEQ ID NO: 6228709 - DNA, 20 bp, Homo sapiens
gacaatgccctgctggcctg

SEQ ID NO: 6228710 - DNA, 23 bp, Homo sapiens
gacaatgcgaggtcgcaactgag

SEQ ID NO: 6228711 - DNA, 16 bp, Homo sapiens
gacaatggcagatgta

SEQ ID NO: 6228712 - DNA, 13 bp, Homo sapiens
gacaatggcagct

SEQ ID NO: 6228713 - DNA, 17 bp, Homo sapiens
gacaatggctatattaa

SEQ ID NO: 6228714 - DNA, 14 bp, Homo sapiens
gacaatgtctgaac

SEQ ID NO: 6228715 - DNA, 19 bp, Homo sapiens
gacaatgtgaaaagaaaaa

SEQ ID NO: 6228716 - DNA, 20 bp, Homo sapiens
gacaatgtgaaaagaaaaat

SEQ ID NO: 6228717 - DNA, 19 bp, Homo sapiens
gacaatgttgtagtgtccc

SEQ ID NO: 6228718 - DNA, 18 bp, Homo sapiens
gacaatgttgtcctcctg

SEQ ID NO: 6228719 - DNA, 16 bp, Homo sapiens
gacaattactcaggtt

SEQ ID NO: 6228720 - DNA, 14 bp, Homo sapiens
gacaattagcagaa

SEQ ID NO: 6228721 - DNA, 13 bp, Homo sapiens
gacaattatgaaa

SEQ ID NO: 6228722 - DNA, 17 bp, Homo sapiens
gacaattcagtgactta

SEQ ID NO: 6228723 - DNA, 16 bp, Homo sapiens
gacaattcatgaactt

SEQ ID NO: 6228724 - DNA, 23 bp, Homo sapiens
gacaattcctagataaaaagatg

SEQ ID NO: 6228725 - DNA, 17 bp, Homo sapiens
gacaattcctccagaga

SEQ ID NO: 6228726 - DNA, 19 bp, Homo sapiens
gacaattcctccagagaca

SEQ ID NO: 6228727 - DNA, 22 bp, Homo sapiens
gacaattcctccagagacactg

SEQ ID NO: 6228728 - DNA, 11 bp, Homo sapiens
gacaattctaa

SEQ ID NO: 6228729 - DNA, 12 bp, Homo sapiens
gacaattctgca

SEQ ID NO: 6228730 - DNA, 13 bp, Homo sapiens
gacaattctttat

SEQ ID NO: 6228731 - DNA, 15 bp, Homo sapiens
gacaattctttatac

SEQ ID NO: 6228732 - DNA, 22 bp, Homo sapiens
gacaattgaggtaagttttttg

SEQ ID NO: 6228733 - DNA, 14 bp, Homo sapiens
gacaatttaccaca

SEQ ID NO: 6228734 - DNA, 22 bp, Homo sapiens
gacaatttatatttaataaaat

SEQ ID NO: 6228735 - DNA, 13 bp, Homo sapiens
gacaatttcaaaa

SEQ ID NO: 6228736 - DNA, 14 bp, Homo sapiens
gacaatttcaaaat

SEQ ID NO: 6228737 - DNA, 19 bp, Homo sapiens
gacaatttccaagaatgat

SEQ ID NO: 6228738 - DNA, 15 bp, Homo sapiens
gacaatttctggcag

SEQ ID NO: 6228739 - DNA, 17 bp, Homo sapiens
gacaatttgatacataa

SEQ ID NO: 6228740 - DNA, 18 bp, Homo sapiens
gacaatttgatacataat

SEQ ID NO: 6228741 - DNA, 20 bp, Homo sapiens
gacaatttgccatagcagtg

SEQ ID NO: 6228742 - DNA, 16 bp, Homo sapiens
gacaattttttttcaa

SEQ ID NO: 6228743 - DNA, 21 bp, Homo sapiens
gacaattttttttcaaatgtg

SEQ ID NO: 6228744 - DNA, 13 bp, Homo sapiens
gacacaaaaaaag

SEQ ID NO: 6228745 - DNA, 17 bp, Homo sapiens
gacacaaaactccgccc

SEQ ID NO: 6228746 - DNA, 15 bp, Homo sapiens
gacacaaaagaagaa

SEQ ID NO: 6228747 - DNA, 18 bp, Homo sapiens
gacacaaagcttctaaag

SEQ ID NO: 6228748 - DNA, 20 bp, Homo sapiens
gacacaaaggtggaataaac

SEQ ID NO: 6228749 - DNA, 11 bp, Homo sapiens
gacacaactca

SEQ ID NO: 6228750 - DNA, 14 bp, Homo sapiens
gacacaactcatcc

SEQ ID NO: 6228751 - DNA, 21 bp, Homo sapiens
gacacaaggcacggccacgtc

SEQ ID NO: 6228752 - DNA, 22 bp, Homo sapiens
gacacaagtggaccttaggcct

SEQ ID NO: 6228753 - DNA, 20 bp, Homo sapiens
gacacaataggtctttctct

SEQ ID NO: 6228754 - DNA, 20 bp, Homo sapiens
gacacaatatgtatgctttt

SEQ ID NO: 6228755 - DNA, 23 bp, Homo sapiens
gacacaatccctggggctgtgca

SEQ ID NO: 6228756 - DNA, 20 bp, Homo sapiens
gacacaatctcggctcactg

SEQ ID NO: 6228757 - DNA, 18 bp, Homo sapiens
gacacaatgttgcactga

SEQ ID NO: 6228758 - DNA, 23 bp, Homo sapiens
gacacaatgttgcactgaaaacc

SEQ ID NO: 6228759 - DNA, 14 bp, Homo sapiens
gacacaatttcatt

SEQ ID NO: 6228760 - DNA, 21 bp, Homo sapiens
gacacacaagcagacacacac

SEQ ID NO: 6228761 - DNA, 10 bp, Homo sapiens
gacacacaca

SEQ ID NO: 6228762 - DNA, 12 bp, Homo sapiens
gacacacacaca

SEQ ID NO: 6228763 - DNA, 15 bp, Homo sapiens
gacacacacacacac

SEQ ID NO: 6228764 - DNA, 20 bp, Homo sapiens
gacacacacacacacacaaa

SEQ ID NO: 6228765 - DNA, 21 bp, Homo sapiens
gacacacacacacacacacat

SEQ ID NO: 6228766 - DNA, 23 bp, Homo sapiens
gacacacacacacacacacatat

SEQ ID NO: 6228767 - DNA, 13 bp, Homo sapiens
gacacacacacgc

SEQ ID NO: 6228768 - DNA, 14 bp, Homo sapiens
gacacacacacgca

SEQ ID NO: 6228769 - DNA, 23 bp, Homo sapiens
gacacacacacgcacgcacacac

SEQ ID NO: 6228770 - DNA, 14 bp, Homo sapiens
gacacacacagctt

SEQ ID NO: 6228771 - DNA, 17 bp, Homo sapiens
gacacacacatatatac

SEQ ID NO: 6228772 - DNA, 20 bp, Homo sapiens
gacacacacatatatacata

SEQ ID NO: 6228773 - DNA, 17 bp, Homo sapiens
gacacacactcaccagt

SEQ ID NO: 6228774 - DNA, 21 bp, Homo sapiens
gacacacactcaccagtggcc

SEQ ID NO: 6228775 - DNA, 19 bp, Homo sapiens
gacacacagaaatgtgtca

SEQ ID NO: 6228776 - DNA, 19 bp, Homo sapiens
gacacacagcactctctaa

SEQ ID NO: 6228777 - DNA, 12 bp, Homo sapiens
gacacacagcct

SEQ ID NO: 6228778 - DNA, 17 bp, Homo sapiens
gacacacagctctgtcc

SEQ ID NO: 6228779 - DNA, 18 bp, Homo sapiens
gacacacagctctgtcct

SEQ ID NO: 6228780 - DNA, 19 bp, Homo sapiens
gacacacagctctgtcctg

SEQ ID NO: 6228781 - DNA, 20 bp, Homo sapiens
gacacacagtctcagtccag

SEQ ID NO: 6228782 - DNA, 21 bp, Homo sapiens
gacacacagtctcagtccaga

SEQ ID NO: 6228783 - DNA, 18 bp, Homo sapiens
gacacacagtgacaaaag

SEQ ID NO: 6228784 - DNA, 19 bp, Homo sapiens
gacacacatacataatggt

SEQ ID NO: 6228785 - DNA, 20 bp, Homo sapiens
gacacacatgacgcaccagt

SEQ ID NO: 6228786 - DNA, 14 bp, Homo sapiens
gacacacatgggca

SEQ ID NO: 6228787 - DNA, 19 bp, Homo sapiens
gacacacatgggcagccca

SEQ ID NO: 6228788 - DNA, 23 bp, Homo sapiens
gacacaccccacaccccagccca

SEQ ID NO: 6228789 - DNA, 19 bp, Homo sapiens
gacacacccctaagtacaa

SEQ ID NO: 6228790 - DNA, 15 bp, Homo sapiens
gacacacgcacacac

SEQ ID NO: 6228791 - DNA, 20 bp, Homo sapiens
gacacacggggcacccagcc

SEQ ID NO: 6228792 - DNA, 21 bp, Homo sapiens
gacacactaaactctggggct

SEQ ID NO: 6228793 - DNA, 15 bp, Homo sapiens
gacacactaaccaag

SEQ ID NO: 6228794 - DNA, 16 bp, Homo sapiens
gacacactcaccattt

SEQ ID NO: 6228795 - DNA, 17 bp, Homo sapiens
gacacactctcatgtcc

SEQ ID NO: 6228796 - DNA, 15 bp, Homo sapiens
gacacactgaagaag

SEQ ID NO: 6228797 - DNA, 21 bp, Homo sapiens
gacacactgcggtgtctgcag

SEQ ID NO: 6228798 - DNA, 22 bp, Homo sapiens
gacacactgcggtgtctgcagc

SEQ ID NO: 6228799 - DNA, 10 bp, Homo sapiens
gacacactgt

SEQ ID NO: 6228800 - DNA, 19 bp, Homo sapiens
gacacagaaaatgttgaga

SEQ ID NO: 6228801 - DNA, 15 bp, Homo sapiens
gacacagaacacaga

SEQ ID NO: 6228802 - DNA, 22 bp, Homo sapiens
gacacagaagtccctaggaggg

SEQ ID NO: 6228803 - DNA, 19 bp, Homo sapiens
gacacagaatagtttacac

SEQ ID NO: 6228804 - DNA, 20 bp, Homo sapiens
gacacagaatagtttacaca

SEQ ID NO: 6228805 - DNA, 13 bp, Homo sapiens
gacacagacattt

SEQ ID NO: 6228806 - DNA, 15 bp, Homo sapiens
gacacagacattttg

SEQ ID NO: 6228807 - DNA, 15 bp, Homo sapiens
gacacagacccagga

SEQ ID NO: 6228808 - DNA, 20 bp, Homo sapiens
gacacagactcatcctgaac

SEQ ID NO: 6228809 - DNA, 22 bp, Homo sapiens
gacacagactggcaataaactc

SEQ ID NO: 6228810 - DNA, 19 bp, Homo sapiens
gacacagaggctggcactg

SEQ ID NO: 6228811 - DNA, 12 bp, Homo sapiens
gacacagataat

SEQ ID NO: 6228812 - DNA, 15 bp, Homo sapiens
gacacagatgaaaca

SEQ ID NO: 6228813 - DNA, 16 bp, Homo sapiens
gacacagcacaagggc

SEQ ID NO: 6228814 - DNA, 18 bp, Homo sapiens
gacacagcacaagggcac

SEQ ID NO: 6228815 - DNA, 15 bp, Homo sapiens
gacacagcagcttca

SEQ ID NO: 6228816 - DNA, 20 bp, Homo sapiens
gacacagcagcttcaccaga

SEQ ID NO: 6228817 - DNA, 22 bp, Homo sapiens
gacacagcagcttcaccagagc

SEQ ID NO: 6228818 - DNA, 14 bp, Homo sapiens
gacacagcagtatt

SEQ ID NO: 6228819 - DNA, 15 bp, Homo sapiens
gacacagcagtattg

SEQ ID NO: 6228820 - DNA, 14 bp, Homo sapiens
gacacagcctcccc

SEQ ID NO: 6228821 - DNA, 22 bp, Homo sapiens
gacacagcgtccctagcagtga

SEQ ID NO: 6228822 - DNA, 23 bp, Homo sapiens
gacacagctcttcattccattga

SEQ ID NO: 6228823 - DNA, 21 bp, Homo sapiens
gacacagctcttccagggcag

SEQ ID NO: 6228824 - DNA, 17 bp, Homo sapiens
gacacagctcttctcca

SEQ ID NO: 6228825 - DNA, 22 bp, Homo sapiens
gacacagctcttctccaggctg

SEQ ID NO: 6228826 - DNA, 23 bp, Homo sapiens
gacacagctcttctccaggctgt

SEQ ID NO: 6228827 - DNA, 19 bp, Homo sapiens
gacacagctgagctggcct

SEQ ID NO: 6228828 - DNA, 18 bp, Homo sapiens
gacacagcttgtgaatgt

SEQ ID NO: 6228829 - DNA, 13 bp, Homo sapiens
gacacaggaaaaa

SEQ ID NO: 6228830 - DNA, 14 bp, Homo sapiens
gacacaggaagaat

SEQ ID NO: 6228831 - DNA, 18 bp, Homo sapiens
gacacaggagaccacccc

SEQ ID NO: 6228832 - DNA, 16 bp, Homo sapiens
gacacaggatgaagca

SEQ ID NO: 6228833 - DNA, 14 bp, Homo sapiens
gacacaggccagcc

SEQ ID NO: 6228834 - DNA, 15 bp, Homo sapiens
gacacaggccagccc

SEQ ID NO: 6228835 - DNA, 17 bp, Homo sapiens
gacacaggccagcccca

SEQ ID NO: 6228836 - DNA, 15 bp, Homo sapiens
gacacaggccagcct

SEQ ID NO: 6228837 - DNA, 12 bp, Homo sapiens
gacacaggcccg

SEQ ID NO: 6228838 - DNA, 20 bp, Homo sapiens
gacacaggcccggctccagg

SEQ ID NO: 6228839 - DNA, 21 bp, Homo sapiens
gacacaggcctgtgtagctgt

SEQ ID NO: 6228840 - DNA, 15 bp, Homo sapiens
gacacaggctgccgc

SEQ ID NO: 6228841 - DNA, 18 bp, Homo sapiens
gacacagggacttgaagt

SEQ ID NO: 6228842 - DNA, 19 bp, Homo sapiens
gacacagggacttgaagtt

SEQ ID NO: 6228843 - DNA, 20 bp, Homo sapiens
gacacagggacttgaagttg

SEQ ID NO: 6228844 - DNA, 21 bp, Homo sapiens
gacacagggacttgaagttgt

SEQ ID NO: 6228845 - DNA, 12 bp, Homo sapiens
gacacaggtcac

SEQ ID NO: 6228846 - DNA, 22 bp, Homo sapiens
gacacaggtctttcctaaggct

SEQ ID NO: 6228847 - DNA, 15 bp, Homo sapiens
gacacagtcagcatg

SEQ ID NO: 6228848 - DNA, 20 bp, Homo sapiens
gacacagtgtgtgacgcaga

SEQ ID NO: 6228849 - DNA, 18 bp, Homo sapiens
gacacagtttctattgta

SEQ ID NO: 6228850 - DNA, 21 bp, Homo sapiens
gacacagtttctattgtaaat

SEQ ID NO: 6228851 - DNA, 13 bp, Homo sapiens
gacacataaaagt

SEQ ID NO: 6228852 - DNA, 15 bp, Homo sapiens
gacacatatacatat

SEQ ID NO: 6228853 - DNA, 22 bp, Homo sapiens
gacacatcaagcttttctgtag

SEQ ID NO: 6228854 - DNA, 12 bp, Homo sapiens
gacacatcagca

SEQ ID NO: 6228855 - DNA, 18 bp, Homo sapiens
gacacatcagcatgtttt

SEQ ID NO: 6228856 - DNA, 19 bp, Homo sapiens
gacacatcagcatgttttc

SEQ ID NO: 6228857 - DNA, 18 bp, Homo sapiens
gacacatccattgctggc

SEQ ID NO: 6228858 - DNA, 22 bp, Homo sapiens
gacacatccccttagaggacct

SEQ ID NO: 6228859 - DNA, 21 bp, Homo sapiens
gacacatgaaggtaaataaaa

SEQ ID NO: 6228860 - DNA, 16 bp, Homo sapiens
gacacatgctatgttc

SEQ ID NO: 6228861 - DNA, 19 bp, Homo sapiens
gacacatgctgttggcctc

SEQ ID NO: 6228862 - DNA, 23 bp, Homo sapiens
gacacatggattttggcagggcg

SEQ ID NO: 6228863 - DNA, 23 bp, Homo sapiens
gacacatgtccaagaagcccagg

SEQ ID NO: 6228864 - DNA, 23 bp, Homo sapiens
gacacattaatgataaactcaga

SEQ ID NO: 6228865 - DNA, 15 bp, Homo sapiens
gacacattacaaagc

SEQ ID NO: 6228866 - DNA, 23 bp, Homo sapiens
gacacattctcctgtgcccctca

SEQ ID NO: 6228867 - DNA, 13 bp, Homo sapiens
gacacattgcctt

SEQ ID NO: 6228868 - DNA, 15 bp, Homo sapiens
gacacattgccttct

SEQ ID NO: 6228869 - DNA, 22 bp, Homo sapiens
gacacattgccttctggagctg

SEQ ID NO: 6228870 - DNA, 19 bp, Homo sapiens
gacacattgttttccagaa

SEQ ID NO: 6228871 - DNA, 14 bp, Homo sapiens
gacacatttaccaa

SEQ ID NO: 6228872 - DNA, 16 bp, Homo sapiens
gcaaatgaaagtttta

SEQ ID NO: 6228873 - DNA, 16 bp, Homo sapiens
gcaaatgaatcattgt

SEQ ID NO: 6228874 - DNA, 17 bp, Homo sapiens
gcaaatgaatcattgtt

SEQ ID NO: 6228875 - DNA, 18 bp, Homo sapiens
gcaaatgaatgcctttca

SEQ ID NO: 6228876 - DNA, 20 bp, Homo sapiens
gcaaatgaatttatcatttt

SEQ ID NO: 6228877 - DNA, 22 bp, Homo sapiens
gcaaatgaatttatcattttag

SEQ ID NO: 6228878 - DNA, 16 bp, Homo sapiens
gcaaatgagatttctt

SEQ ID NO: 6228879 - DNA, 20 bp, Homo sapiens
gcaaatgagatttctttgaa

SEQ ID NO: 6228880 - DNA, 16 bp, Homo sapiens
gcaaatgagctctgaa

SEQ ID NO: 6228881 - DNA, 14 bp, Homo sapiens
gcaaatgagggagg

SEQ ID NO: 6228882 - DNA, 21 bp, Homo sapiens
gcaaatgcattctatcgttat

SEQ ID NO: 6228883 - DNA, 21 bp, Homo sapiens
gcaaatgccaactgttggaat

SEQ ID NO: 6228884 - DNA, 18 bp, Homo sapiens
gcaaatgccagggcccgc

SEQ ID NO: 6228885 - DNA, 11 bp, Homo sapiens
gcaaatgccct

SEQ ID NO: 6228886 - DNA, 21 bp, Homo sapiens
gcaaatgccttttcaaatgca

SEQ ID NO: 6228887 - DNA, 14 bp, Homo sapiens
gcaaatggagataa

SEQ ID NO: 6228888 - DNA, 20 bp, Homo sapiens
gcaaatggcagttttaatct

SEQ ID NO: 6228889 - DNA, 21 bp, Homo sapiens
gcaaatgggagctgagcagcc

SEQ ID NO: 6228890 - DNA, 21 bp, Homo sapiens
gcaaatgggcagctccatcct

SEQ ID NO: 6228891 - DNA, 20 bp, Homo sapiens
gcaaatgtaaagtctagaaa

SEQ ID NO: 6228892 - DNA, 22 bp, Homo sapiens
gcaaatgtaaagtctagaaaat

SEQ ID NO: 6228893 - DNA, 23 bp, Homo sapiens
gcaaatgtagtatggcctgtgtc

SEQ ID NO: 6228894 - DNA, 16 bp, Homo sapiens
gcaaatgtcacagtaa

SEQ ID NO: 6228895 - DNA, 21 bp, Homo sapiens
gcaaatgtcagatacaatgta

SEQ ID NO: 6228896 - DNA, 13 bp, Homo sapiens
gcaaatgtccaag

SEQ ID NO: 6228897 - DNA, 21 bp, Homo sapiens
gcaaatgtccaagcatcagca

SEQ ID NO: 6228898 - DNA, 18 bp, Homo sapiens
gcaaatgtcttccaggtc

SEQ ID NO: 6228899 - DNA, 23 bp, Homo sapiens
gcaaatgttaaaagttttatatg

SEQ ID NO: 6228900 - DNA, 21 bp, Homo sapiens
gcaaatgttacatagtgtagg

SEQ ID NO: 6228901 - DNA, 16 bp, Homo sapiens
gcaaatgttgctctag

SEQ ID NO: 6228902 - DNA, 20 bp, Homo sapiens
gcaaatgttgggaaagtatt

SEQ ID NO: 6228903 - DNA, 17 bp, Homo sapiens
gcaaatgttgtatttca

SEQ ID NO: 6228904 - DNA, 19 bp, Homo sapiens
gcaaatgttgtatttcaaa

SEQ ID NO: 6228905 - DNA, 14 bp, Homo sapiens
gcaaatgtttactg

SEQ ID NO: 6228906 - DNA, 16 bp, Homo sapiens
gcaaatgtttactgta

SEQ ID NO: 6228907 - DNA, 22 bp, Homo sapiens
gcaaattaaaacatatttcatt

SEQ ID NO: 6228908 - DNA, 19 bp, Homo sapiens
gcaaattaaacaatataag

SEQ ID NO: 6228909 - DNA, 13 bp, Homo sapiens
gcaaattaaaggg

SEQ ID NO: 6228910 - DNA, 18 bp, Homo sapiens
gcaaattaatgtgtaaaa

SEQ ID NO: 6228911 - DNA, 21 bp, Homo sapiens
gcaaattaattggcagcagat

SEQ ID NO: 6228912 - DNA, 22 bp, Homo sapiens
gcaaattagggctacattgtaa

SEQ ID NO: 6228913 - DNA, 12 bp, Homo sapiens
gcaaattagtaa

SEQ ID NO: 6228914 - DNA, 14 bp, Homo sapiens
gcaaattattctag

SEQ ID NO: 6228915 - DNA, 16 bp, Homo sapiens
gcaaattatttattac

SEQ ID NO: 6228916 - DNA, 17 bp, Homo sapiens
gcaaattatttattact

SEQ ID NO: 6228917 - DNA, 17 bp, Homo sapiens
gcaaattatttttaaaa

SEQ ID NO: 6228918 - DNA, 17 bp, Homo sapiens
gcaaattccacccctcc

SEQ ID NO: 6228919 - DNA, 19 bp, Homo sapiens
gcaaattccacccctcctt

SEQ ID NO: 6228920 - DNA, 21 bp, Homo sapiens
gcaaattgattcaaatgttac

SEQ ID NO: 6228921 - DNA, 20 bp, Homo sapiens
gcaaattgctagtcagggtg

SEQ ID NO: 6228922 - DNA, 21 bp, Homo sapiens
gcaaattgctagtcagggtga

SEQ ID NO: 6228923 - DNA, 14 bp, Homo sapiens
gcaaattggagaaa

SEQ ID NO: 6228924 - DNA, 16 bp, Homo sapiens
gcaaattgtatcttat

SEQ ID NO: 6228925 - DNA, 13 bp, Homo sapiens
gcaaattgtgaaa

SEQ ID NO: 6228926 - DNA, 16 bp, Homo sapiens
gcaaattgtttcagtt

SEQ ID NO: 6228927 - DNA, 20 bp, Homo sapiens
gcaaatttagtttgttaaag

SEQ ID NO: 6228928 - DNA, 16 bp, Homo sapiens
gcaaatttataatttt

SEQ ID NO: 6228929 - DNA, 23 bp, Homo sapiens
gcaaatttcaaaagacatgttgt

SEQ ID NO: 6228930 - DNA, 24 bp, Homo sapiens
gcaaatttctagatatgagaaata

SEQ ID NO: 6228931 - DNA, 17 bp, Homo sapiens
gcaaatttctataaatt

SEQ ID NO: 6228932 - DNA, 15 bp, Homo sapiens
gcaaatttgtgaact

SEQ ID NO: 6228933 - DNA, 12 bp, Homo sapiens
gcaaattttaaa

SEQ ID NO: 6228934 - DNA, 14 bp, Homo sapiens
gcaaattttaactg

SEQ ID NO: 6228935 - DNA, 17 bp, Homo sapiens
gcaaattttgtattatt

SEQ ID NO: 6228936 - DNA, 18 bp, Homo sapiens
gcaaattttgtattattg

SEQ ID NO: 6228937 - DNA, 22 bp, Homo sapiens
gcaaatttttttgtatttttag

SEQ ID NO: 6228938 - DNA, 14 bp, Homo sapiens
gcaacaaaatacat

SEQ ID NO: 6228939 - DNA, 19 bp, Homo sapiens
gcaacaaacctcactgaga

SEQ ID NO: 6228940 - DNA, 15 bp, Homo sapiens
gcaacaaaggatttg

SEQ ID NO: 6228941 - DNA, 16 bp, Homo sapiens
gcaacaaatatttata

SEQ ID NO: 6228942 - DNA, 17 bp, Homo sapiens
gcaacaacaacagaaca

SEQ ID NO: 6228943 - DNA, 20 bp, Homo sapiens
gcaacaaccttaaaggccgt

SEQ ID NO: 6228944 - DNA, 20 bp, Homo sapiens
gcaacaactgtcagttcatc

SEQ ID NO: 6228945 - DNA, 18 bp, Homo sapiens
gcaacaacttactaaatc

SEQ ID NO: 6228946 - DNA, 22 bp, Homo sapiens
gcaacaagaccaccacttcgaa

SEQ ID NO: 6228947 - DNA, 21 bp, Homo sapiens
gcaacaagcccgttagcccca

SEQ ID NO: 6228948 - DNA, 15 bp, Homo sapiens
gcaacaagctcatcc

SEQ ID NO: 6228949 - DNA, 18 bp, Homo sapiens
gcaacaagctcatccctg

SEQ ID NO: 6228950 - DNA, 15 bp, Homo sapiens
gcaacaataataaat

SEQ ID NO: 6228951 - DNA, 19 bp, Homo sapiens
gcaacaataattcatcaag

SEQ ID NO: 6228952 - DNA, 12 bp, Homo sapiens
gcaacaatgcaa

SEQ ID NO: 6228953 - DNA, 13 bp, Homo sapiens
gcaacacaacatt

SEQ ID NO: 6228954 - DNA, 15 bp, Homo sapiens
gcaacacagaggaat

SEQ ID NO: 6228955 - DNA, 15 bp, Homo sapiens
gcaacacagccacta

SEQ ID NO: 6228956 - DNA, 14 bp, Homo sapiens
gcaacacagcctgg

SEQ ID NO: 6228957 - DNA, 15 bp, Homo sapiens
gcaacacagcctggg

SEQ ID NO: 6228958 - DNA, 16 bp, Homo sapiens
gcaacacagcctgggc

SEQ ID NO: 6228959 - DNA, 15 bp, Homo sapiens
gcaacacccaagtcc

SEQ ID NO: 6228960 - DNA, 16 bp, Homo sapiens
gcaacacccaagtcca

SEQ ID NO: 6228961 - DNA, 18 bp, Homo sapiens
gcaacacctccttgcttt

SEQ ID NO: 6228962 - DNA, 20 bp, Homo sapiens
gcaacacctccttgctttgc

SEQ ID NO: 6228963 - DNA, 17 bp, Homo sapiens
gcaacactctatattta

SEQ ID NO: 6228964 - DNA, 12 bp, Homo sapiens
gcaacactgcca

SEQ ID NO: 6228965 - DNA, 22 bp, Homo sapiens
gcaacactgccagaagtgtgtt

SEQ ID NO: 6228966 - DNA, 14 bp, Homo sapiens
gcaacactgctgtc

SEQ ID NO: 6228967 - DNA, 11 bp, Homo sapiens
gcaacactgga

SEQ ID NO: 6228968 - DNA, 18 bp, Homo sapiens
gcaacactggtctgctgt

SEQ ID NO: 6228969 - DNA, 21 bp, Homo sapiens
gcaacacttggaacagtgttt

SEQ ID NO: 6228970 - DNA, 13 bp, Homo sapiens
gcaacagaaaaaa

SEQ ID NO: 6228971 - DNA, 22 bp, Homo sapiens
gcaacagaaaccaagagacaca

SEQ ID NO: 6228972 - DNA, 15 bp, Homo sapiens
gcaacagactgcctt

SEQ ID NO: 6228973 - DNA, 23 bp, Homo sapiens
gcaacagactgccttatattatt

SEQ ID NO: 6228974 - DNA, 17 bp, Homo sapiens
gcaacagagagaaaaag

SEQ ID NO: 6228975 - DNA, 14 bp, Homo sapiens
gcaacagagcactt

SEQ ID NO: 6228976 - DNA, 19 bp, Homo sapiens
gcaacagagtgagaccctg

SEQ ID NO: 6228977 - DNA, 16 bp, Homo sapiens
gcaacagatcagtaaa

SEQ ID NO: 6228978 - DNA, 14 bp, Homo sapiens
gcaacagatctgga

SEQ ID NO: 6228979 - DNA, 20 bp, Homo sapiens
gcaacagatctggaacctca

SEQ ID NO: 6228980 - DNA, 19 bp, Homo sapiens
gcaacagcaaatcacgacc

SEQ ID NO: 6228981 - DNA, 21 bp, Homo sapiens
gcaacagcaaattaatgtgta

SEQ ID NO: 6228982 - DNA, 15 bp, Homo sapiens
gcaacagcaagaaat

SEQ ID NO: 6228983 - DNA, 23 bp, Homo sapiens
gcaacagcctttgaatgtaacca

SEQ ID NO: 6228984 - DNA, 21 bp, Homo sapiens
gcaacaggaatcaagagctgc

SEQ ID NO: 6228985 - DNA, 13 bp, Homo sapiens
gcaacaggacaga

SEQ ID NO: 6228986 - DNA, 19 bp, Homo sapiens
gcaacaggaccaggagcca

SEQ ID NO: 6228987 - DNA, 15 bp, Homo sapiens
gcaacaggctgggct

SEQ ID NO: 6228988 - DNA, 16 bp, Homo sapiens
gcaacaggctgggctt

SEQ ID NO: 6228989 - DNA, 12 bp, Homo sapiens
gcaacagggagc

SEQ ID NO: 6228990 - DNA, 21 bp, Homo sapiens
gcaacaggggaggaaaaaaga

SEQ ID NO: 6228991 - DNA, 23 bp, Homo sapiens
gcaacaggggaggaaaaaagaac

SEQ ID NO: 6228992 - DNA, 15 bp, Homo sapiens
gcaacagtgttctga

SEQ ID NO: 6228993 - DNA, 18 bp, Homo sapiens
gcaacagtgttctgagcc

SEQ ID NO: 6228994 - DNA, 19 bp, Homo sapiens
gcaacagtgttctgagccc

SEQ ID NO: 6228995 - DNA, 20 bp, Homo sapiens
gcaacagtgttctgagcccc

SEQ ID NO: 6228996 - DNA, 13 bp, Homo sapiens
gcaacatagcaaa

SEQ ID NO: 6228997 - DNA, 21 bp, Homo sapiens
gcaacatagtgagattctgtt

SEQ ID NO: 6228998 - DNA, 13 bp, Homo sapiens
gcaacatccaaaa

SEQ ID NO: 6228999 - DNA, 19 bp, Homo sapiens
gcaacatctcgagccccct

SEQ ID NO: 6229000 - DNA, 17 bp, Homo sapiens
gcaacatctctgaatcc

SEQ ID NO: 6229001 - DNA, 12 bp, Homo sapiens
gcaacatctttt

SEQ ID NO: 6229002 - DNA, 13 bp, Homo sapiens
gcaacatcttttt

SEQ ID NO: 6229003 - DNA, 23 bp, Homo sapiens
gcaacatgcttcatgaaaatcct

SEQ ID NO: 6229004 - DNA, 19 bp, Homo sapiens
gcaacatggtccagtttct

SEQ ID NO: 6229005 - DNA, 19 bp, Homo sapiens
gcaacattaccttgtcttt

SEQ ID NO: 6229006 - DNA, 14 bp, Homo sapiens
gcaacattccaaga

SEQ ID NO: 6229007 - DNA, 16 bp, Homo sapiens
gcaacattccacagct

SEQ ID NO: 6229008 - DNA, 18 bp, Homo sapiens
gcaacattggacagaaaa

SEQ ID NO: 6229009 - DNA, 20 bp, Homo sapiens
gcaacattggacagaaaatg

SEQ ID NO: 6229010 - DNA, 16 bp, Homo sapiens
gcaacatttccgaaga

SEQ ID NO: 6229011 - DNA, 20 bp, Homo sapiens
gcaacatttgacaaaactaa

SEQ ID NO: 6229012 - DNA, 17 bp, Homo sapiens
gcaacatttggggagag

SEQ ID NO: 6229013 - DNA, 19 bp, Homo sapiens
gcaacattttcttgaattt

SEQ ID NO: 6229014 - DNA, 20 bp, Homo sapiens
gcaacattttcttgaatttt

SEQ ID NO: 6229015 - DNA, 15 bp, Homo sapiens
gcaaccaaaaagaaa

SEQ ID NO: 6229016 - DNA, 12 bp, Homo sapiens
gcaaccaaaagg

SEQ ID NO: 6229017 - DNA, 20 bp, Homo sapiens
gcaaccaaaagggaaaaaat

SEQ ID NO: 6229018 - DNA, 15 bp, Homo sapiens
gcaaccaactgcccc

SEQ ID NO: 6229019 - DNA, 17 bp, Homo sapiens
gcaaccaactgccccag

SEQ ID NO: 6229020 - DNA, 18 bp, Homo sapiens
gcaaccaactgccccagg

SEQ ID NO: 6229021 - DNA, 16 bp, Homo sapiens
gcaaccaataaaagcc

SEQ ID NO: 6229022 - DNA, 13 bp, Homo sapiens
gcaaccacacacc

SEQ ID NO: 6229023 - DNA, 15 bp, Homo sapiens
gcaaccactctgtgg

SEQ ID NO: 6229024 - DNA, 18 bp, Homo sapiens
gcaaccactctgtggcca

SEQ ID NO: 6229025 - DNA, 20 bp, Homo sapiens
gcaaccactctgtggccagc

SEQ ID NO: 6229026 - DNA, 13 bp, Homo sapiens
gcaaccagaagtt

SEQ ID NO: 6229027 - DNA, 12 bp, Homo sapiens
gcaaccagccag

SEQ ID NO: 6229028 - DNA, 20 bp, Homo sapiens
gcaaccaggaacagcaaatg

SEQ ID NO: 6229029 - DNA, 15 bp, Homo sapiens
gcaaccaggcagctg

SEQ ID NO: 6229030 - DNA, 22 bp, Homo sapiens
gcaaccatttttagaaggaaaa

SEQ ID NO: 6229031 - DNA, 20 bp, Homo sapiens
gcaacccaaggactgaggga

SEQ ID NO: 6229032 - DNA, 13 bp, Homo sapiens
gcaacccacagct

SEQ ID NO: 6229033 - DNA, 14 bp, Homo sapiens
gcaacccacagctc

SEQ ID NO: 6229034 - DNA, 17 bp, Homo sapiens
gcaacccacagctcagc

SEQ ID NO: 6229035 - DNA, 22 bp, Homo sapiens
gcaacccagtcacactgtggcc

SEQ ID NO: 6229036 - DNA, 21 bp, Homo sapiens
gcaacccatgccctggaccag

SEQ ID NO: 6229037 - DNA, 19 bp, Homo sapiens
gcaaccccaggctgaagca

SEQ ID NO: 6229038 - DNA, 21 bp, Homo sapiens
gcaaccccagttctgctcctc

SEQ ID NO: 6229039 - DNA, 24 bp, Homo sapiens
gcaaccccagttctgctcctctcc

SEQ ID NO: 6229040 - DNA, 21 bp, Homo sapiens
gcaacccctggaccccagcct

SEQ ID NO: 6229041 - DNA, 16 bp, Homo sapiens
gcaacccgctggagcc

SEQ ID NO: 6229042 - DNA, 14 bp, Homo sapiens
gcaaccctcagctg

SEQ ID NO: 6229043 - DNA, 12 bp, Homo sapiens
gcaaccctccta

SEQ ID NO: 6229044 - DNA, 16 bp, Homo sapiens
gcaaccctgcctgtca

SEQ ID NO: 6229045 - DNA, 14 bp, Homo sapiens
gcaaccgcttccct

SEQ ID NO: 6229046 - DNA, 23 bp, Homo sapiens
gcaaccgtctgttatgctgtgac

SEQ ID NO: 6229047 - DNA, 18 bp, Homo sapiens
gcaaccgtggcccttcct

SEQ ID NO: 6229048 - DNA, 19 bp, Homo sapiens
gcaaccgtggcccttcctg

SEQ ID NO: 6229049 - DNA, 24 bp, Homo sapiens
gcaaccgtggcccttcctggacag

SEQ ID NO: 6229050 - DNA, 21 bp, Homo sapiens
gacacattttctcctaggaga

SEQ ID NO: 6229051 - DNA, 22 bp, Homo sapiens
gacacattttctcctaggagaa

SEQ ID NO: 6229052 - DNA, 20 bp, Homo sapiens
gacacattttttaggaaatg

SEQ ID NO: 6229053 - DNA, 15 bp, Homo sapiens
gacaccaaaatgaac

SEQ ID NO: 6229054 - DNA, 14 bp, Homo sapiens
gacaccaaagttct

SEQ ID NO: 6229055 - DNA, 20 bp, Homo sapiens
gacaccaaattccaaacttc

SEQ ID NO: 6229056 - DNA, 23 bp, Homo sapiens
gacaccaaattctgtggctgcca

SEQ ID NO: 6229057 - DNA, 17 bp, Homo sapiens
gacaccaaccagacagc

SEQ ID NO: 6229058 - DNA, 18 bp, Homo sapiens
gacaccaagctcaccctt

SEQ ID NO: 6229059 - DNA, 13 bp, Homo sapiens
gacaccaataaat

SEQ ID NO: 6229060 - DNA, 14 bp, Homo sapiens
gacaccacacccag

SEQ ID NO: 6229061 - DNA, 19 bp, Homo sapiens
gacaccacacccagcctca

SEQ ID NO: 6229062 - DNA, 14 bp, Homo sapiens
gacaccacagcctc

SEQ ID NO: 6229063 - DNA, 16 bp, Homo sapiens
gacaccacagcctccc

SEQ ID NO: 6229064 - DNA, 22 bp, Homo sapiens
gacaccacagcctccccttccc

SEQ ID NO: 6229065 - DNA, 23 bp, Homo sapiens
gacaccacagcctccccttccca

SEQ ID NO: 6229066 - DNA, 16 bp, Homo sapiens
gacaccaccaacaggc

SEQ ID NO: 6229067 - DNA, 18 bp, Homo sapiens
gacaccaccactgtgtcc

SEQ ID NO: 6229068 - DNA, 20 bp, Homo sapiens
gacaccaccgaatatattac

SEQ ID NO: 6229069 - DNA, 22 bp, Homo sapiens
gacaccaccgaatatattactg

SEQ ID NO: 6229070 - DNA, 16 bp, Homo sapiens
gacaccacctggagtg

SEQ ID NO: 6229071 - DNA, 17 bp, Homo sapiens
gacaccacgctggagct

SEQ ID NO: 6229072 - DNA, 20 bp, Homo sapiens
gacaccacgctggagctgtg

SEQ ID NO: 6229073 - DNA, 12 bp, Homo sapiens
gacaccactcct

SEQ ID NO: 6229074 - DNA, 22 bp, Homo sapiens
gacaccactcctgccagcccgg

SEQ ID NO: 6229075 - DNA, 21 bp, Homo sapiens
gacaccactgagctctgcctc

SEQ ID NO: 6229076 - DNA, 13 bp, Homo sapiens
gacaccactggga

SEQ ID NO: 6229077 - DNA, 16 bp, Homo sapiens
gacaccactgggaacc

SEQ ID NO: 6229078 - DNA, 17 bp, Homo sapiens
gacaccagaaagccctc

SEQ ID NO: 6229079 - DNA, 13 bp, Homo sapiens
gacaccagaataa

SEQ ID NO: 6229080 - DNA, 22 bp, Homo sapiens
gacaccagagcagatgcagaga

SEQ ID NO: 6229081 - DNA, 19 bp, Homo sapiens
gacaccagagtgtatgcat

SEQ ID NO: 6229082 - DNA, 21 bp, Homo sapiens
gacaccagagtgtatgcatac

SEQ ID NO: 6229083 - DNA, 18 bp, Homo sapiens
gacaccagccctgctgct

SEQ ID NO: 6229084 - DNA, 23 bp, Homo sapiens
gacaccagccctgctgcttccta

SEQ ID NO: 6229085 - DNA, 22 bp, Homo sapiens
gacaccagcctttctcccaggc

SEQ ID NO: 6229086 - DNA, 20 bp, Homo sapiens
gacaccaggagtccctggta

SEQ ID NO: 6229087 - DNA, 16 bp, Homo sapiens
gacaccagtgaaagaa

SEQ ID NO: 6229088 - DNA, 14 bp, Homo sapiens
gacaccatcaccac

SEQ ID NO: 6229089 - DNA, 17 bp, Homo sapiens
gacaccatgtgcaataa

SEQ ID NO: 6229090 - DNA, 23 bp, Homo sapiens
gacaccattaccaaaataataaa

SEQ ID NO: 6229091 - DNA, 22 bp, Homo sapiens
gacaccattcattccatgtcca

SEQ ID NO: 6229092 - DNA, 17 bp, Homo sapiens
gacacccaaagcccact

SEQ ID NO: 6229093 - DNA, 18 bp, Homo sapiens
gacacccaagagggctgc

SEQ ID NO: 6229094 - DNA, 12 bp, Homo sapiens
gacacccaaggg

SEQ ID NO: 6229095 - DNA, 15 bp, Homo sapiens
gacacccacacaggt

SEQ ID NO: 6229096 - DNA, 21 bp, Homo sapiens
gacacccacacaggtggccat

SEQ ID NO: 6229097 - DNA, 21 bp, Homo sapiens
gacacccaccccctctttgtg

SEQ ID NO: 6229098 - DNA, 16 bp, Homo sapiens
gacacccaccctgtgc

SEQ ID NO: 6229099 - DNA, 22 bp, Homo sapiens
gacacccaccctgtgccatcac

SEQ ID NO: 6229100 - DNA, 14 bp, Homo sapiens
gacacccaggactt

SEQ ID NO: 6229101 - DNA, 14 bp, Homo sapiens
gacacccaggcccg

SEQ ID NO: 6229102 - DNA, 16 bp, Homo sapiens
gacacccaggcccgag

SEQ ID NO: 6229103 - DNA, 12 bp, Homo sapiens
gacacccagggt

SEQ ID NO: 6229104 - DNA, 13 bp, Homo sapiens
gacacccatgcca

SEQ ID NO: 6229105 - DNA, 20 bp, Homo sapiens
gacacccatgccagagaggt

SEQ ID NO: 6229106 - DNA, 19 bp, Homo sapiens
gacacccatgtttctctgg

SEQ ID NO: 6229107 - DNA, 15 bp, Homo sapiens
gacacccattttcac

SEQ ID NO: 6229108 - DNA, 14 bp, Homo sapiens
gacaccccacttag

SEQ ID NO: 6229109 - DNA, 21 bp, Homo sapiens
gacacccccagctgactgttg

SEQ ID NO: 6229110 - DNA, 21 bp, Homo sapiens
gacaccccccgccccccacct

SEQ ID NO: 6229111 - DNA, 13 bp, Homo sapiens
gacaccccctcgc

SEQ ID NO: 6229112 - DNA, 14 bp, Homo sapiens
gacacccctgctct

SEQ ID NO: 6229113 - DNA, 18 bp, Homo sapiens
gacacccctgctctaccc

SEQ ID NO: 6229114 - DNA, 19 bp, Homo sapiens
gacacccctgctctaccca

SEQ ID NO: 6229115 - DNA, 19 bp, Homo sapiens
gacaccctaactcttgctc

SEQ ID NO: 6229116 - DNA, 21 bp, Homo sapiens
gacaccctaactcttgctcac

SEQ ID NO: 6229117 - DNA, 22 bp, Homo sapiens
gacaccctaactcttgctcact

SEQ ID NO: 6229118 - DNA, 16 bp, Homo sapiens
gacaccctccactctg

SEQ ID NO: 6229119 - DNA, 21 bp, Homo sapiens
gacaccctccactctgaggtc

SEQ ID NO: 6229120 - DNA, 23 bp, Homo sapiens
gacaccctccctccagggtcctc

SEQ ID NO: 6229121 - DNA, 13 bp, Homo sapiens
gacaccctctggg

SEQ ID NO: 6229122 - DNA, 23 bp, Homo sapiens
gacaccctctgggggtcctctct

SEQ ID NO: 6229123 - DNA, 21 bp, Homo sapiens
gacaccctggcctgaactgag

SEQ ID NO: 6229124 - DNA, 23 bp, Homo sapiens
gacaccctggcctgaactgagga

SEQ ID NO: 6229125 - DNA, 20 bp, Homo sapiens
gacaccctggtcctgacttc

SEQ ID NO: 6229126 - DNA, 19 bp, Homo sapiens
gacaccctttaatgttcta

SEQ ID NO: 6229127 - DNA, 17 bp, Homo sapiens
gacaccgctcagtatta

SEQ ID NO: 6229128 - DNA, 18 bp, Homo sapiens
gacaccggagtatgtgca

SEQ ID NO: 6229129 - DNA, 19 bp, Homo sapiens
gacaccggagtatgtgcag

SEQ ID NO: 6229130 - DNA, 20 bp, Homo sapiens
gacaccggagtatgtgcagt

SEQ ID NO: 6229131 - DNA, 17 bp, Homo sapiens
gacaccgtcgaccagga

SEQ ID NO: 6229132 - DNA, 15 bp, Homo sapiens
gacaccgtggcctgg

SEQ ID NO: 6229133 - DNA, 17 bp, Homo sapiens
gacaccgtggggaaggg

SEQ ID NO: 6229134 - DNA, 22 bp, Homo sapiens
gacaccgtggggaaggggtgca

SEQ ID NO: 6229135 - DNA, 17 bp, Homo sapiens
gacacctacagcagcac

SEQ ID NO: 6229136 - DNA, 18 bp, Homo sapiens
gacacctacagcagcacg

SEQ ID NO: 6229137 - DNA, 13 bp, Homo sapiens
gacacctaccatg

SEQ ID NO: 6229138 - DNA, 16 bp, Homo sapiens
gacacctaccatgctg

SEQ ID NO: 6229139 - DNA, 18 bp, Homo sapiens
gacacctaccatgctgct

SEQ ID NO: 6229140 - DNA, 15 bp, Homo sapiens
gacacctaggctagg

SEQ ID NO: 6229141 - DNA, 20 bp, Homo sapiens
gacacctaggctagggtggg

SEQ ID NO: 6229142 - DNA, 22 bp, Homo sapiens
gacacctatcagagaagcagca

SEQ ID NO: 6229143 - DNA, 13 bp, Homo sapiens
gacacctcactga

SEQ ID NO: 6229144 - DNA, 13 bp, Homo sapiens
gacacctccaagt

SEQ ID NO: 6229145 - DNA, 14 bp, Homo sapiens
gacacctcccaggg

SEQ ID NO: 6229146 - DNA, 15 bp, Homo sapiens
gacacctcccagggg

SEQ ID NO: 6229147 - DNA, 14 bp, Homo sapiens
gacacctcccccta

SEQ ID NO: 6229148 - DNA, 15 bp, Homo sapiens
gacacctccccctac

SEQ ID NO: 6229149 - DNA, 19 bp, Homo sapiens
gacacctccgagaggcagc

SEQ ID NO: 6229150 - DNA, 21 bp, Homo sapiens
gacacctcgcccttcagccca

SEQ ID NO: 6229151 - DNA, 17 bp, Homo sapiens
gacacctgcacctcccc

SEQ ID NO: 6229152 - DNA, 18 bp, Homo sapiens
gacacctgcagcctttgg

SEQ ID NO: 6229153 - DNA, 10 bp, Homo sapiens
gacacctgcc

SEQ ID NO: 6229154 - DNA, 14 bp, Homo sapiens
gacacctgccccag

SEQ ID NO: 6229155 - DNA, 13 bp, Homo sapiens
gacacctgccctg

SEQ ID NO: 6229156 - DNA, 23 bp, Homo sapiens
gacacctgccctgccctgccacc

SEQ ID NO: 6229157 - DNA, 19 bp, Homo sapiens
gacacctggccgcctccag

SEQ ID NO: 6229158 - DNA, 20 bp, Homo sapiens
gacacctggccgcctccagg

SEQ ID NO: 6229159 - DNA, 12 bp, Homo sapiens
gacacctgggag

SEQ ID NO: 6229160 - DNA, 18 bp, Homo sapiens
gacacctgggagaaatct

SEQ ID NO: 6229161 - DNA, 16 bp, Homo sapiens
gacacctgtactggag

SEQ ID NO: 6229162 - DNA, 17 bp, Homo sapiens
gacacctgtactggaga

SEQ ID NO: 6229163 - DNA, 18 bp, Homo sapiens
gacacctgtactggagag

SEQ ID NO: 6229164 - DNA, 10 bp, Homo sapiens
gacacctgtc

SEQ ID NO: 6229165 - DNA, 18 bp, Homo sapiens
gacaccttcccagctgct

SEQ ID NO: 6229166 - DNA, 16 bp, Homo sapiens
gacacctttaacacag

SEQ ID NO: 6229167 - DNA, 14 bp, Homo sapiens
gacacctttaggtt

SEQ ID NO: 6229168 - DNA, 15 bp, Homo sapiens
gacacctttgaatta

SEQ ID NO: 6229169 - DNA, 22 bp, Homo sapiens
gacacgaatattgctgatggtg

SEQ ID NO: 6229170 - DNA, 14 bp, Homo sapiens
gacacgagccacaa

SEQ ID NO: 6229171 - DNA, 20 bp, Homo sapiens
gacacgcacggcagccacag

SEQ ID NO: 6229172 - DNA, 18 bp, Homo sapiens
gacacgcagcctgctctg

SEQ ID NO: 6229173 - DNA, 21 bp, Homo sapiens
gacacgccttcccctcagcca

SEQ ID NO: 6229174 - DNA, 22 bp, Homo sapiens
gacacgcgcccccctcccagag

SEQ ID NO: 6229175 - DNA, 15 bp, Homo sapiens
gacacggcctctggg

SEQ ID NO: 6229176 - DNA, 22 bp, Homo sapiens
gacacggcctctggggagaccg

SEQ ID NO: 6229177 - DNA, 15 bp, Homo sapiens
gacacggcttcactg

SEQ ID NO: 6229178 - DNA, 17 bp, Homo sapiens
gacacgggcagcctggc

SEQ ID NO: 6229179 - DNA, 21 bp, Homo sapiens
gacacgggcctgtccacaggc

SEQ ID NO: 6229180 - DNA, 22 bp, Homo sapiens
gacacgggcctgtccacaggct

SEQ ID NO: 6229181 - DNA, 22 bp, Homo sapiens
gacacggggatcatctctgtga

SEQ ID NO: 6229182 - DNA, 18 bp, Homo sapiens
gacacggtgaaatccagg

SEQ ID NO: 6229183 - DNA, 15 bp, Homo sapiens
gacacgtccacccca

SEQ ID NO: 6229184 - DNA, 23 bp, Homo sapiens
gacacgtgatggaccaaagccac

SEQ ID NO: 6229185 - DNA, 16 bp, Homo sapiens
gacacgtggcctgcac

SEQ ID NO: 6229186 - DNA, 20 bp, Homo sapiens
gacacgtgggctcccctctt

SEQ ID NO: 6229187 - DNA, 16 bp, Homo sapiens
gacacgtgtttttgta

SEQ ID NO: 6229188 - DNA, 16 bp, Homo sapiens
gacactaaaaactgat

SEQ ID NO: 6229189 - DNA, 23 bp, Homo sapiens
gacactaaaaactgatcagtgta

SEQ ID NO: 6229190 - DNA, 20 bp, Homo sapiens
gacactaaactccatgatat

SEQ ID NO: 6229191 - DNA, 17 bp, Homo sapiens
gacactaaccacgctgg

SEQ ID NO: 6229192 - DNA, 15 bp, Homo sapiens
gacactaacgacttc

SEQ ID NO: 6229193 - DNA, 14 bp, Homo sapiens
gacactaactttgt

SEQ ID NO: 6229194 - DNA, 18 bp, Homo sapiens
gacactaagttatagtat

SEQ ID NO: 6229195 - DNA, 15 bp, Homo sapiens
gacactaattcctta

SEQ ID NO: 6229196 - DNA, 21 bp, Homo sapiens
gacactaattccttaaatgaa

SEQ ID NO: 6229197 - DNA, 14 bp, Homo sapiens
gacactacacccag

SEQ ID NO: 6229198 - DNA, 16 bp, Homo sapiens
gacactacatatctaa

SEQ ID NO: 6229199 - DNA, 13 bp, Homo sapiens
gacactaccccat

SEQ ID NO: 6229200 - DNA, 15 bp, Homo sapiens
gacactaccctgaga

SEQ ID NO: 6229201 - DNA, 22 bp, Homo sapiens
gacactaccctgagatctgcac

SEQ ID NO: 6229202 - DNA, 15 bp, Homo sapiens
gacactaggagactg

SEQ ID NO: 6229203 - DNA, 23 bp, Homo sapiens
gacactagggaaaggtaaataca

SEQ ID NO: 6229204 - DNA, 21 bp, Homo sapiens
gacactagtagagcaaagact

SEQ ID NO: 6229205 - DNA, 22 bp, Homo sapiens
gacactagttcagaggaagcac

SEQ ID NO: 6229206 - DNA, 16 bp, Homo sapiens
gacactatatatttct

SEQ ID NO: 6229207 - DNA, 12 bp, Homo sapiens
gacactatatct

SEQ ID NO: 6229208 - DNA, 17 bp, Homo sapiens
gacactcaataaacagt

SEQ ID NO: 6229209 - DNA, 18 bp, Homo sapiens
gacactcaataaacagtc

SEQ ID NO: 6229210 - DNA, 14 bp, Homo sapiens
gacactcagggcag

SEQ ID NO: 6229211 - DNA, 22 bp, Homo sapiens
gacactcagggcagctgcctgg

SEQ ID NO: 6229212 - DNA, 23 bp, Homo sapiens
gacactcagggcagctgcctggc

SEQ ID NO: 6229213 - DNA, 18 bp, Homo sapiens
gacactccaactctacac

SEQ ID NO: 6229214 - DNA, 15 bp, Homo sapiens
gacactccagggaca

SEQ ID NO: 6229215 - DNA, 13 bp, Homo sapiens
gacactcccaccc

SEQ ID NO: 6229216 - DNA, 15 bp, Homo sapiens
gacactcccttgggc

SEQ ID NO: 6229217 - DNA, 15 bp, Homo sapiens
gacactcctagactt

SEQ ID NO: 6229218 - DNA, 22 bp, Homo sapiens
gacactcctagagaacgcagcc

SEQ ID NO: 6229219 - DNA, 13 bp, Homo sapiens
gacactccttccc

SEQ ID NO: 6229220 - DNA, 21 bp, Homo sapiens
gacactctagtgacttcctgg

SEQ ID NO: 6229221 - DNA, 17 bp, Homo sapiens
gacactctccttgcagt

SEQ ID NO: 6229222 - DNA, 18 bp, Homo sapiens
gacactctccttgcagtt

SEQ ID NO: 6229223 - DNA, 19 bp, Homo sapiens
gacactctccttgcagttc

SEQ ID NO: 6229224 - DNA, 12 bp, Homo sapiens
gacactctgctc

SEQ ID NO: 6229225 - DNA, 20 bp, Homo sapiens
gacactgaaagttttgtaaa

SEQ ID NO: 6229226 - DNA, 12 bp, Homo sapiens
gacactgaaatg

SEQ ID NO: 6229227 - DNA, 22 bp, Homo sapiens
gacactgaaatgccttactttg

SEQ ID NO: 6229228 - DNA, 16 bp, Homo sapiens
gcaaccgtggggaggc

SEQ ID NO: 6229229 - DNA, 19 bp, Homo sapiens
gcaacctacctgttgagca

SEQ ID NO: 6229230 - DNA, 22 bp, Homo sapiens
gcaacctcaccttcctgtgggt

SEQ ID NO: 6229231 - DNA, 17 bp, Homo sapiens
gcaacctccacctccca

SEQ ID NO: 6229232 - DNA, 16 bp, Homo sapiens
gcaacctccacctcct

SEQ ID NO: 6229233 - DNA, 18 bp, Homo sapiens
gcaacctccacctcctga

SEQ ID NO: 6229234 - DNA, 19 bp, Homo sapiens
gcaacctccacctcctgag

SEQ ID NO: 6229235 - DNA, 13 bp, Homo sapiens
gcaacctccgcct

SEQ ID NO: 6229236 - DNA, 19 bp, Homo sapiens
gcaacctccgcctcttggg

SEQ ID NO: 6229237 - DNA, 23 bp, Homo sapiens
gcaacctctgccccccaagttca

SEQ ID NO: 6229238 - DNA, 15 bp, Homo sapiens
gcaacctctgcctcc

SEQ ID NO: 6229239 - DNA, 18 bp, Homo sapiens
gcaacctctgcctcctgg

SEQ ID NO: 6229240 - DNA, 23 bp, Homo sapiens
gcaacctcttcagctgggaaggc

SEQ ID NO: 6229241 - DNA, 16 bp, Homo sapiens
gcaacctcttggcctg

SEQ ID NO: 6229242 - DNA, 18 bp, Homo sapiens
gcaacctgacagcaaaca

SEQ ID NO: 6229243 - DNA, 18 bp, Homo sapiens
gcaacctggctctggccc

SEQ ID NO: 6229244 - DNA, 13 bp, Homo sapiens
gcaacctgtgcaa

SEQ ID NO: 6229245 - DNA, 14 bp, Homo sapiens
gcaacctgtgcaaa

SEQ ID NO: 6229246 - DNA, 13 bp, Homo sapiens
gcaacctgtggct

SEQ ID NO: 6229247 - DNA, 20 bp, Homo sapiens
gcaacctgtggctcagggga

SEQ ID NO: 6229248 - DNA, 18 bp, Homo sapiens
gcaaccttaaagcaataa

SEQ ID NO: 6229249 - DNA, 14 bp, Homo sapiens
gcaaccttgtactt

SEQ ID NO: 6229250 - DNA, 20 bp, Homo sapiens
gcaaccttgtactttacaat

SEQ ID NO: 6229251 - DNA, 23 bp, Homo sapiens
gcaacctttcacctttgtgtatt

SEQ ID NO: 6229252 - DNA, 20 bp, Homo sapiens
gcaacgaccagggccgagga

SEQ ID NO: 6229253 - DNA, 16 bp, Homo sapiens
gcaacgatcacaaatg

SEQ ID NO: 6229254 - DNA, 21 bp, Homo sapiens
gcaacgatcacaaatgacttt

SEQ ID NO: 6229255 - DNA, 23 bp, Homo sapiens
gcaacgatcacaaatgactttat

SEQ ID NO: 6229256 - DNA, 14 bp, Homo sapiens
gcaacgattcacag

SEQ ID NO: 6229257 - DNA, 19 bp, Homo sapiens
gcaacgcctgccttctggg

SEQ ID NO: 6229258 - DNA, 17 bp, Homo sapiens
gcaacgctattccagct

SEQ ID NO: 6229259 - DNA, 13 bp, Homo sapiens
gcaacgctcactg

SEQ ID NO: 6229260 - DNA, 22 bp, Homo sapiens
gcaacgggattgaagggtcctg

SEQ ID NO: 6229261 - DNA, 17 bp, Homo sapiens
gcaacgtagcctgggct

SEQ ID NO: 6229262 - DNA, 13 bp, Homo sapiens
gcaactaaggaca

SEQ ID NO: 6229263 - DNA, 15 bp, Homo sapiens
gcaactaaggacaaa

SEQ ID NO: 6229264 - DNA, 16 bp, Homo sapiens
gcaactaaggacaaat

SEQ ID NO: 6229265 - DNA, 18 bp, Homo sapiens
gcaactacaacttctcct

SEQ ID NO: 6229266 - DNA, 18 bp, Homo sapiens
gcaactacagaagtggaa

SEQ ID NO: 6229267 - DNA, 19 bp, Homo sapiens
gcaactacagaagtggaag

SEQ ID NO: 6229268 - DNA, 19 bp, Homo sapiens
gcaactagtaaaatgctgg

SEQ ID NO: 6229269 - DNA, 19 bp, Homo sapiens
gcaactatcagactaagcc

SEQ ID NO: 6229270 - DNA, 22 bp, Homo sapiens
gcaactcaaggactttgcagcc

SEQ ID NO: 6229271 - DNA, 21 bp, Homo sapiens
gcaactccagcgtcctcagca

SEQ ID NO: 6229272 - DNA, 13 bp, Homo sapiens
gcaactccatgcc

SEQ ID NO: 6229273 - DNA, 14 bp, Homo sapiens
gcaactccatgcct

SEQ ID NO: 6229274 - DNA, 17 bp, Homo sapiens
gcaactcccacgactgt

SEQ ID NO: 6229275 - DNA, 20 bp, Homo sapiens
gcaactcgtgacagcctctg

SEQ ID NO: 6229276 - DNA, 22 bp, Homo sapiens
gcaactcgtgacagcctctgac

SEQ ID NO: 6229277 - DNA, 23 bp, Homo sapiens
gcaactcgtgacagcctctgact

SEQ ID NO: 6229278 - DNA, 17 bp, Homo sapiens
gcaactctccactccat

SEQ ID NO: 6229279 - DNA, 15 bp, Homo sapiens
gcaactcttgattat

SEQ ID NO: 6229280 - DNA, 21 bp, Homo sapiens
gcaactgaataaatacctctt

SEQ ID NO: 6229281 - DNA, 22 bp, Homo sapiens
gcaactgacttcatttgtgcca

SEQ ID NO: 6229282 - DNA, 15 bp, Homo sapiens
gcaactgaggcagac

SEQ ID NO: 6229283 - DNA, 21 bp, Homo sapiens
gcaactgaggcagacagcagc

SEQ ID NO: 6229284 - DNA, 21 bp, Homo sapiens
gcaactgctgatgctcatggt

SEQ ID NO: 6229285 - DNA, 18 bp, Homo sapiens
gcaactgctggtgatttt

SEQ ID NO: 6229286 - DNA, 11 bp, Homo sapiens
gcaactgggac

SEQ ID NO: 6229287 - DNA, 19 bp, Homo sapiens
gcaactggtatatatttag

SEQ ID NO: 6229288 - DNA, 20 bp, Homo sapiens
gcaactgtctatttctgctg

SEQ ID NO: 6229289 - DNA, 16 bp, Homo sapiens
gcaactgtgcagcacc

SEQ ID NO: 6229290 - DNA, 21 bp, Homo sapiens
gcaactgttatgaaataaaga

SEQ ID NO: 6229291 - DNA, 16 bp, Homo sapiens
gcaactgttggataat

SEQ ID NO: 6229292 - DNA, 21 bp, Homo sapiens
gcaacttagatctctcctgca

SEQ ID NO: 6229293 - DNA, 22 bp, Homo sapiens
gcaacttagatctctcctgcaa

SEQ ID NO: 6229294 - DNA, 17 bp, Homo sapiens
gcaacttcagtcctggg

SEQ ID NO: 6229295 - DNA, 19 bp, Homo sapiens
gcaacttcagtcctgggag

SEQ ID NO: 6229296 - DNA, 16 bp, Homo sapiens
gcaacttcatcccagc

SEQ ID NO: 6229297 - DNA, 14 bp, Homo sapiens
gcaacttcccaggc

SEQ ID NO: 6229298 - DNA, 15 bp, Homo sapiens
gcaacttcccaggcc

SEQ ID NO: 6229299 - DNA, 20 bp, Homo sapiens
gcaacttccgcctcctgtgt

SEQ ID NO: 6229300 - DNA, 22 bp, Homo sapiens
gcaacttccgcctcctgtgttc

SEQ ID NO: 6229301 - DNA, 17 bp, Homo sapiens
gcaacttccgctgaggg

SEQ ID NO: 6229302 - DNA, 15 bp, Homo sapiens
gcaacttgaagaaac

SEQ ID NO: 6229303 - DNA, 16 bp, Homo sapiens
gcaacttgagggacga

SEQ ID NO: 6229304 - DNA, 20 bp, Homo sapiens
gcaacttgtcctagcacaga

SEQ ID NO: 6229305 - DNA, 22 bp, Homo sapiens
gcaacttgtctttttctggact

SEQ ID NO: 6229306 - DNA, 23 bp, Homo sapiens
gcaacttgtctttttctggactg

SEQ ID NO: 6229307 - DNA, 13 bp, Homo sapiens
gcaacttgtgaac

SEQ ID NO: 6229308 - DNA, 16 bp, Homo sapiens
gcaacttgtgaactcc

SEQ ID NO: 6229309 - DNA, 21 bp, Homo sapiens
gcaacttgtgttcctaacagg

SEQ ID NO: 6229310 - DNA, 17 bp, Homo sapiens
gcaactttaagcagctc

SEQ ID NO: 6229311 - DNA, 20 bp, Homo sapiens
gcaactttagaaagaaattg

SEQ ID NO: 6229312 - DNA, 12 bp, Homo sapiens
gcaactttcttc

SEQ ID NO: 6229313 - DNA, 14 bp, Homo sapiens
gcaacttttaaagc

SEQ ID NO: 6229314 - DNA, 15 bp, Homo sapiens
gcaactttttaaagt

SEQ ID NO: 6229315 - DNA, 18 bp, Homo sapiens
gcaagaaaaaaaaatgcc

SEQ ID NO: 6229316 - DNA, 18 bp, Homo sapiens
gcaagaaaaaaacttact

SEQ ID NO: 6229317 - DNA, 19 bp, Homo sapiens
gcaagaaaactaggcaatg

SEQ ID NO: 6229318 - DNA, 13 bp, Homo sapiens
gcaagaaaagagt

SEQ ID NO: 6229319 - DNA, 17 bp, Homo sapiens
gcaagaaaagcgcagag

SEQ ID NO: 6229320 - DNA, 14 bp, Homo sapiens
gcaagaaagcttga

SEQ ID NO: 6229321 - DNA, 20 bp, Homo sapiens
gcaagaaagcttgagtctca

SEQ ID NO: 6229322 - DNA, 12 bp, Homo sapiens
gcaagaaatccc

SEQ ID NO: 6229323 - DNA, 20 bp, Homo sapiens
gcaagaaattcattaaagaa

SEQ ID NO: 6229324 - DNA, 21 bp, Homo sapiens
gcaagaactcatcactgtggc

SEQ ID NO: 6229325 - DNA, 11 bp, Homo sapiens
gcaagaacttg

SEQ ID NO: 6229326 - DNA, 12 bp, Homo sapiens
gcaagaacttgt

SEQ ID NO: 6229327 - DNA, 18 bp, Homo sapiens
gcaagaacttgtttacaa

SEQ ID NO: 6229328 - DNA, 15 bp, Homo sapiens
gcaagaagattctaa

SEQ ID NO: 6229329 - DNA, 21 bp, Homo sapiens
gcaagaagattctaaaacatt

SEQ ID NO: 6229330 - DNA, 20 bp, Homo sapiens
gcaagaagctgcttctgccc

SEQ ID NO: 6229331 - DNA, 14 bp, Homo sapiens
gcaagaaggaattg

SEQ ID NO: 6229332 - DNA, 16 bp, Homo sapiens
gcaagaataaaaaaga

SEQ ID NO: 6229333 - DNA, 13 bp, Homo sapiens
gcaagaattaaaa

SEQ ID NO: 6229334 - DNA, 18 bp, Homo sapiens
gcaagaatttctggaaga

SEQ ID NO: 6229335 - DNA, 15 bp, Homo sapiens
gcaagaatttgatcg

SEQ ID NO: 6229336 - DNA, 17 bp, Homo sapiens
gcaagacaatgacactg

SEQ ID NO: 6229337 - DNA, 17 bp, Homo sapiens
gcaagacacccagtgga

SEQ ID NO: 6229338 - DNA, 20 bp, Homo sapiens
gcaagacagaaaagtgcctg

SEQ ID NO: 6229339 - DNA, 20 bp, Homo sapiens
gcaagacagtggcactaaaa

SEQ ID NO: 6229340 - DNA, 18 bp, Homo sapiens
gcaagaccacggagggag

SEQ ID NO: 6229341 - DNA, 16 bp, Homo sapiens
gcaagaccctgtctct

SEQ ID NO: 6229342 - DNA, 17 bp, Homo sapiens
gcaagacctagtcccct

SEQ ID NO: 6229343 - DNA, 22 bp, Homo sapiens
gcaagacctagtcccctttcct

SEQ ID NO: 6229344 - DNA, 23 bp, Homo sapiens
gcaagacctcatctgtggagctg

SEQ ID NO: 6229345 - DNA, 14 bp, Homo sapiens
gcaagacctcttcc

SEQ ID NO: 6229346 - DNA, 15 bp, Homo sapiens
gcaagacctgaaaat

SEQ ID NO: 6229347 - DNA, 14 bp, Homo sapiens
gcaagacgccctct

SEQ ID NO: 6229348 - DNA, 20 bp, Homo sapiens
gcaagacgctgtgctgccct

SEQ ID NO: 6229349 - DNA, 21 bp, Homo sapiens
gcaagacgctgtgctgccctg

SEQ ID NO: 6229350 - DNA, 22 bp, Homo sapiens
gcaagacgctgtgctgccctgc

SEQ ID NO: 6229351 - DNA, 23 bp, Homo sapiens
gcaagacgctgtgctgccctgcc

SEQ ID NO: 6229352 - DNA, 16 bp, Homo sapiens
gcaagactcgaataaa

SEQ ID NO: 6229353 - DNA, 15 bp, Homo sapiens
gcaagactctgtctc

SEQ ID NO: 6229354 - DNA, 16 bp, Homo sapiens
gcaagactctgtctca

SEQ ID NO: 6229355 - DNA, 21 bp, Homo sapiens
gcaagactctgtctcaataaa

SEQ ID NO: 6229356 - DNA, 23 bp, Homo sapiens
gcaagactctgtctcaataaata

SEQ ID NO: 6229357 - DNA, 16 bp, Homo sapiens
gcaagactgaattaat

SEQ ID NO: 6229358 - DNA, 21 bp, Homo sapiens
gcaagactgcaaactttttta

SEQ ID NO: 6229359 - DNA, 16 bp, Homo sapiens
gcaagactgcaagaga

SEQ ID NO: 6229360 - DNA, 18 bp, Homo sapiens
gcaagactgttgctcaaa

SEQ ID NO: 6229361 - DNA, 20 bp, Homo sapiens
gcaagacttcactgcagcct

SEQ ID NO: 6229362 - DNA, 21 bp, Homo sapiens
gcaagacttcactgcagcctt

SEQ ID NO: 6229363 - DNA, 22 bp, Homo sapiens
gcaagacttcactgcagccttt

SEQ ID NO: 6229364 - DNA, 23 bp, Homo sapiens
gcaagacttcactgcagcctttc

SEQ ID NO: 6229365 - DNA, 19 bp, Homo sapiens
gcaagacttctctttgcct

SEQ ID NO: 6229366 - DNA, 22 bp, Homo sapiens
gcaagacttctctttgcctcaa

SEQ ID NO: 6229367 - DNA, 14 bp, Homo sapiens
gcaagagaaatgag

SEQ ID NO: 6229368 - DNA, 19 bp, Homo sapiens
gcaagagaaatgaggaaga

SEQ ID NO: 6229369 - DNA, 20 bp, Homo sapiens
gcaagagaacatttctagaa

SEQ ID NO: 6229370 - DNA, 19 bp, Homo sapiens
gcaagagaacattttactg

SEQ ID NO: 6229371 - DNA, 15 bp, Homo sapiens
gcaagagacagagcc

SEQ ID NO: 6229372 - DNA, 16 bp, Homo sapiens
gcaagagacagagccc

SEQ ID NO: 6229373 - DNA, 21 bp, Homo sapiens
gcaagagacagagcccccaag

SEQ ID NO: 6229374 - DNA, 14 bp, Homo sapiens
gcaagagactttgt

SEQ ID NO: 6229375 - DNA, 13 bp, Homo sapiens
gcaagagagaacc

SEQ ID NO: 6229376 - DNA, 22 bp, Homo sapiens
gcaagagatattttgggcatgt

SEQ ID NO: 6229377 - DNA, 21 bp, Homo sapiens
gcaagagatcatatcctcaga

SEQ ID NO: 6229378 - DNA, 15 bp, Homo sapiens
gcaagagcagatact

SEQ ID NO: 6229379 - DNA, 13 bp, Homo sapiens
gcaagagccaggg

SEQ ID NO: 6229380 - DNA, 20 bp, Homo sapiens
gcaagagcctgagactggaa

SEQ ID NO: 6229381 - DNA, 23 bp, Homo sapiens
gcaagagccttggtgtccacctg

SEQ ID NO: 6229382 - DNA, 19 bp, Homo sapiens
gcaagagcgttactgtaga

SEQ ID NO: 6229383 - DNA, 16 bp, Homo sapiens
gcaagagctcaggaga

SEQ ID NO: 6229384 - DNA, 17 bp, Homo sapiens
gcaagagctcaggagaa

SEQ ID NO: 6229385 - DNA, 18 bp, Homo sapiens
gcaagaggcaagctgaaa

SEQ ID NO: 6229386 - DNA, 19 bp, Homo sapiens
gcaagaggcaagctgaaat

SEQ ID NO: 6229387 - DNA, 23 bp, Homo sapiens
gcaagaggccgtggctgctgtgg

SEQ ID NO: 6229388 - DNA, 19 bp, Homo sapiens
gcaagagggacagagcccg

SEQ ID NO: 6229389 - DNA, 14 bp, Homo sapiens
gcaagagggagggg

SEQ ID NO: 6229390 - DNA, 17 bp, Homo sapiens
gcaagagggaggggaca

SEQ ID NO: 6229391 - DNA, 20 bp, Homo sapiens
gcaagagggggtggaggggt

SEQ ID NO: 6229392 - DNA, 13 bp, Homo sapiens
gcaagaggggtgg

SEQ ID NO: 6229393 - DNA, 15 bp, Homo sapiens
gcaagagggtctctt

SEQ ID NO: 6229394 - DNA, 22 bp, Homo sapiens
gcaagagggtctctttgttcaa

SEQ ID NO: 6229395 - DNA, 18 bp, Homo sapiens
gcaagaggtgcctgggag

SEQ ID NO: 6229396 - DNA, 14 bp, Homo sapiens
gcaagagtatactt

SEQ ID NO: 6229397 - DNA, 19 bp, Homo sapiens
gcaagagtctgtctcaaaa

SEQ ID NO: 6229398 - DNA, 18 bp, Homo sapiens
gcaagagtgattgcagct

SEQ ID NO: 6229399 - DNA, 12 bp, Homo sapiens
gcaagagtgggc

SEQ ID NO: 6229400 - DNA, 19 bp, Homo sapiens
gcaagagtgggctttccag

SEQ ID NO: 6229401 - DNA, 20 bp, Homo sapiens
gcaagagtgggctttccagg

SEQ ID NO: 6229402 - DNA, 15 bp, Homo sapiens
gcaagagtgtgaaat

SEQ ID NO: 6229403 - DNA, 13 bp, Homo sapiens
gcaagatatttat

SEQ ID NO: 6229404 - DNA, 16 bp, Homo sapiens
gcaagatatttatata

SEQ ID NO: 6229405 - DNA, 19 bp, Homo sapiens
gacactgaaggcaaatctc

SEQ ID NO: 6229406 - DNA, 13 bp, Homo sapiens
gacactgacaaag

SEQ ID NO: 6229407 - DNA, 20 bp, Homo sapiens
gacactgagctgtgacccag

SEQ ID NO: 6229408 - DNA, 16 bp, Homo sapiens
gacactgagcttctga

SEQ ID NO: 6229409 - DNA, 15 bp, Homo sapiens
gacactgatgggcaa

SEQ ID NO: 6229410 - DNA, 19 bp, Homo sapiens
gacactgatgggtcctgct

SEQ ID NO: 6229411 - DNA, 21 bp, Homo sapiens
gacactgatgggtcctgctgc

SEQ ID NO: 6229412 - DNA, 19 bp, Homo sapiens
gacactgccaagagccgac

SEQ ID NO: 6229413 - DNA, 17 bp, Homo sapiens
gacactgccactctccc

SEQ ID NO: 6229414 - DNA, 13 bp, Homo sapiens
gacactgcctggg

SEQ ID NO: 6229415 - DNA, 14 bp, Homo sapiens
gacactgcctgggc

SEQ ID NO: 6229416 - DNA, 13 bp, Homo sapiens
gacactgcctttg

SEQ ID NO: 6229417 - DNA, 21 bp, Homo sapiens
gacactgcctttgctgccttc

SEQ ID NO: 6229418 - DNA, 22 bp, Homo sapiens
gacactgcctttgctgccttct

SEQ ID NO: 6229419 - DNA, 20 bp, Homo sapiens
gacactgcggggcttggctg

SEQ ID NO: 6229420 - DNA, 22 bp, Homo sapiens
gacactgcggggcttggctgag

SEQ ID NO: 6229421 - DNA, 19 bp, Homo sapiens
gacactgctgcaccagagt

SEQ ID NO: 6229422 - DNA, 13 bp, Homo sapiens
gacactggcccca

SEQ ID NO: 6229423 - DNA, 22 bp, Homo sapiens
gacactggctgccagctatttt

SEQ ID NO: 6229424 - DNA, 17 bp, Homo sapiens
gacactgggaggccagt

SEQ ID NO: 6229425 - DNA, 17 bp, Homo sapiens
gacactgggcagcaagg

SEQ ID NO: 6229426 - DNA, 14 bp, Homo sapiens
gacactggggtctg

SEQ ID NO: 6229427 - DNA, 20 bp, Homo sapiens
gacactggggtctgtttctg

SEQ ID NO: 6229428 - DNA, 20 bp, Homo sapiens
gacactggtattcctgcctc

SEQ ID NO: 6229429 - DNA, 14 bp, Homo sapiens
gacactggtctcag

SEQ ID NO: 6229430 - DNA, 18 bp, Homo sapiens
gacactggtctcagagga

SEQ ID NO: 6229431 - DNA, 20 bp, Homo sapiens
gacactggtgccatgtcagc

SEQ ID NO: 6229432 - DNA, 15 bp, Homo sapiens
gacactggtgtatct

SEQ ID NO: 6229433 - DNA, 19 bp, Homo sapiens
gacactggtttacacttta

SEQ ID NO: 6229434 - DNA, 20 bp, Homo sapiens
gacactgtatgactctcctc

SEQ ID NO: 6229435 - DNA, 13 bp, Homo sapiens
gacactgtgaaat

SEQ ID NO: 6229436 - DNA, 17 bp, Homo sapiens
gacactgtgacaatgac

SEQ ID NO: 6229437 - DNA, 17 bp, Homo sapiens
gacactgtgaccctggg

SEQ ID NO: 6229438 - DNA, 21 bp, Homo sapiens
gacactgtgagagttgtctct

SEQ ID NO: 6229439 - DNA, 23 bp, Homo sapiens
gacactgtgagagttgtctctgt

SEQ ID NO: 6229440 - DNA, 21 bp, Homo sapiens
gacactgtgcaaattttttga

SEQ ID NO: 6229441 - DNA, 15 bp, Homo sapiens
gacactgtgcaggcc

SEQ ID NO: 6229442 - DNA, 21 bp, Homo sapiens
gacactgtgcaggcccaggca

SEQ ID NO: 6229443 - DNA, 23 bp, Homo sapiens
gacactgtgcccagcccggacct

SEQ ID NO: 6229444 - DNA, 20 bp, Homo sapiens
gacactgtggaaagctttga

SEQ ID NO: 6229445 - DNA, 23 bp, Homo sapiens
gacactgtggaaagctttgaaca

SEQ ID NO: 6229446 - DNA, 22 bp, Homo sapiens
gacactgtggagactttctgtt

SEQ ID NO: 6229447 - DNA, 13 bp, Homo sapiens
gacactgtggcag

SEQ ID NO: 6229448 - DNA, 15 bp, Homo sapiens
gacactgtggcagca

SEQ ID NO: 6229449 - DNA, 24 bp, Homo sapiens
gacactgtggttatgcagaagcag

SEQ ID NO: 6229450 - DNA, 16 bp, Homo sapiens
gacactgttaatagta

SEQ ID NO: 6229451 - DNA, 12 bp, Homo sapiens
gacactgttctt

SEQ ID NO: 6229452 - DNA, 17 bp, Homo sapiens
gacactgttgcaaaggt

SEQ ID NO: 6229453 - DNA, 19 bp, Homo sapiens
gacactgtttacaagaaaa

SEQ ID NO: 6229454 - DNA, 15 bp, Homo sapiens
gacactgtttcctga

SEQ ID NO: 6229455 - DNA, 16 bp, Homo sapiens
gacactgttttcctta

SEQ ID NO: 6229456 - DNA, 19 bp, Homo sapiens
gacacttaattctgttctg

SEQ ID NO: 6229457 - DNA, 23 bp, Homo sapiens
gacacttatccacgagagcgcag

SEQ ID NO: 6229458 - DNA, 19 bp, Homo sapiens
gacacttcaaactgcggac

SEQ ID NO: 6229459 - DNA, 14 bp, Homo sapiens
gacacttcagatct

SEQ ID NO: 6229460 - DNA, 16 bp, Homo sapiens
gacacttccccttgtc

SEQ ID NO: 6229461 - DNA, 18 bp, Homo sapiens
gacacttccctgggcctc

SEQ ID NO: 6229462 - DNA, 20 bp, Homo sapiens
gacacttccgtcacatccca

SEQ ID NO: 6229463 - DNA, 12 bp, Homo sapiens
gacacttcctgc

SEQ ID NO: 6229464 - DNA, 14 bp, Homo sapiens
gacacttcctgtcc

SEQ ID NO: 6229465 - DNA, 17 bp, Homo sapiens
gacacttctcaggaaat

SEQ ID NO: 6229466 - DNA, 23 bp, Homo sapiens
gacacttgccttcttcacccagc

SEQ ID NO: 6229467 - DNA, 22 bp, Homo sapiens
gacacttgtaaattgttgtttc

SEQ ID NO: 6229468 - DNA, 23 bp, Homo sapiens
gacactttaattaccaacctgtt

SEQ ID NO: 6229469 - DNA, 15 bp, Homo sapiens
gacactttacctctt

SEQ ID NO: 6229470 - DNA, 18 bp, Homo sapiens
gacactttgaaatgtgtt

SEQ ID NO: 6229471 - DNA, 21 bp, Homo sapiens
gacactttgaaatgtgtttct

SEQ ID NO: 6229472 - DNA, 23 bp, Homo sapiens
gacactttgaactcctcaagggc

SEQ ID NO: 6229473 - DNA, 21 bp, Homo sapiens
gacactttgccaaggctctcc

SEQ ID NO: 6229474 - DNA, 17 bp, Homo sapiens
gacacttttaaaaaaca

SEQ ID NO: 6229475 - DNA, 19 bp, Homo sapiens
gacacttttcaaaagaaga

SEQ ID NO: 6229476 - DNA, 13 bp, Homo sapiens
gacactttttgta

SEQ ID NO: 6229477 - DNA, 22 bp, Homo sapiens
gacagaaaaaaaaatgttttat

SEQ ID NO: 6229478 - DNA, 20 bp, Homo sapiens
gacagaaaaaaataaaaaca

SEQ ID NO: 6229479 - DNA, 15 bp, Homo sapiens
gacagaaaagtgcct

SEQ ID NO: 6229480 - DNA, 18 bp, Homo sapiens
gacagaaaagtgcctgag

SEQ ID NO: 6229481 - DNA, 17 bp, Homo sapiens
gacagaaaatatgtatt

SEQ ID NO: 6229482 - DNA, 22 bp, Homo sapiens
gacagaaaatatgtattaacac

SEQ ID NO: 6229483 - DNA, 18 bp, Homo sapiens
gacagaaacagagagaga

SEQ ID NO: 6229484 - DNA, 16 bp, Homo sapiens
gacagaaaccaagcca

SEQ ID NO: 6229485 - DNA, 12 bp, Homo sapiens
gacagaaagcag

SEQ ID NO: 6229486 - DNA, 13 bp, Homo sapiens
gacagaaagcctc

SEQ ID NO: 6229487 - DNA, 21 bp, Homo sapiens
gacagaaaggagagtggccat

SEQ ID NO: 6229488 - DNA, 13 bp, Homo sapiens
gacagaacactgt

SEQ ID NO: 6229489 - DNA, 15 bp, Homo sapiens
gacagaacactgtct

SEQ ID NO: 6229490 - DNA, 21 bp, Homo sapiens
gacagaacattgccttcctcg

SEQ ID NO: 6229491 - DNA, 19 bp, Homo sapiens
gacagaaccaacgggtctg

SEQ ID NO: 6229492 - DNA, 19 bp, Homo sapiens
gacagaacttcagcattgt

SEQ ID NO: 6229493 - DNA, 21 bp, Homo sapiens
gacagaagagaaggaagccat

SEQ ID NO: 6229494 - DNA, 16 bp, Homo sapiens
gacagaagcagctctt

SEQ ID NO: 6229495 - DNA, 14 bp, Homo sapiens
gacagaagcaggag

SEQ ID NO: 6229496 - DNA, 13 bp, Homo sapiens
gacagaagcaggc

SEQ ID NO: 6229497 - DNA, 17 bp, Homo sapiens
gacagaagcaggctgga

SEQ ID NO: 6229498 - DNA, 23 bp, Homo sapiens
gacagaagcttgtggggtacatg

SEQ ID NO: 6229499 - DNA, 16 bp, Homo sapiens
gacagaaggaccagcc

SEQ ID NO: 6229500 - DNA, 13 bp, Homo sapiens
gacagaaggactg

SEQ ID NO: 6229501 - DNA, 20 bp, Homo sapiens
gacagaaggcaaagtttcca

SEQ ID NO: 6229502 - DNA, 16 bp, Homo sapiens
gacagaaggccttgaa

SEQ ID NO: 6229503 - DNA, 20 bp, Homo sapiens
gacagaaggctcctgccccc

SEQ ID NO: 6229504 - DNA, 23 bp, Homo sapiens
gacagaaggtgccactttaccca

SEQ ID NO: 6229505 - DNA, 14 bp, Homo sapiens
gacagaagtcaggt

SEQ ID NO: 6229506 - DNA, 15 bp, Homo sapiens
gacagaagtttgcac

SEQ ID NO: 6229507 - DNA, 15 bp, Homo sapiens
gacagaatatacaca

SEQ ID NO: 6229508 - DNA, 15 bp, Homo sapiens
gacagaatggatata

SEQ ID NO: 6229509 - DNA, 20 bp, Homo sapiens
gacagaatggctatcaaaag

SEQ ID NO: 6229510 - DNA, 20 bp, Homo sapiens
gacagaatgtatctgtgaag

SEQ ID NO: 6229511 - DNA, 15 bp, Homo sapiens
gacagaatgtgttct

SEQ ID NO: 6229512 - DNA, 20 bp, Homo sapiens
gacagaattctcccagcgtt

SEQ ID NO: 6229513 - DNA, 21 bp, Homo sapiens
gacagaattttttttgttgtt

SEQ ID NO: 6229514 - DNA, 16 bp, Homo sapiens
gacagacacacactgg

SEQ ID NO: 6229515 - DNA, 22 bp, Homo sapiens
gacagacacacactggctcctg

SEQ ID NO: 6229516 - DNA, 14 bp, Homo sapiens
gacagacacaggcc

SEQ ID NO: 6229517 - DNA, 14 bp, Homo sapiens
gacagacacctccc

SEQ ID NO: 6229518 - DNA, 23 bp, Homo sapiens
gacagacacctccccctacccat

SEQ ID NO: 6229519 - DNA, 15 bp, Homo sapiens
gacagacagccaggt

SEQ ID NO: 6229520 - DNA, 16 bp, Homo sapiens
gacagacagccctcca

SEQ ID NO: 6229521 - DNA, 15 bp, Homo sapiens
gacagacaggctctt

SEQ ID NO: 6229522 - DNA, 21 bp, Homo sapiens
gacagacaggctcttagcagc

SEQ ID NO: 6229523 - DNA, 19 bp, Homo sapiens
gacagaccacttgccacgc

SEQ ID NO: 6229524 - DNA, 12 bp, Homo sapiens
gacagaccagcc

SEQ ID NO: 6229525 - DNA, 16 bp, Homo sapiens
gacagacccagggtgg

SEQ ID NO: 6229526 - DNA, 17 bp, Homo sapiens
gacagacccagggtggt

SEQ ID NO: 6229527 - DNA, 16 bp, Homo sapiens
gacagacccaggtctt

SEQ ID NO: 6229528 - DNA, 17 bp, Homo sapiens
gacagacccaggtcttc

SEQ ID NO: 6229529 - DNA, 21 bp, Homo sapiens
gacagacccaggtcttccaga

SEQ ID NO: 6229530 - DNA, 16 bp, Homo sapiens
gacagaccttcacaga

SEQ ID NO: 6229531 - DNA, 22 bp, Homo sapiens
gacagacgagacaacagcacac

SEQ ID NO: 6229532 - DNA, 23 bp, Homo sapiens
gacagacgcctgcttttgcaaat

SEQ ID NO: 6229533 - DNA, 19 bp, Homo sapiens
gacagacggaaatgaaatt

SEQ ID NO: 6229534 - DNA, 19 bp, Homo sapiens
gacagacggacgggacagc

SEQ ID NO: 6229535 - DNA, 23 bp, Homo sapiens
gacagacggacgggacagcggcc

SEQ ID NO: 6229536 - DNA, 15 bp, Homo sapiens
gacagactatttgct

SEQ ID NO: 6229537 - DNA, 14 bp, Homo sapiens
gacagactcactgg

SEQ ID NO: 6229538 - DNA, 16 bp, Homo sapiens
gacagactcctgagga

SEQ ID NO: 6229539 - DNA, 14 bp, Homo sapiens
gacagactggccgg

SEQ ID NO: 6229540 - DNA, 16 bp, Homo sapiens
gacagacttcacagcg

SEQ ID NO: 6229541 - DNA, 20 bp, Homo sapiens
gacagacttcacagcgtctg

SEQ ID NO: 6229542 - DNA, 15 bp, Homo sapiens
gacagacttgagaac

SEQ ID NO: 6229543 - DNA, 18 bp, Homo sapiens
gacagacttgagaacttg

SEQ ID NO: 6229544 - DNA, 15 bp, Homo sapiens
gacagactttggaca

SEQ ID NO: 6229545 - DNA, 20 bp, Homo sapiens
gacagactttggacagtggc

SEQ ID NO: 6229546 - DNA, 17 bp, Homo sapiens
gacagagaaacagacag

SEQ ID NO: 6229547 - DNA, 20 bp, Homo sapiens
gacagagaaatgtgaagggt

SEQ ID NO: 6229548 - DNA, 22 bp, Homo sapiens
gacagagaatatgtctgctcct

SEQ ID NO: 6229549 - DNA, 18 bp, Homo sapiens
gacagagacacctgcacc

SEQ ID NO: 6229550 - DNA, 22 bp, Homo sapiens
gacagagacagaaacagagaga

SEQ ID NO: 6229551 - DNA, 16 bp, Homo sapiens
gacagagacagagaga

SEQ ID NO: 6229552 - DNA, 22 bp, Homo sapiens
gacagagagccaagctaatgtg

SEQ ID NO: 6229553 - DNA, 19 bp, Homo sapiens
gacagagaggacgtgggcg

SEQ ID NO: 6229554 - DNA, 19 bp, Homo sapiens
gacagagaggactgtaggg

SEQ ID NO: 6229555 - DNA, 19 bp, Homo sapiens
gacagagatggcagagcca

SEQ ID NO: 6229556 - DNA, 21 bp, Homo sapiens
gacagagcaagtgagaccctg

SEQ ID NO: 6229557 - DNA, 16 bp, Homo sapiens
gacagagcaggctttg

SEQ ID NO: 6229558 - DNA, 19 bp, Homo sapiens
gacagagcaggctttgtga

SEQ ID NO: 6229559 - DNA, 17 bp, Homo sapiens
gacagagccagaggcac

SEQ ID NO: 6229560 - DNA, 16 bp, Homo sapiens
gacagagccaggagaa

SEQ ID NO: 6229561 - DNA, 19 bp, Homo sapiens
gacagagccccaccctcag

SEQ ID NO: 6229562 - DNA, 15 bp, Homo sapiens
gacagagcccccaag

SEQ ID NO: 6229563 - DNA, 16 bp, Homo sapiens
gacagagcccccaagc

SEQ ID NO: 6229564 - DNA, 18 bp, Homo sapiens
gacagagcccccaagcct

SEQ ID NO: 6229565 - DNA, 11 bp, Homo sapiens
gacagagcccg

SEQ ID NO: 6229566 - DNA, 16 bp, Homo sapiens
gacagagccctgtgag

SEQ ID NO: 6229567 - DNA, 17 bp, Homo sapiens
gacagagccctgtgagg

SEQ ID NO: 6229568 - DNA, 14 bp, Homo sapiens
gacagagcctccac

SEQ ID NO: 6229569 - DNA, 13 bp, Homo sapiens
gacagagcctgcc

SEQ ID NO: 6229570 - DNA, 15 bp, Homo sapiens
gacagagcctgcccc

SEQ ID NO: 6229571 - DNA, 16 bp, Homo sapiens
gacagagcctgcccca

SEQ ID NO: 6229572 - DNA, 10 bp, Homo sapiens
gacagagctg

SEQ ID NO: 6229573 - DNA, 20 bp, Homo sapiens
gacagagctggttgggaaga

SEQ ID NO: 6229574 - DNA, 13 bp, Homo sapiens
gacagaggaaagg

SEQ ID NO: 6229575 - DNA, 23 bp, Homo sapiens
gacagaggaggatgtaaggcctt

SEQ ID NO: 6229576 - DNA, 16 bp, Homo sapiens
gacagaggccaaggac

SEQ ID NO: 6229577 - DNA, 18 bp, Homo sapiens
gacagaggccaaggactg

SEQ ID NO: 6229578 - DNA, 19 bp, Homo sapiens
gacagaggccaaggactga

SEQ ID NO: 6229579 - DNA, 11 bp, Homo sapiens
gacagaggccc

SEQ ID NO: 6229580 - DNA, 13 bp, Homo sapiens
gacagaggcccca

SEQ ID NO: 6229581 - DNA, 18 bp, Homo sapiens
gacagaggccccagcctc

SEQ ID NO: 6229582 - DNA, 13 bp, Homo sapiens
gacagaggccctc

SEQ ID NO: 6229583 - DNA, 17 bp, Homo sapiens
gcaagatcttgtctcca

SEQ ID NO: 6229584 - DNA, 13 bp, Homo sapiens
gcaagatgagctg

SEQ ID NO: 6229585 - DNA, 13 bp, Homo sapiens
gcaagatgtgaat

SEQ ID NO: 6229586 - DNA, 14 bp, Homo sapiens
gcaagatgtgaatt

SEQ ID NO: 6229587 - DNA, 21 bp, Homo sapiens
gcaagatgtgaattattgaca

SEQ ID NO: 6229588 - DNA, 18 bp, Homo sapiens
gcaagatgtttcttgcct

SEQ ID NO: 6229589 - DNA, 22 bp, Homo sapiens
gcaagatgtttcttgccttttg

SEQ ID NO: 6229590 - DNA, 14 bp, Homo sapiens
gcaagatgttttgt

SEQ ID NO: 6229591 - DNA, 17 bp, Homo sapiens
gcaagatgttttgtata

SEQ ID NO: 6229592 - DNA, 13 bp, Homo sapiens
gcaagattaggaa

SEQ ID NO: 6229593 - DNA, 18 bp, Homo sapiens
gcaagattctgtgggcag

SEQ ID NO: 6229594 - DNA, 22 bp, Homo sapiens
gcaagattggaaagacaggaag

SEQ ID NO: 6229595 - DNA, 22 bp, Homo sapiens
gcaagattttccacaagattcc

SEQ ID NO: 6229596 - DNA, 23 bp, Homo sapiens
gcaagcaaatcccatttcttgaa

SEQ ID NO: 6229597 - DNA, 15 bp, Homo sapiens
gcaagcaagaggccg

SEQ ID NO: 6229598 - DNA, 20 bp, Homo sapiens
gcaagcaccaacctccagac

SEQ ID NO: 6229599 - DNA, 18 bp, Homo sapiens
gcaagcaccatcccctcc

SEQ ID NO: 6229600 - DNA, 16 bp, Homo sapiens
gcaagcacctcctgcc

SEQ ID NO: 6229601 - DNA, 18 bp, Homo sapiens
gcaagcacctcctgcctc

SEQ ID NO: 6229602 - DNA, 20 bp, Homo sapiens
gcaagcacctcctgcctcga

SEQ ID NO: 6229603 - DNA, 17 bp, Homo sapiens
gcaagcacctgggtgtg

SEQ ID NO: 6229604 - DNA, 21 bp, Homo sapiens
gcaagcacctgggtgtgctcc

SEQ ID NO: 6229605 - DNA, 18 bp, Homo sapiens
gcaagcagatgacagagg

SEQ ID NO: 6229606 - DNA, 14 bp, Homo sapiens
gcaagcagcgggct

SEQ ID NO: 6229607 - DNA, 16 bp, Homo sapiens
gcaagcagctggtcag

SEQ ID NO: 6229608 - DNA, 13 bp, Homo sapiens
gcaagcagggaaa

SEQ ID NO: 6229609 - DNA, 19 bp, Homo sapiens
gcaagcagtctaccctgtc

SEQ ID NO: 6229610 - DNA, 21 bp, Homo sapiens
gcaagcagtctaccctgtcct

SEQ ID NO: 6229611 - DNA, 11 bp, Homo sapiens
gcaagcatgct

SEQ ID NO: 6229612 - DNA, 18 bp, Homo sapiens
gcaagcattcagaagaaa

SEQ ID NO: 6229613 - DNA, 11 bp, Homo sapiens
gcaagccacag

SEQ ID NO: 6229614 - DNA, 15 bp, Homo sapiens
gcaagccacagcctg

SEQ ID NO: 6229615 - DNA, 19 bp, Homo sapiens
gcaagccacaggaaggagg

SEQ ID NO: 6229616 - DNA, 11 bp, Homo sapiens
gcaagccagac

SEQ ID NO: 6229617 - DNA, 21 bp, Homo sapiens
gcaagccagcttcctgtgcag

SEQ ID NO: 6229618 - DNA, 13 bp, Homo sapiens
gcaagccagggcc

SEQ ID NO: 6229619 - DNA, 16 bp, Homo sapiens
gcaagccagggcccag

SEQ ID NO: 6229620 - DNA, 18 bp, Homo sapiens
gcaagccagggcccagag

SEQ ID NO: 6229621 - DNA, 11 bp, Homo sapiens
gcaagccataa

SEQ ID NO: 6229622 - DNA, 21 bp, Homo sapiens
gcaagccataacgtgccccca

SEQ ID NO: 6229623 - DNA, 17 bp, Homo sapiens
gcaagccatcatcctcc

SEQ ID NO: 6229624 - DNA, 15 bp, Homo sapiens
gcaagcccacctcgg

SEQ ID NO: 6229625 - DNA, 20 bp, Homo sapiens
gcaagcccacctcggccctc

SEQ ID NO: 6229626 - DNA, 17 bp, Homo sapiens
gcaagcccactggccag

SEQ ID NO: 6229627 - DNA, 13 bp, Homo sapiens
gcaagccccaggg

SEQ ID NO: 6229628 - DNA, 21 bp, Homo sapiens
gcaagccccagggcctggggg

SEQ ID NO: 6229629 - DNA, 22 bp, Homo sapiens
gcaagccccattcacggcctgg

SEQ ID NO: 6229630 - DNA, 23 bp, Homo sapiens
gcaagccccattcacggcctggc

SEQ ID NO: 6229631 - DNA, 17 bp, Homo sapiens
gcaagcccctcagccct

SEQ ID NO: 6229632 - DNA, 23 bp, Homo sapiens
gcaagcccctcagcccttgcccc

SEQ ID NO: 6229633 - DNA, 16 bp, Homo sapiens
gcaagcccctctttct

SEQ ID NO: 6229634 - DNA, 15 bp, Homo sapiens
gcaagcccctgctcc

SEQ ID NO: 6229635 - DNA, 22 bp, Homo sapiens
gcaagcccgttaaataattccc

SEQ ID NO: 6229636 - DNA, 15 bp, Homo sapiens
gcaagccctacagag

SEQ ID NO: 6229637 - DNA, 11 bp, Homo sapiens
gcaagccctgc

SEQ ID NO: 6229638 - DNA, 13 bp, Homo sapiens
gcaagccctgccc

SEQ ID NO: 6229639 - DNA, 14 bp, Homo sapiens
gcaagccctgccca

SEQ ID NO: 6229640 - DNA, 16 bp, Homo sapiens
gcaagccctgcccaca

SEQ ID NO: 6229641 - DNA, 20 bp, Homo sapiens
gcaagccctgcccacagaaa

SEQ ID NO: 6229642 - DNA, 23 bp, Homo sapiens
gcaagccctgttgacacaggtct

SEQ ID NO: 6229643 - DNA, 19 bp, Homo sapiens
gcaagcctaagggatcctg

SEQ ID NO: 6229644 - DNA, 23 bp, Homo sapiens
gcaagcctgagtggtgaggggcc

SEQ ID NO: 6229645 - DNA, 22 bp, Homo sapiens
gcaagcgacacaggctgccgct

SEQ ID NO: 6229646 - DNA, 16 bp, Homo sapiens
gcaagctaggccccag

SEQ ID NO: 6229647 - DNA, 21 bp, Homo sapiens
gcaagctaggccccagaggcc

SEQ ID NO: 6229648 - DNA, 19 bp, Homo sapiens
gcaagctctcagcaagtgc

SEQ ID NO: 6229649 - DNA, 17 bp, Homo sapiens
gcaagctctgccctggc

SEQ ID NO: 6229650 - DNA, 19 bp, Homo sapiens
gcaagctctgccctggctg

SEQ ID NO: 6229651 - DNA, 17 bp, Homo sapiens
gcaagctgattaaatga

SEQ ID NO: 6229652 - DNA, 13 bp, Homo sapiens
gcaagctgcccag

SEQ ID NO: 6229653 - DNA, 18 bp, Homo sapiens
gcaagctgcccagccctg

SEQ ID NO: 6229654 - DNA, 20 bp, Homo sapiens
gcaagctgcccagccctggc

SEQ ID NO: 6229655 - DNA, 23 bp, Homo sapiens
gcaagctgcccagccctggccca

SEQ ID NO: 6229656 - DNA, 15 bp, Homo sapiens
gcaagctggatgcag

SEQ ID NO: 6229657 - DNA, 12 bp, Homo sapiens
gcaagctggcct

SEQ ID NO: 6229658 - DNA, 10 bp, Homo sapiens
gcaagctgtg

SEQ ID NO: 6229659 - DNA, 13 bp, Homo sapiens
gcaagctgtgtta

SEQ ID NO: 6229660 - DNA, 14 bp, Homo sapiens
gcaagctgtgttac

SEQ ID NO: 6229661 - DNA, 16 bp, Homo sapiens
gcaagctgtgttactt

SEQ ID NO: 6229662 - DNA, 19 bp, Homo sapiens
gcaagctgtgttacttgaa

SEQ ID NO: 6229663 - DNA, 23 bp, Homo sapiens
gcaagcttaatggctgataattt

SEQ ID NO: 6229664 - DNA, 21 bp, Homo sapiens
gcaagcttacacaagaagtga

SEQ ID NO: 6229665 - DNA, 16 bp, Homo sapiens
gcaagcttatttagca

SEQ ID NO: 6229666 - DNA, 15 bp, Homo sapiens
gcaagcttcttgctg

SEQ ID NO: 6229667 - DNA, 18 bp, Homo sapiens
gcaagcttgaggccaaga

SEQ ID NO: 6229668 - DNA, 17 bp, Homo sapiens
gcaagcttggctgtaga

SEQ ID NO: 6229669 - DNA, 20 bp, Homo sapiens
gcaagcttggtcaaactttt

SEQ ID NO: 6229670 - DNA, 18 bp, Homo sapiens
gcaagcttgtgtgggccc

SEQ ID NO: 6229671 - DNA, 17 bp, Homo sapiens
gcaagctttaacagact

SEQ ID NO: 6229672 - DNA, 9 bp, Homo sapiens
gcaaggaaa

SEQ ID NO: 6229673 - DNA, 11 bp, Homo sapiens
gcaaggaaaaa

SEQ ID NO: 6229674 - DNA, 16 bp, Homo sapiens
gcaaggaaaaagaaaa

SEQ ID NO: 6229675 - DNA, 19 bp, Homo sapiens
gcaaggaaaaagaaaataa

SEQ ID NO: 6229676 - DNA, 17 bp, Homo sapiens
gcaaggaaatgtcctgc

SEQ ID NO: 6229677 - DNA, 16 bp, Homo sapiens
gcaaggaaattaagaa

SEQ ID NO: 6229678 - DNA, 21 bp, Homo sapiens
gcaaggaaattaagaactgaa

SEQ ID NO: 6229679 - DNA, 12 bp, Homo sapiens
gcaaggaacaga

SEQ ID NO: 6229680 - DNA, 15 bp, Homo sapiens
gcaaggaagctttgg

SEQ ID NO: 6229681 - DNA, 21 bp, Homo sapiens
gcaaggacaacctgcccctcc

SEQ ID NO: 6229682 - DNA, 21 bp, Homo sapiens
gcaaggacacagatgaaacac

SEQ ID NO: 6229683 - DNA, 19 bp, Homo sapiens
gcaaggacattgccccaag

SEQ ID NO: 6229684 - DNA, 15 bp, Homo sapiens
gcaaggaccaggact

SEQ ID NO: 6229685 - DNA, 20 bp, Homo sapiens
gcaaggaccaggactccctc

SEQ ID NO: 6229686 - DNA, 21 bp, Homo sapiens
gcaaggaccaggactccctcc

SEQ ID NO: 6229687 - DNA, 17 bp, Homo sapiens
gcaaggacctaaaacat

SEQ ID NO: 6229688 - DNA, 20 bp, Homo sapiens
gcaaggactcccggagcctg

SEQ ID NO: 6229689 - DNA, 13 bp, Homo sapiens
gcaaggagaatat

SEQ ID NO: 6229690 - DNA, 18 bp, Homo sapiens
gcaaggagatttacaact

SEQ ID NO: 6229691 - DNA, 16 bp, Homo sapiens
gcaaggaggaggagtc

SEQ ID NO: 6229692 - DNA, 19 bp, Homo sapiens
gcaaggagtttaaatgaga

SEQ ID NO: 6229693 - DNA, 23 bp, Homo sapiens
gcaaggagtttattacaatgtat

SEQ ID NO: 6229694 - DNA, 16 bp, Homo sapiens
gcaaggatacccggtg

SEQ ID NO: 6229695 - DNA, 11 bp, Homo sapiens
gcaaggatcac

SEQ ID NO: 6229696 - DNA, 19 bp, Homo sapiens
gcaaggatgaaagacaaag

SEQ ID NO: 6229697 - DNA, 22 bp, Homo sapiens
gcaaggatgaaagacaaagaag

SEQ ID NO: 6229698 - DNA, 21 bp, Homo sapiens
gcaaggattacacatttcact

SEQ ID NO: 6229699 - DNA, 22 bp, Homo sapiens
gcaaggattacacatttcactg

SEQ ID NO: 6229700 - DNA, 17 bp, Homo sapiens
gcaaggattacagaaac

SEQ ID NO: 6229701 - DNA, 20 bp, Homo sapiens
gcaaggattacagaaactga

SEQ ID NO: 6229702 - DNA, 17 bp, Homo sapiens
gcaaggcaagaagtggg

SEQ ID NO: 6229703 - DNA, 19 bp, Homo sapiens
gcaaggcaagaagtgggat

SEQ ID NO: 6229704 - DNA, 15 bp, Homo sapiens
gcaaggcagaaggcc

SEQ ID NO: 6229705 - DNA, 12 bp, Homo sapiens
gcaaggcagagc

SEQ ID NO: 6229706 - DNA, 16 bp, Homo sapiens
gcaaggcagagccttt

SEQ ID NO: 6229707 - DNA, 15 bp, Homo sapiens
gcaaggcagccgtgg

SEQ ID NO: 6229708 - DNA, 18 bp, Homo sapiens
gcaaggcatacctgtcct

SEQ ID NO: 6229709 - DNA, 22 bp, Homo sapiens
gcaaggccacctcttcctggcc

SEQ ID NO: 6229710 - DNA, 14 bp, Homo sapiens
gcaaggcccgagca

SEQ ID NO: 6229711 - DNA, 19 bp, Homo sapiens
gcaaggcccgagcagctga

SEQ ID NO: 6229712 - DNA, 23 bp, Homo sapiens
gcaaggcccgagcagctgagcag

SEQ ID NO: 6229713 - DNA, 24 bp, Homo sapiens
gcaaggcccgagcagctgagcagg

SEQ ID NO: 6229714 - DNA, 14 bp, Homo sapiens
gcaaggccctgctg

SEQ ID NO: 6229715 - DNA, 15 bp, Homo sapiens
gcaaggccctgctgc

SEQ ID NO: 6229716 - DNA, 12 bp, Homo sapiens
gcaaggccctgt

SEQ ID NO: 6229717 - DNA, 17 bp, Homo sapiens
gcaaggccctgtcccag

SEQ ID NO: 6229718 - DNA, 20 bp, Homo sapiens
gcaaggccctgtcccagcag

SEQ ID NO: 6229719 - DNA, 20 bp, Homo sapiens
gcaaggcctctcagacccag

SEQ ID NO: 6229720 - DNA, 13 bp, Homo sapiens
gcaaggcctgtgc

SEQ ID NO: 6229721 - DNA, 23 bp, Homo sapiens
gcaaggccttggtggagcagcca

SEQ ID NO: 6229722 - DNA, 23 bp, Homo sapiens
gcaaggcggtggacttgaacttt

SEQ ID NO: 6229723 - DNA, 15 bp, Homo sapiens
gcaaggctatgtgat

SEQ ID NO: 6229724 - DNA, 16 bp, Homo sapiens
gcaaggctgccggctg

SEQ ID NO: 6229725 - DNA, 11 bp, Homo sapiens
gcaaggctgct

SEQ ID NO: 6229726 - DNA, 14 bp, Homo sapiens
gcaagggagaaaag

SEQ ID NO: 6229727 - DNA, 19 bp, Homo sapiens
gcaagggagaaaagagaaa

SEQ ID NO: 6229728 - DNA, 20 bp, Homo sapiens
gcaagggagaaaagagaaac

SEQ ID NO: 6229729 - DNA, 13 bp, Homo sapiens
gcaagggaggcgc

SEQ ID NO: 6229730 - DNA, 22 bp, Homo sapiens
gcaagggcacaagtcctggatg

SEQ ID NO: 6229731 - DNA, 16 bp, Homo sapiens
gcaagggcagggacag

SEQ ID NO: 6229732 - DNA, 14 bp, Homo sapiens
gcaagggcatcagg

SEQ ID NO: 6229733 - DNA, 15 bp, Homo sapiens
gcaagggcatcaggc

SEQ ID NO: 6229734 - DNA, 12 bp, Homo sapiens
gcaagggcccag

SEQ ID NO: 6229735 - DNA, 14 bp, Homo sapiens
gcaagggcccagag

SEQ ID NO: 6229736 - DNA, 10 bp, Homo sapiens
gcaagggctc

SEQ ID NO: 6229737 - DNA, 13 bp, Homo sapiens
gcaagggctccag

SEQ ID NO: 6229738 - DNA, 20 bp, Homo sapiens
gcaaggggcagccagccctg

SEQ ID NO: 6229739 - DNA, 14 bp, Homo sapiens
gcaaggggccagga

SEQ ID NO: 6229740 - DNA, 15 bp, Homo sapiens
gcaaggggccaggaa

SEQ ID NO: 6229741 - DNA, 13 bp, Homo sapiens
gcaaggggctcag

SEQ ID NO: 6229742 - DNA, 16 bp, Homo sapiens
gcaaggggctggctgg

SEQ ID NO: 6229743 - DNA, 20 bp, Homo sapiens
gcaaggggctggctggagtc

SEQ ID NO: 6229744 - DNA, 13 bp, Homo sapiens
gcaagggggcggg

SEQ ID NO: 6229745 - DNA, 21 bp, Homo sapiens
gcaagggggtgtcatctgagg

SEQ ID NO: 6229746 - DNA, 18 bp, Homo sapiens
gcaaggggtgcctgggaa

SEQ ID NO: 6229747 - DNA, 19 bp, Homo sapiens
gcaaggggtgcctgggaac

SEQ ID NO: 6229748 - DNA, 13 bp, Homo sapiens
gcaagggtgcctc

SEQ ID NO: 6229749 - DNA, 14 bp, Homo sapiens
gcaagggtgctgtg

SEQ ID NO: 6229750 - DNA, 17 bp, Homo sapiens
gcaaggtactctggtga

SEQ ID NO: 6229751 - DNA, 14 bp, Homo sapiens
gcaaggtcattttt

SEQ ID NO: 6229752 - DNA, 19 bp, Homo sapiens
gcaaggtctggcctcaggt

SEQ ID NO: 6229753 - DNA, 18 bp, Homo sapiens
gcaaggtcttgctctcct

SEQ ID NO: 6229754 - DNA, 23 bp, Homo sapiens
gcaaggtgcacctgccccaggct

SEQ ID NO: 6229755 - DNA, 23 bp, Homo sapiens
gcaaggtggagtggatgcctcag

SEQ ID NO: 6229756 - DNA, 11 bp, Homo sapiens
gcaaggtggcc

SEQ ID NO: 6229757 - DNA, 22 bp, Homo sapiens
gcaaggtggcctctgcctgggg

SEQ ID NO: 6229758 - DNA, 20 bp, Homo sapiens
gcaaggtgggggagcctgga

SEQ ID NO: 6229759 - DNA, 21 bp, Homo sapiens
gcaaggtgggggagcctggag

SEQ ID NO: 6229760 - DNA, 22 bp, Homo sapiens
gcaaggtgggggagcctggagc

SEQ ID NO: 6229761 - DNA, 24 bp, Homo sapiens
gcaaggtgggggtcaggctacagg

SEQ ID NO: 6229762 - DNA, 14 bp, Homo sapiens
gacagaggccctgc

SEQ ID NO: 6229763 - DNA, 22 bp, Homo sapiens
gacagaggccctgccacgtccc

SEQ ID NO: 6229764 - DNA, 12 bp, Homo sapiens
gacagaggcctg

SEQ ID NO: 6229765 - DNA, 20 bp, Homo sapiens
gacagagggaaacacagcag

SEQ ID NO: 6229766 - DNA, 16 bp, Homo sapiens
gacagagggaagaaaa

SEQ ID NO: 6229767 - DNA, 14 bp, Homo sapiens
gacagagggagaag

SEQ ID NO: 6229768 - DNA, 17 bp, Homo sapiens
gacagagggagaaggga

SEQ ID NO: 6229769 - DNA, 17 bp, Homo sapiens
gacagaggggcagggga

SEQ ID NO: 6229770 - DNA, 18 bp, Homo sapiens
gacagagggtcacagtgt

SEQ ID NO: 6229771 - DNA, 17 bp, Homo sapiens
gacagagggtggctgga

SEQ ID NO: 6229772 - DNA, 23 bp, Homo sapiens
gacagaggttgtagtgagccaag

SEQ ID NO: 6229773 - DNA, 14 bp, Homo sapiens
gacagaggtttcat

SEQ ID NO: 6229774 - DNA, 15 bp, Homo sapiens
gacagaggttttgaa

SEQ ID NO: 6229775 - DNA, 21 bp, Homo sapiens
gacagagtctcactgttgccc

SEQ ID NO: 6229776 - DNA, 18 bp, Homo sapiens
gacagagtgaatttcagt

SEQ ID NO: 6229777 - DNA, 16 bp, Homo sapiens
gacagagtgccctggg

SEQ ID NO: 6229778 - DNA, 21 bp, Homo sapiens
gacagagtggatctggagtct

SEQ ID NO: 6229779 - DNA, 14 bp, Homo sapiens
gacagagttcacag

SEQ ID NO: 6229780 - DNA, 21 bp, Homo sapiens
gacagagttcacaggaggcca

SEQ ID NO: 6229781 - DNA, 19 bp, Homo sapiens
gacagagttggtgttcata

SEQ ID NO: 6229782 - DNA, 20 bp, Homo sapiens
gacagatacatagatggacc

SEQ ID NO: 6229783 - DNA, 22 bp, Homo sapiens
gacagatacctccaaccctgcc

SEQ ID NO: 6229784 - DNA, 23 bp, Homo sapiens
gacagatacctccaaccctgccg

SEQ ID NO: 6229785 - DNA, 16 bp, Homo sapiens
gacagatagtgaaaca

SEQ ID NO: 6229786 - DNA, 15 bp, Homo sapiens
gacagatatttcaaa

SEQ ID NO: 6229787 - DNA, 20 bp, Homo sapiens
gacagatcaagctgtgagac

SEQ ID NO: 6229788 - DNA, 19 bp, Homo sapiens
gacagatcaggctagccct

SEQ ID NO: 6229789 - DNA, 23 bp, Homo sapiens
gacagatcatagatttctgattt

SEQ ID NO: 6229790 - DNA, 22 bp, Homo sapiens
gacagatcataggaagtggctg

SEQ ID NO: 6229791 - DNA, 15 bp, Homo sapiens
gacagatccccgttc

SEQ ID NO: 6229792 - DNA, 21 bp, Homo sapiens
gacagatctctgctttggaaa

SEQ ID NO: 6229793 - DNA, 13 bp, Homo sapiens
gacagatcttgag

SEQ ID NO: 6229794 - DNA, 19 bp, Homo sapiens
gacagatgaccgcaataat

SEQ ID NO: 6229795 - DNA, 16 bp, Homo sapiens
gacagatgagcaggag

SEQ ID NO: 6229796 - DNA, 21 bp, Homo sapiens
gacagatgagcaggagcttgg

SEQ ID NO: 6229797 - DNA, 15 bp, Homo sapiens
gacagatgaggcttt

SEQ ID NO: 6229798 - DNA, 19 bp, Homo sapiens
gacagatgccccagagctg

SEQ ID NO: 6229799 - DNA, 14 bp, Homo sapiens
gacagatgcctcct

SEQ ID NO: 6229800 - DNA, 19 bp, Homo sapiens
gacagatgcctccttcctc

SEQ ID NO: 6229801 - DNA, 17 bp, Homo sapiens
gacagatgcctggtgag

SEQ ID NO: 6229802 - DNA, 21 bp, Homo sapiens
gacagatgcctggtgagcagg

SEQ ID NO: 6229803 - DNA, 20 bp, Homo sapiens
gacagatgctggtggaggaa

SEQ ID NO: 6229804 - DNA, 13 bp, Homo sapiens
gacagatggacca

SEQ ID NO: 6229805 - DNA, 18 bp, Homo sapiens
gacagatggaccaaaaga

SEQ ID NO: 6229806 - DNA, 19 bp, Homo sapiens
gacagatggacgcaggccc

SEQ ID NO: 6229807 - DNA, 21 bp, Homo sapiens
gacagatggacgcaggccctg

SEQ ID NO: 6229808 - DNA, 15 bp, Homo sapiens
gacagatggcccaag

SEQ ID NO: 6229809 - DNA, 17 bp, Homo sapiens
gacagatgggtgtcccc

SEQ ID NO: 6229810 - DNA, 21 bp, Homo sapiens
gacagatgggtgtcccctggt

SEQ ID NO: 6229811 - DNA, 19 bp, Homo sapiens
gacagatgttatttttgta

SEQ ID NO: 6229812 - DNA, 20 bp, Homo sapiens
gacagattcagtcttgcctt

SEQ ID NO: 6229813 - DNA, 22 bp, Homo sapiens
gacagattcataaagtaatgat

SEQ ID NO: 6229814 - DNA, 15 bp, Homo sapiens
gacagattcgcagca

SEQ ID NO: 6229815 - DNA, 12 bp, Homo sapiens
gacagatttcag

SEQ ID NO: 6229816 - DNA, 23 bp, Homo sapiens
gacagatttcagtaatgtcttca

SEQ ID NO: 6229817 - DNA, 23 bp, Homo sapiens
gacagatttgaggactgaagctg

SEQ ID NO: 6229818 - DNA, 22 bp, Homo sapiens
gacagcaaaaaaagcaactttt

SEQ ID NO: 6229819 - DNA, 20 bp, Homo sapiens
gacagcaaaaccattgcttc

SEQ ID NO: 6229820 - DNA, 21 bp, Homo sapiens
gacagcaaaaccattgcttca

SEQ ID NO: 6229821 - DNA, 23 bp, Homo sapiens
gacagcaaaatgttgaagaaaaa

SEQ ID NO: 6229822 - DNA, 14 bp, Homo sapiens
gacagcaaacacag

SEQ ID NO: 6229823 - DNA, 15 bp, Homo sapiens
gacagcaaacacagt

SEQ ID NO: 6229824 - DNA, 20 bp, Homo sapiens
gacagcaacaaaatcatggc

SEQ ID NO: 6229825 - DNA, 17 bp, Homo sapiens
gacagcaaggtgtggag

SEQ ID NO: 6229826 - DNA, 14 bp, Homo sapiens
gacagcaagtgagc

SEQ ID NO: 6229827 - DNA, 24 bp, Homo sapiens
gacagcacaaggtggcagcaagca

SEQ ID NO: 6229828 - DNA, 13 bp, Homo sapiens
gacagcacacggt

SEQ ID NO: 6229829 - DNA, 14 bp, Homo sapiens
gacagcacagatgt

SEQ ID NO: 6229830 - DNA, 13 bp, Homo sapiens
gacagcacaggca

SEQ ID NO: 6229831 - DNA, 14 bp, Homo sapiens
gacagcacaggcag

SEQ ID NO: 6229832 - DNA, 17 bp, Homo sapiens
gacagcaccactgctga

SEQ ID NO: 6229833 - DNA, 19 bp, Homo sapiens
gacagcaccactgctgagg

SEQ ID NO: 6229834 - DNA, 19 bp, Homo sapiens
gacagcactcctcggcagg

SEQ ID NO: 6229835 - DNA, 14 bp, Homo sapiens
gacagcagaactgc

SEQ ID NO: 6229836 - DNA, 13 bp, Homo sapiens
gacagcagaagcc

SEQ ID NO: 6229837 - DNA, 12 bp, Homo sapiens
gacagcagcact

SEQ ID NO: 6229838 - DNA, 12 bp, Homo sapiens
gacagcagcagc

SEQ ID NO: 6229839 - DNA, 15 bp, Homo sapiens
gacagcagcagcctg

SEQ ID NO: 6229840 - DNA, 14 bp, Homo sapiens
gacagcagcatctc

SEQ ID NO: 6229841 - DNA, 16 bp, Homo sapiens
gacagcagcctgtatg

SEQ ID NO: 6229842 - DNA, 17 bp, Homo sapiens
gacagcagcctgtatgt

SEQ ID NO: 6229843 - DNA, 21 bp, Homo sapiens
gacagcagcctgtatgtggtg

SEQ ID NO: 6229844 - DNA, 14 bp, Homo sapiens
gacagcagcctgtg

SEQ ID NO: 6229845 - DNA, 16 bp, Homo sapiens
gacagcagctcaggca

SEQ ID NO: 6229846 - DNA, 13 bp, Homo sapiens
gacagcagctgga

SEQ ID NO: 6229847 - DNA, 18 bp, Homo sapiens
gacagcagggaccgggcg

SEQ ID NO: 6229848 - DNA, 19 bp, Homo sapiens
gacagcaggtgtacacatg

SEQ ID NO: 6229849 - DNA, 22 bp, Homo sapiens
gacagcagtatcacaggccaga

SEQ ID NO: 6229850 - DNA, 20 bp, Homo sapiens
gacagcataccttggactga

SEQ ID NO: 6229851 - DNA, 15 bp, Homo sapiens
gacagcatcagaaat

SEQ ID NO: 6229852 - DNA, 17 bp, Homo sapiens
gacagcatcccttccca

SEQ ID NO: 6229853 - DNA, 12 bp, Homo sapiens
gacagcatgact

SEQ ID NO: 6229854 - DNA, 13 bp, Homo sapiens
gacagcatgcccc

SEQ ID NO: 6229855 - DNA, 19 bp, Homo sapiens
gacagcatgccccttggct

SEQ ID NO: 6229856 - DNA, 15 bp, Homo sapiens
gacagcattttaagg

SEQ ID NO: 6229857 - DNA, 16 bp, Homo sapiens
gacagccaaaggctgg

SEQ ID NO: 6229858 - DNA, 17 bp, Homo sapiens
gacagccaaaggctggc

SEQ ID NO: 6229859 - DNA, 11 bp, Homo sapiens
gacagccacac

SEQ ID NO: 6229860 - DNA, 12 bp, Homo sapiens
gacagccagagc

SEQ ID NO: 6229861 - DNA, 17 bp, Homo sapiens
gacagccagagcctgtc

SEQ ID NO: 6229862 - DNA, 16 bp, Homo sapiens
gacagccagagctggg

SEQ ID NO: 6229863 - DNA, 13 bp, Homo sapiens
gacagccagggca

SEQ ID NO: 6229864 - DNA, 18 bp, Homo sapiens
gacagccaggtggcacct

SEQ ID NO: 6229865 - DNA, 22 bp, Homo sapiens
gacagccaggtggcacctgcag

SEQ ID NO: 6229866 - DNA, 15 bp, Homo sapiens
gacagcccagagcct

SEQ ID NO: 6229867 - DNA, 11 bp, Homo sapiens
gacagcccagc

SEQ ID NO: 6229868 - DNA, 23 bp, Homo sapiens
gacagcccaggatactggcacag

SEQ ID NO: 6229869 - DNA, 10 bp, Homo sapiens
gacagcccca

SEQ ID NO: 6229870 - DNA, 20 bp, Homo sapiens
gacagccccaagcttctgag

SEQ ID NO: 6229871 - DNA, 15 bp, Homo sapiens
gacagccccaccctg

SEQ ID NO: 6229872 - DNA, 18 bp, Homo sapiens
gacagccccagagcaggg

SEQ ID NO: 6229873 - DNA, 14 bp, Homo sapiens
gacagccccagggc

SEQ ID NO: 6229874 - DNA, 17 bp, Homo sapiens
gacagccccagggccct

SEQ ID NO: 6229875 - DNA, 13 bp, Homo sapiens
gacagcccgggag

SEQ ID NO: 6229876 - DNA, 20 bp, Homo sapiens
gacagcccgggctctgcctc

SEQ ID NO: 6229877 - DNA, 21 bp, Homo sapiens
gacagcccgggctctgcctcc

SEQ ID NO: 6229878 - DNA, 22 bp, Homo sapiens
gacagcccgggctctgcctccc

SEQ ID NO: 6229879 - DNA, 14 bp, Homo sapiens
gacagccctgccta

SEQ ID NO: 6229880 - DNA, 17 bp, Homo sapiens
gacagccctgcctatcc

SEQ ID NO: 6229881 - DNA, 21 bp, Homo sapiens
gacagccctgcctatcctctg

SEQ ID NO: 6229882 - DNA, 15 bp, Homo sapiens
gacagccgcctggag

SEQ ID NO: 6229883 - DNA, 22 bp, Homo sapiens
gacagccggagcagttggcctg

SEQ ID NO: 6229884 - DNA, 19 bp, Homo sapiens
gacagccggatcttggaga

SEQ ID NO: 6229885 - DNA, 19 bp, Homo sapiens
gacagcctccaccttgagc

SEQ ID NO: 6229886 - DNA, 18 bp, Homo sapiens
gacagcctccccctgtcc

SEQ ID NO: 6229887 - DNA, 14 bp, Homo sapiens
gacagcctcctagg

SEQ ID NO: 6229888 - DNA, 15 bp, Homo sapiens
gacagcctcctaggc

SEQ ID NO: 6229889 - DNA, 13 bp, Homo sapiens
gacagcctctgac

SEQ ID NO: 6229890 - DNA, 17 bp, Homo sapiens
gacagcctcttcagccc

SEQ ID NO: 6229891 - DNA, 19 bp, Homo sapiens
gacagcctcttcagcccct

SEQ ID NO: 6229892 - DNA, 19 bp, Homo sapiens
gacagcctcttctgtccca

SEQ ID NO: 6229893 - DNA, 14 bp, Homo sapiens
gacagcctgcctct

SEQ ID NO: 6229894 - DNA, 19 bp, Homo sapiens
gacagcctggcacagggca

SEQ ID NO: 6229895 - DNA, 15 bp, Homo sapiens
gacagcctggggggg

SEQ ID NO: 6229896 - DNA, 22 bp, Homo sapiens
gacagcctgtggcggtgcctgg

SEQ ID NO: 6229897 - DNA, 23 bp, Homo sapiens
gacagcctgtggcggtgcctggg

SEQ ID NO: 6229898 - DNA, 11 bp, Homo sapiens
gacagccttca

SEQ ID NO: 6229899 - DNA, 12 bp, Homo sapiens
gacagccttcag

SEQ ID NO: 6229900 - DNA, 13 bp, Homo sapiens
gacagccttgcaa

SEQ ID NO: 6229901 - DNA, 14 bp, Homo sapiens
gacagcgacagaaa

SEQ ID NO: 6229902 - DNA, 18 bp, Homo sapiens
gacagcgatataatttta

SEQ ID NO: 6229903 - DNA, 18 bp, Homo sapiens
gacagcgatggcaggcct

SEQ ID NO: 6229904 - DNA, 19 bp, Homo sapiens
gacagcgccatgtgtgtca

SEQ ID NO: 6229905 - DNA, 21 bp, Homo sapiens
gacagcggcccggcccacgca

SEQ ID NO: 6229906 - DNA, 14 bp, Homo sapiens
gacagcggggaagg

SEQ ID NO: 6229907 - DNA, 22 bp, Homo sapiens
gacagcgggtaaaaagagaagg

SEQ ID NO: 6229908 - DNA, 21 bp, Homo sapiens
gacagcgtccggggtggtgga

SEQ ID NO: 6229909 - DNA, 20 bp, Homo sapiens
gacagctactaacctggaga

SEQ ID NO: 6229910 - DNA, 21 bp, Homo sapiens
gacagctactaacctggagac

SEQ ID NO: 6229911 - DNA, 23 bp, Homo sapiens
gacagctactaacctggagacag

SEQ ID NO: 6229912 - DNA, 19 bp, Homo sapiens
gacagctacttctgggaaa

SEQ ID NO: 6229913 - DNA, 18 bp, Homo sapiens
gacagctccaccctggcc

SEQ ID NO: 6229914 - DNA, 17 bp, Homo sapiens
gacagctccctctgcct

SEQ ID NO: 6229915 - DNA, 23 bp, Homo sapiens
gacagctccgcgctcggggctgg

SEQ ID NO: 6229916 - DNA, 16 bp, Homo sapiens
gacagctcctggacca

SEQ ID NO: 6229917 - DNA, 11 bp, Homo sapiens
gacagctcctt

SEQ ID NO: 6229918 - DNA, 13 bp, Homo sapiens
gacagctccttct

SEQ ID NO: 6229919 - DNA, 14 bp, Homo sapiens
gacagctctggggt

SEQ ID NO: 6229920 - DNA, 10 bp, Homo sapiens
gacagctctt

SEQ ID NO: 6229921 - DNA, 20 bp, Homo sapiens
gacagctctttttgtgaagt

SEQ ID NO: 6229922 - DNA, 18 bp, Homo sapiens
gacagctgactgaatgca

SEQ ID NO: 6229923 - DNA, 11 bp, Homo sapiens
gacagctgcaa

SEQ ID NO: 6229924 - DNA, 16 bp, Homo sapiens
gacagctgcaagccag

SEQ ID NO: 6229925 - DNA, 22 bp, Homo sapiens
gacagctgcaagccagggatga

SEQ ID NO: 6229926 - DNA, 15 bp, Homo sapiens
gacagctgcaggtgc

SEQ ID NO: 6229927 - DNA, 14 bp, Homo sapiens
gacagctgcccaga

SEQ ID NO: 6229928 - DNA, 15 bp, Homo sapiens
gacagctgcccagac

SEQ ID NO: 6229929 - DNA, 12 bp, Homo sapiens
gacagctgcctg

SEQ ID NO: 6229930 - DNA, 17 bp, Homo sapiens
gacagctgcctgggatc

SEQ ID NO: 6229931 - DNA, 17 bp, Homo sapiens
gacagctgctcagagcc

SEQ ID NO: 6229932 - DNA, 18 bp, Homo sapiens
gacagctgctgggaccca

SEQ ID NO: 6229933 - DNA, 14 bp, Homo sapiens
gacagctgcttctg

SEQ ID NO: 6229934 - DNA, 20 bp, Homo sapiens
gacagctggcggaggctgct

SEQ ID NO: 6229935 - DNA, 22 bp, Homo sapiens
gacagctggcggaggctgctcg

SEQ ID NO: 6229936 - DNA, 13 bp, Homo sapiens
gacagctggctgc

SEQ ID NO: 6229937 - DNA, 17 bp, Homo sapiens
gacagctggctgctgac

SEQ ID NO: 6229938 - DNA, 21 bp, Homo sapiens
gacagctggctgctgacagga

SEQ ID NO: 6229939 - DNA, 16 bp, Homo sapiens
gacagctggctgggcc

SEQ ID NO: 6229940 - DNA, 22 bp, Homo sapiens
gacagctgtccctgtcaccaag

SEQ ID NO: 6229941 - DNA, 19 bp, Homo sapiens
gcaaggtgtgctctgagcc

SEQ ID NO: 6229942 - DNA, 23 bp, Homo sapiens
gcaaggtgtgctctgagccacag

SEQ ID NO: 6229943 - DNA, 16 bp, Homo sapiens
gcaaggtgtggaggct

SEQ ID NO: 6229944 - DNA, 17 bp, Homo sapiens
gcaaggtgtggaggctc

SEQ ID NO: 6229945 - DNA, 23 bp, Homo sapiens
gcaaggttccacagagtaagaca

SEQ ID NO: 6229946 - DNA, 22 bp, Homo sapiens
gcaaggtttaggctggtggccc

SEQ ID NO: 6229947 - DNA, 18 bp, Homo sapiens
gcaaggtttcgtggcagc

SEQ ID NO: 6229948 - DNA, 20 bp, Homo sapiens
gcaagtaacttctgacttac

SEQ ID NO: 6229949 - DNA, 14 bp, Homo sapiens
gcaagtagataaat

SEQ ID NO: 6229950 - DNA, 15 bp, Homo sapiens
gcaagtagcaggact

SEQ ID NO: 6229951 - DNA, 16 bp, Homo sapiens
gcaagtagcaggacta

SEQ ID NO: 6229952 - DNA, 12 bp, Homo sapiens
gcaagtagctgg

SEQ ID NO: 6229953 - DNA, 18 bp, Homo sapiens
gcaagtagctttccacat

SEQ ID NO: 6229954 - DNA, 18 bp, Homo sapiens
gcaagtatgtgagtgtgt

SEQ ID NO: 6229955 - DNA, 16 bp, Homo sapiens
gcaagtcacaaaggaa

SEQ ID NO: 6229956 - DNA, 13 bp, Homo sapiens
gcaagtcacagaa

SEQ ID NO: 6229957 - DNA, 22 bp, Homo sapiens
gcaagtcactaaatttctcagt

SEQ ID NO: 6229958 - DNA, 23 bp, Homo sapiens
gcaagtcagaggatggccagtgt

SEQ ID NO: 6229959 - DNA, 12 bp, Homo sapiens
gcaagtcaggac

SEQ ID NO: 6229960 - DNA, 23 bp, Homo sapiens
gcaagtcatacttaggaatttct

SEQ ID NO: 6229961 - DNA, 14 bp, Homo sapiens
gcaagtcattgagt

SEQ ID NO: 6229962 - DNA, 14 bp, Homo sapiens
gcaagtccacccca

SEQ ID NO: 6229963 - DNA, 18 bp, Homo sapiens
gcaagtccatagctgagc

SEQ ID NO: 6229964 - DNA, 22 bp, Homo sapiens
gcaagtccatagctgagctgga

SEQ ID NO: 6229965 - DNA, 21 bp, Homo sapiens
gcaagtcccagacaaggagag

SEQ ID NO: 6229966 - DNA, 14 bp, Homo sapiens
gcaagtcccaggga

SEQ ID NO: 6229967 - DNA, 14 bp, Homo sapiens
gcaagtccccagcc

SEQ ID NO: 6229968 - DNA, 22 bp, Homo sapiens
gcaagtccctgactctctgtga

SEQ ID NO: 6229969 - DNA, 19 bp, Homo sapiens
gcaagtcccttcagactgg

SEQ ID NO: 6229970 - DNA, 22 bp, Homo sapiens
gcaagtcccttcagactggccc

SEQ ID NO: 6229971 - DNA, 16 bp, Homo sapiens
gcaagtcctgcaacca

SEQ ID NO: 6229972 - DNA, 18 bp, Homo sapiens
gcaagtccttttgtaaag

SEQ ID NO: 6229973 - DNA, 12 bp, Homo sapiens
gcaagtctgcag

SEQ ID NO: 6229974 - DNA, 13 bp, Homo sapiens
gcaagtctgcagg

SEQ ID NO: 6229975 - DNA, 21 bp, Homo sapiens
gcaagtctgccgattttgtaa

SEQ ID NO: 6229976 - DNA, 12 bp, Homo sapiens
gcaagtctgtga

SEQ ID NO: 6229977 - DNA, 11 bp, Homo sapiens
gcaagtcttaa

SEQ ID NO: 6229978 - DNA, 13 bp, Homo sapiens
gcaagtcttaaca

SEQ ID NO: 6229979 - DNA, 22 bp, Homo sapiens
gcaagtgagagagatgggagct

SEQ ID NO: 6229980 - DNA, 13 bp, Homo sapiens
gcaagtgagagct

SEQ ID NO: 6229981 - DNA, 15 bp, Homo sapiens
gcaagtgagagctgg

SEQ ID NO: 6229982 - DNA, 21 bp, Homo sapiens
gcaagtgagaggggagggagg

SEQ ID NO: 6229983 - DNA, 22 bp, Homo sapiens
gcaagtgagaggggagggaggg

SEQ ID NO: 6229984 - DNA, 17 bp, Homo sapiens
gcaagtgagcagagatg

SEQ ID NO: 6229985 - DNA, 15 bp, Homo sapiens
gcaagtgaggcaaga

SEQ ID NO: 6229986 - DNA, 19 bp, Homo sapiens
gcaagtgaggcaagagaaa

SEQ ID NO: 6229987 - DNA, 13 bp, Homo sapiens
gcaagtgaggccg

SEQ ID NO: 6229988 - DNA, 17 bp, Homo sapiens
gcaagtgaggccggaga

SEQ ID NO: 6229989 - DNA, 18 bp, Homo sapiens
gcaagtgatatcacctct

SEQ ID NO: 6229990 - DNA, 20 bp, Homo sapiens
gcaagtgattgggacagagg

SEQ ID NO: 6229991 - DNA, 12 bp, Homo sapiens
gcaagtgattta

SEQ ID NO: 6229992 - DNA, 13 bp, Homo sapiens
gcaagtgcccagt

SEQ ID NO: 6229993 - DNA, 15 bp, Homo sapiens
gcaagtgcccagtgg

SEQ ID NO: 6229994 - DNA, 17 bp, Homo sapiens
gcaagtgcccgccctgc

SEQ ID NO: 6229995 - DNA, 15 bp, Homo sapiens
gcaagtgcctgggat

SEQ ID NO: 6229996 - DNA, 13 bp, Homo sapiens
gcaagtgctcagg

SEQ ID NO: 6229997 - DNA, 12 bp, Homo sapiens
gcaagtgctgga

SEQ ID NO: 6229998 - DNA, 17 bp, Homo sapiens
gcaagtggagctgtctg

SEQ ID NO: 6229999 - DNA, 20 bp, Homo sapiens
gcaagtggagctgtctgtct

SEQ ID NO: 6230000 - DNA, 18 bp, Homo sapiens
gcaagtggatggcccagc

SEQ ID NO: 6230001 - DNA, 19 bp, Homo sapiens
gcaagtggatggcccagca

SEQ ID NO: 6230002 - DNA, 21 bp, Homo sapiens
gcaagtggatggcccagcagg

SEQ ID NO: 6230003 - DNA, 16 bp, Homo sapiens
gcaagtggatgggaat

SEQ ID NO: 6230004 - DNA, 23 bp, Homo sapiens
gcaagtggatgggaatttgtcag

SEQ ID NO: 6230005 - DNA, 20 bp, Homo sapiens
gcaagtgggagatgaaaacc

SEQ ID NO: 6230006 - DNA, 17 bp, Homo sapiens
gcaagtggggctggttt

SEQ ID NO: 6230007 - DNA, 15 bp, Homo sapiens
gcaagtggttaagaa

SEQ ID NO: 6230008 - DNA, 21 bp, Homo sapiens
gcaagtgtctggagcggctgc

SEQ ID NO: 6230009 - DNA, 17 bp, Homo sapiens
gcaagtgtctgtgtgca

SEQ ID NO: 6230010 - DNA, 16 bp, Homo sapiens
gcaagtgtgcactcca

SEQ ID NO: 6230011 - DNA, 22 bp, Homo sapiens
gcaagtgtggggggtccttctc

SEQ ID NO: 6230012 - DNA, 18 bp, Homo sapiens
gcaagtgtgtgagtgtga

SEQ ID NO: 6230013 - DNA, 20 bp, Homo sapiens
gcaagtgttagaattgcctt

SEQ ID NO: 6230014 - DNA, 19 bp, Homo sapiens
gcaagtgttcccaaattga

SEQ ID NO: 6230015 - DNA, 16 bp, Homo sapiens
gcaagtgtttctgttc

SEQ ID NO: 6230016 - DNA, 15 bp, Homo sapiens
gcaagtgtttgtggg

SEQ ID NO: 6230017 - DNA, 16 bp, Homo sapiens
gcaagttaagagaaac

SEQ ID NO: 6230018 - DNA, 23 bp, Homo sapiens
gcaagttattttatttgcttatt

SEQ ID NO: 6230019 - DNA, 16 bp, Homo sapiens
gcaagttcaagactga

SEQ ID NO: 6230020 - DNA, 22 bp, Homo sapiens
gcaagttcaagggctctttctc

SEQ ID NO: 6230021 - DNA, 16 bp, Homo sapiens
gcaagttcagggaagc

SEQ ID NO: 6230022 - DNA, 18 bp, Homo sapiens
gcaagttcagggaagcag

SEQ ID NO: 6230023 - DNA, 21 bp, Homo sapiens
gcaagttcagggaagcaggca

SEQ ID NO: 6230024 - DNA, 16 bp, Homo sapiens
gcaagttcattttaaa

SEQ ID NO: 6230025 - DNA, 13 bp, Homo sapiens
gcaagttcccagt

SEQ ID NO: 6230026 - DNA, 20 bp, Homo sapiens
gcaagttctagagaagaggc

SEQ ID NO: 6230027 - DNA, 14 bp, Homo sapiens
gcaagttgtactgt

SEQ ID NO: 6230028 - DNA, 23 bp, Homo sapiens
gcaagttttaaacccaaaatata

SEQ ID NO: 6230029 - DNA, 20 bp, Homo sapiens
gcaagttttccctgaagtta

SEQ ID NO: 6230030 - DNA, 15 bp, Homo sapiens
gcaataaaactgcta

SEQ ID NO: 6230031 - DNA, 16 bp, Homo sapiens
gcaataaaatgggttt

SEQ ID NO: 6230032 - DNA, 16 bp, Homo sapiens
gcaataaaattatttg

SEQ ID NO: 6230033 - DNA, 21 bp, Homo sapiens
gcaataaaatttaaaaaataa

SEQ ID NO: 6230034 - DNA, 13 bp, Homo sapiens
gcaataaagaaga

SEQ ID NO: 6230035 - DNA, 15 bp, Homo sapiens
gcaataaagtggaaa

SEQ ID NO: 6230036 - DNA, 20 bp, Homo sapiens
gcaataaataaagcttggga

SEQ ID NO: 6230037 - DNA, 16 bp, Homo sapiens
gcaataaatattattt

SEQ ID NO: 6230038 - DNA, 12 bp, Homo sapiens
gcaataaatgaa

SEQ ID NO: 6230039 - DNA, 20 bp, Homo sapiens
gcaataaatgccctctctga

SEQ ID NO: 6230040 - DNA, 13 bp, Homo sapiens
gcaataaatggct

SEQ ID NO: 6230041 - DNA, 18 bp, Homo sapiens
gcaataaattttgaaaag

SEQ ID NO: 6230042 - DNA, 20 bp, Homo sapiens
gcaataacaagcatgcataa

SEQ ID NO: 6230043 - DNA, 19 bp, Homo sapiens
gcaataacagttttaagat

SEQ ID NO: 6230044 - DNA, 15 bp, Homo sapiens
gcaataactctggga

SEQ ID NO: 6230045 - DNA, 14 bp, Homo sapiens
gcaataactgaaaa

SEQ ID NO: 6230046 - DNA, 16 bp, Homo sapiens
gcaataactgaaaatg

SEQ ID NO: 6230047 - DNA, 16 bp, Homo sapiens
gcaataagaaatgaac

SEQ ID NO: 6230048 - DNA, 23 bp, Homo sapiens
gcaataagaaatgaacaaaagat

SEQ ID NO: 6230049 - DNA, 14 bp, Homo sapiens
gcaataagaacaaa

SEQ ID NO: 6230050 - DNA, 20 bp, Homo sapiens
gcaataagctggactagtgt

SEQ ID NO: 6230051 - DNA, 21 bp, Homo sapiens
gcaataaggaaatgtatattc

SEQ ID NO: 6230052 - DNA, 23 bp, Homo sapiens
gcaataaggggagagtaaccctg

SEQ ID NO: 6230053 - DNA, 19 bp, Homo sapiens
gcaataagttcattaaaca

SEQ ID NO: 6230054 - DNA, 16 bp, Homo sapiens
gcaataagttgaatga

SEQ ID NO: 6230055 - DNA, 16 bp, Homo sapiens
gcaataataaagtact

SEQ ID NO: 6230056 - DNA, 14 bp, Homo sapiens
gcaataataataaa

SEQ ID NO: 6230057 - DNA, 16 bp, Homo sapiens
gcaataataataaatt

SEQ ID NO: 6230058 - DNA, 19 bp, Homo sapiens
gcaataatatcaaaacaag

SEQ ID NO: 6230059 - DNA, 20 bp, Homo sapiens
gcaataatattttctgtgta

SEQ ID NO: 6230060 - DNA, 14 bp, Homo sapiens
gcaataatgcagta

SEQ ID NO: 6230061 - DNA, 21 bp, Homo sapiens
gcaataatggtcccatccagg

SEQ ID NO: 6230062 - DNA, 23 bp, Homo sapiens
gcaataatggtcccatccaggca

SEQ ID NO: 6230063 - DNA, 22 bp, Homo sapiens
gcaataattaggatctatgcaa

SEQ ID NO: 6230064 - DNA, 14 bp, Homo sapiens
gcaataattgtttc

SEQ ID NO: 6230065 - DNA, 20 bp, Homo sapiens
gcaataattgtttccaactt

SEQ ID NO: 6230066 - DNA, 16 bp, Homo sapiens
gcaataatttgtacaa

SEQ ID NO: 6230067 - DNA, 17 bp, Homo sapiens
gcaataatttgtacaat

SEQ ID NO: 6230068 - DNA, 22 bp, Homo sapiens
gcaataatttgtacaatggttt

SEQ ID NO: 6230069 - DNA, 13 bp, Homo sapiens
gcaatacaacttt

SEQ ID NO: 6230070 - DNA, 15 bp, Homo sapiens
gcaatacaactttac

SEQ ID NO: 6230071 - DNA, 12 bp, Homo sapiens
gcaatacatttt

SEQ ID NO: 6230072 - DNA, 17 bp, Homo sapiens
gcaataccaacctgaaa

SEQ ID NO: 6230073 - DNA, 23 bp, Homo sapiens
gcaatacgggagtgacccagcta

SEQ ID NO: 6230074 - DNA, 18 bp, Homo sapiens
gcaatacgtttgtgcaga

SEQ ID NO: 6230075 - DNA, 19 bp, Homo sapiens
gcaatacgtttgtgcagaa

SEQ ID NO: 6230076 - DNA, 20 bp, Homo sapiens
gcaatacgtttgtgcagaat

SEQ ID NO: 6230077 - DNA, 16 bp, Homo sapiens
gcaatactcatcagag

SEQ ID NO: 6230078 - DNA, 17 bp, Homo sapiens
gcaatactcatcagagc

SEQ ID NO: 6230079 - DNA, 20 bp, Homo sapiens
gcaatactcatcagagcagc

SEQ ID NO: 6230080 - DNA, 18 bp, Homo sapiens
gcaatactgccgctgccc

SEQ ID NO: 6230081 - DNA, 20 bp, Homo sapiens
gcaatactgccgctgccccc

SEQ ID NO: 6230082 - DNA, 13 bp, Homo sapiens
gcaatagaaacaa

SEQ ID NO: 6230083 - DNA, 15 bp, Homo sapiens
gcaatagagactgta

SEQ ID NO: 6230084 - DNA, 20 bp, Homo sapiens
gcaatagattactgatgtga

SEQ ID NO: 6230085 - DNA, 22 bp, Homo sapiens
gcaatagcgctcccttttcacc

SEQ ID NO: 6230086 - DNA, 22 bp, Homo sapiens
gcaataggtggaaagagaaatg

SEQ ID NO: 6230087 - DNA, 16 bp, Homo sapiens
gcaatagtcattaaaa

SEQ ID NO: 6230088 - DNA, 20 bp, Homo sapiens
gcaatagtgtgttctgatta

SEQ ID NO: 6230089 - DNA, 20 bp, Homo sapiens
gcaatataaaaatgtgaatc

SEQ ID NO: 6230090 - DNA, 13 bp, Homo sapiens
gcaatataagcat

SEQ ID NO: 6230091 - DNA, 16 bp, Homo sapiens
gcaatataagcataaa

SEQ ID NO: 6230092 - DNA, 11 bp, Homo sapiens
gcaatatataa

SEQ ID NO: 6230093 - DNA, 17 bp, Homo sapiens
gcaatatatctaaattg

SEQ ID NO: 6230094 - DNA, 14 bp, Homo sapiens
gcaatatatttgta

SEQ ID NO: 6230095 - DNA, 15 bp, Homo sapiens
gcaatatattttgta

SEQ ID NO: 6230096 - DNA, 19 bp, Homo sapiens
gcaatatcaacaacaagtt

SEQ ID NO: 6230097 - DNA, 13 bp, Homo sapiens
gcaatatgaagtt

SEQ ID NO: 6230098 - DNA, 17 bp, Homo sapiens
gcaatatgggcgggcag

SEQ ID NO: 6230099 - DNA, 14 bp, Homo sapiens
gcaatatgtaaata

SEQ ID NO: 6230100 - DNA, 22 bp, Homo sapiens
gcaatattctctgtacatatta

SEQ ID NO: 6230101 - DNA, 21 bp, Homo sapiens
gcaatattctgtaactattgg

SEQ ID NO: 6230102 - DNA, 23 bp, Homo sapiens
gcaatatttaacaatttattctg

SEQ ID NO: 6230103 - DNA, 22 bp, Homo sapiens
gcaatatttatagggcttttat

SEQ ID NO: 6230104 - DNA, 23 bp, Homo sapiens
gcaatatttccctggaatttaat

SEQ ID NO: 6230105 - DNA, 18 bp, Homo sapiens
gcaatatttgaattttaa

SEQ ID NO: 6230106 - DNA, 13 bp, Homo sapiens
gcaatcaaaaata

SEQ ID NO: 6230107 - DNA, 22 bp, Homo sapiens
gcaatcaaaaatatgtgttttt

SEQ ID NO: 6230108 - DNA, 14 bp, Homo sapiens
gcaatcacaaaggc

SEQ ID NO: 6230109 - DNA, 15 bp, Homo sapiens
gcaatcacaaaggct

SEQ ID NO: 6230110 - DNA, 23 bp, Homo sapiens
gcaatcacacgactgtcatctaa

SEQ ID NO: 6230111 - DNA, 17 bp, Homo sapiens
gcaatcactgggcccag

SEQ ID NO: 6230112 - DNA, 20 bp, Homo sapiens
gcaatcactgggcccagagg

SEQ ID NO: 6230113 - DNA, 22 bp, Homo sapiens
gcaatcaggattttaaacatgt

SEQ ID NO: 6230114 - DNA, 20 bp, Homo sapiens
gcaatcatttcccctcccgt

SEQ ID NO: 6230115 - DNA, 13 bp, Homo sapiens
gcaatcattttat

SEQ ID NO: 6230116 - DNA, 22 bp, Homo sapiens
gcaatcattttatataaagaaa

SEQ ID NO: 6230117 - DNA, 15 bp, Homo sapiens
gcaatccacctgcct

SEQ ID NO: 6230118 - DNA, 21 bp, Homo sapiens
gcaatccaggctgttctcagc

SEQ ID NO: 6230119 - DNA, 21 bp, Homo sapiens
gcaatccatgttagtttttac

SEQ ID NO: 6230120 - DNA, 12 bp, Homo sapiens
gcaatcccagca

SEQ ID NO: 6230121 - DNA, 18 bp, Homo sapiens
gcaatcccagcaccttag

SEQ ID NO: 6230122 - DNA, 16 bp, Homo sapiens
gcaatcctacttctat

SEQ ID NO: 6230123 - DNA, 23 bp, Homo sapiens
gcaatcctcccacttcagcctcc

SEQ ID NO: 6230124 - DNA, 14 bp, Homo sapiens
gcaatcctcctgag

SEQ ID NO: 6230125 - DNA, 20 bp, Homo sapiens
gcaatcctcctgcctcagcc

SEQ ID NO: 6230126 - DNA, 13 bp, Homo sapiens
gcaatccttacaa

SEQ ID NO: 6230127 - DNA, 14 bp, Homo sapiens
gcaatccttacaaa

SEQ ID NO: 6230128 - DNA, 16 bp, Homo sapiens
gcaatccttacaaatg

SEQ ID NO: 6230129 - DNA, 16 bp, Homo sapiens
gcaatcgcatcccggc

SEQ ID NO: 6230130 - DNA, 17 bp, Homo sapiens
gcaatcgcatcccggct

SEQ ID NO: 6230131 - DNA, 18 bp, Homo sapiens
gcaatcgggataaaacag

SEQ ID NO: 6230132 - DNA, 17 bp, Homo sapiens
gcaatcgttctgctggc

SEQ ID NO: 6230133 - DNA, 21 bp, Homo sapiens
gcaatctccccttgatttaaa

SEQ ID NO: 6230134 - DNA, 19 bp, Homo sapiens
gcaatctcggctcattgaa

SEQ ID NO: 6230135 - DNA, 17 bp, Homo sapiens
gcaatctcttcattatt

SEQ ID NO: 6230136 - DNA, 13 bp, Homo sapiens
gcaatctgaccct

SEQ ID NO: 6230137 - DNA, 21 bp, Homo sapiens
gcaatctggaagaaagccctg

SEQ ID NO: 6230138 - DNA, 21 bp, Homo sapiens
gcaatctggctcctcctggaa

SEQ ID NO: 6230139 - DNA, 23 bp, Homo sapiens
gcaatctggggatactggcaaag

SEQ ID NO: 6230140 - DNA, 15 bp, Homo sapiens
gcaatctgtccagac

SEQ ID NO: 6230141 - DNA, 14 bp, Homo sapiens
gcaatcttctactt

SEQ ID NO: 6230142 - DNA, 16 bp, Homo sapiens
gcaatcttgctgtgaa

SEQ ID NO: 6230143 - DNA, 12 bp, Homo sapiens
gcaatctttgaa

SEQ ID NO: 6230144 - DNA, 13 bp, Homo sapiens
gcaatctttgaaa

SEQ ID NO: 6230145 - DNA, 16 bp, Homo sapiens
gcaatctttgaaataa

SEQ ID NO: 6230146 - DNA, 19 bp, Homo sapiens
gcaatgaagtctctgaagt

SEQ ID NO: 6230147 - DNA, 11 bp, Homo sapiens
gcaatgaatta

SEQ ID NO: 6230148 - DNA, 19 bp, Homo sapiens
gcaatgacaggtaaattaa

SEQ ID NO: 6230149 - DNA, 23 bp, Homo sapiens
gcaatgacataaccaatttgtaa

SEQ ID NO: 6230150 - DNA, 15 bp, Homo sapiens
gcaatgacctttcaa

SEQ ID NO: 6230151 - DNA, 23 bp, Homo sapiens
gcaatgacctttcaataggaaaa

SEQ ID NO: 6230152 - DNA, 21 bp, Homo sapiens
gcaatgactcgttacctgccg

SEQ ID NO: 6230153 - DNA, 19 bp, Homo sapiens
gcaatgatcagacttgatt

SEQ ID NO: 6230154 - DNA, 22 bp, Homo sapiens
gcaatgatgacccactaaagag

SEQ ID NO: 6230155 - DNA, 14 bp, Homo sapiens
gcaatgattactct

SEQ ID NO: 6230156 - DNA, 15 bp, Homo sapiens
gcaatgcaagaaaaa

SEQ ID NO: 6230157 - DNA, 15 bp, Homo sapiens
gcaatgccatcatct

SEQ ID NO: 6230158 - DNA, 14 bp, Homo sapiens
gcaatgccccaaac

SEQ ID NO: 6230159 - DNA, 14 bp, Homo sapiens
gcaatgccccctcc

SEQ ID NO: 6230160 - DNA, 17 bp, Homo sapiens
gcaatgccccctcccct

SEQ ID NO: 6230161 - DNA, 18 bp, Homo sapiens
gcaatgccccctcccctc

SEQ ID NO: 6230162 - DNA, 20 bp, Homo sapiens
gcaatgccctacctgcctgt

SEQ ID NO: 6230163 - DNA, 13 bp, Homo sapiens
gcaatgccctgcc

SEQ ID NO: 6230164 - DNA, 22 bp, Homo sapiens
gcaatgccctgccttgctgcct

SEQ ID NO: 6230165 - DNA, 23 bp, Homo sapiens
gcaatgccctgccttgctgcctt

SEQ ID NO: 6230166 - DNA, 18 bp, Homo sapiens
gcaatgcgtcttgtgaaa

SEQ ID NO: 6230167 - DNA, 18 bp, Homo sapiens
gcaatgcgtgttgtacat

SEQ ID NO: 6230168 - DNA, 22 bp, Homo sapiens
gcaatgctggctgttggctggg

SEQ ID NO: 6230169 - DNA, 14 bp, Homo sapiens
gcaatgctgtactt

SEQ ID NO: 6230170 - DNA, 20 bp, Homo sapiens
gcaatggatcagccaaggcc

SEQ ID NO: 6230171 - DNA, 16 bp, Homo sapiens
gcaatggccagagcct

SEQ ID NO: 6230172 - DNA, 19 bp, Homo sapiens
gcaatggccagagcctctg

SEQ ID NO: 6230173 - DNA, 18 bp, Homo sapiens
gcaatggccaggggccag

SEQ ID NO: 6230174 - DNA, 20 bp, Homo sapiens
gcaatggccaggggccagga

SEQ ID NO: 6230175 - DNA, 23 bp, Homo sapiens
gcaatgggagggggctccatgga

SEQ ID NO: 6230176 - DNA, 23 bp, Homo sapiens
gcaatgggcagctatccagtgac

SEQ ID NO: 6230177 - DNA, 14 bp, Homo sapiens
gcaatggggagagg

SEQ ID NO: 6230178 - DNA, 17 bp, Homo sapiens
gcaatggggagaggcaa

SEQ ID NO: 6230179 - DNA, 15 bp, Homo sapiens
gcaatgggtaaggga

SEQ ID NO: 6230180 - DNA, 21 bp, Homo sapiens
gcaatgggtaagggagggaag

SEQ ID NO: 6230181 - DNA, 17 bp, Homo sapiens
gcaatgggtactccagc

SEQ ID NO: 6230182 - DNA, 16 bp, Homo sapiens
gcaatgggtcactcat

SEQ ID NO: 6230183 - DNA, 22 bp, Homo sapiens
gcaatggtgtcagtatccaggc

SEQ ID NO: 6230184 - DNA, 23 bp, Homo sapiens
gcaatggtgtcagtatccaggct

SEQ ID NO: 6230185 - DNA, 20 bp, Homo sapiens
gcaatggtgttgccctgagt

SEQ ID NO: 6230186 - DNA, 13 bp, Homo sapiens
gcaatgtaaatat

SEQ ID NO: 6230187 - DNA, 19 bp, Homo sapiens
gcaatgtaaatattttaaa

SEQ ID NO: 6230188 - DNA, 14 bp, Homo sapiens
gcaatgtatagtgt

SEQ ID NO: 6230189 - DNA, 14 bp, Homo sapiens
gcaatgtcctgcat

SEQ ID NO: 6230190 - DNA, 19 bp, Homo sapiens
gcaatgtctgagtgaacct

SEQ ID NO: 6230191 - DNA, 17 bp, Homo sapiens
gcaatgtcttaaataaa

SEQ ID NO: 6230192 - DNA, 17 bp, Homo sapiens
gcaatgtgaaaaatctg

SEQ ID NO: 6230193 - DNA, 14 bp, Homo sapiens
gcaatgtgctactg

SEQ ID NO: 6230194 - DNA, 15 bp, Homo sapiens
gcaatgtgggcagag

SEQ ID NO: 6230195 - DNA, 22 bp, Homo sapiens
gcaatgtggtgacacctccccc

SEQ ID NO: 6230196 - DNA, 17 bp, Homo sapiens
gcaatgtgtataaacaa

SEQ ID NO: 6230197 - DNA, 23 bp, Homo sapiens
gcaatgtgtataaacaagaaaaa

SEQ ID NO: 6230198 - DNA, 18 bp, Homo sapiens
gcaatgtgtgtatatgga

SEQ ID NO: 6230199 - DNA, 23 bp, Homo sapiens
gcaatgttccgttcatctgagga

SEQ ID NO: 6230200 - DNA, 20 bp, Homo sapiens
gcaatgttggttttttataa

SEQ ID NO: 6230201 - DNA, 14 bp, Homo sapiens
gcaatgttttcctt

SEQ ID NO: 6230202 - DNA, 15 bp, Homo sapiens
gcaatgttttgcttt

SEQ ID NO: 6230203 - DNA, 23 bp, Homo sapiens
gcaatgtttttctcaaaaagctg

SEQ ID NO: 6230204 - DNA, 21 bp, Homo sapiens
gcaattaaacttccaaagaaa

SEQ ID NO: 6230205 - DNA, 21 bp, Homo sapiens
gcaattaaagtgatactgaaa

SEQ ID NO: 6230206 - DNA, 20 bp, Homo sapiens
gcaattacaacggagtcaaa

SEQ ID NO: 6230207 - DNA, 17 bp, Homo sapiens
gcaattagcagaagtga

SEQ ID NO: 6230208 - DNA, 18 bp, Homo sapiens
gcaattagtctgaaactg

SEQ ID NO: 6230209 - DNA, 22 bp, Homo sapiens
gcaattagtctgaaactggctt

SEQ ID NO: 6230210 - DNA, 16 bp, Homo sapiens
gcaattatattgtcct

SEQ ID NO: 6230211 - DNA, 17 bp, Homo sapiens
gcaattatttaaagaaa

SEQ ID NO: 6230212 - DNA, 11 bp, Homo sapiens
gcaattcaact

SEQ ID NO: 6230213 - DNA, 13 bp, Homo sapiens
gcaattcaatgca

SEQ ID NO: 6230214 - DNA, 21 bp, Homo sapiens
gcaattcaatgcaatgaaaac

SEQ ID NO: 6230215 - DNA, 21 bp, Homo sapiens
gcaattcagtcctgggcaaag

SEQ ID NO: 6230216 - DNA, 16 bp, Homo sapiens
gcaattcatgtaacag

SEQ ID NO: 6230217 - DNA, 11 bp, Homo sapiens
gcaattccaat

SEQ ID NO: 6230218 - DNA, 16 bp, Homo sapiens
gcaattccaggctgag

SEQ ID NO: 6230219 - DNA, 19 bp, Homo sapiens
gcaattccaggctgagcca

SEQ ID NO: 6230220 - DNA, 18 bp, Homo sapiens
gcaattcccctctgctgc

SEQ ID NO: 6230221 - DNA, 21 bp, Homo sapiens
gcaattcccctctgctgctgt

SEQ ID NO: 6230222 - DNA, 17 bp, Homo sapiens
gcaattccgcatttaat

SEQ ID NO: 6230223 - DNA, 20 bp, Homo sapiens
gcaattctaagtgagatgtt

SEQ ID NO: 6230224 - DNA, 14 bp, Homo sapiens
gcaattctcctgcc

SEQ ID NO: 6230225 - DNA, 15 bp, Homo sapiens
gcaattctcctgcct

SEQ ID NO: 6230226 - DNA, 18 bp, Homo sapiens
gcaattctcctgcctcag

SEQ ID NO: 6230227 - DNA, 23 bp, Homo sapiens
gcaattctcctgcctcagcctcc

SEQ ID NO: 6230228 - DNA, 18 bp, Homo sapiens
gcaattctctttctttta

SEQ ID NO: 6230229 - DNA, 19 bp, Homo sapiens
gcaattctctttcttttac

SEQ ID NO: 6230230 - DNA, 15 bp, Homo sapiens
gcaattctgactgtc

SEQ ID NO: 6230231 - DNA, 16 bp, Homo sapiens
gcaattctggaagctg

SEQ ID NO: 6230232 - DNA, 18 bp, Homo sapiens
gcaattgcacaaatacaa

SEQ ID NO: 6230233 - DNA, 21 bp, Homo sapiens
gcaattgcttctctaaaacag

SEQ ID NO: 6230234 - DNA, 18 bp, Homo sapiens
gcaattggaacaaagtga

SEQ ID NO: 6230235 - DNA, 23 bp, Homo sapiens
gcaattggcaccgaagcccagag

SEQ ID NO: 6230236 - DNA, 20 bp, Homo sapiens
gcaattggggaagaaaaaat

SEQ ID NO: 6230237 - DNA, 23 bp, Homo sapiens
gcaattgtaaacagaaattgcaa

SEQ ID NO: 6230238 - DNA, 18 bp, Homo sapiens
gcaattgtatatatatgt

SEQ ID NO: 6230239 - DNA, 13 bp, Homo sapiens
gcaattgtctatt

SEQ ID NO: 6230240 - DNA, 23 bp, Homo sapiens
gcaattgttacaagtgttcttag

SEQ ID NO: 6230241 - DNA, 19 bp, Homo sapiens
gcaattgtttaagaatcat

SEQ ID NO: 6230242 - DNA, 21 bp, Homo sapiens
gcaattgtttaagaatcatgg

SEQ ID NO: 6230243 - DNA, 18 bp, Homo sapiens
gcaatttaaatgttatga

SEQ ID NO: 6230244 - DNA, 14 bp, Homo sapiens
gcaatttacctggt

SEQ ID NO: 6230245 - DNA, 17 bp, Homo sapiens
gcaatttattaaaatga

SEQ ID NO: 6230246 - DNA, 14 bp, Homo sapiens
gcaatttcatatgc

SEQ ID NO: 6230247 - DNA, 17 bp, Homo sapiens
gcaatttctaattttta

SEQ ID NO: 6230248 - DNA, 13 bp, Homo sapiens
gcaatttgaaggt

SEQ ID NO: 6230249 - DNA, 13 bp, Homo sapiens
gcaatttgagcca

SEQ ID NO: 6230250 - DNA, 20 bp, Homo sapiens
gcaatttgagccatttaaag

SEQ ID NO: 6230251 - DNA, 14 bp, Homo sapiens
gcaatttgtaaata

SEQ ID NO: 6230252 - DNA, 12 bp, Homo sapiens
gcaatttgtctt

SEQ ID NO: 6230253 - DNA, 20 bp, Homo sapiens
gcaatttgtttgtgcttcta

SEQ ID NO: 6230254 - DNA, 23 bp, Homo sapiens
gcaattttaacacacataaagga

SEQ ID NO: 6230255 - DNA, 18 bp, Homo sapiens
gcaattttaatcccctgc

SEQ ID NO: 6230256 - DNA, 20 bp, Homo sapiens
gcaattttaatcccctgcac

SEQ ID NO: 6230257 - DNA, 16 bp, Homo sapiens
gcaattttactgtgaa

SEQ ID NO: 6230258 - DNA, 13 bp, Homo sapiens
gcaattttagtgt

SEQ ID NO: 6230259 - DNA, 23 bp, Homo sapiens
gcaattttataaggacttcctga

SEQ ID NO: 6230260 - DNA, 13 bp, Homo sapiens
gcaattttctttg

SEQ ID NO: 6230261 - DNA, 14 bp, Homo sapiens
gcaattttgtaacg

SEQ ID NO: 6230262 - DNA, 14 bp, Homo sapiens
gcaattttgtggtt

SEQ ID NO: 6230263 - DNA, 16 bp, Homo sapiens
gcaatttttaaactag

SEQ ID NO: 6230264 - DNA, 17 bp, Homo sapiens
gcaatttttttatacta

SEQ ID NO: 6230265 - DNA, 13 bp, Homo sapiens
gcacaaaaaatga

SEQ ID NO: 6230266 - DNA, 14 bp, Homo sapiens
gcacaaaaaatgag

SEQ ID NO: 6230267 - DNA, 15 bp, Homo sapiens
gcacaaaaaatttaa

SEQ ID NO: 6230268 - DNA, 23 bp, Homo sapiens
gcacaaaacccagacctgttagc

SEQ ID NO: 6230269 - DNA, 21 bp, Homo sapiens
gcacaaaactacttttctaaa

SEQ ID NO: 6230270 - DNA, 14 bp, Homo sapiens
gcacaaaagcagat

SEQ ID NO: 6230271 - DNA, 23 bp, Homo sapiens
gcacaaaatgaatgaggtctggg

SEQ ID NO: 6230272 - DNA, 14 bp, Homo sapiens
gcacaaacagaatt

SEQ ID NO: 6230273 - DNA, 16 bp, Homo sapiens
gcacaaacagaggccg

SEQ ID NO: 6230274 - DNA, 14 bp, Homo sapiens
gcacaaacatagac

SEQ ID NO: 6230275 - DNA, 15 bp, Homo sapiens
gcacaaacattgctg

SEQ ID NO: 6230276 - DNA, 17 bp, Homo sapiens
gcacaaacatttttcaa

SEQ ID NO: 6230277 - DNA, 19 bp, Homo sapiens
gcacaaaccctggggactc

SEQ ID NO: 6230278 - DNA, 14 bp, Homo sapiens
gcacaaaccttctt

SEQ ID NO: 6230279 - DNA, 20 bp, Homo sapiens
gcacaaaccttcttttcaat

SEQ ID NO: 6230280 - DNA, 15 bp, Homo sapiens
gcacaaactgcagct

SEQ ID NO: 6230281 - DNA, 19 bp, Homo sapiens
gcacaaactgcagctgtga

SEQ ID NO: 6230282 - DNA, 16 bp, Homo sapiens
gcacaaactgtcgtct

SEQ ID NO: 6230283 - DNA, 22 bp, Homo sapiens
gcacaaacttgtgagcatcaga

SEQ ID NO: 6230284 - DNA, 18 bp, Homo sapiens
gcacaaagaagaaagctg

SEQ ID NO: 6230285 - DNA, 23 bp, Homo sapiens
gcacaaagataacgcaggagaga

SEQ ID NO: 6230286 - DNA, 17 bp, Homo sapiens
gcacaaagcactggcct

SEQ ID NO: 6230287 - DNA, 18 bp, Homo sapiens
gcacaaagcactggcctt

SEQ ID NO: 6230288 - DNA, 14 bp, Homo sapiens
gcacaaagtggcat

SEQ ID NO: 6230289 - DNA, 18 bp, Homo sapiens
gcacaaagttctcagagc

SEQ ID NO: 6230290 - DNA, 23 bp, Homo sapiens
gcacaaattctgtctctggatta

SEQ ID NO: 6230291 - DNA, 17 bp, Homo sapiens
gcacaaccatgttcttg

SEQ ID NO: 6230292 - DNA, 16 bp, Homo sapiens
gcacaaccggtccctt

SEQ ID NO: 6230293 - DNA, 17 bp, Homo sapiens
gcacaacctgcatcttt

SEQ ID NO: 6230294 - DNA, 22 bp, Homo sapiens
gcacaacgctctaccctgcagc

SEQ ID NO: 6230295 - DNA, 23 bp, Homo sapiens
gcacaacgctctaccctgcagct

SEQ ID NO: 6230296 - DNA, 15 bp, Homo sapiens
gcacaactgctgttt

SEQ ID NO: 6230297 - DNA, 15 bp, Homo sapiens
gacagctgtgcctcg

SEQ ID NO: 6230298 - DNA, 21 bp, Homo sapiens
gacagcttacctagtcttgta

SEQ ID NO: 6230299 - DNA, 17 bp, Homo sapiens
gacagcttagaattatt

SEQ ID NO: 6230300 - DNA, 13 bp, Homo sapiens
gacagcttagtga

SEQ ID NO: 6230301 - DNA, 13 bp, Homo sapiens
gacagcttcctca

SEQ ID NO: 6230302 - DNA, 15 bp, Homo sapiens
gacagcttgagccgg

SEQ ID NO: 6230303 - DNA, 13 bp, Homo sapiens
gacagctttcctg

SEQ ID NO: 6230304 - DNA, 22 bp, Homo sapiens
gacagctttctaactcacaggc

SEQ ID NO: 6230305 - DNA, 14 bp, Homo sapiens
gacagctttctggg

SEQ ID NO: 6230306 - DNA, 15 bp, Homo sapiens
gacagctttgctgct

SEQ ID NO: 6230307 - DNA, 20 bp, Homo sapiens
gacaggaaagccctccccct

SEQ ID NO: 6230308 - DNA, 19 bp, Homo sapiens
gacaggaacacccagcccc

SEQ ID NO: 6230309 - DNA, 23 bp, Homo sapiens
gacaggaacccatcactgtgtct

SEQ ID NO: 6230310 - DNA, 13 bp, Homo sapiens
gacaggaacggct

SEQ ID NO: 6230311 - DNA, 17 bp, Homo sapiens
gacaggaagactggaga

SEQ ID NO: 6230312 - DNA, 19 bp, Homo sapiens
gacaggaagcacagcaggt

SEQ ID NO: 6230313 - DNA, 14 bp, Homo sapiens
gacaggaaggtctg

SEQ ID NO: 6230314 - DNA, 21 bp, Homo sapiens
gacaggaaggtctgatttgca

SEQ ID NO: 6230315 - DNA, 22 bp, Homo sapiens
gacaggaaggtctgatttgcag

SEQ ID NO: 6230316 - DNA, 23 bp, Homo sapiens
gacaggaaggtctgatttgcagg

SEQ ID NO: 6230317 - DNA, 16 bp, Homo sapiens
gacaggacagaatgtg

SEQ ID NO: 6230318 - DNA, 14 bp, Homo sapiens
gacaggaccaggga

SEQ ID NO: 6230319 - DNA, 18 bp, Homo sapiens
gacaggaccccagctctg

SEQ ID NO: 6230320 - DNA, 17 bp, Homo sapiens
gacaggacccctgcagt

SEQ ID NO: 6230321 - DNA, 12 bp, Homo sapiens
gacaggaccctc

SEQ ID NO: 6230322 - DNA, 15 bp, Homo sapiens
gacaggaccctcagg

SEQ ID NO: 6230323 - DNA, 18 bp, Homo sapiens
gacaggaccctcaggaat

SEQ ID NO: 6230324 - DNA, 13 bp, Homo sapiens
gacaggacgctga

SEQ ID NO: 6230325 - DNA, 21 bp, Homo sapiens
gacaggacgctgaccgtggag

SEQ ID NO: 6230326 - DNA, 22 bp, Homo sapiens
gacaggactaacactcagaagc

SEQ ID NO: 6230327 - DNA, 23 bp, Homo sapiens
gacaggactaacactcagaagcc

SEQ ID NO: 6230328 - DNA, 14 bp, Homo sapiens
gacaggactgcaga

SEQ ID NO: 6230329 - DNA, 11 bp, Homo sapiens
gacaggagaaa

SEQ ID NO: 6230330 - DNA, 23 bp, Homo sapiens
gacaggagaaaaattattcccat

SEQ ID NO: 6230331 - DNA, 20 bp, Homo sapiens
gacaggagaaacacttgaac

SEQ ID NO: 6230332 - DNA, 12 bp, Homo sapiens
gacaggagaaat

SEQ ID NO: 6230333 - DNA, 24 bp, Homo sapiens
gacaggagaaatgcatccattcct

SEQ ID NO: 6230334 - DNA, 14 bp, Homo sapiens
gacaggagaagaga

SEQ ID NO: 6230335 - DNA, 21 bp, Homo sapiens
gacaggagacctggcactgga

SEQ ID NO: 6230336 - DNA, 22 bp, Homo sapiens
gacaggagagattatttacaag

SEQ ID NO: 6230337 - DNA, 19 bp, Homo sapiens
gacaggagatgctgtgccc

SEQ ID NO: 6230338 - DNA, 22 bp, Homo sapiens
gacaggagatgctgtgcccctg

SEQ ID NO: 6230339 - DNA, 11 bp, Homo sapiens
gacaggagcct

SEQ ID NO: 6230340 - DNA, 19 bp, Homo sapiens
gacaggagcctagcggagc

SEQ ID NO: 6230341 - DNA, 16 bp, Homo sapiens
gacaggagcctggtcc

SEQ ID NO: 6230342 - DNA, 14 bp, Homo sapiens
gacaggaggaggag

SEQ ID NO: 6230343 - DNA, 15 bp, Homo sapiens
gacaggaggcggccc

SEQ ID NO: 6230344 - DNA, 23 bp, Homo sapiens
gacaggaggcggcccggccagcg

SEQ ID NO: 6230345 - DNA, 17 bp, Homo sapiens
gacaggagggcaagggc

SEQ ID NO: 6230346 - DNA, 19 bp, Homo sapiens
gacaggaggggcccacaat

SEQ ID NO: 6230347 - DNA, 21 bp, Homo sapiens
gacaggaggggcccacaatgg

SEQ ID NO: 6230348 - DNA, 22 bp, Homo sapiens
gacaggaggtatgacctgggtg

SEQ ID NO: 6230349 - DNA, 20 bp, Homo sapiens
gacaggagtcagtgtctggc

SEQ ID NO: 6230350 - DNA, 18 bp, Homo sapiens
gacaggataataaaacat

SEQ ID NO: 6230351 - DNA, 13 bp, Homo sapiens
gacaggatgtggc

SEQ ID NO: 6230352 - DNA, 16 bp, Homo sapiens
gacaggatgtggcact

SEQ ID NO: 6230353 - DNA, 21 bp, Homo sapiens
gacaggatgtggcactgcttg

SEQ ID NO: 6230354 - DNA, 17 bp, Homo sapiens
gacaggatttggccaca

SEQ ID NO: 6230355 - DNA, 16 bp, Homo sapiens
gacaggcaaataaaag

SEQ ID NO: 6230356 - DNA, 13 bp, Homo sapiens
gacaggcaagcac

SEQ ID NO: 6230357 - DNA, 18 bp, Homo sapiens
gacaggcaagcacctcct

SEQ ID NO: 6230358 - DNA, 20 bp, Homo sapiens
gacaggcaagcacctcctgc

SEQ ID NO: 6230359 - DNA, 21 bp, Homo sapiens
gacaggcaagcacctcctgcc

SEQ ID NO: 6230360 - DNA, 13 bp, Homo sapiens
gacaggcacaaaa

SEQ ID NO: 6230361 - DNA, 15 bp, Homo sapiens
gacaggcaccatgct

SEQ ID NO: 6230362 - DNA, 10 bp, Homo sapiens
gacaggcagc

SEQ ID NO: 6230363 - DNA, 13 bp, Homo sapiens
gacaggcagcaga

SEQ ID NO: 6230364 - DNA, 15 bp, Homo sapiens
gacaggcagcccagc

SEQ ID NO: 6230365 - DNA, 16 bp, Homo sapiens
gacaggcagcccagca

SEQ ID NO: 6230366 - DNA, 18 bp, Homo sapiens
gacaggcagcccagcagt

SEQ ID NO: 6230367 - DNA, 17 bp, Homo sapiens
gacaggcagcctccttt

SEQ ID NO: 6230368 - DNA, 15 bp, Homo sapiens
gacaggcagcctgga

SEQ ID NO: 6230369 - DNA, 19 bp, Homo sapiens
gacaggccatgtgagccac

SEQ ID NO: 6230370 - DNA, 20 bp, Homo sapiens
gacaggcccagcgcggccag

SEQ ID NO: 6230371 - DNA, 22 bp, Homo sapiens
gacaggcccagcgcggccagcg

SEQ ID NO: 6230372 - DNA, 19 bp, Homo sapiens
gacaggccctccctgtctc

SEQ ID NO: 6230373 - DNA, 20 bp, Homo sapiens
gacaggccctccctgtctcc

SEQ ID NO: 6230374 - DNA, 15 bp, Homo sapiens
gacaggcctgaagat

SEQ ID NO: 6230375 - DNA, 19 bp, Homo sapiens
gacaggcctgaagatatta

SEQ ID NO: 6230376 - DNA, 22 bp, Homo sapiens
gacaggccttcctcctctcaaa

SEQ ID NO: 6230377 - DNA, 22 bp, Homo sapiens
gacaggcctttccctgccggcc

SEQ ID NO: 6230378 - DNA, 21 bp, Homo sapiens
gacaggcgagagaggagccag

SEQ ID NO: 6230379 - DNA, 24 bp, Homo sapiens
gacaggcgagagaggagccagaca

SEQ ID NO: 6230380 - DNA, 15 bp, Homo sapiens
gacaggcgcctgcca

SEQ ID NO: 6230381 - DNA, 19 bp, Homo sapiens
gacaggcgctggacagagg

SEQ ID NO: 6230382 - DNA, 20 bp, Homo sapiens
gacaggcgggctcggaggct

SEQ ID NO: 6230383 - DNA, 21 bp, Homo sapiens
gacaggcggggcccagcgctc

SEQ ID NO: 6230384 - DNA, 18 bp, Homo sapiens
gacaggctctagagagag

SEQ ID NO: 6230385 - DNA, 23 bp, Homo sapiens
gacaggctctcctggctgtccta

SEQ ID NO: 6230386 - DNA, 18 bp, Homo sapiens
gacaggctcttagcagct

SEQ ID NO: 6230387 - DNA, 16 bp, Homo sapiens
gacaggctcttctttc

SEQ ID NO: 6230388 - DNA, 18 bp, Homo sapiens
gacaggctcttctttccc

SEQ ID NO: 6230389 - DNA, 23 bp, Homo sapiens
gacaggctgaagagagggacagg

SEQ ID NO: 6230390 - DNA, 21 bp, Homo sapiens
gacaggctggaagatagctgt

SEQ ID NO: 6230391 - DNA, 21 bp, Homo sapiens
gacaggctggaatgagggagg

SEQ ID NO: 6230392 - DNA, 18 bp, Homo sapiens
gacaggctggcattctag

SEQ ID NO: 6230393 - DNA, 14 bp, Homo sapiens
gacaggctggctcc

SEQ ID NO: 6230394 - DNA, 21 bp, Homo sapiens
gacaggctggctccagatgca

SEQ ID NO: 6230395 - DNA, 13 bp, Homo sapiens
gacaggctgggtc

SEQ ID NO: 6230396 - DNA, 15 bp, Homo sapiens
gacaggctgggtcct

SEQ ID NO: 6230397 - DNA, 19 bp, Homo sapiens
gacaggctgggtcctgcca

SEQ ID NO: 6230398 - DNA, 23 bp, Homo sapiens
gacaggctgggtcctgccagctg

SEQ ID NO: 6230399 - DNA, 19 bp, Homo sapiens
gacaggctgtgactcttct

SEQ ID NO: 6230400 - DNA, 22 bp, Homo sapiens
gacaggcttcgtctcagaaggc

SEQ ID NO: 6230401 - DNA, 23 bp, Homo sapiens
gacaggcttcgtctcagaaggct

SEQ ID NO: 6230402 - DNA, 13 bp, Homo sapiens
gacagggacccac

SEQ ID NO: 6230403 - DNA, 14 bp, Homo sapiens
gacagggagaagtt

SEQ ID NO: 6230404 - DNA, 17 bp, Homo sapiens
gacagggaggacgctct

SEQ ID NO: 6230405 - DNA, 14 bp, Homo sapiens
gacagggaggccac

SEQ ID NO: 6230406 - DNA, 15 bp, Homo sapiens
gacagggagggccgg

SEQ ID NO: 6230407 - DNA, 19 bp, Homo sapiens
gacagggagggggacctgt

SEQ ID NO: 6230408 - DNA, 23 bp, Homo sapiens
gacagggatgagcatggagctgg

SEQ ID NO: 6230409 - DNA, 18 bp, Homo sapiens
gacagggcaatcttgtcc

SEQ ID NO: 6230410 - DNA, 23 bp, Homo sapiens
gacagggcacaccgggcactcag

SEQ ID NO: 6230411 - DNA, 12 bp, Homo sapiens
gacagggcaggc

SEQ ID NO: 6230412 - DNA, 16 bp, Homo sapiens
gacagggcaggcgggc

SEQ ID NO: 6230413 - DNA, 14 bp, Homo sapiens
gacagggcatggcc

SEQ ID NO: 6230414 - DNA, 20 bp, Homo sapiens
gacagggcatggccaggtgg

SEQ ID NO: 6230415 - DNA, 22 bp, Homo sapiens
gacagggcatggccaggtggcc

SEQ ID NO: 6230416 - DNA, 10 bp, Homo sapiens
gacagggcca

SEQ ID NO: 6230417 - DNA, 16 bp, Homo sapiens
gacagggccagggttg

SEQ ID NO: 6230418 - DNA, 18 bp, Homo sapiens
gacagggccagtgcagtt

SEQ ID NO: 6230419 - DNA, 14 bp, Homo sapiens
gacagggccagtgg

SEQ ID NO: 6230420 - DNA, 21 bp, Homo sapiens
gacagggcccgggcccaggca

SEQ ID NO: 6230421 - DNA, 16 bp, Homo sapiens
gacagggccctggagc

SEQ ID NO: 6230422 - DNA, 15 bp, Homo sapiens
gacagggcctggagc

SEQ ID NO: 6230423 - DNA, 16 bp, Homo sapiens
gacagggcctggagcc

SEQ ID NO: 6230424 - DNA, 17 bp, Homo sapiens
gacagggcgggggtggc

SEQ ID NO: 6230425 - DNA, 18 bp, Homo sapiens
gacagggcgggggtggcg

SEQ ID NO: 6230426 - DNA, 13 bp, Homo sapiens
gacagggctccag

SEQ ID NO: 6230427 - DNA, 14 bp, Homo sapiens
gacagggctccagc

SEQ ID NO: 6230428 - DNA, 15 bp, Homo sapiens
gacagggctgctccc

SEQ ID NO: 6230429 - DNA, 20 bp, Homo sapiens
gacagggctggcccagccct

SEQ ID NO: 6230430 - DNA, 21 bp, Homo sapiens
gacagggctggcccagccctg

SEQ ID NO: 6230431 - DNA, 13 bp, Homo sapiens
gacagggctggct

SEQ ID NO: 6230432 - DNA, 12 bp, Homo sapiens
gacagggcttct

SEQ ID NO: 6230433 - DNA, 16 bp, Homo sapiens
gacagggcttctcctg

SEQ ID NO: 6230434 - DNA, 17 bp, Homo sapiens
gacagggcttggggagc

SEQ ID NO: 6230435 - DNA, 20 bp, Homo sapiens
gacaggggcaggaggaaggg

SEQ ID NO: 6230436 - DNA, 13 bp, Homo sapiens
gacaggggctcag

SEQ ID NO: 6230437 - DNA, 20 bp, Homo sapiens
gacagggggtgggaagggga

SEQ ID NO: 6230438 - DNA, 14 bp, Homo sapiens
gacaggggttcctt

SEQ ID NO: 6230439 - DNA, 20 bp, Homo sapiens
gacaggggttccttctgggc

SEQ ID NO: 6230440 - DNA, 14 bp, Homo sapiens
gacagggtcctgct

SEQ ID NO: 6230441 - DNA, 17 bp, Homo sapiens
gacagggtctcactatg

SEQ ID NO: 6230442 - DNA, 17 bp, Homo sapiens
gacagggtctcactgtg

SEQ ID NO: 6230443 - DNA, 19 bp, Homo sapiens
gacagggtctccctatgtt

SEQ ID NO: 6230444 - DNA, 21 bp, Homo sapiens
gacagggtcttttttcatttc

SEQ ID NO: 6230445 - DNA, 21 bp, Homo sapiens
gacagggtgaataaagcaggg

SEQ ID NO: 6230446 - DNA, 20 bp, Homo sapiens
gacagggtgctgatgggaag

SEQ ID NO: 6230447 - DNA, 17 bp, Homo sapiens
gacagggtgggagggag

SEQ ID NO: 6230448 - DNA, 23 bp, Homo sapiens
gacagggtgggagggaggaggga

SEQ ID NO: 6230449 - DNA, 17 bp, Homo sapiens
gacagggtgggcttcct

SEQ ID NO: 6230450 - DNA, 20 bp, Homo sapiens
gacagggtgggcttcctgcc

SEQ ID NO: 6230451 - DNA, 22 bp, Homo sapiens
gacagggtgggcttcctgccct

SEQ ID NO: 6230452 - DNA, 12 bp, Homo sapiens
gacagggtgggg

SEQ ID NO: 6230453 - DNA, 23 bp, Homo sapiens
gacagggtggggcttagaatggg

SEQ ID NO: 6230454 - DNA, 12 bp, Homo sapiens
gacagggtttca

SEQ ID NO: 6230455 - DNA, 17 bp, Homo sapiens
gacagggtttcaccatg

SEQ ID NO: 6230456 - DNA, 20 bp, Homo sapiens
gacagggtttggctgtgtct

SEQ ID NO: 6230457 - DNA, 22 bp, Homo sapiens
gacagggttttgccatgttggc

SEQ ID NO: 6230458 - DNA, 23 bp, Homo sapiens
gacagggttttttcatttttgtg

SEQ ID NO: 6230459 - DNA, 21 bp, Homo sapiens
gacaggtacttggagggctca

SEQ ID NO: 6230460 - DNA, 16 bp, Homo sapiens
gacaggtccctcccct

SEQ ID NO: 6230461 - DNA, 15 bp, Homo sapiens
gacaggtctagactt

SEQ ID NO: 6230462 - DNA, 20 bp, Homo sapiens
gacaggtctagactttctca

SEQ ID NO: 6230463 - DNA, 15 bp, Homo sapiens
gacaggtctctgaga

SEQ ID NO: 6230464 - DNA, 19 bp, Homo sapiens
gacaggtctctgagacagg

SEQ ID NO: 6230465 - DNA, 14 bp, Homo sapiens
gacaggtctgggag

SEQ ID NO: 6230466 - DNA, 13 bp, Homo sapiens
gacaggtgacagt

SEQ ID NO: 6230467 - DNA, 22 bp, Homo sapiens
gacaggtgacagtggctgctct

SEQ ID NO: 6230468 - DNA, 17 bp, Homo sapiens
gacaggtgatgctctgg

SEQ ID NO: 6230469 - DNA, 20 bp, Homo sapiens
gacaggtgcctaacctggga

SEQ ID NO: 6230470 - DNA, 16 bp, Homo sapiens
gacaggtgggagatgg

SEQ ID NO: 6230471 - DNA, 17 bp, Homo sapiens
gacaggtggggcctcag

SEQ ID NO: 6230472 - DNA, 21 bp, Homo sapiens
gacaggtggggcctcagcctg

SEQ ID NO: 6230473 - DNA, 16 bp, Homo sapiens
gacaggttaaatatat

SEQ ID NO: 6230474 - DNA, 17 bp, Homo sapiens
gcacaactgttgatggt

SEQ ID NO: 6230475 - DNA, 19 bp, Homo sapiens
gcacaactttaagaggaca

SEQ ID NO: 6230476 - DNA, 24 bp, Homo sapiens
gcacaagaagcgtgagacgccacc

SEQ ID NO: 6230477 - DNA, 13 bp, Homo sapiens
gcacaagaaggcc

SEQ ID NO: 6230478 - DNA, 17 bp, Homo sapiens
gcacaagaaggccagcc

SEQ ID NO: 6230479 - DNA, 20 bp, Homo sapiens
gcacaagaaggccagcccac

SEQ ID NO: 6230480 - DNA, 18 bp, Homo sapiens
gcacaagacccctgctcc

SEQ ID NO: 6230481 - DNA, 19 bp, Homo sapiens
gcacaagactgacgccagg

SEQ ID NO: 6230482 - DNA, 20 bp, Homo sapiens
gcacaagactgacgccaggg

SEQ ID NO: 6230483 - DNA, 19 bp, Homo sapiens
gcacaagactggcccagtg

SEQ ID NO: 6230484 - DNA, 20 bp, Homo sapiens
gcacaagactggcccagtgc

SEQ ID NO: 6230485 - DNA, 19 bp, Homo sapiens
gcacaagaggaagagagag

SEQ ID NO: 6230486 - DNA, 20 bp, Homo sapiens
gcacaagatgccccagggat

SEQ ID NO: 6230487 - DNA, 22 bp, Homo sapiens
gcacaagatgccccagggatgg

SEQ ID NO: 6230488 - DNA, 13 bp, Homo sapiens
gcacaagcagggc

SEQ ID NO: 6230489 - DNA, 22 bp, Homo sapiens
gcacaagccacaagtcttccag

SEQ ID NO: 6230490 - DNA, 12 bp, Homo sapiens
gcacaagccagg

SEQ ID NO: 6230491 - DNA, 17 bp, Homo sapiens
gcacaagccagggtgtg

SEQ ID NO: 6230492 - DNA, 12 bp, Homo sapiens
gcacaagctcag

SEQ ID NO: 6230493 - DNA, 13 bp, Homo sapiens
gcacaagctcaga

SEQ ID NO: 6230494 - DNA, 15 bp, Homo sapiens
gcacaagctccaagc

SEQ ID NO: 6230495 - DNA, 17 bp, Homo sapiens
gcacaagctccaagctc

SEQ ID NO: 6230496 - DNA, 14 bp, Homo sapiens
gcacaagctgcacc

SEQ ID NO: 6230497 - DNA, 22 bp, Homo sapiens
gcacaagctgcaccctcaggca

SEQ ID NO: 6230498 - DNA, 20 bp, Homo sapiens
gcacaagcttgtatatacat

SEQ ID NO: 6230499 - DNA, 22 bp, Homo sapiens
gcacaagcttgtatatacatat

SEQ ID NO: 6230500 - DNA, 23 bp, Homo sapiens
gcacaaggaaagttattttcaga

SEQ ID NO: 6230501 - DNA, 16 bp, Homo sapiens
gcacaaggaaataaag

SEQ ID NO: 6230502 - DNA, 22 bp, Homo sapiens
gcacaaggacattgtatgcagg

SEQ ID NO: 6230503 - DNA, 13 bp, Homo sapiens
gcacaaggcctta

SEQ ID NO: 6230504 - DNA, 23 bp, Homo sapiens
gcacaaggccttgcctggcctga

SEQ ID NO: 6230505 - DNA, 15 bp, Homo sapiens
gcacaagggcacatt

SEQ ID NO: 6230506 - DNA, 18 bp, Homo sapiens
gcacaaggtggcagcaag

SEQ ID NO: 6230507 - DNA, 14 bp, Homo sapiens
gcacaagttcctgg

SEQ ID NO: 6230508 - DNA, 17 bp, Homo sapiens
gcacaagttcctggttt

SEQ ID NO: 6230509 - DNA, 20 bp, Homo sapiens
gcacaataaaaccaagcctc

SEQ ID NO: 6230510 - DNA, 23 bp, Homo sapiens
gcacaataactagtaataccaaa

SEQ ID NO: 6230511 - DNA, 18 bp, Homo sapiens
gcacaataactcctccca

SEQ ID NO: 6230512 - DNA, 19 bp, Homo sapiens
gcacaataactcctcccag

SEQ ID NO: 6230513 - DNA, 21 bp, Homo sapiens
gcacaataactcctcccaggg

SEQ ID NO: 6230514 - DNA, 22 bp, Homo sapiens
gcacaataactcctcccagggt

SEQ ID NO: 6230515 - DNA, 15 bp, Homo sapiens
gcacaataatttgtt

SEQ ID NO: 6230516 - DNA, 17 bp, Homo sapiens
gcacaatattgaacttt

SEQ ID NO: 6230517 - DNA, 19 bp, Homo sapiens
gcacaatattgaacttttt

SEQ ID NO: 6230518 - DNA, 19 bp, Homo sapiens
gcacaatcactaaacttta

SEQ ID NO: 6230519 - DNA, 22 bp, Homo sapiens
gcacaatcactaaactttattt

SEQ ID NO: 6230520 - DNA, 14 bp, Homo sapiens
gcacaatgaatgta

SEQ ID NO: 6230521 - DNA, 15 bp, Homo sapiens
gcacaatgaatgtat

SEQ ID NO: 6230522 - DNA, 19 bp, Homo sapiens
gcacaatgaccagcaggag

SEQ ID NO: 6230523 - DNA, 20 bp, Homo sapiens
gcacaatggtcttacattgg

SEQ ID NO: 6230524 - DNA, 22 bp, Homo sapiens
gcacaatgttggagcagcaggc

SEQ ID NO: 6230525 - DNA, 23 bp, Homo sapiens
gcacaatgttggagcagcaggcc

SEQ ID NO: 6230526 - DNA, 17 bp, Homo sapiens
gcacaattctgtccctg

SEQ ID NO: 6230527 - DNA, 21 bp, Homo sapiens
gcacaattctgtccctgtccc

SEQ ID NO: 6230528 - DNA, 14 bp, Homo sapiens
gcacaattctgttt

SEQ ID NO: 6230529 - DNA, 16 bp, Homo sapiens
gcacaattctgtttta

SEQ ID NO: 6230530 - DNA, 15 bp, Homo sapiens
gcacaatttaaaaca

SEQ ID NO: 6230531 - DNA, 22 bp, Homo sapiens
gcacaatttaatatattcaaga

SEQ ID NO: 6230532 - DNA, 15 bp, Homo sapiens
gcacaatttagaaaa

SEQ ID NO: 6230533 - DNA, 18 bp, Homo sapiens
gcacaatttgagcaattc

SEQ ID NO: 6230534 - DNA, 12 bp, Homo sapiens
gcacaatttgca

SEQ ID NO: 6230535 - DNA, 20 bp, Homo sapiens
gcacacaacaggctgtgtgt

SEQ ID NO: 6230536 - DNA, 20 bp, Homo sapiens
gcacacaaggggcccttgga

SEQ ID NO: 6230537 - DNA, 14 bp, Homo sapiens
gcacacaatcctat

SEQ ID NO: 6230538 - DNA, 10 bp, Homo sapiens
gcacacacac

SEQ ID NO: 6230539 - DNA, 20 bp, Homo sapiens
gcacacacacacacaggagg

SEQ ID NO: 6230540 - DNA, 22 bp, Homo sapiens
gcacacacacacacatgcacac

SEQ ID NO: 6230541 - DNA, 14 bp, Homo sapiens
gcacacacacacat

SEQ ID NO: 6230542 - DNA, 22 bp, Homo sapiens
gcacacacacaccaatgcgcac

SEQ ID NO: 6230543 - DNA, 15 bp, Homo sapiens
gcacacacacataca

SEQ ID NO: 6230544 - DNA, 19 bp, Homo sapiens
gcacacacacgcaaataca

SEQ ID NO: 6230545 - DNA, 19 bp, Homo sapiens
gcacacacactcttcaagt

SEQ ID NO: 6230546 - DNA, 14 bp, Homo sapiens
gcacacacagctcc

SEQ ID NO: 6230547 - DNA, 15 bp, Homo sapiens
gcacacacagctcct

SEQ ID NO: 6230548 - DNA, 16 bp, Homo sapiens
gcacacacagctcctc

SEQ ID NO: 6230549 - DNA, 20 bp, Homo sapiens
gcacacacatctggccctga

SEQ ID NO: 6230550 - DNA, 13 bp, Homo sapiens
gcacacacatgga

SEQ ID NO: 6230551 - DNA, 12 bp, Homo sapiens
gcacacaccaga

SEQ ID NO: 6230552 - DNA, 15 bp, Homo sapiens
gcacacaccagagcc

SEQ ID NO: 6230553 - DNA, 18 bp, Homo sapiens
gcacacaccagagcccac

SEQ ID NO: 6230554 - DNA, 20 bp, Homo sapiens
gcacacaccagagcccacct

SEQ ID NO: 6230555 - DNA, 12 bp, Homo sapiens
gcacacacccat

SEQ ID NO: 6230556 - DNA, 16 bp, Homo sapiens
gcacacacctcagagg

SEQ ID NO: 6230557 - DNA, 16 bp, Homo sapiens
gcacacacctccgaga

SEQ ID NO: 6230558 - DNA, 20 bp, Homo sapiens
gcacacacctgggtggacac

SEQ ID NO: 6230559 - DNA, 23 bp, Homo sapiens
gcacacacctgggtggacacaag

SEQ ID NO: 6230560 - DNA, 13 bp, Homo sapiens
gcacacacctgta

SEQ ID NO: 6230561 - DNA, 23 bp, Homo sapiens
gcacacacggttttggcagctga

SEQ ID NO: 6230562 - DNA, 13 bp, Homo sapiens
gcacacactgacc

SEQ ID NO: 6230563 - DNA, 20 bp, Homo sapiens
gcacacagacggcctagggg

SEQ ID NO: 6230564 - DNA, 18 bp, Homo sapiens
gcacacagagaagggaag

SEQ ID NO: 6230565 - DNA, 23 bp, Homo sapiens
gcacacagcacgggggccaagga

SEQ ID NO: 6230566 - DNA, 15 bp, Homo sapiens
gcacacagcagcccc

SEQ ID NO: 6230567 - DNA, 17 bp, Homo sapiens
gcacacagcggctgcct

SEQ ID NO: 6230568 - DNA, 13 bp, Homo sapiens
gcacacagctact

SEQ ID NO: 6230569 - DNA, 15 bp, Homo sapiens
gcacacagctgagca

SEQ ID NO: 6230570 - DNA, 16 bp, Homo sapiens
gcacacagctgagcac

SEQ ID NO: 6230571 - DNA, 18 bp, Homo sapiens
gcacacagctgagcactt

SEQ ID NO: 6230572 - DNA, 19 bp, Homo sapiens
gcacacagctgcagagaca

SEQ ID NO: 6230573 - DNA, 12 bp, Homo sapiens
gcacacaggaca

SEQ ID NO: 6230574 - DNA, 17 bp, Homo sapiens
gcacacaggacagcggg

SEQ ID NO: 6230575 - DNA, 15 bp, Homo sapiens
gcacacaggcagcca

SEQ ID NO: 6230576 - DNA, 16 bp, Homo sapiens
gcacacaggcagccag

SEQ ID NO: 6230577 - DNA, 23 bp, Homo sapiens
gcacacagggcccggccacaccc

SEQ ID NO: 6230578 - DNA, 22 bp, Homo sapiens
gcacacagggctcacagggcag

SEQ ID NO: 6230579 - DNA, 21 bp, Homo sapiens
gcacacagggtggtggcacat

SEQ ID NO: 6230580 - DNA, 14 bp, Homo sapiens
gcacacagtcacct

SEQ ID NO: 6230581 - DNA, 13 bp, Homo sapiens
gcacacataacac

SEQ ID NO: 6230582 - DNA, 13 bp, Homo sapiens
gcacacatatata

SEQ ID NO: 6230583 - DNA, 14 bp, Homo sapiens
gcacacatatatag

SEQ ID NO: 6230584 - DNA, 16 bp, Homo sapiens
gcacacatcttacctc

SEQ ID NO: 6230585 - DNA, 18 bp, Homo sapiens
gcacacatcttacctctc

SEQ ID NO: 6230586 - DNA, 16 bp, Homo sapiens
gcacacattggccgct

SEQ ID NO: 6230587 - DNA, 18 bp, Homo sapiens
gcacaccaaattgctgag

SEQ ID NO: 6230588 - DNA, 13 bp, Homo sapiens
gcacaccaaggcc

SEQ ID NO: 6230589 - DNA, 18 bp, Homo sapiens
gcacaccaaggccctgca

SEQ ID NO: 6230590 - DNA, 22 bp, Homo sapiens
gcacaccaatcttactttgtaa

SEQ ID NO: 6230591 - DNA, 14 bp, Homo sapiens
gcacaccaccctcc

SEQ ID NO: 6230592 - DNA, 16 bp, Homo sapiens
gcacaccaccctcccg

SEQ ID NO: 6230593 - DNA, 14 bp, Homo sapiens
gcacaccactgccc

SEQ ID NO: 6230594 - DNA, 16 bp, Homo sapiens
gcacaccactgccctg

SEQ ID NO: 6230595 - DNA, 21 bp, Homo sapiens
gcacaccactgccctgcctgc

SEQ ID NO: 6230596 - DNA, 22 bp, Homo sapiens
gcacaccactgccctgcctgcc

SEQ ID NO: 6230597 - DNA, 22 bp, Homo sapiens
gcacaccagagacaagcagagt

SEQ ID NO: 6230598 - DNA, 23 bp, Homo sapiens
gcacaccagagacaagcagagta

SEQ ID NO: 6230599 - DNA, 12 bp, Homo sapiens
gcacaccagccg

SEQ ID NO: 6230600 - DNA, 23 bp, Homo sapiens
gcacaccagccgctgcagggctc

SEQ ID NO: 6230601 - DNA, 14 bp, Homo sapiens
gcacaccagttact

SEQ ID NO: 6230602 - DNA, 14 bp, Homo sapiens
gcacacccactgcc

SEQ ID NO: 6230603 - DNA, 14 bp, Homo sapiens
gcacaccccactcc

SEQ ID NO: 6230604 - DNA, 14 bp, Homo sapiens
gcacacccctgcac

SEQ ID NO: 6230605 - DNA, 17 bp, Homo sapiens
gcacacccctgcacaca

SEQ ID NO: 6230606 - DNA, 18 bp, Homo sapiens
gcacacccctgcacacac

SEQ ID NO: 6230607 - DNA, 13 bp, Homo sapiens
gcacacccctggg

SEQ ID NO: 6230608 - DNA, 20 bp, Homo sapiens
gcacaccctcactctgccag

SEQ ID NO: 6230609 - DNA, 12 bp, Homo sapiens
gcacaccctggg

SEQ ID NO: 6230610 - DNA, 22 bp, Homo sapiens
gcacaccgccatcctctgcctc

SEQ ID NO: 6230611 - DNA, 16 bp, Homo sapiens
gcacaccgtccctctc

SEQ ID NO: 6230612 - DNA, 23 bp, Homo sapiens
gcacacctcggccgaggcctgcg

SEQ ID NO: 6230613 - DNA, 15 bp, Homo sapiens
gcacacctctggctg

SEQ ID NO: 6230614 - DNA, 16 bp, Homo sapiens
gcacacctctggctgt

SEQ ID NO: 6230615 - DNA, 12 bp, Homo sapiens
gcacacctgtgt

SEQ ID NO: 6230616 - DNA, 13 bp, Homo sapiens
gcacacctgtgtc

SEQ ID NO: 6230617 - DNA, 16 bp, Homo sapiens
gcacacctgtgtccaa

SEQ ID NO: 6230618 - DNA, 16 bp, Homo sapiens
gcacacctttattcag

SEQ ID NO: 6230619 - DNA, 14 bp, Homo sapiens
gcacacgcctccca

SEQ ID NO: 6230620 - DNA, 16 bp, Homo sapiens
gcacacgcgttatagt

SEQ ID NO: 6230621 - DNA, 20 bp, Homo sapiens
gcacacgcgttatagtaact

SEQ ID NO: 6230622 - DNA, 18 bp, Homo sapiens
gcacacgctgctctgccc

SEQ ID NO: 6230623 - DNA, 21 bp, Homo sapiens
gcacacgctgctctgccccag

SEQ ID NO: 6230624 - DNA, 16 bp, Homo sapiens
gcacacggcacagagc

SEQ ID NO: 6230625 - DNA, 13 bp, Homo sapiens
gcacacggccctg

SEQ ID NO: 6230626 - DNA, 18 bp, Homo sapiens
gcacacggccctgcccca

SEQ ID NO: 6230627 - DNA, 23 bp, Homo sapiens
gcacacggccctgccccatcctg

SEQ ID NO: 6230628 - DNA, 22 bp, Homo sapiens
gcacacggctggtcactctgcc

SEQ ID NO: 6230629 - DNA, 22 bp, Homo sapiens
gcacacgggaaagccttaaaaa

SEQ ID NO: 6230630 - DNA, 14 bp, Homo sapiens
gcacactaagaaat

SEQ ID NO: 6230631 - DNA, 23 bp, Homo sapiens
gcacactcagcacccccttctct

SEQ ID NO: 6230632 - DNA, 13 bp, Homo sapiens
gcacactcagtgg

SEQ ID NO: 6230633 - DNA, 19 bp, Homo sapiens
gcacactcatgcacacaga

SEQ ID NO: 6230634 - DNA, 19 bp, Homo sapiens
gcacactccatctcctgct

SEQ ID NO: 6230635 - DNA, 20 bp, Homo sapiens
gcacactcccctgcactgga

SEQ ID NO: 6230636 - DNA, 21 bp, Homo sapiens
gcacactcccctgcactggag

SEQ ID NO: 6230637 - DNA, 13 bp, Homo sapiens
gcacactccctct

SEQ ID NO: 6230638 - DNA, 19 bp, Homo sapiens
gcacactctcccattatat

SEQ ID NO: 6230639 - DNA, 16 bp, Homo sapiens
gcacactctggtcttg

SEQ ID NO: 6230640 - DNA, 17 bp, Homo sapiens
gcacactgagtttgaac

SEQ ID NO: 6230641 - DNA, 19 bp, Homo sapiens
gcacactgcagggctgctg

SEQ ID NO: 6230642 - DNA, 20 bp, Homo sapiens
gcacactgcagggctgctgt

SEQ ID NO: 6230643 - DNA, 21 bp, Homo sapiens
gcacactgcagggctgctgtg

SEQ ID NO: 6230644 - DNA, 23 bp, Homo sapiens
gcacactgcagggctgctgtggc

SEQ ID NO: 6230645 - DNA, 13 bp, Homo sapiens
gcacactgccaaa

SEQ ID NO: 6230646 - DNA, 19 bp, Homo sapiens
gcacactgccaaataaaca

SEQ ID NO: 6230647 - DNA, 20 bp, Homo sapiens
gcacactgccaaataaacag

SEQ ID NO: 6230648 - DNA, 21 bp, Homo sapiens
gcacactgccaaataaacagc

SEQ ID NO: 6230649 - DNA, 22 bp, Homo sapiens
gcacactggctcacccagtcct

SEQ ID NO: 6230650 - DNA, 15 bp, Homo sapiens
gcacactgtgaaaat

SEQ ID NO: 6230651 - DNA, 15 bp, Homo sapiens
gcacacttatttatg

SEQ ID NO: 6230652 - DNA, 19 bp, Homo sapiens
gacaggttacgaagacaaa

SEQ ID NO: 6230653 - DNA, 16 bp, Homo sapiens
gacaggttagctgctc

SEQ ID NO: 6230654 - DNA, 16 bp, Homo sapiens
gacaggttcccagcag

SEQ ID NO: 6230655 - DNA, 19 bp, Homo sapiens
gacaggtttgggacccctg

SEQ ID NO: 6230656 - DNA, 19 bp, Homo sapiens
gacaggttttcacataaat

SEQ ID NO: 6230657 - DNA, 15 bp, Homo sapiens
gacagtaacttggtt

SEQ ID NO: 6230658 - DNA, 17 bp, Homo sapiens
gacagtaacttggttat

SEQ ID NO: 6230659 - DNA, 22 bp, Homo sapiens
gacagtaagagtttacaagaaa

SEQ ID NO: 6230660 - DNA, 19 bp, Homo sapiens
gacagtaattgtgtttaca

SEQ ID NO: 6230661 - DNA, 20 bp, Homo sapiens
gacagtaattgtgtttacat

SEQ ID NO: 6230662 - DNA, 14 bp, Homo sapiens
gacagtagcatact

SEQ ID NO: 6230663 - DNA, 16 bp, Homo sapiens
gacagtatatttgaaa

SEQ ID NO: 6230664 - DNA, 19 bp, Homo sapiens
gacagtatatttgaaactg

SEQ ID NO: 6230665 - DNA, 15 bp, Homo sapiens
gacagtatcccacat

SEQ ID NO: 6230666 - DNA, 18 bp, Homo sapiens
gacagtatcccacatcca

SEQ ID NO: 6230667 - DNA, 21 bp, Homo sapiens
gacagtatgagtcaatgtgca

SEQ ID NO: 6230668 - DNA, 20 bp, Homo sapiens
gacagtatttattggtgggt

SEQ ID NO: 6230669 - DNA, 16 bp, Homo sapiens
gacagtcaaggagtgg

SEQ ID NO: 6230670 - DNA, 15 bp, Homo sapiens
gacagtcaaggtgat

SEQ ID NO: 6230671 - DNA, 14 bp, Homo sapiens
gacagtcaccccag

SEQ ID NO: 6230672 - DNA, 14 bp, Homo sapiens
gacagtcacttcct

SEQ ID NO: 6230673 - DNA, 16 bp, Homo sapiens
gacagtcagcatttct

SEQ ID NO: 6230674 - DNA, 17 bp, Homo sapiens
gacagtcatcatcaggg

SEQ ID NO: 6230675 - DNA, 23 bp, Homo sapiens
gacagtcatcatcagggcctggg

SEQ ID NO: 6230676 - DNA, 14 bp, Homo sapiens
gacagtccacaggg

SEQ ID NO: 6230677 - DNA, 19 bp, Homo sapiens
gacagtccagcctggagat

SEQ ID NO: 6230678 - DNA, 14 bp, Homo sapiens
gacagtccctgcca

SEQ ID NO: 6230679 - DNA, 15 bp, Homo sapiens
gacagtccctgccaa

SEQ ID NO: 6230680 - DNA, 16 bp, Homo sapiens
gacagtccctgccaat

SEQ ID NO: 6230681 - DNA, 14 bp, Homo sapiens
gacagtccctgctg

SEQ ID NO: 6230682 - DNA, 17 bp, Homo sapiens
gacagtccctgctgggg

SEQ ID NO: 6230683 - DNA, 18 bp, Homo sapiens
gacagtccctgctgggga

SEQ ID NO: 6230684 - DNA, 18 bp, Homo sapiens
gacagtcccttgctgaca

SEQ ID NO: 6230685 - DNA, 16 bp, Homo sapiens
gacagtcctctccacc

SEQ ID NO: 6230686 - DNA, 17 bp, Homo sapiens
gacagtcctctccacct

SEQ ID NO: 6230687 - DNA, 15 bp, Homo sapiens
gacagtctcaaattt

SEQ ID NO: 6230688 - DNA, 23 bp, Homo sapiens
gacagtctcaagcactaaaaagt

SEQ ID NO: 6230689 - DNA, 14 bp, Homo sapiens
gacagtctcaccat

SEQ ID NO: 6230690 - DNA, 23 bp, Homo sapiens
gacagtctcaccatttccccagg

SEQ ID NO: 6230691 - DNA, 13 bp, Homo sapiens
gacagtctcactc

SEQ ID NO: 6230692 - DNA, 17 bp, Homo sapiens
gacagtctccctgatgg

SEQ ID NO: 6230693 - DNA, 23 bp, Homo sapiens
gacagtctccctgatggaccctc

SEQ ID NO: 6230694 - DNA, 15 bp, Homo sapiens
gacagtcttgtgctt

SEQ ID NO: 6230695 - DNA, 22 bp, Homo sapiens
gacagtctttgatcatcatgta

SEQ ID NO: 6230696 - DNA, 23 bp, Homo sapiens
gacagtctttgggtacctatttt

SEQ ID NO: 6230697 - DNA, 15 bp, Homo sapiens
gacagtgaagcagca

SEQ ID NO: 6230698 - DNA, 22 bp, Homo sapiens
gacagtgacgtgactcagagct

SEQ ID NO: 6230699 - DNA, 21 bp, Homo sapiens
gacagtgagactctgtctcag

SEQ ID NO: 6230700 - DNA, 19 bp, Homo sapiens
gacagtgaggtcctggggg

SEQ ID NO: 6230701 - DNA, 15 bp, Homo sapiens
gacagtgatctccat

SEQ ID NO: 6230702 - DNA, 16 bp, Homo sapiens
gacagtgatctccata

SEQ ID NO: 6230703 - DNA, 21 bp, Homo sapiens
gacagtgatctccatatgtta

SEQ ID NO: 6230704 - DNA, 15 bp, Homo sapiens
gacagtgatgcctgc

SEQ ID NO: 6230705 - DNA, 16 bp, Homo sapiens
gacagtgatgcctgcc

SEQ ID NO: 6230706 - DNA, 13 bp, Homo sapiens
gacagtgcagtgc

SEQ ID NO: 6230707 - DNA, 23 bp, Homo sapiens
gacagtgccacatactgcggacc

SEQ ID NO: 6230708 - DNA, 15 bp, Homo sapiens
gacagtgccatcccc

SEQ ID NO: 6230709 - DNA, 10 bp, Homo sapiens
gacagtgccc

SEQ ID NO: 6230710 - DNA, 14 bp, Homo sapiens
gacagtgcccatgc

SEQ ID NO: 6230711 - DNA, 14 bp, Homo sapiens
gacagtgccctgag

SEQ ID NO: 6230712 - DNA, 10 bp, Homo sapiens
gacagtgcct

SEQ ID NO: 6230713 - DNA, 13 bp, Homo sapiens
gacagtgcctctt

SEQ ID NO: 6230714 - DNA, 20 bp, Homo sapiens
gacagtgcctcttccagtga

SEQ ID NO: 6230715 - DNA, 22 bp, Homo sapiens
gacagtgcctgggaatgtatta

SEQ ID NO: 6230716 - DNA, 13 bp, Homo sapiens
gacagtgccttct

SEQ ID NO: 6230717 - DNA, 20 bp, Homo sapiens
gacagtgcgtgatttctcag

SEQ ID NO: 6230718 - DNA, 21 bp, Homo sapiens
gacagtgctctaggctgcccc

SEQ ID NO: 6230719 - DNA, 14 bp, Homo sapiens
gacagtgctgaccc

SEQ ID NO: 6230720 - DNA, 21 bp, Homo sapiens
gacagtgctgcagctccctgg

SEQ ID NO: 6230721 - DNA, 13 bp, Homo sapiens
gacagtgctgttg

SEQ ID NO: 6230722 - DNA, 15 bp, Homo sapiens
gacagtgcttgcatc

SEQ ID NO: 6230723 - DNA, 23 bp, Homo sapiens
gacagtgcttgcatcctatttgg

SEQ ID NO: 6230724 - DNA, 18 bp, Homo sapiens
gacagtggcaggacagga

SEQ ID NO: 6230725 - DNA, 18 bp, Homo sapiens
gacagtggcctcttgagt

SEQ ID NO: 6230726 - DNA, 16 bp, Homo sapiens
gacagtggctgctctg

SEQ ID NO: 6230727 - DNA, 18 bp, Homo sapiens
gacagtggctgctctggg

SEQ ID NO: 6230728 - DNA, 22 bp, Homo sapiens
gacagtgggcaggaggccccag

SEQ ID NO: 6230729 - DNA, 18 bp, Homo sapiens
gacagtgggggtgcctgg

SEQ ID NO: 6230730 - DNA, 14 bp, Homo sapiens
gacagtggtgggcg

SEQ ID NO: 6230731 - DNA, 18 bp, Homo sapiens
gacagtggttatatttca

SEQ ID NO: 6230732 - DNA, 15 bp, Homo sapiens
gacagtgtcatggtg

SEQ ID NO: 6230733 - DNA, 19 bp, Homo sapiens
gacagtgtgggacaggctc

SEQ ID NO: 6230734 - DNA, 24 bp, Homo sapiens
gacagtgtgggacaggctcttctt

SEQ ID NO: 6230735 - DNA, 19 bp, Homo sapiens
gacagtgtggggataaaga

SEQ ID NO: 6230736 - DNA, 19 bp, Homo sapiens
gacagtgttcaaattctga

SEQ ID NO: 6230737 - DNA, 23 bp, Homo sapiens
gacagtgtttcgtcatgttggcc

SEQ ID NO: 6230738 - DNA, 20 bp, Homo sapiens
gacagtgttttaggtgcctg

SEQ ID NO: 6230739 - DNA, 13 bp, Homo sapiens
gacagttacttac

SEQ ID NO: 6230740 - DNA, 15 bp, Homo sapiens
gacagttcacaccct

SEQ ID NO: 6230741 - DNA, 17 bp, Homo sapiens
gacagttcatatgtacc

SEQ ID NO: 6230742 - DNA, 19 bp, Homo sapiens
gacagttcattcagggccg

SEQ ID NO: 6230743 - DNA, 13 bp, Homo sapiens
gacagttctctgt

SEQ ID NO: 6230744 - DNA, 15 bp, Homo sapiens
gacagttctgaagaa

SEQ ID NO: 6230745 - DNA, 20 bp, Homo sapiens
gacagttgatggagccccag

SEQ ID NO: 6230746 - DNA, 21 bp, Homo sapiens
gacagttgatggagccccagg

SEQ ID NO: 6230747 - DNA, 22 bp, Homo sapiens
gacagttggagggaaagccagc

SEQ ID NO: 6230748 - DNA, 14 bp, Homo sapiens
gacagttggcagag

SEQ ID NO: 6230749 - DNA, 19 bp, Homo sapiens
gacagtttaccagttgcct

SEQ ID NO: 6230750 - DNA, 21 bp, Homo sapiens
gacagtttaccagttgccttt

SEQ ID NO: 6230751 - DNA, 17 bp, Homo sapiens
gacagtttatcatgaag

SEQ ID NO: 6230752 - DNA, 21 bp, Homo sapiens
gacagtttatcatgaagcctg

SEQ ID NO: 6230753 - DNA, 17 bp, Homo sapiens
gacagtttatcctgtct

SEQ ID NO: 6230754 - DNA, 13 bp, Homo sapiens
gacagtttccaaa

SEQ ID NO: 6230755 - DNA, 21 bp, Homo sapiens
gacagtttcttagctttttaa

SEQ ID NO: 6230756 - DNA, 14 bp, Homo sapiens
gacagtttcttgca

SEQ ID NO: 6230757 - DNA, 15 bp, Homo sapiens
gacagtttcttttgt

SEQ ID NO: 6230758 - DNA, 15 bp, Homo sapiens
gacagtttgtaaatg

SEQ ID NO: 6230759 - DNA, 16 bp, Homo sapiens
gacagtttgtaaatgt

SEQ ID NO: 6230760 - DNA, 17 bp, Homo sapiens
gacagtttgtaaatgtt

SEQ ID NO: 6230761 - DNA, 19 bp, Homo sapiens
gacagtttgtaaatgttat

SEQ ID NO: 6230762 - DNA, 17 bp, Homo sapiens
gacagtttgtttcctgt

SEQ ID NO: 6230763 - DNA, 12 bp, Homo sapiens
gacataaaactt

SEQ ID NO: 6230764 - DNA, 13 bp, Homo sapiens
gacataaaacttt

SEQ ID NO: 6230765 - DNA, 16 bp, Homo sapiens
gacataaaactttaaa

SEQ ID NO: 6230766 - DNA, 18 bp, Homo sapiens
gacataaaactttaaaag

SEQ ID NO: 6230767 - DNA, 20 bp, Homo sapiens
gacataaaactttaaaaggc

SEQ ID NO: 6230768 - DNA, 21 bp, Homo sapiens
gacataaaactttaaaaggca

SEQ ID NO: 6230769 - DNA, 15 bp, Homo sapiens
gacataaaattccac

SEQ ID NO: 6230770 - DNA, 17 bp, Homo sapiens
gacataaaatttacatt

SEQ ID NO: 6230771 - DNA, 17 bp, Homo sapiens
gacataaacaaagacat

SEQ ID NO: 6230772 - DNA, 20 bp, Homo sapiens
gacataaacccatctgtaat

SEQ ID NO: 6230773 - DNA, 17 bp, Homo sapiens
gacataaaggaaaagac

SEQ ID NO: 6230774 - DNA, 22 bp, Homo sapiens
gacataaagttgataaagattt

SEQ ID NO: 6230775 - DNA, 14 bp, Homo sapiens
gacataacgttttt

SEQ ID NO: 6230776 - DNA, 15 bp, Homo sapiens
gacataagataaaat

SEQ ID NO: 6230777 - DNA, 14 bp, Homo sapiens
gacataagtaactt

SEQ ID NO: 6230778 - DNA, 15 bp, Homo sapiens
gacataataaagtat

SEQ ID NO: 6230779 - DNA, 23 bp, Homo sapiens
gacataatatattctatttttat

SEQ ID NO: 6230780 - DNA, 12 bp, Homo sapiens
gacataatgtag

SEQ ID NO: 6230781 - DNA, 13 bp, Homo sapiens
gacataatgtagt

SEQ ID NO: 6230782 - DNA, 13 bp, Homo sapiens
gacataatttcag

SEQ ID NO: 6230783 - DNA, 23 bp, Homo sapiens
gacataatttcagtgggaaatat

SEQ ID NO: 6230784 - DNA, 14 bp, Homo sapiens
gacatacacaaatg

SEQ ID NO: 6230785 - DNA, 14 bp, Homo sapiens
gacatacagctgcc

SEQ ID NO: 6230786 - DNA, 20 bp, Homo sapiens
gacatacatattatctcatt

SEQ ID NO: 6230787 - DNA, 16 bp, Homo sapiens
gacatactaaccagca

SEQ ID NO: 6230788 - DNA, 15 bp, Homo sapiens
gacatactctctgcc

SEQ ID NO: 6230789 - DNA, 16 bp, Homo sapiens
gacatactctctgcct

SEQ ID NO: 6230790 - DNA, 21 bp, Homo sapiens
gacatactctctgcctggtgg

SEQ ID NO: 6230791 - DNA, 17 bp, Homo sapiens
gacatacttgaagggcc

SEQ ID NO: 6230792 - DNA, 20 bp, Homo sapiens
gacatacttgaagggccaga

SEQ ID NO: 6230793 - DNA, 22 bp, Homo sapiens
gacatacttgaagggccagagc

SEQ ID NO: 6230794 - DNA, 15 bp, Homo sapiens
gacatagactgcaaa

SEQ ID NO: 6230795 - DNA, 20 bp, Homo sapiens
gacatagagagggagaagaa

SEQ ID NO: 6230796 - DNA, 15 bp, Homo sapiens
gacatagaggtatat

SEQ ID NO: 6230797 - DNA, 20 bp, Homo sapiens
gacatagatattttcacaat

SEQ ID NO: 6230798 - DNA, 20 bp, Homo sapiens
gacatagccgattctctgcc

SEQ ID NO: 6230799 - DNA, 11 bp, Homo sapiens
gacatagcctt

SEQ ID NO: 6230800 - DNA, 14 bp, Homo sapiens
gacatagcctttgt

SEQ ID NO: 6230801 - DNA, 15 bp, Homo sapiens
gacatagcctttgtg

SEQ ID NO: 6230802 - DNA, 16 bp, Homo sapiens
gacatagcctttgtgc

SEQ ID NO: 6230803 - DNA, 17 bp, Homo sapiens
gacatagtggatggaca

SEQ ID NO: 6230804 - DNA, 22 bp, Homo sapiens
gacatagtggatggacagatgg

SEQ ID NO: 6230805 - DNA, 16 bp, Homo sapiens
gacatatatattaaaa

SEQ ID NO: 6230806 - DNA, 16 bp, Homo sapiens
gacatatattatatat

SEQ ID NO: 6230807 - DNA, 16 bp, Homo sapiens
gacatatcagtgacct

SEQ ID NO: 6230808 - DNA, 21 bp, Homo sapiens
gacatatgttaggaatactct

SEQ ID NO: 6230809 - DNA, 11 bp, Homo sapiens
gacatatttaa

SEQ ID NO: 6230810 - DNA, 17 bp, Homo sapiens
gacatatttaatgtttt

SEQ ID NO: 6230811 - DNA, 18 bp, Homo sapiens
gacatcacagcagaatga

SEQ ID NO: 6230812 - DNA, 23 bp, Homo sapiens
gacatcacagcagaatgaagacc

SEQ ID NO: 6230813 - DNA, 15 bp, Homo sapiens
gacatcacagcagcc

SEQ ID NO: 6230814 - DNA, 15 bp, Homo sapiens
gacatcacagggcct

SEQ ID NO: 6230815 - DNA, 16 bp, Homo sapiens
gacatcacagggtggg

SEQ ID NO: 6230816 - DNA, 19 bp, Homo sapiens
gacatcaccgtcattgatg

SEQ ID NO: 6230817 - DNA, 16 bp, Homo sapiens
gacatcacttgtacaa

SEQ ID NO: 6230818 - DNA, 22 bp, Homo sapiens
gacatcacttgtacaaaataaa

SEQ ID NO: 6230819 - DNA, 18 bp, Homo sapiens
gacatcagattgttaagg

SEQ ID NO: 6230820 - DNA, 17 bp, Homo sapiens
gacatcagatttcttaa

SEQ ID NO: 6230821 - DNA, 23 bp, Homo sapiens
gacatcagcactttaccagaggc

SEQ ID NO: 6230822 - DNA, 12 bp, Homo sapiens
gacatcagccag

SEQ ID NO: 6230823 - DNA, 14 bp, Homo sapiens
gacatcagccagct

SEQ ID NO: 6230824 - DNA, 13 bp, Homo sapiens
gacatcagcccgg

SEQ ID NO: 6230825 - DNA, 14 bp, Homo sapiens
gacatcagcctgct

SEQ ID NO: 6230826 - DNA, 14 bp, Homo sapiens
gacatcagggagta

SEQ ID NO: 6230827 - DNA, 20 bp, Homo sapiens
gacatcagtggcatggctcc

SEQ ID NO: 6230828 - DNA, 16 bp, Homo sapiens
gacatcagtgtttgtt

SEQ ID NO: 6230829 - DNA, 24 bp, Homo sapiens
gacatcatgctggtgagtgccacg

SEQ ID NO: 6230830 - DNA, 16 bp, Homo sapiens
gacatcattgtcagcc

SEQ ID NO: 6230831 - DNA, 18 bp, Homo sapiens
gcacacttatttatgaat

SEQ ID NO: 6230832 - DNA, 12 bp, Homo sapiens
gcacacttcccc

SEQ ID NO: 6230833 - DNA, 14 bp, Homo sapiens
gcacacttggccca

SEQ ID NO: 6230834 - DNA, 18 bp, Homo sapiens
gcacacttgtatattgaa

SEQ ID NO: 6230835 - DNA, 22 bp, Homo sapiens
gcacactttctggcaaacgttt

SEQ ID NO: 6230836 - DNA, 14 bp, Homo sapiens
gcacactttgccat

SEQ ID NO: 6230837 - DNA, 18 bp, Homo sapiens
gcacactttggcccaggg

SEQ ID NO: 6230838 - DNA, 21 bp, Homo sapiens
gcacactttggtaccagataa

SEQ ID NO: 6230839 - DNA, 13 bp, Homo sapiens
gcacagaaaacta

SEQ ID NO: 6230840 - DNA, 16 bp, Homo sapiens
gcacagaaaactagaa

SEQ ID NO: 6230841 - DNA, 21 bp, Homo sapiens
gcacagaaaatggaagacagc

SEQ ID NO: 6230842 - DNA, 23 bp, Homo sapiens
gcacagaaaatggaagacagctc

SEQ ID NO: 6230843 - DNA, 20 bp, Homo sapiens
gcacagaaacacaatatttt

SEQ ID NO: 6230844 - DNA, 20 bp, Homo sapiens
gcacagaaacttgaactcca

SEQ ID NO: 6230845 - DNA, 19 bp, Homo sapiens
gcacagaaagggcagcttc

SEQ ID NO: 6230846 - DNA, 15 bp, Homo sapiens
gcacagaaatctgaa

SEQ ID NO: 6230847 - DNA, 23 bp, Homo sapiens
gcacagaacaggaggtgtgaatg

SEQ ID NO: 6230848 - DNA, 11 bp, Homo sapiens
gcacagaagag

SEQ ID NO: 6230849 - DNA, 13 bp, Homo sapiens
gcacagaagagga

SEQ ID NO: 6230850 - DNA, 16 bp, Homo sapiens
gcacagaagaggagtc

SEQ ID NO: 6230851 - DNA, 19 bp, Homo sapiens
gcacagaaggaatctgtgc

SEQ ID NO: 6230852 - DNA, 20 bp, Homo sapiens
gcacagaaggaatctgtgca

SEQ ID NO: 6230853 - DNA, 14 bp, Homo sapiens
gcacagaaggctgg

SEQ ID NO: 6230854 - DNA, 15 bp, Homo sapiens
gcacagaagtcctgt

SEQ ID NO: 6230855 - DNA, 22 bp, Homo sapiens
gcacagacaagcagcccttgct

SEQ ID NO: 6230856 - DNA, 23 bp, Homo sapiens
gcacagacatctcctcaccccag

SEQ ID NO: 6230857 - DNA, 16 bp, Homo sapiens
gcacagaccaggcctt

SEQ ID NO: 6230858 - DNA, 20 bp, Homo sapiens
gcacagaccctgccctgtgg

SEQ ID NO: 6230859 - DNA, 18 bp, Homo sapiens
gcacagacctcagagatg

SEQ ID NO: 6230860 - DNA, 17 bp, Homo sapiens
gcacagacctctcccac

SEQ ID NO: 6230861 - DNA, 18 bp, Homo sapiens
gcacagacctctcccacc

SEQ ID NO: 6230862 - DNA, 13 bp, Homo sapiens
gcacagactggtc

SEQ ID NO: 6230863 - DNA, 16 bp, Homo sapiens
gcacagagaagacaaa

SEQ ID NO: 6230864 - DNA, 18 bp, Homo sapiens
gcacagagacggtctgga

SEQ ID NO: 6230865 - DNA, 20 bp, Homo sapiens
gcacagagagcggcttcccc

SEQ ID NO: 6230866 - DNA, 21 bp, Homo sapiens
gcacagagagggacacatgcc

SEQ ID NO: 6230867 - DNA, 15 bp, Homo sapiens
gcacagagagggggc

SEQ ID NO: 6230868 - DNA, 23 bp, Homo sapiens
gcacagagcacacttatttatga

SEQ ID NO: 6230869 - DNA, 23 bp, Homo sapiens
gcacagagcatccgtctcccctc

SEQ ID NO: 6230870 - DNA, 12 bp, Homo sapiens
gcacagagccca

SEQ ID NO: 6230871 - DNA, 17 bp, Homo sapiens
gcacagagcccaatgca

SEQ ID NO: 6230872 - DNA, 15 bp, Homo sapiens
gcacagagccctgag

SEQ ID NO: 6230873 - DNA, 22 bp, Homo sapiens
gcacagagcctggccccaggcc

SEQ ID NO: 6230874 - DNA, 18 bp, Homo sapiens
gcacagagcgtccttccc

SEQ ID NO: 6230875 - DNA, 17 bp, Homo sapiens
gcacagagctctccagc

SEQ ID NO: 6230876 - DNA, 23 bp, Homo sapiens
gcacagagctctccagctccaag

SEQ ID NO: 6230877 - DNA, 20 bp, Homo sapiens
gcacagaggcagctgtgtgg

SEQ ID NO: 6230878 - DNA, 13 bp, Homo sapiens
gcacagaggcctg

SEQ ID NO: 6230879 - DNA, 21 bp, Homo sapiens
gcacagaggtcaggaagcagg

SEQ ID NO: 6230880 - DNA, 13 bp, Homo sapiens
gcacagagtcctt

SEQ ID NO: 6230881 - DNA, 19 bp, Homo sapiens
gcacagagtcgatgctcaa

SEQ ID NO: 6230882 - DNA, 22 bp, Homo sapiens
gcacagagttgttacattttta

SEQ ID NO: 6230883 - DNA, 19 bp, Homo sapiens
gcacagatatactttgtgg

SEQ ID NO: 6230884 - DNA, 18 bp, Homo sapiens
gcacagatgaccaaagtc

SEQ ID NO: 6230885 - DNA, 14 bp, Homo sapiens
gcacagatgaggag

SEQ ID NO: 6230886 - DNA, 15 bp, Homo sapiens
gcacagatgcccacg

SEQ ID NO: 6230887 - DNA, 18 bp, Homo sapiens
gcacagatggatttgcct

SEQ ID NO: 6230888 - DNA, 24 bp, Homo sapiens
gcacagatggatttgcctgtgcca

SEQ ID NO: 6230889 - DNA, 23 bp, Homo sapiens
gcacagatggatttgtttggacc

SEQ ID NO: 6230890 - DNA, 14 bp, Homo sapiens
gcacagatggccag

SEQ ID NO: 6230891 - DNA, 19 bp, Homo sapiens
gcacagattcccaggccag

SEQ ID NO: 6230892 - DNA, 21 bp, Homo sapiens
gcacagattcccaggccaggg

SEQ ID NO: 6230893 - DNA, 22 bp, Homo sapiens
gcacagattcccaggccagggc

SEQ ID NO: 6230894 - DNA, 15 bp, Homo sapiens
gcacagattgaagaa

SEQ ID NO: 6230895 - DNA, 17 bp, Homo sapiens
gcacagattgctgaaac

SEQ ID NO: 6230896 - DNA, 21 bp, Homo sapiens
gcacagattttaattgtcatg

SEQ ID NO: 6230897 - DNA, 13 bp, Homo sapiens
gcacagcaaactg

SEQ ID NO: 6230898 - DNA, 14 bp, Homo sapiens
gcacagcaagaaaa

SEQ ID NO: 6230899 - DNA, 22 bp, Homo sapiens
gcacagcaaggaggctggctgg

SEQ ID NO: 6230900 - DNA, 22 bp, Homo sapiens
gcacagcacaaattagttatat

SEQ ID NO: 6230901 - DNA, 15 bp, Homo sapiens
gcacagcagcctggg

SEQ ID NO: 6230902 - DNA, 20 bp, Homo sapiens
gcacagcaggacctgtgctt

SEQ ID NO: 6230903 - DNA, 12 bp, Homo sapiens
gcacagcaggct

SEQ ID NO: 6230904 - DNA, 20 bp, Homo sapiens
gcacagcaggggagccctga

SEQ ID NO: 6230905 - DNA, 22 bp, Homo sapiens
gcacagcatgagaggctctgtg

SEQ ID NO: 6230906 - DNA, 23 bp, Homo sapiens
gcacagcatttgctttcctctga

SEQ ID NO: 6230907 - DNA, 19 bp, Homo sapiens
gcacagccaacgagacaca

SEQ ID NO: 6230908 - DNA, 16 bp, Homo sapiens
gcacagccaatctcca

SEQ ID NO: 6230909 - DNA, 14 bp, Homo sapiens
gcacagccacccgt

SEQ ID NO: 6230910 - DNA, 13 bp, Homo sapiens
gcacagccacctc

SEQ ID NO: 6230911 - DNA, 14 bp, Homo sapiens
gcacagccacctcc

SEQ ID NO: 6230912 - DNA, 16 bp, Homo sapiens
gcacagccacctccgc

SEQ ID NO: 6230913 - DNA, 18 bp, Homo sapiens
gcacagccacctccgcca

SEQ ID NO: 6230914 - DNA, 13 bp, Homo sapiens
gcacagccagaaa

SEQ ID NO: 6230915 - DNA, 17 bp, Homo sapiens
gcacagcccaaagaagg

SEQ ID NO: 6230916 - DNA, 12 bp, Homo sapiens
gcacagcccaac

SEQ ID NO: 6230917 - DNA, 19 bp, Homo sapiens
gcacagcccaaccaggagg

SEQ ID NO: 6230918 - DNA, 23 bp, Homo sapiens
gcacagcccaaccaggaggggtc

SEQ ID NO: 6230919 - DNA, 13 bp, Homo sapiens
gcacagcccctgg

SEQ ID NO: 6230920 - DNA, 15 bp, Homo sapiens
gcacagcccctggag

SEQ ID NO: 6230921 - DNA, 13 bp, Homo sapiens
gcacagccctccc

SEQ ID NO: 6230922 - DNA, 16 bp, Homo sapiens
gcacagccctcccgcc

SEQ ID NO: 6230923 - DNA, 19 bp, Homo sapiens
gcacagccctcccgcccct

SEQ ID NO: 6230924 - DNA, 20 bp, Homo sapiens
gcacagccctccgaccctca

SEQ ID NO: 6230925 - DNA, 14 bp, Homo sapiens
gcacagccctgagt

SEQ ID NO: 6230926 - DNA, 18 bp, Homo sapiens
gcacagccctgagtgtcc

SEQ ID NO: 6230927 - DNA, 21 bp, Homo sapiens
gcacagccgcgggccaggagg

SEQ ID NO: 6230928 - DNA, 23 bp, Homo sapiens
gcacagcctcggggatggggagg

SEQ ID NO: 6230929 - DNA, 17 bp, Homo sapiens
gcacagcctggggaggg

SEQ ID NO: 6230930 - DNA, 18 bp, Homo sapiens
gcacagcgcgggcggagg

SEQ ID NO: 6230931 - DNA, 21 bp, Homo sapiens
gcacagctactcagatctgca

SEQ ID NO: 6230932 - DNA, 13 bp, Homo sapiens
gcacagctcccgg

SEQ ID NO: 6230933 - DNA, 14 bp, Homo sapiens
gcacagctccctgc

SEQ ID NO: 6230934 - DNA, 15 bp, Homo sapiens
gcacagctcctcccc

SEQ ID NO: 6230935 - DNA, 19 bp, Homo sapiens
gcacagctcctcccctgcc

SEQ ID NO: 6230936 - DNA, 21 bp, Homo sapiens
gcacagctcctcccctgccgc

SEQ ID NO: 6230937 - DNA, 14 bp, Homo sapiens
gcacagctcctgcc

SEQ ID NO: 6230938 - DNA, 17 bp, Homo sapiens
gcacagctcctgccagg

SEQ ID NO: 6230939 - DNA, 13 bp, Homo sapiens
gcacagctctcac

SEQ ID NO: 6230940 - DNA, 16 bp, Homo sapiens
gcacagctcttcacac

SEQ ID NO: 6230941 - DNA, 23 bp, Homo sapiens
gcacagctgccctgctgccacag

SEQ ID NO: 6230942 - DNA, 13 bp, Homo sapiens
gcacagctgcttg

SEQ ID NO: 6230943 - DNA, 18 bp, Homo sapiens
gcacagctggagaaatgg

SEQ ID NO: 6230944 - DNA, 18 bp, Homo sapiens
gcacagctgggagcctgg

SEQ ID NO: 6230945 - DNA, 14 bp, Homo sapiens
gcacagctgggata

SEQ ID NO: 6230946 - DNA, 18 bp, Homo sapiens
gcacagctgggatacaca

SEQ ID NO: 6230947 - DNA, 13 bp, Homo sapiens
gcacagctgggca

SEQ ID NO: 6230948 - DNA, 23 bp, Homo sapiens
gcacagctgggcatgccatgtct

SEQ ID NO: 6230949 - DNA, 18 bp, Homo sapiens
gcacagctgtctgccagg

SEQ ID NO: 6230950 - DNA, 19 bp, Homo sapiens
gcacagctgtctgccaggc

SEQ ID NO: 6230951 - DNA, 21 bp, Homo sapiens
gcacagctgtctgccaggcac

SEQ ID NO: 6230952 - DNA, 18 bp, Homo sapiens
gcacagctgtgaggacag

SEQ ID NO: 6230953 - DNA, 19 bp, Homo sapiens
gcacagcttagatttcata

SEQ ID NO: 6230954 - DNA, 16 bp, Homo sapiens
gcacagcttcatttcc

SEQ ID NO: 6230955 - DNA, 21 bp, Homo sapiens
gcacagcttcctgagtcaccc

SEQ ID NO: 6230956 - DNA, 21 bp, Homo sapiens
gcacagcttgacctgaggctg

SEQ ID NO: 6230957 - DNA, 17 bp, Homo sapiens
gcacagcttgggtcagg

SEQ ID NO: 6230958 - DNA, 22 bp, Homo sapiens
gcacagcttttgtatagaaaat

SEQ ID NO: 6230959 - DNA, 21 bp, Homo sapiens
gcacaggagagcacccacagc

SEQ ID NO: 6230960 - DNA, 16 bp, Homo sapiens
gcacaggagctacctg

SEQ ID NO: 6230961 - DNA, 20 bp, Homo sapiens
gcacaggagctacctgtgtg

SEQ ID NO: 6230962 - DNA, 16 bp, Homo sapiens
gcacaggaggcaggca

SEQ ID NO: 6230963 - DNA, 23 bp, Homo sapiens
gcacaggagggggtcgtggagag

SEQ ID NO: 6230964 - DNA, 13 bp, Homo sapiens
gcacaggcactga

SEQ ID NO: 6230965 - DNA, 22 bp, Homo sapiens
gcacaggcactgaacaggctgg

SEQ ID NO: 6230966 - DNA, 23 bp, Homo sapiens
gcacaggcactgaacaggctggg

SEQ ID NO: 6230967 - DNA, 19 bp, Homo sapiens
gcacaggcagccccacgga

SEQ ID NO: 6230968 - DNA, 16 bp, Homo sapiens
gcacaggcaggaagag

SEQ ID NO: 6230969 - DNA, 17 bp, Homo sapiens
gcacaggcaggaagaga

SEQ ID NO: 6230970 - DNA, 15 bp, Homo sapiens
gcacaggcagggcag

SEQ ID NO: 6230971 - DNA, 16 bp, Homo sapiens
gcacaggcagggcagg

SEQ ID NO: 6230972 - DNA, 16 bp, Homo sapiens
gcacaggccacttgct

SEQ ID NO: 6230973 - DNA, 19 bp, Homo sapiens
gcacaggccacttgctcag

SEQ ID NO: 6230974 - DNA, 12 bp, Homo sapiens
gcacaggcccgc

SEQ ID NO: 6230975 - DNA, 18 bp, Homo sapiens
gcacaggcctctgcctgc

SEQ ID NO: 6230976 - DNA, 13 bp, Homo sapiens
gcacaggctgagt

SEQ ID NO: 6230977 - DNA, 15 bp, Homo sapiens
gcacaggctgttgaa

SEQ ID NO: 6230978 - DNA, 14 bp, Homo sapiens
gcacaggcttgctg

SEQ ID NO: 6230979 - DNA, 23 bp, Homo sapiens
gcacagggaaaattgccccatcc

SEQ ID NO: 6230980 - DNA, 18 bp, Homo sapiens
gcacagggaagggcttgg

SEQ ID NO: 6230981 - DNA, 19 bp, Homo sapiens
gcacagggcagctgggccc

SEQ ID NO: 6230982 - DNA, 16 bp, Homo sapiens
gcacagggcagtggga

SEQ ID NO: 6230983 - DNA, 12 bp, Homo sapiens
gcacagggcatg

SEQ ID NO: 6230984 - DNA, 11 bp, Homo sapiens
gcacagggcct

SEQ ID NO: 6230985 - DNA, 16 bp, Homo sapiens
gcacagggcctggccc

SEQ ID NO: 6230986 - DNA, 12 bp, Homo sapiens
gcacaggggccc

SEQ ID NO: 6230987 - DNA, 15 bp, Homo sapiens
gcacaggggccccag

SEQ ID NO: 6230988 - DNA, 20 bp, Homo sapiens
gcacagggggattctgagca

SEQ ID NO: 6230989 - DNA, 21 bp, Homo sapiens
gcacagggggattctgagcag

SEQ ID NO: 6230990 - DNA, 12 bp, Homo sapiens
gcacagggtctg

SEQ ID NO: 6230991 - DNA, 17 bp, Homo sapiens
gcacagggtctgctctt

SEQ ID NO: 6230992 - DNA, 15 bp, Homo sapiens
gcacaggtcaggggt

SEQ ID NO: 6230993 - DNA, 21 bp, Homo sapiens
gcacaggtcaggggtgacaca

SEQ ID NO: 6230994 - DNA, 23 bp, Homo sapiens
gcacaggtcaggggtgacacaga

SEQ ID NO: 6230995 - DNA, 11 bp, Homo sapiens
gcacaggtcca

SEQ ID NO: 6230996 - DNA, 17 bp, Homo sapiens
gcacaggtccaaggctg

SEQ ID NO: 6230997 - DNA, 22 bp, Homo sapiens
gcacaggtccaaggctggtccc

SEQ ID NO: 6230998 - DNA, 14 bp, Homo sapiens
gcacaggtcccacc

SEQ ID NO: 6230999 - DNA, 17 bp, Homo sapiens
gcacaggtcccacctcc

SEQ ID NO: 6231000 - DNA, 15 bp, Homo sapiens
gcacaggtgtaaata

SEQ ID NO: 6231001 - DNA, 16 bp, Homo sapiens
gcacaggtgtctgcct

SEQ ID NO: 6231002 - DNA, 15 bp, Homo sapiens
gcacaggtttgtttt

SEQ ID NO: 6231003 - DNA, 22 bp, Homo sapiens
gcacagtaaaagtaaagactat

SEQ ID NO: 6231004 - DNA, 16 bp, Homo sapiens
gcacagtaagcatgct

SEQ ID NO: 6231005 - DNA, 15 bp, Homo sapiens
gcacagtaatatgaa

SEQ ID NO: 6231006 - DNA, 15 bp, Homo sapiens
gcacagtacacacaa

SEQ ID NO: 6231007 - DNA, 23 bp, Homo sapiens
gcacagtagtgttgggtggagga

SEQ ID NO: 6231008 - DNA, 16 bp, Homo sapiens
gcacagtatctgctgt

SEQ ID NO: 6231009 - DNA, 17 bp, Homo sapiens
gacatccaagcttcctt

SEQ ID NO: 6231010 - DNA, 18 bp, Homo sapiens
gacatccacataaccctg

SEQ ID NO: 6231011 - DNA, 12 bp, Homo sapiens
gacatccacatg

SEQ ID NO: 6231012 - DNA, 15 bp, Homo sapiens
gacatccagaaagct

SEQ ID NO: 6231013 - DNA, 20 bp, Homo sapiens
gacatccataaagaagcaat

SEQ ID NO: 6231014 - DNA, 17 bp, Homo sapiens
gacatcccagaccagcc

SEQ ID NO: 6231015 - DNA, 23 bp, Homo sapiens
gacatcccaggaggggcctctga

SEQ ID NO: 6231016 - DNA, 18 bp, Homo sapiens
gacatcccctgctggccg

SEQ ID NO: 6231017 - DNA, 15 bp, Homo sapiens
gacatcccttcctgg

SEQ ID NO: 6231018 - DNA, 23 bp, Homo sapiens
gacatcccttcctggaaacagca

SEQ ID NO: 6231019 - DNA, 22 bp, Homo sapiens
gacatccgtcattgctgctgct

SEQ ID NO: 6231020 - DNA, 22 bp, Homo sapiens
gacatcctagaggtagagaaac

SEQ ID NO: 6231021 - DNA, 15 bp, Homo sapiens
gacatcctagcccca

SEQ ID NO: 6231022 - DNA, 15 bp, Homo sapiens
gacatcctcctccca

SEQ ID NO: 6231023 - DNA, 23 bp, Homo sapiens
gacatcctcttctgcttaggaga

SEQ ID NO: 6231024 - DNA, 14 bp, Homo sapiens
gacatcctgtataa

SEQ ID NO: 6231025 - DNA, 21 bp, Homo sapiens
gacatcctgtcatctgagaat

SEQ ID NO: 6231026 - DNA, 24 bp, Homo sapiens
gacatcctgtcatctgagaatgaa

SEQ ID NO: 6231027 - DNA, 15 bp, Homo sapiens
gacatccttgcagtt

SEQ ID NO: 6231028 - DNA, 13 bp, Homo sapiens
gacatcgatatga

SEQ ID NO: 6231029 - DNA, 23 bp, Homo sapiens
gacatcgccaaggactgactgag

SEQ ID NO: 6231030 - DNA, 19 bp, Homo sapiens
gacatcgtaggcagccacg

SEQ ID NO: 6231031 - DNA, 22 bp, Homo sapiens
gacatcgtaggcagccacggcc

SEQ ID NO: 6231032 - DNA, 19 bp, Homo sapiens
gacatctacctatacttaa

SEQ ID NO: 6231033 - DNA, 19 bp, Homo sapiens
gacatctccagtgtgccag

SEQ ID NO: 6231034 - DNA, 14 bp, Homo sapiens
gacatctcctggct

SEQ ID NO: 6231035 - DNA, 13 bp, Homo sapiens
gacatctctctgg

SEQ ID NO: 6231036 - DNA, 16 bp, Homo sapiens
gacatctctctggctt

SEQ ID NO: 6231037 - DNA, 16 bp, Homo sapiens
gacatctctgactttc

SEQ ID NO: 6231038 - DNA, 15 bp, Homo sapiens
gacatctctgcaccc

SEQ ID NO: 6231039 - DNA, 15 bp, Homo sapiens
gacatctctggagcc

SEQ ID NO: 6231040 - DNA, 16 bp, Homo sapiens
gacatctctttgaatt

SEQ ID NO: 6231041 - DNA, 14 bp, Homo sapiens
gacatctgaggaaa

SEQ ID NO: 6231042 - DNA, 20 bp, Homo sapiens
gacatctggaatctggagac

SEQ ID NO: 6231043 - DNA, 15 bp, Homo sapiens
gacatctgtagggaa

SEQ ID NO: 6231044 - DNA, 12 bp, Homo sapiens
gacatcttaaat

SEQ ID NO: 6231045 - DNA, 16 bp, Homo sapiens
gacatcttatttactt

SEQ ID NO: 6231046 - DNA, 21 bp, Homo sapiens
gacatcttcaaagcttgaaga

SEQ ID NO: 6231047 - DNA, 17 bp, Homo sapiens
gacatcttgtcattttt

SEQ ID NO: 6231048 - DNA, 22 bp, Homo sapiens
gacatctttaacatagtcctgt

SEQ ID NO: 6231049 - DNA, 13 bp, Homo sapiens
gacatctttttaa

SEQ ID NO: 6231050 - DNA, 16 bp, Homo sapiens
gacatgaaaactattt

SEQ ID NO: 6231051 - DNA, 15 bp, Homo sapiens
gacatgaaaagttat

SEQ ID NO: 6231052 - DNA, 17 bp, Homo sapiens
gacatgaaatgtacatg

SEQ ID NO: 6231053 - DNA, 12 bp, Homo sapiens
gacatgaagcat

SEQ ID NO: 6231054 - DNA, 20 bp, Homo sapiens
gacatgaaggtaggtaaata

SEQ ID NO: 6231055 - DNA, 14 bp, Homo sapiens
gacatgaatactat

SEQ ID NO: 6231056 - DNA, 11 bp, Homo sapiens
gacatgaattt

SEQ ID NO: 6231057 - DNA, 23 bp, Homo sapiens
gacatgaattttaaataatgtat

SEQ ID NO: 6231058 - DNA, 15 bp, Homo sapiens
gacatgaccctctgt

SEQ ID NO: 6231059 - DNA, 22 bp, Homo sapiens
gacatgacttttctggaagaca

SEQ ID NO: 6231060 - DNA, 17 bp, Homo sapiens
gacatgagtctccagat

SEQ ID NO: 6231061 - DNA, 19 bp, Homo sapiens
gacatgagtgcgtgctcag

SEQ ID NO: 6231062 - DNA, 13 bp, Homo sapiens
gacatgagtttaa

SEQ ID NO: 6231063 - DNA, 22 bp, Homo sapiens
gacatgatatagtcagctgcct

SEQ ID NO: 6231064 - DNA, 20 bp, Homo sapiens
gacatgattagcagaagaaa

SEQ ID NO: 6231065 - DNA, 20 bp, Homo sapiens
gacatgcaataaaatttaaa

SEQ ID NO: 6231066 - DNA, 15 bp, Homo sapiens
gacatgcacccgcat

SEQ ID NO: 6231067 - DNA, 22 bp, Homo sapiens
gacatgcacccgcatgtacaaa

SEQ ID NO: 6231068 - DNA, 13 bp, Homo sapiens
gacatgcactgac

SEQ ID NO: 6231069 - DNA, 16 bp, Homo sapiens
gacatgcagctctgat

SEQ ID NO: 6231070 - DNA, 19 bp, Homo sapiens
gacatgcattgttggctat

SEQ ID NO: 6231071 - DNA, 13 bp, Homo sapiens
gacatgccaccct

SEQ ID NO: 6231072 - DNA, 19 bp, Homo sapiens
gacatgccaccctctccat

SEQ ID NO: 6231073 - DNA, 21 bp, Homo sapiens
gacatgccaccctctccatgc

SEQ ID NO: 6231074 - DNA, 15 bp, Homo sapiens
gacatgccatccatt

SEQ ID NO: 6231075 - DNA, 16 bp, Homo sapiens
gacatgccctgtgtgg

SEQ ID NO: 6231076 - DNA, 18 bp, Homo sapiens
gacatgcctatatgagaa

SEQ ID NO: 6231077 - DNA, 14 bp, Homo sapiens
gacatgcctgtcct

SEQ ID NO: 6231078 - DNA, 22 bp, Homo sapiens
gacatgcctgtcctgaaagcgg

SEQ ID NO: 6231079 - DNA, 19 bp, Homo sapiens
gacatgcggcctgcatggt

SEQ ID NO: 6231080 - DNA, 22 bp, Homo sapiens
gacatgcgggctgggcagctgt

SEQ ID NO: 6231081 - DNA, 17 bp, Homo sapiens
gacatgcggtagccagc

SEQ ID NO: 6231082 - DNA, 16 bp, Homo sapiens
gacatgcgtgtgtcag

SEQ ID NO: 6231083 - DNA, 19 bp, Homo sapiens
gacatgctaacctctctga

SEQ ID NO: 6231084 - DNA, 15 bp, Homo sapiens
gacatgctcacctct

SEQ ID NO: 6231085 - DNA, 20 bp, Homo sapiens
gacatgctcacctctagcct

SEQ ID NO: 6231086 - DNA, 15 bp, Homo sapiens
gacatgctgaagcca

SEQ ID NO: 6231087 - DNA, 18 bp, Homo sapiens
gacatgctgaagccaaag

SEQ ID NO: 6231088 - DNA, 15 bp, Homo sapiens
gacatgctgactgtc

SEQ ID NO: 6231089 - DNA, 14 bp, Homo sapiens
gacatgctgacttt

SEQ ID NO: 6231090 - DNA, 12 bp, Homo sapiens
gacatgctgccc

SEQ ID NO: 6231091 - DNA, 14 bp, Homo sapiens
gacatgctgcccac

SEQ ID NO: 6231092 - DNA, 19 bp, Homo sapiens
gacatgctgcccaccccct

SEQ ID NO: 6231093 - DNA, 23 bp, Homo sapiens
gacatgctttccatttttttctt

SEQ ID NO: 6231094 - DNA, 13 bp, Homo sapiens
gacatggaaaggg

SEQ ID NO: 6231095 - DNA, 14 bp, Homo sapiens
gacatggaaatgaa

SEQ ID NO: 6231096 - DNA, 20 bp, Homo sapiens
gacatggaacagtgtaaatc

SEQ ID NO: 6231097 - DNA, 12 bp, Homo sapiens
gacatggaaggt

SEQ ID NO: 6231098 - DNA, 20 bp, Homo sapiens
gacatggaaggttagaggtt

SEQ ID NO: 6231099 - DNA, 17 bp, Homo sapiens
gacatggaccagcatct

SEQ ID NO: 6231100 - DNA, 18 bp, Homo sapiens
gacatggaccagcatctg

SEQ ID NO: 6231101 - DNA, 18 bp, Homo sapiens
gacatggacctccaggct

SEQ ID NO: 6231102 - DNA, 18 bp, Homo sapiens
gacatggaccttctctcc

SEQ ID NO: 6231103 - DNA, 17 bp, Homo sapiens
gacatggatgcgaggac

SEQ ID NO: 6231104 - DNA, 20 bp, Homo sapiens
gacatggatgcgaggaccac

SEQ ID NO: 6231105 - DNA, 17 bp, Homo sapiens
gacatggcacaggcccg

SEQ ID NO: 6231106 - DNA, 16 bp, Homo sapiens
gacatggcccattgga

SEQ ID NO: 6231107 - DNA, 16 bp, Homo sapiens
gacatgggacatttgc

SEQ ID NO: 6231108 - DNA, 22 bp, Homo sapiens
gacatgggacatttgctcatgg

SEQ ID NO: 6231109 - DNA, 22 bp, Homo sapiens
gacatgggaggggtctagctgg

SEQ ID NO: 6231110 - DNA, 11 bp, Homo sapiens
gacatgggcag

SEQ ID NO: 6231111 - DNA, 20 bp, Homo sapiens
gacatggggaaggcagaggc

SEQ ID NO: 6231112 - DNA, 23 bp, Homo sapiens
gacatggggaaggcagaggctgg

SEQ ID NO: 6231113 - DNA, 18 bp, Homo sapiens
gacatggggcaagccagg

SEQ ID NO: 6231114 - DNA, 19 bp, Homo sapiens
gacatggggcaagccaggg

SEQ ID NO: 6231115 - DNA, 20 bp, Homo sapiens
gacatggggcaagccagggc

SEQ ID NO: 6231116 - DNA, 16 bp, Homo sapiens
gacatggggcatagaa

SEQ ID NO: 6231117 - DNA, 17 bp, Homo sapiens
gacatgggtattttata

SEQ ID NO: 6231118 - DNA, 22 bp, Homo sapiens
gacatggtgagtctatttttaa

SEQ ID NO: 6231119 - DNA, 14 bp, Homo sapiens
gacatggtgcctga

SEQ ID NO: 6231120 - DNA, 18 bp, Homo sapiens
gacatggtgcctgagagg

SEQ ID NO: 6231121 - DNA, 17 bp, Homo sapiens
gacatgtaaaaagacaa

SEQ ID NO: 6231122 - DNA, 16 bp, Homo sapiens
gacatgtctacttttt

SEQ ID NO: 6231123 - DNA, 15 bp, Homo sapiens
gacatgtctgttcta

SEQ ID NO: 6231124 - DNA, 14 bp, Homo sapiens
gacatgtgaaacct

SEQ ID NO: 6231125 - DNA, 15 bp, Homo sapiens
gacatgtgaaacctt

SEQ ID NO: 6231126 - DNA, 16 bp, Homo sapiens
gacatgtgacatttat

SEQ ID NO: 6231127 - DNA, 20 bp, Homo sapiens
gacatgtgctattgaactga

SEQ ID NO: 6231128 - DNA, 23 bp, Homo sapiens
gacatgtggaaagtgaatttgaa

SEQ ID NO: 6231129 - DNA, 17 bp, Homo sapiens
gacatgtggcagcaggc

SEQ ID NO: 6231130 - DNA, 14 bp, Homo sapiens
gacatgtgggtgga

SEQ ID NO: 6231131 - DNA, 17 bp, Homo sapiens
gacatgtgggtggagaa

SEQ ID NO: 6231132 - DNA, 21 bp, Homo sapiens
gacatgtgggtggagaaggga

SEQ ID NO: 6231133 - DNA, 15 bp, Homo sapiens
gacatgttcccttct

SEQ ID NO: 6231134 - DNA, 20 bp, Homo sapiens
gacatgttttgataaagtag

SEQ ID NO: 6231135 - DNA, 17 bp, Homo sapiens
gacatgtttttatatgt

SEQ ID NO: 6231136 - DNA, 14 bp, Homo sapiens
gacatgtttttgtt

SEQ ID NO: 6231137 - DNA, 18 bp, Homo sapiens
gacatgtttttgttttct

SEQ ID NO: 6231138 - DNA, 21 bp, Homo sapiens
gacattaaatgcaataatttt

SEQ ID NO: 6231139 - DNA, 19 bp, Homo sapiens
gacattaacaaataaaaaa

SEQ ID NO: 6231140 - DNA, 18 bp, Homo sapiens
gacattaacagttttcca

SEQ ID NO: 6231141 - DNA, 19 bp, Homo sapiens
gacattaagaatgttggtt

SEQ ID NO: 6231142 - DNA, 21 bp, Homo sapiens
gacattaataaagttgctttt

SEQ ID NO: 6231143 - DNA, 22 bp, Homo sapiens
gacattagaaaaaaatgaaaca

SEQ ID NO: 6231144 - DNA, 13 bp, Homo sapiens
gacattagagaaa

SEQ ID NO: 6231145 - DNA, 17 bp, Homo sapiens
gacattagagaaaacct

SEQ ID NO: 6231146 - DNA, 23 bp, Homo sapiens
gacattagtaacataataaatta

SEQ ID NO: 6231147 - DNA, 13 bp, Homo sapiens
gacattagtttga

SEQ ID NO: 6231148 - DNA, 14 bp, Homo sapiens
gacattatagacat

SEQ ID NO: 6231149 - DNA, 20 bp, Homo sapiens
gacattatagacattgagga

SEQ ID NO: 6231150 - DNA, 13 bp, Homo sapiens
gacattatgtgtg

SEQ ID NO: 6231151 - DNA, 21 bp, Homo sapiens
gacattatgtgtgcatgtgtg

SEQ ID NO: 6231152 - DNA, 13 bp, Homo sapiens
gacattattaaag

SEQ ID NO: 6231153 - DNA, 23 bp, Homo sapiens
gacattcaccaacaacagtcagc

SEQ ID NO: 6231154 - DNA, 14 bp, Homo sapiens
gacattcactgagt

SEQ ID NO: 6231155 - DNA, 13 bp, Homo sapiens
gacattcactgct

SEQ ID NO: 6231156 - DNA, 19 bp, Homo sapiens
gacattcactgctgatttt

SEQ ID NO: 6231157 - DNA, 12 bp, Homo sapiens
gacattcactgg

SEQ ID NO: 6231158 - DNA, 19 bp, Homo sapiens
gacattcagactaaaaata

SEQ ID NO: 6231159 - DNA, 12 bp, Homo sapiens
gacattccctgc

SEQ ID NO: 6231160 - DNA, 16 bp, Homo sapiens
gacattccttgctgaa

SEQ ID NO: 6231161 - DNA, 17 bp, Homo sapiens
gacattccttgtcacca

SEQ ID NO: 6231162 - DNA, 23 bp, Homo sapiens
gacattctcttactttttgtaaa

SEQ ID NO: 6231163 - DNA, 14 bp, Homo sapiens
gacattctctttga

SEQ ID NO: 6231164 - DNA, 15 bp, Homo sapiens
gacattctctttgat

SEQ ID NO: 6231165 - DNA, 18 bp, Homo sapiens
gacattctctttgataac

SEQ ID NO: 6231166 - DNA, 21 bp, Homo sapiens
gacattctctttgataacaaa

SEQ ID NO: 6231167 - DNA, 22 bp, Homo sapiens
gacattctctttgataacaaaa

SEQ ID NO: 6231168 - DNA, 23 bp, Homo sapiens
gacattctctttgataacaaaaa

SEQ ID NO: 6231169 - DNA, 19 bp, Homo sapiens
gacattctgaatgcttcta

SEQ ID NO: 6231170 - DNA, 13 bp, Homo sapiens
gacattctgattc

SEQ ID NO: 6231171 - DNA, 17 bp, Homo sapiens
gacattctgccaggccc

SEQ ID NO: 6231172 - DNA, 22 bp, Homo sapiens
gacattctgccaggcccccaag

SEQ ID NO: 6231173 - DNA, 19 bp, Homo sapiens
gacattctgtctttcaaaa

SEQ ID NO: 6231174 - DNA, 23 bp, Homo sapiens
gacattcttagctgtaacttaac

SEQ ID NO: 6231175 - DNA, 11 bp, Homo sapiens
gacattcttcc

SEQ ID NO: 6231176 - DNA, 14 bp, Homo sapiens
gacattcttttaat

SEQ ID NO: 6231177 - DNA, 18 bp, Homo sapiens
gacattgacagcaattca

SEQ ID NO: 6231178 - DNA, 22 bp, Homo sapiens
gacattgactatttttgttttt

SEQ ID NO: 6231179 - DNA, 15 bp, Homo sapiens
gacattgaggacctc

SEQ ID NO: 6231180 - DNA, 16 bp, Homo sapiens
gacattgccccaagat

SEQ ID NO: 6231181 - DNA, 13 bp, Homo sapiens
gacattgcctcca

SEQ ID NO: 6231182 - DNA, 17 bp, Homo sapiens
gacattgcggacagcca

SEQ ID NO: 6231183 - DNA, 23 bp, Homo sapiens
gacattgcggacagccacggcca

SEQ ID NO: 6231184 - DNA, 18 bp, Homo sapiens
gacattgctaagatgctc

SEQ ID NO: 6231185 - DNA, 15 bp, Homo sapiens
gacattgctctctgg

SEQ ID NO: 6231186 - DNA, 23 bp, Homo sapiens
gacattgctttactgtcaaaata

SEQ ID NO: 6231187 - DNA, 20 bp, Homo sapiens
gcacagtatctgctgttctt

SEQ ID NO: 6231188 - DNA, 22 bp, Homo sapiens
gcacagtatctgctgttcttca

SEQ ID NO: 6231189 - DNA, 23 bp, Homo sapiens
gcacagtattatttctccatccc

SEQ ID NO: 6231190 - DNA, 11 bp, Homo sapiens
gcacagtattt

SEQ ID NO: 6231191 - DNA, 13 bp, Homo sapiens
gcacagtatttaa

SEQ ID NO: 6231192 - DNA, 16 bp, Homo sapiens
gcacagtatttaacat

SEQ ID NO: 6231193 - DNA, 17 bp, Homo sapiens
gcacagtcaggggctgg

SEQ ID NO: 6231194 - DNA, 23 bp, Homo sapiens
gcacagtccacagctgaagagca

SEQ ID NO: 6231195 - DNA, 12 bp, Homo sapiens
gcacagtccaga

SEQ ID NO: 6231196 - DNA, 16 bp, Homo sapiens
gcacagtccaggaaca

SEQ ID NO: 6231197 - DNA, 14 bp, Homo sapiens
gcacagtgaatgtg

SEQ ID NO: 6231198 - DNA, 18 bp, Homo sapiens
gcacagtgacttctgaga

SEQ ID NO: 6231199 - DNA, 17 bp, Homo sapiens
gcacagtgatgccgggc

SEQ ID NO: 6231200 - DNA, 22 bp, Homo sapiens
gcacagtgatgccgggcgccag

SEQ ID NO: 6231201 - DNA, 12 bp, Homo sapiens
gcacagtgattt

SEQ ID NO: 6231202 - DNA, 13 bp, Homo sapiens
gcacagtgcatct

SEQ ID NO: 6231203 - DNA, 15 bp, Homo sapiens
gcacagtgcatctca

SEQ ID NO: 6231204 - DNA, 21 bp, Homo sapiens
gcacagtgcatctcagcccac

SEQ ID NO: 6231205 - DNA, 15 bp, Homo sapiens
gcacagtgcctgatg

SEQ ID NO: 6231206 - DNA, 14 bp, Homo sapiens
gcacagtgcctgca

SEQ ID NO: 6231207 - DNA, 14 bp, Homo sapiens
gcacagtgctgccc

SEQ ID NO: 6231208 - DNA, 20 bp, Homo sapiens
gcacagtgctgccccttgca

SEQ ID NO: 6231209 - DNA, 13 bp, Homo sapiens
gcacagtggcaca

SEQ ID NO: 6231210 - DNA, 22 bp, Homo sapiens
gcacagtggcgcatgcctgtaa

SEQ ID NO: 6231211 - DNA, 13 bp, Homo sapiens
gcacagtggctca

SEQ ID NO: 6231212 - DNA, 13 bp, Homo sapiens
gcacagtgggagc

SEQ ID NO: 6231213 - DNA, 22 bp, Homo sapiens
gcacagtgggagctgagctgga

SEQ ID NO: 6231214 - DNA, 15 bp, Homo sapiens
gcacagtgtctgggc

SEQ ID NO: 6231215 - DNA, 22 bp, Homo sapiens
gcacagttagttgtgaaagaaa

SEQ ID NO: 6231216 - DNA, 17 bp, Homo sapiens
gcacagttctatttgct

SEQ ID NO: 6231217 - DNA, 18 bp, Homo sapiens
gcacagttggcccgggtg

SEQ ID NO: 6231218 - DNA, 19 bp, Homo sapiens
gcacagttgtctattctga

SEQ ID NO: 6231219 - DNA, 21 bp, Homo sapiens
gcacagttgtctattctgagc

SEQ ID NO: 6231220 - DNA, 22 bp, Homo sapiens
gcacagtttagaacagagggac

SEQ ID NO: 6231221 - DNA, 12 bp, Homo sapiens
gcacagtttgaa

SEQ ID NO: 6231222 - DNA, 23 bp, Homo sapiens
gcacagtttgctatttgctttag

SEQ ID NO: 6231223 - DNA, 19 bp, Homo sapiens
gcacagttttagaataagg

SEQ ID NO: 6231224 - DNA, 18 bp, Homo sapiens
gcacagttttctgagaaa

SEQ ID NO: 6231225 - DNA, 20 bp, Homo sapiens
gcacagttttctgagaaaga

SEQ ID NO: 6231226 - DNA, 22 bp, Homo sapiens
gcacagttttctgagaaagact

SEQ ID NO: 6231227 - DNA, 15 bp, Homo sapiens
gcacagtttttgtaa

SEQ ID NO: 6231228 - DNA, 10 bp, Homo sapiens
gcacataaaa

SEQ ID NO: 6231229 - DNA, 14 bp, Homo sapiens
gcacataaactttg

SEQ ID NO: 6231230 - DNA, 13 bp, Homo sapiens
gcacataatttgc

SEQ ID NO: 6231231 - DNA, 16 bp, Homo sapiens
gcacataccttcatgt

SEQ ID NO: 6231232 - DNA, 21 bp, Homo sapiens
gcacatactacctagaagtaa

SEQ ID NO: 6231233 - DNA, 22 bp, Homo sapiens
gcacatactacctagaagtaag

SEQ ID NO: 6231234 - DNA, 20 bp, Homo sapiens
gcacatagagatatgcacac

SEQ ID NO: 6231235 - DNA, 16 bp, Homo sapiens
gcacatagagcttttt

SEQ ID NO: 6231236 - DNA, 21 bp, Homo sapiens
gcacatagctatcaagtgtgc

SEQ ID NO: 6231237 - DNA, 22 bp, Homo sapiens
gcacataggctggtggccttgg

SEQ ID NO: 6231238 - DNA, 23 bp, Homo sapiens
gcacataggctggtggccttggg

SEQ ID NO: 6231239 - DNA, 17 bp, Homo sapiens
gcacatatacacacaca

SEQ ID NO: 6231240 - DNA, 15 bp, Homo sapiens
gcacatatacatcta

SEQ ID NO: 6231241 - DNA, 17 bp, Homo sapiens
gcacatatattttttac

SEQ ID NO: 6231242 - DNA, 19 bp, Homo sapiens
gcacatattagtgcagcca

SEQ ID NO: 6231243 - DNA, 20 bp, Homo sapiens
gcacatattagtgcagccaa

SEQ ID NO: 6231244 - DNA, 14 bp, Homo sapiens
gcacatattgagca

SEQ ID NO: 6231245 - DNA, 14 bp, Homo sapiens
gcacatatttcaca

SEQ ID NO: 6231246 - DNA, 21 bp, Homo sapiens
gcacatatttgcatgggaggg

SEQ ID NO: 6231247 - DNA, 14 bp, Homo sapiens
gcacatcacctctt

SEQ ID NO: 6231248 - DNA, 21 bp, Homo sapiens
gcacatcactgagaagatggc

SEQ ID NO: 6231249 - DNA, 22 bp, Homo sapiens
gcacatcactgagaagatggca

SEQ ID NO: 6231250 - DNA, 23 bp, Homo sapiens
gcacatcactgagaagatggcac

SEQ ID NO: 6231251 - DNA, 15 bp, Homo sapiens
gcacatcagaaagga

SEQ ID NO: 6231252 - DNA, 19 bp, Homo sapiens
gcacatcagcacgatttct

SEQ ID NO: 6231253 - DNA, 21 bp, Homo sapiens
gcacatcagcacgatttctgt

SEQ ID NO: 6231254 - DNA, 22 bp, Homo sapiens
gcacatcatattctattgttta

SEQ ID NO: 6231255 - DNA, 18 bp, Homo sapiens
gcacatcatgagccttca

SEQ ID NO: 6231256 - DNA, 20 bp, Homo sapiens
gcacatccaccaaactcctg

SEQ ID NO: 6231257 - DNA, 22 bp, Homo sapiens
gcacatccaccaaactcctgcc

SEQ ID NO: 6231258 - DNA, 19 bp, Homo sapiens
gcacatccaggcaatggcc

SEQ ID NO: 6231259 - DNA, 21 bp, Homo sapiens
gcacatccattcccaagaaat

SEQ ID NO: 6231260 - DNA, 16 bp, Homo sapiens
gcacatctacatgcca

SEQ ID NO: 6231261 - DNA, 16 bp, Homo sapiens
gcacatctccagaaaa

SEQ ID NO: 6231262 - DNA, 22 bp, Homo sapiens
gcacatctccagaaaaatgaaa

SEQ ID NO: 6231263 - DNA, 19 bp, Homo sapiens
gcacatctctctgccctct

SEQ ID NO: 6231264 - DNA, 13 bp, Homo sapiens
gcacatctctgct

SEQ ID NO: 6231265 - DNA, 16 bp, Homo sapiens
gcacatctctgcttga

SEQ ID NO: 6231266 - DNA, 13 bp, Homo sapiens
gcacatctgcatt

SEQ ID NO: 6231267 - DNA, 23 bp, Homo sapiens
gcacatctgggaggctggtctcc

SEQ ID NO: 6231268 - DNA, 13 bp, Homo sapiens
gcacatgaaagtt

SEQ ID NO: 6231269 - DNA, 15 bp, Homo sapiens
gcacatgaagaaata

SEQ ID NO: 6231270 - DNA, 22 bp, Homo sapiens
gcacatgacatttgtcctgcag

SEQ ID NO: 6231271 - DNA, 14 bp, Homo sapiens
gcacatgaggaggg

SEQ ID NO: 6231272 - DNA, 16 bp, Homo sapiens
gcacatgaggagggtg

SEQ ID NO: 6231273 - DNA, 16 bp, Homo sapiens
gcacatgattgtataa

SEQ ID NO: 6231274 - DNA, 14 bp, Homo sapiens
gcacatgatttcac

SEQ ID NO: 6231275 - DNA, 17 bp, Homo sapiens
gcacatgatttcacaaa

SEQ ID NO: 6231276 - DNA, 19 bp, Homo sapiens
gcacatgattttcttttgt

SEQ ID NO: 6231277 - DNA, 17 bp, Homo sapiens
gcacatgcacctaccca

SEQ ID NO: 6231278 - DNA, 21 bp, Homo sapiens
gcacatgcactactgaaattt

SEQ ID NO: 6231279 - DNA, 23 bp, Homo sapiens
gcacatgcccgggggacgcctgc

SEQ ID NO: 6231280 - DNA, 17 bp, Homo sapiens
gcacatgcctctctcag

SEQ ID NO: 6231281 - DNA, 14 bp, Homo sapiens
gcacatgcctctgt

SEQ ID NO: 6231282 - DNA, 23 bp, Homo sapiens
gcacatgctgagtctcccaaggc

SEQ ID NO: 6231283 - DNA, 16 bp, Homo sapiens
gcacatgctgtctggc

SEQ ID NO: 6231284 - DNA, 21 bp, Homo sapiens
gcacatgctgtctggccctgg

SEQ ID NO: 6231285 - DNA, 22 bp, Homo sapiens
gcacatgctgtctggccctggg

SEQ ID NO: 6231286 - DNA, 21 bp, Homo sapiens
gcacatgcttagcttatcttt

SEQ ID NO: 6231287 - DNA, 15 bp, Homo sapiens
gcacatggccataga

SEQ ID NO: 6231288 - DNA, 16 bp, Homo sapiens
gcacatggccatagag

SEQ ID NO: 6231289 - DNA, 19 bp, Homo sapiens
gcacatggccatagaggcc

SEQ ID NO: 6231290 - DNA, 14 bp, Homo sapiens
gcacatggcctgag

SEQ ID NO: 6231291 - DNA, 15 bp, Homo sapiens
gcacatgtaataaat

SEQ ID NO: 6231292 - DNA, 20 bp, Homo sapiens
gcacatgtaataaattcaaa

SEQ ID NO: 6231293 - DNA, 18 bp, Homo sapiens
gcacatgtacatatggaa

SEQ ID NO: 6231294 - DNA, 15 bp, Homo sapiens
gcacatgtattctgt

SEQ ID NO: 6231295 - DNA, 13 bp, Homo sapiens
gcacatgtcttaa

SEQ ID NO: 6231296 - DNA, 13 bp, Homo sapiens
gcacatgtgccac

SEQ ID NO: 6231297 - DNA, 15 bp, Homo sapiens
gcacatgtgccacac

SEQ ID NO: 6231298 - DNA, 21 bp, Homo sapiens
gcacatgtgccacacagtgac

SEQ ID NO: 6231299 - DNA, 23 bp, Homo sapiens
gcacatgtggttttttggtgttt

SEQ ID NO: 6231300 - DNA, 17 bp, Homo sapiens
gcacatgtgtatttata

SEQ ID NO: 6231301 - DNA, 20 bp, Homo sapiens
gcacatgttaccatgtctga

SEQ ID NO: 6231302 - DNA, 20 bp, Homo sapiens
gcacatgttactgcttcatt

SEQ ID NO: 6231303 - DNA, 21 bp, Homo sapiens
gcacatgttggaggagagagc

SEQ ID NO: 6231304 - DNA, 22 bp, Homo sapiens
gcacatgttggaggagagagcc

SEQ ID NO: 6231305 - DNA, 21 bp, Homo sapiens
gcacattaaatgactcttccc

SEQ ID NO: 6231306 - DNA, 18 bp, Homo sapiens
gcacattaactccctcca

SEQ ID NO: 6231307 - DNA, 14 bp, Homo sapiens
gcacattaactgtt

SEQ ID NO: 6231308 - DNA, 13 bp, Homo sapiens
gcacattattgta

SEQ ID NO: 6231309 - DNA, 15 bp, Homo sapiens
gcacattcatcctca

SEQ ID NO: 6231310 - DNA, 13 bp, Homo sapiens
gcacattcctggc

SEQ ID NO: 6231311 - DNA, 14 bp, Homo sapiens
gcacattctccctt

SEQ ID NO: 6231312 - DNA, 18 bp, Homo sapiens
gcacattgagctgtgcaa

SEQ ID NO: 6231313 - DNA, 17 bp, Homo sapiens
gcacattgccctgaggg

SEQ ID NO: 6231314 - DNA, 17 bp, Homo sapiens
gcacattgcctgttctg

SEQ ID NO: 6231315 - DNA, 22 bp, Homo sapiens
gcacattgcctgttctgcttcg

SEQ ID NO: 6231316 - DNA, 20 bp, Homo sapiens
gcacattggaagctcccacc

SEQ ID NO: 6231317 - DNA, 17 bp, Homo sapiens
gcacattggcagtgtgt

SEQ ID NO: 6231318 - DNA, 23 bp, Homo sapiens
gcacattgggtggggctcctggg

SEQ ID NO: 6231319 - DNA, 21 bp, Homo sapiens
gcacatttaagagacagtcac

SEQ ID NO: 6231320 - DNA, 17 bp, Homo sapiens
gcacatttaataatcag

SEQ ID NO: 6231321 - DNA, 11 bp, Homo sapiens
gcacatttcag

SEQ ID NO: 6231322 - DNA, 15 bp, Homo sapiens
gcacatttcagggag

SEQ ID NO: 6231323 - DNA, 16 bp, Homo sapiens
gcacatttccccagac

SEQ ID NO: 6231324 - DNA, 22 bp, Homo sapiens
gcacatttccccagacctgagc

SEQ ID NO: 6231325 - DNA, 16 bp, Homo sapiens
gcacatttctggattg

SEQ ID NO: 6231326 - DNA, 22 bp, Homo sapiens
gcacattttacttagctggaga

SEQ ID NO: 6231327 - DNA, 22 bp, Homo sapiens
gcacattttccacggaaacaga

SEQ ID NO: 6231328 - DNA, 18 bp, Homo sapiens
gcacattttgacacaatg

SEQ ID NO: 6231329 - DNA, 19 bp, Homo sapiens
gcacattttgtggctgttg

SEQ ID NO: 6231330 - DNA, 17 bp, Homo sapiens
gcaccaaaataagaaaa

SEQ ID NO: 6231331 - DNA, 20 bp, Homo sapiens
gcaccaaaataagaaaagat

SEQ ID NO: 6231332 - DNA, 22 bp, Homo sapiens
gcaccaaacctaagtccttcca

SEQ ID NO: 6231333 - DNA, 24 bp, Homo sapiens
gcaccaaacctaagtccttccacc

SEQ ID NO: 6231334 - DNA, 10 bp, Homo sapiens
gcaccaaaga

SEQ ID NO: 6231335 - DNA, 19 bp, Homo sapiens
gcaccaaagatgcagccgc

SEQ ID NO: 6231336 - DNA, 21 bp, Homo sapiens
gcaccaaagatgcagccgcct

SEQ ID NO: 6231337 - DNA, 21 bp, Homo sapiens
gcaccaaatcaaaatctctcc

SEQ ID NO: 6231338 - DNA, 22 bp, Homo sapiens
gcaccaaatcaaaatctctcca

SEQ ID NO: 6231339 - DNA, 16 bp, Homo sapiens
gcaccaacccagccgc

SEQ ID NO: 6231340 - DNA, 17 bp, Homo sapiens
gcaccaacctcactgcc

SEQ ID NO: 6231341 - DNA, 19 bp, Homo sapiens
gcaccaacctcactgccct

SEQ ID NO: 6231342 - DNA, 19 bp, Homo sapiens
gcaccaacctccagactca

SEQ ID NO: 6231343 - DNA, 20 bp, Homo sapiens
gcaccaacctccagactcag

SEQ ID NO: 6231344 - DNA, 14 bp, Homo sapiens
gcaccaagaaagct

SEQ ID NO: 6231345 - DNA, 17 bp, Homo sapiens
gcaccaagagccaatgg

SEQ ID NO: 6231346 - DNA, 11 bp, Homo sapiens
gcaccaagcag

SEQ ID NO: 6231347 - DNA, 23 bp, Homo sapiens
gcaccaaggcaacggcaccattg

SEQ ID NO: 6231348 - DNA, 20 bp, Homo sapiens
gcaccaagggacaggagaag

SEQ ID NO: 6231349 - DNA, 18 bp, Homo sapiens
gcaccaataaaggaggaa

SEQ ID NO: 6231350 - DNA, 19 bp, Homo sapiens
gcaccacacgcaaaccaac

SEQ ID NO: 6231351 - DNA, 17 bp, Homo sapiens
gcaccacactcagccct

SEQ ID NO: 6231352 - DNA, 23 bp, Homo sapiens
gcaccacactgggtgcgtctcca

SEQ ID NO: 6231353 - DNA, 12 bp, Homo sapiens
gcaccacagcct

SEQ ID NO: 6231354 - DNA, 13 bp, Homo sapiens
gcaccacaggctg

SEQ ID NO: 6231355 - DNA, 16 bp, Homo sapiens
gcaccaccacacagtc

SEQ ID NO: 6231356 - DNA, 20 bp, Homo sapiens
gcaccaccagccagcgcagg

SEQ ID NO: 6231357 - DNA, 17 bp, Homo sapiens
gcaccaccaggagcagc

SEQ ID NO: 6231358 - DNA, 19 bp, Homo sapiens
gcaccaccaggagcagcag

SEQ ID NO: 6231359 - DNA, 21 bp, Homo sapiens
gcaccaccaggagcagcagcc

SEQ ID NO: 6231360 - DNA, 13 bp, Homo sapiens
gcaccaccagggc

SEQ ID NO: 6231361 - DNA, 14 bp, Homo sapiens
gcaccaccagggct

SEQ ID NO: 6231362 - DNA, 19 bp, Homo sapiens
gcaccaccagggtggacca

SEQ ID NO: 6231363 - DNA, 14 bp, Homo sapiens
gcaccaccaggtct

SEQ ID NO: 6231364 - DNA, 22 bp, Homo sapiens
gacattggagaaggagatttta

SEQ ID NO: 6231365 - DNA, 12 bp, Homo sapiens
gacattgtattt

SEQ ID NO: 6231366 - DNA, 13 bp, Homo sapiens
gacattgtcaata

SEQ ID NO: 6231367 - DNA, 16 bp, Homo sapiens
gacattgtcagaatgt

SEQ ID NO: 6231368 - DNA, 18 bp, Homo sapiens
gacattgtcagaatgttg

SEQ ID NO: 6231369 - DNA, 22 bp, Homo sapiens
gacattgtcagaatgttgtgtt

SEQ ID NO: 6231370 - DNA, 20 bp, Homo sapiens
gacattgtctcccgcccccc

SEQ ID NO: 6231371 - DNA, 22 bp, Homo sapiens
gacattgttggcagcataaagg

SEQ ID NO: 6231372 - DNA, 19 bp, Homo sapiens
gacattgttggccaaagcc

SEQ ID NO: 6231373 - DNA, 13 bp, Homo sapiens
gacattgttttgc

SEQ ID NO: 6231374 - DNA, 13 bp, Homo sapiens
gacatttaaatgt

SEQ ID NO: 6231375 - DNA, 18 bp, Homo sapiens
gacatttatactcttttt

SEQ ID NO: 6231376 - DNA, 20 bp, Homo sapiens
gacatttatattaaataaca

SEQ ID NO: 6231377 - DNA, 13 bp, Homo sapiens
gacatttatcttt

SEQ ID NO: 6231378 - DNA, 15 bp, Homo sapiens
gacatttcaaataac

SEQ ID NO: 6231379 - DNA, 18 bp, Homo sapiens
gacatttcactaaaagtc

SEQ ID NO: 6231380 - DNA, 16 bp, Homo sapiens
gacatttcatctgggt

SEQ ID NO: 6231381 - DNA, 15 bp, Homo sapiens
gacatttccaagctg

SEQ ID NO: 6231382 - DNA, 14 bp, Homo sapiens
gacatttccctcct

SEQ ID NO: 6231383 - DNA, 16 bp, Homo sapiens
gacatttccctcctgg

SEQ ID NO: 6231384 - DNA, 24 bp, Homo sapiens
gacatttccctcctgggagagaag

SEQ ID NO: 6231385 - DNA, 22 bp, Homo sapiens
gacatttcggaagtggtgggga

SEQ ID NO: 6231386 - DNA, 13 bp, Homo sapiens
gacatttctctaa

SEQ ID NO: 6231387 - DNA, 18 bp, Homo sapiens
gacatttctgctctcagc

SEQ ID NO: 6231388 - DNA, 14 bp, Homo sapiens
gacatttcttcccc

SEQ ID NO: 6231389 - DNA, 13 bp, Homo sapiens
gacatttctttgg

SEQ ID NO: 6231390 - DNA, 14 bp, Homo sapiens
gacatttctttgga

SEQ ID NO: 6231391 - DNA, 22 bp, Homo sapiens
gacatttcttttctttttacat

SEQ ID NO: 6231392 - DNA, 21 bp, Homo sapiens
gacatttgatagaaaggaaca

SEQ ID NO: 6231393 - DNA, 16 bp, Homo sapiens
gacatttgctcatgga

SEQ ID NO: 6231394 - DNA, 22 bp, Homo sapiens
gacatttgctgaactcagcaca

SEQ ID NO: 6231395 - DNA, 16 bp, Homo sapiens
gacatttggagagggg

SEQ ID NO: 6231396 - DNA, 20 bp, Homo sapiens
gacatttgggactgtcttga

SEQ ID NO: 6231397 - DNA, 12 bp, Homo sapiens
gacatttgtcat

SEQ ID NO: 6231398 - DNA, 19 bp, Homo sapiens
gacatttgtcattttcatt

SEQ ID NO: 6231399 - DNA, 20 bp, Homo sapiens
gacatttgtcattttcatta

SEQ ID NO: 6231400 - DNA, 17 bp, Homo sapiens
gacatttgtgtggaaat

SEQ ID NO: 6231401 - DNA, 20 bp, Homo sapiens
gacattttaaaaaatggtca

SEQ ID NO: 6231402 - DNA, 15 bp, Homo sapiens
gacattttaacaaga

SEQ ID NO: 6231403 - DNA, 23 bp, Homo sapiens
gacattttaagtttgtagtaaaa

SEQ ID NO: 6231404 - DNA, 15 bp, Homo sapiens
gacattttatgtctt

SEQ ID NO: 6231405 - DNA, 11 bp, Homo sapiens
gacattttatt

SEQ ID NO: 6231406 - DNA, 14 bp, Homo sapiens
gacattttcaataa

SEQ ID NO: 6231407 - DNA, 18 bp, Homo sapiens
gacattttcatgcttcca

SEQ ID NO: 6231408 - DNA, 16 bp, Homo sapiens
gacattttctcttaga

SEQ ID NO: 6231409 - DNA, 20 bp, Homo sapiens
gacattttctttcatgggca

SEQ ID NO: 6231410 - DNA, 17 bp, Homo sapiens
gacattttcttttatta

SEQ ID NO: 6231411 - DNA, 17 bp, Homo sapiens
gacattttgccaaaatt

SEQ ID NO: 6231412 - DNA, 18 bp, Homo sapiens
gacattttggggttttat

SEQ ID NO: 6231413 - DNA, 17 bp, Homo sapiens
gacattttgtagctagt

SEQ ID NO: 6231414 - DNA, 18 bp, Homo sapiens
gacattttgtagctagtt

SEQ ID NO: 6231415 - DNA, 22 bp, Homo sapiens
gacattttgtagctagtttaaa

SEQ ID NO: 6231416 - DNA, 23 bp, Homo sapiens
gacattttgtgtgagacttaaaa

SEQ ID NO: 6231417 - DNA, 13 bp, Homo sapiens
gacatttttcatt

SEQ ID NO: 6231418 - DNA, 16 bp, Homo sapiens
gacatttttcattcat

SEQ ID NO: 6231419 - DNA, 18 bp, Homo sapiens
gacatttttcattcatga

SEQ ID NO: 6231420 - DNA, 22 bp, Homo sapiens
gacatttttcattcatgaatat

SEQ ID NO: 6231421 - DNA, 19 bp, Homo sapiens
gacatttttccggagaaga

SEQ ID NO: 6231422 - DNA, 23 bp, Homo sapiens
gacatttttccgtttgcttttgt

SEQ ID NO: 6231423 - DNA, 13 bp, Homo sapiens
gacatttttcctc

SEQ ID NO: 6231424 - DNA, 12 bp, Homo sapiens
gacatttttgtc

SEQ ID NO: 6231425 - DNA, 14 bp, Homo sapiens
gacatttttgtgcc

SEQ ID NO: 6231426 - DNA, 23 bp, Homo sapiens
gaccaaaaaaaagcatgaatatt

SEQ ID NO: 6231427 - DNA, 18 bp, Homo sapiens
gaccaaaaaacctcactg

SEQ ID NO: 6231428 - DNA, 19 bp, Homo sapiens
gaccaaaaaacctcactgg

SEQ ID NO: 6231429 - DNA, 23 bp, Homo sapiens
gaccaaaaaacctcactgggcct

SEQ ID NO: 6231430 - DNA, 13 bp, Homo sapiens
gaccaaaaaccag

SEQ ID NO: 6231431 - DNA, 19 bp, Homo sapiens
gaccaaaaccagagggcag

SEQ ID NO: 6231432 - DNA, 20 bp, Homo sapiens
gaccaaaaccagagggcagt

SEQ ID NO: 6231433 - DNA, 13 bp, Homo sapiens
gaccaaacctagc

SEQ ID NO: 6231434 - DNA, 18 bp, Homo sapiens
gaccaaactacttcattt

SEQ ID NO: 6231435 - DNA, 13 bp, Homo sapiens
gaccaaactgtgg

SEQ ID NO: 6231436 - DNA, 18 bp, Homo sapiens
gaccaaagactgcagaac

SEQ ID NO: 6231437 - DNA, 21 bp, Homo sapiens
gaccaaagacttgttaaatgt

SEQ ID NO: 6231438 - DNA, 22 bp, Homo sapiens
gaccaaagacttgttaaatgta

SEQ ID NO: 6231439 - DNA, 17 bp, Homo sapiens
gaccaaagccacctgct

SEQ ID NO: 6231440 - DNA, 18 bp, Homo sapiens
gaccaaagccacctgctg

SEQ ID NO: 6231441 - DNA, 20 bp, Homo sapiens
gaccaaagggaagtgaggcc

SEQ ID NO: 6231442 - DNA, 16 bp, Homo sapiens
gaccaaagggagtctg

SEQ ID NO: 6231443 - DNA, 12 bp, Homo sapiens
gaccaaaggggg

SEQ ID NO: 6231444 - DNA, 13 bp, Homo sapiens
gaccaaagtccct

SEQ ID NO: 6231445 - DNA, 17 bp, Homo sapiens
gaccaaagtcccttcct

SEQ ID NO: 6231446 - DNA, 16 bp, Homo sapiens
gaccaaagtttgcaac

SEQ ID NO: 6231447 - DNA, 17 bp, Homo sapiens
gaccaaagtttgcaact

SEQ ID NO: 6231448 - DNA, 18 bp, Homo sapiens
gaccaaataattaaaaga

SEQ ID NO: 6231449 - DNA, 21 bp, Homo sapiens
gaccaaatcacccaatcccag

SEQ ID NO: 6231450 - DNA, 17 bp, Homo sapiens
gaccaaatgtaaaatat

SEQ ID NO: 6231451 - DNA, 23 bp, Homo sapiens
gaccaaattccttggcatgcctt

SEQ ID NO: 6231452 - DNA, 15 bp, Homo sapiens
gaccaaattgcttct

SEQ ID NO: 6231453 - DNA, 16 bp, Homo sapiens
gaccaaattgcttcta

SEQ ID NO: 6231454 - DNA, 17 bp, Homo sapiens
gaccaacaagggcagtg

SEQ ID NO: 6231455 - DNA, 17 bp, Homo sapiens
gaccaacatggagaaac

SEQ ID NO: 6231456 - DNA, 21 bp, Homo sapiens
gaccaacatggagaaaccctg

SEQ ID NO: 6231457 - DNA, 17 bp, Homo sapiens
gaccaacccatgccctg

SEQ ID NO: 6231458 - DNA, 19 bp, Homo sapiens
gaccaacccatgccctgcc

SEQ ID NO: 6231459 - DNA, 14 bp, Homo sapiens
gaccaaccctggga

SEQ ID NO: 6231460 - DNA, 17 bp, Homo sapiens
gaccaaccctgtttcct

SEQ ID NO: 6231461 - DNA, 13 bp, Homo sapiens
gaccaacctgacc

SEQ ID NO: 6231462 - DNA, 20 bp, Homo sapiens
gaccaacctgctctgtcccc

SEQ ID NO: 6231463 - DNA, 20 bp, Homo sapiens
gaccaactagacattctgtc

SEQ ID NO: 6231464 - DNA, 17 bp, Homo sapiens
gaccaactgccctaagc

SEQ ID NO: 6231465 - DNA, 16 bp, Homo sapiens
gaccaactggcttctg

SEQ ID NO: 6231466 - DNA, 17 bp, Homo sapiens
gaccaactggcttctgt

SEQ ID NO: 6231467 - DNA, 22 bp, Homo sapiens
gaccaactggcttctgtgcact

SEQ ID NO: 6231468 - DNA, 12 bp, Homo sapiens
gaccaactgtgt

SEQ ID NO: 6231469 - DNA, 10 bp, Homo sapiens
gaccaagaat

SEQ ID NO: 6231470 - DNA, 21 bp, Homo sapiens
gaccaagactgagccagctta

SEQ ID NO: 6231471 - DNA, 15 bp, Homo sapiens
gaccaagagagaaag

SEQ ID NO: 6231472 - DNA, 23 bp, Homo sapiens
gaccaagatgggcacatgaggag

SEQ ID NO: 6231473 - DNA, 16 bp, Homo sapiens
gaccaagcaggaagct

SEQ ID NO: 6231474 - DNA, 19 bp, Homo sapiens
gaccaagcaggaagctcag

SEQ ID NO: 6231475 - DNA, 18 bp, Homo sapiens
gaccaagccggtgcccac

SEQ ID NO: 6231476 - DNA, 20 bp, Homo sapiens
gaccaagcggctcaagaata

SEQ ID NO: 6231477 - DNA, 23 bp, Homo sapiens
gaccaagcttaaggagaggagag

SEQ ID NO: 6231478 - DNA, 20 bp, Homo sapiens
gaccaagcttagtcctggga

SEQ ID NO: 6231479 - DNA, 16 bp, Homo sapiens
gaccaaggaacaaaaa

SEQ ID NO: 6231480 - DNA, 14 bp, Homo sapiens
gaccaaggaacaag

SEQ ID NO: 6231481 - DNA, 16 bp, Homo sapiens
gaccaaggaacaagac

SEQ ID NO: 6231482 - DNA, 18 bp, Homo sapiens
gaccaaggaacaagaccc

SEQ ID NO: 6231483 - DNA, 23 bp, Homo sapiens
gaccaaggaacaagacccccagg

SEQ ID NO: 6231484 - DNA, 13 bp, Homo sapiens
gaccaaggacccc

SEQ ID NO: 6231485 - DNA, 15 bp, Homo sapiens
gaccaagggcagagg

SEQ ID NO: 6231486 - DNA, 17 bp, Homo sapiens
gaccaaggtgaagcaaa

SEQ ID NO: 6231487 - DNA, 18 bp, Homo sapiens
gaccaaggttccagctca

SEQ ID NO: 6231488 - DNA, 17 bp, Homo sapiens
gaccaagtataaacttt

SEQ ID NO: 6231489 - DNA, 18 bp, Homo sapiens
gaccaagtccaagcccgt

SEQ ID NO: 6231490 - DNA, 12 bp, Homo sapiens
gaccaagtctct

SEQ ID NO: 6231491 - DNA, 23 bp, Homo sapiens
gaccaagtctctctaagacaaat

SEQ ID NO: 6231492 - DNA, 21 bp, Homo sapiens
gaccaagttataaatcaatgt

SEQ ID NO: 6231493 - DNA, 18 bp, Homo sapiens
gaccaataaatttgtaac

SEQ ID NO: 6231494 - DNA, 16 bp, Homo sapiens
gaccaatacatttgta

SEQ ID NO: 6231495 - DNA, 16 bp, Homo sapiens
gaccaatagcccacag

SEQ ID NO: 6231496 - DNA, 17 bp, Homo sapiens
gaccaatccccagccta

SEQ ID NO: 6231497 - DNA, 18 bp, Homo sapiens
gaccaatcgggagtagca

SEQ ID NO: 6231498 - DNA, 15 bp, Homo sapiens
gaccaatctctgtga

SEQ ID NO: 6231499 - DNA, 18 bp, Homo sapiens
gaccaatgggtttgccaa

SEQ ID NO: 6231500 - DNA, 20 bp, Homo sapiens
gaccaattattgatatatat

SEQ ID NO: 6231501 - DNA, 15 bp, Homo sapiens
gaccaattgaagcat

SEQ ID NO: 6231502 - DNA, 16 bp, Homo sapiens
gaccaattgccctgcc

SEQ ID NO: 6231503 - DNA, 15 bp, Homo sapiens
gaccaattgtgctgc

SEQ ID NO: 6231504 - DNA, 18 bp, Homo sapiens
gaccaattgtgctgccat

SEQ ID NO: 6231505 - DNA, 19 bp, Homo sapiens
gaccaatttatgggagaat

SEQ ID NO: 6231506 - DNA, 20 bp, Homo sapiens
gaccaatttgcaccagtttt

SEQ ID NO: 6231507 - DNA, 14 bp, Homo sapiens
gaccacaacatgag

SEQ ID NO: 6231508 - DNA, 16 bp, Homo sapiens
gaccacacagtcccca

SEQ ID NO: 6231509 - DNA, 21 bp, Homo sapiens
gaccacacatttgtgtaaaca

SEQ ID NO: 6231510 - DNA, 19 bp, Homo sapiens
gaccacaccaaccaggcct

SEQ ID NO: 6231511 - DNA, 16 bp, Homo sapiens
gaccacaccctgtact

SEQ ID NO: 6231512 - DNA, 17 bp, Homo sapiens
gaccacacctccctgaa

SEQ ID NO: 6231513 - DNA, 20 bp, Homo sapiens
gaccacacctccctgaacca

SEQ ID NO: 6231514 - DNA, 16 bp, Homo sapiens
gaccacacctgcctct

SEQ ID NO: 6231515 - DNA, 18 bp, Homo sapiens
gaccacaccttggccttc

SEQ ID NO: 6231516 - DNA, 20 bp, Homo sapiens
gaccacacgcaggcctccct

SEQ ID NO: 6231517 - DNA, 18 bp, Homo sapiens
gaccacacttcctgtcca

SEQ ID NO: 6231518 - DNA, 20 bp, Homo sapiens
gaccacacttcctgtccaga

SEQ ID NO: 6231519 - DNA, 13 bp, Homo sapiens
gaccacagaggct

SEQ ID NO: 6231520 - DNA, 22 bp, Homo sapiens
gaccacagaggctgtggtcaga

SEQ ID NO: 6231521 - DNA, 17 bp, Homo sapiens
gaccacagccgggtgtg

SEQ ID NO: 6231522 - DNA, 19 bp, Homo sapiens
gaccacagctgctggccag

SEQ ID NO: 6231523 - DNA, 21 bp, Homo sapiens
gaccacagctgctggccaggg

SEQ ID NO: 6231524 - DNA, 21 bp, Homo sapiens
gaccacaggcatctacacagc

SEQ ID NO: 6231525 - DNA, 21 bp, Homo sapiens
gaccacaggtgcacgccacca

SEQ ID NO: 6231526 - DNA, 23 bp, Homo sapiens
gaccacaggtgcccgccaccaca

SEQ ID NO: 6231527 - DNA, 22 bp, Homo sapiens
gaccacagtgggtggcacctcc

SEQ ID NO: 6231528 - DNA, 13 bp, Homo sapiens
gaccacatccacc

SEQ ID NO: 6231529 - DNA, 16 bp, Homo sapiens
gaccacatccacccca

SEQ ID NO: 6231530 - DNA, 20 bp, Homo sapiens
gaccacatccaccccagccc

SEQ ID NO: 6231531 - DNA, 15 bp, Homo sapiens
gaccacatgccactg

SEQ ID NO: 6231532 - DNA, 18 bp, Homo sapiens
gaccacatgccactgcct

SEQ ID NO: 6231533 - DNA, 20 bp, Homo sapiens
gaccacatgccactgcctgc

SEQ ID NO: 6231534 - DNA, 18 bp, Homo sapiens
gaccacattttatattta

SEQ ID NO: 6231535 - DNA, 12 bp, Homo sapiens
gaccaccaacac

SEQ ID NO: 6231536 - DNA, 17 bp, Homo sapiens
gaccaccaacacacagg

SEQ ID NO: 6231537 - DNA, 19 bp, Homo sapiens
gaccaccaacacacaggaa

SEQ ID NO: 6231538 - DNA, 12 bp, Homo sapiens
gaccaccaagcc

SEQ ID NO: 6231539 - DNA, 14 bp, Homo sapiens
gaccaccaagcctt

SEQ ID NO: 6231540 - DNA, 16 bp, Homo sapiens
gaccaccagccccagc

SEQ ID NO: 6231541 - DNA, 19 bp, Homo sapiens
gaccaccagccccagcaag

SEQ ID NO: 6231542 - DNA, 15 bp, Homo sapiens
gcaccaccaggtctc

SEQ ID NO: 6231543 - DNA, 19 bp, Homo sapiens
gcaccaccatttaatttca

SEQ ID NO: 6231544 - DNA, 17 bp, Homo sapiens
gcaccacccatggagag

SEQ ID NO: 6231545 - DNA, 21 bp, Homo sapiens
gcaccacccccagtcccccca

SEQ ID NO: 6231546 - DNA, 15 bp, Homo sapiens
gcaccaccctccttc

SEQ ID NO: 6231547 - DNA, 19 bp, Homo sapiens
gcaccaccgaccaactcca

SEQ ID NO: 6231548 - DNA, 21 bp, Homo sapiens
gcaccaccgaccaactccaga

SEQ ID NO: 6231549 - DNA, 22 bp, Homo sapiens
gcaccaccgaccaactccagac

SEQ ID NO: 6231550 - DNA, 20 bp, Homo sapiens
gcaccacggcgtttttttac

SEQ ID NO: 6231551 - DNA, 13 bp, Homo sapiens
gcaccactctggg

SEQ ID NO: 6231552 - DNA, 14 bp, Homo sapiens
gcaccactctgggc

SEQ ID NO: 6231553 - DNA, 14 bp, Homo sapiens
gcaccactgcactc

SEQ ID NO: 6231554 - DNA, 22 bp, Homo sapiens
gcaccactgcactccagcctgg

SEQ ID NO: 6231555 - DNA, 23 bp, Homo sapiens
gcaccactgcactccagcctggg

SEQ ID NO: 6231556 - DNA, 21 bp, Homo sapiens
gcaccactgctgaggagtctg

SEQ ID NO: 6231557 - DNA, 15 bp, Homo sapiens
gcaccactgcttccc

SEQ ID NO: 6231558 - DNA, 16 bp, Homo sapiens
gcaccagacacccagg

SEQ ID NO: 6231559 - DNA, 18 bp, Homo sapiens
gcaccagacacccaggac

SEQ ID NO: 6231560 - DNA, 20 bp, Homo sapiens
gcaccagacacccaggactt

SEQ ID NO: 6231561 - DNA, 15 bp, Homo sapiens
gcaccagaggctgca

SEQ ID NO: 6231562 - DNA, 22 bp, Homo sapiens
gcaccagagtgaaagggctatg

SEQ ID NO: 6231563 - DNA, 16 bp, Homo sapiens
gcaccagatgacacat

SEQ ID NO: 6231564 - DNA, 17 bp, Homo sapiens
gcaccagatgcaacctc

SEQ ID NO: 6231565 - DNA, 23 bp, Homo sapiens
gcaccagatgggatgggctttct

SEQ ID NO: 6231566 - DNA, 16 bp, Homo sapiens
gcaccagcagcctgga

SEQ ID NO: 6231567 - DNA, 11 bp, Homo sapiens
gcaccagccag

SEQ ID NO: 6231568 - DNA, 12 bp, Homo sapiens
gcaccagccagc

SEQ ID NO: 6231569 - DNA, 14 bp, Homo sapiens
gcaccagccccctg

SEQ ID NO: 6231570 - DNA, 17 bp, Homo sapiens
gcaccagccccctggat

SEQ ID NO: 6231571 - DNA, 15 bp, Homo sapiens
gcaccagcccttccc

SEQ ID NO: 6231572 - DNA, 20 bp, Homo sapiens
gcaccagcccttccctgctt

SEQ ID NO: 6231573 - DNA, 14 bp, Homo sapiens
gcaccagcctcagt

SEQ ID NO: 6231574 - DNA, 20 bp, Homo sapiens
gcaccagcctcagtgcagcc

SEQ ID NO: 6231575 - DNA, 16 bp, Homo sapiens
gcaccagcctgagcca

SEQ ID NO: 6231576 - DNA, 19 bp, Homo sapiens
gcaccagcctgagccacag

SEQ ID NO: 6231577 - DNA, 17 bp, Homo sapiens
gcaccagcgaagggagt

SEQ ID NO: 6231578 - DNA, 17 bp, Homo sapiens
gcaccagcgcccccaga

SEQ ID NO: 6231579 - DNA, 12 bp, Homo sapiens
gcaccagctctg

SEQ ID NO: 6231580 - DNA, 15 bp, Homo sapiens
gcaccagctctgtgg

SEQ ID NO: 6231581 - DNA, 18 bp, Homo sapiens
gcaccagctctgtggcct

SEQ ID NO: 6231582 - DNA, 11 bp, Homo sapiens
gcaccagctgc

SEQ ID NO: 6231583 - DNA, 18 bp, Homo sapiens
gcaccagctgctctgccc

SEQ ID NO: 6231584 - DNA, 19 bp, Homo sapiens
gcaccagcttctccaggct

SEQ ID NO: 6231585 - DNA, 20 bp, Homo sapiens
gcaccagggcgctgggaagg

SEQ ID NO: 6231586 - DNA, 21 bp, Homo sapiens
gcaccaggggtgcacaataaa

SEQ ID NO: 6231587 - DNA, 19 bp, Homo sapiens
gcaccaggggtttctcgca

SEQ ID NO: 6231588 - DNA, 18 bp, Homo sapiens
gcaccagtgccgcctgtg

SEQ ID NO: 6231589 - DNA, 19 bp, Homo sapiens
gcaccagtgtcctcccctc

SEQ ID NO: 6231590 - DNA, 18 bp, Homo sapiens
gcaccagttatgtttgaa

SEQ ID NO: 6231591 - DNA, 22 bp, Homo sapiens
gcaccagttgctgcttcaattt

SEQ ID NO: 6231592 - DNA, 21 bp, Homo sapiens
gcaccagttttatccataatg

SEQ ID NO: 6231593 - DNA, 22 bp, Homo sapiens
gcaccataaccaagaaatacta

SEQ ID NO: 6231594 - DNA, 12 bp, Homo sapiens
gcaccataactt

SEQ ID NO: 6231595 - DNA, 20 bp, Homo sapiens
gcaccatactccttgcttcc

SEQ ID NO: 6231596 - DNA, 20 bp, Homo sapiens
gcaccatcacaatacagata

SEQ ID NO: 6231597 - DNA, 14 bp, Homo sapiens
gcaccatcagcctg

SEQ ID NO: 6231598 - DNA, 18 bp, Homo sapiens
gcaccatccaccctgcag

SEQ ID NO: 6231599 - DNA, 19 bp, Homo sapiens
gcaccatccaccctgcagg

SEQ ID NO: 6231600 - DNA, 16 bp, Homo sapiens
gcaccatccagctccc

SEQ ID NO: 6231601 - DNA, 17 bp, Homo sapiens
gcaccatccagctcccc

SEQ ID NO: 6231602 - DNA, 14 bp, Homo sapiens
gcaccatccctttt

SEQ ID NO: 6231603 - DNA, 21 bp, Homo sapiens
gcaccatccctttttgaagtg

SEQ ID NO: 6231604 - DNA, 17 bp, Homo sapiens
gcaccatccgccagggc

SEQ ID NO: 6231605 - DNA, 19 bp, Homo sapiens
gcaccatccgccagggccc

SEQ ID NO: 6231606 - DNA, 17 bp, Homo sapiens
gcaccatctctcctcct

SEQ ID NO: 6231607 - DNA, 13 bp, Homo sapiens
gcaccatctgcca

SEQ ID NO: 6231608 - DNA, 15 bp, Homo sapiens
gcaccatctgcttgg

SEQ ID NO: 6231609 - DNA, 17 bp, Homo sapiens
gcaccatcttacagaga

SEQ ID NO: 6231610 - DNA, 20 bp, Homo sapiens
gcaccatcttacagagactc

SEQ ID NO: 6231611 - DNA, 20 bp, Homo sapiens
gcaccatgctgctggggaag

SEQ ID NO: 6231612 - DNA, 16 bp, Homo sapiens
gcaccatgctgggccg

SEQ ID NO: 6231613 - DNA, 20 bp, Homo sapiens
gcaccatgctgggccggggt

SEQ ID NO: 6231614 - DNA, 19 bp, Homo sapiens
gcaccatggaggcaggctc

SEQ ID NO: 6231615 - DNA, 19 bp, Homo sapiens
gcaccatgttggcctcttc

SEQ ID NO: 6231616 - DNA, 15 bp, Homo sapiens
gcaccattcaggaac

SEQ ID NO: 6231617 - DNA, 22 bp, Homo sapiens
gcaccattcaggaacctggacc

SEQ ID NO: 6231618 - DNA, 16 bp, Homo sapiens
gcaccattctcctgcc

SEQ ID NO: 6231619 - DNA, 22 bp, Homo sapiens
gcaccattctttcttggtgcat

SEQ ID NO: 6231620 - DNA, 14 bp, Homo sapiens
gcaccattgctgct

SEQ ID NO: 6231621 - DNA, 22 bp, Homo sapiens
gcaccattgctgctccttagct

SEQ ID NO: 6231622 - DNA, 22 bp, Homo sapiens
gcaccattgcttaaaagaaagt

SEQ ID NO: 6231623 - DNA, 15 bp, Homo sapiens
gcaccattttgtcag

SEQ ID NO: 6231624 - DNA, 15 bp, Homo sapiens
gcacccaaagggtta

SEQ ID NO: 6231625 - DNA, 22 bp, Homo sapiens
gcacccacaagcccgtgacaga

SEQ ID NO: 6231626 - DNA, 12 bp, Homo sapiens
gcacccacacag

SEQ ID NO: 6231627 - DNA, 15 bp, Homo sapiens
gcacccacagccgca

SEQ ID NO: 6231628 - DNA, 17 bp, Homo sapiens
gcacccaccactctcag

SEQ ID NO: 6231629 - DNA, 19 bp, Homo sapiens
gcacccaccactctcagga

SEQ ID NO: 6231630 - DNA, 11 bp, Homo sapiens
gcacccaccca

SEQ ID NO: 6231631 - DNA, 14 bp, Homo sapiens
gcacccacccatgc

SEQ ID NO: 6231632 - DNA, 12 bp, Homo sapiens
gcacccacccct

SEQ ID NO: 6231633 - DNA, 13 bp, Homo sapiens
gcacccaccctgg

SEQ ID NO: 6231634 - DNA, 14 bp, Homo sapiens
gcacccaccctggg

SEQ ID NO: 6231635 - DNA, 12 bp, Homo sapiens
gcacccaccgtc

SEQ ID NO: 6231636 - DNA, 15 bp, Homo sapiens
gcacccactcaccag

SEQ ID NO: 6231637 - DNA, 12 bp, Homo sapiens
gcacccactgga

SEQ ID NO: 6231638 - DNA, 22 bp, Homo sapiens
gcacccactgtgcaccaggcac

SEQ ID NO: 6231639 - DNA, 12 bp, Homo sapiens
gcacccagagca

SEQ ID NO: 6231640 - DNA, 17 bp, Homo sapiens
gcacccagagcaccccc

SEQ ID NO: 6231641 - DNA, 13 bp, Homo sapiens
gcacccagccaaa

SEQ ID NO: 6231642 - DNA, 11 bp, Homo sapiens
gcacccagccc

SEQ ID NO: 6231643 - DNA, 13 bp, Homo sapiens
gcacccagccctg

SEQ ID NO: 6231644 - DNA, 21 bp, Homo sapiens
gcacccagcctctagggaccc

SEQ ID NO: 6231645 - DNA, 13 bp, Homo sapiens
gcacccaggcagg

SEQ ID NO: 6231646 - DNA, 23 bp, Homo sapiens
gcacccaggcaggtgcagggaag

SEQ ID NO: 6231647 - DNA, 16 bp, Homo sapiens
gcacccaggcctccct

SEQ ID NO: 6231648 - DNA, 20 bp, Homo sapiens
gcacccaggcctccctgcag

SEQ ID NO: 6231649 - DNA, 13 bp, Homo sapiens
gcacccaggctcc

SEQ ID NO: 6231650 - DNA, 14 bp, Homo sapiens
gcacccaggctcca

SEQ ID NO: 6231651 - DNA, 16 bp, Homo sapiens
gcacccaggctccatg

SEQ ID NO: 6231652 - DNA, 17 bp, Homo sapiens
gcacccaggctccatgg

SEQ ID NO: 6231653 - DNA, 19 bp, Homo sapiens
gcacccaggctccatgggg

SEQ ID NO: 6231654 - DNA, 23 bp, Homo sapiens
gcacccagtgagcactcccaagt

SEQ ID NO: 6231655 - DNA, 16 bp, Homo sapiens
gcacccatccaccgtc

SEQ ID NO: 6231656 - DNA, 23 bp, Homo sapiens
gcacccatccaccgtcccctccc

SEQ ID NO: 6231657 - DNA, 17 bp, Homo sapiens
gcaccccaaagctttcc

SEQ ID NO: 6231658 - DNA, 20 bp, Homo sapiens
gcaccccaaagctttcctgc

SEQ ID NO: 6231659 - DNA, 15 bp, Homo sapiens
gcaccccaagtccag

SEQ ID NO: 6231660 - DNA, 11 bp, Homo sapiens
gcaccccacag

SEQ ID NO: 6231661 - DNA, 12 bp, Homo sapiens
gcaccccacagc

SEQ ID NO: 6231662 - DNA, 14 bp, Homo sapiens
gcaccccacagctg

SEQ ID NO: 6231663 - DNA, 17 bp, Homo sapiens
gcaccccacagctgggg

SEQ ID NO: 6231664 - DNA, 13 bp, Homo sapiens
gcaccccacgccc

SEQ ID NO: 6231665 - DNA, 13 bp, Homo sapiens
gcaccccactcct

SEQ ID NO: 6231666 - DNA, 17 bp, Homo sapiens
gcaccccactcctcagt

SEQ ID NO: 6231667 - DNA, 15 bp, Homo sapiens
gcaccccactgggag

SEQ ID NO: 6231668 - DNA, 19 bp, Homo sapiens
gcaccccagcgtcaggcct

SEQ ID NO: 6231669 - DNA, 14 bp, Homo sapiens
gcaccccagctacc

SEQ ID NO: 6231670 - DNA, 20 bp, Homo sapiens
gcaccccagctaccccttct

SEQ ID NO: 6231671 - DNA, 16 bp, Homo sapiens
gcaccccaggcagctc

SEQ ID NO: 6231672 - DNA, 19 bp, Homo sapiens
gcaccccaggcagctcctg

SEQ ID NO: 6231673 - DNA, 17 bp, Homo sapiens
gcaccccatgctgttga

SEQ ID NO: 6231674 - DNA, 23 bp, Homo sapiens
gcacccccacaagctgtccctgc

SEQ ID NO: 6231675 - DNA, 12 bp, Homo sapiens
gcacccccaccc

SEQ ID NO: 6231676 - DNA, 18 bp, Homo sapiens
gcacccccacccacctcc

SEQ ID NO: 6231677 - DNA, 20 bp, Homo sapiens
gcacccccaccccctgccca

SEQ ID NO: 6231678 - DNA, 15 bp, Homo sapiens
gcacccccacgccct

SEQ ID NO: 6231679 - DNA, 22 bp, Homo sapiens
gcacccccactttcgcctcctc

SEQ ID NO: 6231680 - DNA, 23 bp, Homo sapiens
gcacccccactttcgcctcctcc

SEQ ID NO: 6231681 - DNA, 13 bp, Homo sapiens
gcacccccagcct

SEQ ID NO: 6231682 - DNA, 14 bp, Homo sapiens
gcacccccagcctg

SEQ ID NO: 6231683 - DNA, 20 bp, Homo sapiens
gcacccccagcctgggccta

SEQ ID NO: 6231684 - DNA, 22 bp, Homo sapiens
gcacccccaggacagcacacgg

SEQ ID NO: 6231685 - DNA, 20 bp, Homo sapiens
gcacccccaggattcccaga

SEQ ID NO: 6231686 - DNA, 17 bp, Homo sapiens
gcacccccatgctgcct

SEQ ID NO: 6231687 - DNA, 14 bp, Homo sapiens
gcacccccctgggc

SEQ ID NO: 6231688 - DNA, 16 bp, Homo sapiens
gcacccccctgtgcct

SEQ ID NO: 6231689 - DNA, 19 bp, Homo sapiens
gcacccccctgtgcctgct

SEQ ID NO: 6231690 - DNA, 18 bp, Homo sapiens
gcacccccctgttctaag

SEQ ID NO: 6231691 - DNA, 18 bp, Homo sapiens
gcacccccggcccagtgc

SEQ ID NO: 6231692 - DNA, 19 bp, Homo sapiens
gcacccccggcccagtgcc

SEQ ID NO: 6231693 - DNA, 18 bp, Homo sapiens
gcaccccctcattcccct

SEQ ID NO: 6231694 - DNA, 17 bp, Homo sapiens
gcaccccctcctgctgc

SEQ ID NO: 6231695 - DNA, 15 bp, Homo sapiens
gcaccccctctcctg

SEQ ID NO: 6231696 - DNA, 17 bp, Homo sapiens
gcaccccctctcctgga

SEQ ID NO: 6231697 - DNA, 18 bp, Homo sapiens
gcaccccctctcctggag

SEQ ID NO: 6231698 - DNA, 13 bp, Homo sapiens
gcaccccctgcag

SEQ ID NO: 6231699 - DNA, 15 bp, Homo sapiens
gcaccccctgcagct

SEQ ID NO: 6231700 - DNA, 19 bp, Homo sapiens
gcaccccctgcagcttgta

SEQ ID NO: 6231701 - DNA, 21 bp, Homo sapiens
gcaccccctgctccaccagca

SEQ ID NO: 6231702 - DNA, 21 bp, Homo sapiens
gcaccccctggcttgaacctt

SEQ ID NO: 6231703 - DNA, 23 bp, Homo sapiens
gcaccccgatgtggacctctact

SEQ ID NO: 6231704 - DNA, 18 bp, Homo sapiens
gcaccccgcccctgcatg

SEQ ID NO: 6231705 - DNA, 19 bp, Homo sapiens
gcaccccggatcgaggaca

SEQ ID NO: 6231706 - DNA, 18 bp, Homo sapiens
gcaccccgttcccagcgc

SEQ ID NO: 6231707 - DNA, 13 bp, Homo sapiens
gcacccctccagt

SEQ ID NO: 6231708 - DNA, 22 bp, Homo sapiens
gcacccctccccattcacagag

SEQ ID NO: 6231709 - DNA, 14 bp, Homo sapiens
gcacccctgcctcc

SEQ ID NO: 6231710 - DNA, 15 bp, Homo sapiens
gcacccctgcctcct

SEQ ID NO: 6231711 - DNA, 16 bp, Homo sapiens
gcacccctgcctcctg

SEQ ID NO: 6231712 - DNA, 17 bp, Homo sapiens
gcacccctgcctcctgc

SEQ ID NO: 6231713 - DNA, 12 bp, Homo sapiens
gcacccctggtg

SEQ ID NO: 6231714 - DNA, 13 bp, Homo sapiens
gcaccccttccat

SEQ ID NO: 6231715 - DNA, 16 bp, Homo sapiens
gcaccccttccatgtg

SEQ ID NO: 6231716 - DNA, 14 bp, Homo sapiens
gcaccccttcctcc

SEQ ID NO: 6231717 - DNA, 14 bp, Homo sapiens
gcaccccttcctgg

SEQ ID NO: 6231718 - DNA, 23 bp, Homo sapiens
gcaccccttcctgggcacacgct

SEQ ID NO: 6231719 - DNA, 19 bp, Homo sapiens
gcacccctttccccagcct

SEQ ID NO: 6231720 - DNA, 18 bp, Homo sapiens
gcacccctttcctcccca

SEQ ID NO: 6231721 - DNA, 14 bp, Homo sapiens
gcacccggcctgga

SEQ ID NO: 6231722 - DNA, 20 bp, Homo sapiens
gaccaccagccgccccagcc

SEQ ID NO: 6231723 - DNA, 21 bp, Homo sapiens
gaccaccagccgccccagccc

SEQ ID NO: 6231724 - DNA, 22 bp, Homo sapiens
gaccaccagccgccccagcccc

SEQ ID NO: 6231725 - DNA, 18 bp, Homo sapiens
gaccaccagggtcccagg

SEQ ID NO: 6231726 - DNA, 22 bp, Homo sapiens
gaccaccagggtcccaggaagc

SEQ ID NO: 6231727 - DNA, 18 bp, Homo sapiens
gaccacccaacctcaccc

SEQ ID NO: 6231728 - DNA, 22 bp, Homo sapiens
gaccacccaacctcaccctcct

SEQ ID NO: 6231729 - DNA, 12 bp, Homo sapiens
gaccacccacct

SEQ ID NO: 6231730 - DNA, 19 bp, Homo sapiens
gaccacccccaaacacaaa

SEQ ID NO: 6231731 - DNA, 11 bp, Homo sapiens
gaccacccccg

SEQ ID NO: 6231732 - DNA, 21 bp, Homo sapiens
gaccacccccgagcttgcctc

SEQ ID NO: 6231733 - DNA, 24 bp, Homo sapiens
gaccacccccgagcttgcctcagg

SEQ ID NO: 6231734 - DNA, 20 bp, Homo sapiens
gaccaccccgcctgccctca

SEQ ID NO: 6231735 - DNA, 13 bp, Homo sapiens
gaccacccctctc

SEQ ID NO: 6231736 - DNA, 19 bp, Homo sapiens
gaccacccctgcctccacc

SEQ ID NO: 6231737 - DNA, 16 bp, Homo sapiens
gaccacccctgtgcgc

SEQ ID NO: 6231738 - DNA, 21 bp, Homo sapiens
gaccaccctccctgactggcc

SEQ ID NO: 6231739 - DNA, 23 bp, Homo sapiens
gaccaccctccctgactggcctg

SEQ ID NO: 6231740 - DNA, 14 bp, Homo sapiens
gaccaccctgccaa

SEQ ID NO: 6231741 - DNA, 16 bp, Homo sapiens
gaccaccctgccaagg

SEQ ID NO: 6231742 - DNA, 13 bp, Homo sapiens
gaccaccctgcct

SEQ ID NO: 6231743 - DNA, 18 bp, Homo sapiens
gaccaccctgcctgtgga

SEQ ID NO: 6231744 - DNA, 23 bp, Homo sapiens
gaccacctagtctgtaactcttt

SEQ ID NO: 6231745 - DNA, 11 bp, Homo sapiens
gaccacctgcc

SEQ ID NO: 6231746 - DNA, 12 bp, Homo sapiens
gaccacctgcca

SEQ ID NO: 6231747 - DNA, 13 bp, Homo sapiens
gaccacctgccag

SEQ ID NO: 6231748 - DNA, 14 bp, Homo sapiens
gaccacctgccagc

SEQ ID NO: 6231749 - DNA, 17 bp, Homo sapiens
gaccacctgccagccat

SEQ ID NO: 6231750 - DNA, 18 bp, Homo sapiens
gaccacctgccagccatc

SEQ ID NO: 6231751 - DNA, 18 bp, Homo sapiens
gaccaccttcccttcctc

SEQ ID NO: 6231752 - DNA, 22 bp, Homo sapiens
gaccaccttcccttcctcagca

SEQ ID NO: 6231753 - DNA, 16 bp, Homo sapiens
gaccaccttctgtccc

SEQ ID NO: 6231754 - DNA, 22 bp, Homo sapiens
gaccaccttctgtccccagccc

SEQ ID NO: 6231755 - DNA, 18 bp, Homo sapiens
gaccacgacctcgtccat

SEQ ID NO: 6231756 - DNA, 24 bp, Homo sapiens
gaccacgaggctgattcctctcat

SEQ ID NO: 6231757 - DNA, 21 bp, Homo sapiens
gaccacgcacctccacgccac

SEQ ID NO: 6231758 - DNA, 19 bp, Homo sapiens
gaccacgccccaggacctc

SEQ ID NO: 6231759 - DNA, 21 bp, Homo sapiens
gaccacgcccgtcctgcctgt

SEQ ID NO: 6231760 - DNA, 17 bp, Homo sapiens
gaccacgccgccctcca

SEQ ID NO: 6231761 - DNA, 20 bp, Homo sapiens
gaccacggacgtttccatca

SEQ ID NO: 6231762 - DNA, 23 bp, Homo sapiens
gaccacgggcctcagtttcccca

SEQ ID NO: 6231763 - DNA, 19 bp, Homo sapiens
gaccacggtccaatccagc

SEQ ID NO: 6231764 - DNA, 19 bp, Homo sapiens
gaccacggtgtggggggtg

SEQ ID NO: 6231765 - DNA, 22 bp, Homo sapiens
gaccacggtgtggggggtgccc

SEQ ID NO: 6231766 - DNA, 17 bp, Homo sapiens
gaccacgtctccctggc

SEQ ID NO: 6231767 - DNA, 22 bp, Homo sapiens
gaccacgtctccctggccccag

SEQ ID NO: 6231768 - DNA, 23 bp, Homo sapiens
gaccacgtctccctggccccagt

SEQ ID NO: 6231769 - DNA, 17 bp, Homo sapiens
gaccacgtgctaccccc

SEQ ID NO: 6231770 - DNA, 12 bp, Homo sapiens
gaccactacagt

SEQ ID NO: 6231771 - DNA, 17 bp, Homo sapiens
gaccactagctaagcaa

SEQ ID NO: 6231772 - DNA, 21 bp, Homo sapiens
gaccactagctaagcaagcca

SEQ ID NO: 6231773 - DNA, 13 bp, Homo sapiens
gaccactcagccc

SEQ ID NO: 6231774 - DNA, 14 bp, Homo sapiens
gaccactccagaga

SEQ ID NO: 6231775 - DNA, 15 bp, Homo sapiens
gaccactccagagaa

SEQ ID NO: 6231776 - DNA, 16 bp, Homo sapiens
gaccactcgaggcctg

SEQ ID NO: 6231777 - DNA, 22 bp, Homo sapiens
gaccactcttctttaagccata

SEQ ID NO: 6231778 - DNA, 20 bp, Homo sapiens
gaccactgaattcactccag

SEQ ID NO: 6231779 - DNA, 16 bp, Homo sapiens
gaccactgcagaagac

SEQ ID NO: 6231780 - DNA, 21 bp, Homo sapiens
gaccactgcagaagacagtat

SEQ ID NO: 6231781 - DNA, 13 bp, Homo sapiens
gaccactggccct

SEQ ID NO: 6231782 - DNA, 14 bp, Homo sapiens
gaccactggccctg

SEQ ID NO: 6231783 - DNA, 14 bp, Homo sapiens
gaccactgggcccc

SEQ ID NO: 6231784 - DNA, 17 bp, Homo sapiens
gaccactgggcccctca

SEQ ID NO: 6231785 - DNA, 19 bp, Homo sapiens
gaccactgggcccctcagg

SEQ ID NO: 6231786 - DNA, 17 bp, Homo sapiens
gaccactgggtgagaga

SEQ ID NO: 6231787 - DNA, 11 bp, Homo sapiens
gaccactgtct

SEQ ID NO: 6231788 - DNA, 15 bp, Homo sapiens
gaccactgtcttttt

SEQ ID NO: 6231789 - DNA, 16 bp, Homo sapiens
gaccactgtttcttgc

SEQ ID NO: 6231790 - DNA, 22 bp, Homo sapiens
gaccacttccaggggaacctgc

SEQ ID NO: 6231791 - DNA, 15 bp, Homo sapiens
gaccacttgaggcct

SEQ ID NO: 6231792 - DNA, 16 bp, Homo sapiens
gaccacttgaggcctg

SEQ ID NO: 6231793 - DNA, 17 bp, Homo sapiens
gaccacttgatatgact

SEQ ID NO: 6231794 - DNA, 12 bp, Homo sapiens
gaccagaaaata

SEQ ID NO: 6231795 - DNA, 16 bp, Homo sapiens
gaccagaaacagggac

SEQ ID NO: 6231796 - DNA, 19 bp, Homo sapiens
gaccagaaacctgggagag

SEQ ID NO: 6231797 - DNA, 21 bp, Homo sapiens
gaccagaaatcaaaaagggaa

SEQ ID NO: 6231798 - DNA, 18 bp, Homo sapiens
gaccagaagacaaaggcc

SEQ ID NO: 6231799 - DNA, 12 bp, Homo sapiens
gaccagaaggca

SEQ ID NO: 6231800 - DNA, 19 bp, Homo sapiens
gaccagaagtgaatgggaa

SEQ ID NO: 6231801 - DNA, 19 bp, Homo sapiens
gaccagaagtggcaggagg

SEQ ID NO: 6231802 - DNA, 20 bp, Homo sapiens
gaccagaagtggcaggagga

SEQ ID NO: 6231803 - DNA, 23 bp, Homo sapiens
gaccagaatcagattcaggagct

SEQ ID NO: 6231804 - DNA, 16 bp, Homo sapiens
gaccagaatgaaaact

SEQ ID NO: 6231805 - DNA, 22 bp, Homo sapiens
gaccagaatgaaaactgtaaat

SEQ ID NO: 6231806 - DNA, 12 bp, Homo sapiens
gaccagaattcc

SEQ ID NO: 6231807 - DNA, 15 bp, Homo sapiens
gaccagaattccctt

SEQ ID NO: 6231808 - DNA, 21 bp, Homo sapiens
gaccagacaccttgacagggc

SEQ ID NO: 6231809 - DNA, 22 bp, Homo sapiens
gaccagacaccttgacagggca

SEQ ID NO: 6231810 - DNA, 24 bp, Homo sapiens
gaccagacaccttgacagggcaca

SEQ ID NO: 6231811 - DNA, 11 bp, Homo sapiens
gaccagagaat

SEQ ID NO: 6231812 - DNA, 14 bp, Homo sapiens
gaccagagaatgca

SEQ ID NO: 6231813 - DNA, 22 bp, Homo sapiens
gaccagagccagatgcaggaca

SEQ ID NO: 6231814 - DNA, 17 bp, Homo sapiens
gaccagagctatgaatc

SEQ ID NO: 6231815 - DNA, 15 bp, Homo sapiens
gaccagagctgtctg

SEQ ID NO: 6231816 - DNA, 16 bp, Homo sapiens
gaccagagctgtctga

SEQ ID NO: 6231817 - DNA, 21 bp, Homo sapiens
gaccagaggagcctttttaaa

SEQ ID NO: 6231818 - DNA, 20 bp, Homo sapiens
gaccagagggatgggagagt

SEQ ID NO: 6231819 - DNA, 21 bp, Homo sapiens
gaccagaggtgggaggcccct

SEQ ID NO: 6231820 - DNA, 17 bp, Homo sapiens
gaccagataaatagaac

SEQ ID NO: 6231821 - DNA, 21 bp, Homo sapiens
gaccagataaatagaactatc

SEQ ID NO: 6231822 - DNA, 21 bp, Homo sapiens
gaccagatccttttccatccc

SEQ ID NO: 6231823 - DNA, 17 bp, Homo sapiens
gaccagatctttctctt

SEQ ID NO: 6231824 - DNA, 16 bp, Homo sapiens
gaccagatgtccgtct

SEQ ID NO: 6231825 - DNA, 13 bp, Homo sapiens
gaccagcaaatac

SEQ ID NO: 6231826 - DNA, 18 bp, Homo sapiens
gaccagcacactcccgag

SEQ ID NO: 6231827 - DNA, 20 bp, Homo sapiens
gaccagcaccatctctcctc

SEQ ID NO: 6231828 - DNA, 18 bp, Homo sapiens
gaccagcactcagcctca

SEQ ID NO: 6231829 - DNA, 18 bp, Homo sapiens
gaccagcactgaccccga

SEQ ID NO: 6231830 - DNA, 18 bp, Homo sapiens
gaccagcagacagagcca

SEQ ID NO: 6231831 - DNA, 19 bp, Homo sapiens
gaccagcagacagagccag

SEQ ID NO: 6231832 - DNA, 18 bp, Homo sapiens
gaccagcagatcccagct

SEQ ID NO: 6231833 - DNA, 20 bp, Homo sapiens
gaccagcagatcccagctca

SEQ ID NO: 6231834 - DNA, 16 bp, Homo sapiens
gaccagcagccccaca

SEQ ID NO: 6231835 - DNA, 14 bp, Homo sapiens
gaccagcagcgcct

SEQ ID NO: 6231836 - DNA, 16 bp, Homo sapiens
gaccagcagcgccttt

SEQ ID NO: 6231837 - DNA, 14 bp, Homo sapiens
gaccagcaggaggg

SEQ ID NO: 6231838 - DNA, 17 bp, Homo sapiens
gaccagcaggagggaag

SEQ ID NO: 6231839 - DNA, 19 bp, Homo sapiens
gaccagcaggagggaagga

SEQ ID NO: 6231840 - DNA, 22 bp, Homo sapiens
gaccagcaggagggaaggacag

SEQ ID NO: 6231841 - DNA, 23 bp, Homo sapiens
gaccagcaggagggaaggacaga

SEQ ID NO: 6231842 - DNA, 14 bp, Homo sapiens
gaccagcaggctcc

SEQ ID NO: 6231843 - DNA, 20 bp, Homo sapiens
gaccagcaggctcctcagcc

SEQ ID NO: 6231844 - DNA, 21 bp, Homo sapiens
gaccagcaggctcctcagccc

SEQ ID NO: 6231845 - DNA, 23 bp, Homo sapiens
gaccagcaggctcctcagccctc

SEQ ID NO: 6231846 - DNA, 17 bp, Homo sapiens
gaccagcaggctggcct

SEQ ID NO: 6231847 - DNA, 17 bp, Homo sapiens
gaccagcagtctgcctg

SEQ ID NO: 6231848 - DNA, 11 bp, Homo sapiens
gaccagcatag

SEQ ID NO: 6231849 - DNA, 14 bp, Homo sapiens
gaccagcatctggt

SEQ ID NO: 6231850 - DNA, 16 bp, Homo sapiens
gaccagccagcagcag

SEQ ID NO: 6231851 - DNA, 14 bp, Homo sapiens
gaccagcccacagc

SEQ ID NO: 6231852 - DNA, 12 bp, Homo sapiens
gaccagcccacg

SEQ ID NO: 6231853 - DNA, 23 bp, Homo sapiens
gaccagcccacgctgactacagg

SEQ ID NO: 6231854 - DNA, 12 bp, Homo sapiens
gaccagcccctt

SEQ ID NO: 6231855 - DNA, 15 bp, Homo sapiens
gaccagccccttcct

SEQ ID NO: 6231856 - DNA, 16 bp, Homo sapiens
gaccagccccttcctg

SEQ ID NO: 6231857 - DNA, 17 bp, Homo sapiens
gaccagccccttcctgg

SEQ ID NO: 6231858 - DNA, 16 bp, Homo sapiens
gaccagccgcccagat

SEQ ID NO: 6231859 - DNA, 23 bp, Homo sapiens
gaccagccgcccagatcatgccg

SEQ ID NO: 6231860 - DNA, 18 bp, Homo sapiens
gaccagccgtgagcatgt

SEQ ID NO: 6231861 - DNA, 20 bp, Homo sapiens
gaccagcctccatgctgcct

SEQ ID NO: 6231862 - DNA, 21 bp, Homo sapiens
gaccagcctccatgctgcctc

SEQ ID NO: 6231863 - DNA, 15 bp, Homo sapiens
gaccagcctgccagg

SEQ ID NO: 6231864 - DNA, 21 bp, Homo sapiens
gaccagcctgccaggccctcc

SEQ ID NO: 6231865 - DNA, 23 bp, Homo sapiens
gaccagcctgccaggccctccag

SEQ ID NO: 6231866 - DNA, 12 bp, Homo sapiens
gaccagcctggc

SEQ ID NO: 6231867 - DNA, 22 bp, Homo sapiens
gaccagcctggccaacatggta

SEQ ID NO: 6231868 - DNA, 12 bp, Homo sapiens
gaccagcctggg

SEQ ID NO: 6231869 - DNA, 14 bp, Homo sapiens
gaccagcctgggca

SEQ ID NO: 6231870 - DNA, 17 bp, Homo sapiens
gaccagcctgggcagca

SEQ ID NO: 6231871 - DNA, 20 bp, Homo sapiens
gaccagcctgtaccttgctg

SEQ ID NO: 6231872 - DNA, 12 bp, Homo sapiens
gaccagcctttc

SEQ ID NO: 6231873 - DNA, 16 bp, Homo sapiens
gaccagcctttcttcc

SEQ ID NO: 6231874 - DNA, 17 bp, Homo sapiens
gaccagcggctgctcaa

SEQ ID NO: 6231875 - DNA, 21 bp, Homo sapiens
gaccagcggtccatgggtctg

SEQ ID NO: 6231876 - DNA, 21 bp, Homo sapiens
gaccagctcagaggcccagga

SEQ ID NO: 6231877 - DNA, 19 bp, Homo sapiens
gaccagctccccctccctc

SEQ ID NO: 6231878 - DNA, 13 bp, Homo sapiens
gaccagctccccg

SEQ ID NO: 6231879 - DNA, 14 bp, Homo sapiens
gaccagctccccgg

SEQ ID NO: 6231880 - DNA, 19 bp, Homo sapiens
gaccagctgctccgaggac

SEQ ID NO: 6231881 - DNA, 20 bp, Homo sapiens
gaccagctgctccgaggacc

SEQ ID NO: 6231882 - DNA, 23 bp, Homo sapiens
gaccagctgctccgaggacccag

SEQ ID NO: 6231883 - DNA, 16 bp, Homo sapiens
gaccagctggcctggg

SEQ ID NO: 6231884 - DNA, 11 bp, Homo sapiens
gaccagctggg

SEQ ID NO: 6231885 - DNA, 23 bp, Homo sapiens
gaccagctggggggcagggggga

SEQ ID NO: 6231886 - DNA, 14 bp, Homo sapiens
gaccaggaaggaag

SEQ ID NO: 6231887 - DNA, 15 bp, Homo sapiens
gaccaggaaggaaga

SEQ ID NO: 6231888 - DNA, 16 bp, Homo sapiens
gaccaggacccaggga

SEQ ID NO: 6231889 - DNA, 14 bp, Homo sapiens
gaccaggactatag

SEQ ID NO: 6231890 - DNA, 22 bp, Homo sapiens
gaccaggactatagcccaggtc

SEQ ID NO: 6231891 - DNA, 14 bp, Homo sapiens
gaccaggactccct

SEQ ID NO: 6231892 - DNA, 18 bp, Homo sapiens
gaccaggactctgccttc

SEQ ID NO: 6231893 - DNA, 15 bp, Homo sapiens
gaccaggagccaggt

SEQ ID NO: 6231894 - DNA, 11 bp, Homo sapiens
gaccaggaggg

SEQ ID NO: 6231895 - DNA, 23 bp, Homo sapiens
gaccaggagggcactggagctgt

SEQ ID NO: 6231896 - DNA, 11 bp, Homo sapiens
gaccaggagtg

SEQ ID NO: 6231897 - DNA, 18 bp, Homo sapiens
gaccaggagtgggtgggg

SEQ ID NO: 6231898 - DNA, 15 bp, Homo sapiens
gaccaggatccagcc

SEQ ID NO: 6231899 - DNA, 16 bp, Homo sapiens
gaccaggatggagcaa

SEQ ID NO: 6231900 - DNA, 20 bp, Homo sapiens
gcacccggcctggatgccag

SEQ ID NO: 6231901 - DNA, 14 bp, Homo sapiens
gcacccgtaccccc

SEQ ID NO: 6231902 - DNA, 20 bp, Homo sapiens
gcacccgtacccccgtggtc

SEQ ID NO: 6231903 - DNA, 22 bp, Homo sapiens
gcacccgtgccacgcgctctgc

SEQ ID NO: 6231904 - DNA, 18 bp, Homo sapiens
gcacccgttcaccttctt

SEQ ID NO: 6231905 - DNA, 17 bp, Homo sapiens
gcaccctaggcagcctg

SEQ ID NO: 6231906 - DNA, 12 bp, Homo sapiens
gcaccctcaggg

SEQ ID NO: 6231907 - DNA, 19 bp, Homo sapiens
gcaccctcagggagcctcc

SEQ ID NO: 6231908 - DNA, 15 bp, Homo sapiens
gcaccctccacagga

SEQ ID NO: 6231909 - DNA, 13 bp, Homo sapiens
gcaccctccaccc

SEQ ID NO: 6231910 - DNA, 14 bp, Homo sapiens
gcaccctccaccct

SEQ ID NO: 6231911 - DNA, 16 bp, Homo sapiens
gcaccctcccccgcag

SEQ ID NO: 6231912 - DNA, 13 bp, Homo sapiens
gcaccctcccctc

SEQ ID NO: 6231913 - DNA, 15 bp, Homo sapiens
gcaccctcctagggc

SEQ ID NO: 6231914 - DNA, 12 bp, Homo sapiens
gcaccctctggc

SEQ ID NO: 6231915 - DNA, 20 bp, Homo sapiens
gcaccctgcagagcacacag

SEQ ID NO: 6231916 - DNA, 13 bp, Homo sapiens
gcaccctgcaggc

SEQ ID NO: 6231917 - DNA, 17 bp, Homo sapiens
gcaccctgcaggcaggc

SEQ ID NO: 6231918 - DNA, 21 bp, Homo sapiens
gcaccctgcaggcaggcagac

SEQ ID NO: 6231919 - DNA, 22 bp, Homo sapiens
gcaccctgccccaccccacctc

SEQ ID NO: 6231920 - DNA, 22 bp, Homo sapiens
gcaccctgcctacgccaggaga

SEQ ID NO: 6231921 - DNA, 17 bp, Homo sapiens
gcaccctgcgcctccag

SEQ ID NO: 6231922 - DNA, 18 bp, Homo sapiens
gcaccctgcgcctccaga

SEQ ID NO: 6231923 - DNA, 20 bp, Homo sapiens
gcaccctggagagtgcacat

SEQ ID NO: 6231924 - DNA, 12 bp, Homo sapiens
gcaccctggcct

SEQ ID NO: 6231925 - DNA, 14 bp, Homo sapiens
gcaccctggcctgg

SEQ ID NO: 6231926 - DNA, 17 bp, Homo sapiens
gcaccctggcctggtcc

SEQ ID NO: 6231927 - DNA, 22 bp, Homo sapiens
gcaccctggcctggtccctggt

SEQ ID NO: 6231928 - DNA, 12 bp, Homo sapiens
gcaccctggctg

SEQ ID NO: 6231929 - DNA, 13 bp, Homo sapiens
gcaccctgggtgc

SEQ ID NO: 6231930 - DNA, 17 bp, Homo sapiens
gcaccctgtggccctgg

SEQ ID NO: 6231931 - DNA, 14 bp, Homo sapiens
gcacccttaagaag

SEQ ID NO: 6231932 - DNA, 13 bp, Homo sapiens
gcacccttccctc

SEQ ID NO: 6231933 - DNA, 16 bp, Homo sapiens
gcacccttctttcctc

SEQ ID NO: 6231934 - DNA, 18 bp, Homo sapiens
gcacccttctttcctctt

SEQ ID NO: 6231935 - DNA, 15 bp, Homo sapiens
gcacccttcttttct

SEQ ID NO: 6231936 - DNA, 15 bp, Homo sapiens
gcaccgaatattgag

SEQ ID NO: 6231937 - DNA, 15 bp, Homo sapiens
gcaccgaccccgggc

SEQ ID NO: 6231938 - DNA, 16 bp, Homo sapiens
gcaccgaccccgggcc

SEQ ID NO: 6231939 - DNA, 20 bp, Homo sapiens
gcaccgactagacacacaaa

SEQ ID NO: 6231940 - DNA, 20 bp, Homo sapiens
gcaccgaggttgcattctag

SEQ ID NO: 6231941 - DNA, 15 bp, Homo sapiens
gcaccgcagcatgtg

SEQ ID NO: 6231942 - DNA, 16 bp, Homo sapiens
gcaccgcagcctctgc

SEQ ID NO: 6231943 - DNA, 12 bp, Homo sapiens
gcaccgccacgt

SEQ ID NO: 6231944 - DNA, 19 bp, Homo sapiens
gcaccgccagagtgtcctg

SEQ ID NO: 6231945 - DNA, 20 bp, Homo sapiens
gcaccgccagagtgtcctgc

SEQ ID NO: 6231946 - DNA, 23 bp, Homo sapiens
gcaccgccagagtgtcctgctac

SEQ ID NO: 6231947 - DNA, 14 bp, Homo sapiens
gcaccgccagccgc

SEQ ID NO: 6231948 - DNA, 14 bp, Homo sapiens
gcaccgccatgcat

SEQ ID NO: 6231949 - DNA, 20 bp, Homo sapiens
gcaccgccatgcatgatggg

SEQ ID NO: 6231950 - DNA, 21 bp, Homo sapiens
gcaccgccatgcatgatgggt

SEQ ID NO: 6231951 - DNA, 17 bp, Homo sapiens
gcaccgcccacccacac

SEQ ID NO: 6231952 - DNA, 19 bp, Homo sapiens
gcaccgcccacccacaccc

SEQ ID NO: 6231953 - DNA, 16 bp, Homo sapiens
gcaccgccgcagaagc

SEQ ID NO: 6231954 - DNA, 17 bp, Homo sapiens
gcaccgccgcagaagca

SEQ ID NO: 6231955 - DNA, 16 bp, Homo sapiens
gcaccgccgccaccag

SEQ ID NO: 6231956 - DNA, 19 bp, Homo sapiens
gcaccgccggccagctggg

SEQ ID NO: 6231957 - DNA, 14 bp, Homo sapiens
gcaccgcctcttcc

SEQ ID NO: 6231958 - DNA, 14 bp, Homo sapiens
gcaccgcctgcccc

SEQ ID NO: 6231959 - DNA, 16 bp, Homo sapiens
gcaccgcctgccccca

SEQ ID NO: 6231960 - DNA, 21 bp, Homo sapiens
gcaccgcctgccctcccgcac

SEQ ID NO: 6231961 - DNA, 22 bp, Homo sapiens
gcaccgcggcgcttcccagcac

SEQ ID NO: 6231962 - DNA, 21 bp, Homo sapiens
gcaccgctgggttctgactct

SEQ ID NO: 6231963 - DNA, 22 bp, Homo sapiens
gcaccggacagtcggaaaagcg

SEQ ID NO: 6231964 - DNA, 14 bp, Homo sapiens
gcaccggcctggct

SEQ ID NO: 6231965 - DNA, 12 bp, Homo sapiens
gcaccggcgctg

SEQ ID NO: 6231966 - DNA, 20 bp, Homo sapiens
gcaccggctcaggagagggc

SEQ ID NO: 6231967 - DNA, 15 bp, Homo sapiens
gcaccggctggcctg

SEQ ID NO: 6231968 - DNA, 18 bp, Homo sapiens
gcaccggctggcctggcc

SEQ ID NO: 6231969 - DNA, 14 bp, Homo sapiens
gcaccgggaccccc

SEQ ID NO: 6231970 - DNA, 20 bp, Homo sapiens
gcaccgggaccccctcacca

SEQ ID NO: 6231971 - DNA, 23 bp, Homo sapiens
gcaccgggctccatgcctctgga

SEQ ID NO: 6231972 - DNA, 16 bp, Homo sapiens
gcaccggggcctgggc

SEQ ID NO: 6231973 - DNA, 20 bp, Homo sapiens
gcaccgggggagagggacac

SEQ ID NO: 6231974 - DNA, 22 bp, Homo sapiens
gcaccgggggagagggacactc

SEQ ID NO: 6231975 - DNA, 17 bp, Homo sapiens
gcaccgtcatggcttaa

SEQ ID NO: 6231976 - DNA, 15 bp, Homo sapiens
gcaccgtccaggccc

SEQ ID NO: 6231977 - DNA, 16 bp, Homo sapiens
gcaccgtcccgccagt

SEQ ID NO: 6231978 - DNA, 22 bp, Homo sapiens
gcaccgtgatggagaggacaga

SEQ ID NO: 6231979 - DNA, 13 bp, Homo sapiens
gcaccgtgctggg

SEQ ID NO: 6231980 - DNA, 21 bp, Homo sapiens
gcaccgtggtcagagggactg

SEQ ID NO: 6231981 - DNA, 19 bp, Homo sapiens
gcaccgtggtgtgaggccc

SEQ ID NO: 6231982 - DNA, 20 bp, Homo sapiens
gcaccgtggtgtgaggcccc

SEQ ID NO: 6231983 - DNA, 21 bp, Homo sapiens
gcaccgtggtgtgaggccccc

SEQ ID NO: 6231984 - DNA, 15 bp, Homo sapiens
gcaccgtgtcctcct

SEQ ID NO: 6231985 - DNA, 23 bp, Homo sapiens
gcacctaaaacccaaaggtggca

SEQ ID NO: 6231986 - DNA, 14 bp, Homo sapiens
gcacctaaaactta

SEQ ID NO: 6231987 - DNA, 19 bp, Homo sapiens
gcacctaaaccaccagtgc

SEQ ID NO: 6231988 - DNA, 14 bp, Homo sapiens
gcacctaaagcagc

SEQ ID NO: 6231989 - DNA, 17 bp, Homo sapiens
gcacctaaagcagccag

SEQ ID NO: 6231990 - DNA, 18 bp, Homo sapiens
gcacctaatccaggcaga

SEQ ID NO: 6231991 - DNA, 22 bp, Homo sapiens
gcacctaatccaggcagatcca

SEQ ID NO: 6231992 - DNA, 17 bp, Homo sapiens
gcacctacatccccagg

SEQ ID NO: 6231993 - DNA, 18 bp, Homo sapiens
gcacctacatccccaggt

SEQ ID NO: 6231994 - DNA, 21 bp, Homo sapiens
gcacctaccaccacgcccggc

SEQ ID NO: 6231995 - DNA, 22 bp, Homo sapiens
gcacctaccaccacgcccggct

SEQ ID NO: 6231996 - DNA, 19 bp, Homo sapiens
gcacctaccatcagggaca

SEQ ID NO: 6231997 - DNA, 21 bp, Homo sapiens
gcacctactacatcgccctcc

SEQ ID NO: 6231998 - DNA, 23 bp, Homo sapiens
gcacctactacatcgccctccac

SEQ ID NO: 6231999 - DNA, 21 bp, Homo sapiens
gcacctactatgtgctgggtg

SEQ ID NO: 6232000 - DNA, 19 bp, Homo sapiens
gcacctaggtggggcctgg

SEQ ID NO: 6232001 - DNA, 16 bp, Homo sapiens
gcacctagtccagtga

SEQ ID NO: 6232002 - DNA, 18 bp, Homo sapiens
gcacctatagtcccagct

SEQ ID NO: 6232003 - DNA, 21 bp, Homo sapiens
gcacctatagtcccagctact

SEQ ID NO: 6232004 - DNA, 19 bp, Homo sapiens
gcacctatcacccaggctg

SEQ ID NO: 6232005 - DNA, 17 bp, Homo sapiens
gcacctatctcagccat

SEQ ID NO: 6232006 - DNA, 18 bp, Homo sapiens
gcacctatctcagccata

SEQ ID NO: 6232007 - DNA, 19 bp, Homo sapiens
gcacctatggcccagccac

SEQ ID NO: 6232008 - DNA, 21 bp, Homo sapiens
gcacctcacagaaatgagatc

SEQ ID NO: 6232009 - DNA, 10 bp, Homo sapiens
gcacctcaga

SEQ ID NO: 6232010 - DNA, 24 bp, Homo sapiens
gcacctcagaaagtcaccaggact

SEQ ID NO: 6232011 - DNA, 12 bp, Homo sapiens
gcacctcagaca

SEQ ID NO: 6232012 - DNA, 16 bp, Homo sapiens
gcacctcagacaatcc

SEQ ID NO: 6232013 - DNA, 23 bp, Homo sapiens
gcacctcagcctcccaagtagct

SEQ ID NO: 6232014 - DNA, 14 bp, Homo sapiens
gcacctcaggctga

SEQ ID NO: 6232015 - DNA, 12 bp, Homo sapiens
gcacctcagggc

SEQ ID NO: 6232016 - DNA, 14 bp, Homo sapiens
gcacctccagctgt

SEQ ID NO: 6232017 - DNA, 14 bp, Homo sapiens
gcacctccaggcag

SEQ ID NO: 6232018 - DNA, 19 bp, Homo sapiens
gcacctccaggcaggccag

SEQ ID NO: 6232019 - DNA, 22 bp, Homo sapiens
gcacctccaggcaggccaggct

SEQ ID NO: 6232020 - DNA, 20 bp, Homo sapiens
gcacctccaggcctgttgct

SEQ ID NO: 6232021 - DNA, 23 bp, Homo sapiens
gcacctcccagtttgctgggttt

SEQ ID NO: 6232022 - DNA, 11 bp, Homo sapiens
gcacctcccat

SEQ ID NO: 6232023 - DNA, 20 bp, Homo sapiens
gcacctccccagacagggct

SEQ ID NO: 6232024 - DNA, 22 bp, Homo sapiens
gcacctccccagacagggctcc

SEQ ID NO: 6232025 - DNA, 18 bp, Homo sapiens
gcacctccccccactgca

SEQ ID NO: 6232026 - DNA, 20 bp, Homo sapiens
gcacctccccgctctccctg

SEQ ID NO: 6232027 - DNA, 15 bp, Homo sapiens
gcacctccccgctgg

SEQ ID NO: 6232028 - DNA, 19 bp, Homo sapiens
gcacctccctccccagctc

SEQ ID NO: 6232029 - DNA, 22 bp, Homo sapiens
gcacctccctccccagctccgg

SEQ ID NO: 6232030 - DNA, 15 bp, Homo sapiens
gcacctccggctgcc

SEQ ID NO: 6232031 - DNA, 16 bp, Homo sapiens
gcacctccggctgcct

SEQ ID NO: 6232032 - DNA, 20 bp, Homo sapiens
gcacctcctaccctcccacc

SEQ ID NO: 6232033 - DNA, 18 bp, Homo sapiens
gcacctcctccgtgggca

SEQ ID NO: 6232034 - DNA, 15 bp, Homo sapiens
gcacctcctgcctcg

SEQ ID NO: 6232035 - DNA, 16 bp, Homo sapiens
gcacctctccagctcc

SEQ ID NO: 6232036 - DNA, 20 bp, Homo sapiens
gcacctctcttgaaccccaa

SEQ ID NO: 6232037 - DNA, 21 bp, Homo sapiens
gcacctctcttgaaccccaaa

SEQ ID NO: 6232038 - DNA, 16 bp, Homo sapiens
gcacctctggctagag

SEQ ID NO: 6232039 - DNA, 18 bp, Homo sapiens
gcacctctggctagagcc

SEQ ID NO: 6232040 - DNA, 22 bp, Homo sapiens
gcacctctggctagagccgagg

SEQ ID NO: 6232041 - DNA, 14 bp, Homo sapiens
gcacctctgtgctg

SEQ ID NO: 6232042 - DNA, 14 bp, Homo sapiens
gcacctcttccttg

SEQ ID NO: 6232043 - DNA, 20 bp, Homo sapiens
gcacctcttccttgatgttt

SEQ ID NO: 6232044 - DNA, 12 bp, Homo sapiens
gcacctcttgaa

SEQ ID NO: 6232045 - DNA, 13 bp, Homo sapiens
gcacctcttggct

SEQ ID NO: 6232046 - DNA, 14 bp, Homo sapiens
gcacctcttggctt

SEQ ID NO: 6232047 - DNA, 15 bp, Homo sapiens
gcacctgaaattaat

SEQ ID NO: 6232048 - DNA, 23 bp, Homo sapiens
gcacctgaaattaatttgtgaat

SEQ ID NO: 6232049 - DNA, 20 bp, Homo sapiens
gcacctgaccgctgcccagg

SEQ ID NO: 6232050 - DNA, 11 bp, Homo sapiens
gcacctgagcc

SEQ ID NO: 6232051 - DNA, 21 bp, Homo sapiens
gcacctgaggcccagcagagc

SEQ ID NO: 6232052 - DNA, 23 bp, Homo sapiens
gcacctgagggggaaaaaacagt

SEQ ID NO: 6232053 - DNA, 18 bp, Homo sapiens
gcacctgattagttgaaa

SEQ ID NO: 6232054 - DNA, 15 bp, Homo sapiens
gcacctgcagccaag

SEQ ID NO: 6232055 - DNA, 19 bp, Homo sapiens
gcacctgcagccaagcaaa

SEQ ID NO: 6232056 - DNA, 15 bp, Homo sapiens
gcacctgcagcggct

SEQ ID NO: 6232057 - DNA, 18 bp, Homo sapiens
gcacctgcaggcgtgacc

SEQ ID NO: 6232058 - DNA, 20 bp, Homo sapiens
gcacctgcaggttgggccat

SEQ ID NO: 6232059 - DNA, 23 bp, Homo sapiens
gcacctgcatccgtagttccctg

SEQ ID NO: 6232060 - DNA, 11 bp, Homo sapiens
gcacctgccac

SEQ ID NO: 6232061 - DNA, 14 bp, Homo sapiens
gcacctgccaccgc

SEQ ID NO: 6232062 - DNA, 16 bp, Homo sapiens
gcacctgccaccgcca

SEQ ID NO: 6232063 - DNA, 22 bp, Homo sapiens
gcacctgccaccgccagaggac

SEQ ID NO: 6232064 - DNA, 16 bp, Homo sapiens
gcacctgccagcctgg

SEQ ID NO: 6232065 - DNA, 17 bp, Homo sapiens
gcacctgccagcctggc

SEQ ID NO: 6232066 - DNA, 13 bp, Homo sapiens
gcacctgcccagc

SEQ ID NO: 6232067 - DNA, 17 bp, Homo sapiens
gcacctgccccctggtg

SEQ ID NO: 6232068 - DNA, 13 bp, Homo sapiens
gcacctgccccgt

SEQ ID NO: 6232069 - DNA, 21 bp, Homo sapiens
gcacctgccctacctgcccca

SEQ ID NO: 6232070 - DNA, 19 bp, Homo sapiens
gcacctgccgacctcgtcc

SEQ ID NO: 6232071 - DNA, 14 bp, Homo sapiens
gcacctgcctagct

SEQ ID NO: 6232072 - DNA, 21 bp, Homo sapiens
gcacctgcctagctcttgggc

SEQ ID NO: 6232073 - DNA, 16 bp, Homo sapiens
gcacctgcctccacca

SEQ ID NO: 6232074 - DNA, 19 bp, Homo sapiens
gcacctgcctccaccagca

SEQ ID NO: 6232075 - DNA, 21 bp, Homo sapiens
gcacctgcctccaccagcaag

SEQ ID NO: 6232076 - DNA, 14 bp, Homo sapiens
gcacctgcctccag

SEQ ID NO: 6232077 - DNA, 18 bp, Homo sapiens
gcacctgcctccagccgc

SEQ ID NO: 6232078 - DNA, 20 bp, Homo sapiens
gaccaggatggagcaagctc

SEQ ID NO: 6232079 - DNA, 15 bp, Homo sapiens
gaccaggatttctaa

SEQ ID NO: 6232080 - DNA, 12 bp, Homo sapiens
gaccaggccaat

SEQ ID NO: 6232081 - DNA, 13 bp, Homo sapiens
gaccaggccctgc

SEQ ID NO: 6232082 - DNA, 14 bp, Homo sapiens
gaccaggccctgct

SEQ ID NO: 6232083 - DNA, 18 bp, Homo sapiens
gaccaggcctggagggca

SEQ ID NO: 6232084 - DNA, 14 bp, Homo sapiens
gaccaggctgcagc

SEQ ID NO: 6232085 - DNA, 14 bp, Homo sapiens
gaccaggctggggc

SEQ ID NO: 6232086 - DNA, 15 bp, Homo sapiens
gaccaggctggggcc

SEQ ID NO: 6232087 - DNA, 16 bp, Homo sapiens
gaccaggcttggcctt

SEQ ID NO: 6232088 - DNA, 13 bp, Homo sapiens
gaccagggatgct

SEQ ID NO: 6232089 - DNA, 22 bp, Homo sapiens
gaccagggatgctgggctgggc

SEQ ID NO: 6232090 - DNA, 13 bp, Homo sapiens
gaccagggcaagg

SEQ ID NO: 6232091 - DNA, 12 bp, Homo sapiens
gaccagggccac

SEQ ID NO: 6232092 - DNA, 18 bp, Homo sapiens
gaccagggctggggcagc

SEQ ID NO: 6232093 - DNA, 16 bp, Homo sapiens
gaccaggggaccagag

SEQ ID NO: 6232094 - DNA, 13 bp, Homo sapiens
gaccaggggagag

SEQ ID NO: 6232095 - DNA, 19 bp, Homo sapiens
gaccaggggccctacctgg

SEQ ID NO: 6232096 - DNA, 21 bp, Homo sapiens
gaccaggggccctacctgggg

SEQ ID NO: 6232097 - DNA, 22 bp, Homo sapiens
gaccaggggccctacctgggga

SEQ ID NO: 6232098 - DNA, 15 bp, Homo sapiens
gaccagggtggccac

SEQ ID NO: 6232099 - DNA, 16 bp, Homo sapiens
gaccagggtggccaca

SEQ ID NO: 6232100 - DNA, 17 bp, Homo sapiens
gaccagggtggccacac

SEQ ID NO: 6232101 - DNA, 19 bp, Homo sapiens
gaccagggtggccacacag

SEQ ID NO: 6232102 - DNA, 20 bp, Homo sapiens
gaccagggtggccacacagg

SEQ ID NO: 6232103 - DNA, 23 bp, Homo sapiens
gaccaggtcctgctccgctgcct

SEQ ID NO: 6232104 - DNA, 18 bp, Homo sapiens
gaccaggtctacagtgat

SEQ ID NO: 6232105 - DNA, 22 bp, Homo sapiens
gaccaggtcttgttcaagcagc

SEQ ID NO: 6232106 - DNA, 13 bp, Homo sapiens
gaccaggtgacct

SEQ ID NO: 6232107 - DNA, 21 bp, Homo sapiens
gaccaggtgtctagaggcaac

SEQ ID NO: 6232108 - DNA, 21 bp, Homo sapiens
gaccaggttattttaaaaaga

SEQ ID NO: 6232109 - DNA, 14 bp, Homo sapiens
gaccagtagtgacc

SEQ ID NO: 6232110 - DNA, 17 bp, Homo sapiens
gaccagtcaacctgggc

SEQ ID NO: 6232111 - DNA, 18 bp, Homo sapiens
gaccagtcaacctgggca

SEQ ID NO: 6232112 - DNA, 21 bp, Homo sapiens
gaccagtcaggatgaggcccc

SEQ ID NO: 6232113 - DNA, 14 bp, Homo sapiens
gaccagtcccacac

SEQ ID NO: 6232114 - DNA, 20 bp, Homo sapiens
gaccagtcccacaccgctgg

SEQ ID NO: 6232115 - DNA, 16 bp, Homo sapiens
gaccagtcccagagca

SEQ ID NO: 6232116 - DNA, 11 bp, Homo sapiens
gaccagtgaag

SEQ ID NO: 6232117 - DNA, 23 bp, Homo sapiens
gaccagtgaagacgtcaggggca

SEQ ID NO: 6232118 - DNA, 19 bp, Homo sapiens
gaccagtgagcgcttgggc

SEQ ID NO: 6232119 - DNA, 14 bp, Homo sapiens
gaccagtggctggt

SEQ ID NO: 6232120 - DNA, 21 bp, Homo sapiens
gaccagtggctggtctcaccc

SEQ ID NO: 6232121 - DNA, 15 bp, Homo sapiens
gaccagtgggatggg

SEQ ID NO: 6232122 - DNA, 16 bp, Homo sapiens
gaccagtgggatgggc

SEQ ID NO: 6232123 - DNA, 22 bp, Homo sapiens
gaccagtggtgccttggaggga

SEQ ID NO: 6232124 - DNA, 15 bp, Homo sapiens
gaccagttgggagca

SEQ ID NO: 6232125 - DNA, 22 bp, Homo sapiens
gaccagtttaagccgcagacct

SEQ ID NO: 6232126 - DNA, 21 bp, Homo sapiens
gaccagtttatgtttgtggtt

SEQ ID NO: 6232127 - DNA, 15 bp, Homo sapiens
gaccagtttgcagag

SEQ ID NO: 6232128 - DNA, 18 bp, Homo sapiens
gaccataaagatcacacc

SEQ ID NO: 6232129 - DNA, 19 bp, Homo sapiens
gaccataacagccaacagg

SEQ ID NO: 6232130 - DNA, 18 bp, Homo sapiens
gaccataattttttttaa

SEQ ID NO: 6232131 - DNA, 17 bp, Homo sapiens
gaccatacgcggaggag

SEQ ID NO: 6232132 - DNA, 17 bp, Homo sapiens
gaccatattacctggat

SEQ ID NO: 6232133 - DNA, 18 bp, Homo sapiens
gaccatattacctggatt

SEQ ID NO: 6232134 - DNA, 15 bp, Homo sapiens
gaccatatttttaaa

SEQ ID NO: 6232135 - DNA, 18 bp, Homo sapiens
gaccatcaagaacctaca

SEQ ID NO: 6232136 - DNA, 21 bp, Homo sapiens
gaccatccactctaccctccc

SEQ ID NO: 6232137 - DNA, 14 bp, Homo sapiens
gaccatccattctc

SEQ ID NO: 6232138 - DNA, 17 bp, Homo sapiens
gaccatccattctcctc

SEQ ID NO: 6232139 - DNA, 20 bp, Homo sapiens
gaccatcccatgagcagtcc

SEQ ID NO: 6232140 - DNA, 18 bp, Homo sapiens
gaccatccctgaaggccc

SEQ ID NO: 6232141 - DNA, 19 bp, Homo sapiens
gaccatccctgaaggcccc

SEQ ID NO: 6232142 - DNA, 12 bp, Homo sapiens
gaccatcctggc

SEQ ID NO: 6232143 - DNA, 15 bp, Homo sapiens
gaccatcgtccagcc

SEQ ID NO: 6232144 - DNA, 16 bp, Homo sapiens
gaccatcgtccagccc

SEQ ID NO: 6232145 - DNA, 17 bp, Homo sapiens
gaccatcgtccagccct

SEQ ID NO: 6232146 - DNA, 13 bp, Homo sapiens
gaccatctctgta

SEQ ID NO: 6232147 - DNA, 14 bp, Homo sapiens
gaccatctgctgca

SEQ ID NO: 6232148 - DNA, 15 bp, Homo sapiens
gaccatctgctttta

SEQ ID NO: 6232149 - DNA, 13 bp, Homo sapiens
gaccatctgtgac

SEQ ID NO: 6232150 - DNA, 21 bp, Homo sapiens
gaccatctgtgactataaagc

SEQ ID NO: 6232151 - DNA, 12 bp, Homo sapiens
gaccatgccaga

SEQ ID NO: 6232152 - DNA, 21 bp, Homo sapiens
gaccatgccagattctgcctc

SEQ ID NO: 6232153 - DNA, 20 bp, Homo sapiens
gaccatgctgtctggcacag

SEQ ID NO: 6232154 - DNA, 22 bp, Homo sapiens
gaccatggagtggcagcccagc

SEQ ID NO: 6232155 - DNA, 22 bp, Homo sapiens
gaccatggccgaagccccttgg

SEQ ID NO: 6232156 - DNA, 19 bp, Homo sapiens
gaccatggggtggaaggag

SEQ ID NO: 6232157 - DNA, 22 bp, Homo sapiens
gaccatggttttggctctccca

SEQ ID NO: 6232158 - DNA, 17 bp, Homo sapiens
gaccatgtgaatctggg

SEQ ID NO: 6232159 - DNA, 21 bp, Homo sapiens
gaccatgtgcggagcagcctt

SEQ ID NO: 6232160 - DNA, 22 bp, Homo sapiens
gaccatgtgcggagcagccttt

SEQ ID NO: 6232161 - DNA, 14 bp, Homo sapiens
gaccatgtggccac

SEQ ID NO: 6232162 - DNA, 13 bp, Homo sapiens
gaccatgttcatt

SEQ ID NO: 6232163 - DNA, 14 bp, Homo sapiens
gaccatgttcatta

SEQ ID NO: 6232164 - DNA, 17 bp, Homo sapiens
gaccatgttcattataa

SEQ ID NO: 6232165 - DNA, 15 bp, Homo sapiens
gaccatgttgcactg

SEQ ID NO: 6232166 - DNA, 16 bp, Homo sapiens
gaccattaataaagac

SEQ ID NO: 6232167 - DNA, 17 bp, Homo sapiens
gaccattcctgtccctt

SEQ ID NO: 6232168 - DNA, 18 bp, Homo sapiens
gaccattctcaccctgtg

SEQ ID NO: 6232169 - DNA, 19 bp, Homo sapiens
gaccattctccacctgcca

SEQ ID NO: 6232170 - DNA, 22 bp, Homo sapiens
gaccattctccacctgccaggg

SEQ ID NO: 6232171 - DNA, 11 bp, Homo sapiens
gaccattctgc

SEQ ID NO: 6232172 - DNA, 12 bp, Homo sapiens
gaccattctgcc

SEQ ID NO: 6232173 - DNA, 20 bp, Homo sapiens
gaccattctgtgaccaaaat

SEQ ID NO: 6232174 - DNA, 14 bp, Homo sapiens
gaccattgacctca

SEQ ID NO: 6232175 - DNA, 17 bp, Homo sapiens
gaccattggggctccca

SEQ ID NO: 6232176 - DNA, 15 bp, Homo sapiens
gaccattgtcttcca

SEQ ID NO: 6232177 - DNA, 19 bp, Homo sapiens
gaccattgtcttccaaccc

SEQ ID NO: 6232178 - DNA, 23 bp, Homo sapiens
gaccattgtcttccaaccccagc

SEQ ID NO: 6232179 - DNA, 20 bp, Homo sapiens
gaccatttagtcctcacctt

SEQ ID NO: 6232180 - DNA, 13 bp, Homo sapiens
gaccatttataat

SEQ ID NO: 6232181 - DNA, 21 bp, Homo sapiens
gaccatttataatgttagtag

SEQ ID NO: 6232182 - DNA, 11 bp, Homo sapiens
gaccattttcc

SEQ ID NO: 6232183 - DNA, 14 bp, Homo sapiens
gaccattttcctgc

SEQ ID NO: 6232184 - DNA, 19 bp, Homo sapiens
gaccattttcctgcattgg

SEQ ID NO: 6232185 - DNA, 19 bp, Homo sapiens
gaccattttttaatttact

SEQ ID NO: 6232186 - DNA, 20 bp, Homo sapiens
gacccaaaacagctttgtct

SEQ ID NO: 6232187 - DNA, 19 bp, Homo sapiens
gacccaaaaggcagaagca

SEQ ID NO: 6232188 - DNA, 20 bp, Homo sapiens
gacccaaaaggcagaagcaa

SEQ ID NO: 6232189 - DNA, 23 bp, Homo sapiens
gacccaaaatgtgaatgaagcta

SEQ ID NO: 6232190 - DNA, 19 bp, Homo sapiens
gacccaaaccccctgcagc

SEQ ID NO: 6232191 - DNA, 21 bp, Homo sapiens
gacccaaaccccctgcagccc

SEQ ID NO: 6232192 - DNA, 12 bp, Homo sapiens
gacccaaagacc

SEQ ID NO: 6232193 - DNA, 13 bp, Homo sapiens
gacccaaagacca

SEQ ID NO: 6232194 - DNA, 14 bp, Homo sapiens
gacccaaagcaaaa

SEQ ID NO: 6232195 - DNA, 15 bp, Homo sapiens
gacccaaaggaagaa

SEQ ID NO: 6232196 - DNA, 18 bp, Homo sapiens
gacccaaatttccctggg

SEQ ID NO: 6232197 - DNA, 23 bp, Homo sapiens
gacccaacccatgcccctgacag

SEQ ID NO: 6232198 - DNA, 19 bp, Homo sapiens
gacccaactgatcctgctc

SEQ ID NO: 6232199 - DNA, 20 bp, Homo sapiens
gacccaactgatcctgctcc

SEQ ID NO: 6232200 - DNA, 22 bp, Homo sapiens
gacccaactttctcactgctgt

SEQ ID NO: 6232201 - DNA, 22 bp, Homo sapiens
gacccaagaactcctgaaatca

SEQ ID NO: 6232202 - DNA, 15 bp, Homo sapiens
gacccaagaggtggg

SEQ ID NO: 6232203 - DNA, 23 bp, Homo sapiens
gacccaagccctgaggcctgagg

SEQ ID NO: 6232204 - DNA, 18 bp, Homo sapiens
gacccaaggaaaactgca

SEQ ID NO: 6232205 - DNA, 13 bp, Homo sapiens
gacccaaggagga

SEQ ID NO: 6232206 - DNA, 17 bp, Homo sapiens
gacccaagtagctgcta

SEQ ID NO: 6232207 - DNA, 17 bp, Homo sapiens
gacccaatgctcctgga

SEQ ID NO: 6232208 - DNA, 18 bp, Homo sapiens
gacccaatgtaggagctg

SEQ ID NO: 6232209 - DNA, 19 bp, Homo sapiens
gacccaatgtaggagctgc

SEQ ID NO: 6232210 - DNA, 23 bp, Homo sapiens
gacccacaaagagagtgcgccct

SEQ ID NO: 6232211 - DNA, 15 bp, Homo sapiens
gacccacaagaaatg

SEQ ID NO: 6232212 - DNA, 22 bp, Homo sapiens
gacccacaagaaatgaaagcag

SEQ ID NO: 6232213 - DNA, 17 bp, Homo sapiens
gacccacactgctacac

SEQ ID NO: 6232214 - DNA, 13 bp, Homo sapiens
gacccacagaact

SEQ ID NO: 6232215 - DNA, 15 bp, Homo sapiens
gacccacagaacttg

SEQ ID NO: 6232216 - DNA, 14 bp, Homo sapiens
gacccacagcctct

SEQ ID NO: 6232217 - DNA, 14 bp, Homo sapiens
gacccacagctctg

SEQ ID NO: 6232218 - DNA, 14 bp, Homo sapiens
gacccacatgccat

SEQ ID NO: 6232219 - DNA, 13 bp, Homo sapiens
gacccacatgtaa

SEQ ID NO: 6232220 - DNA, 19 bp, Homo sapiens
gacccaccaaactgcacac

SEQ ID NO: 6232221 - DNA, 19 bp, Homo sapiens
gacccaccaaggtctcaca

SEQ ID NO: 6232222 - DNA, 17 bp, Homo sapiens
gacccaccatccttcca

SEQ ID NO: 6232223 - DNA, 22 bp, Homo sapiens
gacccaccatccttccatcctg

SEQ ID NO: 6232224 - DNA, 15 bp, Homo sapiens
gacccacccagcccc

SEQ ID NO: 6232225 - DNA, 18 bp, Homo sapiens
gacccacccatcttcctg

SEQ ID NO: 6232226 - DNA, 20 bp, Homo sapiens
gacccacccatcttcctgct

SEQ ID NO: 6232227 - DNA, 22 bp, Homo sapiens
gacccacccatcttcctgctgc

SEQ ID NO: 6232228 - DNA, 16 bp, Homo sapiens
gacccaccccaactct

SEQ ID NO: 6232229 - DNA, 15 bp, Homo sapiens
gacccaccccacctg

SEQ ID NO: 6232230 - DNA, 17 bp, Homo sapiens
gacccaccccacctgca

SEQ ID NO: 6232231 - DNA, 19 bp, Homo sapiens
gacccacccccagccttgc

SEQ ID NO: 6232232 - DNA, 23 bp, Homo sapiens
gacccacccccagccttgcccag

SEQ ID NO: 6232233 - DNA, 16 bp, Homo sapiens
gacccacccctgtgct

SEQ ID NO: 6232234 - DNA, 18 bp, Homo sapiens
gacccacccctgtgctcc

SEQ ID NO: 6232235 - DNA, 21 bp, Homo sapiens
gacccacccgccttggcctcc

SEQ ID NO: 6232236 - DNA, 15 bp, Homo sapiens
gacccacctccccct

SEQ ID NO: 6232237 - DNA, 12 bp, Homo sapiens
gacccacctgct

SEQ ID NO: 6232238 - DNA, 19 bp, Homo sapiens
gacccacctgggccaagga

SEQ ID NO: 6232239 - DNA, 22 bp, Homo sapiens
gacccacctgggccaaggactc

SEQ ID NO: 6232240 - DNA, 20 bp, Homo sapiens
gacccacgaaactgccctgg

SEQ ID NO: 6232241 - DNA, 22 bp, Homo sapiens
gacccacgaaactgccctggct

SEQ ID NO: 6232242 - DNA, 16 bp, Homo sapiens
gacccacggagccctc

SEQ ID NO: 6232243 - DNA, 18 bp, Homo sapiens
gacccacgtgctagggga

SEQ ID NO: 6232244 - DNA, 15 bp, Homo sapiens
gacccactaaagagt

SEQ ID NO: 6232245 - DNA, 16 bp, Homo sapiens
gacccactcacacttg

SEQ ID NO: 6232246 - DNA, 22 bp, Homo sapiens
gacccactccgactccccctcc

SEQ ID NO: 6232247 - DNA, 12 bp, Homo sapiens
gacccactgctt

SEQ ID NO: 6232248 - DNA, 18 bp, Homo sapiens
gacccactggttccttct

SEQ ID NO: 6232249 - DNA, 23 bp, Homo sapiens
gacccacttctcatcacacacat

SEQ ID NO: 6232250 - DNA, 21 bp, Homo sapiens
gacccactttgtaatttttgc

SEQ ID NO: 6232251 - DNA, 20 bp, Homo sapiens
gacccagaatggagcctgct

SEQ ID NO: 6232252 - DNA, 17 bp, Homo sapiens
gacccagagccctctga

SEQ ID NO: 6232253 - DNA, 14 bp, Homo sapiens
gacccagaggtcca

SEQ ID NO: 6232254 - DNA, 24 bp, Homo sapiens
gacccagaggtccaggtcccagcc

SEQ ID NO: 6232255 - DNA, 22 bp, Homo sapiens
gacccagagtggagtctgagtc

SEQ ID NO: 6232256 - DNA, 23 bp, Homo sapiens
gcacctgcctccggcctgcactc

SEQ ID NO: 6232257 - DNA, 19 bp, Homo sapiens
gcacctgcctgccgctgca

SEQ ID NO: 6232258 - DNA, 11 bp, Homo sapiens
gcacctgctcc

SEQ ID NO: 6232259 - DNA, 17 bp, Homo sapiens
gcacctgctcccagtgg

SEQ ID NO: 6232260 - DNA, 12 bp, Homo sapiens
gcacctgctgcg

SEQ ID NO: 6232261 - DNA, 16 bp, Homo sapiens
gcacctgctgcgtccc

SEQ ID NO: 6232262 - DNA, 12 bp, Homo sapiens
gcacctgctgtc

SEQ ID NO: 6232263 - DNA, 15 bp, Homo sapiens
gcacctgctgtctgg

SEQ ID NO: 6232264 - DNA, 15 bp, Homo sapiens
gcacctgcttccacc

SEQ ID NO: 6232265 - DNA, 13 bp, Homo sapiens
gcacctgcttccc

SEQ ID NO: 6232266 - DNA, 19 bp, Homo sapiens
gcacctgcttcccccactt

SEQ ID NO: 6232267 - DNA, 23 bp, Homo sapiens
gcacctgcttcccccacttcacc

SEQ ID NO: 6232268 - DNA, 22 bp, Homo sapiens
gcacctggaatatataaccagt

SEQ ID NO: 6232269 - DNA, 14 bp, Homo sapiens
gcacctggaccccc

SEQ ID NO: 6232270 - DNA, 17 bp, Homo sapiens
gcacctggaccccctgc

SEQ ID NO: 6232271 - DNA, 19 bp, Homo sapiens
gcacctggaccccctgccc

SEQ ID NO: 6232272 - DNA, 23 bp, Homo sapiens
gcacctggaccccctgcccgcca

SEQ ID NO: 6232273 - DNA, 11 bp, Homo sapiens
gcacctggcct

SEQ ID NO: 6232274 - DNA, 15 bp, Homo sapiens
gcacctggcctgggc

SEQ ID NO: 6232275 - DNA, 17 bp, Homo sapiens
gcacctggcctgggcca

SEQ ID NO: 6232276 - DNA, 18 bp, Homo sapiens
gcacctggcctgggccac

SEQ ID NO: 6232277 - DNA, 21 bp, Homo sapiens
gcacctgggaaaacagaggaa

SEQ ID NO: 6232278 - DNA, 22 bp, Homo sapiens
gcacctgggcagctcctccctg

SEQ ID NO: 6232279 - DNA, 17 bp, Homo sapiens
gcacctgggccccactg

SEQ ID NO: 6232280 - DNA, 19 bp, Homo sapiens
gcacctgggccccactgga

SEQ ID NO: 6232281 - DNA, 21 bp, Homo sapiens
gcacctgggccccactggaca

SEQ ID NO: 6232282 - DNA, 16 bp, Homo sapiens
gcacctgggccctggg

SEQ ID NO: 6232283 - DNA, 18 bp, Homo sapiens
gcacctgggccctggggc

SEQ ID NO: 6232284 - DNA, 19 bp, Homo sapiens
gcacctgggccctggggcc

SEQ ID NO: 6232285 - DNA, 20 bp, Homo sapiens
gcacctgggccctggggcct

SEQ ID NO: 6232286 - DNA, 22 bp, Homo sapiens
gcacctgggccctggggcctgt

SEQ ID NO: 6232287 - DNA, 21 bp, Homo sapiens
gcacctgggctgaggaggcag

SEQ ID NO: 6232288 - DNA, 20 bp, Homo sapiens
gcacctgggctttctggaat

SEQ ID NO: 6232289 - DNA, 21 bp, Homo sapiens
gcacctgggtgctctggctgg

SEQ ID NO: 6232290 - DNA, 18 bp, Homo sapiens
gcacctgggtgtgctcca

SEQ ID NO: 6232291 - DNA, 23 bp, Homo sapiens
gcacctgggtgtgctccaggctt

SEQ ID NO: 6232292 - DNA, 21 bp, Homo sapiens
gcacctggtggggaggaagaa

SEQ ID NO: 6232293 - DNA, 17 bp, Homo sapiens
gcacctggtgggtggtg

SEQ ID NO: 6232294 - DNA, 22 bp, Homo sapiens
gcacctgtacagtggaaccgtt

SEQ ID NO: 6232295 - DNA, 16 bp, Homo sapiens
gcacctgtagtcccag

SEQ ID NO: 6232296 - DNA, 18 bp, Homo sapiens
gcacctgtagtcccagct

SEQ ID NO: 6232297 - DNA, 14 bp, Homo sapiens
gcacctgtcacctt

SEQ ID NO: 6232298 - DNA, 19 bp, Homo sapiens
gcacctgtcccagaaaaag

SEQ ID NO: 6232299 - DNA, 23 bp, Homo sapiens
gcacctgtccccaccctccactc

SEQ ID NO: 6232300 - DNA, 21 bp, Homo sapiens
gcacctgtctgctccagctct

SEQ ID NO: 6232301 - DNA, 14 bp, Homo sapiens
gcacctgtggccag

SEQ ID NO: 6232302 - DNA, 19 bp, Homo sapiens
gcacctgtggccagagcac

SEQ ID NO: 6232303 - DNA, 15 bp, Homo sapiens
gcacctgtggcctct

SEQ ID NO: 6232304 - DNA, 18 bp, Homo sapiens
gcacctgtgttccagccc

SEQ ID NO: 6232305 - DNA, 12 bp, Homo sapiens
gcacctgtttcc

SEQ ID NO: 6232306 - DNA, 21 bp, Homo sapiens
gcaccttaatattattggggt

SEQ ID NO: 6232307 - DNA, 18 bp, Homo sapiens
gcaccttaccaactttct

SEQ ID NO: 6232308 - DNA, 20 bp, Homo sapiens
gcaccttaccaactttctgt

SEQ ID NO: 6232309 - DNA, 13 bp, Homo sapiens
gcaccttagtggc

SEQ ID NO: 6232310 - DNA, 21 bp, Homo sapiens
gcaccttcaagcgctccaggg

SEQ ID NO: 6232311 - DNA, 15 bp, Homo sapiens
gcaccttcagaatat

SEQ ID NO: 6232312 - DNA, 14 bp, Homo sapiens
gcaccttcagactt

SEQ ID NO: 6232313 - DNA, 19 bp, Homo sapiens
gcaccttccccctccccca

SEQ ID NO: 6232314 - DNA, 15 bp, Homo sapiens
gcaccttcctcactt

SEQ ID NO: 6232315 - DNA, 16 bp, Homo sapiens
gcaccttcctcacttc

SEQ ID NO: 6232316 - DNA, 23 bp, Homo sapiens
gcaccttcttggcgctggagagt

SEQ ID NO: 6232317 - DNA, 16 bp, Homo sapiens
gcaccttctttctgga

SEQ ID NO: 6232318 - DNA, 19 bp, Homo sapiens
gcaccttctttctggactg

SEQ ID NO: 6232319 - DNA, 17 bp, Homo sapiens
gcaccttgattggaaaa

SEQ ID NO: 6232320 - DNA, 16 bp, Homo sapiens
gcaccttggcccagga

SEQ ID NO: 6232321 - DNA, 22 bp, Homo sapiens
gcaccttggcccaggagctctg

SEQ ID NO: 6232322 - DNA, 18 bp, Homo sapiens
gcaccttgggcacgggag

SEQ ID NO: 6232323 - DNA, 18 bp, Homo sapiens
gcaccttgtcatgtacca

SEQ ID NO: 6232324 - DNA, 18 bp, Homo sapiens
gcaccttgtgcctggggt

SEQ ID NO: 6232325 - DNA, 19 bp, Homo sapiens
gcaccttgtgcctggggtg

SEQ ID NO: 6232326 - DNA, 14 bp, Homo sapiens
gcaccttgtgtctg

SEQ ID NO: 6232327 - DNA, 14 bp, Homo sapiens
gcacctttctctga

SEQ ID NO: 6232328 - DNA, 18 bp, Homo sapiens
gcacctttctctgagaag

SEQ ID NO: 6232329 - DNA, 16 bp, Homo sapiens
gcacctttgagagagg

SEQ ID NO: 6232330 - DNA, 19 bp, Homo sapiens
gcacctttgagagaggggg

SEQ ID NO: 6232331 - DNA, 20 bp, Homo sapiens
gcaccttttataccagagac

SEQ ID NO: 6232332 - DNA, 15 bp, Homo sapiens
gcacgaaatgttatt

SEQ ID NO: 6232333 - DNA, 15 bp, Homo sapiens
gcacgaacccacctg

SEQ ID NO: 6232334 - DNA, 17 bp, Homo sapiens
gcacgaacccacctgct

SEQ ID NO: 6232335 - DNA, 13 bp, Homo sapiens
gcacgacagtgga

SEQ ID NO: 6232336 - DNA, 17 bp, Homo sapiens
gcacgacgccctctccc

SEQ ID NO: 6232337 - DNA, 20 bp, Homo sapiens
gcacgacgtcagcctcttac

SEQ ID NO: 6232338 - DNA, 22 bp, Homo sapiens
gcacgactgcgggagccagact

SEQ ID NO: 6232339 - DNA, 15 bp, Homo sapiens
gcacgagcctgggcg

SEQ ID NO: 6232340 - DNA, 23 bp, Homo sapiens
gcacgaggccttcagaaaagaca

SEQ ID NO: 6232341 - DNA, 16 bp, Homo sapiens
gcacgaggggggccag

SEQ ID NO: 6232342 - DNA, 15 bp, Homo sapiens
gcacgatctcagctc

SEQ ID NO: 6232343 - DNA, 16 bp, Homo sapiens
gcacgatctcagctca

SEQ ID NO: 6232344 - DNA, 16 bp, Homo sapiens
gcacgcaagcctcagc

SEQ ID NO: 6232345 - DNA, 10 bp, Homo sapiens
gcacgcacac

SEQ ID NO: 6232346 - DNA, 11 bp, Homo sapiens
gcacgcacaca

SEQ ID NO: 6232347 - DNA, 12 bp, Homo sapiens
gcacgcacacac

SEQ ID NO: 6232348 - DNA, 13 bp, Homo sapiens
gcacgcacacaca

SEQ ID NO: 6232349 - DNA, 15 bp, Homo sapiens
gcacgcacacacaca

SEQ ID NO: 6232350 - DNA, 16 bp, Homo sapiens
gcacgcacacacacat

SEQ ID NO: 6232351 - DNA, 22 bp, Homo sapiens
gcacgcacacacacatacagag

SEQ ID NO: 6232352 - DNA, 19 bp, Homo sapiens
gcacgcacacgcacacatc

SEQ ID NO: 6232353 - DNA, 21 bp, Homo sapiens
gcacgcacacgcacacatctt

SEQ ID NO: 6232354 - DNA, 15 bp, Homo sapiens
gcacgcaccactgct

SEQ ID NO: 6232355 - DNA, 19 bp, Homo sapiens
gcacgcaccactgcttccc

SEQ ID NO: 6232356 - DNA, 19 bp, Homo sapiens
gcacgcacccacaccctac

SEQ ID NO: 6232357 - DNA, 21 bp, Homo sapiens
gcacgcacccacaccctacag

SEQ ID NO: 6232358 - DNA, 21 bp, Homo sapiens
gcacgcacccgtatctgccct

SEQ ID NO: 6232359 - DNA, 16 bp, Homo sapiens
gcacgcacctgtagtc

SEQ ID NO: 6232360 - DNA, 12 bp, Homo sapiens
gcacgcagtggc

SEQ ID NO: 6232361 - DNA, 17 bp, Homo sapiens
gcacgcagttatgttac

SEQ ID NO: 6232362 - DNA, 16 bp, Homo sapiens
gcacgcatctgtagtt

SEQ ID NO: 6232363 - DNA, 16 bp, Homo sapiens
gcacgcatgtccctcc

SEQ ID NO: 6232364 - DNA, 18 bp, Homo sapiens
gcacgccaaccccagcag

SEQ ID NO: 6232365 - DNA, 22 bp, Homo sapiens
gcacgccaccacacctggcttt

SEQ ID NO: 6232366 - DNA, 15 bp, Homo sapiens
gcacgcccatgtgtg

SEQ ID NO: 6232367 - DNA, 21 bp, Homo sapiens
gcacgcctctccccaccttct

SEQ ID NO: 6232368 - DNA, 13 bp, Homo sapiens
gcacgcctgagcg

SEQ ID NO: 6232369 - DNA, 16 bp, Homo sapiens
gcacgcctgcaggctg

SEQ ID NO: 6232370 - DNA, 19 bp, Homo sapiens
gcacgcctgcaggctggag

SEQ ID NO: 6232371 - DNA, 20 bp, Homo sapiens
gcacgcctgcaggctggaga

SEQ ID NO: 6232372 - DNA, 21 bp, Homo sapiens
gcacgcctgccatcttctccc

SEQ ID NO: 6232373 - DNA, 13 bp, Homo sapiens
gcacgcctgcccc

SEQ ID NO: 6232374 - DNA, 13 bp, Homo sapiens
gcacgcctgctgg

SEQ ID NO: 6232375 - DNA, 18 bp, Homo sapiens
gcacgcgccctttctacc

SEQ ID NO: 6232376 - DNA, 18 bp, Homo sapiens
gcacgcgcgagtgtgctg

SEQ ID NO: 6232377 - DNA, 19 bp, Homo sapiens
gcacgcgcgagtgtgctgt

SEQ ID NO: 6232378 - DNA, 22 bp, Homo sapiens
gcacgcggatgctactactgca

SEQ ID NO: 6232379 - DNA, 23 bp, Homo sapiens
gcacgcggattaatttgcatctg

SEQ ID NO: 6232380 - DNA, 20 bp, Homo sapiens
gcacgcggccgctctccgcc

SEQ ID NO: 6232381 - DNA, 21 bp, Homo sapiens
gcacgcggccgctctccgccc

SEQ ID NO: 6232382 - DNA, 15 bp, Homo sapiens
gcacgcgtgtgcagg

SEQ ID NO: 6232383 - DNA, 14 bp, Homo sapiens
gcacgctcgctgcc

SEQ ID NO: 6232384 - DNA, 12 bp, Homo sapiens
gcacgctgtggg

SEQ ID NO: 6232385 - DNA, 21 bp, Homo sapiens
gcacgcttgcgtatgtctgtt

SEQ ID NO: 6232386 - DNA, 12 bp, Homo sapiens
gcacggactctt

SEQ ID NO: 6232387 - DNA, 14 bp, Homo sapiens
gcacggagagaagg

SEQ ID NO: 6232388 - DNA, 18 bp, Homo sapiens
gcacggagccgcgggaca

SEQ ID NO: 6232389 - DNA, 17 bp, Homo sapiens
gcacggagcgccccggc

SEQ ID NO: 6232390 - DNA, 20 bp, Homo sapiens
gcacggagtgttggggctgg

SEQ ID NO: 6232391 - DNA, 21 bp, Homo sapiens
gcacggagtgttggggctggg

SEQ ID NO: 6232392 - DNA, 14 bp, Homo sapiens
gcacggcagccaca

SEQ ID NO: 6232393 - DNA, 16 bp, Homo sapiens
gcacggcagccacagc

SEQ ID NO: 6232394 - DNA, 20 bp, Homo sapiens
gcacggcagcttgagcctgt

SEQ ID NO: 6232395 - DNA, 13 bp, Homo sapiens
gcacggctctggg

SEQ ID NO: 6232396 - DNA, 22 bp, Homo sapiens
gcacggctctgtccccagcctg

SEQ ID NO: 6232397 - DNA, 15 bp, Homo sapiens
gcacgggcaaagaaa

SEQ ID NO: 6232398 - DNA, 18 bp, Homo sapiens
gcacgggcaaagaaaaca

SEQ ID NO: 6232399 - DNA, 15 bp, Homo sapiens
gcacgggcatgcaca

SEQ ID NO: 6232400 - DNA, 19 bp, Homo sapiens
gcacgggccctccctccca

SEQ ID NO: 6232401 - DNA, 13 bp, Homo sapiens
gcacggggacctg

SEQ ID NO: 6232402 - DNA, 14 bp, Homo sapiens
gcacggggacctgg

SEQ ID NO: 6232403 - DNA, 14 bp, Homo sapiens
gcacgggggagtga

SEQ ID NO: 6232404 - DNA, 20 bp, Homo sapiens
gcacgggggagtgagacagg

SEQ ID NO: 6232405 - DNA, 14 bp, Homo sapiens
gcacgggtccctgc

SEQ ID NO: 6232406 - DNA, 14 bp, Homo sapiens
gcacgggtggtccc

SEQ ID NO: 6232407 - DNA, 16 bp, Homo sapiens
gcacgggtggtccccg

SEQ ID NO: 6232408 - DNA, 23 bp, Homo sapiens
gcacgggtgtcacggccaggcag

SEQ ID NO: 6232409 - DNA, 18 bp, Homo sapiens
gcacggtcccccaggagg

SEQ ID NO: 6232410 - DNA, 18 bp, Homo sapiens
gcacggtgactctgtcca

SEQ ID NO: 6232411 - DNA, 16 bp, Homo sapiens
gcacggtgggccttgc

SEQ ID NO: 6232412 - DNA, 18 bp, Homo sapiens
gcacggtggtgaggcagt

SEQ ID NO: 6232413 - DNA, 15 bp, Homo sapiens
gcacggtttgtgaga

SEQ ID NO: 6232414 - DNA, 16 bp, Homo sapiens
gcacggtttgtgagag

SEQ ID NO: 6232415 - DNA, 20 bp, Homo sapiens
gcacgtaggttccccagaga

SEQ ID NO: 6232416 - DNA, 21 bp, Homo sapiens
gcacgtagtagggtcaggcca

SEQ ID NO: 6232417 - DNA, 21 bp, Homo sapiens
gcacgtatttatttataagtt

SEQ ID NO: 6232418 - DNA, 17 bp, Homo sapiens
gcacgtcaccctcctga

SEQ ID NO: 6232419 - DNA, 19 bp, Homo sapiens
gcacgtcaccctcctgagc

SEQ ID NO: 6232420 - DNA, 21 bp, Homo sapiens
gcacgtcaccctcctgagcct

SEQ ID NO: 6232421 - DNA, 20 bp, Homo sapiens
gcacgtcgcccgctgagctg

SEQ ID NO: 6232422 - DNA, 13 bp, Homo sapiens
gcacgtctcagag

SEQ ID NO: 6232423 - DNA, 14 bp, Homo sapiens
gcacgtctcctgct

SEQ ID NO: 6232424 - DNA, 16 bp, Homo sapiens
gcacgtctcctgctgc

SEQ ID NO: 6232425 - DNA, 17 bp, Homo sapiens
gcacgtctcctgctgcg

SEQ ID NO: 6232426 - DNA, 18 bp, Homo sapiens
gcacgtctcctgctgcgt

SEQ ID NO: 6232427 - DNA, 21 bp, Homo sapiens
gcacgtctcctgctgcgtgac

SEQ ID NO: 6232428 - DNA, 16 bp, Homo sapiens
gcacgtgacaggctcg

SEQ ID NO: 6232429 - DNA, 19 bp, Homo sapiens
gcacgtgatctgctggcct

SEQ ID NO: 6232430 - DNA, 15 bp, Homo sapiens
gcacgtgcaaggact

SEQ ID NO: 6232431 - DNA, 13 bp, Homo sapiens
gcacgtgcacaca

SEQ ID NO: 6232432 - DNA, 18 bp, Homo sapiens
gcacgtgcacacacctgc

SEQ ID NO: 6232433 - DNA, 12 bp, Homo sapiens
gcacgtgcctgt

SEQ ID NO: 6232434 - DNA, 14 bp, Homo sapiens
gcacgtgcctgtgg

SEQ ID NO: 6232435 - DNA, 17 bp, Homo sapiens
gacccagatatggaaac

SEQ ID NO: 6232436 - DNA, 14 bp, Homo sapiens
gacccagcagcagc

SEQ ID NO: 6232437 - DNA, 15 bp, Homo sapiens
gacccagcaggaagc

SEQ ID NO: 6232438 - DNA, 21 bp, Homo sapiens
gacccagcaggaagccaggct

SEQ ID NO: 6232439 - DNA, 23 bp, Homo sapiens
gacccagcaggaagccaggctga

SEQ ID NO: 6232440 - DNA, 22 bp, Homo sapiens
gacccagcatctcccagcaaga

SEQ ID NO: 6232441 - DNA, 20 bp, Homo sapiens
gacccagcatgggttagtgc

SEQ ID NO: 6232442 - DNA, 17 bp, Homo sapiens
gacccagccagctgcag

SEQ ID NO: 6232443 - DNA, 22 bp, Homo sapiens
gacccagccagctgcagggcac

SEQ ID NO: 6232444 - DNA, 14 bp, Homo sapiens
gacccagccaggcc

SEQ ID NO: 6232445 - DNA, 19 bp, Homo sapiens
gacccagccccttcccctg

SEQ ID NO: 6232446 - DNA, 21 bp, Homo sapiens
gacccagccccttcccctggg

SEQ ID NO: 6232447 - DNA, 22 bp, Homo sapiens
gacccagccccttcccctggga

SEQ ID NO: 6232448 - DNA, 23 bp, Homo sapiens
gacccagccccttgagaaacctt

SEQ ID NO: 6232449 - DNA, 20 bp, Homo sapiens
gacccagcccgcggcctgga

SEQ ID NO: 6232450 - DNA, 17 bp, Homo sapiens
gacccagccctcatccc

SEQ ID NO: 6232451 - DNA, 12 bp, Homo sapiens
gacccagcctga

SEQ ID NO: 6232452 - DNA, 23 bp, Homo sapiens
gacccagcgccggggggagggag

SEQ ID NO: 6232453 - DNA, 18 bp, Homo sapiens
gacccagctactctgtcc

SEQ ID NO: 6232454 - DNA, 19 bp, Homo sapiens
gacccagctactctgtcca

SEQ ID NO: 6232455 - DNA, 21 bp, Homo sapiens
gacccagctactctgtccagg

SEQ ID NO: 6232456 - DNA, 23 bp, Homo sapiens
gacccagctactctgtccaggcc

SEQ ID NO: 6232457 - DNA, 16 bp, Homo sapiens
gacccagctcctctga

SEQ ID NO: 6232458 - DNA, 19 bp, Homo sapiens
gacccagcttagagttctt

SEQ ID NO: 6232459 - DNA, 15 bp, Homo sapiens
gacccaggaaaggca

SEQ ID NO: 6232460 - DNA, 21 bp, Homo sapiens
gacccaggaaaggcaggattg

SEQ ID NO: 6232461 - DNA, 15 bp, Homo sapiens
gacccaggaaccgat

SEQ ID NO: 6232462 - DNA, 22 bp, Homo sapiens
gacccaggacaggatccaggcc

SEQ ID NO: 6232463 - DNA, 20 bp, Homo sapiens
gacccaggactcctccccac

SEQ ID NO: 6232464 - DNA, 22 bp, Homo sapiens
gacccaggagacaaacagccct

SEQ ID NO: 6232465 - DNA, 18 bp, Homo sapiens
gacccaggagtccagacc

SEQ ID NO: 6232466 - DNA, 16 bp, Homo sapiens
gacccaggagtccagc

SEQ ID NO: 6232467 - DNA, 20 bp, Homo sapiens
gacccaggatatctgaaaat

SEQ ID NO: 6232468 - DNA, 21 bp, Homo sapiens
gacccaggatatctgaaaata

SEQ ID NO: 6232469 - DNA, 16 bp, Homo sapiens
gacccaggcacctgca

SEQ ID NO: 6232470 - DNA, 15 bp, Homo sapiens
gacccaggccctcca

SEQ ID NO: 6232471 - DNA, 13 bp, Homo sapiens
gacccaggccgca

SEQ ID NO: 6232472 - DNA, 18 bp, Homo sapiens
gacccaggccgcctgcca

SEQ ID NO: 6232473 - DNA, 17 bp, Homo sapiens
gacccaggctcccagcc

SEQ ID NO: 6232474 - DNA, 23 bp, Homo sapiens
gacccaggctccgcccttagtcc

SEQ ID NO: 6232475 - DNA, 15 bp, Homo sapiens
gacccagggaacagc

SEQ ID NO: 6232476 - DNA, 19 bp, Homo sapiens
gacccagggaacagccact

SEQ ID NO: 6232477 - DNA, 16 bp, Homo sapiens
gacccagggactctcc

SEQ ID NO: 6232478 - DNA, 12 bp, Homo sapiens
gacccagggcag

SEQ ID NO: 6232479 - DNA, 15 bp, Homo sapiens
gacccagggcagtgt

SEQ ID NO: 6232480 - DNA, 23 bp, Homo sapiens
gacccagggcagtgtggtgggag

SEQ ID NO: 6232481 - DNA, 12 bp, Homo sapiens
gacccagggcct

SEQ ID NO: 6232482 - DNA, 13 bp, Homo sapiens
gacccagggccta

SEQ ID NO: 6232483 - DNA, 21 bp, Homo sapiens
gacccagggcctgacttgagc

SEQ ID NO: 6232484 - DNA, 23 bp, Homo sapiens
gacccagggcctgacttgagcca

SEQ ID NO: 6232485 - DNA, 18 bp, Homo sapiens
gacccaggggtccaggcc

SEQ ID NO: 6232486 - DNA, 20 bp, Homo sapiens
gacccaggggtccaggcccc

SEQ ID NO: 6232487 - DNA, 14 bp, Homo sapiens
gacccaggtcttcc

SEQ ID NO: 6232488 - DNA, 19 bp, Homo sapiens
gacccaggtcttccagacc

SEQ ID NO: 6232489 - DNA, 22 bp, Homo sapiens
gacccaggtggagggcacagcc

SEQ ID NO: 6232490 - DNA, 23 bp, Homo sapiens
gacccaggtggagggcacagccc

SEQ ID NO: 6232491 - DNA, 12 bp, Homo sapiens
gacccaggtgtg

SEQ ID NO: 6232492 - DNA, 16 bp, Homo sapiens
gacccaggtgtgcctg

SEQ ID NO: 6232493 - DNA, 19 bp, Homo sapiens
gacccaggtgtgcctgtgc

SEQ ID NO: 6232494 - DNA, 20 bp, Homo sapiens
gacccagtcccacactgtgg

SEQ ID NO: 6232495 - DNA, 16 bp, Homo sapiens
gacccagtccctgggg

SEQ ID NO: 6232496 - DNA, 17 bp, Homo sapiens
gacccagtgcactccgg

SEQ ID NO: 6232497 - DNA, 12 bp, Homo sapiens
gacccagtgcag

SEQ ID NO: 6232498 - DNA, 15 bp, Homo sapiens
gacccagtgccccca

SEQ ID NO: 6232499 - DNA, 20 bp, Homo sapiens
gacccagtgcccccactgac

SEQ ID NO: 6232500 - DNA, 14 bp, Homo sapiens
gacccagtggcagg

SEQ ID NO: 6232501 - DNA, 15 bp, Homo sapiens
gacccagtggcaggg

SEQ ID NO: 6232502 - DNA, 16 bp, Homo sapiens
gacccagtggcagggc

SEQ ID NO: 6232503 - DNA, 14 bp, Homo sapiens
gacccagtggggag

SEQ ID NO: 6232504 - DNA, 12 bp, Homo sapiens
gacccagtgtgt

SEQ ID NO: 6232505 - DNA, 16 bp, Homo sapiens
gacccagtgtgtgctc

SEQ ID NO: 6232506 - DNA, 23 bp, Homo sapiens
gacccagtgtgtgctcagcagcc

SEQ ID NO: 6232507 - DNA, 21 bp, Homo sapiens
gacccatccctgcctggaggc

SEQ ID NO: 6232508 - DNA, 11 bp, Homo sapiens
gacccatctgt

SEQ ID NO: 6232509 - DNA, 15 bp, Homo sapiens
gacccatgctgccct

SEQ ID NO: 6232510 - DNA, 18 bp, Homo sapiens
gacccatgctgccctgtg

SEQ ID NO: 6232511 - DNA, 14 bp, Homo sapiens
gacccatgggcagg

SEQ ID NO: 6232512 - DNA, 18 bp, Homo sapiens
gacccatgggcaggagac

SEQ ID NO: 6232513 - DNA, 18 bp, Homo sapiens
gacccatgggggctgtct

SEQ ID NO: 6232514 - DNA, 20 bp, Homo sapiens
gacccatgtaatccttttgt

SEQ ID NO: 6232515 - DNA, 17 bp, Homo sapiens
gacccattcacatttta

SEQ ID NO: 6232516 - DNA, 20 bp, Homo sapiens
gacccattctacacagagca

SEQ ID NO: 6232517 - DNA, 20 bp, Homo sapiens
gacccatttaatttctattg

SEQ ID NO: 6232518 - DNA, 23 bp, Homo sapiens
gaccccaaacaccttccagctcc

SEQ ID NO: 6232519 - DNA, 19 bp, Homo sapiens
gaccccaaagactctggag

SEQ ID NO: 6232520 - DNA, 18 bp, Homo sapiens
gaccccaaagagcctgga

SEQ ID NO: 6232521 - DNA, 23 bp, Homo sapiens
gaccccaaagagcctggagaagc

SEQ ID NO: 6232522 - DNA, 15 bp, Homo sapiens
gaccccaacctcaga

SEQ ID NO: 6232523 - DNA, 21 bp, Homo sapiens
gaccccaaggacctgcctccc

SEQ ID NO: 6232524 - DNA, 13 bp, Homo sapiens
gaccccacacgcc

SEQ ID NO: 6232525 - DNA, 21 bp, Homo sapiens
gaccccacacgccggggctgg

SEQ ID NO: 6232526 - DNA, 22 bp, Homo sapiens
gaccccacacgccggggctggc

SEQ ID NO: 6232527 - DNA, 22 bp, Homo sapiens
gaccccacatccttctcactgc

SEQ ID NO: 6232528 - DNA, 18 bp, Homo sapiens
gaccccaccctgtctgca

SEQ ID NO: 6232529 - DNA, 15 bp, Homo sapiens
gaccccaccgccacc

SEQ ID NO: 6232530 - DNA, 23 bp, Homo sapiens
gaccccacgtgcgacagagagag

SEQ ID NO: 6232531 - DNA, 15 bp, Homo sapiens
gaccccactcccctc

SEQ ID NO: 6232532 - DNA, 15 bp, Homo sapiens
gaccccactggagtc

SEQ ID NO: 6232533 - DNA, 21 bp, Homo sapiens
gaccccactggagtctctctc

SEQ ID NO: 6232534 - DNA, 13 bp, Homo sapiens
gaccccagagaaa

SEQ ID NO: 6232535 - DNA, 12 bp, Homo sapiens
gaccccagagga

SEQ ID NO: 6232536 - DNA, 13 bp, Homo sapiens
gaccccagaggga

SEQ ID NO: 6232537 - DNA, 23 bp, Homo sapiens
gaccccagagggaccagctgggg

SEQ ID NO: 6232538 - DNA, 19 bp, Homo sapiens
gaccccagatacctgtgag

SEQ ID NO: 6232539 - DNA, 20 bp, Homo sapiens
gaccccagatacctgtgagg

SEQ ID NO: 6232540 - DNA, 18 bp, Homo sapiens
gaccccagcggctgagtc

SEQ ID NO: 6232541 - DNA, 19 bp, Homo sapiens
gaccccagcggctgagtca

SEQ ID NO: 6232542 - DNA, 12 bp, Homo sapiens
gaccccagctcc

SEQ ID NO: 6232543 - DNA, 20 bp, Homo sapiens
gaccccagctccaggcagga

SEQ ID NO: 6232544 - DNA, 12 bp, Homo sapiens
gaccccagctct

SEQ ID NO: 6232545 - DNA, 12 bp, Homo sapiens
gaccccagctgc

SEQ ID NO: 6232546 - DNA, 22 bp, Homo sapiens
gaccccagctgtgagccttggc

SEQ ID NO: 6232547 - DNA, 12 bp, Homo sapiens
gaccccagggca

SEQ ID NO: 6232548 - DNA, 18 bp, Homo sapiens
gaccccagggcacaggag

SEQ ID NO: 6232549 - DNA, 19 bp, Homo sapiens
gaccccagggcacaggagc

SEQ ID NO: 6232550 - DNA, 13 bp, Homo sapiens
gaccccagggcag

SEQ ID NO: 6232551 - DNA, 12 bp, Homo sapiens
gaccccagggtg

SEQ ID NO: 6232552 - DNA, 17 bp, Homo sapiens
gaccccaggtcagccct

SEQ ID NO: 6232553 - DNA, 18 bp, Homo sapiens
gaccccaggtcagccctg

SEQ ID NO: 6232554 - DNA, 23 bp, Homo sapiens
gaccccaggtcagccctgtgtct

SEQ ID NO: 6232555 - DNA, 19 bp, Homo sapiens
gaccccagtcaagctccta

SEQ ID NO: 6232556 - DNA, 15 bp, Homo sapiens
gaccccagtgcctgc

SEQ ID NO: 6232557 - DNA, 16 bp, Homo sapiens
gaccccagtgcctgca

SEQ ID NO: 6232558 - DNA, 13 bp, Homo sapiens
gaccccagtttct

SEQ ID NO: 6232559 - DNA, 19 bp, Homo sapiens
gaccccatcactcgcagga

SEQ ID NO: 6232560 - DNA, 14 bp, Homo sapiens
gaccccatctcatt

SEQ ID NO: 6232561 - DNA, 15 bp, Homo sapiens
gaccccatctgccca

SEQ ID NO: 6232562 - DNA, 18 bp, Homo sapiens
gaccccatctgcccagga

SEQ ID NO: 6232563 - DNA, 19 bp, Homo sapiens
gaccccatctgtgaataag

SEQ ID NO: 6232564 - DNA, 19 bp, Homo sapiens
gaccccatggtccatcccc

SEQ ID NO: 6232565 - DNA, 21 bp, Homo sapiens
gaccccatggtccatcccctg

SEQ ID NO: 6232566 - DNA, 20 bp, Homo sapiens
gaccccattctgagctcccc

SEQ ID NO: 6232567 - DNA, 21 bp, Homo sapiens
gacccccaaccaagtggctcc

SEQ ID NO: 6232568 - DNA, 14 bp, Homo sapiens
gacccccaactcct

SEQ ID NO: 6232569 - DNA, 14 bp, Homo sapiens
gacccccacaacaa

SEQ ID NO: 6232570 - DNA, 12 bp, Homo sapiens
gacccccacccc

SEQ ID NO: 6232571 - DNA, 15 bp, Homo sapiens
gacccccaccccttc

SEQ ID NO: 6232572 - DNA, 17 bp, Homo sapiens
gacccccaccccttccc

SEQ ID NO: 6232573 - DNA, 16 bp, Homo sapiens
gacccccaccctgcac

SEQ ID NO: 6232574 - DNA, 21 bp, Homo sapiens
gacccccactgccgcctcctt

SEQ ID NO: 6232575 - DNA, 13 bp, Homo sapiens
gacccccagctcc

SEQ ID NO: 6232576 - DNA, 12 bp, Homo sapiens
gacccccaggaa

SEQ ID NO: 6232577 - DNA, 21 bp, Homo sapiens
gacccccaggaaggaaacaga

SEQ ID NO: 6232578 - DNA, 12 bp, Homo sapiens
gacccccaggac

SEQ ID NO: 6232579 - DNA, 11 bp, Homo sapiens
gacccccaggc

SEQ ID NO: 6232580 - DNA, 24 bp, Homo sapiens
gacccccaggcctgtccaccctgc

SEQ ID NO: 6232581 - DNA, 15 bp, Homo sapiens
gacccccatccagcc

SEQ ID NO: 6232582 - DNA, 16 bp, Homo sapiens
gacccccatccagcct

SEQ ID NO: 6232583 - DNA, 20 bp, Homo sapiens
gacccccatccagcctccag

SEQ ID NO: 6232584 - DNA, 16 bp, Homo sapiens
gacccccatctctgca

SEQ ID NO: 6232585 - DNA, 18 bp, Homo sapiens
gacccccatctgagctgg

SEQ ID NO: 6232586 - DNA, 14 bp, Homo sapiens
gacccccatgtaaa

SEQ ID NO: 6232587 - DNA, 13 bp, Homo sapiens
gaccccccacccc

SEQ ID NO: 6232588 - DNA, 21 bp, Homo sapiens
gaccccccagcccctcctccc

SEQ ID NO: 6232589 - DNA, 23 bp, Homo sapiens
gaccccccagcccctcctccctc

SEQ ID NO: 6232590 - DNA, 15 bp, Homo sapiens
gacccccccagtccg

SEQ ID NO: 6232591 - DNA, 23 bp, Homo sapiens
gacccccccccaatcggactgcc

SEQ ID NO: 6232592 - DNA, 18 bp, Homo sapiens
gacccccctcaggaccct

SEQ ID NO: 6232593 - DNA, 14 bp, Homo sapiens
gacccccgaggccc

SEQ ID NO: 6232594 - DNA, 15 bp, Homo sapiens
gacccccgaggcccc

SEQ ID NO: 6232595 - DNA, 20 bp, Homo sapiens
gacccccgaggcccccctct

SEQ ID NO: 6232596 - DNA, 16 bp, Homo sapiens
gacccccgccccctgc

SEQ ID NO: 6232597 - DNA, 20 bp, Homo sapiens
gacccccggcctccaggctg

SEQ ID NO: 6232598 - DNA, 23 bp, Homo sapiens
gacccccggcctccaggctgggg

SEQ ID NO: 6232599 - DNA, 21 bp, Homo sapiens
gaccccctcaccatccagtgg

SEQ ID NO: 6232600 - DNA, 13 bp, Homo sapiens
gaccccctccccc

SEQ ID NO: 6232601 - DNA, 16 bp, Homo sapiens
gaccccctcgccagct

SEQ ID NO: 6232602 - DNA, 15 bp, Homo sapiens
gaccccctgcccgcc

SEQ ID NO: 6232603 - DNA, 14 bp, Homo sapiens
gacccccttcccct

SEQ ID NO: 6232604 - DNA, 18 bp, Homo sapiens
gacccccttgcccaggcc

SEQ ID NO: 6232605 - DNA, 18 bp, Homo sapiens
gaccccgagaagtgctct

SEQ ID NO: 6232606 - DNA, 20 bp, Homo sapiens
gaccccgagcctggctccaa

SEQ ID NO: 6232607 - DNA, 14 bp, Homo sapiens
gaccccgagggctg

SEQ ID NO: 6232608 - DNA, 15 bp, Homo sapiens
gaccccgcacccggc

SEQ ID NO: 6232609 - DNA, 20 bp, Homo sapiens
gaccccgcacccggctcgtg

SEQ ID NO: 6232610 - DNA, 14 bp, Homo sapiens
gaccccgcactgca

SEQ ID NO: 6232611 - DNA, 15 bp, Homo sapiens
gaccccgcactgcag

SEQ ID NO: 6232612 - DNA, 18 bp, Homo sapiens
gaccccgcagcacgcctc

SEQ ID NO: 6232613 - DNA, 15 bp, Homo sapiens
gcacgtggagagctg

SEQ ID NO: 6232614 - DNA, 18 bp, Homo sapiens
gcacgtggagagctggtg

SEQ ID NO: 6232615 - DNA, 18 bp, Homo sapiens
gcacgtggagatagtgcc

SEQ ID NO: 6232616 - DNA, 23 bp, Homo sapiens
gcacgtgggtcttcagggggcca

SEQ ID NO: 6232617 - DNA, 14 bp, Homo sapiens
gcacgtgtgtgcac

SEQ ID NO: 6232618 - DNA, 16 bp, Homo sapiens
gcacgtgtgtttttct

SEQ ID NO: 6232619 - DNA, 23 bp, Homo sapiens
gcacgtgtgtttttctattaaaa

SEQ ID NO: 6232620 - DNA, 19 bp, Homo sapiens
gcacgttctccagactcta

SEQ ID NO: 6232621 - DNA, 16 bp, Homo sapiens
gcacgttgctgaaggt

SEQ ID NO: 6232622 - DNA, 19 bp, Homo sapiens
gcacgtttaaagttctgtg

SEQ ID NO: 6232623 - DNA, 21 bp, Homo sapiens
gcacgttttctggcttctgct

SEQ ID NO: 6232624 - DNA, 22 bp, Homo sapiens
gcactaaaaagtggctaattca

SEQ ID NO: 6232625 - DNA, 23 bp, Homo sapiens
gcactaaaacccatcttccccgg

SEQ ID NO: 6232626 - DNA, 16 bp, Homo sapiens
gcactaaaatgaggat

SEQ ID NO: 6232627 - DNA, 21 bp, Homo sapiens
gcactaaaatgaggatccagg

SEQ ID NO: 6232628 - DNA, 23 bp, Homo sapiens
gcactaaaatgaggatccagggc

SEQ ID NO: 6232629 - DNA, 19 bp, Homo sapiens
gcactaaaccacttctctg

SEQ ID NO: 6232630 - DNA, 20 bp, Homo sapiens
gcactaaaccacttctctgc

SEQ ID NO: 6232631 - DNA, 15 bp, Homo sapiens
gcactaaagccagcc

SEQ ID NO: 6232632 - DNA, 18 bp, Homo sapiens
gcactaaagccagcctga

SEQ ID NO: 6232633 - DNA, 22 bp, Homo sapiens
gcactaaagtatgtaaagtatg

SEQ ID NO: 6232634 - DNA, 19 bp, Homo sapiens
gcactaaccaatgcctttt

SEQ ID NO: 6232635 - DNA, 17 bp, Homo sapiens
gcactaaccccagctgc

SEQ ID NO: 6232636 - DNA, 15 bp, Homo sapiens
gcactaagatatttc

SEQ ID NO: 6232637 - DNA, 19 bp, Homo sapiens
gcactaaggccgtgtctct

SEQ ID NO: 6232638 - DNA, 20 bp, Homo sapiens
gcactaaggtggacagcaga

SEQ ID NO: 6232639 - DNA, 20 bp, Homo sapiens
gcactaaggtgtgctctgat

SEQ ID NO: 6232640 - DNA, 23 bp, Homo sapiens
gcactaagtcatggtcctggctg

SEQ ID NO: 6232641 - DNA, 22 bp, Homo sapiens
gcactaagtctcttttttacaa

SEQ ID NO: 6232642 - DNA, 23 bp, Homo sapiens
gcactaagtctcttttttacaaa

SEQ ID NO: 6232643 - DNA, 13 bp, Homo sapiens
gcactaattagtg

SEQ ID NO: 6232644 - DNA, 19 bp, Homo sapiens
gcactacaacttaattgct

SEQ ID NO: 6232645 - DNA, 13 bp, Homo sapiens
gcactacaatcat

SEQ ID NO: 6232646 - DNA, 15 bp, Homo sapiens
gcactacaggaggaa

SEQ ID NO: 6232647 - DNA, 15 bp, Homo sapiens
gcactacataaactg

SEQ ID NO: 6232648 - DNA, 16 bp, Homo sapiens
gcactacataaactga

SEQ ID NO: 6232649 - DNA, 13 bp, Homo sapiens
gcactacatgtgg

SEQ ID NO: 6232650 - DNA, 17 bp, Homo sapiens
gcactactcagttatta

SEQ ID NO: 6232651 - DNA, 16 bp, Homo sapiens
gcactactgggtgtca

SEQ ID NO: 6232652 - DNA, 18 bp, Homo sapiens
gcactactgggtgtcatt

SEQ ID NO: 6232653 - DNA, 21 bp, Homo sapiens
gcactagaactttgtgccagc

SEQ ID NO: 6232654 - DNA, 21 bp, Homo sapiens
gcactagaccatataactgtg

SEQ ID NO: 6232655 - DNA, 20 bp, Homo sapiens
gcactagagaatgcacagat

SEQ ID NO: 6232656 - DNA, 20 bp, Homo sapiens
gcactagcattttcttgaac

SEQ ID NO: 6232657 - DNA, 15 bp, Homo sapiens
gcactagccaaacct

SEQ ID NO: 6232658 - DNA, 16 bp, Homo sapiens
gcactagcctccctct

SEQ ID NO: 6232659 - DNA, 19 bp, Homo sapiens
gcactagcctccctctcct

SEQ ID NO: 6232660 - DNA, 21 bp, Homo sapiens
gcactagcctccctctcctct

SEQ ID NO: 6232661 - DNA, 18 bp, Homo sapiens
gcactagccttcccagct

SEQ ID NO: 6232662 - DNA, 20 bp, Homo sapiens
gcactagcctttggctctgg

SEQ ID NO: 6232663 - DNA, 13 bp, Homo sapiens
gcactaggaattc

SEQ ID NO: 6232664 - DNA, 14 bp, Homo sapiens
gcactaggacttgg

SEQ ID NO: 6232665 - DNA, 16 bp, Homo sapiens
gcactaggcaggtaat

SEQ ID NO: 6232666 - DNA, 20 bp, Homo sapiens
gcactaggtaggcttctacc

SEQ ID NO: 6232667 - DNA, 21 bp, Homo sapiens
gcactaggtaggcttctacct

SEQ ID NO: 6232668 - DNA, 22 bp, Homo sapiens
gcactagtcaccgacagcggcc

SEQ ID NO: 6232669 - DNA, 21 bp, Homo sapiens
gcactagtttgattattatgt

SEQ ID NO: 6232670 - DNA, 23 bp, Homo sapiens
gcactagtttgattattatgttt

SEQ ID NO: 6232671 - DNA, 15 bp, Homo sapiens
gcactatatgcaaac

SEQ ID NO: 6232672 - DNA, 18 bp, Homo sapiens
gcactatatgtttacaca

SEQ ID NO: 6232673 - DNA, 15 bp, Homo sapiens
gcactatatttgtat

SEQ ID NO: 6232674 - DNA, 16 bp, Homo sapiens
gcactatatttgtata

SEQ ID NO: 6232675 - DNA, 15 bp, Homo sapiens
gcactatctttaaac

SEQ ID NO: 6232676 - DNA, 15 bp, Homo sapiens
gcactatgaaaatca

SEQ ID NO: 6232677 - DNA, 22 bp, Homo sapiens
gcactatgaggaataattattt

SEQ ID NO: 6232678 - DNA, 15 bp, Homo sapiens
gcactatttatttac

SEQ ID NO: 6232679 - DNA, 15 bp, Homo sapiens
gcactattttatatt

SEQ ID NO: 6232680 - DNA, 16 bp, Homo sapiens
gcactattttatattt

SEQ ID NO: 6232681 - DNA, 21 bp, Homo sapiens
gcactcaaacctggagctgag

SEQ ID NO: 6232682 - DNA, 22 bp, Homo sapiens
gcactcaaacctggagctgagg

SEQ ID NO: 6232683 - DNA, 20 bp, Homo sapiens
gcactcaaatcttaagaaat

SEQ ID NO: 6232684 - DNA, 21 bp, Homo sapiens
gcactcaaatcttaagaaata

SEQ ID NO: 6232685 - DNA, 13 bp, Homo sapiens
gcactcaacatga

SEQ ID NO: 6232686 - DNA, 19 bp, Homo sapiens
gcactcaaccaacctcccc

SEQ ID NO: 6232687 - DNA, 22 bp, Homo sapiens
gcactcacacaggacccccttc

SEQ ID NO: 6232688 - DNA, 13 bp, Homo sapiens
gcactcagaagac

SEQ ID NO: 6232689 - DNA, 19 bp, Homo sapiens
gcactcagaagttgtgcta

SEQ ID NO: 6232690 - DNA, 13 bp, Homo sapiens
gcactcagccacg

SEQ ID NO: 6232691 - DNA, 16 bp, Homo sapiens
gcactcagccacgacc

SEQ ID NO: 6232692 - DNA, 13 bp, Homo sapiens
gcactcaggagca

SEQ ID NO: 6232693 - DNA, 17 bp, Homo sapiens
gcactcaggagcacagc

SEQ ID NO: 6232694 - DNA, 22 bp, Homo sapiens
gcactcaggagcacagccatag

SEQ ID NO: 6232695 - DNA, 18 bp, Homo sapiens
gcactcatagggtgctct

SEQ ID NO: 6232696 - DNA, 17 bp, Homo sapiens
gcactcatgacggcctg

SEQ ID NO: 6232697 - DNA, 22 bp, Homo sapiens
gcactcatgacggcctgcctgc

SEQ ID NO: 6232698 - DNA, 17 bp, Homo sapiens
gcactcatgtggactgg

SEQ ID NO: 6232699 - DNA, 21 bp, Homo sapiens
gcactcatgtggactgggacc

SEQ ID NO: 6232700 - DNA, 13 bp, Homo sapiens
gcactccaaccta

SEQ ID NO: 6232701 - DNA, 18 bp, Homo sapiens
gcactccaacctaacctg

SEQ ID NO: 6232702 - DNA, 20 bp, Homo sapiens
gcactccaacctaacctgtg

SEQ ID NO: 6232703 - DNA, 13 bp, Homo sapiens
gcactccacacat

SEQ ID NO: 6232704 - DNA, 12 bp, Homo sapiens
gcactccagact

SEQ ID NO: 6232705 - DNA, 15 bp, Homo sapiens
gcactccagactctg

SEQ ID NO: 6232706 - DNA, 19 bp, Homo sapiens
gcactccagcctgggcgac

SEQ ID NO: 6232707 - DNA, 16 bp, Homo sapiens
gcactccagcctgggg

SEQ ID NO: 6232708 - DNA, 21 bp, Homo sapiens
gcactccagcctgggggacag

SEQ ID NO: 6232709 - DNA, 17 bp, Homo sapiens
gcactccagcctgggtg

SEQ ID NO: 6232710 - DNA, 15 bp, Homo sapiens
gcactccatgcttag

SEQ ID NO: 6232711 - DNA, 18 bp, Homo sapiens
gcactcccacctgacaca

SEQ ID NO: 6232712 - DNA, 22 bp, Homo sapiens
gcactcccacctgacacaccag

SEQ ID NO: 6232713 - DNA, 17 bp, Homo sapiens
gcactcccaggcccctg

SEQ ID NO: 6232714 - DNA, 19 bp, Homo sapiens
gcactccccagagctgtgc

SEQ ID NO: 6232715 - DNA, 22 bp, Homo sapiens
gcactccccagagctgtgccag

SEQ ID NO: 6232716 - DNA, 15 bp, Homo sapiens
gcactcccccaggat

SEQ ID NO: 6232717 - DNA, 12 bp, Homo sapiens
gcactcccctgc

SEQ ID NO: 6232718 - DNA, 15 bp, Homo sapiens
gcactcccctgctgg

SEQ ID NO: 6232719 - DNA, 20 bp, Homo sapiens
gcactccccttgccttcccc

SEQ ID NO: 6232720 - DNA, 22 bp, Homo sapiens
gcactccccttgccttcccctg

SEQ ID NO: 6232721 - DNA, 19 bp, Homo sapiens
gcactcccgctgcacacag

SEQ ID NO: 6232722 - DNA, 20 bp, Homo sapiens
gcactcccgctgcacacaga

SEQ ID NO: 6232723 - DNA, 13 bp, Homo sapiens
gcactcccgggat

SEQ ID NO: 6232724 - DNA, 18 bp, Homo sapiens
gcactccctaagaaaccc

SEQ ID NO: 6232725 - DNA, 13 bp, Homo sapiens
gcactccctggcc

SEQ ID NO: 6232726 - DNA, 20 bp, Homo sapiens
gcactcccttaggcattatt

SEQ ID NO: 6232727 - DNA, 23 bp, Homo sapiens
gcactcccttggtggcaagagcc

SEQ ID NO: 6232728 - DNA, 23 bp, Homo sapiens
gcactccgcgccgatgccaccgg

SEQ ID NO: 6232729 - DNA, 16 bp, Homo sapiens
gcactccggcctgggt

SEQ ID NO: 6232730 - DNA, 21 bp, Homo sapiens
gcactccggtcccaaatgtag

SEQ ID NO: 6232731 - DNA, 12 bp, Homo sapiens
gcactcctactg

SEQ ID NO: 6232732 - DNA, 17 bp, Homo sapiens
gcactcctcaagacttt

SEQ ID NO: 6232733 - DNA, 14 bp, Homo sapiens
gcactcctcacaca

SEQ ID NO: 6232734 - DNA, 20 bp, Homo sapiens
gcactcctcggtactcccat

SEQ ID NO: 6232735 - DNA, 14 bp, Homo sapiens
gcactcctctgtct

SEQ ID NO: 6232736 - DNA, 16 bp, Homo sapiens
gcactcctctgtctct

SEQ ID NO: 6232737 - DNA, 17 bp, Homo sapiens
gcactcctctgtctctg

SEQ ID NO: 6232738 - DNA, 12 bp, Homo sapiens
gcactcctgccc

SEQ ID NO: 6232739 - DNA, 13 bp, Homo sapiens
gcactcctgcccc

SEQ ID NO: 6232740 - DNA, 16 bp, Homo sapiens
gcactcctgccccggc

SEQ ID NO: 6232741 - DNA, 18 bp, Homo sapiens
gcactcctgccccggccc

SEQ ID NO: 6232742 - DNA, 15 bp, Homo sapiens
gcactcctttaaagc

SEQ ID NO: 6232743 - DNA, 16 bp, Homo sapiens
gcactcgagaccatcc

SEQ ID NO: 6232744 - DNA, 21 bp, Homo sapiens
gcactctaaaaggttcaggga

SEQ ID NO: 6232745 - DNA, 14 bp, Homo sapiens
gcactctaaactgc

SEQ ID NO: 6232746 - DNA, 23 bp, Homo sapiens
gcactctaaactgcaaacagaaa

SEQ ID NO: 6232747 - DNA, 17 bp, Homo sapiens
gcactctaattagagaa

SEQ ID NO: 6232748 - DNA, 15 bp, Homo sapiens
gcactctagattcca

SEQ ID NO: 6232749 - DNA, 18 bp, Homo sapiens
gcactctagccggagtga

SEQ ID NO: 6232750 - DNA, 21 bp, Homo sapiens
gcactctagcctggcaacaga

SEQ ID NO: 6232751 - DNA, 22 bp, Homo sapiens
gcactctagggtgaaccaagct

SEQ ID NO: 6232752 - DNA, 23 bp, Homo sapiens
gcactctcatcaccccagaggcc

SEQ ID NO: 6232753 - DNA, 21 bp, Homo sapiens
gcactctccaccctggctggg

SEQ ID NO: 6232754 - DNA, 20 bp, Homo sapiens
gcactctccccgctcagggg

SEQ ID NO: 6232755 - DNA, 16 bp, Homo sapiens
gcactctcctgtctga

SEQ ID NO: 6232756 - DNA, 19 bp, Homo sapiens
gcactctctaaatcttcct

SEQ ID NO: 6232757 - DNA, 20 bp, Homo sapiens
gcactctctaaatcttcctt

SEQ ID NO: 6232758 - DNA, 24 bp, Homo sapiens
gcactctctaaatcttccttgtga

SEQ ID NO: 6232759 - DNA, 13 bp, Homo sapiens
gcactctctgcag

SEQ ID NO: 6232760 - DNA, 17 bp, Homo sapiens
gcactctctgcagtcct

SEQ ID NO: 6232761 - DNA, 21 bp, Homo sapiens
gcactctctgcagtcctccgg

SEQ ID NO: 6232762 - DNA, 15 bp, Homo sapiens
gcactctctgccagc

SEQ ID NO: 6232763 - DNA, 19 bp, Homo sapiens
gcactctctgccagctcca

SEQ ID NO: 6232764 - DNA, 23 bp, Homo sapiens
gcactctctgccagctccacagg

SEQ ID NO: 6232765 - DNA, 20 bp, Homo sapiens
gcactctctgccattctgtg

SEQ ID NO: 6232766 - DNA, 21 bp, Homo sapiens
gcactctgccatcctgataca

SEQ ID NO: 6232767 - DNA, 11 bp, Homo sapiens
gcactctgctg

SEQ ID NO: 6232768 - DNA, 12 bp, Homo sapiens
gcactctgctgg

SEQ ID NO: 6232769 - DNA, 13 bp, Homo sapiens
gcactctggactc

SEQ ID NO: 6232770 - DNA, 13 bp, Homo sapiens
gcactctggcagc

SEQ ID NO: 6232771 - DNA, 14 bp, Homo sapiens
gcactctggcagca

SEQ ID NO: 6232772 - DNA, 22 bp, Homo sapiens
gcactctgggtctggccagggc

SEQ ID NO: 6232773 - DNA, 20 bp, Homo sapiens
gcactctgtagcaaatttgt

SEQ ID NO: 6232774 - DNA, 17 bp, Homo sapiens
gcactctgtatatttga

SEQ ID NO: 6232775 - DNA, 12 bp, Homo sapiens
gcactctgtgcc

SEQ ID NO: 6232776 - DNA, 21 bp, Homo sapiens
gcactctgtgcccatgggcac

SEQ ID NO: 6232777 - DNA, 13 bp, Homo sapiens
gcactctgtgtgg

SEQ ID NO: 6232778 - DNA, 15 bp, Homo sapiens
gcactcttaaagcaa

SEQ ID NO: 6232779 - DNA, 18 bp, Homo sapiens
gcactcttgttcccacac

SEQ ID NO: 6232780 - DNA, 19 bp, Homo sapiens
gcactcttttgagcagtaa

SEQ ID NO: 6232781 - DNA, 17 bp, Homo sapiens
gcactgaaaaaaaatct

SEQ ID NO: 6232782 - DNA, 19 bp, Homo sapiens
gcactgaaaacttagccag

SEQ ID NO: 6232783 - DNA, 20 bp, Homo sapiens
gcactgaaaacttagccaga

SEQ ID NO: 6232784 - DNA, 22 bp, Homo sapiens
gcactgaaagtcacggctgcgc

SEQ ID NO: 6232785 - DNA, 16 bp, Homo sapiens
gcactgaacaggctgg

SEQ ID NO: 6232786 - DNA, 17 bp, Homo sapiens
gcactgaacaggctggg

SEQ ID NO: 6232787 - DNA, 23 bp, Homo sapiens
gcactgaacaggctggggccttt

SEQ ID NO: 6232788 - DNA, 15 bp, Homo sapiens
gcactgaagagctct

SEQ ID NO: 6232789 - DNA, 17 bp, Homo sapiens
gcactgaagagctcttg

SEQ ID NO: 6232790 - DNA, 22 bp, Homo sapiens
gaccccgcagcacgcctctccc

SEQ ID NO: 6232791 - DNA, 20 bp, Homo sapiens
gaccccgcaggatccctcct

SEQ ID NO: 6232792 - DNA, 13 bp, Homo sapiens
gaccccgcccctg

SEQ ID NO: 6232793 - DNA, 23 bp, Homo sapiens
gaccccggaggcgtggaggagag

SEQ ID NO: 6232794 - DNA, 18 bp, Homo sapiens
gaccccgggcgtggacca

SEQ ID NO: 6232795 - DNA, 17 bp, Homo sapiens
gaccccgtggctctggg

SEQ ID NO: 6232796 - DNA, 24 bp, Homo sapiens
gacccctaccccctcatcccccag

SEQ ID NO: 6232797 - DNA, 14 bp, Homo sapiens
gacccctagttccc

SEQ ID NO: 6232798 - DNA, 21 bp, Homo sapiens
gacccctagttccctctgctc

SEQ ID NO: 6232799 - DNA, 22 bp, Homo sapiens
gacccctagttccctctgctca

SEQ ID NO: 6232800 - DNA, 11 bp, Homo sapiens
gacccctcacc

SEQ ID NO: 6232801 - DNA, 22 bp, Homo sapiens
gacccctcaccttgcaacacac

SEQ ID NO: 6232802 - DNA, 20 bp, Homo sapiens
gacccctcagccccagccca

SEQ ID NO: 6232803 - DNA, 18 bp, Homo sapiens
gacccctccatgtgggct

SEQ ID NO: 6232804 - DNA, 20 bp, Homo sapiens
gacccctccctgcaggggct

SEQ ID NO: 6232805 - DNA, 12 bp, Homo sapiens
gacccctcctca

SEQ ID NO: 6232806 - DNA, 17 bp, Homo sapiens
gacccctcctcactggc

SEQ ID NO: 6232807 - DNA, 19 bp, Homo sapiens
gacccctcctcactggcca

SEQ ID NO: 6232808 - DNA, 16 bp, Homo sapiens
gacccctcctcccttt

SEQ ID NO: 6232809 - DNA, 13 bp, Homo sapiens
gacccctcctggg

SEQ ID NO: 6232810 - DNA, 16 bp, Homo sapiens
gacccctcctggggcc

SEQ ID NO: 6232811 - DNA, 20 bp, Homo sapiens
gacccctcgcaaccctgcct

SEQ ID NO: 6232812 - DNA, 17 bp, Homo sapiens
gacccctcgccccagcc

SEQ ID NO: 6232813 - DNA, 18 bp, Homo sapiens
gacccctcgccccagcct

SEQ ID NO: 6232814 - DNA, 17 bp, Homo sapiens
gacccctcgtccacccc

SEQ ID NO: 6232815 - DNA, 18 bp, Homo sapiens
gacccctcgtccaccccc

SEQ ID NO: 6232816 - DNA, 14 bp, Homo sapiens
gacccctctcctca

SEQ ID NO: 6232817 - DNA, 16 bp, Homo sapiens
gacccctgagcttgca

SEQ ID NO: 6232818 - DNA, 14 bp, Homo sapiens
gacccctgcccaag

SEQ ID NO: 6232819 - DNA, 13 bp, Homo sapiens
gacccctgcctgg

SEQ ID NO: 6232820 - DNA, 15 bp, Homo sapiens
gacccctgccttcct

SEQ ID NO: 6232821 - DNA, 16 bp, Homo sapiens
gacccctgccttcctc

SEQ ID NO: 6232822 - DNA, 19 bp, Homo sapiens
gacccctgctcccagcctg

SEQ ID NO: 6232823 - DNA, 22 bp, Homo sapiens
gacccctgctcccagcctgctg

SEQ ID NO: 6232824 - DNA, 14 bp, Homo sapiens
gacccctgctcctg

SEQ ID NO: 6232825 - DNA, 20 bp, Homo sapiens
gacccctggaccaccagccc

SEQ ID NO: 6232826 - DNA, 12 bp, Homo sapiens
gacccctggcca

SEQ ID NO: 6232827 - DNA, 13 bp, Homo sapiens
gacccctggccac

SEQ ID NO: 6232828 - DNA, 13 bp, Homo sapiens
gacccctggcctc

SEQ ID NO: 6232829 - DNA, 12 bp, Homo sapiens
gacccctggctg

SEQ ID NO: 6232830 - DNA, 14 bp, Homo sapiens
gacccctgggagct

SEQ ID NO: 6232831 - DNA, 16 bp, Homo sapiens
gacccctgggggaggc

SEQ ID NO: 6232832 - DNA, 16 bp, Homo sapiens
gacccctggggtggcc

SEQ ID NO: 6232833 - DNA, 18 bp, Homo sapiens
gacccctgtaaggggcca

SEQ ID NO: 6232834 - DNA, 15 bp, Homo sapiens
gacccctgtccagga

SEQ ID NO: 6232835 - DNA, 13 bp, Homo sapiens
gacccctgtctcc

SEQ ID NO: 6232836 - DNA, 12 bp, Homo sapiens
gacccctgtctt

SEQ ID NO: 6232837 - DNA, 12 bp, Homo sapiens
gacccctgtggc

SEQ ID NO: 6232838 - DNA, 16 bp, Homo sapiens
gacccctgttcatgcc

SEQ ID NO: 6232839 - DNA, 13 bp, Homo sapiens
gaccccttcctgt

SEQ ID NO: 6232840 - DNA, 16 bp, Homo sapiens
gaccccttcctgtctg

SEQ ID NO: 6232841 - DNA, 20 bp, Homo sapiens
gaccccttcctgtctggccc

SEQ ID NO: 6232842 - DNA, 21 bp, Homo sapiens
gaccccttcctgtctggccca

SEQ ID NO: 6232843 - DNA, 16 bp, Homo sapiens
gaccccttcctttcct

SEQ ID NO: 6232844 - DNA, 12 bp, Homo sapiens
gaccccttctct

SEQ ID NO: 6232845 - DNA, 14 bp, Homo sapiens
gaccccttctctct

SEQ ID NO: 6232846 - DNA, 16 bp, Homo sapiens
gaccccttctctctcc

SEQ ID NO: 6232847 - DNA, 11 bp, Homo sapiens
gaccccttgct

SEQ ID NO: 6232848 - DNA, 15 bp, Homo sapiens
gaccccttgctccct

SEQ ID NO: 6232849 - DNA, 12 bp, Homo sapiens
gaccccttggct

SEQ ID NO: 6232850 - DNA, 22 bp, Homo sapiens
gaccccttgttgcactgccccc

SEQ ID NO: 6232851 - DNA, 23 bp, Homo sapiens
gaccccttgttgcactgccccct

SEQ ID NO: 6232852 - DNA, 12 bp, Homo sapiens
gacccctttccc

SEQ ID NO: 6232853 - DNA, 13 bp, Homo sapiens
gacccctttcccc

SEQ ID NO: 6232854 - DNA, 14 bp, Homo sapiens
gacccctttccccc

SEQ ID NO: 6232855 - DNA, 17 bp, Homo sapiens
gacccctttcccccacc

SEQ ID NO: 6232856 - DNA, 19 bp, Homo sapiens
gaccccttttagtcaggag

SEQ ID NO: 6232857 - DNA, 17 bp, Homo sapiens
gaccccttttcagcttc

SEQ ID NO: 6232858 - DNA, 15 bp, Homo sapiens
gacccgacctggccg

SEQ ID NO: 6232859 - DNA, 16 bp, Homo sapiens
gacccgaggcccagat

SEQ ID NO: 6232860 - DNA, 15 bp, Homo sapiens
gacccgcaacaagta

SEQ ID NO: 6232861 - DNA, 13 bp, Homo sapiens
gacccgccagccc

SEQ ID NO: 6232862 - DNA, 16 bp, Homo sapiens
gacccgccagccccgc

SEQ ID NO: 6232863 - DNA, 19 bp, Homo sapiens
gacccgccagccccgctcc

SEQ ID NO: 6232864 - DNA, 14 bp, Homo sapiens
gacccgccaggtca

SEQ ID NO: 6232865 - DNA, 16 bp, Homo sapiens
gacccgccggatgaca

SEQ ID NO: 6232866 - DNA, 14 bp, Homo sapiens
gacccgcctgctcc

SEQ ID NO: 6232867 - DNA, 23 bp, Homo sapiens
gacccgctcggacttactgcctg

SEQ ID NO: 6232868 - DNA, 23 bp, Homo sapiens
gacccggagctaacactggcccc

SEQ ID NO: 6232869 - DNA, 11 bp, Homo sapiens
gacccggaggc

SEQ ID NO: 6232870 - DNA, 23 bp, Homo sapiens
gacccggaggccacatgagtccc

SEQ ID NO: 6232871 - DNA, 18 bp, Homo sapiens
gacccggaggccgaggcc

SEQ ID NO: 6232872 - DNA, 17 bp, Homo sapiens
gacccggaggggcctgg

SEQ ID NO: 6232873 - DNA, 16 bp, Homo sapiens
gacccggattggccct

SEQ ID NO: 6232874 - DNA, 17 bp, Homo sapiens
gacccggattggccctg

SEQ ID NO: 6232875 - DNA, 23 bp, Homo sapiens
gacccggattggccctgcccctc

SEQ ID NO: 6232876 - DNA, 19 bp, Homo sapiens
gacccggcaccccctgcag

SEQ ID NO: 6232877 - DNA, 20 bp, Homo sapiens
gacccggcaccccctgcagc

SEQ ID NO: 6232878 - DNA, 16 bp, Homo sapiens
gacccggcctctctgc

SEQ ID NO: 6232879 - DNA, 20 bp, Homo sapiens
gacccggcctctctgcccca

SEQ ID NO: 6232880 - DNA, 23 bp, Homo sapiens
gacccggcctctctgccccaccc

SEQ ID NO: 6232881 - DNA, 22 bp, Homo sapiens
gacccggctgggtcggccctgc

SEQ ID NO: 6232882 - DNA, 14 bp, Homo sapiens
gacccgggaaggaa

SEQ ID NO: 6232883 - DNA, 15 bp, Homo sapiens
gacccgggaaggaag

SEQ ID NO: 6232884 - DNA, 22 bp, Homo sapiens
gacccggggatggattggcctc

SEQ ID NO: 6232885 - DNA, 17 bp, Homo sapiens
gacccggggcagctggc

SEQ ID NO: 6232886 - DNA, 16 bp, Homo sapiens
gacccggggtctcctg

SEQ ID NO: 6232887 - DNA, 19 bp, Homo sapiens
gacccggggtctcctggac

SEQ ID NO: 6232888 - DNA, 15 bp, Homo sapiens
gacccgtctccagct

SEQ ID NO: 6232889 - DNA, 18 bp, Homo sapiens
gacccgtctccagctgct

SEQ ID NO: 6232890 - DNA, 19 bp, Homo sapiens
gacccgttcatgggggagg

SEQ ID NO: 6232891 - DNA, 22 bp, Homo sapiens
gaccctactcccttgccctaga

SEQ ID NO: 6232892 - DNA, 20 bp, Homo sapiens
gaccctactgaagtggctgg

SEQ ID NO: 6232893 - DNA, 15 bp, Homo sapiens
gaccctaggtgctca

SEQ ID NO: 6232894 - DNA, 17 bp, Homo sapiens
gaccctatctcccacaa

SEQ ID NO: 6232895 - DNA, 18 bp, Homo sapiens
gaccctatttgtttcatt

SEQ ID NO: 6232896 - DNA, 12 bp, Homo sapiens
gaccctcagcag

SEQ ID NO: 6232897 - DNA, 15 bp, Homo sapiens
gaccctcagcagctc

SEQ ID NO: 6232898 - DNA, 12 bp, Homo sapiens
gaccctcagccc

SEQ ID NO: 6232899 - DNA, 16 bp, Homo sapiens
gaccctcagctgtcac

SEQ ID NO: 6232900 - DNA, 17 bp, Homo sapiens
gaccctcagctgtcacc

SEQ ID NO: 6232901 - DNA, 20 bp, Homo sapiens
gaccctcatctttcttccaa

SEQ ID NO: 6232902 - DNA, 17 bp, Homo sapiens
gaccctcatgctgccaa

SEQ ID NO: 6232903 - DNA, 21 bp, Homo sapiens
gaccctcatgctgccaatatc

SEQ ID NO: 6232904 - DNA, 22 bp, Homo sapiens
gaccctcatggcccccaggggc

SEQ ID NO: 6232905 - DNA, 11 bp, Homo sapiens
gaccctccaag

SEQ ID NO: 6232906 - DNA, 13 bp, Homo sapiens
gaccctccaaggc

SEQ ID NO: 6232907 - DNA, 22 bp, Homo sapiens
gaccctccaaggccaggccttg

SEQ ID NO: 6232908 - DNA, 21 bp, Homo sapiens
gaccctccaccgcagaaggaa

SEQ ID NO: 6232909 - DNA, 15 bp, Homo sapiens
gaccctccagtgctg

SEQ ID NO: 6232910 - DNA, 15 bp, Homo sapiens
gaccctcccactccc

SEQ ID NO: 6232911 - DNA, 21 bp, Homo sapiens
gaccctcccagtctcatctcc

SEQ ID NO: 6232912 - DNA, 23 bp, Homo sapiens
gaccctcccagtctcatctcctg

SEQ ID NO: 6232913 - DNA, 13 bp, Homo sapiens
gaccctcccatgg

SEQ ID NO: 6232914 - DNA, 12 bp, Homo sapiens
gaccctccccca

SEQ ID NO: 6232915 - DNA, 15 bp, Homo sapiens
gaccctccccgcacc

SEQ ID NO: 6232916 - DNA, 13 bp, Homo sapiens
gaccctccccggc

SEQ ID NO: 6232917 - DNA, 17 bp, Homo sapiens
gaccctcccctgcctcc

SEQ ID NO: 6232918 - DNA, 23 bp, Homo sapiens
gaccctcctccactccacctcca

SEQ ID NO: 6232919 - DNA, 17 bp, Homo sapiens
gaccctcctgtccagca

SEQ ID NO: 6232920 - DNA, 20 bp, Homo sapiens
gaccctcctgtccagcaggt

SEQ ID NO: 6232921 - DNA, 20 bp, Homo sapiens
gaccctcctgttgcacccag

SEQ ID NO: 6232922 - DNA, 23 bp, Homo sapiens
gaccctcctgttgcacccagccc

SEQ ID NO: 6232923 - DNA, 20 bp, Homo sapiens
gaccctccttccccacccca

SEQ ID NO: 6232924 - DNA, 22 bp, Homo sapiens
gaccctccttccccaccccata

SEQ ID NO: 6232925 - DNA, 15 bp, Homo sapiens
gaccctcgagagcct

SEQ ID NO: 6232926 - DNA, 19 bp, Homo sapiens
gaccctcgagagccttact

SEQ ID NO: 6232927 - DNA, 15 bp, Homo sapiens
gaccctcgcagacct

SEQ ID NO: 6232928 - DNA, 16 bp, Homo sapiens
gaccctcgcagaccta

SEQ ID NO: 6232929 - DNA, 12 bp, Homo sapiens
gaccctcgcagc

SEQ ID NO: 6232930 - DNA, 14 bp, Homo sapiens
gaccctcgcagcag

SEQ ID NO: 6232931 - DNA, 16 bp, Homo sapiens
gaccctcgcagcaggt

SEQ ID NO: 6232932 - DNA, 14 bp, Homo sapiens
gaccctcgctggcc

SEQ ID NO: 6232933 - DNA, 18 bp, Homo sapiens
gaccctcgctggccccca

SEQ ID NO: 6232934 - DNA, 16 bp, Homo sapiens
gaccctcgggccccat

SEQ ID NO: 6232935 - DNA, 16 bp, Homo sapiens
gaccctcggggcagga

SEQ ID NO: 6232936 - DNA, 18 bp, Homo sapiens
gaccctcggggcaggaag

SEQ ID NO: 6232937 - DNA, 18 bp, Homo sapiens
gaccctcgtggccttccc

SEQ ID NO: 6232938 - DNA, 14 bp, Homo sapiens
gaccctctaacctc

SEQ ID NO: 6232939 - DNA, 18 bp, Homo sapiens
gaccctctaacctcgccc

SEQ ID NO: 6232940 - DNA, 11 bp, Homo sapiens
gaccctctcaa

SEQ ID NO: 6232941 - DNA, 21 bp, Homo sapiens
gaccctctcaaactaacaggc

SEQ ID NO: 6232942 - DNA, 12 bp, Homo sapiens
gaccctctcact

SEQ ID NO: 6232943 - DNA, 16 bp, Homo sapiens
gaccctctccacccca

SEQ ID NO: 6232944 - DNA, 20 bp, Homo sapiens
gaccctctgaccctagctct

SEQ ID NO: 6232945 - DNA, 15 bp, Homo sapiens
gaccctctgccacca

SEQ ID NO: 6232946 - DNA, 20 bp, Homo sapiens
gaccctctgccaccagagac

SEQ ID NO: 6232947 - DNA, 14 bp, Homo sapiens
gaccctctgcggcc

SEQ ID NO: 6232948 - DNA, 17 bp, Homo sapiens
gaccctctgctgaagac

SEQ ID NO: 6232949 - DNA, 18 bp, Homo sapiens
gaccctctggaaatatgt

SEQ ID NO: 6232950 - DNA, 13 bp, Homo sapiens
gaccctctgggaa

SEQ ID NO: 6232951 - DNA, 21 bp, Homo sapiens
gaccctctgggaacctcccag

SEQ ID NO: 6232952 - DNA, 23 bp, Homo sapiens
gaccctctgggaacctcccagag

SEQ ID NO: 6232953 - DNA, 14 bp, Homo sapiens
gaccctcttctctg

SEQ ID NO: 6232954 - DNA, 20 bp, Homo sapiens
gaccctcttgcccatcctga

SEQ ID NO: 6232955 - DNA, 13 bp, Homo sapiens
gaccctgaaatgt

SEQ ID NO: 6232956 - DNA, 20 bp, Homo sapiens
gaccctgaacccacacctgg

SEQ ID NO: 6232957 - DNA, 17 bp, Homo sapiens
gaccctgacctccgccc

SEQ ID NO: 6232958 - DNA, 13 bp, Homo sapiens
gaccctgaggccc

SEQ ID NO: 6232959 - DNA, 20 bp, Homo sapiens
gaccctgagggtttccacct

SEQ ID NO: 6232960 - DNA, 20 bp, Homo sapiens
gaccctgagtccgggaggca

SEQ ID NO: 6232961 - DNA, 18 bp, Homo sapiens
gaccctgatgcaggtcag

SEQ ID NO: 6232962 - DNA, 19 bp, Homo sapiens
gaccctgatgcttaataaa

SEQ ID NO: 6232963 - DNA, 19 bp, Homo sapiens
gaccctgcaaacagaacag

SEQ ID NO: 6232964 - DNA, 18 bp, Homo sapiens
gaccctgcaagaccacgg

SEQ ID NO: 6232965 - DNA, 21 bp, Homo sapiens
gaccctgcaagaccacggagg

SEQ ID NO: 6232966 - DNA, 14 bp, Homo sapiens
gaccctgcaccctc

SEQ ID NO: 6232967 - DNA, 19 bp, Homo sapiens
gaccctgccaactttccag

SEQ ID NO: 6232968 - DNA, 22 bp, Homo sapiens
gaccctgccaactttccagact

SEQ ID NO: 6232969 - DNA, 12 bp, Homo sapiens
gaccctgccaca

SEQ ID NO: 6232970 - DNA, 15 bp, Homo sapiens
gaccctgccacagcc

SEQ ID NO: 6232971 - DNA, 18 bp, Homo sapiens
gcactgaagccggacagc

SEQ ID NO: 6232972 - DNA, 22 bp, Homo sapiens
gcactgaagccggacagctgcc

SEQ ID NO: 6232973 - DNA, 17 bp, Homo sapiens
gcactgaagtgcttagt

SEQ ID NO: 6232974 - DNA, 17 bp, Homo sapiens
gcactgaagtggccctc

SEQ ID NO: 6232975 - DNA, 14 bp, Homo sapiens
gcactgaagtttga

SEQ ID NO: 6232976 - DNA, 23 bp, Homo sapiens
gcactgaagtttttgaaatacct

SEQ ID NO: 6232977 - DNA, 16 bp, Homo sapiens
gcactgacaccctggt

SEQ ID NO: 6232978 - DNA, 17 bp, Homo sapiens
gcactgacagatttcca

SEQ ID NO: 6232979 - DNA, 16 bp, Homo sapiens
gcactgacagcctggg

SEQ ID NO: 6232980 - DNA, 16 bp, Homo sapiens
gcactgacagccttgc

SEQ ID NO: 6232981 - DNA, 18 bp, Homo sapiens
gcactgacagccttgccc

SEQ ID NO: 6232982 - DNA, 15 bp, Homo sapiens
gcactgaccaggccc

SEQ ID NO: 6232983 - DNA, 22 bp, Homo sapiens
gcactgaccctcggcctctact

SEQ ID NO: 6232984 - DNA, 22 bp, Homo sapiens
gcactgacctgctccgccagga

SEQ ID NO: 6232985 - DNA, 16 bp, Homo sapiens
gcactgactctggaaa

SEQ ID NO: 6232986 - DNA, 15 bp, Homo sapiens
gcactgactgtgaaa

SEQ ID NO: 6232987 - DNA, 15 bp, Homo sapiens
gcactgacttctaag

SEQ ID NO: 6232988 - DNA, 13 bp, Homo sapiens
gcactgagagggc

SEQ ID NO: 6232989 - DNA, 13 bp, Homo sapiens
gcactgagcagag

SEQ ID NO: 6232990 - DNA, 12 bp, Homo sapiens
gcactgagcagg

SEQ ID NO: 6232991 - DNA, 16 bp, Homo sapiens
gcactgagcagggatc

SEQ ID NO: 6232992 - DNA, 12 bp, Homo sapiens
gcactgagcccc

SEQ ID NO: 6232993 - DNA, 23 bp, Homo sapiens
gcactgagctcacatgggactgg

SEQ ID NO: 6232994 - DNA, 18 bp, Homo sapiens
gcactgaggaagaacggg

SEQ ID NO: 6232995 - DNA, 16 bp, Homo sapiens
gcactgaggacacaga

SEQ ID NO: 6232996 - DNA, 12 bp, Homo sapiens
gcactgagggcc

SEQ ID NO: 6232997 - DNA, 15 bp, Homo sapiens
gcactgagggccaca

SEQ ID NO: 6232998 - DNA, 16 bp, Homo sapiens
gcactgagggccacac

SEQ ID NO: 6232999 - DNA, 20 bp, Homo sapiens
gcactgagggccacactatt

SEQ ID NO: 6233000 - DNA, 13 bp, Homo sapiens
gcactgatagtcc

SEQ ID NO: 6233001 - DNA, 14 bp, Homo sapiens
gcactgatatttta

SEQ ID NO: 6233002 - DNA, 13 bp, Homo sapiens
gcactgatgctgc

SEQ ID NO: 6233003 - DNA, 19 bp, Homo sapiens
gcactgatgctgcccctca

SEQ ID NO: 6233004 - DNA, 22 bp, Homo sapiens
gcactgatgctgcccctcatct

SEQ ID NO: 6233005 - DNA, 19 bp, Homo sapiens
gcactgatggaaaatacca

SEQ ID NO: 6233006 - DNA, 17 bp, Homo sapiens
gcactgatgttgtgttt

SEQ ID NO: 6233007 - DNA, 18 bp, Homo sapiens
gcactgatgttgtgtttt

SEQ ID NO: 6233008 - DNA, 20 bp, Homo sapiens
gcactgatgttgtgttttta

SEQ ID NO: 6233009 - DNA, 19 bp, Homo sapiens
gcactgatttcacaacaga

SEQ ID NO: 6233010 - DNA, 17 bp, Homo sapiens
gcactgcacctgcctcc

SEQ ID NO: 6233011 - DNA, 19 bp, Homo sapiens
gcactgcacctgcctccag

SEQ ID NO: 6233012 - DNA, 21 bp, Homo sapiens
gcactgcacctgcctccagcc

SEQ ID NO: 6233013 - DNA, 15 bp, Homo sapiens
gcactgcagaaacct

SEQ ID NO: 6233014 - DNA, 20 bp, Homo sapiens
gcactgcagacgggaatgcc

SEQ ID NO: 6233015 - DNA, 14 bp, Homo sapiens
gcactgcagccaca

SEQ ID NO: 6233016 - DNA, 19 bp, Homo sapiens
gcactgcagccacagggga

SEQ ID NO: 6233017 - DNA, 16 bp, Homo sapiens
gcactgcagtctgcag

SEQ ID NO: 6233018 - DNA, 10 bp, Homo sapiens
gcactgcatg

SEQ ID NO: 6233019 - DNA, 16 bp, Homo sapiens
gcactgcatgggaaat

SEQ ID NO: 6233020 - DNA, 14 bp, Homo sapiens
gcactgccactggg

SEQ ID NO: 6233021 - DNA, 15 bp, Homo sapiens
gcactgccagactga

SEQ ID NO: 6233022 - DNA, 13 bp, Homo sapiens
gcactgccaggag

SEQ ID NO: 6233023 - DNA, 17 bp, Homo sapiens
gcactgccaggagggac

SEQ ID NO: 6233024 - DNA, 21 bp, Homo sapiens
gcactgccattagactgaatt

SEQ ID NO: 6233025 - DNA, 19 bp, Homo sapiens
gcactgcccagggaagccc

SEQ ID NO: 6233026 - DNA, 13 bp, Homo sapiens
gcactgcccatcc

SEQ ID NO: 6233027 - DNA, 17 bp, Homo sapiens
gcactgcccatcccacc

SEQ ID NO: 6233028 - DNA, 18 bp, Homo sapiens
gcactgcccatcccaccc

SEQ ID NO: 6233029 - DNA, 15 bp, Homo sapiens
gcactgccctccgcc

SEQ ID NO: 6233030 - DNA, 17 bp, Homo sapiens
gcactgcctctatgccc

SEQ ID NO: 6233031 - DNA, 22 bp, Homo sapiens
gcactgcctctatgccctgcag

SEQ ID NO: 6233032 - DNA, 23 bp, Homo sapiens
gcactgcctctatgccctgcaga

SEQ ID NO: 6233033 - DNA, 14 bp, Homo sapiens
gcactgcctctcac

SEQ ID NO: 6233034 - DNA, 16 bp, Homo sapiens
gcactgcctgccaagc

SEQ ID NO: 6233035 - DNA, 21 bp, Homo sapiens
gcactgcctgctcccatcctg

SEQ ID NO: 6233036 - DNA, 18 bp, Homo sapiens
gcactgccttctcctctc

SEQ ID NO: 6233037 - DNA, 17 bp, Homo sapiens
gcactgcgccacctgct

SEQ ID NO: 6233038 - DNA, 22 bp, Homo sapiens
gcactgctaggcgagtgccagg

SEQ ID NO: 6233039 - DNA, 17 bp, Homo sapiens
gcactgctccctacccc

SEQ ID NO: 6233040 - DNA, 13 bp, Homo sapiens
gcactgctgcctc

SEQ ID NO: 6233041 - DNA, 14 bp, Homo sapiens
gcactgctgcctca

SEQ ID NO: 6233042 - DNA, 17 bp, Homo sapiens
gcactgctgcctcagct

SEQ ID NO: 6233043 - DNA, 18 bp, Homo sapiens
gcactgctgcctcagctc

SEQ ID NO: 6233044 - DNA, 18 bp, Homo sapiens
gcactgctgggtggccca

SEQ ID NO: 6233045 - DNA, 16 bp, Homo sapiens
gcactgcttccagtga

SEQ ID NO: 6233046 - DNA, 18 bp, Homo sapiens
gcactgcttccagtgagg

SEQ ID NO: 6233047 - DNA, 20 bp, Homo sapiens
gcactgcttccagtgaggct

SEQ ID NO: 6233048 - DNA, 20 bp, Homo sapiens
gcactgcttgaggaggggca

SEQ ID NO: 6233049 - DNA, 23 bp, Homo sapiens
gcactgcttgaggaggggcacct

SEQ ID NO: 6233050 - DNA, 11 bp, Homo sapiens
gcactgcttta

SEQ ID NO: 6233051 - DNA, 17 bp, Homo sapiens
gcactggaaccacctgg

SEQ ID NO: 6233052 - DNA, 20 bp, Homo sapiens
gcactggaatatctgagaat

SEQ ID NO: 6233053 - DNA, 11 bp, Homo sapiens
gcactggactc

SEQ ID NO: 6233054 - DNA, 16 bp, Homo sapiens
gcactggagccacagg

SEQ ID NO: 6233055 - DNA, 17 bp, Homo sapiens
gcactggagccacaggc

SEQ ID NO: 6233056 - DNA, 21 bp, Homo sapiens
gcactggagccacaggcaggg

SEQ ID NO: 6233057 - DNA, 22 bp, Homo sapiens
gcactggagctgggaggtctcg

SEQ ID NO: 6233058 - DNA, 14 bp, Homo sapiens
gcactggaggcctc

SEQ ID NO: 6233059 - DNA, 15 bp, Homo sapiens
gcactggaggcctct

SEQ ID NO: 6233060 - DNA, 19 bp, Homo sapiens
gcactggaggcctctgcaa

SEQ ID NO: 6233061 - DNA, 18 bp, Homo sapiens
gcactggagtccagtctc

SEQ ID NO: 6233062 - DNA, 14 bp, Homo sapiens
gcactggagtgcag

SEQ ID NO: 6233063 - DNA, 16 bp, Homo sapiens
gcactggatggacttg

SEQ ID NO: 6233064 - DNA, 23 bp, Homo sapiens
gcactggatggacttggcttcag

SEQ ID NO: 6233065 - DNA, 17 bp, Homo sapiens
gcactggattgtagaac

SEQ ID NO: 6233066 - DNA, 19 bp, Homo sapiens
gcactggcaaacagggcct

SEQ ID NO: 6233067 - DNA, 23 bp, Homo sapiens
gcactggcaaacagggcctctgc

SEQ ID NO: 6233068 - DNA, 20 bp, Homo sapiens
gcactggccacccctcccca

SEQ ID NO: 6233069 - DNA, 12 bp, Homo sapiens
gcactggccaga

SEQ ID NO: 6233070 - DNA, 13 bp, Homo sapiens
gcactggccagag

SEQ ID NO: 6233071 - DNA, 11 bp, Homo sapiens
gcactggcctg

SEQ ID NO: 6233072 - DNA, 16 bp, Homo sapiens
gcactggccttctgat

SEQ ID NO: 6233073 - DNA, 17 bp, Homo sapiens
gcactggccttctgatg

SEQ ID NO: 6233074 - DNA, 13 bp, Homo sapiens
gcactggccttgc

SEQ ID NO: 6233075 - DNA, 15 bp, Homo sapiens
gcactggcgaggaga

SEQ ID NO: 6233076 - DNA, 15 bp, Homo sapiens
gcactggctctctcc

SEQ ID NO: 6233077 - DNA, 16 bp, Homo sapiens
gcactggctctctcca

SEQ ID NO: 6233078 - DNA, 18 bp, Homo sapiens
gcactggctctctccagg

SEQ ID NO: 6233079 - DNA, 23 bp, Homo sapiens
gcactggctgaacttggagaggg

SEQ ID NO: 6233080 - DNA, 15 bp, Homo sapiens
gcactggctgctctg

SEQ ID NO: 6233081 - DNA, 14 bp, Homo sapiens
gcactgggaagctg

SEQ ID NO: 6233082 - DNA, 23 bp, Homo sapiens
gcactgggaagctggagtgctgc

SEQ ID NO: 6233083 - DNA, 14 bp, Homo sapiens
gcactgggaaggaa

SEQ ID NO: 6233084 - DNA, 16 bp, Homo sapiens
gcactgggaaggaaac

SEQ ID NO: 6233085 - DNA, 21 bp, Homo sapiens
gcactgggaatttatttatgt

SEQ ID NO: 6233086 - DNA, 12 bp, Homo sapiens
gcactgggagca

SEQ ID NO: 6233087 - DNA, 14 bp, Homo sapiens
gcactgggaggcag

SEQ ID NO: 6233088 - DNA, 15 bp, Homo sapiens
gcactgggatcacag

SEQ ID NO: 6233089 - DNA, 16 bp, Homo sapiens
gcactgggcacaggcc

SEQ ID NO: 6233090 - DNA, 13 bp, Homo sapiens
gcactgggcaggt

SEQ ID NO: 6233091 - DNA, 21 bp, Homo sapiens
gcactgggcaggttcctgggg

SEQ ID NO: 6233092 - DNA, 17 bp, Homo sapiens
gcactgggccacggagg

SEQ ID NO: 6233093 - DNA, 18 bp, Homo sapiens
gcactgggccacggagga

SEQ ID NO: 6233094 - DNA, 16 bp, Homo sapiens
gcactgggccggcagc

SEQ ID NO: 6233095 - DNA, 19 bp, Homo sapiens
gcactgggccggcagcctg

SEQ ID NO: 6233096 - DNA, 15 bp, Homo sapiens
gcactgggctccgga

SEQ ID NO: 6233097 - DNA, 12 bp, Homo sapiens
gcactgggctgt

SEQ ID NO: 6233098 - DNA, 14 bp, Homo sapiens
gcactgggcttggg

SEQ ID NO: 6233099 - DNA, 16 bp, Homo sapiens
gcactggggaaaaata

SEQ ID NO: 6233100 - DNA, 23 bp, Homo sapiens
gcactggggagcccgtctcagtg

SEQ ID NO: 6233101 - DNA, 16 bp, Homo sapiens
gcactgggggaacaga

SEQ ID NO: 6233102 - DNA, 20 bp, Homo sapiens
gcactgggtacccaagtgaa

SEQ ID NO: 6233103 - DNA, 16 bp, Homo sapiens
gcactgggtttgctcc

SEQ ID NO: 6233104 - DNA, 22 bp, Homo sapiens
gcactggtaggttgggacacca

SEQ ID NO: 6233105 - DNA, 14 bp, Homo sapiens
gcactggtgccaaa

SEQ ID NO: 6233106 - DNA, 23 bp, Homo sapiens
gcactggtgccaaaaccaggcct

SEQ ID NO: 6233107 - DNA, 11 bp, Homo sapiens
gcactggtggg

SEQ ID NO: 6233108 - DNA, 20 bp, Homo sapiens
gcactggtgtgaactcaccc

SEQ ID NO: 6233109 - DNA, 19 bp, Homo sapiens
gcactggtttgttccctgt

SEQ ID NO: 6233110 - DNA, 9 bp, Homo sapiens
gcactgtaa

SEQ ID NO: 6233111 - DNA, 12 bp, Homo sapiens
gcactgtaaaat

SEQ ID NO: 6233112 - DNA, 13 bp, Homo sapiens
gcactgtaaaatg

SEQ ID NO: 6233113 - DNA, 23 bp, Homo sapiens
gcactgtaaaatgtgggattatg

SEQ ID NO: 6233114 - DNA, 12 bp, Homo sapiens
gcactgtaaata

SEQ ID NO: 6233115 - DNA, 19 bp, Homo sapiens
gcactgtaaatatccctcc

SEQ ID NO: 6233116 - DNA, 16 bp, Homo sapiens
gcactgtagttctaag

SEQ ID NO: 6233117 - DNA, 21 bp, Homo sapiens
gcactgtatcatttcatgctt

SEQ ID NO: 6233118 - DNA, 15 bp, Homo sapiens
gcactgtatgctgga

SEQ ID NO: 6233119 - DNA, 16 bp, Homo sapiens
gcactgtattgctcct

SEQ ID NO: 6233120 - DNA, 21 bp, Homo sapiens
gcactgtcactttgctctggg

SEQ ID NO: 6233121 - DNA, 16 bp, Homo sapiens
gcactgtcaggaatgg

SEQ ID NO: 6233122 - DNA, 15 bp, Homo sapiens
gcactgtcatgccca

SEQ ID NO: 6233123 - DNA, 15 bp, Homo sapiens
gcactgtccagctgg

SEQ ID NO: 6233124 - DNA, 16 bp, Homo sapiens
gcactgtccagggccc

SEQ ID NO: 6233125 - DNA, 19 bp, Homo sapiens
gcactgtccagggcccatg

SEQ ID NO: 6233126 - DNA, 14 bp, Homo sapiens
gcactgtcctgctc

SEQ ID NO: 6233127 - DNA, 15 bp, Homo sapiens
gcactgtcctgctcc

SEQ ID NO: 6233128 - DNA, 16 bp, Homo sapiens
gcactgtcctgctcca

SEQ ID NO: 6233129 - DNA, 17 bp, Homo sapiens
gcactgtcctgctccac

SEQ ID NO: 6233130 - DNA, 18 bp, Homo sapiens
gcactgtcctgctccaca

SEQ ID NO: 6233131 - DNA, 21 bp, Homo sapiens
gcactgtcctgctccacagtg

SEQ ID NO: 6233132 - DNA, 11 bp, Homo sapiens
gcactgtctgc

SEQ ID NO: 6233133 - DNA, 22 bp, Homo sapiens
gcactgtgaacctgggcactcc

SEQ ID NO: 6233134 - DNA, 19 bp, Homo sapiens
gcactgtgaagacccagca

SEQ ID NO: 6233135 - DNA, 14 bp, Homo sapiens
gcactgtgaaggac

SEQ ID NO: 6233136 - DNA, 17 bp, Homo sapiens
gcactgtgaatcctggc

SEQ ID NO: 6233137 - DNA, 20 bp, Homo sapiens
gcactgtgaatcctggcaag

SEQ ID NO: 6233138 - DNA, 11 bp, Homo sapiens
gcactgtgcta

SEQ ID NO: 6233139 - DNA, 16 bp, Homo sapiens
gcactgtgctcagggc

SEQ ID NO: 6233140 - DNA, 12 bp, Homo sapiens
gcactgtgcttg

SEQ ID NO: 6233141 - DNA, 16 bp, Homo sapiens
gcactgtggcactgcc

SEQ ID NO: 6233142 - DNA, 16 bp, Homo sapiens
gcactgtggtcaggcc

SEQ ID NO: 6233143 - DNA, 19 bp, Homo sapiens
gcactgtggtcaggcccag

SEQ ID NO: 6233144 - DNA, 22 bp, Homo sapiens
gcactgttaatacacagtactt

SEQ ID NO: 6233145 - DNA, 14 bp, Homo sapiens
gcactgttcacatc

SEQ ID NO: 6233146 - DNA, 18 bp, Homo sapiens
gcactgttccccctgtgc

SEQ ID NO: 6233147 - DNA, 19 bp, Homo sapiens
gcactgttccccctgtgca

SEQ ID NO: 6233148 - DNA, 18 bp, Homo sapiens
gcactgttgagaaggaga

SEQ ID NO: 6233149 - DNA, 20 bp, Homo sapiens
gcactgttgcaaactcagtg

SEQ ID NO: 6233150 - DNA, 13 bp, Homo sapiens
gcactgtttcttc

SEQ ID NO: 6233151 - DNA, 20 bp, Homo sapiens
gcactgttttatctctgtga

SEQ ID NO: 6233152 - DNA, 22 bp, Homo sapiens
gaccctgccacagccagaggag

SEQ ID NO: 6233153 - DNA, 14 bp, Homo sapiens
gaccctgccaggca

SEQ ID NO: 6233154 - DNA, 15 bp, Homo sapiens
gaccctgccaggcac

SEQ ID NO: 6233155 - DNA, 16 bp, Homo sapiens
gaccctgccaggcaca

SEQ ID NO: 6233156 - DNA, 18 bp, Homo sapiens
gaccctgccaggcacagg

SEQ ID NO: 6233157 - DNA, 23 bp, Homo sapiens
gaccctgccaggcacaggcaggg

SEQ ID NO: 6233158 - DNA, 22 bp, Homo sapiens
gaccctgcccaccccatccctg

SEQ ID NO: 6233159 - DNA, 13 bp, Homo sapiens
gaccctgcccaga

SEQ ID NO: 6233160 - DNA, 16 bp, Homo sapiens
gaccctgcccagagct

SEQ ID NO: 6233161 - DNA, 19 bp, Homo sapiens
gaccctgcccctaactcct

SEQ ID NO: 6233162 - DNA, 11 bp, Homo sapiens
gaccctgccct

SEQ ID NO: 6233163 - DNA, 13 bp, Homo sapiens
gaccctgccctgt

SEQ ID NO: 6233164 - DNA, 12 bp, Homo sapiens
gaccctgcctct

SEQ ID NO: 6233165 - DNA, 23 bp, Homo sapiens
gaccctgcctctcccaggcaggg

SEQ ID NO: 6233166 - DNA, 15 bp, Homo sapiens
gaccctgcgcccctg

SEQ ID NO: 6233167 - DNA, 16 bp, Homo sapiens
gaccctgcgcccctgc

SEQ ID NO: 6233168 - DNA, 17 bp, Homo sapiens
gaccctgcgcccctgcc

SEQ ID NO: 6233169 - DNA, 19 bp, Homo sapiens
gaccctgcgcccctgccca

SEQ ID NO: 6233170 - DNA, 17 bp, Homo sapiens
gaccctgctcacaggca

SEQ ID NO: 6233171 - DNA, 14 bp, Homo sapiens
gaccctgcttcacc

SEQ ID NO: 6233172 - DNA, 20 bp, Homo sapiens
gaccctggaattcagcaccc

SEQ ID NO: 6233173 - DNA, 21 bp, Homo sapiens
gaccctggaattcagcaccct

SEQ ID NO: 6233174 - DNA, 17 bp, Homo sapiens
gaccctggacccagcct

SEQ ID NO: 6233175 - DNA, 20 bp, Homo sapiens
gaccctggactcgccactgg

SEQ ID NO: 6233176 - DNA, 14 bp, Homo sapiens
gaccctggagcccg

SEQ ID NO: 6233177 - DNA, 16 bp, Homo sapiens
gaccctggagcccggc

SEQ ID NO: 6233178 - DNA, 18 bp, Homo sapiens
gaccctggagcccggcag

SEQ ID NO: 6233179 - DNA, 22 bp, Homo sapiens
gaccctggagcggctctcctga

SEQ ID NO: 6233180 - DNA, 13 bp, Homo sapiens
gaccctggctcct

SEQ ID NO: 6233181 - DNA, 12 bp, Homo sapiens
gaccctgggaga

SEQ ID NO: 6233182 - DNA, 15 bp, Homo sapiens
gaccctgggagagaa

SEQ ID NO: 6233183 - DNA, 17 bp, Homo sapiens
gaccctgggagagaagt

SEQ ID NO: 6233184 - DNA, 12 bp, Homo sapiens
gaccctgggagt

SEQ ID NO: 6233185 - DNA, 12 bp, Homo sapiens
gaccctgggcag

SEQ ID NO: 6233186 - DNA, 12 bp, Homo sapiens
gaccctgggccc

SEQ ID NO: 6233187 - DNA, 15 bp, Homo sapiens
gaccctgggcctgga

SEQ ID NO: 6233188 - DNA, 10 bp, Homo sapiens
gaccctgggg

SEQ ID NO: 6233189 - DNA, 12 bp, Homo sapiens
gaccctggggcg

SEQ ID NO: 6233190 - DNA, 18 bp, Homo sapiens
gaccctggggcgtgcagc

SEQ ID NO: 6233191 - DNA, 23 bp, Homo sapiens
gaccctggggcgtgcagcaggga

SEQ ID NO: 6233192 - DNA, 16 bp, Homo sapiens
gaccctggggctggct

SEQ ID NO: 6233193 - DNA, 18 bp, Homo sapiens
gaccctgggggcacagga

SEQ ID NO: 6233194 - DNA, 21 bp, Homo sapiens
gaccctgggtcaccttcctgg

SEQ ID NO: 6233195 - DNA, 23 bp, Homo sapiens
gaccctgggtcgggacagaccag

SEQ ID NO: 6233196 - DNA, 17 bp, Homo sapiens
gaccctgggtgggctct

SEQ ID NO: 6233197 - DNA, 21 bp, Homo sapiens
gaccctgggtgggctctgtgc

SEQ ID NO: 6233198 - DNA, 22 bp, Homo sapiens
gaccctgggtgggctctgtgca

SEQ ID NO: 6233199 - DNA, 17 bp, Homo sapiens
gaccctggtgacctcct

SEQ ID NO: 6233200 - DNA, 20 bp, Homo sapiens
gaccctggtgacctcctgtc

SEQ ID NO: 6233201 - DNA, 22 bp, Homo sapiens
gaccctggttattgatgtggcc

SEQ ID NO: 6233202 - DNA, 21 bp, Homo sapiens
gaccctggtttttttcctgtg

SEQ ID NO: 6233203 - DNA, 17 bp, Homo sapiens
gaccctgtatatagccc

SEQ ID NO: 6233204 - DNA, 18 bp, Homo sapiens
gaccctgtcccctaggga

SEQ ID NO: 6233205 - DNA, 17 bp, Homo sapiens
gaccctgtccggcccag

SEQ ID NO: 6233206 - DNA, 17 bp, Homo sapiens
gaccctgtctttgctgt

SEQ ID NO: 6233207 - DNA, 20 bp, Homo sapiens
gaccctgtgacatggtgcct

SEQ ID NO: 6233208 - DNA, 15 bp, Homo sapiens
gaccctgtgcaggag

SEQ ID NO: 6233209 - DNA, 12 bp, Homo sapiens
gaccctgtgccc

SEQ ID NO: 6233210 - DNA, 13 bp, Homo sapiens
gaccctgtgcccc

SEQ ID NO: 6233211 - DNA, 18 bp, Homo sapiens
gaccctgtgccccgcctc

SEQ ID NO: 6233212 - DNA, 22 bp, Homo sapiens
gaccctgtgccccgcctcccgg

SEQ ID NO: 6233213 - DNA, 14 bp, Homo sapiens
gaccctgtgcctgt

SEQ ID NO: 6233214 - DNA, 14 bp, Homo sapiens
gaccctgtggaagc

SEQ ID NO: 6233215 - DNA, 15 bp, Homo sapiens
gacccttaggccttt

SEQ ID NO: 6233216 - DNA, 15 bp, Homo sapiens
gacccttataaaatc

SEQ ID NO: 6233217 - DNA, 15 bp, Homo sapiens
gacccttccagacat

SEQ ID NO: 6233218 - DNA, 17 bp, Homo sapiens
gacccttccagacatac

SEQ ID NO: 6233219 - DNA, 22 bp, Homo sapiens
gacccttcccaatcagcactga

SEQ ID NO: 6233220 - DNA, 16 bp, Homo sapiens
gacccttcccagccct

SEQ ID NO: 6233221 - DNA, 20 bp, Homo sapiens
gacccttcccagccctcatc

SEQ ID NO: 6233222 - DNA, 22 bp, Homo sapiens
gacccttctactttttccttcc

SEQ ID NO: 6233223 - DNA, 23 bp, Homo sapiens
gacccttctactttttccttcct

SEQ ID NO: 6233224 - DNA, 24 bp, Homo sapiens
gacccttctactttttccttcctg

SEQ ID NO: 6233225 - DNA, 20 bp, Homo sapiens
gacccttctgggtccaggga

SEQ ID NO: 6233226 - DNA, 17 bp, Homo sapiens
gacccttcttgcctgct

SEQ ID NO: 6233227 - DNA, 20 bp, Homo sapiens
gacccttcttgcctgctggg

SEQ ID NO: 6233228 - DNA, 15 bp, Homo sapiens
gacccttgaagatgt

SEQ ID NO: 6233229 - DNA, 17 bp, Homo sapiens
gacccttgacacctgct

SEQ ID NO: 6233230 - DNA, 15 bp, Homo sapiens
gacccttgcattaga

SEQ ID NO: 6233231 - DNA, 19 bp, Homo sapiens
gacccttgcctgcctccta

SEQ ID NO: 6233232 - DNA, 17 bp, Homo sapiens
gacccttggtgtttccc

SEQ ID NO: 6233233 - DNA, 22 bp, Homo sapiens
gacccttggtgtttcccttcct

SEQ ID NO: 6233234 - DNA, 23 bp, Homo sapiens
gaccctttagccaaacccttgtc

SEQ ID NO: 6233235 - DNA, 13 bp, Homo sapiens
gaccctttcagaa

SEQ ID NO: 6233236 - DNA, 16 bp, Homo sapiens
gaccctttcctccccc

SEQ ID NO: 6233237 - DNA, 17 bp, Homo sapiens
gaccctttcctccccca

SEQ ID NO: 6233238 - DNA, 23 bp, Homo sapiens
gaccctttcctcccccagcgtca

SEQ ID NO: 6233239 - DNA, 14 bp, Homo sapiens
gaccctttccttcc

SEQ ID NO: 6233240 - DNA, 17 bp, Homo sapiens
gaccctttgttgaaaaa

SEQ ID NO: 6233241 - DNA, 24 bp, Homo sapiens
gaccctttgttgaaaaatgttgct

SEQ ID NO: 6233242 - DNA, 15 bp, Homo sapiens
gacccttttctcagg

SEQ ID NO: 6233243 - DNA, 14 bp, Homo sapiens
gaccgagccctgga

SEQ ID NO: 6233244 - DNA, 19 bp, Homo sapiens
gaccgaggctacagctcca

SEQ ID NO: 6233245 - DNA, 17 bp, Homo sapiens
gaccgaggctggagctg

SEQ ID NO: 6233246 - DNA, 22 bp, Homo sapiens
gaccgagtgtggagctgcttcc

SEQ ID NO: 6233247 - DNA, 19 bp, Homo sapiens
gaccgatgtgtctcccaga

SEQ ID NO: 6233248 - DNA, 12 bp, Homo sapiens
gaccgcacttat

SEQ ID NO: 6233249 - DNA, 16 bp, Homo sapiens
gaccgcagagggaagc

SEQ ID NO: 6233250 - DNA, 20 bp, Homo sapiens
gaccgccagatggggcctct

SEQ ID NO: 6233251 - DNA, 17 bp, Homo sapiens
gaccgccagattctccc

SEQ ID NO: 6233252 - DNA, 14 bp, Homo sapiens
gaccgccccagggc

SEQ ID NO: 6233253 - DNA, 16 bp, Homo sapiens
gaccgccccctcctct

SEQ ID NO: 6233254 - DNA, 23 bp, Homo sapiens
gaccgccctccgtcgggcccctg

SEQ ID NO: 6233255 - DNA, 17 bp, Homo sapiens
gaccgcccttttcccct

SEQ ID NO: 6233256 - DNA, 18 bp, Homo sapiens
gaccgcccttttccccta

SEQ ID NO: 6233257 - DNA, 12 bp, Homo sapiens
gaccgcgcaggc

SEQ ID NO: 6233258 - DNA, 17 bp, Homo sapiens
gaccgcgcccctgggac

SEQ ID NO: 6233259 - DNA, 18 bp, Homo sapiens
gaccgcgcccctgggact

SEQ ID NO: 6233260 - DNA, 21 bp, Homo sapiens
gaccgcgctagggctccgagg

SEQ ID NO: 6233261 - DNA, 16 bp, Homo sapiens
gaccgcgtagagagcc

SEQ ID NO: 6233262 - DNA, 16 bp, Homo sapiens
gaccgctgcccaggtg

SEQ ID NO: 6233263 - DNA, 18 bp, Homo sapiens
gaccgcttcacccctgca

SEQ ID NO: 6233264 - DNA, 19 bp, Homo sapiens
gaccgcttcacccctgcac

SEQ ID NO: 6233265 - DNA, 14 bp, Homo sapiens
gaccgcttcccaga

SEQ ID NO: 6233266 - DNA, 16 bp, Homo sapiens
gaccggaagctcctgg

SEQ ID NO: 6233267 - DNA, 16 bp, Homo sapiens
gaccggaattgagagg

SEQ ID NO: 6233268 - DNA, 15 bp, Homo sapiens
gaccggacgcatgca

SEQ ID NO: 6233269 - DNA, 21 bp, Homo sapiens
gaccggccctgcccctcttcc

SEQ ID NO: 6233270 - DNA, 13 bp, Homo sapiens
gaccggccgcagc

SEQ ID NO: 6233271 - DNA, 16 bp, Homo sapiens
gaccggcctgccagga

SEQ ID NO: 6233272 - DNA, 18 bp, Homo sapiens
gaccggcctgccaggagg

SEQ ID NO: 6233273 - DNA, 14 bp, Homo sapiens
gaccggcctggacc

SEQ ID NO: 6233274 - DNA, 14 bp, Homo sapiens
gaccgggcactccc

SEQ ID NO: 6233275 - DNA, 17 bp, Homo sapiens
gaccgggcactcccggg

SEQ ID NO: 6233276 - DNA, 14 bp, Homo sapiens
gaccgggggccaga

SEQ ID NO: 6233277 - DNA, 15 bp, Homo sapiens
gaccgggggccagac

SEQ ID NO: 6233278 - DNA, 12 bp, Homo sapiens
gaccggggtcct

SEQ ID NO: 6233279 - DNA, 15 bp, Homo sapiens
gaccggggtggagtc

SEQ ID NO: 6233280 - DNA, 17 bp, Homo sapiens
gaccgggtgggcctggc

SEQ ID NO: 6233281 - DNA, 19 bp, Homo sapiens
gaccgggtgggcctggcct

SEQ ID NO: 6233282 - DNA, 20 bp, Homo sapiens
gaccggtttggagtaatcag

SEQ ID NO: 6233283 - DNA, 18 bp, Homo sapiens
gaccgtacaaactcagat

SEQ ID NO: 6233284 - DNA, 12 bp, Homo sapiens
gaccgtcttcct

SEQ ID NO: 6233285 - DNA, 15 bp, Homo sapiens
gaccgtgaggccaga

SEQ ID NO: 6233286 - DNA, 21 bp, Homo sapiens
gaccgtgccattgtactccag

SEQ ID NO: 6233287 - DNA, 17 bp, Homo sapiens
gaccgtgccccacctcc

SEQ ID NO: 6233288 - DNA, 19 bp, Homo sapiens
gaccgtgccccacctcccc

SEQ ID NO: 6233289 - DNA, 22 bp, Homo sapiens
gaccgtgccccacctccccaca

SEQ ID NO: 6233290 - DNA, 15 bp, Homo sapiens
gaccgtggacaggcc

SEQ ID NO: 6233291 - DNA, 17 bp, Homo sapiens
gaccgtggacaggccca

SEQ ID NO: 6233292 - DNA, 18 bp, Homo sapiens
gaccgtggacaggcccag

SEQ ID NO: 6233293 - DNA, 18 bp, Homo sapiens
gaccgtggtgtcctctgt

SEQ ID NO: 6233294 - DNA, 20 bp, Homo sapiens
gaccgtggtgtcctctgtcc

SEQ ID NO: 6233295 - DNA, 14 bp, Homo sapiens
gaccgtgtacaata

SEQ ID NO: 6233296 - DNA, 22 bp, Homo sapiens
gaccgttcagtgtcccaggcag

SEQ ID NO: 6233297 - DNA, 20 bp, Homo sapiens
gaccgtttccaagctgcggg

SEQ ID NO: 6233298 - DNA, 19 bp, Homo sapiens
gaccgttttcatcctggcc

SEQ ID NO: 6233299 - DNA, 18 bp, Homo sapiens
gaccgtttttatattact

SEQ ID NO: 6233300 - DNA, 21 bp, Homo sapiens
gacctaaaagttgaaaagcca

SEQ ID NO: 6233301 - DNA, 22 bp, Homo sapiens
gacctaaaagttgaaaagccaa

SEQ ID NO: 6233302 - DNA, 13 bp, Homo sapiens
gacctaaagcatt

SEQ ID NO: 6233303 - DNA, 22 bp, Homo sapiens
gacctaaagcattttttaaaag

SEQ ID NO: 6233304 - DNA, 21 bp, Homo sapiens
gacctaaagggtatgagctgg

SEQ ID NO: 6233305 - DNA, 16 bp, Homo sapiens
gacctaaatgacctca

SEQ ID NO: 6233306 - DNA, 17 bp, Homo sapiens
gacctaaatgacctcag

SEQ ID NO: 6233307 - DNA, 21 bp, Homo sapiens
gacctaacctaggagggctct

SEQ ID NO: 6233308 - DNA, 15 bp, Homo sapiens
gacctaactgtgaac

SEQ ID NO: 6233309 - DNA, 12 bp, Homo sapiens
gacctaagaaca

SEQ ID NO: 6233310 - DNA, 14 bp, Homo sapiens
gacctaagccctgc

SEQ ID NO: 6233311 - DNA, 13 bp, Homo sapiens
gacctaaggcaga

SEQ ID NO: 6233312 - DNA, 23 bp, Homo sapiens
gacctaaggcagacaggaaggaa

SEQ ID NO: 6233313 - DNA, 14 bp, Homo sapiens
gacctaatatcatt

SEQ ID NO: 6233314 - DNA, 18 bp, Homo sapiens
gacctaatatcattttat

SEQ ID NO: 6233315 - DNA, 19 bp, Homo sapiens
gacctaatatcattttatt

SEQ ID NO: 6233316 - DNA, 23 bp, Homo sapiens
gacctaatatcattttattcaca

SEQ ID NO: 6233317 - DNA, 14 bp, Homo sapiens
gacctaatgctcct

SEQ ID NO: 6233318 - DNA, 18 bp, Homo sapiens
gacctaatgctggcctga

SEQ ID NO: 6233319 - DNA, 13 bp, Homo sapiens
gacctacaaatca

SEQ ID NO: 6233320 - DNA, 13 bp, Homo sapiens
gacctacaggctg

SEQ ID NO: 6233321 - DNA, 13 bp, Homo sapiens
gacctacaggggg

SEQ ID NO: 6233322 - DNA, 16 bp, Homo sapiens
gacctacattccctct

SEQ ID NO: 6233323 - DNA, 19 bp, Homo sapiens
gacctacattccctctcct

SEQ ID NO: 6233324 - DNA, 18 bp, Homo sapiens
gacctaccaggacagaac

SEQ ID NO: 6233325 - DNA, 18 bp, Homo sapiens
gacctaccccagccaggc

SEQ ID NO: 6233326 - DNA, 20 bp, Homo sapiens
gacctaccccagccaggctc

SEQ ID NO: 6233327 - DNA, 21 bp, Homo sapiens
gacctaccccagccaggctcc

SEQ ID NO: 6233328 - DNA, 20 bp, Homo sapiens
gacctaccctggaccgagtg

SEQ ID NO: 6233329 - DNA, 14 bp, Homo sapiens
gacctacctcaggt

SEQ ID NO: 6233330 - DNA, 15 bp, Homo sapiens
gacctacctcaggtt

SEQ ID NO: 6233331 - DNA, 20 bp, Homo sapiens
gcactgttttctagtgtatc

SEQ ID NO: 6233332 - DNA, 22 bp, Homo sapiens
gcactgttttctagtgtatcaa

SEQ ID NO: 6233333 - DNA, 17 bp, Homo sapiens
gcacttaagtgcacttt

SEQ ID NO: 6233334 - DNA, 20 bp, Homo sapiens
gcacttaatattagcttgct

SEQ ID NO: 6233335 - DNA, 21 bp, Homo sapiens
gcacttaatattagcttgctt

SEQ ID NO: 6233336 - DNA, 13 bp, Homo sapiens
gcacttacaattt

SEQ ID NO: 6233337 - DNA, 18 bp, Homo sapiens
gcacttacctgcttgagc

SEQ ID NO: 6233338 - DNA, 23 bp, Homo sapiens
gcacttacctgcttgagctttct

SEQ ID NO: 6233339 - DNA, 18 bp, Homo sapiens
gcacttagacctgccagc

SEQ ID NO: 6233340 - DNA, 22 bp, Homo sapiens
gcacttagtaggtcctcaataa

SEQ ID NO: 6233341 - DNA, 21 bp, Homo sapiens
gcacttataggtaacgtgatt

SEQ ID NO: 6233342 - DNA, 20 bp, Homo sapiens
gcacttatatagcacctttc

SEQ ID NO: 6233343 - DNA, 16 bp, Homo sapiens
gcacttatgatttcat

SEQ ID NO: 6233344 - DNA, 19 bp, Homo sapiens
gcacttattgaccattttt

SEQ ID NO: 6233345 - DNA, 14 bp, Homo sapiens
gcacttattgtaaa

SEQ ID NO: 6233346 - DNA, 22 bp, Homo sapiens
gcacttattttttaatgtgaga

SEQ ID NO: 6233347 - DNA, 14 bp, Homo sapiens
gcacttcaagcaaa

SEQ ID NO: 6233348 - DNA, 17 bp, Homo sapiens
gcacttcacagctggac

SEQ ID NO: 6233349 - DNA, 17 bp, Homo sapiens
gcacttcagaattccat

SEQ ID NO: 6233350 - DNA, 14 bp, Homo sapiens
gcacttcagatcaa

SEQ ID NO: 6233351 - DNA, 19 bp, Homo sapiens
gcacttcaggtccgtgggc

SEQ ID NO: 6233352 - DNA, 14 bp, Homo sapiens
gcacttcatatcta

SEQ ID NO: 6233353 - DNA, 12 bp, Homo sapiens
gcacttcatccc

SEQ ID NO: 6233354 - DNA, 24 bp, Homo sapiens
gcacttcatcccggagcgcacctg

SEQ ID NO: 6233355 - DNA, 23 bp, Homo sapiens
gcacttcatctggctgcctttgc

SEQ ID NO: 6233356 - DNA, 23 bp, Homo sapiens
gcacttcattgagagttttgtct

SEQ ID NO: 6233357 - DNA, 20 bp, Homo sapiens
gcacttcccagagcatcttg

SEQ ID NO: 6233358 - DNA, 13 bp, Homo sapiens
gcacttcccagga

SEQ ID NO: 6233359 - DNA, 12 bp, Homo sapiens
gcacttccctgc

SEQ ID NO: 6233360 - DNA, 17 bp, Homo sapiens
gcacttcctccacagtc

SEQ ID NO: 6233361 - DNA, 19 bp, Homo sapiens
gcacttcctcccctcgccc

SEQ ID NO: 6233362 - DNA, 22 bp, Homo sapiens
gcacttcctctcgcggccctca

SEQ ID NO: 6233363 - DNA, 22 bp, Homo sapiens
gcacttcctgttttataatgaa

SEQ ID NO: 6233364 - DNA, 16 bp, Homo sapiens
gcacttctggggccag

SEQ ID NO: 6233365 - DNA, 19 bp, Homo sapiens
gcacttctggggccagccc

SEQ ID NO: 6233366 - DNA, 21 bp, Homo sapiens
gcacttctggggccagcccct

SEQ ID NO: 6233367 - DNA, 12 bp, Homo sapiens
gcacttctgttc

SEQ ID NO: 6233368 - DNA, 23 bp, Homo sapiens
gcacttctttttctcgctgtcct

SEQ ID NO: 6233369 - DNA, 23 bp, Homo sapiens
gcacttgacaccaaccagacagc

SEQ ID NO: 6233370 - DNA, 24 bp, Homo sapiens
gcacttgacaccaaccagacagca

SEQ ID NO: 6233371 - DNA, 23 bp, Homo sapiens
gcacttgagaaccagtctcctca

SEQ ID NO: 6233372 - DNA, 17 bp, Homo sapiens
gcacttgagctgtctga

SEQ ID NO: 6233373 - DNA, 12 bp, Homo sapiens
gcacttgagttt

SEQ ID NO: 6233374 - DNA, 19 bp, Homo sapiens
gcacttgcctatgatactg

SEQ ID NO: 6233375 - DNA, 12 bp, Homo sapiens
gcacttgcctgg

SEQ ID NO: 6233376 - DNA, 13 bp, Homo sapiens
gcacttgcctggg

SEQ ID NO: 6233377 - DNA, 15 bp, Homo sapiens
gcacttgctggaaga

SEQ ID NO: 6233378 - DNA, 21 bp, Homo sapiens
gcacttggcaaaaagaatccc

SEQ ID NO: 6233379 - DNA, 13 bp, Homo sapiens
gcacttggccctt

SEQ ID NO: 6233380 - DNA, 14 bp, Homo sapiens
gcacttggcctcag

SEQ ID NO: 6233381 - DNA, 17 bp, Homo sapiens
gcacttggcctcagctg

SEQ ID NO: 6233382 - DNA, 21 bp, Homo sapiens
gcacttggcctcagctggctg

SEQ ID NO: 6233383 - DNA, 14 bp, Homo sapiens
gcacttggcctctt

SEQ ID NO: 6233384 - DNA, 19 bp, Homo sapiens
gcacttgggggctcagcaa

SEQ ID NO: 6233385 - DNA, 21 bp, Homo sapiens
gcacttgggggctcagcaagg

SEQ ID NO: 6233386 - DNA, 10 bp, Homo sapiens
gcacttgtat

SEQ ID NO: 6233387 - DNA, 19 bp, Homo sapiens
gcacttgtgatcctaaaat

SEQ ID NO: 6233388 - DNA, 15 bp, Homo sapiens
gcacttgttatatta

SEQ ID NO: 6233389 - DNA, 17 bp, Homo sapiens
gcacttgttatattata

SEQ ID NO: 6233390 - DNA, 17 bp, Homo sapiens
gcacttgttccttctgc

SEQ ID NO: 6233391 - DNA, 23 bp, Homo sapiens
gcactttaaaaaattttttgatt

SEQ ID NO: 6233392 - DNA, 23 bp, Homo sapiens
gcactttaaagaggctgtgtggc

SEQ ID NO: 6233393 - DNA, 18 bp, Homo sapiens
gcactttaaatgaagcta

SEQ ID NO: 6233394 - DNA, 19 bp, Homo sapiens
gcactttaacacagtgtct

SEQ ID NO: 6233395 - DNA, 16 bp, Homo sapiens
gcactttaaccctctc

SEQ ID NO: 6233396 - DNA, 16 bp, Homo sapiens
gcactttaccagaggc

SEQ ID NO: 6233397 - DNA, 18 bp, Homo sapiens
gcactttagaatatgcct

SEQ ID NO: 6233398 - DNA, 20 bp, Homo sapiens
gcactttagaatatgccttg

SEQ ID NO: 6233399 - DNA, 11 bp, Homo sapiens
gcactttagac

SEQ ID NO: 6233400 - DNA, 16 bp, Homo sapiens
gcactttagacatttt

SEQ ID NO: 6233401 - DNA, 14 bp, Homo sapiens
gcactttagcagat

SEQ ID NO: 6233402 - DNA, 17 bp, Homo sapiens
gcactttagcagatgtg

SEQ ID NO: 6233403 - DNA, 16 bp, Homo sapiens
gcactttataaacact

SEQ ID NO: 6233404 - DNA, 20 bp, Homo sapiens
gcactttatattttcctctt

SEQ ID NO: 6233405 - DNA, 22 bp, Homo sapiens
gcactttcattgccagtgtctt

SEQ ID NO: 6233406 - DNA, 15 bp, Homo sapiens
gcactttccaatgcc

SEQ ID NO: 6233407 - DNA, 20 bp, Homo sapiens
gcactttccaatgccacaga

SEQ ID NO: 6233408 - DNA, 22 bp, Homo sapiens
gcactttccacttccagagggg

SEQ ID NO: 6233409 - DNA, 19 bp, Homo sapiens
gcactttccacttcttcct

SEQ ID NO: 6233410 - DNA, 23 bp, Homo sapiens
gcactttccacttcttcctttct

SEQ ID NO: 6233411 - DNA, 15 bp, Homo sapiens
gcactttcccccttc

SEQ ID NO: 6233412 - DNA, 22 bp, Homo sapiens
gcactttccctagaaagccata

SEQ ID NO: 6233413 - DNA, 20 bp, Homo sapiens
gcactttcctccacctccca

SEQ ID NO: 6233414 - DNA, 17 bp, Homo sapiens
gcactttcctcctggca

SEQ ID NO: 6233415 - DNA, 17 bp, Homo sapiens
gcactttcctttcaata

SEQ ID NO: 6233416 - DNA, 20 bp, Homo sapiens
gcactttcctttcaataaag

SEQ ID NO: 6233417 - DNA, 21 bp, Homo sapiens
gcactttcctttcaataaagt

SEQ ID NO: 6233418 - DNA, 16 bp, Homo sapiens
gcactttctaatgttt

SEQ ID NO: 6233419 - DNA, 22 bp, Homo sapiens
gcactttctacaatgtgaactt

SEQ ID NO: 6233420 - DNA, 13 bp, Homo sapiens
gcactttctcggt

SEQ ID NO: 6233421 - DNA, 21 bp, Homo sapiens
gcactttctcggtccactctt

SEQ ID NO: 6233422 - DNA, 15 bp, Homo sapiens
gcactttctgtagta

SEQ ID NO: 6233423 - DNA, 19 bp, Homo sapiens
gcactttgaaaatatttct

SEQ ID NO: 6233424 - DNA, 21 bp, Homo sapiens
gcactttgaaaatatttctat

SEQ ID NO: 6233425 - DNA, 22 bp, Homo sapiens
gcactttgaaaatatttctatg

SEQ ID NO: 6233426 - DNA, 22 bp, Homo sapiens
gcactttgaaatacctcatgtt

SEQ ID NO: 6233427 - DNA, 23 bp, Homo sapiens
gcactttgacagcgcacagctgc

SEQ ID NO: 6233428 - DNA, 15 bp, Homo sapiens
gcactttgagaggct

SEQ ID NO: 6233429 - DNA, 21 bp, Homo sapiens
gcactttgatgtcatgtgttc

SEQ ID NO: 6233430 - DNA, 14 bp, Homo sapiens
gcactttgcactta

SEQ ID NO: 6233431 - DNA, 19 bp, Homo sapiens
gcactttgctttaatataa

SEQ ID NO: 6233432 - DNA, 14 bp, Homo sapiens
gcactttgggaggc

SEQ ID NO: 6233433 - DNA, 22 bp, Homo sapiens
gcactttgggaggccgaggcgg

SEQ ID NO: 6233434 - DNA, 17 bp, Homo sapiens
gcactttgggaggctga

SEQ ID NO: 6233435 - DNA, 21 bp, Homo sapiens
gcactttgggaggctgaggcg

SEQ ID NO: 6233436 - DNA, 21 bp, Homo sapiens
gcactttgggtttttaactca

SEQ ID NO: 6233437 - DNA, 13 bp, Homo sapiens
gcactttgtaaat

SEQ ID NO: 6233438 - DNA, 17 bp, Homo sapiens
gcactttgtagtgtttg

SEQ ID NO: 6233439 - DNA, 16 bp, Homo sapiens
gcactttgttctggct

SEQ ID NO: 6233440 - DNA, 18 bp, Homo sapiens
gcactttgttctggctct

SEQ ID NO: 6233441 - DNA, 17 bp, Homo sapiens
gcactttgtttagaaaa

SEQ ID NO: 6233442 - DNA, 21 bp, Homo sapiens
gcacttttaacaaaaaaggaa

SEQ ID NO: 6233443 - DNA, 17 bp, Homo sapiens
gcacttttagccagaga

SEQ ID NO: 6233444 - DNA, 21 bp, Homo sapiens
gcacttttagccagagatgca

SEQ ID NO: 6233445 - DNA, 22 bp, Homo sapiens
gcacttttagccagagatgcaa

SEQ ID NO: 6233446 - DNA, 12 bp, Homo sapiens
gcacttttattt

SEQ ID NO: 6233447 - DNA, 18 bp, Homo sapiens
gcacttttattttcattg

SEQ ID NO: 6233448 - DNA, 13 bp, Homo sapiens
gcacttttgaatg

SEQ ID NO: 6233449 - DNA, 16 bp, Homo sapiens
gcactttttaaaaaac

SEQ ID NO: 6233450 - DNA, 16 bp, Homo sapiens
gcactttttaattcac

SEQ ID NO: 6233451 - DNA, 20 bp, Homo sapiens
gcactttttaattcaccaaa

SEQ ID NO: 6233452 - DNA, 17 bp, Homo sapiens
gcactttttccttactg

SEQ ID NO: 6233453 - DNA, 16 bp, Homo sapiens
gcactttttggctgac

SEQ ID NO: 6233454 - DNA, 21 bp, Homo sapiens
gcacttttttatgaagaaaaa

SEQ ID NO: 6233455 - DNA, 20 bp, Homo sapiens
gcagaaaaaacaaaaaaact

SEQ ID NO: 6233456 - DNA, 18 bp, Homo sapiens
gcagaaaaatgtcattga

SEQ ID NO: 6233457 - DNA, 15 bp, Homo sapiens
gcagaaaacagagcc

SEQ ID NO: 6233458 - DNA, 21 bp, Homo sapiens
gcagaaaacagagcctgccta

SEQ ID NO: 6233459 - DNA, 14 bp, Homo sapiens
gcagaaaacattgt

SEQ ID NO: 6233460 - DNA, 15 bp, Homo sapiens
gcagaaaacattgtt

SEQ ID NO: 6233461 - DNA, 19 bp, Homo sapiens
gcagaaaagaggagaccct

SEQ ID NO: 6233462 - DNA, 20 bp, Homo sapiens
gcagaaaagcacctgccgac

SEQ ID NO: 6233463 - DNA, 16 bp, Homo sapiens
gcagaaaagctcagag

SEQ ID NO: 6233464 - DNA, 18 bp, Homo sapiens
gcagaaaataaaggaagc

SEQ ID NO: 6233465 - DNA, 22 bp, Homo sapiens
gcagaaaatcttttactagtgt

SEQ ID NO: 6233466 - DNA, 12 bp, Homo sapiens
gcagaaaatgaa

SEQ ID NO: 6233467 - DNA, 15 bp, Homo sapiens
gcagaaacaaaatga

SEQ ID NO: 6233468 - DNA, 20 bp, Homo sapiens
gcagaaacacacagtcacat

SEQ ID NO: 6233469 - DNA, 11 bp, Homo sapiens
gcagaaacaga

SEQ ID NO: 6233470 - DNA, 17 bp, Homo sapiens
gcagaaacccccaggag

SEQ ID NO: 6233471 - DNA, 18 bp, Homo sapiens
gcagaaaccctgagcaga

SEQ ID NO: 6233472 - DNA, 20 bp, Homo sapiens
gcagaaacctatctcaggga

SEQ ID NO: 6233473 - DNA, 10 bp, Homo sapiens
gcagaaagat

SEQ ID NO: 6233474 - DNA, 17 bp, Homo sapiens
gcagaaagcagaggctg

SEQ ID NO: 6233475 - DNA, 13 bp, Homo sapiens
gcagaaaggagat

SEQ ID NO: 6233476 - DNA, 14 bp, Homo sapiens
gcagaaaggctgca

SEQ ID NO: 6233477 - DNA, 13 bp, Homo sapiens
gcagaaagggaaa

SEQ ID NO: 6233478 - DNA, 21 bp, Homo sapiens
gcagaaaggttctgcccggga

SEQ ID NO: 6233479 - DNA, 16 bp, Homo sapiens
gcagaaatagttgtct

SEQ ID NO: 6233480 - DNA, 17 bp, Homo sapiens
gcagaaatagttgtctg

SEQ ID NO: 6233481 - DNA, 21 bp, Homo sapiens
gcagaaatagttgtctgtgct

SEQ ID NO: 6233482 - DNA, 19 bp, Homo sapiens
gcagaaatatagtgcaata

SEQ ID NO: 6233483 - DNA, 12 bp, Homo sapiens
gcagaaatgatt

SEQ ID NO: 6233484 - DNA, 19 bp, Homo sapiens
gcagaaatgtggatgctct

SEQ ID NO: 6233485 - DNA, 17 bp, Homo sapiens
gcagaaattctgttttt

SEQ ID NO: 6233486 - DNA, 14 bp, Homo sapiens
gcagaacaaatgtg

SEQ ID NO: 6233487 - DNA, 22 bp, Homo sapiens
gcagaacaaatgtgtttttcta

SEQ ID NO: 6233488 - DNA, 12 bp, Homo sapiens
gcagaacacctg

SEQ ID NO: 6233489 - DNA, 14 bp, Homo sapiens
gcagaacagtgaaa

SEQ ID NO: 6233490 - DNA, 13 bp, Homo sapiens
gcagaacagtgat

SEQ ID NO: 6233491 - DNA, 20 bp, Homo sapiens
gcagaacagttaagcagccg

SEQ ID NO: 6233492 - DNA, 12 bp, Homo sapiens
gcagaaccagcc

SEQ ID NO: 6233493 - DNA, 15 bp, Homo sapiens
gcagaaccagcctca

SEQ ID NO: 6233494 - DNA, 21 bp, Homo sapiens
gcagaaccagctctttggtgc

SEQ ID NO: 6233495 - DNA, 16 bp, Homo sapiens
gcagaaccctggtgag

SEQ ID NO: 6233496 - DNA, 22 bp, Homo sapiens
gcagaaccggtcccagcctggg

SEQ ID NO: 6233497 - DNA, 21 bp, Homo sapiens
gcagaacctgcacacaggaca

SEQ ID NO: 6233498 - DNA, 23 bp, Homo sapiens
gcagaacctgcacacaggacagc

SEQ ID NO: 6233499 - DNA, 19 bp, Homo sapiens
gcagaacctggtggctgga

SEQ ID NO: 6233500 - DNA, 18 bp, Homo sapiens
gcagaacgatgcctgcag

SEQ ID NO: 6233501 - DNA, 19 bp, Homo sapiens
gcagaactaaactcattta

SEQ ID NO: 6233502 - DNA, 20 bp, Homo sapiens
gcagaactcctacctgaagg

SEQ ID NO: 6233503 - DNA, 21 bp, Homo sapiens
gcagaactcctacctgaaggc

SEQ ID NO: 6233504 - DNA, 18 bp, Homo sapiens
gcagaactctctgtcttc

SEQ ID NO: 6233505 - DNA, 17 bp, Homo sapiens
gcagaactgaagccact

SEQ ID NO: 6233506 - DNA, 19 bp, Homo sapiens
gcagaactgctggggctgg

SEQ ID NO: 6233507 - DNA, 15 bp, Homo sapiens
gcagaactttctctt

SEQ ID NO: 6233508 - DNA, 13 bp, Homo sapiens
gacctacctccct

SEQ ID NO: 6233509 - DNA, 15 bp, Homo sapiens
gacctacctccctcc

SEQ ID NO: 6233510 - DNA, 19 bp, Homo sapiens
gacctacctccctccctct

SEQ ID NO: 6233511 - DNA, 22 bp, Homo sapiens
gacctacctccctccctctccg

SEQ ID NO: 6233512 - DNA, 15 bp, Homo sapiens
gacctacctggcccc

SEQ ID NO: 6233513 - DNA, 22 bp, Homo sapiens
gacctacgttcctggccccctc

SEQ ID NO: 6233514 - DNA, 23 bp, Homo sapiens
gacctactcctccccctcctcca

SEQ ID NO: 6233515 - DNA, 16 bp, Homo sapiens
gacctactgaacccag

SEQ ID NO: 6233516 - DNA, 21 bp, Homo sapiens
gacctactgaacccagagtca

SEQ ID NO: 6233517 - DNA, 17 bp, Homo sapiens
gacctactgttctaaag

SEQ ID NO: 6233518 - DNA, 13 bp, Homo sapiens
gacctagaagctt

SEQ ID NO: 6233519 - DNA, 19 bp, Homo sapiens
gacctagaccagtttgcat

SEQ ID NO: 6233520 - DNA, 14 bp, Homo sapiens
gacctagacctggg

SEQ ID NO: 6233521 - DNA, 16 bp, Homo sapiens
gacctagacctgggcc

SEQ ID NO: 6233522 - DNA, 20 bp, Homo sapiens
gacctagcctggatggcccc

SEQ ID NO: 6233523 - DNA, 16 bp, Homo sapiens
gacctagctatgttgg

SEQ ID NO: 6233524 - DNA, 17 bp, Homo sapiens
gacctagctctttgggc

SEQ ID NO: 6233525 - DNA, 19 bp, Homo sapiens
gacctagctctttgggcct

SEQ ID NO: 6233526 - DNA, 17 bp, Homo sapiens
gacctagctgttgtaaa

SEQ ID NO: 6233527 - DNA, 19 bp, Homo sapiens
gacctagctgttgtaaaga

SEQ ID NO: 6233528 - DNA, 16 bp, Homo sapiens
gacctaggcagtaggc

SEQ ID NO: 6233529 - DNA, 16 bp, Homo sapiens
gacctagggatcctga

SEQ ID NO: 6233530 - DNA, 12 bp, Homo sapiens
gacctaggggga

SEQ ID NO: 6233531 - DNA, 21 bp, Homo sapiens
gacctagggggacggggctga

SEQ ID NO: 6233532 - DNA, 19 bp, Homo sapiens
gacctagtcccctttcctc

SEQ ID NO: 6233533 - DNA, 20 bp, Homo sapiens
gacctataacctgtaggaaa

SEQ ID NO: 6233534 - DNA, 18 bp, Homo sapiens
gacctatactgaaagatc

SEQ ID NO: 6233535 - DNA, 15 bp, Homo sapiens
gacctatcacttcca

SEQ ID NO: 6233536 - DNA, 19 bp, Homo sapiens
gacctatgataaataacca

SEQ ID NO: 6233537 - DNA, 17 bp, Homo sapiens
gacctatgcagggaggc

SEQ ID NO: 6233538 - DNA, 22 bp, Homo sapiens
gacctatgtacttaatccttta

SEQ ID NO: 6233539 - DNA, 16 bp, Homo sapiens
gacctatgttgtaatt

SEQ ID NO: 6233540 - DNA, 13 bp, Homo sapiens
gacctatgtttgc

SEQ ID NO: 6233541 - DNA, 16 bp, Homo sapiens
gacctcaaatgatgtg

SEQ ID NO: 6233542 - DNA, 22 bp, Homo sapiens
gacctcaaatgatgtgcctgct

SEQ ID NO: 6233543 - DNA, 13 bp, Homo sapiens
gacctcaacctgt

SEQ ID NO: 6233544 - DNA, 16 bp, Homo sapiens
gacctcaagccctgag

SEQ ID NO: 6233545 - DNA, 17 bp, Homo sapiens
gacctcaagccctgagg

SEQ ID NO: 6233546 - DNA, 22 bp, Homo sapiens
gacctcaagccctgaggggcag

SEQ ID NO: 6233547 - DNA, 20 bp, Homo sapiens
gacctcaagggacagggaat

SEQ ID NO: 6233548 - DNA, 20 bp, Homo sapiens
gacctcaagtgatctgtcca

SEQ ID NO: 6233549 - DNA, 17 bp, Homo sapiens
gacctcaagtgtcctga

SEQ ID NO: 6233550 - DNA, 17 bp, Homo sapiens
gacctcacacacctctg

SEQ ID NO: 6233551 - DNA, 18 bp, Homo sapiens
gacctcacacacctctgc

SEQ ID NO: 6233552 - DNA, 21 bp, Homo sapiens
gacctcacacacctctgcccc

SEQ ID NO: 6233553 - DNA, 16 bp, Homo sapiens
gacctcacagtgaccc

SEQ ID NO: 6233554 - DNA, 20 bp, Homo sapiens
gacctcacagtgacccttcc

SEQ ID NO: 6233555 - DNA, 22 bp, Homo sapiens
gacctcacagtgacccttccca

SEQ ID NO: 6233556 - DNA, 18 bp, Homo sapiens
gacctcaccggcatgctg

SEQ ID NO: 6233557 - DNA, 20 bp, Homo sapiens
gacctcaccggcatgctggc

SEQ ID NO: 6233558 - DNA, 17 bp, Homo sapiens
gacctcacctaggaagt

SEQ ID NO: 6233559 - DNA, 14 bp, Homo sapiens
gacctcacctccat

SEQ ID NO: 6233560 - DNA, 17 bp, Homo sapiens
gacctcacctggtcctc

SEQ ID NO: 6233561 - DNA, 16 bp, Homo sapiens
gacctcactggcctgc

SEQ ID NO: 6233562 - DNA, 15 bp, Homo sapiens
gacctcactttatta

SEQ ID NO: 6233563 - DNA, 16 bp, Homo sapiens
gacctcagaagtaaag

SEQ ID NO: 6233564 - DNA, 19 bp, Homo sapiens
gacctcagagtccaggccc

SEQ ID NO: 6233565 - DNA, 21 bp, Homo sapiens
gacctcagagtccaggcccca

SEQ ID NO: 6233566 - DNA, 14 bp, Homo sapiens
gacctcagcaaatc

SEQ ID NO: 6233567 - DNA, 20 bp, Homo sapiens
gacctcagcaagctgcccag

SEQ ID NO: 6233568 - DNA, 11 bp, Homo sapiens
gacctcagcca

SEQ ID NO: 6233569 - DNA, 13 bp, Homo sapiens
gacctcagcctgt

SEQ ID NO: 6233570 - DNA, 16 bp, Homo sapiens
gacctcagcctgtgct

SEQ ID NO: 6233571 - DNA, 20 bp, Homo sapiens
gacctcagccttccccttgc

SEQ ID NO: 6233572 - DNA, 17 bp, Homo sapiens
gacctcagctgcacatt

SEQ ID NO: 6233573 - DNA, 19 bp, Homo sapiens
gacctcagctgcacattcc

SEQ ID NO: 6233574 - DNA, 20 bp, Homo sapiens
gacctcagctgcacattcct

SEQ ID NO: 6233575 - DNA, 16 bp, Homo sapiens
gacctcagctgcttct

SEQ ID NO: 6233576 - DNA, 17 bp, Homo sapiens
gacctcaggagggcagg

SEQ ID NO: 6233577 - DNA, 19 bp, Homo sapiens
gacctcaggagggcaggct

SEQ ID NO: 6233578 - DNA, 21 bp, Homo sapiens
gacctcaggcactagcctttg

SEQ ID NO: 6233579 - DNA, 11 bp, Homo sapiens
gacctcaggcc

SEQ ID NO: 6233580 - DNA, 18 bp, Homo sapiens
gacctcagggctatgtgg

SEQ ID NO: 6233581 - DNA, 13 bp, Homo sapiens
gacctcaggggca

SEQ ID NO: 6233582 - DNA, 15 bp, Homo sapiens
gacctcaggggcacc

SEQ ID NO: 6233583 - DNA, 19 bp, Homo sapiens
gacctcaggtgatccaccc

SEQ ID NO: 6233584 - DNA, 20 bp, Homo sapiens
gacctcaggtgatccaccca

SEQ ID NO: 6233585 - DNA, 19 bp, Homo sapiens
gacctcaggtgatccgccc

SEQ ID NO: 6233586 - DNA, 18 bp, Homo sapiens
gacctcagtgactcagaa

SEQ ID NO: 6233587 - DNA, 20 bp, Homo sapiens
gacctcagttttatcatttt

SEQ ID NO: 6233588 - DNA, 14 bp, Homo sapiens
gacctcatcagcct

SEQ ID NO: 6233589 - DNA, 16 bp, Homo sapiens
gacctcatcagccttg

SEQ ID NO: 6233590 - DNA, 19 bp, Homo sapiens
gacctcatcaggatgaacc

SEQ ID NO: 6233591 - DNA, 14 bp, Homo sapiens
gacctcatccaaac

SEQ ID NO: 6233592 - DNA, 16 bp, Homo sapiens
gacctcatctgcctgc

SEQ ID NO: 6233593 - DNA, 18 bp, Homo sapiens
gacctcatgatctgccca

SEQ ID NO: 6233594 - DNA, 12 bp, Homo sapiens
gacctcatgccc

SEQ ID NO: 6233595 - DNA, 17 bp, Homo sapiens
gacctcatgcccagctc

SEQ ID NO: 6233596 - DNA, 20 bp, Homo sapiens
gacctccacctgggagatgc

SEQ ID NO: 6233597 - DNA, 23 bp, Homo sapiens
gacctccagattattttctatat

SEQ ID NO: 6233598 - DNA, 18 bp, Homo sapiens
gacctccaggggctcctg

SEQ ID NO: 6233599 - DNA, 23 bp, Homo sapiens
gacctccaggggctcctgggttg

SEQ ID NO: 6233600 - DNA, 18 bp, Homo sapiens
gacctccagtgagtacct

SEQ ID NO: 6233601 - DNA, 19 bp, Homo sapiens
gacctccagtgagtacctg

SEQ ID NO: 6233602 - DNA, 20 bp, Homo sapiens
gacctccagtgagtacctgc

SEQ ID NO: 6233603 - DNA, 17 bp, Homo sapiens
gacctccatactgggct

SEQ ID NO: 6233604 - DNA, 16 bp, Homo sapiens
gacctccatgcccccg

SEQ ID NO: 6233605 - DNA, 22 bp, Homo sapiens
gacctccatgcccccgccacct

SEQ ID NO: 6233606 - DNA, 24 bp, Homo sapiens
gacctccatgcccccgccacctcc

SEQ ID NO: 6233607 - DNA, 15 bp, Homo sapiens
gacctcccagcccta

SEQ ID NO: 6233608 - DNA, 14 bp, Homo sapiens
gacctcccaggaca

SEQ ID NO: 6233609 - DNA, 13 bp, Homo sapiens
gacctccccaccc

SEQ ID NO: 6233610 - DNA, 19 bp, Homo sapiens
gacctccccacccgctccc

SEQ ID NO: 6233611 - DNA, 16 bp, Homo sapiens
gacctccccagcccag

SEQ ID NO: 6233612 - DNA, 17 bp, Homo sapiens
gacctccccagcccagg

SEQ ID NO: 6233613 - DNA, 16 bp, Homo sapiens
gacctccccagcccct

SEQ ID NO: 6233614 - DNA, 13 bp, Homo sapiens
gacctcccccagg

SEQ ID NO: 6233615 - DNA, 16 bp, Homo sapiens
gacctccccctccttc

SEQ ID NO: 6233616 - DNA, 19 bp, Homo sapiens
gacctccccctccttccca

SEQ ID NO: 6233617 - DNA, 13 bp, Homo sapiens
gacctcccctccc

SEQ ID NO: 6233618 - DNA, 14 bp, Homo sapiens
gacctcccctcttc

SEQ ID NO: 6233619 - DNA, 17 bp, Homo sapiens
gacctccctggcttgag

SEQ ID NO: 6233620 - DNA, 20 bp, Homo sapiens
gacctccctgtctctacaaa

SEQ ID NO: 6233621 - DNA, 17 bp, Homo sapiens
gacctccctgtgagaga

SEQ ID NO: 6233622 - DNA, 21 bp, Homo sapiens
gacctcccttccgaccctctg

SEQ ID NO: 6233623 - DNA, 18 bp, Homo sapiens
gacctccgcccctgcccc

SEQ ID NO: 6233624 - DNA, 17 bp, Homo sapiens
gacctccgcctcctggg

SEQ ID NO: 6233625 - DNA, 21 bp, Homo sapiens
gacctccggagcgccctgcag

SEQ ID NO: 6233626 - DNA, 22 bp, Homo sapiens
gacctccggccaggtgcctcct

SEQ ID NO: 6233627 - DNA, 17 bp, Homo sapiens
gacctccgtcctctccc

SEQ ID NO: 6233628 - DNA, 18 bp, Homo sapiens
gacctccgtgcccaggcc

SEQ ID NO: 6233629 - DNA, 19 bp, Homo sapiens
gacctccgtgcccaggccc

SEQ ID NO: 6233630 - DNA, 17 bp, Homo sapiens
gacctcctaacaagtag

SEQ ID NO: 6233631 - DNA, 22 bp, Homo sapiens
gacctcctccctcattcatctt

SEQ ID NO: 6233632 - DNA, 16 bp, Homo sapiens
gacctcctcctgccct

SEQ ID NO: 6233633 - DNA, 17 bp, Homo sapiens
gacctcctcctgccctc

SEQ ID NO: 6233634 - DNA, 14 bp, Homo sapiens
gacctcctctgggc

SEQ ID NO: 6233635 - DNA, 18 bp, Homo sapiens
gacctcctctgggccctg

SEQ ID NO: 6233636 - DNA, 19 bp, Homo sapiens
gacctcctctgggccctgt

SEQ ID NO: 6233637 - DNA, 12 bp, Homo sapiens
gacctcctgcag

SEQ ID NO: 6233638 - DNA, 12 bp, Homo sapiens
gacctcctgcct

SEQ ID NO: 6233639 - DNA, 14 bp, Homo sapiens
gacctcctgtcact

SEQ ID NO: 6233640 - DNA, 19 bp, Homo sapiens
gacctcctgtcactcactg

SEQ ID NO: 6233641 - DNA, 19 bp, Homo sapiens
gacctccttagccctgtct

SEQ ID NO: 6233642 - DNA, 20 bp, Homo sapiens
gacctccttagccctgtctg

SEQ ID NO: 6233643 - DNA, 22 bp, Homo sapiens
gacctcgactggtttttctaag

SEQ ID NO: 6233644 - DNA, 21 bp, Homo sapiens
gacctcggacagagcccccct

SEQ ID NO: 6233645 - DNA, 15 bp, Homo sapiens
gacctcgggctgttc

SEQ ID NO: 6233646 - DNA, 16 bp, Homo sapiens
gacctcgtactcagga

SEQ ID NO: 6233647 - DNA, 19 bp, Homo sapiens
gacctcgtactcaggagcc

SEQ ID NO: 6233648 - DNA, 15 bp, Homo sapiens
gacctcgtcctcccc

SEQ ID NO: 6233649 - DNA, 18 bp, Homo sapiens
gacctcgtcctccccctg

SEQ ID NO: 6233650 - DNA, 22 bp, Homo sapiens
gacctcgtcctccccctgccag

SEQ ID NO: 6233651 - DNA, 21 bp, Homo sapiens
gacctcgtctttgcttgtcct

SEQ ID NO: 6233652 - DNA, 22 bp, Homo sapiens
gacctcgtgatccgcctgcctc

SEQ ID NO: 6233653 - DNA, 23 bp, Homo sapiens
gacctctataattgccactgaga

SEQ ID NO: 6233654 - DNA, 15 bp, Homo sapiens
gacctctcactgcct

SEQ ID NO: 6233655 - DNA, 22 bp, Homo sapiens
gacctctcagcatagcctgcct

SEQ ID NO: 6233656 - DNA, 17 bp, Homo sapiens
gacctctcagggcctgg

SEQ ID NO: 6233657 - DNA, 20 bp, Homo sapiens
gacctctccagcatcccagc

SEQ ID NO: 6233658 - DNA, 19 bp, Homo sapiens
gacctctccagctctggct

SEQ ID NO: 6233659 - DNA, 15 bp, Homo sapiens
gacctctcccaccca

SEQ ID NO: 6233660 - DNA, 12 bp, Homo sapiens
gacctctcccag

SEQ ID NO: 6233661 - DNA, 14 bp, Homo sapiens
gacctctcccaggg

SEQ ID NO: 6233662 - DNA, 13 bp, Homo sapiens
gacctctccggcc

SEQ ID NO: 6233663 - DNA, 17 bp, Homo sapiens
gacctctccggcctggc

SEQ ID NO: 6233664 - DNA, 16 bp, Homo sapiens
gacctctctcggcccc

SEQ ID NO: 6233665 - DNA, 17 bp, Homo sapiens
gacctctctgcctctct

SEQ ID NO: 6233666 - DNA, 14 bp, Homo sapiens
gacctctgacagca

SEQ ID NO: 6233667 - DNA, 13 bp, Homo sapiens
gacctctgatccc

SEQ ID NO: 6233668 - DNA, 18 bp, Homo sapiens
gacctctgcaagacaaag

SEQ ID NO: 6233669 - DNA, 14 bp, Homo sapiens
gacctctgcagcaa

SEQ ID NO: 6233670 - DNA, 15 bp, Homo sapiens
gacctctgctctgag

SEQ ID NO: 6233671 - DNA, 17 bp, Homo sapiens
gacctctgtaggcagca

SEQ ID NO: 6233672 - DNA, 12 bp, Homo sapiens
gacctctgttgt

SEQ ID NO: 6233673 - DNA, 16 bp, Homo sapiens
gacctcttcagctgct

SEQ ID NO: 6233674 - DNA, 13 bp, Homo sapiens
gacctcttccctc

SEQ ID NO: 6233675 - DNA, 18 bp, Homo sapiens
gacctcttccctctgggc

SEQ ID NO: 6233676 - DNA, 22 bp, Homo sapiens
gacctcttccctctgggcctgt

SEQ ID NO: 6233677 - DNA, 18 bp, Homo sapiens
gacctcttcctggaataa

SEQ ID NO: 6233678 - DNA, 15 bp, Homo sapiens
gacctcttctgaagc

SEQ ID NO: 6233679 - DNA, 23 bp, Homo sapiens
gacctcttctgaagctagaaaca

SEQ ID NO: 6233680 - DNA, 18 bp, Homo sapiens
gacctcttgctgtctctg

SEQ ID NO: 6233681 - DNA, 18 bp, Homo sapiens
gacctctttactctctcc

SEQ ID NO: 6233682 - DNA, 18 bp, Homo sapiens
gacctgaaataatatatt

SEQ ID NO: 6233683 - DNA, 15 bp, Homo sapiens
gacctgaaattccaa

SEQ ID NO: 6233684 - DNA, 23 bp, Homo sapiens
gacctgaaattccaaagtctcta

SEQ ID NO: 6233685 - DNA, 22 bp, Homo sapiens
gacctgaactctgcaactgaat

SEQ ID NO: 6233686 - DNA, 17 bp, Homo sapiens
gcagaactttttttgtg

SEQ ID NO: 6233687 - DNA, 16 bp, Homo sapiens
gcagaagaaaggaaca

SEQ ID NO: 6233688 - DNA, 17 bp, Homo sapiens
gcagaagaagctgggag

SEQ ID NO: 6233689 - DNA, 22 bp, Homo sapiens
gcagaagaagctgggagggagg

SEQ ID NO: 6233690 - DNA, 23 bp, Homo sapiens
gcagaagaagctgggagggaggg

SEQ ID NO: 6233691 - DNA, 16 bp, Homo sapiens
gcagaagaatctttct

SEQ ID NO: 6233692 - DNA, 21 bp, Homo sapiens
gcagaagaattgaacccagga

SEQ ID NO: 6233693 - DNA, 16 bp, Homo sapiens
gcagaagacaaaaaga

SEQ ID NO: 6233694 - DNA, 20 bp, Homo sapiens
gcagaagacaccagagcaga

SEQ ID NO: 6233695 - DNA, 23 bp, Homo sapiens
gcagaagacgggaggggaggcat

SEQ ID NO: 6233696 - DNA, 18 bp, Homo sapiens
gcagaagacgtctcccct

SEQ ID NO: 6233697 - DNA, 16 bp, Homo sapiens
gcagaagagaaaggac

SEQ ID NO: 6233698 - DNA, 12 bp, Homo sapiens
gcagaagaggga

SEQ ID NO: 6233699 - DNA, 21 bp, Homo sapiens
gcagaagagggaggcttcctg

SEQ ID NO: 6233700 - DNA, 16 bp, Homo sapiens
gcagaagagggtgtgt

SEQ ID NO: 6233701 - DNA, 13 bp, Homo sapiens
gcagaagatagag

SEQ ID NO: 6233702 - DNA, 17 bp, Homo sapiens
gcagaagcaataataaa

SEQ ID NO: 6233703 - DNA, 14 bp, Homo sapiens
gcagaagcagcccc

SEQ ID NO: 6233704 - DNA, 21 bp, Homo sapiens
gcagaagcattgcctggactg

SEQ ID NO: 6233705 - DNA, 19 bp, Homo sapiens
gcagaagccagagggtggg

SEQ ID NO: 6233706 - DNA, 15 bp, Homo sapiens
gcagaagccccaaag

SEQ ID NO: 6233707 - DNA, 21 bp, Homo sapiens
gcagaagcgtctcccttggcc

SEQ ID NO: 6233708 - DNA, 21 bp, Homo sapiens
gcagaagctatgtttttaaag

SEQ ID NO: 6233709 - DNA, 23 bp, Homo sapiens
gcagaagctctcgatggacaatg

SEQ ID NO: 6233710 - DNA, 20 bp, Homo sapiens
gcagaaggaaaaatgtgtaa

SEQ ID NO: 6233711 - DNA, 22 bp, Homo sapiens
gcagaaggaaagaagggggccc

SEQ ID NO: 6233712 - DNA, 16 bp, Homo sapiens
gcagaaggaaatgatg

SEQ ID NO: 6233713 - DNA, 12 bp, Homo sapiens
gcagaaggaaga

SEQ ID NO: 6233714 - DNA, 13 bp, Homo sapiens
gcagaaggaagac

SEQ ID NO: 6233715 - DNA, 18 bp, Homo sapiens
gcagaaggaagacttcat

SEQ ID NO: 6233716 - DNA, 13 bp, Homo sapiens
gcagaaggaaggc

SEQ ID NO: 6233717 - DNA, 22 bp, Homo sapiens
gcagaaggaaggcagggaggag

SEQ ID NO: 6233718 - DNA, 22 bp, Homo sapiens
gcagaaggaagggcatccttct

SEQ ID NO: 6233719 - DNA, 13 bp, Homo sapiens
gcagaaggacagg

SEQ ID NO: 6233720 - DNA, 18 bp, Homo sapiens
gcagaaggagagtgagtg

SEQ ID NO: 6233721 - DNA, 21 bp, Homo sapiens
gcagaaggaggaagggactgg

SEQ ID NO: 6233722 - DNA, 19 bp, Homo sapiens
gcagaaggattttttaaag

SEQ ID NO: 6233723 - DNA, 22 bp, Homo sapiens
gcagaaggcaaggccctgccct

SEQ ID NO: 6233724 - DNA, 12 bp, Homo sapiens
gcagaaggcctt

SEQ ID NO: 6233725 - DNA, 19 bp, Homo sapiens
gcagaaggccttgccttgt

SEQ ID NO: 6233726 - DNA, 13 bp, Homo sapiens
gcagaagggaatt

SEQ ID NO: 6233727 - DNA, 18 bp, Homo sapiens
gcagaagggagctggctc

SEQ ID NO: 6233728 - DNA, 20 bp, Homo sapiens
gcagaagtgagcccccccct

SEQ ID NO: 6233729 - DNA, 11 bp, Homo sapiens
gcagaataaag

SEQ ID NO: 6233730 - DNA, 12 bp, Homo sapiens
gcagaataaagc

SEQ ID NO: 6233731 - DNA, 13 bp, Homo sapiens
gcagaataaagca

SEQ ID NO: 6233732 - DNA, 15 bp, Homo sapiens
gcagaataaagcaat

SEQ ID NO: 6233733 - DNA, 20 bp, Homo sapiens
gcagaataaagcaattttcc

SEQ ID NO: 6233734 - DNA, 18 bp, Homo sapiens
gcagaataatctttgggt

SEQ ID NO: 6233735 - DNA, 11 bp, Homo sapiens
gcagaataatg

SEQ ID NO: 6233736 - DNA, 16 bp, Homo sapiens
gcagaataatggaaac

SEQ ID NO: 6233737 - DNA, 17 bp, Homo sapiens
gcagaataatggaaaca

SEQ ID NO: 6233738 - DNA, 16 bp, Homo sapiens
gcagaatactggtctc

SEQ ID NO: 6233739 - DNA, 17 bp, Homo sapiens
gcagaatacttttctct

SEQ ID NO: 6233740 - DNA, 17 bp, Homo sapiens
gcagaatagcaaggtgc

SEQ ID NO: 6233741 - DNA, 17 bp, Homo sapiens
gcagaatcctggccctc

SEQ ID NO: 6233742 - DNA, 23 bp, Homo sapiens
gcagaatctttgcaagaaagtca

SEQ ID NO: 6233743 - DNA, 14 bp, Homo sapiens
gcagaatgaaaatc

SEQ ID NO: 6233744 - DNA, 23 bp, Homo sapiens
gcagaatgaacccatagggagct

SEQ ID NO: 6233745 - DNA, 13 bp, Homo sapiens
gcagaatgaagac

SEQ ID NO: 6233746 - DNA, 15 bp, Homo sapiens
gcagaatgaagccat

SEQ ID NO: 6233747 - DNA, 17 bp, Homo sapiens
gcagaatgaagccattt

SEQ ID NO: 6233748 - DNA, 16 bp, Homo sapiens
gcagaatgactctgga

SEQ ID NO: 6233749 - DNA, 16 bp, Homo sapiens
gcagaatgagatgatt

SEQ ID NO: 6233750 - DNA, 17 bp, Homo sapiens
gcagaatgagatgattt

SEQ ID NO: 6233751 - DNA, 18 bp, Homo sapiens
gcagaatgagatgattta

SEQ ID NO: 6233752 - DNA, 14 bp, Homo sapiens
gcagaatggagaaa

SEQ ID NO: 6233753 - DNA, 16 bp, Homo sapiens
gcagaatggagaaagt

SEQ ID NO: 6233754 - DNA, 16 bp, Homo sapiens
gcagaatggaggcagg

SEQ ID NO: 6233755 - DNA, 21 bp, Homo sapiens
gcagaattctaggcagcacct

SEQ ID NO: 6233756 - DNA, 14 bp, Homo sapiens
gcagaattgacagt

SEQ ID NO: 6233757 - DNA, 22 bp, Homo sapiens
gcagaattgacagttgaacaga

SEQ ID NO: 6233758 - DNA, 20 bp, Homo sapiens
gcagaattggaaaagactaa

SEQ ID NO: 6233759 - DNA, 11 bp, Homo sapiens
gcagaatttta

SEQ ID NO: 6233760 - DNA, 12 bp, Homo sapiens
gcagaattttaa

SEQ ID NO: 6233761 - DNA, 13 bp, Homo sapiens
gcagaattttaat

SEQ ID NO: 6233762 - DNA, 18 bp, Homo sapiens
gcagaattttaatgtgaa

SEQ ID NO: 6233763 - DNA, 21 bp, Homo sapiens
gcagacaaaaagaacaaaaaa

SEQ ID NO: 6233764 - DNA, 13 bp, Homo sapiens
gcagacaaacaga

SEQ ID NO: 6233765 - DNA, 16 bp, Homo sapiens
gcagacaaagccctgt

SEQ ID NO: 6233766 - DNA, 18 bp, Homo sapiens
gcagacaaagccctgtcc

SEQ ID NO: 6233767 - DNA, 18 bp, Homo sapiens
gcagacaacaccttcctc

SEQ ID NO: 6233768 - DNA, 22 bp, Homo sapiens
gcagacaacaccttcctcctgc

SEQ ID NO: 6233769 - DNA, 23 bp, Homo sapiens
gcagacaacaccttcctcctgca

SEQ ID NO: 6233770 - DNA, 13 bp, Homo sapiens
gcagacaagagct

SEQ ID NO: 6233771 - DNA, 22 bp, Homo sapiens
gcagacaagagggcaagcctct

SEQ ID NO: 6233772 - DNA, 14 bp, Homo sapiens
gcagacaataaacc

SEQ ID NO: 6233773 - DNA, 20 bp, Homo sapiens
gcagacaataaaccctcaga

SEQ ID NO: 6233774 - DNA, 13 bp, Homo sapiens
gcagacaattctc

SEQ ID NO: 6233775 - DNA, 10 bp, Homo sapiens
gcagacacac

SEQ ID NO: 6233776 - DNA, 14 bp, Homo sapiens
gcagacacacacac

SEQ ID NO: 6233777 - DNA, 15 bp, Homo sapiens
gcagacacacacaca

SEQ ID NO: 6233778 - DNA, 16 bp, Homo sapiens
gcagacacacacacac

SEQ ID NO: 6233779 - DNA, 15 bp, Homo sapiens
gcagacacacacata

SEQ ID NO: 6233780 - DNA, 18 bp, Homo sapiens
gcagacacaccgcggcca

SEQ ID NO: 6233781 - DNA, 19 bp, Homo sapiens
gcagacacaccgcggccag

SEQ ID NO: 6233782 - DNA, 16 bp, Homo sapiens
gcagacacagggactt

SEQ ID NO: 6233783 - DNA, 21 bp, Homo sapiens
gcagacacagggacttgaagt

SEQ ID NO: 6233784 - DNA, 22 bp, Homo sapiens
gcagacacagggacttgaagtt

SEQ ID NO: 6233785 - DNA, 23 bp, Homo sapiens
gcagacacagggacttgaagttg

SEQ ID NO: 6233786 - DNA, 18 bp, Homo sapiens
gcagacacctaaccccag

SEQ ID NO: 6233787 - DNA, 20 bp, Homo sapiens
gcagacacctaaccccaggg

SEQ ID NO: 6233788 - DNA, 22 bp, Homo sapiens
gcagacacctaaccccagggca

SEQ ID NO: 6233789 - DNA, 15 bp, Homo sapiens
gcagacacctggact

SEQ ID NO: 6233790 - DNA, 20 bp, Homo sapiens
gcagacacctgtgcacccca

SEQ ID NO: 6233791 - DNA, 15 bp, Homo sapiens
gcagacaccttggac

SEQ ID NO: 6233792 - DNA, 15 bp, Homo sapiens
gcagacagaaactgg

SEQ ID NO: 6233793 - DNA, 15 bp, Homo sapiens
gcagacagaagtgta

SEQ ID NO: 6233794 - DNA, 12 bp, Homo sapiens
gcagacagagaa

SEQ ID NO: 6233795 - DNA, 14 bp, Homo sapiens
gcagacagagaaat

SEQ ID NO: 6233796 - DNA, 22 bp, Homo sapiens
gcagacagagaaatgtgaaggg

SEQ ID NO: 6233797 - DNA, 20 bp, Homo sapiens
gcagacagcagctcaggcac

SEQ ID NO: 6233798 - DNA, 21 bp, Homo sapiens
gcagacagcagctcaggcaca

SEQ ID NO: 6233799 - DNA, 18 bp, Homo sapiens
gcagacagcaggcagcgc

SEQ ID NO: 6233800 - DNA, 13 bp, Homo sapiens
gcagacaggacca

SEQ ID NO: 6233801 - DNA, 17 bp, Homo sapiens
gcagacaggaggaatca

SEQ ID NO: 6233802 - DNA, 19 bp, Homo sapiens
gcagacaggcggggcccag

SEQ ID NO: 6233803 - DNA, 13 bp, Homo sapiens
gcagacaggtggg

SEQ ID NO: 6233804 - DNA, 20 bp, Homo sapiens
gcagacaggtgggagatgga

SEQ ID NO: 6233805 - DNA, 17 bp, Homo sapiens
gcagacagttaagagaa

SEQ ID NO: 6233806 - DNA, 14 bp, Homo sapiens
gcagacatctctgg

SEQ ID NO: 6233807 - DNA, 17 bp, Homo sapiens
gcagacatctctggagc

SEQ ID NO: 6233808 - DNA, 18 bp, Homo sapiens
gcagacatctctggagcc

SEQ ID NO: 6233809 - DNA, 15 bp, Homo sapiens
gcagacatgccttgg

SEQ ID NO: 6233810 - DNA, 15 bp, Homo sapiens
gcagacattgtcagc

SEQ ID NO: 6233811 - DNA, 22 bp, Homo sapiens
gcagaccacactctgcctggcc

SEQ ID NO: 6233812 - DNA, 13 bp, Homo sapiens
gcagaccaccccg

SEQ ID NO: 6233813 - DNA, 17 bp, Homo sapiens
gcagaccagagagctca

SEQ ID NO: 6233814 - DNA, 17 bp, Homo sapiens
gcagaccagcacttcaa

SEQ ID NO: 6233815 - DNA, 18 bp, Homo sapiens
gcagaccagctggcgggt

SEQ ID NO: 6233816 - DNA, 19 bp, Homo sapiens
gcagaccagctggcgggtg

SEQ ID NO: 6233817 - DNA, 19 bp, Homo sapiens
gcagaccaggaaggaagag

SEQ ID NO: 6233818 - DNA, 22 bp, Homo sapiens
gcagaccatgaagtaaattatg

SEQ ID NO: 6233819 - DNA, 21 bp, Homo sapiens
gcagacccatacctttccagg

SEQ ID NO: 6233820 - DNA, 14 bp, Homo sapiens
gcagaccccaggtt

SEQ ID NO: 6233821 - DNA, 22 bp, Homo sapiens
gcagaccctgaacccacacctg

SEQ ID NO: 6233822 - DNA, 16 bp, Homo sapiens
gcagaccctgccaggg

SEQ ID NO: 6233823 - DNA, 15 bp, Homo sapiens
gcagaccctgcccct

SEQ ID NO: 6233824 - DNA, 19 bp, Homo sapiens
gcagaccgggggccagaca

SEQ ID NO: 6233825 - DNA, 21 bp, Homo sapiens
gcagacctaagccctgccccg

SEQ ID NO: 6233826 - DNA, 13 bp, Homo sapiens
gcagacctcactg

SEQ ID NO: 6233827 - DNA, 18 bp, Homo sapiens
gcagacctcactgtcagg

SEQ ID NO: 6233828 - DNA, 21 bp, Homo sapiens
gcagacctcatgcccagctct

SEQ ID NO: 6233829 - DNA, 22 bp, Homo sapiens
gcagacctccccagcccctagc

SEQ ID NO: 6233830 - DNA, 23 bp, Homo sapiens
gcagacctccccagcccctagcc

SEQ ID NO: 6233831 - DNA, 14 bp, Homo sapiens
gcagacctggagct

SEQ ID NO: 6233832 - DNA, 21 bp, Homo sapiens
gcagacctgtcaccctgcagg

SEQ ID NO: 6233833 - DNA, 22 bp, Homo sapiens
gcagacctgtcaccctgcagga

SEQ ID NO: 6233834 - DNA, 14 bp, Homo sapiens
gcagacctgtcctc

SEQ ID NO: 6233835 - DNA, 16 bp, Homo sapiens
gcagacctgtcctcct

SEQ ID NO: 6233836 - DNA, 13 bp, Homo sapiens
gcagaccttactc

SEQ ID NO: 6233837 - DNA, 19 bp, Homo sapiens
gcagaccttactcagggga

SEQ ID NO: 6233838 - DNA, 20 bp, Homo sapiens
gcagaccttactcaggggat

SEQ ID NO: 6233839 - DNA, 21 bp, Homo sapiens
gcagacgcagcagctgggacc

SEQ ID NO: 6233840 - DNA, 20 bp, Homo sapiens
gcagacgggaggggaaaggc

SEQ ID NO: 6233841 - DNA, 17 bp, Homo sapiens
gcagacgggcaagaagc

SEQ ID NO: 6233842 - DNA, 20 bp, Homo sapiens
gcagacgggcaagaagctgc

SEQ ID NO: 6233843 - DNA, 21 bp, Homo sapiens
gcagacgggcaagaagctgct

SEQ ID NO: 6233844 - DNA, 14 bp, Homo sapiens
gcagacgggcacag

SEQ ID NO: 6233845 - DNA, 16 bp, Homo sapiens
gcagacggggggctgc

SEQ ID NO: 6233846 - DNA, 13 bp, Homo sapiens
gcagacggtctgt

SEQ ID NO: 6233847 - DNA, 18 bp, Homo sapiens
gcagacggtctgtgtgct

SEQ ID NO: 6233848 - DNA, 22 bp, Homo sapiens
gcagacggtctgtgtgctgttt

SEQ ID NO: 6233849 - DNA, 21 bp, Homo sapiens
gcagacggtgtggttgggggt

SEQ ID NO: 6233850 - DNA, 17 bp, Homo sapiens
gcagacgtccatagctc

SEQ ID NO: 6233851 - DNA, 16 bp, Homo sapiens
gcagacgtctgccttg

SEQ ID NO: 6233852 - DNA, 22 bp, Homo sapiens
gcagacgtctgccttggcatcc

SEQ ID NO: 6233853 - DNA, 15 bp, Homo sapiens
gcagacgtctggccc

SEQ ID NO: 6233854 - DNA, 17 bp, Homo sapiens
gcagacgtctggccctg

SEQ ID NO: 6233855 - DNA, 15 bp, Homo sapiens
gcagactatgcaaac

SEQ ID NO: 6233856 - DNA, 16 bp, Homo sapiens
gcagactcagctgcta

SEQ ID NO: 6233857 - DNA, 22 bp, Homo sapiens
gcagactccaatggggccagca

SEQ ID NO: 6233858 - DNA, 17 bp, Homo sapiens
gcagactccagcccctg

SEQ ID NO: 6233859 - DNA, 18 bp, Homo sapiens
gcagactccagcccctgg

SEQ ID NO: 6233860 - DNA, 22 bp, Homo sapiens
gcagactcctcagatctgaaca

SEQ ID NO: 6233861 - DNA, 23 bp, Homo sapiens
gcagactcgttctcgtgacccag

SEQ ID NO: 6233862 - DNA, 15 bp, Homo sapiens
gcagactctacagag

SEQ ID NO: 6233863 - DNA, 20 bp, Homo sapiens
gcagactctttatgcttgca

SEQ ID NO: 6233864 - DNA, 23 bp, Homo sapiens
gacctgaagagcgctcctctgcc

SEQ ID NO: 6233865 - DNA, 22 bp, Homo sapiens
gacctgaagggtgacatcccag

SEQ ID NO: 6233866 - DNA, 21 bp, Homo sapiens
gacctgaaggtattggcctgt

SEQ ID NO: 6233867 - DNA, 13 bp, Homo sapiens
gacctgaagttca

SEQ ID NO: 6233868 - DNA, 21 bp, Homo sapiens
gacctgaatgacctgcagtca

SEQ ID NO: 6233869 - DNA, 16 bp, Homo sapiens
gacctgaatgcttctg

SEQ ID NO: 6233870 - DNA, 13 bp, Homo sapiens
gacctgacacctg

SEQ ID NO: 6233871 - DNA, 16 bp, Homo sapiens
gacctgacacctgccg

SEQ ID NO: 6233872 - DNA, 18 bp, Homo sapiens
gacctgaccagactgtgg

SEQ ID NO: 6233873 - DNA, 15 bp, Homo sapiens
gacctgaccagtcag

SEQ ID NO: 6233874 - DNA, 23 bp, Homo sapiens
gacctgacccaacacccccgacg

SEQ ID NO: 6233875 - DNA, 19 bp, Homo sapiens
gacctgaccccattcctga

SEQ ID NO: 6233876 - DNA, 20 bp, Homo sapiens
gacctgaccccattcctgat

SEQ ID NO: 6233877 - DNA, 13 bp, Homo sapiens
gacctgaccggca

SEQ ID NO: 6233878 - DNA, 16 bp, Homo sapiens
gacctgagaatgtatc

SEQ ID NO: 6233879 - DNA, 16 bp, Homo sapiens
gacctgagagcatctc

SEQ ID NO: 6233880 - DNA, 14 bp, Homo sapiens
gacctgagatgctg

SEQ ID NO: 6233881 - DNA, 12 bp, Homo sapiens
gacctgagcctg

SEQ ID NO: 6233882 - DNA, 13 bp, Homo sapiens
gacctgagcctgc

SEQ ID NO: 6233883 - DNA, 15 bp, Homo sapiens
gacctgagcctgccg

SEQ ID NO: 6233884 - DNA, 17 bp, Homo sapiens
gacctgagcctgccgag

SEQ ID NO: 6233885 - DNA, 20 bp, Homo sapiens
gacctgagcggcaccctggt

SEQ ID NO: 6233886 - DNA, 22 bp, Homo sapiens
gacctgagcggcaccctggtct

SEQ ID NO: 6233887 - DNA, 22 bp, Homo sapiens
gacctgagctccccaccacccc

SEQ ID NO: 6233888 - DNA, 16 bp, Homo sapiens
gacctgagctggccag

SEQ ID NO: 6233889 - DNA, 21 bp, Homo sapiens
gacctgagctggccaggccct

SEQ ID NO: 6233890 - DNA, 14 bp, Homo sapiens
gacctgagctggga

SEQ ID NO: 6233891 - DNA, 13 bp, Homo sapiens
gacctgaggaagc

SEQ ID NO: 6233892 - DNA, 16 bp, Homo sapiens
gacctgaggagacatc

SEQ ID NO: 6233893 - DNA, 14 bp, Homo sapiens
gacctgaggccctt

SEQ ID NO: 6233894 - DNA, 21 bp, Homo sapiens
gacctgaggcccttctctcca

SEQ ID NO: 6233895 - DNA, 17 bp, Homo sapiens
gacctgagtttgggaga

SEQ ID NO: 6233896 - DNA, 22 bp, Homo sapiens
gacctgatcattacatggctgt

SEQ ID NO: 6233897 - DNA, 23 bp, Homo sapiens
gacctgatcattacatggctgtg

SEQ ID NO: 6233898 - DNA, 15 bp, Homo sapiens
gacctgatcctggag

SEQ ID NO: 6233899 - DNA, 14 bp, Homo sapiens
gacctgatgacctg

SEQ ID NO: 6233900 - DNA, 13 bp, Homo sapiens
gacctgatggaga

SEQ ID NO: 6233901 - DNA, 14 bp, Homo sapiens
gacctgatggagag

SEQ ID NO: 6233902 - DNA, 23 bp, Homo sapiens
gacctgatttctgagcatttaat

SEQ ID NO: 6233903 - DNA, 20 bp, Homo sapiens
gacctgcacgccaccgctgc

SEQ ID NO: 6233904 - DNA, 17 bp, Homo sapiens
gacctgcacttggcctc

SEQ ID NO: 6233905 - DNA, 20 bp, Homo sapiens
gacctgcaggccaagagcag

SEQ ID NO: 6233906 - DNA, 20 bp, Homo sapiens
gacctgcagtcagggcccag

SEQ ID NO: 6233907 - DNA, 20 bp, Homo sapiens
gacctgcagtgaggggccct

SEQ ID NO: 6233908 - DNA, 23 bp, Homo sapiens
gacctgcagtgaggggccctcca

SEQ ID NO: 6233909 - DNA, 18 bp, Homo sapiens
gacctgcagttggcctca

SEQ ID NO: 6233910 - DNA, 19 bp, Homo sapiens
gacctgcagttggcctcag

SEQ ID NO: 6233911 - DNA, 22 bp, Homo sapiens
gacctgcagttggcctcagcag

SEQ ID NO: 6233912 - DNA, 19 bp, Homo sapiens
gacctgcatatttagctgt

SEQ ID NO: 6233913 - DNA, 17 bp, Homo sapiens
gacctgcatccttcctg

SEQ ID NO: 6233914 - DNA, 20 bp, Homo sapiens
gacctgcatccttcctgggg

SEQ ID NO: 6233915 - DNA, 21 bp, Homo sapiens
gacctgcatccttcctgggga

SEQ ID NO: 6233916 - DNA, 22 bp, Homo sapiens
gacctgcatccttcctggggac

SEQ ID NO: 6233917 - DNA, 15 bp, Homo sapiens
gacctgccaccaggg

SEQ ID NO: 6233918 - DNA, 15 bp, Homo sapiens
gacctgccaggcagg

SEQ ID NO: 6233919 - DNA, 17 bp, Homo sapiens
gacctgccaggcagggg

SEQ ID NO: 6233920 - DNA, 21 bp, Homo sapiens
gacctgccaggcaggggtggg

SEQ ID NO: 6233921 - DNA, 13 bp, Homo sapiens
gacctgcccacaa
